United States Patent 11,421,016 (CANCER NEOEPITOPES) - sequence listing, part 27

SEQ ID NO: 1199440 - protein, 9 aa, Homo Sapiens
GVPLVRTGL

SEQ ID NO: 1199441 - protein, 9 aa, Homo Sapiens
QAQDTSGHR

SEQ ID NO: 1199442 - protein, 9 aa, Homo Sapiens
PLPPRAPHP

SEQ ID NO: 1199443 - protein, 9 aa, Homo Sapiens
IYHLYHHPP

SEQ ID NO: 1199444 - protein, 9 aa, Homo Sapiens
LPGQPNFPC

SEQ ID NO: 1199445 - protein, 9 aa, Homo Sapiens
GLFHKLPSI

SEQ ID NO: 1199446 - protein, 9 aa, Homo Sapiens
PTLQEKKSH

SEQ ID NO: 1199447 - protein, 9 aa, Homo Sapiens
QNFISPKKP

SEQ ID NO: 1199448 - protein, 9 aa, Homo Sapiens
SRQPRLPPP

SEQ ID NO: 1199449 - protein, 9 aa, Homo Sapiens
IGGGVARVE

SEQ ID NO: 1199450 - protein, 9 aa, Homo Sapiens
QLPGASHQR

SEQ ID NO: 1199451 - protein, 9 aa, Homo Sapiens
HHHPQLALH

SEQ ID NO: 1199452 - protein, 9 aa, Homo Sapiens
CGEEPSHEG

SEQ ID NO: 1199453 - protein, 9 aa, Homo Sapiens
YYHEHFTLL

SEQ ID NO: 1199454 - protein, 9 aa, Homo Sapiens
RSPHPGPRH

SEQ ID NO: 1199455 - protein, 9 aa, Homo Sapiens
HERPEDVSP

SEQ ID NO: 1199456 - protein, 9 aa, Homo Sapiens
GKVQVGGNW

SEQ ID NO: 1199457 - protein, 9 aa, Homo Sapiens
TLINSFLYQ

SEQ ID NO: 1199458 - protein, 9 aa, Homo Sapiens
ASCSDGRSS

SEQ ID NO: 1199459 - protein, 9 aa, Homo Sapiens
TGPPRLPPK

SEQ ID NO: 1199460 - protein, 9 aa, Homo Sapiens
DDIVATGSA

SEQ ID NO: 1199461 - protein, 9 aa, Homo Sapiens
MKLFCSVGQ

SEQ ID NO: 1199462 - protein, 9 aa, Homo Sapiens
VGGAWALGC

SEQ ID NO: 1199463 - protein, 9 aa, Homo Sapiens
GHRGTHELG

SEQ ID NO: 1199464 - protein, 9 aa, Homo Sapiens
PIQGLHCPQ

SEQ ID NO: 1199465 - protein, 9 aa, Homo Sapiens
GKKCICSSI

SEQ ID NO: 1199466 - protein, 9 aa, Homo Sapiens
PPPRLPLRP

SEQ ID NO: 1199467 - protein, 9 aa, Homo Sapiens
TEDNPRVAR

SEQ ID NO: 1199468 - protein, 9 aa, Homo Sapiens
EESIPSCSS

SEQ ID NO: 1199469 - protein, 9 aa, Homo Sapiens
EVHWAVRRG

SEQ ID NO: 1199470 - protein, 9 aa, Homo Sapiens
RRIYTAALI

SEQ ID NO: 1199471 - protein, 9 aa, Homo Sapiens
RVLACRVTL

SEQ ID NO: 1199472 - protein, 9 aa, Homo Sapiens
ETRWQARHL

SEQ ID NO: 1199473 - protein, 9 aa, Homo Sapiens
RRPWVVTAR

SEQ ID NO: 1199474 - protein, 9 aa, Homo Sapiens
SVARGQGHR

SEQ ID NO: 1199475 - protein, 9 aa, Homo Sapiens
ARAGVCCEP

SEQ ID NO: 1199476 - protein, 9 aa, Homo Sapiens
LRLQSLLSL

SEQ ID NO: 1199477 - protein, 9 aa, Homo Sapiens
MAKTIRFTV

SEQ ID NO: 1199478 - protein, 9 aa, Homo Sapiens
CINGHRDRS

SEQ ID NO: 1199479 - protein, 9 aa, Homo Sapiens
DNSHISDTS

SEQ ID NO: 1199480 - protein, 9 aa, Homo Sapiens
IHQVPLILT

SEQ ID NO: 1199481 - protein, 9 aa, Homo Sapiens
IIHGPAPAP

SEQ ID NO: 1199482 - protein, 9 aa, Homo Sapiens
GVGAGRRRR

SEQ ID NO: 1199483 - protein, 9 aa, Homo Sapiens
GPSLGLAPS

SEQ ID NO: 1199484 - protein, 9 aa, Homo Sapiens
RRLREQFLR

SEQ ID NO: 1199485 - protein, 9 aa, Homo Sapiens
QAVFLDFDF

SEQ ID NO: 1199486 - protein, 9 aa, Homo Sapiens
GVMVEILVV

SEQ ID NO: 1199487 - protein, 9 aa, Homo Sapiens
KDGEERGRR

SEQ ID NO: 1199488 - protein, 9 aa, Homo Sapiens
FDILKPYMN

SEQ ID NO: 1199489 - protein, 9 aa, Homo Sapiens
CKQDLSNAT

SEQ ID NO: 1199490 - protein, 9 aa, Homo Sapiens
HSPHIWPVQ

SEQ ID NO: 1199491 - protein, 9 aa, Homo Sapiens
KEKKEEGKE

SEQ ID NO: 1199492 - protein, 9 aa, Homo Sapiens
RAVTPHSLT

SEQ ID NO: 1199493 - protein, 9 aa, Homo Sapiens
ECVSLHMEK

SEQ ID NO: 1199494 - protein, 9 aa, Homo Sapiens
GSLTATSCL

SEQ ID NO: 1199495 - protein, 9 aa, Homo Sapiens
LCHVTGSAA

SEQ ID NO: 1199496 - protein, 9 aa, Homo Sapiens
CSVNVTPQQ

SEQ ID NO: 1199497 - protein, 9 aa, Homo Sapiens
NILLVFDYA

SEQ ID NO: 1199498 - protein, 9 aa, Homo Sapiens
RQTRPKSSV

SEQ ID NO: 1199499 - protein, 9 aa, Homo Sapiens
NGNNQKLRV

SEQ ID NO: 1199500 - protein, 9 aa, Homo Sapiens
SMRTGTLGS

SEQ ID NO: 1199501 - protein, 9 aa, Homo Sapiens
GGSRAQKLC

SEQ ID NO: 1199502 - protein, 9 aa, Homo Sapiens
RLGMQNLNS

SEQ ID NO: 1199503 - protein, 9 aa, Homo Sapiens
THTGEHPFA

SEQ ID NO: 1199504 - protein, 9 aa, Homo Sapiens
DHSPPHRAA

SEQ ID NO: 1199505 - protein, 9 aa, Homo Sapiens
GYWFWEGAI

SEQ ID NO: 1199506 - protein, 9 aa, Homo Sapiens
SRAEIHHSW

SEQ ID NO: 1199507 - protein, 9 aa, Homo Sapiens
HGSNAVGRR

SEQ ID NO: 1199508 - protein, 9 aa, Homo Sapiens
DGFLTVCSE

SEQ ID NO: 1199509 - protein, 9 aa, Homo Sapiens
VIRHLSHRA

SEQ ID NO: 1199510 - protein, 9 aa, Homo Sapiens
PEIVVHMDL

SEQ ID NO: 1199511 - protein, 9 aa, Homo Sapiens
LCPALPAGH

SEQ ID NO: 1199512 - protein, 9 aa, Homo Sapiens
DYAFVHFST

SEQ ID NO: 1199513 - protein, 9 aa, Homo Sapiens
HQDIKENLA

SEQ ID NO: 1199514 - protein, 9 aa, Homo Sapiens
KECLCLYAP

SEQ ID NO: 1199515 - protein, 9 aa, Homo Sapiens
CQIRAWCRA

SEQ ID NO: 1199516 - protein, 9 aa, Homo Sapiens
SPPEPQART

SEQ ID NO: 1199517 - protein, 9 aa, Homo Sapiens
MVPSNENCH

SEQ ID NO: 1199518 - protein, 9 aa, Homo Sapiens
KRQGESSGL

SEQ ID NO: 1199519 - protein, 9 aa, Homo Sapiens
TGPSSLTTA

SEQ ID NO: 1199520 - protein, 9 aa, Homo Sapiens
ASESGASGR

SEQ ID NO: 1199521 - protein, 9 aa, Homo Sapiens
SGSRSLWPP

SEQ ID NO: 1199522 - protein, 9 aa, Homo Sapiens
DPGVCIFGY

SEQ ID NO: 1199523 - protein, 9 aa, Homo Sapiens
SGARGSPWT

SEQ ID NO: 1199524 - protein, 9 aa, Homo Sapiens
CQTNCPACT

SEQ ID NO: 1199525 - protein, 9 aa, Homo Sapiens
IQGKADIRI

SEQ ID NO: 1199526 - protein, 9 aa, Homo Sapiens
GQVEEHFRG

SEQ ID NO: 1199527 - protein, 9 aa, Homo Sapiens
CWMTSRTLA

SEQ ID NO: 1199528 - protein, 9 aa, Homo Sapiens
GVVSAFART

SEQ ID NO: 1199529 - protein, 9 aa, Homo Sapiens
PQDQWGPKD

SEQ ID NO: 1199530 - protein, 9 aa, Homo Sapiens
HRGEQPPDQ

SEQ ID NO: 1199531 - protein, 9 aa, Homo Sapiens
KASKVPGGS

SEQ ID NO: 1199532 - protein, 9 aa, Homo Sapiens
GRRRQAGAP

SEQ ID NO: 1199533 - protein, 9 aa, Homo Sapiens
GSRAQKLCA

SEQ ID NO: 1199534 - protein, 9 aa, Homo Sapiens
RSRRGRGAR

SEQ ID NO: 1199535 - protein, 9 aa, Homo Sapiens
PREGERSYS

SEQ ID NO: 1199536 - protein, 9 aa, Homo Sapiens
RSLPLTWWL

SEQ ID NO: 1199537 - protein, 9 aa, Homo Sapiens
PFYCAELRW

SEQ ID NO: 1199538 - protein, 9 aa, Homo Sapiens
HFSPPLPAS

SEQ ID NO: 1199539 - protein, 9 aa, Homo Sapiens
PRELRSPRP

SEQ ID NO: 1199540 - protein, 9 aa, Homo Sapiens
PRSPTPTRR

SEQ ID NO: 1199541 - protein, 9 aa, Homo Sapiens
FSASSTTLD

SEQ ID NO: 1199542 - protein, 9 aa, Homo Sapiens
FGWQMRAST

SEQ ID NO: 1199543 - protein, 9 aa, Homo Sapiens
DFQLAPPGS

SEQ ID NO: 1199544 - protein, 9 aa, Homo Sapiens
AQDWVQENY

SEQ ID NO: 1199545 - protein, 9 aa, Homo Sapiens
LCGALAAPD

SEQ ID NO: 1199546 - protein, 9 aa, Homo Sapiens
PASTGQAYS

SEQ ID NO: 1199547 - protein, 9 aa, Homo Sapiens
VDPKREQQQ

SEQ ID NO: 1199548 - protein, 9 aa, Homo Sapiens
QCVFHFSTA

SEQ ID NO: 1199549 - protein, 9 aa, Homo Sapiens
RASLLWLAS

SEQ ID NO: 1199550 - protein, 9 aa, Homo Sapiens
GRPPTPLFI

SEQ ID NO: 1199551 - protein, 9 aa, Homo Sapiens
PTPVHRPPD

SEQ ID NO: 1199552 - protein, 9 aa, Homo Sapiens
KLHLTLGAP

SEQ ID NO: 1199553 - protein, 9 aa, Homo Sapiens
GPTMPHVPR

SEQ ID NO: 1199554 - protein, 9 aa, Homo Sapiens
NNEYDAYLS

SEQ ID NO: 1199555 - protein, 9 aa, Homo Sapiens
STAGTIFCL

SEQ ID NO: 1199556 - protein, 9 aa, Homo Sapiens
PQELADKRL

SEQ ID NO: 1199557 - protein, 9 aa, Homo Sapiens
PGGSRPGWK

SEQ ID NO: 1199558 - protein, 9 aa, Homo Sapiens
GFTQDRGLQ

SEQ ID NO: 1199559 - protein, 9 aa, Homo Sapiens
KSSFVNSLA

SEQ ID NO: 1199560 - protein, 9 aa, Homo Sapiens
NWWFIFTMD

SEQ ID NO: 1199561 - protein, 9 aa, Homo Sapiens
LMGGCPGHL

SEQ ID NO: 1199562 - protein, 9 aa, Homo Sapiens
PSLGLAPSA

SEQ ID NO: 1199563 - protein, 9 aa, Homo Sapiens
KQFGMPEGK

SEQ ID NO: 1199564 - protein, 9 aa, Homo Sapiens
AVPLLKKLL

SEQ ID NO: 1199565 - protein, 9 aa, Homo Sapiens
VKTCLWVFL

SEQ ID NO: 1199566 - protein, 9 aa, Homo Sapiens
GPVADLWAD

SEQ ID NO: 1199567 - protein, 9 aa, Homo Sapiens
EGSHRCRQP

SEQ ID NO: 1199568 - protein, 9 aa, Homo Sapiens
LSYYHKKMG

SEQ ID NO: 1199569 - protein, 9 aa, Homo Sapiens
SHQRGRPRE

SEQ ID NO: 1199570 - protein, 9 aa, Homo Sapiens
CWLHVSMYR

SEQ ID NO: 1199571 - protein, 9 aa, Homo Sapiens
LKGRRAAAP

SEQ ID NO: 1199572 - protein, 9 aa, Homo Sapiens
GAASASCCC

SEQ ID NO: 1199573 - protein, 9 aa, Homo Sapiens
SGSMVLGCL

SEQ ID NO: 1199574 - protein, 9 aa, Homo Sapiens
KEPVAMDVG

SEQ ID NO: 1199575 - protein, 9 aa, Homo Sapiens
IRTLSARAV

SEQ ID NO: 1199576 - protein, 9 aa, Homo Sapiens
GAGARTASP

SEQ ID NO: 1199577 - protein, 9 aa, Homo Sapiens
PQARGPGAR

SEQ ID NO: 1199578 - protein, 9 aa, Homo Sapiens
AQLRASLTG

SEQ ID NO: 1199579 - protein, 9 aa, Homo Sapiens
RVVEGAGVG

SEQ ID NO: 1199580 - protein, 9 aa, Homo Sapiens
VMGWPNGWC

SEQ ID NO: 1199581 - protein, 9 aa, Homo Sapiens
KLVETHIHN

SEQ ID NO: 1199582 - protein, 9 aa, Homo Sapiens
AAWPSRRAQ

SEQ ID NO: 1199583 - protein, 9 aa, Homo Sapiens
RQPRLPPPP

SEQ ID NO: 1199584 - protein, 9 aa, Homo Sapiens
QKKGFTSSL

SEQ ID NO: 1199585 - protein, 9 aa, Homo Sapiens
SLAASVPTS

SEQ ID NO: 1199586 - protein, 9 aa, Homo Sapiens
QQEWPQRWP

SEQ ID NO: 1199587 - protein, 9 aa, Homo Sapiens
PLTWWLAHD

SEQ ID NO: 1199588 - protein, 9 aa, Homo Sapiens
RVQAGQHAG

SEQ ID NO: 1199589 - protein, 9 aa, Homo Sapiens
QKKAPPLVE

SEQ ID NO: 1199590 - protein, 9 aa, Homo Sapiens
RGAQGMILV

SEQ ID NO: 1199591 - protein, 9 aa, Homo Sapiens
VGAGDVGKS

SEQ ID NO: 1199592 - protein, 9 aa, Homo Sapiens
YAWLCSQLC

SEQ ID NO: 1199593 - protein, 9 aa, Homo Sapiens
LAPLLKLAR

SEQ ID NO: 1199594 - protein, 9 aa, Homo Sapiens
TERTRSPHP

SEQ ID NO: 1199595 - protein, 9 aa, Homo Sapiens
RSSSPTQLP

SEQ ID NO: 1199596 - protein, 9 aa, Homo Sapiens
AQSWCAKCN

SEQ ID NO: 1199597 - protein, 9 aa, Homo Sapiens
GAYGMQTCG

SEQ ID NO: 1199598 - protein, 9 aa, Homo Sapiens
SFQLPMCTN

SEQ ID NO: 1199599 - protein, 9 aa, Homo Sapiens
PPPPPTTTT

SEQ ID NO: 1199600 - protein, 9 aa, Homo Sapiens
QVPQDWRQR

SEQ ID NO: 1199601 - protein, 9 aa, Homo Sapiens
PRKNLRCHM

SEQ ID NO: 1199602 - protein, 9 aa, Homo Sapiens
NRSLPGTTR

SEQ ID NO: 1199603 - protein, 9 aa, Homo Sapiens
KHVKGLLNM

SEQ ID NO: 1199604 - protein, 9 aa, Homo Sapiens
KVCAVPTWA

SEQ ID NO: 1199605 - protein, 9 aa, Homo Sapiens
PDSSGSRSL

SEQ ID NO: 1199606 - protein, 9 aa, Homo Sapiens
RSRATGSPR

SEQ ID NO: 1199607 - protein, 9 aa, Homo Sapiens
RPRELRSPR

SEQ ID NO: 1199608 - protein, 9 aa, Homo Sapiens
TVTRTPATW

SEQ ID NO: 1199609 - protein, 9 aa, Homo Sapiens
WPSFSWTIR

SEQ ID NO: 1199610 - protein, 9 aa, Homo Sapiens
PTTTTTTTP

SEQ ID NO: 1199611 - protein, 9 aa, Homo Sapiens
SCTNSNAST

SEQ ID NO: 1199612 - protein, 9 aa, Homo Sapiens
SSKTTELQL

SEQ ID NO: 1199613 - protein, 9 aa, Homo Sapiens
HSPLATYAP

SEQ ID NO: 1199614 - protein, 9 aa, Homo Sapiens
VIWAVRHIS

SEQ ID NO: 1199615 - protein, 9 aa, Homo Sapiens
LQGFLIPLG

SEQ ID NO: 1199616 - protein, 9 aa, Homo Sapiens
TRVYRIGRS

SEQ ID NO: 1199617 - protein, 9 aa, Homo Sapiens
TTCMVTAAT

SEQ ID NO: 1199618 - protein, 9 aa, Homo Sapiens
CLCLYAPVV

SEQ ID NO: 1199619 - protein, 9 aa, Homo Sapiens
GLLEEDIFM

SEQ ID NO: 1199620 - protein, 9 aa, Homo Sapiens
KRISKMFLT

SEQ ID NO: 1199621 - protein, 9 aa, Homo Sapiens
LGCGGGAGC

SEQ ID NO: 1199622 - protein, 9 aa, Homo Sapiens
VELSLFSRM

SEQ ID NO: 1199623 - protein, 9 aa, Homo Sapiens
IPITNAASC

SEQ ID NO: 1199624 - protein, 9 aa, Homo Sapiens
DKVQVPSKP

SEQ ID NO: 1199625 - protein, 9 aa, Homo Sapiens
NCAPRPRRS

SEQ ID NO: 1199626 - protein, 9 aa, Homo Sapiens
AGVMSVCLF

SEQ ID NO: 1199627 - protein, 9 aa, Homo Sapiens
QKARGGLPC

SEQ ID NO: 1199628 - protein, 9 aa, Homo Sapiens
PPSLPPGPG

SEQ ID NO: 1199629 - protein, 9 aa, Homo Sapiens
HAGASRGTG

SEQ ID NO: 1199630 - protein, 9 aa, Homo Sapiens
PQPLPRSTC

SEQ ID NO: 1199631 - protein, 9 aa, Homo Sapiens
AVWEVIWAV

SEQ ID NO: 1199632 - protein, 9 aa, Homo Sapiens
APARARRTW

SEQ ID NO: 1199633 - protein, 9 aa, Homo Sapiens
QSDWTVVEV

SEQ ID NO: 1199634 - protein, 9 aa, Homo Sapiens
RVLSLLKLA

SEQ ID NO: 1199635 - protein, 9 aa, Homo Sapiens
SVIFYDPCL

SEQ ID NO: 1199636 - protein, 9 aa, Homo Sapiens
TNTSISATS

SEQ ID NO: 1199637 - protein, 9 aa, Homo Sapiens
ASTQLPAAQ

SEQ ID NO: 1199638 - protein, 9 aa, Homo Sapiens
VCPQVHCCS

SEQ ID NO: 1199639 - protein, 9 aa, Homo Sapiens
LHSHMYYFL

SEQ ID NO: 1199640 - protein, 9 aa, Homo Sapiens
CRTQPSSCP

SEQ ID NO: 1199641 - protein, 9 aa, Homo Sapiens
VSIPGLNVM

SEQ ID NO: 1199642 - protein, 9 aa, Homo Sapiens
CLAWSPRAV

SEQ ID NO: 1199643 - protein, 9 aa, Homo Sapiens
YPVWSSRTL

SEQ ID NO: 1199644 - protein, 9 aa, Homo Sapiens
PGPKYKLPS

SEQ ID NO: 1199645 - protein, 9 aa, Homo Sapiens
NPLIYSLSN

SEQ ID NO: 1199646 - protein, 9 aa, Homo Sapiens
RGQVNYDGE

SEQ ID NO: 1199647 - protein, 9 aa, Homo Sapiens
PKPQAKAVA

SEQ ID NO: 1199648 - protein, 9 aa, Homo Sapiens
GIPCIYVSA

SEQ ID NO: 1199649 - protein, 9 aa, Homo Sapiens
WLMCMCQLN

SEQ ID NO: 1199650 - protein, 9 aa, Homo Sapiens
KGTMKTSTN

SEQ ID NO: 1199651 - protein, 9 aa, Homo Sapiens
PRHPLLIVS

SEQ ID NO: 1199652 - protein, 9 aa, Homo Sapiens
CRSPCKSSK

SEQ ID NO: 1199653 - protein, 9 aa, Homo Sapiens
TSNLLMVTI

SEQ ID NO: 1199654 - protein, 9 aa, Homo Sapiens
VTGAHLLHE

SEQ ID NO: 1199655 - protein, 9 aa, Homo Sapiens
LQRVHGGLW

SEQ ID NO: 1199656 - protein, 9 aa, Homo Sapiens
ADHLLDLYA

SEQ ID NO: 1199657 - protein, 9 aa, Homo Sapiens
HCTLTWSRS

SEQ ID NO: 1199658 - protein, 9 aa, Homo Sapiens
PDLAGTMCA

SEQ ID NO: 1199659 - protein, 9 aa, Homo Sapiens
WVEGEVHAV

SEQ ID NO: 1199660 - protein, 9 aa, Homo Sapiens
IFLYGHLGL

SEQ ID NO: 1199661 - protein, 9 aa, Homo Sapiens
GTERTRSPH

SEQ ID NO: 1199662 - protein, 9 aa, Homo Sapiens
LPEPILADD

SEQ ID NO: 1199663 - protein, 9 aa, Homo Sapiens
SMPACARGP

SEQ ID NO: 1199664 - protein, 9 aa, Homo Sapiens
SHQFQLSDI

SEQ ID NO: 1199665 - protein, 9 aa, Homo Sapiens
FKSSFVNSL

SEQ ID NO: 1199666 - protein, 9 aa, Homo Sapiens
VLHLVHQLH

SEQ ID NO: 1199667 - protein, 9 aa, Homo Sapiens
GFGGDVVEG

SEQ ID NO: 1199668 - protein, 9 aa, Homo Sapiens
HPLPPRPRP

SEQ ID NO: 1199669 - protein, 9 aa, Homo Sapiens
ARGGLPCRL

SEQ ID NO: 1199670 - protein, 9 aa, Homo Sapiens
MALQCPRHW

SEQ ID NO: 1199671 - protein, 9 aa, Homo Sapiens
VANSLQLKI

SEQ ID NO: 1199672 - protein, 9 aa, Homo Sapiens
RRLCSHTLL

SEQ ID NO: 1199673 - protein, 9 aa, Homo Sapiens
PRGRRGVGR

SEQ ID NO: 1199674 - protein, 9 aa, Homo Sapiens
LLGLLLALF

SEQ ID NO: 1199675 - protein, 9 aa, Homo Sapiens
APSTAIILR

SEQ ID NO: 1199676 - protein, 9 aa, Homo Sapiens
MTLLARLHL

SEQ ID NO: 1199677 - protein, 9 aa, Homo Sapiens
LLASDRNPR

SEQ ID NO: 1199678 - protein, 9 aa, Homo Sapiens
MDVGDDLKD

SEQ ID NO: 1199679 - protein, 9 aa, Homo Sapiens
DRLRSGARG

SEQ ID NO: 1199680 - protein, 9 aa, Homo Sapiens
GAPPRASQP

SEQ ID NO: 1199681 - protein, 9 aa, Homo Sapiens
KPLEKNGQE

SEQ ID NO: 1199682 - protein, 9 aa, Homo Sapiens
SSQAGTGGT

SEQ ID NO: 1199683 - protein, 9 aa, Homo Sapiens
AHEVAPKRI

SEQ ID NO: 1199684 - protein, 9 aa, Homo Sapiens
KKVRSLHTR

SEQ ID NO: 1199685 - protein, 9 aa, Homo Sapiens
PCDRSWLPC

SEQ ID NO: 1199686 - protein, 9 aa, Homo Sapiens
GCWGWQQSW

SEQ ID NO: 1199687 - protein, 9 aa, Homo Sapiens
PAPPPCRPR

SEQ ID NO: 1199688 - protein, 9 aa, Homo Sapiens
CKLSNWSSW

SEQ ID NO: 1199689 - protein, 9 aa, Homo Sapiens
IDVLHLVHQ

SEQ ID NO: 1199690 - protein, 9 aa, Homo Sapiens
YQLHLHFLK

SEQ ID NO: 1199691 - protein, 9 aa, Homo Sapiens
TAGGSTSVF

SEQ ID NO: 1199692 - protein, 9 aa, Homo Sapiens
MSEPGWASS

SEQ ID NO: 1199693 - protein, 9 aa, Homo Sapiens
LVVELEPWL

SEQ ID NO: 1199694 - protein, 9 aa, Homo Sapiens
HTSNNLKAP

SEQ ID NO: 1199695 - protein, 9 aa, Homo Sapiens
RRNFLEAWR

SEQ ID NO: 1199696 - protein, 9 aa, Homo Sapiens
ARLLLHFGQ

SEQ ID NO: 1199697 - protein, 9 aa, Homo Sapiens
ISKKSITTE

SEQ ID NO: 1199698 - protein, 9 aa, Homo Sapiens
RSPPTSCPP

SEQ ID NO: 1199699 - protein, 9 aa, Homo Sapiens
VEPDLHLEV

SEQ ID NO: 1199700 - protein, 9 aa, Homo Sapiens
ACQIILVNL

SEQ ID NO: 1199701 - protein, 9 aa, Homo Sapiens
DRKFLGEEQ

SEQ ID NO: 1199702 - protein, 9 aa, Homo Sapiens
CGPPSPPGC

SEQ ID NO: 1199703 - protein, 9 aa, Homo Sapiens
GHADSHVFL

SEQ ID NO: 1199704 - protein, 9 aa, Homo Sapiens
SGLESGEAP

SEQ ID NO: 1199705 - protein, 9 aa, Homo Sapiens
CRPRVTPGP

SEQ ID NO: 1199706 - protein, 9 aa, Homo Sapiens
CLDKVQVPS

SEQ ID NO: 1199707 - protein, 9 aa, Homo Sapiens
KAAQARVAV

SEQ ID NO: 1199708 - protein, 9 aa, Homo Sapiens
RPCTHLAFP

SEQ ID NO: 1199709 - protein, 9 aa, Homo Sapiens
NASFGSTRG

SEQ ID NO: 1199710 - protein, 9 aa, Homo Sapiens
IFNILLVFD

SEQ ID NO: 1199711 - protein, 9 aa, Homo Sapiens
RVSSSQSTK

SEQ ID NO: 1199712 - protein, 9 aa, Homo Sapiens
KVAGLSRGL

SEQ ID NO: 1199713 - protein, 9 aa, Homo Sapiens
GPPKDNKLL

SEQ ID NO: 1199714 - protein, 9 aa, Homo Sapiens
AFLRVAMEL

SEQ ID NO: 1199715 - protein, 9 aa, Homo Sapiens
ANASSLRKN

SEQ ID NO: 1199716 - protein, 9 aa, Homo Sapiens
FLLLHLLVG

SEQ ID NO: 1199717 - protein, 9 aa, Homo Sapiens
GAGVGEHEF

SEQ ID NO: 1199718 - protein, 9 aa, Homo Sapiens
HYHRLRRYC

SEQ ID NO: 1199719 - protein, 9 aa, Homo Sapiens
HPTTGPSGS

SEQ ID NO: 1199720 - protein, 9 aa, Homo Sapiens
AGPPMREVA

SEQ ID NO: 1199721 - protein, 9 aa, Homo Sapiens
VGIAWLTQY

SEQ ID NO: 1199722 - protein, 9 aa, Homo Sapiens
RTCRALAPA

SEQ ID NO: 1199723 - protein, 9 aa, Homo Sapiens
NATLSEKLS

SEQ ID NO: 1199724 - protein, 9 aa, Homo Sapiens
ISACNGLRG

SEQ ID NO: 1199725 - protein, 9 aa, Homo Sapiens
RKALITFLT

SEQ ID NO: 1199726 - protein, 9 aa, Homo Sapiens
MNSNISSPV

SEQ ID NO: 1199727 - protein, 9 aa, Homo Sapiens
TSRGGGGSR

SEQ ID NO: 1199728 - protein, 9 aa, Homo Sapiens
GHCSVPEGP

SEQ ID NO: 1199729 - protein, 9 aa, Homo Sapiens
SGSGGVSPP

SEQ ID NO: 1199730 - protein, 9 aa, Homo Sapiens
EGIPCIYVS

SEQ ID NO: 1199731 - protein, 9 aa, Homo Sapiens
RDVHVVAIL

SEQ ID NO: 1199732 - protein, 9 aa, Homo Sapiens
LKTRAKCLL

SEQ ID NO: 1199733 - protein, 9 aa, Homo Sapiens
KSSAMAPED

SEQ ID NO: 1199734 - protein, 9 aa, Homo Sapiens
LSIHFAAHD

SEQ ID NO: 1199735 - protein, 9 aa, Homo Sapiens
TIKSILIHD

SEQ ID NO: 1199736 - protein, 9 aa, Homo Sapiens
ADWACLWSP

SEQ ID NO: 1199737 - protein, 9 aa, Homo Sapiens
AIDVWSCVC

SEQ ID NO: 1199738 - protein, 9 aa, Homo Sapiens
YHLAWLSDW

SEQ ID NO: 1199739 - protein, 9 aa, Homo Sapiens
LAWDPPRSC

SEQ ID NO: 1199740 - protein, 9 aa, Homo Sapiens
GATFPHVQR

SEQ ID NO: 1199741 - protein, 9 aa, Homo Sapiens
TWPRPSAPP

SEQ ID NO: 1199742 - protein, 9 aa, Homo Sapiens
NVPTAASPC

SEQ ID NO: 1199743 - protein, 9 aa, Homo Sapiens
HLVEIAPKW

SEQ ID NO: 1199744 - protein, 9 aa, Homo Sapiens
SSPQPAGYF

SEQ ID NO: 1199745 - protein, 9 aa, Homo Sapiens
HLLVGLALA

SEQ ID NO: 1199746 - protein, 9 aa, Homo Sapiens
DCTLEYAPV

SEQ ID NO: 1199747 - protein, 9 aa, Homo Sapiens
YRNMVVCSC

SEQ ID NO: 1199748 - protein, 9 aa, Homo Sapiens
FLRGFISIL

SEQ ID NO: 1199749 - protein, 9 aa, Homo Sapiens
WCNELSLPA

SEQ ID NO: 1199750 - protein, 9 aa, Homo Sapiens
YLHPILRWQ

SEQ ID NO: 1199751 - protein, 9 aa, Homo Sapiens
VGRGPTILD

SEQ ID NO: 1199752 - protein, 9 aa, Homo Sapiens
FVALAVFSM

SEQ ID NO: 1199753 - protein, 9 aa, Homo Sapiens
FVHFSTEKM

SEQ ID NO: 1199754 - protein, 9 aa, Homo Sapiens
VSTAACLLG

SEQ ID NO: 1199755 - protein, 9 aa, Homo Sapiens
PSTPPAAPA

SEQ ID NO: 1199756 - protein, 9 aa, Homo Sapiens
TVATQVSVP

SEQ ID NO: 1199757 - protein, 9 aa, Homo Sapiens
CGTLSPRSR

SEQ ID NO: 1199758 - protein, 9 aa, Homo Sapiens
RFPLLPGHA

SEQ ID NO: 1199759 - protein, 9 aa, Homo Sapiens
REDVGPSLG

SEQ ID NO: 1199760 - protein, 9 aa, Homo Sapiens
HPDVDAPGH

SEQ ID NO: 1199761 - protein, 9 aa, Homo Sapiens
SHLIFSIDP

SEQ ID NO: 1199762 - protein, 9 aa, Homo Sapiens
PTRAPRRGC

SEQ ID NO: 1199763 - protein, 9 aa, Homo Sapiens
RVAALGQQR

SEQ ID NO: 1199764 - protein, 9 aa, Homo Sapiens
PLGEAVGLI

SEQ ID NO: 1199765 - protein, 9 aa, Homo Sapiens
RSGGRSRAE

SEQ ID NO: 1199766 - protein, 9 aa, Homo Sapiens
ECRQGHRHH

SEQ ID NO: 1199767 - protein, 9 aa, Homo Sapiens
PHPKGHRGH

SEQ ID NO: 1199768 - protein, 9 aa, Homo Sapiens
LHLTLGAPT

SEQ ID NO: 1199769 - protein, 9 aa, Homo Sapiens
ITVLRDSGA

SEQ ID NO: 1199770 - protein, 9 aa, Homo Sapiens
LLEVIVDVV

SEQ ID NO: 1199771 - protein, 9 aa, Homo Sapiens
ISGFGGDVV

SEQ ID NO: 1199772 - protein, 9 aa, Homo Sapiens
MGQGPLPRH

SEQ ID NO: 1199773 - protein, 9 aa, Homo Sapiens
ALTPAATTW

SEQ ID NO: 1199774 - protein, 9 aa, Homo Sapiens
FDWSGGALP

SEQ ID NO: 1199775 - protein, 9 aa, Homo Sapiens
SSSSGLTSQ

SEQ ID NO: 1199776 - protein, 9 aa, Homo Sapiens
CHPGPGYLF

SEQ ID NO: 1199777 - protein, 9 aa, Homo Sapiens
NMATFISQC

SEQ ID NO: 1199778 - protein, 9 aa, Homo Sapiens
QRPPWRTSR

SEQ ID NO: 1199779 - protein, 9 aa, Homo Sapiens
ATGSARSCF

SEQ ID NO: 1199780 - protein, 9 aa, Homo Sapiens
FVKTMVCCL

SEQ ID NO: 1199781 - protein, 9 aa, Homo Sapiens
HRLDGRSLQ

SEQ ID NO: 1199782 - protein, 9 aa, Homo Sapiens
QLVIHSAVM

SEQ ID NO: 1199783 - protein, 9 aa, Homo Sapiens
GPGPMNPLV

SEQ ID NO: 1199784 - protein, 9 aa, Homo Sapiens
VVPDDRSVV

SEQ ID NO: 1199785 - protein, 9 aa, Homo Sapiens
LCSSTPTCL

SEQ ID NO: 1199786 - protein, 9 aa, Homo Sapiens
LKLMKLNPL

SEQ ID NO: 1199787 - protein, 9 aa, Homo Sapiens
FPLLPGHAR

SEQ ID NO: 1199788 - protein, 9 aa, Homo Sapiens
LVTDKSHSK

SEQ ID NO: 1199789 - protein, 9 aa, Homo Sapiens
RHQDAEWQH

SEQ ID NO: 1199790 - protein, 9 aa, Homo Sapiens
LRGYGLCTM

SEQ ID NO: 1199791 - protein, 9 aa, Homo Sapiens
HSQASHMLP

SEQ ID NO: 1199792 - protein, 9 aa, Homo Sapiens
SQWVMSQTQ

SEQ ID NO: 1199793 - protein, 9 aa, Homo Sapiens
KFGWQMRAS

SEQ ID NO: 1199794 - protein, 9 aa, Homo Sapiens
AASWAPPKR

SEQ ID NO: 1199795 - protein, 9 aa, Homo Sapiens
LIAWLSSCQ

SEQ ID NO: 1199796 - protein, 9 aa, Homo Sapiens
GGFKRRLCS

SEQ ID NO: 1199797 - protein, 9 aa, Homo Sapiens
APSMPACAR

SEQ ID NO: 1199798 - protein, 9 aa, Homo Sapiens
WSSCWAAPV

SEQ ID NO: 1199799 - protein, 9 aa, Homo Sapiens
RPVQRPQQQ

SEQ ID NO: 1199800 - protein, 9 aa, Homo Sapiens
RASTQLPAA

SEQ ID NO: 1199801 - protein, 9 aa, Homo Sapiens
SRTLAACPS

SEQ ID NO: 1199802 - protein, 9 aa, Homo Sapiens
PKGHRGHHH

SEQ ID NO: 1199803 - protein, 9 aa, Homo Sapiens
VRERQARPE

SEQ ID NO: 1199804 - protein, 9 aa, Homo Sapiens
TTTPSTPAI

SEQ ID NO: 1199805 - protein, 9 aa, Homo Sapiens
CHMLERFVE

SEQ ID NO: 1199806 - protein, 9 aa, Homo Sapiens
AGGSMKDRI

SEQ ID NO: 1199807 - protein, 9 aa, Homo Sapiens
RAAGGAAAA

SEQ ID NO: 1199808 - protein, 9 aa, Homo Sapiens
QVFLVVFLY

SEQ ID NO: 1199809 - protein, 9 aa, Homo Sapiens
PPTFPCSSL

SEQ ID NO: 1199810 - protein, 9 aa, Homo Sapiens
RRRSRRGRG

SEQ ID NO: 1199811 - protein, 9 aa, Homo Sapiens
EVYRQQPQQ

SEQ ID NO: 1199812 - protein, 9 aa, Homo Sapiens
PILQIDSAR

SEQ ID NO: 1199813 - protein, 9 aa, Homo Sapiens
ILYLDLLDA

SEQ ID NO: 1199814 - protein, 9 aa, Homo Sapiens
DKTRKIEAQ

SEQ ID NO: 1199815 - protein, 9 aa, Homo Sapiens
CEAQEAVHA

SEQ ID NO: 1199816 - protein, 9 aa, Homo Sapiens
PMLWTMDPS

SEQ ID NO: 1199817 - protein, 9 aa, Homo Sapiens
AKDCDPSSP

SEQ ID NO: 1199818 - protein, 9 aa, Homo Sapiens
KFTSSWSGT

SEQ ID NO: 1199819 - protein, 9 aa, Homo Sapiens
RRDKNFSST

SEQ ID NO: 1199820 - protein, 9 aa, Homo Sapiens
APMDSPCCQ

SEQ ID NO: 1199821 - protein, 9 aa, Homo Sapiens
RWRVSSSQS

SEQ ID NO: 1199822 - protein, 9 aa, Homo Sapiens
AAQAEPPVP

SEQ ID NO: 1199823 - protein, 9 aa, Homo Sapiens
RLIVSWTPV

SEQ ID NO: 1199824 - protein, 9 aa, Homo Sapiens
RALHSLAQQ

SEQ ID NO: 1199825 - protein, 9 aa, Homo Sapiens
QPAGYFALG

SEQ ID NO: 1199826 - protein, 9 aa, Homo Sapiens
VFSWDETEY

SEQ ID NO: 1199827 - protein, 9 aa, Homo Sapiens
GPAVTFGKA

SEQ ID NO: 1199828 - protein, 9 aa, Homo Sapiens
PSLFEFQGP

SEQ ID NO: 1199829 - protein, 9 aa, Homo Sapiens
MGAVMFITL

SEQ ID NO: 1199830 - protein, 9 aa, Homo Sapiens
GRLPVTPGP

SEQ ID NO: 1199831 - protein, 9 aa, Homo Sapiens
CCCPTARGR

SEQ ID NO: 1199832 - protein, 9 aa, Homo Sapiens
RQRGRPHAP

SEQ ID NO: 1199833 - protein, 9 aa, Homo Sapiens
MGGNRSICL

SEQ ID NO: 1199834 - protein, 9 aa, Homo Sapiens
LMGVDSTAA

SEQ ID NO: 1199835 - protein, 9 aa, Homo Sapiens
VHVVAILGS

SEQ ID NO: 1199836 - protein, 9 aa, Homo Sapiens
HSQQPGALR

SEQ ID NO: 1199837 - protein, 9 aa, Homo Sapiens
MFLTVIMRL

SEQ ID NO: 1199838 - protein, 9 aa, Homo Sapiens
NLRCHMLER

SEQ ID NO: 1199839 - protein, 9 aa, Homo Sapiens
KTRKALITF

SEQ ID NO: 1199840 - protein, 9 aa, Homo Sapiens
RNGSSGGGG

SEQ ID NO: 1199841 - protein, 9 aa, Homo Sapiens
TSVFPDKKS

SEQ ID NO: 1199842 - protein, 9 aa, Homo Sapiens
LQDLSISRR

SEQ ID NO: 1199843 - protein, 9 aa, Homo Sapiens
VVGVGVMVE

SEQ ID NO: 1199844 - protein, 9 aa, Homo Sapiens
YHLYHHPPG

SEQ ID NO: 1199845 - protein, 9 aa, Homo Sapiens
LLIALPSLQ

SEQ ID NO: 1199846 - protein, 9 aa, Homo Sapiens
VYRCPVGGP

SEQ ID NO: 1199847 - protein, 9 aa, Homo Sapiens
TGLHLHRQI

SEQ ID NO: 1199848 - protein, 9 aa, Homo Sapiens
PGALRQAPG

SEQ ID NO: 1199849 - protein, 9 aa, Homo Sapiens
YPIAQGDHQ

SEQ ID NO: 1199850 - protein, 9 aa, Homo Sapiens
FLFYHAKTG

SEQ ID NO: 1199851 - protein, 9 aa, Homo Sapiens
PDPSRLLLG

SEQ ID NO: 1199852 - protein, 9 aa, Homo Sapiens
PRLSEHTHR

SEQ ID NO: 1199853 - protein, 9 aa, Homo Sapiens
AAPGLAARR

SEQ ID NO: 1199854 - protein, 9 aa, Homo Sapiens
PAARSPLTG

SEQ ID NO: 1199855 - protein, 9 aa, Homo Sapiens
GLPAMGGAW

SEQ ID NO: 1199856 - protein, 9 aa, Homo Sapiens
WSPSPLSGH

SEQ ID NO: 1199857 - protein, 9 aa, Homo Sapiens
FKTNEEKRQ

SEQ ID NO: 1199858 - protein, 9 aa, Homo Sapiens
LSCWHRYLF

SEQ ID NO: 1199859 - protein, 9 aa, Homo Sapiens
RTAWVEGEV

SEQ ID NO: 1199860 - protein, 9 aa, Homo Sapiens
PLNIMSMGI

SEQ ID NO: 1199861 - protein, 9 aa, Homo Sapiens
DNRPGSGGG

SEQ ID NO: 1199862 - protein, 9 aa, Homo Sapiens
VVGEEHSLT

SEQ ID NO: 1199863 - protein, 9 aa, Homo Sapiens
SKSKKGTMK

SEQ ID NO: 1199864 - protein, 9 aa, Homo Sapiens
KWEELKKKL

SEQ ID NO: 1199865 - protein, 9 aa, Homo Sapiens
CVIPPDLTA

SEQ ID NO: 1199866 - protein, 9 aa, Homo Sapiens
YRDIANMII

SEQ ID NO: 1199867 - protein, 9 aa, Homo Sapiens
EVSHLCNFN

SEQ ID NO: 1199868 - protein, 9 aa, Homo Sapiens
PEYTCWASQ

SEQ ID NO: 1199869 - protein, 9 aa, Homo Sapiens
QSPQQQPPQ

SEQ ID NO: 1199870 - protein, 9 aa, Homo Sapiens
RLYMSRIHG

SEQ ID NO: 1199871 - protein, 9 aa, Homo Sapiens
EHSLDHSHE

SEQ ID NO: 1199872 - protein, 9 aa, Homo Sapiens
TRARCCPGG

SEQ ID NO: 1199873 - protein, 9 aa, Homo Sapiens
SSFGQKMGK

SEQ ID NO: 1199874 - protein, 9 aa, Homo Sapiens
APTCASPRG

SEQ ID NO: 1199875 - protein, 9 aa, Homo Sapiens
RKSWAASWA

SEQ ID NO: 1199876 - protein, 9 aa, Homo Sapiens
SGRGLSPLS

SEQ ID NO: 1199877 - protein, 9 aa, Homo Sapiens
PLVPTRAPP

SEQ ID NO: 1199878 - protein, 9 aa, Homo Sapiens
HPRSPTPTR

SEQ ID NO: 1199879 - protein, 9 aa, Homo Sapiens
AYSSHQLKT

SEQ ID NO: 1199880 - protein, 9 aa, Homo Sapiens
VTSNLLMVT

SEQ ID NO: 1199881 - protein, 9 aa, Homo Sapiens
DKSAGSGVP

SEQ ID NO: 1199882 - protein, 9 aa, Homo Sapiens
VEQPPNPNS

SEQ ID NO: 1199883 - protein, 9 aa, Homo Sapiens
RDHSPPHRA

SEQ ID NO: 1199884 - protein, 9 aa, Homo Sapiens
VIAVEAPPQ

SEQ ID NO: 1199885 - protein, 9 aa, Homo Sapiens
RRPVPNPPT

SEQ ID NO: 1199886 - protein, 9 aa, Homo Sapiens
LLWLASRPS

SEQ ID NO: 1199887 - protein, 9 aa, Homo Sapiens
PGYHARDED

SEQ ID NO: 1199888 - protein, 9 aa, Homo Sapiens
HFVANSLQL

SEQ ID NO: 1199889 - protein, 9 aa, Homo Sapiens
RGRAPAPLP

SEQ ID NO: 1199890 - protein, 9 aa, Homo Sapiens
LVFSSCDLK

SEQ ID NO: 1199891 - protein, 9 aa, Homo Sapiens
TSRKSRPCI

SEQ ID NO: 1199892 - protein, 9 aa, Homo Sapiens
LAWAPDAAG

SEQ ID NO: 1199893 - protein, 9 aa, Homo Sapiens
EVLKTFALQ

SEQ ID NO: 1199894 - protein, 9 aa, Homo Sapiens
PDIPPKPSF

SEQ ID NO: 1199895 - protein, 9 aa, Homo Sapiens
PAEQEAGSK

SEQ ID NO: 1199896 - protein, 9 aa, Homo Sapiens
SVGPRSSSP

SEQ ID NO: 1199897 - protein, 9 aa, Homo Sapiens
HREKMNRMW

SEQ ID NO: 1199898 - protein, 9 aa, Homo Sapiens
AARTAATPT

SEQ ID NO: 1199899 - protein, 9 aa, Homo Sapiens
LLRAFDGAH

SEQ ID NO: 1199900 - protein, 9 aa, Homo Sapiens
GVILSIDDY

SEQ ID NO: 1199901 - protein, 9 aa, Homo Sapiens
ETWITTGWI

SEQ ID NO: 1199902 - protein, 9 aa, Homo Sapiens
ALVGGLDGD

SEQ ID NO: 1199903 - protein, 9 aa, Homo Sapiens
PRSINPTLT

SEQ ID NO: 1199904 - protein, 9 aa, Homo Sapiens
PPPFPAAHA

SEQ ID NO: 1199905 - protein, 9 aa, Homo Sapiens
ADAQVAGPE

SEQ ID NO: 1199906 - protein, 9 aa, Homo Sapiens
PPSSWPGHM

SEQ ID NO: 1199907 - protein, 9 aa, Homo Sapiens
CFCLVFFFL

SEQ ID NO: 1199908 - protein, 9 aa, Homo Sapiens
LMAMLWHGL

SEQ ID NO: 1199909 - protein, 9 aa, Homo Sapiens
TWKPSTWTE

SEQ ID NO: 1199910 - protein, 9 aa, Homo Sapiens
WKPSPLMNN

SEQ ID NO: 1199911 - protein, 9 aa, Homo Sapiens
VPLGPWNGT

SEQ ID NO: 1199912 - protein, 9 aa, Homo Sapiens
ILLSREGLV

SEQ ID NO: 1199913 - protein, 9 aa, Homo Sapiens
CGQVIIISD

SEQ ID NO: 1199914 - protein, 9 aa, Homo Sapiens
RPAHLVPAV

SEQ ID NO: 1199915 - protein, 9 aa, Homo Sapiens
HPSADEFHL

SEQ ID NO: 1199916 - protein, 9 aa, Homo Sapiens
RRTSSARTS

SEQ ID NO: 1199917 - protein, 9 aa, Homo Sapiens
LPAFGRATL

SEQ ID NO: 1199918 - protein, 9 aa, Homo Sapiens
AVKLEGGQA

SEQ ID NO: 1199919 - protein, 9 aa, Homo Sapiens
GVKLGVGVF

SEQ ID NO: 1199920 - protein, 9 aa, Homo Sapiens
RQQCLVCVP

SEQ ID NO: 1199921 - protein, 9 aa, Homo Sapiens
RDRPCQLHA

SEQ ID NO: 1199922 - protein, 9 aa, Homo Sapiens
TSWSCQPLP

SEQ ID NO: 1199923 - protein, 9 aa, Homo Sapiens
LPSNTGYAL

SEQ ID NO: 1199924 - protein, 9 aa, Homo Sapiens
SPTGCKSWK

SEQ ID NO: 1199925 - protein, 9 aa, Homo Sapiens
GHRLQHGVG

SEQ ID NO: 1199926 - protein, 9 aa, Homo Sapiens
EKLSGETTL

SEQ ID NO: 1199927 - protein, 9 aa, Homo Sapiens
LGSGEEVPQ

SEQ ID NO: 1199928 - protein, 9 aa, Homo Sapiens
HFSILLCKR

SEQ ID NO: 1199929 - protein, 9 aa, Homo Sapiens
SYDYVRRCL

SEQ ID NO: 1199930 - protein, 9 aa, Homo Sapiens
PRVTPAPPP

SEQ ID NO: 1199931 - protein, 9 aa, Homo Sapiens
AHSRSATGS

SEQ ID NO: 1199932 - protein, 9 aa, Homo Sapiens
RQQPQQQKG

SEQ ID NO: 1199933 - protein, 9 aa, Homo Sapiens
TDREASIVI

SEQ ID NO: 1199934 - protein, 9 aa, Homo Sapiens
SAIWNGNHG

SEQ ID NO: 1199935 - protein, 9 aa, Homo Sapiens
APRAHTVLS

SEQ ID NO: 1199936 - protein, 9 aa, Homo Sapiens
DGSEVDVEV

SEQ ID NO: 1199937 - protein, 9 aa, Homo Sapiens
SPLPSRSLL

SEQ ID NO: 1199938 - protein, 9 aa, Homo Sapiens
AGSVPQLRI

SEQ ID NO: 1199939 - protein, 9 aa, Homo Sapiens
LPVPILYLD

SEQ ID NO: 1199940 - protein, 9 aa, Homo Sapiens
PSSSTLERV

SEQ ID NO: 1199941 - protein, 9 aa, Homo Sapiens
IVRPEGSHR

SEQ ID NO: 1199942 - protein, 9 aa, Homo Sapiens
LKDGEERGR

SEQ ID NO: 1199943 - protein, 9 aa, Homo Sapiens
SSSPTQLPS

SEQ ID NO: 1199944 - protein, 9 aa, Homo Sapiens
VVEQAAEGG

SEQ ID NO: 1199945 - protein, 9 aa, Homo Sapiens
PDDVASPQS

SEQ ID NO: 1199946 - protein, 9 aa, Homo Sapiens
GEEVPQVGP

SEQ ID NO: 1199947 - protein, 9 aa, Homo Sapiens
VVVVKNGRR

SEQ ID NO: 1199948 - protein, 9 aa, Homo Sapiens
GDHQSPINI

SEQ ID NO: 1199949 - protein, 9 aa, Homo Sapiens
KDMQLGRLY

SEQ ID NO: 1199950 - protein, 9 aa, Homo Sapiens
LVDRHRVTR

SEQ ID NO: 1199951 - protein, 9 aa, Homo Sapiens
MYRSAHFLP

SEQ ID NO: 1199952 - protein, 9 aa, Homo Sapiens
EINQNNNFQ

SEQ ID NO: 1199953 - protein, 9 aa, Homo Sapiens
TIGARIAEY

SEQ ID NO: 1199954 - protein, 9 aa, Homo Sapiens
FTFRKEDML

SEQ ID NO: 1199955 - protein, 9 aa, Homo Sapiens
SVVKKGGIF

SEQ ID NO: 1199956 - protein, 9 aa, Homo Sapiens
AYSPGPAST

SEQ ID NO: 1199957 - protein, 9 aa, Homo Sapiens
LMQKHHRRE

SEQ ID NO: 1199958 - protein, 9 aa, Homo Sapiens
EPGPGGGRE

SEQ ID NO: 1199959 - protein, 9 aa, Homo Sapiens
LCKRKIFLW

SEQ ID NO: 1199960 - protein, 9 aa, Homo Sapiens
MLLISKVRE

SEQ ID NO: 1199961 - protein, 9 aa, Homo Sapiens
PDSARPPPR

SEQ ID NO: 1199962 - protein, 9 aa, Homo Sapiens
RNSRNSLIQ

SEQ ID NO: 1199963 - protein, 9 aa, Homo Sapiens
LQREGEEKD

SEQ ID NO: 1199964 - protein, 9 aa, Homo Sapiens
KLHQRGQSN

SEQ ID NO: 1199965 - protein, 9 aa, Homo Sapiens
SVSISFISS

SEQ ID NO: 1199966 - protein, 9 aa, Homo Sapiens
MEAPSVGVA

SEQ ID NO: 1199967 - protein, 9 aa, Homo Sapiens
SESGASGRR

SEQ ID NO: 1199968 - protein, 9 aa, Homo Sapiens
KNGQEADLG

SEQ ID NO: 1199969 - protein, 9 aa, Homo Sapiens
KAESEIKKK

SEQ ID NO: 1199970 - protein, 9 aa, Homo Sapiens
GSFSDNFYP

SEQ ID NO: 1199971 - protein, 9 aa, Homo Sapiens
TDAGTVQEM

SEQ ID NO: 1199972 - protein, 9 aa, Homo Sapiens
GVGPGPHAV

SEQ ID NO: 1199973 - protein, 9 aa, Homo Sapiens
AGPCLPSST

SEQ ID NO: 1199974 - protein, 9 aa, Homo Sapiens
TEQYYSFFW

SEQ ID NO: 1199975 - protein, 9 aa, Homo Sapiens
ASAPQARCW

SEQ ID NO: 1199976 - protein, 9 aa, Homo Sapiens
PSLLFFNPI

SEQ ID NO: 1199977 - protein, 9 aa, Homo Sapiens
LHERPEDVS

SEQ ID NO: 1199978 - protein, 9 aa, Homo Sapiens
GPGVCFIHF

SEQ ID NO: 1199979 - protein, 9 aa, Homo Sapiens
QECVSLHME

SEQ ID NO: 1199980 - protein, 9 aa, Homo Sapiens
QWCPDGSHL

SEQ ID NO: 1199981 - protein, 9 aa, Homo Sapiens
RGVCFDVHD

SEQ ID NO: 1199982 - protein, 9 aa, Homo Sapiens
REAAGGAPA

SEQ ID NO: 1199983 - protein, 9 aa, Homo Sapiens
VGVGVMVEI

SEQ ID NO: 1199984 - protein, 9 aa, Homo Sapiens
TSTTSAASS

SEQ ID NO: 1199985 - protein, 9 aa, Homo Sapiens
PGYLFRVAM

SEQ ID NO: 1199986 - protein, 9 aa, Homo Sapiens
EYTCWASQS

SEQ ID NO: 1199987 - protein, 9 aa, Homo Sapiens
LACPAYPYP

SEQ ID NO: 1199988 - protein, 9 aa, Homo Sapiens
RGAFIYNML

SEQ ID NO: 1199989 - protein, 9 aa, Homo Sapiens
PSSCPPAWI

SEQ ID NO: 1199990 - protein, 9 aa, Homo Sapiens
GTRDVQGQA

SEQ ID NO: 1199991 - protein, 9 aa, Homo Sapiens
CCSTKQLVS

SEQ ID NO: 1199992 - protein, 9 aa, Homo Sapiens
SFIFQNIAT

SEQ ID NO: 1199993 - protein, 9 aa, Homo Sapiens
LGFQNPTLT

SEQ ID NO: 1199994 - protein, 9 aa, Homo Sapiens
AGHVHGIAP

SEQ ID NO: 1199995 - protein, 9 aa, Homo Sapiens
ADLGHWRRG

SEQ ID NO: 1199996 - protein, 9 aa, Homo Sapiens
KLENNMCGV

SEQ ID NO: 1199997 - protein, 9 aa, Homo Sapiens
SLWPPQRPS

SEQ ID NO: 1199998 - protein, 9 aa, Homo Sapiens
HVADFWWRV

SEQ ID NO: 1199999 - protein, 9 aa, Homo Sapiens
LGGFGGFSS

SEQ ID NO: 1200000 - protein, 9 aa, Homo Sapiens
RVKWTGSSA

SEQ ID NO: 1200001 - protein, 9 aa, Homo Sapiens
SRLLLPRKH

SEQ ID NO: 1200002 - protein, 9 aa, Homo Sapiens
SAGFSSMLS

SEQ ID NO: 1200003 - protein, 9 aa, Homo Sapiens
ILCSTHQKD

SEQ ID NO: 1200004 - protein, 9 aa, Homo Sapiens
YLRCLRAWF

SEQ ID NO: 1200005 - protein, 9 aa, Homo Sapiens
PPLLSCWHR

SEQ ID NO: 1200006 - protein, 9 aa, Homo Sapiens
PALSWGKWP

SEQ ID NO: 1200007 - protein, 9 aa, Homo Sapiens
HLADAQVAG

SEQ ID NO: 1200008 - protein, 9 aa, Homo Sapiens
MFSKQGALT

SEQ ID NO: 1200009 - protein, 9 aa, Homo Sapiens
APKRIEEKI

SEQ ID NO: 1200010 - protein, 9 aa, Homo Sapiens
DEFVRESDC

SEQ ID NO: 1200011 - protein, 9 aa, Homo Sapiens
TTKKGIRPT

SEQ ID NO: 1200012 - protein, 9 aa, Homo Sapiens
SRRYQKYRR

SEQ ID NO: 1200013 - protein, 9 aa, Homo Sapiens
LGGSPASPA

SEQ ID NO: 1200014 - protein, 9 aa, Homo Sapiens
ITRVYRIGR

SEQ ID NO: 1200015 - protein, 9 aa, Homo Sapiens
RKSKRKRKG

SEQ ID NO: 1200016 - protein, 9 aa, Homo Sapiens
PKCTPKCHP

SEQ ID NO: 1200017 - protein, 9 aa, Homo Sapiens
TINTTRHGQ

SEQ ID NO: 1200018 - protein, 9 aa, Homo Sapiens
NWSSWGSCS

SEQ ID NO: 1200019 - protein, 9 aa, Homo Sapiens
SPAKLVRLV

SEQ ID NO: 1200020 - protein, 9 aa, Homo Sapiens
SRTHSSPTA

SEQ ID NO: 1200021 - protein, 9 aa, Homo Sapiens
RTAATPTLP

SEQ ID NO: 1200022 - protein, 9 aa, Homo Sapiens
GEPPSGVKR

SEQ ID NO: 1200023 - protein, 9 aa, Homo Sapiens
VLWPKAFYP

SEQ ID NO: 1200024 - protein, 9 aa, Homo Sapiens
RVPSPLTPL

SEQ ID NO: 1200025 - protein, 9 aa, Homo Sapiens
CHPDVDAPG

SEQ ID NO: 1200026 - protein, 9 aa, Homo Sapiens
AFNGLMSLR

SEQ ID NO: 1200027 - protein, 9 aa, Homo Sapiens
FCIFSESRH

SEQ ID NO: 1200028 - protein, 9 aa, Homo Sapiens
AAGGNRRTA

SEQ ID NO: 1200029 - protein, 9 aa, Homo Sapiens
RWRWNEDGA

SEQ ID NO: 1200030 - protein, 9 aa, Homo Sapiens
EEKKQGGPT

SEQ ID NO: 1200031 - protein, 9 aa, Homo Sapiens
LLAWDPPRS

SEQ ID NO: 1200032 - protein, 9 aa, Homo Sapiens
LSPTAWSHC

SEQ ID NO: 1200033 - protein, 9 aa, Homo Sapiens
AKAQVKTEA

SEQ ID NO: 1200034 - protein, 9 aa, Homo Sapiens
KNSLKLMKL

SEQ ID NO: 1200035 - protein, 9 aa, Homo Sapiens
AQVFLVVFL

SEQ ID NO: 1200036 - protein, 9 aa, Homo Sapiens
GAGGGGGNP

SEQ ID NO: 1200037 - protein, 9 aa, Homo Sapiens
SCFRPAGQQ

SEQ ID NO: 1200038 - protein, 9 aa, Homo Sapiens
KVKNLTDEL

SEQ ID NO: 1200039 - protein, 9 aa, Homo Sapiens
IAGLEEDKE

SEQ ID NO: 1200040 - protein, 9 aa, Homo Sapiens
FLIKSLLVT

SEQ ID NO: 1200041 - protein, 9 aa, Homo Sapiens
KDDQEGRFV

SEQ ID NO: 1200042 - protein, 9 aa, Homo Sapiens
SLFAFSLSM

SEQ ID NO: 1200043 - protein, 9 aa, Homo Sapiens
AVWLHFSPP

SEQ ID NO: 1200044 - protein, 9 aa, Homo Sapiens
IRETEEIAS

SEQ ID NO: 1200045 - protein, 9 aa, Homo Sapiens
RVSASKRIS

SEQ ID NO: 1200046 - protein, 9 aa, Homo Sapiens
NDARHGGWT

SEQ ID NO: 1200047 - protein, 9 aa, Homo Sapiens
SAAARTAAT

SEQ ID NO: 1200048 - protein, 9 aa, Homo Sapiens
GQHWHTTEA

SEQ ID NO: 1200049 - protein, 9 aa, Homo Sapiens
LNNNNNNNH

SEQ ID NO: 1200050 - protein, 9 aa, Homo Sapiens
GAMVEAGGF

SEQ ID NO: 1200051 - protein, 9 aa, Homo Sapiens
RGIQNEKET

SEQ ID NO: 1200052 - protein, 9 aa, Homo Sapiens
GTRPGLGLG

SEQ ID NO: 1200053 - protein, 9 aa, Homo Sapiens
RGPRAPVRA

SEQ ID NO: 1200054 - protein, 9 aa, Homo Sapiens
GEKYRVLAC

SEQ ID NO: 1200055 - protein, 9 aa, Homo Sapiens
STPAIRVRV

SEQ ID NO: 1200056 - protein, 9 aa, Homo Sapiens
GAGAQDGVH

SEQ ID NO: 1200057 - protein, 9 aa, Homo Sapiens
YPWPPAPLT

SEQ ID NO: 1200058 - protein, 9 aa, Homo Sapiens
VLHLTLGAD

SEQ ID NO: 1200059 - protein, 9 aa, Homo Sapiens
PPTPFDRHP

SEQ ID NO: 1200060 - protein, 9 aa, Homo Sapiens
AAHRTGIRI

SEQ ID NO: 1200061 - protein, 9 aa, Homo Sapiens
QWCTTSAPR

SEQ ID NO: 1200062 - protein, 9 aa, Homo Sapiens
TGDSSRVIV

SEQ ID NO: 1200063 - protein, 9 aa, Homo Sapiens
HAKTGRTST

SEQ ID NO: 1200064 - protein, 9 aa, Homo Sapiens
SCVYVCMCV

SEQ ID NO: 1200065 - protein, 9 aa, Homo Sapiens
TWRCCANYV

SEQ ID NO: 1200066 - protein, 9 aa, Homo Sapiens
HPRLPGPLS

SEQ ID NO: 1200067 - protein, 9 aa, Homo Sapiens
PHRVTHTRE

SEQ ID NO: 1200068 - protein, 9 aa, Homo Sapiens
RRRRRRPPR

SEQ ID NO: 1200069 - protein, 9 aa, Homo Sapiens
LNIMSMGIT

SEQ ID NO: 1200070 - protein, 9 aa, Homo Sapiens
RRWRGRGQH

SEQ ID NO: 1200071 - protein, 9 aa, Homo Sapiens
IVAPTRTSS

SEQ ID NO: 1200072 - protein, 9 aa, Homo Sapiens
MGCRSLAIT

SEQ ID NO: 1200073 - protein, 9 aa, Homo Sapiens
RTCVCWPSF

SEQ ID NO: 1200074 - protein, 9 aa, Homo Sapiens
PQRPPRSIL

SEQ ID NO: 1200075 - protein, 9 aa, Homo Sapiens
KNEPQRPPR

SEQ ID NO: 1200076 - protein, 9 aa, Homo Sapiens
WLSLALRSR

SEQ ID NO: 1200077 - protein, 9 aa, Homo Sapiens
LRQALVRCG

SEQ ID NO: 1200078 - protein, 9 aa, Homo Sapiens
SHSQASHML

SEQ ID NO: 1200079 - protein, 9 aa, Homo Sapiens
WLQENIAGV

SEQ ID NO: 1200080 - protein, 9 aa, Homo Sapiens
CAARRRTTC

SEQ ID NO: 1200081 - protein, 9 aa, Homo Sapiens
AEPRLTRCC

SEQ ID NO: 1200082 - protein, 9 aa, Homo Sapiens
VLVPSGEEQ

SEQ ID NO: 1200083 - protein, 9 aa, Homo Sapiens
DKKKKDKKR

SEQ ID NO: 1200084 - protein, 9 aa, Homo Sapiens
CQPHQAGSP

SEQ ID NO: 1200085 - protein, 9 aa, Homo Sapiens
LIAHSLVTV

SEQ ID NO: 1200086 - protein, 9 aa, Homo Sapiens
ANFACTGNP

SEQ ID NO: 1200087 - protein, 9 aa, Homo Sapiens
TEAQHRKTP

SEQ ID NO: 1200088 - protein, 9 aa, Homo Sapiens
LEILEIIEA

SEQ ID NO: 1200089 - protein, 9 aa, Homo Sapiens
LVVLAAVGV

SEQ ID NO: 1200090 - protein, 9 aa, Homo Sapiens
HSSVLATGL

SEQ ID NO: 1200091 - protein, 9 aa, Homo Sapiens
LLEEKQKED

SEQ ID NO: 1200092 - protein, 9 aa, Homo Sapiens
RGPMPGSCR

SEQ ID NO: 1200093 - protein, 9 aa, Homo Sapiens
YQPTIQTHN

SEQ ID NO: 1200094 - protein, 9 aa, Homo Sapiens
FNGLMSLRL

SEQ ID NO: 1200095 - protein, 9 aa, Homo Sapiens
DGRVDSQRG

SEQ ID NO: 1200096 - protein, 9 aa, Homo Sapiens
RSLAITQGR

SEQ ID NO: 1200097 - protein, 9 aa, Homo Sapiens
FDCKLSNWS

SEQ ID NO: 1200098 - protein, 9 aa, Homo Sapiens
HEVHWAVRR

SEQ ID NO: 1200099 - protein, 9 aa, Homo Sapiens
PPWFIVDGP

SEQ ID NO: 1200100 - protein, 9 aa, Homo Sapiens
CPEYLINLV

SEQ ID NO: 1200101 - protein, 9 aa, Homo Sapiens
SGLSVSVGC

SEQ ID NO: 1200102 - protein, 9 aa, Homo Sapiens
LPCLKIVIA

SEQ ID NO: 1200103 - protein, 9 aa, Homo Sapiens
LVAVQHLRP

SEQ ID NO: 1200104 - protein, 9 aa, Homo Sapiens
ACGCGCEAQ

SEQ ID NO: 1200105 - protein, 9 aa, Homo Sapiens
RPVATLSPG

SEQ ID NO: 1200106 - protein, 9 aa, Homo Sapiens
LFVKTMVCC

SEQ ID NO: 1200107 - protein, 9 aa, Homo Sapiens
LITAVAKRS

SEQ ID NO: 1200108 - protein, 9 aa, Homo Sapiens
HSRGRELGR

SEQ ID NO: 1200109 - protein, 9 aa, Homo Sapiens
HLVVGRVVE

SEQ ID NO: 1200110 - protein, 9 aa, Homo Sapiens
SSKTMQLKK

SEQ ID NO: 1200111 - protein, 9 aa, Homo Sapiens
VVYDLAGDE

SEQ ID NO: 1200112 - protein, 9 aa, Homo Sapiens
CSGLSVSVG

SEQ ID NO: 1200113 - protein, 9 aa, Homo Sapiens
PHLLATVTN

SEQ ID NO: 1200114 - protein, 9 aa, Homo Sapiens
ITSTKTRKA

SEQ ID NO: 1200115 - protein, 9 aa, Homo Sapiens
RYTDAGTVQ

SEQ ID NO: 1200116 - protein, 9 aa, Homo Sapiens
SPPGCDGGN

SEQ ID NO: 1200117 - protein, 9 aa, Homo Sapiens
MVIAEGVGC

SEQ ID NO: 1200118 - protein, 9 aa, Homo Sapiens
TPPGSCGFT

SEQ ID NO: 1200119 - protein, 9 aa, Homo Sapiens
ACARRCAEP

SEQ ID NO: 1200120 - protein, 9 aa, Homo Sapiens
LFNYVRCMF

SEQ ID NO: 1200121 - protein, 9 aa, Homo Sapiens
AVLYYIVWS

SEQ ID NO: 1200122 - protein, 9 aa, Homo Sapiens
ATFISQCTV

SEQ ID NO: 1200123 - protein, 9 aa, Homo Sapiens
RRNGFWRQE

SEQ ID NO: 1200124 - protein, 9 aa, Homo Sapiens
SAGSGVPGA

SEQ ID NO: 1200125 - protein, 9 aa, Homo Sapiens
PNRKASQNA

SEQ ID NO: 1200126 - protein, 9 aa, Homo Sapiens
TASPQWSPS

SEQ ID NO: 1200127 - protein, 9 aa, Homo Sapiens
LERVSPGGA

SEQ ID NO: 1200128 - protein, 9 aa, Homo Sapiens
HPGRRRARP

SEQ ID NO: 1200129 - protein, 9 aa, Homo Sapiens
AASVGHCSV

SEQ ID NO: 1200130 - protein, 9 aa, Homo Sapiens
APLEALTGQ

SEQ ID NO: 1200131 - protein, 9 aa, Homo Sapiens
QMQHSPHIW

SEQ ID NO: 1200132 - protein, 9 aa, Homo Sapiens
VWSSRTLCS

SEQ ID NO: 1200133 - protein, 9 aa, Homo Sapiens
GVGEPRHCI

SEQ ID NO: 1200134 - protein, 9 aa, Homo Sapiens
KNTDCIWDW

SEQ ID NO: 1200135 - protein, 9 aa, Homo Sapiens
GTAGGGGSW

SEQ ID NO: 1200136 - protein, 9 aa, Homo Sapiens
GVAQSPQQQ

SEQ ID NO: 1200137 - protein, 9 aa, Homo Sapiens
KKKTEAAEK

SEQ ID NO: 1200138 - protein, 9 aa, Homo Sapiens
KEKGTANIK

SEQ ID NO: 1200139 - protein, 9 aa, Homo Sapiens
PPEPQARTK

SEQ ID NO: 1200140 - protein, 9 aa, Homo Sapiens
TAWVEGEVH

SEQ ID NO: 1200141 - protein, 9 aa, Homo Sapiens
PSRAAPQAP

SEQ ID NO: 1200142 - protein, 9 aa, Homo Sapiens
THKIVHAGE

SEQ ID NO: 1200143 - protein, 9 aa, Homo Sapiens
AGGGVGEPR

SEQ ID NO: 1200144 - protein, 9 aa, Homo Sapiens
HRGHHHPQL

SEQ ID NO: 1200145 - protein, 9 aa, Homo Sapiens
TINQTDKEK

SEQ ID NO: 1200146 - protein, 9 aa, Homo Sapiens
GTMKTSTNC

SEQ ID NO: 1200147 - protein, 9 aa, Homo Sapiens
TWRRSLPLR

SEQ ID NO: 1200148 - protein, 9 aa, Homo Sapiens
LVYSTDICS

SEQ ID NO: 1200149 - protein, 9 aa, Homo Sapiens
MCAPVGNGC

SEQ ID NO: 1200150 - protein, 9 aa, Homo Sapiens
GSHGRRQVR

SEQ ID NO: 1200151 - protein, 9 aa, Homo Sapiens
REKMNRMWQ

SEQ ID NO: 1200152 - protein, 9 aa, Homo Sapiens
GCKNKQPQK

SEQ ID NO: 1200153 - protein, 9 aa, Homo Sapiens
CHVTGSAAC

SEQ ID NO: 1200154 - protein, 9 aa, Homo Sapiens
AARAILHVQ

SEQ ID NO: 1200155 - protein, 9 aa, Homo Sapiens
PAGPHTAPA

SEQ ID NO: 1200156 - protein, 9 aa, Homo Sapiens
ALQQRQQCL

SEQ ID NO: 1200157 - protein, 9 aa, Homo Sapiens
IYCCWEEYR

SEQ ID NO: 1200158 - protein, 9 aa, Homo Sapiens
PQTGQAPAG

SEQ ID NO: 1200159 - protein, 9 aa, Homo Sapiens
IGAPRRRAT

SEQ ID NO: 1200160 - protein, 9 aa, Homo Sapiens
RCTWAMSMS

SEQ ID NO: 1200161 - protein, 9 aa, Homo Sapiens
EGGSRAQKL

SEQ ID NO: 1200162 - protein, 9 aa, Homo Sapiens
LEGECRQGH

SEQ ID NO: 1200163 - protein, 9 aa, Homo Sapiens
NEYQASSIP

SEQ ID NO: 1200164 - protein, 9 aa, Homo Sapiens
TTTTTPSTP

SEQ ID NO: 1200165 - protein, 9 aa, Homo Sapiens
APGYHARDE

SEQ ID NO: 1200166 - protein, 9 aa, Homo Sapiens
ITVGPRGHL

SEQ ID NO: 1200167 - protein, 9 aa, Homo Sapiens
DHNFLSIFK

SEQ ID NO: 1200168 - protein, 9 aa, Homo Sapiens
RKVLPSSED

SEQ ID NO: 1200169 - protein, 9 aa, Homo Sapiens
KVIFTNYLP

SEQ ID NO: 1200170 - protein, 9 aa, Homo Sapiens
TLYQCGCGT

SEQ ID NO: 1200171 - protein, 9 aa, Homo Sapiens
EQAVFLDFD

SEQ ID NO: 1200172 - protein, 9 aa, Homo Sapiens
GVNPVNSNN

SEQ ID NO: 1200173 - protein, 9 aa, Homo Sapiens
NKLFRRSLL

SEQ ID NO: 1200174 - protein, 9 aa, Homo Sapiens
ACCGTRRSC

SEQ ID NO: 1200175 - protein, 9 aa, Homo Sapiens
GYSGSVIRH

SEQ ID NO: 1200176 - protein, 9 aa, Homo Sapiens
NKVKNLTDE

SEQ ID NO: 1200177 - protein, 9 aa, Homo Sapiens
RVIFHFCTM

SEQ ID NO: 1200178 - protein, 9 aa, Homo Sapiens
PLRENKKEH

SEQ ID NO: 1200179 - protein, 9 aa, Homo Sapiens
VVVLLAARR

SEQ ID NO: 1200180 - protein, 9 aa, Homo Sapiens
SRPRASCSD

SEQ ID NO: 1200181 - protein, 9 aa, Homo Sapiens
GVGAAVQRL

SEQ ID NO: 1200182 - protein, 9 aa, Homo Sapiens
GPGGGREAA

SEQ ID NO: 1200183 - protein, 9 aa, Homo Sapiens
PLGPWNGTT

SEQ ID NO: 1200184 - protein, 9 aa, Homo Sapiens
NEIQNGNVS

SEQ ID NO: 1200185 - protein, 9 aa, Homo Sapiens
WWLAHDCLT

SEQ ID NO: 1200186 - protein, 9 aa, Homo Sapiens
VGPRSSSPT

SEQ ID NO: 1200187 - protein, 9 aa, Homo Sapiens
EEVAVGRLP

SEQ ID NO: 1200188 - protein, 9 aa, Homo Sapiens
VVHTTLFLS

SEQ ID NO: 1200189 - protein, 9 aa, Homo Sapiens
QPLDHEEPE

SEQ ID NO: 1200190 - protein, 9 aa, Homo Sapiens
VIHSQQPGA

SEQ ID NO: 1200191 - protein, 9 aa, Homo Sapiens
RCCPGGLPG

SEQ ID NO: 1200192 - protein, 9 aa, Homo Sapiens
VPSAFSCLA

SEQ ID NO: 1200193 - protein, 9 aa, Homo Sapiens
PNPNSRGFW

SEQ ID NO: 1200194 - protein, 9 aa, Homo Sapiens
FRRSLLRRK

SEQ ID NO: 1200195 - protein, 9 aa, Homo Sapiens
ESYCPEYLI

SEQ ID NO: 1200196 - protein, 9 aa, Homo Sapiens
SSACSAGGD

SEQ ID NO: 1200197 - protein, 9 aa, Homo Sapiens
RAKGTPKPS

SEQ ID NO: 1200198 - protein, 9 aa, Homo Sapiens
RLEQLLLFL

SEQ ID NO: 1200199 - protein, 9 aa, Homo Sapiens
SVTTLYDLS

SEQ ID NO: 1200200 - protein, 9 aa, Homo Sapiens
FAFSLSMMA

SEQ ID NO: 1200201 - protein, 9 aa, Homo Sapiens
FIIIHTFAV

SEQ ID NO: 1200202 - protein, 9 aa, Homo Sapiens
AGQQTGIPT

SEQ ID NO: 1200203 - protein, 9 aa, Homo Sapiens
VQLWAGAAR

SEQ ID NO: 1200204 - protein, 9 aa, Homo Sapiens
QERDRKFLG

SEQ ID NO: 1200205 - protein, 9 aa, Homo Sapiens
PSWNHEVKL

SEQ ID NO: 1200206 - protein, 9 aa, Homo Sapiens
RHSPGQMLF

SEQ ID NO: 1200207 - protein, 9 aa, Homo Sapiens
KEIDRERAA

SEQ ID NO: 1200208 - protein, 9 aa, Homo Sapiens
ESDCSSVQA

SEQ ID NO: 1200209 - protein, 9 aa, Homo Sapiens
DPSWNHEVK

SEQ ID NO: 1200210 - protein, 9 aa, Homo Sapiens
KIVIAVTTS

SEQ ID NO: 1200211 - protein, 9 aa, Homo Sapiens
QGALGTACL

SEQ ID NO: 1200212 - protein, 9 aa, Homo Sapiens
IGPACQIIL

SEQ ID NO: 1200213 - protein, 9 aa, Homo Sapiens
CSLTQGPRT

SEQ ID NO: 1200214 - protein, 9 aa, Homo Sapiens
RARGCPPFT

SEQ ID NO: 1200215 - protein, 9 aa, Homo Sapiens
KNWEKLENL

SEQ ID NO: 1200216 - protein, 9 aa, Homo Sapiens
YPKLLSMEV

SEQ ID NO: 1200217 - protein, 9 aa, Homo Sapiens
TKDIVDVGL

SEQ ID NO: 1200218 - protein, 9 aa, Homo Sapiens
QKCIFSFNS

SEQ ID NO: 1200219 - protein, 9 aa, Homo Sapiens
LAPGSAGSV

SEQ ID NO: 1200220 - protein, 9 aa, Homo Sapiens
LHVSMYRSA

SEQ ID NO: 1200221 - protein, 9 aa, Homo Sapiens
ARWDAGLSG

SEQ ID NO: 1200222 - protein, 9 aa, Homo Sapiens
PYHPGHHGA

SEQ ID NO: 1200223 - protein, 9 aa, Homo Sapiens
TLTTYTLVL

SEQ ID NO: 1200224 - protein, 9 aa, Homo Sapiens
GNAFSYNSS

SEQ ID NO: 1200225 - protein, 9 aa, Homo Sapiens
SLGGPRRRS

SEQ ID NO: 1200226 - protein, 9 aa, Homo Sapiens
QQSHLMGPG

SEQ ID NO: 1200227 - protein, 9 aa, Homo Sapiens
KCLRSAQHI

SEQ ID NO: 1200228 - protein, 9 aa, Homo Sapiens
SWHRPQLRR

SEQ ID NO: 1200229 - protein, 9 aa, Homo Sapiens
VVQGFGDVG

SEQ ID NO: 1200230 - protein, 9 aa, Homo Sapiens
YLGCPNLLQ

SEQ ID NO: 1200231 - protein, 9 aa, Homo Sapiens
VNDNGIEVL

SEQ ID NO: 1200232 - protein, 9 aa, Homo Sapiens
ENGIPPAHL

SEQ ID NO: 1200233 - protein, 9 aa, Homo Sapiens
LGELKKLVE

SEQ ID NO: 1200234 - protein, 9 aa, Homo Sapiens
RSATGSARS

SEQ ID NO: 1200235 - protein, 9 aa, Homo Sapiens
FFLFWFGLV

SEQ ID NO: 1200236 - protein, 9 aa, Homo Sapiens
GWSSRRARC

SEQ ID NO: 1200237 - protein, 9 aa, Homo Sapiens
LFKFFWFGY

SEQ ID NO: 1200238 - protein, 9 aa, Homo Sapiens
DKQYFVVLI

SEQ ID NO: 1200239 - protein, 9 aa, Homo Sapiens
GTTTADHTM

SEQ ID NO: 1200240 - protein, 9 aa, Homo Sapiens
GMNFVQDLC

SEQ ID NO: 1200241 - protein, 9 aa, Homo Sapiens
PSPPGCDGG

SEQ ID NO: 1200242 - protein, 9 aa, Homo Sapiens
RHPLLIVST

SEQ ID NO: 1200243 - protein, 9 aa, Homo Sapiens
TCRALAPAL

SEQ ID NO: 1200244 - protein, 9 aa, Homo Sapiens
GSVPQLRIW

SEQ ID NO: 1200245 - protein, 9 aa, Homo Sapiens
QFGEGAVDA

SEQ ID NO: 1200246 - protein, 9 aa, Homo Sapiens
SKRKRKGKG

SEQ ID NO: 1200247 - protein, 9 aa, Homo Sapiens
SALIAARGL

SEQ ID NO: 1200248 - protein, 9 aa, Homo Sapiens
DDSGVIRLY

SEQ ID NO: 1200249 - protein, 9 aa, Homo Sapiens
RGPPKDNKL

SEQ ID NO: 1200250 - protein, 9 aa, Homo Sapiens
PYYPGIGNG

SEQ ID NO: 1200251 - protein, 9 aa, Homo Sapiens
WPSRRAQRR

SEQ ID NO: 1200252 - protein, 9 aa, Homo Sapiens
MNIFNQSAD

SEQ ID NO: 1200253 - protein, 9 aa, Homo Sapiens
LIEPTVDVY

SEQ ID NO: 1200254 - protein, 9 aa, Homo Sapiens
KESVFSWDE

SEQ ID NO: 1200255 - protein, 9 aa, Homo Sapiens
RHGGWTTKM

SEQ ID NO: 1200256 - protein, 9 aa, Homo Sapiens
AYKRFHVKD

SEQ ID NO: 1200257 - protein, 9 aa, Homo Sapiens
AQIKAANKA

SEQ ID NO: 1200258 - protein, 9 aa, Homo Sapiens
KETVLSALQ

SEQ ID NO: 1200259 - protein, 9 aa, Homo Sapiens
MDSPCCQAP

SEQ ID NO: 1200260 - protein, 9 aa, Homo Sapiens
PRWPRGLLC

SEQ ID NO: 1200261 - protein, 9 aa, Homo Sapiens
AAEKCLAST

SEQ ID NO: 1200262 - protein, 9 aa, Homo Sapiens
LLHILEGIG

SEQ ID NO: 1200263 - protein, 9 aa, Homo Sapiens
ALRHRFDCI

SEQ ID NO: 1200264 - protein, 9 aa, Homo Sapiens
DSANLLPLD

SEQ ID NO: 1200265 - protein, 9 aa, Homo Sapiens
PAKLVRLVS

SEQ ID NO: 1200266 - protein, 9 aa, Homo Sapiens
PTAALGWSP

SEQ ID NO: 1200267 - protein, 9 aa, Homo Sapiens
EAPSAPVHS

SEQ ID NO: 1200268 - protein, 9 aa, Homo Sapiens
GSLLCTPPG

SEQ ID NO: 1200269 - protein, 9 aa, Homo Sapiens
PRWLLSQKE

SEQ ID NO: 1200270 - protein, 9 aa, Homo Sapiens
IKRDVNRRR

SEQ ID NO: 1200271 - protein, 9 aa, Homo Sapiens
NEALGYLKN

SEQ ID NO: 1200272 - protein, 9 aa, Homo Sapiens
CTPKCHPKC

SEQ ID NO: 1200273 - protein, 9 aa, Homo Sapiens
QLFPVPGLP

SEQ ID NO: 1200274 - protein, 9 aa, Homo Sapiens
LWRSNGAYN

SEQ ID NO: 1200275 - protein, 9 aa, Homo Sapiens
QWVMSQTQQ

SEQ ID NO: 1200276 - protein, 9 aa, Homo Sapiens
FSTMGYGYI

SEQ ID NO: 1200277 - protein, 9 aa, Homo Sapiens
ISGTIEDAS

SEQ ID NO: 1200278 - protein, 9 aa, Homo Sapiens
LKWHYYYQS

SEQ ID NO: 1200279 - protein, 9 aa, Homo Sapiens
NARAKFRCN

SEQ ID NO: 1200280 - protein, 9 aa, Homo Sapiens
GCSVDRTAE

SEQ ID NO: 1200281 - protein, 9 aa, Homo Sapiens
RRPKKMNTA

SEQ ID NO: 1200282 - protein, 9 aa, Homo Sapiens
SHVFLHHAL

SEQ ID NO: 1200283 - protein, 9 aa, Homo Sapiens
IQNGNVSLF

SEQ ID NO: 1200284 - protein, 9 aa, Homo Sapiens
GKVLRPLEG

SEQ ID NO: 1200285 - protein, 9 aa, Homo Sapiens
ELFCLEHDI

SEQ ID NO: 1200286 - protein, 9 aa, Homo Sapiens
RALGFGTKY

SEQ ID NO: 1200287 - protein, 9 aa, Homo Sapiens
PRYASCETG

SEQ ID NO: 1200288 - protein, 9 aa, Homo Sapiens
VTACLLILL

SEQ ID NO: 1200289 - protein, 9 aa, Homo Sapiens
SVNPRSRAT

SEQ ID NO: 1200290 - protein, 9 aa, Homo Sapiens
PSNSRKFGW

SEQ ID NO: 1200291 - protein, 9 aa, Homo Sapiens
ILMAMLWHG

SEQ ID NO: 1200292 - protein, 9 aa, Homo Sapiens
RGLVDGGGS

SEQ ID NO: 1200293 - protein, 9 aa, Homo Sapiens
LGAGLVENL

SEQ ID NO: 1200294 - protein, 9 aa, Homo Sapiens
PVHGHGKVQ

SEQ ID NO: 1200295 - protein, 9 aa, Homo Sapiens
AQAQKKNSL

SEQ ID NO: 1200296 - protein, 9 aa, Homo Sapiens
DSHPHPPQP

SEQ ID NO: 1200297 - protein, 9 aa, Homo Sapiens
LGWAGIIWE

SEQ ID NO: 1200298 - protein, 9 aa, Homo Sapiens
CRTKFKSIQ

SEQ ID NO: 1200299 - protein, 9 aa, Homo Sapiens
SPPVPLGPW

SEQ ID NO: 1200300 - protein, 9 aa, Homo Sapiens
DHVRPVGAF

SEQ ID NO: 1200301 - protein, 9 aa, Homo Sapiens
VYMDIPAPE

SEQ ID NO: 1200302 - protein, 9 aa, Homo Sapiens
PCLAQAPIP

SEQ ID NO: 1200303 - protein, 9 aa, Homo Sapiens
ASRGTGGAL

SEQ ID NO: 1200304 - protein, 9 aa, Homo Sapiens
GQRDRPCQL

SEQ ID NO: 1200305 - protein, 9 aa, Homo Sapiens
AQQPGHIHG

SEQ ID NO: 1200306 - protein, 9 aa, Homo Sapiens
MNNNNVVKV

SEQ ID NO: 1200307 - protein, 9 aa, Homo Sapiens
SMACGSAES

SEQ ID NO: 1200308 - protein, 9 aa, Homo Sapiens
LRQILGRIT

SEQ ID NO: 1200309 - protein, 9 aa, Homo Sapiens
YSFSEIHFV

SEQ ID NO: 1200310 - protein, 9 aa, Homo Sapiens
LPAAPAARS

SEQ ID NO: 1200311 - protein, 9 aa, Homo Sapiens
RLGLPAIVV

SEQ ID NO: 1200312 - protein, 9 aa, Homo Sapiens
SYYHKKMGW

SEQ ID NO: 1200313 - protein, 9 aa, Homo Sapiens
SKNSSRNQF

SEQ ID NO: 1200314 - protein, 9 aa, Homo Sapiens
EAAGPQGPP

SEQ ID NO: 1200315 - protein, 9 aa, Homo Sapiens
QLNWNKDDQ

SEQ ID NO: 1200316 - protein, 9 aa, Homo Sapiens
TPAGPHTAP

SEQ ID NO: 1200317 - protein, 9 aa, Homo Sapiens
IVISKKESV

SEQ ID NO: 1200318 - protein, 9 aa, Homo Sapiens
ERGVSEVDR

SEQ ID NO: 1200319 - protein, 9 aa, Homo Sapiens
DPLQAKAYD

SEQ ID NO: 1200320 - protein, 9 aa, Homo Sapiens
HRSPPTSCP

SEQ ID NO: 1200321 - protein, 9 aa, Homo Sapiens
DKVLVFSSC

SEQ ID NO: 1200322 - protein, 9 aa, Homo Sapiens
PHIWPVQPH

SEQ ID NO: 1200323 - protein, 9 aa, Homo Sapiens
HPFFPRDKS

SEQ ID NO: 1200324 - protein, 9 aa, Homo Sapiens
EEVLIPPLR

SEQ ID NO: 1200325 - protein, 9 aa, Homo Sapiens
PGRRRRWHT

SEQ ID NO: 1200326 - protein, 9 aa, Homo Sapiens
QEFVKGWFE

SEQ ID NO: 1200327 - protein, 9 aa, Homo Sapiens
VWLRQRLCR

SEQ ID NO: 1200328 - protein, 9 aa, Homo Sapiens
EVLVCPVHL

SEQ ID NO: 1200329 - protein, 9 aa, Homo Sapiens
MNTMGYNTD

SEQ ID NO: 1200330 - protein, 9 aa, Homo Sapiens
RPAGQVSGS

SEQ ID NO: 1200331 - protein, 9 aa, Homo Sapiens
KFVPVDYSF

SEQ ID NO: 1200332 - protein, 9 aa, Homo Sapiens
AQLVARPRG

SEQ ID NO: 1200333 - protein, 9 aa, Homo Sapiens
EVVVDGEIM

SEQ ID NO: 1200334 - protein, 9 aa, Homo Sapiens
LEAHCPLQT

SEQ ID NO: 1200335 - protein, 9 aa, Homo Sapiens
AGAQDGVHE

SEQ ID NO: 1200336 - protein, 9 aa, Homo Sapiens
GLLEVRLWP

SEQ ID NO: 1200337 - protein, 9 aa, Homo Sapiens
RQWGPGEGE

SEQ ID NO: 1200338 - protein, 9 aa, Homo Sapiens
IHTNMYVNS

SEQ ID NO: 1200339 - protein, 9 aa, Homo Sapiens
KGGGQPGGC

SEQ ID NO: 1200340 - protein, 9 aa, Homo Sapiens
AWDPPRSCR

SEQ ID NO: 1200341 - protein, 9 aa, Homo Sapiens
PSADMGAYG

SEQ ID NO: 1200342 - protein, 9 aa, Homo Sapiens
TLQNYLPPV

SEQ ID NO: 1200343 - protein, 9 aa, Homo Sapiens
KYLSMQDRM

SEQ ID NO: 1200344 - protein, 9 aa, Homo Sapiens
AWRASFLMA

SEQ ID NO: 1200345 - protein, 9 aa, Homo Sapiens
RAAAALRAV

SEQ ID NO: 1200346 - protein, 9 aa, Homo Sapiens
DEGWELIKT

SEQ ID NO: 1200347 - protein, 9 aa, Homo Sapiens
SYIMKELLT

SEQ ID NO: 1200348 - protein, 9 aa, Homo Sapiens
NNFSRSPPT

SEQ ID NO: 1200349 - protein, 9 aa, Homo Sapiens
KLSAFPKPP

SEQ ID NO: 1200350 - protein, 9 aa, Homo Sapiens
RAHSRSATG

SEQ ID NO: 1200351 - protein, 9 aa, Homo Sapiens
PALAHLQEE

SEQ ID NO: 1200352 - protein, 9 aa, Homo Sapiens
VGVPTGGAL

SEQ ID NO: 1200353 - protein, 9 aa, Homo Sapiens
CIEFRPVDC

SEQ ID NO: 1200354 - protein, 9 aa, Homo Sapiens
TEDDGIYTY

SEQ ID NO: 1200355 - protein, 9 aa, Homo Sapiens
SWAPPKRCA

SEQ ID NO: 1200356 - protein, 9 aa, Homo Sapiens
WFRAMAGLQ

SEQ ID NO: 1200357 - protein, 9 aa, Homo Sapiens
KKLVNYYSC

SEQ ID NO: 1200358 - protein, 9 aa, Homo Sapiens
LGAAPLPPR

SEQ ID NO: 1200359 - protein, 9 aa, Homo Sapiens
LAEDHPRIL

SEQ ID NO: 1200360 - protein, 9 aa, Homo Sapiens
SEKLSGETT

SEQ ID NO: 1200361 - protein, 9 aa, Homo Sapiens
FLLSHEAGG

SEQ ID NO: 1200362 - protein, 9 aa, Homo Sapiens
SRPPGPQCP

SEQ ID NO: 1200363 - protein, 9 aa, Homo Sapiens
LWLASRPSS

SEQ ID NO: 1200364 - protein, 9 aa, Homo Sapiens
AQGICPRPP

SEQ ID NO: 1200365 - protein, 9 aa, Homo Sapiens
NGVHSPIMA

SEQ ID NO: 1200366 - protein, 9 aa, Homo Sapiens
ALPPACPLC

SEQ ID NO: 1200367 - protein, 9 aa, Homo Sapiens
EERRPIASP

SEQ ID NO: 1200368 - protein, 9 aa, Homo Sapiens
LSGRKAPRV

SEQ ID NO: 1200369 - protein, 9 aa, Homo Sapiens
DKGSVSEEA

SEQ ID NO: 1200370 - protein, 9 aa, Homo Sapiens
GFGDVGLHS

SEQ ID NO: 1200371 - protein, 9 aa, Homo Sapiens
LNEGTDAAQ

SEQ ID NO: 1200372 - protein, 9 aa, Homo Sapiens
MRQYLERGE

SEQ ID NO: 1200373 - protein, 9 aa, Homo Sapiens
PLIYSLSNK

SEQ ID NO: 1200374 - protein, 9 aa, Homo Sapiens
AGSPRYQGA

SEQ ID NO: 1200375 - protein, 9 aa, Homo Sapiens
PRVTPRPPP

SEQ ID NO: 1200376 - protein, 9 aa, Homo Sapiens
SPSTNATLP

SEQ ID NO: 1200377 - protein, 9 aa, Homo Sapiens
PRAVLSAIV

SEQ ID NO: 1200378 - protein, 9 aa, Homo Sapiens
NYKKMESCM

SEQ ID NO: 1200379 - protein, 9 aa, Homo Sapiens
ALSRPPGPQ

SEQ ID NO: 1200380 - protein, 9 aa, Homo Sapiens
FSGDFQPFV

SEQ ID NO: 1200381 - protein, 9 aa, Homo Sapiens
MKELLTCSH

SEQ ID NO: 1200382 - protein, 9 aa, Homo Sapiens
EAAVAGSGS

SEQ ID NO: 1200383 - protein, 9 aa, Homo Sapiens
QTWTGGTLS

SEQ ID NO: 1200384 - protein, 9 aa, Homo Sapiens
PQDQVAQSP

SEQ ID NO: 1200385 - protein, 9 aa, Homo Sapiens
PSEASIARN

SEQ ID NO: 1200386 - protein, 9 aa, Homo Sapiens
VPRLSLDHN

SEQ ID NO: 1200387 - protein, 9 aa, Homo Sapiens
IADSGVATP

SEQ ID NO: 1200388 - protein, 9 aa, Homo Sapiens
TTELQLKLE

SEQ ID NO: 1200389 - protein, 9 aa, Homo Sapiens
IVVHMDLMR

SEQ ID NO: 1200390 - protein, 9 aa, Homo Sapiens
VHSPLHYSA

SEQ ID NO: 1200391 - protein, 9 aa, Homo Sapiens
RRRRLLGLG

SEQ ID NO: 1200392 - protein, 9 aa, Homo Sapiens
VTTGKVVCR

SEQ ID NO: 1200393 - protein, 9 aa, Homo Sapiens
SAVTVAVGC

SEQ ID NO: 1200394 - protein, 9 aa, Homo Sapiens
FLVVFLYMW

SEQ ID NO: 1200395 - protein, 9 aa, Homo Sapiens
VTNSLVDLE

SEQ ID NO: 1200396 - protein, 9 aa, Homo Sapiens
FRKRQWGPG

SEQ ID NO: 1200397 - protein, 9 aa, Homo Sapiens
KVPGGSRPG

SEQ ID NO: 1200398 - protein, 9 aa, Homo Sapiens
FLGCPQASS

SEQ ID NO: 1200399 - protein, 9 aa, Homo Sapiens
QLCRKARLG

SEQ ID NO: 1200400 - protein, 9 aa, Homo Sapiens
EFMVDKVIY

SEQ ID NO: 1200401 - protein, 9 aa, Homo Sapiens
NDNGIEVLK

SEQ ID NO: 1200402 - protein, 9 aa, Homo Sapiens
TRLSQQNEE

SEQ ID NO: 1200403 - protein, 9 aa, Homo Sapiens
ASLRATVPR

SEQ ID NO: 1200404 - protein, 9 aa, Homo Sapiens
RPTSAWQLD

SEQ ID NO: 1200405 - protein, 9 aa, Homo Sapiens
GCRCWKATS

SEQ ID NO: 1200406 - protein, 9 aa, Homo Sapiens
AQAIPKTWR

SEQ ID NO: 1200407 - protein, 9 aa, Homo Sapiens
PLTAAEQAV

SEQ ID NO: 1200408 - protein, 9 aa, Homo Sapiens
VAAARAAAR

SEQ ID NO: 1200409 - protein, 9 aa, Homo Sapiens
HSLDHSHEM

SEQ ID NO: 1200410 - protein, 9 aa, Homo Sapiens
NISSPVNLG

SEQ ID NO: 1200411 - protein, 9 aa, Homo Sapiens
PCWTCPRAS

SEQ ID NO: 1200412 - protein, 9 aa, Homo Sapiens
TTMMEGAVL

SEQ ID NO: 1200413 - protein, 9 aa, Homo Sapiens
TAVAPKAGP

SEQ ID NO: 1200414 - protein, 9 aa, Homo Sapiens
GRLYMKTLL

SEQ ID NO: 1200415 - protein, 9 aa, Homo Sapiens
PKMCAPVGN

SEQ ID NO: 1200416 - protein, 9 aa, Homo Sapiens
DSQNVIDHK

SEQ ID NO: 1200417 - protein, 9 aa, Homo Sapiens
RKVAFVLGH

SEQ ID NO: 1200418 - protein, 9 aa, Homo Sapiens
HHRRERRFG

SEQ ID NO: 1200419 - protein, 9 aa, Homo Sapiens
HAHALPKHL

SEQ ID NO: 1200420 - protein, 9 aa, Homo Sapiens
MNRMWQRIA

SEQ ID NO: 1200421 - protein, 9 aa, Homo Sapiens
THTEHAKRK

SEQ ID NO: 1200422 - protein, 9 aa, Homo Sapiens
GHNKLFRRS

SEQ ID NO: 1200423 - protein, 9 aa, Homo Sapiens
PPKRCAARR

SEQ ID NO: 1200424 - protein, 9 aa, Homo Sapiens
EGQVEEHFR

SEQ ID NO: 1200425 - protein, 9 aa, Homo Sapiens
GPIACLMPL

SEQ ID NO: 1200426 - protein, 9 aa, Homo Sapiens
LWTLCSSTP

SEQ ID NO: 1200427 - protein, 9 aa, Homo Sapiens
GIEVLKTFA

SEQ ID NO: 1200428 - protein, 9 aa, Homo Sapiens
LGALEAHPF

SEQ ID NO: 1200429 - protein, 9 aa, Homo Sapiens
CLAQAPIPW

SEQ ID NO: 1200430 - protein, 9 aa, Homo Sapiens
PGRGGQRAR

SEQ ID NO: 1200431 - protein, 9 aa, Homo Sapiens
DLAKKKTCF

SEQ ID NO: 1200432 - protein, 9 aa, Homo Sapiens
KKNMSCLWT

SEQ ID NO: 1200433 - protein, 9 aa, Homo Sapiens
PPATLPEST

SEQ ID NO: 1200434 - protein, 9 aa, Homo Sapiens
GHLRLLLQA

SEQ ID NO: 1200435 - protein, 9 aa, Homo Sapiens
APHQPALSW

SEQ ID NO: 1200436 - protein, 9 aa, Homo Sapiens
ATNVSNWHW

SEQ ID NO: 1200437 - protein, 9 aa, Homo Sapiens
VGPCKLSSP

SEQ ID NO: 1200438 - protein, 9 aa, Homo Sapiens
PVGMTGPAR

SEQ ID NO: 1200439 - protein, 9 aa, Homo Sapiens
PMVTRWRWN

SEQ ID NO: 1200440 - protein, 9 aa, Homo Sapiens
KSHSKPSQI

SEQ ID NO: 1200441 - protein, 9 aa, Homo Sapiens
GSRVIFHFC

SEQ ID NO: 1200442 - protein, 9 aa, Homo Sapiens
KIRILKYSK

SEQ ID NO: 1200443 - protein, 9 aa, Homo Sapiens
VPRGPDGAS

SEQ ID NO: 1200444 - protein, 9 aa, Homo Sapiens
FLGALEAHP

SEQ ID NO: 1200445 - protein, 9 aa, Homo Sapiens
RPMYHILRY

SEQ ID NO: 1200446 - protein, 9 aa, Homo Sapiens
DSLSNHNSK

SEQ ID NO: 1200447 - protein, 9 aa, Homo Sapiens
IIHTFAVKL

SEQ ID NO: 1200448 - protein, 9 aa, Homo Sapiens
FNILLVFDY

SEQ ID NO: 1200449 - protein, 9 aa, Homo Sapiens
AVRHISSEH

SEQ ID NO: 1200450 - protein, 9 aa, Homo Sapiens
ASTGQAYSA

SEQ ID NO: 1200451 - protein, 9 aa, Homo Sapiens
QKQSTITNM

SEQ ID NO: 1200452 - protein, 9 aa, Homo Sapiens
TNLIKLCQL

SEQ ID NO: 1200453 - protein, 9 aa, Homo Sapiens
QLVLWGWRP

SEQ ID NO: 1200454 - protein, 9 aa, Homo Sapiens
HARDEDAGH

SEQ ID NO: 1200455 - protein, 9 aa, Homo Sapiens
TAERVEALE

SEQ ID NO: 1200456 - protein, 9 aa, Homo Sapiens
PCPRTTWSA

SEQ ID NO: 1200457 - protein, 9 aa, Homo Sapiens
KIWESWQMK

SEQ ID NO: 1200458 - protein, 9 aa, Homo Sapiens
DAPGHADSH

SEQ ID NO: 1200459 - protein, 9 aa, Homo Sapiens
PPVPLLEHT

SEQ ID NO: 1200460 - protein, 9 aa, Homo Sapiens
APELVEPGH

SEQ ID NO: 1200461 - protein, 9 aa, Homo Sapiens
PEERPPATL

SEQ ID NO: 1200462 - protein, 9 aa, Homo Sapiens
INAEHSWAD

SEQ ID NO: 1200463 - protein, 9 aa, Homo Sapiens
FALGLQEEV

SEQ ID NO: 1200464 - protein, 9 aa, Homo Sapiens
GLPLTHVQD

SEQ ID NO: 1200465 - protein, 9 aa, Homo Sapiens
EVFWMWSRD

SEQ ID NO: 1200466 - protein, 9 aa, Homo Sapiens
NTDKQYFVV

SEQ ID NO: 1200467 - protein, 9 aa, Homo Sapiens
MATMMMVDP

SEQ ID NO: 1200468 - protein, 9 aa, Homo Sapiens
VLGPGEADS

SEQ ID NO: 1200469 - protein, 9 aa, Homo Sapiens
GQQRQPAAR

SEQ ID NO: 1200470 - protein, 9 aa, Homo Sapiens
FALFQEGGG

SEQ ID NO: 1200471 - protein, 9 aa, Homo Sapiens
QLNSAAPQL

SEQ ID NO: 1200472 - protein, 9 aa, Homo Sapiens
SPPWFIVDG

SEQ ID NO: 1200473 - protein, 9 aa, Homo Sapiens
SSASSAYHH

SEQ ID NO: 1200474 - protein, 9 aa, Homo Sapiens
GKLSAFPKP

SEQ ID NO: 1200475 - protein, 9 aa, Homo Sapiens
NFHKSPKRW

SEQ ID NO: 1200476 - protein, 9 aa, Homo Sapiens
LGPTLEETW

SEQ ID NO: 1200477 - protein, 9 aa, Homo Sapiens
YQAANRFAY

SEQ ID NO: 1200478 - protein, 9 aa, Homo Sapiens
PTKKKPPPP

SEQ ID NO: 1200479 - protein, 9 aa, Homo Sapiens
EVAAGPPMR

SEQ ID NO: 1200480 - protein, 9 aa, Homo Sapiens
RQLPHGELH

SEQ ID NO: 1200481 - protein, 9 aa, Homo Sapiens
PDIGKQSTC

SEQ ID NO: 1200482 - protein, 9 aa, Homo Sapiens
GARLEQLLL

SEQ ID NO: 1200483 - protein, 9 aa, Homo Sapiens
PSHACRSAS

SEQ ID NO: 1200484 - protein, 9 aa, Homo Sapiens
MVDPLVLTA

SEQ ID NO: 1200485 - protein, 9 aa, Homo Sapiens
AEMPASLCM

SEQ ID NO: 1200486 - protein, 9 aa, Homo Sapiens
CLVFFFLFW

SEQ ID NO: 1200487 - protein, 9 aa, Homo Sapiens
PAIDVWSCV

SEQ ID NO: 1200488 - protein, 9 aa, Homo Sapiens
TRVPGAKQL

SEQ ID NO: 1200489 - protein, 9 aa, Homo Sapiens
VISVTAMQC

SEQ ID NO: 1200490 - protein, 9 aa, Homo Sapiens
RRPSYRPWR

SEQ ID NO: 1200491 - protein, 9 aa, Homo Sapiens
SQVFWLADS

SEQ ID NO: 1200492 - protein, 9 aa, Homo Sapiens
ARALHSLAQ

SEQ ID NO: 1200493 - protein, 9 aa, Homo Sapiens
ARPLEGECR

SEQ ID NO: 1200494 - protein, 9 aa, Homo Sapiens
PDLMNMLVL

SEQ ID NO: 1200495 - protein, 9 aa, Homo Sapiens
GGHVEVREA

SEQ ID NO: 1200496 - protein, 9 aa, Homo Sapiens
VDRRLHSHM

SEQ ID NO: 1200497 - protein, 9 aa, Homo Sapiens
QQQQQQQSQ

SEQ ID NO: 1200498 - protein, 9 aa, Homo Sapiens
HTLQNYLPP

SEQ ID NO: 1200499 - protein, 9 aa, Homo Sapiens
FSLGLHTGE

SEQ ID NO: 1200500 - protein, 9 aa, Homo Sapiens
TSAWQLDGI

SEQ ID NO: 1200501 - protein, 9 aa, Homo Sapiens
EALVLITEA

SEQ ID NO: 1200502 - protein, 9 aa, Homo Sapiens
AVEMHAVVI

SEQ ID NO: 1200503 - protein, 9 aa, Homo Sapiens
LSIWPRQAS

SEQ ID NO: 1200504 - protein, 9 aa, Homo Sapiens
DISEIESGM

SEQ ID NO: 1200505 - protein, 9 aa, Homo Sapiens
PSPLTPLST

SEQ ID NO: 1200506 - protein, 9 aa, Homo Sapiens
EGKKLVNYY

SEQ ID NO: 1200507 - protein, 9 aa, Homo Sapiens
PSFNCSSGD

SEQ ID NO: 1200508 - protein, 9 aa, Homo Sapiens
ELRVLRRVC

SEQ ID NO: 1200509 - protein, 9 aa, Homo Sapiens
ARSCPTTSE

SEQ ID NO: 1200510 - protein, 9 aa, Homo Sapiens
SWCNELSLP

SEQ ID NO: 1200511 - protein, 9 aa, Homo Sapiens
TLDMMKKPC

SEQ ID NO: 1200512 - protein, 9 aa, Homo Sapiens
GHPSTPDIG

SEQ ID NO: 1200513 - protein, 9 aa, Homo Sapiens
PLGDIVGVP

SEQ ID NO: 1200514 - protein, 9 aa, Homo Sapiens
EELGRVDGN

SEQ ID NO: 1200515 - protein, 9 aa, Homo Sapiens
SRRCCPPSS

SEQ ID NO: 1200516 - protein, 9 aa, Homo Sapiens
LQGARLEQL

SEQ ID NO: 1200517 - protein, 9 aa, Homo Sapiens
RSTFLPAPS

SEQ ID NO: 1200518 - protein, 9 aa, Homo Sapiens
TQKFSVMRR

SEQ ID NO: 1200519 - protein, 9 aa, Homo Sapiens
ASGRRVMDS

SEQ ID NO: 1200520 - protein, 9 aa, Homo Sapiens
HLMPGPDSS

SEQ ID NO: 1200521 - protein, 9 aa, Homo Sapiens
PFFPRDKSA

SEQ ID NO: 1200522 - protein, 9 aa, Homo Sapiens
LRNKIGSLV

SEQ ID NO: 1200523 - protein, 9 aa, Homo Sapiens
LVKMLHINN

SEQ ID NO: 1200524 - protein, 9 aa, Homo Sapiens
TLRHQVVLR

SEQ ID NO: 1200525 - protein, 9 aa, Homo Sapiens
TPDIGKQST

SEQ ID NO: 1200526 - protein, 9 aa, Homo Sapiens
VLNFHKSPK

SEQ ID NO: 1200527 - protein, 9 aa, Homo Sapiens
APGPGPMNP

SEQ ID NO: 1200528 - protein, 9 aa, Homo Sapiens
GGRILLQRN

SEQ ID NO: 1200529 - protein, 9 aa, Homo Sapiens
MDRPPIGWK

SEQ ID NO: 1200530 - protein, 9 aa, Homo Sapiens
VTVMAEKNF

SEQ ID NO: 1200531 - protein, 9 aa, Homo Sapiens
CVLAPVAVN

SEQ ID NO: 1200532 - protein, 9 aa, Homo Sapiens
VHSCVYVCM

SEQ ID NO: 1200533 - protein, 9 aa, Homo Sapiens
VDANGKNLG

SEQ ID NO: 1200534 - protein, 9 aa, Homo Sapiens
RSLLIPPPR

SEQ ID NO: 1200535 - protein, 9 aa, Homo Sapiens
GHRHHQEED

SEQ ID NO: 1200536 - protein, 9 aa, Homo Sapiens
SRTDQKFVP

SEQ ID NO: 1200537 - protein, 9 aa, Homo Sapiens
HPPLPSPPV

SEQ ID NO: 1200538 - protein, 9 aa, Homo Sapiens
FQDLLQEGL

SEQ ID NO: 1200539 - protein, 9 aa, Homo Sapiens
QDTSKNIIR

SEQ ID NO: 1200540 - protein, 9 aa, Homo Sapiens
GTTQTCAVN

SEQ ID NO: 1200541 - protein, 9 aa, Homo Sapiens
TKEIDRERA

SEQ ID NO: 1200542 - protein, 9 aa, Homo Sapiens
AVWKLQLLD

SEQ ID NO: 1200543 - protein, 9 aa, Homo Sapiens
WGPPQSCRR

SEQ ID NO: 1200544 - protein, 9 aa, Homo Sapiens
CRAPPSRPS

SEQ ID NO: 1200545 - protein, 9 aa, Homo Sapiens
ATTEMLEEW

SEQ ID NO: 1200546 - protein, 9 aa, Homo Sapiens
NAGGSMKDR

SEQ ID NO: 1200547 - protein, 9 aa, Homo Sapiens
VKKGGIFSA

SEQ ID NO: 1200548 - protein, 9 aa, Homo Sapiens
PHSPVRLGD

SEQ ID NO: 1200549 - protein, 9 aa, Homo Sapiens
QAPHQPALS

SEQ ID NO: 1200550 - protein, 9 aa, Homo Sapiens
QNIATQATG

SEQ ID NO: 1200551 - protein, 9 aa, Homo Sapiens
DVWMLLGAA

SEQ ID NO: 1200552 - protein, 9 aa, Homo Sapiens
GDASCARWR

SEQ ID NO: 1200553 - protein, 9 aa, Homo Sapiens
LNIKCRICG

SEQ ID NO: 1200554 - protein, 9 aa, Homo Sapiens
CVGHYNEVK

SEQ ID NO: 1200555 - protein, 9 aa, Homo Sapiens
RDKSNLLNH

SEQ ID NO: 1200556 - protein, 9 aa, Homo Sapiens
ERRPIASPW

SEQ ID NO: 1200557 - protein, 9 aa, Homo Sapiens
SCCVIPPDL

SEQ ID NO: 1200558 - protein, 9 aa, Homo Sapiens
GSHVGAADG

SEQ ID NO: 1200559 - protein, 9 aa, Homo Sapiens
LDVTTGKVV

SEQ ID NO: 1200560 - protein, 9 aa, Homo Sapiens
VIVTVNLIV

SEQ ID NO: 1200561 - protein, 9 aa, Homo Sapiens
IVLHKLHLT

SEQ ID NO: 1200562 - protein, 9 aa, Homo Sapiens
ACLMPLVAF

SEQ ID NO: 1200563 - protein, 9 aa, Homo Sapiens
LYMKTLLPV

SEQ ID NO: 1200564 - protein, 9 aa, Homo Sapiens
RPPSSWPGH

SEQ ID NO: 1200565 - protein, 9 aa, Homo Sapiens
AGSEERSDP

SEQ ID NO: 1200566 - protein, 9 aa, Homo Sapiens
INSPTGCKS

SEQ ID NO: 1200567 - protein, 9 aa, Homo Sapiens
NMLSEPNMA

SEQ ID NO: 1200568 - protein, 9 aa, Homo Sapiens
FKNGKMGIN

SEQ ID NO: 1200569 - protein, 9 aa, Homo Sapiens
PPPHPLPRS

SEQ ID NO: 1200570 - protein, 9 aa, Homo Sapiens
EDGYRLEKE

SEQ ID NO: 1200571 - protein, 9 aa, Homo Sapiens
CPSWRSGCV

SEQ ID NO: 1200572 - protein, 9 aa, Homo Sapiens
ECGWSPVLD

SEQ ID NO: 1200573 - protein, 9 aa, Homo Sapiens
TVGPRGHLL

SEQ ID NO: 1200574 - protein, 9 aa, Homo Sapiens
GMRGIQNEK

SEQ ID NO: 1200575 - protein, 9 aa, Homo Sapiens
DARLEKLGI

SEQ ID NO: 1200576 - protein, 9 aa, Homo Sapiens
EAQEAVHAH

SEQ ID NO: 1200577 - protein, 9 aa, Homo Sapiens
WAAPVITSS

SEQ ID NO: 1200578 - protein, 9 aa, Homo Sapiens
SVKQAGKSQ

SEQ ID NO: 1200579 - protein, 9 aa, Homo Sapiens
TTTTPSTPA

SEQ ID NO: 1200580 - protein, 9 aa, Homo Sapiens
VVPTCHNSK

SEQ ID NO: 1200581 - protein, 9 aa, Homo Sapiens
DCGNAFSYN

SEQ ID NO: 1200582 - protein, 9 aa, Homo Sapiens
WPVGMTGPA

SEQ ID NO: 1200583 - protein, 9 aa, Homo Sapiens
EKNRIATQK

SEQ ID NO: 1200584 - protein, 9 aa, Homo Sapiens
APATVRPGT

SEQ ID NO: 1200585 - protein, 9 aa, Homo Sapiens
EELQVIQCV

SEQ ID NO: 1200586 - protein, 9 aa, Homo Sapiens
PHPPLPSPP

SEQ ID NO: 1200587 - protein, 9 aa, Homo Sapiens
KETWITTGW

SEQ ID NO: 1200588 - protein, 9 aa, Homo Sapiens
CTVSSLLVL

SEQ ID NO: 1200589 - protein, 9 aa, Homo Sapiens
DLKSCSRPC

SEQ ID NO: 1200590 - protein, 9 aa, Homo Sapiens
IQRLSVSWK

SEQ ID NO: 1200591 - protein, 9 aa, Homo Sapiens
LQDLAPPAP

SEQ ID NO: 1200592 - protein, 9 aa, Homo Sapiens
INPKSPLLC

SEQ ID NO: 1200593 - protein, 9 aa, Homo Sapiens
KPGRGGQRA

SEQ ID NO: 1200594 - protein, 9 aa, Homo Sapiens
LLSLYSVAV

SEQ ID NO: 1200595 - protein, 9 aa, Homo Sapiens
IRHLSHRAN

SEQ ID NO: 1200596 - protein, 9 aa, Homo Sapiens
AVQSLPYGI

SEQ ID NO: 1200597 - protein, 9 aa, Homo Sapiens
RLGGGRRGA

SEQ ID NO: 1200598 - protein, 9 aa, Homo Sapiens
MTSWHRPQL

SEQ ID NO: 1200599 - protein, 9 aa, Homo Sapiens
QCLVCVPVH

SEQ ID NO: 1200600 - protein, 9 aa, Homo Sapiens
QTNTPLSLT

SEQ ID NO: 1200601 - protein, 9 aa, Homo Sapiens
LMCMCQLNP

SEQ ID NO: 1200602 - protein, 9 aa, Homo Sapiens
PGAPPCQSA

SEQ ID NO: 1200603 - protein, 9 aa, Homo Sapiens
RRLCGRGAR

SEQ ID NO: 1200604 - protein, 9 aa, Homo Sapiens
LLIAISGFI

SEQ ID NO: 1200605 - protein, 9 aa, Homo Sapiens
AHSLPSDPH

SEQ ID NO: 1200606 - protein, 9 aa, Homo Sapiens
ASTGAVKAV

SEQ ID NO: 1200607 - protein, 9 aa, Homo Sapiens
WSSSPKFTS

SEQ ID NO: 1200608 - protein, 9 aa, Homo Sapiens
SVVRPLACS

SEQ ID NO: 1200609 - protein, 9 aa, Homo Sapiens
AGDELVLGA

SEQ ID NO: 1200610 - protein, 9 aa, Homo Sapiens
LTTRVKKVW

SEQ ID NO: 1200611 - protein, 9 aa, Homo Sapiens
LQGALGTAC

SEQ ID NO: 1200612 - protein, 9 aa, Homo Sapiens
QRLPGHLNA

SEQ ID NO: 1200613 - protein, 9 aa, Homo Sapiens
VVASELGYF

SEQ ID NO: 1200614 - protein, 9 aa, Homo Sapiens
WLPCRGPMP

SEQ ID NO: 1200615 - protein, 9 aa, Homo Sapiens
DLLHQLVTV

SEQ ID NO: 1200616 - protein, 9 aa, Homo Sapiens
SNYPPECTL

SEQ ID NO: 1200617 - protein, 9 aa, Homo Sapiens
CGAWPPPWL

SEQ ID NO: 1200618 - protein, 9 aa, Homo Sapiens
VQAGSEERS

SEQ ID NO: 1200619 - protein, 9 aa, Homo Sapiens
SPKFTSSWS

SEQ ID NO: 1200620 - protein, 9 aa, Homo Sapiens
SGRKAPRVA

SEQ ID NO: 1200621 - protein, 9 aa, Homo Sapiens
SELLPGPAA

SEQ ID NO: 1200622 - protein, 9 aa, Homo Sapiens
VQELQKHHS

SEQ ID NO: 1200623 - protein, 9 aa, Homo Sapiens
RNLQRNLKV

SEQ ID NO: 1200624 - protein, 9 aa, Homo Sapiens
ELGYRTQGV

SEQ ID NO: 1200625 - protein, 9 aa, Homo Sapiens
GFAGDDAPP

SEQ ID NO: 1200626 - protein, 9 aa, Homo Sapiens
DSTAILSRQ

SEQ ID NO: 1200627 - protein, 9 aa, Homo Sapiens
RLLLPRKHR

SEQ ID NO: 1200628 - protein, 9 aa, Homo Sapiens
CCKNRTGAE

SEQ ID NO: 1200629 - protein, 9 aa, Homo Sapiens
VSERAGGQR

SEQ ID NO: 1200630 - protein, 9 aa, Homo Sapiens
SLAAHRSTA

SEQ ID NO: 1200631 - protein, 9 aa, Homo Sapiens
TFFLGRWAE

SEQ ID NO: 1200632 - protein, 9 aa, Homo Sapiens
ERGAAKQRL

SEQ ID NO: 1200633 - protein, 9 aa, Homo Sapiens
SLQMVYPQR

SEQ ID NO: 1200634 - protein, 9 aa, Homo Sapiens
SAQHISFPD

SEQ ID NO: 1200635 - protein, 9 aa, Homo Sapiens
SPQKSSAMA

SEQ ID NO: 1200636 - protein, 9 aa, Homo Sapiens
GVTAAKAGM

SEQ ID NO: 1200637 - protein, 9 aa, Homo Sapiens
CFPPKGYAF

SEQ ID NO: 1200638 - protein, 9 aa, Homo Sapiens
LRGPPTAPQ

SEQ ID NO: 1200639 - protein, 9 aa, Homo Sapiens
RPGAPGPCL

SEQ ID NO: 1200640 - protein, 9 aa, Homo Sapiens
PEALGLGRV

SEQ ID NO: 1200641 - protein, 9 aa, Homo Sapiens
PPAPLTSVP

SEQ ID NO: 1200642 - protein, 9 aa, Homo Sapiens
SPRPCRRGT

SEQ ID NO: 1200643 - protein, 9 aa, Homo Sapiens
SVLLLKSRL

SEQ ID NO: 1200644 - protein, 9 aa, Homo Sapiens
HLPPRTKWP

SEQ ID NO: 1200645 - protein, 9 aa, Homo Sapiens
PRAPVRAWR

SEQ ID NO: 1200646 - protein, 9 aa, Homo Sapiens
YREAPIDKR

SEQ ID NO: 1200647 - protein, 9 aa, Homo Sapiens
WSRLSLLAP

SEQ ID NO: 1200648 - protein, 9 aa, Homo Sapiens
ALHEGSLYP

SEQ ID NO: 1200649 - protein, 9 aa, Homo Sapiens
KEMLALTSD

SEQ ID NO: 1200650 - protein, 9 aa, Homo Sapiens
GTLVWERGV

SEQ ID NO: 1200651 - protein, 9 aa, Homo Sapiens
LVGGLDGDD

SEQ ID NO: 1200652 - protein, 9 aa, Homo Sapiens
SCARWRTRC

SEQ ID NO: 1200653 - protein, 9 aa, Homo Sapiens
PQDWRQRCL

SEQ ID NO: 1200654 - protein, 9 aa, Homo Sapiens
SGILGVPLT

SEQ ID NO: 1200655 - protein, 9 aa, Homo Sapiens
DPFSKMGNL

SEQ ID NO: 1200656 - protein, 9 aa, Homo Sapiens
ASLTGPPWQ

SEQ ID NO: 1200657 - protein, 9 aa, Homo Sapiens
DHLLDLYAS

SEQ ID NO: 1200658 - protein, 9 aa, Homo Sapiens
FKLDLSLNF

SEQ ID NO: 1200659 - protein, 9 aa, Homo Sapiens
SDGITILVG

SEQ ID NO: 1200660 - protein, 9 aa, Homo Sapiens
RQKKAPPLV

SEQ ID NO: 1200661 - protein, 9 aa, Homo Sapiens
SSGRLLPPL

SEQ ID NO: 1200662 - protein, 9 aa, Homo Sapiens
DRCEGQVEE

SEQ ID NO: 1200663 - protein, 9 aa, Homo Sapiens
SAVFLLAVP

SEQ ID NO: 1200664 - protein, 9 aa, Homo Sapiens
WRTSRGQAQ

SEQ ID NO: 1200665 - protein, 9 aa, Homo Sapiens
LNHQRTHTG

SEQ ID NO: 1200666 - protein, 9 aa, Homo Sapiens
LEGRTSFPR

SEQ ID NO: 1200667 - protein, 9 aa, Homo Sapiens
RGAPGHPGV

SEQ ID NO: 1200668 - protein, 9 aa, Homo Sapiens
STWTLYSSA

SEQ ID NO: 1200669 - protein, 9 aa, Homo Sapiens
HDILAGMRM

SEQ ID NO: 1200670 - protein, 9 aa, Homo Sapiens
FSFNSHCQE

SEQ ID NO: 1200671 - protein, 9 aa, Homo Sapiens
PSLWDRQGY

SEQ ID NO: 1200672 - protein, 9 aa, Homo Sapiens
AVLLVAVAL

SEQ ID NO: 1200673 - protein, 9 aa, Homo Sapiens
SPLCLINIR

SEQ ID NO: 1200674 - protein, 9 aa, Homo Sapiens
PCLRRLCGR

SEQ ID NO: 1200675 - protein, 9 aa, Homo Sapiens
PLLEAFPLP

SEQ ID NO: 1200676 - protein, 9 aa, Homo Sapiens
SHMYYFLKH

SEQ ID NO: 1200677 - protein, 9 aa, Homo Sapiens
IAVEAPPQT

SEQ ID NO: 1200678 - protein, 9 aa, Homo Sapiens
SASRLWRAR

SEQ ID NO: 1200679 - protein, 9 aa, Homo Sapiens
ERPGVGPCK

SEQ ID NO: 1200680 - protein, 9 aa, Homo Sapiens
RVVSKGKKC

SEQ ID NO: 1200681 - protein, 9 aa, Homo Sapiens
MLHRWSWRM

SEQ ID NO: 1200682 - protein, 9 aa, Homo Sapiens
TSACRPPLP

SEQ ID NO: 1200683 - protein, 9 aa, Homo Sapiens
RLSEHTHRY

SEQ ID NO: 1200684 - protein, 9 aa, Homo Sapiens
AANRFAYNA

SEQ ID NO: 1200685 - protein, 9 aa, Homo Sapiens
SAVMWGRQL

SEQ ID NO: 1200686 - protein, 9 aa, Homo Sapiens
ESEIAGLEE

SEQ ID NO: 1200687 - protein, 9 aa, Homo Sapiens
TTYTLVLTA

SEQ ID NO: 1200688 - protein, 9 aa, Homo Sapiens
RRCCSLTQG

SEQ ID NO: 1200689 - protein, 9 aa, Homo Sapiens
MQKHHRRER

SEQ ID NO: 1200690 - protein, 9 aa, Homo Sapiens
AQQQRVQSQ

SEQ ID NO: 1200691 - protein, 9 aa, Homo Sapiens
RPPPSRHCP

SEQ ID NO: 1200692 - protein, 9 aa, Homo Sapiens
QNIEAMSSY

SEQ ID NO: 1200693 - protein, 9 aa, Homo Sapiens
GSGPGRRRR

SEQ ID NO: 1200694 - protein, 9 aa, Homo Sapiens
HIVIEAHEQ

SEQ ID NO: 1200695 - protein, 9 aa, Homo Sapiens
LGNAPLHCA

SEQ ID NO: 1200696 - protein, 9 aa, Homo Sapiens
PRDLKSCSR

SEQ ID NO: 1200697 - protein, 9 aa, Homo Sapiens
IKVTRNLKE

SEQ ID NO: 1200698 - protein, 9 aa, Homo Sapiens
FPADATTEM

SEQ ID NO: 1200699 - protein, 9 aa, Homo Sapiens
RLASSAPTW

SEQ ID NO: 1200700 - protein, 9 aa, Homo Sapiens
EKEHYKCEI

SEQ ID NO: 1200701 - protein, 9 aa, Homo Sapiens
PVPPTGTPR

SEQ ID NO: 1200702 - protein, 9 aa, Homo Sapiens
LTPSRSQWV

SEQ ID NO: 1200703 - protein, 9 aa, Homo Sapiens
EPDLHLEVV

SEQ ID NO: 1200704 - protein, 9 aa, Homo Sapiens
GGTLSHQIK

SEQ ID NO: 1200705 - protein, 9 aa, Homo Sapiens
THFVANSLQ

SEQ ID NO: 1200706 - protein, 9 aa, Homo Sapiens
PGPAHGLHV

SEQ ID NO: 1200707 - protein, 9 aa, Homo Sapiens
PSSNEEIHL

SEQ ID NO: 1200708 - protein, 9 aa, Homo Sapiens
HSAVMWGRQ

SEQ ID NO: 1200709 - protein, 9 aa, Homo Sapiens
WPHHLCPIL

SEQ ID NO: 1200710 - protein, 9 aa, Homo Sapiens
YRRRRTFHG

SEQ ID NO: 1200711 - protein, 9 aa, Homo Sapiens
KKKDKKRRN

SEQ ID NO: 1200712 - protein, 9 aa, Homo Sapiens
EVRDHLGLR

SEQ ID NO: 1200713 - protein, 9 aa, Homo Sapiens
QHPCNTLKY

SEQ ID NO: 1200714 - protein, 9 aa, Homo Sapiens
SSAAQLPGA

SEQ ID NO: 1200715 - protein, 9 aa, Homo Sapiens
RAARVDGPV

SEQ ID NO: 1200716 - protein, 9 aa, Homo Sapiens
HLHEEKVEV

SEQ ID NO: 1200717 - protein, 9 aa, Homo Sapiens
EIHLVDDAF

SEQ ID NO: 1200718 - protein, 9 aa, Homo Sapiens
GSGGGTTTG

SEQ ID NO: 1200719 - protein, 9 aa, Homo Sapiens
HTQGPPHHG

SEQ ID NO: 1200720 - protein, 9 aa, Homo Sapiens
SPQSRVDGS

SEQ ID NO: 1200721 - protein, 9 aa, Homo Sapiens
TGAGKDWPS

SEQ ID NO: 1200722 - protein, 9 aa, Homo Sapiens
VIILYDHVR

SEQ ID NO: 1200723 - protein, 9 aa, Homo Sapiens
VVFLYMWSF

SEQ ID NO: 1200724 - protein, 9 aa, Homo Sapiens
VKWTGSSAA

SEQ ID NO: 1200725 - protein, 9 aa, Homo Sapiens
GEAPSAPVH

SEQ ID NO: 1200726 - protein, 9 aa, Homo Sapiens
DELSGLDET

SEQ ID NO: 1200727 - protein, 9 aa, Homo Sapiens
HILEGIGHV

SEQ ID NO: 1200728 - protein, 9 aa, Homo Sapiens
LMTAMWLSA

SEQ ID NO: 1200729 - protein, 9 aa, Homo Sapiens
EVIVDVVMK

SEQ ID NO: 1200730 - protein, 9 aa, Homo Sapiens
RASTPAPCL

SEQ ID NO: 1200731 - protein, 9 aa, Homo Sapiens
LLEVRLWPQ

SEQ ID NO: 1200732 - protein, 9 aa, Homo Sapiens
RINRAIQEL

SEQ ID NO: 1200733 - protein, 9 aa, Homo Sapiens
EPELLQFQV

SEQ ID NO: 1200734 - protein, 9 aa, Homo Sapiens
GRGLSPLSV

SEQ ID NO: 1200735 - protein, 9 aa, Homo Sapiens
IRLYMSRIH

SEQ ID NO: 1200736 - protein, 9 aa, Homo Sapiens
GRRGVGRCP

SEQ ID NO: 1200737 - protein, 9 aa, Homo Sapiens
PQPKSTPDA

SEQ ID NO: 1200738 - protein, 9 aa, Homo Sapiens
PNFAICGLH

SEQ ID NO: 1200739 - protein, 9 aa, Homo Sapiens
WAGIIWEAE

SEQ ID NO: 1200740 - protein, 9 aa, Homo Sapiens
ALGWSPCDR

SEQ ID NO: 1200741 - protein, 9 aa, Homo Sapiens
ICSPLCLIN

SEQ ID NO: 1200742 - protein, 9 aa, Homo Sapiens
SSKRSFGTT

SEQ ID NO: 1200743 - protein, 9 aa, Homo Sapiens
SHVVSLVST

SEQ ID NO: 1200744 - protein, 9 aa, Homo Sapiens
KNKQPQKTS

SEQ ID NO: 1200745 - protein, 9 aa, Homo Sapiens
VAAPHPRTA

SEQ ID NO: 1200746 - protein, 9 aa, Homo Sapiens
TRNCSSTSC

SEQ ID NO: 1200747 - protein, 9 aa, Homo Sapiens
AGGVKRSIP

SEQ ID NO: 1200748 - protein, 9 aa, Homo Sapiens
ALRRLGVGA

SEQ ID NO: 1200749 - protein, 9 aa, Homo Sapiens
SWCCRPSAS

SEQ ID NO: 1200750 - protein, 9 aa, Homo Sapiens
QVSGSQVSA

SEQ ID NO: 1200751 - protein, 9 aa, Homo Sapiens
TDAFLGRPP

SEQ ID NO: 1200752 - protein, 9 aa, Homo Sapiens
VVGPLGEAV

SEQ ID NO: 1200753 - protein, 9 aa, Homo Sapiens
GSAGAGPPG

SEQ ID NO: 1200754 - protein, 9 aa, Homo Sapiens
SPLLVEARA

SEQ ID NO: 1200755 - protein, 9 aa, Homo Sapiens
RQCIRTAEI

SEQ ID NO: 1200756 - protein, 9 aa, Homo Sapiens
MYRFEDTGF

SEQ ID NO: 1200757 - protein, 9 aa, Homo Sapiens
SQPSSASSA

SEQ ID NO: 1200758 - protein, 9 aa, Homo Sapiens
TFLGLWNTQ

SEQ ID NO: 1200759 - protein, 9 aa, Homo Sapiens
CSQLCRKAR

SEQ ID NO: 1200760 - protein, 9 aa, Homo Sapiens
TISLSFKES

SEQ ID NO: 1200761 - protein, 9 aa, Homo Sapiens
EILEIIEAI

SEQ ID NO: 1200762 - protein, 9 aa, Homo Sapiens
LWHGLAQGG

SEQ ID NO: 1200763 - protein, 9 aa, Homo Sapiens
LEKNYTEDV

SEQ ID NO: 1200764 - protein, 9 aa, Homo Sapiens
SGEAPSAPV

SEQ ID NO: 1200765 - protein, 9 aa, Homo Sapiens
TRCCLSRSV

SEQ ID NO: 1200766 - protein, 9 aa, Homo Sapiens
PCRRGTLAS

SEQ ID NO: 1200767 - protein, 9 aa, Homo Sapiens
HTPMYSFLS

SEQ ID NO: 1200768 - protein, 9 aa, Homo Sapiens
CGIHTREWV

SEQ ID NO: 1200769 - protein, 9 aa, Homo Sapiens
LAAHYSRSD

SEQ ID NO: 1200770 - protein, 9 aa, Homo Sapiens
RSRQSGATG

SEQ ID NO: 1200771 - protein, 9 aa, Homo Sapiens
WKSCGMASW

SEQ ID NO: 1200772 - protein, 9 aa, Homo Sapiens
KAMPQDQVA

SEQ ID NO: 1200773 - protein, 9 aa, Homo Sapiens
AQLQYRPFP

SEQ ID NO: 1200774 - protein, 9 aa, Homo Sapiens
YVSERTVIA

SEQ ID NO: 1200775 - protein, 9 aa, Homo Sapiens
HINGQHLQH

SEQ ID NO: 1200776 - protein, 9 aa, Homo Sapiens
QEEEGEIYH

SEQ ID NO: 1200777 - protein, 9 aa, Homo Sapiens
AQTHRDTLT

SEQ ID NO: 1200778 - protein, 9 aa, Homo Sapiens
HRVQAGQHA

SEQ ID NO: 1200779 - protein, 9 aa, Homo Sapiens
QNNVGDTSC

SEQ ID NO: 1200780 - protein, 9 aa, Homo Sapiens
PGAGAADTE

SEQ ID NO: 1200781 - protein, 9 aa, Homo Sapiens
HVVALVGGL

SEQ ID NO: 1200782 - protein, 9 aa, Homo Sapiens
AARQAVQLW

SEQ ID NO: 1200783 - protein, 9 aa, Homo Sapiens
FDWYRHQNG

SEQ ID NO: 1200784 - protein, 9 aa, Homo Sapiens
GYVSERTVI

SEQ ID NO: 1200785 - protein, 9 aa, Homo Sapiens
HEVQVPPGR

SEQ ID NO: 1200786 - protein, 9 aa, Homo Sapiens
YPEFQSSSV

SEQ ID NO: 1200787 - protein, 9 aa, Homo Sapiens
RCQIRAWCR

SEQ ID NO: 1200788 - protein, 9 aa, Homo Sapiens
FFFLFWFGL

SEQ ID NO: 1200789 - protein, 9 aa, Homo Sapiens
DANQSATLN

SEQ ID NO: 1200790 - protein, 9 aa, Homo Sapiens
PVSSVGGRR

SEQ ID NO: 1200791 - protein, 9 aa, Homo Sapiens
WRARAWRML

SEQ ID NO: 1200792 - protein, 9 aa, Homo Sapiens
APVPGSSAP

SEQ ID NO: 1200793 - protein, 9 aa, Homo Sapiens
RRPARPGAT

SEQ ID NO: 1200794 - protein, 9 aa, Homo Sapiens
YPHVFHKKN

SEQ ID NO: 1200795 - protein, 9 aa, Homo Sapiens
GKAQLRASL

SEQ ID NO: 1200796 - protein, 9 aa, Homo Sapiens
HHRAQDKKR

SEQ ID NO: 1200797 - protein, 9 aa, Homo Sapiens
SSAFDRYTD

SEQ ID NO: 1200798 - protein, 9 aa, Homo Sapiens
DGQNLVEWR

SEQ ID NO: 1200799 - protein, 9 aa, Homo Sapiens
RARALGLAG

SEQ ID NO: 1200800 - protein, 9 aa, Homo Sapiens
RGISITSSS

SEQ ID NO: 1200801 - protein, 9 aa, Homo Sapiens
ACLWSPSLL

SEQ ID NO: 1200802 - protein, 9 aa, Homo Sapiens
TSPRASLLW

SEQ ID NO: 1200803 - protein, 9 aa, Homo Sapiens
MPWRSSRRQ

SEQ ID NO: 1200804 - protein, 9 aa, Homo Sapiens
TIHCNRIAA

SEQ ID NO: 1200805 - protein, 9 aa, Homo Sapiens
QLSFLPLPW

SEQ ID NO: 1200806 - protein, 9 aa, Homo Sapiens
HGQSGQGQS

SEQ ID NO: 1200807 - protein, 9 aa, Homo Sapiens
DCGLGTECL

SEQ ID NO: 1200808 - protein, 9 aa, Homo Sapiens
QRRCCSLTQ

SEQ ID NO: 1200809 - protein, 9 aa, Homo Sapiens
PEPSSAGTQ

SEQ ID NO: 1200810 - protein, 9 aa, Homo Sapiens
VCFDVHDVT

SEQ ID NO: 1200811 - protein, 9 aa, Homo Sapiens
IHSAVMWGR

SEQ ID NO: 1200812 - protein, 9 aa, Homo Sapiens
PKPPEDGTL

SEQ ID NO: 1200813 - protein, 9 aa, Homo Sapiens
VGLGCGFGG

SEQ ID NO: 1200814 - protein, 9 aa, Homo Sapiens
PCSSTSTTS

SEQ ID NO: 1200815 - protein, 9 aa, Homo Sapiens
ASQNAYYFF

SEQ ID NO: 1200816 - protein, 9 aa, Homo Sapiens
ISRTCRSPC

SEQ ID NO: 1200817 - protein, 9 aa, Homo Sapiens
ELKKVVKVW

SEQ ID NO: 1200818 - protein, 9 aa, Homo Sapiens
KVQVPSKPE

SEQ ID NO: 1200819 - protein, 9 aa, Homo Sapiens
LEEDIFMPL

SEQ ID NO: 1200820 - protein, 9 aa, Homo Sapiens
GPTGCFCPA

SEQ ID NO: 1200821 - protein, 9 aa, Homo Sapiens
TEDGFLTVC

SEQ ID NO: 1200822 - protein, 9 aa, Homo Sapiens
DQLGNAPLH

SEQ ID NO: 1200823 - protein, 9 aa, Homo Sapiens
IVDVVMKVK

SEQ ID NO: 1200824 - protein, 9 aa, Homo Sapiens
PGASHQRGR

SEQ ID NO: 1200825 - protein, 9 aa, Homo Sapiens
RPVAGAGEE

SEQ ID NO: 1200826 - protein, 9 aa, Homo Sapiens
ARRRAGAGA

SEQ ID NO: 1200827 - protein, 9 aa, Homo Sapiens
SSTCGTLSP

SEQ ID NO: 1200828 - protein, 9 aa, Homo Sapiens
KKESVFSWD

SEQ ID NO: 1200829 - protein, 9 aa, Homo Sapiens
SPVLDTCYG

SEQ ID NO: 1200830 - protein, 9 aa, Homo Sapiens
LAHLVVGRV

SEQ ID NO: 1200831 - protein, 9 aa, Homo Sapiens
YTAALIDRD

SEQ ID NO: 1200832 - protein, 9 aa, Homo Sapiens
KCEDCGNAF

SEQ ID NO: 1200833 - protein, 9 aa, Homo Sapiens
RGQAVVGEE

SEQ ID NO: 1200834 - protein, 9 aa, Homo Sapiens
EDGFLTVCS

SEQ ID NO: 1200835 - protein, 9 aa, Homo Sapiens
HERRKVVVI

SEQ ID NO: 1200836 - protein, 9 aa, Homo Sapiens
LLHVSEPSE

SEQ ID NO: 1200837 - protein, 9 aa, Homo Sapiens
HSQLYGKGE

SEQ ID NO: 1200838 - protein, 9 aa, Homo Sapiens
ACEVFCFYK

SEQ ID NO: 1200839 - protein, 9 aa, Homo Sapiens
LGNGHNKLF

SEQ ID NO: 1200840 - protein, 9 aa, Homo Sapiens
QQRQPAARL

SEQ ID NO: 1200841 - protein, 9 aa, Homo Sapiens
HPSRLRSVL

SEQ ID NO: 1200842 - protein, 9 aa, Homo Sapiens
AGPHTAPAA

SEQ ID NO: 1200843 - protein, 9 aa, Homo Sapiens
AGRRAAGAT

SEQ ID NO: 1200844 - protein, 9 aa, Homo Sapiens
GKSQGGRIL

SEQ ID NO: 1200845 - protein, 9 aa, Homo Sapiens
AGFSSMLSE

SEQ ID NO: 1200846 - protein, 9 aa, Homo Sapiens
FGDVGLHSM

SEQ ID NO: 1200847 - protein, 9 aa, Homo Sapiens
GGGVPAGHV

SEQ ID NO: 1200848 - protein, 9 aa, Homo Sapiens
IQLSYRKVR

SEQ ID NO: 1200849 - protein, 9 aa, Homo Sapiens
TLHLLPGQA

SEQ ID NO: 1200850 - protein, 9 aa, Homo Sapiens
TQDRGLQAL

SEQ ID NO: 1200851 - protein, 9 aa, Homo Sapiens
LVPYPRIHS

SEQ ID NO: 1200852 - protein, 9 aa, Homo Sapiens
ADVEAQRLL

SEQ ID NO: 1200853 - protein, 9 aa, Homo Sapiens
TDANGRVNA

SEQ ID NO: 1200854 - protein, 9 aa, Homo Sapiens
SLEAHTCWQ

SEQ ID NO: 1200855 - protein, 9 aa, Homo Sapiens
DDCKNLQWM

SEQ ID NO: 1200856 - protein, 9 aa, Homo Sapiens
TIKGLITTN

SEQ ID NO: 1200857 - protein, 9 aa, Homo Sapiens
QIVIVQYPL

SEQ ID NO: 1200858 - protein, 9 aa, Homo Sapiens
MYETQMPLQ

SEQ ID NO: 1200859 - protein, 9 aa, Homo Sapiens
EVEAPSFEM

SEQ ID NO: 1200860 - protein, 9 aa, Homo Sapiens
ERQVGRDVK

SEQ ID NO: 1200861 - protein, 9 aa, Homo Sapiens
RAAGAHGLA

SEQ ID NO: 1200862 - protein, 9 aa, Homo Sapiens
QAPAGVPRQ

SEQ ID NO: 1200863 - protein, 9 aa, Homo Sapiens
ETTTKLVPE

SEQ ID NO: 1200864 - protein, 9 aa, Homo Sapiens
NSRNSLIQM

SEQ ID NO: 1200865 - protein, 9 aa, Homo Sapiens
HNHALHMPR

SEQ ID NO: 1200866 - protein, 9 aa, Homo Sapiens
RDHAVVVRV

SEQ ID NO: 1200867 - protein, 9 aa, Homo Sapiens
GALGTACLI

SEQ ID NO: 1200868 - protein, 9 aa, Homo Sapiens
LVLERLERE

SEQ ID NO: 1200869 - protein, 9 aa, Homo Sapiens
SFVQTKCKK

SEQ ID NO: 1200870 - protein, 9 aa, Homo Sapiens
ENDDDANQS

SEQ ID NO: 1200871 - protein, 9 aa, Homo Sapiens
APRPVAGAG

SEQ ID NO: 1200872 - protein, 9 aa, Homo Sapiens
GPTPTEPPL

SEQ ID NO: 1200873 - protein, 9 aa, Homo Sapiens
MLTALGFRY

SEQ ID NO: 1200874 - protein, 9 aa, Homo Sapiens
EAHPFFPRD

SEQ ID NO: 1200875 - protein, 9 aa, Homo Sapiens
AMCSRSWAR

SEQ ID NO: 1200876 - protein, 9 aa, Homo Sapiens
RTLLLALVV

SEQ ID NO: 1200877 - protein, 9 aa, Homo Sapiens
GKSQQENRR

SEQ ID NO: 1200878 - protein, 9 aa, Homo Sapiens
PGVCRVDER

SEQ ID NO: 1200879 - protein, 9 aa, Homo Sapiens
DSARVFWEG

SEQ ID NO: 1200880 - protein, 9 aa, Homo Sapiens
QVPPGRRQY

SEQ ID NO: 1200881 - protein, 9 aa, Homo Sapiens
AGLVENLQA

SEQ ID NO: 1200882 - protein, 9 aa, Homo Sapiens
TPAAGEWTS

SEQ ID NO: 1200883 - protein, 9 aa, Homo Sapiens
ACPPVRRDK

SEQ ID NO: 1200884 - protein, 9 aa, Homo Sapiens
SNEEIHLVD

SEQ ID NO: 1200885 - protein, 9 aa, Homo Sapiens
PYPWPPAPL

SEQ ID NO: 1200886 - protein, 9 aa, Homo Sapiens
RRVCHANII

SEQ ID NO: 1200887 - protein, 9 aa, Homo Sapiens
GCPPFTVPG

SEQ ID NO: 1200888 - protein, 9 aa, Homo Sapiens
SKFSLDRPS

SEQ ID NO: 1200889 - protein, 9 aa, Homo Sapiens
RSQWVMSQT

SEQ ID NO: 1200890 - protein, 9 aa, Homo Sapiens
RRRNFLEAW

SEQ ID NO: 1200891 - protein, 9 aa, Homo Sapiens
QAVQLWAGA

SEQ ID NO: 1200892 - protein, 9 aa, Homo Sapiens
QFVINYCIE

SEQ ID NO: 1200893 - protein, 9 aa, Homo Sapiens
GPPRLPPKP

SEQ ID NO: 1200894 - protein, 9 aa, Homo Sapiens
FFSTGPTRP

SEQ ID NO: 1200895 - protein, 9 aa, Homo Sapiens
HVRDLVQRL

SEQ ID NO: 1200896 - protein, 9 aa, Homo Sapiens
FVLNRMQAV

SEQ ID NO: 1200897 - protein, 9 aa, Homo Sapiens
NWGWPVEVR

SEQ ID NO: 1200898 - protein, 9 aa, Homo Sapiens
SSIPPTRLL

SEQ ID NO: 1200899 - protein, 9 aa, Homo Sapiens
GGGSGGGTT

SEQ ID NO: 1200900 - protein, 9 aa, Homo Sapiens
EQQRLQEGE

SEQ ID NO: 1200901 - protein, 9 aa, Homo Sapiens
GGRRRQAGA

SEQ ID NO: 1200902 - protein, 9 aa, Homo Sapiens
PGDVEGLGQ

SEQ ID NO: 1200903 - protein, 9 aa, Homo Sapiens
LGMAYFPTI

SEQ ID NO: 1200904 - protein, 9 aa, Homo Sapiens
PLPASHPLF

SEQ ID NO: 1200905 - protein, 9 aa, Homo Sapiens
TMMPRLRVI

SEQ ID NO: 1200906 - protein, 9 aa, Homo Sapiens
CISYVFITC

SEQ ID NO: 1200907 - protein, 9 aa, Homo Sapiens
KEFRRLTAD

SEQ ID NO: 1200908 - protein, 9 aa, Homo Sapiens
GSARPPSFL

SEQ ID NO: 1200909 - protein, 9 aa, Homo Sapiens
SYITSTKTR

SEQ ID NO: 1200910 - protein, 9 aa, Homo Sapiens
SLGILPEEE

SEQ ID NO: 1200911 - protein, 9 aa, Homo Sapiens
KQISALAMH

SEQ ID NO: 1200912 - protein, 9 aa, Homo Sapiens
LPGEDGQNL

SEQ ID NO: 1200913 - protein, 9 aa, Homo Sapiens
LVKNHEHGG

SEQ ID NO: 1200914 - protein, 9 aa, Homo Sapiens
CVVLNFHKS

SEQ ID NO: 1200915 - protein, 9 aa, Homo Sapiens
ATPVPPTGT

SEQ ID NO: 1200916 - protein, 9 aa, Homo Sapiens
KRGKSQGGR

SEQ ID NO: 1200917 - protein, 9 aa, Homo Sapiens
TGIRIFAVG

SEQ ID NO: 1200918 - protein, 9 aa, Homo Sapiens
AVGGLRALR

SEQ ID NO: 1200919 - protein, 9 aa, Homo Sapiens
LDKVMGPLS

SEQ ID NO: 1200920 - protein, 9 aa, Homo Sapiens
SRHCPPPTA

SEQ ID NO: 1200921 - protein, 9 aa, Homo Sapiens
NIATQATGT

SEQ ID NO: 1200922 - protein, 9 aa, Homo Sapiens
FRSMEGLLK

SEQ ID NO: 1200923 - protein, 9 aa, Homo Sapiens
DFNWWFIFT

SEQ ID NO: 1200924 - protein, 9 aa, Homo Sapiens
CPPLEVHLH

SEQ ID NO: 1200925 - protein, 9 aa, Homo Sapiens
GGCGHHRLD

SEQ ID NO: 1200926 - protein, 9 aa, Homo Sapiens
LVFLGMARC

SEQ ID NO: 1200927 - protein, 9 aa, Homo Sapiens
IEAVDCSDI

SEQ ID NO: 1200928 - protein, 9 aa, Homo Sapiens
DNYGLTPLY

SEQ ID NO: 1200929 - protein, 9 aa, Homo Sapiens
STHPLRTVA

SEQ ID NO: 1200930 - protein, 9 aa, Homo Sapiens
YVGDALAQF

SEQ ID NO: 1200931 - protein, 9 aa, Homo Sapiens
TAGGGGSWS

SEQ ID NO: 1200932 - protein, 9 aa, Homo Sapiens
DAQVAGPEV

SEQ ID NO: 1200933 - protein, 9 aa, Homo Sapiens
KSHCLQDSY

SEQ ID NO: 1200934 - protein, 9 aa, Homo Sapiens
GGRRGAPGH

SEQ ID NO: 1200935 - protein, 9 aa, Homo Sapiens
DGHEQQLSI

SEQ ID NO: 1200936 - protein, 9 aa, Homo Sapiens
DPRKLEAFA

SEQ ID NO: 1200937 - protein, 9 aa, Homo Sapiens
VGIMEEAEP

SEQ ID NO: 1200938 - protein, 9 aa, Homo Sapiens
PLLPRLVAG

SEQ ID NO: 1200939 - protein, 9 aa, Homo Sapiens
TDQEHELKE

SEQ ID NO: 1200940 - protein, 9 aa, Homo Sapiens
LQAMQKRHL

SEQ ID NO: 1200941 - protein, 9 aa, Homo Sapiens
KESTHTSEF

SEQ ID NO: 1200942 - protein, 9 aa, Homo Sapiens
LFTLINSFL

SEQ ID NO: 1200943 - protein, 9 aa, Homo Sapiens
YVCMYVCAC

SEQ ID NO: 1200944 - protein, 9 aa, Homo Sapiens
YASCETGFK

SEQ ID NO: 1200945 - protein, 9 aa, Homo Sapiens
GWMPRCTWA

SEQ ID NO: 1200946 - protein, 9 aa, Homo Sapiens
DSGRPRMAI

SEQ ID NO: 1200947 - protein, 9 aa, Homo Sapiens
CMGESAQAA

SEQ ID NO: 1200948 - protein, 9 aa, Homo Sapiens
EALGLGRVL

SEQ ID NO: 1200949 - protein, 9 aa, Homo Sapiens
GHRAGHLPA

SEQ ID NO: 1200950 - protein, 9 aa, Homo Sapiens
GLAWLLLAW

SEQ ID NO: 1200951 - protein, 9 aa, Homo Sapiens
ASSDHEGTV

SEQ ID NO: 1200952 - protein, 9 aa, Homo Sapiens
GCQAPSCLS

SEQ ID NO: 1200953 - protein, 9 aa, Homo Sapiens
KRRLCSHTL

SEQ ID NO: 1200954 - protein, 9 aa, Homo Sapiens
LALMQKHHR

SEQ ID NO: 1200955 - protein, 9 aa, Homo Sapiens
LLTYTKIYI

SEQ ID NO: 1200956 - protein, 9 aa, Homo Sapiens
EGECRQGHR

SEQ ID NO: 1200957 - protein, 9 aa, Homo Sapiens
AHHLPRPIQ

SEQ ID NO: 1200958 - protein, 9 aa, Homo Sapiens
NAGSISCSV

SEQ ID NO: 1200959 - protein, 9 aa, Homo Sapiens
VYVVCVHSC

SEQ ID NO: 1200960 - protein, 9 aa, Homo Sapiens
EVQVPPGRR

SEQ ID NO: 1200961 - protein, 9 aa, Homo Sapiens
TTKTCNPET

SEQ ID NO: 1200962 - protein, 9 aa, Homo Sapiens
GCGHHRLDG

SEQ ID NO: 1200963 - protein, 9 aa, Homo Sapiens
TFPCSSLRL

SEQ ID NO: 1200964 - protein, 9 aa, Homo Sapiens
INSFLYQCV

SEQ ID NO: 1200965 - protein, 9 aa, Homo Sapiens
PLTTSNDKC

SEQ ID NO: 1200966 - protein, 9 aa, Homo Sapiens
PADATTEML

SEQ ID NO: 1200967 - protein, 9 aa, Homo Sapiens
DLEAQIKAA

SEQ ID NO: 1200968 - protein, 9 aa, Homo Sapiens
RPRAGTRPG

SEQ ID NO: 1200969 - protein, 9 aa, Homo Sapiens
VHGHGKVQV

SEQ ID NO: 1200970 - protein, 9 aa, Homo Sapiens
KCLLHPLPP

SEQ ID NO: 1200971 - protein, 9 aa, Homo Sapiens
MTQISKYAM

SEQ ID NO: 1200972 - protein, 9 aa, Homo Sapiens
TAYVAIVHH

SEQ ID NO: 1200973 - protein, 9 aa, Homo Sapiens
TTVHPEPPT

SEQ ID NO: 1200974 - protein, 9 aa, Homo Sapiens
FMVDKVIYL

SEQ ID NO: 1200975 - protein, 9 aa, Homo Sapiens
AKMNGQPAF

SEQ ID NO: 1200976 - protein, 9 aa, Homo Sapiens
YEILTEGRE

SEQ ID NO: 1200977 - protein, 9 aa, Homo Sapiens
ATRRPLKGR

SEQ ID NO: 1200978 - protein, 9 aa, Homo Sapiens
IWLPSVHVP

SEQ ID NO: 1200979 - protein, 9 aa, Homo Sapiens
AGTGLEQSP

SEQ ID NO: 1200980 - protein, 9 aa, Homo Sapiens
VRLGDQVHI

SEQ ID NO: 1200981 - protein, 9 aa, Homo Sapiens
TDRWSELTE

SEQ ID NO: 1200982 - protein, 9 aa, Homo Sapiens
ISAPISSDA

SEQ ID NO: 1200983 - protein, 9 aa, Homo Sapiens
LPYISGMNF

SEQ ID NO: 1200984 - protein, 9 aa, Homo Sapiens
SFMGLPLDR

SEQ ID NO: 1200985 - protein, 9 aa, Homo Sapiens
YTRIIQATE

SEQ ID NO: 1200986 - protein, 9 aa, Homo Sapiens
TFHLHHCRT

SEQ ID NO: 1200987 - protein, 9 aa, Homo Sapiens
ASTPAPCLT

SEQ ID NO: 1200988 - protein, 9 aa, Homo Sapiens
IRKQCVGHY

SEQ ID NO: 1200989 - protein, 9 aa, Homo Sapiens
SNSGRPPPT

SEQ ID NO: 1200990 - protein, 9 aa, Homo Sapiens
DLLTYTKIY

SEQ ID NO: 1200991 - protein, 9 aa, Homo Sapiens
CHPKCTPKC

SEQ ID NO: 1200992 - protein, 9 aa, Homo Sapiens
LDLLDAHFD

SEQ ID NO: 1200993 - protein, 9 aa, Homo Sapiens
DVTTGKVVC

SEQ ID NO: 1200994 - protein, 9 aa, Homo Sapiens
PAVTFGKAQ

SEQ ID NO: 1200995 - protein, 9 aa, Homo Sapiens
VESDPRKLE

SEQ ID NO: 1200996 - protein, 9 aa, Homo Sapiens
YRGQVNYDG

SEQ ID NO: 1200997 - protein, 9 aa, Homo Sapiens
VSEVDRGEA

SEQ ID NO: 1200998 - protein, 9 aa, Homo Sapiens
LAVIVVASE

SEQ ID NO: 1200999 - protein, 9 aa, Homo Sapiens
LILWGHAGK

SEQ ID NO: 1201000 - protein, 9 aa, Homo Sapiens
SPVHGYWFW

SEQ ID NO: 1201001 - protein, 9 aa, Homo Sapiens
PWFIVDGPF

SEQ ID NO: 1201002 - protein, 9 aa, Homo Sapiens
GLPSPTHST

SEQ ID NO: 1201003 - protein, 9 aa, Homo Sapiens
NPRPGCGAP

SEQ ID NO: 1201004 - protein, 9 aa, Homo Sapiens
VTRTPATWR

SEQ ID NO: 1201005 - protein, 9 aa, Homo Sapiens
GGELPEPHG

SEQ ID NO: 1201006 - protein, 9 aa, Homo Sapiens
SSARSWWSM

SEQ ID NO: 1201007 - protein, 9 aa, Homo Sapiens
MGNVPDRGA

SEQ ID NO: 1201008 - protein, 9 aa, Homo Sapiens
RGRPHAPPA

SEQ ID NO: 1201009 - protein, 9 aa, Homo Sapiens
ASRPLPGAA

SEQ ID NO: 1201010 - protein, 9 aa, Homo Sapiens
SQTKKTKDL

SEQ ID NO: 1201011 - protein, 9 aa, Homo Sapiens
YKALKNGVH

SEQ ID NO: 1201012 - protein, 9 aa, Homo Sapiens
SVTSPISHL

SEQ ID NO: 1201013 - protein, 9 aa, Homo Sapiens
ALGLAGPAR

SEQ ID NO: 1201014 - protein, 9 aa, Homo Sapiens
EEVLQDLSI

SEQ ID NO: 1201015 - protein, 9 aa, Homo Sapiens
SGGRSRAEK

SEQ ID NO: 1201016 - protein, 9 aa, Homo Sapiens
SDAPLEALT

SEQ ID NO: 1201017 - protein, 9 aa, Homo Sapiens
SGMGSPGSR

SEQ ID NO: 1201018 - protein, 9 aa, Homo Sapiens
RAAPQAPSA

SEQ ID NO: 1201019 - protein, 9 aa, Homo Sapiens
PCSLSAPAE

SEQ ID NO: 1201020 - protein, 9 aa, Homo Sapiens
SLASVRGIQ

SEQ ID NO: 1201021 - protein, 9 aa, Homo Sapiens
RAHPGVISE

SEQ ID NO: 1201022 - protein, 9 aa, Homo Sapiens
LSDTEIQGE

SEQ ID NO: 1201023 - protein, 9 aa, Homo Sapiens
RGRGARPNH

SEQ ID NO: 1201024 - protein, 9 aa, Homo Sapiens
TSSACSAGG

SEQ ID NO: 1201025 - protein, 9 aa, Homo Sapiens
DLNCVVSGQ

SEQ ID NO: 1201026 - protein, 9 aa, Homo Sapiens
ASHPLFGRL

SEQ ID NO: 1201027 - protein, 9 aa, Homo Sapiens
SWSCQPLPQ

SEQ ID NO: 1201028 - protein, 9 aa, Homo Sapiens
SLRVEILPM

SEQ ID NO: 1201029 - protein, 9 aa, Homo Sapiens
RRRLGQALL

SEQ ID NO: 1201030 - protein, 9 aa, Homo Sapiens
PFTTKTCNP

SEQ ID NO: 1201031 - protein, 9 aa, Homo Sapiens
QPGALRQAP

SEQ ID NO: 1201032 - protein, 9 aa, Homo Sapiens
NTSISATSF

SEQ ID NO: 1201033 - protein, 9 aa, Homo Sapiens
LKIVDDPKA

SEQ ID NO: 1201034 - protein, 9 aa, Homo Sapiens
HGDGVLFHG

SEQ ID NO: 1201035 - protein, 9 aa, Homo Sapiens
KRLGVCTGR

SEQ ID NO: 1201036 - protein, 9 aa, Homo Sapiens
RRRSRTCTS

SEQ ID NO: 1201037 - protein, 9 aa, Homo Sapiens
LKFKSMHGD

SEQ ID NO: 1201038 - protein, 9 aa, Homo Sapiens
ALPAGHRLQ

SEQ ID NO: 1201039 - protein, 9 aa, Homo Sapiens
VQALDVATR

SEQ ID NO: 1201040 - protein, 9 aa, Homo Sapiens
VSGCGRAPA

SEQ ID NO: 1201041 - protein, 9 aa, Homo Sapiens
QTPPASAVQ

SEQ ID NO: 1201042 - protein, 9 aa, Homo Sapiens
GTLGSLTAT

SEQ ID NO: 1201043 - protein, 9 aa, Homo Sapiens
GCPFQGRHV

SEQ ID NO: 1201044 - protein, 9 aa, Homo Sapiens
SWKMAAVFL

SEQ ID NO: 1201045 - protein, 9 aa, Homo Sapiens
GAPGHPGVG

SEQ ID NO: 1201046 - protein, 9 aa, Homo Sapiens
CAPVGNGCA

SEQ ID NO: 1201047 - protein, 9 aa, Homo Sapiens
VDKGKCLGG

SEQ ID NO: 1201048 - protein, 9 aa, Homo Sapiens
RGIQGRSMS

SEQ ID NO: 1201049 - protein, 9 aa, Homo Sapiens
ISQCTVELS

SEQ ID NO: 1201050 - protein, 9 aa, Homo Sapiens
TEGRERILV

SEQ ID NO: 1201051 - protein, 9 aa, Homo Sapiens
PGSSPRPCR

SEQ ID NO: 1201052 - protein, 9 aa, Homo Sapiens
NNQKRFHQQ

SEQ ID NO: 1201053 - protein, 9 aa, Homo Sapiens
GTQAARRPP

SEQ ID NO: 1201054 - protein, 9 aa, Homo Sapiens
APAQPPGPA

SEQ ID NO: 1201055 - protein, 9 aa, Homo Sapiens
EVKREHLED

SEQ ID NO: 1201056 - protein, 9 aa, Homo Sapiens
VNSDVGMLK

SEQ ID NO: 1201057 - protein, 9 aa, Homo Sapiens
GSCFRPAGQ

SEQ ID NO: 1201058 - protein, 9 aa, Homo Sapiens
RITRLEILE

SEQ ID NO: 1201059 - protein, 9 aa, Homo Sapiens
SRRGRGARP

SEQ ID NO: 1201060 - protein, 9 aa, Homo Sapiens
GTQLPGRRR

SEQ ID NO: 1201061 - protein, 9 aa, Homo Sapiens
LPLTHVQDL

SEQ ID NO: 1201062 - protein, 9 aa, Homo Sapiens
GVFLRGFIS

SEQ ID NO: 1201063 - protein, 9 aa, Homo Sapiens
EYGTIKGLI

SEQ ID NO: 1201064 - protein, 9 aa, Homo Sapiens
SARTTVWTA

SEQ ID NO: 1201065 - protein, 9 aa, Homo Sapiens
RGRLPRHPR

SEQ ID NO: 1201066 - protein, 9 aa, Homo Sapiens
ATFCPRNVP

SEQ ID NO: 1201067 - protein, 9 aa, Homo Sapiens
AVASAGFSS

SEQ ID NO: 1201068 - protein, 9 aa, Homo Sapiens
WWFIFTMDY

SEQ ID NO: 1201069 - protein, 9 aa, Homo Sapiens
DPGPTGCFC

SEQ ID NO: 1201070 - protein, 9 aa, Homo Sapiens
STKTRKALI

SEQ ID NO: 1201071 - protein, 9 aa, Homo Sapiens
EAPELVEPG

SEQ ID NO: 1201072 - protein, 9 aa, Homo Sapiens
SNNLYCDYH

SEQ ID NO: 1201073 - protein, 9 aa, Homo Sapiens
TGPSGSGVW

SEQ ID NO: 1201074 - protein, 9 aa, Homo Sapiens
TFITGQKAV

SEQ ID NO: 1201075 - protein, 9 aa, Homo Sapiens
TRELGARWD

SEQ ID NO: 1201076 - protein, 9 aa, Homo Sapiens
GGRPPVWGL

SEQ ID NO: 1201077 - protein, 9 aa, Homo Sapiens
LKKKWEELK

SEQ ID NO: 1201078 - protein, 9 aa, Homo Sapiens
CASPRGPPS

SEQ ID NO: 1201079 - protein, 9 aa, Homo Sapiens
LSVVHMAFG

SEQ ID NO: 1201080 - protein, 9 aa, Homo Sapiens
GCLPLHCGP

SEQ ID NO: 1201081 - protein, 9 aa, Homo Sapiens
GKRGCGCLV

SEQ ID NO: 1201082 - protein, 9 aa, Homo Sapiens
SCVDSAVTV

SEQ ID NO: 1201083 - protein, 9 aa, Homo Sapiens
PLRGYGLCT

SEQ ID NO: 1201084 - protein, 9 aa, Homo Sapiens
CSHVALLSA

SEQ ID NO: 1201085 - protein, 9 aa, Homo Sapiens
IGRTGAGKS

SEQ ID NO: 1201086 - protein, 9 aa, Homo Sapiens
VGPLGEAVG

SEQ ID NO: 1201087 - protein, 9 aa, Homo Sapiens
PPALAHLQE

SEQ ID NO: 1201088 - protein, 9 aa, Homo Sapiens
SCQSGFGGR

SEQ ID NO: 1201089 - protein, 9 aa, Homo Sapiens
WESWQMKTI

SEQ ID NO: 1201090 - protein, 9 aa, Homo Sapiens
ARTLRRYTS

SEQ ID NO: 1201091 - protein, 9 aa, Homo Sapiens
NPTLTRLFE

SEQ ID NO: 1201092 - protein, 9 aa, Homo Sapiens
KAVAWSRLL

SEQ ID NO: 1201093 - protein, 9 aa, Homo Sapiens
LQEEEGEIY

SEQ ID NO: 1201094 - protein, 9 aa, Homo Sapiens
RECQGFVPD

SEQ ID NO: 1201095 - protein, 9 aa, Homo Sapiens
GGAGRLASS

SEQ ID NO: 1201096 - protein, 9 aa, Homo Sapiens
GVWPCIVLW

SEQ ID NO: 1201097 - protein, 9 aa, Homo Sapiens
ALFNYVRCM

SEQ ID NO: 1201098 - protein, 9 aa, Homo Sapiens
EPEGVAAPH

SEQ ID NO: 1201099 - protein, 9 aa, Homo Sapiens
RRRAGAGAA

SEQ ID NO: 1201100 - protein, 9 aa, Homo Sapiens
SRDNPDLGA

SEQ ID NO: 1201101 - protein, 9 aa, Homo Sapiens
LCHCAELGY

SEQ ID NO: 1201102 - protein, 9 aa, Homo Sapiens
IAWLSSCQV

SEQ ID NO: 1201103 - protein, 9 aa, Homo Sapiens
TTTSRKSRP

SEQ ID NO: 1201104 - protein, 9 aa, Homo Sapiens
GERGPGLPL

SEQ ID NO: 1201105 - protein, 9 aa, Homo Sapiens
FVIADSGVA

SEQ ID NO: 1201106 - protein, 9 aa, Homo Sapiens
PSWRSGCVP

SEQ ID NO: 1201107 - protein, 9 aa, Homo Sapiens
ACRPPLPLR

SEQ ID NO: 1201108 - protein, 9 aa, Homo Sapiens
VVEAGGSHV

SEQ ID NO: 1201109 - protein, 9 aa, Homo Sapiens
DSLLIIGLA

SEQ ID NO: 1201110 - protein, 9 aa, Homo Sapiens
QPLFPQILA

SEQ ID NO: 1201111 - protein, 9 aa, Homo Sapiens
LTILLPGHW

SEQ ID NO: 1201112 - protein, 9 aa, Homo Sapiens
NSDNAETKD

SEQ ID NO: 1201113 - protein, 9 aa, Homo Sapiens
LTAFGIAFL

SEQ ID NO: 1201114 - protein, 9 aa, Homo Sapiens
WRITWSSSP

SEQ ID NO: 1201115 - protein, 9 aa, Homo Sapiens
KDDDFLEKK

SEQ ID NO: 1201116 - protein, 9 aa, Homo Sapiens
GWREASRPH

SEQ ID NO: 1201117 - protein, 9 aa, Homo Sapiens
SANQPVVST

SEQ ID NO: 1201118 - protein, 9 aa, Homo Sapiens
LTTVHPEPP

SEQ ID NO: 1201119 - protein, 9 aa, Homo Sapiens
GGSEFLFLL

SEQ ID NO: 1201120 - protein, 9 aa, Homo Sapiens
GPEVVGPLG

SEQ ID NO: 1201121 - protein, 9 aa, Homo Sapiens
EVLIPPLRP

SEQ ID NO: 1201122 - protein, 9 aa, Homo Sapiens
RTVAVCMGE

SEQ ID NO: 1201123 - protein, 9 aa, Homo Sapiens
CLINIRHPI

SEQ ID NO: 1201124 - protein, 9 aa, Homo Sapiens
SFNASIMTD

SEQ ID NO: 1201125 - protein, 9 aa, Homo Sapiens
VADFWWRVD

SEQ ID NO: 1201126 - protein, 9 aa, Homo Sapiens
TDCGIHTRE

SEQ ID NO: 1201127 - protein, 9 aa, Homo Sapiens
ATPPSTNCS

SEQ ID NO: 1201128 - protein, 9 aa, Homo Sapiens
AHEEQLGDE

SEQ ID NO: 1201129 - protein, 9 aa, Homo Sapiens
GQHLWLSHR

SEQ ID NO: 1201130 - protein, 9 aa, Homo Sapiens
TPGPPPCRP

SEQ ID NO: 1201131 - protein, 9 aa, Homo Sapiens
LGRNLPGQP

SEQ ID NO: 1201132 - protein, 9 aa, Homo Sapiens
RQPKYRDRK

SEQ ID NO: 1201133 - protein, 9 aa, Homo Sapiens
NPRTARASR

SEQ ID NO: 1201134 - protein, 9 aa, Homo Sapiens
THLFGGIAE

SEQ ID NO: 1201135 - protein, 9 aa, Homo Sapiens
RGGGQVPEL

SEQ ID NO: 1201136 - protein, 9 aa, Homo Sapiens
CNELSLPAL

SEQ ID NO: 1201137 - protein, 9 aa, Homo Sapiens
GSRSLWPPQ

SEQ ID NO: 1201138 - protein, 9 aa, Homo Sapiens
QLSDPGVCI

SEQ ID NO: 1201139 - protein, 9 aa, Homo Sapiens
FCLVFFFLF

SEQ ID NO: 1201140 - protein, 9 aa, Homo Sapiens
SRSQWVMSQ

SEQ ID NO: 1201141 - protein, 9 aa, Homo Sapiens
CSPLCLINI

SEQ ID NO: 1201142 - protein, 9 aa, Homo Sapiens
KNKKLRSLY

SEQ ID NO: 1201143 - protein, 9 aa, Homo Sapiens
HGEGYAKPN

SEQ ID NO: 1201144 - protein, 9 aa, Homo Sapiens
YGPGVCFIH

SEQ ID NO: 1201145 - protein, 9 aa, Homo Sapiens
APTLSVVRT

SEQ ID NO: 1201146 - protein, 9 aa, Homo Sapiens
ARDVLCHQA

SEQ ID NO: 1201147 - protein, 9 aa, Homo Sapiens
GSLYPPPFP

SEQ ID NO: 1201148 - protein, 9 aa, Homo Sapiens
GCGFGGTTS

SEQ ID NO: 1201149 - protein, 9 aa, Homo Sapiens
DNGVTCPAT

SEQ ID NO: 1201150 - protein, 9 aa, Homo Sapiens
KRDVNRRRA

SEQ ID NO: 1201151 - protein, 9 aa, Homo Sapiens
IRGSSSANH

SEQ ID NO: 1201152 - protein, 9 aa, Homo Sapiens
EGEIYHLYH

SEQ ID NO: 1201153 - protein, 9 aa, Homo Sapiens
EAFLRVAME

SEQ ID NO: 1201154 - protein, 9 aa, Homo Sapiens
HDNKRHSPG

SEQ ID NO: 1201155 - protein, 9 aa, Homo Sapiens
APTARAPPS

SEQ ID NO: 1201156 - protein, 9 aa, Homo Sapiens
GGDASCARW

SEQ ID NO: 1201157 - protein, 9 aa, Homo Sapiens
SSNCKNGSP

SEQ ID NO: 1201158 - protein, 9 aa, Homo Sapiens
SIWPRQASR

SEQ ID NO: 1201159 - protein, 9 aa, Homo Sapiens
ALHRARPPQ

SEQ ID NO: 1201160 - protein, 9 aa, Homo Sapiens
KRAATVTRT

SEQ ID NO: 1201161 - protein, 9 aa, Homo Sapiens
WRTRCWACC

SEQ ID NO: 1201162 - protein, 9 aa, Homo Sapiens
HPPGRQLPH

SEQ ID NO: 1201163 - protein, 9 aa, Homo Sapiens
SSPRPCRRG

SEQ ID NO: 1201164 - protein, 9 aa, Homo Sapiens
DSLQQAWTV

SEQ ID NO: 1201165 - protein, 9 aa, Homo Sapiens
AETRVPGAK

SEQ ID NO: 1201166 - protein, 9 aa, Homo Sapiens
VTRWRWNED

SEQ ID NO: 1201167 - protein, 9 aa, Homo Sapiens
VASSGELSF

SEQ ID NO: 1201168 - protein, 9 aa, Homo Sapiens
LSLGTVLSA

SEQ ID NO: 1201169 - protein, 9 aa, Homo Sapiens
DDLIKVSDD

SEQ ID NO: 1201170 - protein, 9 aa, Homo Sapiens
GEEEEEDVE

SEQ ID NO: 1201171 - protein, 9 aa, Homo Sapiens
TAATFCPRN

SEQ ID NO: 1201172 - protein, 9 aa, Homo Sapiens
VQGFGDVGL

SEQ ID NO: 1201173 - protein, 9 aa, Homo Sapiens
VECAKNLLS

SEQ ID NO: 1201174 - protein, 9 aa, Homo Sapiens
NTAYVAIVH

SEQ ID NO: 1201175 - protein, 9 aa, Homo Sapiens
IPRASRPLP

SEQ ID NO: 1201176 - protein, 9 aa, Homo Sapiens
LVLWGWRPK

SEQ ID NO: 1201177 - protein, 9 aa, Homo Sapiens
SCSRPCVWS

SEQ ID NO: 1201178 - protein, 9 aa, Homo Sapiens
DRCQNFVMA

SEQ ID NO: 1201179 - protein, 9 aa, Homo Sapiens
AFIYNMLTD

SEQ ID NO: 1201180 - protein, 9 aa, Homo Sapiens
RGPGLPLLD

SEQ ID NO: 1201181 - protein, 9 aa, Homo Sapiens
HPGRVKHVE

SEQ ID NO: 1201182 - protein, 9 aa, Homo Sapiens
DSQQCTQRQ

SEQ ID NO: 1201183 - protein, 9 aa, Homo Sapiens
LCRAPPSRP

SEQ ID NO: 1201184 - protein, 9 aa, Homo Sapiens
LHGVEPLAK

SEQ ID NO: 1201185 - protein, 9 aa, Homo Sapiens
RLSVSWKKR

SEQ ID NO: 1201186 - protein, 9 aa, Homo Sapiens
ERNPKGKKR

SEQ ID NO: 1201187 - protein, 9 aa, Homo Sapiens
SGGVSPPSL

SEQ ID NO: 1201188 - protein, 9 aa, Homo Sapiens
LLTLVGNTI

SEQ ID NO: 1201189 - protein, 9 aa, Homo Sapiens
DLGTFHDQA

SEQ ID NO: 1201190 - protein, 9 aa, Homo Sapiens
LTLVGNTII

SEQ ID NO: 1201191 - protein, 9 aa, Homo Sapiens
VHFSTEKMQ

SEQ ID NO: 1201192 - protein, 9 aa, Homo Sapiens
NPRLDFHPR

SEQ ID NO: 1201193 - protein, 9 aa, Homo Sapiens
TSRPWDPGC

SEQ ID NO: 1201194 - protein, 9 aa, Homo Sapiens
PTRARCCPG

SEQ ID NO: 1201195 - protein, 9 aa, Homo Sapiens
TVEYNDGRP

SEQ ID NO: 1201196 - protein, 9 aa, Homo Sapiens
GGTFLVSAV

SEQ ID NO: 1201197 - protein, 9 aa, Homo Sapiens
PGFPEKYPS

SEQ ID NO: 1201198 - protein, 9 aa, Homo Sapiens
QTNANQLQK

SEQ ID NO: 1201199 - protein, 9 aa, Homo Sapiens
SSGLNLGIA

SEQ ID NO: 1201200 - protein, 9 aa, Homo Sapiens
GCGRAPAQP

SEQ ID NO: 1201201 - protein, 9 aa, Homo Sapiens
GISITSSSH

SEQ ID NO: 1201202 - protein, 9 aa, Homo Sapiens
GRVLRPHIL

SEQ ID NO: 1201203 - protein, 9 aa, Homo Sapiens
TYDGQHWHT

SEQ ID NO: 1201204 - protein, 9 aa, Homo Sapiens
PSRSLLIPP

SEQ ID NO: 1201205 - protein, 9 aa, Homo Sapiens
HALPKHLAD

SEQ ID NO: 1201206 - protein, 9 aa, Homo Sapiens
GTCLMVTAL

SEQ ID NO: 1201207 - protein, 9 aa, Homo Sapiens
PMTTSADPR

SEQ ID NO: 1201208 - protein, 9 aa, Homo Sapiens
VVNGTGRRA

SEQ ID NO: 1201209 - protein, 9 aa, Homo Sapiens
ASLCMVSRT

SEQ ID NO: 1201210 - protein, 9 aa, Homo Sapiens
SINPTLTRL

SEQ ID NO: 1201211 - protein, 9 aa, Homo Sapiens
YAIVGIAWL

SEQ ID NO: 1201212 - protein, 9 aa, Homo Sapiens
PCHLLPLSD

SEQ ID NO: 1201213 - protein, 9 aa, Homo Sapiens
KLDGLQRIR

SEQ ID NO: 1201214 - protein, 9 aa, Homo Sapiens
NWSSCWAAP

SEQ ID NO: 1201215 - protein, 9 aa, Homo Sapiens
SAPLRPSTR

SEQ ID NO: 1201216 - protein, 9 aa, Homo Sapiens
SGYVDNPNK

SEQ ID NO: 1201217 - protein, 9 aa, Homo Sapiens
DDGIYTYIA

SEQ ID NO: 1201218 - protein, 9 aa, Homo Sapiens
PYEITLLNC

SEQ ID NO: 1201219 - protein, 9 aa, Homo Sapiens
SSLDPLAFF

SEQ ID NO: 1201220 - protein, 9 aa, Homo Sapiens
SPQSDWTVV

SEQ ID NO: 1201221 - protein, 9 aa, Homo Sapiens
VDVGLAGDT

SEQ ID NO: 1201222 - protein, 9 aa, Homo Sapiens
SPPSLPPGP

SEQ ID NO: 1201223 - protein, 9 aa, Homo Sapiens
QSTCAPGAG

SEQ ID NO: 1201224 - protein, 9 aa, Homo Sapiens
EASIARNLQ

SEQ ID NO: 1201225 - protein, 9 aa, Homo Sapiens
PDQWCPDGS

SEQ ID NO: 1201226 - protein, 9 aa, Homo Sapiens
QPTATPPST

SEQ ID NO: 1201227 - protein, 9 aa, Homo Sapiens
ALAAIERQM

SEQ ID NO: 1201228 - protein, 9 aa, Homo Sapiens
DQVSCCQQT

SEQ ID NO: 1201229 - protein, 9 aa, Homo Sapiens
SFSEIHFVK

SEQ ID NO: 1201230 - protein, 9 aa, Homo Sapiens
GRHRSCPWL

SEQ ID NO: 1201231 - protein, 9 aa, Homo Sapiens
PASVPPGRR

SEQ ID NO: 1201232 - protein, 9 aa, Homo Sapiens
RLALEALLN

SEQ ID NO: 1201233 - protein, 9 aa, Homo Sapiens
YHPGHHGAD

SEQ ID NO: 1201234 - protein, 9 aa, Homo Sapiens
SPGEARAPL

SEQ ID NO: 1201235 - protein, 9 aa, Homo Sapiens
GVSPLAPCP

SEQ ID NO: 1201236 - protein, 9 aa, Homo Sapiens
DVRKCLPAA

SEQ ID NO: 1201237 - protein, 9 aa, Homo Sapiens
SWTCSQTRP

SEQ ID NO: 1201238 - protein, 9 aa, Homo Sapiens
SFGQKMGKV

SEQ ID NO: 1201239 - protein, 9 aa, Homo Sapiens
ECKKSSTVP

SEQ ID NO: 1201240 - protein, 9 aa, Homo Sapiens
HHPQLALHE

SEQ ID NO: 1201241 - protein, 9 aa, Homo Sapiens
GQACINGHR

SEQ ID NO: 1201242 - protein, 9 aa, Homo Sapiens
VLLDVWARL

SEQ ID NO: 1201243 - protein, 9 aa, Homo Sapiens
AGPPGAGAA

SEQ ID NO: 1201244 - protein, 9 aa, Homo Sapiens
SLPLTWWLA

SEQ ID NO: 1201245 - protein, 9 aa, Homo Sapiens
LVSTEIFPA

SEQ ID NO: 1201246 - protein, 9 aa, Homo Sapiens
PQPPPPPHP

SEQ ID NO: 1201247 - protein, 9 aa, Homo Sapiens
GLRFVVYDL

SEQ ID NO: 1201248 - protein, 9 aa, Homo Sapiens
AEQEAGSKI

SEQ ID NO: 1201249 - protein, 9 aa, Homo Sapiens
SIFLYGHLG

SEQ ID NO: 1201250 - protein, 9 aa, Homo Sapiens
LAGYNDFNC

SEQ ID NO: 1201251 - protein, 9 aa, Homo Sapiens
RGLSPLSVC

SEQ ID NO: 1201252 - protein, 9 aa, Homo Sapiens
AGDVGKSAL

SEQ ID NO: 1201253 - protein, 9 aa, Homo Sapiens
PASPARRRA

SEQ ID NO: 1201254 - protein, 9 aa, Homo Sapiens
WTFANLQQS

SEQ ID NO: 1201255 - protein, 9 aa, Homo Sapiens
PRRRNFLEA

SEQ ID NO: 1201256 - protein, 9 aa, Homo Sapiens
FWQFFVGVR

SEQ ID NO: 1201257 - protein, 9 aa, Homo Sapiens
QPQQQHHHH

SEQ ID NO: 1201258 - protein, 9 aa, Homo Sapiens
GACPACPLR

SEQ ID NO: 1201259 - protein, 9 aa, Homo Sapiens
ALPKHLADA

SEQ ID NO: 1201260 - protein, 9 aa, Homo Sapiens
VLQDLSISR

SEQ ID NO: 1201261 - protein, 9 aa, Homo Sapiens
GFTNQGLFH

SEQ ID NO: 1201262 - protein, 9 aa, Homo Sapiens
KECMQACLD

SEQ ID NO: 1201263 - protein, 9 aa, Homo Sapiens
QSPQLRGHA

SEQ ID NO: 1201264 - protein, 9 aa, Homo Sapiens
EQCRQCDLY

SEQ ID NO: 1201265 - protein, 9 aa, Homo Sapiens
GAGKDWPSA

SEQ ID NO: 1201266 - protein, 9 aa, Homo Sapiens
SCVSAHTAN

SEQ ID NO: 1201267 - protein, 9 aa, Homo Sapiens
TTFLGLWNT

SEQ ID NO: 1201268 - protein, 9 aa, Homo Sapiens
VNLIEKVTS

SEQ ID NO: 1201269 - protein, 9 aa, Homo Sapiens
RKMAGRKRR

SEQ ID NO: 1201270 - protein, 9 aa, Homo Sapiens
SLQGALGTA

SEQ ID NO: 1201271 - protein, 9 aa, Homo Sapiens
RSRELRTFR

SEQ ID NO: 1201272 - protein, 9 aa, Homo Sapiens
IGRSNFRKV

SEQ ID NO: 1201273 - protein, 9 aa, Homo Sapiens
PQQQRQRGR

SEQ ID NO: 1201274 - protein, 9 aa, Homo Sapiens
KPGPREGER

SEQ ID NO: 1201275 - protein, 9 aa, Homo Sapiens
SMMAALTFG

SEQ ID NO: 1201276 - protein, 9 aa, Homo Sapiens
PASLARKCL

SEQ ID NO: 1201277 - protein, 9 aa, Homo Sapiens
HANAPRAHT

SEQ ID NO: 1201278 - protein, 9 aa, Homo Sapiens
ASRPHQCLR

SEQ ID NO: 1201279 - protein, 9 aa, Homo Sapiens
QRLLAAVPV

SEQ ID NO: 1201280 - protein, 9 aa, Homo Sapiens
LQRRTAWVE

SEQ ID NO: 1201281 - protein, 9 aa, Homo Sapiens
EQQQLLRRK

SEQ ID NO: 1201282 - protein, 9 aa, Homo Sapiens
AELRWMLRS

SEQ ID NO: 1201283 - protein, 9 aa, Homo Sapiens
PRRACQKQS

SEQ ID NO: 1201284 - protein, 9 aa, Homo Sapiens
VAEAAAVVM

SEQ ID NO: 1201285 - protein, 9 aa, Homo Sapiens
EFFNAGGSM

SEQ ID NO: 1201286 - protein, 9 aa, Homo Sapiens
KCTPKCHPK

SEQ ID NO: 1201287 - protein, 9 aa, Homo Sapiens
LPQPLPRST

SEQ ID NO: 1201288 - protein, 9 aa, Homo Sapiens
VEAPSFEMT

SEQ ID NO: 1201289 - protein, 9 aa, Homo Sapiens
VGPSLGLAP

SEQ ID NO: 1201290 - protein, 9 aa, Homo Sapiens
AQKPQQMNA

SEQ ID NO: 1201291 - protein, 9 aa, Homo Sapiens
RETAAGGGP

SEQ ID NO: 1201292 - protein, 9 aa, Homo Sapiens
QLWAGAARA

SEQ ID NO: 1201293 - protein, 9 aa, Homo Sapiens
QALDVATRH

SEQ ID NO: 1201294 - protein, 9 aa, Homo Sapiens
HLGFRLQAF

SEQ ID NO: 1201295 - protein, 9 aa, Homo Sapiens
FDRHPQMSE

SEQ ID NO: 1201296 - protein, 9 aa, Homo Sapiens
HGGLVKLPL

SEQ ID NO: 1201297 - protein, 9 aa, Homo Sapiens
QAKAYDADA

SEQ ID NO: 1201298 - protein, 9 aa, Homo Sapiens
FFNPIRAVP

SEQ ID NO: 1201299 - protein, 9 aa, Homo Sapiens
SIVILHSIV

SEQ ID NO: 1201300 - protein, 9 aa, Homo Sapiens
VVSGQAHAQ

SEQ ID NO: 1201301 - protein, 9 aa, Homo Sapiens
TAEIVASLL

SEQ ID NO: 1201302 - protein, 9 aa, Homo Sapiens
DRHRVTRCR

SEQ ID NO: 1201303 - protein, 9 aa, Homo Sapiens
RPPSFLPQR

SEQ ID NO: 1201304 - protein, 9 aa, Homo Sapiens
KAQGICPRP

SEQ ID NO: 1201305 - protein, 9 aa, Homo Sapiens
WPKAFYPVW

SEQ ID NO: 1201306 - protein, 9 aa, Homo Sapiens
DTEPGPGGG

SEQ ID NO: 1201307 - protein, 9 aa, Homo Sapiens
MKAQGICPR

SEQ ID NO: 1201308 - protein, 9 aa, Homo Sapiens
RAGPALPPA

SEQ ID NO: 1201309 - protein, 9 aa, Homo Sapiens
AGATPTGPS

SEQ ID NO: 1201310 - protein, 9 aa, Homo Sapiens
DDGSDAPLE

SEQ ID NO: 1201311 - protein, 9 aa, Homo Sapiens
LHTPMYSFL

SEQ ID NO: 1201312 - protein, 9 aa, Homo Sapiens
VCTPNGIVF

SEQ ID NO: 1201313 - protein, 9 aa, Homo Sapiens
AGHRGTHEL

SEQ ID NO: 1201314 - protein, 9 aa, Homo Sapiens
GAASSPAWP

SEQ ID NO: 1201315 - protein, 9 aa, Homo Sapiens
YWFWEGAII

SEQ ID NO: 1201316 - protein, 9 aa, Homo Sapiens
VMWMWGEQE

SEQ ID NO: 1201317 - protein, 9 aa, Homo Sapiens
LAPCPPLEV

SEQ ID NO: 1201318 - protein, 9 aa, Homo Sapiens
PPFTVPGPI

SEQ ID NO: 1201319 - protein, 9 aa, Homo Sapiens
AQRAARVDG

SEQ ID NO: 1201320 - protein, 9 aa, Homo Sapiens
KWTEWKMHV

SEQ ID NO: 1201321 - protein, 9 aa, Homo Sapiens
APRDHSPPH

SEQ ID NO: 1201322 - protein, 9 aa, Homo Sapiens
PKEVYRQQP

SEQ ID NO: 1201323 - protein, 9 aa, Homo Sapiens
LPRSPRSPS

SEQ ID NO: 1201324 - protein, 9 aa, Homo Sapiens
FWRPPTREL

SEQ ID NO: 1201325 - protein, 9 aa, Homo Sapiens
YHRLRRYCV

SEQ ID NO: 1201326 - protein, 9 aa, Homo Sapiens
SSTSCGSCP

SEQ ID NO: 1201327 - protein, 9 aa, Homo Sapiens
MCPIPPTKN

SEQ ID NO: 1201328 - protein, 9 aa, Homo Sapiens
LEPPMLWTM

SEQ ID NO: 1201329 - protein, 9 aa, Homo Sapiens
TRGCRTGPC

SEQ ID NO: 1201330 - protein, 9 aa, Homo Sapiens
RPSAPPWPR

SEQ ID NO: 1201331 - protein, 9 aa, Homo Sapiens
LMPSYDPDT

SEQ ID NO: 1201332 - protein, 9 aa, Homo Sapiens
GCGAPDPRR

SEQ ID NO: 1201333 - protein, 9 aa, Homo Sapiens
SVRSWCCRP

SEQ ID NO: 1201334 - protein, 9 aa, Homo Sapiens
PQRTHHPHP

SEQ ID NO: 1201335 - protein, 9 aa, Homo Sapiens
SNFRKVRSF

SEQ ID NO: 1201336 - protein, 9 aa, Homo Sapiens
LGDIVGVPT

SEQ ID NO: 1201337 - protein, 9 aa, Homo Sapiens
RRLGVGAAV

SEQ ID NO: 1201338 - protein, 9 aa, Homo Sapiens
GNFLEAVKR

SEQ ID NO: 1201339 - protein, 9 aa, Homo Sapiens
SSSGQHCSS

SEQ ID NO: 1201340 - protein, 9 aa, Homo Sapiens
HSSHILCMA

SEQ ID NO: 1201341 - protein, 9 aa, Homo Sapiens
TSSLPCLKI

SEQ ID NO: 1201342 - protein, 9 aa, Homo Sapiens
KTTELQLKL

SEQ ID NO: 1201343 - protein, 9 aa, Homo Sapiens
FHKSPKRWG

SEQ ID NO: 1201344 - protein, 9 aa, Homo Sapiens
SSSKLKNGF

SEQ ID NO: 1201345 - protein, 9 aa, Homo Sapiens
DGVMVRVGS

SEQ ID NO: 1201346 - protein, 9 aa, Homo Sapiens
LLTCSHPFS

SEQ ID NO: 1201347 - protein, 9 aa, Homo Sapiens
RRALFNYVR

SEQ ID NO: 1201348 - protein, 9 aa, Homo Sapiens
DDHGPIKMY

SEQ ID NO: 1201349 - protein, 9 aa, Homo Sapiens
KNFVKRRRN

SEQ ID NO: 1201350 - protein, 9 aa, Homo Sapiens
HQVPLILTP

SEQ ID NO: 1201351 - protein, 9 aa, Homo Sapiens
QGLDFGEFG

SEQ ID NO: 1201352 - protein, 9 aa, Homo Sapiens
SSKLKNGFT

SEQ ID NO: 1201353 - protein, 9 aa, Homo Sapiens
GPKYKLPSN

SEQ ID NO: 1201354 - protein, 9 aa, Homo Sapiens
VTPGPAHGL

SEQ ID NO: 1201355 - protein, 9 aa, Homo Sapiens
EPSVPLLPR

SEQ ID NO: 1201356 - protein, 9 aa, Homo Sapiens
PGPIACLMP

SEQ ID NO: 1201357 - protein, 9 aa, Homo Sapiens
ECLVHRAVC

SEQ ID NO: 1201358 - protein, 9 aa, Homo Sapiens
GVLAYGIYC

SEQ ID NO: 1201359 - protein, 9 aa, Homo Sapiens
RGQAQDTSG

SEQ ID NO: 1201360 - protein, 9 aa, Homo Sapiens
QPAGGELPE

SEQ ID NO: 1201361 - protein, 9 aa, Homo Sapiens
GAWPPPWLS

SEQ ID NO: 1201362 - protein, 9 aa, Homo Sapiens
QLGRLYMKT

SEQ ID NO: 1201363 - protein, 9 aa, Homo Sapiens
EPWIKKSKE

SEQ ID NO: 1201364 - protein, 9 aa, Homo Sapiens
SHISALIAA

SEQ ID NO: 1201365 - protein, 9 aa, Homo Sapiens
HAQKPQQMN

SEQ ID NO: 1201366 - protein, 9 aa, Homo Sapiens
PAIRVRVSP

SEQ ID NO: 1201367 - protein, 9 aa, Homo Sapiens
GLAQRAARV

SEQ ID NO: 1201368 - protein, 9 aa, Homo Sapiens
DLRKSHLIF

SEQ ID NO: 1201369 - protein, 9 aa, Homo Sapiens
HEHFTLLTG

SEQ ID NO: 1201370 - protein, 9 aa, Homo Sapiens
AVFLLAVPL

SEQ ID NO: 1201371 - protein, 9 aa, Homo Sapiens
MEPQDQWGP

SEQ ID NO: 1201372 - protein, 9 aa, Homo Sapiens
FDRNQPSFD

SEQ ID NO: 1201373 - protein, 9 aa, Homo Sapiens
CAELRWMLR

SEQ ID NO: 1201374 - protein, 9 aa, Homo Sapiens
LLSTNLIKL

SEQ ID NO: 1201375 - protein, 9 aa, Homo Sapiens
NAHRVVRKS

SEQ ID NO: 1201376 - protein, 9 aa, Homo Sapiens
YQGQWSGAV

SEQ ID NO: 1201377 - protein, 9 aa, Homo Sapiens
TLDRSEEST

SEQ ID NO: 1201378 - protein, 9 aa, Homo Sapiens
PQMSEPGWA

SEQ ID NO: 1201379 - protein, 9 aa, Homo Sapiens
YNMLTDFIR

SEQ ID NO: 1201380 - protein, 9 aa, Homo Sapiens
LEVTTFCSE

SEQ ID NO: 1201381 - protein, 9 aa, Homo Sapiens
GCQTNCPAC

SEQ ID NO: 1201382 - protein, 9 aa, Homo Sapiens
LPPRTKWPL

SEQ ID NO: 1201383 - protein, 9 aa, Homo Sapiens
WMLRSRCPK

SEQ ID NO: 1201384 - protein, 9 aa, Homo Sapiens
DYKSVPLKT

SEQ ID NO: 1201385 - protein, 9 aa, Homo Sapiens
AGSGVPGAT

SEQ ID NO: 1201386 - protein, 9 aa, Homo Sapiens
VPAVDGHEQ

SEQ ID NO: 1201387 - protein, 9 aa, Homo Sapiens
SAAGSPSVN

SEQ ID NO: 1201388 - protein, 9 aa, Homo Sapiens
ENLAFPGDL

SEQ ID NO: 1201389 - protein, 9 aa, Homo Sapiens
LRSLPLTWW

SEQ ID NO: 1201390 - protein, 9 aa, Homo Sapiens
QETTSSKTT

SEQ ID NO: 1201391 - protein, 9 aa, Homo Sapiens
YGIYCCWEE

SEQ ID NO: 1201392 - protein, 9 aa, Homo Sapiens
LVARPRGRR

SEQ ID NO: 1201393 - protein, 9 aa, Homo Sapiens
PIPPTKNGG

SEQ ID NO: 1201394 - protein, 9 aa, Homo Sapiens
TMKKDKLHH

SEQ ID NO: 1201395 - protein, 9 aa, Homo Sapiens
APRRRATAL

SEQ ID NO: 1201396 - protein, 9 aa, Homo Sapiens
VTRLCQQTE

SEQ ID NO: 1201397 - protein, 9 aa, Homo Sapiens
MRELINSPF

SEQ ID NO: 1201398 - protein, 9 aa, Homo Sapiens
SKCVYWVDS

SEQ ID NO: 1201399 - protein, 9 aa, Homo Sapiens
PHGLWFLLK

SEQ ID NO: 1201400 - protein, 9 aa, Homo Sapiens
SSRTWASPC

SEQ ID NO: 1201401 - protein, 9 aa, Homo Sapiens
DLILWGHAG

SEQ ID NO: 1201402 - protein, 9 aa, Homo Sapiens
SLWDRQGYT

SEQ ID NO: 1201403 - protein, 9 aa, Homo Sapiens
TDCIWDWRK

SEQ ID NO: 1201404 - protein, 9 aa, Homo Sapiens
ILYQGQWSG

SEQ ID NO: 1201405 - protein, 9 aa, Homo Sapiens
PYSLWRLTG

SEQ ID NO: 1201406 - protein, 9 aa, Homo Sapiens
NCVVSGQAH

SEQ ID NO: 1201407 - protein, 9 aa, Homo Sapiens
PRDKSAGSG

SEQ ID NO: 1201408 - protein, 9 aa, Homo Sapiens
WTMDPSPEA

SEQ ID NO: 1201409 - protein, 9 aa, Homo Sapiens
GPWAWRATR

SEQ ID NO: 1201410 - protein, 9 aa, Homo Sapiens
ELWSTCLTP

SEQ ID NO: 1201411 - protein, 9 aa, Homo Sapiens
RSCPTTSEG

SEQ ID NO: 1201412 - protein, 9 aa, Homo Sapiens
SHAHGLSHL

SEQ ID NO: 1201413 - protein, 9 aa, Homo Sapiens
GEAVGLHER

SEQ ID NO: 1201414 - protein, 9 aa, Homo Sapiens
NNVGLLGAG

SEQ ID NO: 1201415 - protein, 9 aa, Homo Sapiens
QREEQPLFP

SEQ ID NO: 1201416 - protein, 9 aa, Homo Sapiens
THDSFEKTE

SEQ ID NO: 1201417 - protein, 9 aa, Homo Sapiens
QNTFHTLTT

SEQ ID NO: 1201418 - protein, 9 aa, Homo Sapiens
GGAGDELVL

SEQ ID NO: 1201419 - protein, 9 aa, Homo Sapiens
GAGRAIPRA

SEQ ID NO: 1201420 - protein, 9 aa, Homo Sapiens
VRIIEAILN

SEQ ID NO: 1201421 - protein, 9 aa, Homo Sapiens
GPNKGATTR

SEQ ID NO: 1201422 - protein, 9 aa, Homo Sapiens
DSAASISAC

SEQ ID NO: 1201423 - protein, 9 aa, Homo Sapiens
RCGGGCEYL

SEQ ID NO: 1201424 - protein, 9 aa, Homo Sapiens
SNHNSKFHP

SEQ ID NO: 1201425 - protein, 9 aa, Homo Sapiens
APQPGGTPT

SEQ ID NO: 1201426 - protein, 9 aa, Homo Sapiens
PHAVSGCGR

SEQ ID NO: 1201427 - protein, 9 aa, Homo Sapiens
SPLMNNNNV

SEQ ID NO: 1201428 - protein, 9 aa, Homo Sapiens
EGGRDRAQG

SEQ ID NO: 1201429 - protein, 9 aa, Homo Sapiens
PLGQVPQDW

SEQ ID NO: 1201430 - protein, 9 aa, Homo Sapiens
QCPRHWQVC

SEQ ID NO: 1201431 - protein, 9 aa, Homo Sapiens
AAAKFLSAN

SEQ ID NO: 1201432 - protein, 9 aa, Homo Sapiens
GERSYSMEH

SEQ ID NO: 1201433 - protein, 9 aa, Homo Sapiens
CSAAHGCAM

SEQ ID NO: 1201434 - protein, 9 aa, Homo Sapiens
HLWIHSDER

SEQ ID NO: 1201435 - protein, 9 aa, Homo Sapiens
DADAQEQRG

SEQ ID NO: 1201436 - protein, 9 aa, Homo Sapiens
QGARLEQLL

SEQ ID NO: 1201437 - protein, 9 aa, Homo Sapiens
AELWSTCLT

SEQ ID NO: 1201438 - protein, 9 aa, Homo Sapiens
LDHNFLSIF

SEQ ID NO: 1201439 - protein, 9 aa, Homo Sapiens
PFPAAHARV

SEQ ID NO: 1201440 - protein, 9 aa, Homo Sapiens
HCCSSTNSI

SEQ ID NO: 1201441 - protein, 9 aa, Homo Sapiens
VGAGAAWHH

SEQ ID NO: 1201442 - protein, 9 aa, Homo Sapiens
ADGVWPCIV

SEQ ID NO: 1201443 - protein, 9 aa, Homo Sapiens
TSNDKCRFS

SEQ ID NO: 1201444 - protein, 9 aa, Homo Sapiens
FPEHFIGNM

SEQ ID NO: 1201445 - protein, 9 aa, Homo Sapiens
NSALRPHRV

SEQ ID NO: 1201446 - protein, 9 aa, Homo Sapiens
MRGLLEVRL

SEQ ID NO: 1201447 - protein, 9 aa, Homo Sapiens
AVHAHALPK

SEQ ID NO: 1201448 - protein, 9 aa, Homo Sapiens
TVTAMAMVY

SEQ ID NO: 1201449 - protein, 9 aa, Homo Sapiens
RLDALHGPP

SEQ ID NO: 1201450 - protein, 9 aa, Homo Sapiens
WDPGCVQAG

SEQ ID NO: 1201451 - protein, 9 aa, Homo Sapiens
VRSQVDKVI

SEQ ID NO: 1201452 - protein, 9 aa, Homo Sapiens
HDRSVSRDG

SEQ ID NO: 1201453 - protein, 9 aa, Homo Sapiens
VLRTVAVCM

SEQ ID NO: 1201454 - protein, 9 aa, Homo Sapiens
RHYGPGVCF

SEQ ID NO: 1201455 - protein, 9 aa, Homo Sapiens
LATSVDKGK

SEQ ID NO: 1201456 - protein, 9 aa, Homo Sapiens
YSTDICSPS

SEQ ID NO: 1201457 - protein, 9 aa, Homo Sapiens
PFTVPGPIA

SEQ ID NO: 1201458 - protein, 9 aa, Homo Sapiens
DPHLLATVT

SEQ ID NO: 1201459 - protein, 9 aa, Homo Sapiens
QRGRPHAPP

SEQ ID NO: 1201460 - protein, 9 aa, Homo Sapiens
MAELQGMNI

SEQ ID NO: 1201461 - protein, 9 aa, Homo Sapiens
FHQQLNSAA

SEQ ID NO: 1201462 - protein, 9 aa, Homo Sapiens
PEPHGLPLG

SEQ ID NO: 1201463 - protein, 9 aa, Homo Sapiens
CNTLKYPNG

SEQ ID NO: 1201464 - protein, 9 aa, Homo Sapiens
HVALEAWGQ

SEQ ID NO: 1201465 - protein, 9 aa, Homo Sapiens
RKMRPAHLV

SEQ ID NO: 1201466 - protein, 9 aa, Homo Sapiens
SMPFLDDDY

SEQ ID NO: 1201467 - protein, 9 aa, Homo Sapiens
CLMNTMGYN

SEQ ID NO: 1201468 - protein, 9 aa, Homo Sapiens
FRAGSVPQL

SEQ ID NO: 1201469 - protein, 9 aa, Homo Sapiens
DSPVPPGPQ

SEQ ID NO: 1201470 - protein, 9 aa, Homo Sapiens
KNLRCHMLE

SEQ ID NO: 1201471 - protein, 9 aa, Homo Sapiens
HEGTVILWD

SEQ ID NO: 1201472 - protein, 9 aa, Homo Sapiens
GAAKAVGPP

SEQ ID NO: 1201473 - protein, 9 aa, Homo Sapiens
FDEQTLKRQ

SEQ ID NO: 1201474 - protein, 9 aa, Homo Sapiens
VGRVVEAGG

SEQ ID NO: 1201475 - protein, 9 aa, Homo Sapiens
GGGKGTESS

SEQ ID NO: 1201476 - protein, 9 aa, Homo Sapiens
GSRPGWKRT

SEQ ID NO: 1201477 - protein, 9 aa, Homo Sapiens
HGCAMRWTL

SEQ ID NO: 1201478 - protein, 9 aa, Homo Sapiens
AISEVLVCP

SEQ ID NO: 1201479 - protein, 9 aa, Homo Sapiens
KAAASGPIS

SEQ ID NO: 1201480 - protein, 9 aa, Homo Sapiens
TTKLVPEEH

SEQ ID NO: 1201481 - protein, 9 aa, Homo Sapiens
RPAGQQTGI

SEQ ID NO: 1201482 - protein, 9 aa, Homo Sapiens
PSDQVSCCQ

SEQ ID NO: 1201483 - protein, 9 aa, Homo Sapiens
YVVSSAALT

SEQ ID NO: 1201484 - protein, 9 aa, Homo Sapiens
HFIISPTSI

SEQ ID NO: 1201485 - protein, 9 aa, Homo Sapiens
MGCPFQGRH

SEQ ID NO: 1201486 - protein, 9 aa, Homo Sapiens
RSQQAQKEN

SEQ ID NO: 1201487 - protein, 9 aa, Homo Sapiens
SSSPKFTSS

SEQ ID NO: 1201488 - protein, 9 aa, Homo Sapiens
DDDDCKNLQ

SEQ ID NO: 1201489 - protein, 9 aa, Homo Sapiens
SWEIVMETL

SEQ ID NO: 1201490 - protein, 9 aa, Homo Sapiens
PEAGHPHNP

SEQ ID NO: 1201491 - protein, 9 aa, Homo Sapiens
VYFRSMEGL

SEQ ID NO: 1201492 - protein, 9 aa, Homo Sapiens
EFRRWKVAD

SEQ ID NO: 1201493 - protein, 9 aa, Homo Sapiens
ADATTEMLE

SEQ ID NO: 1201494 - protein, 9 aa, Homo Sapiens
FFDRNQPSF

SEQ ID NO: 1201495 - protein, 9 aa, Homo Sapiens
SDQVSCCQQ

SEQ ID NO: 1201496 - protein, 9 aa, Homo Sapiens
CCPGGLPGH

SEQ ID NO: 1201497 - protein, 9 aa, Homo Sapiens
RVWRGAGTG

SEQ ID NO: 1201498 - protein, 9 aa, Homo Sapiens
GLLLHGVEP

SEQ ID NO: 1201499 - protein, 9 aa, Homo Sapiens
LTYTKIYIQ

SEQ ID NO: 1201500 - protein, 9 aa, Homo Sapiens
LRDSGAADG

SEQ ID NO: 1201501 - protein, 9 aa, Homo Sapiens
ITGQKAVKV

SEQ ID NO: 1201502 - protein, 9 aa, Homo Sapiens
SKVAGLSRG

SEQ ID NO: 1201503 - protein, 9 aa, Homo Sapiens
LPLLDTDPA

SEQ ID NO: 1201504 - protein, 9 aa, Homo Sapiens
NILGKVSIA

SEQ ID NO: 1201505 - protein, 9 aa, Homo Sapiens
QTQQILPFP

SEQ ID NO: 1201506 - protein, 9 aa, Homo Sapiens
LGARAGARG

SEQ ID NO: 1201507 - protein, 9 aa, Homo Sapiens
GGALQGLAC

SEQ ID NO: 1201508 - protein, 9 aa, Homo Sapiens
LAHARFSGW

SEQ ID NO: 1201509 - protein, 9 aa, Homo Sapiens
YSFLSNLSF

SEQ ID NO: 1201510 - protein, 9 aa, Homo Sapiens
PACARGPRA

SEQ ID NO: 1201511 - protein, 9 aa, Homo Sapiens
VTQDHLGFQ

SEQ ID NO: 1201512 - protein, 9 aa, Homo Sapiens
LVLGAGLVE

SEQ ID NO: 1201513 - protein, 9 aa, Homo Sapiens
MMTSWHRPQ

SEQ ID NO: 1201514 - protein, 9 aa, Homo Sapiens
RTSELTLLL

SEQ ID NO: 1201515 - protein, 9 aa, Homo Sapiens
CWPDAHLSA

SEQ ID NO: 1201516 - protein, 9 aa, Homo Sapiens
ETVLSALQR

SEQ ID NO: 1201517 - protein, 9 aa, Homo Sapiens
NSTEARSCP

SEQ ID NO: 1201518 - protein, 9 aa, Homo Sapiens
KERAQEDLR

SEQ ID NO: 1201519 - protein, 9 aa, Homo Sapiens
LEGGQACIN

SEQ ID NO: 1201520 - protein, 9 aa, Homo Sapiens
RAPKSSQNV

SEQ ID NO: 1201521 - protein, 9 aa, Homo Sapiens
GELKKLVET

SEQ ID NO: 1201522 - protein, 9 aa, Homo Sapiens
AFPQGCYST

SEQ ID NO: 1201523 - protein, 9 aa, Homo Sapiens
MVLGCLFAP

SEQ ID NO: 1201524 - protein, 9 aa, Homo Sapiens
TEAGPPALA

SEQ ID NO: 1201525 - protein, 9 aa, Homo Sapiens
KPEPVSVDM

SEQ ID NO: 1201526 - protein, 9 aa, Homo Sapiens
GGCSSSGTE

SEQ ID NO: 1201527 - protein, 9 aa, Homo Sapiens
TTVWTAASA

SEQ ID NO: 1201528 - protein, 9 aa, Homo Sapiens
GKRTQGTPA

SEQ ID NO: 1201529 - protein, 9 aa, Homo Sapiens
NGGGGGKRA

SEQ ID NO: 1201530 - protein, 9 aa, Homo Sapiens
FTTKTCNPE

SEQ ID NO: 1201531 - protein, 9 aa, Homo Sapiens
AHLGFRLQA

SEQ ID NO: 1201532 - protein, 9 aa, Homo Sapiens
STKQLVSLE

SEQ ID NO: 1201533 - protein, 9 aa, Homo Sapiens
NAGKSNWRQ

SEQ ID NO: 1201534 - protein, 9 aa, Homo Sapiens
KGLLEEDIF

SEQ ID NO: 1201535 - protein, 9 aa, Homo Sapiens
SPLLCVTRP

SEQ ID NO: 1201536 - protein, 9 aa, Homo Sapiens
VASTDRWSE

SEQ ID NO: 1201537 - protein, 9 aa, Homo Sapiens
LLWDILQKT

SEQ ID NO: 1201538 - protein, 9 aa, Homo Sapiens
AHRTGIRIF

SEQ ID NO: 1201539 - protein, 9 aa, Homo Sapiens
PGPGRPAGQ

SEQ ID NO: 1201540 - protein, 9 aa, Homo Sapiens
PRSRLSHKE

SEQ ID NO: 1201541 - protein, 9 aa, Homo Sapiens
WSFIGPACQ

SEQ ID NO: 1201542 - protein, 9 aa, Homo Sapiens
VKAVTKVIP

SEQ ID NO: 1201543 - protein, 9 aa, Homo Sapiens
SNSKNSSRN

SEQ ID NO: 1201544 - protein, 9 aa, Homo Sapiens
KLKNGFTFR

SEQ ID NO: 1201545 - protein, 9 aa, Homo Sapiens
WPGLKPRRA

SEQ ID NO: 1201546 - protein, 9 aa, Homo Sapiens
FMGLPLDRL

SEQ ID NO: 1201547 - protein, 9 aa, Homo Sapiens
WRSNGAYNI

SEQ ID NO: 1201548 - protein, 9 aa, Homo Sapiens
IVITVLNSY

SEQ ID NO: 1201549 - protein, 9 aa, Homo Sapiens
THPLRTVAL

SEQ ID NO: 1201550 - protein, 9 aa, Homo Sapiens
ALHGPPRTG

SEQ ID NO: 1201551 - protein, 9 aa, Homo Sapiens
GKMGINAEH

SEQ ID NO: 1201552 - protein, 9 aa, Homo Sapiens
RRRTFHGDY

SEQ ID NO: 1201553 - protein, 9 aa, Homo Sapiens
ALIGFVEFV

SEQ ID NO: 1201554 - protein, 9 aa, Homo Sapiens
TQKKNMSCL

SEQ ID NO: 1201555 - protein, 9 aa, Homo Sapiens
GAAVWGAGR

SEQ ID NO: 1201556 - protein, 9 aa, Homo Sapiens
GMILVYDIA

SEQ ID NO: 1201557 - protein, 9 aa, Homo Sapiens
PVQRPQQQR

SEQ ID NO: 1201558 - protein, 9 aa, Homo Sapiens
SRSTTRPSW

SEQ ID NO: 1201559 - protein, 9 aa, Homo Sapiens
RVTPAPPPC

SEQ ID NO: 1201560 - protein, 9 aa, Homo Sapiens
WVEVAWCEV

SEQ ID NO: 1201561 - protein, 9 aa, Homo Sapiens
PPGSCGFTQ

SEQ ID NO: 1201562 - protein, 9 aa, Homo Sapiens
GGGSEFLFL

SEQ ID NO: 1201563 - protein, 9 aa, Homo Sapiens
PVAPPPQPG

SEQ ID NO: 1201564 - protein, 9 aa, Homo Sapiens
KVYRLINEE

SEQ ID NO: 1201565 - protein, 9 aa, Homo Sapiens
FQECVSLHM

SEQ ID NO: 1201566 - protein, 9 aa, Homo Sapiens
DSARLAADD

SEQ ID NO: 1201567 - protein, 9 aa, Homo Sapiens
RRAAGATPT

SEQ ID NO: 1201568 - protein, 9 aa, Homo Sapiens
DLLLVTDKS

SEQ ID NO: 1201569 - protein, 9 aa, Homo Sapiens
PVHQGLLRT

SEQ ID NO: 1201570 - protein, 9 aa, Homo Sapiens
GAVVGLRPV

SEQ ID NO: 1201571 - protein, 9 aa, Homo Sapiens
ARAAGGAAA

SEQ ID NO: 1201572 - protein, 9 aa, Homo Sapiens
SSMSEFQHL

SEQ ID NO: 1201573 - protein, 9 aa, Homo Sapiens
QTYLVLERL

SEQ ID NO: 1201574 - protein, 9 aa, Homo Sapiens
PGTPHSHIK

SEQ ID NO: 1201575 - protein, 9 aa, Homo Sapiens
RRVSRKMGF

SEQ ID NO: 1201576 - protein, 9 aa, Homo Sapiens
SAAGGSGGH

SEQ ID NO: 1201577 - protein, 9 aa, Homo Sapiens
KKDKKRRNL

SEQ ID NO: 1201578 - protein, 9 aa, Homo Sapiens
GTQPGRRRS

SEQ ID NO: 1201579 - protein, 9 aa, Homo Sapiens
ELQLPPLPP

SEQ ID NO: 1201580 - protein, 9 aa, Homo Sapiens
HALVFLGMA

SEQ ID NO: 1201581 - protein, 9 aa, Homo Sapiens
SGSQVSAPT

SEQ ID NO: 1201582 - protein, 9 aa, Homo Sapiens
TLTWSRSSF

SEQ ID NO: 1201583 - protein, 9 aa, Homo Sapiens
CCPRPLGLA

SEQ ID NO: 1201584 - protein, 9 aa, Homo Sapiens
LVGAGAAWH

SEQ ID NO: 1201585 - protein, 9 aa, Homo Sapiens
SSGGGGGTK

SEQ ID NO: 1201586 - protein, 9 aa, Homo Sapiens
LLAPFLRPC

SEQ ID NO: 1201587 - protein, 9 aa, Homo Sapiens
MSDLMPVHF

SEQ ID NO: 1201588 - protein, 9 aa, Homo Sapiens
LAYQNFMID

SEQ ID NO: 1201589 - protein, 9 aa, Homo Sapiens
MPCVFLVDF

SEQ ID NO: 1201590 - protein, 9 aa, Homo Sapiens
LPPNLSPTV

SEQ ID NO: 1201591 - protein, 9 aa, Homo Sapiens
SMNITMPLA

SEQ ID NO: 1201592 - protein, 9 aa, Homo Sapiens
KPPEDGTLL

SEQ ID NO: 1201593 - protein, 9 aa, Homo Sapiens
YESEIAGLE

SEQ ID NO: 1201594 - protein, 9 aa, Homo Sapiens
VEALESALK

SEQ ID NO: 1201595 - protein, 9 aa, Homo Sapiens
RGPGARRHP

SEQ ID NO: 1201596 - protein, 9 aa, Homo Sapiens
FGEFGVGGY

SEQ ID NO: 1201597 - protein, 9 aa, Homo Sapiens
SQAGTGGTP

SEQ ID NO: 1201598 - protein, 9 aa, Homo Sapiens
PRTTPAAGE

SEQ ID NO: 1201599 - protein, 9 aa, Homo Sapiens
HKPPRHQCP

SEQ ID NO: 1201600 - protein, 9 aa, Homo Sapiens
LSIWPRTRC

SEQ ID NO: 1201601 - protein, 9 aa, Homo Sapiens
FDSWRTKEM

SEQ ID NO: 1201602 - protein, 9 aa, Homo Sapiens
RHAYSSHQL

SEQ ID NO: 1201603 - protein, 9 aa, Homo Sapiens
PGQPNFPCR

SEQ ID NO: 1201604 - protein, 9 aa, Homo Sapiens
MGNLRNLFP

SEQ ID NO: 1201605 - protein, 9 aa, Homo Sapiens
TGFTNQGLF

SEQ ID NO: 1201606 - protein, 9 aa, Homo Sapiens
EEQMECLEA

SEQ ID NO: 1201607 - protein, 9 aa, Homo Sapiens
PSGSAPAPT

SEQ ID NO: 1201608 - protein, 9 aa, Homo Sapiens
AHDPPQSLP

SEQ ID NO: 1201609 - protein, 9 aa, Homo Sapiens
PYVCERCCK

SEQ ID NO: 1201610 - protein, 9 aa, Homo Sapiens
TRSVAHPAR

SEQ ID NO: 1201611 - protein, 9 aa, Homo Sapiens
PPPRWPRGL

SEQ ID NO: 1201612 - protein, 9 aa, Homo Sapiens
EKKSHSLSS

SEQ ID NO: 1201613 - protein, 9 aa, Homo Sapiens
AAVAKVPTP

SEQ ID NO: 1201614 - protein, 9 aa, Homo Sapiens
CTPPGSCGF

SEQ ID NO: 1201615 - protein, 9 aa, Homo Sapiens
NQLPVPILY

SEQ ID NO: 1201616 - protein, 9 aa, Homo Sapiens
RDSGAADGP

SEQ ID NO: 1201617 - protein, 9 aa, Homo Sapiens
KDKKKEKGT

SEQ ID NO: 1201618 - protein, 9 aa, Homo Sapiens
KVLVFSSCD

SEQ ID NO: 1201619 - protein, 9 aa, Homo Sapiens
PTDERSWVH

SEQ ID NO: 1201620 - protein, 9 aa, Homo Sapiens
LEQSPQLLR

SEQ ID NO: 1201621 - protein, 9 aa, Homo Sapiens
GADPSLWDR

SEQ ID NO: 1201622 - protein, 9 aa, Homo Sapiens
LLRAHPGVI

SEQ ID NO: 1201623 - protein, 9 aa, Homo Sapiens
RTPPRRRSR

SEQ ID NO: 1201624 - protein, 9 aa, Homo Sapiens
MLHTNTATV

SEQ ID NO: 1201625 - protein, 9 aa, Homo Sapiens
VKLEPPMLW

SEQ ID NO: 1201626 - protein, 9 aa, Homo Sapiens
GAPPCQSAE

SEQ ID NO: 1201627 - protein, 9 aa, Homo Sapiens
AGGNRRTAN

SEQ ID NO: 1201628 - protein, 9 aa, Homo Sapiens
CTTVIIFWV

SEQ ID NO: 1201629 - protein, 9 aa, Homo Sapiens
SKRSFGTTN

SEQ ID NO: 1201630 - protein, 9 aa, Homo Sapiens
PPGRQLPHG

SEQ ID NO: 1201631 - protein, 9 aa, Homo Sapiens
PFFYVNMAD

SEQ ID NO: 1201632 - protein, 9 aa, Homo Sapiens
GEAVGLINA

SEQ ID NO: 1201633 - protein, 9 aa, Homo Sapiens
QWCWSLVIW

SEQ ID NO: 1201634 - protein, 9 aa, Homo Sapiens
SEIKKKQFY

SEQ ID NO: 1201635 - protein, 9 aa, Homo Sapiens
FLKAVHDLL

SEQ ID NO: 1201636 - protein, 9 aa, Homo Sapiens
TAPEFRRWK

SEQ ID NO: 1201637 - protein, 9 aa, Homo Sapiens
ERRVEDILT

SEQ ID NO: 1201638 - protein, 9 aa, Homo Sapiens
EQRRMERKA

SEQ ID NO: 1201639 - protein, 9 aa, Homo Sapiens
APLSQQEWP

SEQ ID NO: 1201640 - protein, 9 aa, Homo Sapiens
LRSGARGSP

SEQ ID NO: 1201641 - protein, 9 aa, Homo Sapiens
QGQWSGAVV

SEQ ID NO: 1201642 - protein, 9 aa, Homo Sapiens
RWPAPAARR

SEQ ID NO: 1201643 - protein, 9 aa, Homo Sapiens
NETFQHPCN

SEQ ID NO: 1201644 - protein, 9 aa, Homo Sapiens
PSTGPTPCA

SEQ ID NO: 1201645 - protein, 9 aa, Homo Sapiens
LNWSSCWAA

SEQ ID NO: 1201646 - protein, 9 aa, Homo Sapiens
FKDNSHISD

SEQ ID NO: 1201647 - protein, 9 aa, Homo Sapiens
SVNAVSMMT

SEQ ID NO: 1201648 - protein, 9 aa, Homo Sapiens
LGDLSVPSA

SEQ ID NO: 1201649 - protein, 9 aa, Homo Sapiens
LPAGHRLQH

SEQ ID NO: 1201650 - protein, 9 aa, Homo Sapiens
VGCFESCSS

SEQ ID NO: 1201651 - protein, 9 aa, Homo Sapiens
FSEIHFVKP

SEQ ID NO: 1201652 - protein, 9 aa, Homo Sapiens
QASSWKMAA

SEQ ID NO: 1201653 - protein, 9 aa, Homo Sapiens
PPRSTFLPA

SEQ ID NO: 1201654 - protein, 9 aa, Homo Sapiens
GWKRTQQRP

SEQ ID NO: 1201655 - protein, 9 aa, Homo Sapiens
PEKIHTKLI

SEQ ID NO: 1201656 - protein, 9 aa, Homo Sapiens
PPPPTTTTT

SEQ ID NO: 1201657 - protein, 9 aa, Homo Sapiens
ARMGCRSLA

SEQ ID NO: 1201658 - protein, 9 aa, Homo Sapiens
QAPCWTCPR

SEQ ID NO: 1201659 - protein, 9 aa, Homo Sapiens
VNSNNVFFS

SEQ ID NO: 1201660 - protein, 9 aa, Homo Sapiens
RDMLGGMGF

SEQ ID NO: 1201661 - protein, 9 aa, Homo Sapiens
RAEIHHSWT

SEQ ID NO: 1201662 - protein, 9 aa, Homo Sapiens
PVAVNDNGI

SEQ ID NO: 1201663 - protein, 9 aa, Homo Sapiens
VDGGGSGGG

SEQ ID NO: 1201664 - protein, 9 aa, Homo Sapiens
REKNRIATQ

SEQ ID NO: 1201665 - protein, 9 aa, Homo Sapiens
ETDKDDPGP

SEQ ID NO: 1201666 - protein, 9 aa, Homo Sapiens
TLQEKKSHS

SEQ ID NO: 1201667 - protein, 9 aa, Homo Sapiens
FPASLARKC

SEQ ID NO: 1201668 - protein, 9 aa, Homo Sapiens
LEEALVLIT

SEQ ID NO: 1201669 - protein, 9 aa, Homo Sapiens
CLNLKQFIL

SEQ ID NO: 1201670 - protein, 9 aa, Homo Sapiens
TKQLVSLEA

SEQ ID NO: 1201671 - protein, 9 aa, Homo Sapiens
LKQFILFHP

SEQ ID NO: 1201672 - protein, 9 aa, Homo Sapiens
IWAVRHISS

SEQ ID NO: 1201673 - protein, 9 aa, Homo Sapiens
PAIVVVLLA

SEQ ID NO: 1201674 - protein, 9 aa, Homo Sapiens
NMYRFEDTG

SEQ ID NO: 1201675 - protein, 9 aa, Homo Sapiens
SHLSVAWRA

SEQ ID NO: 1201676 - protein, 9 aa, Homo Sapiens
CFIYVAPGI

SEQ ID NO: 1201677 - protein, 9 aa, Homo Sapiens
PCWTRPSFD

SEQ ID NO: 1201678 - protein, 9 aa, Homo Sapiens
PLSVCPETM

SEQ ID NO: 1201679 - protein, 9 aa, Homo Sapiens
RDVLCHQAL

SEQ ID NO: 1201680 - protein, 9 aa, Homo Sapiens
TSYLMRPKV

SEQ ID NO: 1201681 - protein, 9 aa, Homo Sapiens
QAANRFAYN

SEQ ID NO: 1201682 - protein, 9 aa, Homo Sapiens
GNQMAELQG

SEQ ID NO: 1201683 - protein, 9 aa, Homo Sapiens
QQRVQSQRS

SEQ ID NO: 1201684 - protein, 9 aa, Homo Sapiens
GHKAVYRIS

SEQ ID NO: 1201685 - protein, 9 aa, Homo Sapiens
MISKCVYWV

SEQ ID NO: 1201686 - protein, 9 aa, Homo Sapiens
TWTRLPRRS

SEQ ID NO: 1201687 - protein, 9 aa, Homo Sapiens
LVVWVCHPD

SEQ ID NO: 1201688 - protein, 9 aa, Homo Sapiens
DNVNRALHS

SEQ ID NO: 1201689 - protein, 9 aa, Homo Sapiens
PVRLGDQVH

SEQ ID NO: 1201690 - protein, 9 aa, Homo Sapiens
PFWVRPAGM

SEQ ID NO: 1201691 - protein, 9 aa, Homo Sapiens
GFTYARYSS

SEQ ID NO: 1201692 - protein, 9 aa, Homo Sapiens
QELADKRLS

SEQ ID NO: 1201693 - protein, 9 aa, Homo Sapiens
KCVYWVDSR

SEQ ID NO: 1201694 - protein, 9 aa, Homo Sapiens
STCLTPDSL

SEQ ID NO: 1201695 - protein, 9 aa, Homo Sapiens
GRKERAQED

SEQ ID NO: 1201696 - protein, 9 aa, Homo Sapiens
PGHARVYAG

SEQ ID NO: 1201697 - protein, 9 aa, Homo Sapiens
GAHPPPSGP

SEQ ID NO: 1201698 - protein, 9 aa, Homo Sapiens
IQFALVSLH

SEQ ID NO: 1201699 - protein, 9 aa, Homo Sapiens
PTLLMGMCP

SEQ ID NO: 1201700 - protein, 9 aa, Homo Sapiens
SSCGSCGCS

SEQ ID NO: 1201701 - protein, 9 aa, Homo Sapiens
SVRERQARP

SEQ ID NO: 1201702 - protein, 9 aa, Homo Sapiens
FLDVTTGKV

SEQ ID NO: 1201703 - protein, 9 aa, Homo Sapiens
CVPVHGHGK

SEQ ID NO: 1201704 - protein, 9 aa, Homo Sapiens
RPVGAFAKT

SEQ ID NO: 1201705 - protein, 9 aa, Homo Sapiens
MQHSPHIWP

SEQ ID NO: 1201706 - protein, 9 aa, Homo Sapiens
SQPLNIMSM

SEQ ID NO: 1201707 - protein, 9 aa, Homo Sapiens
VLGVAISEV

SEQ ID NO: 1201708 - protein, 9 aa, Homo Sapiens
TGWIIRLGI

SEQ ID NO: 1201709 - protein, 9 aa, Homo Sapiens
NSKNSSRNQ

SEQ ID NO: 1201710 - protein, 9 aa, Homo Sapiens
PNVLDSFHC

SEQ ID NO: 1201711 - protein, 9 aa, Homo Sapiens
VGEHEFDCK

SEQ ID NO: 1201712 - protein, 9 aa, Homo Sapiens
QCTVELSLF

SEQ ID NO: 1201713 - protein, 9 aa, Homo Sapiens
PPGCLPLHC

SEQ ID NO: 1201714 - protein, 9 aa, Homo Sapiens
FALQQRQQC

SEQ ID NO: 1201715 - protein, 9 aa, Homo Sapiens
NMLTDFIRE

SEQ ID NO: 1201716 - protein, 9 aa, Homo Sapiens
ARVWRGAGT

SEQ ID NO: 1201717 - protein, 9 aa, Homo Sapiens
FSGAPPRAS

SEQ ID NO: 1201718 - protein, 9 aa, Homo Sapiens
SQTQQILPF

SEQ ID NO: 1201719 - protein, 9 aa, Homo Sapiens
TCHLMPGPD

SEQ ID NO: 1201720 - protein, 9 aa, Homo Sapiens
AMLWHGLAQ

SEQ ID NO: 1201721 - protein, 9 aa, Homo Sapiens
VQPGPYEAS

SEQ ID NO: 1201722 - protein, 9 aa, Homo Sapiens
WVSLPLPST

SEQ ID NO: 1201723 - protein, 9 aa, Homo Sapiens
PSWRITWSS

SEQ ID NO: 1201724 - protein, 9 aa, Homo Sapiens
YVEDGSGGS

SEQ ID NO: 1201725 - protein, 9 aa, Homo Sapiens
QPTIQTHNI

SEQ ID NO: 1201726 - protein, 9 aa, Homo Sapiens
IPPTSRGSS

SEQ ID NO: 1201727 - protein, 9 aa, Homo Sapiens
HFLKAVHDL

SEQ ID NO: 1201728 - protein, 9 aa, Homo Sapiens
ERAGQRGKA

SEQ ID NO: 1201729 - protein, 9 aa, Homo Sapiens
QIRHVVVVG

SEQ ID NO: 1201730 - protein, 9 aa, Homo Sapiens
NGCAGGGVG

SEQ ID NO: 1201731 - protein, 9 aa, Homo Sapiens
ATVRPGTQA

SEQ ID NO: 1201732 - protein, 9 aa, Homo Sapiens
LCTPGLRDA

SEQ ID NO: 1201733 - protein, 9 aa, Homo Sapiens
GNLKWHYYY

SEQ ID NO: 1201734 - protein, 9 aa, Homo Sapiens
KKTFFLGRW

SEQ ID NO: 1201735 - protein, 9 aa, Homo Sapiens
QQRQRGRPH

SEQ ID NO: 1201736 - protein, 9 aa, Homo Sapiens
ENMRGVCFD

SEQ ID NO: 1201737 - protein, 9 aa, Homo Sapiens
GGLVKLPLD

SEQ ID NO: 1201738 - protein, 9 aa, Homo Sapiens
HVQHQPLGV

SEQ ID NO: 1201739 - protein, 9 aa, Homo Sapiens
SPQLLRGPP

SEQ ID NO: 1201740 - protein, 9 aa, Homo Sapiens
LDTLRVPSP

SEQ ID NO: 1201741 - protein, 9 aa, Homo Sapiens
RLTRERAAA

SEQ ID NO: 1201742 - protein, 9 aa, Homo Sapiens
LGVLALQGA

SEQ ID NO: 1201743 - protein, 9 aa, Homo Sapiens
GHEQQLSIH

SEQ ID NO: 1201744 - protein, 9 aa, Homo Sapiens
PDAHLSAAG

SEQ ID NO: 1201745 - protein, 9 aa, Homo Sapiens
VGAGRRRRR

SEQ ID NO: 1201746 - protein, 9 aa, Homo Sapiens
TTVATQVSV

SEQ ID NO: 1201747 - protein, 9 aa, Homo Sapiens
QPHPKGHRG

SEQ ID NO: 1201748 - protein, 9 aa, Homo Sapiens
TPVPPTGTP

SEQ ID NO: 1201749 - protein, 9 aa, Homo Sapiens
LPPPPPCPA

SEQ ID NO: 1201750 - protein, 9 aa, Homo Sapiens
VHLHEEKVE

SEQ ID NO: 1201751 - protein, 9 aa, Homo Sapiens
HRYEAANRT

SEQ ID NO: 1201752 - protein, 9 aa, Homo Sapiens
ESDPRKLEA

SEQ ID NO: 1201753 - protein, 9 aa, Homo Sapiens
WRTSSACSA

SEQ ID NO: 1201754 - protein, 9 aa, Homo Sapiens
IPRLVHLYM

SEQ ID NO: 1201755 - protein, 9 aa, Homo Sapiens
NGFWRQEQS

SEQ ID NO: 1201756 - protein, 9 aa, Homo Sapiens
FTWDTEYTC

SEQ ID NO: 1201757 - protein, 9 aa, Homo Sapiens
SGGAAGQRT

SEQ ID NO: 1201758 - protein, 9 aa, Homo Sapiens
PTCLRTCHL

SEQ ID NO: 1201759 - protein, 9 aa, Homo Sapiens
GAIADVEAQ

SEQ ID NO: 1201760 - protein, 9 aa, Homo Sapiens
YDTLDIASI

SEQ ID NO: 1201761 - protein, 9 aa, Homo Sapiens
LEVRDHLGL

SEQ ID NO: 1201762 - protein, 9 aa, Homo Sapiens
SVHAICQAM

SEQ ID NO: 1201763 - protein, 9 aa, Homo Sapiens
EYKPPKNPL

SEQ ID NO: 1201764 - protein, 9 aa, Homo Sapiens
RLAHARFSG

SEQ ID NO: 1201765 - protein, 9 aa, Homo Sapiens
LGYRTQGVC

SEQ ID NO: 1201766 - protein, 9 aa, Homo Sapiens
LGVCTGRAA

SEQ ID NO: 1201767 - protein, 9 aa, Homo Sapiens
APWWHPGRR

SEQ ID NO: 1201768 - protein, 9 aa, Homo Sapiens
SLPSDPHLL

SEQ ID NO: 1201769 - protein, 9 aa, Homo Sapiens
TNWKPSWTS

SEQ ID NO: 1201770 - protein, 9 aa, Homo Sapiens
WARLECEIN

SEQ ID NO: 1201771 - protein, 9 aa, Homo Sapiens
LGALPLHTQ

SEQ ID NO: 1201772 - protein, 9 aa, Homo Sapiens
FPAMLHAHQ

SEQ ID NO: 1201773 - protein, 9 aa, Homo Sapiens
DSGGAAGQR

SEQ ID NO: 1201774 - protein, 9 aa, Homo Sapiens
RSLYDIPYM

SEQ ID NO: 1201775 - protein, 9 aa, Homo Sapiens
RQCDLYFEH

SEQ ID NO: 1201776 - protein, 9 aa, Homo Sapiens
NSGRPPPTP

SEQ ID NO: 1201777 - protein, 9 aa, Homo Sapiens
TPKPSKPGK

SEQ ID NO: 1201778 - protein, 9 aa, Homo Sapiens
QEEQDDELD

SEQ ID NO: 1201779 - protein, 9 aa, Homo Sapiens
ISLPLRGFL

SEQ ID NO: 1201780 - protein, 9 aa, Homo Sapiens
QLPHGELHR

SEQ ID NO: 1201781 - protein, 9 aa, Homo Sapiens
RPKSSVHPT

SEQ ID NO: 1201782 - protein, 9 aa, Homo Sapiens
PSPLMNNNN

SEQ ID NO: 1201783 - protein, 9 aa, Homo Sapiens
PTSAWQLDG

SEQ ID NO: 1201784 - protein, 9 aa, Homo Sapiens
KKRKRRRRK

SEQ ID NO: 1201785 - protein, 9 aa, Homo Sapiens
PKTWRRSLP

SEQ ID NO: 1201786 - protein, 9 aa, Homo Sapiens
HDLKMNSGV

SEQ ID NO: 1201787 - protein, 9 aa, Homo Sapiens
SIFKLDGLQ

SEQ ID NO: 1201788 - protein, 9 aa, Homo Sapiens
WVGMVLLHC

SEQ ID NO: 1201789 - protein, 9 aa, Homo Sapiens
NFMQLRDRL

SEQ ID NO: 1201790 - protein, 9 aa, Homo Sapiens
PILCHPDKV

SEQ ID NO: 1201791 - protein, 9 aa, Homo Sapiens
ISSPVNLGN

SEQ ID NO: 1201792 - protein, 9 aa, Homo Sapiens
KQGALTLEI

SEQ ID NO: 1201793 - protein, 9 aa, Homo Sapiens
PHPLPRSPR

SEQ ID NO: 1201794 - protein, 9 aa, Homo Sapiens
STQLPAAQR

SEQ ID NO: 1201795 - protein, 9 aa, Homo Sapiens
LLLHLLVGL

SEQ ID NO: 1201796 - protein, 9 aa, Homo Sapiens
ELWEQKKLR

SEQ ID NO: 1201797 - protein, 9 aa, Homo Sapiens
ICAVGLIGN

SEQ ID NO: 1201798 - protein, 9 aa, Homo Sapiens
EEQGNQMAE

SEQ ID NO: 1201799 - protein, 9 aa, Homo Sapiens
HLPPRGDQC

SEQ ID NO: 1201800 - protein, 9 aa, Homo Sapiens
PPGGPARGT

SEQ ID NO: 1201801 - protein, 9 aa, Homo Sapiens
EFYYRGQVN

SEQ ID NO: 1201802 - protein, 9 aa, Homo Sapiens
VCILGELFT

SEQ ID NO: 1201803 - protein, 9 aa, Homo Sapiens
SEERSDPLC

SEQ ID NO: 1201804 - protein, 9 aa, Homo Sapiens
QGFLIPLGD

SEQ ID NO: 1201805 - protein, 9 aa, Homo Sapiens
APPAPLSQQ

SEQ ID NO: 1201806 - protein, 9 aa, Homo Sapiens
TGRRARALG

SEQ ID NO: 1201807 - protein, 9 aa, Homo Sapiens
ISKKESVFS

SEQ ID NO: 1201808 - protein, 9 aa, Homo Sapiens
HAVVVRVYR

SEQ ID NO: 1201809 - protein, 9 aa, Homo Sapiens
AHTANFGQQ

SEQ ID NO: 1201810 - protein, 9 aa, Homo Sapiens
KCEIKRLNK

SEQ ID NO: 1201811 - protein, 9 aa, Homo Sapiens
QVGGNWGWP

SEQ ID NO: 1201812 - protein, 9 aa, Homo Sapiens
EKETCMSCP

SEQ ID NO: 1201813 - protein, 9 aa, Homo Sapiens
AIVRPEGSH

SEQ ID NO: 1201814 - protein, 9 aa, Homo Sapiens
LLKMWQGEE

SEQ ID NO: 1201815 - protein, 9 aa, Homo Sapiens
TRSPHPGPR

SEQ ID NO: 1201816 - protein, 9 aa, Homo Sapiens
GSTSVFPDK

SEQ ID NO: 1201817 - protein, 9 aa, Homo Sapiens
MREEQGNQM

SEQ ID NO: 1201818 - protein, 9 aa, Homo Sapiens
AQTPALGQA

SEQ ID NO: 1201819 - protein, 9 aa, Homo Sapiens
AKAYDADAQ

SEQ ID NO: 1201820 - protein, 9 aa, Homo Sapiens
TSPCTKLMA

SEQ ID NO: 1201821 - protein, 9 aa, Homo Sapiens
QDSYITSTK

SEQ ID NO: 1201822 - protein, 9 aa, Homo Sapiens
SQSRSSSLF

SEQ ID NO: 1201823 - protein, 9 aa, Homo Sapiens
GQWSGAVVG

SEQ ID NO: 1201824 - protein, 9 aa, Homo Sapiens
CPQVHCCSS

SEQ ID NO: 1201825 - protein, 9 aa, Homo Sapiens
EQLLLFLGS

SEQ ID NO: 1201826 - protein, 9 aa, Homo Sapiens
IRILKYSKA

SEQ ID NO: 1201827 - protein, 9 aa, Homo Sapiens
ESDFPTPAA

SEQ ID NO: 1201828 - protein, 9 aa, Homo Sapiens
WITTGWIIR

SEQ ID NO: 1201829 - protein, 9 aa, Homo Sapiens
DRVPYDISA

SEQ ID NO: 1201830 - protein, 9 aa, Homo Sapiens
PSQGYRRWR

SEQ ID NO: 1201831 - protein, 9 aa, Homo Sapiens
YSLWRLTGL

SEQ ID NO: 1201832 - protein, 9 aa, Homo Sapiens
PSFPAMLHA

SEQ ID NO: 1201833 - protein, 9 aa, Homo Sapiens
DLDLAKKKT

SEQ ID NO: 1201834 - protein, 9 aa, Homo Sapiens
FSAVASDLG

SEQ ID NO: 1201835 - protein, 9 aa, Homo Sapiens
HLIFSIDPK

SEQ ID NO: 1201836 - protein, 9 aa, Homo Sapiens
PLPTASGLK

SEQ ID NO: 1201837 - protein, 9 aa, Homo Sapiens
IIILVSRLD

SEQ ID NO: 1201838 - protein, 9 aa, Homo Sapiens
NAFTMYTTC

SEQ ID NO: 1201839 - protein, 9 aa, Homo Sapiens
RKVHLHEEK

SEQ ID NO: 1201840 - protein, 9 aa, Homo Sapiens
APLTSVPWP

SEQ ID NO: 1201841 - protein, 9 aa, Homo Sapiens
QGASLAGHR

SEQ ID NO: 1201842 - protein, 9 aa, Homo Sapiens
HVGAADGLD

SEQ ID NO: 1201843 - protein, 9 aa, Homo Sapiens
WLKCSAAHG

SEQ ID NO: 1201844 - protein, 9 aa, Homo Sapiens
QDLLQEGLT

SEQ ID NO: 1201845 - protein, 9 aa, Homo Sapiens
TSVDKGKCL

SEQ ID NO: 1201846 - protein, 9 aa, Homo Sapiens
VIAEGVGCF

SEQ ID NO: 1201847 - protein, 9 aa, Homo Sapiens
KEKEHYKCE

SEQ ID NO: 1201848 - protein, 9 aa, Homo Sapiens
VDDGKGIRR

SEQ ID NO: 1201849 - protein, 9 aa, Homo Sapiens
TTEINQNNN

SEQ ID NO: 1201850 - protein, 9 aa, Homo Sapiens
SAGAGPPGA

SEQ ID NO: 1201851 - protein, 9 aa, Homo Sapiens
IAQGDHQSP

SEQ ID NO: 1201852 - protein, 9 aa, Homo Sapiens
LFTQFMGAV

SEQ ID NO: 1201853 - protein, 9 aa, Homo Sapiens
KISTTEDTP

SEQ ID NO: 1201854 - protein, 9 aa, Homo Sapiens
SVRYTPLAK

SEQ ID NO: 1201855 - protein, 9 aa, Homo Sapiens
GRRQVREPR

SEQ ID NO: 1201856 - protein, 9 aa, Homo Sapiens
VIHHFFCRV

SEQ ID NO: 1201857 - protein, 9 aa, Homo Sapiens
IIGRTGAGK

SEQ ID NO: 1201858 - protein, 9 aa, Homo Sapiens
VGNVYTPGT

SEQ ID NO: 1201859 - protein, 9 aa, Homo Sapiens
QLAPWPGLP

SEQ ID NO: 1201860 - protein, 9 aa, Homo Sapiens
LDMMKKPCC

SEQ ID NO: 1201861 - protein, 9 aa, Homo Sapiens
QDLDEMNIK

SEQ ID NO: 1201862 - protein, 9 aa, Homo Sapiens
LQTPPASAV

SEQ ID NO: 1201863 - protein, 9 aa, Homo Sapiens
RPNHVLIHN

SEQ ID NO: 1201864 - protein, 9 aa, Homo Sapiens
EVSNMGNDD

SEQ ID NO: 1201865 - protein, 9 aa, Homo Sapiens
CGIRQPKYR

SEQ ID NO: 1201866 - protein, 9 aa, Homo Sapiens
ILPYISGMN

SEQ ID NO: 1201867 - protein, 9 aa, Homo Sapiens
FHGDYFAKN

SEQ ID NO: 1201868 - protein, 9 aa, Homo Sapiens
RSRRRGLPC

SEQ ID NO: 1201869 - protein, 9 aa, Homo Sapiens
RFSVRYTPL

SEQ ID NO: 1201870 - protein, 9 aa, Homo Sapiens
GWRARAWRM

SEQ ID NO: 1201871 - protein, 9 aa, Homo Sapiens
LGTACLIPP

SEQ ID NO: 1201872 - protein, 9 aa, Homo Sapiens
ASHQRGRPR

SEQ ID NO: 1201873 - protein, 9 aa, Homo Sapiens
NFLSIFKLD

SEQ ID NO: 1201874 - protein, 9 aa, Homo Sapiens
FLWRSNGAY

SEQ ID NO: 1201875 - protein, 9 aa, Homo Sapiens
LLELSSLKP

SEQ ID NO: 1201876 - protein, 9 aa, Homo Sapiens
FKAHEVAPK

SEQ ID NO: 1201877 - protein, 9 aa, Homo Sapiens
SMKLFCSVG

SEQ ID NO: 1201878 - protein, 9 aa, Homo Sapiens
LHPILRWQR

SEQ ID NO: 1201879 - protein, 9 aa, Homo Sapiens
LGLGARAGA

SEQ ID NO: 1201880 - protein, 9 aa, Homo Sapiens
TSCGSCPRS

SEQ ID NO: 1201881 - protein, 9 aa, Homo Sapiens
YNEIQNGNV

SEQ ID NO: 1201882 - protein, 9 aa, Homo Sapiens
NDRCFGILS

SEQ ID NO: 1201883 - protein, 9 aa, Homo Sapiens
LRKQYGGDF

SEQ ID NO: 1201884 - protein, 9 aa, Homo Sapiens
SKAEYAPPI

SEQ ID NO: 1201885 - protein, 9 aa, Homo Sapiens
TGQAYSAAP

SEQ ID NO: 1201886 - protein, 9 aa, Homo Sapiens
CGCEAQEAV

SEQ ID NO: 1201887 - protein, 9 aa, Homo Sapiens
PVPLLEHTP

SEQ ID NO: 1201888 - protein, 9 aa, Homo Sapiens
RRGRQCIRT

SEQ ID NO: 1201889 - protein, 9 aa, Homo Sapiens
ERLMGKRVN

SEQ ID NO: 1201890 - protein, 9 aa, Homo Sapiens
NVGDTSCGQ

SEQ ID NO: 1201891 - protein, 9 aa, Homo Sapiens
QLRRRPPRE

SEQ ID NO: 1201892 - protein, 9 aa, Homo Sapiens
TARATSPCT

SEQ ID NO: 1201893 - protein, 9 aa, Homo Sapiens
LCGYSVEVK

SEQ ID NO: 1201894 - protein, 9 aa, Homo Sapiens
LDSLDGGMK

SEQ ID NO: 1201895 - protein, 9 aa, Homo Sapiens
ASEGWHWGA

SEQ ID NO: 1201896 - protein, 9 aa, Homo Sapiens
RTKMAGGLH

SEQ ID NO: 1201897 - protein, 9 aa, Homo Sapiens
TQEASGVTA

SEQ ID NO: 1201898 - protein, 9 aa, Homo Sapiens
DTEYTCVKE

SEQ ID NO: 1201899 - protein, 9 aa, Homo Sapiens
PGPTGCFCP

SEQ ID NO: 1201900 - protein, 9 aa, Homo Sapiens
EMDISKKSI

SEQ ID NO: 1201901 - protein, 9 aa, Homo Sapiens
QNWMSSVRS

SEQ ID NO: 1201902 - protein, 9 aa, Homo Sapiens
ADALDDGNT

SEQ ID NO: 1201903 - protein, 9 aa, Homo Sapiens
WPWTRCLRM

SEQ ID NO: 1201904 - protein, 9 aa, Homo Sapiens
CVYWVDSRF

SEQ ID NO: 1201905 - protein, 9 aa, Homo Sapiens
YWQILFSVI

SEQ ID NO: 1201906 - protein, 9 aa, Homo Sapiens
SYVGIVTVI

SEQ ID NO: 1201907 - protein, 9 aa, Homo Sapiens
NLQRNLKVL

SEQ ID NO: 1201908 - protein, 9 aa, Homo Sapiens
AQHISFPDL

SEQ ID NO: 1201909 - protein, 9 aa, Homo Sapiens
GGAQAIPKT

SEQ ID NO: 1201910 - protein, 9 aa, Homo Sapiens
AIERQMAKI

SEQ ID NO: 1201911 - protein, 9 aa, Homo Sapiens
AIQLIQFAL

SEQ ID NO: 1201912 - protein, 9 aa, Homo Sapiens
ITWSSSPKF

SEQ ID NO: 1201913 - protein, 9 aa, Homo Sapiens
NCSSTSCGS

SEQ ID NO: 1201914 - protein, 9 aa, Homo Sapiens
TIIYNCTLV

SEQ ID NO: 1201915 - protein, 9 aa, Homo Sapiens
KTYVESGNA

SEQ ID NO: 1201916 - protein, 9 aa, Homo Sapiens
TGTPRSPCP

SEQ ID NO: 1201917 - protein, 9 aa, Homo Sapiens
VAQSPKHRF

SEQ ID NO: 1201918 - protein, 9 aa, Homo Sapiens
MCSRSWARS

SEQ ID NO: 1201919 - protein, 9 aa, Homo Sapiens
DGLGSKGEP

SEQ ID NO: 1201920 - protein, 9 aa, Homo Sapiens
HEEKVEVWF

SEQ ID NO: 1201921 - protein, 9 aa, Homo Sapiens
RWQRLRYGV

SEQ ID NO: 1201922 - protein, 9 aa, Homo Sapiens
KGRRAAAPG

SEQ ID NO: 1201923 - protein, 9 aa, Homo Sapiens
FLYMWSFCF

SEQ ID NO: 1201924 - protein, 9 aa, Homo Sapiens
TRLCVALTS

SEQ ID NO: 1201925 - protein, 9 aa, Homo Sapiens
TARRRVSRK

SEQ ID NO: 1201926 - protein, 9 aa, Homo Sapiens
IIRRIQTHG

SEQ ID NO: 1201927 - protein, 9 aa, Homo Sapiens
SHPHPPQPT

SEQ ID NO: 1201928 - protein, 9 aa, Homo Sapiens
KKEEGKEQE

SEQ ID NO: 1201929 - protein, 9 aa, Homo Sapiens
DVTSNLLMV

SEQ ID NO: 1201930 - protein, 9 aa, Homo Sapiens
RRGTLASSA

SEQ ID NO: 1201931 - protein, 9 aa, Homo Sapiens
AARRRRLLG

SEQ ID NO: 1201932 - protein, 9 aa, Homo Sapiens
QLEGASDAD

SEQ ID NO: 1201933 - protein, 9 aa, Homo Sapiens
AGRPGVPLV

SEQ ID NO: 1201934 - protein, 9 aa, Homo Sapiens
VSLVSTAAC

SEQ ID NO: 1201935 - protein, 9 aa, Homo Sapiens
TCSHPFSKS

SEQ ID NO: 1201936 - protein, 9 aa, Homo Sapiens
GALQGLACR

SEQ ID NO: 1201937 - protein, 9 aa, Homo Sapiens
SSSIQVFSI

SEQ ID NO: 1201938 - protein, 9 aa, Homo Sapiens
FLSANKMKE

SEQ ID NO: 1201939 - protein, 9 aa, Homo Sapiens
PTFPCSSLR

SEQ ID NO: 1201940 - protein, 9 aa, Homo Sapiens
CTPNGIVFD

SEQ ID NO: 1201941 - protein, 9 aa, Homo Sapiens
GQAAAAGGR

SEQ ID NO: 1201942 - protein, 9 aa, Homo Sapiens
FVPGGGAAK

SEQ ID NO: 1201943 - protein, 9 aa, Homo Sapiens
TPGDPAPVA

SEQ ID NO: 1201944 - protein, 9 aa, Homo Sapiens
WQMKTIHCN

SEQ ID NO: 1201945 - protein, 9 aa, Homo Sapiens
AFHPNYKKM

SEQ ID NO: 1201946 - protein, 9 aa, Homo Sapiens
QGIIPRAIT

SEQ ID NO: 1201947 - protein, 9 aa, Homo Sapiens
NIMSMGITW

SEQ ID NO: 1201948 - protein, 9 aa, Homo Sapiens
PGLPLTHVQ

SEQ ID NO: 1201949 - protein, 9 aa, Homo Sapiens
EVKWTEWKM

SEQ ID NO: 1201950 - protein, 9 aa, Homo Sapiens
VLAATSKFL

SEQ ID NO: 1201951 - protein, 9 aa, Homo Sapiens
VPSKAPGVC

SEQ ID NO: 1201952 - protein, 9 aa, Homo Sapiens
GLGRQKKAP

SEQ ID NO: 1201953 - protein, 9 aa, Homo Sapiens
GYTMYETQM

SEQ ID NO: 1201954 - protein, 9 aa, Homo Sapiens
TTSRPWDPG

SEQ ID NO: 1201955 - protein, 9 aa, Homo Sapiens
TEIQGEIGI

SEQ ID NO: 1201956 - protein, 9 aa, Homo Sapiens
LPLLLFTLI

SEQ ID NO: 1201957 - protein, 9 aa, Homo Sapiens
LIIALSYVG

SEQ ID NO: 1201958 - protein, 9 aa, Homo Sapiens
RALRCISSG

SEQ ID NO: 1201959 - protein, 9 aa, Homo Sapiens
KVDIYLDQT

SEQ ID NO: 1201960 - protein, 9 aa, Homo Sapiens
ANGRVNAVA

SEQ ID NO: 1201961 - protein, 9 aa, Homo Sapiens
IYNMLTDFI

SEQ ID NO: 1201962 - protein, 9 aa, Homo Sapiens
FYSQPLNIM

SEQ ID NO: 1201963 - protein, 9 aa, Homo Sapiens
RPSHACRSA

SEQ ID NO: 1201964 - protein, 9 aa, Homo Sapiens
LPARPLEGE

SEQ ID NO: 1201965 - protein, 9 aa, Homo Sapiens
APMSVGPRS

SEQ ID NO: 1201966 - protein, 9 aa, Homo Sapiens
FVLRGTILV

SEQ ID NO: 1201967 - protein, 9 aa, Homo Sapiens
SPLTPLSTI

SEQ ID NO: 1201968 - protein, 9 aa, Homo Sapiens
SPARRRAGA

SEQ ID NO: 1201969 - protein, 9 aa, Homo Sapiens
KSPLLCVTR

SEQ ID NO: 1201970 - protein, 9 aa, Homo Sapiens
LCFATGAGK

SEQ ID NO: 1201971 - protein, 9 aa, Homo Sapiens
DSGAADGPD

SEQ ID NO: 1201972 - protein, 9 aa, Homo Sapiens
GDSNSSSSP

SEQ ID NO: 1201973 - protein, 9 aa, Homo Sapiens
MDFLKCVPV

SEQ ID NO: 1201974 - protein, 9 aa, Homo Sapiens
LHARTQLSR

SEQ ID NO: 1201975 - protein, 9 aa, Homo Sapiens
TDGRKERAQ

SEQ ID NO: 1201976 - protein, 9 aa, Homo Sapiens
REQQRLQEG

SEQ ID NO: 1201977 - protein, 9 aa, Homo Sapiens
RSRTCTSSS

SEQ ID NO: 1201978 - protein, 9 aa, Homo Sapiens
LAPVAVNDN

SEQ ID NO: 1201979 - protein, 9 aa, Homo Sapiens
LSGETTLVK

SEQ ID NO: 1201980 - protein, 9 aa, Homo Sapiens
PRGPPSPAP

SEQ ID NO: 1201981 - protein, 9 aa, Homo Sapiens
YPPECTLKG

SEQ ID NO: 1201982 - protein, 9 aa, Homo Sapiens
PNKTAANIR

SEQ ID NO: 1201983 - protein, 9 aa, Homo Sapiens
CWSRDQNTF

SEQ ID NO: 1201984 - protein, 9 aa, Homo Sapiens
KLDLSLNFG

SEQ ID NO: 1201985 - protein, 9 aa, Homo Sapiens
DVAKGQPGF

SEQ ID NO: 1201986 - protein, 9 aa, Homo Sapiens
GAFVGPRCS

SEQ ID NO: 1201987 - protein, 9 aa, Homo Sapiens
PAKESTHTS

SEQ ID NO: 1201988 - protein, 9 aa, Homo Sapiens
SAESSMSED

SEQ ID NO: 1201989 - protein, 9 aa, Homo Sapiens
YPPPFPAAH

SEQ ID NO: 1201990 - protein, 9 aa, Homo Sapiens
GAAAARAAG

SEQ ID NO: 1201991 - protein, 9 aa, Homo Sapiens
RVCHALVFL

SEQ ID NO: 1201992 - protein, 9 aa, Homo Sapiens
QYLERGESI

SEQ ID NO: 1201993 - protein, 9 aa, Homo Sapiens
GSAGSVSGS

SEQ ID NO: 1201994 - protein, 9 aa, Homo Sapiens
SKFLRKCSL

SEQ ID NO: 1201995 - protein, 9 aa, Homo Sapiens
SSGEDADDP

SEQ ID NO: 1201996 - protein, 9 aa, Homo Sapiens
FPLPRASLR

SEQ ID NO: 1201997 - protein, 9 aa, Homo Sapiens
SLSGAQQQL

SEQ ID NO: 1201998 - protein, 9 aa, Homo Sapiens
WAWRATRRP

SEQ ID NO: 1201999 - protein, 9 aa, Homo Sapiens
YRPWRGTTR

SEQ ID NO: 1202000 - protein, 9 aa, Homo Sapiens
KNIPGIRGA

SEQ ID NO: 1202001 - protein, 9 aa, Homo Sapiens
LGPWGWLGT

SEQ ID NO: 1202002 - protein, 9 aa, Homo Sapiens
HWHTTEACF

SEQ ID NO: 1202003 - protein, 9 aa, Homo Sapiens
AGPARAVTP

SEQ ID NO: 1202004 - protein, 9 aa, Homo Sapiens
KVAFEIKKA

SEQ ID NO: 1202005 - protein, 9 aa, Homo Sapiens
IDLLTFITG

SEQ ID NO: 1202006 - protein, 9 aa, Homo Sapiens
KFSFAEHQR

SEQ ID NO: 1202007 - protein, 9 aa, Homo Sapiens
PQRGPRPLH

SEQ ID NO: 1202008 - protein, 9 aa, Homo Sapiens
AARLLLHFG

SEQ ID NO: 1202009 - protein, 9 aa, Homo Sapiens
PNGCAAGPK

SEQ ID NO: 1202010 - protein, 9 aa, Homo Sapiens
WVGIFRVNT

SEQ ID NO: 1202011 - protein, 9 aa, Homo Sapiens
RPHQCLRCQ

SEQ ID NO: 1202012 - protein, 9 aa, Homo Sapiens
SKEAPPIPK

SEQ ID NO: 1202013 - protein, 9 aa, Homo Sapiens
PPMMRNSTT

SEQ ID NO: 1202014 - protein, 9 aa, Homo Sapiens
APPGCLPLH

SEQ ID NO: 1202015 - protein, 9 aa, Homo Sapiens
LRPPPSRHC

SEQ ID NO: 1202016 - protein, 9 aa, Homo Sapiens
SVPQLRIWL

SEQ ID NO: 1202017 - protein, 9 aa, Homo Sapiens
MSSICTVPN

SEQ ID NO: 1202018 - protein, 9 aa, Homo Sapiens
RRTFHGDYF

SEQ ID NO: 1202019 - protein, 9 aa, Homo Sapiens
RSRCPKSTS

SEQ ID NO: 1202020 - protein, 9 aa, Homo Sapiens
RAPAQPPGP

SEQ ID NO: 1202021 - protein, 9 aa, Homo Sapiens
PAQRYIDSK

SEQ ID NO: 1202022 - protein, 9 aa, Homo Sapiens
GQCICDNEY

SEQ ID NO: 1202023 - protein, 9 aa, Homo Sapiens
PPCRSSRTW

SEQ ID NO: 1202024 - protein, 9 aa, Homo Sapiens
GAAQMSWSL

SEQ ID NO: 1202025 - protein, 9 aa, Homo Sapiens
RGPGLFPRS

SEQ ID NO: 1202026 - protein, 9 aa, Homo Sapiens
RRPPREGPN

SEQ ID NO: 1202027 - protein, 9 aa, Homo Sapiens
PPAAPAPAP

SEQ ID NO: 1202028 - protein, 9 aa, Homo Sapiens
QTEARVQAL

SEQ ID NO: 1202029 - protein, 9 aa, Homo Sapiens
PSTLMPSYD

SEQ ID NO: 1202030 - protein, 9 aa, Homo Sapiens
HRVVRKSWM

SEQ ID NO: 1202031 - protein, 9 aa, Homo Sapiens
VTCLMNTMG

SEQ ID NO: 1202032 - protein, 9 aa, Homo Sapiens
LRCAVEKNQ

SEQ ID NO: 1202033 - protein, 9 aa, Homo Sapiens
MEGLLKQAI

SEQ ID NO: 1202034 - protein, 9 aa, Homo Sapiens
LRRRPPREG

SEQ ID NO: 1202035 - protein, 9 aa, Homo Sapiens
NVYTPGTQH

SEQ ID NO: 1202036 - protein, 9 aa, Homo Sapiens
EERKSKRKR

SEQ ID NO: 1202037 - protein, 9 aa, Homo Sapiens
PQLMQNFYQ

SEQ ID NO: 1202038 - protein, 9 aa, Homo Sapiens
SLSRPHGRS

SEQ ID NO: 1202039 - protein, 9 aa, Homo Sapiens
VSAPTCASP

SEQ ID NO: 1202040 - protein, 9 aa, Homo Sapiens
SFLTPPCAR

SEQ ID NO: 1202041 - protein, 9 aa, Homo Sapiens
KSTHLLLLI

SEQ ID NO: 1202042 - protein, 9 aa, Homo Sapiens
NTPLRCAVE

SEQ ID NO: 1202043 - protein, 9 aa, Homo Sapiens
LLVTVGNVY

SEQ ID NO: 1202044 - protein, 9 aa, Homo Sapiens
EKNGQEADL

SEQ ID NO: 1202045 - protein, 9 aa, Homo Sapiens
TSSKTTELQ

SEQ ID NO: 1202046 - protein, 9 aa, Homo Sapiens
YYIPGQGHS

SEQ ID NO: 1202047 - protein, 9 aa, Homo Sapiens
GITRVYRIG

SEQ ID NO: 1202048 - protein, 9 aa, Homo Sapiens
PPVWGLPGW

SEQ ID NO: 1202049 - protein, 9 aa, Homo Sapiens
KGPGKYICQ

SEQ ID NO: 1202050 - protein, 9 aa, Homo Sapiens
SPCWLSCGS

SEQ ID NO: 1202051 - protein, 9 aa, Homo Sapiens
WLAHDCLTP

SEQ ID NO: 1202052 - protein, 9 aa, Homo Sapiens
IISIFLYIL

SEQ ID NO: 1202053 - protein, 9 aa, Homo Sapiens
TQGPPHHGG

SEQ ID NO: 1202054 - protein, 9 aa, Homo Sapiens
PKRCAARRR

SEQ ID NO: 1202055 - protein, 9 aa, Homo Sapiens
RYQKYRRKG

SEQ ID NO: 1202056 - protein, 9 aa, Homo Sapiens
PHKAESKSC

SEQ ID NO: 1202057 - protein, 9 aa, Homo Sapiens
DDDDDDCKN

SEQ ID NO: 1202058 - protein, 9 aa, Homo Sapiens
RTHSSPTAS

SEQ ID NO: 1202059 - protein, 9 aa, Homo Sapiens
TAAPMSVGP

SEQ ID NO: 1202060 - protein, 9 aa, Homo Sapiens
CFYKLVTLK

SEQ ID NO: 1202061 - protein, 9 aa, Homo Sapiens
KGTPKPSKP

SEQ ID NO: 1202062 - protein, 9 aa, Homo Sapiens
YRPFPSALG

SEQ ID NO: 1202063 - protein, 9 aa, Homo Sapiens
FDGAHPPPS

SEQ ID NO: 1202064 - protein, 9 aa, Homo Sapiens
SNMGNDDPE

SEQ ID NO: 1202065 - protein, 9 aa, Homo Sapiens
GRREDVGPS

SEQ ID NO: 1202066 - protein, 9 aa, Homo Sapiens
VVKPGRGGQ

SEQ ID NO: 1202067 - protein, 9 aa, Homo Sapiens
GAFIYNMLT

SEQ ID NO: 1202068 - protein, 9 aa, Homo Sapiens
KALKNGVHS

SEQ ID NO: 1202069 - protein, 9 aa, Homo Sapiens
ATSWSCQPL

SEQ ID NO: 1202070 - protein, 9 aa, Homo Sapiens
RRQAAQDGR

SEQ ID NO: 1202071 - protein, 9 aa, Homo Sapiens
LMSLLASIF

SEQ ID NO: 1202072 - protein, 9 aa, Homo Sapiens
QGKQEENNV

SEQ ID NO: 1202073 - protein, 9 aa, Homo Sapiens
LSVVRTEGS

SEQ ID NO: 1202074 - protein, 9 aa, Homo Sapiens
AARDCTLEY

SEQ ID NO: 1202075 - protein, 9 aa, Homo Sapiens
SEASIARNL

SEQ ID NO: 1202076 - protein, 9 aa, Homo Sapiens
AGTTTAAGT

SEQ ID NO: 1202077 - protein, 9 aa, Homo Sapiens
PQGHLAVTL

SEQ ID NO: 1202078 - protein, 9 aa, Homo Sapiens
VKQQNTLRH

SEQ ID NO: 1202079 - protein, 9 aa, Homo Sapiens
DASCARWRT

SEQ ID NO: 1202080 - protein, 9 aa, Homo Sapiens
ATELATISS

SEQ ID NO: 1202081 - protein, 9 aa, Homo Sapiens
VISWLLIFN

SEQ ID NO: 1202082 - protein, 9 aa, Homo Sapiens
CRTFESDFP

SEQ ID NO: 1202083 - protein, 9 aa, Homo Sapiens
AEGGHVEVR

SEQ ID NO: 1202084 - protein, 9 aa, Homo Sapiens
PPQRPSNSR

SEQ ID NO: 1202085 - protein, 9 aa, Homo Sapiens
GSPWTGSAV

SEQ ID NO: 1202086 - protein, 9 aa, Homo Sapiens
RHCPPPTAA

SEQ ID NO: 1202087 - protein, 9 aa, Homo Sapiens
LAAPDLAGT

SEQ ID NO: 1202088 - protein, 9 aa, Homo Sapiens
LHIECSDEK

SEQ ID NO: 1202089 - protein, 9 aa, Homo Sapiens
VIFYDPCLQ

SEQ ID NO: 1202090 - protein, 9 aa, Homo Sapiens
PVKPFLFYH

SEQ ID NO: 1202091 - protein, 9 aa, Homo Sapiens
SWRTKEMLA

SEQ ID NO: 1202092 - protein, 9 aa, Homo Sapiens
HTLYIDALH

SEQ ID NO: 1202093 - protein, 9 aa, Homo Sapiens
DQWCPDGSH

SEQ ID NO: 1202094 - protein, 9 aa, Homo Sapiens
EVQDRKLTK

SEQ ID NO: 1202095 - protein, 9 aa, Homo Sapiens
LFGNPMMCD

SEQ ID NO: 1202096 - protein, 9 aa, Homo Sapiens
YYRGQVNYD

SEQ ID NO: 1202097 - protein, 9 aa, Homo Sapiens
LTLQCNPRL

SEQ ID NO: 1202098 - protein, 9 aa, Homo Sapiens
EKVKQQNTL

SEQ ID NO: 1202099 - protein, 9 aa, Homo Sapiens
SNTGMPDIS

SEQ ID NO: 1202100 - protein, 9 aa, Homo Sapiens
PKLVSSADL

SEQ ID NO: 1202101 - protein, 9 aa, Homo Sapiens
DTSHLSVAW

SEQ ID NO: 1202102 - protein, 9 aa, Homo Sapiens
PRSASRASG

SEQ ID NO: 1202103 - protein, 9 aa, Homo Sapiens
WRSGCVPRR

SEQ ID NO: 1202104 - protein, 9 aa, Homo Sapiens
TWAMSMSLP

SEQ ID NO: 1202105 - protein, 9 aa, Homo Sapiens
ATLSEKLSG

SEQ ID NO: 1202106 - protein, 9 aa, Homo Sapiens
PGNQRSNRS

SEQ ID NO: 1202107 - protein, 9 aa, Homo Sapiens
AKYLDVGWG

SEQ ID NO: 1202108 - protein, 9 aa, Homo Sapiens
FGKAQEDPK

SEQ ID NO: 1202109 - protein, 9 aa, Homo Sapiens
GRCPPGPWA

SEQ ID NO: 1202110 - protein, 9 aa, Homo Sapiens
GCSKGGRGS

SEQ ID NO: 1202111 - protein, 9 aa, Homo Sapiens
KMLRTRSKG

SEQ ID NO: 1202112 - protein, 9 aa, Homo Sapiens
QRGLLLHGV

SEQ ID NO: 1202113 - protein, 9 aa, Homo Sapiens
RGNKYLAKT

SEQ ID NO: 1202114 - protein, 9 aa, Homo Sapiens
RPHPLYFRG

SEQ ID NO: 1202115 - protein, 9 aa, Homo Sapiens
AGTAKRARS

SEQ ID NO: 1202116 - protein, 9 aa, Homo Sapiens
KKDKLHHRA

SEQ ID NO: 1202117 - protein, 9 aa, Homo Sapiens
KSWAASWAP

SEQ ID NO: 1202118 - protein, 9 aa, Homo Sapiens
EVRRVAPHF

SEQ ID NO: 1202119 - protein, 9 aa, Homo Sapiens
GLQALGSRS

SEQ ID NO: 1202120 - protein, 9 aa, Homo Sapiens
PGCVQAGSE

SEQ ID NO: 1202121 - protein, 9 aa, Homo Sapiens
NSVADCMPC

SEQ ID NO: 1202122 - protein, 9 aa, Homo Sapiens
QGALTLEIR

SEQ ID NO: 1202123 - protein, 9 aa, Homo Sapiens
KMRPAHLVP

SEQ ID NO: 1202124 - protein, 9 aa, Homo Sapiens
AVAAFVLAN

SEQ ID NO: 1202125 - protein, 9 aa, Homo Sapiens
WRGTTRNCS

SEQ ID NO: 1202126 - protein, 9 aa, Homo Sapiens
ELVEPGHRA

SEQ ID NO: 1202127 - protein, 9 aa, Homo Sapiens
ERSDPLCVL

SEQ ID NO: 1202128 - protein, 9 aa, Homo Sapiens
LRGFLLHQP

SEQ ID NO: 1202129 - protein, 9 aa, Homo Sapiens
SLCTTVIIF

SEQ ID NO: 1202130 - protein, 9 aa, Homo Sapiens
CAELGYRTQ

SEQ ID NO: 1202131 - protein, 9 aa, Homo Sapiens
LLLFCYIGC

SEQ ID NO: 1202132 - protein, 9 aa, Homo Sapiens
TSSLGKSDG

SEQ ID NO: 1202133 - protein, 9 aa, Homo Sapiens
FKLDGLQRI

SEQ ID NO: 1202134 - protein, 9 aa, Homo Sapiens
TLLLKALAP

SEQ ID NO: 1202135 - protein, 9 aa, Homo Sapiens
GLWNTQYPE

SEQ ID NO: 1202136 - protein, 9 aa, Homo Sapiens
DCKRICRGA

SEQ ID NO: 1202137 - protein, 9 aa, Homo Sapiens
WLQQTTGCS

SEQ ID NO: 1202138 - protein, 9 aa, Homo Sapiens
IEAILNHPG

SEQ ID NO: 1202139 - protein, 9 aa, Homo Sapiens
FVPRDVVLD

SEQ ID NO: 1202140 - protein, 9 aa, Homo Sapiens
HTNTATVTT

SEQ ID NO: 1202141 - protein, 9 aa, Homo Sapiens
VCMYVCACI

SEQ ID NO: 1202142 - protein, 9 aa, Homo Sapiens
LPYDTRSRR

SEQ ID NO: 1202143 - protein, 9 aa, Homo Sapiens
QAPKASSWA

SEQ ID NO: 1202144 - protein, 9 aa, Homo Sapiens
GVSPPSLPP

SEQ ID NO: 1202145 - protein, 9 aa, Homo Sapiens
NEQKARGGL

SEQ ID NO: 1202146 - protein, 9 aa, Homo Sapiens
VPNEALGYL

SEQ ID NO: 1202147 - protein, 9 aa, Homo Sapiens
KNGDELHGG

SEQ ID NO: 1202148 - protein, 9 aa, Homo Sapiens
IDRERAAQT

SEQ ID NO: 1202149 - protein, 9 aa, Homo Sapiens
AVSLGAPCW

SEQ ID NO: 1202150 - protein, 9 aa, Homo Sapiens
TCLMVTALC

SEQ ID NO: 1202151 - protein, 9 aa, Homo Sapiens
ARAAARAAA

SEQ ID NO: 1202152 - protein, 9 aa, Homo Sapiens
TYARYSSRR

SEQ ID NO: 1202153 - protein, 9 aa, Homo Sapiens
RLLAPFLRP

SEQ ID NO: 1202154 - protein, 9 aa, Homo Sapiens
TVPRHSSVL

SEQ ID NO: 1202155 - protein, 9 aa, Homo Sapiens
ARAAARAAG

SEQ ID NO: 1202156 - protein, 9 aa, Homo Sapiens
ETATWRCCA

SEQ ID NO: 1202157 - protein, 9 aa, Homo Sapiens
GKCIDVDEC

SEQ ID NO: 1202158 - protein, 9 aa, Homo Sapiens
SPRPERSSS

SEQ ID NO: 1202159 - protein, 9 aa, Homo Sapiens
VRTCVCWPS

SEQ ID NO: 1202160 - protein, 9 aa, Homo Sapiens
KEYLKKKWE

SEQ ID NO: 1202161 - protein, 9 aa, Homo Sapiens
ILADDLIKV

SEQ ID NO: 1202162 - protein, 9 aa, Homo Sapiens
QTCAVNCPS

SEQ ID NO: 1202163 - protein, 9 aa, Homo Sapiens
GGALPYDTR

SEQ ID NO: 1202164 - protein, 9 aa, Homo Sapiens
QTWTRLPRR

SEQ ID NO: 1202165 - protein, 9 aa, Homo Sapiens
LKPYMNIFN

SEQ ID NO: 1202166 - protein, 9 aa, Homo Sapiens
SVHPTTGPS

SEQ ID NO: 1202167 - protein, 9 aa, Homo Sapiens
GQHLQHQTG

SEQ ID NO: 1202168 - protein, 9 aa, Homo Sapiens
NHHIVAPTR

SEQ ID NO: 1202169 - protein, 9 aa, Homo Sapiens
GTGLEQSPQ

SEQ ID NO: 1202170 - protein, 9 aa, Homo Sapiens
TPGLQPPAP

SEQ ID NO: 1202171 - protein, 9 aa, Homo Sapiens
GARWDAGLS

SEQ ID NO: 1202172 - protein, 9 aa, Homo Sapiens
TAAAAATSL

SEQ ID NO: 1202173 - protein, 9 aa, Homo Sapiens
FISPKKPKT

SEQ ID NO: 1202174 - protein, 9 aa, Homo Sapiens
DNGIEVLKT

SEQ ID NO: 1202175 - protein, 9 aa, Homo Sapiens
CSSAGNNSK

SEQ ID NO: 1202176 - protein, 9 aa, Homo Sapiens
PLAQLQYRP

SEQ ID NO: 1202177 - protein, 9 aa, Homo Sapiens
GFVPDAELH

SEQ ID NO: 1202178 - protein, 9 aa, Homo Sapiens
LVAFMLPAP

SEQ ID NO: 1202179 - protein, 9 aa, Homo Sapiens
HQPLPGQHL

SEQ ID NO: 1202180 - protein, 9 aa, Homo Sapiens
HELGVVKPG

SEQ ID NO: 1202181 - protein, 9 aa, Homo Sapiens
AEATTRLNV

SEQ ID NO: 1202182 - protein, 9 aa, Homo Sapiens
PCQSAECQP

SEQ ID NO: 1202183 - protein, 9 aa, Homo Sapiens
NPVNSNNVF

SEQ ID NO: 1202184 - protein, 9 aa, Homo Sapiens
MVYVLKRQG

SEQ ID NO: 1202185 - protein, 9 aa, Homo Sapiens
EFRPVDCAD

SEQ ID NO: 1202186 - protein, 9 aa, Homo Sapiens
DPMFDLSLN

SEQ ID NO: 1202187 - protein, 9 aa, Homo Sapiens
GRQLPHGEL

SEQ ID NO: 1202188 - protein, 9 aa, Homo Sapiens
AHLVGHIGR

SEQ ID NO: 1202189 - protein, 9 aa, Homo Sapiens
APSTCSTRS

SEQ ID NO: 1202190 - protein, 9 aa, Homo Sapiens
GMYNMSAGM

SEQ ID NO: 1202191 - protein, 9 aa, Homo Sapiens
CMTPASVPP

SEQ ID NO: 1202192 - protein, 9 aa, Homo Sapiens
STDREASIV

SEQ ID NO: 1202193 - protein, 9 aa, Homo Sapiens
HVHYLRCLR

SEQ ID NO: 1202194 - protein, 9 aa, Homo Sapiens
KFQDLLQEG

SEQ ID NO: 1202195 - protein, 9 aa, Homo Sapiens
TVGLELPAS

SEQ ID NO: 1202196 - protein, 9 aa, Homo Sapiens
FSLQLDEYR

SEQ ID NO: 1202197 - protein, 9 aa, Homo Sapiens
PGLSRPATS

SEQ ID NO: 1202198 - protein, 9 aa, Homo Sapiens
MKEATFVLR

SEQ ID NO: 1202199 - protein, 9 aa, Homo Sapiens
LSQKETLKQ

SEQ ID NO: 1202200 - protein, 9 aa, Homo Sapiens
EAGSKISCQ

SEQ ID NO: 1202201 - protein, 9 aa, Homo Sapiens
NYRRPMYHI

SEQ ID NO: 1202202 - protein, 9 aa, Homo Sapiens
AASGPISAA

SEQ ID NO: 1202203 - protein, 9 aa, Homo Sapiens
DILKPYMNI

SEQ ID NO: 1202204 - protein, 9 aa, Homo Sapiens
ICISYVFIT

SEQ ID NO: 1202205 - protein, 9 aa, Homo Sapiens
SNENCHKTY

SEQ ID NO: 1202206 - protein, 9 aa, Homo Sapiens
PSVHVPPQT

SEQ ID NO: 1202207 - protein, 9 aa, Homo Sapiens
IILYDHVRP

SEQ ID NO: 1202208 - protein, 9 aa, Homo Sapiens
KKRRNLQRN

SEQ ID NO: 1202209 - protein, 9 aa, Homo Sapiens
RQVGRDVKA

SEQ ID NO: 1202210 - protein, 9 aa, Homo Sapiens
QEAVHAHAL

SEQ ID NO: 1202211 - protein, 9 aa, Homo Sapiens
SSPKFTSSW

SEQ ID NO: 1202212 - protein, 9 aa, Homo Sapiens
MIRDNGVTC

SEQ ID NO: 1202213 - protein, 9 aa, Homo Sapiens
CPRASTQLP

SEQ ID NO: 1202214 - protein, 9 aa, Homo Sapiens
EAAGGAPAR

SEQ ID NO: 1202215 - protein, 9 aa, Homo Sapiens
AHLVVGRVV

SEQ ID NO: 1202216 - protein, 9 aa, Homo Sapiens
NDTLDSTWT

SEQ ID NO: 1202217 - protein, 9 aa, Homo Sapiens
NIREIEQNA

SEQ ID NO: 1202218 - protein, 9 aa, Homo Sapiens
LCGATFPHV

SEQ ID NO: 1202219 - protein, 9 aa, Homo Sapiens
YFALGAKEA

SEQ ID NO: 1202220 - protein, 9 aa, Homo Sapiens
QDGLMVIVT

SEQ ID NO: 1202221 - protein, 9 aa, Homo Sapiens
REGPNKGAT

SEQ ID NO: 1202222 - protein, 9 aa, Homo Sapiens
ALHTLQNYL

SEQ ID NO: 1202223 - protein, 9 aa, Homo Sapiens
VCMGESAQA

SEQ ID NO: 1202224 - protein, 9 aa, Homo Sapiens
QNGNVSLFF

SEQ ID NO: 1202225 - protein, 9 aa, Homo Sapiens
VSFPVDFFR

SEQ ID NO: 1202226 - protein, 9 aa, Homo Sapiens
KMGKVIFTN

SEQ ID NO: 1202227 - protein, 9 aa, Homo Sapiens
HPRSRLSHK

SEQ ID NO: 1202228 - protein, 9 aa, Homo Sapiens
RTGAPARAR

SEQ ID NO: 1202229 - protein, 9 aa, Homo Sapiens
TLVLTAFGI

SEQ ID NO: 1202230 - protein, 9 aa, Homo Sapiens
RPLGLADWA

SEQ ID NO: 1202231 - protein, 9 aa, Homo Sapiens
IVIEAHEQL

SEQ ID NO: 1202232 - protein, 9 aa, Homo Sapiens
KVWMRVKYT

SEQ ID NO: 1202233 - protein, 9 aa, Homo Sapiens
AAAPNDSSG

SEQ ID NO: 1202234 - protein, 9 aa, Homo Sapiens
GSKTRVPLK

SEQ ID NO: 1202235 - protein, 9 aa, Homo Sapiens
PPLPSPPVP

SEQ ID NO: 1202236 - protein, 9 aa, Homo Sapiens
HSLTAAGGA

SEQ ID NO: 1202237 - protein, 9 aa, Homo Sapiens
GDGQLFPVP

SEQ ID NO: 1202238 - protein, 9 aa, Homo Sapiens
SIPCESNEV

SEQ ID NO: 1202239 - protein, 9 aa, Homo Sapiens
LGVGAAVQR

SEQ ID NO: 1202240 - protein, 9 aa, Homo Sapiens
AEYSQPSSA

SEQ ID NO: 1202241 - protein, 9 aa, Homo Sapiens
KVILKTENI

SEQ ID NO: 1202242 - protein, 9 aa, Homo Sapiens
QGGEPQQQA

SEQ ID NO: 1202243 - protein, 9 aa, Homo Sapiens
YQQLFEDIW

SEQ ID NO: 1202244 - protein, 9 aa, Homo Sapiens
YTSSQEKLK

SEQ ID NO: 1202245 - protein, 9 aa, Homo Sapiens
PGPPKLVSS

SEQ ID NO: 1202246 - protein, 9 aa, Homo Sapiens
PTQLPSLEA

SEQ ID NO: 1202247 - protein, 9 aa, Homo Sapiens
ARRRRLLGL

SEQ ID NO: 1202248 - protein, 9 aa, Homo Sapiens
LRWQRLRYG

SEQ ID NO: 1202249 - protein, 9 aa, Homo Sapiens
PPFPAAHAR

SEQ ID NO: 1202250 - protein, 9 aa, Homo Sapiens
GKWPVGMTG

SEQ ID NO: 1202251 - protein, 9 aa, Homo Sapiens
LYPGQRDKQ

SEQ ID NO: 1202252 - protein, 9 aa, Homo Sapiens
PTSRGSSLQ

SEQ ID NO: 1202253 - protein, 9 aa, Homo Sapiens
PPSTNCSRR

SEQ ID NO: 1202254 - protein, 9 aa, Homo Sapiens
KSLWECGWS

SEQ ID NO: 1202255 - protein, 9 aa, Homo Sapiens
ETRGPRAPP

SEQ ID NO: 1202256 - protein, 9 aa, Homo Sapiens
GDIVGVPTG

SEQ ID NO: 1202257 - protein, 9 aa, Homo Sapiens
RWSELTEAE

SEQ ID NO: 1202258 - protein, 9 aa, Homo Sapiens
HFCTMKCDE

SEQ ID NO: 1202259 - protein, 9 aa, Homo Sapiens
LRTSELTLL

SEQ ID NO: 1202260 - protein, 9 aa, Homo Sapiens
LQRNLLRLQ

SEQ ID NO: 1202261 - protein, 9 aa, Homo Sapiens
PAAQAEPPV

SEQ ID NO: 1202262 - protein, 9 aa, Homo Sapiens
LRKEPVAMD

SEQ ID NO: 1202263 - protein, 9 aa, Homo Sapiens
CPPRVTPRP

SEQ ID NO: 1202264 - protein, 9 aa, Homo Sapiens
GRDVKALRR

SEQ ID NO: 1202265 - protein, 9 aa, Homo Sapiens
APQRPPSSW

SEQ ID NO: 1202266 - protein, 9 aa, Homo Sapiens
GHDFRGEIF

SEQ ID NO: 1202267 - protein, 9 aa, Homo Sapiens
SWEVPPRST

SEQ ID NO: 1202268 - protein, 9 aa, Homo Sapiens
LAACPSGSA

SEQ ID NO: 1202269 - protein, 9 aa, Homo Sapiens
CCPPSSSTL

SEQ ID NO: 1202270 - protein, 9 aa, Homo Sapiens
FQREEQPLF

SEQ ID NO: 1202271 - protein, 9 aa, Homo Sapiens
CIRTAEIVA

SEQ ID NO: 1202272 - protein, 9 aa, Homo Sapiens
DHKVTGAHL

SEQ ID NO: 1202273 - protein, 9 aa, Homo Sapiens
PLGISVLLL

SEQ ID NO: 1202274 - protein, 9 aa, Homo Sapiens
LLSRHQDAE

SEQ ID NO: 1202275 - protein, 9 aa, Homo Sapiens
GSLVQPGPY

SEQ ID NO: 1202276 - protein, 9 aa, Homo Sapiens
LWIPAFMVE

SEQ ID NO: 1202277 - protein, 9 aa, Homo Sapiens
WDPSFNCSS

SEQ ID NO: 1202278 - protein, 9 aa, Homo Sapiens
KEKTSACRP

SEQ ID NO: 1202279 - protein, 9 aa, Homo Sapiens
VGHYNEVKS

SEQ ID NO: 1202280 - protein, 9 aa, Homo Sapiens
VYCCKKCTY

SEQ ID NO: 1202281 - protein, 9 aa, Homo Sapiens
AGHRLQHGV

SEQ ID NO: 1202282 - protein, 9 aa, Homo Sapiens
DGQCICDNE

SEQ ID NO: 1202283 - protein, 9 aa, Homo Sapiens
MRGIQNEKE

SEQ ID NO: 1202284 - protein, 9 aa, Homo Sapiens
IAAVISVTA

SEQ ID NO: 1202285 - protein, 9 aa, Homo Sapiens
KELASRLRC

SEQ ID NO: 1202286 - protein, 9 aa, Homo Sapiens
SMALTPAAT

SEQ ID NO: 1202287 - protein, 9 aa, Homo Sapiens
QHCSSSRQS

SEQ ID NO: 1202288 - protein, 9 aa, Homo Sapiens
PRVARVNNK

SEQ ID NO: 1202289 - protein, 9 aa, Homo Sapiens
GFLIPLGDL

SEQ ID NO: 1202290 - protein, 9 aa, Homo Sapiens
SSCMTPASV

SEQ ID NO: 1202291 - protein, 9 aa, Homo Sapiens
PQTSKVAGL

SEQ ID NO: 1202292 - protein, 9 aa, Homo Sapiens
VKIRDRRSS

SEQ ID NO: 1202293 - protein, 9 aa, Homo Sapiens
HGPIKMYKC

SEQ ID NO: 1202294 - protein, 9 aa, Homo Sapiens
LADAQVAGP

SEQ ID NO: 1202295 - protein, 9 aa, Homo Sapiens
VWMRVKYTK

SEQ ID NO: 1202296 - protein, 9 aa, Homo Sapiens
PGPREGERS

SEQ ID NO: 1202297 - protein, 9 aa, Homo Sapiens
WPRSVGGLR

SEQ ID NO: 1202298 - protein, 9 aa, Homo Sapiens
PAPCLTHCT

SEQ ID NO: 1202299 - protein, 9 aa, Homo Sapiens
LQYRPFPSA

SEQ ID NO: 1202300 - protein, 9 aa, Homo Sapiens
ARAEGIPCI

SEQ ID NO: 1202301 - protein, 9 aa, Homo Sapiens
DPKADGMTD

SEQ ID NO: 1202302 - protein, 9 aa, Homo Sapiens
WGWLGTQLP

SEQ ID NO: 1202303 - protein, 9 aa, Homo Sapiens
KPERRVEDI

SEQ ID NO: 1202304 - protein, 9 aa, Homo Sapiens
WEQKKLREQ

SEQ ID NO: 1202305 - protein, 9 aa, Homo Sapiens
GQPGRHRQG

SEQ ID NO: 1202306 - protein, 9 aa, Homo Sapiens
RALHSAVKQ

SEQ ID NO: 1202307 - protein, 9 aa, Homo Sapiens
WSELPPGRA

SEQ ID NO: 1202308 - protein, 9 aa, Homo Sapiens
VMGPLSFNA

SEQ ID NO: 1202309 - protein, 9 aa, Homo Sapiens
QAIPKTWRR

SEQ ID NO: 1202310 - protein, 9 aa, Homo Sapiens
FNMAYGVKR

SEQ ID NO: 1202311 - protein, 9 aa, Homo Sapiens
YLNRVHSAI

SEQ ID NO: 1202312 - protein, 9 aa, Homo Sapiens
IKPYVRSKG

SEQ ID NO: 1202313 - protein, 9 aa, Homo Sapiens
AEEFMVDKV

SEQ ID NO: 1202314 - protein, 9 aa, Homo Sapiens
IFRQDSDLT

SEQ ID NO: 1202315 - protein, 9 aa, Homo Sapiens
EDAVASAGF

SEQ ID NO: 1202316 - protein, 9 aa, Homo Sapiens
TGTLGSLTA

SEQ ID NO: 1202317 - protein, 9 aa, Homo Sapiens
PLRASRRCC

SEQ ID NO: 1202318 - protein, 9 aa, Homo Sapiens
DLAWLYPGQ

SEQ ID NO: 1202319 - protein, 9 aa, Homo Sapiens
RSGSLLCTP

SEQ ID NO: 1202320 - protein, 9 aa, Homo Sapiens
CKNGSPQKG

SEQ ID NO: 1202321 - protein, 9 aa, Homo Sapiens
RQRRRRRRR

SEQ ID NO: 1202322 - protein, 9 aa, Homo Sapiens
AAPGAKAAA

SEQ ID NO: 1202323 - protein, 9 aa, Homo Sapiens
SKGEPGGGP

SEQ ID NO: 1202324 - protein, 9 aa, Homo Sapiens
LIVNPGTKS

SEQ ID NO: 1202325 - protein, 9 aa, Homo Sapiens
HLPAAPAAR

SEQ ID NO: 1202326 - protein, 9 aa, Homo Sapiens
NAAVALLMD

SEQ ID NO: 1202327 - protein, 9 aa, Homo Sapiens
GGRPRRALG

SEQ ID NO: 1202328 - protein, 9 aa, Homo Sapiens
QAVYCCKKC

SEQ ID NO: 1202329 - protein, 9 aa, Homo Sapiens
AVSNKFQDL

SEQ ID NO: 1202330 - protein, 9 aa, Homo Sapiens
VVGLRPVAH

SEQ ID NO: 1202331 - protein, 9 aa, Homo Sapiens
SRPCIWSCV

SEQ ID NO: 1202332 - protein, 9 aa, Homo Sapiens
GLGELKKLV

SEQ ID NO: 1202333 - protein, 9 aa, Homo Sapiens
MSVGPRSSS

SEQ ID NO: 1202334 - protein, 9 aa, Homo Sapiens
CHNHALHMP

SEQ ID NO: 1202335 - protein, 9 aa, Homo Sapiens
SISFISSSS

SEQ ID NO: 1202336 - protein, 9 aa, Homo Sapiens
RRPASPARR

SEQ ID NO: 1202337 - protein, 9 aa, Homo Sapiens
RPSCDMMEL

SEQ ID NO: 1202338 - protein, 9 aa, Homo Sapiens
CMCPIPPTK

SEQ ID NO: 1202339 - protein, 9 aa, Homo Sapiens
GGAAGQRTE

SEQ ID NO: 1202340 - protein, 9 aa, Homo Sapiens
GLFNMSQLL

SEQ ID NO: 1202341 - protein, 9 aa, Homo Sapiens
SRVIVASYD

SEQ ID NO: 1202342 - protein, 9 aa, Homo Sapiens
PPPTKKRGK

SEQ ID NO: 1202343 - protein, 9 aa, Homo Sapiens
RSLQGALGT

SEQ ID NO: 1202344 - protein, 9 aa, Homo Sapiens
EEKDSGGRR

SEQ ID NO: 1202345 - protein, 9 aa, Homo Sapiens
ACPSGSAPA

SEQ ID NO: 1202346 - protein, 9 aa, Homo Sapiens
HLGLPLILS

SEQ ID NO: 1202347 - protein, 9 aa, Homo Sapiens
INAGKSNWR

SEQ ID NO: 1202348 - protein, 9 aa, Homo Sapiens
LRLQTGTPR

SEQ ID NO: 1202349 - protein, 9 aa, Homo Sapiens
MSSVRSWCC

SEQ ID NO: 1202350 - protein, 9 aa, Homo Sapiens
VAAASLEPF

SEQ ID NO: 1202351 - protein, 9 aa, Homo Sapiens
PSALGPWGW

SEQ ID NO: 1202352 - protein, 9 aa, Homo Sapiens
MEWKIEGRL

SEQ ID NO: 1202353 - protein, 9 aa, Homo Sapiens
EHELKEKQR

SEQ ID NO: 1202354 - protein, 9 aa, Homo Sapiens
KFQREEQPL

SEQ ID NO: 1202355 - protein, 9 aa, Homo Sapiens
PSSLECTYI

SEQ ID NO: 1202356 - protein, 9 aa, Homo Sapiens
CAGGGVGEP

SEQ ID NO: 1202357 - protein, 9 aa, Homo Sapiens
RCLRMRPPR

SEQ ID NO: 1202358 - protein, 9 aa, Homo Sapiens
LHCPQAPHQ

SEQ ID NO: 1202359 - protein, 9 aa, Homo Sapiens
ESRHPSRPS

SEQ ID NO: 1202360 - protein, 9 aa, Homo Sapiens
NGNLKWHYY

SEQ ID NO: 1202361 - protein, 9 aa, Homo Sapiens
GRATLLFLI

SEQ ID NO: 1202362 - protein, 9 aa, Homo Sapiens
FLGSNQLPV

SEQ ID NO: 1202363 - protein, 9 aa, Homo Sapiens
PGSAPSMPA

SEQ ID NO: 1202364 - protein, 9 aa, Homo Sapiens
SPTPVHRPP

SEQ ID NO: 1202365 - protein, 9 aa, Homo Sapiens
DKRIAKHVA

SEQ ID NO: 1202366 - protein, 9 aa, Homo Sapiens
PATAAANEL

SEQ ID NO: 1202367 - protein, 9 aa, Homo Sapiens
RRWATWLSL

SEQ ID NO: 1202368 - protein, 9 aa, Homo Sapiens
LYGLEVTLI

SEQ ID NO: 1202369 - protein, 9 aa, Homo Sapiens
MDKIFRQDS

SEQ ID NO: 1202370 - protein, 9 aa, Homo Sapiens
LPCPPRVTP

SEQ ID NO: 1202371 - protein, 9 aa, Homo Sapiens
QEHELKEKQ

SEQ ID NO: 1202372 - protein, 9 aa, Homo Sapiens
STCGTLSPR

SEQ ID NO: 1202373 - protein, 9 aa, Homo Sapiens
RTAETRVPG

SEQ ID NO: 1202374 - protein, 9 aa, Homo Sapiens
LEKETCMSC

SEQ ID NO: 1202375 - protein, 9 aa, Homo Sapiens
VGVARRRRR

SEQ ID NO: 1202376 - protein, 9 aa, Homo Sapiens
RLDGRSLQG

SEQ ID NO: 1202377 - protein, 9 aa, Homo Sapiens
CSEGMSPLT

SEQ ID NO: 1202378 - protein, 9 aa, Homo Sapiens
SRRGGGGGS

SEQ ID NO: 1202379 - protein, 9 aa, Homo Sapiens
EHFIGNMLL

SEQ ID NO: 1202380 - protein, 9 aa, Homo Sapiens
QQQQQSQQP

SEQ ID NO: 1202381 - protein, 9 aa, Homo Sapiens
ESTHTSEFK

SEQ ID NO: 1202382 - protein, 9 aa, Homo Sapiens
PADPYSSCA

SEQ ID NO: 1202383 - protein, 9 aa, Homo Sapiens
VADGQAALV

SEQ ID NO: 1202384 - protein, 9 aa, Homo Sapiens
FHLTPEPVP

SEQ ID NO: 1202385 - protein, 9 aa, Homo Sapiens
VLDVFASGS

SEQ ID NO: 1202386 - protein, 9 aa, Homo Sapiens
ENKVKNLTD

SEQ ID NO: 1202387 - protein, 9 aa, Homo Sapiens
YLANHQRIH

SEQ ID NO: 1202388 - protein, 9 aa, Homo Sapiens
AVVEQAAEG

SEQ ID NO: 1202389 - protein, 9 aa, Homo Sapiens
WKMHVSFLN

SEQ ID NO: 1202390 - protein, 9 aa, Homo Sapiens
TMMEGAVLP

SEQ ID NO: 1202391 - protein, 9 aa, Homo Sapiens
QAMQKRHLH

SEQ ID NO: 1202392 - protein, 9 aa, Homo Sapiens
PPTLWTLCS

SEQ ID NO: 1202393 - protein, 9 aa, Homo Sapiens
AVYCCKKCT

SEQ ID NO: 1202394 - protein, 9 aa, Homo Sapiens
EAQRLLAAV

SEQ ID NO: 1202395 - protein, 9 aa, Homo Sapiens
LGRVDGNFL

SEQ ID NO: 1202396 - protein, 9 aa, Homo Sapiens
KPQDPNVLD

SEQ ID NO: 1202397 - protein, 9 aa, Homo Sapiens
HPKGHRGHH

SEQ ID NO: 1202398 - protein, 9 aa, Homo Sapiens
QLPSLEALA

SEQ ID NO: 1202399 - protein, 9 aa, Homo Sapiens
GGGEMGPGP

SEQ ID NO: 1202400 - protein, 9 aa, Homo Sapiens
GFVEFVLHL

SEQ ID NO: 1202401 - protein, 9 aa, Homo Sapiens
TSLALSMMP

SEQ ID NO: 1202402 - protein, 9 aa, Homo Sapiens
TPTEPPLPT

SEQ ID NO: 1202403 - protein, 9 aa, Homo Sapiens
ITRLEILEI

SEQ ID NO: 1202404 - protein, 9 aa, Homo Sapiens
FADLHALRA

SEQ ID NO: 1202405 - protein, 9 aa, Homo Sapiens
PNDRCFGIL

SEQ ID NO: 1202406 - protein, 9 aa, Homo Sapiens
EIHFVKPDT

SEQ ID NO: 1202407 - protein, 9 aa, Homo Sapiens
LPAPSPAPQ

SEQ ID NO: 1202408 - protein, 9 aa, Homo Sapiens
SLLSLYSVA

SEQ ID NO: 1202409 - protein, 9 aa, Homo Sapiens
MVRVGSCVD

SEQ ID NO: 1202410 - protein, 9 aa, Homo Sapiens
HLQYRPAQH

SEQ ID NO: 1202411 - protein, 9 aa, Homo Sapiens
PVSLHERPE

SEQ ID NO: 1202412 - protein, 9 aa, Homo Sapiens
FILFHPSLL

SEQ ID NO: 1202413 - protein, 9 aa, Homo Sapiens
MGKRVNLEC

SEQ ID NO: 1202414 - protein, 9 aa, Homo Sapiens
HEAGGDLRR

SEQ ID NO: 1202415 - protein, 9 aa, Homo Sapiens
RFTVRTCVC

SEQ ID NO: 1202416 - protein, 9 aa, Homo Sapiens
DVASPQSDW

SEQ ID NO: 1202417 - protein, 9 aa, Homo Sapiens
DIVDVGLAG

SEQ ID NO: 1202418 - protein, 9 aa, Homo Sapiens
SSSTLERVS

SEQ ID NO: 1202419 - protein, 9 aa, Homo Sapiens
YGTIKGLIT

SEQ ID NO: 1202420 - protein, 9 aa, Homo Sapiens
FRWRVSSSQ

SEQ ID NO: 1202421 - protein, 9 aa, Homo Sapiens
CWAAPVITS

SEQ ID NO: 1202422 - protein, 9 aa, Homo Sapiens
SVSRDGGWG

SEQ ID NO: 1202423 - protein, 9 aa, Homo Sapiens
PAVDGHEQQ

SEQ ID NO: 1202424 - protein, 9 aa, Homo Sapiens
QKRFHQQLN

SEQ ID NO: 1202425 - protein, 9 aa, Homo Sapiens
RVNLQHVDS

SEQ ID NO: 1202426 - protein, 9 aa, Homo Sapiens
ATFPHVQRG

SEQ ID NO: 1202427 - protein, 9 aa, Homo Sapiens
GPVETDGRK

SEQ ID NO: 1202428 - protein, 9 aa, Homo Sapiens
VLIGSFIAF

SEQ ID NO: 1202429 - protein, 9 aa, Homo Sapiens
RCISSGWRH

SEQ ID NO: 1202430 - protein, 9 aa, Homo Sapiens
YVAIVHHNQ

SEQ ID NO: 1202431 - protein, 9 aa, Homo Sapiens
NSPLAMALC

SEQ ID NO: 1202432 - protein, 9 aa, Homo Sapiens
LHKVLRPFY

SEQ ID NO: 1202433 - protein, 9 aa, Homo Sapiens
KYQPTIQTH

SEQ ID NO: 1202434 - protein, 9 aa, Homo Sapiens
HKTYDTTVD

SEQ ID NO: 1202435 - protein, 9 aa, Homo Sapiens
ARLLSERGA

SEQ ID NO: 1202436 - protein, 9 aa, Homo Sapiens
SVLATGLHL

SEQ ID NO: 1202437 - protein, 9 aa, Homo Sapiens
NMGNDDPEM

SEQ ID NO: 1202438 - protein, 9 aa, Homo Sapiens
GWPGLKPRR

SEQ ID NO: 1202439 - protein, 9 aa, Homo Sapiens
RRPKATSQS

SEQ ID NO: 1202440 - protein, 9 aa, Homo Sapiens
WMSGKQRED

SEQ ID NO: 1202441 - protein, 9 aa, Homo Sapiens
REVRRVAPH

SEQ ID NO: 1202442 - protein, 9 aa, Homo Sapiens
AMVYVLKRQ

SEQ ID NO: 1202443 - protein, 9 aa, Homo Sapiens
GLLLYYQRR

SEQ ID NO: 1202444 - protein, 9 aa, Homo Sapiens
QKCMVSINV

SEQ ID NO: 1202445 - protein, 9 aa, Homo Sapiens
LPRSTCTLW

SEQ ID NO: 1202446 - protein, 9 aa, Homo Sapiens
DSGGRRPNI

SEQ ID NO: 1202447 - protein, 9 aa, Homo Sapiens
RSRYVWLRQ

SEQ ID NO: 1202448 - protein, 9 aa, Homo Sapiens
DGQLFPVPG

SEQ ID NO: 1202449 - protein, 9 aa, Homo Sapiens
NTTRHGQSG

SEQ ID NO: 1202450 - protein, 9 aa, Homo Sapiens
FSEREHSLD

SEQ ID NO: 1202451 - protein, 9 aa, Homo Sapiens
PCFHGQTIK

SEQ ID NO: 1202452 - protein, 9 aa, Homo Sapiens
GAQGMILVY

SEQ ID NO: 1202453 - protein, 9 aa, Homo Sapiens
CCEPATCPA

SEQ ID NO: 1202454 - protein, 9 aa, Homo Sapiens
YMWSFCFSP

SEQ ID NO: 1202455 - protein, 9 aa, Homo Sapiens
ADSGRPRMA

SEQ ID NO: 1202456 - protein, 9 aa, Homo Sapiens
TCMCTHIHL

SEQ ID NO: 1202457 - protein, 9 aa, Homo Sapiens
KKLVETHIH

SEQ ID NO: 1202458 - protein, 9 aa, Homo Sapiens
HVCPWLQWP

SEQ ID NO: 1202459 - protein, 9 aa, Homo Sapiens
SCGCSKGGR

SEQ ID NO: 1202460 - protein, 9 aa, Homo Sapiens
DMQLGRLYM

SEQ ID NO: 1202461 - protein, 9 aa, Homo Sapiens
PAWILYQGQ

SEQ ID NO: 1202462 - protein, 9 aa, Homo Sapiens
RRAAGAHGL

SEQ ID NO: 1202463 - protein, 9 aa, Homo Sapiens
MREVAEAAA

SEQ ID NO: 1202464 - protein, 9 aa, Homo Sapiens
GVIPPPPPP

SEQ ID NO: 1202465 - protein, 9 aa, Homo Sapiens
WSDGVPCSM

SEQ ID NO: 1202466 - protein, 9 aa, Homo Sapiens
ADDPMFDLS

SEQ ID NO: 1202467 - protein, 9 aa, Homo Sapiens
CYSSVDPKR

SEQ ID NO: 1202468 - protein, 9 aa, Homo Sapiens
PTRAHSRSA

SEQ ID NO: 1202469 - protein, 9 aa, Homo Sapiens
VGVCMLMTS

SEQ ID NO: 1202470 - protein, 9 aa, Homo Sapiens
TVQRTDPMS

SEQ ID NO: 1202471 - protein, 9 aa, Homo Sapiens
TDPMSRYRF

SEQ ID NO: 1202472 - protein, 9 aa, Homo Sapiens
FTVQRTDPM

SEQ ID NO: 1202473 - protein, 9 aa, Homo Sapiens
KVGVCMLMT

SEQ ID NO: 1202474 - protein, 9 aa, Homo Sapiens
AAKVGVCML

SEQ ID NO: 1202475 - protein, 9 aa, Homo Sapiens
QRTDPMSRY

SEQ ID NO: 1202476 - protein, 9 aa, Homo Sapiens
LMAAKVGVC

SEQ ID NO: 1202477 - protein, 9 aa, Homo Sapiens
VQRTDPMSR

SEQ ID NO: 1202478 - protein, 9 aa, Homo Sapiens
GVCMLMTSD

SEQ ID NO: 1202479 - protein, 9 aa, Homo Sapiens
DPMSRYRFT

SEQ ID NO: 1202480 - protein, 9 aa, Homo Sapiens
AKVGVCMLM

SEQ ID NO: 1202481 - protein, 9 aa, Homo Sapiens
PMSRYRFTL

SEQ ID NO: 1202482 - protein, 9 aa, Homo Sapiens
MSRYRFTLS

SEQ ID NO: 1202483 - protein, 9 aa, Homo Sapiens
RTDPMSRYR

SEQ ID NO: 1202484 - protein, 9 aa, Homo Sapiens
MAAKVGVCM

SEQ ID NO: 1202485 - protein, 9 aa, Homo Sapiens
KTKESIVEE

SEQ ID NO: 1202486 - protein, 9 aa, Homo Sapiens
VLAAGEEGG

SEQ ID NO: 1202487 - protein, 9 aa, Homo Sapiens
FTVIPDSTQ

SEQ ID NO: 1202488 - protein, 9 aa, Homo Sapiens
DDQDDLKRC

SEQ ID NO: 1202489 - protein, 9 aa, Homo Sapiens
LRPGTRAAF

SEQ ID NO: 1202490 - protein, 9 aa, Homo Sapiens
VSDLVAQYV

SEQ ID NO: 1202491 - protein, 9 aa, Homo Sapiens
WILKKIKCL

SEQ ID NO: 1202492 - protein, 9 aa, Homo Sapiens
SIPVSQICK

SEQ ID NO: 1202493 - protein, 9 aa, Homo Sapiens
AVLAAGEEG

SEQ ID NO: 1202494 - protein, 9 aa, Homo Sapiens
AAGEEGGAG

SEQ ID NO: 1202495 - protein, 9 aa, Homo Sapiens
TLRPGTRAA

SEQ ID NO: 1202496 - protein, 9 aa, Homo Sapiens
NMKTKESIV

SEQ ID NO: 1202497 - protein, 9 aa, Homo Sapiens
SIVEEANKA

SEQ ID NO: 1202498 - protein, 9 aa, Homo Sapiens
HLPLERINV

SEQ ID NO: 1202499 - protein, 9 aa, Homo Sapiens
GLPGVVTLQ

SEQ ID NO: 1202500 - protein, 9 aa, Homo Sapiens
LERINVHHR

SEQ ID NO: 1202501 - protein, 9 aa, Homo Sapiens
RGRACFCAL

SEQ ID NO: 1202502 - protein, 9 aa, Homo Sapiens
LRAAAEAAL

SEQ ID NO: 1202503 - protein, 9 aa, Homo Sapiens
TKESIVEEA

SEQ ID NO: 1202504 - protein, 9 aa, Homo Sapiens
LKKIKCLQS

SEQ ID NO: 1202505 - protein, 9 aa, Homo Sapiens
EALEGLPGV

SEQ ID NO: 1202506 - protein, 9 aa, Homo Sapiens
SSIPVSQIC

SEQ ID NO: 1202507 - protein, 9 aa, Homo Sapiens
SHLPLERIN

SEQ ID NO: 1202508 - protein, 9 aa, Homo Sapiens
DQDDLKRCS

SEQ ID NO: 1202509 - protein, 9 aa, Homo Sapiens
KKIKCLQSG

SEQ ID NO: 1202510 - protein, 9 aa, Homo Sapiens
ESIVEEANK

SEQ ID NO: 1202511 - protein, 9 aa, Homo Sapiens
SQICKSPNE

SEQ ID NO: 1202512 - protein, 9 aa, Homo Sapiens
ILKKIKCLQ

SEQ ID NO: 1202513 - protein, 9 aa, Homo Sapiens
DDLKRCSMS

SEQ ID NO: 1202514 - protein, 9 aa, Homo Sapiens
RINVHHREA

SEQ ID NO: 1202515 - protein, 9 aa, Homo Sapiens
GRACFCALL

SEQ ID NO: 1202516 - protein, 9 aa, Homo Sapiens
DIRGRACFC

SEQ ID NO: 1202517 - protein, 9 aa, Homo Sapiens
IKCLQSGGL

SEQ ID NO: 1202518 - protein, 9 aa, Homo Sapiens
PLERINVHH

SEQ ID NO: 1202519 - protein, 9 aa, Homo Sapiens
TVIPDSTQK

SEQ ID NO: 1202520 - protein, 9 aa, Homo Sapiens
QICKSPNER

SEQ ID NO: 1202521 - protein, 9 aa, Homo Sapiens
DGADEFTVI

SEQ ID NO: 1202522 - protein, 9 aa, Homo Sapiens
ADEFTVIPD

SEQ ID NO: 1202523 - protein, 9 aa, Homo Sapiens
INVHHREAS

SEQ ID NO: 1202524 - protein, 9 aa, Homo Sapiens
VSQICKSPN

SEQ ID NO: 1202525 - protein, 9 aa, Homo Sapiens
LEGLPGVVT

SEQ ID NO: 1202526 - protein, 9 aa, Homo Sapiens
LKRCSMSID

SEQ ID NO: 1202527 - protein, 9 aa, Homo Sapiens
EAALSQTGF

SEQ ID NO: 1202528 - protein, 9 aa, Homo Sapiens
DLKRCSMSI

SEQ ID NO: 1202529 - protein, 9 aa, Homo Sapiens
PPDIRGRAC

SEQ ID NO: 1202530 - protein, 9 aa, Homo Sapiens
LRTLVSDLV

SEQ ID NO: 1202531 - protein, 9 aa, Homo Sapiens
DILRTLVSD

SEQ ID NO: 1202532 - protein, 9 aa, Homo Sapiens
FSSIPVSQI

SEQ ID NO: 1202533 - protein, 9 aa, Homo Sapiens
ALEGLPGVV

SEQ ID NO: 1202534 - protein, 9 aa, Homo Sapiens
TFSSIPVSQ

SEQ ID NO: 1202535 - protein, 9 aa, Homo Sapiens
KESIVEEAN

SEQ ID NO: 1202536 - protein, 9 aa, Homo Sapiens
PVSQICKSP

SEQ ID NO: 1202537 - protein, 9 aa, Homo Sapiens
GVVTLQIGG

SEQ ID NO: 1202538 - protein, 9 aa, Homo Sapiens
DLNMKTKES

SEQ ID NO: 1202539 - protein, 9 aa, Homo Sapiens
CLQSGGLSA

SEQ ID NO: 1202540 - protein, 9 aa, Homo Sapiens
KRCSMSIDD

SEQ ID NO: 1202541 - protein, 9 aa, Homo Sapiens
LPLERINVH

SEQ ID NO: 1202542 - protein, 9 aa, Homo Sapiens
LSQTGFSYD

SEQ ID NO: 1202543 - protein, 9 aa, Homo Sapiens
FTLRPGTRA

SEQ ID NO: 1202544 - protein, 9 aa, Homo Sapiens
RAAAEAALS

SEQ ID NO: 1202545 - protein, 9 aa, Homo Sapiens
TDILRTLVS

SEQ ID NO: 1202546 - protein, 9 aa, Homo Sapiens
VVTLQIGGN

SEQ ID NO: 1202547 - protein, 9 aa, Homo Sapiens
DSHLPLERI

SEQ ID NO: 1202548 - protein, 9 aa, Homo Sapiens
PGTRAAFCY

SEQ ID NO: 1202549 - protein, 9 aa, Homo Sapiens
KWILKKIKC

SEQ ID NO: 1202550 - protein, 9 aa, Homo Sapiens
ERINVHHRE

SEQ ID NO: 1202551 - protein, 9 aa, Homo Sapiens
GADEFTVIP

SEQ ID NO: 1202552 - protein, 9 aa, Homo Sapiens
EDGADEFTV

SEQ ID NO: 1202553 - protein, 9 aa, Homo Sapiens
DEFTVIPDS

SEQ ID NO: 1202554 - protein, 9 aa, Homo Sapiens
ALSQTGFSY

SEQ ID NO: 1202555 - protein, 9 aa, Homo Sapiens
RPGTRAAFC

SEQ ID NO: 1202556 - protein, 9 aa, Homo Sapiens
RCSMSIDDT

SEQ ID NO: 1202557 - protein, 9 aa, Homo Sapiens
AALSQTGFS

SEQ ID NO: 1202558 - protein, 9 aa, Homo Sapiens
MKTKESIVE

SEQ ID NO: 1202559 - protein, 9 aa, Homo Sapiens
AAAEAALSQ

SEQ ID NO: 1202560 - protein, 9 aa, Homo Sapiens
RQSILFSTD

SEQ ID NO: 1202561 - protein, 9 aa, Homo Sapiens
AGEEGGAGG

SEQ ID NO: 1202562 - protein, 9 aa, Homo Sapiens
FTDILRTLV

SEQ ID NO: 1202563 - protein, 9 aa, Homo Sapiens
IRGRACFCA

SEQ ID NO: 1202564 - protein, 9 aa, Homo Sapiens
PDIRGRACF

SEQ ID NO: 1202565 - protein, 9 aa, Homo Sapiens
LVSDLVAQY

SEQ ID NO: 1202566 - protein, 9 aa, Homo Sapiens
KIKCLQSGG

SEQ ID NO: 1202567 - protein, 9 aa, Homo Sapiens
QDDLKRCSM

SEQ ID NO: 1202568 - protein, 9 aa, Homo Sapiens
GTRAAFCYQ

SEQ ID NO: 1202569 - protein, 9 aa, Homo Sapiens
TLVSDLVAQ

SEQ ID NO: 1202570 - protein, 9 aa, Homo Sapiens
PGVVTLQIG

SEQ ID NO: 1202571 - protein, 9 aa, Homo Sapiens
GEEGGAGGG

SEQ ID NO: 1202572 - protein, 9 aa, Homo Sapiens
IPVSQICKS

SEQ ID NO: 1202573 - protein, 9 aa, Homo Sapiens
TRAAFCYQI

SEQ ID NO: 1202574 - protein, 9 aa, Homo Sapiens
KCLQSGGLS

SEQ ID NO: 1202575 - protein, 9 aa, Homo Sapiens
LAAGEEGGA

SEQ ID NO: 1202576 - protein, 9 aa, Homo Sapiens
EEGGAGGGP

SEQ ID NO: 1202577 - protein, 9 aa, Homo Sapiens
LNMKTKESI

SEQ ID NO: 1202578 - protein, 9 aa, Homo Sapiens
LPGVVTLQI

SEQ ID NO: 1202579 - protein, 9 aa, Homo Sapiens
CSMSIDDTP

SEQ ID NO: 1202580 - protein, 9 aa, Homo Sapiens
RACFCALLN

SEQ ID NO: 1202581 - protein, 9 aa, Homo Sapiens
VIPDSTQKQ

SEQ ID NO: 1202582 - protein, 9 aa, Homo Sapiens
AAEAALSQT

SEQ ID NO: 1202583 - protein, 9 aa, Homo Sapiens
RTLVSDLVA

SEQ ID NO: 1202584 - protein, 9 aa, Homo Sapiens
EFTVIPDST

SEQ ID NO: 1202585 - protein, 9 aa, Homo Sapiens
EGLPGVVTL

SEQ ID NO: 1202586 - protein, 9 aa, Homo Sapiens
QSILFSTDV

SEQ ID NO: 1202587 - protein, 9 aa, Homo Sapiens
ILRTLVSDL

SEQ ID NO: 1202588 - protein, 9 aa, Homo Sapiens
EGGAGGGPG

SEQ ID NO: 1202589 - protein, 9 aa, Homo Sapiens
AEAALSQTG

SEQ ID NO: 1202590 - protein, 9 aa, Homo Sapiens
FLAYNCYGP

SEQ ID NO: 1202591 - protein, 9 aa, Homo Sapiens
GSGRGDERV

SEQ ID NO: 1202592 - protein, 9 aa, Homo Sapiens
RTTASEALQ

SEQ ID NO: 1202593 - protein, 9 aa, Homo Sapiens
CWWPLGTLG

SEQ ID NO: 1202594 - protein, 9 aa, Homo Sapiens
DPSRFRIER

SEQ ID NO: 1202595 - protein, 9 aa, Homo Sapiens
VKVLLTDMH

SEQ ID NO: 1202596 - protein, 9 aa, Homo Sapiens
SRKLPNGEL

SEQ ID NO: 1202597 - protein, 9 aa, Homo Sapiens
LMEARVRVL

SEQ ID NO: 1202598 - protein, 9 aa, Homo Sapiens
ERKSRTTAS

SEQ ID NO: 1202599 - protein, 9 aa, Homo Sapiens
SLPPEPPAG

SEQ ID NO: 1202600 - protein, 9 aa, Homo Sapiens
RFRIERVIG

SEQ ID NO: 1202601 - protein, 9 aa, Homo Sapiens
TCSLPLCWW

SEQ ID NO: 1202602 - protein, 9 aa, Homo Sapiens
CYGPGVSTD

SEQ ID NO: 1202603 - protein, 9 aa, Homo Sapiens
WWPLGTLGP

SEQ ID NO: 1202604 - protein, 9 aa, Homo Sapiens
PPGLMEARV

SEQ ID NO: 1202605 - protein, 9 aa, Homo Sapiens
DFFFRVVPS

SEQ ID NO: 1202606 - protein, 9 aa, Homo Sapiens
LWSRKLPNG

SEQ ID NO: 1202607 - protein, 9 aa, Homo Sapiens
SHCEEQLVK

SEQ ID NO: 1202608 - protein, 9 aa, Homo Sapiens
PGLMEARVR

SEQ ID NO: 1202609 - protein, 9 aa, Homo Sapiens
IVKVLLTDM

SEQ ID NO: 1202610 - protein, 9 aa, Homo Sapiens
EKAAAAEMA

SEQ ID NO: 1202611 - protein, 9 aa, Homo Sapiens
LRFLAYNCY

SEQ ID NO: 1202612 - protein, 9 aa, Homo Sapiens
FRIERVIGA

SEQ ID NO: 1202613 - protein, 9 aa, Homo Sapiens
DQEEEEEEK

SEQ ID NO: 1202614 - protein, 9 aa, Homo Sapiens
LSGSGRGDE

SEQ ID NO: 1202615 - protein, 9 aa, Homo Sapiens
KILWSRKLP

SEQ ID NO: 1202616 - protein, 9 aa, Homo Sapiens
HCEEQLVKM

SEQ ID NO: 1202617 - protein, 9 aa, Homo Sapiens
EEEEKAAAA

SEQ ID NO: 1202618 - protein, 9 aa, Homo Sapiens
IMKRNISHC

SEQ ID NO: 1202619 - protein, 9 aa, Homo Sapiens
QMYHYSCAA

SEQ ID NO: 1202620 - protein, 9 aa, Homo Sapiens
ISHCEEQLV

SEQ ID NO: 1202621 - protein, 9 aa, Homo Sapiens
LPPGLMEAR

SEQ ID NO: 1202622 - protein, 9 aa, Homo Sapiens
ARVRVLDPD

SEQ ID NO: 1202623 - protein, 9 aa, Homo Sapiens
IDPSRFRIE

SEQ ID NO: 1202624 - protein, 9 aa, Homo Sapiens
ILWSRKLPN

SEQ ID NO: 1202625 - protein, 9 aa, Homo Sapiens
RGDERVAFV

SEQ ID NO: 1202626 - protein, 9 aa, Homo Sapiens
KVLLTDMHL

SEQ ID NO: 1202627 - protein, 9 aa, Homo Sapiens
KMIVKVLLT

SEQ ID NO: 1202628 - protein, 9 aa, Homo Sapiens
GLMEARVRV

SEQ ID NO: 1202629 - protein, 9 aa, Homo Sapiens
LPPEPPAGR

SEQ ID NO: 1202630 - protein, 9 aa, Homo Sapiens
ALHLACASD

SEQ ID NO: 1202631 - protein, 9 aa, Homo Sapiens
KSRTTASEA

SEQ ID NO: 1202632 - protein, 9 aa, Homo Sapiens
EEEEEEKAA

SEQ ID NO: 1202633 - protein, 9 aa, Homo Sapiens
CASDHVKVV

SEQ ID NO: 1202634 - protein, 9 aa, Homo Sapiens
RKLPNGELQ

SEQ ID NO: 1202635 - protein, 9 aa, Homo Sapiens
CEEQLVKMF

SEQ ID NO: 1202636 - protein, 9 aa, Homo Sapiens
PLCWWPLGT

SEQ ID NO: 1202637 - protein, 9 aa, Homo Sapiens
NSRYDFFFR

SEQ ID NO: 1202638 - protein, 9 aa, Homo Sapiens
SRFRIERVI

SEQ ID NO: 1202639 - protein, 9 aa, Homo Sapiens
LHLACASDH

SEQ ID NO: 1202640 - protein, 9 aa, Homo Sapiens
LKMIVKVLL

SEQ ID NO: 1202641 - protein, 9 aa, Homo Sapiens
PSRFRIERV

SEQ ID NO: 1202642 - protein, 9 aa, Homo Sapiens
VKERKSRTT

SEQ ID NO: 1202643 - protein, 9 aa, Homo Sapiens
HLACASDHV

SEQ ID NO: 1202644 - protein, 9 aa, Homo Sapiens
DNSRYDFFF

SEQ ID NO: 1202645 - protein, 9 aa, Homo Sapiens
EPPAGRRHL

SEQ ID NO: 1202646 - protein, 9 aa, Homo Sapiens
TSLPPEPPA

SEQ ID NO: 1202647 - protein, 9 aa, Homo Sapiens
NISHCEEQL

SEQ ID NO: 1202648 - protein, 9 aa, Homo Sapiens
PTSLPPEPP

SEQ ID NO: 1202649 - protein, 9 aa, Homo Sapiens
RYDFFFRVV

SEQ ID NO: 1202650 - protein, 9 aa, Homo Sapiens
YHYSCAAGA

SEQ ID NO: 1202651 - protein, 9 aa, Homo Sapiens
SGRGDERVA

SEQ ID NO: 1202652 - protein, 9 aa, Homo Sapiens
EKLKMIVKV

SEQ ID NO: 1202653 - protein, 9 aa, Homo Sapiens
KERKSRTTA

SEQ ID NO: 1202654 - protein, 9 aa, Homo Sapiens
KLKMIVKVL

SEQ ID NO: 1202655 - protein, 9 aa, Homo Sapiens
SLRFLAYNC

SEQ ID NO: 1202656 - protein, 9 aa, Homo Sapiens
LAYNCYGPG

SEQ ID NO: 1202657 - protein, 9 aa, Homo Sapiens
EEKAAAAEM

SEQ ID NO: 1202658 - protein, 9 aa, Homo Sapiens
SHLSGSGRG

SEQ ID NO: 1202659 - protein, 9 aa, Homo Sapiens
WSRKLPNGE

SEQ ID NO: 1202660 - protein, 9 aa, Homo Sapiens
CEPTSLPPE

SEQ ID NO: 1202661 - protein, 9 aa, Homo Sapiens
SCAAGAGTF

SEQ ID NO: 1202662 - protein, 9 aa, Homo Sapiens
FFRVVPSDT

SEQ ID NO: 1202663 - protein, 9 aa, Homo Sapiens
AKEIDPSRF

SEQ ID NO: 1202664 - protein, 9 aa, Homo Sapiens
MKRNISHCE

SEQ ID NO: 1202665 - protein, 9 aa, Homo Sapiens
QEEEEEEKA

SEQ ID NO: 1202666 - protein, 9 aa, Homo Sapiens
SLPLCWWPL

SEQ ID NO: 1202667 - protein, 9 aa, Homo Sapiens
EARVRVLDP

SEQ ID NO: 1202668 - protein, 9 aa, Homo Sapiens
PPEPPAGRR

SEQ ID NO: 1202669 - protein, 9 aa, Homo Sapiens
TTASEALQH

SEQ ID NO: 1202670 - protein, 9 aa, Homo Sapiens
CSLPLCWWP

SEQ ID NO: 1202671 - protein, 9 aa, Homo Sapiens
EPTSLPPEP

SEQ ID NO: 1202672 - protein, 9 aa, Homo Sapiens
MYHYSCAAG

SEQ ID NO: 1202673 - protein, 9 aa, Homo Sapiens
ASDHVKVVT

SEQ ID NO: 1202674 - protein, 9 aa, Homo Sapiens
LVKERKSRT

SEQ ID NO: 1202675 - protein, 9 aa, Homo Sapiens
ACASDHVKV

SEQ ID NO: 1202676 - protein, 9 aa, Homo Sapiens
YDFFFRVVP

SEQ ID NO: 1202677 - protein, 9 aa, Homo Sapiens
GLYTDFVLA

SEQ ID NO: 1202678 - protein, 9 aa, Homo Sapiens
LCWWPLGTL

SEQ ID NO: 1202679 - protein, 9 aa, Homo Sapiens
DHVKVVTLL

SEQ ID NO: 1202680 - protein, 9 aa, Homo Sapiens
CTQMYHYSC

SEQ ID NO: 1202681 - protein, 9 aa, Homo Sapiens
VLLTDMHLP

SEQ ID NO: 1202682 - protein, 9 aa, Homo Sapiens
MIVKVLLTD

SEQ ID NO: 1202683 - protein, 9 aa, Homo Sapiens
YNCYGPGVS

SEQ ID NO: 1202684 - protein, 9 aa, Homo Sapiens
FRVVPSDTY

SEQ ID NO: 1202685 - protein, 9 aa, Homo Sapiens
EEEKAAAAE

SEQ ID NO: 1202686 - protein, 9 aa, Homo Sapiens
KLPNGELQP

SEQ ID NO: 1202687 - protein, 9 aa, Homo Sapiens
PEPPAGRRH

SEQ ID NO: 1202688 - protein, 9 aa, Homo Sapiens
TQMYHYSCA

SEQ ID NO: 1202689 - protein, 9 aa, Homo Sapiens
FFFRVVPSD

SEQ ID NO: 1202690 - protein, 9 aa, Homo Sapiens
LACASDHVK

SEQ ID NO: 1202691 - protein, 9 aa, Homo Sapiens
YTDFVLAEG

SEQ ID NO: 1202692 - protein, 9 aa, Homo Sapiens
EIDPSRFRI

SEQ ID NO: 1202693 - protein, 9 aa, Homo Sapiens
RKSRTTASE

SEQ ID NO: 1202694 - protein, 9 aa, Homo Sapiens
SGLYTDFVL

SEQ ID NO: 1202695 - protein, 9 aa, Homo Sapiens
KRNISHCEE

SEQ ID NO: 1202696 - protein, 9 aa, Homo Sapiens
YSCAAGAGT

SEQ ID NO: 1202697 - protein, 9 aa, Homo Sapiens
KCTQMYHYS

SEQ ID NO: 1202698 - protein, 9 aa, Homo Sapiens
RNISHCEEQ

SEQ ID NO: 1202699 - protein, 9 aa, Homo Sapiens
LPLCWWPLG

SEQ ID NO: 1202700 - protein, 9 aa, Homo Sapiens
SGSGRGDER

SEQ ID NO: 1202701 - protein, 9 aa, Homo Sapiens
KEIDPSRFR

SEQ ID NO: 1202702 - protein, 9 aa, Homo Sapiens
VTCSLPLCW

SEQ ID NO: 1202703 - protein, 9 aa, Homo Sapiens
SRYDFFFRV

SEQ ID NO: 1202704 - protein, 9 aa, Homo Sapiens
PKILWSRKL

SEQ ID NO: 1202705 - protein, 9 aa, Homo Sapiens
HSGLYTDFV

SEQ ID NO: 1202706 - protein, 9 aa, Homo Sapiens
GRGDERVAF

SEQ ID NO: 1202707 - protein, 9 aa, Homo Sapiens
LYTDFVLAE

SEQ ID NO: 1202708 - protein, 9 aa, Homo Sapiens
TDFVLAEGW

SEQ ID NO: 1202709 - protein, 9 aa, Homo Sapiens
APKILWSRK

SEQ ID NO: 1202710 - protein, 9 aa, Homo Sapiens
FHSGLYTDF

SEQ ID NO: 1202711 - protein, 9 aa, Homo Sapiens
DFVLAEGWF

SEQ ID NO: 1202712 - protein, 9 aa, Homo Sapiens
AYNCYGPGV

SEQ ID NO: 1202713 - protein, 9 aa, Homo Sapiens
KAAAAEMAV

SEQ ID NO: 1202714 - protein, 9 aa, Homo Sapiens
ISHLSGSGR

SEQ ID NO: 1202715 - protein, 9 aa, Homo Sapiens
QFHSGLYTD

SEQ ID NO: 1202716 - protein, 9 aa, Homo Sapiens
RVRVLDPDV

SEQ ID NO: 1202717 - protein, 9 aa, Homo Sapiens
SRTTASEAL

SEQ ID NO: 1202718 - protein, 9 aa, Homo Sapiens
MEARVRVLD

SEQ ID NO: 1202719 - protein, 9 aa, Homo Sapiens
EEEEEKAAA

SEQ ID NO: 1202720 - protein, 9 aa, Homo Sapiens
HYSCAAGAG

SEQ ID NO: 1202721 - protein, 9 aa, Homo Sapiens
NCYGPGVST

SEQ ID NO: 1202722 - protein, 9 aa, Homo Sapiens
RFLAYNCYG

SEQ ID NO: 1202723 - protein, 9 aa, Homo Sapiens
HLSGSGRGD

SEQ ID NO: 1202724 - protein, 9 aa, Homo Sapiens
SDHVKVVTL

SEQ ID NO: 1202725 - protein, 9 aa, Homo Sapiens
HCLLLPAHT

SEQ ID NO: 1202726 - protein, 9 aa, Homo Sapiens
HRHTGIHTD

SEQ ID NO: 1202727 - protein, 9 aa, Homo Sapiens
YIDSDCTGN

SEQ ID NO: 1202728 - protein, 9 aa, Homo Sapiens
VPRFLTCNL

SEQ ID NO: 1202729 - protein, 9 aa, Homo Sapiens
VVMGGKEDN

SEQ ID NO: 1202730 - protein, 9 aa, Homo Sapiens
NHKRMHTGE

SEQ ID NO: 1202731 - protein, 9 aa, Homo Sapiens
AHTGIHTDT

SEQ ID NO: 1202732 - protein, 9 aa, Homo Sapiens
FLTCNLAFA

SEQ ID NO: 1202733 - protein, 9 aa, Homo Sapiens
TGIHTDTHR

SEQ ID NO: 1202734 - protein, 9 aa, Homo Sapiens
RHTHTQAYT

SEQ ID NO: 1202735 - protein, 9 aa, Homo Sapiens
HRHTHTQAY

SEQ ID NO: 1202736 - protein, 9 aa, Homo Sapiens
TGMHRHTHT

SEQ ID NO: 1202737 - protein, 9 aa, Homo Sapiens
LNVPRFLTC

SEQ ID NO: 1202738 - protein, 9 aa, Homo Sapiens
AYTRECLGT

SEQ ID NO: 1202739 - protein, 9 aa, Homo Sapiens
TGNPDEDCE

SEQ ID NO: 1202740 - protein, 9 aa, Homo Sapiens
LAQEEEESG

SEQ ID NO: 1202741 - protein, 9 aa, Homo Sapiens
THTVVVMGG

SEQ ID NO: 1202742 - protein, 9 aa, Homo Sapiens
SHRHTHTHR

SEQ ID NO: 1202743 - protein, 9 aa, Homo Sapiens
AKRMWSLER

SEQ ID NO: 1202744 - protein, 9 aa, Homo Sapiens
ENLAASQGL

SEQ ID NO: 1202745 - protein, 9 aa, Homo Sapiens
HSRTHAYTR

SEQ ID NO: 1202746 - protein, 9 aa, Homo Sapiens
IHTDTHRNT

SEQ ID NO: 1202747 - protein, 9 aa, Homo Sapiens
HRHIHSRTH

SEQ ID NO: 1202748 - protein, 9 aa, Homo Sapiens
NLAASQGLA

SEQ ID NO: 1202749 - protein, 9 aa, Homo Sapiens
QEEEESGQE

SEQ ID NO: 1202750 - protein, 9 aa, Homo Sapiens
CTGNPDEDC

SEQ ID NO: 1202751 - protein, 9 aa, Homo Sapiens
TRECLGTHT

SEQ ID NO: 1202752 - protein, 9 aa, Homo Sapiens
HTGMHRHTH

SEQ ID NO: 1202753 - protein, 9 aa, Homo Sapiens
NPEDLQAAN

SEQ ID NO: 1202754 - protein, 9 aa, Homo Sapiens
AYTQTHIQA

SEQ ID NO: 1202755 - protein, 9 aa, Homo Sapiens
ECLGTHTVV

SEQ ID NO: 1202756 - protein, 9 aa, Homo Sapiens
LAASQGLAH

SEQ ID NO: 1202757 - protein, 9 aa, Homo Sapiens
THRHIHSRT

SEQ ID NO: 1202758 - protein, 9 aa, Homo Sapiens
GTHTVVVMG

SEQ ID NO: 1202759 - protein, 9 aa, Homo Sapiens
LLLPAHTLQ

SEQ ID NO: 1202760 - protein, 9 aa, Homo Sapiens
TRLLKSNNP

SEQ ID NO: 1202761 - protein, 9 aa, Homo Sapiens
QAHTGIHTD

SEQ ID NO: 1202762 - protein, 9 aa, Homo Sapiens
AASQGLAHM

SEQ ID NO: 1202763 - protein, 9 aa, Homo Sapiens
TCNLAFADF

SEQ ID NO: 1202764 - protein, 9 aa, Homo Sapiens
HTQAYTLTY

SEQ ID NO: 1202765 - protein, 9 aa, Homo Sapiens
NVPRFLTCN

SEQ ID NO: 1202766 - protein, 9 aa, Homo Sapiens
DSDCTGNPD

SEQ ID NO: 1202767 - protein, 9 aa, Homo Sapiens
LGTHTVVVM

SEQ ID NO: 1202768 - protein, 9 aa, Homo Sapiens
GMHRHTHTQ

SEQ ID NO: 1202769 - protein, 9 aa, Homo Sapiens
YTQTHIQAQ

SEQ ID NO: 1202770 - protein, 9 aa, Homo Sapiens
SDCTGNPDE

SEQ ID NO: 1202771 - protein, 9 aa, Homo Sapiens
THRHTQAYT

SEQ ID NO: 1202772 - protein, 9 aa, Homo Sapiens
AYTLTYTGT

SEQ ID NO: 1202773 - protein, 9 aa, Homo Sapiens
QTHIQAQTG

SEQ ID NO: 1202774 - protein, 9 aa, Homo Sapiens
LLKSNNPED

SEQ ID NO: 1202775 - protein, 9 aa, Homo Sapiens
ELAQEEEES

SEQ ID NO: 1202776 - protein, 9 aa, Homo Sapiens
TGTHRHTHT

SEQ ID NO: 1202777 - protein, 9 aa, Homo Sapiens
MWSLERRLA

SEQ ID NO: 1202778 - protein, 9 aa, Homo Sapiens
RECLGTHTV

SEQ ID NO: 1202779 - protein, 9 aa, Homo Sapiens
RHTGIHTDT

SEQ ID NO: 1202780 - protein, 9 aa, Homo Sapiens
SQGLAHMIA

SEQ ID NO: 1202781 - protein, 9 aa, Homo Sapiens
HRHTQAYTQ

SEQ ID NO: 1202782 - protein, 9 aa, Homo Sapiens
PHCLLLPAH

SEQ ID NO: 1202783 - protein, 9 aa, Homo Sapiens
RFLTCNLAF

SEQ ID NO: 1202784 - protein, 9 aa, Homo Sapiens
LTNHKRMHT

SEQ ID NO: 1202785 - protein, 9 aa, Homo Sapiens
RLLKSNNPE

SEQ ID NO: 1202786 - protein, 9 aa, Homo Sapiens
TDTHRNTQA

SEQ ID NO: 1202787 - protein, 9 aa, Homo Sapiens
LGLAKRMWS

SEQ ID NO: 1202788 - protein, 9 aa, Homo Sapiens
DCTGNPDED

SEQ ID NO: 1202789 - protein, 9 aa, Homo Sapiens
RMWSLERRL

SEQ ID NO: 1202790 - protein, 9 aa, Homo Sapiens
VMGGKEDNG

SEQ ID NO: 1202791 - protein, 9 aa, Homo Sapiens
LTLGLAKRM

SEQ ID NO: 1202792 - protein, 9 aa, Homo Sapiens
TDTHSHRHT

SEQ ID NO: 1202793 - protein, 9 aa, Homo Sapiens
DPHCLLLPA

SEQ ID NO: 1202794 - protein, 9 aa, Homo Sapiens
HRYTHRHTQ

SEQ ID NO: 1202795 - protein, 9 aa, Homo Sapiens
THRHTGIHT

SEQ ID NO: 1202796 - protein, 9 aa, Homo Sapiens
HAYTRECLG

SEQ ID NO: 1202797 - protein, 9 aa, Homo Sapiens
IDSDCTGNP

SEQ ID NO: 1202798 - protein, 9 aa, Homo Sapiens
GGKEDNGYL

SEQ ID NO: 1202799 - protein, 9 aa, Homo Sapiens
THRHTHTHR

SEQ ID NO: 1202800 - protein, 9 aa, Homo Sapiens
HIQAQTGTH

SEQ ID NO: 1202801 - protein, 9 aa, Homo Sapiens
NGYLLEKKI

SEQ ID NO: 1202802 - protein, 9 aa, Homo Sapiens
KRMWSLERR

SEQ ID NO: 1202803 - protein, 9 aa, Homo Sapiens
LTYTGTHRH

SEQ ID NO: 1202804 - protein, 9 aa, Homo Sapiens
THRYTHRHT

SEQ ID NO: 1202805 - protein, 9 aa, Homo Sapiens
THTHRHTGI

SEQ ID NO: 1202806 - protein, 9 aa, Homo Sapiens
GEYIDSDCT

SEQ ID NO: 1202807 - protein, 9 aa, Homo Sapiens
DTHSHRHTH

SEQ ID NO: 1202808 - protein, 9 aa, Homo Sapiens
ASQGLAHMI

SEQ ID NO: 1202809 - protein, 9 aa, Homo Sapiens
TQAHTGIHT

SEQ ID NO: 1202810 - protein, 9 aa, Homo Sapiens
GTHRHTHTH

SEQ ID NO: 1202811 - protein, 9 aa, Homo Sapiens
MHRHTHTQA

SEQ ID NO: 1202812 - protein, 9 aa, Homo Sapiens
RYTHRHTQA

SEQ ID NO: 1202813 - protein, 9 aa, Homo Sapiens
GIHTDTHRN

SEQ ID NO: 1202814 - protein, 9 aa, Homo Sapiens
KLNVPRFLT

SEQ ID NO: 1202815 - protein, 9 aa, Homo Sapiens
QAQTGTHRH

SEQ ID NO: 1202816 - protein, 9 aa, Homo Sapiens
TNHKRMHTG

SEQ ID NO: 1202817 - protein, 9 aa, Homo Sapiens
IHSRTHAYT

SEQ ID NO: 1202818 - protein, 9 aa, Homo Sapiens
HTHTHRHTG

SEQ ID NO: 1202819 - protein, 9 aa, Homo Sapiens
LPAHTLQGE

SEQ ID NO: 1202820 - protein, 9 aa, Homo Sapiens
HTHTQAYTL

SEQ ID NO: 1202821 - protein, 9 aa, Homo Sapiens
THTHRYTHR

SEQ ID NO: 1202822 - protein, 9 aa, Homo Sapiens
SNNPEDLQA

SEQ ID NO: 1202823 - protein, 9 aa, Homo Sapiens
TVVVMGGKE

SEQ ID NO: 1202824 - protein, 9 aa, Homo Sapiens
HTHRHTGIH

SEQ ID NO: 1202825 - protein, 9 aa, Homo Sapiens
EYIDSDCTG

SEQ ID NO: 1202826 - protein, 9 aa, Homo Sapiens
RHTHTHRHT

SEQ ID NO: 1202827 - protein, 9 aa, Homo Sapiens
HTDTDTHSH

SEQ ID NO: 1202828 - protein, 9 aa, Homo Sapiens
RHTGMHRHT

SEQ ID NO: 1202829 - protein, 9 aa, Homo Sapiens
TQAYTQTHI

SEQ ID NO: 1202830 - protein, 9 aa, Homo Sapiens
RHIHSRTHA

SEQ ID NO: 1202831 - protein, 9 aa, Homo Sapiens
QAYTQTHIQ

SEQ ID NO: 1202832 - protein, 9 aa, Homo Sapiens
EDNGYLLEK

SEQ ID NO: 1202833 - protein, 9 aa, Homo Sapiens
SILTNHKRM

SEQ ID NO: 1202834 - protein, 9 aa, Homo Sapiens
RHTHTHRYT

SEQ ID NO: 1202835 - protein, 9 aa, Homo Sapiens
THRNTQAHT

SEQ ID NO: 1202836 - protein, 9 aa, Homo Sapiens
IQAQTGTHR

SEQ ID NO: 1202837 - protein, 9 aa, Homo Sapiens
CLLLPAHTL

SEQ ID NO: 1202838 - protein, 9 aa, Homo Sapiens
TQAYTLTYT

SEQ ID NO: 1202839 - protein, 9 aa, Homo Sapiens
DTDTHSHRH

SEQ ID NO: 1202840 - protein, 9 aa, Homo Sapiens
HTDTHRNTQ

SEQ ID NO: 1202841 - protein, 9 aa, Homo Sapiens
HTHTHRYTH

SEQ ID NO: 1202842 - protein, 9 aa, Homo Sapiens
PRFLTCNLA

SEQ ID NO: 1202843 - protein, 9 aa, Homo Sapiens
HTHRYTHRH

SEQ ID NO: 1202844 - protein, 9 aa, Homo Sapiens
SRTHAYTRE

SEQ ID NO: 1202845 - protein, 9 aa, Homo Sapiens
ILTNHKRMH

SEQ ID NO: 1202846 - protein, 9 aa, Homo Sapiens
THAYTRECL

SEQ ID NO: 1202847 - protein, 9 aa, Homo Sapiens
MGGKEDNGY

SEQ ID NO: 1202848 - protein, 9 aa, Homo Sapiens
GLAKRMWSL

SEQ ID NO: 1202849 - protein, 9 aa, Homo Sapiens
THTQAYTLT

SEQ ID NO: 1202850 - protein, 9 aa, Homo Sapiens
NTQAHTGIH

SEQ ID NO: 1202851 - protein, 9 aa, Homo Sapiens
YTGTHRHTH

SEQ ID NO: 1202852 - protein, 9 aa, Homo Sapiens
LTCNLAFAD

SEQ ID NO: 1202853 - protein, 9 aa, Homo Sapiens
HTVVVMGGK

SEQ ID NO: 1202854 - protein, 9 aa, Homo Sapiens
TGIHTDTDT

SEQ ID NO: 1202855 - protein, 9 aa, Homo Sapiens
RTHAYTREC

SEQ ID NO: 1202856 - protein, 9 aa, Homo Sapiens
HRNTQAHTG

SEQ ID NO: 1202857 - protein, 9 aa, Homo Sapiens
HTGIHTDTD

SEQ ID NO: 1202858 - protein, 9 aa, Homo Sapiens
CLGTHTVVV

SEQ ID NO: 1202859 - protein, 9 aa, Homo Sapiens
GTHRHIHSR

SEQ ID NO: 1202860 - protein, 9 aa, Homo Sapiens
TYTGTHRHT

SEQ ID NO: 1202861 - protein, 9 aa, Homo Sapiens
QTGTHRHIH

SEQ ID NO: 1202862 - protein, 9 aa, Homo Sapiens
NENLAASQG

SEQ ID NO: 1202863 - protein, 9 aa, Homo Sapiens
HTGIHTDTH

SEQ ID NO: 1202864 - protein, 9 aa, Homo Sapiens
RDEEEEEEG

SEQ ID NO: 1202865 - protein, 9 aa, Homo Sapiens
NNPEDLQAA

SEQ ID NO: 1202866 - protein, 9 aa, Homo Sapiens
LKSNNPEDL

SEQ ID NO: 1202867 - protein, 9 aa, Homo Sapiens
AQTGTHRHI

SEQ ID NO: 1202868 - protein, 9 aa, Homo Sapiens
YTLTYTGTH

SEQ ID NO: 1202869 - protein, 9 aa, Homo Sapiens
HTQAYTQTH

SEQ ID NO: 1202870 - protein, 9 aa, Homo Sapiens
TLTYTGTHR

SEQ ID NO: 1202871 - protein, 9 aa, Homo Sapiens
KSNNPEDLQ

SEQ ID NO: 1202872 - protein, 9 aa, Homo Sapiens
KEDNGYLLE

SEQ ID NO: 1202873 - protein, 9 aa, Homo Sapiens
LAKRMWSLE

SEQ ID NO: 1202874 - protein, 9 aa, Homo Sapiens
HRHTHTHRY

SEQ ID NO: 1202875 - protein, 9 aa, Homo Sapiens
AQEEEESGQ

SEQ ID NO: 1202876 - protein, 9 aa, Homo Sapiens
DEEEEEEGM

SEQ ID NO: 1202877 - protein, 9 aa, Homo Sapiens
YTHRHTQAY

SEQ ID NO: 1202878 - protein, 9 aa, Homo Sapiens
HRHTHTHRH

SEQ ID NO: 1202879 - protein, 9 aa, Homo Sapiens
IHTDTDTHS

SEQ ID NO: 1202880 - protein, 9 aa, Homo Sapiens
LNENLAASQ

SEQ ID NO: 1202881 - protein, 9 aa, Homo Sapiens
THIQAQTGT

SEQ ID NO: 1202882 - protein, 9 aa, Homo Sapiens
HSHRHTHTH

SEQ ID NO: 1202883 - protein, 9 aa, Homo Sapiens
DNGYLLEKK

SEQ ID NO: 1202884 - protein, 9 aa, Homo Sapiens
QAYTLTYTG

SEQ ID NO: 1202885 - protein, 9 aa, Homo Sapiens
HIHSRTHAY

SEQ ID NO: 1202886 - protein, 9 aa, Homo Sapiens
THSHRHTHT

SEQ ID NO: 1202887 - protein, 9 aa, Homo Sapiens
LTRLLKSNN

SEQ ID NO: 1202888 - protein, 9 aa, Homo Sapiens
RHTQAYTQT

SEQ ID NO: 1202889 - protein, 9 aa, Homo Sapiens
TGTHRHIHS

SEQ ID NO: 1202890 - protein, 9 aa, Homo Sapiens
YTRECLGTH

SEQ ID NO: 1202891 - protein, 9 aa, Homo Sapiens
DTHRNTQAH

SEQ ID NO: 1202892 - protein, 9 aa, Homo Sapiens
GIHTDTDTH

SEQ ID NO: 1202893 - protein, 9 aa, Homo Sapiens
TQTHIQAQT

SEQ ID NO: 1202894 - protein, 9 aa, Homo Sapiens
TDTDTHSHR

SEQ ID NO: 1202895 - protein, 9 aa, Homo Sapiens
DLNENLAAS

SEQ ID NO: 1202896 - protein, 9 aa, Homo Sapiens
RNTQAHTGI

SEQ ID NO: 1202897 - protein, 9 aa, Homo Sapiens
TLGLAKRMW

SEQ ID NO: 1202898 - protein, 9 aa, Homo Sapiens
GYLLEKKIY

SEQ ID NO: 1202899 - protein, 9 aa, Homo Sapiens
LLPAHTLQG

SEQ ID NO: 1202900 - protein, 9 aa, Homo Sapiens
GKEDNGYLL

SEQ ID NO: 1202901 - protein, 9 aa, Homo Sapiens
HRHTGMHRH

SEQ ID NO: 1202902 - protein, 9 aa, Homo Sapiens
VVVMGGKED

SEQ ID NO: 1202903 - protein, 9 aa, Homo Sapiens
PTGMMLPGD

SEQ ID NO: 1202904 - protein, 9 aa, Homo Sapiens
QPSLSHRRN

SEQ ID NO: 1202905 - protein, 9 aa, Homo Sapiens
GPHQQSHQQ

SEQ ID NO: 1202906 - protein, 9 aa, Homo Sapiens
LARAWKQMC

SEQ ID NO: 1202907 - protein, 9 aa, Homo Sapiens
HRVELRPTM

SEQ ID NO: 1202908 - protein, 9 aa, Homo Sapiens
NQQEIYQEL

SEQ ID NO: 1202909 - protein, 9 aa, Homo Sapiens
LSHRRNREL

SEQ ID NO: 1202910 - protein, 9 aa, Homo Sapiens
QQSHQQSTR

SEQ ID NO: 1202911 - protein, 9 aa, Homo Sapiens
LELKPLSED

SEQ ID NO: 1202912 - protein, 9 aa, Homo Sapiens
PQEHPGLGG

SEQ ID NO: 1202913 - protein, 9 aa, Homo Sapiens
VPGVFSRSV

SEQ ID NO: 1202914 - protein, 9 aa, Homo Sapiens
REEVPGVFS

SEQ ID NO: 1202915 - protein, 9 aa, Homo Sapiens
ELRPTMLSE

SEQ ID NO: 1202916 - protein, 9 aa, Homo Sapiens
HQQSHQQST

SEQ ID NO: 1202917 - protein, 9 aa, Homo Sapiens
SNQQEIYQE

SEQ ID NO: 1202918 - protein, 9 aa, Homo Sapiens
LNQIVTEPH

SEQ ID NO: 1202919 - protein, 9 aa, Homo Sapiens
SSSSSGDTS

SEQ ID NO: 1202920 - protein, 9 aa, Homo Sapiens
TMLSEERAL

SEQ ID NO: 1202921 - protein, 9 aa, Homo Sapiens
EKADLLELK

SEQ ID NO: 1202922 - protein, 9 aa, Homo Sapiens
AHQPSLSHR

SEQ ID NO: 1202923 - protein, 9 aa, Homo Sapiens
KQMCWFYYQ

SEQ ID NO: 1202924 - protein, 9 aa, Homo Sapiens
LREEVPGVF

SEQ ID NO: 1202925 - protein, 9 aa, Homo Sapiens
SGDTSSTGE

SEQ ID NO: 1202926 - protein, 9 aa, Homo Sapiens
SSSSGDTSS

SEQ ID NO: 1202927 - protein, 9 aa, Homo Sapiens
ELPEKSNQQ

SEQ ID NO: 1202928 - protein, 9 aa, Homo Sapiens
VELRPTMLS

SEQ ID NO: 1202929 - protein, 9 aa, Homo Sapiens
RPTMLSEER

SEQ ID NO: 1202930 - protein, 9 aa, Homo Sapiens
MHQQQQQQM

SEQ ID NO: 1202931 - protein, 9 aa, Homo Sapiens
MVSSRQRRL

SEQ ID NO: 1202932 - protein, 9 aa, Homo Sapiens
GSSSSSGDT

SEQ ID NO: 1202933 - protein, 9 aa, Homo Sapiens
APAAMVSSR

SEQ ID NO: 1202934 - protein, 9 aa, Homo Sapiens
GDTSSTGEE

SEQ ID NO: 1202935 - protein, 9 aa, Homo Sapiens
GGEAVGTGE

SEQ ID NO: 1202936 - protein, 9 aa, Homo Sapiens
AWKQMCWFY

SEQ ID NO: 1202937 - protein, 9 aa, Homo Sapiens
AAMVSSRQR

SEQ ID NO: 1202938 - protein, 9 aa, Homo Sapiens
EPHANFPQF

SEQ ID NO: 1202939 - protein, 9 aa, Homo Sapiens
PGDLGSTVW

SEQ ID NO: 1202940 - protein, 9 aa, Homo Sapiens
GIVAPAAMV

SEQ ID NO: 1202941 - protein, 9 aa, Homo Sapiens
LKPLSEDFV

SEQ ID NO: 1202942 - protein, 9 aa, Homo Sapiens
HQQQQQQMQ

SEQ ID NO: 1202943 - protein, 9 aa, Homo Sapiens
TPTGMMLPG

SEQ ID NO: 1202944 - protein, 9 aa, Homo Sapiens
EKSNQQEIY

SEQ ID NO: 1202945 - protein, 9 aa, Homo Sapiens
VGELPEKSN

SEQ ID NO: 1202946 - protein, 9 aa, Homo Sapiens
SHRRNRELK

SEQ ID NO: 1202947 - protein, 9 aa, Homo Sapiens
GLGGEAVGT

SEQ ID NO: 1202948 - protein, 9 aa, Homo Sapiens
ELKPLSEDF

SEQ ID NO: 1202949 - protein, 9 aa, Homo Sapiens
HPGLGGEAV

SEQ ID NO: 1202950 - protein, 9 aa, Homo Sapiens
HANFPQFLH

SEQ ID NO: 1202951 - protein, 9 aa, Homo Sapiens
HRRNRELKT

SEQ ID NO: 1202952 - protein, 9 aa, Homo Sapiens
SLSHRRNRE

SEQ ID NO: 1202953 - protein, 9 aa, Homo Sapiens
SGSSSSSGD

SEQ ID NO: 1202954 - protein, 9 aa, Homo Sapiens
QMCWFYYQY

SEQ ID NO: 1202955 - protein, 9 aa, Homo Sapiens
ADLLELKPL

SEQ ID NO: 1202956 - protein, 9 aa, Homo Sapiens
DLLELKPLS

SEQ ID NO: 1202957 - protein, 9 aa, Homo Sapiens
QSHQQSTRG

SEQ ID NO: 1202958 - protein, 9 aa, Homo Sapiens
LGGEAVGTG

SEQ ID NO: 1202959 - protein, 9 aa, Homo Sapiens
VTEPHANFP

SEQ ID NO: 1202960 - protein, 9 aa, Homo Sapiens
KADLLELKP

SEQ ID NO: 1202961 - protein, 9 aa, Homo Sapiens
TEPHANFPQ

SEQ ID NO: 1202962 - protein, 9 aa, Homo Sapiens
IVTEPHANF

SEQ ID NO: 1202963 - protein, 9 aa, Homo Sapiens
EVPGVFSRS

SEQ ID NO: 1202964 - protein, 9 aa, Homo Sapiens
KSNQQEIYQ

SEQ ID NO: 1202965 - protein, 9 aa, Homo Sapiens
GMMLPGDLG

SEQ ID NO: 1202966 - protein, 9 aa, Homo Sapiens
SHQQSTRGR

SEQ ID NO: 1202967 - protein, 9 aa, Homo Sapiens
TPQEHPGLG

SEQ ID NO: 1202968 - protein, 9 aa, Homo Sapiens
MLSEERALR

SEQ ID NO: 1202969 - protein, 9 aa, Homo Sapiens
CWFYYQYLL

SEQ ID NO: 1202970 - protein, 9 aa, Homo Sapiens
VSSRQRRLS

SEQ ID NO: 1202971 - protein, 9 aa, Homo Sapiens
LLELKPLSE

SEQ ID NO: 1202972 - protein, 9 aa, Homo Sapiens
PHQQSHQQS

SEQ ID NO: 1202973 - protein, 9 aa, Homo Sapiens
PEKSNQQEI

SEQ ID NO: 1202974 - protein, 9 aa, Homo Sapiens
NQIVTEPHA

SEQ ID NO: 1202975 - protein, 9 aa, Homo Sapiens
HQPSLSHRR

SEQ ID NO: 1202976 - protein, 9 aa, Homo Sapiens
HQQSTRGRS

SEQ ID NO: 1202977 - protein, 9 aa, Homo Sapiens
EHPGLGGEA

SEQ ID NO: 1202978 - protein, 9 aa, Homo Sapiens
QSTRGRSAG

SEQ ID NO: 1202979 - protein, 9 aa, Homo Sapiens
WKQMCWFYY

SEQ ID NO: 1202980 - protein, 9 aa, Homo Sapiens
PTMLSEERA

SEQ ID NO: 1202981 - protein, 9 aa, Homo Sapiens
SSGDTSSTG

SEQ ID NO: 1202982 - protein, 9 aa, Homo Sapiens
MMLPGDLGS

SEQ ID NO: 1202983 - protein, 9 aa, Homo Sapiens
MLPGDLGST

SEQ ID NO: 1202984 - protein, 9 aa, Homo Sapiens
PHANFPQFL

SEQ ID NO: 1202985 - protein, 9 aa, Homo Sapiens
AMVSSRQRR

SEQ ID NO: 1202986 - protein, 9 aa, Homo Sapiens
RRNRELKTL

SEQ ID NO: 1202987 - protein, 9 aa, Homo Sapiens
KPLSEDFVW

SEQ ID NO: 1202988 - protein, 9 aa, Homo Sapiens
LRPTMLSEE

SEQ ID NO: 1202989 - protein, 9 aa, Homo Sapiens
RAWKQMCWF

SEQ ID NO: 1202990 - protein, 9 aa, Homo Sapiens
EEVPGVFSR

SEQ ID NO: 1202991 - protein, 9 aa, Homo Sapiens
LPEKSNQQE

SEQ ID NO: 1202992 - protein, 9 aa, Homo Sapiens
GSGSSSSSG

SEQ ID NO: 1202993 - protein, 9 aa, Homo Sapiens
TGMMLPGDL

SEQ ID NO: 1202994 - protein, 9 aa, Homo Sapiens
LPGDLGSTV

SEQ ID NO: 1202995 - protein, 9 aa, Homo Sapiens
QEHPGLGGE

SEQ ID NO: 1202996 - protein, 9 aa, Homo Sapiens
IVAPAAMVS

SEQ ID NO: 1202997 - protein, 9 aa, Homo Sapiens
VAPAAMVSS

SEQ ID NO: 1202998 - protein, 9 aa, Homo Sapiens
PGLGGEAVG

SEQ ID NO: 1202999 - protein, 9 aa, Homo Sapiens
PAAMVSSRQ

SEQ ID NO: 1203000 - protein, 9 aa, Homo Sapiens
GELPEKSNQ

SEQ ID NO: 1203001 - protein, 9 aa, Homo Sapiens
PSLSHRRNR

SEQ ID NO: 1203002 - protein, 9 aa, Homo Sapiens
MCWFYYQYL

SEQ ID NO: 1203003 - protein, 9 aa, Homo Sapiens
QIVTEPHAN

SEQ ID NO: 1203004 - protein, 9 aa, Homo Sapiens
SSSGDTSST

SEQ ID NO: 1203005 - protein, 9 aa, Homo Sapiens
ARAWKQMCW

SEQ ID NO: 1203006 - protein, 9 aa, Homo Sapiens
QQSTRGRSA

SEQ ID NO: 1203007 - protein, 9 aa, Homo Sapiens
GDLGSTVWL

SEQ ID NO: 1203008 - protein, 9 aa, Homo Sapiens
RVELRPTML

SEQ ID NO: 1203009 - protein, 9 aa, Homo Sapiens
AASQDPAGV

SEQ ID NO: 1203010 - protein, 9 aa, Homo Sapiens
HLVDHFFCE

SEQ ID NO: 1203011 - protein, 9 aa, Homo Sapiens
NLEEYAVSL

SEQ ID NO: 1203012 - protein, 9 aa, Homo Sapiens
LCGHHLVDH

SEQ ID NO: 1203013 - protein, 9 aa, Homo Sapiens
FQIHSIVLS

SEQ ID NO: 1203014 - protein, 9 aa, Homo Sapiens
KWKEEEEAR

SEQ ID NO: 1203015 - protein, 9 aa, Homo Sapiens
ASQDPAGVQ

SEQ ID NO: 1203016 - protein, 9 aa, Homo Sapiens
EAEAAAASQ

SEQ ID NO: 1203017 - protein, 9 aa, Homo Sapiens
MEEEEEQKW

SEQ ID NO: 1203018 - protein, 9 aa, Homo Sapiens
IVLSTFASL

SEQ ID NO: 1203019 - protein, 9 aa, Homo Sapiens
SIVLSTFAS

SEQ ID NO: 1203020 - protein, 9 aa, Homo Sapiens
EEAEAAAAS

SEQ ID NO: 1203021 - protein, 9 aa, Homo Sapiens
VLEMNLEEY

SEQ ID NO: 1203022 - protein, 9 aa, Homo Sapiens
EQKWKEEEE

SEQ ID NO: 1203023 - protein, 9 aa, Homo Sapiens
PFQIHSIVL

SEQ ID NO: 1203024 - protein, 9 aa, Homo Sapiens
QKWKEEEEA

SEQ ID NO: 1203025 - protein, 9 aa, Homo Sapiens
AAAASQDPA

SEQ ID NO: 1203026 - protein, 9 aa, Homo Sapiens
FWVPLCGHH

SEQ ID NO: 1203027 - protein, 9 aa, Homo Sapiens
HHLVDHFFC

SEQ ID NO: 1203028 - protein, 9 aa, Homo Sapiens
LRFQGDSCL

SEQ ID NO: 1203029 - protein, 9 aa, Homo Sapiens
QIHSIVLST

SEQ ID NO: 1203030 - protein, 9 aa, Homo Sapiens
PLCGHHLVD

SEQ ID NO: 1203031 - protein, 9 aa, Homo Sapiens
SCLEQSGCY

SEQ ID NO: 1203032 - protein, 9 aa, Homo Sapiens
EMNLEEYAV

SEQ ID NO: 1203033 - protein, 9 aa, Homo Sapiens
LEEYAVSLL

SEQ ID NO: 1203034 - protein, 9 aa, Homo Sapiens
EEEEQKWKE

SEQ ID NO: 1203035 - protein, 9 aa, Homo Sapiens
CGHHLVDHF

SEQ ID NO: 1203036 - protein, 9 aa, Homo Sapiens
EYAVSLLRL

SEQ ID NO: 1203037 - protein, 9 aa, Homo Sapiens
YPFQIHSIV

SEQ ID NO: 1203038 - protein, 9 aa, Homo Sapiens
HSIVLSTFA

SEQ ID NO: 1203039 - protein, 9 aa, Homo Sapiens
DSCLEQSGC

SEQ ID NO: 1203040 - protein, 9 aa, Homo Sapiens
EEEQKWKEE

SEQ ID NO: 1203041 - protein, 9 aa, Homo Sapiens
EAAAASQDP

SEQ ID NO: 1203042 - protein, 9 aa, Homo Sapiens
PLRFQGDSC

SEQ ID NO: 1203043 - protein, 9 aa, Homo Sapiens
WVPLCGHHL

SEQ ID NO: 1203044 - protein, 9 aa, Homo Sapiens
VLSTFASLI

SEQ ID NO: 1203045 - protein, 9 aa, Homo Sapiens
GDSCLEQSG

SEQ ID NO: 1203046 - protein, 9 aa, Homo Sapiens
CLEQSGCYH

SEQ ID NO: 1203047 - protein, 9 aa, Homo Sapiens
MNLEEYAVS

SEQ ID NO: 1203048 - protein, 9 aa, Homo Sapiens
KMEEEEEQK

SEQ ID NO: 1203049 - protein, 9 aa, Homo Sapiens
EEYAVSLLR

SEQ ID NO: 1203050 - protein, 9 aa, Homo Sapiens
LEMNLEEYA

SEQ ID NO: 1203051 - protein, 9 aa, Homo Sapiens
GHHLVDHFF

SEQ ID NO: 1203052 - protein, 9 aa, Homo Sapiens
AAASQDPAG

SEQ ID NO: 1203053 - protein, 9 aa, Homo Sapiens
SQDPAGVQW

SEQ ID NO: 1203054 - protein, 9 aa, Homo Sapiens
AVLEMNLEE

SEQ ID NO: 1203055 - protein, 9 aa, Homo Sapiens
EEEEEQKWK

SEQ ID NO: 1203056 - protein, 9 aa, Homo Sapiens
VPLCGHHLV

SEQ ID NO: 1203057 - protein, 9 aa, Homo Sapiens
RFQGDSCLE

SEQ ID NO: 1203058 - protein, 9 aa, Homo Sapiens
FQGDSCLEQ

SEQ ID NO: 1203059 - protein, 9 aa, Homo Sapiens
EEQKWKEEE

SEQ ID NO: 1203060 - protein, 9 aa, Homo Sapiens
AEAAAASQD

SEQ ID NO: 1203061 - protein, 9 aa, Homo Sapiens
QGDSCLEQS

SEQ ID NO: 1203062 - protein, 9 aa, Homo Sapiens
IHSIVLSTF

SEQ ID NO: 1203063 - protein, 9 aa, Homo Sapiens
MNKGKAIFQ

SEQ ID NO: 1203064 - protein, 9 aa, Homo Sapiens
QKLRRACLV

SEQ ID NO: 1203065 - protein, 9 aa, Homo Sapiens
VLSHLPSHH

SEQ ID NO: 1203066 - protein, 9 aa, Homo Sapiens
IGDFGLATE

SEQ ID NO: 1203067 - protein, 9 aa, Homo Sapiens
LTAIDRYIY

SEQ ID NO: 1203068 - protein, 9 aa, Homo Sapiens
WRARSTSTS

SEQ ID NO: 1203069 - protein, 9 aa, Homo Sapiens
CKEAINVLS

SEQ ID NO: 1203070 - protein, 9 aa, Homo Sapiens
KAIFQFSAT

SEQ ID NO: 1203071 - protein, 9 aa, Homo Sapiens
FQFSATSAL

SEQ ID NO: 1203072 - protein, 9 aa, Homo Sapiens
THTHTWRAR

SEQ ID NO: 1203073 - protein, 9 aa, Homo Sapiens
THTHTHTLT

SEQ ID NO: 1203074 - protein, 9 aa, Homo Sapiens
VFSQIMNPE

SEQ ID NO: 1203075 - protein, 9 aa, Homo Sapiens
TLLVSRKCQ

SEQ ID NO: 1203076 - protein, 9 aa, Homo Sapiens
YIYIHRPLA

SEQ ID NO: 1203077 - protein, 9 aa, Homo Sapiens
TWRARSTST

SEQ ID NO: 1203078 - protein, 9 aa, Homo Sapiens
TAIDRYIYI

SEQ ID NO: 1203079 - protein, 9 aa, Homo Sapiens
HTHTLTHTH

SEQ ID NO: 1203080 - protein, 9 aa, Homo Sapiens
RKASIQQKL

SEQ ID NO: 1203081 - protein, 9 aa, Homo Sapiens
GNTFSQSCS

SEQ ID NO: 1203082 - protein, 9 aa, Homo Sapiens
RARSTSTST

SEQ ID NO: 1203083 - protein, 9 aa, Homo Sapiens
AIFQFSATS

SEQ ID NO: 1203084 - protein, 9 aa, Homo Sapiens
QRKASIQQK

SEQ ID NO: 1203085 - protein, 9 aa, Homo Sapiens
SKQEAWSTH

SEQ ID NO: 1203086 - protein, 9 aa, Homo Sapiens
KAVSVFSQI

SEQ ID NO: 1203087 - protein, 9 aa, Homo Sapiens
QEAWSTHNT

SEQ ID NO: 1203088 - protein, 9 aa, Homo Sapiens
KGKAIFQFS

SEQ ID NO: 1203089 - protein, 9 aa, Homo Sapiens
AINVLSHLP

SEQ ID NO: 1203090 - protein, 9 aa, Homo Sapiens
THTLTHTHT

SEQ ID NO: 1203091 - protein, 9 aa, Homo Sapiens
LATEKSRWS

SEQ ID NO: 1203092 - protein, 9 aa, Homo Sapiens
PGRPRSKQE

SEQ ID NO: 1203093 - protein, 9 aa, Homo Sapiens
IQQKLRRAC

SEQ ID NO: 1203094 - protein, 9 aa, Homo Sapiens
VSRKCQIDI

SEQ ID NO: 1203095 - protein, 9 aa, Homo Sapiens
NTFSQSCSL

SEQ ID NO: 1203096 - protein, 9 aa, Homo Sapiens
CDDCGNTFS

SEQ ID NO: 1203097 - protein, 9 aa, Homo Sapiens
EAWSTHNTV

SEQ ID NO: 1203098 - protein, 9 aa, Homo Sapiens
AVSVFSQIM

SEQ ID NO: 1203099 - protein, 9 aa, Homo Sapiens
HTLTHTHTW

SEQ ID NO: 1203100 - protein, 9 aa, Homo Sapiens
AIDRYIYIH

SEQ ID NO: 1203101 - protein, 9 aa, Homo Sapiens
LVSRKCQID

SEQ ID NO: 1203102 - protein, 9 aa, Homo Sapiens
GRPRSKQEA

SEQ ID NO: 1203103 - protein, 9 aa, Homo Sapiens
VSVFSQIMN

SEQ ID NO: 1203104 - protein, 9 aa, Homo Sapiens
IHTHTHTHT

SEQ ID NO: 1203105 - protein, 9 aa, Homo Sapiens
NKGKAIFQF

SEQ ID NO: 1203106 - protein, 9 aa, Homo Sapiens
EAINVLSHL

SEQ ID NO: 1203107 - protein, 9 aa, Homo Sapiens
QFSATSALY

SEQ ID NO: 1203108 - protein, 9 aa, Homo Sapiens
YNCKEAINV

SEQ ID NO: 1203109 - protein, 9 aa, Homo Sapiens
EKSRWSGSH

SEQ ID NO: 1203110 - protein, 9 aa, Homo Sapiens
HTWRARSTS

SEQ ID NO: 1203111 - protein, 9 aa, Homo Sapiens
RSTSTSTIS

SEQ ID NO: 1203112 - protein, 9 aa, Homo Sapiens
KQEAWSTHN

SEQ ID NO: 1203113 - protein, 9 aa, Homo Sapiens
IFQFSATSA

SEQ ID NO: 1203114 - protein, 9 aa, Homo Sapiens
LLVSRKCQI

SEQ ID NO: 1203115 - protein, 9 aa, Homo Sapiens
LTHTHTWRA

SEQ ID NO: 1203116 - protein, 9 aa, Homo Sapiens
GLATEKSRW

SEQ ID NO: 1203117 - protein, 9 aa, Homo Sapiens
MAKAVSVFS

SEQ ID NO: 1203118 - protein, 9 aa, Homo Sapiens
GDFGLATEK

SEQ ID NO: 1203119 - protein, 9 aa, Homo Sapiens
KVVTLLVSR

SEQ ID NO: 1203120 - protein, 9 aa, Homo Sapiens
CGNTFSQSC

SEQ ID NO: 1203121 - protein, 9 aa, Homo Sapiens
ECDDCGNTF

SEQ ID NO: 1203122 - protein, 9 aa, Homo Sapiens
HTHTHTHTL

SEQ ID NO: 1203123 - protein, 9 aa, Homo Sapiens
GKAIFQFSA

SEQ ID NO: 1203124 - protein, 9 aa, Homo Sapiens
DDCGNTFSQ

SEQ ID NO: 1203125 - protein, 9 aa, Homo Sapiens
QQKLRRACL

SEQ ID NO: 1203126 - protein, 9 aa, Homo Sapiens
DFGLATEKS

SEQ ID NO: 1203127 - protein, 9 aa, Homo Sapiens
SRKCQIDIY

SEQ ID NO: 1203128 - protein, 9 aa, Homo Sapiens
ARSTSTSTI

SEQ ID NO: 1203129 - protein, 9 aa, Homo Sapiens
AKAVSVFSQ

SEQ ID NO: 1203130 - protein, 9 aa, Homo Sapiens
THTWRARST

SEQ ID NO: 1203131 - protein, 9 aa, Homo Sapiens
EMAKAVSVF

SEQ ID NO: 1203132 - protein, 9 aa, Homo Sapiens
INVLSHLPS

SEQ ID NO: 1203133 - protein, 9 aa, Homo Sapiens
NEMAKAVSV

SEQ ID NO: 1203134 - protein, 9 aa, Homo Sapiens
SVFSQIMNP

SEQ ID NO: 1203135 - protein, 9 aa, Homo Sapiens
RYIYIHRPL

SEQ ID NO: 1203136 - protein, 9 aa, Homo Sapiens
VTLLVSRKC

SEQ ID NO: 1203137 - protein, 9 aa, Homo Sapiens
TLTHTHTWR

SEQ ID NO: 1203138 - protein, 9 aa, Homo Sapiens
PRSKQEAWS

SEQ ID NO: 1203139 - protein, 9 aa, Homo Sapiens
RPRSKQEAW

SEQ ID NO: 1203140 - protein, 9 aa, Homo Sapiens
IDRYIYIHR

SEQ ID NO: 1203141 - protein, 9 aa, Homo Sapiens
RSKQEAWST

SEQ ID NO: 1203142 - protein, 9 aa, Homo Sapiens
VKVVTLLVS

SEQ ID NO: 1203143 - protein, 9 aa, Homo Sapiens
YECDDCGNT

SEQ ID NO: 1203144 - protein, 9 aa, Homo Sapiens
KASIQQKLR

SEQ ID NO: 1203145 - protein, 9 aa, Homo Sapiens
KQRKASIQQ

SEQ ID NO: 1203146 - protein, 9 aa, Homo Sapiens
YIHRPLAYK

SEQ ID NO: 1203147 - protein, 9 aa, Homo Sapiens
TEKSRWSGS

SEQ ID NO: 1203148 - protein, 9 aa, Homo Sapiens
PYECDDCGN

SEQ ID NO: 1203149 - protein, 9 aa, Homo Sapiens
IYIHRPLAY

SEQ ID NO: 1203150 - protein, 9 aa, Homo Sapiens
ATEKSRWSG

SEQ ID NO: 1203151 - protein, 9 aa, Homo Sapiens
DCGNTFSQS

SEQ ID NO: 1203152 - protein, 9 aa, Homo Sapiens
SIQQKLRRA

SEQ ID NO: 1203153 - protein, 9 aa, Homo Sapiens
NCKEAINVL

SEQ ID NO: 1203154 - protein, 9 aa, Homo Sapiens
HTHTHTLTH

SEQ ID NO: 1203155 - protein, 9 aa, Homo Sapiens
VVTLLVSRK

SEQ ID NO: 1203156 - protein, 9 aa, Homo Sapiens
STSTSTISA

SEQ ID NO: 1203157 - protein, 9 aa, Homo Sapiens
KEAINVLSH

SEQ ID NO: 1203158 - protein, 9 aa, Homo Sapiens
THTHTLTHT

SEQ ID NO: 1203159 - protein, 9 aa, Homo Sapiens
FGLATEKSR

SEQ ID NO: 1203160 - protein, 9 aa, Homo Sapiens
HTHTWRARS

SEQ ID NO: 1203161 - protein, 9 aa, Homo Sapiens
DRYIYIHRP

SEQ ID NO: 1203162 - protein, 9 aa, Homo Sapiens
ASIQQKLRR

SEQ ID NO: 1203163 - protein, 9 aa, Homo Sapiens
NVLSHLPSH

SEQ ID NO: 1203164 - protein, 9 aa, Homo Sapiens
LGGPASLSP

SEQ ID NO: 1203165 - protein, 9 aa, Homo Sapiens
GPPEVPAEP

SEQ ID NO: 1203166 - protein, 9 aa, Homo Sapiens
LDVVRKEGE

SEQ ID NO: 1203167 - protein, 9 aa, Homo Sapiens
QAGSSHDVK

SEQ ID NO: 1203168 - protein, 9 aa, Homo Sapiens
PASLSPLTP

SEQ ID NO: 1203169 - protein, 9 aa, Homo Sapiens
LLGGPASLS

SEQ ID NO: 1203170 - protein, 9 aa, Homo Sapiens
KDLRENFCW

SEQ ID NO: 1203171 - protein, 9 aa, Homo Sapiens
FCWNPDGSE

SEQ ID NO: 1203172 - protein, 9 aa, Homo Sapiens
HVHRAASEG

SEQ ID NO: 1203173 - protein, 9 aa, Homo Sapiens
RSLLGGPAS

SEQ ID NO: 1203174 - protein, 9 aa, Homo Sapiens
SRRLLAKDP

SEQ ID NO: 1203175 - protein, 9 aa, Homo Sapiens
LRENFCWNP

SEQ ID NO: 1203176 - protein, 9 aa, Homo Sapiens
VPAEPDHDG

SEQ ID NO: 1203177 - protein, 9 aa, Homo Sapiens
HLPLERINV

SEQ ID NO: 1203178 - protein, 9 aa, Homo Sapiens
WNPDGSEAP

SEQ ID NO: 1203179 - protein, 9 aa, Homo Sapiens
HMMYTFSLA

SEQ ID NO: 1203180 - protein, 9 aa, Homo Sapiens
LERINVHHR

SEQ ID NO: 1203181 - protein, 9 aa, Homo Sapiens
AGPPEVPAE

SEQ ID NO: 1203182 - protein, 9 aa, Homo Sapiens
MMYTFSLAT

SEQ ID NO: 1203183 - protein, 9 aa, Homo Sapiens
GALPGQAGS

SEQ ID NO: 1203184 - protein, 9 aa, Homo Sapiens
AGWFSRRLL

SEQ ID NO: 1203185 - protein, 9 aa, Homo Sapiens
SHLPLERIN

SEQ ID NO: 1203186 - protein, 9 aa, Homo Sapiens
RENFCWNPD

SEQ ID NO: 1203187 - protein, 9 aa, Homo Sapiens
LGIFDDAGW

SEQ ID NO: 1203188 - protein, 9 aa, Homo Sapiens
HRAASEGKN

SEQ ID NO: 1203189 - protein, 9 aa, Homo Sapiens
RKLGIFDDA

SEQ ID NO: 1203190 - protein, 9 aa, Homo Sapiens
RRLLAKDPE

SEQ ID NO: 1203191 - protein, 9 aa, Homo Sapiens
LELANCKFG

SEQ ID NO: 1203192 - protein, 9 aa, Homo Sapiens
GSSHDVKPF

SEQ ID NO: 1203193 - protein, 9 aa, Homo Sapiens
MAAAAGAAV

SEQ ID NO: 1203194 - protein, 9 aa, Homo Sapiens
SLLGGPASL

SEQ ID NO: 1203195 - protein, 9 aa, Homo Sapiens
VVMAAAAGA

SEQ ID NO: 1203196 - protein, 9 aa, Homo Sapiens
PLERINVHH

SEQ ID NO: 1203197 - protein, 9 aa, Homo Sapiens
DDAGWFSRR

SEQ ID NO: 1203198 - protein, 9 aa, Homo Sapiens
WQHLELANC

SEQ ID NO: 1203199 - protein, 9 aa, Homo Sapiens
KHMMYTFSL

SEQ ID NO: 1203200 - protein, 9 aa, Homo Sapiens
INVHHREAS

SEQ ID NO: 1203201 - protein, 9 aa, Homo Sapiens
VHRAASEGK

SEQ ID NO: 1203202 - protein, 9 aa, Homo Sapiens
PQQQQQHGV

SEQ ID NO: 1203203 - protein, 9 aa, Homo Sapiens
AGAGPPEVP

SEQ ID NO: 1203204 - protein, 9 aa, Homo Sapiens
RSRKLGIFD

SEQ ID NO: 1203205 - protein, 9 aa, Homo Sapiens
EVVMAAAAG

SEQ ID NO: 1203206 - protein, 9 aa, Homo Sapiens
VRKEGESCD

SEQ ID NO: 1203207 - protein, 9 aa, Homo Sapiens
VLDVVRKEG

SEQ ID NO: 1203208 - protein, 9 aa, Homo Sapiens
ASLSPLTPS

SEQ ID NO: 1203209 - protein, 9 aa, Homo Sapiens
VKHMMYTFS

SEQ ID NO: 1203210 - protein, 9 aa, Homo Sapiens
HLELANCKF

SEQ ID NO: 1203211 - protein, 9 aa, Homo Sapiens
GGPASLSPL

SEQ ID NO: 1203212 - protein, 9 aa, Homo Sapiens
AVILCHVHR

SEQ ID NO: 1203213 - protein, 9 aa, Homo Sapiens
PGQAGSSHD

SEQ ID NO: 1203214 - protein, 9 aa, Homo Sapiens
AGSSHDVKP

SEQ ID NO: 1203215 - protein, 9 aa, Homo Sapiens
QQPQQQQQH

SEQ ID NO: 1203216 - protein, 9 aa, Homo Sapiens
WVKHMMYTF

SEQ ID NO: 1203217 - protein, 9 aa, Homo Sapiens
LPLERINVH

SEQ ID NO: 1203218 - protein, 9 aa, Homo Sapiens
SRKLGIFDD

SEQ ID NO: 1203219 - protein, 9 aa, Homo Sapiens
GIFDDAGWF

SEQ ID NO: 1203220 - protein, 9 aa, Homo Sapiens
LCHVHRAAS

SEQ ID NO: 1203221 - protein, 9 aa, Homo Sapiens
NFCWNPDGS

SEQ ID NO: 1203222 - protein, 9 aa, Homo Sapiens
LPGQAGSSH

SEQ ID NO: 1203223 - protein, 9 aa, Homo Sapiens
KLGIFDDAG

SEQ ID NO: 1203224 - protein, 9 aa, Homo Sapiens
CHVHRAASE

SEQ ID NO: 1203225 - protein, 9 aa, Homo Sapiens
VMAAAAGAA

SEQ ID NO: 1203226 - protein, 9 aa, Homo Sapiens
EGESCDCLQ

SEQ ID NO: 1203227 - protein, 9 aa, Homo Sapiens
DSHLPLERI

SEQ ID NO: 1203228 - protein, 9 aa, Homo Sapiens
SLSPLTPSF

SEQ ID NO: 1203229 - protein, 9 aa, Homo Sapiens
RLLAKDPEG

SEQ ID NO: 1203230 - protein, 9 aa, Homo Sapiens
YAVILCHVH

SEQ ID NO: 1203231 - protein, 9 aa, Homo Sapiens
ERINVHHRE

SEQ ID NO: 1203232 - protein, 9 aa, Homo Sapiens
WFSRRLLAK

SEQ ID NO: 1203233 - protein, 9 aa, Homo Sapiens
CWNPDGSEA

SEQ ID NO: 1203234 - protein, 9 aa, Homo Sapiens
DTWVKHMMY

SEQ ID NO: 1203235 - protein, 9 aa, Homo Sapiens
GESCDCLQG

SEQ ID NO: 1203236 - protein, 9 aa, Homo Sapiens
SSHDVKPFS

SEQ ID NO: 1203237 - protein, 9 aa, Homo Sapiens
GPASLSPLT

SEQ ID NO: 1203238 - protein, 9 aa, Homo Sapiens
ANCKFGQFP

SEQ ID NO: 1203239 - protein, 9 aa, Homo Sapiens
ILCHVHRAA

SEQ ID NO: 1203240 - protein, 9 aa, Homo Sapiens
GWFSRRLLA

SEQ ID NO: 1203241 - protein, 9 aa, Homo Sapiens
SRHRIQSKQ

SEQ ID NO: 1203242 - protein, 9 aa, Homo Sapiens
DAGWFSRRL

SEQ ID NO: 1203243 - protein, 9 aa, Homo Sapiens
QHLELANCK

SEQ ID NO: 1203244 - protein, 9 aa, Homo Sapiens
PEVPAEPDH

SEQ ID NO: 1203245 - protein, 9 aa, Homo Sapiens
ENFCWNPDG

SEQ ID NO: 1203246 - protein, 9 aa, Homo Sapiens
PPEVPAEPD

SEQ ID NO: 1203247 - protein, 9 aa, Homo Sapiens
GAGPPEVPA

SEQ ID NO: 1203248 - protein, 9 aa, Homo Sapiens
GQAGSSHDV

SEQ ID NO: 1203249 - protein, 9 aa, Homo Sapiens
KEGESCDCL

SEQ ID NO: 1203250 - protein, 9 aa, Homo Sapiens
ELANCKFGQ

SEQ ID NO: 1203251 - protein, 9 aa, Homo Sapiens
IFDDAGWFS

SEQ ID NO: 1203252 - protein, 9 aa, Homo Sapiens
RINVHHREA

SEQ ID NO: 1203253 - protein, 9 aa, Homo Sapiens
RKEGESCDC

SEQ ID NO: 1203254 - protein, 9 aa, Homo Sapiens
ALPGQAGSS

SEQ ID NO: 1203255 - protein, 9 aa, Homo Sapiens
FGWQHLELA

SEQ ID NO: 1203256 - protein, 9 aa, Homo Sapiens
LANCKFGQF

SEQ ID NO: 1203257 - protein, 9 aa, Homo Sapiens
QPQQQQQHG

SEQ ID NO: 1203258 - protein, 9 aa, Homo Sapiens
GWQHLELAN

SEQ ID NO: 1203259 - protein, 9 aa, Homo Sapiens
GAGAGPPEV

SEQ ID NO: 1203260 - protein, 9 aa, Homo Sapiens
VILCHVHRA

SEQ ID NO: 1203261 - protein, 9 aa, Homo Sapiens
ESDTWVKHM

SEQ ID NO: 1203262 - protein, 9 aa, Homo Sapiens
EVPAEPDHD

SEQ ID NO: 1203263 - protein, 9 aa, Homo Sapiens
SDTWVKHMM

SEQ ID NO: 1203264 - protein, 9 aa, Homo Sapiens
TWVKHMMYT

SEQ ID NO: 1203265 - protein, 9 aa, Homo Sapiens
FDDAGWFSR

SEQ ID NO: 1203266 - protein, 9 aa, Homo Sapiens
VVRKEGESC

SEQ ID NO: 1203267 - protein, 9 aa, Homo Sapiens
DVVRKEGES

SEQ ID NO: 1203268 - protein, 9 aa, Homo Sapiens
FSRRLLAKD

SEQ ID NO: 1203269 - protein, 9 aa, Homo Sapiens
AKLKSSTVG

SEQ ID NO: 1203270 - protein, 9 aa, Homo Sapiens
GQTFRAVAS

SEQ ID NO: 1203271 - protein, 9 aa, Homo Sapiens
MLQQVKEDH

SEQ ID NO: 1203272 - protein, 9 aa, Homo Sapiens
GPLPASHPL

SEQ ID NO: 1203273 - protein, 9 aa, Homo Sapiens
VEAKLKSST

SEQ ID NO: 1203274 - protein, 9 aa, Homo Sapiens
LKKEQDISA

SEQ ID NO: 1203275 - protein, 9 aa, Homo Sapiens
THTHTHTET

SEQ ID NO: 1203276 - protein, 9 aa, Homo Sapiens
PASHPLFGR

SEQ ID NO: 1203277 - protein, 9 aa, Homo Sapiens
ETERERERE

SEQ ID NO: 1203278 - protein, 9 aa, Homo Sapiens
PGPLPASHP

SEQ ID NO: 1203279 - protein, 9 aa, Homo Sapiens
PPGPPMARL

SEQ ID NO: 1203280 - protein, 9 aa, Homo Sapiens
QQVKEDHTR

SEQ ID NO: 1203281 - protein, 9 aa, Homo Sapiens
RGQLAVAGS

SEQ ID NO: 1203282 - protein, 9 aa, Homo Sapiens
PKEEPPHWE

SEQ ID NO: 1203283 - protein, 9 aa, Homo Sapiens
AQVEYNQCI

SEQ ID NO: 1203284 - protein, 9 aa, Homo Sapiens
HTHTETERE

SEQ ID NO: 1203285 - protein, 9 aa, Homo Sapiens
PLPASHPLF

SEQ ID NO: 1203286 - protein, 9 aa, Homo Sapiens
NSDSSTVSS

SEQ ID NO: 1203287 - protein, 9 aa, Homo Sapiens
KQLPYNKDS

SEQ ID NO: 1203288 - protein, 9 aa, Homo Sapiens
IERGQLAVA

SEQ ID NO: 1203289 - protein, 9 aa, Homo Sapiens
VAPSDIMGA

SEQ ID NO: 1203290 - protein, 9 aa, Homo Sapiens
KPKEEPPHW

SEQ ID NO: 1203291 - protein, 9 aa, Homo Sapiens
QVKEDHTRV

SEQ ID NO: 1203292 - protein, 9 aa, Homo Sapiens
DSSTVSSGA

SEQ ID NO: 1203293 - protein, 9 aa, Homo Sapiens
WQSSGTSST

SEQ ID NO: 1203294 - protein, 9 aa, Homo Sapiens
ERGQLAVAG

SEQ ID NO: 1203295 - protein, 9 aa, Homo Sapiens
TNSDSSTVS

SEQ ID NO: 1203296 - protein, 9 aa, Homo Sapiens
MARLPPGPP

SEQ ID NO: 1203297 - protein, 9 aa, Homo Sapiens
HTHTHTETE

SEQ ID NO: 1203298 - protein, 9 aa, Homo Sapiens
LTYESGPDK

SEQ ID NO: 1203299 - protein, 9 aa, Homo Sapiens
EEPPHWEVP

SEQ ID NO: 1203300 - protein, 9 aa, Homo Sapiens
LPASHPLFG

SEQ ID NO: 1203301 - protein, 9 aa, Homo Sapiens
WEVPENETP

SEQ ID NO: 1203302 - protein, 9 aa, Homo Sapiens
KDSYLARFQ

SEQ ID NO: 1203303 - protein, 9 aa, Homo Sapiens
RMGQTFRAV

SEQ ID NO: 1203304 - protein, 9 aa, Homo Sapiens
APSDIMGAG

SEQ ID NO: 1203305 - protein, 9 aa, Homo Sapiens
CISLLNEGQ

SEQ ID NO: 1203306 - protein, 9 aa, Homo Sapiens
TETERERER

SEQ ID NO: 1203307 - protein, 9 aa, Homo Sapiens
EAKLKSSTV

SEQ ID NO: 1203308 - protein, 9 aa, Homo Sapiens
QTFRAVASS

SEQ ID NO: 1203309 - protein, 9 aa, Homo Sapiens
LQQVKEDHT

SEQ ID NO: 1203310 - protein, 9 aa, Homo Sapiens
AVEAKLKSS

SEQ ID NO: 1203311 - protein, 9 aa, Homo Sapiens
TSCSWQSSG

SEQ ID NO: 1203312 - protein, 9 aa, Homo Sapiens
QLPYNKDSY

SEQ ID NO: 1203313 - protein, 9 aa, Homo Sapiens
QCISLLNEG

SEQ ID NO: 1203314 - protein, 9 aa, Homo Sapiens
TVAPSDIMG

SEQ ID NO: 1203315 - protein, 9 aa, Homo Sapiens
HWEVPENET

SEQ ID NO: 1203316 - protein, 9 aa, Homo Sapiens
EPPHWEVPE

SEQ ID NO: 1203317 - protein, 9 aa, Homo Sapiens
KLKSSTVGL

SEQ ID NO: 1203318 - protein, 9 aa, Homo Sapiens
PSDIMGAGV

SEQ ID NO: 1203319 - protein, 9 aa, Homo Sapiens
ETVAPSDIM

SEQ ID NO: 1203320 - protein, 9 aa, Homo Sapiens
SGPDKVRAW

SEQ ID NO: 1203321 - protein, 9 aa, Homo Sapiens
QAQVEYNQC

SEQ ID NO: 1203322 - protein, 9 aa, Homo Sapiens
DAVEAKLKS

SEQ ID NO: 1203323 - protein, 9 aa, Homo Sapiens
GQLAVAGST

SEQ ID NO: 1203324 - protein, 9 aa, Homo Sapiens
YNQCISLLN

SEQ ID NO: 1203325 - protein, 9 aa, Homo Sapiens
KEEPPHWEV

SEQ ID NO: 1203326 - protein, 9 aa, Homo Sapiens
THTHTETER

SEQ ID NO: 1203327 - protein, 9 aa, Homo Sapiens
SRMGQTFRA

SEQ ID NO: 1203328 - protein, 9 aa, Homo Sapiens
PPHWEVPEN

SEQ ID NO: 1203329 - protein, 9 aa, Homo Sapiens
PMLQQVKED

SEQ ID NO: 1203330 - protein, 9 aa, Homo Sapiens
TYESGPDKV

SEQ ID NO: 1203331 - protein, 9 aa, Homo Sapiens
KKEQDISAH

SEQ ID NO: 1203332 - protein, 9 aa, Homo Sapiens
ESGPDKVRA

SEQ ID NO: 1203333 - protein, 9 aa, Homo Sapiens
YESGPDKVR

SEQ ID NO: 1203334 - protein, 9 aa, Homo Sapiens
PHWEVPENE

SEQ ID NO: 1203335 - protein, 9 aa, Homo Sapiens
DKVRAWLEA

SEQ ID NO: 1203336 - protein, 9 aa, Homo Sapiens
PGPPMARLP

SEQ ID NO: 1203337 - protein, 9 aa, Homo Sapiens
CSWQSSGTS

SEQ ID NO: 1203338 - protein, 9 aa, Homo Sapiens
MGQTFRAVA

SEQ ID NO: 1203339 - protein, 9 aa, Homo Sapiens
YDAVEAKLK

SEQ ID NO: 1203340 - protein, 9 aa, Homo Sapiens
PPMLQQVKE

SEQ ID NO: 1203341 - protein, 9 aa, Homo Sapiens
KEQDISAHL

SEQ ID NO: 1203342 - protein, 9 aa, Homo Sapiens
ATNSDSSTV

SEQ ID NO: 1203343 - protein, 9 aa, Homo Sapiens
ASHPLFGRL

SEQ ID NO: 1203344 - protein, 9 aa, Homo Sapiens
NKDSYLARF

SEQ ID NO: 1203345 - protein, 9 aa, Homo Sapiens
ISAHLERMK

SEQ ID NO: 1203346 - protein, 9 aa, Homo Sapiens
REKQLPYNK

SEQ ID NO: 1203347 - protein, 9 aa, Homo Sapiens
SDSSTVSSG

SEQ ID NO: 1203348 - protein, 9 aa, Homo Sapiens
EYNQCISLL

SEQ ID NO: 1203349 - protein, 9 aa, Homo Sapiens
HTETERERE

SEQ ID NO: 1203350 - protein, 9 aa, Homo Sapiens
LPYNKDSYL

SEQ ID NO: 1203351 - protein, 9 aa, Homo Sapiens
PPMARLPPG

SEQ ID NO: 1203352 - protein, 9 aa, Homo Sapiens
VEYNQCISL

SEQ ID NO: 1203353 - protein, 9 aa, Homo Sapiens
EKQLPYNKD

SEQ ID NO: 1203354 - protein, 9 aa, Homo Sapiens
GPPMARLPP

SEQ ID NO: 1203355 - protein, 9 aa, Homo Sapiens
SWQSSGTSS

SEQ ID NO: 1203356 - protein, 9 aa, Homo Sapiens
KIERGQLAV

SEQ ID NO: 1203357 - protein, 9 aa, Homo Sapiens
QDISAHLER

SEQ ID NO: 1203358 - protein, 9 aa, Homo Sapiens
GPDKVRAWL

SEQ ID NO: 1203359 - protein, 9 aa, Homo Sapiens
RLPPGPPMA

SEQ ID NO: 1203360 - protein, 9 aa, Homo Sapiens
SHPLFGRLV

SEQ ID NO: 1203361 - protein, 9 aa, Homo Sapiens
EELKKEQDI

SEQ ID NO: 1203362 - protein, 9 aa, Homo Sapiens
TFRAVASSM

SEQ ID NO: 1203363 - protein, 9 aa, Homo Sapiens
LPPMLQQVK

SEQ ID NO: 1203364 - protein, 9 aa, Homo Sapiens
AHYDAVEAK

SEQ ID NO: 1203365 - protein, 9 aa, Homo Sapiens
PYNKDSYLA

SEQ ID NO: 1203366 - protein, 9 aa, Homo Sapiens
PDKVRAWLE

SEQ ID NO: 1203367 - protein, 9 aa, Homo Sapiens
WLPPMLQQV

SEQ ID NO: 1203368 - protein, 9 aa, Homo Sapiens
KVRAWLEAK

SEQ ID NO: 1203369 - protein, 9 aa, Homo Sapiens
EWLPPMLQQ

SEQ ID NO: 1203370 - protein, 9 aa, Homo Sapiens
THTETERER

SEQ ID NO: 1203371 - protein, 9 aa, Homo Sapiens
ARLPPGPPM

SEQ ID NO: 1203372 - protein, 9 aa, Homo Sapiens
LLSRMGQTF

SEQ ID NO: 1203373 - protein, 9 aa, Homo Sapiens
QVEYNQCIS

SEQ ID NO: 1203374 - protein, 9 aa, Homo Sapiens
DISAHLERM

SEQ ID NO: 1203375 - protein, 9 aa, Homo Sapiens
FRAVASSMR

SEQ ID NO: 1203376 - protein, 9 aa, Homo Sapiens
NQCISLLNE

SEQ ID NO: 1203377 - protein, 9 aa, Homo Sapiens
HYDAVEAKL

SEQ ID NO: 1203378 - protein, 9 aa, Homo Sapiens
FKIERGQLA

SEQ ID NO: 1203379 - protein, 9 aa, Homo Sapiens
YNKDSYLAR

SEQ ID NO: 1203380 - protein, 9 aa, Homo Sapiens
QLAVAGSTG

SEQ ID NO: 1203381 - protein, 9 aa, Homo Sapiens
PMARLPPGP

SEQ ID NO: 1203382 - protein, 9 aa, Homo Sapiens
ELKKEQDIS

SEQ ID NO: 1203383 - protein, 9 aa, Homo Sapiens
SCSWQSSGT

SEQ ID NO: 1203384 - protein, 9 aa, Homo Sapiens
LLPGPLPAS

SEQ ID NO: 1203385 - protein, 9 aa, Homo Sapiens
LPGPLPASH

SEQ ID NO: 1203386 - protein, 9 aa, Homo Sapiens
EQDISAHLE

SEQ ID NO: 1203387 - protein, 9 aa, Homo Sapiens
LSRMGQTFR

SEQ ID NO: 1203388 - protein, 9 aa, Homo Sapiens
LQCKYLDES

SEQ ID NO: 1203389 - protein, 9 aa, Homo Sapiens
GKGPCPFHC

SEQ ID NO: 1203390 - protein, 9 aa, Homo Sapiens
CKYLDESSG

SEQ ID NO: 1203391 - protein, 9 aa, Homo Sapiens
IPGAVTVCA

SEQ ID NO: 1203392 - protein, 9 aa, Homo Sapiens
RNIFDFITV

SEQ ID NO: 1203393 - protein, 9 aa, Homo Sapiens
LHWLPAVSG

SEQ ID NO: 1203394 - protein, 9 aa, Homo Sapiens
GSRTAAGPR

SEQ ID NO: 1203395 - protein, 9 aa, Homo Sapiens
LKPHSQISV

SEQ ID NO: 1203396 - protein, 9 aa, Homo Sapiens
DTRNIFDFI

SEQ ID NO: 1203397 - protein, 9 aa, Homo Sapiens
PPPGTLRGS

SEQ ID NO: 1203398 - protein, 9 aa, Homo Sapiens
QKVSELHRA

SEQ ID NO: 1203399 - protein, 9 aa, Homo Sapiens
WLPAVSGLV

SEQ ID NO: 1203400 - protein, 9 aa, Homo Sapiens
SRTAAGPRW

SEQ ID NO: 1203401 - protein, 9 aa, Homo Sapiens
SITPIPSSS

SEQ ID NO: 1203402 - protein, 9 aa, Homo Sapiens
KMLHWLPAV

SEQ ID NO: 1203403 - protein, 9 aa, Homo Sapiens
IPPPGTLRG

SEQ ID NO: 1203404 - protein, 9 aa, Homo Sapiens
QSGHEITLS

SEQ ID NO: 1203405 - protein, 9 aa, Homo Sapiens
LATEKSRWS

SEQ ID NO: 1203406 - protein, 9 aa, Homo Sapiens
QWDLEAGDR

SEQ ID NO: 1203407 - protein, 9 aa, Homo Sapiens
MMKKYSLSD

SEQ ID NO: 1203408 - protein, 9 aa, Homo Sapiens
PNACPALTW

SEQ ID NO: 1203409 - protein, 9 aa, Homo Sapiens
VCPTATHSV

SEQ ID NO: 1203410 - protein, 9 aa, Homo Sapiens
LHVIWTDPS

SEQ ID NO: 1203411 - protein, 9 aa, Homo Sapiens
SARTSRPTP

SEQ ID NO: 1203412 - protein, 9 aa, Homo Sapiens
KKRKKKNNM

SEQ ID NO: 1203413 - protein, 9 aa, Homo Sapiens
CPFHCRQIG

SEQ ID NO: 1203414 - protein, 9 aa, Homo Sapiens
SHRCLRIPP

SEQ ID NO: 1203415 - protein, 9 aa, Homo Sapiens
SQISVSCEE

SEQ ID NO: 1203416 - protein, 9 aa, Homo Sapiens
ATHSVHSQV

SEQ ID NO: 1203417 - protein, 9 aa, Homo Sapiens
EKETEQTPA

SEQ ID NO: 1203418 - protein, 9 aa, Homo Sapiens
GTPGEAVAA

SEQ ID NO: 1203419 - protein, 9 aa, Homo Sapiens
KKKKRKKKN

SEQ ID NO: 1203420 - protein, 9 aa, Homo Sapiens
EFNVTYPSN

SEQ ID NO: 1203421 - protein, 9 aa, Homo Sapiens
SLSDPAFAY

SEQ ID NO: 1203422 - protein, 9 aa, Homo Sapiens
TATHSVHSQ

SEQ ID NO: 1203423 - protein, 9 aa, Homo Sapiens
ESHRCLRIP

SEQ ID NO: 1203424 - protein, 9 aa, Homo Sapiens
QISVSCEEL

SEQ ID NO: 1203425 - protein, 9 aa, Homo Sapiens
HRCLRIPPP

SEQ ID NO: 1203426 - protein, 9 aa, Homo Sapiens
PGTPGEAVA

SEQ ID NO: 1203427 - protein, 9 aa, Homo Sapiens
QIPGAVTVC

SEQ ID NO: 1203428 - protein, 9 aa, Homo Sapiens
VTVCAHRLR

SEQ ID NO: 1203429 - protein, 9 aa, Homo Sapiens
WGQQIPGAV

SEQ ID NO: 1203430 - protein, 9 aa, Homo Sapiens
TSITPIPSS

SEQ ID NO: 1203431 - protein, 9 aa, Homo Sapiens
QCKYLDESS

SEQ ID NO: 1203432 - protein, 9 aa, Homo Sapiens
TATSITPIP

SEQ ID NO: 1203433 - protein, 9 aa, Homo Sapiens
AYNSARTSR

SEQ ID NO: 1203434 - protein, 9 aa, Homo Sapiens
HRRGGGGAG

SEQ ID NO: 1203435 - protein, 9 aa, Homo Sapiens
RIANTGMDT

SEQ ID NO: 1203436 - protein, 9 aa, Homo Sapiens
ATESHRCLR

SEQ ID NO: 1203437 - protein, 9 aa, Homo Sapiens
PHSQISVSC

SEQ ID NO: 1203438 - protein, 9 aa, Homo Sapiens
SCCTTLLFA

SEQ ID NO: 1203439 - protein, 9 aa, Homo Sapiens
KRKKKNNMA

SEQ ID NO: 1203440 - protein, 9 aa, Homo Sapiens
YPSNCSHLP

SEQ ID NO: 1203441 - protein, 9 aa, Homo Sapiens
RDTRNIFDF

SEQ ID NO: 1203442 - protein, 9 aa, Homo Sapiens
SWSSCSHQY

SEQ ID NO: 1203443 - protein, 9 aa, Homo Sapiens
AAEAAEVRA

SEQ ID NO: 1203444 - protein, 9 aa, Homo Sapiens
KPHSQISVS

SEQ ID NO: 1203445 - protein, 9 aa, Homo Sapiens
NPPLTQEKP

SEQ ID NO: 1203446 - protein, 9 aa, Homo Sapiens
TDASIMDGK

SEQ ID NO: 1203447 - protein, 9 aa, Homo Sapiens
ERPCLLETC

SEQ ID NO: 1203448 - protein, 9 aa, Homo Sapiens
AEVRARPGV

SEQ ID NO: 1203449 - protein, 9 aa, Homo Sapiens
EELCWRQRR

SEQ ID NO: 1203450 - protein, 9 aa, Homo Sapiens
AKIRIANTG

SEQ ID NO: 1203451 - protein, 9 aa, Homo Sapiens
LTQEKPAKT

SEQ ID NO: 1203452 - protein, 9 aa, Homo Sapiens
LETCDESPA

SEQ ID NO: 1203453 - protein, 9 aa, Homo Sapiens
SRHRIQSKQ

SEQ ID NO: 1203454 - protein, 9 aa, Homo Sapiens
SHQYLKKFL

SEQ ID NO: 1203455 - protein, 9 aa, Homo Sapiens
VQTCLQTIK

SEQ ID NO: 1203456 - protein, 9 aa, Homo Sapiens
ELVQTCLQT

SEQ ID NO: 1203457 - protein, 9 aa, Homo Sapiens
GEPAHHPGC

SEQ ID NO: 1203458 - protein, 9 aa, Homo Sapiens
PPLTQEKPA

SEQ ID NO: 1203459 - protein, 9 aa, Homo Sapiens
RGPGKGPCP

SEQ ID NO: 1203460 - protein, 9 aa, Homo Sapiens
ACAQSGHEI

SEQ ID NO: 1203461 - protein, 9 aa, Homo Sapiens
SKDWPSDQW

SEQ ID NO: 1203462 - protein, 9 aa, Homo Sapiens
ISVSCEELP

SEQ ID NO: 1203463 - protein, 9 aa, Homo Sapiens
GTVCPTATH

SEQ ID NO: 1203464 - protein, 9 aa, Homo Sapiens
GPRWAVPVH

SEQ ID NO: 1203465 - protein, 9 aa, Homo Sapiens
PAVSGLVAT

SEQ ID NO: 1203466 - protein, 9 aa, Homo Sapiens
VCAHRLRHH

SEQ ID NO: 1203467 - protein, 9 aa, Homo Sapiens
ERQVEELCW

SEQ ID NO: 1203468 - protein, 9 aa, Homo Sapiens
KIRIANTGM

SEQ ID NO: 1203469 - protein, 9 aa, Homo Sapiens
IENAKIRIA

SEQ ID NO: 1203470 - protein, 9 aa, Homo Sapiens
SCSHQYLKK

SEQ ID NO: 1203471 - protein, 9 aa, Homo Sapiens
ALVAYNSAR

SEQ ID NO: 1203472 - protein, 9 aa, Homo Sapiens
KTNPPLTQE

SEQ ID NO: 1203473 - protein, 9 aa, Homo Sapiens
GVCWVVTNC

SEQ ID NO: 1203474 - protein, 9 aa, Homo Sapiens
VTNCPALMH

SEQ ID NO: 1203475 - protein, 9 aa, Homo Sapiens
YNSARTSRP

SEQ ID NO: 1203476 - protein, 9 aa, Homo Sapiens
LVQTCLQTI

SEQ ID NO: 1203477 - protein, 9 aa, Homo Sapiens
PGTLRGSRT

SEQ ID NO: 1203478 - protein, 9 aa, Homo Sapiens
RPRWGQQIP

SEQ ID NO: 1203479 - protein, 9 aa, Homo Sapiens
TCLQTIKFI

SEQ ID NO: 1203480 - protein, 9 aa, Homo Sapiens
LNYFRDTRN

SEQ ID NO: 1203481 - protein, 9 aa, Homo Sapiens
PVPGTPGEA

SEQ ID NO: 1203482 - protein, 9 aa, Homo Sapiens
VIWTDPSLH

SEQ ID NO: 1203483 - protein, 9 aa, Homo Sapiens
TLLFASSWG

SEQ ID NO: 1203484 - protein, 9 aa, Homo Sapiens
KVARSRDVE

SEQ ID NO: 1203485 - protein, 9 aa, Homo Sapiens
FSKKKKRKK

SEQ ID NO: 1203486 - protein, 9 aa, Homo Sapiens
AAFLKKLGL

SEQ ID NO: 1203487 - protein, 9 aa, Homo Sapiens
VLHVIWTDP

SEQ ID NO: 1203488 - protein, 9 aa, Homo Sapiens
FRDTRNIFD

SEQ ID NO: 1203489 - protein, 9 aa, Homo Sapiens
ITPIPSSSL

SEQ ID NO: 1203490 - protein, 9 aa, Homo Sapiens
IRIANTGMD

SEQ ID NO: 1203491 - protein, 9 aa, Homo Sapiens
FFPQKVSEL

SEQ ID NO: 1203492 - protein, 9 aa, Homo Sapiens
CLRIPPPGT

SEQ ID NO: 1203493 - protein, 9 aa, Homo Sapiens
TEFNVTYPS

SEQ ID NO: 1203494 - protein, 9 aa, Homo Sapiens
ENCPVPGTP

SEQ ID NO: 1203495 - protein, 9 aa, Homo Sapiens
KENCPVPGT

SEQ ID NO: 1203496 - protein, 9 aa, Homo Sapiens
RTSRPTPVV

SEQ ID NO: 1203497 - protein, 9 aa, Homo Sapiens
AAGPRWAVP

SEQ ID NO: 1203498 - protein, 9 aa, Homo Sapiens
RGSRTAAGP

SEQ ID NO: 1203499 - protein, 9 aa, Homo Sapiens
TLRGSRTAA

SEQ ID NO: 1203500 - protein, 9 aa, Homo Sapiens
ELHRATESH

SEQ ID NO: 1203501 - protein, 9 aa, Homo Sapiens
PRWAVPVHV

SEQ ID NO: 1203502 - protein, 9 aa, Homo Sapiens
FAKVARSRD

SEQ ID NO: 1203503 - protein, 9 aa, Homo Sapiens
KETEQTPAL

SEQ ID NO: 1203504 - protein, 9 aa, Homo Sapiens
FLKKLGLPD

SEQ ID NO: 1203505 - protein, 9 aa, Homo Sapiens
VTYPSNCSH

SEQ ID NO: 1203506 - protein, 9 aa, Homo Sapiens
GHRRGGGGA

SEQ ID NO: 1203507 - protein, 9 aa, Homo Sapiens
VRARPGVTL

SEQ ID NO: 1203508 - protein, 9 aa, Homo Sapiens
EPAHHPGCQ

SEQ ID NO: 1203509 - protein, 9 aa, Homo Sapiens
ENFAKVARS

SEQ ID NO: 1203510 - protein, 9 aa, Homo Sapiens
WSSCSHQYL

SEQ ID NO: 1203511 - protein, 9 aa, Homo Sapiens
LERQVEELC

SEQ ID NO: 1203512 - protein, 9 aa, Homo Sapiens
NGEVETDAS

SEQ ID NO: 1203513 - protein, 9 aa, Homo Sapiens
TRNIFDFIT

SEQ ID NO: 1203514 - protein, 9 aa, Homo Sapiens
WTDPSLHQP

SEQ ID NO: 1203515 - protein, 9 aa, Homo Sapiens
CAHRLRHHR

SEQ ID NO: 1203516 - protein, 9 aa, Homo Sapiens
CPVPGTPGE

SEQ ID NO: 1203517 - protein, 9 aa, Homo Sapiens
HVIWTDPSL

SEQ ID NO: 1203518 - protein, 9 aa, Homo Sapiens
WAVPVHVPG

SEQ ID NO: 1203519 - protein, 9 aa, Homo Sapiens
HQQQQQQMQ

SEQ ID NO: 1203520 - protein, 9 aa, Homo Sapiens
TVCPTATHS

SEQ ID NO: 1203521 - protein, 9 aa, Homo Sapiens
LGVCWVVTN

SEQ ID NO: 1203522 - protein, 9 aa, Homo Sapiens
AVTVCAHRL

SEQ ID NO: 1203523 - protein, 9 aa, Homo Sapiens
RQVEELCWR

SEQ ID NO: 1203524 - protein, 9 aa, Homo Sapiens
VCWVVTNCP

SEQ ID NO: 1203525 - protein, 9 aa, Homo Sapiens
NACPALTWL

SEQ ID NO: 1203526 - protein, 9 aa, Homo Sapiens
FLNYFRDTR

SEQ ID NO: 1203527 - protein, 9 aa, Homo Sapiens
NSEKETEQT

SEQ ID NO: 1203528 - protein, 9 aa, Homo Sapiens
GDRPRWGQQ

SEQ ID NO: 1203529 - protein, 9 aa, Homo Sapiens
HEITLSNLN

SEQ ID NO: 1203530 - protein, 9 aa, Homo Sapiens
PILFFFFPQ

SEQ ID NO: 1203531 - protein, 9 aa, Homo Sapiens
ATSITPIPS

SEQ ID NO: 1203532 - protein, 9 aa, Homo Sapiens
PQKVSELHR

SEQ ID NO: 1203533 - protein, 9 aa, Homo Sapiens
RLRHHRCGL

SEQ ID NO: 1203534 - protein, 9 aa, Homo Sapiens
RATESHRCL

SEQ ID NO: 1203535 - protein, 9 aa, Homo Sapiens
PGAVTVCAH

SEQ ID NO: 1203536 - protein, 9 aa, Homo Sapiens
PTATSITPI

SEQ ID NO: 1203537 - protein, 9 aa, Homo Sapiens
GLATEKSRW

SEQ ID NO: 1203538 - protein, 9 aa, Homo Sapiens
VPGTPGEAV

SEQ ID NO: 1203539 - protein, 9 aa, Homo Sapiens
EQQENFAKV

SEQ ID NO: 1203540 - protein, 9 aa, Homo Sapiens
MHQQQQQQM

SEQ ID NO: 1203541 - protein, 9 aa, Homo Sapiens
RYRARGSPY

SEQ ID NO: 1203542 - protein, 9 aa, Homo Sapiens
LVAYNSART

SEQ ID NO: 1203543 - protein, 9 aa, Homo Sapiens
HRATESHRC

SEQ ID NO: 1203544 - protein, 9 aa, Homo Sapiens
LRGSRTAAG

SEQ ID NO: 1203545 - protein, 9 aa, Homo Sapiens
ATEKSRWSG

SEQ ID NO: 1203546 - protein, 9 aa, Homo Sapiens
LMLGVCWVV

SEQ ID NO: 1203547 - protein, 9 aa, Homo Sapiens
NTNGEVETD

SEQ ID NO: 1203548 - protein, 9 aa, Homo Sapiens
GAVTVCAHR

SEQ ID NO: 1203549 - protein, 9 aa, Homo Sapiens
GRRAWRPNA

SEQ ID NO: 1203550 - protein, 9 aa, Homo Sapiens
GEVETDASI

SEQ ID NO: 1203551 - protein, 9 aa, Homo Sapiens
CPTATHSVH

SEQ ID NO: 1203552 - protein, 9 aa, Homo Sapiens
LGLPDLILG

SEQ ID NO: 1203553 - protein, 9 aa, Homo Sapiens
ELCWRQRRA

SEQ ID NO: 1203554 - protein, 9 aa, Homo Sapiens
AEAAEAAEV

SEQ ID NO: 1203555 - protein, 9 aa, Homo Sapiens
FFFPQKVSE

SEQ ID NO: 1203556 - protein, 9 aa, Homo Sapiens
CLQTIKFIL

SEQ ID NO: 1203557 - protein, 9 aa, Homo Sapiens
NYFRDTRNI

SEQ ID NO: 1203558 - protein, 9 aa, Homo Sapiens
KDWPSDQWD

SEQ ID NO: 1203559 - protein, 9 aa, Homo Sapiens
TNGEVETDA

SEQ ID NO: 1203560 - protein, 9 aa, Homo Sapiens
PTATHSVHS

SEQ ID NO: 1203561 - protein, 9 aa, Homo Sapiens
LLFASSWGW

SEQ ID NO: 1203562 - protein, 9 aa, Homo Sapiens
CTTLLFASS

SEQ ID NO: 1203563 - protein, 9 aa, Homo Sapiens
TIKFILPKE

SEQ ID NO: 1203564 - protein, 9 aa, Homo Sapiens
PERPSKDWP

SEQ ID NO: 1203565 - protein, 9 aa, Homo Sapiens
AQRGLQCKY

SEQ ID NO: 1203566 - protein, 9 aa, Homo Sapiens
PAHHPGCQL

SEQ ID NO: 1203567 - protein, 9 aa, Homo Sapiens
QENFAKVAR

SEQ ID NO: 1203568 - protein, 9 aa, Homo Sapiens
SELHRATES

SEQ ID NO: 1203569 - protein, 9 aa, Homo Sapiens
VAYNSARTS

SEQ ID NO: 1203570 - protein, 9 aa, Homo Sapiens
IWTDPSLHQ

SEQ ID NO: 1203571 - protein, 9 aa, Homo Sapiens
EVRARPGVT

SEQ ID NO: 1203572 - protein, 9 aa, Homo Sapiens
LQTIKFILP

SEQ ID NO: 1203573 - protein, 9 aa, Homo Sapiens
NCPVPGTPG

SEQ ID NO: 1203574 - protein, 9 aa, Homo Sapiens
SSCSHQYLK

SEQ ID NO: 1203575 - protein, 9 aa, Homo Sapiens
ATTPTATSI

SEQ ID NO: 1203576 - protein, 9 aa, Homo Sapiens
DLEAGDRPR

SEQ ID NO: 1203577 - protein, 9 aa, Homo Sapiens
GLSCCTTLL

SEQ ID NO: 1203578 - protein, 9 aa, Homo Sapiens
EAGDRPRWG

SEQ ID NO: 1203579 - protein, 9 aa, Homo Sapiens
WDLEAGDRP

SEQ ID NO: 1203580 - protein, 9 aa, Homo Sapiens
TTPTATSIT

SEQ ID NO: 1203581 - protein, 9 aa, Homo Sapiens
AGDRPRWGQ

SEQ ID NO: 1203582 - protein, 9 aa, Homo Sapiens
LSDPAFAYA

SEQ ID NO: 1203583 - protein, 9 aa, Homo Sapiens
GLKTNPPLT

SEQ ID NO: 1203584 - protein, 9 aa, Homo Sapiens
IGDFGLATE

SEQ ID NO: 1203585 - protein, 9 aa, Homo Sapiens
QQIPGAVTV

SEQ ID NO: 1203586 - protein, 9 aa, Homo Sapiens
KKYSLSDPA

SEQ ID NO: 1203587 - protein, 9 aa, Homo Sapiens
RPNACPALT

SEQ ID NO: 1203588 - protein, 9 aa, Homo Sapiens
LGTEFNVTY

SEQ ID NO: 1203589 - protein, 9 aa, Homo Sapiens
KYSLSDPAF

SEQ ID NO: 1203590 - protein, 9 aa, Homo Sapiens
RGSPYFQHA

SEQ ID NO: 1203591 - protein, 9 aa, Homo Sapiens
CWRQRRAAK

SEQ ID NO: 1203592 - protein, 9 aa, Homo Sapiens
CCTTLLFAS

SEQ ID NO: 1203593 - protein, 9 aa, Homo Sapiens
AAAFLKKLG

SEQ ID NO: 1203594 - protein, 9 aa, Homo Sapiens
RRGGGGAGF

SEQ ID NO: 1203595 - protein, 9 aa, Homo Sapiens
DQWDLEAGD

SEQ ID NO: 1203596 - protein, 9 aa, Homo Sapiens
LKKLGLPDL

SEQ ID NO: 1203597 - protein, 9 aa, Homo Sapiens
PCPFHCRQI

SEQ ID NO: 1203598 - protein, 9 aa, Homo Sapiens
LEAGDRPRW

SEQ ID NO: 1203599 - protein, 9 aa, Homo Sapiens
VFSKKKKRK

SEQ ID NO: 1203600 - protein, 9 aa, Homo Sapiens
DAAAFLKKL

SEQ ID NO: 1203601 - protein, 9 aa, Homo Sapiens
QVFSKKKKR

SEQ ID NO: 1203602 - protein, 9 aa, Homo Sapiens
MLKPHSQIS

SEQ ID NO: 1203603 - protein, 9 aa, Homo Sapiens
QTIKFILPK

SEQ ID NO: 1203604 - protein, 9 aa, Homo Sapiens
TNPPLTQEK

SEQ ID NO: 1203605 - protein, 9 aa, Homo Sapiens
RKKKNNMAA

SEQ ID NO: 1203606 - protein, 9 aa, Homo Sapiens
GSPYFQHAE

SEQ ID NO: 1203607 - protein, 9 aa, Homo Sapiens
FPILFFFFP

SEQ ID NO: 1203608 - protein, 9 aa, Homo Sapiens
ARTSRPTPV

SEQ ID NO: 1203609 - protein, 9 aa, Homo Sapiens
ATHNSEKET

SEQ ID NO: 1203610 - protein, 9 aa, Homo Sapiens
TESHRCLRI

SEQ ID NO: 1203611 - protein, 9 aa, Homo Sapiens
RWGQQIPGA

SEQ ID NO: 1203612 - protein, 9 aa, Homo Sapiens
RPSKDWPSD

SEQ ID NO: 1203613 - protein, 9 aa, Homo Sapiens
SEKETEQTP

SEQ ID NO: 1203614 - protein, 9 aa, Homo Sapiens
LNTNGEVET

SEQ ID NO: 1203615 - protein, 9 aa, Homo Sapiens
MVLHVIWTD

SEQ ID NO: 1203616 - protein, 9 aa, Homo Sapiens
WPSDQWDLE

SEQ ID NO: 1203617 - protein, 9 aa, Homo Sapiens
PRWGQQIPG

SEQ ID NO: 1203618 - protein, 9 aa, Homo Sapiens
EAAEVRARP

SEQ ID NO: 1203619 - protein, 9 aa, Homo Sapiens
HMPERPSKD

SEQ ID NO: 1203620 - protein, 9 aa, Homo Sapiens
TQEKPAKTS

SEQ ID NO: 1203621 - protein, 9 aa, Homo Sapiens
RGGGGAGFR

SEQ ID NO: 1203622 - protein, 9 aa, Homo Sapiens
ENAKIRIAN

SEQ ID NO: 1203623 - protein, 9 aa, Homo Sapiens
MPERPSKDW

SEQ ID NO: 1203624 - protein, 9 aa, Homo Sapiens
PPGTLRGSR

SEQ ID NO: 1203625 - protein, 9 aa, Homo Sapiens
GDFGLATEK

SEQ ID NO: 1203626 - protein, 9 aa, Homo Sapiens
ILFFFFPQK

SEQ ID NO: 1203627 - protein, 9 aa, Homo Sapiens
ITLSNLNLS

SEQ ID NO: 1203628 - protein, 9 aa, Homo Sapiens
MKKYSLSDP

SEQ ID NO: 1203629 - protein, 9 aa, Homo Sapiens
MLHWLPAVS

SEQ ID NO: 1203630 - protein, 9 aa, Homo Sapiens
DFGLATEKS

SEQ ID NO: 1203631 - protein, 9 aa, Homo Sapiens
RIPPPGTLR

SEQ ID NO: 1203632 - protein, 9 aa, Homo Sapiens
RRAWRPNAC

SEQ ID NO: 1203633 - protein, 9 aa, Homo Sapiens
AAQRGLQCK

SEQ ID NO: 1203634 - protein, 9 aa, Homo Sapiens
EVETDASIM

SEQ ID NO: 1203635 - protein, 9 aa, Homo Sapiens
FNVTYPSNC

SEQ ID NO: 1203636 - protein, 9 aa, Homo Sapiens
KVSELHRAT

SEQ ID NO: 1203637 - protein, 9 aa, Homo Sapiens
NFAKVARSR

SEQ ID NO: 1203638 - protein, 9 aa, Homo Sapiens
GLQCKYLDE

SEQ ID NO: 1203639 - protein, 9 aa, Homo Sapiens
EQATHNSEK

SEQ ID NO: 1203640 - protein, 9 aa, Homo Sapiens
SGHEITLSN

SEQ ID NO: 1203641 - protein, 9 aa, Homo Sapiens
AGTVCPTAT

SEQ ID NO: 1203642 - protein, 9 aa, Homo Sapiens
GPCPFHCRQ

SEQ ID NO: 1203643 - protein, 9 aa, Homo Sapiens
QRGLQCKYL

SEQ ID NO: 1203644 - protein, 9 aa, Homo Sapiens
YFRDTRNIF

SEQ ID NO: 1203645 - protein, 9 aa, Homo Sapiens
TERPCLLET

SEQ ID NO: 1203646 - protein, 9 aa, Homo Sapiens
TPTATSITP

SEQ ID NO: 1203647 - protein, 9 aa, Homo Sapiens
PSDQWDLEA

SEQ ID NO: 1203648 - protein, 9 aa, Homo Sapiens
QATHNSEKE

SEQ ID NO: 1203649 - protein, 9 aa, Homo Sapiens
TEKSRWSGS

SEQ ID NO: 1203650 - protein, 9 aa, Homo Sapiens
MLGVCWVVT

SEQ ID NO: 1203651 - protein, 9 aa, Homo Sapiens
YSLSDPAFA

SEQ ID NO: 1203652 - protein, 9 aa, Homo Sapiens
RPCLLETCD

SEQ ID NO: 1203653 - protein, 9 aa, Homo Sapiens
ETDASIMDG

SEQ ID NO: 1203654 - protein, 9 aa, Homo Sapiens
LRIPPPGTL

SEQ ID NO: 1203655 - protein, 9 aa, Homo Sapiens
TDPSLHQPM

SEQ ID NO: 1203656 - protein, 9 aa, Homo Sapiens
GPGKGPCPF

SEQ ID NO: 1203657 - protein, 9 aa, Homo Sapiens
VMMKKYSLS

SEQ ID NO: 1203658 - protein, 9 aa, Homo Sapiens
QVEELCWRQ

SEQ ID NO: 1203659 - protein, 9 aa, Homo Sapiens
PLTQEKPAK

SEQ ID NO: 1203660 - protein, 9 aa, Homo Sapiens
RTAAGPRWA

SEQ ID NO: 1203661 - protein, 9 aa, Homo Sapiens
TPGEAVAAR

SEQ ID NO: 1203662 - protein, 9 aa, Homo Sapiens
FGLATEKSR

SEQ ID NO: 1203663 - protein, 9 aa, Homo Sapiens
LHRATESHR

SEQ ID NO: 1203664 - protein, 9 aa, Homo Sapiens
CAQSGHEIT

SEQ ID NO: 1203665 - protein, 9 aa, Homo Sapiens
KKKRKKKNN

SEQ ID NO: 1203666 - protein, 9 aa, Homo Sapiens
EITLSNLNL

SEQ ID NO: 1203667 - protein, 9 aa, Homo Sapiens
AAEVRARPG

SEQ ID NO: 1203668 - protein, 9 aa, Homo Sapiens
EVMMKKYSL

SEQ ID NO: 1203669 - protein, 9 aa, Homo Sapiens
KAGTVCPTA

SEQ ID NO: 1203670 - protein, 9 aa, Homo Sapiens
HSQISVSCE

SEQ ID NO: 1203671 - protein, 9 aa, Homo Sapiens
PSKDWPSDQ

SEQ ID NO: 1203672 - protein, 9 aa, Homo Sapiens
HQYLKKFLS

SEQ ID NO: 1203673 - protein, 9 aa, Homo Sapiens
VSELHRATE

SEQ ID NO: 1203674 - protein, 9 aa, Homo Sapiens
LCWRQRRAA

SEQ ID NO: 1203675 - protein, 9 aa, Homo Sapiens
NSARTSRPT

SEQ ID NO: 1203676 - protein, 9 aa, Homo Sapiens
WRPNACPAL

SEQ ID NO: 1203677 - protein, 9 aa, Homo Sapiens
AVSGLVATR

SEQ ID NO: 1203678 - protein, 9 aa, Homo Sapiens
AWRPNACPA

SEQ ID NO: 1203679 - protein, 9 aa, Homo Sapiens
KKLGLPDLI

SEQ ID NO: 1203680 - protein, 9 aa, Homo Sapiens
LFFFFPQKV

SEQ ID NO: 1203681 - protein, 9 aa, Homo Sapiens
GGLSCCTTL

SEQ ID NO: 1203682 - protein, 9 aa, Homo Sapiens
PCLLETCDE

SEQ ID NO: 1203683 - protein, 9 aa, Homo Sapiens
YFQHAEVRI

SEQ ID NO: 1203684 - protein, 9 aa, Homo Sapiens
GTLRGSRTA

SEQ ID NO: 1203685 - protein, 9 aa, Homo Sapiens
KRIENAKIR

SEQ ID NO: 1203686 - protein, 9 aa, Homo Sapiens
TGRRAWRPN

SEQ ID NO: 1203687 - protein, 9 aa, Homo Sapiens
CWVVTNCPA

SEQ ID NO: 1203688 - protein, 9 aa, Homo Sapiens
FPQKVSELH

SEQ ID NO: 1203689 - protein, 9 aa, Homo Sapiens
LKTNPPLTQ

SEQ ID NO: 1203690 - protein, 9 aa, Homo Sapiens
PYFQHAEVR

SEQ ID NO: 1203691 - protein, 9 aa, Homo Sapiens
EKSRWSGSH

SEQ ID NO: 1203692 - protein, 9 aa, Homo Sapiens
RAWRPNACP

SEQ ID NO: 1203693 - protein, 9 aa, Homo Sapiens
RARGSPYFQ

SEQ ID NO: 1203694 - protein, 9 aa, Homo Sapiens
LEQQENFAK

SEQ ID NO: 1203695 - protein, 9 aa, Homo Sapiens
PGKGPCPFH

SEQ ID NO: 1203696 - protein, 9 aa, Homo Sapiens
TTLLFASSW

SEQ ID NO: 1203697 - protein, 9 aa, Homo Sapiens
VFSWSSCSH

SEQ ID NO: 1203698 - protein, 9 aa, Homo Sapiens
TCDESPASR

SEQ ID NO: 1203699 - protein, 9 aa, Homo Sapiens
TYPSNCSHL

SEQ ID NO: 1203700 - protein, 9 aa, Homo Sapiens
SVSCEELPE

SEQ ID NO: 1203701 - protein, 9 aa, Homo Sapiens
GTEFNVTYP

SEQ ID NO: 1203702 - protein, 9 aa, Homo Sapiens
SDQWDLEAG

SEQ ID NO: 1203703 - protein, 9 aa, Homo Sapiens
SPYFQHAEV

SEQ ID NO: 1203704 - protein, 9 aa, Homo Sapiens
CLLETCDES

SEQ ID NO: 1203705 - protein, 9 aa, Homo Sapiens
RIENAKIRI

SEQ ID NO: 1203706 - protein, 9 aa, Homo Sapiens
FSWSSCSHQ

SEQ ID NO: 1203707 - protein, 9 aa, Homo Sapiens
WVVTNCPAL

SEQ ID NO: 1203708 - protein, 9 aa, Homo Sapiens
RCLRIPPPG

SEQ ID NO: 1203709 - protein, 9 aa, Homo Sapiens
EAAQRGLQC

SEQ ID NO: 1203710 - protein, 9 aa, Homo Sapiens
TVCAHRLRH

SEQ ID NO: 1203711 - protein, 9 aa, Homo Sapiens
TAAGPRWAV

SEQ ID NO: 1203712 - protein, 9 aa, Homo Sapiens
HNSEKETEQ

SEQ ID NO: 1203713 - protein, 9 aa, Homo Sapiens
NAKIRIANT

SEQ ID NO: 1203714 - protein, 9 aa, Homo Sapiens
DPSLHQPMF

SEQ ID NO: 1203715 - protein, 9 aa, Homo Sapiens
EAAEAAEVR

SEQ ID NO: 1203716 - protein, 9 aa, Homo Sapiens
AFLKKLGLP

SEQ ID NO: 1203717 - protein, 9 aa, Homo Sapiens
QTCLQTIKF

SEQ ID NO: 1203718 - protein, 9 aa, Homo Sapiens
GQQIPGAVT

SEQ ID NO: 1203719 - protein, 9 aa, Homo Sapiens
KLGLPDLIL

SEQ ID NO: 1203720 - protein, 9 aa, Homo Sapiens
VETDASIMD

SEQ ID NO: 1203721 - protein, 9 aa, Homo Sapiens
YRARGSPYF

SEQ ID NO: 1203722 - protein, 9 aa, Homo Sapiens
LSCCTTLLF

SEQ ID NO: 1203723 - protein, 9 aa, Homo Sapiens
CSHQYLKKF

SEQ ID NO: 1203724 - protein, 9 aa, Homo Sapiens
AGPRWAVPV

SEQ ID NO: 1203725 - protein, 9 aa, Homo Sapiens
QQENFAKVA

SEQ ID NO: 1203726 - protein, 9 aa, Homo Sapiens
GHEITLSNL

SEQ ID NO: 1203727 - protein, 9 aa, Homo Sapiens
VEELCWRQR

SEQ ID NO: 1203728 - protein, 9 aa, Homo Sapiens
LPAVSGLVA

SEQ ID NO: 1203729 - protein, 9 aa, Homo Sapiens
LLETCDESP

SEQ ID NO: 1203730 - protein, 9 aa, Homo Sapiens
ARGSPYFQH

SEQ ID NO: 1203731 - protein, 9 aa, Homo Sapiens
ERPSKDWPS

SEQ ID NO: 1203732 - protein, 9 aa, Homo Sapiens
RGLQCKYLD

SEQ ID NO: 1203733 - protein, 9 aa, Homo Sapiens
AQSGHEITL

SEQ ID NO: 1203734 - protein, 9 aa, Homo Sapiens
VVTNCPALM

SEQ ID NO: 1203735 - protein, 9 aa, Homo Sapiens
AHRLRHHRC

SEQ ID NO: 1203736 - protein, 9 aa, Homo Sapiens
RWAVPVHVP

SEQ ID NO: 1203737 - protein, 9 aa, Homo Sapiens
THNSEKETE

SEQ ID NO: 1203738 - protein, 9 aa, Homo Sapiens
DRPRWGQQI

SEQ ID NO: 1203739 - protein, 9 aa, Homo Sapiens
VSGLVATRP

SEQ ID NO: 1203740 - protein, 9 aa, Homo Sapiens
AEAAEVRAR

SEQ ID NO: 1203741 - protein, 9 aa, Homo Sapiens
FFFFPQKVS

SEQ ID NO: 1203742 - protein, 9 aa, Homo Sapiens
KGPCPFHCR

SEQ ID NO: 1203743 - protein, 9 aa, Homo Sapiens
AKVARSRDV

SEQ ID NO: 1203744 - protein, 9 aa, Homo Sapiens
RRGPGKGPC

SEQ ID NO: 1203745 - protein, 9 aa, Homo Sapiens
HRLRHHRCG

SEQ ID NO: 1203746 - protein, 9 aa, Homo Sapiens
HWLPAVSGL

SEQ ID NO: 1203747 - protein, 9 aa, Homo Sapiens
NVTYPSNCS

SEQ ID NO: 1203748 - protein, 9 aa, Homo Sapiens
DWPSDQWDL

SEQ ID NO: 1203749 - protein, 9 aa, Homo Sapiens
ETCDESPAS

SEQ ID NO: 1203750 - protein, 9 aa, Homo Sapiens
HPLSQLLNL

SEQ ID NO: 1203751 - protein, 9 aa, Homo Sapiens
SGNASGHPL

SEQ ID NO: 1203752 - protein, 9 aa, Homo Sapiens
AGIGFDLGG

SEQ ID NO: 1203753 - protein, 9 aa, Homo Sapiens
TGMTSMTIK

SEQ ID NO: 1203754 - protein, 9 aa, Homo Sapiens
PSGNASGHP

SEQ ID NO: 1203755 - protein, 9 aa, Homo Sapiens
DLGGGAGLA

SEQ ID NO: 1203756 - protein, 9 aa, Homo Sapiens
GMTSMTIKG

SEQ ID NO: 1203757 - protein, 9 aa, Homo Sapiens
MSSCCRPQC

SEQ ID NO: 1203758 - protein, 9 aa, Homo Sapiens
ASGHPLSQL

SEQ ID NO: 1203759 - protein, 9 aa, Homo Sapiens
GGAGIGFDL

SEQ ID NO: 1203760 - protein, 9 aa, Homo Sapiens
CMSSCCRPQ

SEQ ID NO: 1203761 - protein, 9 aa, Homo Sapiens
TTGMTSMTI

SEQ ID NO: 1203762 - protein, 9 aa, Homo Sapiens
YCRPSCCMS

SEQ ID NO: 1203763 - protein, 9 aa, Homo Sapiens
SGHPLSQLL

SEQ ID NO: 1203764 - protein, 9 aa, Homo Sapiens
MTSMTIKGS

SEQ ID NO: 1203765 - protein, 9 aa, Homo Sapiens
GSTTGMTSM

SEQ ID NO: 1203766 - protein, 9 aa, Homo Sapiens
PGKKKKKLG

SEQ ID NO: 1203767 - protein, 9 aa, Homo Sapiens
SCCMSSCCR

SEQ ID NO: 1203768 - protein, 9 aa, Homo Sapiens
GHPLSQLLN

SEQ ID NO: 1203769 - protein, 9 aa, Homo Sapiens
TYCRPSCCM

SEQ ID NO: 1203770 - protein, 9 aa, Homo Sapiens
SMTIKGSGF

SEQ ID NO: 1203771 - protein, 9 aa, Homo Sapiens
APSGNASGH

SEQ ID NO: 1203772 - protein, 9 aa, Homo Sapiens
NASGHPLSQ

SEQ ID NO: 1203773 - protein, 9 aa, Homo Sapiens
CCMSSCCRP

SEQ ID NO: 1203774 - protein, 9 aa, Homo Sapiens
GFDLGGGAG

SEQ ID NO: 1203775 - protein, 9 aa, Homo Sapiens
MTIKGSGFA

SEQ ID NO: 1203776 - protein, 9 aa, Homo Sapiens
GAGIGFDLG

SEQ ID NO: 1203777 - protein, 9 aa, Homo Sapiens
TSMTIKGSG

SEQ ID NO: 1203778 - protein, 9 aa, Homo Sapiens
GGGAGIGFD

SEQ ID NO: 1203779 - protein, 9 aa, Homo Sapiens
GNASGHPLS

SEQ ID NO: 1203780 - protein, 9 aa, Homo Sapiens
IGFDLGGGA

SEQ ID NO: 1203781 - protein, 9 aa, Homo Sapiens
GKKKKKLGP

SEQ ID NO: 1203782 - protein, 9 aa, Homo Sapiens
FDLGGGAGL

SEQ ID NO: 1203783 - protein, 9 aa, Homo Sapiens
TPGKKKKKL

SEQ ID NO: 1203784 - protein, 9 aa, Homo Sapiens
STTGMTSMT

SEQ ID NO: 1203785 - protein, 9 aa, Homo Sapiens
GIGFDLGGG

SEQ ID NO: 1203786 - protein, 9 aa, Homo Sapiens
EVLLCDHNG

SEQ ID NO: 1203787 - protein, 9 aa, Homo Sapiens
AIALAFAVF

SEQ ID NO: 1203788 - protein, 9 aa, Homo Sapiens
KEIKRNASG

SEQ ID NO: 1203789 - protein, 9 aa, Homo Sapiens
DLTRPQDCT

SEQ ID NO: 1203790 - protein, 9 aa, Homo Sapiens
PDISGGREI

SEQ ID NO: 1203791 - protein, 9 aa, Homo Sapiens
EEDLISKEA

SEQ ID NO: 1203792 - protein, 9 aa, Homo Sapiens
PSWSPDISG

SEQ ID NO: 1203793 - protein, 9 aa, Homo Sapiens
VTVCKMHVL

SEQ ID NO: 1203794 - protein, 9 aa, Homo Sapiens
EDLISKEAS

SEQ ID NO: 1203795 - protein, 9 aa, Homo Sapiens
LKIVCEVLL

SEQ ID NO: 1203796 - protein, 9 aa, Homo Sapiens
VCEVLLCDH

SEQ ID NO: 1203797 - protein, 9 aa, Homo Sapiens
QELAKQLKE

SEQ ID NO: 1203798 - protein, 9 aa, Homo Sapiens
IALAFAVFS

SEQ ID NO: 1203799 - protein, 9 aa, Homo Sapiens
KIVCEVLLC

SEQ ID NO: 1203800 - protein, 9 aa, Homo Sapiens
AYICVFIYT

SEQ ID NO: 1203801 - protein, 9 aa, Homo Sapiens
LTRPQDCTI

SEQ ID NO: 1203802 - protein, 9 aa, Homo Sapiens
VFSPFFNPI

SEQ ID NO: 1203803 - protein, 9 aa, Homo Sapiens
ISKEASFMS

SEQ ID NO: 1203804 - protein, 9 aa, Homo Sapiens
LCDHNGGLP

SEQ ID NO: 1203805 - protein, 9 aa, Homo Sapiens
LLCDHNGGL

SEQ ID NO: 1203806 - protein, 9 aa, Homo Sapiens
AFAVFSPFF

SEQ ID NO: 1203807 - protein, 9 aa, Homo Sapiens
TRPQDCTIK

SEQ ID NO: 1203808 - protein, 9 aa, Homo Sapiens
PVTVCKMHV

SEQ ID NO: 1203809 - protein, 9 aa, Homo Sapiens
KRILPVTVC

SEQ ID NO: 1203810 - protein, 9 aa, Homo Sapiens
ALAFAVFSP

SEQ ID NO: 1203811 - protein, 9 aa, Homo Sapiens
YICVFIYTH

SEQ ID NO: 1203812 - protein, 9 aa, Homo Sapiens
FAVFSPFFN

SEQ ID NO: 1203813 - protein, 9 aa, Homo Sapiens
DLISKEASF

SEQ ID NO: 1203814 - protein, 9 aa, Homo Sapiens
SWSPDISGG

SEQ ID NO: 1203815 - protein, 9 aa, Homo Sapiens
IHAYAYICV

SEQ ID NO: 1203816 - protein, 9 aa, Homo Sapiens
QDCTIKSSQ

SEQ ID NO: 1203817 - protein, 9 aa, Homo Sapiens
DISGGREIF

SEQ ID NO: 1203818 - protein, 9 aa, Homo Sapiens
GGREIFKPR

SEQ ID NO: 1203819 - protein, 9 aa, Homo Sapiens
LKEIKRNAS

SEQ ID NO: 1203820 - protein, 9 aa, Homo Sapiens
ISGGREIFK

SEQ ID NO: 1203821 - protein, 9 aa, Homo Sapiens
PQDCTIKSS

SEQ ID NO: 1203822 - protein, 9 aa, Homo Sapiens
SGGREIFKP

SEQ ID NO: 1203823 - protein, 9 aa, Homo Sapiens
ELAKQLKEI

SEQ ID NO: 1203824 - protein, 9 aa, Homo Sapiens
IVCEVLLCD

SEQ ID NO: 1203825 - protein, 9 aa, Homo Sapiens
RPQDCTIKS

SEQ ID NO: 1203826 - protein, 9 aa, Homo Sapiens
SKEASFMSL

SEQ ID NO: 1203827 - protein, 9 aa, Homo Sapiens
LQELAKQLK

SEQ ID NO: 1203828 - protein, 9 aa, Homo Sapiens
LISKEASFM

SEQ ID NO: 1203829 - protein, 9 aa, Homo Sapiens
LPVTVCKMH

SEQ ID NO: 1203830 - protein, 9 aa, Homo Sapiens
YAYICVFIY

SEQ ID NO: 1203831 - protein, 9 aa, Homo Sapiens
AYAYICVFI

SEQ ID NO: 1203832 - protein, 9 aa, Homo Sapiens
RSKRILPVT

SEQ ID NO: 1203833 - protein, 9 aa, Homo Sapiens
VFIYTHMHT

SEQ ID NO: 1203834 - protein, 9 aa, Homo Sapiens
GLDAPLFGV

SEQ ID NO: 1203835 - protein, 9 aa, Homo Sapiens
HAYAYICVF

SEQ ID NO: 1203836 - protein, 9 aa, Homo Sapiens
ICVFIYTHM

SEQ ID NO: 1203837 - protein, 9 aa, Homo Sapiens
CTIKSSQFF

SEQ ID NO: 1203838 - protein, 9 aa, Homo Sapiens
SKRILPVTV

SEQ ID NO: 1203839 - protein, 9 aa, Homo Sapiens
ERSKRILPV

SEQ ID NO: 1203840 - protein, 9 aa, Homo Sapiens
KQLKEIKRN

SEQ ID NO: 1203841 - protein, 9 aa, Homo Sapiens
LAKQLKEIK

SEQ ID NO: 1203842 - protein, 9 aa, Homo Sapiens
DCTIKSSQF

SEQ ID NO: 1203843 - protein, 9 aa, Homo Sapiens
LAFAVFSPF

SEQ ID NO: 1203844 - protein, 9 aa, Homo Sapiens
QLKEIKRNA

SEQ ID NO: 1203845 - protein, 9 aa, Homo Sapiens
KEASFMSLN

SEQ ID NO: 1203846 - protein, 9 aa, Homo Sapiens
ASFMSLNRL

SEQ ID NO: 1203847 - protein, 9 aa, Homo Sapiens
AKQLKEIKR

SEQ ID NO: 1203848 - protein, 9 aa, Homo Sapiens
WSPDISGGR

SEQ ID NO: 1203849 - protein, 9 aa, Homo Sapiens
AVFSPFFNP

SEQ ID NO: 1203850 - protein, 9 aa, Homo Sapiens
RILPVTVCK

SEQ ID NO: 1203851 - protein, 9 aa, Homo Sapiens
CVFIYTHMH

SEQ ID NO: 1203852 - protein, 9 aa, Homo Sapiens
SDLTRPQDC

SEQ ID NO: 1203853 - protein, 9 aa, Homo Sapiens
ILPVTVCKM

SEQ ID NO: 1203854 - protein, 9 aa, Homo Sapiens
EASFMSLNR

SEQ ID NO: 1203855 - protein, 9 aa, Homo Sapiens
VLLCDHNGG

SEQ ID NO: 1203856 - protein, 9 aa, Homo Sapiens
CEVLLCDHN

SEQ ID NO: 1203857 - protein, 9 aa, Homo Sapiens
FSPFFNPII

SEQ ID NO: 1203858 - protein, 9 aa, Homo Sapiens
SPDISGGRE

SEQ ID NO: 1203859 - protein, 9 aa, Homo Sapiens
PDKLHSLAL

SEQ ID NO: 1203860 - protein, 9 aa, Homo Sapiens
HAAFTGSQD

SEQ ID NO: 1203861 - protein, 9 aa, Homo Sapiens
TELLLLGFL

SEQ ID NO: 1203862 - protein, 9 aa, Homo Sapiens
WLRRYLENR

SEQ ID NO: 1203863 - protein, 9 aa, Homo Sapiens
TAYWTNFAK

SEQ ID NO: 1203864 - protein, 9 aa, Homo Sapiens
TRVVPDKLH

SEQ ID NO: 1203865 - protein, 9 aa, Homo Sapiens
QKFAGLGFL

SEQ ID NO: 1203866 - protein, 9 aa, Homo Sapiens
KREPGELSG

SEQ ID NO: 1203867 - protein, 9 aa, Homo Sapiens
YFRKKREED

SEQ ID NO: 1203868 - protein, 9 aa, Homo Sapiens
VTTHKCMHH

SEQ ID NO: 1203869 - protein, 9 aa, Homo Sapiens
NRKETLQRT

SEQ ID NO: 1203870 - protein, 9 aa, Homo Sapiens
KKGKERQEG

SEQ ID NO: 1203871 - protein, 9 aa, Homo Sapiens
AQLLGCSHV

SEQ ID NO: 1203872 - protein, 9 aa, Homo Sapiens
CSSWGPGSF

SEQ ID NO: 1203873 - protein, 9 aa, Homo Sapiens
TICCCCCWA

SEQ ID NO: 1203874 - protein, 9 aa, Homo Sapiens
GSFTRSCGY

SEQ ID NO: 1203875 - protein, 9 aa, Homo Sapiens
FLISPSSCS

SEQ ID NO: 1203876 - protein, 9 aa, Homo Sapiens
PSSCSSWGP

SEQ ID NO: 1203877 - protein, 9 aa, Homo Sapiens
CGYPTLCSS

SEQ ID NO: 1203878 - protein, 9 aa, Homo Sapiens
AASAVSGLS

SEQ ID NO: 1203879 - protein, 9 aa, Homo Sapiens
WGPGSFTRS

SEQ ID NO: 1203880 - protein, 9 aa, Homo Sapiens
PTLCSSWIS

SEQ ID NO: 1203881 - protein, 9 aa, Homo Sapiens
FRKKREEDG

SEQ ID NO: 1203882 - protein, 9 aa, Homo Sapiens
DLCLYKGSL

SEQ ID NO: 1203883 - protein, 9 aa, Homo Sapiens
HVCSRTPVE

SEQ ID NO: 1203884 - protein, 9 aa, Homo Sapiens
CLYKGSLGL

SEQ ID NO: 1203885 - protein, 9 aa, Homo Sapiens
NVARYFRKK

SEQ ID NO: 1203886 - protein, 9 aa, Homo Sapiens
AGLGFLISP

SEQ ID NO: 1203887 - protein, 9 aa, Homo Sapiens
QRPPQKFAG

SEQ ID NO: 1203888 - protein, 9 aa, Homo Sapiens
GELSGVWTS

SEQ ID NO: 1203889 - protein, 9 aa, Homo Sapiens
REPGELSGV

SEQ ID NO: 1203890 - protein, 9 aa, Homo Sapiens
RPPQKFAGL

SEQ ID NO: 1203891 - protein, 9 aa, Homo Sapiens
FTRSCGYPT

SEQ ID NO: 1203892 - protein, 9 aa, Homo Sapiens
AMTAYWTNF

SEQ ID NO: 1203893 - protein, 9 aa, Homo Sapiens
SCGYPTLCS

SEQ ID NO: 1203894 - protein, 9 aa, Homo Sapiens
TRSCGYPTL

SEQ ID NO: 1203895 - protein, 9 aa, Homo Sapiens
QTMVTELLL

SEQ ID NO: 1203896 - protein, 9 aa, Homo Sapiens
CSSWISKRE

SEQ ID NO: 1203897 - protein, 9 aa, Homo Sapiens
TVSKAMTAY

SEQ ID NO: 1203898 - protein, 9 aa, Homo Sapiens
GSQDLCLYK

SEQ ID NO: 1203899 - protein, 9 aa, Homo Sapiens
YIISDMKVA

SEQ ID NO: 1203900 - protein, 9 aa, Homo Sapiens
SQDLCLYKG

SEQ ID NO: 1203901 - protein, 9 aa, Homo Sapiens
KGKERQEGQ

SEQ ID NO: 1203902 - protein, 9 aa, Homo Sapiens
LCLYKGSLG

SEQ ID NO: 1203903 - protein, 9 aa, Homo Sapiens
ENQTMVTEL

SEQ ID NO: 1203904 - protein, 9 aa, Homo Sapiens
KCMHHEVKR

SEQ ID NO: 1203905 - protein, 9 aa, Homo Sapiens
LENRKETLQ

SEQ ID NO: 1203906 - protein, 9 aa, Homo Sapiens
ICCCCCWAP

SEQ ID NO: 1203907 - protein, 9 aa, Homo Sapiens
IKKKKKKKG

SEQ ID NO: 1203908 - protein, 9 aa, Homo Sapiens
SWISKREPG

SEQ ID NO: 1203909 - protein, 9 aa, Homo Sapiens
LTICCCCCW

SEQ ID NO: 1203910 - protein, 9 aa, Homo Sapiens
RKKREEDGH

SEQ ID NO: 1203911 - protein, 9 aa, Homo Sapiens
SKAMTAYWT

SEQ ID NO: 1203912 - protein, 9 aa, Homo Sapiens
SSWISKREP

SEQ ID NO: 1203913 - protein, 9 aa, Homo Sapiens
YLENRKETL

SEQ ID NO: 1203914 - protein, 9 aa, Homo Sapiens
VCSRTPVET

SEQ ID NO: 1203915 - protein, 9 aa, Homo Sapiens
GPGSFTRSC

SEQ ID NO: 1203916 - protein, 9 aa, Homo Sapiens
SSWGPGSFT

SEQ ID NO: 1203917 - protein, 9 aa, Homo Sapiens
KAMTAYWTN

SEQ ID NO: 1203918 - protein, 9 aa, Homo Sapiens
MTAYWTNFA

SEQ ID NO: 1203919 - protein, 9 aa, Homo Sapiens
GYPTLCSSW

SEQ ID NO: 1203920 - protein, 9 aa, Homo Sapiens
FTGSQDLCL

SEQ ID NO: 1203921 - protein, 9 aa, Homo Sapiens
KRPKISFSY

SEQ ID NO: 1203922 - protein, 9 aa, Homo Sapiens
WTSAWRTHA

SEQ ID NO: 1203923 - protein, 9 aa, Homo Sapiens
LHSLALGVS

SEQ ID NO: 1203924 - protein, 9 aa, Homo Sapiens
ERQEGQRPP

SEQ ID NO: 1203925 - protein, 9 aa, Homo Sapiens
KLHSLALGV

SEQ ID NO: 1203926 - protein, 9 aa, Homo Sapiens
PGELSGVWT

SEQ ID NO: 1203927 - protein, 9 aa, Homo Sapiens
ISFSYIISD

SEQ ID NO: 1203928 - protein, 9 aa, Homo Sapiens
SAVSGLSRQ

SEQ ID NO: 1203929 - protein, 9 aa, Homo Sapiens
RPKISFSYI

SEQ ID NO: 1203930 - protein, 9 aa, Homo Sapiens
FSYIISDMK

SEQ ID NO: 1203931 - protein, 9 aa, Homo Sapiens
QEGQRPPQK

SEQ ID NO: 1203932 - protein, 9 aa, Homo Sapiens
QLLGCSHVC

SEQ ID NO: 1203933 - protein, 9 aa, Homo Sapiens
WISKREPGE

SEQ ID NO: 1203934 - protein, 9 aa, Homo Sapiens
VVPDKLHSL

SEQ ID NO: 1203935 - protein, 9 aa, Homo Sapiens
EPGELSGVW

SEQ ID NO: 1203936 - protein, 9 aa, Homo Sapiens
RTVSKAMTA

SEQ ID NO: 1203937 - protein, 9 aa, Homo Sapiens
ELLLLGFLL

SEQ ID NO: 1203938 - protein, 9 aa, Homo Sapiens
VWTSAWRTH

SEQ ID NO: 1203939 - protein, 9 aa, Homo Sapiens
KFAGLGFLI

SEQ ID NO: 1203940 - protein, 9 aa, Homo Sapiens
HKCMHHEVK

SEQ ID NO: 1203941 - protein, 9 aa, Homo Sapiens
LSGVWTSAW

SEQ ID NO: 1203942 - protein, 9 aa, Homo Sapiens
GNVARYFRK

SEQ ID NO: 1203943 - protein, 9 aa, Homo Sapiens
PGSFTRSCG

SEQ ID NO: 1203944 - protein, 9 aa, Homo Sapiens
PPQKFAGLG

SEQ ID NO: 1203945 - protein, 9 aa, Homo Sapiens
ELSGVWTSA

SEQ ID NO: 1203946 - protein, 9 aa, Homo Sapiens
ISPSSCSSW

SEQ ID NO: 1203947 - protein, 9 aa, Homo Sapiens
LYKGSLGLH

SEQ ID NO: 1203948 - protein, 9 aa, Homo Sapiens
PQKFAGLGF

SEQ ID NO: 1203949 - protein, 9 aa, Homo Sapiens
TGSQDLCLY

SEQ ID NO: 1203950 - protein, 9 aa, Homo Sapiens
AWRTHAAFT

SEQ ID NO: 1203951 - protein, 9 aa, Homo Sapiens
TTHKCMHHE

SEQ ID NO: 1203952 - protein, 9 aa, Homo Sapiens
SFTRSCGYP

SEQ ID NO: 1203953 - protein, 9 aa, Homo Sapiens
LISPSSCSS

SEQ ID NO: 1203954 - protein, 9 aa, Homo Sapiens
QDLCLYKGS

SEQ ID NO: 1203955 - protein, 9 aa, Homo Sapiens
RYFRKKREE

SEQ ID NO: 1203956 - protein, 9 aa, Homo Sapiens
WRTHAAFTG

SEQ ID NO: 1203957 - protein, 9 aa, Homo Sapiens
ISKREPGEL

SEQ ID NO: 1203958 - protein, 9 aa, Homo Sapiens
SYIISDMKV

SEQ ID NO: 1203959 - protein, 9 aa, Homo Sapiens
AFTGSQDLC

SEQ ID NO: 1203960 - protein, 9 aa, Homo Sapiens
GCSHVCSRT

SEQ ID NO: 1203961 - protein, 9 aa, Homo Sapiens
LCSSWISKR

SEQ ID NO: 1203962 - protein, 9 aa, Homo Sapiens
RYLENRKET

SEQ ID NO: 1203963 - protein, 9 aa, Homo Sapiens
VTELLLLGF

SEQ ID NO: 1203964 - protein, 9 aa, Homo Sapiens
SGVWTSAWR

SEQ ID NO: 1203965 - protein, 9 aa, Homo Sapiens
HSLALGVSY

SEQ ID NO: 1203966 - protein, 9 aa, Homo Sapiens
TSAWRTHAA

SEQ ID NO: 1203967 - protein, 9 aa, Homo Sapiens
MAASAVSGL

SEQ ID NO: 1203968 - protein, 9 aa, Homo Sapiens
CMHHEVKRL

SEQ ID NO: 1203969 - protein, 9 aa, Homo Sapiens
SPSSCSSWG

SEQ ID NO: 1203970 - protein, 9 aa, Homo Sapiens
VARYFRKKR

SEQ ID NO: 1203971 - protein, 9 aa, Homo Sapiens
LLGCSHVCS

SEQ ID NO: 1203972 - protein, 9 aa, Homo Sapiens
KKKGKERQE

SEQ ID NO: 1203973 - protein, 9 aa, Homo Sapiens
KKKKKGKER

SEQ ID NO: 1203974 - protein, 9 aa, Homo Sapiens
CSHVCSRTP

SEQ ID NO: 1203975 - protein, 9 aa, Homo Sapiens
FAGLGFLIS

SEQ ID NO: 1203976 - protein, 9 aa, Homo Sapiens
MHHEVKRLN

SEQ ID NO: 1203977 - protein, 9 aa, Homo Sapiens
YPTLCSSWI

SEQ ID NO: 1203978 - protein, 9 aa, Homo Sapiens
AAFTGSQDL

SEQ ID NO: 1203979 - protein, 9 aa, Homo Sapiens
PKISFSYII

SEQ ID NO: 1203980 - protein, 9 aa, Homo Sapiens
TLCSSWISK

SEQ ID NO: 1203981 - protein, 9 aa, Homo Sapiens
RVVPDKLHS

SEQ ID NO: 1203982 - protein, 9 aa, Homo Sapiens
ARYFRKKRE

SEQ ID NO: 1203983 - protein, 9 aa, Homo Sapiens
GLLLLLLVT

SEQ ID NO: 1203984 - protein, 9 aa, Homo Sapiens
RSCGYPTLC

SEQ ID NO: 1203985 - protein, 9 aa, Homo Sapiens
SSCSSWGPG

SEQ ID NO: 1203986 - protein, 9 aa, Homo Sapiens
NQTMVTELL

SEQ ID NO: 1203987 - protein, 9 aa, Homo Sapiens
SWGPGSFTR

SEQ ID NO: 1203988 - protein, 9 aa, Homo Sapiens
KISFSYIIS

SEQ ID NO: 1203989 - protein, 9 aa, Homo Sapiens
LGCSHVCSR

SEQ ID NO: 1203990 - protein, 9 aa, Homo Sapiens
SAWRTHAAF

SEQ ID NO: 1203991 - protein, 9 aa, Homo Sapiens
GKERQEGQR

SEQ ID NO: 1203992 - protein, 9 aa, Homo Sapiens
SKREPGELS

SEQ ID NO: 1203993 - protein, 9 aa, Homo Sapiens
THAAFTGSQ

SEQ ID NO: 1203994 - protein, 9 aa, Homo Sapiens
GVWTSAWRT

SEQ ID NO: 1203995 - protein, 9 aa, Homo Sapiens
RRYLENRKE

SEQ ID NO: 1203996 - protein, 9 aa, Homo Sapiens
RQEGQRPPQ

SEQ ID NO: 1203997 - protein, 9 aa, Homo Sapiens
SCSSWGPGS

SEQ ID NO: 1203998 - protein, 9 aa, Homo Sapiens
LRRYLENRK

SEQ ID NO: 1203999 - protein, 9 aa, Homo Sapiens
MVTELLLLG

SEQ ID NO: 1204000 - protein, 9 aa, Homo Sapiens
RKETLQRTD

SEQ ID NO: 1204001 - protein, 9 aa, Homo Sapiens
THKCMHHEV

SEQ ID NO: 1204002 - protein, 9 aa, Homo Sapiens
YKGSLGLHI

SEQ ID NO: 1204003 - protein, 9 aa, Homo Sapiens
VPDKLHSLA

SEQ ID NO: 1204004 - protein, 9 aa, Homo Sapiens
DKLHSLALG

SEQ ID NO: 1204005 - protein, 9 aa, Homo Sapiens
ELVTTHKCM

SEQ ID NO: 1204006 - protein, 9 aa, Homo Sapiens
GLGFLISPS

SEQ ID NO: 1204007 - protein, 9 aa, Homo Sapiens
VSKAMTAYW

SEQ ID NO: 1204008 - protein, 9 aa, Homo Sapiens
TMVTELLLL

SEQ ID NO: 1204009 - protein, 9 aa, Homo Sapiens
GGLLLLLLV

SEQ ID NO: 1204010 - protein, 9 aa, Homo Sapiens
SHVCSRTPV

SEQ ID NO: 1204011 - protein, 9 aa, Homo Sapiens
GGSSSSSSD

SEQ ID NO: 1204012 - protein, 9 aa, Homo Sapiens
KERQEGQRP

SEQ ID NO: 1204013 - protein, 9 aa, Homo Sapiens
SFSYIISDM

SEQ ID NO: 1204014 - protein, 9 aa, Homo Sapiens
LLLLGFLLG

SEQ ID NO: 1204015 - protein, 9 aa, Homo Sapiens
EGQRPPQKF

SEQ ID NO: 1204016 - protein, 9 aa, Homo Sapiens
DRTVSKAMT

SEQ ID NO: 1204017 - protein, 9 aa, Homo Sapiens
RTHAAFTGS

SEQ ID NO: 1204018 - protein, 9 aa, Homo Sapiens
YGNVARYFR

SEQ ID NO: 1204019 - protein, 9 aa, Homo Sapiens
GQRPPQKFA

SEQ ID NO: 1204020 - protein, 9 aa, Homo Sapiens
ENRKETLQR

SEQ ID NO: 1204021 - protein, 9 aa, Homo Sapiens
KKKKGKERQ

SEQ ID NO: 1204022 - protein, 9 aa, Homo Sapiens
LVTTHKCMH

SEQ ID NO: 1204023 - protein, 9 aa, Homo Sapiens
LGFLISPSS

SEQ ID NO: 1204024 - protein, 9 aa, Homo Sapiens
ASAVSGLSR

SEQ ID NO: 1204025 - protein, 9 aa, Homo Sapiens
GFLISPSSC

SEQ ID NO: 1204026 - protein, 9 aa, Homo Sapiens
PLRLDHSLA

SEQ ID NO: 1204027 - protein, 9 aa, Homo Sapiens
YICENAGSG

SEQ ID NO: 1204028 - protein, 9 aa, Homo Sapiens
LCLVCGFLW

SEQ ID NO: 1204029 - protein, 9 aa, Homo Sapiens
APTPPSMSP

SEQ ID NO: 1204030 - protein, 9 aa, Homo Sapiens
IGDFGLATE

SEQ ID NO: 1204031 - protein, 9 aa, Homo Sapiens
FSQYYETYI

SEQ ID NO: 1204032 - protein, 9 aa, Homo Sapiens
FLRECIIPR

SEQ ID NO: 1204033 - protein, 9 aa, Homo Sapiens
IRTARQHPP

SEQ ID NO: 1204034 - protein, 9 aa, Homo Sapiens
RMTLGCVSD

SEQ ID NO: 1204035 - protein, 9 aa, Homo Sapiens
ALTRVLASR

SEQ ID NO: 1204036 - protein, 9 aa, Homo Sapiens
AIRTARQHP

SEQ ID NO: 1204037 - protein, 9 aa, Homo Sapiens
CCTRDTCET

SEQ ID NO: 1204038 - protein, 9 aa, Homo Sapiens
SFRQLVFPR

SEQ ID NO: 1204039 - protein, 9 aa, Homo Sapiens
AAAIRTARQ

SEQ ID NO: 1204040 - protein, 9 aa, Homo Sapiens
AVQSLRDRE

SEQ ID NO: 1204041 - protein, 9 aa, Homo Sapiens
GCVSDHWAQ

SEQ ID NO: 1204042 - protein, 9 aa, Homo Sapiens
LRLDHSLAA

SEQ ID NO: 1204043 - protein, 9 aa, Homo Sapiens
SHGRCTLIV

SEQ ID NO: 1204044 - protein, 9 aa, Homo Sapiens
CPAPCGCAG

SEQ ID NO: 1204045 - protein, 9 aa, Homo Sapiens
LVCGFLWFL

SEQ ID NO: 1204046 - protein, 9 aa, Homo Sapiens
EIGHFLREC

SEQ ID NO: 1204047 - protein, 9 aa, Homo Sapiens
DEFERQLSE

SEQ ID NO: 1204048 - protein, 9 aa, Homo Sapiens
TKSEELNLH

SEQ ID NO: 1204049 - protein, 9 aa, Homo Sapiens
LNLHIKYII

SEQ ID NO: 1204050 - protein, 9 aa, Homo Sapiens
LPEAPHPGK

SEQ ID NO: 1204051 - protein, 9 aa, Homo Sapiens
SGCRGVSAK

SEQ ID NO: 1204052 - protein, 9 aa, Homo Sapiens
QQLSITQSL

SEQ ID NO: 1204053 - protein, 9 aa, Homo Sapiens
RDTGLGDKR

SEQ ID NO: 1204054 - protein, 9 aa, Homo Sapiens
KQQLSITQS

SEQ ID NO: 1204055 - protein, 9 aa, Homo Sapiens
PSMSPASNT

SEQ ID NO: 1204056 - protein, 9 aa, Homo Sapiens
TCETRNRGI

SEQ ID NO: 1204057 - protein, 9 aa, Homo Sapiens
GKPSGCRGV

SEQ ID NO: 1204058 - protein, 9 aa, Homo Sapiens
RQLVFPRFE

SEQ ID NO: 1204059 - protein, 9 aa, Homo Sapiens
GLLLSGGDR

SEQ ID NO: 1204060 - protein, 9 aa, Homo Sapiens
TGHIANCAL

SEQ ID NO: 1204061 - protein, 9 aa, Homo Sapiens
IRSYPPLRL

SEQ ID NO: 1204062 - protein, 9 aa, Homo Sapiens
GLGDKRFPL

SEQ ID NO: 1204063 - protein, 9 aa, Homo Sapiens
YEISHGRCT

SEQ ID NO: 1204064 - protein, 9 aa, Homo Sapiens
ILRSHLIVL

SEQ ID NO: 1204065 - protein, 9 aa, Homo Sapiens
VSAKTKTAL

SEQ ID NO: 1204066 - protein, 9 aa, Homo Sapiens
MIRMTLGCV

SEQ ID NO: 1204067 - protein, 9 aa, Homo Sapiens
CVRNFLYIL

SEQ ID NO: 1204068 - protein, 9 aa, Homo Sapiens
EEDSFRQLV

SEQ ID NO: 1204069 - protein, 9 aa, Homo Sapiens
VCTANQGNG

SEQ ID NO: 1204070 - protein, 9 aa, Homo Sapiens
ISHGRCTLI

SEQ ID NO: 1204071 - protein, 9 aa, Homo Sapiens
GCCTRDTCE

SEQ ID NO: 1204072 - protein, 9 aa, Homo Sapiens
TRDTCETRN

SEQ ID NO: 1204073 - protein, 9 aa, Homo Sapiens
NQLHVQLLE

SEQ ID NO: 1204074 - protein, 9 aa, Homo Sapiens
RDTCETRNR

SEQ ID NO: 1204075 - protein, 9 aa, Homo Sapiens
SEELNLHIK

SEQ ID NO: 1204076 - protein, 9 aa, Homo Sapiens
NRVKTGHIA

SEQ ID NO: 1204077 - protein, 9 aa, Homo Sapiens
PFFVCTANQ

SEQ ID NO: 1204078 - protein, 9 aa, Homo Sapiens
RWSRHRRML

SEQ ID NO: 1204079 - protein, 9 aa, Homo Sapiens
ANLYLLPQG

SEQ ID NO: 1204080 - protein, 9 aa, Homo Sapiens
CTRDTCETR

SEQ ID NO: 1204081 - protein, 9 aa, Homo Sapiens
LATEKSRWS

SEQ ID NO: 1204082 - protein, 9 aa, Homo Sapiens
IGHFLRECI

SEQ ID NO: 1204083 - protein, 9 aa, Homo Sapiens
DYEISHGRC

SEQ ID NO: 1204084 - protein, 9 aa, Homo Sapiens
EISHGRCTL

SEQ ID NO: 1204085 - protein, 9 aa, Homo Sapiens
VYGNRQSEK

SEQ ID NO: 1204086 - protein, 9 aa, Homo Sapiens
TPPSMSPAS

SEQ ID NO: 1204087 - protein, 9 aa, Homo Sapiens
GVSAKTKTA

SEQ ID NO: 1204088 - protein, 9 aa, Homo Sapiens
LHIKYIIDH

SEQ ID NO: 1204089 - protein, 9 aa, Homo Sapiens
ETYICENAG

SEQ ID NO: 1204090 - protein, 9 aa, Homo Sapiens
KPGVDVPHP

SEQ ID NO: 1204091 - protein, 9 aa, Homo Sapiens
LRECIIPRS

SEQ ID NO: 1204092 - protein, 9 aa, Homo Sapiens
ESLYNAVQS

SEQ ID NO: 1204093 - protein, 9 aa, Homo Sapiens
LELRSCKGY

SEQ ID NO: 1204094 - protein, 9 aa, Homo Sapiens
LVILCLVCG

SEQ ID NO: 1204095 - protein, 9 aa, Homo Sapiens
EPMVVMAST

SEQ ID NO: 1204096 - protein, 9 aa, Homo Sapiens
HFLRECIIP

SEQ ID NO: 1204097 - protein, 9 aa, Homo Sapiens
NRQSEKPDE

SEQ ID NO: 1204098 - protein, 9 aa, Homo Sapiens
VKQQLSITQ

SEQ ID NO: 1204099 - protein, 9 aa, Homo Sapiens
GGDRWSRHR

SEQ ID NO: 1204100 - protein, 9 aa, Homo Sapiens
GHFLRECII

SEQ ID NO: 1204101 - protein, 9 aa, Homo Sapiens
CIIPRSVLY

SEQ ID NO: 1204102 - protein, 9 aa, Homo Sapiens
YIRSYPPLR

SEQ ID NO: 1204103 - protein, 9 aa, Homo Sapiens
TVRTTPVTS

SEQ ID NO: 1204104 - protein, 9 aa, Homo Sapiens
INPQHARCV

SEQ ID NO: 1204105 - protein, 9 aa, Homo Sapiens
QLLELRSCK

SEQ ID NO: 1204106 - protein, 9 aa, Homo Sapiens
QLVFPRFEE

SEQ ID NO: 1204107 - protein, 9 aa, Homo Sapiens
YETYICENA

SEQ ID NO: 1204108 - protein, 9 aa, Homo Sapiens
HLANLYLLP

SEQ ID NO: 1204109 - protein, 9 aa, Homo Sapiens
VVMASTAVA

SEQ ID NO: 1204110 - protein, 9 aa, Homo Sapiens
CETRNRGIS

SEQ ID NO: 1204111 - protein, 9 aa, Homo Sapiens
LAPTPPSMS

SEQ ID NO: 1204112 - protein, 9 aa, Homo Sapiens
VQSLRDREF

SEQ ID NO: 1204113 - protein, 9 aa, Homo Sapiens
GCRGVSAKT

SEQ ID NO: 1204114 - protein, 9 aa, Homo Sapiens
TGLGDKRFP

SEQ ID NO: 1204115 - protein, 9 aa, Homo Sapiens
AAAAAAIRT

SEQ ID NO: 1204116 - protein, 9 aa, Homo Sapiens
APCGCAGTL

SEQ ID NO: 1204117 - protein, 9 aa, Homo Sapiens
MVVMASTAV

SEQ ID NO: 1204118 - protein, 9 aa, Homo Sapiens
ELNLHIKYI

SEQ ID NO: 1204119 - protein, 9 aa, Homo Sapiens
PMVVMASTA

SEQ ID NO: 1204120 - protein, 9 aa, Homo Sapiens
QGLILRSHL

SEQ ID NO: 1204121 - protein, 9 aa, Homo Sapiens
PCGCAGTLV

SEQ ID NO: 1204122 - protein, 9 aa, Homo Sapiens
DKRFPLDTA

SEQ ID NO: 1204123 - protein, 9 aa, Homo Sapiens
SHMRLFLFG

SEQ ID NO: 1204124 - protein, 9 aa, Homo Sapiens
GEPMVVMAS

SEQ ID NO: 1204125 - protein, 9 aa, Homo Sapiens
CTLIVTATD

SEQ ID NO: 1204126 - protein, 9 aa, Homo Sapiens
AKLVILCLV

SEQ ID NO: 1204127 - protein, 9 aa, Homo Sapiens
KAPRALPEA

SEQ ID NO: 1204128 - protein, 9 aa, Homo Sapiens
SKSYLSHMR

SEQ ID NO: 1204129 - protein, 9 aa, Homo Sapiens
PPLRLDHSL

SEQ ID NO: 1204130 - protein, 9 aa, Homo Sapiens
HFKNVKQQL

SEQ ID NO: 1204131 - protein, 9 aa, Homo Sapiens
ERQLSENKQ

SEQ ID NO: 1204132 - protein, 9 aa, Homo Sapiens
ILCLVCGFL

SEQ ID NO: 1204133 - protein, 9 aa, Homo Sapiens
QHARCVRNF

SEQ ID NO: 1204134 - protein, 9 aa, Homo Sapiens
NVKQQLSIT

SEQ ID NO: 1204135 - protein, 9 aa, Homo Sapiens
SAGEPMVVM

SEQ ID NO: 1204136 - protein, 9 aa, Homo Sapiens
RECIIPRSV

SEQ ID NO: 1204137 - protein, 9 aa, Homo Sapiens
NLHIKYIID

SEQ ID NO: 1204138 - protein, 9 aa, Homo Sapiens
VDVPHPWGL

SEQ ID NO: 1204139 - protein, 9 aa, Homo Sapiens
EKSRWSGSH

SEQ ID NO: 1204140 - protein, 9 aa, Homo Sapiens
RSHLIVLLK

SEQ ID NO: 1204141 - protein, 9 aa, Homo Sapiens
AAAAAIRTA

SEQ ID NO: 1204142 - protein, 9 aa, Homo Sapiens
RSALTRVLA

SEQ ID NO: 1204143 - protein, 9 aa, Homo Sapiens
RTTPVTSSA

SEQ ID NO: 1204144 - protein, 9 aa, Homo Sapiens
CLVCGFLWF

SEQ ID NO: 1204145 - protein, 9 aa, Homo Sapiens
EFERQLSEN

SEQ ID NO: 1204146 - protein, 9 aa, Homo Sapiens
YGNRQSEKP

SEQ ID NO: 1204147 - protein, 9 aa, Homo Sapiens
PGVDVPHPW

SEQ ID NO: 1204148 - protein, 9 aa, Homo Sapiens
PVPLPFFVC

SEQ ID NO: 1204149 - protein, 9 aa, Homo Sapiens
VMASTAVAV

SEQ ID NO: 1204150 - protein, 9 aa, Homo Sapiens
GLILRSHLI

SEQ ID NO: 1204151 - protein, 9 aa, Homo Sapiens
YNRVKTGHI

SEQ ID NO: 1204152 - protein, 9 aa, Homo Sapiens
MVLISCHGL

SEQ ID NO: 1204153 - protein, 9 aa, Homo Sapiens
MSPASNTQS

SEQ ID NO: 1204154 - protein, 9 aa, Homo Sapiens
RVKTGHIAN

SEQ ID NO: 1204155 - protein, 9 aa, Homo Sapiens
SYPPLRLDH

SEQ ID NO: 1204156 - protein, 9 aa, Homo Sapiens
HIANCALPC

SEQ ID NO: 1204157 - protein, 9 aa, Homo Sapiens
FDEFERQLS

SEQ ID NO: 1204158 - protein, 9 aa, Homo Sapiens
GHIANCALP

SEQ ID NO: 1204159 - protein, 9 aa, Homo Sapiens
PSGCRGVSA

SEQ ID NO: 1204160 - protein, 9 aa, Homo Sapiens
VPLPFFVCT

SEQ ID NO: 1204161 - protein, 9 aa, Homo Sapiens
HIKYIIDHF

SEQ ID NO: 1204162 - protein, 9 aa, Homo Sapiens
CAKLVILCL

SEQ ID NO: 1204163 - protein, 9 aa, Homo Sapiens
YMIRMTLGC

SEQ ID NO: 1204164 - protein, 9 aa, Homo Sapiens
QLHVQLLEL

SEQ ID NO: 1204165 - protein, 9 aa, Homo Sapiens
CVSDHWAQY

SEQ ID NO: 1204166 - protein, 9 aa, Homo Sapiens
KNVKQQLSI

SEQ ID NO: 1204167 - protein, 9 aa, Homo Sapiens
LSENKQERD

SEQ ID NO: 1204168 - protein, 9 aa, Homo Sapiens
ALPEAPHPG

SEQ ID NO: 1204169 - protein, 9 aa, Homo Sapiens
FFVCTANQG

SEQ ID NO: 1204170 - protein, 9 aa, Homo Sapiens
QYYETYICE

SEQ ID NO: 1204171 - protein, 9 aa, Homo Sapiens
HMRLFLFGF

SEQ ID NO: 1204172 - protein, 9 aa, Homo Sapiens
GLATEKSRW

SEQ ID NO: 1204173 - protein, 9 aa, Homo Sapiens
GNRQSEKPD

SEQ ID NO: 1204174 - protein, 9 aa, Homo Sapiens
MTLGCVSDH

SEQ ID NO: 1204175 - protein, 9 aa, Homo Sapiens
GDKRFPLDT

SEQ ID NO: 1204176 - protein, 9 aa, Homo Sapiens
GDFGLATEK

SEQ ID NO: 1204177 - protein, 9 aa, Homo Sapiens
AAIRTARQH

SEQ ID NO: 1204178 - protein, 9 aa, Homo Sapiens
LYLLPQGAQ

SEQ ID NO: 1204179 - protein, 9 aa, Homo Sapiens
HARCVRNFL

SEQ ID NO: 1204180 - protein, 9 aa, Homo Sapiens
LGDKRFPLD

SEQ ID NO: 1204181 - protein, 9 aa, Homo Sapiens
VKTGHIANC

SEQ ID NO: 1204182 - protein, 9 aa, Homo Sapiens
RGVSAKTKT

SEQ ID NO: 1204183 - protein, 9 aa, Homo Sapiens
TLGCVSDHW

SEQ ID NO: 1204184 - protein, 9 aa, Homo Sapiens
VLRSALTRV

SEQ ID NO: 1204185 - protein, 9 aa, Homo Sapiens
DFGLATEKS

SEQ ID NO: 1204186 - protein, 9 aa, Homo Sapiens
RQLSENKQE

SEQ ID NO: 1204187 - protein, 9 aa, Homo Sapiens
RSYPPLRLD

SEQ ID NO: 1204188 - protein, 9 aa, Homo Sapiens
EDSFRQLVF

SEQ ID NO: 1204189 - protein, 9 aa, Homo Sapiens
PPSMSPASN

SEQ ID NO: 1204190 - protein, 9 aa, Homo Sapiens
RSAAAAAAI

SEQ ID NO: 1204191 - protein, 9 aa, Homo Sapiens
HGRCTLIVT

SEQ ID NO: 1204192 - protein, 9 aa, Homo Sapiens
YHESLYNAV

SEQ ID NO: 1204193 - protein, 9 aa, Homo Sapiens
KRFPLDTAE

SEQ ID NO: 1204194 - protein, 9 aa, Homo Sapiens
LYAHVYGNR

SEQ ID NO: 1204195 - protein, 9 aa, Homo Sapiens
LTRVLASRT

SEQ ID NO: 1204196 - protein, 9 aa, Homo Sapiens
KTVHLANLY

SEQ ID NO: 1204197 - protein, 9 aa, Homo Sapiens
KTGHIANCA

SEQ ID NO: 1204198 - protein, 9 aa, Homo Sapiens
SLYNAVQSL

SEQ ID NO: 1204199 - protein, 9 aa, Homo Sapiens
PTPPSMSPA

SEQ ID NO: 1204200 - protein, 9 aa, Homo Sapiens
LSGGDRWSR

SEQ ID NO: 1204201 - protein, 9 aa, Homo Sapiens
QSILFSTDV

SEQ ID NO: 1204202 - protein, 9 aa, Homo Sapiens
ARCVRNFLY

SEQ ID NO: 1204203 - protein, 9 aa, Homo Sapiens
CRGVSAKTK

SEQ ID NO: 1204204 - protein, 9 aa, Homo Sapiens
HVYGNRQSE

SEQ ID NO: 1204205 - protein, 9 aa, Homo Sapiens
RALPEAPHP

SEQ ID NO: 1204206 - protein, 9 aa, Homo Sapiens
NINPQHARC

SEQ ID NO: 1204207 - protein, 9 aa, Homo Sapiens
SKAPRALPE

SEQ ID NO: 1204208 - protein, 9 aa, Homo Sapiens
LRSALTRVL

SEQ ID NO: 1204209 - protein, 9 aa, Homo Sapiens
LANLYLLPQ

SEQ ID NO: 1204210 - protein, 9 aa, Homo Sapiens
SHLIVLLKH

SEQ ID NO: 1204211 - protein, 9 aa, Homo Sapiens
PKPGVDVPH

SEQ ID NO: 1204212 - protein, 9 aa, Homo Sapiens
DTCETRNRG

SEQ ID NO: 1204213 - protein, 9 aa, Homo Sapiens
SENKQERDK

SEQ ID NO: 1204214 - protein, 9 aa, Homo Sapiens
YLLPQGAQA

SEQ ID NO: 1204215 - protein, 9 aa, Homo Sapiens
SPASNTQSP

SEQ ID NO: 1204216 - protein, 9 aa, Homo Sapiens
SALTRVLAS

SEQ ID NO: 1204217 - protein, 9 aa, Homo Sapiens
AKVPKPGVD

SEQ ID NO: 1204218 - protein, 9 aa, Homo Sapiens
VILCLVCGF

SEQ ID NO: 1204219 - protein, 9 aa, Homo Sapiens
AGCPAPCGC

SEQ ID NO: 1204220 - protein, 9 aa, Homo Sapiens
PRALPEAPH

SEQ ID NO: 1204221 - protein, 9 aa, Homo Sapiens
AHVYGNRQS

SEQ ID NO: 1204222 - protein, 9 aa, Homo Sapiens
ITVRTTPVT

SEQ ID NO: 1204223 - protein, 9 aa, Homo Sapiens
LRSHLIVLL

SEQ ID NO: 1204224 - protein, 9 aa, Homo Sapiens
RQSILFSTD

SEQ ID NO: 1204225 - protein, 9 aa, Homo Sapiens
CTANQGNGT

SEQ ID NO: 1204226 - protein, 9 aa, Homo Sapiens
PQHARCVRN

SEQ ID NO: 1204227 - protein, 9 aa, Homo Sapiens
PLPFFVCTA

SEQ ID NO: 1204228 - protein, 9 aa, Homo Sapiens
RCVRNFLYI

SEQ ID NO: 1204229 - protein, 9 aa, Homo Sapiens
PAPCGCAGT

SEQ ID NO: 1204230 - protein, 9 aa, Homo Sapiens
QLSENKQER

SEQ ID NO: 1204231 - protein, 9 aa, Homo Sapiens
HVQLLELRS

SEQ ID NO: 1204232 - protein, 9 aa, Homo Sapiens
DSFRQLVFP

SEQ ID NO: 1204233 - protein, 9 aa, Homo Sapiens
GVDVPHPWG

SEQ ID NO: 1204234 - protein, 9 aa, Homo Sapiens
RQSEKPDEN

SEQ ID NO: 1204235 - protein, 9 aa, Homo Sapiens
LYNAVQSLR

SEQ ID NO: 1204236 - protein, 9 aa, Homo Sapiens
LLLSGGDRW

SEQ ID NO: 1204237 - protein, 9 aa, Homo Sapiens
TVHLANLYL

SEQ ID NO: 1204238 - protein, 9 aa, Homo Sapiens
MASTAVAVT

SEQ ID NO: 1204239 - protein, 9 aa, Homo Sapiens
GCAGTLVDC

SEQ ID NO: 1204240 - protein, 9 aa, Homo Sapiens
LGCVSDHWA

SEQ ID NO: 1204241 - protein, 9 aa, Homo Sapiens
AGEPMVVMA

SEQ ID NO: 1204242 - protein, 9 aa, Homo Sapiens
LVFPRFEEV

SEQ ID NO: 1204243 - protein, 9 aa, Homo Sapiens
KPSGCRGVS

SEQ ID NO: 1204244 - protein, 9 aa, Homo Sapiens
LLELRSCKG

SEQ ID NO: 1204245 - protein, 9 aa, Homo Sapiens
RLFLFGFLN

SEQ ID NO: 1204246 - protein, 9 aa, Homo Sapiens
VPKPGVDVP

SEQ ID NO: 1204247 - protein, 9 aa, Homo Sapiens
FRQLVFPRF

SEQ ID NO: 1204248 - protein, 9 aa, Homo Sapiens
TRVLASRTL

SEQ ID NO: 1204249 - protein, 9 aa, Homo Sapiens
YPPLRLDHS

SEQ ID NO: 1204250 - protein, 9 aa, Homo Sapiens
VLASRTLAP

SEQ ID NO: 1204251 - protein, 9 aa, Homo Sapiens
HESLYNAVQ

SEQ ID NO: 1204252 - protein, 9 aa, Homo Sapiens
SSSKAPRAL

SEQ ID NO: 1204253 - protein, 9 aa, Homo Sapiens
YNAVQSLRD

SEQ ID NO: 1204254 - protein, 9 aa, Homo Sapiens
SGGDRWSRH

SEQ ID NO: 1204255 - protein, 9 aa, Homo Sapiens
TEKSRWSGS

SEQ ID NO: 1204256 - protein, 9 aa, Homo Sapiens
QLSITQSLC

SEQ ID NO: 1204257 - protein, 9 aa, Homo Sapiens
KSEELNLHI

SEQ ID NO: 1204258 - protein, 9 aa, Homo Sapiens
SAAAAAAIR

SEQ ID NO: 1204259 - protein, 9 aa, Homo Sapiens
HLIVLLKHK

SEQ ID NO: 1204260 - protein, 9 aa, Homo Sapiens
FKNVKQQLS

SEQ ID NO: 1204261 - protein, 9 aa, Homo Sapiens
SMSPASNTQ

SEQ ID NO: 1204262 - protein, 9 aa, Homo Sapiens
DRWSRHRRM

SEQ ID NO: 1204263 - protein, 9 aa, Homo Sapiens
ATEKSRWSG

SEQ ID NO: 1204264 - protein, 9 aa, Homo Sapiens
GRCTLIVTA

SEQ ID NO: 1204265 - protein, 9 aa, Homo Sapiens
LYNRVKTGH

SEQ ID NO: 1204266 - protein, 9 aa, Homo Sapiens
LNQLHVQLL

SEQ ID NO: 1204267 - protein, 9 aa, Homo Sapiens
KLVILCLVC

SEQ ID NO: 1204268 - protein, 9 aa, Homo Sapiens
VAKVPKPGV

SEQ ID NO: 1204269 - protein, 9 aa, Homo Sapiens
RFPLDTAEE

SEQ ID NO: 1204270 - protein, 9 aa, Homo Sapiens
VQLLELRSC

SEQ ID NO: 1204271 - protein, 9 aa, Homo Sapiens
NAVQSLRDR

SEQ ID NO: 1204272 - protein, 9 aa, Homo Sapiens
LILRSHLIV

SEQ ID NO: 1204273 - protein, 9 aa, Homo Sapiens
LQGLILRSH

SEQ ID NO: 1204274 - protein, 9 aa, Homo Sapiens
YAHVYGNRQ

SEQ ID NO: 1204275 - protein, 9 aa, Homo Sapiens
VFPRFEEVT

SEQ ID NO: 1204276 - protein, 9 aa, Homo Sapiens
AGCCTRDTC

SEQ ID NO: 1204277 - protein, 9 aa, Homo Sapiens
FVCTANQGN

SEQ ID NO: 1204278 - protein, 9 aa, Homo Sapiens
LHVQLLELR

SEQ ID NO: 1204279 - protein, 9 aa, Homo Sapiens
AAGCPAPCG

SEQ ID NO: 1204280 - protein, 9 aa, Homo Sapiens
VRTTPVTSS

SEQ ID NO: 1204281 - protein, 9 aa, Homo Sapiens
RVLASRTLA

SEQ ID NO: 1204282 - protein, 9 aa, Homo Sapiens
AAAAIRTAR

SEQ ID NO: 1204283 - protein, 9 aa, Homo Sapiens
IRMTLGCVS

SEQ ID NO: 1204284 - protein, 9 aa, Homo Sapiens
NPQHARCVR

SEQ ID NO: 1204285 - protein, 9 aa, Homo Sapiens
SYLSHMRLF

SEQ ID NO: 1204286 - protein, 9 aa, Homo Sapiens
APRALPEAP

SEQ ID NO: 1204287 - protein, 9 aa, Homo Sapiens
VLISCHGLF

SEQ ID NO: 1204288 - protein, 9 aa, Homo Sapiens
MRLFLFGFL

SEQ ID NO: 1204289 - protein, 9 aa, Homo Sapiens
EELNLHIKY

SEQ ID NO: 1204290 - protein, 9 aa, Homo Sapiens
ICENAGSGQ

SEQ ID NO: 1204291 - protein, 9 aa, Homo Sapiens
LLSGGDRWS

SEQ ID NO: 1204292 - protein, 9 aa, Homo Sapiens
LSHMRLFLF

SEQ ID NO: 1204293 - protein, 9 aa, Homo Sapiens
TYICENAGS

SEQ ID NO: 1204294 - protein, 9 aa, Homo Sapiens
LPFFVCTAN

SEQ ID NO: 1204295 - protein, 9 aa, Homo Sapiens
LMVLISCHG

SEQ ID NO: 1204296 - protein, 9 aa, Homo Sapiens
YYETYICEN

SEQ ID NO: 1204297 - protein, 9 aa, Homo Sapiens
GCPAPCGCA

SEQ ID NO: 1204298 - protein, 9 aa, Homo Sapiens
VHLANLYLL

SEQ ID NO: 1204299 - protein, 9 aa, Homo Sapiens
GDRWSRHRR

SEQ ID NO: 1204300 - protein, 9 aa, Homo Sapiens
FGLATEKSR

SEQ ID NO: 1204301 - protein, 9 aa, Homo Sapiens
NLYLLPQGA

SEQ ID NO: 1204302 - protein, 9 aa, Homo Sapiens
ECIIPRSVL

SEQ ID NO: 1204303 - protein, 9 aa, Homo Sapiens
KSYLSHMRL

SEQ ID NO: 1204304 - protein, 9 aa, Homo Sapiens
SSKAPRALP

SEQ ID NO: 1204305 - protein, 9 aa, Homo Sapiens
SHFKNVKQQ

SEQ ID NO: 1204306 - protein, 9 aa, Homo Sapiens
CGCAGTLVD

SEQ ID NO: 1204307 - protein, 9 aa, Homo Sapiens
RCTLIVTAT

SEQ ID NO: 1204308 - protein, 9 aa, Homo Sapiens
YLSHMRLFL

SEQ ID NO: 1204309 - protein, 9 aa, Homo Sapiens
KVPKPGVDV

SEQ ID NO: 1204310 - protein, 9 aa, Homo Sapiens
SQYYETYIC

SEQ ID NO: 1204311 - protein, 9 aa, Homo Sapiens
FERQLSENK

SEQ ID NO: 1204312 - protein, 9 aa, Homo Sapiens
RLDHSLAAH

SEQ ID NO: 1204313 - protein, 9 aa, Homo Sapiens
DTGLGDKRF

SEQ ID NO: 1204314 - protein, 9 aa, Homo Sapiens
GEAALVHAA

SEQ ID NO: 1204315 - protein, 9 aa, Homo Sapiens
WDCTCELVP

SEQ ID NO: 1204316 - protein, 9 aa, Homo Sapiens
LSTLALIEQ

SEQ ID NO: 1204317 - protein, 9 aa, Homo Sapiens
MCPVYDRDH

SEQ ID NO: 1204318 - protein, 9 aa, Homo Sapiens
PGEAALVHA

SEQ ID NO: 1204319 - protein, 9 aa, Homo Sapiens
LELLECLVS

SEQ ID NO: 1204320 - protein, 9 aa, Homo Sapiens
LESMQRLLR

SEQ ID NO: 1204321 - protein, 9 aa, Homo Sapiens
SHSKQEGLI

SEQ ID NO: 1204322 - protein, 9 aa, Homo Sapiens
EQFLGKREV

SEQ ID NO: 1204323 - protein, 9 aa, Homo Sapiens
PSPVVAKTE

SEQ ID NO: 1204324 - protein, 9 aa, Homo Sapiens
PGFIKVVSH

SEQ ID NO: 1204325 - protein, 9 aa, Homo Sapiens
ALIEQFLGK

SEQ ID NO: 1204326 - protein, 9 aa, Homo Sapiens
ESPGEAALV

SEQ ID NO: 1204327 - protein, 9 aa, Homo Sapiens
EAESPGEAA

SEQ ID NO: 1204328 - protein, 9 aa, Homo Sapiens
EVLAFKNQT

SEQ ID NO: 1204329 - protein, 9 aa, Homo Sapiens
KSICYAFTA

SEQ ID NO: 1204330 - protein, 9 aa, Homo Sapiens
TLCPPPSPV

SEQ ID NO: 1204331 - protein, 9 aa, Homo Sapiens
IKVVSHSKQ

SEQ ID NO: 1204332 - protein, 9 aa, Homo Sapiens
TRLLLELLE

SEQ ID NO: 1204333 - protein, 9 aa, Homo Sapiens
KELLKSICY

SEQ ID NO: 1204334 - protein, 9 aa, Homo Sapiens
LIEQFLGKR

SEQ ID NO: 1204335 - protein, 9 aa, Homo Sapiens
SPVVAKTEI

SEQ ID NO: 1204336 - protein, 9 aa, Homo Sapiens
KKWRVGTTV

SEQ ID NO: 1204337 - protein, 9 aa, Homo Sapiens
PPSPVVAKT

SEQ ID NO: 1204338 - protein, 9 aa, Homo Sapiens
AFKNQTLGL

SEQ ID NO: 1204339 - protein, 9 aa, Homo Sapiens
KPGFIKVVS

SEQ ID NO: 1204340 - protein, 9 aa, Homo Sapiens
FCYEAESPG

SEQ ID NO: 1204341 - protein, 9 aa, Homo Sapiens
GKDLESMQR

SEQ ID NO: 1204342 - protein, 9 aa, Homo Sapiens
FIKVVSHSK

SEQ ID NO: 1204343 - protein, 9 aa, Homo Sapiens
KNQTLGLID

SEQ ID NO: 1204344 - protein, 9 aa, Homo Sapiens
NPWDCTCEL

SEQ ID NO: 1204345 - protein, 9 aa, Homo Sapiens
VVAKTEIAL

SEQ ID NO: 1204346 - protein, 9 aa, Homo Sapiens
TLALIEQFL

SEQ ID NO: 1204347 - protein, 9 aa, Homo Sapiens
KDLESMQRL

SEQ ID NO: 1204348 - protein, 9 aa, Homo Sapiens
TCELVPFKQ

SEQ ID NO: 1204349 - protein, 9 aa, Homo Sapiens
YEAESPGEA

SEQ ID NO: 1204350 - protein, 9 aa, Homo Sapiens
QTLGLIDAS

SEQ ID NO: 1204351 - protein, 9 aa, Homo Sapiens
FKNQTLGLI

SEQ ID NO: 1204352 - protein, 9 aa, Homo Sapiens
ELVPFKQWI

SEQ ID NO: 1204353 - protein, 9 aa, Homo Sapiens
LPPKKKWRV

SEQ ID NO: 1204354 - protein, 9 aa, Homo Sapiens
LLECLVSRH

SEQ ID NO: 1204355 - protein, 9 aa, Homo Sapiens
IMCPVYDRD

SEQ ID NO: 1204356 - protein, 9 aa, Homo Sapiens
SICYAFTAL

SEQ ID NO: 1204357 - protein, 9 aa, Homo Sapiens
MQRLLRKHE

SEQ ID NO: 1204358 - protein, 9 aa, Homo Sapiens
CELVPFKQW

SEQ ID NO: 1204359 - protein, 9 aa, Homo Sapiens
ENPWDCTCE

SEQ ID NO: 1204360 - protein, 9 aa, Homo Sapiens
KVVSHSKQE

SEQ ID NO: 1204361 - protein, 9 aa, Homo Sapiens
LCPPPSPVV

SEQ ID NO: 1204362 - protein, 9 aa, Homo Sapiens
PVVAKTEIA

SEQ ID NO: 1204363 - protein, 9 aa, Homo Sapiens
LLKSICYAF

SEQ ID NO: 1204364 - protein, 9 aa, Homo Sapiens
RKELLKSIC

SEQ ID NO: 1204365 - protein, 9 aa, Homo Sapiens
KWRVGTTVH

SEQ ID NO: 1204366 - protein, 9 aa, Homo Sapiens
IPATNKILV

SEQ ID NO: 1204367 - protein, 9 aa, Homo Sapiens
PPPSPVVAK

SEQ ID NO: 1204368 - protein, 9 aa, Homo Sapiens
GFIKVVSHS

SEQ ID NO: 1204369 - protein, 9 aa, Homo Sapiens
YDRDHNVEF

SEQ ID NO: 1204370 - protein, 9 aa, Homo Sapiens
DLESMQRLL

SEQ ID NO: 1204371 - protein, 9 aa, Homo Sapiens
NTRLLLELL

SEQ ID NO: 1204372 - protein, 9 aa, Homo Sapiens
QLPPKKKWR

SEQ ID NO: 1204373 - protein, 9 aa, Homo Sapiens
TQFLGKLRQ

SEQ ID NO: 1204374 - protein, 9 aa, Homo Sapiens
DCTCELVPF

SEQ ID NO: 1204375 - protein, 9 aa, Homo Sapiens
VPPAIPATN

SEQ ID NO: 1204376 - protein, 9 aa, Homo Sapiens
PWDCTCELV

SEQ ID NO: 1204377 - protein, 9 aa, Homo Sapiens
ELLKSICYA

SEQ ID NO: 1204378 - protein, 9 aa, Homo Sapiens
LALIEQFLG

SEQ ID NO: 1204379 - protein, 9 aa, Homo Sapiens
QFLGKLRQV

SEQ ID NO: 1204380 - protein, 9 aa, Homo Sapiens
PPAIPATNK

SEQ ID NO: 1204381 - protein, 9 aa, Homo Sapiens
SMQRLLRKH

SEQ ID NO: 1204382 - protein, 9 aa, Homo Sapiens
SPGEAALVH

SEQ ID NO: 1204383 - protein, 9 aa, Homo Sapiens
CGKDLESMQ

SEQ ID NO: 1204384 - protein, 9 aa, Homo Sapiens
QQLPPKKKW

SEQ ID NO: 1204385 - protein, 9 aa, Homo Sapiens
PKKKWRVGT

SEQ ID NO: 1204386 - protein, 9 aa, Homo Sapiens
MDVPPAIPA

SEQ ID NO: 1204387 - protein, 9 aa, Homo Sapiens
STQFLGKLR

SEQ ID NO: 1204388 - protein, 9 aa, Homo Sapiens
PATNKILVD

SEQ ID NO: 1204389 - protein, 9 aa, Homo Sapiens
LKSICYAFT

SEQ ID NO: 1204390 - protein, 9 aa, Homo Sapiens
KMDVPPAIP

SEQ ID NO: 1204391 - protein, 9 aa, Homo Sapiens
ICYAFTALD

SEQ ID NO: 1204392 - protein, 9 aa, Homo Sapiens
VVSHSKQEG

SEQ ID NO: 1204393 - protein, 9 aa, Homo Sapiens
DRDHNVEFN

SEQ ID NO: 1204394 - protein, 9 aa, Homo Sapiens
NQTLGLIDA

SEQ ID NO: 1204395 - protein, 9 aa, Homo Sapiens
RLLLELLEC

SEQ ID NO: 1204396 - protein, 9 aa, Homo Sapiens
PVYDRDHNV

SEQ ID NO: 1204397 - protein, 9 aa, Homo Sapiens
RDHNVEFNG

SEQ ID NO: 1204398 - protein, 9 aa, Homo Sapiens
DVPPAIPAT

SEQ ID NO: 1204399 - protein, 9 aa, Homo Sapiens
CPPPSPVVA

SEQ ID NO: 1204400 - protein, 9 aa, Homo Sapiens
QFLGKREVP

SEQ ID NO: 1204401 - protein, 9 aa, Homo Sapiens
ELLECLVSR

SEQ ID NO: 1204402 - protein, 9 aa, Homo Sapiens
PAIPATNKI

SEQ ID NO: 1204403 - protein, 9 aa, Homo Sapiens
AESPGEAAL

SEQ ID NO: 1204404 - protein, 9 aa, Homo Sapiens
NIMCPVYDR

SEQ ID NO: 1204405 - protein, 9 aa, Homo Sapiens
FEVLAFKNQ

SEQ ID NO: 1204406 - protein, 9 aa, Homo Sapiens
CTCELVPFK

SEQ ID NO: 1204407 - protein, 9 aa, Homo Sapiens
STLALIEQF

SEQ ID NO: 1204408 - protein, 9 aa, Homo Sapiens
DCGKDLESM

SEQ ID NO: 1204409 - protein, 9 aa, Homo Sapiens
VSHSKQEGL

SEQ ID NO: 1204410 - protein, 9 aa, Homo Sapiens
CYEAESPGE

SEQ ID NO: 1204411 - protein, 9 aa, Homo Sapiens
VYDRDHNVE

SEQ ID NO: 1204412 - protein, 9 aa, Homo Sapiens
CYAFTALDV

SEQ ID NO: 1204413 - protein, 9 aa, Homo Sapiens
CPVYDRDHN

SEQ ID NO: 1204414 - protein, 9 aa, Homo Sapiens
AIPATNKIL

SEQ ID NO: 1204415 - protein, 9 aa, Homo Sapiens
LLELLECLV

SEQ ID NO: 1204416 - protein, 9 aa, Homo Sapiens
WRVGTTVHC

SEQ ID NO: 1204417 - protein, 9 aa, Homo Sapiens
ESMQRLLRK

SEQ ID NO: 1204418 - protein, 9 aa, Homo Sapiens
KKKWRVGTT

SEQ ID NO: 1204419 - protein, 9 aa, Homo Sapiens
NNTRLLLEL

SEQ ID NO: 1204420 - protein, 9 aa, Homo Sapiens
IEQFLGKRE

SEQ ID NO: 1204421 - protein, 9 aa, Homo Sapiens
PPKKKWRVG

SEQ ID NO: 1204422 - protein, 9 aa, Homo Sapiens
LAFKNQTLG

SEQ ID NO: 1204423 - protein, 9 aa, Homo Sapiens
VLAFKNQTL

SEQ ID NO: 1204424 - protein, 9 aa, Homo Sapiens
LLLELLECL

SEQ ID NO: 1204425 - protein, 9 aa, Homo Sapiens
VSSVDVKQV

SEQ ID NO: 1204426 - protein, 9 aa, Homo Sapiens
IGDFGLATE

SEQ ID NO: 1204427 - protein, 9 aa, Homo Sapiens
VTTTLKLIL

SEQ ID NO: 1204428 - protein, 9 aa, Homo Sapiens
TLKLILVML

SEQ ID NO: 1204429 - protein, 9 aa, Homo Sapiens
FVTLRQHKN

SEQ ID NO: 1204430 - protein, 9 aa, Homo Sapiens
KLILVMLEI

SEQ ID NO: 1204431 - protein, 9 aa, Homo Sapiens
KKLKLAPLQ

SEQ ID NO: 1204432 - protein, 9 aa, Homo Sapiens
ILYNDTDAD

SEQ ID NO: 1204433 - protein, 9 aa, Homo Sapiens
FSAVKSLIN

SEQ ID NO: 1204434 - protein, 9 aa, Homo Sapiens
NIDSVTFKD

SEQ ID NO: 1204435 - protein, 9 aa, Homo Sapiens
AANEVSSVD

SEQ ID NO: 1204436 - protein, 9 aa, Homo Sapiens
ITTPSKKKL

SEQ ID NO: 1204437 - protein, 9 aa, Homo Sapiens
PSKKKLKLA

SEQ ID NO: 1204438 - protein, 9 aa, Homo Sapiens
PLQVTTTLK

SEQ ID NO: 1204439 - protein, 9 aa, Homo Sapiens
RCTIDIDEY

SEQ ID NO: 1204440 - protein, 9 aa, Homo Sapiens
QVTTTLKLI

SEQ ID NO: 1204441 - protein, 9 aa, Homo Sapiens
LATEKSRWS

SEQ ID NO: 1204442 - protein, 9 aa, Homo Sapiens
NRLPFSAVK

SEQ ID NO: 1204443 - protein, 9 aa, Homo Sapiens
SSVDVKQVK

SEQ ID NO: 1204444 - protein, 9 aa, Homo Sapiens
IDSVTFKDF

SEQ ID NO: 1204445 - protein, 9 aa, Homo Sapiens
TFKDFILKH

SEQ ID NO: 1204446 - protein, 9 aa, Homo Sapiens
VKSLINSPS

SEQ ID NO: 1204447 - protein, 9 aa, Homo Sapiens
LQVTTTLKL

SEQ ID NO: 1204448 - protein, 9 aa, Homo Sapiens
SVDVKQVKV

SEQ ID NO: 1204449 - protein, 9 aa, Homo Sapiens
AVKSLINSP

SEQ ID NO: 1204450 - protein, 9 aa, Homo Sapiens
KDFILKHCP

SEQ ID NO: 1204451 - protein, 9 aa, Homo Sapiens
KLKLAPLQV

SEQ ID NO: 1204452 - protein, 9 aa, Homo Sapiens
KKKLKLAPL

SEQ ID NO: 1204453 - protein, 9 aa, Homo Sapiens
LVMLEIVTE

SEQ ID NO: 1204454 - protein, 9 aa, Homo Sapiens
LAPLQVTTT

SEQ ID NO: 1204455 - protein, 9 aa, Homo Sapiens
NNVILYNDT

SEQ ID NO: 1204456 - protein, 9 aa, Homo Sapiens
SAVKSLINS

SEQ ID NO: 1204457 - protein, 9 aa, Homo Sapiens
EKSRWSGSH

SEQ ID NO: 1204458 - protein, 9 aa, Homo Sapiens
QHKNEPLII

SEQ ID NO: 1204459 - protein, 9 aa, Homo Sapiens
VDVKQVKVT

SEQ ID NO: 1204460 - protein, 9 aa, Homo Sapiens
LILVMLEIV

SEQ ID NO: 1204461 - protein, 9 aa, Homo Sapiens
DEYISKPCM

SEQ ID NO: 1204462 - protein, 9 aa, Homo Sapiens
ANNVILYND

SEQ ID NO: 1204463 - protein, 9 aa, Homo Sapiens
ILVMLEIVT

SEQ ID NO: 1204464 - protein, 9 aa, Homo Sapiens
SNRLPFSAV

SEQ ID NO: 1204465 - protein, 9 aa, Homo Sapiens
VTFKDFILK

SEQ ID NO: 1204466 - protein, 9 aa, Homo Sapiens
DIDEYISKP

SEQ ID NO: 1204467 - protein, 9 aa, Homo Sapiens
YISKPCMNH

SEQ ID NO: 1204468 - protein, 9 aa, Homo Sapiens
TTTLKLILV

SEQ ID NO: 1204469 - protein, 9 aa, Homo Sapiens
RQHKNEPLI

SEQ ID NO: 1204470 - protein, 9 aa, Homo Sapiens
VLFVTLRQH

SEQ ID NO: 1204471 - protein, 9 aa, Homo Sapiens
TPSKKKLKL

SEQ ID NO: 1204472 - protein, 9 aa, Homo Sapiens
TLRQHKNEP

SEQ ID NO: 1204473 - protein, 9 aa, Homo Sapiens
YNDTDADTA

SEQ ID NO: 1204474 - protein, 9 aa, Homo Sapiens
GLATEKSRW

SEQ ID NO: 1204475 - protein, 9 aa, Homo Sapiens
SVTFKDFIL

SEQ ID NO: 1204476 - protein, 9 aa, Homo Sapiens
PFSAVKSLI

SEQ ID NO: 1204477 - protein, 9 aa, Homo Sapiens
GDFGLATEK

SEQ ID NO: 1204478 - protein, 9 aa, Homo Sapiens
RLPFSAVKS

SEQ ID NO: 1204479 - protein, 9 aa, Homo Sapiens
LKLILVMLE

SEQ ID NO: 1204480 - protein, 9 aa, Homo Sapiens
DFGLATEKS

SEQ ID NO: 1204481 - protein, 9 aa, Homo Sapiens
KAANEVSSV

SEQ ID NO: 1204482 - protein, 9 aa, Homo Sapiens
VVLFVTLRQ

SEQ ID NO: 1204483 - protein, 9 aa, Homo Sapiens
VTLRQHKNE

SEQ ID NO: 1204484 - protein, 9 aa, Homo Sapiens
EVSSVDVKQ

SEQ ID NO: 1204485 - protein, 9 aa, Homo Sapiens
MANNVILYN

SEQ ID NO: 1204486 - protein, 9 aa, Homo Sapiens
IDIDEYISK

SEQ ID NO: 1204487 - protein, 9 aa, Homo Sapiens
ATEKSRWSG

SEQ ID NO: 1204488 - protein, 9 aa, Homo Sapiens
FKDFILKHC

SEQ ID NO: 1204489 - protein, 9 aa, Homo Sapiens
APLQVTTTL

SEQ ID NO: 1204490 - protein, 9 aa, Homo Sapiens
EYISKPCMN

SEQ ID NO: 1204491 - protein, 9 aa, Homo Sapiens
TTLKLILVM

SEQ ID NO: 1204492 - protein, 9 aa, Homo Sapiens
TTPSKKKLK

SEQ ID NO: 1204493 - protein, 9 aa, Homo Sapiens
ANEVSSVDV

SEQ ID NO: 1204494 - protein, 9 aa, Homo Sapiens
ENIDSVTFK

SEQ ID NO: 1204495 - protein, 9 aa, Homo Sapiens
LRQHKNEPL

SEQ ID NO: 1204496 - protein, 9 aa, Homo Sapiens
LFVTLRQHK

SEQ ID NO: 1204497 - protein, 9 aa, Homo Sapiens
TEKSRWSGS

SEQ ID NO: 1204498 - protein, 9 aa, Homo Sapiens
LPFSAVKSL

SEQ ID NO: 1204499 - protein, 9 aa, Homo Sapiens
SKKKLKLAP

SEQ ID NO: 1204500 - protein, 9 aa, Homo Sapiens
NVILYNDTD

SEQ ID NO: 1204501 - protein, 9 aa, Homo Sapiens
NEVSSVDVK

SEQ ID NO: 1204502 - protein, 9 aa, Homo Sapiens
NDTDADTAL

SEQ ID NO: 1204503 - protein, 9 aa, Homo Sapiens
VILYNDTDA

SEQ ID NO: 1204504 - protein, 9 aa, Homo Sapiens
LYNDTDADT

SEQ ID NO: 1204505 - protein, 9 aa, Homo Sapiens
DSVTFKDFI

SEQ ID NO: 1204506 - protein, 9 aa, Homo Sapiens
IDEYISKPC

SEQ ID NO: 1204507 - protein, 9 aa, Homo Sapiens
LKLAPLQVT

SEQ ID NO: 1204508 - protein, 9 aa, Homo Sapiens
FGLATEKSR

SEQ ID NO: 1204509 - protein, 9 aa, Homo Sapiens
CTIDIDEYI

SEQ ID NO: 1204510 - protein, 9 aa, Homo Sapiens
TIDIDEYIS

SEQ ID NO: 1204511 - protein, 9 aa, Homo Sapiens
KLAPLQVTT

SEQ ID NO: 1204512 - protein, 9 aa, Homo Sapiens
LGSSQVSVI

SEQ ID NO: 1204513 - protein, 9 aa, Homo Sapiens
LLKIACMDT

SEQ ID NO: 1204514 - protein, 9 aa, Homo Sapiens
PAGSETVSA

SEQ ID NO: 1204515 - protein, 9 aa, Homo Sapiens
IGDFGLATE

SEQ ID NO: 1204516 - protein, 9 aa, Homo Sapiens
SQVSVIHFS

SEQ ID NO: 1204517 - protein, 9 aa, Homo Sapiens
DQSICKRAS

SEQ ID NO: 1204518 - protein, 9 aa, Homo Sapiens
LAVPAMSLP

SEQ ID NO: 1204519 - protein, 9 aa, Homo Sapiens
ILGPDGNMP

SEQ ID NO: 1204520 - protein, 9 aa, Homo Sapiens
PPPPEDDSS

SEQ ID NO: 1204521 - protein, 9 aa, Homo Sapiens
GNSLKKVDP

SEQ ID NO: 1204522 - protein, 9 aa, Homo Sapiens
ITYKSNPNQ

SEQ ID NO: 1204523 - protein, 9 aa, Homo Sapiens
QCHGSSGFC

SEQ ID NO: 1204524 - protein, 9 aa, Homo Sapiens
MPQFENISI

SEQ ID NO: 1204525 - protein, 9 aa, Homo Sapiens
PGLPFKIGS

SEQ ID NO: 1204526 - protein, 9 aa, Homo Sapiens
SLGSSQVSV

SEQ ID NO: 1204527 - protein, 9 aa, Homo Sapiens
ETFYSEYAE

SEQ ID NO: 1204528 - protein, 9 aa, Homo Sapiens
FPKPGTASP

SEQ ID NO: 1204529 - protein, 9 aa, Homo Sapiens
PPGLPFKIG

SEQ ID NO: 1204530 - protein, 9 aa, Homo Sapiens
VKSVEMHHK

SEQ ID NO: 1204531 - protein, 9 aa, Homo Sapiens
VQGTRNMIE

SEQ ID NO: 1204532 - protein, 9 aa, Homo Sapiens
RSLQEHMGN

SEQ ID NO: 1204533 - protein, 9 aa, Homo Sapiens
TNWPDALDP

SEQ ID NO: 1204534 - protein, 9 aa, Homo Sapiens
AHCAAPSAP

SEQ ID NO: 1204535 - protein, 9 aa, Homo Sapiens
VEMHHKALS

SEQ ID NO: 1204536 - protein, 9 aa, Homo Sapiens
PLQCHGSSG

SEQ ID NO: 1204537 - protein, 9 aa, Homo Sapiens
DTHTRQQPC

SEQ ID NO: 1204538 - protein, 9 aa, Homo Sapiens
SICKRASGR

SEQ ID NO: 1204539 - protein, 9 aa, Homo Sapiens
VTSKPCKMN

SEQ ID NO: 1204540 - protein, 9 aa, Homo Sapiens
AAHCAAPSA

SEQ ID NO: 1204541 - protein, 9 aa, Homo Sapiens
YSEYAECCV

SEQ ID NO: 1204542 - protein, 9 aa, Homo Sapiens
TRNMIEACV

SEQ ID NO: 1204543 - protein, 9 aa, Homo Sapiens
YMVIMNPNL

SEQ ID NO: 1204544 - protein, 9 aa, Homo Sapiens
NPNQILPDS

SEQ ID NO: 1204545 - protein, 9 aa, Homo Sapiens
RNMIEACVQ

SEQ ID NO: 1204546 - protein, 9 aa, Homo Sapiens
LDSMIKVLT

SEQ ID NO: 1204547 - protein, 9 aa, Homo Sapiens
VVVGATNWP

SEQ ID NO: 1204548 - protein, 9 aa, Homo Sapiens
KSVEMHHKA

SEQ ID NO: 1204549 - protein, 9 aa, Homo Sapiens
ICKRASGRP

SEQ ID NO: 1204550 - protein, 9 aa, Homo Sapiens
VSVIHFSHG

SEQ ID NO: 1204551 - protein, 9 aa, Homo Sapiens
EYAECCVDV

SEQ ID NO: 1204552 - protein, 9 aa, Homo Sapiens
MIEACVQTG

SEQ ID NO: 1204553 - protein, 9 aa, Homo Sapiens
FFWTQGFPK

SEQ ID NO: 1204554 - protein, 9 aa, Homo Sapiens
SGRPRCDLL

SEQ ID NO: 1204555 - protein, 9 aa, Homo Sapiens
CHGSSGFCW

SEQ ID NO: 1204556 - protein, 9 aa, Homo Sapiens
LTFTHNPHQ

SEQ ID NO: 1204557 - protein, 9 aa, Homo Sapiens
CAAPSAPGA

SEQ ID NO: 1204558 - protein, 9 aa, Homo Sapiens
LPASLGPDS

SEQ ID NO: 1204559 - protein, 9 aa, Homo Sapiens
GTRNMIEAC

SEQ ID NO: 1204560 - protein, 9 aa, Homo Sapiens
MVIMNPNLC

SEQ ID NO: 1204561 - protein, 9 aa, Homo Sapiens
PDTHTRQQP

SEQ ID NO: 1204562 - protein, 9 aa, Homo Sapiens
LCPGQNSGN

SEQ ID NO: 1204563 - protein, 9 aa, Homo Sapiens
RASGRPRCD

SEQ ID NO: 1204564 - protein, 9 aa, Homo Sapiens
CKMNLSKLN

SEQ ID NO: 1204565 - protein, 9 aa, Homo Sapiens
FKIGSISRQ

SEQ ID NO: 1204566 - protein, 9 aa, Homo Sapiens
NQSRCVRVR

SEQ ID NO: 1204567 - protein, 9 aa, Homo Sapiens
SLQEHMGNV

SEQ ID NO: 1204568 - protein, 9 aa, Homo Sapiens
AAERSLQEH

SEQ ID NO: 1204569 - protein, 9 aa, Homo Sapiens
TQGFPKPGT

SEQ ID NO: 1204570 - protein, 9 aa, Homo Sapiens
HKALSEALP

SEQ ID NO: 1204571 - protein, 9 aa, Homo Sapiens
LPFKIGSIS

SEQ ID NO: 1204572 - protein, 9 aa, Homo Sapiens
HGSSGFCWC

SEQ ID NO: 1204573 - protein, 9 aa, Homo Sapiens
DTVTSKPCK

SEQ ID NO: 1204574 - protein, 9 aa, Homo Sapiens
DLQPLLKIA

SEQ ID NO: 1204575 - protein, 9 aa, Homo Sapiens
RCVRVRIFR

SEQ ID NO: 1204576 - protein, 9 aa, Homo Sapiens
EQAILCPGQ

SEQ ID NO: 1204577 - protein, 9 aa, Homo Sapiens
TYKSNPNQI

SEQ ID NO: 1204578 - protein, 9 aa, Homo Sapiens
AERSLQEHM

SEQ ID NO: 1204579 - protein, 9 aa, Homo Sapiens
NRGLKKKKQ

SEQ ID NO: 1204580 - protein, 9 aa, Homo Sapiens
GFFWTQGFP

SEQ ID NO: 1204581 - protein, 9 aa, Homo Sapiens
NMIEACVQT

SEQ ID NO: 1204582 - protein, 9 aa, Homo Sapiens
SPAAHCAAP

SEQ ID NO: 1204583 - protein, 9 aa, Homo Sapiens
THTRQQPCP

SEQ ID NO: 1204584 - protein, 9 aa, Homo Sapiens
VPAMSLPDD

SEQ ID NO: 1204585 - protein, 9 aa, Homo Sapiens
EMHHKALSE

SEQ ID NO: 1204586 - protein, 9 aa, Homo Sapiens
LNRGLKKKK

SEQ ID NO: 1204587 - protein, 9 aa, Homo Sapiens
LATEKSRWS

SEQ ID NO: 1204588 - protein, 9 aa, Homo Sapiens
KRASGRPRC

SEQ ID NO: 1204589 - protein, 9 aa, Homo Sapiens
GCPPPPEDD

SEQ ID NO: 1204590 - protein, 9 aa, Homo Sapiens
QVENQSRCV

SEQ ID NO: 1204591 - protein, 9 aa, Homo Sapiens
PFKIGSISR

SEQ ID NO: 1204592 - protein, 9 aa, Homo Sapiens
PCKMNLSKL

SEQ ID NO: 1204593 - protein, 9 aa, Homo Sapiens
TVTSKPCKM

SEQ ID NO: 1204594 - protein, 9 aa, Homo Sapiens
GPDGNMPQF

SEQ ID NO: 1204595 - protein, 9 aa, Homo Sapiens
VNVQGTRNM

SEQ ID NO: 1204596 - protein, 9 aa, Homo Sapiens
RQSPAAHCA

SEQ ID NO: 1204597 - protein, 9 aa, Homo Sapiens
HCAAPSAPG

SEQ ID NO: 1204598 - protein, 9 aa, Homo Sapiens
PPPGLPFKI

SEQ ID NO: 1204599 - protein, 9 aa, Homo Sapiens
CLGPDTHTR

SEQ ID NO: 1204600 - protein, 9 aa, Homo Sapiens
NMPQFENIS

SEQ ID NO: 1204601 - protein, 9 aa, Homo Sapiens
ASLGPDSEE

SEQ ID NO: 1204602 - protein, 9 aa, Homo Sapiens
ITFPPAGSE

SEQ ID NO: 1204603 - protein, 9 aa, Homo Sapiens
CPGQNSGNY

SEQ ID NO: 1204604 - protein, 9 aa, Homo Sapiens
EKSRWSGSH

SEQ ID NO: 1204605 - protein, 9 aa, Homo Sapiens
ALGCPPPPE

SEQ ID NO: 1204606 - protein, 9 aa, Homo Sapiens
VGATNWPDA

SEQ ID NO: 1204607 - protein, 9 aa, Homo Sapiens
LQCHGSSGF

SEQ ID NO: 1204608 - protein, 9 aa, Homo Sapiens
LPVTIPSAV

SEQ ID NO: 1204609 - protein, 9 aa, Homo Sapiens
IACMDTYMI

SEQ ID NO: 1204610 - protein, 9 aa, Homo Sapiens
GSETVSAAA

SEQ ID NO: 1204611 - protein, 9 aa, Homo Sapiens
TFYSEYAEC

SEQ ID NO: 1204612 - protein, 9 aa, Homo Sapiens
HHKALSEAL

SEQ ID NO: 1204613 - protein, 9 aa, Homo Sapiens
GFPKPGTAS

SEQ ID NO: 1204614 - protein, 9 aa, Homo Sapiens
YETFYSEYA

SEQ ID NO: 1204615 - protein, 9 aa, Homo Sapiens
AMSLPDDVR

SEQ ID NO: 1204616 - protein, 9 aa, Homo Sapiens
PNQILPDSV

SEQ ID NO: 1204617 - protein, 9 aa, Homo Sapiens
VIMNPNLCG

SEQ ID NO: 1204618 - protein, 9 aa, Homo Sapiens
AVPAMSLPD

SEQ ID NO: 1204619 - protein, 9 aa, Homo Sapiens
IPSAVSTGH

SEQ ID NO: 1204620 - protein, 9 aa, Homo Sapiens
VLTFTHNPH

SEQ ID NO: 1204621 - protein, 9 aa, Homo Sapiens
HPALGCPPP

SEQ ID NO: 1204622 - protein, 9 aa, Homo Sapiens
EILGPDGNM

SEQ ID NO: 1204623 - protein, 9 aa, Homo Sapiens
QEHMGNVVE

SEQ ID NO: 1204624 - protein, 9 aa, Homo Sapiens
PVTIPSAVS

SEQ ID NO: 1204625 - protein, 9 aa, Homo Sapiens
NVQGTRNMI

SEQ ID NO: 1204626 - protein, 9 aa, Homo Sapiens
AECCVDVKP

SEQ ID NO: 1204627 - protein, 9 aa, Homo Sapiens
SMIKVLTFT

SEQ ID NO: 1204628 - protein, 9 aa, Homo Sapiens
PTLAVPAMS

SEQ ID NO: 1204629 - protein, 9 aa, Homo Sapiens
NWPDALDPA

SEQ ID NO: 1204630 - protein, 9 aa, Homo Sapiens
LSPPPGLPF

SEQ ID NO: 1204631 - protein, 9 aa, Homo Sapiens
IMNPNLCGL

SEQ ID NO: 1204632 - protein, 9 aa, Homo Sapiens
KIACMDTYM

SEQ ID NO: 1204633 - protein, 9 aa, Homo Sapiens
IKVLTFTHN

SEQ ID NO: 1204634 - protein, 9 aa, Homo Sapiens
FWTQGFPKP

SEQ ID NO: 1204635 - protein, 9 aa, Homo Sapiens
QAILCPGQN

SEQ ID NO: 1204636 - protein, 9 aa, Homo Sapiens
VLDSMIKVL

SEQ ID NO: 1204637 - protein, 9 aa, Homo Sapiens
LGPDGNMPQ

SEQ ID NO: 1204638 - protein, 9 aa, Homo Sapiens
NQILPDSVD

SEQ ID NO: 1204639 - protein, 9 aa, Homo Sapiens
GLATEKSRW

SEQ ID NO: 1204640 - protein, 9 aa, Homo Sapiens
MSLPDDVRR

SEQ ID NO: 1204641 - protein, 9 aa, Homo Sapiens
GDFGLATEK

SEQ ID NO: 1204642 - protein, 9 aa, Homo Sapiens
ETVSAAAKN

SEQ ID NO: 1204643 - protein, 9 aa, Homo Sapiens
QVSVIHFSH

SEQ ID NO: 1204644 - protein, 9 aa, Homo Sapiens
DGFFWTQGF

SEQ ID NO: 1204645 - protein, 9 aa, Homo Sapiens
CKRASGRPR

SEQ ID NO: 1204646 - protein, 9 aa, Homo Sapiens
SEYAECCVD

SEQ ID NO: 1204647 - protein, 9 aa, Homo Sapiens
VVGATNWPD

SEQ ID NO: 1204648 - protein, 9 aa, Homo Sapiens
AAAERSLQE

SEQ ID NO: 1204649 - protein, 9 aa, Homo Sapiens
SVEMHHKAL

SEQ ID NO: 1204650 - protein, 9 aa, Homo Sapiens
TLAVPAMSL

SEQ ID NO: 1204651 - protein, 9 aa, Homo Sapiens
DFGLATEKS

SEQ ID NO: 1204652 - protein, 9 aa, Homo Sapiens
QPLLKIACM

SEQ ID NO: 1204653 - protein, 9 aa, Homo Sapiens
PLPASLGPD

SEQ ID NO: 1204654 - protein, 9 aa, Homo Sapiens
MNPNLCGLL

SEQ ID NO: 1204655 - protein, 9 aa, Homo Sapiens
PPCLGPDTH

SEQ ID NO: 1204656 - protein, 9 aa, Homo Sapiens
CDLQPLLKI

SEQ ID NO: 1204657 - protein, 9 aa, Homo Sapiens
TIPSAVSTG

SEQ ID NO: 1204658 - protein, 9 aa, Homo Sapiens
PLLKIACMD

SEQ ID NO: 1204659 - protein, 9 aa, Homo Sapiens
ILCPGQNSG

SEQ ID NO: 1204660 - protein, 9 aa, Homo Sapiens
PAMSLPDDV

SEQ ID NO: 1204661 - protein, 9 aa, Homo Sapiens
NSLKKVDPQ

SEQ ID NO: 1204662 - protein, 9 aa, Homo Sapiens
PALGCPPPP

SEQ ID NO: 1204663 - protein, 9 aa, Homo Sapiens
ATEKSRWSG

SEQ ID NO: 1204664 - protein, 9 aa, Homo Sapiens
PSAVSTGHT

SEQ ID NO: 1204665 - protein, 9 aa, Homo Sapiens
LRQSPAAHC

SEQ ID NO: 1204666 - protein, 9 aa, Homo Sapiens
AILCPGQNS

SEQ ID NO: 1204667 - protein, 9 aa, Homo Sapiens
LGPDTHTRQ

SEQ ID NO: 1204668 - protein, 9 aa, Homo Sapiens
VTIPSAVST

SEQ ID NO: 1204669 - protein, 9 aa, Homo Sapiens
LGPDSEEHS

SEQ ID NO: 1204670 - protein, 9 aa, Homo Sapiens
GLEQAILCP

SEQ ID NO: 1204671 - protein, 9 aa, Homo Sapiens
KPCKMNLSK

SEQ ID NO: 1204672 - protein, 9 aa, Homo Sapiens
SSGFCWCVD

SEQ ID NO: 1204673 - protein, 9 aa, Homo Sapiens
AVSTGHTTP

SEQ ID NO: 1204674 - protein, 9 aa, Homo Sapiens
GHPALGCPP

SEQ ID NO: 1204675 - protein, 9 aa, Homo Sapiens
TSKPCKMNL

SEQ ID NO: 1204676 - protein, 9 aa, Homo Sapiens
SGFCWCVDP

SEQ ID NO: 1204677 - protein, 9 aa, Homo Sapiens
SSQVSVIHF

SEQ ID NO: 1204678 - protein, 9 aa, Homo Sapiens
VILDGNSLK

SEQ ID NO: 1204679 - protein, 9 aa, Homo Sapiens
VENQSRCVR

SEQ ID NO: 1204680 - protein, 9 aa, Homo Sapiens
GSSQVSVIH

SEQ ID NO: 1204681 - protein, 9 aa, Homo Sapiens
NPNLCGLLV

SEQ ID NO: 1204682 - protein, 9 aa, Homo Sapiens
GPDSEEHSL

SEQ ID NO: 1204683 - protein, 9 aa, Homo Sapiens
CVRVRIFRA

SEQ ID NO: 1204684 - protein, 9 aa, Homo Sapiens
AGSETVSAA

SEQ ID NO: 1204685 - protein, 9 aa, Homo Sapiens
PNLCGLLVL

SEQ ID NO: 1204686 - protein, 9 aa, Homo Sapiens
SKPCKMNLS

SEQ ID NO: 1204687 - protein, 9 aa, Homo Sapiens
KKVDPQLVD

SEQ ID NO: 1204688 - protein, 9 aa, Homo Sapiens
EPLPASLGP

SEQ ID NO: 1204689 - protein, 9 aa, Homo Sapiens
QSRCVRVRI

SEQ ID NO: 1204690 - protein, 9 aa, Homo Sapiens
PPAGSETVS

SEQ ID NO: 1204691 - protein, 9 aa, Homo Sapiens
KSNPNQILP

SEQ ID NO: 1204692 - protein, 9 aa, Homo Sapiens
EDTVTSKPC

SEQ ID NO: 1204693 - protein, 9 aa, Homo Sapiens
GNMPQFENI

SEQ ID NO: 1204694 - protein, 9 aa, Homo Sapiens
GSSGFCWCV

SEQ ID NO: 1204695 - protein, 9 aa, Homo Sapiens
ASLGSSQVS

SEQ ID NO: 1204696 - protein, 9 aa, Homo Sapiens
SLKKVDPQL

SEQ ID NO: 1204697 - protein, 9 aa, Homo Sapiens
GLPFKIGSI

SEQ ID NO: 1204698 - protein, 9 aa, Homo Sapiens
TFPPAGSET

SEQ ID NO: 1204699 - protein, 9 aa, Homo Sapiens
GPDTHTRQQ

SEQ ID NO: 1204700 - protein, 9 aa, Homo Sapiens
LPLQCHGSS

SEQ ID NO: 1204701 - protein, 9 aa, Homo Sapiens
QGFPKPGTA

SEQ ID NO: 1204702 - protein, 9 aa, Homo Sapiens
DSMIKVLTF

SEQ ID NO: 1204703 - protein, 9 aa, Homo Sapiens
NLCGLLVLA

SEQ ID NO: 1204704 - protein, 9 aa, Homo Sapiens
HYMVIMNPN

SEQ ID NO: 1204705 - protein, 9 aa, Homo Sapiens
WTQGFPKPG

SEQ ID NO: 1204706 - protein, 9 aa, Homo Sapiens
DGNMPQFEN

SEQ ID NO: 1204707 - protein, 9 aa, Homo Sapiens
RAAAERSLQ

SEQ ID NO: 1204708 - protein, 9 aa, Homo Sapiens
PAAHCAAPS

SEQ ID NO: 1204709 - protein, 9 aa, Homo Sapiens
LDGNSLKKV

SEQ ID NO: 1204710 - protein, 9 aa, Homo Sapiens
AGLEQAILC

SEQ ID NO: 1204711 - protein, 9 aa, Homo Sapiens
CPPPPEDDS

SEQ ID NO: 1204712 - protein, 9 aa, Homo Sapiens
PPPEDDSSL

SEQ ID NO: 1204713 - protein, 9 aa, Homo Sapiens
LGCPPPPED

SEQ ID NO: 1204714 - protein, 9 aa, Homo Sapiens
PDGNMPQFE

SEQ ID NO: 1204715 - protein, 9 aa, Homo Sapiens
SETVSAAAK

SEQ ID NO: 1204716 - protein, 9 aa, Homo Sapiens
RGLKKKKQY

SEQ ID NO: 1204717 - protein, 9 aa, Homo Sapiens
YKSNPNQIL

SEQ ID NO: 1204718 - protein, 9 aa, Homo Sapiens
LKKVDPQLV

SEQ ID NO: 1204719 - protein, 9 aa, Homo Sapiens
LKIACMDTY

SEQ ID NO: 1204720 - protein, 9 aa, Homo Sapiens
QGTRNMIEA

SEQ ID NO: 1204721 - protein, 9 aa, Homo Sapiens
ATNWPDALD

SEQ ID NO: 1204722 - protein, 9 aa, Homo Sapiens
KALSEALPG

SEQ ID NO: 1204723 - protein, 9 aa, Homo Sapiens
LQPLLKIAC

SEQ ID NO: 1204724 - protein, 9 aa, Homo Sapiens
ENQSRCVRV

SEQ ID NO: 1204725 - protein, 9 aa, Homo Sapiens
ASGRPRCDL

SEQ ID NO: 1204726 - protein, 9 aa, Homo Sapiens
PCLGPDTHT

SEQ ID NO: 1204727 - protein, 9 aa, Homo Sapiens
VVVVGATNW

SEQ ID NO: 1204728 - protein, 9 aa, Homo Sapiens
SPPPGLPFK

SEQ ID NO: 1204729 - protein, 9 aa, Homo Sapiens
FPPAGSETV

SEQ ID NO: 1204730 - protein, 9 aa, Homo Sapiens
VRVRIFRAE

SEQ ID NO: 1204731 - protein, 9 aa, Homo Sapiens
QSICKRASG

SEQ ID NO: 1204732 - protein, 9 aa, Homo Sapiens
TASLGSSQV

SEQ ID NO: 1204733 - protein, 9 aa, Homo Sapiens
HTRQQPCPG

SEQ ID NO: 1204734 - protein, 9 aa, Homo Sapiens
QILPDSVDW

SEQ ID NO: 1204735 - protein, 9 aa, Homo Sapiens
MHHKALSEA

SEQ ID NO: 1204736 - protein, 9 aa, Homo Sapiens
VPTLAVPAM

SEQ ID NO: 1204737 - protein, 9 aa, Homo Sapiens
YAECCVDVK

SEQ ID NO: 1204738 - protein, 9 aa, Homo Sapiens
PASLGPDSE

SEQ ID NO: 1204739 - protein, 9 aa, Homo Sapiens
ERSLQEHMG

SEQ ID NO: 1204740 - protein, 9 aa, Homo Sapiens
SNPNQILPD

SEQ ID NO: 1204741 - protein, 9 aa, Homo Sapiens
VEPLPASLG

SEQ ID NO: 1204742 - protein, 9 aa, Homo Sapiens
LQEHMGNVV

SEQ ID NO: 1204743 - protein, 9 aa, Homo Sapiens
SAVSTGHTT

SEQ ID NO: 1204744 - protein, 9 aa, Homo Sapiens
FYSEYAECC

SEQ ID NO: 1204745 - protein, 9 aa, Homo Sapiens
SRCVRVRIF

SEQ ID NO: 1204746 - protein, 9 aa, Homo Sapiens
SLLLLLLGA

SEQ ID NO: 1204747 - protein, 9 aa, Homo Sapiens
MIKVLTFTH

SEQ ID NO: 1204748 - protein, 9 aa, Homo Sapiens
TEKSRWSGS

SEQ ID NO: 1204749 - protein, 9 aa, Homo Sapiens
WPDALDPAL

SEQ ID NO: 1204750 - protein, 9 aa, Homo Sapiens
PSLLLLLLG

SEQ ID NO: 1204751 - protein, 9 aa, Homo Sapiens
QSPAAHCAA

SEQ ID NO: 1204752 - protein, 9 aa, Homo Sapiens
FGLATEKSR

SEQ ID NO: 1204753 - protein, 9 aa, Homo Sapiens
GATNWPDAL

SEQ ID NO: 1204754 - protein, 9 aa, Homo Sapiens
LEQAILCPG

SEQ ID NO: 1204755 - protein, 9 aa, Homo Sapiens
SLGPDSEEH

SEQ ID NO: 1204756 - protein, 9 aa, Homo Sapiens
ILDGNSLKK

SEQ ID NO: 1204757 - protein, 9 aa, Homo Sapiens
KVLTFTHNP

SEQ ID NO: 1204758 - protein, 9 aa, Homo Sapiens
DGNSLKKVD

SEQ ID NO: 1204759 - protein, 9 aa, Homo Sapiens
LFLVMFMYA

SEQ ID NO: 1204760 - protein, 9 aa, Homo Sapiens
QHFLMVPRD

SEQ ID NO: 1204761 - protein, 9 aa, Homo Sapiens
TIAQVLEAH

SEQ ID NO: 1204762 - protein, 9 aa, Homo Sapiens
LKTCKDIDE

SEQ ID NO: 1204763 - protein, 9 aa, Homo Sapiens
KLPLTKGLG

SEQ ID NO: 1204764 - protein, 9 aa, Homo Sapiens
NPQQSLAPL

SEQ ID NO: 1204765 - protein, 9 aa, Homo Sapiens
GVDMALGTL

SEQ ID NO: 1204766 - protein, 9 aa, Homo Sapiens
SKALGTDTA

SEQ ID NO: 1204767 - protein, 9 aa, Homo Sapiens
LRALRGVDM

SEQ ID NO: 1204768 - protein, 9 aa, Homo Sapiens
DMALGTLAW

SEQ ID NO: 1204769 - protein, 9 aa, Homo Sapiens
HWLALLTAS

SEQ ID NO: 1204770 - protein, 9 aa, Homo Sapiens
AGPSSKALG

SEQ ID NO: 1204771 - protein, 9 aa, Homo Sapiens
SFSAYHTAF

SEQ ID NO: 1204772 - protein, 9 aa, Homo Sapiens
RKHQQHFLM

SEQ ID NO: 1204773 - protein, 9 aa, Homo Sapiens
RLCIQKLFP

SEQ ID NO: 1204774 - protein, 9 aa, Homo Sapiens
VTDRHRKHQ

SEQ ID NO: 1204775 - protein, 9 aa, Homo Sapiens
FVPQLHRGS

SEQ ID NO: 1204776 - protein, 9 aa, Homo Sapiens
PVELSWENA

SEQ ID NO: 1204777 - protein, 9 aa, Homo Sapiens
TAEDFLSQS

SEQ ID NO: 1204778 - protein, 9 aa, Homo Sapiens
ALLRWAGLW

SEQ ID NO: 1204779 - protein, 9 aa, Homo Sapiens
IAQVLEAHA

SEQ ID NO: 1204780 - protein, 9 aa, Homo Sapiens
RVSCVELLN

SEQ ID NO: 1204781 - protein, 9 aa, Homo Sapiens
SGPRALCQE

SEQ ID NO: 1204782 - protein, 9 aa, Homo Sapiens
RVDAISADC

SEQ ID NO: 1204783 - protein, 9 aa, Homo Sapiens
LALLRWAGL

SEQ ID NO: 1204784 - protein, 9 aa, Homo Sapiens
GPSSKALGT

SEQ ID NO: 1204785 - protein, 9 aa, Homo Sapiens
GGKGPGGST

SEQ ID NO: 1204786 - protein, 9 aa, Homo Sapiens
SIHNDTIWS

SEQ ID NO: 1204787 - protein, 9 aa, Homo Sapiens
AGRAACTAA

SEQ ID NO: 1204788 - protein, 9 aa, Homo Sapiens
RNQVDDIQS

SEQ ID NO: 1204789 - protein, 9 aa, Homo Sapiens
TDRHRKHQQ

SEQ ID NO: 1204790 - protein, 9 aa, Homo Sapiens
LMVPFSLCA

SEQ ID NO: 1204791 - protein, 9 aa, Homo Sapiens
DTAEDFLSQ

SEQ ID NO: 1204792 - protein, 9 aa, Homo Sapiens
LLLFLVMFM

SEQ ID NO: 1204793 - protein, 9 aa, Homo Sapiens
RWAGLWTLW

SEQ ID NO: 1204794 - protein, 9 aa, Homo Sapiens
VDAISADCP

SEQ ID NO: 1204795 - protein, 9 aa, Homo Sapiens
LRGVDMALG

SEQ ID NO: 1204796 - protein, 9 aa, Homo Sapiens
TLWWWAGLR

SEQ ID NO: 1204797 - protein, 9 aa, Homo Sapiens
FSLCAGALF

SEQ ID NO: 1204798 - protein, 9 aa, Homo Sapiens
IFYSGSERK

SEQ ID NO: 1204799 - protein, 9 aa, Homo Sapiens
GLWTLWWWA

SEQ ID NO: 1204800 - protein, 9 aa, Homo Sapiens
VDKTSCWSL

SEQ ID NO: 1204801 - protein, 9 aa, Homo Sapiens
CIQKLFPKK

SEQ ID NO: 1204802 - protein, 9 aa, Homo Sapiens
KKASRRMLE

SEQ ID NO: 1204803 - protein, 9 aa, Homo Sapiens
QVSIHNDTI

SEQ ID NO: 1204804 - protein, 9 aa, Homo Sapiens
QSPPGQWQY

SEQ ID NO: 1204805 - protein, 9 aa, Homo Sapiens
TDTAEDFLS

SEQ ID NO: 1204806 - protein, 9 aa, Homo Sapiens
AEDFLSQSP

SEQ ID NO: 1204807 - protein, 9 aa, Homo Sapiens
VAVTCNPST

SEQ ID NO: 1204808 - protein, 9 aa, Homo Sapiens
ITYAKIFYS

SEQ ID NO: 1204809 - protein, 9 aa, Homo Sapiens
VTIAQVLEA

SEQ ID NO: 1204810 - protein, 9 aa, Homo Sapiens
IQKLFPKKK

SEQ ID NO: 1204811 - protein, 9 aa, Homo Sapiens
LVDYMYWKK

SEQ ID NO: 1204812 - protein, 9 aa, Homo Sapiens
KGPGGSTAY

SEQ ID NO: 1204813 - protein, 9 aa, Homo Sapiens
AGALFLSAR

SEQ ID NO: 1204814 - protein, 9 aa, Homo Sapiens
AWGTQEVAG

SEQ ID NO: 1204815 - protein, 9 aa, Homo Sapiens
CWSLRITYA

SEQ ID NO: 1204816 - protein, 9 aa, Homo Sapiens
WLALLTASG

SEQ ID NO: 1204817 - protein, 9 aa, Homo Sapiens
ATVGFVPQL

SEQ ID NO: 1204818 - protein, 9 aa, Homo Sapiens
IQSFLDSRH

SEQ ID NO: 1204819 - protein, 9 aa, Homo Sapiens
RDRAAGPSS

SEQ ID NO: 1204820 - protein, 9 aa, Homo Sapiens
SCVELLNTV

SEQ ID NO: 1204821 - protein, 9 aa, Homo Sapiens
FMYAIFGMS

SEQ ID NO: 1204822 - protein, 9 aa, Homo Sapiens
PDLKTCKDI

SEQ ID NO: 1204823 - protein, 9 aa, Homo Sapiens
LLALLRWAG

SEQ ID NO: 1204824 - protein, 9 aa, Homo Sapiens
GGRGGKGPG

SEQ ID NO: 1204825 - protein, 9 aa, Homo Sapiens
MSFSAYHTA

SEQ ID NO: 1204826 - protein, 9 aa, Homo Sapiens
LWTLWWWAG

SEQ ID NO: 1204827 - protein, 9 aa, Homo Sapiens
QGQPGAVAV

SEQ ID NO: 1204828 - protein, 9 aa, Homo Sapiens
GAGGRGGKG

SEQ ID NO: 1204829 - protein, 9 aa, Homo Sapiens
LGTDTAEDF

SEQ ID NO: 1204830 - protein, 9 aa, Homo Sapiens
CILVLHLHP

SEQ ID NO: 1204831 - protein, 9 aa, Homo Sapiens
FSAQQANLM

SEQ ID NO: 1204832 - protein, 9 aa, Homo Sapiens
SERKVTIAQ

SEQ ID NO: 1204833 - protein, 9 aa, Homo Sapiens
AVNPQQSLA

SEQ ID NO: 1204834 - protein, 9 aa, Homo Sapiens
FLMVPRDRA

SEQ ID NO: 1204835 - protein, 9 aa, Homo Sapiens
SWADHWLRG

SEQ ID NO: 1204836 - protein, 9 aa, Homo Sapiens
DTIWSVLVA

SEQ ID NO: 1204837 - protein, 9 aa, Homo Sapiens
CYQGSSWAD

SEQ ID NO: 1204838 - protein, 9 aa, Homo Sapiens
TQGPVELSW

SEQ ID NO: 1204839 - protein, 9 aa, Homo Sapiens
DKTSCWSLR

SEQ ID NO: 1204840 - protein, 9 aa, Homo Sapiens
VDYMYWKKA

SEQ ID NO: 1204841 - protein, 9 aa, Homo Sapiens
RAAGPSSKA

SEQ ID NO: 1204842 - protein, 9 aa, Homo Sapiens
GRAACTAAV

SEQ ID NO: 1204843 - protein, 9 aa, Homo Sapiens
LHLHPLPRG

SEQ ID NO: 1204844 - protein, 9 aa, Homo Sapiens
LLRWAGLWT

SEQ ID NO: 1204845 - protein, 9 aa, Homo Sapiens
VLTAVNPQQ

SEQ ID NO: 1204846 - protein, 9 aa, Homo Sapiens
MALGTLAWG

SEQ ID NO: 1204847 - protein, 9 aa, Homo Sapiens
VPDGATVGF

SEQ ID NO: 1204848 - protein, 9 aa, Homo Sapiens
AVDKTSCWS

SEQ ID NO: 1204849 - protein, 9 aa, Homo Sapiens
MYWKKASRR

SEQ ID NO: 1204850 - protein, 9 aa, Homo Sapiens
LPRLCIQKL

SEQ ID NO: 1204851 - protein, 9 aa, Homo Sapiens
VSIHNDTIW

SEQ ID NO: 1204852 - protein, 9 aa, Homo Sapiens
ACTAAVDKT

SEQ ID NO: 1204853 - protein, 9 aa, Homo Sapiens
LCIQKLFPK

SEQ ID NO: 1204854 - protein, 9 aa, Homo Sapiens
QSFLDSRHL

SEQ ID NO: 1204855 - protein, 9 aa, Homo Sapiens
PGAVAVTCN

SEQ ID NO: 1204856 - protein, 9 aa, Homo Sapiens
QPGAVAVTC

SEQ ID NO: 1204857 - protein, 9 aa, Homo Sapiens
DSLDTCYST

SEQ ID NO: 1204858 - protein, 9 aa, Homo Sapiens
TYAKIFYSG

SEQ ID NO: 1204859 - protein, 9 aa, Homo Sapiens
DRHRKHQQH

SEQ ID NO: 1204860 - protein, 9 aa, Homo Sapiens
VLEAHAQVT

SEQ ID NO: 1204861 - protein, 9 aa, Homo Sapiens
AGLRALRGV

SEQ ID NO: 1204862 - protein, 9 aa, Homo Sapiens
AHAQVTDRH

SEQ ID NO: 1204863 - protein, 9 aa, Homo Sapiens
KLFPKKKCF

SEQ ID NO: 1204864 - protein, 9 aa, Homo Sapiens
GPVELSWEN

SEQ ID NO: 1204865 - protein, 9 aa, Homo Sapiens
HWLRGKKLT

SEQ ID NO: 1204866 - protein, 9 aa, Homo Sapiens
HQQHFLMVP

SEQ ID NO: 1204867 - protein, 9 aa, Homo Sapiens
ALFLSARRD

SEQ ID NO: 1204868 - protein, 9 aa, Homo Sapiens
SSWADHWLR

SEQ ID NO: 1204869 - protein, 9 aa, Homo Sapiens
ADHWLRGKK

SEQ ID NO: 1204870 - protein, 9 aa, Homo Sapiens
QQSLAPLPR

SEQ ID NO: 1204871 - protein, 9 aa, Homo Sapiens
ERKVTIAQV

SEQ ID NO: 1204872 - protein, 9 aa, Homo Sapiens
LALLTASGP

SEQ ID NO: 1204873 - protein, 9 aa, Homo Sapiens
HQQQQQQMQ

SEQ ID NO: 1204874 - protein, 9 aa, Homo Sapiens
FLSARRDNR

SEQ ID NO: 1204875 - protein, 9 aa, Homo Sapiens
VPRDRAAGP

SEQ ID NO: 1204876 - protein, 9 aa, Homo Sapiens
VNPQQSLAP

SEQ ID NO: 1204877 - protein, 9 aa, Homo Sapiens
DIQSFLDSR

SEQ ID NO: 1204878 - protein, 9 aa, Homo Sapiens
GQWQYGSLR

SEQ ID NO: 1204879 - protein, 9 aa, Homo Sapiens
AQQANLMVP

SEQ ID NO: 1204880 - protein, 9 aa, Homo Sapiens
LLFLVMFMY

SEQ ID NO: 1204881 - protein, 9 aa, Homo Sapiens
GTDTAEDFL

SEQ ID NO: 1204882 - protein, 9 aa, Homo Sapiens
WQYGSLRKE

SEQ ID NO: 1204883 - protein, 9 aa, Homo Sapiens
SCWSLRITY

SEQ ID NO: 1204884 - protein, 9 aa, Homo Sapiens
PRLCIQKLF

SEQ ID NO: 1204885 - protein, 9 aa, Homo Sapiens
QQHFLMVPR

SEQ ID NO: 1204886 - protein, 9 aa, Homo Sapiens
QANLMVPFS

SEQ ID NO: 1204887 - protein, 9 aa, Homo Sapiens
DAISADCPS

SEQ ID NO: 1204888 - protein, 9 aa, Homo Sapiens
ELSWENAGH

SEQ ID NO: 1204889 - protein, 9 aa, Homo Sapiens
RITYAKIFY

SEQ ID NO: 1204890 - protein, 9 aa, Homo Sapiens
WWAGLRALR

SEQ ID NO: 1204891 - protein, 9 aa, Homo Sapiens
EVLQDSLDT

SEQ ID NO: 1204892 - protein, 9 aa, Homo Sapiens
LDTCYSTPS

SEQ ID NO: 1204893 - protein, 9 aa, Homo Sapiens
AVTCNPSTL

SEQ ID NO: 1204894 - protein, 9 aa, Homo Sapiens
KPDLKTCKD

SEQ ID NO: 1204895 - protein, 9 aa, Homo Sapiens
AACTAAVDK

SEQ ID NO: 1204896 - protein, 9 aa, Homo Sapiens
QWQYGSLRK

SEQ ID NO: 1204897 - protein, 9 aa, Homo Sapiens
YKPDLKTCK

SEQ ID NO: 1204898 - protein, 9 aa, Homo Sapiens
MVPFSLCAG

SEQ ID NO: 1204899 - protein, 9 aa, Homo Sapiens
NQVDDIQSF

SEQ ID NO: 1204900 - protein, 9 aa, Homo Sapiens
TVGFVPQLH

SEQ ID NO: 1204901 - protein, 9 aa, Homo Sapiens
QRVSCVELL

SEQ ID NO: 1204902 - protein, 9 aa, Homo Sapiens
TLAWGTQEV

SEQ ID NO: 1204903 - protein, 9 aa, Homo Sapiens
QSLAPLPRL

SEQ ID NO: 1204904 - protein, 9 aa, Homo Sapiens
RGVDMALGT

SEQ ID NO: 1204905 - protein, 9 aa, Homo Sapiens
LWWWAGLRA

SEQ ID NO: 1204906 - protein, 9 aa, Homo Sapiens
LEAHAQVTD

SEQ ID NO: 1204907 - protein, 9 aa, Homo Sapiens
NSDKRKVKD

SEQ ID NO: 1204908 - protein, 9 aa, Homo Sapiens
RHRKHQQHF

SEQ ID NO: 1204909 - protein, 9 aa, Homo Sapiens
RALRGVDMA

SEQ ID NO: 1204910 - protein, 9 aa, Homo Sapiens
AAVDKTSCW

SEQ ID NO: 1204911 - protein, 9 aa, Homo Sapiens
PFSLCAGAL

SEQ ID NO: 1204912 - protein, 9 aa, Homo Sapiens
NDTIWSVLV

SEQ ID NO: 1204913 - protein, 9 aa, Homo Sapiens
QGPVELSWE

SEQ ID NO: 1204914 - protein, 9 aa, Homo Sapiens
LRWAGLWTL

SEQ ID NO: 1204915 - protein, 9 aa, Homo Sapiens
LRKETFCYQ

SEQ ID NO: 1204916 - protein, 9 aa, Homo Sapiens
WTLWWWAGL

SEQ ID NO: 1204917 - protein, 9 aa, Homo Sapiens
SGEDDGNSD

SEQ ID NO: 1204918 - protein, 9 aa, Homo Sapiens
KIFYSGSER

SEQ ID NO: 1204919 - protein, 9 aa, Homo Sapiens
NLMVPFSLC

SEQ ID NO: 1204920 - protein, 9 aa, Homo Sapiens
VSCVELLNT

SEQ ID NO: 1204921 - protein, 9 aa, Homo Sapiens
GLRALRGVD

SEQ ID NO: 1204922 - protein, 9 aa, Homo Sapiens
ALRGVDMAL

SEQ ID NO: 1204923 - protein, 9 aa, Homo Sapiens
LCAGALFLS

SEQ ID NO: 1204924 - protein, 9 aa, Homo Sapiens
WAGLRALRG

SEQ ID NO: 1204925 - protein, 9 aa, Homo Sapiens
SSKALGTDT

SEQ ID NO: 1204926 - protein, 9 aa, Homo Sapiens
KMQRVSCVE

SEQ ID NO: 1204927 - protein, 9 aa, Homo Sapiens
SGSERKVTI

SEQ ID NO: 1204928 - protein, 9 aa, Homo Sapiens
SLCAGALFL

SEQ ID NO: 1204929 - protein, 9 aa, Homo Sapiens
LSQSPPGQW

SEQ ID NO: 1204930 - protein, 9 aa, Homo Sapiens
YHTAFICLG

SEQ ID NO: 1204931 - protein, 9 aa, Homo Sapiens
RKETFCYQG

SEQ ID NO: 1204932 - protein, 9 aa, Homo Sapiens
DGATVGFVP

SEQ ID NO: 1204933 - protein, 9 aa, Homo Sapiens
HAQVTDRHR

SEQ ID NO: 1204934 - protein, 9 aa, Homo Sapiens
IHNDTIWSV

SEQ ID NO: 1204935 - protein, 9 aa, Homo Sapiens
LVMFMYAIF

SEQ ID NO: 1204936 - protein, 9 aa, Homo Sapiens
PRVDAISAD

SEQ ID NO: 1204937 - protein, 9 aa, Homo Sapiens
TCYSTPSSC

SEQ ID NO: 1204938 - protein, 9 aa, Homo Sapiens
DGNSDKRKV

SEQ ID NO: 1204939 - protein, 9 aa, Homo Sapiens
VPFSLCAGA

SEQ ID NO: 1204940 - protein, 9 aa, Homo Sapiens
EDFLSQSPP

SEQ ID NO: 1204941 - protein, 9 aa, Homo Sapiens
WKKASRRML

SEQ ID NO: 1204942 - protein, 9 aa, Homo Sapiens
ARRDNRECI

SEQ ID NO: 1204943 - protein, 9 aa, Homo Sapiens
YGSLRKETF

SEQ ID NO: 1204944 - protein, 9 aa, Homo Sapiens
ALGTDTAED

SEQ ID NO: 1204945 - protein, 9 aa, Homo Sapiens
YWKKASRRM

SEQ ID NO: 1204946 - protein, 9 aa, Homo Sapiens
ETFCYQGSS

SEQ ID NO: 1204947 - protein, 9 aa, Homo Sapiens
SAQQANLMV

SEQ ID NO: 1204948 - protein, 9 aa, Homo Sapiens
QKLFPKKKC

SEQ ID NO: 1204949 - protein, 9 aa, Homo Sapiens
RGKKLTVYP

SEQ ID NO: 1204950 - protein, 9 aa, Homo Sapiens
EVAGRAACT

SEQ ID NO: 1204951 - protein, 9 aa, Homo Sapiens
LRGKKLTVY

SEQ ID NO: 1204952 - protein, 9 aa, Homo Sapiens
QEVAGRAAC

SEQ ID NO: 1204953 - protein, 9 aa, Homo Sapiens
EAHAQVTDR

SEQ ID NO: 1204954 - protein, 9 aa, Homo Sapiens
AGGRGGKGP

SEQ ID NO: 1204955 - protein, 9 aa, Homo Sapiens
DNRECILVL

SEQ ID NO: 1204956 - protein, 9 aa, Homo Sapiens
AVAVTCNPS

SEQ ID NO: 1204957 - protein, 9 aa, Homo Sapiens
GQPGAVAVT

SEQ ID NO: 1204958 - protein, 9 aa, Homo Sapiens
TCKDIDECE

SEQ ID NO: 1204959 - protein, 9 aa, Homo Sapiens
LLTASGPRA

SEQ ID NO: 1204960 - protein, 9 aa, Homo Sapiens
FRNQVDDIQ

SEQ ID NO: 1204961 - protein, 9 aa, Homo Sapiens
MHQQQQQQM

SEQ ID NO: 1204962 - protein, 9 aa, Homo Sapiens
DLKTCKDID

SEQ ID NO: 1204963 - protein, 9 aa, Homo Sapiens
SAYHTAFIC

SEQ ID NO: 1204964 - protein, 9 aa, Homo Sapiens
ALLTASGPR

SEQ ID NO: 1204965 - protein, 9 aa, Homo Sapiens
HRKHQQHFL

SEQ ID NO: 1204966 - protein, 9 aa, Homo Sapiens
CTAAVDKTS

SEQ ID NO: 1204967 - protein, 9 aa, Homo Sapiens
TQEVAGRAA

SEQ ID NO: 1204968 - protein, 9 aa, Homo Sapiens
YAKIFYSGS

SEQ ID NO: 1204969 - protein, 9 aa, Homo Sapiens
GATVGFVPQ

SEQ ID NO: 1204970 - protein, 9 aa, Homo Sapiens
ILVLHLHPL

SEQ ID NO: 1204971 - protein, 9 aa, Homo Sapiens
YSGSERKVT

SEQ ID NO: 1204972 - protein, 9 aa, Homo Sapiens
FLSQSPPGQ

SEQ ID NO: 1204973 - protein, 9 aa, Homo Sapiens
AKIFYSGSE

SEQ ID NO: 1204974 - protein, 9 aa, Homo Sapiens
DHWLRGKKL

SEQ ID NO: 1204975 - protein, 9 aa, Homo Sapiens
GTLAWGTQE

SEQ ID NO: 1204976 - protein, 9 aa, Homo Sapiens
DTCYSTPSS

SEQ ID NO: 1204977 - protein, 9 aa, Homo Sapiens
ADPKLPLTK

SEQ ID NO: 1204978 - protein, 9 aa, Homo Sapiens
AGLWTLWWW

SEQ ID NO: 1204979 - protein, 9 aa, Homo Sapiens
FYSGSERKV

SEQ ID NO: 1204980 - protein, 9 aa, Homo Sapiens
ASGPRALCQ

SEQ ID NO: 1204981 - protein, 9 aa, Homo Sapiens
TASGPRALC

SEQ ID NO: 1204982 - protein, 9 aa, Homo Sapiens
SLRITYAKI

SEQ ID NO: 1204983 - protein, 9 aa, Homo Sapiens
ECILVLHLH

SEQ ID NO: 1204984 - protein, 9 aa, Homo Sapiens
LTAVNPQQS

SEQ ID NO: 1204985 - protein, 9 aa, Homo Sapiens
WMSFSAYHT

SEQ ID NO: 1204986 - protein, 9 aa, Homo Sapiens
ISADCPSLQ

SEQ ID NO: 1204987 - protein, 9 aa, Homo Sapiens
QDSLDTCYS

SEQ ID NO: 1204988 - protein, 9 aa, Homo Sapiens
ALGTLAWGT

SEQ ID NO: 1204989 - protein, 9 aa, Homo Sapiens
FSAYHTAFI

SEQ ID NO: 1204990 - protein, 9 aa, Homo Sapiens
GTQEVAGRA

SEQ ID NO: 1204991 - protein, 9 aa, Homo Sapiens
KETFCYQGS

SEQ ID NO: 1204992 - protein, 9 aa, Homo Sapiens
LVLHLHPLP

SEQ ID NO: 1204993 - protein, 9 aa, Homo Sapiens
NRECILVLH

SEQ ID NO: 1204994 - protein, 9 aa, Homo Sapiens
LRITYAKIF

SEQ ID NO: 1204995 - protein, 9 aa, Homo Sapiens
ADCPSLQTK

SEQ ID NO: 1204996 - protein, 9 aa, Homo Sapiens
VDMALGTLA

SEQ ID NO: 1204997 - protein, 9 aa, Homo Sapiens
RKVTIAQVL

SEQ ID NO: 1204998 - protein, 9 aa, Homo Sapiens
ANLMVPFSL

SEQ ID NO: 1204999 - protein, 9 aa, Homo Sapiens
TQGADPKLP

SEQ ID NO: 1205000 - protein, 9 aa, Homo Sapiens
GALFLSARR

SEQ ID NO: 1205001 - protein, 9 aa, Homo Sapiens
RGGKGPGGS

SEQ ID NO: 1205002 - protein, 9 aa, Homo Sapiens
PDGATVGFV

SEQ ID NO: 1205003 - protein, 9 aa, Homo Sapiens
FLVMFMYAI

SEQ ID NO: 1205004 - protein, 9 aa, Homo Sapiens
GNSDKRKVK

SEQ ID NO: 1205005 - protein, 9 aa, Homo Sapiens
QGADPKLPL

SEQ ID NO: 1205006 - protein, 9 aa, Homo Sapiens
GADPKLPLT

SEQ ID NO: 1205007 - protein, 9 aa, Homo Sapiens
LFPKKKCFI

SEQ ID NO: 1205008 - protein, 9 aa, Homo Sapiens
QVDDIQSFL

SEQ ID NO: 1205009 - protein, 9 aa, Homo Sapiens
HFLMVPRDR

SEQ ID NO: 1205010 - protein, 9 aa, Homo Sapiens
LLTQGADPK

SEQ ID NO: 1205011 - protein, 9 aa, Homo Sapiens
VGFVPQLHR

SEQ ID NO: 1205012 - protein, 9 aa, Homo Sapiens
LSARRDNRE

SEQ ID NO: 1205013 - protein, 9 aa, Homo Sapiens
TAVNPQQSL

SEQ ID NO: 1205014 - protein, 9 aa, Homo Sapiens
HNDTIWSVL

SEQ ID NO: 1205015 - protein, 9 aa, Homo Sapiens
MFMYAIFGM

SEQ ID NO: 1205016 - protein, 9 aa, Homo Sapiens
QGSSWADHW

SEQ ID NO: 1205017 - protein, 9 aa, Homo Sapiens
KTSCWSLRI

SEQ ID NO: 1205018 - protein, 9 aa, Homo Sapiens
GFVPQLHRG

SEQ ID NO: 1205019 - protein, 9 aa, Homo Sapiens
MQRVSCVEL

SEQ ID NO: 1205020 - protein, 9 aa, Homo Sapiens
QVLEAHAQV

SEQ ID NO: 1205021 - protein, 9 aa, Homo Sapiens
AQVLEAHAQ

SEQ ID NO: 1205022 - protein, 9 aa, Homo Sapiens
VMFMYAIFG

SEQ ID NO: 1205023 - protein, 9 aa, Homo Sapiens
RDNRECILV

SEQ ID NO: 1205024 - protein, 9 aa, Homo Sapiens
DYMYWKKAS

SEQ ID NO: 1205025 - protein, 9 aa, Homo Sapiens
QYGSLRKET

SEQ ID NO: 1205026 - protein, 9 aa, Homo Sapiens
PQQSLAPLP

SEQ ID NO: 1205027 - protein, 9 aa, Homo Sapiens
QQANLMVPF

SEQ ID NO: 1205028 - protein, 9 aa, Homo Sapiens
PKLPLTKGL

SEQ ID NO: 1205029 - protein, 9 aa, Homo Sapiens
LAWGTQEVA

SEQ ID NO: 1205030 - protein, 9 aa, Homo Sapiens
EDDGNSDKR

SEQ ID NO: 1205031 - protein, 9 aa, Homo Sapiens
GSERKVTIA

SEQ ID NO: 1205032 - protein, 9 aa, Homo Sapiens
GKGPGGSTA

SEQ ID NO: 1205033 - protein, 9 aa, Homo Sapiens
HLHPLPRGT

SEQ ID NO: 1205034 - protein, 9 aa, Homo Sapiens
VPKKMQRVS

SEQ ID NO: 1205035 - protein, 9 aa, Homo Sapiens
AETQGPVEL

SEQ ID NO: 1205036 - protein, 9 aa, Homo Sapiens
VTCNPSTLG

SEQ ID NO: 1205037 - protein, 9 aa, Homo Sapiens
LFLSARRDN

SEQ ID NO: 1205038 - protein, 9 aa, Homo Sapiens
KALGTDTAE

SEQ ID NO: 1205039 - protein, 9 aa, Homo Sapiens
DCPSLQTKL

SEQ ID NO: 1205040 - protein, 9 aa, Homo Sapiens
DPKLPLTKG

SEQ ID NO: 1205041 - protein, 9 aa, Homo Sapiens
CWMSFSAYH

SEQ ID NO: 1205042 - protein, 9 aa, Homo Sapiens
LTASGPRAL

SEQ ID NO: 1205043 - protein, 9 aa, Homo Sapiens
KDIDECESS

SEQ ID NO: 1205044 - protein, 9 aa, Homo Sapiens
DDIQSFLDS

SEQ ID NO: 1205045 - protein, 9 aa, Homo Sapiens
AAGPSSKAL

SEQ ID NO: 1205046 - protein, 9 aa, Homo Sapiens
GGAGGRGGK

SEQ ID NO: 1205047 - protein, 9 aa, Homo Sapiens
GKKLTVYPW

SEQ ID NO: 1205048 - protein, 9 aa, Homo Sapiens
GSGEDDGNS

SEQ ID NO: 1205049 - protein, 9 aa, Homo Sapiens
TFCYQGSSW

SEQ ID NO: 1205050 - protein, 9 aa, Homo Sapiens
SLRKETFCY

SEQ ID NO: 1205051 - protein, 9 aa, Homo Sapiens
LHPLPRGTG

SEQ ID NO: 1205052 - protein, 9 aa, Homo Sapiens
SARRDNREC

SEQ ID NO: 1205053 - protein, 9 aa, Homo Sapiens
RRDNRECIL

SEQ ID NO: 1205054 - protein, 9 aa, Homo Sapiens
KQVSIHNDT

SEQ ID NO: 1205055 - protein, 9 aa, Homo Sapiens
TAAVDKTSC

SEQ ID NO: 1205056 - protein, 9 aa, Homo Sapiens
SLVDYMYWK

SEQ ID NO: 1205057 - protein, 9 aa, Homo Sapiens
LMVPRDRAA

SEQ ID NO: 1205058 - protein, 9 aa, Homo Sapiens
YQGSSWADH

SEQ ID NO: 1205059 - protein, 9 aa, Homo Sapiens
FCYQGSSWA

SEQ ID NO: 1205060 - protein, 9 aa, Homo Sapiens
DDGNSDKRK

SEQ ID NO: 1205061 - protein, 9 aa, Homo Sapiens
GSLRKETFC

SEQ ID NO: 1205062 - protein, 9 aa, Homo Sapiens
WAGLWTLWW

SEQ ID NO: 1205063 - protein, 9 aa, Homo Sapiens
SQSPPGQWQ

SEQ ID NO: 1205064 - protein, 9 aa, Homo Sapiens
QVTDRHRKH

SEQ ID NO: 1205065 - protein, 9 aa, Homo Sapiens
AKQVSIHND

SEQ ID NO: 1205066 - protein, 9 aa, Homo Sapiens
AISADCPSL

SEQ ID NO: 1205067 - protein, 9 aa, Homo Sapiens
GRGGKGPGG

SEQ ID NO: 1205068 - protein, 9 aa, Homo Sapiens
WSLRITYAK

SEQ ID NO: 1205069 - protein, 9 aa, Homo Sapiens
DFLSQSPPG

SEQ ID NO: 1205070 - protein, 9 aa, Homo Sapiens
LGTLAWGTQ

SEQ ID NO: 1205071 - protein, 9 aa, Homo Sapiens
MYAIFGMSN

SEQ ID NO: 1205072 - protein, 9 aa, Homo Sapiens
VLHLHPLPR

SEQ ID NO: 1205073 - protein, 9 aa, Homo Sapiens
KHQQHFLMV

SEQ ID NO: 1205074 - protein, 9 aa, Homo Sapiens
PGQWQYGSL

SEQ ID NO: 1205075 - protein, 9 aa, Homo Sapiens
WWWAGLRAL

SEQ ID NO: 1205076 - protein, 9 aa, Homo Sapiens
SADCPSLQT

SEQ ID NO: 1205077 - protein, 9 aa, Homo Sapiens
HPLPRGTGV

SEQ ID NO: 1205078 - protein, 9 aa, Homo Sapiens
PPGQWQYGS

SEQ ID NO: 1205079 - protein, 9 aa, Homo Sapiens
HTAFICLGL

SEQ ID NO: 1205080 - protein, 9 aa, Homo Sapiens
WGTQEVAGR

SEQ ID NO: 1205081 - protein, 9 aa, Homo Sapiens
SPPGQWQYG

SEQ ID NO: 1205082 - protein, 9 aa, Homo Sapiens
VLQDSLDTC

SEQ ID NO: 1205083 - protein, 9 aa, Homo Sapiens
VDDIQSFLD

SEQ ID NO: 1205084 - protein, 9 aa, Homo Sapiens
GAVAVTCNP

SEQ ID NO: 1205085 - protein, 9 aa, Homo Sapiens
KKMQRVSCV

SEQ ID NO: 1205086 - protein, 9 aa, Homo Sapiens
TSCWSLRIT

SEQ ID NO: 1205087 - protein, 9 aa, Homo Sapiens
LSWENAGHT

SEQ ID NO: 1205088 - protein, 9 aa, Homo Sapiens
AYHTAFICL

SEQ ID NO: 1205089 - protein, 9 aa, Homo Sapiens
LTQGADPKL

SEQ ID NO: 1205090 - protein, 9 aa, Homo Sapiens
DRAAGPSSK

SEQ ID NO: 1205091 - protein, 9 aa, Homo Sapiens
RAACTAAVD

SEQ ID NO: 1205092 - protein, 9 aa, Homo Sapiens
YGSGEDDGN

SEQ ID NO: 1205093 - protein, 9 aa, Homo Sapiens
RECILVLHL

SEQ ID NO: 1205094 - protein, 9 aa, Homo Sapiens
SLDTCYSTP

SEQ ID NO: 1205095 - protein, 9 aa, Homo Sapiens
KVTIAQVLE

SEQ ID NO: 1205096 - protein, 9 aa, Homo Sapiens
VELSWENAG

SEQ ID NO: 1205097 - protein, 9 aa, Homo Sapiens
AQVTDRHRK

SEQ ID NO: 1205098 - protein, 9 aa, Homo Sapiens
WADHWLRGK

SEQ ID NO: 1205099 - protein, 9 aa, Homo Sapiens
PRDRAAGPS

SEQ ID NO: 1205100 - protein, 9 aa, Homo Sapiens
LQDSLDTCY

SEQ ID NO: 1205101 - protein, 9 aa, Homo Sapiens
PSSKALGTD

SEQ ID NO: 1205102 - protein, 9 aa, Homo Sapiens
WLRGKKLTV

SEQ ID NO: 1205103 - protein, 9 aa, Homo Sapiens
ETQGPVELS

SEQ ID NO: 1205104 - protein, 9 aa, Homo Sapiens
GSSWADHWL

SEQ ID NO: 1205105 - protein, 9 aa, Homo Sapiens
CAGALFLSA

SEQ ID NO: 1205106 - protein, 9 aa, Homo Sapiens
VAGRAACTA

SEQ ID NO: 1205107 - protein, 9 aa, Homo Sapiens
MVPRDRAAG

SEQ ID NO: 1205108 - protein, 9 aa, Homo Sapiens
PKKMQRVSC

SEQ ID NO: 1205109 - protein, 9 aa, Homo Sapiens
GEDDGNSDK

SEQ ID NO: 1205110 - protein, 9 aa, Homo Sapiens
YMYWKKASR

SEQ ID NO: 1205111 - protein, 9 aa, Homo Sapiens
LQGPVLASG

SEQ ID NO: 1205112 - protein, 9 aa, Homo Sapiens
RFGPGYLGG

SEQ ID NO: 1205113 - protein, 9 aa, Homo Sapiens
IILALEQHL

SEQ ID NO: 1205114 - protein, 9 aa, Homo Sapiens
IGDFGLATE

SEQ ID NO: 1205115 - protein, 9 aa, Homo Sapiens
IGGAAVVCR

SEQ ID NO: 1205116 - protein, 9 aa, Homo Sapiens
TVIVLKAPP

SEQ ID NO: 1205117 - protein, 9 aa, Homo Sapiens
FARVSGSIP

SEQ ID NO: 1205118 - protein, 9 aa, Homo Sapiens
WRARSTSTS

SEQ ID NO: 1205119 - protein, 9 aa, Homo Sapiens
ERFVLLNLV

SEQ ID NO: 1205120 - protein, 9 aa, Homo Sapiens
NSALQGQGL

SEQ ID NO: 1205121 - protein, 9 aa, Homo Sapiens
SHVCSRTPV

SEQ ID NO: 1205122 - protein, 9 aa, Homo Sapiens
SALQGQGLL

SEQ ID NO: 1205123 - protein, 9 aa, Homo Sapiens
THTHTWRAR

SEQ ID NO: 1205124 - protein, 9 aa, Homo Sapiens
GLATEKSRW

SEQ ID NO: 1205125 - protein, 9 aa, Homo Sapiens
SLNSLKNLN

SEQ ID NO: 1205126 - protein, 9 aa, Homo Sapiens
AQLLGCSHV

SEQ ID NO: 1205127 - protein, 9 aa, Homo Sapiens
GNLNSALQG

SEQ ID NO: 1205128 - protein, 9 aa, Homo Sapiens
LAERFVLLN

SEQ ID NO: 1205129 - protein, 9 aa, Homo Sapiens
VKQQVIMVS

SEQ ID NO: 1205130 - protein, 9 aa, Homo Sapiens
PLGLFELFF

SEQ ID NO: 1205131 - protein, 9 aa, Homo Sapiens
SHLGGNWAW

SEQ ID NO: 1205132 - protein, 9 aa, Homo Sapiens
KTPKEKDTE

SEQ ID NO: 1205133 - protein, 9 aa, Homo Sapiens
ILALEQHLP

SEQ ID NO: 1205134 - protein, 9 aa, Homo Sapiens
HLGGNWAWN

SEQ ID NO: 1205135 - protein, 9 aa, Homo Sapiens
AMSTCSPAV

SEQ ID NO: 1205136 - protein, 9 aa, Homo Sapiens
GDPGPKRFG

SEQ ID NO: 1205137 - protein, 9 aa, Homo Sapiens
DQSPGVSPV

SEQ ID NO: 1205138 - protein, 9 aa, Homo Sapiens
IDQSPGVSP

SEQ ID NO: 1205139 - protein, 9 aa, Homo Sapiens
HTHTLTHTH

SEQ ID NO: 1205140 - protein, 9 aa, Homo Sapiens
TLQGPVLAS

SEQ ID NO: 1205141 - protein, 9 aa, Homo Sapiens
DPGPKRFGP

SEQ ID NO: 1205142 - protein, 9 aa, Homo Sapiens
TVDGLMEGS

SEQ ID NO: 1205143 - protein, 9 aa, Homo Sapiens
RARSTSTST

SEQ ID NO: 1205144 - protein, 9 aa, Homo Sapiens
GIDQSPGVS

SEQ ID NO: 1205145 - protein, 9 aa, Homo Sapiens
LTVDGLMEG

SEQ ID NO: 1205146 - protein, 9 aa, Homo Sapiens
HVCSRTPVE

SEQ ID NO: 1205147 - protein, 9 aa, Homo Sapiens
IKSWIFFFS

SEQ ID NO: 1205148 - protein, 9 aa, Homo Sapiens
SWNIGGAAV

SEQ ID NO: 1205149 - protein, 9 aa, Homo Sapiens
MEGSLYEFK

SEQ ID NO: 1205150 - protein, 9 aa, Homo Sapiens
RVSGSIPPL

SEQ ID NO: 1205151 - protein, 9 aa, Homo Sapiens
CSSELPQNA

SEQ ID NO: 1205152 - protein, 9 aa, Homo Sapiens
ARVSGSIPP

SEQ ID NO: 1205153 - protein, 9 aa, Homo Sapiens
SELPQNAVL

SEQ ID NO: 1205154 - protein, 9 aa, Homo Sapiens
KSQELSPLG

SEQ ID NO: 1205155 - protein, 9 aa, Homo Sapiens
DTEGKKSGD

SEQ ID NO: 1205156 - protein, 9 aa, Homo Sapiens
STSTSTISA

SEQ ID NO: 1205157 - protein, 9 aa, Homo Sapiens
LATEKSRWS

SEQ ID NO: 1205158 - protein, 9 aa, Homo Sapiens
SGILQDFQG

SEQ ID NO: 1205159 - protein, 9 aa, Homo Sapiens
NLNSALQGQ

SEQ ID NO: 1205160 - protein, 9 aa, Homo Sapiens
DRRSRGQKA

SEQ ID NO: 1205161 - protein, 9 aa, Homo Sapiens
AVLLSKENS

SEQ ID NO: 1205162 - protein, 9 aa, Homo Sapiens
HTHTHTLTH

SEQ ID NO: 1205163 - protein, 9 aa, Homo Sapiens
TPKEKDTEG

SEQ ID NO: 1205164 - protein, 9 aa, Homo Sapiens
ANCIILALE

SEQ ID NO: 1205165 - protein, 9 aa, Homo Sapiens
GQKAKQERE

SEQ ID NO: 1205166 - protein, 9 aa, Homo Sapiens
KNKTPKEKD

SEQ ID NO: 1205167 - protein, 9 aa, Homo Sapiens
NYGNLNSAL

SEQ ID NO: 1205168 - protein, 9 aa, Homo Sapiens
EVKQQVIMV

SEQ ID NO: 1205169 - protein, 9 aa, Homo Sapiens
ILQDFQGEL

SEQ ID NO: 1205170 - protein, 9 aa, Homo Sapiens
KSGDSGRAE

SEQ ID NO: 1205171 - protein, 9 aa, Homo Sapiens
VCDDSWNIG

SEQ ID NO: 1205172 - protein, 9 aa, Homo Sapiens
PKEKDTEGK

SEQ ID NO: 1205173 - protein, 9 aa, Homo Sapiens
KDTEGKKSG

SEQ ID NO: 1205174 - protein, 9 aa, Homo Sapiens
SGQSLTLQC

SEQ ID NO: 1205175 - protein, 9 aa, Homo Sapiens
KKSGDSGRA

SEQ ID NO: 1205176 - protein, 9 aa, Homo Sapiens
KKLEKKNKT

SEQ ID NO: 1205177 - protein, 9 aa, Homo Sapiens
EKKVSCRAM

SEQ ID NO: 1205178 - protein, 9 aa, Homo Sapiens
PEVKQQVIM

SEQ ID NO: 1205179 - protein, 9 aa, Homo Sapiens
IHTHTHTHT

SEQ ID NO: 1205180 - protein, 9 aa, Homo Sapiens
PGPKRFGPG

SEQ ID NO: 1205181 - protein, 9 aa, Homo Sapiens
GVSPVPLRE

SEQ ID NO: 1205182 - protein, 9 aa, Homo Sapiens
DFQGELICP

SEQ ID NO: 1205183 - protein, 9 aa, Homo Sapiens
KKVSCRAMS

SEQ ID NO: 1205184 - protein, 9 aa, Homo Sapiens
IANCIILAL

SEQ ID NO: 1205185 - protein, 9 aa, Homo Sapiens
NCIILALEQ

SEQ ID NO: 1205186 - protein, 9 aa, Homo Sapiens
KRFGPGYLG

SEQ ID NO: 1205187 - protein, 9 aa, Homo Sapiens
TIIANCIIL

SEQ ID NO: 1205188 - protein, 9 aa, Homo Sapiens
AFARVSGSI

SEQ ID NO: 1205189 - protein, 9 aa, Homo Sapiens
LMEGSLYEF

SEQ ID NO: 1205190 - protein, 9 aa, Homo Sapiens
VCSRTPVET

SEQ ID NO: 1205191 - protein, 9 aa, Homo Sapiens
LKNLNNLSS

SEQ ID NO: 1205192 - protein, 9 aa, Homo Sapiens
EKSRWSGSH

SEQ ID NO: 1205193 - protein, 9 aa, Homo Sapiens
HTWRARSTS

SEQ ID NO: 1205194 - protein, 9 aa, Homo Sapiens
RSTSTSTIS

SEQ ID NO: 1205195 - protein, 9 aa, Homo Sapiens
SGDSGRAER

SEQ ID NO: 1205196 - protein, 9 aa, Homo Sapiens
QQVIMVSDT

SEQ ID NO: 1205197 - protein, 9 aa, Homo Sapiens
AKKKLEKKN

SEQ ID NO: 1205198 - protein, 9 aa, Homo Sapiens
ATIIANCII

SEQ ID NO: 1205199 - protein, 9 aa, Homo Sapiens
CSHVCSRTP

SEQ ID NO: 1205200 - protein, 9 aa, Homo Sapiens
CIILALEQH

SEQ ID NO: 1205201 - protein, 9 aa, Homo Sapiens
THTLTHTHT

SEQ ID NO: 1205202 - protein, 9 aa, Homo Sapiens
GCSHVCSRT

SEQ ID NO: 1205203 - protein, 9 aa, Homo Sapiens
ALLMPAGAT

SEQ ID NO: 1205204 - protein, 9 aa, Homo Sapiens
ELSPLGLFE

SEQ ID NO: 1205205 - protein, 9 aa, Homo Sapiens
SQELSPLGL

SEQ ID NO: 1205206 - protein, 9 aa, Homo Sapiens
RAMSTCSPA

SEQ ID NO: 1205207 - protein, 9 aa, Homo Sapiens
GILQDFQGE

SEQ ID NO: 1205208 - protein, 9 aa, Homo Sapiens
LNSALQGQG

SEQ ID NO: 1205209 - protein, 9 aa, Homo Sapiens
SRGQKAKQE

SEQ ID NO: 1205210 - protein, 9 aa, Homo Sapiens
QGPVLASGQ

SEQ ID NO: 1205211 - protein, 9 aa, Homo Sapiens
LQDFQGELI

SEQ ID NO: 1205212 - protein, 9 aa, Homo Sapiens
TIKSWIFFF

SEQ ID NO: 1205213 - protein, 9 aa, Homo Sapiens
QNAVLLSKE

SEQ ID NO: 1205214 - protein, 9 aa, Homo Sapiens
VSGSIPPLP

SEQ ID NO: 1205215 - protein, 9 aa, Homo Sapiens
QLLGCSHVC

SEQ ID NO: 1205216 - protein, 9 aa, Homo Sapiens
AERFVLLNL

SEQ ID NO: 1205217 - protein, 9 aa, Homo Sapiens
GSSLNSLKN

SEQ ID NO: 1205218 - protein, 9 aa, Homo Sapiens
GDSGRAERA

SEQ ID NO: 1205219 - protein, 9 aa, Homo Sapiens
VSCRAMSTC

SEQ ID NO: 1205220 - protein, 9 aa, Homo Sapiens
GPEVKQQVI

SEQ ID NO: 1205221 - protein, 9 aa, Homo Sapiens
KEKDTEGKK

SEQ ID NO: 1205222 - protein, 9 aa, Homo Sapiens
VIGDRRSRG

SEQ ID NO: 1205223 - protein, 9 aa, Homo Sapiens
PGSSLNSLK

SEQ ID NO: 1205224 - protein, 9 aa, Homo Sapiens
LTHTHTWRA

SEQ ID NO: 1205225 - protein, 9 aa, Homo Sapiens
DGLMEGSLY

SEQ ID NO: 1205226 - protein, 9 aa, Homo Sapiens
KNLNNLSSP

SEQ ID NO: 1205227 - protein, 9 aa, Homo Sapiens
CDDSWNIGG

SEQ ID NO: 1205228 - protein, 9 aa, Homo Sapiens
SWIFFFSVQ

SEQ ID NO: 1205229 - protein, 9 aa, Homo Sapiens
GDFGLATEK

SEQ ID NO: 1205230 - protein, 9 aa, Homo Sapiens
KKNKTPKEK

SEQ ID NO: 1205231 - protein, 9 aa, Homo Sapiens
KLEKKNKTP

SEQ ID NO: 1205232 - protein, 9 aa, Homo Sapiens
NSLKNLNNL

SEQ ID NO: 1205233 - protein, 9 aa, Homo Sapiens
RFVLLNLVY

SEQ ID NO: 1205234 - protein, 9 aa, Homo Sapiens
LREKKVSCR

SEQ ID NO: 1205235 - protein, 9 aa, Homo Sapiens
RRSRGQKAK

SEQ ID NO: 1205236 - protein, 9 aa, Homo Sapiens
GPKRFGPGY

SEQ ID NO: 1205237 - protein, 9 aa, Homo Sapiens
HTHTHTHTL

SEQ ID NO: 1205238 - protein, 9 aa, Homo Sapiens
SPGVSPVPL

SEQ ID NO: 1205239 - protein, 9 aa, Homo Sapiens
PIGDPGPKR

SEQ ID NO: 1205240 - protein, 9 aa, Homo Sapiens
KEIQKLAER

SEQ ID NO: 1205241 - protein, 9 aa, Homo Sapiens
LKDQTVIVL

SEQ ID NO: 1205242 - protein, 9 aa, Homo Sapiens
QKLAERFVL

SEQ ID NO: 1205243 - protein, 9 aa, Homo Sapiens
DFGLATEKS

SEQ ID NO: 1205244 - protein, 9 aa, Homo Sapiens
NKTPKEKDT

SEQ ID NO: 1205245 - protein, 9 aa, Homo Sapiens
LGGNWAWNK

SEQ ID NO: 1205246 - protein, 9 aa, Homo Sapiens
ARSTSTSTI

SEQ ID NO: 1205247 - protein, 9 aa, Homo Sapiens
GPVLASGQS

SEQ ID NO: 1205248 - protein, 9 aa, Homo Sapiens
TILTVDGLM

SEQ ID NO: 1205249 - protein, 9 aa, Homo Sapiens
QELSPLGLF

SEQ ID NO: 1205250 - protein, 9 aa, Homo Sapiens
LEKKNKTPK

SEQ ID NO: 1205251 - protein, 9 aa, Homo Sapiens
HTLTHTHTW

SEQ ID NO: 1205252 - protein, 9 aa, Homo Sapiens
THTWRARST

SEQ ID NO: 1205253 - protein, 9 aa, Homo Sapiens
QVIMVSDTE

SEQ ID NO: 1205254 - protein, 9 aa, Homo Sapiens
EIQKLAERF

SEQ ID NO: 1205255 - protein, 9 aa, Homo Sapiens
IGDRRSRGQ

SEQ ID NO: 1205256 - protein, 9 aa, Homo Sapiens
ATEKSRWSG

SEQ ID NO: 1205257 - protein, 9 aa, Homo Sapiens
REKKVSCRA

SEQ ID NO: 1205258 - protein, 9 aa, Homo Sapiens
KQQVIMVSD

SEQ ID NO: 1205259 - protein, 9 aa, Homo Sapiens
GKKSGDSGR

SEQ ID NO: 1205260 - protein, 9 aa, Homo Sapiens
LLGCSHVCS

SEQ ID NO: 1205261 - protein, 9 aa, Homo Sapiens
VSPVPLREP

SEQ ID NO: 1205262 - protein, 9 aa, Homo Sapiens
RSRGQKAKQ

SEQ ID NO: 1205263 - protein, 9 aa, Homo Sapiens
TLTHTHTWR

SEQ ID NO: 1205264 - protein, 9 aa, Homo Sapiens
VLKAPPETR

SEQ ID NO: 1205265 - protein, 9 aa, Homo Sapiens
LPQNAVLLS

SEQ ID NO: 1205266 - protein, 9 aa, Homo Sapiens
PKRFGPGYL

SEQ ID NO: 1205267 - protein, 9 aa, Homo Sapiens
KVSCRAMST

SEQ ID NO: 1205268 - protein, 9 aa, Homo Sapiens
PQNAVLLSK

SEQ ID NO: 1205269 - protein, 9 aa, Homo Sapiens
SLKNLNNLS

SEQ ID NO: 1205270 - protein, 9 aa, Homo Sapiens
SSELPQNAV

SEQ ID NO: 1205271 - protein, 9 aa, Homo Sapiens
GSIPPLPPP

SEQ ID NO: 1205272 - protein, 9 aa, Homo Sapiens
LGLFELFFD

SEQ ID NO: 1205273 - protein, 9 aa, Homo Sapiens
IGDPGPKRF

SEQ ID NO: 1205274 - protein, 9 aa, Homo Sapiens
WNIGGAAVV

SEQ ID NO: 1205275 - protein, 9 aa, Homo Sapiens
FGLATEKSR

SEQ ID NO: 1205276 - protein, 9 aa, Homo Sapiens
LLMPAGATS

SEQ ID NO: 1205277 - protein, 9 aa, Homo Sapiens
EKKNKTPKE

SEQ ID NO: 1205278 - protein, 9 aa, Homo Sapiens
VDGLMEGSL

SEQ ID NO: 1205279 - protein, 9 aa, Homo Sapiens
VLASGQSLT

SEQ ID NO: 1205280 - protein, 9 aa, Homo Sapiens
KKKLEKKNK

SEQ ID NO: 1205281 - protein, 9 aa, Homo Sapiens
YGNLNSALQ

SEQ ID NO: 1205282 - protein, 9 aa, Homo Sapiens
KSWIFFFSV

SEQ ID NO: 1205283 - protein, 9 aa, Homo Sapiens
SSLNSLKNL

SEQ ID NO: 1205284 - protein, 9 aa, Homo Sapiens
SCRAMSTCS

SEQ ID NO: 1205285 - protein, 9 aa, Homo Sapiens
LGCSHVCSR

SEQ ID NO: 1205286 - protein, 9 aa, Homo Sapiens
TNYGNLNSA

SEQ ID NO: 1205287 - protein, 9 aa, Homo Sapiens
IMVSDTEIL

SEQ ID NO: 1205288 - protein, 9 aa, Homo Sapiens
KDQTVIVLK

SEQ ID NO: 1205289 - protein, 9 aa, Homo Sapiens
FLREKKVSC

SEQ ID NO: 1205290 - protein, 9 aa, Homo Sapiens
NAVLLSKEN

SEQ ID NO: 1205291 - protein, 9 aa, Homo Sapiens
LKSQELSPL

SEQ ID NO: 1205292 - protein, 9 aa, Homo Sapiens
LKAPPETRL

SEQ ID NO: 1205293 - protein, 9 aa, Homo Sapiens
GGAAVVCRQ

SEQ ID NO: 1205294 - protein, 9 aa, Homo Sapiens
TEGKKSGDS

SEQ ID NO: 1205295 - protein, 9 aa, Homo Sapiens
EGKKSGDSG

SEQ ID NO: 1205296 - protein, 9 aa, Homo Sapiens
TEKSRWSGS

SEQ ID NO: 1205297 - protein, 9 aa, Homo Sapiens
VIVLKAPPE

SEQ ID NO: 1205298 - protein, 9 aa, Homo Sapiens
YTNYGNLNS

SEQ ID NO: 1205299 - protein, 9 aa, Homo Sapiens
SGSIPPLPP

SEQ ID NO: 1205300 - protein, 9 aa, Homo Sapiens
SPLGLFELF

SEQ ID NO: 1205301 - protein, 9 aa, Homo Sapiens
RGQKAKQER

SEQ ID NO: 1205302 - protein, 9 aa, Homo Sapiens
ILTVDGLME

SEQ ID NO: 1205303 - protein, 9 aa, Homo Sapiens
MNSGILQDF

SEQ ID NO: 1205304 - protein, 9 aa, Homo Sapiens
NIGGAAVVC

SEQ ID NO: 1205305 - protein, 9 aa, Homo Sapiens
DDSWNIGGA

SEQ ID NO: 1205306 - protein, 9 aa, Homo Sapiens
TFLREKKVS

SEQ ID NO: 1205307 - protein, 9 aa, Homo Sapiens
GDRRSRGQK

SEQ ID NO: 1205308 - protein, 9 aa, Homo Sapiens
KLAERFVLL

SEQ ID NO: 1205309 - protein, 9 aa, Homo Sapiens
DSSSSSSSP

SEQ ID NO: 1205310 - protein, 9 aa, Homo Sapiens
LNSLKNLNN

SEQ ID NO: 1205311 - protein, 9 aa, Homo Sapiens
PVLASGQSL

SEQ ID NO: 1205312 - protein, 9 aa, Homo Sapiens
GGAFARVSG

SEQ ID NO: 1205313 - protein, 9 aa, Homo Sapiens
DSWNIGGAA

SEQ ID NO: 1205314 - protein, 9 aa, Homo Sapiens
IQKLAERFV

SEQ ID NO: 1205315 - protein, 9 aa, Homo Sapiens
QDFQGELIC

SEQ ID NO: 1205316 - protein, 9 aa, Homo Sapiens
LMPAGATSG

SEQ ID NO: 1205317 - protein, 9 aa, Homo Sapiens
ELPQNAVLL

SEQ ID NO: 1205318 - protein, 9 aa, Homo Sapiens
QTVIVLKAP

SEQ ID NO: 1205319 - protein, 9 aa, Homo Sapiens
DQTVIVLKA

SEQ ID NO: 1205320 - protein, 9 aa, Homo Sapiens
EKDTEGKKS

SEQ ID NO: 1205321 - protein, 9 aa, Homo Sapiens
THTHTLTHT

SEQ ID NO: 1205322 - protein, 9 aa, Homo Sapiens
ASGQSLTLQ

SEQ ID NO: 1205323 - protein, 9 aa, Homo Sapiens
SGIDQSPGV

SEQ ID NO: 1205324 - protein, 9 aa, Homo Sapiens
IIANCIILA

SEQ ID NO: 1205325 - protein, 9 aa, Homo Sapiens
GAFARVSGS

SEQ ID NO: 1205326 - protein, 9 aa, Homo Sapiens
DTFLREKKV

SEQ ID NO: 1205327 - protein, 9 aa, Homo Sapiens
GLMEGSLYE

SEQ ID NO: 1205328 - protein, 9 aa, Homo Sapiens
VIMVSDTEI

SEQ ID NO: 1205329 - protein, 9 aa, Homo Sapiens
CRAMSTCSP

SEQ ID NO: 1205330 - protein, 9 aa, Homo Sapiens
HTHTWRARS

SEQ ID NO: 1205331 - protein, 9 aa, Homo Sapiens
THTHTHTLT

SEQ ID NO: 1205332 - protein, 9 aa, Homo Sapiens
QSPGVSPVP

SEQ ID NO: 1205333 - protein, 9 aa, Homo Sapiens
TWRARSTST

SEQ ID NO: 1205334 - protein, 9 aa, Homo Sapiens
PGVSPVPLR

SEQ ID NO: 1205335 - protein, 9 aa, Homo Sapiens
LASGQSLTL

SEQ ID NO: 1205336 - protein, 9 aa, Homo Sapiens
IVLKAPPET

SEQ ID NO: 1205337 - protein, 9 aa, Homo Sapiens
LSPLGLFEL

SEQ ID NO: 1205338 - protein, 9 aa, Homo Sapiens
NSGILQDFQ

SEQ ID NO: 1205339 - protein, 9 aa, Homo Sapiens
DVGGPWFRH

SEQ ID NO: 1205340 - protein, 9 aa, Homo Sapiens
KNEGLWLLD

SEQ ID NO: 1205341 - protein, 9 aa, Homo Sapiens
GGPWFRHYD

SEQ ID NO: 1205342 - protein, 9 aa, Homo Sapiens
KKMAAARVA

SEQ ID NO: 1205343 - protein, 9 aa, Homo Sapiens
RVAAAAGRQ

SEQ ID NO: 1205344 - protein, 9 aa, Homo Sapiens
RLPTDLDVG

SEQ ID NO: 1205345 - protein, 9 aa, Homo Sapiens
AARVAAAAG

SEQ ID NO: 1205346 - protein, 9 aa, Homo Sapiens
GLWLLDDSK

SEQ ID NO: 1205347 - protein, 9 aa, Homo Sapiens
DLDVGGPWF

SEQ ID NO: 1205348 - protein, 9 aa, Homo Sapiens
LDIKKNEGL

SEQ ID NO: 1205349 - protein, 9 aa, Homo Sapiens
KMAAARVAA

SEQ ID NO: 1205350 - protein, 9 aa, Homo Sapiens
ARVAAAAGR

SEQ ID NO: 1205351 - protein, 9 aa, Homo Sapiens
IKKNEGLWL

SEQ ID NO: 1205352 - protein, 9 aa, Homo Sapiens
LDVGGPWFR

SEQ ID NO: 1205353 - protein, 9 aa, Homo Sapiens
LPTDLDVGG

SEQ ID NO: 1205354 - protein, 9 aa, Homo Sapiens
VGGPWFRHY

SEQ ID NO: 1205355 - protein, 9 aa, Homo Sapiens
MAAARVAAA

SEQ ID NO: 1205356 - protein, 9 aa, Homo Sapiens
TDLDVGGPW

SEQ ID NO: 1205357 - protein, 9 aa, Homo Sapiens
AAARVAAAA

SEQ ID NO: 1205358 - protein, 9 aa, Homo Sapiens
NEGLWLLDD

SEQ ID NO: 1205359 - protein, 9 aa, Homo Sapiens
ELDIKKNEG

SEQ ID NO: 1205360 - protein, 9 aa, Homo Sapiens
YNEEEEEDC

SEQ ID NO: 1205361 - protein, 9 aa, Homo Sapiens
AYNEEEEED

SEQ ID NO: 1205362 - protein, 9 aa, Homo Sapiens
NEEEEEDCS

SEQ ID NO: 1205363 - protein, 9 aa, Homo Sapiens
PTDLDVGGP

SEQ ID NO: 1205364 - protein, 9 aa, Homo Sapiens
KKNEGLWLL

SEQ ID NO: 1205365 - protein, 9 aa, Homo Sapiens
DIKKNEGLW

SEQ ID NO: 1205366 - protein, 9 aa, Homo Sapiens
NKKMAAARV

SEQ ID NO: 1205367 - protein, 9 aa, Homo Sapiens
EGLWLLDDS

SEQ ID NO: 1205368 - protein, 9 aa, Homo Sapiens
SSNRPGLEL

SEQ ID NO: 1205369 - protein, 9 aa, Homo Sapiens
RGAVTLRGA

SEQ ID NO: 1205370 - protein, 9 aa, Homo Sapiens
LRGAPGRQR

SEQ ID NO: 1205371 - protein, 9 aa, Homo Sapiens
VIALVFERI

SEQ ID NO: 1205372 - protein, 9 aa, Homo Sapiens
IGDFGLATE

SEQ ID NO: 1205373 - protein, 9 aa, Homo Sapiens
CTSYLNSGL

SEQ ID NO: 1205374 - protein, 9 aa, Homo Sapiens
AVLCRGPVA

SEQ ID NO: 1205375 - protein, 9 aa, Homo Sapiens
TSYLNSGLP

SEQ ID NO: 1205376 - protein, 9 aa, Homo Sapiens
VLCRGPVAP

SEQ ID NO: 1205377 - protein, 9 aa, Homo Sapiens
LGESSNRPG

SEQ ID NO: 1205378 - protein, 9 aa, Homo Sapiens
FAMRNVCPP

SEQ ID NO: 1205379 - protein, 9 aa, Homo Sapiens
PGRQRCPAT

SEQ ID NO: 1205380 - protein, 9 aa, Homo Sapiens
RPPPRPAAQ

SEQ ID NO: 1205381 - protein, 9 aa, Homo Sapiens
WSLGESSNR

SEQ ID NO: 1205382 - protein, 9 aa, Homo Sapiens
ATSGWAGGR

SEQ ID NO: 1205383 - protein, 9 aa, Homo Sapiens
SGWAGGRPP

SEQ ID NO: 1205384 - protein, 9 aa, Homo Sapiens
QSLPRLQGF

SEQ ID NO: 1205385 - protein, 9 aa, Homo Sapiens
EEASPPRGS

SEQ ID NO: 1205386 - protein, 9 aa, Homo Sapiens
TLLSVLLEA

SEQ ID NO: 1205387 - protein, 9 aa, Homo Sapiens
PPRPAAQSP

SEQ ID NO: 1205388 - protein, 9 aa, Homo Sapiens
RNVCPPRGF

SEQ ID NO: 1205389 - protein, 9 aa, Homo Sapiens
GRRFYANPS

SEQ ID NO: 1205390 - protein, 9 aa, Homo Sapiens
RIPIFHVEL

SEQ ID NO: 1205391 - protein, 9 aa, Homo Sapiens
VTLRGAPGR

SEQ ID NO: 1205392 - protein, 9 aa, Homo Sapiens
TWATSGWAG

SEQ ID NO: 1205393 - protein, 9 aa, Homo Sapiens
PPPRPAAQS

SEQ ID NO: 1205394 - protein, 9 aa, Homo Sapiens
GPGAQDPAL

SEQ ID NO: 1205395 - protein, 9 aa, Homo Sapiens
LLSVLLEAL

SEQ ID NO: 1205396 - protein, 9 aa, Homo Sapiens
SGLPSHLSF

SEQ ID NO: 1205397 - protein, 9 aa, Homo Sapiens
PVGPEEASP

SEQ ID NO: 1205398 - protein, 9 aa, Homo Sapiens
MRNVCPPRG

SEQ ID NO: 1205399 - protein, 9 aa, Homo Sapiens
RGPVAPLVF

SEQ ID NO: 1205400 - protein, 9 aa, Homo Sapiens
LEHLVVWRV

SEQ ID NO: 1205401 - protein, 9 aa, Homo Sapiens
QFGKSPPGP

SEQ ID NO: 1205402 - protein, 9 aa, Homo Sapiens
AVQLPVGPE

SEQ ID NO: 1205403 - protein, 9 aa, Homo Sapiens
IGGDEPDKF

SEQ ID NO: 1205404 - protein, 9 aa, Homo Sapiens
CPATWATSG

SEQ ID NO: 1205405 - protein, 9 aa, Homo Sapiens
RGAPGRQRC

SEQ ID NO: 1205406 - protein, 9 aa, Homo Sapiens
TLRGAPGRQ

SEQ ID NO: 1205407 - protein, 9 aa, Homo Sapiens
SNRPGLELP

SEQ ID NO: 1205408 - protein, 9 aa, Homo Sapiens
AAQSPAVQL

SEQ ID NO: 1205409 - protein, 9 aa, Homo Sapiens
PPRGSPQAP

SEQ ID NO: 1205410 - protein, 9 aa, Homo Sapiens
AQSPAVQLP

SEQ ID NO: 1205411 - protein, 9 aa, Homo Sapiens
TKKGRRFYA

SEQ ID NO: 1205412 - protein, 9 aa, Homo Sapiens
LPVGPEEAS

SEQ ID NO: 1205413 - protein, 9 aa, Homo Sapiens
ALEHLVVWR

SEQ ID NO: 1205414 - protein, 9 aa, Homo Sapiens
LATEKSRWS

SEQ ID NO: 1205415 - protein, 9 aa, Homo Sapiens
PRPAAQSPA

SEQ ID NO: 1205416 - protein, 9 aa, Homo Sapiens
QRCPATWAT

SEQ ID NO: 1205417 - protein, 9 aa, Homo Sapiens
RCTSYLNSG

SEQ ID NO: 1205418 - protein, 9 aa, Homo Sapiens
RLQGFGAPL

SEQ ID NO: 1205419 - protein, 9 aa, Homo Sapiens
PFLTPVRSV

SEQ ID NO: 1205420 - protein, 9 aa, Homo Sapiens
SLPRLQGFG

SEQ ID NO: 1205421 - protein, 9 aa, Homo Sapiens
LSVLLEALS

SEQ ID NO: 1205422 - protein, 9 aa, Homo Sapiens
RFYANPSDK

SEQ ID NO: 1205423 - protein, 9 aa, Homo Sapiens
GAPGRQRCP

SEQ ID NO: 1205424 - protein, 9 aa, Homo Sapiens
IIGGDEPDK

SEQ ID NO: 1205425 - protein, 9 aa, Homo Sapiens
TSGWAGGRP

SEQ ID NO: 1205426 - protein, 9 aa, Homo Sapiens
PRCTSYLNS

SEQ ID NO: 1205427 - protein, 9 aa, Homo Sapiens
QDPALQSLP

SEQ ID NO: 1205428 - protein, 9 aa, Homo Sapiens
ELPTLLSVL

SEQ ID NO: 1205429 - protein, 9 aa, Homo Sapiens
QGFGAPLGR

SEQ ID NO: 1205430 - protein, 9 aa, Homo Sapiens
KKGRRFYAN

SEQ ID NO: 1205431 - protein, 9 aa, Homo Sapiens
AGGRPPPRP

SEQ ID NO: 1205432 - protein, 9 aa, Homo Sapiens
LQSLPRLQG

SEQ ID NO: 1205433 - protein, 9 aa, Homo Sapiens
VWRVHSEDQ

SEQ ID NO: 1205434 - protein, 9 aa, Homo Sapiens
APGRQRCPA

SEQ ID NO: 1205435 - protein, 9 aa, Homo Sapiens
WLLKQPVSK

SEQ ID NO: 1205436 - protein, 9 aa, Homo Sapiens
FGKSPPGPG

SEQ ID NO: 1205437 - protein, 9 aa, Homo Sapiens
KQPVSKQIE

SEQ ID NO: 1205438 - protein, 9 aa, Homo Sapiens
WAGGRPPPR

SEQ ID NO: 1205439 - protein, 9 aa, Homo Sapiens
SKQIERYSR

SEQ ID NO: 1205440 - protein, 9 aa, Homo Sapiens
GGRPPPRPA

SEQ ID NO: 1205441 - protein, 9 aa, Homo Sapiens
PAAQSPAVQ

SEQ ID NO: 1205442 - protein, 9 aa, Homo Sapiens
PVAPLVFLA

SEQ ID NO: 1205443 - protein, 9 aa, Homo Sapiens
GPVAPLVFL

SEQ ID NO: 1205444 - protein, 9 aa, Homo Sapiens
APLVFLANF

SEQ ID NO: 1205445 - protein, 9 aa, Homo Sapiens
LPTLLSVLL

SEQ ID NO: 1205446 - protein, 9 aa, Homo Sapiens
EKSRWSGSH

SEQ ID NO: 1205447 - protein, 9 aa, Homo Sapiens
WRVHSEDQS

SEQ ID NO: 1205448 - protein, 9 aa, Homo Sapiens
LVVWRVHSE

SEQ ID NO: 1205449 - protein, 9 aa, Homo Sapiens
FYANPSDKQ

SEQ ID NO: 1205450 - protein, 9 aa, Homo Sapiens
LLKQPVSKQ

SEQ ID NO: 1205451 - protein, 9 aa, Homo Sapiens
RVHSEDQSF

SEQ ID NO: 1205452 - protein, 9 aa, Homo Sapiens
LVFERIPIF

SEQ ID NO: 1205453 - protein, 9 aa, Homo Sapiens
SPAVQLPVG

SEQ ID NO: 1205454 - protein, 9 aa, Homo Sapiens
VAPLVFLAN

SEQ ID NO: 1205455 - protein, 9 aa, Homo Sapiens
GAPLGRGAV

SEQ ID NO: 1205456 - protein, 9 aa, Homo Sapiens
SPFLTPVRS

SEQ ID NO: 1205457 - protein, 9 aa, Homo Sapiens
SYLNSGLPS

SEQ ID NO: 1205458 - protein, 9 aa, Homo Sapiens
EPDKFLQVK

SEQ ID NO: 1205459 - protein, 9 aa, Homo Sapiens
GGDEPDKFL

SEQ ID NO: 1205460 - protein, 9 aa, Homo Sapiens
GFGAPLGRG

SEQ ID NO: 1205461 - protein, 9 aa, Homo Sapiens
QPVSKQIER

SEQ ID NO: 1205462 - protein, 9 aa, Homo Sapiens
FLTPVRSVS

SEQ ID NO: 1205463 - protein, 9 aa, Homo Sapiens
DKFLQVKSV

SEQ ID NO: 1205464 - protein, 9 aa, Homo Sapiens
PEEASPPRG

SEQ ID NO: 1205465 - protein, 9 aa, Homo Sapiens
QSPAVQLPV

SEQ ID NO: 1205466 - protein, 9 aa, Homo Sapiens
DEPDKFLQV

SEQ ID NO: 1205467 - protein, 9 aa, Homo Sapiens
PDKFLQVKS

SEQ ID NO: 1205468 - protein, 9 aa, Homo Sapiens
AMRNVCPPR

SEQ ID NO: 1205469 - protein, 9 aa, Homo Sapiens
LKQPVSKQI

SEQ ID NO: 1205470 - protein, 9 aa, Homo Sapiens
GLATEKSRW

SEQ ID NO: 1205471 - protein, 9 aa, Homo Sapiens
GDFGLATEK

SEQ ID NO: 1205472 - protein, 9 aa, Homo Sapiens
DPALQSLPR

SEQ ID NO: 1205473 - protein, 9 aa, Homo Sapiens
NVCPPRGFP

SEQ ID NO: 1205474 - protein, 9 aa, Homo Sapiens
GWAGGRPPP

SEQ ID NO: 1205475 - protein, 9 aa, Homo Sapiens
PELPTLLSV

SEQ ID NO: 1205476 - protein, 9 aa, Homo Sapiens
LNSGLPSHL

SEQ ID NO: 1205477 - protein, 9 aa, Homo Sapiens
PAVQLPVGP

SEQ ID NO: 1205478 - protein, 9 aa, Homo Sapiens
YLNSGLPSH

SEQ ID NO: 1205479 - protein, 9 aa, Homo Sapiens
DFGLATEKS

SEQ ID NO: 1205480 - protein, 9 aa, Homo Sapiens
GAQDPALQS

SEQ ID NO: 1205481 - protein, 9 aa, Homo Sapiens
KFLQVKSVI

SEQ ID NO: 1205482 - protein, 9 aa, Homo Sapiens
ALLSPFLTP

SEQ ID NO: 1205483 - protein, 9 aa, Homo Sapiens
ESSNRPGLE

SEQ ID NO: 1205484 - protein, 9 aa, Homo Sapiens
PTLLSVLLE

SEQ ID NO: 1205485 - protein, 9 aa, Homo Sapiens
GRGAVTLRG

SEQ ID NO: 1205486 - protein, 9 aa, Homo Sapiens
SVLLEALSC

SEQ ID NO: 1205487 - protein, 9 aa, Homo Sapiens
GESSNRPGL

SEQ ID NO: 1205488 - protein, 9 aa, Homo Sapiens
PATWATSGW

SEQ ID NO: 1205489 - protein, 9 aa, Homo Sapiens
LGRGAVTLR

SEQ ID NO: 1205490 - protein, 9 aa, Homo Sapiens
NSGLPSHLS

SEQ ID NO: 1205491 - protein, 9 aa, Homo Sapiens
GKSPPGPGA

SEQ ID NO: 1205492 - protein, 9 aa, Homo Sapiens
RCPATWATS

SEQ ID NO: 1205493 - protein, 9 aa, Homo Sapiens
RPAAQSPAV

SEQ ID NO: 1205494 - protein, 9 aa, Homo Sapiens
ATEKSRWSG

SEQ ID NO: 1205495 - protein, 9 aa, Homo Sapiens
VSKQIERYS

SEQ ID NO: 1205496 - protein, 9 aa, Homo Sapiens
YANPSDKQV

SEQ ID NO: 1205497 - protein, 9 aa, Homo Sapiens
EHLVVWRVH

SEQ ID NO: 1205498 - protein, 9 aa, Homo Sapiens
LLSPFLTPV

SEQ ID NO: 1205499 - protein, 9 aa, Homo Sapiens
HVQFGKSPP

SEQ ID NO: 1205500 - protein, 9 aa, Homo Sapiens
PGAQDPALQ

SEQ ID NO: 1205501 - protein, 9 aa, Homo Sapiens
PPGPGAQDP

SEQ ID NO: 1205502 - protein, 9 aa, Homo Sapiens
SWSLGESSN

SEQ ID NO: 1205503 - protein, 9 aa, Homo Sapiens
VFERIPIFH

SEQ ID NO: 1205504 - protein, 9 aa, Homo Sapiens
SLGESSNRP

SEQ ID NO: 1205505 - protein, 9 aa, Homo Sapiens
RQRCPATWA

SEQ ID NO: 1205506 - protein, 9 aa, Homo Sapiens
GPEEASPPR

SEQ ID NO: 1205507 - protein, 9 aa, Homo Sapiens
ALVFERIPI

SEQ ID NO: 1205508 - protein, 9 aa, Homo Sapiens
PLGRGAVTL

SEQ ID NO: 1205509 - protein, 9 aa, Homo Sapiens
VQLPVGPEE

SEQ ID NO: 1205510 - protein, 9 aa, Homo Sapiens
FERIPIFHV

SEQ ID NO: 1205511 - protein, 9 aa, Homo Sapiens
KSPPGPGAQ

SEQ ID NO: 1205512 - protein, 9 aa, Homo Sapiens
RKALLSPFL

SEQ ID NO: 1205513 - protein, 9 aa, Homo Sapiens
KGRRFYANP

SEQ ID NO: 1205514 - protein, 9 aa, Homo Sapiens
VGPEEASPP

SEQ ID NO: 1205515 - protein, 9 aa, Homo Sapiens
YVIALVFER

SEQ ID NO: 1205516 - protein, 9 aa, Homo Sapiens
SPPGPGAQD

SEQ ID NO: 1205517 - protein, 9 aa, Homo Sapiens
VCPPRGFPP

SEQ ID NO: 1205518 - protein, 9 aa, Homo Sapiens
LQGFGAPLG

SEQ ID NO: 1205519 - protein, 9 aa, Homo Sapiens
EASPPRGSP

SEQ ID NO: 1205520 - protein, 9 aa, Homo Sapiens
VLLEALSCP

SEQ ID NO: 1205521 - protein, 9 aa, Homo Sapiens
KALLSPFLT

SEQ ID NO: 1205522 - protein, 9 aa, Homo Sapiens
PRLQGFGAP

SEQ ID NO: 1205523 - protein, 9 aa, Homo Sapiens
CRGPVAPLV

SEQ ID NO: 1205524 - protein, 9 aa, Homo Sapiens
LPRLQGFGA

SEQ ID NO: 1205525 - protein, 9 aa, Homo Sapiens
TEKSRWSGS

SEQ ID NO: 1205526 - protein, 9 aa, Homo Sapiens
RRFYANPSD

SEQ ID NO: 1205527 - protein, 9 aa, Homo Sapiens
CPPRGFPPY

SEQ ID NO: 1205528 - protein, 9 aa, Homo Sapiens
ERIPIFHVE

SEQ ID NO: 1205529 - protein, 9 aa, Homo Sapiens
GAVTLRGAP

SEQ ID NO: 1205530 - protein, 9 aa, Homo Sapiens
QLPVGPEEA

SEQ ID NO: 1205531 - protein, 9 aa, Homo Sapiens
VVWRVHSED

SEQ ID NO: 1205532 - protein, 9 aa, Homo Sapiens
RWLLKQPVS

SEQ ID NO: 1205533 - protein, 9 aa, Homo Sapiens
LCRGPVAPL

SEQ ID NO: 1205534 - protein, 9 aa, Homo Sapiens
GDEPDKFLQ

SEQ ID NO: 1205535 - protein, 9 aa, Homo Sapiens
LTPVRSVSE

SEQ ID NO: 1205536 - protein, 9 aa, Homo Sapiens
LTKKGRRFY

SEQ ID NO: 1205537 - protein, 9 aa, Homo Sapiens
GRPPPRPAA

SEQ ID NO: 1205538 - protein, 9 aa, Homo Sapiens
ATWATSGWA

SEQ ID NO: 1205539 - protein, 9 aa, Homo Sapiens
ASPPRGSPQ

SEQ ID NO: 1205540 - protein, 9 aa, Homo Sapiens
PGPGAQDPA

SEQ ID NO: 1205541 - protein, 9 aa, Homo Sapiens
APLGRGAVT

SEQ ID NO: 1205542 - protein, 9 aa, Homo Sapiens
LSPFLTPVR

SEQ ID NO: 1205543 - protein, 9 aa, Homo Sapiens
SSWSLGESS

SEQ ID NO: 1205544 - protein, 9 aa, Homo Sapiens
HLVVWRVHS

SEQ ID NO: 1205545 - protein, 9 aa, Homo Sapiens
FGAPLGRGA

SEQ ID NO: 1205546 - protein, 9 aa, Homo Sapiens
PVSKQIERY

SEQ ID NO: 1205547 - protein, 9 aa, Homo Sapiens
FGLATEKSR

SEQ ID NO: 1205548 - protein, 9 aa, Homo Sapiens
IALVFERIP

SEQ ID NO: 1205549 - protein, 9 aa, Homo Sapiens
AQDPALQSL

SEQ ID NO: 1205550 - protein, 9 aa, Homo Sapiens
AVTLRGAPG

SEQ ID NO: 1205551 - protein, 9 aa, Homo Sapiens
GRQRCPATW

SEQ ID NO: 1205552 - protein, 9 aa, Homo Sapiens
ALQSLPRLQ

SEQ ID NO: 1205553 - protein, 9 aa, Homo Sapiens
SPPRGSPQA

SEQ ID NO: 1205554 - protein, 9 aa, Homo Sapiens
WATSGWAGG

SEQ ID NO: 1205555 - protein, 9 aa, Homo Sapiens
VQFGKSPPG

SEQ ID NO: 1205556 - protein, 9 aa, Homo Sapiens
PALQSLPRL

SEQ ID NO: 1205557 - protein, 9 aa, Homo Sapiens
QKERQMRLE

SEQ ID NO: 1205558 - protein, 9 aa, Homo Sapiens
IWLLILSYV

SEQ ID NO: 1205559 - protein, 9 aa, Homo Sapiens
CSKLLAELF

SEQ ID NO: 1205560 - protein, 9 aa, Homo Sapiens
KNFFVEASM

SEQ ID NO: 1205561 - protein, 9 aa, Homo Sapiens
WLLILSYVG

SEQ ID NO: 1205562 - protein, 9 aa, Homo Sapiens
CKEAINVLS

SEQ ID NO: 1205563 - protein, 9 aa, Homo Sapiens
GLCIWLLIL

SEQ ID NO: 1205564 - protein, 9 aa, Homo Sapiens
HGECQACDQ

SEQ ID NO: 1205565 - protein, 9 aa, Homo Sapiens
VLSHLPSHH

SEQ ID NO: 1205566 - protein, 9 aa, Homo Sapiens
IMKLLLPES

SEQ ID NO: 1205567 - protein, 9 aa, Homo Sapiens
LLPESLKAY

SEQ ID NO: 1205568 - protein, 9 aa, Homo Sapiens
CIWLLILSY

SEQ ID NO: 1205569 - protein, 9 aa, Homo Sapiens
LLLPESLKA

SEQ ID NO: 1205570 - protein, 9 aa, Homo Sapiens
VLSLCEKGG

SEQ ID NO: 1205571 - protein, 9 aa, Homo Sapiens
QRLQEQKER

SEQ ID NO: 1205572 - protein, 9 aa, Homo Sapiens
FSEAAYSKL

SEQ ID NO: 1205573 - protein, 9 aa, Homo Sapiens
AINVLSHLP

SEQ ID NO: 1205574 - protein, 9 aa, Homo Sapiens
IFPCSKLLA

SEQ ID NO: 1205575 - protein, 9 aa, Homo Sapiens
NKFSEAAYS

SEQ ID NO: 1205576 - protein, 9 aa, Homo Sapiens
SDYETFKNF

SEQ ID NO: 1205577 - protein, 9 aa, Homo Sapiens
LCEKGGAMI

SEQ ID NO: 1205578 - protein, 9 aa, Homo Sapiens
CEKGGAMIM

SEQ ID NO: 1205579 - protein, 9 aa, Homo Sapiens
LREKIMKLL

SEQ ID NO: 1205580 - protein, 9 aa, Homo Sapiens
YQHGECQAC

SEQ ID NO: 1205581 - protein, 9 aa, Homo Sapiens
LQEQKERQM

SEQ ID NO: 1205582 - protein, 9 aa, Homo Sapiens
SEAAYSKLL

SEQ ID NO: 1205583 - protein, 9 aa, Homo Sapiens
SKLLAELFN

SEQ ID NO: 1205584 - protein, 9 aa, Homo Sapiens
GFINHVNAA

SEQ ID NO: 1205585 - protein, 9 aa, Homo Sapiens
EAINVLSHL

SEQ ID NO: 1205586 - protein, 9 aa, Homo Sapiens
ETFKNFFVE

SEQ ID NO: 1205587 - protein, 9 aa, Homo Sapiens
VNAAMDFTQ

SEQ ID NO: 1205588 - protein, 9 aa, Homo Sapiens
EKGGAMIME

SEQ ID NO: 1205589 - protein, 9 aa, Homo Sapiens
SEIYEAGAP

SEQ ID NO: 1205590 - protein, 9 aa, Homo Sapiens
KIMKLLLPE

SEQ ID NO: 1205591 - protein, 9 aa, Homo Sapiens
DYETFKNFF

SEQ ID NO: 1205592 - protein, 9 aa, Homo Sapiens
YNCKEAINV

SEQ ID NO: 1205593 - protein, 9 aa, Homo Sapiens
KLLAELFNI

SEQ ID NO: 1205594 - protein, 9 aa, Homo Sapiens
QEQKERQMR

SEQ ID NO: 1205595 - protein, 9 aa, Homo Sapiens
YETFKNFFV

SEQ ID NO: 1205596 - protein, 9 aa, Homo Sapiens
REKIMKLLL

SEQ ID NO: 1205597 - protein, 9 aa, Homo Sapiens
DTSVFENAR

SEQ ID NO: 1205598 - protein, 9 aa, Homo Sapiens
EKIMKLLLP

SEQ ID NO: 1205599 - protein, 9 aa, Homo Sapiens
AAMDFTQTP

SEQ ID NO: 1205600 - protein, 9 aa, Homo Sapiens
RLCARYQHG

SEQ ID NO: 1205601 - protein, 9 aa, Homo Sapiens
YEAGAPMAA

SEQ ID NO: 1205602 - protein, 9 aa, Homo Sapiens
FKNFFVEAS

SEQ ID NO: 1205603 - protein, 9 aa, Homo Sapiens
EQKERQMRL

SEQ ID NO: 1205604 - protein, 9 aa, Homo Sapiens
FPCSKLLAE

SEQ ID NO: 1205605 - protein, 9 aa, Homo Sapiens
RYICCVLML

SEQ ID NO: 1205606 - protein, 9 aa, Homo Sapiens
TFKNFFVEA

SEQ ID NO: 1205607 - protein, 9 aa, Homo Sapiens
MKLLLPESL

SEQ ID NO: 1205608 - protein, 9 aa, Homo Sapiens
EAAYSKLLN

SEQ ID NO: 1205609 - protein, 9 aa, Homo Sapiens
KFSEAAYSK

SEQ ID NO: 1205610 - protein, 9 aa, Homo Sapiens
VEDDDDDDV

SEQ ID NO: 1205611 - protein, 9 aa, Homo Sapiens
VRLCARYQH

SEQ ID NO: 1205612 - protein, 9 aa, Homo Sapiens
GAMIMEETG

SEQ ID NO: 1205613 - protein, 9 aa, Homo Sapiens
QHGECQACD

SEQ ID NO: 1205614 - protein, 9 aa, Homo Sapiens
KEAINVLSH

SEQ ID NO: 1205615 - protein, 9 aa, Homo Sapiens
NARYICCVL

SEQ ID NO: 1205616 - protein, 9 aa, Homo Sapiens
LSLCEKGGA

SEQ ID NO: 1205617 - protein, 9 aa, Homo Sapiens
INVLSHLPS

SEQ ID NO: 1205618 - protein, 9 aa, Homo Sapiens
MTNGLCIWL

SEQ ID NO: 1205619 - protein, 9 aa, Homo Sapiens
AIFPCSKLL

SEQ ID NO: 1205620 - protein, 9 aa, Homo Sapiens
GGAMIMEET

SEQ ID NO: 1205621 - protein, 9 aa, Homo Sapiens
NFFVEASMS

SEQ ID NO: 1205622 - protein, 9 aa, Homo Sapiens
KLLLPESLK

SEQ ID NO: 1205623 - protein, 9 aa, Homo Sapiens
AYSKLLNNN

SEQ ID NO: 1205624 - protein, 9 aa, Homo Sapiens
AAYSKLLNN

SEQ ID NO: 1205625 - protein, 9 aa, Homo Sapiens
KGGAMIMEE

SEQ ID NO: 1205626 - protein, 9 aa, Homo Sapiens
TNGLCIWLL

SEQ ID NO: 1205627 - protein, 9 aa, Homo Sapiens
EIYEAGAPM

SEQ ID NO: 1205628 - protein, 9 aa, Homo Sapiens
FFVEASMSV

SEQ ID NO: 1205629 - protein, 9 aa, Homo Sapiens
SVFENARYI

SEQ ID NO: 1205630 - protein, 9 aa, Homo Sapiens
FENARYICC

SEQ ID NO: 1205631 - protein, 9 aa, Homo Sapiens
IQRLQEQKE

SEQ ID NO: 1205632 - protein, 9 aa, Homo Sapiens
FINHVNAAM

SEQ ID NO: 1205633 - protein, 9 aa, Homo Sapiens
YSKLLNNNL

SEQ ID NO: 1205634 - protein, 9 aa, Homo Sapiens
SLCEKGGAM

SEQ ID NO: 1205635 - protein, 9 aa, Homo Sapiens
RLQEQKERQ

SEQ ID NO: 1205636 - protein, 9 aa, Homo Sapiens
NGLCIWLLI

SEQ ID NO: 1205637 - protein, 9 aa, Homo Sapiens
ARYQHGECQ

SEQ ID NO: 1205638 - protein, 9 aa, Homo Sapiens
DAIFPCSKL

SEQ ID NO: 1205639 - protein, 9 aa, Homo Sapiens
TSVFENARY

SEQ ID NO: 1205640 - protein, 9 aa, Homo Sapiens
ADAIFPCSK

SEQ ID NO: 1205641 - protein, 9 aa, Homo Sapiens
VFENARYIC

SEQ ID NO: 1205642 - protein, 9 aa, Homo Sapiens
LCIWLLILS

SEQ ID NO: 1205643 - protein, 9 aa, Homo Sapiens
PCSKLLAEL

SEQ ID NO: 1205644 - protein, 9 aa, Homo Sapiens
HVNAAMDFT

SEQ ID NO: 1205645 - protein, 9 aa, Homo Sapiens
NCKEAINVL

SEQ ID NO: 1205646 - protein, 9 aa, Homo Sapiens
AIQRLQEQK

SEQ ID NO: 1205647 - protein, 9 aa, Homo Sapiens
IYEAGAPMA

SEQ ID NO: 1205648 - protein, 9 aa, Homo Sapiens
ARYICCVLM

SEQ ID NO: 1205649 - protein, 9 aa, Homo Sapiens
NAAMDFTQT

SEQ ID NO: 1205650 - protein, 9 aa, Homo Sapiens
NHVNAAMDF

SEQ ID NO: 1205651 - protein, 9 aa, Homo Sapiens
RYQHGECQA

SEQ ID NO: 1205652 - protein, 9 aa, Homo Sapiens
SKLLNNNLS

SEQ ID NO: 1205653 - protein, 9 aa, Homo Sapiens
LGFINHVNA

SEQ ID NO: 1205654 - protein, 9 aa, Homo Sapiens
CARYQHGEC

SEQ ID NO: 1205655 - protein, 9 aa, Homo Sapiens
LCARYQHGE

SEQ ID NO: 1205656 - protein, 9 aa, Homo Sapiens
EAGAPMAAA

SEQ ID NO: 1205657 - protein, 9 aa, Homo Sapiens
ENARYICCV

SEQ ID NO: 1205658 - protein, 9 aa, Homo Sapiens
INHVNAAMD

SEQ ID NO: 1205659 - protein, 9 aa, Homo Sapiens
EDDDDDDVV

SEQ ID NO: 1205660 - protein, 9 aa, Homo Sapiens
NVLSHLPSH

SEQ ID NO: 1205661 - protein, 9 aa, Homo Sapiens
IMTNGLCIW

SEQ ID NO: 1205662 - protein, 9 aa, Homo Sapiens
RLRRFPNPC

SEQ ID NO: 1205663 - protein, 9 aa, Homo Sapiens
RTMVRTENR

SEQ ID NO: 1205664 - protein, 9 aa, Homo Sapiens
RFPNPCEDK

SEQ ID NO: 1205665 - protein, 9 aa, Homo Sapiens
GIHLRLRRF

SEQ ID NO: 1205666 - protein, 9 aa, Homo Sapiens
HLRLRRFPN

SEQ ID NO: 1205667 - protein, 9 aa, Homo Sapiens
IHLRLRRFP

SEQ ID NO: 1205668 - protein, 9 aa, Homo Sapiens
LRRFPNPCE

SEQ ID NO: 1205669 - protein, 9 aa, Homo Sapiens
RRFPNPCED

SEQ ID NO: 1205670 - protein, 9 aa, Homo Sapiens
RTENRSEPG

SEQ ID NO: 1205671 - protein, 9 aa, Homo Sapiens
VRTENRSEP

SEQ ID NO: 1205672 - protein, 9 aa, Homo Sapiens
RSEPGASMP

SEQ ID NO: 1205673 - protein, 9 aa, Homo Sapiens
ENRSEPGAS

SEQ ID NO: 1205674 - protein, 9 aa, Homo Sapiens
FPNPCEDKD

SEQ ID NO: 1205675 - protein, 9 aa, Homo Sapiens
TENRSEPGA

SEQ ID NO: 1205676 - protein, 9 aa, Homo Sapiens
LRLRRFPNP

SEQ ID NO: 1205677 - protein, 9 aa, Homo Sapiens
MVRTENRSE

SEQ ID NO: 1205678 - protein, 9 aa, Homo Sapiens
TMVRTENRS

SEQ ID NO: 1205679 - protein, 9 aa, Homo Sapiens
NRSEPGASM

SEQ ID NO: 1205680 - protein, 9 aa, Homo Sapiens
LRKDACSWS

SEQ ID NO: 1205681 - protein, 9 aa, Homo Sapiens
LLLRKDACS

SEQ ID NO: 1205682 - protein, 9 aa, Homo Sapiens
MRHRRAHKT

SEQ ID NO: 1205683 - protein, 9 aa, Homo Sapiens
EDGEDAPRP

SEQ ID NO: 1205684 - protein, 9 aa, Homo Sapiens
NPNKPQKEE

SEQ ID NO: 1205685 - protein, 9 aa, Homo Sapiens
LNVLLKTAM

SEQ ID NO: 1205686 - protein, 9 aa, Homo Sapiens
PLSNLHSLG

SEQ ID NO: 1205687 - protein, 9 aa, Homo Sapiens
LNLLISLYE

SEQ ID NO: 1205688 - protein, 9 aa, Homo Sapiens
CSFPHNFVL

SEQ ID NO: 1205689 - protein, 9 aa, Homo Sapiens
LKTAMFVGG

SEQ ID NO: 1205690 - protein, 9 aa, Homo Sapiens
PHNFVLLVQ

SEQ ID NO: 1205691 - protein, 9 aa, Homo Sapiens
SAAMTLSER

SEQ ID NO: 1205692 - protein, 9 aa, Homo Sapiens
TGRTLGASS

SEQ ID NO: 1205693 - protein, 9 aa, Homo Sapiens
DLLRALDSC

SEQ ID NO: 1205694 - protein, 9 aa, Homo Sapiens
VFLMALSEN

SEQ ID NO: 1205695 - protein, 9 aa, Homo Sapiens
GTGRTLGAS

SEQ ID NO: 1205696 - protein, 9 aa, Homo Sapiens
ETGTGRTLG

SEQ ID NO: 1205697 - protein, 9 aa, Homo Sapiens
GEDAPRPGR

SEQ ID NO: 1205698 - protein, 9 aa, Homo Sapiens
LLISLYENG

SEQ ID NO: 1205699 - protein, 9 aa, Homo Sapiens
PNKPQKEEK

SEQ ID NO: 1205700 - protein, 9 aa, Homo Sapiens
ALDSCPGAG

SEQ ID NO: 1205701 - protein, 9 aa, Homo Sapiens
LQQQQQQIS

SEQ ID NO: 1205702 - protein, 9 aa, Homo Sapiens
CFSEPLSNL

SEQ ID NO: 1205703 - protein, 9 aa, Homo Sapiens
HQGPSCSFP

SEQ ID NO: 1205704 - protein, 9 aa, Homo Sapiens
DSCPGAGSS

SEQ ID NO: 1205705 - protein, 9 aa, Homo Sapiens
GPSCSFPHN

SEQ ID NO: 1205706 - protein, 9 aa, Homo Sapiens
NVLLKTAMF

SEQ ID NO: 1205707 - protein, 9 aa, Homo Sapiens
VLLKTAMFV

SEQ ID NO: 1205708 - protein, 9 aa, Homo Sapiens
LLRALDSCP

SEQ ID NO: 1205709 - protein, 9 aa, Homo Sapiens
LMALSENAV

SEQ ID NO: 1205710 - protein, 9 aa, Homo Sapiens
SERFTSYQK

SEQ ID NO: 1205711 - protein, 9 aa, Homo Sapiens
EDCEDGEDA

SEQ ID NO: 1205712 - protein, 9 aa, Homo Sapiens
SCPGAGSSG

SEQ ID NO: 1205713 - protein, 9 aa, Homo Sapiens
QKEEKFHYH

SEQ ID NO: 1205714 - protein, 9 aa, Homo Sapiens
YALMRHRRA

SEQ ID NO: 1205715 - protein, 9 aa, Homo Sapiens
RGLNLLISL

SEQ ID NO: 1205716 - protein, 9 aa, Homo Sapiens
PEDCEDGED

SEQ ID NO: 1205717 - protein, 9 aa, Homo Sapiens
PSCSFPHNF

SEQ ID NO: 1205718 - protein, 9 aa, Homo Sapiens
RTLGASSPP

SEQ ID NO: 1205719 - protein, 9 aa, Homo Sapiens
HRRAHKTEE

SEQ ID NO: 1205720 - protein, 9 aa, Homo Sapiens
EEKFHYHCM

SEQ ID NO: 1205721 - protein, 9 aa, Homo Sapiens
RKDACSWST

SEQ ID NO: 1205722 - protein, 9 aa, Homo Sapiens
CEDGEDAPR

SEQ ID NO: 1205723 - protein, 9 aa, Homo Sapiens
GALAGDGEA

SEQ ID NO: 1205724 - protein, 9 aa, Homo Sapiens
RHRRAHKTE

SEQ ID NO: 1205725 - protein, 9 aa, Homo Sapiens
EKFHYHCMC

SEQ ID NO: 1205726 - protein, 9 aa, Homo Sapiens
ATRCCFSEP

SEQ ID NO: 1205727 - protein, 9 aa, Homo Sapiens
MTLSERFTS

SEQ ID NO: 1205728 - protein, 9 aa, Homo Sapiens
AMTLSERFT

SEQ ID NO: 1205729 - protein, 9 aa, Homo Sapiens
LLRKDACSW

SEQ ID NO: 1205730 - protein, 9 aa, Homo Sapiens
TRCCFSEPL

SEQ ID NO: 1205731 - protein, 9 aa, Homo Sapiens
NKPQKEEKF

SEQ ID NO: 1205732 - protein, 9 aa, Homo Sapiens
FKSAAMTLS

SEQ ID NO: 1205733 - protein, 9 aa, Homo Sapiens
SERADSIKI

SEQ ID NO: 1205734 - protein, 9 aa, Homo Sapiens
KIYIPEAQT

SEQ ID NO: 1205735 - protein, 9 aa, Homo Sapiens
KTAMFVGGC

SEQ ID NO: 1205736 - protein, 9 aa, Homo Sapiens
DSIKIYIPE

SEQ ID NO: 1205737 - protein, 9 aa, Homo Sapiens
KPQKEEKFH

SEQ ID NO: 1205738 - protein, 9 aa, Homo Sapiens
LLKTAMFVG

SEQ ID NO: 1205739 - protein, 9 aa, Homo Sapiens
AHKTEEPFK

SEQ ID NO: 1205740 - protein, 9 aa, Homo Sapiens
REEQEEEEG

SEQ ID NO: 1205741 - protein, 9 aa, Homo Sapiens
FLMALSENA

SEQ ID NO: 1205742 - protein, 9 aa, Homo Sapiens
LAGDGEAGP

SEQ ID NO: 1205743 - protein, 9 aa, Homo Sapiens
ERADSIKIY

SEQ ID NO: 1205744 - protein, 9 aa, Homo Sapiens
EYEDGGALA

SEQ ID NO: 1205745 - protein, 9 aa, Homo Sapiens
GLNLLISLY

SEQ ID NO: 1205746 - protein, 9 aa, Homo Sapiens
MALSENAVL

SEQ ID NO: 1205747 - protein, 9 aa, Homo Sapiens
KDACSWSTG

SEQ ID NO: 1205748 - protein, 9 aa, Homo Sapiens
EDAPRPGRE

SEQ ID NO: 1205749 - protein, 9 aa, Homo Sapiens
VLNVLLKTA

SEQ ID NO: 1205750 - protein, 9 aa, Homo Sapiens
ADSIKIYIP

SEQ ID NO: 1205751 - protein, 9 aa, Homo Sapiens
TLSERFTSY

SEQ ID NO: 1205752 - protein, 9 aa, Homo Sapiens
GGALAGDGE

SEQ ID NO: 1205753 - protein, 9 aa, Homo Sapiens
WRETGTGRT

SEQ ID NO: 1205754 - protein, 9 aa, Homo Sapiens
FSEPLSNLH

SEQ ID NO: 1205755 - protein, 9 aa, Homo Sapiens
CCFSEPLSN

SEQ ID NO: 1205756 - protein, 9 aa, Homo Sapiens
FPHNFVLLV

SEQ ID NO: 1205757 - protein, 9 aa, Homo Sapiens
LSERFTSYQ

SEQ ID NO: 1205758 - protein, 9 aa, Homo Sapiens
RAHKTEEPF

SEQ ID NO: 1205759 - protein, 9 aa, Homo Sapiens
RRAHKTEEP

SEQ ID NO: 1205760 - protein, 9 aa, Homo Sapiens
RALDSCPGA

SEQ ID NO: 1205761 - protein, 9 aa, Homo Sapiens
IRGLNLLIS

SEQ ID NO: 1205762 - protein, 9 aa, Homo Sapiens
RADSIKIYI

SEQ ID NO: 1205763 - protein, 9 aa, Homo Sapiens
PQKEEKFHY

SEQ ID NO: 1205764 - protein, 9 aa, Homo Sapiens
ASERADSIK

SEQ ID NO: 1205765 - protein, 9 aa, Homo Sapiens
EPLSNLHSL

SEQ ID NO: 1205766 - protein, 9 aa, Homo Sapiens
DGGALAGDG

SEQ ID NO: 1205767 - protein, 9 aa, Homo Sapiens
ALMRHRRAH

SEQ ID NO: 1205768 - protein, 9 aa, Homo Sapiens
KEEKFHYHC

SEQ ID NO: 1205769 - protein, 9 aa, Homo Sapiens
TLGASSPPR

SEQ ID NO: 1205770 - protein, 9 aa, Homo Sapiens
DGEDAPRPG

SEQ ID NO: 1205771 - protein, 9 aa, Homo Sapiens
VVFLMALSE

SEQ ID NO: 1205772 - protein, 9 aa, Homo Sapiens
NLLLRKDAC

SEQ ID NO: 1205773 - protein, 9 aa, Homo Sapiens
QLQQQQQQI

SEQ ID NO: 1205774 - protein, 9 aa, Homo Sapiens
DYQIRGLNL

SEQ ID NO: 1205775 - protein, 9 aa, Homo Sapiens
DACSWSTGM

SEQ ID NO: 1205776 - protein, 9 aa, Homo Sapiens
ALSENAVLI

SEQ ID NO: 1205777 - protein, 9 aa, Homo Sapiens
ALAGDGEAG

SEQ ID NO: 1205778 - protein, 9 aa, Homo Sapiens
RCCFSEPLS

SEQ ID NO: 1205779 - protein, 9 aa, Homo Sapiens
TEYEDGGAL

SEQ ID NO: 1205780 - protein, 9 aa, Homo Sapiens
DCEDGEDAP

SEQ ID NO: 1205781 - protein, 9 aa, Homo Sapiens
QPEDCEDGE

SEQ ID NO: 1205782 - protein, 9 aa, Homo Sapiens
EQEEEEGSW

SEQ ID NO: 1205783 - protein, 9 aa, Homo Sapiens
IKIYIPEAQ

SEQ ID NO: 1205784 - protein, 8 aa, Homo Sapiens
KLSVCLLL

SEQ ID NO: 1205785 - protein, 9 aa, Homo Sapiens
SFPHNFVLL

SEQ ID NO: 1205786 - protein, 9 aa, Homo Sapiens
KSAAMTLSE

SEQ ID NO: 1205787 - protein, 9 aa, Homo Sapiens
SCSFPHNFV

SEQ ID NO: 1205788 - protein, 9 aa, Homo Sapiens
SDLLRALDS

SEQ ID NO: 1205789 - protein, 9 aa, Homo Sapiens
NLLISLYEN

SEQ ID NO: 1205790 - protein, 9 aa, Homo Sapiens
EEQEEEEGS

SEQ ID NO: 1205791 - protein, 9 aa, Homo Sapiens
LRALDSCPG

SEQ ID NO: 1205792 - protein, 9 aa, Homo Sapiens
EDGGALAGD

SEQ ID NO: 1205793 - protein, 9 aa, Homo Sapiens
AAMTLSERF

SEQ ID NO: 1205794 - protein, 9 aa, Homo Sapiens
YEDGGALAG

SEQ ID NO: 1205795 - protein, 9 aa, Homo Sapiens
SENAVLILL

SEQ ID NO: 1205796 - protein, 9 aa, Homo Sapiens
QIRGLNLLI

SEQ ID NO: 1205797 - protein, 9 aa, Homo Sapiens
ENAVLILLI

SEQ ID NO: 1205798 - protein, 9 aa, Homo Sapiens
TGTGRTLGA

SEQ ID NO: 1205799 - protein, 9 aa, Homo Sapiens
YQIRGLNLL

SEQ ID NO: 1205800 - protein, 9 aa, Homo Sapiens
LMRHRRAHK

SEQ ID NO: 1205801 - protein, 9 aa, Homo Sapiens
ACSWSTGMQ

SEQ ID NO: 1205802 - protein, 9 aa, Homo Sapiens
GRTLGASSP

SEQ ID NO: 1205803 - protein, 9 aa, Homo Sapiens
LDSCPGAGS

SEQ ID NO: 1205804 - protein, 9 aa, Homo Sapiens
DQVLNVLLK

SEQ ID NO: 1205805 - protein, 9 aa, Homo Sapiens
SEPLSNLHS

SEQ ID NO: 1205806 - protein, 9 aa, Homo Sapiens
QEEEEGSWR

SEQ ID NO: 1205807 - protein, 9 aa, Homo Sapiens
QGPSCSFPH

SEQ ID NO: 1205808 - protein, 9 aa, Homo Sapiens
RETGTGRTL

SEQ ID NO: 1205809 - protein, 9 aa, Homo Sapiens
LSENAVLIL

SEQ ID NO: 1205810 - protein, 9 aa, Homo Sapiens
SIKIYIPEA

SEQ ID NO: 1205811 - protein, 9 aa, Homo Sapiens
NNLLLRKDA

SEQ ID NO: 1205812 - protein, 9 aa, Homo Sapiens
QVLNVLLKT

SEQ ID NO: 1205813 - protein, 9 aa, Homo Sapiens
APVSPVQSP

SEQ ID NO: 1205814 - protein, 9 aa, Homo Sapiens
SEPAGDVPQ

SEQ ID NO: 1205815 - protein, 9 aa, Homo Sapiens
MSEPAGDVP

SEQ ID NO: 1205816 - protein, 9 aa, Homo Sapiens
DIEREIDAI

SEQ ID NO: 1205817 - protein, 9 aa, Homo Sapiens
GKSHSWKVT

SEQ ID NO: 1205818 - protein, 9 aa, Homo Sapiens
THTHCNPLA

SEQ ID NO: 1205819 - protein, 9 aa, Homo Sapiens
QRGDLDQNT

SEQ ID NO: 1205820 - protein, 9 aa, Homo Sapiens
EREIDAILQ

SEQ ID NO: 1205821 - protein, 9 aa, Homo Sapiens
TYAAVKHSR

SEQ ID NO: 1205822 - protein, 9 aa, Homo Sapiens
PQNPCGSKA

SEQ ID NO: 1205823 - protein, 9 aa, Homo Sapiens
QAVTYAAVK

SEQ ID NO: 1205824 - protein, 9 aa, Homo Sapiens
GSWWQDFSW

SEQ ID NO: 1205825 - protein, 9 aa, Homo Sapiens
VKEGPYGTL

SEQ ID NO: 1205826 - protein, 9 aa, Homo Sapiens
SSESAISST

SEQ ID NO: 1205827 - protein, 9 aa, Homo Sapiens
HQGGSWWQD

SEQ ID NO: 1205828 - protein, 9 aa, Homo Sapiens
GDVPQNPCG

SEQ ID NO: 1205829 - protein, 9 aa, Homo Sapiens
DPQAVTYAA

SEQ ID NO: 1205830 - protein, 9 aa, Homo Sapiens
ALREKLLQV

SEQ ID NO: 1205831 - protein, 9 aa, Homo Sapiens
WEGKSHSWK

SEQ ID NO: 1205832 - protein, 9 aa, Homo Sapiens
EKLLQVEQS

SEQ ID NO: 1205833 - protein, 9 aa, Homo Sapiens
ALQPGEKKS

SEQ ID NO: 1205834 - protein, 9 aa, Homo Sapiens
PRKDSEKRN

SEQ ID NO: 1205835 - protein, 9 aa, Homo Sapiens
LGFQIKKKN

SEQ ID NO: 1205836 - protein, 9 aa, Homo Sapiens
LCVQVIICV

SEQ ID NO: 1205837 - protein, 9 aa, Homo Sapiens
KLLQVEQSL

SEQ ID NO: 1205838 - protein, 9 aa, Homo Sapiens
PAKSAPVSP

SEQ ID NO: 1205839 - protein, 9 aa, Homo Sapiens
PYGTLVYTI

SEQ ID NO: 1205840 - protein, 9 aa, Homo Sapiens
PAGDVPQNP

SEQ ID NO: 1205841 - protein, 9 aa, Homo Sapiens
KTRIGVWVT

SEQ ID NO: 1205842 - protein, 9 aa, Homo Sapiens
EHQGGSWWQ

SEQ ID NO: 1205843 - protein, 9 aa, Homo Sapiens
ISSTVNPVA

SEQ ID NO: 1205844 - protein, 9 aa, Homo Sapiens
YAAVKHSRP

SEQ ID NO: 1205845 - protein, 9 aa, Homo Sapiens
GVWVTKPIL

SEQ ID NO: 1205846 - protein, 9 aa, Homo Sapiens
EGPYGTLVY

SEQ ID NO: 1205847 - protein, 9 aa, Homo Sapiens
SQIPPCCSP

SEQ ID NO: 1205848 - protein, 9 aa, Homo Sapiens
VWVTKPILK

SEQ ID NO: 1205849 - protein, 9 aa, Homo Sapiens
SAPVSPVQS

SEQ ID NO: 1205850 - protein, 9 aa, Homo Sapiens
PQRGDLDQN

SEQ ID NO: 1205851 - protein, 9 aa, Homo Sapiens
CTHTHTHTH

SEQ ID NO: 1205852 - protein, 9 aa, Homo Sapiens
GPYGTLVYT

SEQ ID NO: 1205853 - protein, 9 aa, Homo Sapiens
YGTLVYTIK

SEQ ID NO: 1205854 - protein, 9 aa, Homo Sapiens
KLVKEGPYG

SEQ ID NO: 1205855 - protein, 9 aa, Homo Sapiens
VSPVQSPAK

SEQ ID NO: 1205856 - protein, 9 aa, Homo Sapiens
RGDLDQNTI

SEQ ID NO: 1205857 - protein, 9 aa, Homo Sapiens
QGGSWWQDF

SEQ ID NO: 1205858 - protein, 9 aa, Homo Sapiens
FSWEGKSHS

SEQ ID NO: 1205859 - protein, 9 aa, Homo Sapiens
IEREIDAIL

SEQ ID NO: 1205860 - protein, 9 aa, Homo Sapiens
KSHSWKVTS

SEQ ID NO: 1205861 - protein, 9 aa, Homo Sapiens
GDHPPEQHG

SEQ ID NO: 1205862 - protein, 9 aa, Homo Sapiens
CVQVIICVV

SEQ ID NO: 1205863 - protein, 9 aa, Homo Sapiens
RIGVWVTKP

SEQ ID NO: 1205864 - protein, 9 aa, Homo Sapiens
AAVKHSRPR

SEQ ID NO: 1205865 - protein, 9 aa, Homo Sapiens
VEQSLRNLK

SEQ ID NO: 1205866 - protein, 9 aa, Homo Sapiens
AKSAPVSPV

SEQ ID NO: 1205867 - protein, 9 aa, Homo Sapiens
CKCLCVQVI

SEQ ID NO: 1205868 - protein, 9 aa, Homo Sapiens
THTHTHTHC

SEQ ID NO: 1205869 - protein, 9 aa, Homo Sapiens
FGSYLGVNL

SEQ ID NO: 1205870 - protein, 9 aa, Homo Sapiens
HTHTHCNPL

SEQ ID NO: 1205871 - protein, 9 aa, Homo Sapiens
AEHQGGSWW

SEQ ID NO: 1205872 - protein, 9 aa, Homo Sapiens
KFGSYLGVN

SEQ ID NO: 1205873 - protein, 9 aa, Homo Sapiens
ASSSSSEGE

SEQ ID NO: 1205874 - protein, 9 aa, Homo Sapiens
ESAISSTVN

SEQ ID NO: 1205875 - protein, 9 aa, Homo Sapiens
EIDAILQNA

SEQ ID NO: 1205876 - protein, 9 aa, Homo Sapiens
QVEQSLRNL

SEQ ID NO: 1205877 - protein, 9 aa, Homo Sapiens
AVTYAAVKH

SEQ ID NO: 1205878 - protein, 9 aa, Homo Sapiens
KEGPYGTLV

SEQ ID NO: 1205879 - protein, 9 aa, Homo Sapiens
AHMVLNKKF

SEQ ID NO: 1205880 - protein, 9 aa, Homo Sapiens
LQVEQSLRN

SEQ ID NO: 1205881 - protein, 9 aa, Homo Sapiens
HSWKVTSLG

SEQ ID NO: 1205882 - protein, 9 aa, Homo Sapiens
LEDIEREID

SEQ ID NO: 1205883 - protein, 9 aa, Homo Sapiens
QDFSWEGKS

SEQ ID NO: 1205884 - protein, 9 aa, Homo Sapiens
NKQSSESAI

SEQ ID NO: 1205885 - protein, 9 aa, Homo Sapiens
KQSSESAIS

SEQ ID NO: 1205886 - protein, 9 aa, Homo Sapiens
PVSPVQSPA

SEQ ID NO: 1205887 - protein, 9 aa, Homo Sapiens
LPQRGDLDQ

SEQ ID NO: 1205888 - protein, 9 aa, Homo Sapiens
KSAPVSPVQ

SEQ ID NO: 1205889 - protein, 9 aa, Homo Sapiens
DKTRIGVWV

SEQ ID NO: 1205890 - protein, 9 aa, Homo Sapiens
PGEKKSQAS

SEQ ID NO: 1205891 - protein, 9 aa, Homo Sapiens
QSSESAISS

SEQ ID NO: 1205892 - protein, 9 aa, Homo Sapiens
WVTKPILKG

SEQ ID NO: 1205893 - protein, 9 aa, Homo Sapiens
IGVWVTKPI

SEQ ID NO: 1205894 - protein, 9 aa, Homo Sapiens
KFFGLPQRG

SEQ ID NO: 1205895 - protein, 9 aa, Homo Sapiens
SAISSTVNP

SEQ ID NO: 1205896 - protein, 9 aa, Homo Sapiens
DSEKRNSLP

SEQ ID NO: 1205897 - protein, 9 aa, Homo Sapiens
CCSPACTPP

SEQ ID NO: 1205898 - protein, 9 aa, Homo Sapiens
IDAILQNAG

SEQ ID NO: 1205899 - protein, 9 aa, Homo Sapiens
IICVVTLPT

SEQ ID NO: 1205900 - protein, 9 aa, Homo Sapiens
CLCVQVIIC

SEQ ID NO: 1205901 - protein, 9 aa, Homo Sapiens
GLPQRGDLD

SEQ ID NO: 1205902 - protein, 9 aa, Homo Sapiens
DVPQNPCGS

SEQ ID NO: 1205903 - protein, 9 aa, Homo Sapiens
IHPRKDSEK

SEQ ID NO: 1205904 - protein, 9 aa, Homo Sapiens
KCLCVQVII

SEQ ID NO: 1205905 - protein, 9 aa, Homo Sapiens
SPQCRRLAE

SEQ ID NO: 1205906 - protein, 9 aa, Homo Sapiens
EPAGDVPQN

SEQ ID NO: 1205907 - protein, 9 aa, Homo Sapiens
PLASPQCRR

SEQ ID NO: 1205908 - protein, 9 aa, Homo Sapiens
HTHTHTHCN

SEQ ID NO: 1205909 - protein, 9 aa, Homo Sapiens
QPGEKKSQA

SEQ ID NO: 1205910 - protein, 9 aa, Homo Sapiens
QCRRLAEHQ

SEQ ID NO: 1205911 - protein, 9 aa, Homo Sapiens
SHSWKVTSL

SEQ ID NO: 1205912 - protein, 9 aa, Homo Sapiens
AISSTVNPV

SEQ ID NO: 1205913 - protein, 9 aa, Homo Sapiens
SESAISSTV

SEQ ID NO: 1205914 - protein, 9 aa, Homo Sapiens
PQAVTYAAV

SEQ ID NO: 1205915 - protein, 9 aa, Homo Sapiens
LLQVEQSLR

SEQ ID NO: 1205916 - protein, 9 aa, Homo Sapiens
SWEGKSHSW

SEQ ID NO: 1205917 - protein, 9 aa, Homo Sapiens
QKFFGLPQR

SEQ ID NO: 1205918 - protein, 9 aa, Homo Sapiens
QIPPCCSPA

SEQ ID NO: 1205919 - protein, 9 aa, Homo Sapiens
GGSWWQDFS

SEQ ID NO: 1205920 - protein, 9 aa, Homo Sapiens
CNPLASPQC

SEQ ID NO: 1205921 - protein, 9 aa, Homo Sapiens
CSPACTPPP

SEQ ID NO: 1205922 - protein, 9 aa, Homo Sapiens
AGDVPQNPC

SEQ ID NO: 1205923 - protein, 9 aa, Homo Sapiens
KKLVKEGPY

SEQ ID NO: 1205924 - protein, 9 aa, Homo Sapiens
CRRLAEHQG

SEQ ID NO: 1205925 - protein, 9 aa, Homo Sapiens
VGDHPPEQH

SEQ ID NO: 1205926 - protein, 9 aa, Homo Sapiens
SEKRNSLPQ

SEQ ID NO: 1205927 - protein, 9 aa, Homo Sapiens
VQVIICVVT

SEQ ID NO: 1205928 - protein, 9 aa, Homo Sapiens
PCCSPACTP

SEQ ID NO: 1205929 - protein, 9 aa, Homo Sapiens
SWKVTSLGT

SEQ ID NO: 1205930 - protein, 9 aa, Homo Sapiens
VIICVVTLP

SEQ ID NO: 1205931 - protein, 9 aa, Homo Sapiens
DFSWEGKSH

SEQ ID NO: 1205932 - protein, 9 aa, Homo Sapiens
VPQNPCGSK

SEQ ID NO: 1205933 - protein, 9 aa, Homo Sapiens
IIHPRKDSE

SEQ ID NO: 1205934 - protein, 9 aa, Homo Sapiens
ASPQCRRLA

SEQ ID NO: 1205935 - protein, 9 aa, Homo Sapiens
REIDAILQN

SEQ ID NO: 1205936 - protein, 9 aa, Homo Sapiens
SPAKSAPVS

SEQ ID NO: 1205937 - protein, 9 aa, Homo Sapiens
VTKPILKGK

SEQ ID NO: 1205938 - protein, 9 aa, Homo Sapiens
QVIICVVTL

SEQ ID NO: 1205939 - protein, 9 aa, Homo Sapiens
LQPGEKKSQ

SEQ ID NO: 1205940 - protein, 9 aa, Homo Sapiens
EGKSHSWKV

SEQ ID NO: 1205941 - protein, 9 aa, Homo Sapiens
IPPCCSPAC

SEQ ID NO: 1205942 - protein, 9 aa, Homo Sapiens
REKLLQVEQ

SEQ ID NO: 1205943 - protein, 9 aa, Homo Sapiens
VLNKKFGSY

SEQ ID NO: 1205944 - protein, 9 aa, Homo Sapiens
LAEHQGGSW

SEQ ID NO: 1205945 - protein, 9 aa, Homo Sapiens
RKDSEKRNS

SEQ ID NO: 1205946 - protein, 9 aa, Homo Sapiens
LREKLLQVE

SEQ ID NO: 1205947 - protein, 9 aa, Homo Sapiens
AVKHSRPRR

SEQ ID NO: 1205948 - protein, 9 aa, Homo Sapiens
RLAEHQGGS

SEQ ID NO: 1205949 - protein, 9 aa, Homo Sapiens
HTHCNPLAS

SEQ ID NO: 1205950 - protein, 9 aa, Homo Sapiens
HCNPLASPQ

SEQ ID NO: 1205951 - protein, 9 aa, Homo Sapiens
HMVLNKKFG

SEQ ID NO: 1205952 - protein, 9 aa, Homo Sapiens
LIIHPRKDS

SEQ ID NO: 1205953 - protein, 9 aa, Homo Sapiens
LNKKFGSYL

SEQ ID NO: 1205954 - protein, 9 aa, Homo Sapiens
NPLASPQCR

SEQ ID NO: 1205955 - protein, 9 aa, Homo Sapiens
NKKFGSYLG

SEQ ID NO: 1205956 - protein, 9 aa, Homo Sapiens
LVKEGPYGT

SEQ ID NO: 1205957 - protein, 9 aa, Homo Sapiens
WWQDFSWEG

SEQ ID NO: 1205958 - protein, 9 aa, Homo Sapiens
KDSEKRNSL

SEQ ID NO: 1205959 - protein, 9 aa, Homo Sapiens
FGLPQRGDL

SEQ ID NO: 1205960 - protein, 9 aa, Homo Sapiens
GSPAKSAPV

SEQ ID NO: 1205961 - protein, 9 aa, Homo Sapiens
MVLNKKFGS

SEQ ID NO: 1205962 - protein, 9 aa, Homo Sapiens
KKFGSYLGV

SEQ ID NO: 1205963 - protein, 9 aa, Homo Sapiens
SWWQDFSWE

SEQ ID NO: 1205964 - protein, 9 aa, Homo Sapiens
PQCRRLAEH

SEQ ID NO: 1205965 - protein, 9 aa, Homo Sapiens
VTYAAVKHS

SEQ ID NO: 1205966 - protein, 9 aa, Homo Sapiens
WQDFSWEGK

SEQ ID NO: 1205967 - protein, 9 aa, Homo Sapiens
PASSSSSEG

SEQ ID NO: 1205968 - protein, 9 aa, Homo Sapiens
RRLAEHQGG

SEQ ID NO: 1205969 - protein, 9 aa, Homo Sapiens
THTHTHCNP

SEQ ID NO: 1205970 - protein, 9 aa, Homo Sapiens
THCNPLASP

SEQ ID NO: 1205971 - protein, 9 aa, Homo Sapiens
PPSQIPPCC

SEQ ID NO: 1205972 - protein, 9 aa, Homo Sapiens
EDIEREIDA

SEQ ID NO: 1205973 - protein, 9 aa, Homo Sapiens
DAILQNAGT

SEQ ID NO: 1205974 - protein, 9 aa, Homo Sapiens
LASPQCRRL

SEQ ID NO: 1205975 - protein, 9 aa, Homo Sapiens
PPCCSPACT

SEQ ID NO: 1205976 - protein, 9 aa, Homo Sapiens
GPASSSSSE

SEQ ID NO: 1205977 - protein, 9 aa, Homo Sapiens
TRIGVWVTK

SEQ ID NO: 1205978 - protein, 9 aa, Homo Sapiens
FFGLPQRGD

SEQ ID NO: 1205979 - protein, 9 aa, Homo Sapiens
PSQIPPCCS

SEQ ID NO: 1205980 - protein, 9 aa, Homo Sapiens
HPRKDSEKR

SEQ ID NO: 1205981 - protein, 9 aa, Homo Sapiens
CGCGYGCAS

SEQ ID NO: 1205982 - protein, 9 aa, Homo Sapiens
TVVGEEEED

SEQ ID NO: 1205983 - protein, 9 aa, Homo Sapiens
FLFCAAQNH

SEQ ID NO: 1205984 - protein, 9 aa, Homo Sapiens
TDITVSEIF

SEQ ID NO: 1205985 - protein, 9 aa, Homo Sapiens
TWFLFCAAQ

SEQ ID NO: 1205986 - protein, 9 aa, Homo Sapiens
SFPLALSGD

SEQ ID NO: 1205987 - protein, 9 aa, Homo Sapiens
LMVLSFPLA

SEQ ID NO: 1205988 - protein, 9 aa, Homo Sapiens
FPLALSGDT

SEQ ID NO: 1205989 - protein, 9 aa, Homo Sapiens
GTTDITVSE

SEQ ID NO: 1205990 - protein, 9 aa, Homo Sapiens
GTQEEIKKE

SEQ ID NO: 1205991 - protein, 9 aa, Homo Sapiens
RKMAVESRG

SEQ ID NO: 1205992 - protein, 9 aa, Homo Sapiens
RGTQEEIKK

SEQ ID NO: 1205993 - protein, 9 aa, Homo Sapiens
VESRGTQEE

SEQ ID NO: 1205994 - protein, 9 aa, Homo Sapiens
VGEEEEDDD

SEQ ID NO: 1205995 - protein, 9 aa, Homo Sapiens
KMAVESRGT

SEQ ID NO: 1205996 - protein, 9 aa, Homo Sapiens
AVESRGTQE

SEQ ID NO: 1205997 - protein, 9 aa, Homo Sapiens
TVSEIFVSQ

SEQ ID NO: 1205998 - protein, 9 aa, Homo Sapiens
VLSFPLALS

SEQ ID NO: 1205999 - protein, 9 aa, Homo Sapiens
EQLKIDEPE

SEQ ID NO: 1206000 - protein, 9 aa, Homo Sapiens
SGYDVVGPQ

SEQ ID NO: 1206001 - protein, 9 aa, Homo Sapiens
STTWFLFCA

SEQ ID NO: 1206002 - protein, 9 aa, Homo Sapiens
MAVESRGTQ

SEQ ID NO: 1206003 - protein, 9 aa, Homo Sapiens
TLMVLSFPL

SEQ ID NO: 1206004 - protein, 9 aa, Homo Sapiens
FCGCGYGCA

SEQ ID NO: 1206005 - protein, 9 aa, Homo Sapiens
GYDVVGPQS

SEQ ID NO: 1206006 - protein, 9 aa, Homo Sapiens
DSGYDVVGP

SEQ ID NO: 1206007 - protein, 9 aa, Homo Sapiens
CGYGCASGY

SEQ ID NO: 1206008 - protein, 9 aa, Homo Sapiens
WFGLIVPLS

SEQ ID NO: 1206009 - protein, 9 aa, Homo Sapiens
MVLSFPLAL

SEQ ID NO: 1206010 - protein, 9 aa, Homo Sapiens
LFCAAQNHH

SEQ ID NO: 1206011 - protein, 9 aa, Homo Sapiens
DITVSEIFV

SEQ ID NO: 1206012 - protein, 9 aa, Homo Sapiens
GCGYGCASG

SEQ ID NO: 1206013 - protein, 9 aa, Homo Sapiens
KIDEPESLN

SEQ ID NO: 1206014 - protein, 9 aa, Homo Sapiens
CDSGYDVVG

SEQ ID NO: 1206015 - protein, 9 aa, Homo Sapiens
CWFGLIVPL

SEQ ID NO: 1206016 - protein, 9 aa, Homo Sapiens
GEEEEDDDD

SEQ ID NO: 1206017 - protein, 9 aa, Homo Sapiens
FGLIVPLSM

SEQ ID NO: 1206018 - protein, 9 aa, Homo Sapiens
ITVSEIFVS

SEQ ID NO: 1206019 - protein, 9 aa, Homo Sapiens
TVTLMVLSF

SEQ ID NO: 1206020 - protein, 9 aa, Homo Sapiens
TIQCDSGYD

SEQ ID NO: 1206021 - protein, 9 aa, Homo Sapiens
VRCWFGLIV

SEQ ID NO: 1206022 - protein, 9 aa, Homo Sapiens
ESRGTQEEI

SEQ ID NO: 1206023 - protein, 9 aa, Homo Sapiens
VTLMVLSFP

SEQ ID NO: 1206024 - protein, 9 aa, Homo Sapiens
YGCASGYYY

SEQ ID NO: 1206025 - protein, 9 aa, Homo Sapiens
YDVVGPQSI

SEQ ID NO: 1206026 - protein, 9 aa, Homo Sapiens
VVGEEEEDD

SEQ ID NO: 1206027 - protein, 9 aa, Homo Sapiens
EEQLKIDEP

SEQ ID NO: 1206028 - protein, 9 aa, Homo Sapiens
WFLFCAAQN

SEQ ID NO: 1206029 - protein, 9 aa, Homo Sapiens
QLKIDEPES

SEQ ID NO: 1206030 - protein, 9 aa, Homo Sapiens
PESLNDEEL

SEQ ID NO: 1206031 - protein, 9 aa, Homo Sapiens
KGTTDITVS

SEQ ID NO: 1206032 - protein, 9 aa, Homo Sapiens
DVVGPQSIT

SEQ ID NO: 1206033 - protein, 9 aa, Homo Sapiens
RKGTTDITV

SEQ ID NO: 1206034 - protein, 9 aa, Homo Sapiens
RCWFGLIVP

SEQ ID NO: 1206035 - protein, 9 aa, Homo Sapiens
LSFPLALSG

SEQ ID NO: 1206036 - protein, 9 aa, Homo Sapiens
IQCDSGYDV

SEQ ID NO: 1206037 - protein, 9 aa, Homo Sapiens
PRKGTTDIT

SEQ ID NO: 1206038 - protein, 9 aa, Homo Sapiens
CAAQNHHLV

SEQ ID NO: 1206039 - protein, 9 aa, Homo Sapiens
LKIDEPESL

SEQ ID NO: 1206040 - protein, 9 aa, Homo Sapiens
TTDITVSEI

SEQ ID NO: 1206041 - protein, 9 aa, Homo Sapiens
QCDSGYDVV

SEQ ID NO: 1206042 - protein, 9 aa, Homo Sapiens
FCAAQNHHL

SEQ ID NO: 1206043 - protein, 9 aa, Homo Sapiens
EPESLNDEE

SEQ ID NO: 1206044 - protein, 9 aa, Homo Sapiens
DEPESLNDE

SEQ ID NO: 1206045 - protein, 9 aa, Homo Sapiens
TTWFLFCAA

SEQ ID NO: 1206046 - protein, 9 aa, Homo Sapiens
IDEPESLND

SEQ ID NO: 1206047 - protein, 9 aa, Homo Sapiens
FSTTWFLFC

SEQ ID NO: 1206048 - protein, 9 aa, Homo Sapiens
SRGTQEEIK

SEQ ID NO: 1206049 - protein, 9 aa, Homo Sapiens
GYGCASGYY

SEQ ID NO: 1206050 - protein, 9 aa, Homo Sapiens
QLAVHQRLE

SEQ ID NO: 1206051 - protein, 9 aa, Homo Sapiens
TYTVAVKLV

SEQ ID NO: 1206052 - protein, 9 aa, Homo Sapiens
AVHQRLEWR

SEQ ID NO: 1206053 - protein, 9 aa, Homo Sapiens
TMDVMFFPF

SEQ ID NO: 1206054 - protein, 9 aa, Homo Sapiens
CTMDVMFFP

SEQ ID NO: 1206055 - protein, 9 aa, Homo Sapiens
MFFPFDRQN

SEQ ID NO: 1206056 - protein, 9 aa, Homo Sapiens
VAVKLVILP

SEQ ID NO: 1206057 - protein, 9 aa, Homo Sapiens
TDPSLYCIV

SEQ ID NO: 1206058 - protein, 9 aa, Homo Sapiens
VVETDPSLY

SEQ ID NO: 1206059 - protein, 9 aa, Homo Sapiens
AVKLVILPS

SEQ ID NO: 1206060 - protein, 9 aa, Homo Sapiens
LVILPSVPP

SEQ ID NO: 1206061 - protein, 9 aa, Homo Sapiens
PSLYCIVAP

SEQ ID NO: 1206062 - protein, 9 aa, Homo Sapiens
VHQRLEWRP

SEQ ID NO: 1206063 - protein, 9 aa, Homo Sapiens
ETDPSLYCI

SEQ ID NO: 1206064 - protein, 9 aa, Homo Sapiens
SCTMDVMFF

SEQ ID NO: 1206065 - protein, 9 aa, Homo Sapiens
VMFFPFDRQ

SEQ ID NO: 1206066 - protein, 9 aa, Homo Sapiens
VKLVILPSV

SEQ ID NO: 1206067 - protein, 9 aa, Homo Sapiens
KSSCTMDVM

SEQ ID NO: 1206068 - protein, 9 aa, Homo Sapiens
DVMFFPFDR

SEQ ID NO: 1206069 - protein, 9 aa, Homo Sapiens
SLYCIVAPD

SEQ ID NO: 1206070 - protein, 9 aa, Homo Sapiens
KVVETDPSL

SEQ ID NO: 1206071 - protein, 9 aa, Homo Sapiens
NTYTVAVKL

SEQ ID NO: 1206072 - protein, 9 aa, Homo Sapiens
KLVILPSVP

SEQ ID NO: 1206073 - protein, 9 aa, Homo Sapiens
YTVAVKLVI

SEQ ID NO: 1206074 - protein, 9 aa, Homo Sapiens
SSCTMDVMF

SEQ ID NO: 1206075 - protein, 9 aa, Homo Sapiens
LYCIVAPDT

SEQ ID NO: 1206076 - protein, 9 aa, Homo Sapiens
DPSLYCIVA

SEQ ID NO: 1206077 - protein, 9 aa, Homo Sapiens
LAVHQRLEW

SEQ ID NO: 1206078 - protein, 9 aa, Homo Sapiens
VETDPSLYC

SEQ ID NO: 1206079 - protein, 9 aa, Homo Sapiens
MDVMFFPFD

SEQ ID NO: 1206080 - protein, 9 aa, Homo Sapiens
TVAVKLVIL

SEQ ID NO: 1206081 - protein, 9 aa, Homo Sapiens
GDFGLATEK

SEQ ID NO: 1206082 - protein, 9 aa, Homo Sapiens
IGDFGLATE

SEQ ID NO: 1206083 - protein, 9 aa, Homo Sapiens
RPSPERDAI

SEQ ID NO: 1206084 - protein, 9 aa, Homo Sapiens
KLSLPESLK

SEQ ID NO: 1206085 - protein, 9 aa, Homo Sapiens
KESPHTGEF

SEQ ID NO: 1206086 - protein, 9 aa, Homo Sapiens
PERDAIIQL

SEQ ID NO: 1206087 - protein, 9 aa, Homo Sapiens
QSSGYGQQG

SEQ ID NO: 1206088 - protein, 9 aa, Homo Sapiens
SQSSGYGQQ

SEQ ID NO: 1206089 - protein, 9 aa, Homo Sapiens
AIIQLSEIV

SEQ ID NO: 1206090 - protein, 9 aa, Homo Sapiens
ERDAIIQLS

SEQ ID NO: 1206091 - protein, 9 aa, Homo Sapiens
IMKLSLPES

SEQ ID NO: 1206092 - protein, 9 aa, Homo Sapiens
MKLSLPESL

SEQ ID NO: 1206093 - protein, 9 aa, Homo Sapiens
SPSQSPNSD

SEQ ID NO: 1206094 - protein, 9 aa, Homo Sapiens
SLPESLKAY

SEQ ID NO: 1206095 - protein, 9 aa, Homo Sapiens
LSLPESLKA

SEQ ID NO: 1206096 - protein, 9 aa, Homo Sapiens
LLPLGIILF

SEQ ID NO: 1206097 - protein, 9 aa, Homo Sapiens
TGEFKGAAL

SEQ ID NO: 1206098 - protein, 9 aa, Homo Sapiens
NPPPPPPVI

SEQ ID NO: 1206099 - protein, 9 aa, Homo Sapiens
TEKSRWSGS

SEQ ID NO: 1206100 - protein, 9 aa, Homo Sapiens
RDAIIQLSE

SEQ ID NO: 1206101 - protein, 9 aa, Homo Sapiens
GYGQQGSGS

SEQ ID NO: 1206102 - protein, 9 aa, Homo Sapiens
EKSRWSGSH

SEQ ID NO: 1206103 - protein, 9 aa, Homo Sapiens
QSPNSDHGS

SEQ ID NO: 1206104 - protein, 9 aa, Homo Sapiens
DFGLATEKS

SEQ ID NO: 1206105 - protein, 9 aa, Homo Sapiens
IIQLSEIVL

SEQ ID NO: 1206106 - protein, 9 aa, Homo Sapiens
PSPERDAII

SEQ ID NO: 1206107 - protein, 9 aa, Homo Sapiens
EAMFLLEFL

SEQ ID NO: 1206108 - protein, 9 aa, Homo Sapiens
GLDAPLFGV

SEQ ID NO: 1206109 - protein, 9 aa, Homo Sapiens
SQSPNSDHG

SEQ ID NO: 1206110 - protein, 9 aa, Homo Sapiens
ESPHTGEFK

SEQ ID NO: 1206111 - protein, 9 aa, Homo Sapiens
SPERDAIIQ

SEQ ID NO: 1206112 - protein, 9 aa, Homo Sapiens
SSGYGQQGS

SEQ ID NO: 1206113 - protein, 9 aa, Homo Sapiens
SDHGSRRGS

SEQ ID NO: 1206114 - protein, 9 aa, Homo Sapiens
PAKESPHTG

SEQ ID NO: 1206115 - protein, 9 aa, Homo Sapiens
NSDHGSRRG

SEQ ID NO: 1206116 - protein, 9 aa, Homo Sapiens
LLEFLLPLG

SEQ ID NO: 1206117 - protein, 9 aa, Homo Sapiens
DAIIQLSEI

SEQ ID NO: 1206118 - protein, 9 aa, Homo Sapiens
REKIMKLSL

SEQ ID NO: 1206119 - protein, 9 aa, Homo Sapiens
DHGSRRGSI

SEQ ID NO: 1206120 - protein, 9 aa, Homo Sapiens
MFLLEFLLP

SEQ ID NO: 1206121 - protein, 9 aa, Homo Sapiens
ATEKSRWSG

SEQ ID NO: 1206122 - protein, 9 aa, Homo Sapiens
PNSDHGSRR

SEQ ID NO: 1206123 - protein, 9 aa, Homo Sapiens
SGYGQQGSG

SEQ ID NO: 1206124 - protein, 9 aa, Homo Sapiens
FLLPLGIIL

SEQ ID NO: 1206125 - protein, 9 aa, Homo Sapiens
AKESPHTGE

SEQ ID NO: 1206126 - protein, 9 aa, Homo Sapiens
EFLLPLGII

SEQ ID NO: 1206127 - protein, 9 aa, Homo Sapiens
GLATEKSRW

SEQ ID NO: 1206128 - protein, 9 aa, Homo Sapiens
GEFKGAALV

SEQ ID NO: 1206129 - protein, 9 aa, Homo Sapiens
SPHTGEFKG

SEQ ID NO: 1206130 - protein, 9 aa, Homo Sapiens
LREKIMKLS

SEQ ID NO: 1206131 - protein, 9 aa, Homo Sapiens
AMFLLEFLL

SEQ ID NO: 1206132 - protein, 9 aa, Homo Sapiens
KIMKLSLPE

SEQ ID NO: 1206133 - protein, 9 aa, Homo Sapiens
PSQSPNSDH

SEQ ID NO: 1206134 - protein, 9 aa, Homo Sapiens
FGLATEKSR

SEQ ID NO: 1206135 - protein, 9 aa, Homo Sapiens
HTGEFKGAA

SEQ ID NO: 1206136 - protein, 9 aa, Homo Sapiens
LATEKSRWS

SEQ ID NO: 1206137 - protein, 9 aa, Homo Sapiens
SPNSDHGSR

SEQ ID NO: 1206138 - protein, 9 aa, Homo Sapiens
ENPPPPPPV

SEQ ID NO: 1206139 - protein, 9 aa, Homo Sapiens
ESEEEEEER

SEQ ID NO: 1206140 - protein, 9 aa, Homo Sapiens
PHTGEFKGA

SEQ ID NO: 1206141 - protein, 9 aa, Homo Sapiens
EKIMKLSLP

SEQ ID NO: 1206142 - protein, 9 aa, Homo Sapiens
SEEEEEERV

SEQ ID NO: 1206143 - protein, 9 aa, Homo Sapiens
LEFLLPLGI

SEQ ID NO: 1206144 - protein, 9 aa, Homo Sapiens
FLLEFLLPL

SEQ ID NO: 1206145 - protein, 9 aa, Homo Sapiens
SCRQTGDFT

SEQ ID NO: 1206146 - protein, 9 aa, Homo Sapiens
CVNGGSCRQ

SEQ ID NO: 1206147 - protein, 9 aa, Homo Sapiens
PCVNGGSCR

SEQ ID NO: 1206148 - protein, 9 aa, Homo Sapiens
PSPCVNGGS

SEQ ID NO: 1206149 - protein, 9 aa, Homo Sapiens
GGSCRQTGD

SEQ ID NO: 1206150 - protein, 9 aa, Homo Sapiens
VNGGSCRQT

SEQ ID NO: 1206151 - protein, 9 aa, Homo Sapiens
SPCVNGGSC

SEQ ID NO: 1206152 - protein, 9 aa, Homo Sapiens
GSCRQTGDF

SEQ ID NO: 1206153 - protein, 9 aa, Homo Sapiens
NGGSCRQTG

SEQ ID NO: 1206154 - protein, 9 aa, Homo Sapiens
CRKSEVRAK

SEQ ID NO: 1206155 - protein, 9 aa, Homo Sapiens
NFFRLENKH

SEQ ID NO: 1206156 - protein, 9 aa, Homo Sapiens
EYVSLGTLK

SEQ ID NO: 1206157 - protein, 9 aa, Homo Sapiens
GLASFLEGD

SEQ ID NO: 1206158 - protein, 9 aa, Homo Sapiens
KLHGMIRSE

SEQ ID NO: 1206159 - protein, 9 aa, Homo Sapiens
AKLHGMIRS

SEQ ID NO: 1206160 - protein, 9 aa, Homo Sapiens
RVSLRLEGL

SEQ ID NO: 1206161 - protein, 9 aa, Homo Sapiens
TQLELKRRS

SEQ ID NO: 1206162 - protein, 9 aa, Homo Sapiens
VLSFPLALS

SEQ ID NO: 1206163 - protein, 9 aa, Homo Sapiens
LTQLELKRR

SEQ ID NO: 1206164 - protein, 9 aa, Homo Sapiens
FRLENKHLN

SEQ ID NO: 1206165 - protein, 9 aa, Homo Sapiens
TTPMLSCLH

SEQ ID NO: 1206166 - protein, 9 aa, Homo Sapiens
PESARKKEE

SEQ ID NO: 1206167 - protein, 9 aa, Homo Sapiens
GDKKIWPSH

SEQ ID NO: 1206168 - protein, 9 aa, Homo Sapiens
SPPSVEEAS

SEQ ID NO: 1206169 - protein, 9 aa, Homo Sapiens
ETLFQRLQC

SEQ ID NO: 1206170 - protein, 9 aa, Homo Sapiens
FSRVSLRLE

SEQ ID NO: 1206171 - protein, 9 aa, Homo Sapiens
SRSKSRSQF

SEQ ID NO: 1206172 - protein, 9 aa, Homo Sapiens
MVLSFPLAL

SEQ ID NO: 1206173 - protein, 9 aa, Homo Sapiens
RLENKHLNN

SEQ ID NO: 1206174 - protein, 9 aa, Homo Sapiens
CMDTSGLPE

SEQ ID NO: 1206175 - protein, 9 aa, Homo Sapiens
TVTLMVLSF

SEQ ID NO: 1206176 - protein, 9 aa, Homo Sapiens
GGSLVSVLL

SEQ ID NO: 1206177 - protein, 9 aa, Homo Sapiens
VTLMVLSFP

SEQ ID NO: 1206178 - protein, 9 aa, Homo Sapiens
YPNEFLQEY

SEQ ID NO: 1206179 - protein, 9 aa, Homo Sapiens
QRLQCMDTS

SEQ ID NO: 1206180 - protein, 9 aa, Homo Sapiens
EASSSSSLV

SEQ ID NO: 1206181 - protein, 9 aa, Homo Sapiens
EEASSSSSL

SEQ ID NO: 1206182 - protein, 9 aa, Homo Sapiens
SQFSSRSRS

SEQ ID NO: 1206183 - protein, 9 aa, Homo Sapiens
SLRLEGLKK

SEQ ID NO: 1206184 - protein, 9 aa, Homo Sapiens
TLFQRLQCM

SEQ ID NO: 1206185 - protein, 9 aa, Homo Sapiens
VLPESPESA

SEQ ID NO: 1206186 - protein, 9 aa, Homo Sapiens
TFGILDSQF

SEQ ID NO: 1206187 - protein, 9 aa, Homo Sapiens
SPESARKKE

SEQ ID NO: 1206188 - protein, 9 aa, Homo Sapiens
TPMLSCLHI

SEQ ID NO: 1206189 - protein, 9 aa, Homo Sapiens
AVDFTQEGW

SEQ ID NO: 1206190 - protein, 9 aa, Homo Sapiens
LVSVLLPAA

SEQ ID NO: 1206191 - protein, 9 aa, Homo Sapiens
RSQFSSRSR

SEQ ID NO: 1206192 - protein, 9 aa, Homo Sapiens
VSCRKSEVR

SEQ ID NO: 1206193 - protein, 9 aa, Homo Sapiens
FPLALSGDT

SEQ ID NO: 1206194 - protein, 9 aa, Homo Sapiens
TLKMHIRTH

SEQ ID NO: 1206195 - protein, 9 aa, Homo Sapiens
KKIWPSHSL

SEQ ID NO: 1206196 - protein, 9 aa, Homo Sapiens
RRSLDTESL

SEQ ID NO: 1206197 - protein, 9 aa, Homo Sapiens
GILDSQFSF

SEQ ID NO: 1206198 - protein, 9 aa, Homo Sapiens
VSLRLEGLK

SEQ ID NO: 1206199 - protein, 9 aa, Homo Sapiens
RKSEVRAKF

SEQ ID NO: 1206200 - protein, 9 aa, Homo Sapiens
GWQQLDPSQ

SEQ ID NO: 1206201 - protein, 9 aa, Homo Sapiens
ESARKKEEA

SEQ ID NO: 1206202 - protein, 9 aa, Homo Sapiens
DFHYPNEFL

SEQ ID NO: 1206203 - protein, 9 aa, Homo Sapiens
TLMVLSFPL

SEQ ID NO: 1206204 - protein, 9 aa, Homo Sapiens
RLQCMDTSG

SEQ ID NO: 1206205 - protein, 9 aa, Homo Sapiens
GTLKMHIRT

SEQ ID NO: 1206206 - protein, 9 aa, Homo Sapiens
RSLDTESLQ

SEQ ID NO: 1206207 - protein, 9 aa, Homo Sapiens
EGLKKSFYG

SEQ ID NO: 1206208 - protein, 9 aa, Homo Sapiens
EGWQQLDPS

SEQ ID NO: 1206209 - protein, 9 aa, Homo Sapiens
FTQEGWQQL

SEQ ID NO: 1206210 - protein, 9 aa, Homo Sapiens
GSLVSVLLP

SEQ ID NO: 1206211 - protein, 9 aa, Homo Sapiens
SVEEASSSS

SEQ ID NO: 1206212 - protein, 9 aa, Homo Sapiens
DKKIWPSHS

SEQ ID NO: 1206213 - protein, 9 aa, Homo Sapiens
LYLLLVSCR

SEQ ID NO: 1206214 - protein, 9 aa, Homo Sapiens
EGDKKIWPS

SEQ ID NO: 1206215 - protein, 9 aa, Homo Sapiens
SLGTLKMHI

SEQ ID NO: 1206216 - protein, 9 aa, Homo Sapiens
HYPNEFLQE

SEQ ID NO: 1206217 - protein, 9 aa, Homo Sapiens
ILDSQFSFQ

SEQ ID NO: 1206218 - protein, 9 aa, Homo Sapiens
VDFTQEGWQ

SEQ ID NO: 1206219 - protein, 9 aa, Homo Sapiens
PESPESARK

SEQ ID NO: 1206220 - protein, 9 aa, Homo Sapiens
WNFFRLENK

SEQ ID NO: 1206221 - protein, 9 aa, Homo Sapiens
YLLLVSCRK

SEQ ID NO: 1206222 - protein, 9 aa, Homo Sapiens
LGTLKMHIR

SEQ ID NO: 1206223 - protein, 9 aa, Homo Sapiens
NEFLQEYNW

SEQ ID NO: 1206224 - protein, 9 aa, Homo Sapiens
FLEGDKKIW

SEQ ID NO: 1206225 - protein, 9 aa, Homo Sapiens
PSPPSVEEA

SEQ ID NO: 1206226 - protein, 9 aa, Homo Sapiens
FFRLENKHL

SEQ ID NO: 1206227 - protein, 9 aa, Homo Sapiens
KIWPSHSLW

SEQ ID NO: 1206228 - protein, 9 aa, Homo Sapiens
LENKHLNNC

SEQ ID NO: 1206229 - protein, 9 aa, Homo Sapiens
CQLAKKKTK

SEQ ID NO: 1206230 - protein, 9 aa, Homo Sapiens
LEGLKKSFY

SEQ ID NO: 1206231 - protein, 9 aa, Homo Sapiens
RLEGLKKSF

SEQ ID NO: 1206232 - protein, 9 aa, Homo Sapiens
QLELKRRSL

SEQ ID NO: 1206233 - protein, 9 aa, Homo Sapiens
PSVEEASSS

SEQ ID NO: 1206234 - protein, 9 aa, Homo Sapiens
LKRRSLDTE

SEQ ID NO: 1206235 - protein, 9 aa, Homo Sapiens
ESPESARKK

SEQ ID NO: 1206236 - protein, 9 aa, Homo Sapiens
SQFSFQASS

SEQ ID NO: 1206237 - protein, 9 aa, Homo Sapiens
SFPLALSGD

SEQ ID NO: 1206238 - protein, 9 aa, Homo Sapiens
LRLEGLKKS

SEQ ID NO: 1206239 - protein, 9 aa, Homo Sapiens
QFSSRSRSR

SEQ ID NO: 1206240 - protein, 9 aa, Homo Sapiens
DFTQEGWQQ

SEQ ID NO: 1206241 - protein, 9 aa, Homo Sapiens
LHGMIRSEI

SEQ ID NO: 1206242 - protein, 9 aa, Homo Sapiens
VSLGTLKMH

SEQ ID NO: 1206243 - protein, 9 aa, Homo Sapiens
LASFLEGDK

SEQ ID NO: 1206244 - protein, 9 aa, Homo Sapiens
FGILDSQFS

SEQ ID NO: 1206245 - protein, 9 aa, Homo Sapiens
LFQRLQCMD

SEQ ID NO: 1206246 - protein, 9 aa, Homo Sapiens
LELKRRSLD

SEQ ID NO: 1206247 - protein, 9 aa, Homo Sapiens
RSEISGAEI

SEQ ID NO: 1206248 - protein, 9 aa, Homo Sapiens
QCMDTSGLP

SEQ ID NO: 1206249 - protein, 9 aa, Homo Sapiens
RSKSRSQFS

SEQ ID NO: 1206250 - protein, 9 aa, Homo Sapiens
HGMIRSEIS

SEQ ID NO: 1206251 - protein, 9 aa, Homo Sapiens
TTFGILDSQ

SEQ ID NO: 1206252 - protein, 9 aa, Homo Sapiens
LSFPLALSG

SEQ ID NO: 1206253 - protein, 9 aa, Homo Sapiens
SLVSVLLPA

SEQ ID NO: 1206254 - protein, 9 aa, Homo Sapiens
LLVSCRKSE

SEQ ID NO: 1206255 - protein, 9 aa, Homo Sapiens
LPESPESAR

SEQ ID NO: 1206256 - protein, 9 aa, Homo Sapiens
KRRSLDTES

SEQ ID NO: 1206257 - protein, 9 aa, Homo Sapiens
KEYVSLGTL

SEQ ID NO: 1206258 - protein, 9 aa, Homo Sapiens
EFLQEYNWE

SEQ ID NO: 1206259 - protein, 9 aa, Homo Sapiens
QFSFQASSV

SEQ ID NO: 1206260 - protein, 9 aa, Homo Sapiens
FHYPNEFLQ

SEQ ID NO: 1206261 - protein, 9 aa, Homo Sapiens
VAVDFTQEG

SEQ ID NO: 1206262 - protein, 9 aa, Homo Sapiens
SCRKSEVRA

SEQ ID NO: 1206263 - protein, 9 aa, Homo Sapiens
KHLNNCGEF

SEQ ID NO: 1206264 - protein, 9 aa, Homo Sapiens
TQEGWQQLD

SEQ ID NO: 1206265 - protein, 9 aa, Homo Sapiens
GMIRSEISG

SEQ ID NO: 1206266 - protein, 9 aa, Homo Sapiens
IRSEISGAE

SEQ ID NO: 1206267 - protein, 9 aa, Homo Sapiens
SRVSLRLEG

SEQ ID NO: 1206268 - protein, 9 aa, Homo Sapiens
YVSLGTLKM

SEQ ID NO: 1206269 - protein, 9 aa, Homo Sapiens
GTTPMLSCL

SEQ ID NO: 1206270 - protein, 9 aa, Homo Sapiens
SKSRSQFSS

SEQ ID NO: 1206271 - protein, 9 aa, Homo Sapiens
ASSSSSLVP

SEQ ID NO: 1206272 - protein, 9 aa, Homo Sapiens
QLGLASFLE

SEQ ID NO: 1206273 - protein, 9 aa, Homo Sapiens
FLQEYNWEL

SEQ ID NO: 1206274 - protein, 9 aa, Homo Sapiens
QEGWQQLDP

SEQ ID NO: 1206275 - protein, 9 aa, Homo Sapiens
SRSQFSSRS

SEQ ID NO: 1206276 - protein, 9 aa, Homo Sapiens
LQCMDTSGL

SEQ ID NO: 1206277 - protein, 9 aa, Homo Sapiens
LMVLSFPLA

SEQ ID NO: 1206278 - protein, 9 aa, Homo Sapiens
IPGGSLVSV

SEQ ID NO: 1206279 - protein, 9 aa, Homo Sapiens
SEISGAEIA

SEQ ID NO: 1206280 - protein, 9 aa, Homo Sapiens
IDFHYPNEF

SEQ ID NO: 1206281 - protein, 9 aa, Homo Sapiens
MIRSEISGA

SEQ ID NO: 1206282 - protein, 9 aa, Homo Sapiens
ENKHLNNCG

SEQ ID NO: 1206283 - protein, 9 aa, Homo Sapiens
LVSCRKSEV

SEQ ID NO: 1206284 - protein, 9 aa, Homo Sapiens
ASFLEGDKK

SEQ ID NO: 1206285 - protein, 9 aa, Homo Sapiens
IWPSHSLWD

SEQ ID NO: 1206286 - protein, 9 aa, Homo Sapiens
PNEFLQEYN

SEQ ID NO: 1206287 - protein, 9 aa, Homo Sapiens
NKHLNNCGE

SEQ ID NO: 1206288 - protein, 9 aa, Homo Sapiens
PPSVEEASS

SEQ ID NO: 1206289 - protein, 9 aa, Homo Sapiens
KSRSQFSSR

SEQ ID NO: 1206290 - protein, 9 aa, Homo Sapiens
LGLASFLEG

SEQ ID NO: 1206291 - protein, 9 aa, Homo Sapiens
VSVLLPAAR

SEQ ID NO: 1206292 - protein, 9 aa, Homo Sapiens
LLLVSCRKS

SEQ ID NO: 1206293 - protein, 9 aa, Homo Sapiens
QIPGGSLVS

SEQ ID NO: 1206294 - protein, 9 aa, Homo Sapiens
DVLPESPES

SEQ ID NO: 1206295 - protein, 9 aa, Homo Sapiens
QQIPGGSLV

SEQ ID NO: 1206296 - protein, 9 aa, Homo Sapiens
DKEYVSLGT

SEQ ID NO: 1206297 - protein, 9 aa, Homo Sapiens
LDSQFSFQA

SEQ ID NO: 1206298 - protein, 9 aa, Homo Sapiens
VEEASSSSS

SEQ ID NO: 1206299 - protein, 9 aa, Homo Sapiens
SFLEGDKKI

SEQ ID NO: 1206300 - protein, 9 aa, Homo Sapiens
PGGSLVSVL

SEQ ID NO: 1206301 - protein, 9 aa, Homo Sapiens
PMLSCLHIR

SEQ ID NO: 1206302 - protein, 9 aa, Homo Sapiens
FQRLQCMDT

SEQ ID NO: 1206303 - protein, 9 aa, Homo Sapiens
RCQLAKKKT

SEQ ID NO: 1206304 - protein, 9 aa, Homo Sapiens
GGTTPMLSC

SEQ ID NO: 1206305 - protein, 9 aa, Homo Sapiens
LEGDKKIWP

SEQ ID NO: 1206306 - protein, 9 aa, Homo Sapiens
ELKRRSLDT

SEQ ID NO: 1206307 - protein, 9 aa, Homo Sapiens
FSSRSRSRS

SEQ ID NO: 1206308 - protein, 9 aa, Homo Sapiens
SDVLPESPE

SEQ ID NO: 1206309 - protein, 9 aa, Homo Sapiens
DSQFSFQAS

SEQ ID NO: 1206310 - protein, 9 aa, Homo Sapiens
MKTMVPLLQ

SEQ ID NO: 1206311 - protein, 9 aa, Homo Sapiens
KTMVPLLQI

SEQ ID NO: 1206312 - protein, 9 aa, Homo Sapiens
SPPGLAKRP

SEQ ID NO: 1206313 - protein, 9 aa, Homo Sapiens
RPLSALGLK

SEQ ID NO: 1206314 - protein, 9 aa, Homo Sapiens
CCRPCCCLC

SEQ ID NO: 1206315 - protein, 9 aa, Homo Sapiens
ENVKLRQLQ

SEQ ID NO: 1206316 - protein, 9 aa, Homo Sapiens
CCLCPVCGR

SEQ ID NO: 1206317 - protein, 9 aa, Homo Sapiens
VVLKSIMKT

SEQ ID NO: 1206318 - protein, 9 aa, Homo Sapiens
QAIRGWSGD

SEQ ID NO: 1206319 - protein, 9 aa, Homo Sapiens
RPCCCLCPV

SEQ ID NO: 1206320 - protein, 9 aa, Homo Sapiens
DKSRSPQSP

SEQ ID NO: 1206321 - protein, 9 aa, Homo Sapiens
CRPCCCLCP

SEQ ID NO: 1206322 - protein, 9 aa, Homo Sapiens
RVPSVTEAP

SEQ ID NO: 1206323 - protein, 9 aa, Homo Sapiens
VFENVKLRQ

SEQ ID NO: 1206324 - protein, 9 aa, Homo Sapiens
LCPVCGRVS

SEQ ID NO: 1206325 - protein, 9 aa, Homo Sapiens
WRPSLQAIR

SEQ ID NO: 1206326 - protein, 9 aa, Homo Sapiens
PQSPPGKPQ

SEQ ID NO: 1206327 - protein, 9 aa, Homo Sapiens
AYDCYIAIC

SEQ ID NO: 1206328 - protein, 9 aa, Homo Sapiens
VETLSSTSI

SEQ ID NO: 1206329 - protein, 9 aa, Homo Sapiens
KLRQLQKEK

SEQ ID NO: 1206330 - protein, 9 aa, Homo Sapiens
RPSLQAIRG

SEQ ID NO: 1206331 - protein, 9 aa, Homo Sapiens
ASMAYDCYI

SEQ ID NO: 1206332 - protein, 9 aa, Homo Sapiens
ASYLKVDTI

SEQ ID NO: 1206333 - protein, 9 aa, Homo Sapiens
MAYDCYIAI

SEQ ID NO: 1206334 - protein, 9 aa, Homo Sapiens
QWRPSLQAI

SEQ ID NO: 1206335 - protein, 9 aa, Homo Sapiens
VTEAPQLRP

SEQ ID NO: 1206336 - protein, 9 aa, Homo Sapiens
SAFWSEASY

SEQ ID NO: 1206337 - protein, 9 aa, Homo Sapiens
AIRGWSGDP

SEQ ID NO: 1206338 - protein, 9 aa, Homo Sapiens
WSEASYLKV

SEQ ID NO: 1206339 - protein, 9 aa, Homo Sapiens
VLKSIMKTM

SEQ ID NO: 1206340 - protein, 9 aa, Homo Sapiens
RSPQSPPGK

SEQ ID NO: 1206341 - protein, 9 aa, Homo Sapiens
TLSSTSIIC

SEQ ID NO: 1206342 - protein, 9 aa, Homo Sapiens
RSPPGLAKR

SEQ ID NO: 1206343 - protein, 9 aa, Homo Sapiens
PRERVPSVT

SEQ ID NO: 1206344 - protein, 9 aa, Homo Sapiens
DCYIAICFP

SEQ ID NO: 1206345 - protein, 9 aa, Homo Sapiens
EFVFENVKL

SEQ ID NO: 1206346 - protein, 9 aa, Homo Sapiens
NLEAVETLS

SEQ ID NO: 1206347 - protein, 9 aa, Homo Sapiens
IMKTMVPLL

SEQ ID NO: 1206348 - protein, 9 aa, Homo Sapiens
FVFENVKLR

SEQ ID NO: 1206349 - protein, 9 aa, Homo Sapiens
GLAKRPLSA

SEQ ID NO: 1206350 - protein, 9 aa, Homo Sapiens
PSVTEAPQL

SEQ ID NO: 1206351 - protein, 9 aa, Homo Sapiens
KRPLSALGL

SEQ ID NO: 1206352 - protein, 9 aa, Homo Sapiens
LKSIMKTMV

SEQ ID NO: 1206353 - protein, 9 aa, Homo Sapiens
KSIMKTMVP

SEQ ID NO: 1206354 - protein, 9 aa, Homo Sapiens
SIMKTMVPL

SEQ ID NO: 1206355 - protein, 9 aa, Homo Sapiens
TEAPQLRPA

SEQ ID NO: 1206356 - protein, 9 aa, Homo Sapiens
QGDKSRSPQ

SEQ ID NO: 1206357 - protein, 9 aa, Homo Sapiens
LSSTSIICS

SEQ ID NO: 1206358 - protein, 9 aa, Homo Sapiens
CYIAICFPL

SEQ ID NO: 1206359 - protein, 9 aa, Homo Sapiens
SMAYDCYIA

SEQ ID NO: 1206360 - protein, 9 aa, Homo Sapiens
TMVPLLQIG

SEQ ID NO: 1206361 - protein, 9 aa, Homo Sapiens
LAKRPLSAL

SEQ ID NO: 1206362 - protein, 9 aa, Homo Sapiens
EASYLKVDT

SEQ ID NO: 1206363 - protein, 9 aa, Homo Sapiens
FENVKLRQL

SEQ ID NO: 1206364 - protein, 9 aa, Homo Sapiens
CCCLCPVCG

SEQ ID NO: 1206365 - protein, 9 aa, Homo Sapiens
LEAVETLSS

SEQ ID NO: 1206366 - protein, 9 aa, Homo Sapiens
RERVPSVTE

SEQ ID NO: 1206367 - protein, 9 aa, Homo Sapiens
ERVPSVTEA

SEQ ID NO: 1206368 - protein, 9 aa, Homo Sapiens
EAVETLSST

SEQ ID NO: 1206369 - protein, 9 aa, Homo Sapiens
SLQAIRGWS

SEQ ID NO: 1206370 - protein, 9 aa, Homo Sapiens
KSRSPQSPP

SEQ ID NO: 1206371 - protein, 9 aa, Homo Sapiens
VPSVTEAPQ

SEQ ID NO: 1206372 - protein, 9 aa, Homo Sapiens
AFWSEASYL

SEQ ID NO: 1206373 - protein, 9 aa, Homo Sapiens
PPGLAKRPL

SEQ ID NO: 1206374 - protein, 9 aa, Homo Sapiens
SEASYLKVD

SEQ ID NO: 1206375 - protein, 9 aa, Homo Sapiens
SPQSPPGKP

SEQ ID NO: 1206376 - protein, 9 aa, Homo Sapiens
NVKLRQLQK

SEQ ID NO: 1206377 - protein, 9 aa, Homo Sapiens
CPVCGRVSC

SEQ ID NO: 1206378 - protein, 9 aa, Homo Sapiens
LRQLQKEKF

SEQ ID NO: 1206379 - protein, 9 aa, Homo Sapiens
KSAFWSEAS

SEQ ID NO: 1206380 - protein, 9 aa, Homo Sapiens
VKLRQLQKE

SEQ ID NO: 1206381 - protein, 9 aa, Homo Sapiens
SRSPQSPPG

SEQ ID NO: 1206382 - protein, 9 aa, Homo Sapiens
LQWRPSLQA

SEQ ID NO: 1206383 - protein, 9 aa, Homo Sapiens
PSLQAIRGW

SEQ ID NO: 1206384 - protein, 9 aa, Homo Sapiens
FWSEASYLK

SEQ ID NO: 1206385 - protein, 9 aa, Homo Sapiens
SYLKVDTIA

SEQ ID NO: 1206386 - protein, 9 aa, Homo Sapiens
PGLAKRPLS

SEQ ID NO: 1206387 - protein, 9 aa, Homo Sapiens
ETLSSTSII

SEQ ID NO: 1206388 - protein, 9 aa, Homo Sapiens
PCCCLCPVC

SEQ ID NO: 1206389 - protein, 9 aa, Homo Sapiens
CLCPVCGRV

SEQ ID NO: 1206390 - protein, 9 aa, Homo Sapiens
AVETLSSTS

SEQ ID NO: 1206391 - protein, 9 aa, Homo Sapiens
SSTSIICSD

SEQ ID NO: 1206392 - protein, 9 aa, Homo Sapiens
LQAIRGWSG

SEQ ID NO: 1206393 - protein, 9 aa, Homo Sapiens
GDKSRSPQS

SEQ ID NO: 1206394 - protein, 9 aa, Homo Sapiens
SVTEAPQLR

SEQ ID NO: 1206395 - protein, 9 aa, Homo Sapiens
YDCYIAICF

SEQ ID NO: 1206396 - protein, 9 aa, Homo Sapiens
AKRPLSALG

SEQ ID NO: 1206397 - protein, 9 aa, Homo Sapiens
TRPGNGFSC

SEQ ID NO: 1206398 - protein, 9 aa, Homo Sapiens
GNVGLLPLE

SEQ ID NO: 1206399 - protein, 9 aa, Homo Sapiens
WGRLHSHCP

SEQ ID NO: 1206400 - protein, 9 aa, Homo Sapiens
PFVGIEHIL

SEQ ID NO: 1206401 - protein, 9 aa, Homo Sapiens
GFHRHRQDW

SEQ ID NO: 1206402 - protein, 9 aa, Homo Sapiens
VGCQTLATP

SEQ ID NO: 1206403 - protein, 9 aa, Homo Sapiens
AVILVILSA

SEQ ID NO: 1206404 - protein, 9 aa, Homo Sapiens
RARNASQVS

SEQ ID NO: 1206405 - protein, 9 aa, Homo Sapiens
VNQPSSHFL

SEQ ID NO: 1206406 - protein, 9 aa, Homo Sapiens
QRCSSGFHR

SEQ ID NO: 1206407 - protein, 9 aa, Homo Sapiens
HFVNQPSSH

SEQ ID NO: 1206408 - protein, 9 aa, Homo Sapiens
SLLPFVGIE

SEQ ID NO: 1206409 - protein, 9 aa, Homo Sapiens
LHSHCPRHC

SEQ ID NO: 1206410 - protein, 9 aa, Homo Sapiens
FDDLVAAGI

SEQ ID NO: 1206411 - protein, 9 aa, Homo Sapiens
QPSSHFLKT

SEQ ID NO: 1206412 - protein, 9 aa, Homo Sapiens
SHFLKTRPG

SEQ ID NO: 1206413 - protein, 9 aa, Homo Sapiens
RGKRQKPPP

SEQ ID NO: 1206414 - protein, 9 aa, Homo Sapiens
MEQGVYPAE

SEQ ID NO: 1206415 - protein, 9 aa, Homo Sapiens
HRHRQDWVD

SEQ ID NO: 1206416 - protein, 9 aa, Homo Sapiens
PWGRLHSHC

SEQ ID NO: 1206417 - protein, 9 aa, Homo Sapiens
KHFMEQGVY

SEQ ID NO: 1206418 - protein, 9 aa, Homo Sapiens
TISEYIYHY

SEQ ID NO: 1206419 - protein, 9 aa, Homo Sapiens
HYNAQNPSG

SEQ ID NO: 1206420 - protein, 9 aa, Homo Sapiens
PAQLVGCQT

SEQ ID NO: 1206421 - protein, 9 aa, Homo Sapiens
PADVSPMNY

SEQ ID NO: 1206422 - protein, 9 aa, Homo Sapiens
SRGKRQKPP

SEQ ID NO: 1206423 - protein, 9 aa, Homo Sapiens
AGSAEGFHL

SEQ ID NO: 1206424 - protein, 9 aa, Homo Sapiens
LSAPKMKTV

SEQ ID NO: 1206425 - protein, 9 aa, Homo Sapiens
LVGCQTLAT

SEQ ID NO: 1206426 - protein, 9 aa, Homo Sapiens
YHYNAQNPS

SEQ ID NO: 1206427 - protein, 9 aa, Homo Sapiens
AEQPAGSAE

SEQ ID NO: 1206428 - protein, 9 aa, Homo Sapiens
KVPTAHPSP

SEQ ID NO: 1206429 - protein, 9 aa, Homo Sapiens
NASQVSAPG

SEQ ID NO: 1206430 - protein, 9 aa, Homo Sapiens
SDGQYSPTP

SEQ ID NO: 1206431 - protein, 9 aa, Homo Sapiens
QGVYPAEPE

SEQ ID NO: 1206432 - protein, 9 aa, Homo Sapiens
GKRQKPPPT

SEQ ID NO: 1206433 - protein, 9 aa, Homo Sapiens
ARNASQVSA

SEQ ID NO: 1206434 - protein, 9 aa, Homo Sapiens
VHFVNQPSS

SEQ ID NO: 1206435 - protein, 9 aa, Homo Sapiens
EAAAAAAAP

SEQ ID NO: 1206436 - protein, 9 aa, Homo Sapiens
LKTRPGNGF

SEQ ID NO: 1206437 - protein, 9 aa, Homo Sapiens
QTEYEVCGN

SEQ ID NO: 1206438 - protein, 9 aa, Homo Sapiens
FVGIEHILP

SEQ ID NO: 1206439 - protein, 9 aa, Homo Sapiens
PTVTESKSN

SEQ ID NO: 1206440 - protein, 9 aa, Homo Sapiens
GCQTLATPA

SEQ ID NO: 1206441 - protein, 9 aa, Homo Sapiens
GIEHILPIN

SEQ ID NO: 1206442 - protein, 9 aa, Homo Sapiens
PSSHFLKTR

SEQ ID NO: 1206443 - protein, 9 aa, Homo Sapiens
TPYSEYPPF

SEQ ID NO: 1206444 - protein, 9 aa, Homo Sapiens
LKHFMEQGV

SEQ ID NO: 1206445 - protein, 9 aa, Homo Sapiens
SAPKMKTVT

SEQ ID NO: 1206446 - protein, 9 aa, Homo Sapiens
QYSPTPYSE

SEQ ID NO: 1206447 - protein, 9 aa, Homo Sapiens
VGIEHILPI

SEQ ID NO: 1206448 - protein, 9 aa, Homo Sapiens
HSHCPRHCP

SEQ ID NO: 1206449 - protein, 9 aa, Homo Sapiens
FHRHRQDWV

SEQ ID NO: 1206450 - protein, 9 aa, Homo Sapiens
YSPTPYSEY

SEQ ID NO: 1206451 - protein, 9 aa, Homo Sapiens
VSPMNYSLC

SEQ ID NO: 1206452 - protein, 9 aa, Homo Sapiens
GVHFVNQPS

SEQ ID NO: 1206453 - protein, 9 aa, Homo Sapiens
RLPADVSPM

SEQ ID NO: 1206454 - protein, 9 aa, Homo Sapiens
GNGFSCMET

SEQ ID NO: 1206455 - protein, 9 aa, Homo Sapiens
SSHFLKTRP

SEQ ID NO: 1206456 - protein, 9 aa, Homo Sapiens
LGPAQLVGC

SEQ ID NO: 1206457 - protein, 9 aa, Homo Sapiens
SAEGFHLHG

SEQ ID NO: 1206458 - protein, 9 aa, Homo Sapiens
CQTLATPAM

SEQ ID NO: 1206459 - protein, 9 aa, Homo Sapiens
VNYPPTVTE

SEQ ID NO: 1206460 - protein, 9 aa, Homo Sapiens
LVILSAPKM

SEQ ID NO: 1206461 - protein, 9 aa, Homo Sapiens
TERRAKVPT

SEQ ID NO: 1206462 - protein, 9 aa, Homo Sapiens
CSSGFHRHR

SEQ ID NO: 1206463 - protein, 9 aa, Homo Sapiens
LRVTERRAK

SEQ ID NO: 1206464 - protein, 9 aa, Homo Sapiens
SEIYEAGAP

SEQ ID NO: 1206465 - protein, 9 aa, Homo Sapiens
QLVGCQTLA

SEQ ID NO: 1206466 - protein, 9 aa, Homo Sapiens
HFLKTRPGN

SEQ ID NO: 1206467 - protein, 9 aa, Homo Sapiens
AAPEEQSWT

SEQ ID NO: 1206468 - protein, 9 aa, Homo Sapiens
TVNYPPTVT

SEQ ID NO: 1206469 - protein, 9 aa, Homo Sapiens
RQKPPPTPE

SEQ ID NO: 1206470 - protein, 9 aa, Homo Sapiens
ILSAPKMKT

SEQ ID NO: 1206471 - protein, 9 aa, Homo Sapiens
AAGIASGRV

SEQ ID NO: 1206472 - protein, 9 aa, Homo Sapiens
YEAGAPMAA

SEQ ID NO: 1206473 - protein, 9 aa, Homo Sapiens
RRARNASQV

SEQ ID NO: 1206474 - protein, 9 aa, Homo Sapiens
AAAAAPEEQ

SEQ ID NO: 1206475 - protein, 9 aa, Homo Sapiens
PPWGRLHSH

SEQ ID NO: 1206476 - protein, 9 aa, Homo Sapiens
AGIASGRVA

SEQ ID NO: 1206477 - protein, 9 aa, Homo Sapiens
VTVNYPPTV

SEQ ID NO: 1206478 - protein, 9 aa, Homo Sapiens
QRRARNASQ

SEQ ID NO: 1206479 - protein, 9 aa, Homo Sapiens
PAGSAEGFH

SEQ ID NO: 1206480 - protein, 9 aa, Homo Sapiens
VTERRAKVP

SEQ ID NO: 1206481 - protein, 9 aa, Homo Sapiens
TEYEVCGNV

SEQ ID NO: 1206482 - protein, 9 aa, Homo Sapiens
KRQKPPPTP

SEQ ID NO: 1206483 - protein, 9 aa, Homo Sapiens
APEEQSWTG

SEQ ID NO: 1206484 - protein, 9 aa, Homo Sapiens
LSDGQYSPT

SEQ ID NO: 1206485 - protein, 9 aa, Homo Sapiens
YIYHYNAQN

SEQ ID NO: 1206486 - protein, 9 aa, Homo Sapiens
EYIYHYNAQ

SEQ ID NO: 1206487 - protein, 9 aa, Homo Sapiens
PRQRRARNA

SEQ ID NO: 1206488 - protein, 9 aa, Homo Sapiens
SEYIYHYNA

SEQ ID NO: 1206489 - protein, 9 aa, Homo Sapiens
LPFVGIEHI

SEQ ID NO: 1206490 - protein, 9 aa, Homo Sapiens
TVTESKSNE

SEQ ID NO: 1206491 - protein, 9 aa, Homo Sapiens
TAVILVILS

SEQ ID NO: 1206492 - protein, 9 aa, Homo Sapiens
RAKVPTAHP

SEQ ID NO: 1206493 - protein, 9 aa, Homo Sapiens
LQRCSSGFH

SEQ ID NO: 1206494 - protein, 9 aa, Homo Sapiens
LVAAGIASG

SEQ ID NO: 1206495 - protein, 9 aa, Homo Sapiens
VILSAPKMK

SEQ ID NO: 1206496 - protein, 9 aa, Homo Sapiens
AQLVGCQTL

SEQ ID NO: 1206497 - protein, 9 aa, Homo Sapiens
GVYPAEPEL

SEQ ID NO: 1206498 - protein, 9 aa, Homo Sapiens
DLVAAGIAS

SEQ ID NO: 1206499 - protein, 9 aa, Homo Sapiens
RQRRARNAS

SEQ ID NO: 1206500 - protein, 9 aa, Homo Sapiens
RLHSHCPRH

SEQ ID NO: 1206501 - protein, 9 aa, Homo Sapiens
EVCGNVGLL

SEQ ID NO: 1206502 - protein, 9 aa, Homo Sapiens
FLSRGKRQK

SEQ ID NO: 1206503 - protein, 9 aa, Homo Sapiens
RRAKVPTAH

SEQ ID NO: 1206504 - protein, 9 aa, Homo Sapiens
YNAQNPSGE

SEQ ID NO: 1206505 - protein, 9 aa, Homo Sapiens
SPTPYSEYP

SEQ ID NO: 1206506 - protein, 9 aa, Homo Sapiens
PTPYSEYPP

SEQ ID NO: 1206507 - protein, 9 aa, Homo Sapiens
RLKHFMEQG

SEQ ID NO: 1206508 - protein, 9 aa, Homo Sapiens
DGQYSPTPY

SEQ ID NO: 1206509 - protein, 9 aa, Homo Sapiens
VTESKSNEA

SEQ ID NO: 1206510 - protein, 9 aa, Homo Sapiens
LLPFVGIEH

SEQ ID NO: 1206511 - protein, 9 aa, Homo Sapiens
IYHYNAQNP

SEQ ID NO: 1206512 - protein, 9 aa, Homo Sapiens
AAAAPEEQS

SEQ ID NO: 1206513 - protein, 9 aa, Homo Sapiens
GPAQLVGCQ

SEQ ID NO: 1206514 - protein, 9 aa, Homo Sapiens
MNYSLCLKP

SEQ ID NO: 1206515 - protein, 9 aa, Homo Sapiens
IASGRVAVF

SEQ ID NO: 1206516 - protein, 9 aa, Homo Sapiens
SGFHRHRQD

SEQ ID NO: 1206517 - protein, 9 aa, Homo Sapiens
FVNQPSSHF

SEQ ID NO: 1206518 - protein, 9 aa, Homo Sapiens
KTRPGNGFS

SEQ ID NO: 1206519 - protein, 9 aa, Homo Sapiens
ADVSPMNYS

SEQ ID NO: 1206520 - protein, 9 aa, Homo Sapiens
QKPPPTPEG

SEQ ID NO: 1206521 - protein, 9 aa, Homo Sapiens
RPGNGFSCM

SEQ ID NO: 1206522 - protein, 9 aa, Homo Sapiens
GQYSPTPYS

SEQ ID NO: 1206523 - protein, 9 aa, Homo Sapiens
EIYEAGAPM

SEQ ID NO: 1206524 - protein, 9 aa, Homo Sapiens
LPADVSPMN

SEQ ID NO: 1206525 - protein, 9 aa, Homo Sapiens
VILVILSAP

SEQ ID NO: 1206526 - protein, 9 aa, Homo Sapiens
EYEVCGNVG

SEQ ID NO: 1206527 - protein, 9 aa, Homo Sapiens
AKVPTAHPS

SEQ ID NO: 1206528 - protein, 9 aa, Homo Sapiens
NQPSSHFLK

SEQ ID NO: 1206529 - protein, 9 aa, Homo Sapiens
HFMEQGVYP

SEQ ID NO: 1206530 - protein, 9 aa, Homo Sapiens
GSAEGFHLH

SEQ ID NO: 1206531 - protein, 9 aa, Homo Sapiens
PEEQSWTGV

SEQ ID NO: 1206532 - protein, 9 aa, Homo Sapiens
HCPRHCPPW

SEQ ID NO: 1206533 - protein, 9 aa, Homo Sapiens
FLKTRPGNG

SEQ ID NO: 1206534 - protein, 9 aa, Homo Sapiens
VAAGIASGR

SEQ ID NO: 1206535 - protein, 9 aa, Homo Sapiens
EQPAGSAEG

SEQ ID NO: 1206536 - protein, 9 aa, Homo Sapiens
KPPPTPEGK

SEQ ID NO: 1206537 - protein, 9 aa, Homo Sapiens
NYPPTVTES

SEQ ID NO: 1206538 - protein, 9 aa, Homo Sapiens
ERRAKVPTA

SEQ ID NO: 1206539 - protein, 9 aa, Homo Sapiens
EQGVYPAEP

SEQ ID NO: 1206540 - protein, 9 aa, Homo Sapiens
RNASQVSAP

SEQ ID NO: 1206541 - protein, 9 aa, Homo Sapiens
GRLHSHCPR

SEQ ID NO: 1206542 - protein, 9 aa, Homo Sapiens
ISEYIYHYN

SEQ ID NO: 1206543 - protein, 9 aa, Homo Sapiens
DDLVAAGIA

SEQ ID NO: 1206544 - protein, 9 aa, Homo Sapiens
PGNGFSCME

SEQ ID NO: 1206545 - protein, 9 aa, Homo Sapiens
SQTEYEVCG

SEQ ID NO: 1206546 - protein, 9 aa, Homo Sapiens
NGFSCMETI

SEQ ID NO: 1206547 - protein, 9 aa, Homo Sapiens
FMEQGVYPA

SEQ ID NO: 1206548 - protein, 9 aa, Homo Sapiens
LPRQRRARN

SEQ ID NO: 1206549 - protein, 9 aa, Homo Sapiens
SSLLPFVGI

SEQ ID NO: 1206550 - protein, 9 aa, Homo Sapiens
CGNVGLLPL

SEQ ID NO: 1206551 - protein, 9 aa, Homo Sapiens
ILVILSAPK

SEQ ID NO: 1206552 - protein, 9 aa, Homo Sapiens
SHCPRHCPP

SEQ ID NO: 1206553 - protein, 9 aa, Homo Sapiens
LSSLLPFVG

SEQ ID NO: 1206554 - protein, 9 aa, Homo Sapiens
IYEAGAPMA

SEQ ID NO: 1206555 - protein, 9 aa, Homo Sapiens
SPMNYSLCL

SEQ ID NO: 1206556 - protein, 9 aa, Homo Sapiens
QPAGSAEGF

SEQ ID NO: 1206557 - protein, 9 aa, Homo Sapiens
DVSPMNYSL

SEQ ID NO: 1206558 - protein, 9 aa, Homo Sapiens
PMNYSLCLK

SEQ ID NO: 1206559 - protein, 9 aa, Homo Sapiens
SAEQPAGSA

SEQ ID NO: 1206560 - protein, 9 aa, Homo Sapiens
LSRGKRQKP

SEQ ID NO: 1206561 - protein, 9 aa, Homo Sapiens
GIASGRVAV

SEQ ID NO: 1206562 - protein, 9 aa, Homo Sapiens
VSAEQPAGS

SEQ ID NO: 1206563 - protein, 9 aa, Homo Sapiens
RVTERRAKV

SEQ ID NO: 1206564 - protein, 9 aa, Homo Sapiens
YEVCGNVGL

SEQ ID NO: 1206565 - protein, 9 aa, Homo Sapiens
AAAPEEQSW

SEQ ID NO: 1206566 - protein, 9 aa, Homo Sapiens
VCGNVGLLP

SEQ ID NO: 1206567 - protein, 9 aa, Homo Sapiens
EAGAPMAAA

SEQ ID NO: 1206568 - protein, 9 aa, Homo Sapiens
YPPTVTESK

SEQ ID NO: 1206569 - protein, 9 aa, Homo Sapiens
AAAAAAPEE

SEQ ID NO: 1206570 - protein, 9 aa, Homo Sapiens
RCSSGFHRH

SEQ ID NO: 1206571 - protein, 9 aa, Homo Sapiens
PPTVTESKS

SEQ ID NO: 1206572 - protein, 9 aa, Homo Sapiens
SSGFHRHRQ

SEQ ID NO: 1206573 - protein, 9 aa, Homo Sapiens
NSISSMSMW

SEQ ID NO: 1206574 - protein, 9 aa, Homo Sapiens
LRPDKSLTV

SEQ ID NO: 1206575 - protein, 9 aa, Homo Sapiens
SGAGAKPLG

SEQ ID NO: 1206576 - protein, 9 aa, Homo Sapiens
QEHIPFPPM

SEQ ID NO: 1206577 - protein, 9 aa, Homo Sapiens
EHIPFPPML

SEQ ID NO: 1206578 - protein, 9 aa, Homo Sapiens
RVAFCYQIR

SEQ ID NO: 1206579 - protein, 9 aa, Homo Sapiens
SSMSMWSSM

SEQ ID NO: 1206580 - protein, 9 aa, Homo Sapiens
KSLTVSSPF

SEQ ID NO: 1206581 - protein, 9 aa, Homo Sapiens
VQLEQDEYA

SEQ ID NO: 1206582 - protein, 9 aa, Homo Sapiens
LKLNLTSYL

SEQ ID NO: 1206583 - protein, 9 aa, Homo Sapiens
SRPLDMDSI

SEQ ID NO: 1206584 - protein, 9 aa, Homo Sapiens
MWSSMVPSA

SEQ ID NO: 1206585 - protein, 9 aa, Homo Sapiens
PVLPSNLSQ

SEQ ID NO: 1206586 - protein, 9 aa, Homo Sapiens
EDCIRDVPG

SEQ ID NO: 1206587 - protein, 9 aa, Homo Sapiens
PDKSLTVSS

SEQ ID NO: 1206588 - protein, 9 aa, Homo Sapiens
EATSPAAAV

SEQ ID NO: 1206589 - protein, 9 aa, Homo Sapiens
PEEDSGAGA

SEQ ID NO: 1206590 - protein, 9 aa, Homo Sapiens
RPGMRVAFC

SEQ ID NO: 1206591 - protein, 9 aa, Homo Sapiens
IIQDAPAVL

SEQ ID NO: 1206592 - protein, 9 aa, Homo Sapiens
QRSVLTASS

SEQ ID NO: 1206593 - protein, 9 aa, Homo Sapiens
LRPGMRVAF

SEQ ID NO: 1206594 - protein, 9 aa, Homo Sapiens
TLRPGMRVA

SEQ ID NO: 1206595 - protein, 9 aa, Homo Sapiens
VPGVFSRSV

SEQ ID NO: 1206596 - protein, 9 aa, Homo Sapiens
AAVPTPEEA

SEQ ID NO: 1206597 - protein, 9 aa, Homo Sapiens
MRCLLACFL

SEQ ID NO: 1206598 - protein, 9 aa, Homo Sapiens
REEVPGVFS

SEQ ID NO: 1206599 - protein, 9 aa, Homo Sapiens
PEDCIRDVP

SEQ ID NO: 1206600 - protein, 9 aa, Homo Sapiens
MDSSRPLDM

SEQ ID NO: 1206601 - protein, 9 aa, Homo Sapiens
HIPFPPMLF

SEQ ID NO: 1206602 - protein, 9 aa, Homo Sapiens
RQVAGCMHK

SEQ ID NO: 1206603 - protein, 9 aa, Homo Sapiens
SQLRPDKSL

SEQ ID NO: 1206604 - protein, 9 aa, Homo Sapiens
QVEIDCQQC

SEQ ID NO: 1206605 - protein, 9 aa, Homo Sapiens
RPLDMDSII

SEQ ID NO: 1206606 - protein, 9 aa, Homo Sapiens
ICLSHNPLH

SEQ ID NO: 1206607 - protein, 9 aa, Homo Sapiens
CIRDVPGNE

SEQ ID NO: 1206608 - protein, 9 aa, Homo Sapiens
DVTGAEATA

SEQ ID NO: 1206609 - protein, 9 aa, Homo Sapiens
SMDSSRPLD

SEQ ID NO: 1206610 - protein, 9 aa, Homo Sapiens
IAVVFTDEE

SEQ ID NO: 1206611 - protein, 9 aa, Homo Sapiens
KVQELFQRS

SEQ ID NO: 1206612 - protein, 9 aa, Homo Sapiens
PGMRVAFCY

SEQ ID NO: 1206613 - protein, 9 aa, Homo Sapiens
DRVVMCSGP

SEQ ID NO: 1206614 - protein, 9 aa, Homo Sapiens
KMPIIQDAP

SEQ ID NO: 1206615 - protein, 9 aa, Homo Sapiens
EQDEYAKHI

SEQ ID NO: 1206616 - protein, 9 aa, Homo Sapiens
GKEEYSAMR

SEQ ID NO: 1206617 - protein, 9 aa, Homo Sapiens
ETKPEDCIR

SEQ ID NO: 1206618 - protein, 9 aa, Homo Sapiens
ADRRRWLRP

SEQ ID NO: 1206619 - protein, 9 aa, Homo Sapiens
LREEVPGVF

SEQ ID NO: 1206620 - protein, 9 aa, Homo Sapiens
APWSFLCRA

SEQ ID NO: 1206621 - protein, 9 aa, Homo Sapiens
PSQLRPDKS

SEQ ID NO: 1206622 - protein, 9 aa, Homo Sapiens
KQVQLEQDE

SEQ ID NO: 1206623 - protein, 9 aa, Homo Sapiens
FQRSVLTAS

SEQ ID NO: 1206624 - protein, 9 aa, Homo Sapiens
SYLEQFEVI

SEQ ID NO: 1206625 - protein, 9 aa, Homo Sapiens
GCMHKGVHR

SEQ ID NO: 1206626 - protein, 9 aa, Homo Sapiens
VPPPAPWSF

SEQ ID NO: 1206627 - protein, 9 aa, Homo Sapiens
MHKGVHRRA

SEQ ID NO: 1206628 - protein, 9 aa, Homo Sapiens
PPPAPWSFL

SEQ ID NO: 1206629 - protein, 9 aa, Homo Sapiens
QESVTFEDI

SEQ ID NO: 1206630 - protein, 9 aa, Homo Sapiens
KAEVDEDRV

SEQ ID NO: 1206631 - protein, 9 aa, Homo Sapiens
PAVLTNAVI

SEQ ID NO: 1206632 - protein, 9 aa, Homo Sapiens
DSSRPLDMD

SEQ ID NO: 1206633 - protein, 9 aa, Homo Sapiens
CLSHNPLHC

SEQ ID NO: 1206634 - protein, 9 aa, Homo Sapiens
MLFRIVRLA

SEQ ID NO: 1206635 - protein, 9 aa, Homo Sapiens
AEVDEDRVV

SEQ ID NO: 1206636 - protein, 9 aa, Homo Sapiens
MRVAFCYQI

SEQ ID NO: 1206637 - protein, 9 aa, Homo Sapiens
PPSQLRPDK

SEQ ID NO: 1206638 - protein, 9 aa, Homo Sapiens
PLDMDSIIP

SEQ ID NO: 1206639 - protein, 9 aa, Homo Sapiens
PKAEVDEDR

SEQ ID NO: 1206640 - protein, 9 aa, Homo Sapiens
KQVEIDCQQ

SEQ ID NO: 1206641 - protein, 9 aa, Homo Sapiens
ANEYAYRHG

SEQ ID NO: 1206642 - protein, 9 aa, Homo Sapiens
NLTSYLEQF

SEQ ID NO: 1206643 - protein, 9 aa, Homo Sapiens
YRKQVEIDC

SEQ ID NO: 1206644 - protein, 9 aa, Homo Sapiens
RSVLTASSF

SEQ ID NO: 1206645 - protein, 9 aa, Homo Sapiens
LKQVQLEQD

SEQ ID NO: 1206646 - protein, 9 aa, Homo Sapiens
YAYRHGIAE

SEQ ID NO: 1206647 - protein, 9 aa, Homo Sapiens
VPTPEEATS

SEQ ID NO: 1206648 - protein, 9 aa, Homo Sapiens
RGSKDHSIR

SEQ ID NO: 1206649 - protein, 9 aa, Homo Sapiens
GMRVAFCYQ

SEQ ID NO: 1206650 - protein, 9 aa, Homo Sapiens
ILDTAGKEE

SEQ ID NO: 1206651 - protein, 9 aa, Homo Sapiens
EEDSGAGAK

SEQ ID NO: 1206652 - protein, 9 aa, Homo Sapiens
LDILDTAGK

SEQ ID NO: 1206653 - protein, 9 aa, Homo Sapiens
AGKEEYSAM

SEQ ID NO: 1206654 - protein, 9 aa, Homo Sapiens
SMSMWSSMV

SEQ ID NO: 1206655 - protein, 9 aa, Homo Sapiens
ARGSKDHSI

SEQ ID NO: 1206656 - protein, 9 aa, Homo Sapiens
VEIDCQQCM

SEQ ID NO: 1206657 - protein, 9 aa, Homo Sapiens
AKICLSHNP

SEQ ID NO: 1206658 - protein, 9 aa, Homo Sapiens
EATAEPMIL

SEQ ID NO: 1206659 - protein, 9 aa, Homo Sapiens
QLRPDKSLT

SEQ ID NO: 1206660 - protein, 9 aa, Homo Sapiens
NEYAYRHGI

SEQ ID NO: 1206661 - protein, 9 aa, Homo Sapiens
AEATAEPMI

SEQ ID NO: 1206662 - protein, 9 aa, Homo Sapiens
LSAKICLSH

SEQ ID NO: 1206663 - protein, 9 aa, Homo Sapiens
LEQDEYAKH

SEQ ID NO: 1206664 - protein, 9 aa, Homo Sapiens
KPEDCIRDV

SEQ ID NO: 1206665 - protein, 9 aa, Homo Sapiens
FPPMLFRIV

SEQ ID NO: 1206666 - protein, 9 aa, Homo Sapiens
ESVTFEDIA

SEQ ID NO: 1206667 - protein, 9 aa, Homo Sapiens
LACFLDKAA

SEQ ID NO: 1206668 - protein, 9 aa, Homo Sapiens
SVTFEDIAV

SEQ ID NO: 1206669 - protein, 9 aa, Homo Sapiens
ELFQRSVLT

SEQ ID NO: 1206670 - protein, 9 aa, Homo Sapiens
LNLTSYLEQ

SEQ ID NO: 1206671 - protein, 9 aa, Homo Sapiens
EVPPPAPWS

SEQ ID NO: 1206672 - protein, 9 aa, Homo Sapiens
WLRPGTLAP

SEQ ID NO: 1206673 - protein, 9 aa, Homo Sapiens
VTFEDIAVV

SEQ ID NO: 1206674 - protein, 9 aa, Homo Sapiens
KLSAKICLS

SEQ ID NO: 1206675 - protein, 9 aa, Homo Sapiens
RRWLRPGTL

SEQ ID NO: 1206676 - protein, 9 aa, Homo Sapiens
KVLKLNLTS

SEQ ID NO: 1206677 - protein, 9 aa, Homo Sapiens
IPFPPMLFR

SEQ ID NO: 1206678 - protein, 9 aa, Homo Sapiens
GSNSSSSST

SEQ ID NO: 1206679 - protein, 9 aa, Homo Sapiens
HSIRAQEPE

SEQ ID NO: 1206680 - protein, 9 aa, Homo Sapiens
KLNLTSYLE

SEQ ID NO: 1206681 - protein, 9 aa, Homo Sapiens
TSYLEQFEV

SEQ ID NO: 1206682 - protein, 9 aa, Homo Sapiens
WSFLCRALC

SEQ ID NO: 1206683 - protein, 9 aa, Homo Sapiens
QGMSIYPGY

SEQ ID NO: 1206684 - protein, 9 aa, Homo Sapiens
SISSMSMWS

SEQ ID NO: 1206685 - protein, 9 aa, Homo Sapiens
EYAYRHGIA

SEQ ID NO: 1206686 - protein, 9 aa, Homo Sapiens
QLEQDEYAK

SEQ ID NO: 1206687 - protein, 9 aa, Homo Sapiens
VLKLNLTSY

SEQ ID NO: 1206688 - protein, 9 aa, Homo Sapiens
TAGKEEYSA

SEQ ID NO: 1206689 - protein, 9 aa, Homo Sapiens
KEEYSAMRD

SEQ ID NO: 1206690 - protein, 9 aa, Homo Sapiens
TPEEATSPA

SEQ ID NO: 1206691 - protein, 9 aa, Homo Sapiens
PANEYAYRH

SEQ ID NO: 1206692 - protein, 9 aa, Homo Sapiens
GGQGPEEDS

SEQ ID NO: 1206693 - protein, 9 aa, Homo Sapiens
VAGCMHKGV

SEQ ID NO: 1206694 - protein, 9 aa, Homo Sapiens
VAFCYQIRR

SEQ ID NO: 1206695 - protein, 9 aa, Homo Sapiens
IDCQQCMLE

SEQ ID NO: 1206696 - protein, 9 aa, Homo Sapiens
DTAGKEEYS

SEQ ID NO: 1206697 - protein, 9 aa, Homo Sapiens
AVPTPEEAT

SEQ ID NO: 1206698 - protein, 9 aa, Homo Sapiens
GSKDHSIRA

SEQ ID NO: 1206699 - protein, 9 aa, Homo Sapiens
VMRCLLACF

SEQ ID NO: 1206700 - protein, 9 aa, Homo Sapiens
LSMDSSRPL

SEQ ID NO: 1206701 - protein, 9 aa, Homo Sapiens
LPRQVAGCM

SEQ ID NO: 1206702 - protein, 9 aa, Homo Sapiens
NSSSSSTFN

SEQ ID NO: 1206703 - protein, 9 aa, Homo Sapiens
QGPEEDSGA

SEQ ID NO: 1206704 - protein, 9 aa, Homo Sapiens
EVPGVFSRS

SEQ ID NO: 1206705 - protein, 9 aa, Homo Sapiens
SIRAQEPES

SEQ ID NO: 1206706 - protein, 9 aa, Homo Sapiens
IRDVPGNEH

SEQ ID NO: 1206707 - protein, 9 aa, Homo Sapiens
FEDIAVVFT

SEQ ID NO: 1206708 - protein, 9 aa, Homo Sapiens
WSSMVPSAV

SEQ ID NO: 1206709 - protein, 9 aa, Homo Sapiens
DILDTAGKE

SEQ ID NO: 1206710 - protein, 9 aa, Homo Sapiens
EEATSPAAA

SEQ ID NO: 1206711 - protein, 9 aa, Homo Sapiens
DIAVVFTDE

SEQ ID NO: 1206712 - protein, 9 aa, Homo Sapiens
MEVPPPAPW

SEQ ID NO: 1206713 - protein, 9 aa, Homo Sapiens
EIDCQQCML

SEQ ID NO: 1206714 - protein, 9 aa, Homo Sapiens
ACFLDKAAE

SEQ ID NO: 1206715 - protein, 9 aa, Homo Sapiens
LTSYLEQFE

SEQ ID NO: 1206716 - protein, 9 aa, Homo Sapiens
RHGIAEAVG

SEQ ID NO: 1206717 - protein, 9 aa, Homo Sapiens
QVAGCMHKG

SEQ ID NO: 1206718 - protein, 9 aa, Homo Sapiens
VQELFQRSV

SEQ ID NO: 1206719 - protein, 9 aa, Homo Sapiens
MPIIQDAPA

SEQ ID NO: 1206720 - protein, 9 aa, Homo Sapiens
PRQVAGCMH

SEQ ID NO: 1206721 - protein, 9 aa, Homo Sapiens
CLLACFLDK

SEQ ID NO: 1206722 - protein, 9 aa, Homo Sapiens
DEDRVVMCS

SEQ ID NO: 1206723 - protein, 9 aa, Homo Sapiens
TFEDIAVVF

SEQ ID NO: 1206724 - protein, 9 aa, Homo Sapiens
PWSFLCRAL

SEQ ID NO: 1206725 - protein, 9 aa, Homo Sapiens
SYRKQVEID

SEQ ID NO: 1206726 - protein, 9 aa, Homo Sapiens
LFQRSVLTA

SEQ ID NO: 1206727 - protein, 9 aa, Homo Sapiens
AGCMHKGVH

SEQ ID NO: 1206728 - protein, 9 aa, Homo Sapiens
QVQLEQDEY

SEQ ID NO: 1206729 - protein, 9 aa, Homo Sapiens
IQDAPAVLT

SEQ ID NO: 1206730 - protein, 9 aa, Homo Sapiens
VLSMDSSRP

SEQ ID NO: 1206731 - protein, 9 aa, Homo Sapiens
RPDKSLTVS

SEQ ID NO: 1206732 - protein, 9 aa, Homo Sapiens
MADRRRWLR

SEQ ID NO: 1206733 - protein, 9 aa, Homo Sapiens
PTPEEATSP

SEQ ID NO: 1206734 - protein, 9 aa, Homo Sapiens
LSQGMSIYP

SEQ ID NO: 1206735 - protein, 9 aa, Homo Sapiens
QDAPAVLTN

SEQ ID NO: 1206736 - protein, 9 aa, Homo Sapiens
TGAEATAEP

SEQ ID NO: 1206737 - protein, 9 aa, Homo Sapiens
PIIQDAPAV

SEQ ID NO: 1206738 - protein, 9 aa, Homo Sapiens
CFLDKAAEQ

SEQ ID NO: 1206739 - protein, 9 aa, Homo Sapiens
DHSIRAQEP

SEQ ID NO: 1206740 - protein, 9 aa, Homo Sapiens
VTGAEATAE

SEQ ID NO: 1206741 - protein, 9 aa, Homo Sapiens
LPSNLSQGM

SEQ ID NO: 1206742 - protein, 9 aa, Homo Sapiens
PPMLFRIVR

SEQ ID NO: 1206743 - protein, 9 aa, Homo Sapiens
DAPAVLTNA

SEQ ID NO: 1206744 - protein, 9 aa, Homo Sapiens
PSNLSQGMS

SEQ ID NO: 1206745 - protein, 9 aa, Homo Sapiens
SNLSQGMSI

SEQ ID NO: 1206746 - protein, 9 aa, Homo Sapiens
LGKLSAKIC

SEQ ID NO: 1206747 - protein, 9 aa, Homo Sapiens
GKLSAKICL

SEQ ID NO: 1206748 - protein, 9 aa, Homo Sapiens
APAVLTNAV

SEQ ID NO: 1206749 - protein, 9 aa, Homo Sapiens
RWLRPGTLA

SEQ ID NO: 1206750 - protein, 9 aa, Homo Sapiens
RDVPGNEHA

SEQ ID NO: 1206751 - protein, 9 aa, Homo Sapiens
QELFQRSVL

SEQ ID NO: 1206752 - protein, 9 aa, Homo Sapiens
SVLTASSFQ

SEQ ID NO: 1206753 - protein, 9 aa, Homo Sapiens
DKSLTVSSP

SEQ ID NO: 1206754 - protein, 9 aa, Homo Sapiens
ISSMSMWSS

SEQ ID NO: 1206755 - protein, 9 aa, Homo Sapiens
LLACFLDKA

SEQ ID NO: 1206756 - protein, 9 aa, Homo Sapiens
CMHKGVHRR

SEQ ID NO: 1206757 - protein, 9 aa, Homo Sapiens
KICLSHNPL

SEQ ID NO: 1206758 - protein, 9 aa, Homo Sapiens
PMLFRIVRL

SEQ ID NO: 1206759 - protein, 9 aa, Homo Sapiens
EVDEDRVVM

SEQ ID NO: 1206760 - protein, 9 aa, Homo Sapiens
RKQVEIDCQ

SEQ ID NO: 1206761 - protein, 9 aa, Homo Sapiens
GAEATAEPM

SEQ ID NO: 1206762 - protein, 9 aa, Homo Sapiens
GQGPEEDSG

SEQ ID NO: 1206763 - protein, 9 aa, Homo Sapiens
KKDVTGAEA

SEQ ID NO: 1206764 - protein, 9 aa, Homo Sapiens
RVVMCSGPE

SEQ ID NO: 1206765 - protein, 9 aa, Homo Sapiens
DRRRWLRPG

SEQ ID NO: 1206766 - protein, 9 aa, Homo Sapiens
PEEATSPAA

SEQ ID NO: 1206767 - protein, 9 aa, Homo Sapiens
DCIRDVPGN

SEQ ID NO: 1206768 - protein, 9 aa, Homo Sapiens
RRRWLRPGT

SEQ ID NO: 1206769 - protein, 9 aa, Homo Sapiens
VDEDRVVMC

SEQ ID NO: 1206770 - protein, 9 aa, Homo Sapiens
SSRPLDMDS

SEQ ID NO: 1206771 - protein, 9 aa, Homo Sapiens
YRHGIAEAV

SEQ ID NO: 1206772 - protein, 9 aa, Homo Sapiens
HGIAEAVGL

SEQ ID NO: 1206773 - protein, 9 aa, Homo Sapiens
NLSQGMSIY

SEQ ID NO: 1206774 - protein, 9 aa, Homo Sapiens
KDHSIRAQE

SEQ ID NO: 1206775 - protein, 9 aa, Homo Sapiens
RCLLACFLD

SEQ ID NO: 1206776 - protein, 9 aa, Homo Sapiens
EDSGAGAKP

SEQ ID NO: 1206777 - protein, 9 aa, Homo Sapiens
DSYRKQVEI

SEQ ID NO: 1206778 - protein, 9 aa, Homo Sapiens
MSMWSSMVP

SEQ ID NO: 1206779 - protein, 9 aa, Homo Sapiens
ATSPAAAVP

SEQ ID NO: 1206780 - protein, 9 aa, Homo Sapiens
DSGAGAKPL

SEQ ID NO: 1206781 - protein, 9 aa, Homo Sapiens
PKKDVTGAE

SEQ ID NO: 1206782 - protein, 9 aa, Homo Sapiens
TKPEDCIRD

SEQ ID NO: 1206783 - protein, 9 aa, Homo Sapiens
GPEEDSGAG

SEQ ID NO: 1206784 - protein, 9 aa, Homo Sapiens
FTLRPGMRV

SEQ ID NO: 1206785 - protein, 9 aa, Homo Sapiens
LDTAGKEEY

SEQ ID NO: 1206786 - protein, 9 aa, Homo Sapiens
SQGMSIYPG

SEQ ID NO: 1206787 - protein, 9 aa, Homo Sapiens
EEVPGVFSR

SEQ ID NO: 1206788 - protein, 9 aa, Homo Sapiens
PPAPWSFLC

SEQ ID NO: 1206789 - protein, 9 aa, Homo Sapiens
QDEYAKHIK

SEQ ID NO: 1206790 - protein, 9 aa, Homo Sapiens
EDIAVVFTD

SEQ ID NO: 1206791 - protein, 9 aa, Homo Sapiens
AYRHGIAEA

SEQ ID NO: 1206792 - protein, 9 aa, Homo Sapiens
PFPPMLFRI

SEQ ID NO: 1206793 - protein, 9 aa, Homo Sapiens
EDRVVMCSG

SEQ ID NO: 1206794 - protein, 9 aa, Homo Sapiens
PAPWSFLCR

SEQ ID NO: 1206795 - protein, 9 aa, Homo Sapiens
AVMRCLLAC

SEQ ID NO: 1206796 - protein, 9 aa, Homo Sapiens
SNSSSSSTF

SEQ ID NO: 1206797 - protein, 9 aa, Homo Sapiens
KDVTGAEAT

SEQ ID NO: 1206798 - protein, 9 aa, Homo Sapiens
SAKICLSHN

SEQ ID NO: 1206799 - protein, 9 aa, Homo Sapiens
SLKQVQLEQ

SEQ ID NO: 1206800 - protein, 9 aa, Homo Sapiens
SMWSSMVPS

SEQ ID NO: 1206801 - protein, 9 aa, Homo Sapiens
SKDHSIRAQ

SEQ ID NO: 1206802 - protein, 9 aa, Homo Sapiens
VARGSKDHS

SEQ ID NO: 1206803 - protein, 9 aa, Homo Sapiens
VLPSNLSQG

SEQ ID NO: 1206804 - protein, 9 aa, Homo Sapiens
ELEEEENEE

SEQ ID NO: 1206805 - protein, 9 aa, Homo Sapiens
LRKDACSWS

SEQ ID NO: 1206806 - protein, 9 aa, Homo Sapiens
LLLRKDACS

SEQ ID NO: 1206807 - protein, 9 aa, Homo Sapiens
NKEHIFMEN

SEQ ID NO: 1206808 - protein, 9 aa, Homo Sapiens
KLSLPESLK

SEQ ID NO: 1206809 - protein, 9 aa, Homo Sapiens
LIYLGYYFG

SEQ ID NO: 1206810 - protein, 9 aa, Homo Sapiens
SLPLIYLGY

SEQ ID NO: 1206811 - protein, 9 aa, Homo Sapiens
LRPGTRAAF

SEQ ID NO: 1206812 - protein, 9 aa, Homo Sapiens
IMKLSLPES

SEQ ID NO: 1206813 - protein, 9 aa, Homo Sapiens
SEFCGELIS

SEQ ID NO: 1206814 - protein, 9 aa, Homo Sapiens
ESQLHLRCV

SEQ ID NO: 1206815 - protein, 9 aa, Homo Sapiens
PLFTLVANA

SEQ ID NO: 1206816 - protein, 9 aa, Homo Sapiens
LFLCCLLSP

SEQ ID NO: 1206817 - protein, 9 aa, Homo Sapiens
SSFIDVDIL

SEQ ID NO: 1206818 - protein, 9 aa, Homo Sapiens
LFTLVANAD

SEQ ID NO: 1206819 - protein, 9 aa, Homo Sapiens
NSIPQTRSS

SEQ ID NO: 1206820 - protein, 9 aa, Homo Sapiens
VSEQDSELL

SEQ ID NO: 1206821 - protein, 9 aa, Homo Sapiens
DSQYVSEQD

SEQ ID NO: 1206822 - protein, 9 aa, Homo Sapiens
FRPVSSFID

SEQ ID NO: 1206823 - protein, 9 aa, Homo Sapiens
FLFLCCLLS

SEQ ID NO: 1206824 - protein, 9 aa, Homo Sapiens
VMSFRERPY

SEQ ID NO: 1206825 - protein, 9 aa, Homo Sapiens
AVELEEEEN

SEQ ID NO: 1206826 - protein, 9 aa, Homo Sapiens
KYDMQILEE

SEQ ID NO: 1206827 - protein, 9 aa, Homo Sapiens
VVNKEHIFM

SEQ ID NO: 1206828 - protein, 9 aa, Homo Sapiens
QKNEFISEF

SEQ ID NO: 1206829 - protein, 9 aa, Homo Sapiens
LREKIMKLS

SEQ ID NO: 1206830 - protein, 9 aa, Homo Sapiens
ISEFCGELI

SEQ ID NO: 1206831 - protein, 9 aa, Homo Sapiens
FTLRPGTRA

SEQ ID NO: 1206832 - protein, 9 aa, Homo Sapiens
QSPLFTLVA

SEQ ID NO: 1206833 - protein, 9 aa, Homo Sapiens
YVSEQDSEL

SEQ ID NO: 1206834 - protein, 9 aa, Homo Sapiens
ESEEEEEER

SEQ ID NO: 1206835 - protein, 9 aa, Homo Sapiens
DSLDKYDMQ

SEQ ID NO: 1206836 - protein, 9 aa, Homo Sapiens
SEEEEEERV

SEQ ID NO: 1206837 - protein, 9 aa, Homo Sapiens
PSCNNRHFW

SEQ ID NO: 1206838 - protein, 9 aa, Homo Sapiens
LVANADIGN

SEQ ID NO: 1206839 - protein, 9 aa, Homo Sapiens
VESQLHLRC

SEQ ID NO: 1206840 - protein, 9 aa, Homo Sapiens
FLVVNKEHI

SEQ ID NO: 1206841 - protein, 9 aa, Homo Sapiens
VELEEEENE

SEQ ID NO: 1206842 - protein, 9 aa, Homo Sapiens
MWEVMSFRE

SEQ ID NO: 1206843 - protein, 9 aa, Homo Sapiens
GISLPLIYL

SEQ ID NO: 1206844 - protein, 9 aa, Homo Sapiens
SLDSLDKYD

SEQ ID NO: 1206845 - protein, 9 aa, Homo Sapiens
TLRPGTRAA

SEQ ID NO: 1206846 - protein, 9 aa, Homo Sapiens
KIMKLSLPE

SEQ ID NO: 1206847 - protein, 9 aa, Homo Sapiens
FRERPYWDM

SEQ ID NO: 1206848 - protein, 9 aa, Homo Sapiens
LPLIYLGYY

SEQ ID NO: 1206849 - protein, 9 aa, Homo Sapiens
CFLVESQLH

SEQ ID NO: 1206850 - protein, 9 aa, Homo Sapiens
WLWPRYLLL

SEQ ID NO: 1206851 - protein, 9 aa, Homo Sapiens
LSLPESLKA

SEQ ID NO: 1206852 - protein, 9 aa, Homo Sapiens
PRSKKKKLG

SEQ ID NO: 1206853 - protein, 9 aa, Homo Sapiens
LDSLDKYDM

SEQ ID NO: 1206854 - protein, 9 aa, Homo Sapiens
RWLWPRYLL

SEQ ID NO: 1206855 - protein, 9 aa, Homo Sapiens
FLVESQLHL

SEQ ID NO: 1206856 - protein, 9 aa, Homo Sapiens
SQYVSEQDS

SEQ ID NO: 1206857 - protein, 9 aa, Homo Sapiens
RKDACSWST

SEQ ID NO: 1206858 - protein, 9 aa, Homo Sapiens
EHIFMENVG

SEQ ID NO: 1206859 - protein, 9 aa, Homo Sapiens
TLVANADIG

SEQ ID NO: 1206860 - protein, 9 aa, Homo Sapiens
SLDKYDMQI

SEQ ID NO: 1206861 - protein, 9 aa, Homo Sapiens
IQNSIPQTR

SEQ ID NO: 1206862 - protein, 9 aa, Homo Sapiens
CCLLSPLLK

SEQ ID NO: 1206863 - protein, 9 aa, Homo Sapiens
RDVDSQYVS

SEQ ID NO: 1206864 - protein, 9 aa, Homo Sapiens
LVVNKEHIF

SEQ ID NO: 1206865 - protein, 9 aa, Homo Sapiens
QNSIPQTRS

SEQ ID NO: 1206866 - protein, 9 aa, Homo Sapiens
YDMQILEER

SEQ ID NO: 1206867 - protein, 9 aa, Homo Sapiens
LLRKDACSW

SEQ ID NO: 1206868 - protein, 9 aa, Homo Sapiens
LHLRCVKFQ

SEQ ID NO: 1206869 - protein, 9 aa, Homo Sapiens
ERWLWPRYL

SEQ ID NO: 1206870 - protein, 9 aa, Homo Sapiens
REKIMKLSL

SEQ ID NO: 1206871 - protein, 9 aa, Homo Sapiens
WFGISLPLI

SEQ ID NO: 1206872 - protein, 9 aa, Homo Sapiens
FLCCLLSPL

SEQ ID NO: 1206873 - protein, 9 aa, Homo Sapiens
VDSQYVSEQ

SEQ ID NO: 1206874 - protein, 9 aa, Homo Sapiens
TGQFYDRVS

SEQ ID NO: 1206875 - protein, 9 aa, Homo Sapiens
LVESQLHLR

SEQ ID NO: 1206876 - protein, 9 aa, Homo Sapiens
PVSSFIDVD

SEQ ID NO: 1206877 - protein, 9 aa, Homo Sapiens
VMWEVMSFR

SEQ ID NO: 1206878 - protein, 9 aa, Homo Sapiens
IQSPLFTLV

SEQ ID NO: 1206879 - protein, 9 aa, Homo Sapiens
HIFMENVGA

SEQ ID NO: 1206880 - protein, 9 aa, Homo Sapiens
EKIMKLSLP

SEQ ID NO: 1206881 - protein, 9 aa, Homo Sapiens
MKLSLPESL

SEQ ID NO: 1206882 - protein, 9 aa, Homo Sapiens
WEVMSFRER

SEQ ID NO: 1206883 - protein, 9 aa, Homo Sapiens
SFIDVDILP

SEQ ID NO: 1206884 - protein, 9 aa, Homo Sapiens
SCLPSCNNR

SEQ ID NO: 1206885 - protein, 9 aa, Homo Sapiens
FIDVDILPE

SEQ ID NO: 1206886 - protein, 9 aa, Homo Sapiens
EPTVLPERW

SEQ ID NO: 1206887 - protein, 9 aa, Homo Sapiens
LPSCNNRHF

SEQ ID NO: 1206888 - protein, 9 aa, Homo Sapiens
RPVSSFIDV

SEQ ID NO: 1206889 - protein, 9 aa, Homo Sapiens
ISLPLIYLG

SEQ ID NO: 1206890 - protein, 9 aa, Homo Sapiens
SKKKKLGAG

SEQ ID NO: 1206891 - protein, 9 aa, Homo Sapiens
LCCLLSPLL

SEQ ID NO: 1206892 - protein, 9 aa, Homo Sapiens
KNEFISEFC

SEQ ID NO: 1206893 - protein, 9 aa, Homo Sapiens
VSSFIDVDI

SEQ ID NO: 1206894 - protein, 9 aa, Homo Sapiens
MSFRERPYW

SEQ ID NO: 1206895 - protein, 9 aa, Homo Sapiens
SLPESLKAY

SEQ ID NO: 1206896 - protein, 9 aa, Homo Sapiens
LDKYDMQIL

SEQ ID NO: 1206897 - protein, 9 aa, Homo Sapiens
PERWLWPRY

SEQ ID NO: 1206898 - protein, 9 aa, Homo Sapiens
FTLVANADI

SEQ ID NO: 1206899 - protein, 9 aa, Homo Sapiens
VANADIGNG

SEQ ID NO: 1206900 - protein, 9 aa, Homo Sapiens
SIPQTRSSC

SEQ ID NO: 1206901 - protein, 9 aa, Homo Sapiens
LPERWLWPR

SEQ ID NO: 1206902 - protein, 9 aa, Homo Sapiens
PGTRAAFCY

SEQ ID NO: 1206903 - protein, 9 aa, Homo Sapiens
NFLVVNKEH

SEQ ID NO: 1206904 - protein, 9 aa, Homo Sapiens
FGISLPLIY

SEQ ID NO: 1206905 - protein, 9 aa, Homo Sapiens
DKYDMQILE

SEQ ID NO: 1206906 - protein, 9 aa, Homo Sapiens
PLIYLGYYF

SEQ ID NO: 1206907 - protein, 9 aa, Homo Sapiens
VNKEHIFME

SEQ ID NO: 1206908 - protein, 9 aa, Homo Sapiens
VLPERWLWP

SEQ ID NO: 1206909 - protein, 9 aa, Homo Sapiens
NEFISEFCG

SEQ ID NO: 1206910 - protein, 9 aa, Homo Sapiens
EVMSFRERP

SEQ ID NO: 1206911 - protein, 9 aa, Homo Sapiens
ITGQFYDRV

SEQ ID NO: 1206912 - protein, 9 aa, Homo Sapiens
EFISEFCGE

SEQ ID NO: 1206913 - protein, 9 aa, Homo Sapiens
CLPSCNNRH

SEQ ID NO: 1206914 - protein, 9 aa, Homo Sapiens
RERPYWDMS

SEQ ID NO: 1206915 - protein, 9 aa, Homo Sapiens
KEHIFMENV

SEQ ID NO: 1206916 - protein, 9 aa, Homo Sapiens
NLLLRKDAC

SEQ ID NO: 1206917 - protein, 9 aa, Homo Sapiens
QYVSEQDSE

SEQ ID NO: 1206918 - protein, 9 aa, Homo Sapiens
DACSWSTGM

SEQ ID NO: 1206919 - protein, 9 aa, Homo Sapiens
KDACSWSTG

SEQ ID NO: 1206920 - protein, 9 aa, Homo Sapiens
RSKKKKLGA

SEQ ID NO: 1206921 - protein, 9 aa, Homo Sapiens
SQLHLRCVK

SEQ ID NO: 1206922 - protein, 9 aa, Homo Sapiens
GTRAAFCYQ

SEQ ID NO: 1206923 - protein, 9 aa, Homo Sapiens
DFFLFLCCL

SEQ ID NO: 1206924 - protein, 9 aa, Homo Sapiens
QDFRPVSSF

SEQ ID NO: 1206925 - protein, 9 aa, Homo Sapiens
TRDVDSQYV

SEQ ID NO: 1206926 - protein, 9 aa, Homo Sapiens
TRAAFCYQI

SEQ ID NO: 1206927 - protein, 9 aa, Homo Sapiens
TVLPERWLW

SEQ ID NO: 1206928 - protein, 9 aa, Homo Sapiens
LEEEENEEE

SEQ ID NO: 1206929 - protein, 9 aa, Homo Sapiens
RSLDSLDKY

SEQ ID NO: 1206930 - protein, 9 aa, Homo Sapiens
FCGELISQD

SEQ ID NO: 1206931 - protein, 9 aa, Homo Sapiens
TPRSKKKKL

SEQ ID NO: 1206932 - protein, 9 aa, Homo Sapiens
RPGTRAAFC

SEQ ID NO: 1206933 - protein, 9 aa, Homo Sapiens
HLRCVKFQE

SEQ ID NO: 1206934 - protein, 9 aa, Homo Sapiens
ACSWSTGMQ

SEQ ID NO: 1206935 - protein, 9 aa, Homo Sapiens
PTVLPERWL

SEQ ID NO: 1206936 - protein, 9 aa, Homo Sapiens
DFRPVSSFI

SEQ ID NO: 1206937 - protein, 9 aa, Homo Sapiens
SPLFTLVAN

SEQ ID NO: 1206938 - protein, 9 aa, Homo Sapiens
EFCGELISQ

SEQ ID NO: 1206939 - protein, 9 aa, Homo Sapiens
FISEFCGEL

SEQ ID NO: 1206940 - protein, 9 aa, Homo Sapiens
PDFFLFLCC

SEQ ID NO: 1206941 - protein, 9 aa, Homo Sapiens
SFRERPYWD

SEQ ID NO: 1206942 - protein, 9 aa, Homo Sapiens
FFLFLCCLL

SEQ ID NO: 1206943 - protein, 9 aa, Homo Sapiens
CLLSPLLKA

SEQ ID NO: 1206944 - protein, 9 aa, Homo Sapiens
QLHLRCVKF

SEQ ID NO: 1206945 - protein, 9 aa, Homo Sapiens
NNLLLRKDA

SEQ ID NO: 1206946 - protein, 9 aa, Homo Sapiens
IYLGYYFGF

SEQ ID NO: 1206947 - protein, 9 aa, Homo Sapiens
DVDSQYVSE

SEQ ID NO: 1206948 - protein, 9 aa, Homo Sapiens
LRRAPDGAA

SEQ ID NO: 1206949 - protein, 9 aa, Homo Sapiens
VDMDDKDNA

SEQ ID NO: 1206950 - protein, 9 aa, Homo Sapiens
SGYSSYSLR

SEQ ID NO: 1206951 - protein, 9 aa, Homo Sapiens
ELQISFKNY

SEQ ID NO: 1206952 - protein, 9 aa, Homo Sapiens
SLRRAPDGA

SEQ ID NO: 1206953 - protein, 9 aa, Homo Sapiens
DMDDKDNAH

SEQ ID NO: 1206954 - protein, 9 aa, Homo Sapiens
GYSSYSLRR

SEQ ID NO: 1206955 - protein, 9 aa, Homo Sapiens
LQISFKNYD

SEQ ID NO: 1206956 - protein, 9 aa, Homo Sapiens
TVELQISFK

SEQ ID NO: 1206957 - protein, 9 aa, Homo Sapiens
EDRSREERL

SEQ ID NO: 1206958 - protein, 9 aa, Homo Sapiens
YSLRRAPDG

SEQ ID NO: 1206959 - protein, 9 aa, Homo Sapiens
DEEEEEDRS

SEQ ID NO: 1206960 - protein, 9 aa, Homo Sapiens
ETVELQISF

SEQ ID NO: 1206961 - protein, 9 aa, Homo Sapiens
EEEEEDRSR

SEQ ID NO: 1206962 - protein, 9 aa, Homo Sapiens
SYSLRRAPD

SEQ ID NO: 1206963 - protein, 9 aa, Homo Sapiens
QISFKNYDP

SEQ ID NO: 1206964 - protein, 9 aa, Homo Sapiens
RRAPDGAAL

SEQ ID NO: 1206965 - protein, 9 aa, Homo Sapiens
DDKDNAHYA

SEQ ID NO: 1206966 - protein, 9 aa, Homo Sapiens
DRSREERLP

SEQ ID NO: 1206967 - protein, 9 aa, Homo Sapiens
VELQISFKN

SEQ ID NO: 1206968 - protein, 9 aa, Homo Sapiens
KAIPGEGRK

SEQ ID NO: 1206969 - protein, 9 aa, Homo Sapiens
RSREERLPS

SEQ ID NO: 1206970 - protein, 9 aa, Homo Sapiens
NAHYAVQAR

SEQ ID NO: 1206971 - protein, 9 aa, Homo Sapiens
DKDNAHYAV

SEQ ID NO: 1206972 - protein, 9 aa, Homo Sapiens
EEDRSREER

SEQ ID NO: 1206973 - protein, 9 aa, Homo Sapiens
RLWLKRKAI

SEQ ID NO: 1206974 - protein, 9 aa, Homo Sapiens
RLRLWLKRK

SEQ ID NO: 1206975 - protein, 9 aa, Homo Sapiens
KDNAHYAVQ

SEQ ID NO: 1206976 - protein, 9 aa, Homo Sapiens
WLKRKAIPG

SEQ ID NO: 1206977 - protein, 9 aa, Homo Sapiens
KRKAIPGEG

SEQ ID NO: 1206978 - protein, 9 aa, Homo Sapiens
LWLKRKAIP

SEQ ID NO: 1206979 - protein, 9 aa, Homo Sapiens
LRLWLKRKA

SEQ ID NO: 1206980 - protein, 9 aa, Homo Sapiens
GVDMDDKDN

SEQ ID NO: 1206981 - protein, 9 aa, Homo Sapiens
YSSYSLRRA

SEQ ID NO: 1206982 - protein, 9 aa, Homo Sapiens
EEEDRSREE

SEQ ID NO: 1206983 - protein, 9 aa, Homo Sapiens
EEEEDRSRE

SEQ ID NO: 1206984 - protein, 9 aa, Homo Sapiens
SSYSLRRAP

SEQ ID NO: 1206985 - protein, 9 aa, Homo Sapiens
GDEEEEEDR

SEQ ID NO: 1206986 - protein, 9 aa, Homo Sapiens
FKNYDPQKD

SEQ ID NO: 1206987 - protein, 9 aa, Homo Sapiens
LKRKAIPGE

SEQ ID NO: 1206988 - protein, 9 aa, Homo Sapiens
MDDKDNAHY

SEQ ID NO: 1206989 - protein, 9 aa, Homo Sapiens
DNAHYAVQA

SEQ ID NO: 1206990 - protein, 9 aa, Homo Sapiens
ISFKNYDPQ

SEQ ID NO: 1206991 - protein, 9 aa, Homo Sapiens
RKAIPGEGR

SEQ ID NO: 1206992 - protein, 9 aa, Homo Sapiens
SFKNYDPQK

SEQ ID NO: 1206993 - protein, 9 aa, Homo Sapiens
LQDSQDRCY

SEQ ID NO: 1206994 - protein, 9 aa, Homo Sapiens
VLQDSQDRC

SEQ ID NO: 1206995 - protein, 9 aa, Homo Sapiens
IYEGKSEKS

SEQ ID NO: 1206996 - protein, 9 aa, Homo Sapiens
VQSLPAEGA

SEQ ID NO: 1206997 - protein, 9 aa, Homo Sapiens
IFIYEGKSE

SEQ ID NO: 1206998 - protein, 9 aa, Homo Sapiens
TAKKKIFKI

SEQ ID NO: 1206999 - protein, 9 aa, Homo Sapiens
KIFIYEGKS

SEQ ID NO: 1207000 - protein, 9 aa, Homo Sapiens
EVLQDSQDR

SEQ ID NO: 1207001 - protein, 9 aa, Homo Sapiens
KKIFKIFIY

SEQ ID NO: 1207002 - protein, 9 aa, Homo Sapiens
QKAPIEVQS

SEQ ID NO: 1207003 - protein, 9 aa, Homo Sapiens
IFKIFIYEG

SEQ ID NO: 1207004 - protein, 9 aa, Homo Sapiens
EPEVLQDSQ

SEQ ID NO: 1207005 - protein, 9 aa, Homo Sapiens
PIEVQSLPA

SEQ ID NO: 1207006 - protein, 9 aa, Homo Sapiens
EVQSLPAEG

SEQ ID NO: 1207007 - protein, 9 aa, Homo Sapiens
SLPAEGALE

SEQ ID NO: 1207008 - protein, 9 aa, Homo Sapiens
QSLPAEGAL

SEQ ID NO: 1207009 - protein, 9 aa, Homo Sapiens
AKKKIFKIF

SEQ ID NO: 1207010 - protein, 9 aa, Homo Sapiens
IEVQSLPAE

SEQ ID NO: 1207011 - protein, 9 aa, Homo Sapiens
FKIFIYEGK

SEQ ID NO: 1207012 - protein, 9 aa, Homo Sapiens
FIYEGKSEK

SEQ ID NO: 1207013 - protein, 9 aa, Homo Sapiens
PEVLQDSQD

SEQ ID NO: 1207014 - protein, 9 aa, Homo Sapiens
KAPIEVQSL

SEQ ID NO: 1207015 - protein, 9 aa, Homo Sapiens
KIFKIFIYE

SEQ ID NO: 1207016 - protein, 9 aa, Homo Sapiens
SNTAKKKIF

SEQ ID NO: 1207017 - protein, 9 aa, Homo Sapiens
KKKIFKIFI

SEQ ID NO: 1207018 - protein, 9 aa, Homo Sapiens
VSNTAKKKI

SEQ ID NO: 1207019 - protein, 9 aa, Homo Sapiens
APIEVQSLP

SEQ ID NO: 1207020 - protein, 9 aa, Homo Sapiens
NTAKKKIFK

SEQ ID NO: 1207021 - protein, 9 aa, Homo Sapiens
KNTSQVSLH

SEQ ID NO: 1207022 - protein, 9 aa, Homo Sapiens
PSDVDGMIT

SEQ ID NO: 1207023 - protein, 9 aa, Homo Sapiens
SHANAIEKW

SEQ ID NO: 1207024 - protein, 9 aa, Homo Sapiens
SVVFGVIGF

SEQ ID NO: 1207025 - protein, 9 aa, Homo Sapiens
VRTGERGAG

SEQ ID NO: 1207026 - protein, 9 aa, Homo Sapiens
LRHLSLKNA

SEQ ID NO: 1207027 - protein, 9 aa, Homo Sapiens
SHVCSRTPV

SEQ ID NO: 1207028 - protein, 9 aa, Homo Sapiens
ITGFRGMPG

SEQ ID NO: 1207029 - protein, 9 aa, Homo Sapiens
FFPQKVSEL

SEQ ID NO: 1207030 - protein, 9 aa, Homo Sapiens
VSELHRATE

SEQ ID NO: 1207031 - protein, 9 aa, Homo Sapiens
CLRIPPPGT

SEQ ID NO: 1207032 - protein, 9 aa, Homo Sapiens
PPSDVDGMI

SEQ ID NO: 1207033 - protein, 9 aa, Homo Sapiens
TSQVSLHRF

SEQ ID NO: 1207034 - protein, 9 aa, Homo Sapiens
RNYLRKTRD

SEQ ID NO: 1207035 - protein, 9 aa, Homo Sapiens
TVVSVVFGV

SEQ ID NO: 1207036 - protein, 9 aa, Homo Sapiens
VFAGLLILA

SEQ ID NO: 1207037 - protein, 9 aa, Homo Sapiens
QREFDFINK

SEQ ID NO: 1207038 - protein, 9 aa, Homo Sapiens
SWVRTGERG

SEQ ID NO: 1207039 - protein, 9 aa, Homo Sapiens
FNLKNTSQV

SEQ ID NO: 1207040 - protein, 9 aa, Homo Sapiens
NLKNTSQVS

SEQ ID NO: 1207041 - protein, 9 aa, Homo Sapiens
AAGPRWAVP

SEQ ID NO: 1207042 - protein, 9 aa, Homo Sapiens
DLRHLSLKN

SEQ ID NO: 1207043 - protein, 9 aa, Homo Sapiens
TLTVVSVVF

SEQ ID NO: 1207044 - protein, 9 aa, Homo Sapiens
RGSRTAAGP

SEQ ID NO: 1207045 - protein, 9 aa, Homo Sapiens
CQQKNHFQV

SEQ ID NO: 1207046 - protein, 9 aa, Homo Sapiens
ADLRHLSLK

SEQ ID NO: 1207047 - protein, 9 aa, Homo Sapiens
QKVSELHRA

SEQ ID NO: 1207048 - protein, 9 aa, Homo Sapiens
TLRGSRTAA

SEQ ID NO: 1207049 - protein, 9 aa, Homo Sapiens
ELHRATESH

SEQ ID NO: 1207050 - protein, 9 aa, Homo Sapiens
PRWAVPVHV

SEQ ID NO: 1207051 - protein, 9 aa, Homo Sapiens
SRTAAGPRW

SEQ ID NO: 1207052 - protein, 9 aa, Homo Sapiens
YQREFDFIN

SEQ ID NO: 1207053 - protein, 9 aa, Homo Sapiens
QEECRNYLR

SEQ ID NO: 1207054 - protein, 9 aa, Homo Sapiens
KYKKKKELQ

SEQ ID NO: 1207055 - protein, 9 aa, Homo Sapiens
GSSGITGFR

SEQ ID NO: 1207056 - protein, 9 aa, Homo Sapiens
HVCSRTPVE

SEQ ID NO: 1207057 - protein, 9 aa, Homo Sapiens
DVSSHANAI

SEQ ID NO: 1207058 - protein, 9 aa, Homo Sapiens
IPPPGTLRG

SEQ ID NO: 1207059 - protein, 9 aa, Homo Sapiens
LFFFFPQKV

SEQ ID NO: 1207060 - protein, 9 aa, Homo Sapiens
GIIVANGPE

SEQ ID NO: 1207061 - protein, 9 aa, Homo Sapiens
ALEHLVVWR

SEQ ID NO: 1207062 - protein, 9 aa, Homo Sapiens
DAFVCQQKN

SEQ ID NO: 1207063 - protein, 9 aa, Homo Sapiens
ILAYAVEVA

SEQ ID NO: 1207064 - protein, 9 aa, Homo Sapiens
GTLRGSRTA

SEQ ID NO: 1207065 - protein, 9 aa, Homo Sapiens
VFGVIGFMT

SEQ ID NO: 1207066 - protein, 9 aa, Homo Sapiens
EPAHHPGCQ

SEQ ID NO: 1207067 - protein, 9 aa, Homo Sapiens
TATSWVRTG

SEQ ID NO: 1207068 - protein, 9 aa, Homo Sapiens
GPEGLLATV

SEQ ID NO: 1207069 - protein, 9 aa, Homo Sapiens
GITGFRGMP

SEQ ID NO: 1207070 - protein, 9 aa, Homo Sapiens
YADVSSHAN

SEQ ID NO: 1207071 - protein, 9 aa, Homo Sapiens
FPILFFFFP

SEQ ID NO: 1207072 - protein, 9 aa, Homo Sapiens
HRATESHRC

SEQ ID NO: 1207073 - protein, 9 aa, Homo Sapiens
ILFFFFPQK

SEQ ID NO: 1207074 - protein, 9 aa, Homo Sapiens
FPQKVSELH

SEQ ID NO: 1207075 - protein, 9 aa, Homo Sapiens
SQVSLHRFE

SEQ ID NO: 1207076 - protein, 9 aa, Homo Sapiens
EFDFINKIT

SEQ ID NO: 1207077 - protein, 9 aa, Homo Sapiens
NYADVSSHA

SEQ ID NO: 1207078 - protein, 9 aa, Homo Sapiens
TDADLRHLS

SEQ ID NO: 1207079 - protein, 9 aa, Homo Sapiens
RGMPGESGS

SEQ ID NO: 1207080 - protein, 9 aa, Homo Sapiens
VWRVHSEDQ

SEQ ID NO: 1207081 - protein, 9 aa, Homo Sapiens
VCSRTPVET

SEQ ID NO: 1207082 - protein, 9 aa, Homo Sapiens
TESHRCLRI

SEQ ID NO: 1207083 - protein, 9 aa, Homo Sapiens
GTATSWVRT

SEQ ID NO: 1207084 - protein, 9 aa, Homo Sapiens
SSGITGFRG

SEQ ID NO: 1207085 - protein, 9 aa, Homo Sapiens
VSFNLKNTS

SEQ ID NO: 1207086 - protein, 9 aa, Homo Sapiens
FFFFPQKVS

SEQ ID NO: 1207087 - protein, 9 aa, Homo Sapiens
GFRGMPGES

SEQ ID NO: 1207088 - protein, 9 aa, Homo Sapiens
GLLLLLLVT

SEQ ID NO: 1207089 - protein, 9 aa, Homo Sapiens
WAVPVHVPG

SEQ ID NO: 1207090 - protein, 9 aa, Homo Sapiens
GLLILAYAV

SEQ ID NO: 1207091 - protein, 9 aa, Homo Sapiens
DADLRHLSL

SEQ ID NO: 1207092 - protein, 9 aa, Homo Sapiens
ADVSSHANA

SEQ ID NO: 1207093 - protein, 9 aa, Homo Sapiens
VVFGVIGFM

SEQ ID NO: 1207094 - protein, 9 aa, Homo Sapiens
WRVHSEDQS

SEQ ID NO: 1207095 - protein, 9 aa, Homo Sapiens
YKKKKELQG

SEQ ID NO: 1207096 - protein, 9 aa, Homo Sapiens
LVVWRVHSE

SEQ ID NO: 1207097 - protein, 9 aa, Homo Sapiens
IIVANGPEG

SEQ ID NO: 1207098 - protein, 9 aa, Homo Sapiens
ESHRCLRIP

SEQ ID NO: 1207099 - protein, 9 aa, Homo Sapiens
RVHSEDQSF

SEQ ID NO: 1207100 - protein, 9 aa, Homo Sapiens
GCSHVCSRT

SEQ ID NO: 1207101 - protein, 9 aa, Homo Sapiens
GSRTAAGPR

SEQ ID NO: 1207102 - protein, 9 aa, Homo Sapiens
QQKNHFQVT

SEQ ID NO: 1207103 - protein, 9 aa, Homo Sapiens
RHLSLKNAK

SEQ ID NO: 1207104 - protein, 9 aa, Homo Sapiens
HANAIEKWV

SEQ ID NO: 1207105 - protein, 9 aa, Homo Sapiens
CRNYLRKTR

SEQ ID NO: 1207106 - protein, 9 aa, Homo Sapiens
PQKVSELHR

SEQ ID NO: 1207107 - protein, 9 aa, Homo Sapiens
TGTDADLRH

SEQ ID NO: 1207108 - protein, 9 aa, Homo Sapiens
QGTATSWVR

SEQ ID NO: 1207109 - protein, 9 aa, Homo Sapiens
QLLGCSHVC

SEQ ID NO: 1207110 - protein, 9 aa, Homo Sapiens
RATESHRCL

SEQ ID NO: 1207111 - protein, 9 aa, Homo Sapiens
ATESHRCLR

SEQ ID NO: 1207112 - protein, 9 aa, Homo Sapiens
FVCQQKNHF

SEQ ID NO: 1207113 - protein, 9 aa, Homo Sapiens
AQLLGCSHV

SEQ ID NO: 1207114 - protein, 9 aa, Homo Sapiens
PPGTLRGSR

SEQ ID NO: 1207115 - protein, 9 aa, Homo Sapiens
AFVCQQKNH

SEQ ID NO: 1207116 - protein, 9 aa, Homo Sapiens
REFDFINKI

SEQ ID NO: 1207117 - protein, 9 aa, Homo Sapiens
RCLRIPPPG

SEQ ID NO: 1207118 - protein, 9 aa, Homo Sapiens
MSCGRPPSD

SEQ ID NO: 1207119 - protein, 9 aa, Homo Sapiens
NGPEGLLAT

SEQ ID NO: 1207120 - protein, 9 aa, Homo Sapiens
AGLLILAYA

SEQ ID NO: 1207121 - protein, 9 aa, Homo Sapiens
PILFFFFPQ

SEQ ID NO: 1207122 - protein, 9 aa, Homo Sapiens
LILAYAVEV

SEQ ID NO: 1207123 - protein, 9 aa, Homo Sapiens
RIPPPGTLR

SEQ ID NO: 1207124 - protein, 9 aa, Homo Sapiens
GQGTATSWV

SEQ ID NO: 1207125 - protein, 9 aa, Homo Sapiens
TAAGPRWAV

SEQ ID NO: 1207126 - protein, 9 aa, Homo Sapiens
SCGRPPSDV

SEQ ID NO: 1207127 - protein, 9 aa, Homo Sapiens
LKNTSQVSL

SEQ ID NO: 1207128 - protein, 9 aa, Homo Sapiens
VANGPEGLL

SEQ ID NO: 1207129 - protein, 9 aa, Homo Sapiens
VVSVVFGVI

SEQ ID NO: 1207130 - protein, 9 aa, Homo Sapiens
LRGSRTAAG

SEQ ID NO: 1207131 - protein, 9 aa, Homo Sapiens
KVSELHRAT

SEQ ID NO: 1207132 - protein, 9 aa, Homo Sapiens
LLGCSHVCS

SEQ ID NO: 1207133 - protein, 9 aa, Homo Sapiens
SDVDGMITL

SEQ ID NO: 1207134 - protein, 9 aa, Homo Sapiens
IVANGPEGL

SEQ ID NO: 1207135 - protein, 9 aa, Homo Sapiens
MNYADVSSH

SEQ ID NO: 1207136 - protein, 9 aa, Homo Sapiens
EHLVVWRVH

SEQ ID NO: 1207137 - protein, 9 aa, Homo Sapiens
ECRNYLRKT

SEQ ID NO: 1207138 - protein, 9 aa, Homo Sapiens
CSHVCSRTP

SEQ ID NO: 1207139 - protein, 9 aa, Homo Sapiens
LTVVSVVFG

SEQ ID NO: 1207140 - protein, 9 aa, Homo Sapiens
ANGPEGLLA

SEQ ID NO: 1207141 - protein, 9 aa, Homo Sapiens
FFFPQKVSE

SEQ ID NO: 1207142 - protein, 9 aa, Homo Sapiens
RPPSDVDGM

SEQ ID NO: 1207143 - protein, 9 aa, Homo Sapiens
SGITGFRGM

SEQ ID NO: 1207144 - protein, 9 aa, Homo Sapiens
FDFINKITN

SEQ ID NO: 1207145 - protein, 9 aa, Homo Sapiens
AGPRWAVPV

SEQ ID NO: 1207146 - protein, 9 aa, Homo Sapiens
VCQQKNHFQ

SEQ ID NO: 1207147 - protein, 9 aa, Homo Sapiens
FYQREFDFI

SEQ ID NO: 1207148 - protein, 9 aa, Homo Sapiens
GEPAHHPGC

SEQ ID NO: 1207149 - protein, 9 aa, Homo Sapiens
HRCLRIPPP

SEQ ID NO: 1207150 - protein, 9 aa, Homo Sapiens
RKYKKKKEL

SEQ ID NO: 1207151 - protein, 9 aa, Homo Sapiens
GRPPSDVDG

SEQ ID NO: 1207152 - protein, 9 aa, Homo Sapiens
TSWVRTGER

SEQ ID NO: 1207153 - protein, 9 aa, Homo Sapiens
LGCSHVCSR

SEQ ID NO: 1207154 - protein, 9 aa, Homo Sapiens
GPRWAVPVH

SEQ ID NO: 1207155 - protein, 9 aa, Homo Sapiens
QKNHFQVTV

SEQ ID NO: 1207156 - protein, 9 aa, Homo Sapiens
PPPGTLRGS

SEQ ID NO: 1207157 - protein, 9 aa, Homo Sapiens
WVRTGERGA

SEQ ID NO: 1207158 - protein, 9 aa, Homo Sapiens
ITLTVVSVV

SEQ ID NO: 1207159 - protein, 9 aa, Homo Sapiens
PRKYKKKKE

SEQ ID NO: 1207160 - protein, 9 aa, Homo Sapiens
SSHANAIEK

SEQ ID NO: 1207161 - protein, 9 aa, Homo Sapiens
INKITNVSA

SEQ ID NO: 1207162 - protein, 9 aa, Homo Sapiens
SVFAGLLIL

SEQ ID NO: 1207163 - protein, 9 aa, Homo Sapiens
PAHHPGCQL

SEQ ID NO: 1207164 - protein, 9 aa, Homo Sapiens
LRIPPPGTL

SEQ ID NO: 1207165 - protein, 9 aa, Homo Sapiens
LIGIIVANG

SEQ ID NO: 1207166 - protein, 9 aa, Homo Sapiens
SELHRATES

SEQ ID NO: 1207167 - protein, 9 aa, Homo Sapiens
FAGLLILAY

SEQ ID NO: 1207168 - protein, 9 aa, Homo Sapiens
VVWRVHSED

SEQ ID NO: 1207169 - protein, 9 aa, Homo Sapiens
IGIIVANGP

SEQ ID NO: 1207170 - protein, 9 aa, Homo Sapiens
RWAVPVHVP

SEQ ID NO: 1207171 - protein, 9 aa, Homo Sapiens
VSSHANAIE

SEQ ID NO: 1207172 - protein, 9 aa, Homo Sapiens
SFNLKNTSQ

SEQ ID NO: 1207173 - protein, 9 aa, Homo Sapiens
DFINKITNV

SEQ ID NO: 1207174 - protein, 9 aa, Homo Sapiens
TGFRGMPGE

SEQ ID NO: 1207175 - protein, 9 aa, Homo Sapiens
GDDAFVCQQ

SEQ ID NO: 1207176 - protein, 9 aa, Homo Sapiens
ATSWVRTGE

SEQ ID NO: 1207177 - protein, 9 aa, Homo Sapiens
CGRPPSDVD

SEQ ID NO: 1207178 - protein, 9 aa, Homo Sapiens
GGLLLLLLV

SEQ ID NO: 1207179 - protein, 9 aa, Homo Sapiens
FRGMPGESG

SEQ ID NO: 1207180 - protein, 9 aa, Homo Sapiens
HLSLKNAKQ

SEQ ID NO: 1207181 - protein, 9 aa, Homo Sapiens
LLILAYAVE

SEQ ID NO: 1207182 - protein, 9 aa, Homo Sapiens
HLVVWRVHS

SEQ ID NO: 1207183 - protein, 9 aa, Homo Sapiens
PGTLRGSRT

SEQ ID NO: 1207184 - protein, 9 aa, Homo Sapiens
RTAAGPRWA

SEQ ID NO: 1207185 - protein, 9 aa, Homo Sapiens
LEHLVVWRV

SEQ ID NO: 1207186 - protein, 9 aa, Homo Sapiens
ASVFAGLLI

SEQ ID NO: 1207187 - protein, 9 aa, Homo Sapiens
LHRATESHR

SEQ ID NO: 1207188 - protein, 9 aa, Homo Sapiens
VSVVFGVIG

SEQ ID NO: 1207189 - protein, 9 aa, Homo Sapiens
GTDADLRHL

SEQ ID NO: 1207190 - protein, 9 aa, Homo Sapiens
FINKITNVS

SEQ ID NO: 1207191 - protein, 9 aa, Homo Sapiens
DDAFVCQQK

SEQ ID NO: 1207192 - protein, 9 aa, Homo Sapiens
SHRCLRIPP

SEQ ID NO: 1207193 - protein, 9 aa, Homo Sapiens
EECRNYLRK

SEQ ID NO: 1207194 - protein, 9 aa, Homo Sapiens
APESLEVLI

SEQ ID NO: 1207195 - protein, 9 aa, Homo Sapiens
HTRAGQRTR

SEQ ID NO: 1207196 - protein, 9 aa, Homo Sapiens
MKEGECSTR

SEQ ID NO: 1207197 - protein, 9 aa, Homo Sapiens
FYDPETGNY

SEQ ID NO: 1207198 - protein, 9 aa, Homo Sapiens
QTACKSTGG

SEQ ID NO: 1207199 - protein, 9 aa, Homo Sapiens
REEYSAMRD

SEQ ID NO: 1207200 - protein, 9 aa, Homo Sapiens
LDILDTAGR

SEQ ID NO: 1207201 - protein, 9 aa, Homo Sapiens
TACKSTGGK

SEQ ID NO: 1207202 - protein, 9 aa, Homo Sapiens
SPGLLCQGP

SEQ ID NO: 1207203 - protein, 9 aa, Homo Sapiens
CSFPHNFVL

SEQ ID NO: 1207204 - protein, 9 aa, Homo Sapiens
KRCFARCLP

SEQ ID NO: 1207205 - protein, 9 aa, Homo Sapiens
TQCEKISTL

SEQ ID NO: 1207206 - protein, 9 aa, Homo Sapiens
LEWWHVQPT

SEQ ID NO: 1207207 - protein, 9 aa, Homo Sapiens
DRLCEETQC

SEQ ID NO: 1207208 - protein, 9 aa, Homo Sapiens
VKTVTTWTV

SEQ ID NO: 1207209 - protein, 9 aa, Homo Sapiens
ACKSTGGKA

SEQ ID NO: 1207210 - protein, 9 aa, Homo Sapiens
PHNFVLLVQ

SEQ ID NO: 1207211 - protein, 9 aa, Homo Sapiens
NIPTAECLD

SEQ ID NO: 1207212 - protein, 9 aa, Homo Sapiens
TNIPSSVPP

SEQ ID NO: 1207213 - protein, 9 aa, Homo Sapiens
SARGIRGAR

SEQ ID NO: 1207214 - protein, 9 aa, Homo Sapiens
RCFARCLPE

SEQ ID NO: 1207215 - protein, 9 aa, Homo Sapiens
CHGCVTIHR

SEQ ID NO: 1207216 - protein, 9 aa, Homo Sapiens
ALQPGEKKS

SEQ ID NO: 1207217 - protein, 9 aa, Homo Sapiens
KIMPVQKHT

SEQ ID NO: 1207218 - protein, 9 aa, Homo Sapiens
LSVREFSGA

SEQ ID NO: 1207219 - protein, 9 aa, Homo Sapiens
CFARCLPES

SEQ ID NO: 1207220 - protein, 9 aa, Homo Sapiens
TWTVRQVPV

SEQ ID NO: 1207221 - protein, 9 aa, Homo Sapiens
HQGPSCSFP

SEQ ID NO: 1207222 - protein, 9 aa, Homo Sapiens
QKHTRAGQR

SEQ ID NO: 1207223 - protein, 9 aa, Homo Sapiens
GPSCSFPHN

SEQ ID NO: 1207224 - protein, 9 aa, Homo Sapiens
SVPPITSVP

SEQ ID NO: 1207225 - protein, 9 aa, Homo Sapiens
LLCQGPCAP

SEQ ID NO: 1207226 - protein, 9 aa, Homo Sapiens
SKQEAWSTH

SEQ ID NO: 1207227 - protein, 9 aa, Homo Sapiens
ERHITIFSP

SEQ ID NO: 1207228 - protein, 9 aa, Homo Sapiens
QEAWSTHNT

SEQ ID NO: 1207229 - protein, 9 aa, Homo Sapiens
SRGSSAGFE

SEQ ID NO: 1207230 - protein, 9 aa, Homo Sapiens
KHTRAGQRT

SEQ ID NO: 1207231 - protein, 9 aa, Homo Sapiens
PSPEPASPR

SEQ ID NO: 1207232 - protein, 9 aa, Homo Sapiens
PGRPRSKQE

SEQ ID NO: 1207233 - protein, 9 aa, Homo Sapiens
FSGAPESLE

SEQ ID NO: 1207234 - protein, 9 aa, Homo Sapiens
RGIRGARGG

SEQ ID NO: 1207235 - protein, 9 aa, Homo Sapiens
ATNIPSSVP

SEQ ID NO: 1207236 - protein, 9 aa, Homo Sapiens
ETQCEKIST

SEQ ID NO: 1207237 - protein, 9 aa, Homo Sapiens
RCLPESSLQ

SEQ ID NO: 1207238 - protein, 9 aa, Homo Sapiens
EAWSTHNTV

SEQ ID NO: 1207239 - protein, 9 aa, Homo Sapiens
KEGECSTRM

SEQ ID NO: 1207240 - protein, 9 aa, Homo Sapiens
SSVPPITSV

SEQ ID NO: 1207241 - protein, 9 aa, Homo Sapiens
ILDTAGREE

SEQ ID NO: 1207242 - protein, 9 aa, Homo Sapiens
GRPRSKQEA

SEQ ID NO: 1207243 - protein, 9 aa, Homo Sapiens
SVREFSGAP

SEQ ID NO: 1207244 - protein, 9 aa, Homo Sapiens
PSCSFPHNF

SEQ ID NO: 1207245 - protein, 9 aa, Homo Sapiens
LKIMPVQKH

SEQ ID NO: 1207246 - protein, 9 aa, Homo Sapiens
VTTWTVRQV

SEQ ID NO: 1207247 - protein, 9 aa, Homo Sapiens
REAAEKKKE

SEQ ID NO: 1207248 - protein, 9 aa, Homo Sapiens
GIRGARGGA

SEQ ID NO: 1207249 - protein, 9 aa, Homo Sapiens
AGREEYSAM

SEQ ID NO: 1207250 - protein, 9 aa, Homo Sapiens
VVNIPTAEC

SEQ ID NO: 1207251 - protein, 9 aa, Homo Sapiens
MPVQKHTRA

SEQ ID NO: 1207252 - protein, 9 aa, Homo Sapiens
GREEYSAMR

SEQ ID NO: 1207253 - protein, 9 aa, Homo Sapiens
NIPSSVPPI

SEQ ID NO: 1207254 - protein, 9 aa, Homo Sapiens
RLCEETQCE

SEQ ID NO: 1207255 - protein, 9 aa, Homo Sapiens
PGLLCQGPC

SEQ ID NO: 1207256 - protein, 9 aa, Homo Sapiens
GAPESLEVL

SEQ ID NO: 1207257 - protein, 9 aa, Homo Sapiens
RPVSCHGCV

SEQ ID NO: 1207258 - protein, 9 aa, Homo Sapiens
LDTAGREEY

SEQ ID NO: 1207259 - protein, 9 aa, Homo Sapiens
KQEAWSTHN

SEQ ID NO: 1207260 - protein, 9 aa, Homo Sapiens
MPRPVSCHG

SEQ ID NO: 1207261 - protein, 9 aa, Homo Sapiens
PVSCHGCVT

SEQ ID NO: 1207262 - protein, 9 aa, Homo Sapiens
LWFKRCFAR

SEQ ID NO: 1207263 - protein, 9 aa, Homo Sapiens
TGVVNIPTA

SEQ ID NO: 1207264 - protein, 9 aa, Homo Sapiens
TVKTVTTWT

SEQ ID NO: 1207265 - protein, 9 aa, Homo Sapiens
ECSTRMRAQ

SEQ ID NO: 1207266 - protein, 9 aa, Homo Sapiens
TAGREEYSA

SEQ ID NO: 1207267 - protein, 9 aa, Homo Sapiens
TRMRAQNTT

SEQ ID NO: 1207268 - protein, 9 aa, Homo Sapiens
RAPSPEPAS

SEQ ID NO: 1207269 - protein, 9 aa, Homo Sapiens
LQPGEKKSQ

SEQ ID NO: 1207270 - protein, 9 aa, Homo Sapiens
VREFSGAPE

SEQ ID NO: 1207271 - protein, 9 aa, Homo Sapiens
PGEKKSQAS

SEQ ID NO: 1207272 - protein, 9 aa, Homo Sapiens
PTAECLDEY

SEQ ID NO: 1207273 - protein, 9 aa, Homo Sapiens
SCSFPHNFV

SEQ ID NO: 1207274 - protein, 9 aa, Homo Sapiens
SATNIPSSV

SEQ ID NO: 1207275 - protein, 9 aa, Homo Sapiens
LDTLGLLGP

SEQ ID NO: 1207276 - protein, 9 aa, Homo Sapiens
TAWLEWWHV

SEQ ID NO: 1207277 - protein, 9 aa, Homo Sapiens
WFKRCFARC

SEQ ID NO: 1207278 - protein, 9 aa, Homo Sapiens
WWHVQPTLD

SEQ ID NO: 1207279 - protein, 9 aa, Homo Sapiens
EPASPRGAA

SEQ ID NO: 1207280 - protein, 9 aa, Homo Sapiens
PMKEGECST

SEQ ID NO: 1207281 - protein, 9 aa, Homo Sapiens
AMPRPVSCH

SEQ ID NO: 1207282 - protein, 9 aa, Homo Sapiens
AGFERHITI

SEQ ID NO: 1207283 - protein, 9 aa, Homo Sapiens
EWWHVQPTL

SEQ ID NO: 1207284 - protein, 9 aa, Homo Sapiens
MARTKQTAC

SEQ ID NO: 1207285 - protein, 9 aa, Homo Sapiens
QPGEKKSQA

SEQ ID NO: 1207286 - protein, 9 aa, Homo Sapiens
IMPVQKHTR

SEQ ID NO: 1207287 - protein, 9 aa, Homo Sapiens
WTVRQVPVG

SEQ ID NO: 1207288 - protein, 9 aa, Homo Sapiens
ARTKQTACK

SEQ ID NO: 1207289 - protein, 9 aa, Homo Sapiens
CSTRMRAQN

SEQ ID NO: 1207290 - protein, 9 aa, Homo Sapiens
EETQCEKIS

SEQ ID NO: 1207291 - protein, 9 aa, Homo Sapiens
VQKHTRAGQ

SEQ ID NO: 1207292 - protein, 9 aa, Homo Sapiens
FPHNFVLLV

SEQ ID NO: 1207293 - protein, 9 aa, Homo Sapiens
REFSGAPES

SEQ ID NO: 1207294 - protein, 9 aa, Homo Sapiens
PETGNYVKV

SEQ ID NO: 1207295 - protein, 9 aa, Homo Sapiens
EAAEKKKER

SEQ ID NO: 1207296 - protein, 9 aa, Homo Sapiens
SCHGCVTIH

SEQ ID NO: 1207297 - protein, 9 aa, Homo Sapiens
NYVKVSIPS

SEQ ID NO: 1207298 - protein, 9 aa, Homo Sapiens
FARCLPESS

SEQ ID NO: 1207299 - protein, 9 aa, Homo Sapiens
IPSSVPPIT

SEQ ID NO: 1207300 - protein, 9 aa, Homo Sapiens
LGLLGPLGL

SEQ ID NO: 1207301 - protein, 9 aa, Homo Sapiens
SSSPGLLCQ

SEQ ID NO: 1207302 - protein, 9 aa, Homo Sapiens
EGECSTRMR

SEQ ID NO: 1207303 - protein, 9 aa, Homo Sapiens
WHVQPTLDL

SEQ ID NO: 1207304 - protein, 9 aa, Homo Sapiens
ETGNYVKVS

SEQ ID NO: 1207305 - protein, 9 aa, Homo Sapiens
APSPEPASP

SEQ ID NO: 1207306 - protein, 9 aa, Homo Sapiens
STRMRAQNT

SEQ ID NO: 1207307 - protein, 9 aa, Homo Sapiens
PRSKQEAWS

SEQ ID NO: 1207308 - protein, 9 aa, Homo Sapiens
QCEKISTLG

SEQ ID NO: 1207309 - protein, 9 aa, Homo Sapiens
IPTAECLDE

SEQ ID NO: 1207310 - protein, 9 aa, Homo Sapiens
YDPETGNYV

SEQ ID NO: 1207311 - protein, 9 aa, Homo Sapiens
DTLGLLGPL

SEQ ID NO: 1207312 - protein, 9 aa, Homo Sapiens
IRGARGGAQ

SEQ ID NO: 1207313 - protein, 9 aa, Homo Sapiens
RTKQTACKS

SEQ ID NO: 1207314 - protein, 9 aa, Homo Sapiens
TVTTWTVRQ

SEQ ID NO: 1207315 - protein, 9 aa, Homo Sapiens
PEPASPRGA

SEQ ID NO: 1207316 - protein, 9 aa, Homo Sapiens
FDRLCEETQ

SEQ ID NO: 1207317 - protein, 9 aa, Homo Sapiens
GGTAWLEWW

SEQ ID NO: 1207318 - protein, 9 aa, Homo Sapiens
RPRSKQEAW

SEQ ID NO: 1207319 - protein, 9 aa, Homo Sapiens
RSKQEAWST

SEQ ID NO: 1207320 - protein, 9 aa, Homo Sapiens
AWLEWWHVQ

SEQ ID NO: 1207321 - protein, 9 aa, Homo Sapiens
WLEWWHVQP

SEQ ID NO: 1207322 - protein, 9 aa, Homo Sapiens
VPPITSVPR

SEQ ID NO: 1207323 - protein, 9 aa, Homo Sapiens
STGVVNIPT

SEQ ID NO: 1207324 - protein, 9 aa, Homo Sapiens
GVVNIPTAE

SEQ ID NO: 1207325 - protein, 9 aa, Homo Sapiens
ARGIRGARG

SEQ ID NO: 1207326 - protein, 9 aa, Homo Sapiens
GTAWLEWWH

SEQ ID NO: 1207327 - protein, 9 aa, Homo Sapiens
VSCHGCVTI

SEQ ID NO: 1207328 - protein, 9 aa, Homo Sapiens
SAGFERHIT

SEQ ID NO: 1207329 - protein, 9 aa, Homo Sapiens
ASPRGAAGL

SEQ ID NO: 1207330 - protein, 9 aa, Homo Sapiens
PVQKHTRAG

SEQ ID NO: 1207331 - protein, 9 aa, Homo Sapiens
PRPVSCHGC

SEQ ID NO: 1207332 - protein, 9 aa, Homo Sapiens
SPRGAAGLV

SEQ ID NO: 1207333 - protein, 9 aa, Homo Sapiens
DPETGNYVK

SEQ ID NO: 1207334 - protein, 9 aa, Homo Sapiens
AAMPRPVSC

SEQ ID NO: 1207335 - protein, 9 aa, Homo Sapiens
DTAGREEYS

SEQ ID NO: 1207336 - protein, 9 aa, Homo Sapiens
SFPHNFVLL

SEQ ID NO: 1207337 - protein, 9 aa, Homo Sapiens
SSSSPGLLC

SEQ ID NO: 1207338 - protein, 9 aa, Homo Sapiens
LGPLGLWLH

SEQ ID NO: 1207339 - protein, 9 aa, Homo Sapiens
SPEPASPRG

SEQ ID NO: 1207340 - protein, 9 aa, Homo Sapiens
GNYVKVSIP

SEQ ID NO: 1207341 - protein, 9 aa, Homo Sapiens
KTVKTVTTW

SEQ ID NO: 1207342 - protein, 9 aa, Homo Sapiens
TKQTACKST

SEQ ID NO: 1207343 - protein, 9 aa, Homo Sapiens
ARCLPESSL

SEQ ID NO: 1207344 - protein, 9 aa, Homo Sapiens
AALDTLGLL

SEQ ID NO: 1207345 - protein, 9 aa, Homo Sapiens
SSAGFERHI

SEQ ID NO: 1207346 - protein, 9 aa, Homo Sapiens
GLLGPLGLW

SEQ ID NO: 1207347 - protein, 9 aa, Homo Sapiens
DILDTAGRE

SEQ ID NO: 1207348 - protein, 9 aa, Homo Sapiens
GPGSARGIR

SEQ ID NO: 1207349 - protein, 9 aa, Homo Sapiens
RGSSAGFER

SEQ ID NO: 1207350 - protein, 9 aa, Homo Sapiens
SSPGLLCQG

SEQ ID NO: 1207351 - protein, 9 aa, Homo Sapiens
PASPRGAAG

SEQ ID NO: 1207352 - protein, 9 aa, Homo Sapiens
KQTACKSTG

SEQ ID NO: 1207353 - protein, 9 aa, Homo Sapiens
AAEKKKERG

SEQ ID NO: 1207354 - protein, 9 aa, Homo Sapiens
LSSSSPGLL

SEQ ID NO: 1207355 - protein, 9 aa, Homo Sapiens
TAECLDEYE

SEQ ID NO: 1207356 - protein, 9 aa, Homo Sapiens
LLGPLGLWL

SEQ ID NO: 1207357 - protein, 9 aa, Homo Sapiens
SGAPESLEV

SEQ ID NO: 1207358 - protein, 9 aa, Homo Sapiens
CEETQCEKI

SEQ ID NO: 1207359 - protein, 9 aa, Homo Sapiens
CKSTGGKAP

SEQ ID NO: 1207360 - protein, 9 aa, Homo Sapiens
LCEETQCEK

SEQ ID NO: 1207361 - protein, 9 aa, Homo Sapiens
PSSVPPITS

SEQ ID NO: 1207362 - protein, 9 aa, Homo Sapiens
FKRCFARCL

SEQ ID NO: 1207363 - protein, 9 aa, Homo Sapiens
EFSGAPESL

SEQ ID NO: 1207364 - protein, 9 aa, Homo Sapiens
GGPGSARGI

SEQ ID NO: 1207365 - protein, 9 aa, Homo Sapiens
GSARGIRGA

SEQ ID NO: 1207366 - protein, 9 aa, Homo Sapiens
TLGLLGPLG

SEQ ID NO: 1207367 - protein, 9 aa, Homo Sapiens
GSSAGFERH

SEQ ID NO: 1207368 - protein, 9 aa, Homo Sapiens
FERHITIFS

SEQ ID NO: 1207369 - protein, 9 aa, Homo Sapiens
TGNYVKVSI

SEQ ID NO: 1207370 - protein, 9 aa, Homo Sapiens
QGPSCSFPH

SEQ ID NO: 1207371 - protein, 9 aa, Homo Sapiens
ALDTLGLLG

SEQ ID NO: 1207372 - protein, 9 aa, Homo Sapiens
VNIPTAECL

SEQ ID NO: 1207373 - protein, 9 aa, Homo Sapiens
TFYDPETGN

SEQ ID NO: 1207374 - protein, 9 aa, Homo Sapiens
LCQGPCAPP

SEQ ID NO: 1207375 - protein, 9 aa, Homo Sapiens
GFERHITIF

SEQ ID NO: 1207376 - protein, 9 aa, Homo Sapiens
GECSTRMRA

SEQ ID NO: 1207377 - protein, 9 aa, Homo Sapiens
PGSARGIRG

SEQ ID NO: 1207378 - protein, 9 aa, Homo Sapiens
KTVTTWTVR

SEQ ID NO: 1207379 - protein, 9 aa, Homo Sapiens
TTWTVRQVP

SEQ ID NO: 1207380 - protein, 9 aa, Homo Sapiens
GLLCQGPCA

SEQ ID NO: 1207381 - protein, 9 aa, Homo Sapiens
RHNIAIEVD

SEQ ID NO: 1207382 - protein, 9 aa, Homo Sapiens
RRHNIAIEV

SEQ ID NO: 1207383 - protein, 9 aa, Homo Sapiens
RPTFSSWLG

SEQ ID NO: 1207384 - protein, 9 aa, Homo Sapiens
VATAAAMGA

SEQ ID NO: 1207385 - protein, 9 aa, Homo Sapiens
QGPLKFMYV

SEQ ID NO: 1207386 - protein, 9 aa, Homo Sapiens
DAVHSFKFS

SEQ ID NO: 1207387 - protein, 9 aa, Homo Sapiens
RVPRDVSNI

SEQ ID NO: 1207388 - protein, 9 aa, Homo Sapiens
AAVPLLVLC

SEQ ID NO: 1207389 - protein, 9 aa, Homo Sapiens
RKCTQHKSF

SEQ ID NO: 1207390 - protein, 9 aa, Homo Sapiens
GQAPSAAVA

SEQ ID NO: 1207391 - protein, 9 aa, Homo Sapiens
SARNFLDMN

SEQ ID NO: 1207392 - protein, 9 aa, Homo Sapiens
KRAPSVPPF

SEQ ID NO: 1207393 - protein, 9 aa, Homo Sapiens
GGFSRPTFS

SEQ ID NO: 1207394 - protein, 9 aa, Homo Sapiens
FSFLLTYGL

SEQ ID NO: 1207395 - protein, 9 aa, Homo Sapiens
RQRQIVVDK

SEQ ID NO: 1207396 - protein, 9 aa, Homo Sapiens
CIMRQVAKV

SEQ ID NO: 1207397 - protein, 9 aa, Homo Sapiens
SNGHVYKKL

SEQ ID NO: 1207398 - protein, 9 aa, Homo Sapiens
VDFPYEDKL

SEQ ID NO: 1207399 - protein, 9 aa, Homo Sapiens
VLSNKDRAN

SEQ ID NO: 1207400 - protein, 9 aa, Homo Sapiens
NFNASEEAA

SEQ ID NO: 1207401 - protein, 9 aa, Homo Sapiens
ALHLACASD

SEQ ID NO: 1207402 - protein, 9 aa, Homo Sapiens
QRKCTQHKS

SEQ ID NO: 1207403 - protein, 9 aa, Homo Sapiens
ERNLRKPFR

SEQ ID NO: 1207404 - protein, 9 aa, Homo Sapiens
TQPTKSNPV

SEQ ID NO: 1207405 - protein, 9 aa, Homo Sapiens
HGGFSRPTF

SEQ ID NO: 1207406 - protein, 9 aa, Homo Sapiens
GHVYKKLSS

SEQ ID NO: 1207407 - protein, 9 aa, Homo Sapiens
RKELVATDV

SEQ ID NO: 1207408 - protein, 9 aa, Homo Sapiens
LHLACASDH

SEQ ID NO: 1207409 - protein, 9 aa, Homo Sapiens
RGLLQCIMR

SEQ ID NO: 1207410 - protein, 9 aa, Homo Sapiens
SVTSKQIRQ

SEQ ID NO: 1207411 - protein, 9 aa, Homo Sapiens
RIDFNFERS

SEQ ID NO: 1207412 - protein, 9 aa, Homo Sapiens
EDRPNTSKI

SEQ ID NO: 1207413 - protein, 9 aa, Homo Sapiens
TVMDLEAKG

SEQ ID NO: 1207414 - protein, 9 aa, Homo Sapiens
GGKALASSE

SEQ ID NO: 1207415 - protein, 9 aa, Homo Sapiens
HLPHGNGIS

SEQ ID NO: 1207416 - protein, 9 aa, Homo Sapiens
CAICLDEYK

SEQ ID NO: 1207417 - protein, 9 aa, Homo Sapiens
WKVDFPYED

SEQ ID NO: 1207418 - protein, 9 aa, Homo Sapiens
QPTKSNPVL

SEQ ID NO: 1207419 - protein, 9 aa, Homo Sapiens
IQLSICFSS

SEQ ID NO: 1207420 - protein, 9 aa, Homo Sapiens
PAEHKLNEV

SEQ ID NO: 1207421 - protein, 9 aa, Homo Sapiens
ESVTSKQIR

SEQ ID NO: 1207422 - protein, 9 aa, Homo Sapiens
AAVATAAAM

SEQ ID NO: 1207423 - protein, 9 aa, Homo Sapiens
AEHKLNEVS

SEQ ID NO: 1207424 - protein, 9 aa, Homo Sapiens
MQIKRAPSV

SEQ ID NO: 1207425 - protein, 9 aa, Homo Sapiens
HAVFFVYDV

SEQ ID NO: 1207426 - protein, 9 aa, Homo Sapiens
NLLRISIPL

SEQ ID NO: 1207427 - protein, 9 aa, Homo Sapiens
SHLPHGNGI

SEQ ID NO: 1207428 - protein, 9 aa, Homo Sapiens
FSRPTFSSW

SEQ ID NO: 1207429 - protein, 9 aa, Homo Sapiens
SKDNLLRIS

SEQ ID NO: 1207430 - protein, 9 aa, Homo Sapiens
EAETYQDGF

SEQ ID NO: 1207431 - protein, 9 aa, Homo Sapiens
VHSFKFSRN

SEQ ID NO: 1207432 - protein, 9 aa, Homo Sapiens
SLGLDVSGN

SEQ ID NO: 1207433 - protein, 9 aa, Homo Sapiens
QLSICFSSG

SEQ ID NO: 1207434 - protein, 9 aa, Homo Sapiens
DHVKVVTLL

SEQ ID NO: 1207435 - protein, 9 aa, Homo Sapiens
LDSVQTLNA

SEQ ID NO: 1207436 - protein, 9 aa, Homo Sapiens
LVLPATQPL

SEQ ID NO: 1207437 - protein, 9 aa, Homo Sapiens
RRQIATQPT

SEQ ID NO: 1207438 - protein, 9 aa, Homo Sapiens
NIAFPSDEH

SEQ ID NO: 1207439 - protein, 9 aa, Homo Sapiens
YEDKLVGYI

SEQ ID NO: 1207440 - protein, 9 aa, Homo Sapiens
LACASDHVK

SEQ ID NO: 1207441 - protein, 9 aa, Homo Sapiens
PVAAGAKGL

SEQ ID NO: 1207442 - protein, 9 aa, Homo Sapiens
VSARSLSSS

SEQ ID NO: 1207443 - protein, 9 aa, Homo Sapiens
EHEAETYQD

SEQ ID NO: 1207444 - protein, 9 aa, Homo Sapiens
PHPVAAGAK

SEQ ID NO: 1207445 - protein, 9 aa, Homo Sapiens
EAKGTCLRF

SEQ ID NO: 1207446 - protein, 9 aa, Homo Sapiens
DYVQQKKTE

SEQ ID NO: 1207447 - protein, 9 aa, Homo Sapiens
ISWEPPPWV

SEQ ID NO: 1207448 - protein, 9 aa, Homo Sapiens
PNTSKILRT

SEQ ID NO: 1207449 - protein, 9 aa, Homo Sapiens
APGGKALAS

SEQ ID NO: 1207450 - protein, 9 aa, Homo Sapiens
TQHKSFEGT

SEQ ID NO: 1207451 - protein, 9 aa, Homo Sapiens
DFGPEENFN

SEQ ID NO: 1207452 - protein, 9 aa, Homo Sapiens
FFVYDVTKM

SEQ ID NO: 1207453 - protein, 9 aa, Homo Sapiens
EYKDGDKLR

SEQ ID NO: 1207454 - protein, 9 aa, Homo Sapiens
HEAETYQDG

SEQ ID NO: 1207455 - protein, 9 aa, Homo Sapiens
VHAVFFVYD

SEQ ID NO: 1207456 - protein, 9 aa, Homo Sapiens
LLQCIMRQV

SEQ ID NO: 1207457 - protein, 9 aa, Homo Sapiens
SQAVVDAAA

SEQ ID NO: 1207458 - protein, 9 aa, Homo Sapiens
EAPGGKALA

SEQ ID NO: 1207459 - protein, 9 aa, Homo Sapiens
DFPYEDKLV

SEQ ID NO: 1207460 - protein, 9 aa, Homo Sapiens
FECKCPAEH

SEQ ID NO: 1207461 - protein, 9 aa, Homo Sapiens
FMYVAIEFS

SEQ ID NO: 1207462 - protein, 9 aa, Homo Sapiens
IWKVDFPYE

SEQ ID NO: 1207463 - protein, 9 aa, Homo Sapiens
AVHSFKFSR

SEQ ID NO: 1207464 - protein, 9 aa, Homo Sapiens
FSSWLGLQA

SEQ ID NO: 1207465 - protein, 9 aa, Homo Sapiens
RNFLDMNFQ

SEQ ID NO: 1207466 - protein, 9 aa, Homo Sapiens
LVATDVGDD

SEQ ID NO: 1207467 - protein, 9 aa, Homo Sapiens
VQQKKTEGY

SEQ ID NO: 1207468 - protein, 9 aa, Homo Sapiens
IMRQVAKVE

SEQ ID NO: 1207469 - protein, 9 aa, Homo Sapiens
ILLIQLSIC

SEQ ID NO: 1207470 - protein, 9 aa, Homo Sapiens
HMQIKRAPS

SEQ ID NO: 1207471 - protein, 9 aa, Homo Sapiens
REKESSAVS

SEQ ID NO: 1207472 - protein, 9 aa, Homo Sapiens
HKSFEGTDY

SEQ ID NO: 1207473 - protein, 9 aa, Homo Sapiens
EHKLNEVSQ

SEQ ID NO: 1207474 - protein, 9 aa, Homo Sapiens
LDNRGLLRT

SEQ ID NO: 1207475 - protein, 9 aa, Homo Sapiens
YKKLSSIES

SEQ ID NO: 1207476 - protein, 9 aa, Homo Sapiens
AGAKGLEIG

SEQ ID NO: 1207477 - protein, 9 aa, Homo Sapiens
HMCQKFLQQ

SEQ ID NO: 1207478 - protein, 9 aa, Homo Sapiens
GTQSRQRQI

SEQ ID NO: 1207479 - protein, 9 aa, Homo Sapiens
VPRDVSNIN

SEQ ID NO: 1207480 - protein, 9 aa, Homo Sapiens
YVQQKKTEG

SEQ ID NO: 1207481 - protein, 9 aa, Homo Sapiens
PSDEHMCQK

SEQ ID NO: 1207482 - protein, 9 aa, Homo Sapiens
VDAAAVPLL

SEQ ID NO: 1207483 - protein, 9 aa, Homo Sapiens
FPYEDKLVG

SEQ ID NO: 1207484 - protein, 9 aa, Homo Sapiens
EEHEAETYQ

SEQ ID NO: 1207485 - protein, 9 aa, Homo Sapiens
RPMRKTAPK

SEQ ID NO: 1207486 - protein, 9 aa, Homo Sapiens
RQIATQPTK

SEQ ID NO: 1207487 - protein, 9 aa, Homo Sapiens
VQRKCTQHK

SEQ ID NO: 1207488 - protein, 9 aa, Homo Sapiens
EAFQSARNF

SEQ ID NO: 1207489 - protein, 9 aa, Homo Sapiens
FSRNHVDWH

SEQ ID NO: 1207490 - protein, 9 aa, Homo Sapiens
TLSKDNLLR

SEQ ID NO: 1207491 - protein, 9 aa, Homo Sapiens
CKCPAEHKL

SEQ ID NO: 1207492 - protein, 9 aa, Homo Sapiens
GCRPMRKTA

SEQ ID NO: 1207493 - protein, 9 aa, Homo Sapiens
TQPLDGGEF

SEQ ID NO: 1207494 - protein, 9 aa, Homo Sapiens
YKDGDKLRI

SEQ ID NO: 1207495 - protein, 9 aa, Homo Sapiens
HVYKKLSSI

SEQ ID NO: 1207496 - protein, 9 aa, Homo Sapiens
PSAAVATAA

SEQ ID NO: 1207497 - protein, 9 aa, Homo Sapiens
DLDNRGLLR

SEQ ID NO: 1207498 - protein, 9 aa, Homo Sapiens
HLACASDHV

SEQ ID NO: 1207499 - protein, 9 aa, Homo Sapiens
NVHAVFFVY

SEQ ID NO: 1207500 - protein, 9 aa, Homo Sapiens
INPYVLSNK

SEQ ID NO: 1207501 - protein, 9 aa, Homo Sapiens
AVATAAAMG

SEQ ID NO: 1207502 - protein, 9 aa, Homo Sapiens
WERHMQIKR

SEQ ID NO: 1207503 - protein, 9 aa, Homo Sapiens
LESVTSKQI

SEQ ID NO: 1207504 - protein, 9 aa, Homo Sapiens
PGGKALASS

SEQ ID NO: 1207505 - protein, 9 aa, Homo Sapiens
KELVATDVG

SEQ ID NO: 1207506 - protein, 9 aa, Homo Sapiens
SSAVSARSL

SEQ ID NO: 1207507 - protein, 9 aa, Homo Sapiens
ERHMQIKRA

SEQ ID NO: 1207508 - protein, 9 aa, Homo Sapiens
SKQIRQALE

SEQ ID NO: 1207509 - protein, 9 aa, Homo Sapiens
NPYVLSNKD

SEQ ID NO: 1207510 - protein, 9 aa, Homo Sapiens
LLIQLSICF

SEQ ID NO: 1207511 - protein, 9 aa, Homo Sapiens
EENFNASEE

SEQ ID NO: 1207512 - protein, 9 aa, Homo Sapiens
ELAASFSFL

SEQ ID NO: 1207513 - protein, 9 aa, Homo Sapiens
AAGAKGLEI

SEQ ID NO: 1207514 - protein, 9 aa, Homo Sapiens
AICLDEYKD

SEQ ID NO: 1207515 - protein, 9 aa, Homo Sapiens
KDGDKLRIL

SEQ ID NO: 1207516 - protein, 9 aa, Homo Sapiens
NSGTQSRQR

SEQ ID NO: 1207517 - protein, 9 aa, Homo Sapiens
SAAVATAAA

SEQ ID NO: 1207518 - protein, 9 aa, Homo Sapiens
RKPFRSDSG

SEQ ID NO: 1207519 - protein, 9 aa, Homo Sapiens
DPRVPRDVS

SEQ ID NO: 1207520 - protein, 9 aa, Homo Sapiens
TGTLSKDNL

SEQ ID NO: 1207521 - protein, 9 aa, Homo Sapiens
APSAAVATA

SEQ ID NO: 1207522 - protein, 9 aa, Homo Sapiens
AKLDSVQTL

SEQ ID NO: 1207523 - protein, 9 aa, Homo Sapiens
VLSAKLDSV

SEQ ID NO: 1207524 - protein, 9 aa, Homo Sapiens
DLESVTSKQ

SEQ ID NO: 1207525 - protein, 9 aa, Homo Sapiens
ATQPLDGGE

SEQ ID NO: 1207526 - protein, 9 aa, Homo Sapiens
GISLGLDVS

SEQ ID NO: 1207527 - protein, 9 aa, Homo Sapiens
SSNGHVYKK

SEQ ID NO: 1207528 - protein, 9 aa, Homo Sapiens
NASEEAARG

SEQ ID NO: 1207529 - protein, 9 aa, Homo Sapiens
MRKTAPKAK

SEQ ID NO: 1207530 - protein, 9 aa, Homo Sapiens
LTVMDLEAK

SEQ ID NO: 1207531 - protein, 9 aa, Homo Sapiens
AAAVPLLVL

SEQ ID NO: 1207532 - protein, 9 aa, Homo Sapiens
SLSLRKELV

SEQ ID NO: 1207533 - protein, 9 aa, Homo Sapiens
GNGISWEPP

SEQ ID NO: 1207534 - protein, 9 aa, Homo Sapiens
VILLIQLSI

SEQ ID NO: 1207535 - protein, 9 aa, Homo Sapiens
AVSARSLSS

SEQ ID NO: 1207536 - protein, 9 aa, Homo Sapiens
DEYKDGDKL

SEQ ID NO: 1207537 - protein, 9 aa, Homo Sapiens
LRRHNIAIE

SEQ ID NO: 1207538 - protein, 9 aa, Homo Sapiens
SEAFQSARN

SEQ ID NO: 1207539 - protein, 9 aa, Homo Sapiens
CLDEYKDGD

SEQ ID NO: 1207540 - protein, 9 aa, Homo Sapiens
NTSKILRTL

SEQ ID NO: 1207541 - protein, 9 aa, Homo Sapiens
HNIAIEVDA

SEQ ID NO: 1207542 - protein, 9 aa, Homo Sapiens
AKGLEIGEE

SEQ ID NO: 1207543 - protein, 9 aa, Homo Sapiens
SGTQSRQRQ

SEQ ID NO: 1207544 - protein, 9 aa, Homo Sapiens
FPSDEHMCQ

SEQ ID NO: 1207545 - protein, 9 aa, Homo Sapiens
HPVAAGAKG

SEQ ID NO: 1207546 - protein, 9 aa, Homo Sapiens
LPHGNGISW

SEQ ID NO: 1207547 - protein, 9 aa, Homo Sapiens
SPAGISLGL

SEQ ID NO: 1207548 - protein, 9 aa, Homo Sapiens
ECKCPAEHK

SEQ ID NO: 1207549 - protein, 9 aa, Homo Sapiens
FGPEENFNA

SEQ ID NO: 1207550 - protein, 9 aa, Homo Sapiens
ISLGLDVSG

SEQ ID NO: 1207551 - protein, 9 aa, Homo Sapiens
KDNLLRISI

SEQ ID NO: 1207552 - protein, 9 aa, Homo Sapiens
AGQAPSAAV

SEQ ID NO: 1207553 - protein, 9 aa, Homo Sapiens
HGNGISWEP

SEQ ID NO: 1207554 - protein, 9 aa, Homo Sapiens
SDEHMCQKF

SEQ ID NO: 1207555 - protein, 9 aa, Homo Sapiens
DTGTLSKDN

SEQ ID NO: 1207556 - protein, 9 aa, Homo Sapiens
KDLDNRGLL

SEQ ID NO: 1207557 - protein, 9 aa, Homo Sapiens
FNFERSSTV

SEQ ID NO: 1207558 - protein, 9 aa, Homo Sapiens
NLRKPFRSD

SEQ ID NO: 1207559 - protein, 9 aa, Homo Sapiens
LRKPFRSDS

SEQ ID NO: 1207560 - protein, 9 aa, Homo Sapiens
AGFERIDFN

SEQ ID NO: 1207561 - protein, 9 aa, Homo Sapiens
QHKSFEGTD

SEQ ID NO: 1207562 - protein, 9 aa, Homo Sapiens
QPLDGGEFQ

SEQ ID NO: 1207563 - protein, 9 aa, Homo Sapiens
ATQPTKSNP

SEQ ID NO: 1207564 - protein, 9 aa, Homo Sapiens
HSLRRHNIA

SEQ ID NO: 1207565 - protein, 9 aa, Homo Sapiens
VTSKQIRQA

SEQ ID NO: 1207566 - protein, 9 aa, Homo Sapiens
CPAEHKLNE

SEQ ID NO: 1207567 - protein, 9 aa, Homo Sapiens
SNKDRANLI

SEQ ID NO: 1207568 - protein, 9 aa, Homo Sapiens
SDHVKVVTL

SEQ ID NO: 1207569 - protein, 9 aa, Homo Sapiens
EHMCQKFLQ

SEQ ID NO: 1207570 - protein, 9 aa, Homo Sapiens
AKGTCLRFS

SEQ ID NO: 1207571 - protein, 9 aa, Homo Sapiens
ICFSSGNCG

SEQ ID NO: 1207572 - protein, 9 aa, Homo Sapiens
PQLIDYVQQ

SEQ ID NO: 1207573 - protein, 9 aa, Homo Sapiens
QSRQRQIVV

SEQ ID NO: 1207574 - protein, 9 aa, Homo Sapiens
LPATQPLDG

SEQ ID NO: 1207575 - protein, 9 aa, Homo Sapiens
SFKFSRNHV

SEQ ID NO: 1207576 - protein, 9 aa, Homo Sapiens
TQGPLKFMY

SEQ ID NO: 1207577 - protein, 9 aa, Homo Sapiens
VQTLNACCA

SEQ ID NO: 1207578 - protein, 9 aa, Homo Sapiens
GKALASSES

SEQ ID NO: 1207579 - protein, 9 aa, Homo Sapiens
CRPMRKTAP

SEQ ID NO: 1207580 - protein, 9 aa, Homo Sapiens
LSAKLDSVQ

SEQ ID NO: 1207581 - protein, 9 aa, Homo Sapiens
KCPAEHKLN

SEQ ID NO: 1207582 - protein, 9 aa, Homo Sapiens
VAAGAKGLE

SEQ ID NO: 1207583 - protein, 9 aa, Homo Sapiens
FRSDSGSDL

SEQ ID NO: 1207584 - protein, 9 aa, Homo Sapiens
LSNKDRANL

SEQ ID NO: 1207585 - protein, 9 aa, Homo Sapiens
RGCRPMRKT

SEQ ID NO: 1207586 - protein, 9 aa, Homo Sapiens
FLHSLRRHN

SEQ ID NO: 1207587 - protein, 9 aa, Homo Sapiens
PATQPLDGG

SEQ ID NO: 1207588 - protein, 9 aa, Homo Sapiens
KCTQHKSFE

SEQ ID NO: 1207589 - protein, 9 aa, Homo Sapiens
RPNTSKILR

SEQ ID NO: 1207590 - protein, 9 aa, Homo Sapiens
CASDHVKVV

SEQ ID NO: 1207591 - protein, 9 aa, Homo Sapiens
QIKRAPSVP

SEQ ID NO: 1207592 - protein, 9 aa, Homo Sapiens
ESSAVSARS

SEQ ID NO: 1207593 - protein, 9 aa, Homo Sapiens
AFQSARNFL

SEQ ID NO: 1207594 - protein, 9 aa, Homo Sapiens
PAGISLGLD

SEQ ID NO: 1207595 - protein, 9 aa, Homo Sapiens
GRRGCRPMR

SEQ ID NO: 1207596 - protein, 9 aa, Homo Sapiens
IATQPTKSN

SEQ ID NO: 1207597 - protein, 9 aa, Homo Sapiens
SVQTLNACC

SEQ ID NO: 1207598 - protein, 9 aa, Homo Sapiens
QDGFTGNPS

SEQ ID NO: 1207599 - protein, 9 aa, Homo Sapiens
DFNFERSST

SEQ ID NO: 1207600 - protein, 9 aa, Homo Sapiens
LSKDNLLRI

SEQ ID NO: 1207601 - protein, 9 aa, Homo Sapiens
SLRKELVAT

SEQ ID NO: 1207602 - protein, 9 aa, Homo Sapiens
PLKFMYVAI

SEQ ID NO: 1207603 - protein, 9 aa, Homo Sapiens
PPQLIDYVQ

SEQ ID NO: 1207604 - protein, 9 aa, Homo Sapiens
SAEAPGGKA

SEQ ID NO: 1207605 - protein, 9 aa, Homo Sapiens
VMDLEAKGT

SEQ ID NO: 1207606 - protein, 9 aa, Homo Sapiens
DEHMCQKFL

SEQ ID NO: 1207607 - protein, 9 aa, Homo Sapiens
AFPSDEHMC

SEQ ID NO: 1207608 - protein, 9 aa, Homo Sapiens
KLDSVQTLN

SEQ ID NO: 1207609 - protein, 9 aa, Homo Sapiens
ICLDEYKDG

SEQ ID NO: 1207610 - protein, 9 aa, Homo Sapiens
FQSARNFLD

SEQ ID NO: 1207611 - protein, 9 aa, Homo Sapiens
PTKSNPVLI

SEQ ID NO: 1207612 - protein, 9 aa, Homo Sapiens
KFSRNHVDW

SEQ ID NO: 1207613 - protein, 9 aa, Homo Sapiens
MYVAIEFSQ

SEQ ID NO: 1207614 - protein, 9 aa, Homo Sapiens
VVDAAAVPL

SEQ ID NO: 1207615 - protein, 9 aa, Homo Sapiens
GPEENFNAS

SEQ ID NO: 1207616 - protein, 9 aa, Homo Sapiens
SRPTFSSWL

SEQ ID NO: 1207617 - protein, 9 aa, Homo Sapiens
GISWEPPPW

SEQ ID NO: 1207618 - protein, 9 aa, Homo Sapiens
KALASSESE

SEQ ID NO: 1207619 - protein, 9 aa, Homo Sapiens
TYQDGFTGN

SEQ ID NO: 1207620 - protein, 9 aa, Homo Sapiens
SERNLRKPF

SEQ ID NO: 1207621 - protein, 9 aa, Homo Sapiens
ASDHVKVVT

SEQ ID NO: 1207622 - protein, 9 aa, Homo Sapiens
IKRAPSVPP

SEQ ID NO: 1207623 - protein, 9 aa, Homo Sapiens
GFERIDFNF

SEQ ID NO: 1207624 - protein, 9 aa, Homo Sapiens
GAKGLEIGE

SEQ ID NO: 1207625 - protein, 9 aa, Homo Sapiens
LIQLSICFS

SEQ ID NO: 1207626 - protein, 9 aa, Homo Sapiens
LEAKGTCLR

SEQ ID NO: 1207627 - protein, 9 aa, Homo Sapiens
SAKLDSVQT

SEQ ID NO: 1207628 - protein, 9 aa, Homo Sapiens
NGISWEPPP

SEQ ID NO: 1207629 - protein, 9 aa, Homo Sapiens
RDVSNINCE

SEQ ID NO: 1207630 - protein, 9 aa, Homo Sapiens
KKLSSIESD

SEQ ID NO: 1207631 - protein, 9 aa, Homo Sapiens
YQDGFTGNP

SEQ ID NO: 1207632 - protein, 9 aa, Homo Sapiens
YVLSNKDRA

SEQ ID NO: 1207633 - protein, 9 aa, Homo Sapiens
QSARNFLDM

SEQ ID NO: 1207634 - protein, 9 aa, Homo Sapiens
SFECKCPAE

SEQ ID NO: 1207635 - protein, 9 aa, Homo Sapiens
QLIDYVQQK

SEQ ID NO: 1207636 - protein, 9 aa, Homo Sapiens
PEDRPNTSK

SEQ ID NO: 1207637 - protein, 9 aa, Homo Sapiens
LSICFSSGN

SEQ ID NO: 1207638 - protein, 9 aa, Homo Sapiens
GLLQCIMRQ

SEQ ID NO: 1207639 - protein, 9 aa, Homo Sapiens
TFSSWLGLQ

SEQ ID NO: 1207640 - protein, 9 aa, Homo Sapiens
KDAVHSFKF

SEQ ID NO: 1207641 - protein, 9 aa, Homo Sapiens
EDKLVGYIT

SEQ ID NO: 1207642 - protein, 9 aa, Homo Sapiens
ARNFLDMNF

SEQ ID NO: 1207643 - protein, 9 aa, Homo Sapiens
VSNINCEEL

SEQ ID NO: 1207644 - protein, 9 aa, Homo Sapiens
FKFSRNHVD

SEQ ID NO: 1207645 - protein, 9 aa, Homo Sapiens
DAAAVPLLV

SEQ ID NO: 1207646 - protein, 9 aa, Homo Sapiens
SRQRQIVVD

SEQ ID NO: 1207647 - protein, 9 aa, Homo Sapiens
NFLHSLRRH

SEQ ID NO: 1207648 - protein, 9 aa, Homo Sapiens
QCIMRQVAK

SEQ ID NO: 1207649 - protein, 9 aa, Homo Sapiens
GTLSKDNLL

SEQ ID NO: 1207650 - protein, 9 aa, Homo Sapiens
TKSNPVLIY

SEQ ID NO: 1207651 - protein, 9 aa, Homo Sapiens
TSKQIRQAL

SEQ ID NO: 1207652 - protein, 9 aa, Homo Sapiens
VSAEAPGGK

SEQ ID NO: 1207653 - protein, 9 aa, Homo Sapiens
KGLEIGEEA

SEQ ID NO: 1207654 - protein, 9 aa, Homo Sapiens
EELAASFSF

SEQ ID NO: 1207655 - protein, 9 aa, Homo Sapiens
HSFKFSRNH

SEQ ID NO: 1207656 - protein, 9 aa, Homo Sapiens
SAVSARSLS

SEQ ID NO: 1207657 - protein, 9 aa, Homo Sapiens
KPPQLIDYV

SEQ ID NO: 1207658 - protein, 9 aa, Homo Sapiens
AETYQDGFT

SEQ ID NO: 1207659 - protein, 9 aa, Homo Sapiens
ETYQDGFTG

SEQ ID NO: 1207660 - protein, 9 aa, Homo Sapiens
PLDGGEFQC

SEQ ID NO: 1207661 - protein, 9 aa, Homo Sapiens
LQCIMRQVA

SEQ ID NO: 1207662 - protein, 9 aa, Homo Sapiens
DLEAKGTCL

SEQ ID NO: 1207663 - protein, 9 aa, Homo Sapiens
VLPATQPLD

SEQ ID NO: 1207664 - protein, 9 aa, Homo Sapiens
IDFNFERSS

SEQ ID NO: 1207665 - protein, 9 aa, Homo Sapiens
PMRKTAPKA

SEQ ID NO: 1207666 - protein, 9 aa, Homo Sapiens
QVQRKCTQH

SEQ ID NO: 1207667 - protein, 9 aa, Homo Sapiens
RNVHAVFFV

SEQ ID NO: 1207668 - protein, 9 aa, Homo Sapiens
NGHVYKKLS

SEQ ID NO: 1207669 - protein, 9 aa, Homo Sapiens
GLDVSGNSA

SEQ ID NO: 1207670 - protein, 9 aa, Homo Sapiens
PYVLSNKDR

SEQ ID NO: 1207671 - protein, 9 aa, Homo Sapiens
SARSLSSSP

SEQ ID NO: 1207672 - protein, 9 aa, Homo Sapiens
KILRTLTVW

SEQ ID NO: 1207673 - protein, 9 aa, Homo Sapiens
LAASFSFLL

SEQ ID NO: 1207674 - protein, 9 aa, Homo Sapiens
AASFSFLLT

SEQ ID NO: 1207675 - protein, 9 aa, Homo Sapiens
PEENFNASE

SEQ ID NO: 1207676 - protein, 9 aa, Homo Sapiens
DSVQTLNAC

SEQ ID NO: 1207677 - protein, 9 aa, Homo Sapiens
HDPRVPRDV

SEQ ID NO: 1207678 - protein, 9 aa, Homo Sapiens
LGLDVSGNS

SEQ ID NO: 1207679 - protein, 9 aa, Homo Sapiens
FERIDFNFE

SEQ ID NO: 1207680 - protein, 9 aa, Homo Sapiens
TQSRQRQIV

SEQ ID NO: 1207681 - protein, 9 aa, Homo Sapiens
AEAPGGKAL

SEQ ID NO: 1207682 - protein, 9 aa, Homo Sapiens
GFSRPTFSS

SEQ ID NO: 1207683 - protein, 9 aa, Homo Sapiens
AVVDAAAVP

SEQ ID NO: 1207684 - protein, 9 aa, Homo Sapiens
NKDRANLIN

SEQ ID NO: 1207685 - protein, 9 aa, Homo Sapiens
QIATQPTKS

SEQ ID NO: 1207686 - protein, 9 aa, Homo Sapiens
AAGFERIDF

SEQ ID NO: 1207687 - protein, 9 aa, Homo Sapiens
RHMQIKRAP

SEQ ID NO: 1207688 - protein, 9 aa, Homo Sapiens
EKESSAVSA

SEQ ID NO: 1207689 - protein, 9 aa, Homo Sapiens
PHGNGISWE

SEQ ID NO: 1207690 - protein, 9 aa, Homo Sapiens
YYRNVHAVF

SEQ ID NO: 1207691 - protein, 9 aa, Homo Sapiens
SLRRHNIAI

SEQ ID NO: 1207692 - protein, 9 aa, Homo Sapiens
FLLTYGLSL

SEQ ID NO: 1207693 - protein, 9 aa, Homo Sapiens
KPFRSDSGS

SEQ ID NO: 1207694 - protein, 9 aa, Homo Sapiens
KVDFPYEDK

SEQ ID NO: 1207695 - protein, 9 aa, Homo Sapiens
PRDVSNINC

SEQ ID NO: 1207696 - protein, 9 aa, Homo Sapiens
ENFNASEEA

SEQ ID NO: 1207697 - protein, 9 aa, Homo Sapiens
LDGGEFQCV

SEQ ID NO: 1207698 - protein, 9 aa, Homo Sapiens
PFRSDSGSD

SEQ ID NO: 1207699 - protein, 9 aa, Homo Sapiens
GPLKFMYVA

SEQ ID NO: 1207700 - protein, 9 aa, Homo Sapiens
SFSFLLTYG

SEQ ID NO: 1207701 - protein, 9 aa, Homo Sapiens
YVAIEFSQE

SEQ ID NO: 1207702 - protein, 9 aa, Homo Sapiens
ASFSFLLTY

SEQ ID NO: 1207703 - protein, 9 aa, Homo Sapiens
VFFVYDVTK

SEQ ID NO: 1207704 - protein, 9 aa, Homo Sapiens
RRGCRPMRK

SEQ ID NO: 1207705 - protein, 9 aa, Homo Sapiens
LHSLRRHNI

SEQ ID NO: 1207706 - protein, 9 aa, Homo Sapiens
LGRRGCRPM

SEQ ID NO: 1207707 - protein, 9 aa, Homo Sapiens
GSSNGHVYK

SEQ ID NO: 1207708 - protein, 9 aa, Homo Sapiens
PRVPRDVSN

SEQ ID NO: 1207709 - protein, 9 aa, Homo Sapiens
LRKELVATD

SEQ ID NO: 1207710 - protein, 9 aa, Homo Sapiens
ERIDFNFER

SEQ ID NO: 1207711 - protein, 9 aa, Homo Sapiens
IDYVQQKKT

SEQ ID NO: 1207712 - protein, 9 aa, Homo Sapiens
CTQHKSFEG

SEQ ID NO: 1207713 - protein, 9 aa, Homo Sapiens
NFLDMNFQS

SEQ ID NO: 1207714 - protein, 9 aa, Homo Sapiens
CNSGTQSRQ

SEQ ID NO: 1207715 - protein, 9 aa, Homo Sapiens
DVSNINCEE

SEQ ID NO: 1207716 - protein, 9 aa, Homo Sapiens
LDEYKDGDK

SEQ ID NO: 1207717 - protein, 9 aa, Homo Sapiens
ACASDHVKV

SEQ ID NO: 1207718 - protein, 9 aa, Homo Sapiens
DRPNTSKIL

SEQ ID NO: 1207719 - protein, 9 aa, Homo Sapiens
YRNVHAVFF

SEQ ID NO: 1207720 - protein, 9 aa, Homo Sapiens
MRGLLQCIM

SEQ ID NO: 1207721 - protein, 9 aa, Homo Sapiens
SKILRTLTV

SEQ ID NO: 1207722 - protein, 9 aa, Homo Sapiens
LSLRKELVA

SEQ ID NO: 1207723 - protein, 9 aa, Homo Sapiens
QRQIVVDKY

SEQ ID NO: 1207724 - protein, 9 aa, Homo Sapiens
KGTCLRFSP

SEQ ID NO: 1207725 - protein, 9 aa, Homo Sapiens
SICFSSGNC

SEQ ID NO: 1207726 - protein, 9 aa, Homo Sapiens
AVFFVYDVT

SEQ ID NO: 1207727 - protein, 9 aa, Homo Sapiens
SFLLTYGLS

SEQ ID NO: 1207728 - protein, 9 aa, Homo Sapiens
MDLEAKGTC

SEQ ID NO: 1207729 - protein, 9 aa, Homo Sapiens
ELVATDVGD

SEQ ID NO: 1207730 - protein, 9 aa, Homo Sapiens
CWERHMQIK

SEQ ID NO: 1207731 - protein, 9 aa, Homo Sapiens
PYEDKLVGY

SEQ ID NO: 1207732 - protein, 9 aa, Homo Sapiens
QAVVDAAAV

SEQ ID NO: 1207733 - protein, 9 aa, Homo Sapiens
LDVSGNSAE

SEQ ID NO: 1207734 - protein, 9 aa, Homo Sapiens
RNLRKPFRS

SEQ ID NO: 1207735 - protein, 9 aa, Homo Sapiens
AGISLGLDV

SEQ ID NO: 1207736 - protein, 9 aa, Homo Sapiens
LIDYVQQKK

SEQ ID NO: 1207737 - protein, 9 aa, Homo Sapiens
KESSAVSAR

SEQ ID NO: 1207738 - protein, 9 aa, Homo Sapiens
KFMYVAIEF

SEQ ID NO: 1207739 - protein, 9 aa, Homo Sapiens
TSKILRTLT

SEQ ID NO: 1207740 - protein, 9 aa, Homo Sapiens
QIRQALELR

SEQ ID NO: 1207741 - protein, 9 aa, Homo Sapiens
QAPSAAVAT

SEQ ID NO: 1207742 - protein, 9 aa, Homo Sapiens
VYKKLSSIE

SEQ ID NO: 1207743 - protein, 9 aa, Homo Sapiens
LSQAVVDAA

SEQ ID NO: 1207744 - protein, 9 aa, Homo Sapiens
LMRGLLQCI

SEQ ID NO: 1207745 - protein, 9 aa, Homo Sapiens
LKFMYVAIE

SEQ ID NO: 1207746 - protein, 9 aa, Homo Sapiens
PTFSSWLGL

SEQ ID NO: 1207747 - protein, 9 aa, Homo Sapiens
IAFPSDEHM

SEQ ID NO: 1207748 - protein, 9 aa, Homo Sapiens
ASLSLRKEL

SEQ ID NO: 1207749 - protein, 9 aa, Homo Sapiens
KINPYVLSN

SEQ ID NO: 1207750 - protein, 9 aa, Homo Sapiens
DNLLRISIP

SEQ ID NO: 1207751 - protein, 9 aa, Homo Sapiens
FNASEEAAR

SEQ ID NO: 1207752 - protein, 9 aa, Homo Sapiens
KQIRQALEL

SEQ ID NO: 1207753 - protein, 9 aa, Homo Sapiens
REREREREQ

SEQ ID NO: 1207754 - protein, 9 aa, Homo Sapiens
RSIGKRTRR

SEQ ID NO: 1207755 - protein, 9 aa, Homo Sapiens
AGAPAEGAR

SEQ ID NO: 1207756 - protein, 9 aa, Homo Sapiens
AGAGGAVEP

SEQ ID NO: 1207757 - protein, 9 aa, Homo Sapiens
HLSHRRRNK

SEQ ID NO: 1207758 - protein, 9 aa, Homo Sapiens
TQGPGPAGI

SEQ ID NO: 1207759 - protein, 9 aa, Homo Sapiens
APAEGARAR

SEQ ID NO: 1207760 - protein, 9 aa, Homo Sapiens
VRTQGTGNT

SEQ ID NO: 1207761 - protein, 9 aa, Homo Sapiens
CIQGLEEMQ

SEQ ID NO: 1207762 - protein, 9 aa, Homo Sapiens
ARHHVPPAP

SEQ ID NO: 1207763 - protein, 9 aa, Homo Sapiens
NLNTQDAQK

SEQ ID NO: 1207764 - protein, 9 aa, Homo Sapiens
GAAAEEGGV

SEQ ID NO: 1207765 - protein, 9 aa, Homo Sapiens
ALPTAGAQG

SEQ ID NO: 1207766 - protein, 9 aa, Homo Sapiens
EKQHGRSIG

SEQ ID NO: 1207767 - protein, 9 aa, Homo Sapiens
AAVARLARP

SEQ ID NO: 1207768 - protein, 9 aa, Homo Sapiens
QGGRGAGIE

SEQ ID NO: 1207769 - protein, 9 aa, Homo Sapiens
LRKQLSWFC

SEQ ID NO: 1207770 - protein, 9 aa, Homo Sapiens
LLSLVVQIQ

SEQ ID NO: 1207771 - protein, 9 aa, Homo Sapiens
GIRRAPGRR

SEQ ID NO: 1207772 - protein, 9 aa, Homo Sapiens
ARARAGAGA

SEQ ID NO: 1207773 - protein, 9 aa, Homo Sapiens
AGGALPTAG

SEQ ID NO: 1207774 - protein, 9 aa, Homo Sapiens
EREREQTAR

SEQ ID NO: 1207775 - protein, 9 aa, Homo Sapiens
EELLSLVVQ

SEQ ID NO: 1207776 - protein, 9 aa, Homo Sapiens
KQHGRSIGK

SEQ ID NO: 1207777 - protein, 9 aa, Homo Sapiens
GALPTAGAQ

SEQ ID NO: 1207778 - protein, 9 aa, Homo Sapiens
RRGSATAAA

SEQ ID NO: 1207779 - protein, 9 aa, Homo Sapiens
SIGKRTRRY

SEQ ID NO: 1207780 - protein, 9 aa, Homo Sapiens
SVYLELTDS

SEQ ID NO: 1207781 - protein, 9 aa, Homo Sapiens
AGAGAGPRA

SEQ ID NO: 1207782 - protein, 9 aa, Homo Sapiens
GTERQPQAI

SEQ ID NO: 1207783 - protein, 9 aa, Homo Sapiens
AMPSPEARV

SEQ ID NO: 1207784 - protein, 9 aa, Homo Sapiens
RRAPGRRGS

SEQ ID NO: 1207785 - protein, 9 aa, Homo Sapiens
IEGQESPAL

SEQ ID NO: 1207786 - protein, 9 aa, Homo Sapiens
RTRRYRSHP

SEQ ID NO: 1207787 - protein, 9 aa, Homo Sapiens
LGFQIKKKN

SEQ ID NO: 1207788 - protein, 9 aa, Homo Sapiens
LVVQIQPDF

SEQ ID NO: 1207789 - protein, 9 aa, Homo Sapiens
GPRAGAPAE

SEQ ID NO: 1207790 - protein, 9 aa, Homo Sapiens
EREQTARAR

SEQ ID NO: 1207791 - protein, 9 aa, Homo Sapiens
QGAAAEEGG

SEQ ID NO: 1207792 - protein, 9 aa, Homo Sapiens
QSRPYNVSA

SEQ ID NO: 1207793 - protein, 9 aa, Homo Sapiens
DESKEGCIQ

SEQ ID NO: 1207794 - protein, 9 aa, Homo Sapiens
THKFPLLPH

SEQ ID NO: 1207795 - protein, 9 aa, Homo Sapiens
ERQPQAIEF

SEQ ID NO: 1207796 - protein, 9 aa, Homo Sapiens
TRRYRSHPR

SEQ ID NO: 1207797 - protein, 9 aa, Homo Sapiens
PLNWLQSRP

SEQ ID NO: 1207798 - protein, 9 aa, Homo Sapiens
MDESKEGCI

SEQ ID NO: 1207799 - protein, 9 aa, Homo Sapiens
IRRAPGRRG

SEQ ID NO: 1207800 - protein, 9 aa, Homo Sapiens
AGARARQGA

SEQ ID NO: 1207801 - protein, 9 aa, Homo Sapiens
YSTPSVYLE

SEQ ID NO: 1207802 - protein, 9 aa, Homo Sapiens
APAGSTRVP

SEQ ID NO: 1207803 - protein, 9 aa, Homo Sapiens
MAPTQGPGP

SEQ ID NO: 1207804 - protein, 9 aa, Homo Sapiens
KLRKKKKKT

SEQ ID NO: 1207805 - protein, 9 aa, Homo Sapiens
RAMPSPEAR

SEQ ID NO: 1207806 - protein, 9 aa, Homo Sapiens
WLQSRPYNV

SEQ ID NO: 1207807 - protein, 9 aa, Homo Sapiens
SDTLKEAST

SEQ ID NO: 1207808 - protein, 9 aa, Homo Sapiens
QTARARAGA

SEQ ID NO: 1207809 - protein, 9 aa, Homo Sapiens
SLVVQIQPD

SEQ ID NO: 1207810 - protein, 9 aa, Homo Sapiens
DTLKEASTH

SEQ ID NO: 1207811 - protein, 9 aa, Homo Sapiens
AEGARARAG

SEQ ID NO: 1207812 - protein, 9 aa, Homo Sapiens
AAEEGGVGA

SEQ ID NO: 1207813 - protein, 9 aa, Homo Sapiens
PAPGGPFGP

SEQ ID NO: 1207814 - protein, 9 aa, Homo Sapiens
VPPAPGGPF

SEQ ID NO: 1207815 - protein, 9 aa, Homo Sapiens
ARARQGAAA

SEQ ID NO: 1207816 - protein, 9 aa, Homo Sapiens
LSLVVQIQP

SEQ ID NO: 1207817 - protein, 9 aa, Homo Sapiens
PSVYLELTD

SEQ ID NO: 1207818 - protein, 9 aa, Homo Sapiens
AAAVARLAR

SEQ ID NO: 1207819 - protein, 9 aa, Homo Sapiens
AAAEEGGVG

SEQ ID NO: 1207820 - protein, 9 aa, Homo Sapiens
PDHPHLSHR

SEQ ID NO: 1207821 - protein, 9 aa, Homo Sapiens
STPSVYLEL

SEQ ID NO: 1207822 - protein, 9 aa, Homo Sapiens
KKKKKTEKQ

SEQ ID NO: 1207823 - protein, 9 aa, Homo Sapiens
QLRKQLSWF

SEQ ID NO: 1207824 - protein, 9 aa, Homo Sapiens
AEELLSLVV

SEQ ID NO: 1207825 - protein, 9 aa, Homo Sapiens
AAARHHVPP

SEQ ID NO: 1207826 - protein, 9 aa, Homo Sapiens
ATAAARHHV

SEQ ID NO: 1207827 - protein, 9 aa, Homo Sapiens
PAGIRRAPG

SEQ ID NO: 1207828 - protein, 9 aa, Homo Sapiens
RAPAGSTRV

SEQ ID NO: 1207829 - protein, 9 aa, Homo Sapiens
VEPTGAAAV

SEQ ID NO: 1207830 - protein, 9 aa, Homo Sapiens
LNWLQSRPY

SEQ ID NO: 1207831 - protein, 9 aa, Homo Sapiens
HVPPAPGGP

SEQ ID NO: 1207832 - protein, 9 aa, Homo Sapiens
RAGAGAGPR

SEQ ID NO: 1207833 - protein, 9 aa, Homo Sapiens
RKKKKKTEK

SEQ ID NO: 1207834 - protein, 9 aa, Homo Sapiens
VPLNWLQSR

SEQ ID NO: 1207835 - protein, 9 aa, Homo Sapiens
AQGGRGAGI

SEQ ID NO: 1207836 - protein, 9 aa, Homo Sapiens
EKQEKQHGR

SEQ ID NO: 1207837 - protein, 9 aa, Homo Sapiens
EGARARAGA

SEQ ID NO: 1207838 - protein, 9 aa, Homo Sapiens
RGAGIEGQE

SEQ ID NO: 1207839 - protein, 9 aa, Homo Sapiens
LKEASTHYI

SEQ ID NO: 1207840 - protein, 9 aa, Homo Sapiens
ARAGAGAGP

SEQ ID NO: 1207841 - protein, 9 aa, Homo Sapiens
MPSPEARVL

SEQ ID NO: 1207842 - protein, 9 aa, Homo Sapiens
KKTEKQEKQ

SEQ ID NO: 1207843 - protein, 9 aa, Homo Sapiens
SHRRRNKRY

SEQ ID NO: 1207844 - protein, 9 aa, Homo Sapiens
KEGCIQGLE

SEQ ID NO: 1207845 - protein, 9 aa, Homo Sapiens
SQAANGTER

SEQ ID NO: 1207846 - protein, 9 aa, Homo Sapiens
FGPRAPAGS

SEQ ID NO: 1207847 - protein, 9 aa, Homo Sapiens
EPTGAAAVA

SEQ ID NO: 1207848 - protein, 9 aa, Homo Sapiens
STHYIMATD

SEQ ID NO: 1207849 - protein, 9 aa, Homo Sapiens
GGALPTAGA

SEQ ID NO: 1207850 - protein, 9 aa, Homo Sapiens
AANGTERQP

SEQ ID NO: 1207851 - protein, 9 aa, Homo Sapiens
VPAGAGGAV

SEQ ID NO: 1207852 - protein, 9 aa, Homo Sapiens
GARARQGAA

SEQ ID NO: 1207853 - protein, 9 aa, Homo Sapiens
CGLRAMPSP

SEQ ID NO: 1207854 - protein, 9 aa, Homo Sapiens
GGPFGPRAP

SEQ ID NO: 1207855 - protein, 9 aa, Homo Sapiens
RRYRSHPRE

SEQ ID NO: 1207856 - protein, 9 aa, Homo Sapiens
PGPAGIRRA

SEQ ID NO: 1207857 - protein, 9 aa, Homo Sapiens
REREQTARA

SEQ ID NO: 1207858 - protein, 9 aa, Homo Sapiens
CKCKECGKA

SEQ ID NO: 1207859 - protein, 9 aa, Homo Sapiens
TRVPAGAGG

SEQ ID NO: 1207860 - protein, 9 aa, Homo Sapiens
SKEGCIQGL

SEQ ID NO: 1207861 - protein, 9 aa, Homo Sapiens
APGRRGSAT

SEQ ID NO: 1207862 - protein, 9 aa, Homo Sapiens
VSDTLKEAS

SEQ ID NO: 1207863 - protein, 9 aa, Homo Sapiens
RQGAAAEEG

SEQ ID NO: 1207864 - protein, 9 aa, Homo Sapiens
RGSATAAAR

SEQ ID NO: 1207865 - protein, 9 aa, Homo Sapiens
QEKQHGRSI

SEQ ID NO: 1207866 - protein, 9 aa, Homo Sapiens
VARLARPAG

SEQ ID NO: 1207867 - protein, 9 aa, Homo Sapiens
GSTRVPAGA

SEQ ID NO: 1207868 - protein, 9 aa, Homo Sapiens
GAGPRAGAP

SEQ ID NO: 1207869 - protein, 9 aa, Homo Sapiens
RTQGTGNTH

SEQ ID NO: 1207870 - protein, 9 aa, Homo Sapiens
MHTGEKPCK

SEQ ID NO: 1207871 - protein, 9 aa, Homo Sapiens
TGAAAVARL

SEQ ID NO: 1207872 - protein, 9 aa, Homo Sapiens
NTQDAQKRT

SEQ ID NO: 1207873 - protein, 9 aa, Homo Sapiens
REREREQTA

SEQ ID NO: 1207874 - protein, 9 aa, Homo Sapiens
TINLNTQDA

SEQ ID NO: 1207875 - protein, 9 aa, Homo Sapiens
HKFPLLPHR

SEQ ID NO: 1207876 - protein, 9 aa, Homo Sapiens
GGRGAGIEG

SEQ ID NO: 1207877 - protein, 9 aa, Homo Sapiens
AGAGPRAGA

SEQ ID NO: 1207878 - protein, 9 aa, Homo Sapiens
AGGAVEPTG

SEQ ID NO: 1207879 - protein, 9 aa, Homo Sapiens
KRTRRYRSH

SEQ ID NO: 1207880 - protein, 9 aa, Homo Sapiens
GQESPALSY

SEQ ID NO: 1207881 - protein, 9 aa, Homo Sapiens
PGGPFGPRA

SEQ ID NO: 1207882 - protein, 9 aa, Homo Sapiens
AARHHVPPA

SEQ ID NO: 1207883 - protein, 9 aa, Homo Sapiens
ARAGARARQ

SEQ ID NO: 1207884 - protein, 9 aa, Homo Sapiens
LARPAGGAL

SEQ ID NO: 1207885 - protein, 9 aa, Homo Sapiens
QLSWFCLSQ

SEQ ID NO: 1207886 - protein, 9 aa, Homo Sapiens
SATAAARHH

SEQ ID NO: 1207887 - protein, 9 aa, Homo Sapiens
AVEPTGAAA

SEQ ID NO: 1207888 - protein, 9 aa, Homo Sapiens
LSHRRRNKR

SEQ ID NO: 1207889 - protein, 9 aa, Homo Sapiens
KTINLNTQD

SEQ ID NO: 1207890 - protein, 9 aa, Homo Sapiens
KQLSWFCLS

SEQ ID NO: 1207891 - protein, 9 aa, Homo Sapiens
LNTQDAQKR

SEQ ID NO: 1207892 - protein, 9 aa, Homo Sapiens
ARLARPAGG

SEQ ID NO: 1207893 - protein, 9 aa, Homo Sapiens
RMHTGEKPC

SEQ ID NO: 1207894 - protein, 9 aa, Homo Sapiens
ANGTERQPQ

SEQ ID NO: 1207895 - protein, 9 aa, Homo Sapiens
EREREREQT

SEQ ID NO: 1207896 - protein, 9 aa, Homo Sapiens
PAGSTRVPA

SEQ ID NO: 1207897 - protein, 9 aa, Homo Sapiens
APGGPFGPR

SEQ ID NO: 1207898 - protein, 9 aa, Homo Sapiens
AGAQGGRGA

SEQ ID NO: 1207899 - protein, 9 aa, Homo Sapiens
HRRRNKRYA

SEQ ID NO: 1207900 - protein, 9 aa, Homo Sapiens
TQVPLNWLQ

SEQ ID NO: 1207901 - protein, 9 aa, Homo Sapiens
KMDESKEGC

SEQ ID NO: 1207902 - protein, 9 aa, Homo Sapiens
TAAARHHVP

SEQ ID NO: 1207903 - protein, 9 aa, Homo Sapiens
GAQGGRGAG

SEQ ID NO: 1207904 - protein, 9 aa, Homo Sapiens
GTGNTHDCN

SEQ ID NO: 1207905 - protein, 9 aa, Homo Sapiens
TLKEASTHY

SEQ ID NO: 1207906 - protein, 9 aa, Homo Sapiens
TARARAGAG

SEQ ID NO: 1207907 - protein, 9 aa, Homo Sapiens
RARAGAGAG

SEQ ID NO: 1207908 - protein, 9 aa, Homo Sapiens
PRAGAPAEG

SEQ ID NO: 1207909 - protein, 9 aa, Homo Sapiens
TERQPQAIE

SEQ ID NO: 1207910 - protein, 9 aa, Homo Sapiens
RAPGRRGSA

SEQ ID NO: 1207911 - protein, 9 aa, Homo Sapiens
RKKTINLNT

SEQ ID NO: 1207912 - protein, 9 aa, Homo Sapiens
ICGLRAMPS

SEQ ID NO: 1207913 - protein, 9 aa, Homo Sapiens
QGPGPAGIR

SEQ ID NO: 1207914 - protein, 9 aa, Homo Sapiens
RARAGARAR

SEQ ID NO: 1207915 - protein, 9 aa, Homo Sapiens
PAGGALPTA

SEQ ID NO: 1207916 - protein, 9 aa, Homo Sapiens
GKRTRRYRS

SEQ ID NO: 1207917 - protein, 9 aa, Homo Sapiens
GPRAPAGST

SEQ ID NO: 1207918 - protein, 9 aa, Homo Sapiens
PQLRKQLSW

SEQ ID NO: 1207919 - protein, 9 aa, Homo Sapiens
THVRTQGTG

SEQ ID NO: 1207920 - protein, 9 aa, Homo Sapiens
ARQGAAAEE

SEQ ID NO: 1207921 - protein, 9 aa, Homo Sapiens
PTGAAAVAR

SEQ ID NO: 1207922 - protein, 9 aa, Homo Sapiens
GPFGPRAPA

SEQ ID NO: 1207923 - protein, 9 aa, Homo Sapiens
PGRRGSATA

SEQ ID NO: 1207924 - protein, 9 aa, Homo Sapiens
EAEELLSLV

SEQ ID NO: 1207925 - protein, 9 aa, Homo Sapiens
KTEKQEKQH

SEQ ID NO: 1207926 - protein, 9 aa, Homo Sapiens
GPAGIRRAP

SEQ ID NO: 1207927 - protein, 9 aa, Homo Sapiens
LPTAGAQGG

SEQ ID NO: 1207928 - protein, 9 aa, Homo Sapiens
NWLQSRPYN

SEQ ID NO: 1207929 - protein, 9 aa, Homo Sapiens
ARPAGGALP

SEQ ID NO: 1207930 - protein, 9 aa, Homo Sapiens
GCIQGLEEM

SEQ ID NO: 1207931 - protein, 9 aa, Homo Sapiens
LRKKKKKTE

SEQ ID NO: 1207932 - protein, 9 aa, Homo Sapiens
LKTHVRTQG

SEQ ID NO: 1207933 - protein, 9 aa, Homo Sapiens
DHPHLSHRR

SEQ ID NO: 1207934 - protein, 9 aa, Homo Sapiens
AGSTRVPAG

SEQ ID NO: 1207935 - protein, 9 aa, Homo Sapiens
GPGPAGIRR

SEQ ID NO: 1207936 - protein, 9 aa, Homo Sapiens
LSWFCLSQP

SEQ ID NO: 1207937 - protein, 9 aa, Homo Sapiens
NGTERQPQA

SEQ ID NO: 1207938 - protein, 9 aa, Homo Sapiens
DSISSSSSA

SEQ ID NO: 1207939 - protein, 9 aa, Homo Sapiens
AGPRAGAPA

SEQ ID NO: 1207940 - protein, 9 aa, Homo Sapiens
INLNTQDAQ

SEQ ID NO: 1207941 - protein, 9 aa, Homo Sapiens
GSATAAARH

SEQ ID NO: 1207942 - protein, 9 aa, Homo Sapiens
TPSVYLELT

SEQ ID NO: 1207943 - protein, 9 aa, Homo Sapiens
QGTGNTHDC

SEQ ID NO: 1207944 - protein, 9 aa, Homo Sapiens
RPAGGALPT

SEQ ID NO: 1207945 - protein, 9 aa, Homo Sapiens
TAGAQGGRG

SEQ ID NO: 1207946 - protein, 9 aa, Homo Sapiens
STRVPAGAG

SEQ ID NO: 1207947 - protein, 9 aa, Homo Sapiens
LRAMPSPEA

SEQ ID NO: 1207948 - protein, 9 aa, Homo Sapiens
GAGIEGQES

SEQ ID NO: 1207949 - protein, 9 aa, Homo Sapiens
RLARPAGGA

SEQ ID NO: 1207950 - protein, 9 aa, Homo Sapiens
QHGRSIGKR

SEQ ID NO: 1207951 - protein, 9 aa, Homo Sapiens
PAGAGGAVE

SEQ ID NO: 1207952 - protein, 9 aa, Homo Sapiens
EQTARARAG

SEQ ID NO: 1207953 - protein, 9 aa, Homo Sapiens
GRGAGIEGQ

SEQ ID NO: 1207954 - protein, 9 aa, Homo Sapiens
GAAAVARLA

SEQ ID NO: 1207955 - protein, 9 aa, Homo Sapiens
HPHLSHRRR

SEQ ID NO: 1207956 - protein, 9 aa, Homo Sapiens
HHVPPAPGG

SEQ ID NO: 1207957 - protein, 9 aa, Homo Sapiens
LPQLRKQLS

SEQ ID NO: 1207958 - protein, 9 aa, Homo Sapiens
APTQGPGPA

SEQ ID NO: 1207959 - protein, 9 aa, Homo Sapiens
PRAPAGSTR

SEQ ID NO: 1207960 - protein, 9 aa, Homo Sapiens
RQPQAIEFR

SEQ ID NO: 1207961 - protein, 9 aa, Homo Sapiens
ARARAGARA

SEQ ID NO: 1207962 - protein, 9 aa, Homo Sapiens
RKQLSWFCL

SEQ ID NO: 1207963 - protein, 9 aa, Homo Sapiens
EPICGLRAM

SEQ ID NO: 1207964 - protein, 9 aa, Homo Sapiens
KKKKTEKQE

SEQ ID NO: 1207965 - protein, 9 aa, Homo Sapiens
ESKEGCIQG

SEQ ID NO: 1207966 - protein, 9 aa, Homo Sapiens
LQSRPYNVS

SEQ ID NO: 1207967 - protein, 9 aa, Homo Sapiens
EASTHYIMA

SEQ ID NO: 1207968 - protein, 9 aa, Homo Sapiens
PTAGAQGGR

SEQ ID NO: 1207969 - protein, 9 aa, Homo Sapiens
RVPAGAGGA

SEQ ID NO: 1207970 - protein, 9 aa, Homo Sapiens
ASTHYIMAT

SEQ ID NO: 1207971 - protein, 9 aa, Homo Sapiens
RAGAPAEGA

SEQ ID NO: 1207972 - protein, 9 aa, Homo Sapiens
RYRSHPRED

SEQ ID NO: 1207973 - protein, 9 aa, Homo Sapiens
PAEGARARA

SEQ ID NO: 1207974 - protein, 9 aa, Homo Sapiens
VYLELTDSC

SEQ ID NO: 1207975 - protein, 9 aa, Homo Sapiens
GAGGAVEPT

SEQ ID NO: 1207976 - protein, 9 aa, Homo Sapiens
PPAPGGPFG

SEQ ID NO: 1207977 - protein, 9 aa, Homo Sapiens
RARQGAAAE

SEQ ID NO: 1207978 - protein, 9 aa, Homo Sapiens
ELLSLVVQI

SEQ ID NO: 1207979 - protein, 9 aa, Homo Sapiens
GAVEPTGAA

SEQ ID NO: 1207980 - protein, 9 aa, Homo Sapiens
RAGARARQG

SEQ ID NO: 1207981 - protein, 9 aa, Homo Sapiens
AGIRRAPGR

SEQ ID NO: 1207982 - protein, 9 aa, Homo Sapiens
PFGPRAPAG

SEQ ID NO: 1207983 - protein, 9 aa, Homo Sapiens
QVPLNWLQS

SEQ ID NO: 1207984 - protein, 9 aa, Homo Sapiens
IGKRTRRYR

SEQ ID NO: 1207985 - protein, 9 aa, Homo Sapiens
PTQGPGPAG

SEQ ID NO: 1207986 - protein, 9 aa, Homo Sapiens
TEKQEKQHG

SEQ ID NO: 1207987 - protein, 9 aa, Homo Sapiens
HVRTQGTGN

SEQ ID NO: 1207988 - protein, 9 aa, Homo Sapiens
AGIEGQESP

SEQ ID NO: 1207989 - protein, 9 aa, Homo Sapiens
PICGLRAMP

SEQ ID NO: 1207990 - protein, 9 aa, Homo Sapiens
AVARLARPA

SEQ ID NO: 1207991 - protein, 9 aa, Homo Sapiens
RHHVPPAPG

SEQ ID NO: 1207992 - protein, 9 aa, Homo Sapiens
REQTARARA

SEQ ID NO: 1207993 - protein, 9 aa, Homo Sapiens
GRRGSATAA

SEQ ID NO: 1207994 - protein, 9 aa, Homo Sapiens
GAGAGPRAG

SEQ ID NO: 1207995 - protein, 9 aa, Homo Sapiens
EGQESPALS

SEQ ID NO: 1207996 - protein, 9 aa, Homo Sapiens
GIEGQESPA

SEQ ID NO: 1207997 - protein, 9 aa, Homo Sapiens
TQGTGNTHD

SEQ ID NO: 1207998 - protein, 9 aa, Homo Sapiens
EGCIQGLEE

SEQ ID NO: 1207999 - protein, 9 aa, Homo Sapiens
GGAVEPTGA

SEQ ID NO: 1208000 - protein, 9 aa, Homo Sapiens
SISSSSSAD

SEQ ID NO: 1208001 - protein, 9 aa, Homo Sapiens
VVQIQPDFA

SEQ ID NO: 1208002 - protein, 9 aa, Homo Sapiens
TQDAQKRTA

SEQ ID NO: 1208003 - protein, 9 aa, Homo Sapiens
VPDHPHLSH

SEQ ID NO: 1208004 - protein, 9 aa, Homo Sapiens
GAPAEGARA

SEQ ID NO: 1208005 - protein, 9 aa, Homo Sapiens
SWFCLSQPV

SEQ ID NO: 1208006 - protein, 9 aa, Homo Sapiens
KKTINLNTQ

SEQ ID NO: 1208007 - protein, 9 aa, Homo Sapiens
GLRAMPSPE

SEQ ID NO: 1208008 - protein, 9 aa, Homo Sapiens
HGRSIGKRT

SEQ ID NO: 1208009 - protein, 9 aa, Homo Sapiens
GRSIGKRTR

SEQ ID NO: 1208010 - protein, 9 aa, Homo Sapiens
KEASTHYIM

SEQ ID NO: 1208011 - protein, 9 aa, Homo Sapiens
KKKTEKQEK

SEQ ID NO: 1208012 - protein, 9 aa, Homo Sapiens
KTHVRTQGT

SEQ ID NO: 1208013 - protein, 9 aa, Homo Sapiens
PHLSHRRRN

SEQ ID NO: 1208014 - protein, 9 aa, Homo Sapiens
ISSSSSADD

SEQ ID NO: 1208015 - protein, 9 aa, Homo Sapiens
QAANGTERQ

SEQ ID NO: 1208016 - protein, 9 aa, Homo Sapiens
KQEKQHGRS

SEQ ID NO: 1208017 - protein, 9 aa, Homo Sapiens
SVQNGESSP

SEQ ID NO: 1208018 - protein, 9 aa, Homo Sapiens
WTFRPIEAL

SEQ ID NO: 1208019 - protein, 9 aa, Homo Sapiens
YGPLTFMYM

SEQ ID NO: 1208020 - protein, 9 aa, Homo Sapiens
TRGRWTFRP

SEQ ID NO: 1208021 - protein, 9 aa, Homo Sapiens
KAITKHEMK

SEQ ID NO: 1208022 - protein, 9 aa, Homo Sapiens
ENVSVGLEF

SEQ ID NO: 1208023 - protein, 9 aa, Homo Sapiens
ITKHEMKPV

SEQ ID NO: 1208024 - protein, 9 aa, Homo Sapiens
HVWLWAASS

SEQ ID NO: 1208025 - protein, 9 aa, Homo Sapiens
QVDDGGKAL

SEQ ID NO: 1208026 - protein, 9 aa, Homo Sapiens
VSVGLEFLE

SEQ ID NO: 1208027 - protein, 9 aa, Homo Sapiens
TKHEMKPVL

SEQ ID NO: 1208028 - protein, 9 aa, Homo Sapiens
DHLKAITKH

SEQ ID NO: 1208029 - protein, 9 aa, Homo Sapiens
GGKALGVIS

SEQ ID NO: 1208030 - protein, 9 aa, Homo Sapiens
HTRGRWTFR

SEQ ID NO: 1208031 - protein, 9 aa, Homo Sapiens
EGQVDDGGK

SEQ ID NO: 1208032 - protein, 9 aa, Homo Sapiens
ELACLSVQN

SEQ ID NO: 1208033 - protein, 9 aa, Homo Sapiens
DGGKALGVI

SEQ ID NO: 1208034 - protein, 9 aa, Homo Sapiens
RWTFRPIEA

SEQ ID NO: 1208035 - protein, 9 aa, Homo Sapiens
GPLTFMYMG

SEQ ID NO: 1208036 - protein, 9 aa, Homo Sapiens
LYYGPLTFM

SEQ ID NO: 1208037 - protein, 9 aa, Homo Sapiens
LWAASSSSA

SEQ ID NO: 1208038 - protein, 9 aa, Homo Sapiens
GHTRGRWTF

SEQ ID NO: 1208039 - protein, 9 aa, Homo Sapiens
FRPIEALIN

SEQ ID NO: 1208040 - protein, 9 aa, Homo Sapiens
VQNGESSPS

SEQ ID NO: 1208041 - protein, 9 aa, Homo Sapiens
WDHLKAITK

SEQ ID NO: 1208042 - protein, 9 aa, Homo Sapiens
YYGPLTFMY

SEQ ID NO: 1208043 - protein, 9 aa, Homo Sapiens
SSSSAQLFN

SEQ ID NO: 1208044 - protein, 9 aa, Homo Sapiens
PLTFMYMGS

SEQ ID NO: 1208045 - protein, 9 aa, Homo Sapiens
RGRWTFRPI

SEQ ID NO: 1208046 - protein, 9 aa, Homo Sapiens
SSSAQLFNL

SEQ ID NO: 1208047 - protein, 9 aa, Homo Sapiens
CLSVQNGES

SEQ ID NO: 1208048 - protein, 9 aa, Homo Sapiens
AITKHEMKP

SEQ ID NO: 1208049 - protein, 9 aa, Homo Sapiens
LENVSVGLE

SEQ ID NO: 1208050 - protein, 9 aa, Homo Sapiens
DDGGKALGV

SEQ ID NO: 1208051 - protein, 9 aa, Homo Sapiens
MKLENVSVG

SEQ ID NO: 1208052 - protein, 9 aa, Homo Sapiens
PELACLSVQ

SEQ ID NO: 1208053 - protein, 9 aa, Homo Sapiens
NVSVGLEFL

SEQ ID NO: 1208054 - protein, 9 aa, Homo Sapiens
WLWAASSSS

SEQ ID NO: 1208055 - protein, 9 aa, Homo Sapiens
VDDGGKALG

SEQ ID NO: 1208056 - protein, 9 aa, Homo Sapiens
AASSSSAQL

SEQ ID NO: 1208057 - protein, 9 aa, Homo Sapiens
TFRPIEALI

SEQ ID NO: 1208058 - protein, 9 aa, Homo Sapiens
KLENVSVGL

SEQ ID NO: 1208059 - protein, 9 aa, Homo Sapiens
TPELACLSV

SEQ ID NO: 1208060 - protein, 9 aa, Homo Sapiens
ACLSVQNGE

SEQ ID NO: 1208061 - protein, 9 aa, Homo Sapiens
LKAITKHEM

SEQ ID NO: 1208062 - protein, 9 aa, Homo Sapiens
TFMYMGSAS

SEQ ID NO: 1208063 - protein, 9 aa, Homo Sapiens
SWDHLKAIT

SEQ ID NO: 1208064 - protein, 9 aa, Homo Sapiens
GLEFLEREH

SEQ ID NO: 1208065 - protein, 9 aa, Homo Sapiens
VWLWAASSS

SEQ ID NO: 1208066 - protein, 9 aa, Homo Sapiens
VGLEFLERE

SEQ ID NO: 1208067 - protein, 9 aa, Homo Sapiens
GRWTFRPIE

SEQ ID NO: 1208068 - protein, 9 aa, Homo Sapiens
KNFETRLQH

SEQ ID NO: 1208069 - protein, 9 aa, Homo Sapiens
LTFMYMGSA

SEQ ID NO: 1208070 - protein, 9 aa, Homo Sapiens
ASSSSAQLF

SEQ ID NO: 1208071 - protein, 9 aa, Homo Sapiens
LEEGQVDDG

SEQ ID NO: 1208072 - protein, 9 aa, Homo Sapiens
LSVQNGESS

SEQ ID NO: 1208073 - protein, 9 aa, Homo Sapiens
WAASSSSAQ

SEQ ID NO: 1208074 - protein, 9 aa, Homo Sapiens
LACLSVQNG

SEQ ID NO: 1208075 - protein, 9 aa, Homo Sapiens
SVGLEFLER

SEQ ID NO: 1208076 - protein, 9 aa, Homo Sapiens
EEGQVDDGG

SEQ ID NO: 1208077 - protein, 9 aa, Homo Sapiens
HLKAITKHE

SEQ ID NO: 1208078 - protein, 9 aa, Homo Sapiens
GQVDDGGKA

SEQ ID NO: 1208079 - protein, 9 aa, Homo Sapiens
EELCSLHFL

SEQ ID NO: 1208080 - protein, 9 aa, Homo Sapiens
GHPNPGGNG

SEQ ID NO: 1208081 - protein, 9 aa, Homo Sapiens
MAVVCLSVL

SEQ ID NO: 1208082 - protein, 9 aa, Homo Sapiens
RSGHPEGPP

SEQ ID NO: 1208083 - protein, 9 aa, Homo Sapiens
VVCLSVLAA

SEQ ID NO: 1208084 - protein, 9 aa, Homo Sapiens
KLSLPESLK

SEQ ID NO: 1208085 - protein, 9 aa, Homo Sapiens
GHCEKFVFR

SEQ ID NO: 1208086 - protein, 9 aa, Homo Sapiens
MSVADPWKN

SEQ ID NO: 1208087 - protein, 9 aa, Homo Sapiens
PKLTSVQEN

SEQ ID NO: 1208088 - protein, 9 aa, Homo Sapiens
KGHCEKFVF

SEQ ID NO: 1208089 - protein, 9 aa, Homo Sapiens
KIMKLSLPE

SEQ ID NO: 1208090 - protein, 9 aa, Homo Sapiens
LNCMVPFRS

SEQ ID NO: 1208091 - protein, 9 aa, Homo Sapiens
PQSLGPPGH

SEQ ID NO: 1208092 - protein, 9 aa, Homo Sapiens
ELCSLHFLL

SEQ ID NO: 1208093 - protein, 9 aa, Homo Sapiens
LGPPGHPNP

SEQ ID NO: 1208094 - protein, 9 aa, Homo Sapiens
GPPGHPNPG

SEQ ID NO: 1208095 - protein, 9 aa, Homo Sapiens
KLTSVQENL

SEQ ID NO: 1208096 - protein, 9 aa, Homo Sapiens
LEELCSLHF

SEQ ID NO: 1208097 - protein, 9 aa, Homo Sapiens
IMKLSLPES

SEQ ID NO: 1208098 - protein, 9 aa, Homo Sapiens
VPFRSGHPE

SEQ ID NO: 1208099 - protein, 9 aa, Homo Sapiens
FRSGHPEGP

SEQ ID NO: 1208100 - protein, 9 aa, Homo Sapiens
LSLPESLKA

SEQ ID NO: 1208101 - protein, 9 aa, Homo Sapiens
SLHFLLPGL

SEQ ID NO: 1208102 - protein, 9 aa, Homo Sapiens
LHFLLPGLS

SEQ ID NO: 1208103 - protein, 9 aa, Homo Sapiens
WEVIPHSRP

SEQ ID NO: 1208104 - protein, 9 aa, Homo Sapiens
LTSVQENLN

SEQ ID NO: 1208105 - protein, 9 aa, Homo Sapiens
IGGWEVIPH

SEQ ID NO: 1208106 - protein, 9 aa, Homo Sapiens
QSLGPPGHP

SEQ ID NO: 1208107 - protein, 9 aa, Homo Sapiens
HPNPGGNGV

SEQ ID NO: 1208108 - protein, 9 aa, Homo Sapiens
IIGGWEVIP

SEQ ID NO: 1208109 - protein, 9 aa, Homo Sapiens
GGWEVIPHS

SEQ ID NO: 1208110 - protein, 9 aa, Homo Sapiens
LCSLHFLLP

SEQ ID NO: 1208111 - protein, 9 aa, Homo Sapiens
FGTQIIGGW

SEQ ID NO: 1208112 - protein, 9 aa, Homo Sapiens
GTQIIGGWE

SEQ ID NO: 1208113 - protein, 9 aa, Homo Sapiens
AQPSSIFDT

SEQ ID NO: 1208114 - protein, 9 aa, Homo Sapiens
FLLPGLSPQ

SEQ ID NO: 1208115 - protein, 9 aa, Homo Sapiens
REKIMKLSL

SEQ ID NO: 1208116 - protein, 9 aa, Homo Sapiens
SLGPPGHPN

SEQ ID NO: 1208117 - protein, 9 aa, Homo Sapiens
HFLLPGLSP

SEQ ID NO: 1208118 - protein, 9 aa, Homo Sapiens
SVADPWKNI

SEQ ID NO: 1208119 - protein, 9 aa, Homo Sapiens
CSLHFLLPG

SEQ ID NO: 1208120 - protein, 9 aa, Homo Sapiens
GWEVIPHSR

SEQ ID NO: 1208121 - protein, 9 aa, Homo Sapiens
TQIIGGWEV

SEQ ID NO: 1208122 - protein, 9 aa, Homo Sapiens
VQENLNSWI

SEQ ID NO: 1208123 - protein, 9 aa, Homo Sapiens
FVFRFFQEN

SEQ ID NO: 1208124 - protein, 9 aa, Homo Sapiens
PYAQPSSIF

SEQ ID NO: 1208125 - protein, 9 aa, Homo Sapiens
QIIGGWEVI

SEQ ID NO: 1208126 - protein, 9 aa, Homo Sapiens
QPSSIFDTM

SEQ ID NO: 1208127 - protein, 9 aa, Homo Sapiens
GPKLTSVQE

SEQ ID NO: 1208128 - protein, 9 aa, Homo Sapiens
ADPWKNIQL

SEQ ID NO: 1208129 - protein, 9 aa, Homo Sapiens
DPWKNIQLL

SEQ ID NO: 1208130 - protein, 9 aa, Homo Sapiens
PPGHPNPGG

SEQ ID NO: 1208131 - protein, 9 aa, Homo Sapiens
CMVPFRSGH

SEQ ID NO: 1208132 - protein, 9 aa, Homo Sapiens
SLPESLKAY

SEQ ID NO: 1208133 - protein, 9 aa, Homo Sapiens
PGHPNPGGN

SEQ ID NO: 1208134 - protein, 9 aa, Homo Sapiens
NCMVPFRSG

SEQ ID NO: 1208135 - protein, 9 aa, Homo Sapiens
VFRFFQENF

SEQ ID NO: 1208136 - protein, 9 aa, Homo Sapiens
PSSIFDTMS

SEQ ID NO: 1208137 - protein, 9 aa, Homo Sapiens
EKFVFRFFQ

SEQ ID NO: 1208138 - protein, 9 aa, Homo Sapiens
YGPKLTSVQ

SEQ ID NO: 1208139 - protein, 9 aa, Homo Sapiens
VADPWKNIQ

SEQ ID NO: 1208140 - protein, 9 aa, Homo Sapiens
WKNIQLLYS

SEQ ID NO: 1208141 - protein, 9 aa, Homo Sapiens
LREKIMKLS

SEQ ID NO: 1208142 - protein, 9 aa, Homo Sapiens
YAQPSSIFD

SEQ ID NO: 1208143 - protein, 9 aa, Homo Sapiens
QENLNSWIE

SEQ ID NO: 1208144 - protein, 9 aa, Homo Sapiens
PWKNIQLLY

SEQ ID NO: 1208145 - protein, 9 aa, Homo Sapiens
HCEKFVFRF

SEQ ID NO: 1208146 - protein, 9 aa, Homo Sapiens
SIFDTMSPA

SEQ ID NO: 1208147 - protein, 9 aa, Homo Sapiens
MVPFRSGHP

SEQ ID NO: 1208148 - protein, 9 aa, Homo Sapiens
KFVFRFFQE

SEQ ID NO: 1208149 - protein, 9 aa, Homo Sapiens
CEKFVFRFF

SEQ ID NO: 1208150 - protein, 9 aa, Homo Sapiens
KNIQLLYSQ

SEQ ID NO: 1208151 - protein, 9 aa, Homo Sapiens
AVVCLSVLA

SEQ ID NO: 1208152 - protein, 9 aa, Homo Sapiens
ILNCMVPFR

SEQ ID NO: 1208153 - protein, 9 aa, Homo Sapiens
SPYAQPSSI

SEQ ID NO: 1208154 - protein, 9 aa, Homo Sapiens
TSVQENLNS

SEQ ID NO: 1208155 - protein, 9 aa, Homo Sapiens
SSIFDTMSP

SEQ ID NO: 1208156 - protein, 9 aa, Homo Sapiens
IFDTMSPAP

SEQ ID NO: 1208157 - protein, 9 aa, Homo Sapiens
EKIMKLSLP

SEQ ID NO: 1208158 - protein, 9 aa, Homo Sapiens
LKGHCEKFV

SEQ ID NO: 1208159 - protein, 9 aa, Homo Sapiens
SVQENLNSW

SEQ ID NO: 1208160 - protein, 9 aa, Homo Sapiens
PFRSGHPEG

SEQ ID NO: 1208161 - protein, 9 aa, Homo Sapiens
MKLSLPESL

SEQ ID NO: 1208162 - protein, 9 aa, Homo Sapiens
NIQLLYSQH

SEQ ID NO: 1208163 - protein, 9 aa, Homo Sapiens
VSLSGTLPF

SEQ ID NO: 1208164 - protein, 9 aa, Homo Sapiens
SLPELEDWL

SEQ ID NO: 1208165 - protein, 9 aa, Homo Sapiens
DIIEEEPTW

SEQ ID NO: 1208166 - protein, 9 aa, Homo Sapiens
VLSHLPSHH

SEQ ID NO: 1208167 - protein, 9 aa, Homo Sapiens
TLSSYPVKS

SEQ ID NO: 1208168 - protein, 9 aa, Homo Sapiens
SMLFTTSPM

SEQ ID NO: 1208169 - protein, 9 aa, Homo Sapiens
VWSLEPEDF

SEQ ID NO: 1208170 - protein, 9 aa, Homo Sapiens
VFTLKKGRS

SEQ ID NO: 1208171 - protein, 9 aa, Homo Sapiens
NEKLGTSVV

SEQ ID NO: 1208172 - protein, 9 aa, Homo Sapiens
ILDTAGREE

SEQ ID NO: 1208173 - protein, 9 aa, Homo Sapiens
REEYSAMRD

SEQ ID NO: 1208174 - protein, 9 aa, Homo Sapiens
LDILDTAGR

SEQ ID NO: 1208175 - protein, 9 aa, Homo Sapiens
LERFKPYCN

SEQ ID NO: 1208176 - protein, 9 aa, Homo Sapiens
HMRETSVFT

SEQ ID NO: 1208177 - protein, 9 aa, Homo Sapiens
GAETSSAIR

SEQ ID NO: 1208178 - protein, 9 aa, Homo Sapiens
EAVGPEVLQ

SEQ ID NO: 1208179 - protein, 9 aa, Homo Sapiens
VSLPELEDW

SEQ ID NO: 1208180 - protein, 9 aa, Homo Sapiens
SIHYKSMVI

SEQ ID NO: 1208181 - protein, 9 aa, Homo Sapiens
DILDTAGRE

SEQ ID NO: 1208182 - protein, 9 aa, Homo Sapiens
LEPEDFSAV

SEQ ID NO: 1208183 - protein, 9 aa, Homo Sapiens
SVFTLKKGR

SEQ ID NO: 1208184 - protein, 9 aa, Homo Sapiens
YYVTDDKYG

SEQ ID NO: 1208185 - protein, 9 aa, Homo Sapiens
LEPFWPSML

SEQ ID NO: 1208186 - protein, 9 aa, Homo Sapiens
PSMLFTTSP

SEQ ID NO: 1208187 - protein, 9 aa, Homo Sapiens
LLERFKPYC

SEQ ID NO: 1208188 - protein, 9 aa, Homo Sapiens
GPLEPFWPS

SEQ ID NO: 1208189 - protein, 9 aa, Homo Sapiens
LPFNEDEDI

SEQ ID NO: 1208190 - protein, 9 aa, Homo Sapiens
VKSMMGAPI

SEQ ID NO: 1208191 - protein, 9 aa, Homo Sapiens
ACNEKLGTS

SEQ ID NO: 1208192 - protein, 9 aa, Homo Sapiens
MRETSVFTL

SEQ ID NO: 1208193 - protein, 9 aa, Homo Sapiens
TSPMCVSYW

SEQ ID NO: 1208194 - protein, 9 aa, Homo Sapiens
YWLSTRLGS

SEQ ID NO: 1208195 - protein, 9 aa, Homo Sapiens
GGFLLMTNH

SEQ ID NO: 1208196 - protein, 9 aa, Homo Sapiens
AINVLSHLP

SEQ ID NO: 1208197 - protein, 9 aa, Homo Sapiens
ARAECSACL

SEQ ID NO: 1208198 - protein, 9 aa, Homo Sapiens
WSLEPEDFS

SEQ ID NO: 1208199 - protein, 9 aa, Homo Sapiens
YPVKSMMGA

SEQ ID NO: 1208200 - protein, 9 aa, Homo Sapiens
KEAINVLSH

SEQ ID NO: 1208201 - protein, 9 aa, Homo Sapiens
KLGTSVVAK

SEQ ID NO: 1208202 - protein, 9 aa, Homo Sapiens
CKEAINVLS

SEQ ID NO: 1208203 - protein, 9 aa, Homo Sapiens
LSGTLPFNE

SEQ ID NO: 1208204 - protein, 9 aa, Homo Sapiens
TLPFNEDED

SEQ ID NO: 1208205 - protein, 9 aa, Homo Sapiens
GWRARAECS

SEQ ID NO: 1208206 - protein, 9 aa, Homo Sapiens
LIDIIEEEP

SEQ ID NO: 1208207 - protein, 9 aa, Homo Sapiens
SKTYYVTDD

SEQ ID NO: 1208208 - protein, 9 aa, Homo Sapiens
AETSSAIRI

SEQ ID NO: 1208209 - protein, 9 aa, Homo Sapiens
MVIVLTVTM

SEQ ID NO: 1208210 - protein, 9 aa, Homo Sapiens
VIVLTVTMV

SEQ ID NO: 1208211 - protein, 9 aa, Homo Sapiens
GTLPFNEDE

SEQ ID NO: 1208212 - protein, 9 aa, Homo Sapiens
LEAVGPEVL

SEQ ID NO: 1208213 - protein, 9 aa, Homo Sapiens
ECSACLETF

SEQ ID NO: 1208214 - protein, 9 aa, Homo Sapiens
EKLGTSVVA

SEQ ID NO: 1208215 - protein, 9 aa, Homo Sapiens
AGREEYSAM

SEQ ID NO: 1208216 - protein, 9 aa, Homo Sapiens
IDIIEEEPT

SEQ ID NO: 1208217 - protein, 9 aa, Homo Sapiens
RELLEAVGP

SEQ ID NO: 1208218 - protein, 9 aa, Homo Sapiens
EAINVLSHL

SEQ ID NO: 1208219 - protein, 9 aa, Homo Sapiens
SRELLEAVG

SEQ ID NO: 1208220 - protein, 9 aa, Homo Sapiens
AIRIMTVSP

SEQ ID NO: 1208221 - protein, 9 aa, Homo Sapiens
GREEYSAMR

SEQ ID NO: 1208222 - protein, 9 aa, Homo Sapiens
ETSSAIRIM

SEQ ID NO: 1208223 - protein, 9 aa, Homo Sapiens
RIMTVSPGA

SEQ ID NO: 1208224 - protein, 9 aa, Homo Sapiens
ETSVFTLKK

SEQ ID NO: 1208225 - protein, 9 aa, Homo Sapiens
WRARAECSA

SEQ ID NO: 1208226 - protein, 9 aa, Homo Sapiens
HYKSMVIVL

SEQ ID NO: 1208227 - protein, 9 aa, Homo Sapiens
TSVVAKVKI

SEQ ID NO: 1208228 - protein, 9 aa, Homo Sapiens
YNCKEAINV

SEQ ID NO: 1208229 - protein, 9 aa, Homo Sapiens
EVEKMQILL

SEQ ID NO: 1208230 - protein, 9 aa, Homo Sapiens
KMQILLERF

SEQ ID NO: 1208231 - protein, 9 aa, Homo Sapiens
WPSMLFTTS

SEQ ID NO: 1208232 - protein, 9 aa, Homo Sapiens
LDTAGREEY

SEQ ID NO: 1208233 - protein, 9 aa, Homo Sapiens
KTLSSYPVK

SEQ ID NO: 1208234 - protein, 9 aa, Homo Sapiens
PEDFSAVTM

SEQ ID NO: 1208235 - protein, 9 aa, Homo Sapiens
QVSLPELED

SEQ ID NO: 1208236 - protein, 9 aa, Homo Sapiens
TAGREEYSA

SEQ ID NO: 1208237 - protein, 9 aa, Homo Sapiens
DFSAVTMER

SEQ ID NO: 1208238 - protein, 9 aa, Homo Sapiens
ELLEAVGPE

SEQ ID NO: 1208239 - protein, 9 aa, Homo Sapiens
MAWQVSLPE

SEQ ID NO: 1208240 - protein, 9 aa, Homo Sapiens
CVSYWLSTR

SEQ ID NO: 1208241 - protein, 9 aa, Homo Sapiens
LSIHYKSMV

SEQ ID NO: 1208242 - protein, 9 aa, Homo Sapiens
SIEEERMGL

SEQ ID NO: 1208243 - protein, 9 aa, Homo Sapiens
MLFTTSPMC

SEQ ID NO: 1208244 - protein, 9 aa, Homo Sapiens
TTSPMCVSY

SEQ ID NO: 1208245 - protein, 9 aa, Homo Sapiens
RAECSACLE

SEQ ID NO: 1208246 - protein, 9 aa, Homo Sapiens
PVKSMMGAP

SEQ ID NO: 1208247 - protein, 9 aa, Homo Sapiens
MQILLERFK

SEQ ID NO: 1208248 - protein, 9 aa, Homo Sapiens
EPFWPSMLF

SEQ ID NO: 1208249 - protein, 9 aa, Homo Sapiens
QILLERFKP

SEQ ID NO: 1208250 - protein, 9 aa, Homo Sapiens
LLEAVGPEV

SEQ ID NO: 1208251 - protein, 9 aa, Homo Sapiens
VGPEVLQDS

SEQ ID NO: 1208252 - protein, 9 aa, Homo Sapiens
CSACLETFG

SEQ ID NO: 1208253 - protein, 9 aa, Homo Sapiens
GFLLMTNHD

SEQ ID NO: 1208254 - protein, 9 aa, Homo Sapiens
GTSVVAKVK

SEQ ID NO: 1208255 - protein, 9 aa, Homo Sapiens
YVTDDKYGC

SEQ ID NO: 1208256 - protein, 9 aa, Homo Sapiens
EDSIEEERM

SEQ ID NO: 1208257 - protein, 9 aa, Homo Sapiens
SAIRIMTVS

SEQ ID NO: 1208258 - protein, 9 aa, Homo Sapiens
WPMHPAGLQ

SEQ ID NO: 1208259 - protein, 9 aa, Homo Sapiens
SYWLSTRLG

SEQ ID NO: 1208260 - protein, 9 aa, Homo Sapiens
IHYKSMVIV

SEQ ID NO: 1208261 - protein, 9 aa, Homo Sapiens
EEERMGLLE

SEQ ID NO: 1208262 - protein, 9 aa, Homo Sapiens
AWQVSLPEL

SEQ ID NO: 1208263 - protein, 9 aa, Homo Sapiens
TSVFTLKKG

SEQ ID NO: 1208264 - protein, 9 aa, Homo Sapiens
EPEDFSAVT

SEQ ID NO: 1208265 - protein, 9 aa, Homo Sapiens
DSIEEERMG

SEQ ID NO: 1208266 - protein, 9 aa, Homo Sapiens
RETSVFTLK

SEQ ID NO: 1208267 - protein, 9 aa, Homo Sapiens
PLEPFWPSM

SEQ ID NO: 1208268 - protein, 9 aa, Homo Sapiens
SGTLPFNED

SEQ ID NO: 1208269 - protein, 9 aa, Homo Sapiens
SYPVKSMMG

SEQ ID NO: 1208270 - protein, 9 aa, Homo Sapiens
LSSYPVKSM

SEQ ID NO: 1208271 - protein, 9 aa, Homo Sapiens
PWPMHPAGL

SEQ ID NO: 1208272 - protein, 9 aa, Homo Sapiens
ERMGLLEYL

SEQ ID NO: 1208273 - protein, 9 aa, Homo Sapiens
QEDSIEEER

SEQ ID NO: 1208274 - protein, 9 aa, Homo Sapiens
MHMRETSVF

SEQ ID NO: 1208275 - protein, 9 aa, Homo Sapiens
TNHDDYTNQ

SEQ ID NO: 1208276 - protein, 9 aa, Homo Sapiens
MTNHDDYTN

SEQ ID NO: 1208277 - protein, 9 aa, Homo Sapiens
FWPSMLFTT

SEQ ID NO: 1208278 - protein, 9 aa, Homo Sapiens
RARAECSAC

SEQ ID NO: 1208279 - protein, 9 aa, Homo Sapiens
SPMCVSYWL

SEQ ID NO: 1208280 - protein, 9 aa, Homo Sapiens
IRIMTVSPG

SEQ ID NO: 1208281 - protein, 9 aa, Homo Sapiens
SLSGTLPFN

SEQ ID NO: 1208282 - protein, 9 aa, Homo Sapiens
PFWPSMLFT

SEQ ID NO: 1208283 - protein, 9 aa, Homo Sapiens
SLPLLLLLG

SEQ ID NO: 1208284 - protein, 9 aa, Homo Sapiens
HPHIVKLID

SEQ ID NO: 1208285 - protein, 9 aa, Homo Sapiens
FSAVTMERF

SEQ ID NO: 1208286 - protein, 9 aa, Homo Sapiens
SSAIRIMTV

SEQ ID NO: 1208287 - protein, 9 aa, Homo Sapiens
SLEPEDFSA

SEQ ID NO: 1208288 - protein, 9 aa, Homo Sapiens
MACNEKLGT

SEQ ID NO: 1208289 - protein, 9 aa, Homo Sapiens
LPLLLLLGA

SEQ ID NO: 1208290 - protein, 9 aa, Homo Sapiens
KSMVIVLTV

SEQ ID NO: 1208291 - protein, 9 aa, Homo Sapiens
LKTLSSYPV

SEQ ID NO: 1208292 - protein, 9 aa, Homo Sapiens
PLLLLLGAW

SEQ ID NO: 1208293 - protein, 9 aa, Homo Sapiens
AVGPEVLQD

SEQ ID NO: 1208294 - protein, 9 aa, Homo Sapiens
DDGGFLLMT

SEQ ID NO: 1208295 - protein, 9 aa, Homo Sapiens
YVSLSGTLP

SEQ ID NO: 1208296 - protein, 9 aa, Homo Sapiens
FSKTYYVTD

SEQ ID NO: 1208297 - protein, 9 aa, Homo Sapiens
PHIVKLIDI

SEQ ID NO: 1208298 - protein, 9 aa, Homo Sapiens
DTAGREEYS

SEQ ID NO: 1208299 - protein, 9 aa, Homo Sapiens
RMGLLEYLS

SEQ ID NO: 1208300 - protein, 9 aa, Homo Sapiens
EKMQILLER

SEQ ID NO: 1208301 - protein, 9 aa, Homo Sapiens
MCVSYWLST

SEQ ID NO: 1208302 - protein, 9 aa, Homo Sapiens
FLLMTNHDD

SEQ ID NO: 1208303 - protein, 9 aa, Homo Sapiens
LPELEDWLQ

SEQ ID NO: 1208304 - protein, 9 aa, Homo Sapiens
IYVSLSGTL

SEQ ID NO: 1208305 - protein, 9 aa, Homo Sapiens
GGPLEPFWP

SEQ ID NO: 1208306 - protein, 9 aa, Homo Sapiens
WQVSLPELE

SEQ ID NO: 1208307 - protein, 9 aa, Homo Sapiens
IVKLIDIIE

SEQ ID NO: 1208308 - protein, 9 aa, Homo Sapiens
INVLSHLPS

SEQ ID NO: 1208309 - protein, 9 aa, Homo Sapiens
AECSACLET

SEQ ID NO: 1208310 - protein, 9 aa, Homo Sapiens
VFSKTYYVT

SEQ ID NO: 1208311 - protein, 9 aa, Homo Sapiens
SMVIVLTVT

SEQ ID NO: 1208312 - protein, 9 aa, Homo Sapiens
ILLERFKPY

SEQ ID NO: 1208313 - protein, 9 aa, Homo Sapiens
FTTSPMCVS

SEQ ID NO: 1208314 - protein, 9 aa, Homo Sapiens
NCKEAINVL

SEQ ID NO: 1208315 - protein, 9 aa, Homo Sapiens
GYVFSKTYY

SEQ ID NO: 1208316 - protein, 9 aa, Homo Sapiens
EDFSAVTME

SEQ ID NO: 1208317 - protein, 9 aa, Homo Sapiens
VKLIDIIEE

SEQ ID NO: 1208318 - protein, 9 aa, Homo Sapiens
KTYYVTDDK

SEQ ID NO: 1208319 - protein, 9 aa, Homo Sapiens
CNEKLGTSV

SEQ ID NO: 1208320 - protein, 9 aa, Homo Sapiens
PELEDWLQC

SEQ ID NO: 1208321 - protein, 9 aa, Homo Sapiens
VSYWLSTRL

SEQ ID NO: 1208322 - protein, 9 aa, Homo Sapiens
SSYPVKSMM

SEQ ID NO: 1208323 - protein, 9 aa, Homo Sapiens
GGWRARAEC

SEQ ID NO: 1208324 - protein, 9 aa, Homo Sapiens
YKSMVIVLT

SEQ ID NO: 1208325 - protein, 9 aa, Homo Sapiens
LGTSVVAKV

SEQ ID NO: 1208326 - protein, 9 aa, Homo Sapiens
VEKMQILLE

SEQ ID NO: 1208327 - protein, 9 aa, Homo Sapiens
LFTTSPMCV

SEQ ID NO: 1208328 - protein, 9 aa, Homo Sapiens
HIVKLIDII

SEQ ID NO: 1208329 - protein, 9 aa, Homo Sapiens
YVFSKTYYV

SEQ ID NO: 1208330 - protein, 9 aa, Homo Sapiens
TYYVTDDKY

SEQ ID NO: 1208331 - protein, 9 aa, Homo Sapiens
LMTNHDDYT

SEQ ID NO: 1208332 - protein, 9 aa, Homo Sapiens
PMCVSYWLS

SEQ ID NO: 1208333 - protein, 9 aa, Homo Sapiens
EERMGLLEY

SEQ ID NO: 1208334 - protein, 9 aa, Homo Sapiens
KLIDIIEEE

SEQ ID NO: 1208335 - protein, 9 aa, Homo Sapiens
NVLSHLPSH

SEQ ID NO: 1208336 - protein, 9 aa, Homo Sapiens
IEEERMGLL

SEQ ID NO: 1208337 - protein, 9 aa, Homo Sapiens
DGGFLLMTN

SEQ ID NO: 1208338 - protein, 9 aa, Homo Sapiens
LLMTNHDDY

SEQ ID NO: 1208339 - protein, 9 aa, Homo Sapiens
TSSAIRIMT

SEQ ID NO: 1208340 - protein, 9 aa, Homo Sapiens
QRPCPGHCS

SEQ ID NO: 1208341 - protein, 9 aa, Homo Sapiens
PFACKDCER

SEQ ID NO: 1208342 - protein, 9 aa, Homo Sapiens
TSPGGFPSS

SEQ ID NO: 1208343 - protein, 9 aa, Homo Sapiens
KRGKYIKTW

SEQ ID NO: 1208344 - protein, 9 aa, Homo Sapiens
SLYLKMRLR

SEQ ID NO: 1208345 - protein, 9 aa, Homo Sapiens
IGDFGLATE

SEQ ID NO: 1208346 - protein, 9 aa, Homo Sapiens
FACKDCERS

SEQ ID NO: 1208347 - protein, 9 aa, Homo Sapiens
SRRGLLLPA

SEQ ID NO: 1208348 - protein, 9 aa, Homo Sapiens
GGFPSSPSS

SEQ ID NO: 1208349 - protein, 9 aa, Homo Sapiens
LQFVKADDD

SEQ ID NO: 1208350 - protein, 9 aa, Homo Sapiens
EKHSLYLKM

SEQ ID NO: 1208351 - protein, 9 aa, Homo Sapiens
PMYGIMPSK

SEQ ID NO: 1208352 - protein, 9 aa, Homo Sapiens
CKEAINVLS

SEQ ID NO: 1208353 - protein, 9 aa, Homo Sapiens
NCAKALKDT

SEQ ID NO: 1208354 - protein, 9 aa, Homo Sapiens
SSTTTPTSH

SEQ ID NO: 1208355 - protein, 9 aa, Homo Sapiens
YLVGCPGRR

SEQ ID NO: 1208356 - protein, 9 aa, Homo Sapiens
SEMFLLLLR

SEQ ID NO: 1208357 - protein, 9 aa, Homo Sapiens
SSKKFRKPS

SEQ ID NO: 1208358 - protein, 9 aa, Homo Sapiens
SKKFRKPSV

SEQ ID NO: 1208359 - protein, 9 aa, Homo Sapiens
LCVCNSHCV

SEQ ID NO: 1208360 - protein, 9 aa, Homo Sapiens
FEHLSLGSQ

SEQ ID NO: 1208361 - protein, 9 aa, Homo Sapiens
ERSEMFLLL

SEQ ID NO: 1208362 - protein, 9 aa, Homo Sapiens
TVHPISSKK

SEQ ID NO: 1208363 - protein, 9 aa, Homo Sapiens
KKCKGKKVI

SEQ ID NO: 1208364 - protein, 9 aa, Homo Sapiens
PQCHNAWRT

SEQ ID NO: 1208365 - protein, 9 aa, Homo Sapiens
RPPHHFSAP

SEQ ID NO: 1208366 - protein, 9 aa, Homo Sapiens
KYIKTWRPR

SEQ ID NO: 1208367 - protein, 9 aa, Homo Sapiens
RGKYIKTWR

SEQ ID NO: 1208368 - protein, 9 aa, Homo Sapiens
SLQGIAKHL

SEQ ID NO: 1208369 - protein, 9 aa, Homo Sapiens
PHHFSAPCF

SEQ ID NO: 1208370 - protein, 9 aa, Homo Sapiens
ALWALIYSY

SEQ ID NO: 1208371 - protein, 9 aa, Homo Sapiens
RCKKCKGKK

SEQ ID NO: 1208372 - protein, 9 aa, Homo Sapiens
LQIEKEKLR

SEQ ID NO: 1208373 - protein, 9 aa, Homo Sapiens
IHAYAYICV

SEQ ID NO: 1208374 - protein, 9 aa, Homo Sapiens
NAWRTGRPA

SEQ ID NO: 1208375 - protein, 9 aa, Homo Sapiens
RRGLLLPAS

SEQ ID NO: 1208376 - protein, 9 aa, Homo Sapiens
QLSSLCVCN

SEQ ID NO: 1208377 - protein, 9 aa, Homo Sapiens
STTTPTSHM

SEQ ID NO: 1208378 - protein, 9 aa, Homo Sapiens
GIDLQLSHE

SEQ ID NO: 1208379 - protein, 9 aa, Homo Sapiens
WLHKRGKYI

SEQ ID NO: 1208380 - protein, 9 aa, Homo Sapiens
SHMRTQSPP

SEQ ID NO: 1208381 - protein, 9 aa, Homo Sapiens
YICVFIYTH

SEQ ID NO: 1208382 - protein, 9 aa, Homo Sapiens
TQAQARPIA

SEQ ID NO: 1208383 - protein, 9 aa, Homo Sapiens
KDRCKKCKG

SEQ ID NO: 1208384 - protein, 9 aa, Homo Sapiens
RLQIEKEKL

SEQ ID NO: 1208385 - protein, 9 aa, Homo Sapiens
DFGLATEKS

SEQ ID NO: 1208386 - protein, 9 aa, Homo Sapiens
CKKCKGKKV

SEQ ID NO: 1208387 - protein, 9 aa, Homo Sapiens
YAYICVFIY

SEQ ID NO: 1208388 - protein, 9 aa, Homo Sapiens
VTPDGIDLQ

SEQ ID NO: 1208389 - protein, 9 aa, Homo Sapiens
LVGCPGRRS

SEQ ID NO: 1208390 - protein, 9 aa, Homo Sapiens
SQHYGTCSW

SEQ ID NO: 1208391 - protein, 9 aa, Homo Sapiens
KSKQGIPKL

SEQ ID NO: 1208392 - protein, 9 aa, Homo Sapiens
KVEVLVINV

SEQ ID NO: 1208393 - protein, 9 aa, Homo Sapiens
YSYQKAKTA

SEQ ID NO: 1208394 - protein, 9 aa, Homo Sapiens
HFSAPCFVA

SEQ ID NO: 1208395 - protein, 9 aa, Homo Sapiens
RTGRPAYEG

SEQ ID NO: 1208396 - protein, 9 aa, Homo Sapiens
QARPIAENE

SEQ ID NO: 1208397 - protein, 9 aa, Homo Sapiens
HHFSAPCFV

SEQ ID NO: 1208398 - protein, 9 aa, Homo Sapiens
LERSEMFLL

SEQ ID NO: 1208399 - protein, 9 aa, Homo Sapiens
AQARPIAEN

SEQ ID NO: 1208400 - protein, 9 aa, Homo Sapiens
AINVLSHLP

SEQ ID NO: 1208401 - protein, 9 aa, Homo Sapiens
IYSYQKAKT

SEQ ID NO: 1208402 - protein, 9 aa, Homo Sapiens
LSSLCVCNS

SEQ ID NO: 1208403 - protein, 9 aa, Homo Sapiens
GCPGRRSVG

SEQ ID NO: 1208404 - protein, 9 aa, Homo Sapiens
VEVLVINVN

SEQ ID NO: 1208405 - protein, 9 aa, Homo Sapiens
LATEKSRWS

SEQ ID NO: 1208406 - protein, 9 aa, Homo Sapiens
WRTGRPAYE

SEQ ID NO: 1208407 - protein, 9 aa, Homo Sapiens
SPGGFPSSP

SEQ ID NO: 1208408 - protein, 9 aa, Homo Sapiens
VYGGFKSKQ

SEQ ID NO: 1208409 - protein, 9 aa, Homo Sapiens
IAKHLEGLS

SEQ ID NO: 1208410 - protein, 9 aa, Homo Sapiens
RSEMFLLLL

SEQ ID NO: 1208411 - protein, 9 aa, Homo Sapiens
ARPIAENER

SEQ ID NO: 1208412 - protein, 9 aa, Homo Sapiens
PIAENERVM

SEQ ID NO: 1208413 - protein, 9 aa, Homo Sapiens
KEEEKKSKL

SEQ ID NO: 1208414 - protein, 9 aa, Homo Sapiens
DRCKKCKGK

SEQ ID NO: 1208415 - protein, 9 aa, Homo Sapiens
KGKKVIKEV

SEQ ID NO: 1208416 - protein, 9 aa, Homo Sapiens
LVTESLAHQ

SEQ ID NO: 1208417 - protein, 9 aa, Homo Sapiens
ENCAKALKD

SEQ ID NO: 1208418 - protein, 9 aa, Homo Sapiens
QRGKDLVTE

SEQ ID NO: 1208419 - protein, 9 aa, Homo Sapiens
LRMQLSSLC

SEQ ID NO: 1208420 - protein, 9 aa, Homo Sapiens
LGRWVCTQR

SEQ ID NO: 1208421 - protein, 9 aa, Homo Sapiens
GFPSSPSSG

SEQ ID NO: 1208422 - protein, 9 aa, Homo Sapiens
PKFVPQAAG

SEQ ID NO: 1208423 - protein, 9 aa, Homo Sapiens
QCHNAWRTG

SEQ ID NO: 1208424 - protein, 9 aa, Homo Sapiens
EDSLRSNSP

SEQ ID NO: 1208425 - protein, 9 aa, Homo Sapiens
LLRYLVGCP

SEQ ID NO: 1208426 - protein, 9 aa, Homo Sapiens
RLKEEEKKS

SEQ ID NO: 1208427 - protein, 9 aa, Homo Sapiens
SLCVCNSHC

SEQ ID NO: 1208428 - protein, 9 aa, Homo Sapiens
ALIYSYQKA

SEQ ID NO: 1208429 - protein, 9 aa, Homo Sapiens
GKDLVTESL

SEQ ID NO: 1208430 - protein, 9 aa, Homo Sapiens
EGWLHKRGK

SEQ ID NO: 1208431 - protein, 9 aa, Homo Sapiens
RPIAENERV

SEQ ID NO: 1208432 - protein, 9 aa, Homo Sapiens
KEKLRLQIV

SEQ ID NO: 1208433 - protein, 9 aa, Homo Sapiens
EAINVLSHL

SEQ ID NO: 1208434 - protein, 9 aa, Homo Sapiens
VLSHLPSHH

SEQ ID NO: 1208435 - protein, 9 aa, Homo Sapiens
VPSQHYGTC

SEQ ID NO: 1208436 - protein, 9 aa, Homo Sapiens
KHSLYLKMR

SEQ ID NO: 1208437 - protein, 9 aa, Homo Sapiens
ITQAQARPI

SEQ ID NO: 1208438 - protein, 9 aa, Homo Sapiens
QFVKADDDV

SEQ ID NO: 1208439 - protein, 9 aa, Homo Sapiens
EEEKKSKLD

SEQ ID NO: 1208440 - protein, 9 aa, Homo Sapiens
AVSFEHLSL

SEQ ID NO: 1208441 - protein, 9 aa, Homo Sapiens
EKEKLRLQI

SEQ ID NO: 1208442 - protein, 9 aa, Homo Sapiens
AWPKFVPQA

SEQ ID NO: 1208443 - protein, 9 aa, Homo Sapiens
RLLRYLVGC

SEQ ID NO: 1208444 - protein, 9 aa, Homo Sapiens
YNCKEAINV

SEQ ID NO: 1208445 - protein, 9 aa, Homo Sapiens
EKSRWSGSH

SEQ ID NO: 1208446 - protein, 9 aa, Homo Sapiens
EKDRCKKCK

SEQ ID NO: 1208447 - protein, 9 aa, Homo Sapiens
TPTSHMRTQ

SEQ ID NO: 1208448 - protein, 9 aa, Homo Sapiens
SAPCFVAAL

SEQ ID NO: 1208449 - protein, 9 aa, Homo Sapiens
EHLSLGSQD

SEQ ID NO: 1208450 - protein, 9 aa, Homo Sapiens
HAYAYICVF

SEQ ID NO: 1208451 - protein, 9 aa, Homo Sapiens
TQRPCPGHC

SEQ ID NO: 1208452 - protein, 9 aa, Homo Sapiens
WPKFVPQAA

SEQ ID NO: 1208453 - protein, 9 aa, Homo Sapiens
PPHHFSAPC

SEQ ID NO: 1208454 - protein, 9 aa, Homo Sapiens
AYICVFIYT

SEQ ID NO: 1208455 - protein, 9 aa, Homo Sapiens
KKFRKPSVA

SEQ ID NO: 1208456 - protein, 9 aa, Homo Sapiens
YLKMRLRYP

SEQ ID NO: 1208457 - protein, 9 aa, Homo Sapiens
ERLQIEKEK

SEQ ID NO: 1208458 - protein, 9 aa, Homo Sapiens
QGIPKLVAD

SEQ ID NO: 1208459 - protein, 9 aa, Homo Sapiens
SLSTEDSLR

SEQ ID NO: 1208460 - protein, 9 aa, Homo Sapiens
TSSLSTEDS

SEQ ID NO: 1208461 - protein, 9 aa, Homo Sapiens
LYLKMRLRY

SEQ ID NO: 1208462 - protein, 9 aa, Homo Sapiens
HNAWRTGRP

SEQ ID NO: 1208463 - protein, 9 aa, Homo Sapiens
ADDDVAQEI

SEQ ID NO: 1208464 - protein, 9 aa, Homo Sapiens
EFTSSLSTE

SEQ ID NO: 1208465 - protein, 9 aa, Homo Sapiens
CVFIYTHMH

SEQ ID NO: 1208466 - protein, 9 aa, Homo Sapiens
VINVNECDN

SEQ ID NO: 1208467 - protein, 9 aa, Homo Sapiens
DGIDLQLSH

SEQ ID NO: 1208468 - protein, 9 aa, Homo Sapiens
NSTTFPSRR

SEQ ID NO: 1208469 - protein, 9 aa, Homo Sapiens
EEKKSKLDE

SEQ ID NO: 1208470 - protein, 9 aa, Homo Sapiens
LKEEEKKSK

SEQ ID NO: 1208471 - protein, 9 aa, Homo Sapiens
EKKSKLDEF

SEQ ID NO: 1208472 - protein, 9 aa, Homo Sapiens
ATVHPISSK

SEQ ID NO: 1208473 - protein, 9 aa, Homo Sapiens
SPTSPGGFP

SEQ ID NO: 1208474 - protein, 9 aa, Homo Sapiens
LLQFVKADD

SEQ ID NO: 1208475 - protein, 9 aa, Homo Sapiens
RPRDPPALD

SEQ ID NO: 1208476 - protein, 9 aa, Homo Sapiens
LHKRGKYIK

SEQ ID NO: 1208477 - protein, 9 aa, Homo Sapiens
AKHLEGLSE

SEQ ID NO: 1208478 - protein, 9 aa, Homo Sapiens
KPFACKDCE

SEQ ID NO: 1208479 - protein, 9 aa, Homo Sapiens
TPDGIDLQL

SEQ ID NO: 1208480 - protein, 9 aa, Homo Sapiens
GKVEVLVIN

SEQ ID NO: 1208481 - protein, 9 aa, Homo Sapiens
PTSPGGFPS

SEQ ID NO: 1208482 - protein, 9 aa, Homo Sapiens
SFEHLSLGS

SEQ ID NO: 1208483 - protein, 9 aa, Homo Sapiens
FPSSPSSGQ

SEQ ID NO: 1208484 - protein, 9 aa, Homo Sapiens
SRQQQQHLH

SEQ ID NO: 1208485 - protein, 9 aa, Homo Sapiens
GLATEKSRW

SEQ ID NO: 1208486 - protein, 9 aa, Homo Sapiens
TTPTSHMRT

SEQ ID NO: 1208487 - protein, 9 aa, Homo Sapiens
YGGFKSKQG

SEQ ID NO: 1208488 - protein, 9 aa, Homo Sapiens
GDFGLATEK

SEQ ID NO: 1208489 - protein, 9 aa, Homo Sapiens
TLERSEMFL

SEQ ID NO: 1208490 - protein, 9 aa, Homo Sapiens
TTTPTSHMR

SEQ ID NO: 1208491 - protein, 9 aa, Homo Sapiens
RGLLLPASP

SEQ ID NO: 1208492 - protein, 9 aa, Homo Sapiens
ACKDCERSF

SEQ ID NO: 1208493 - protein, 9 aa, Homo Sapiens
KCKGKKVIK

SEQ ID NO: 1208494 - protein, 9 aa, Homo Sapiens
APCFVAALP

SEQ ID NO: 1208495 - protein, 9 aa, Homo Sapiens
TGRPAYEGR

SEQ ID NO: 1208496 - protein, 9 aa, Homo Sapiens
TTFPSRRGL

SEQ ID NO: 1208497 - protein, 9 aa, Homo Sapiens
SSLSTEDSL

SEQ ID NO: 1208498 - protein, 9 aa, Homo Sapiens
IEKEKLRLQ

SEQ ID NO: 1208499 - protein, 9 aa, Homo Sapiens
KFVPQAAGD

SEQ ID NO: 1208500 - protein, 9 aa, Homo Sapiens
INVNECDNY

SEQ ID NO: 1208501 - protein, 9 aa, Homo Sapiens
HITQAQARP

SEQ ID NO: 1208502 - protein, 9 aa, Homo Sapiens
TESLAHQVE

SEQ ID NO: 1208503 - protein, 9 aa, Homo Sapiens
VCTQRPCPG

SEQ ID NO: 1208504 - protein, 9 aa, Homo Sapiens
PDGIDLQLS

SEQ ID NO: 1208505 - protein, 9 aa, Homo Sapiens
LSLGSQDDS

SEQ ID NO: 1208506 - protein, 9 aa, Homo Sapiens
IDLQLSHEA

SEQ ID NO: 1208507 - protein, 9 aa, Homo Sapiens
PTSHMRTQS

SEQ ID NO: 1208508 - protein, 9 aa, Homo Sapiens
SGEKPFACK

SEQ ID NO: 1208509 - protein, 9 aa, Homo Sapiens
PRDPPALDS

SEQ ID NO: 1208510 - protein, 9 aa, Homo Sapiens
FVPSQHYGT

SEQ ID NO: 1208511 - protein, 9 aa, Homo Sapiens
QGIAKHLEG

SEQ ID NO: 1208512 - protein, 9 aa, Homo Sapiens
EKPFACKDC

SEQ ID NO: 1208513 - protein, 9 aa, Homo Sapiens
DDDVAQEIA

SEQ ID NO: 1208514 - protein, 9 aa, Homo Sapiens
ELLQFVKAD

SEQ ID NO: 1208515 - protein, 9 aa, Homo Sapiens
PGGFPSSPS

SEQ ID NO: 1208516 - protein, 9 aa, Homo Sapiens
AYAYICVFI

SEQ ID NO: 1208517 - protein, 9 aa, Homo Sapiens
LIYSYQKAK

SEQ ID NO: 1208518 - protein, 9 aa, Homo Sapiens
GKYIKTWRP

SEQ ID NO: 1208519 - protein, 9 aa, Homo Sapiens
LRPPHHFSA

SEQ ID NO: 1208520 - protein, 9 aa, Homo Sapiens
STTFPSRRG

SEQ ID NO: 1208521 - protein, 9 aa, Homo Sapiens
RMQLSSLCV

SEQ ID NO: 1208522 - protein, 9 aa, Homo Sapiens
INVLSHLPS

SEQ ID NO: 1208523 - protein, 9 aa, Homo Sapiens
FVKADDDVA

SEQ ID NO: 1208524 - protein, 9 aa, Homo Sapiens
MFLLLLRRF

SEQ ID NO: 1208525 - protein, 9 aa, Homo Sapiens
RDPPALDSQ

SEQ ID NO: 1208526 - protein, 9 aa, Homo Sapiens
SYQKAKTAL

SEQ ID NO: 1208527 - protein, 9 aa, Homo Sapiens
RQQQQHLHR

SEQ ID NO: 1208528 - protein, 9 aa, Homo Sapiens
ICVFIYTHM

SEQ ID NO: 1208529 - protein, 9 aa, Homo Sapiens
VKADDDVAQ

SEQ ID NO: 1208530 - protein, 9 aa, Homo Sapiens
CTQRPCPGH

SEQ ID NO: 1208531 - protein, 9 aa, Homo Sapiens
SAWPKFVPQ

SEQ ID NO: 1208532 - protein, 9 aa, Homo Sapiens
ISSKKFRKP

SEQ ID NO: 1208533 - protein, 9 aa, Homo Sapiens
LKMRLRYPV

SEQ ID NO: 1208534 - protein, 9 aa, Homo Sapiens
MYGIMPSKK

SEQ ID NO: 1208535 - protein, 9 aa, Homo Sapiens
STEDSLRSN

SEQ ID NO: 1208536 - protein, 9 aa, Homo Sapiens
YGIMPSKKV

SEQ ID NO: 1208537 - protein, 9 aa, Homo Sapiens
LGSQDDSAG

SEQ ID NO: 1208538 - protein, 9 aa, Homo Sapiens
TSHMRTQSP

SEQ ID NO: 1208539 - protein, 9 aa, Homo Sapiens
CHNAWRTGR

SEQ ID NO: 1208540 - protein, 9 aa, Homo Sapiens
EMFLLLLRR

SEQ ID NO: 1208541 - protein, 9 aa, Homo Sapiens
SLGSQDDSA

SEQ ID NO: 1208542 - protein, 9 aa, Homo Sapiens
LSTEDSLRS

SEQ ID NO: 1208543 - protein, 9 aa, Homo Sapiens
TLGRWVCTQ

SEQ ID NO: 1208544 - protein, 9 aa, Homo Sapiens
QAQARPIAE

SEQ ID NO: 1208545 - protein, 9 aa, Homo Sapiens
ESLAHQVEG

SEQ ID NO: 1208546 - protein, 9 aa, Homo Sapiens
TVSRQQQQH

SEQ ID NO: 1208547 - protein, 9 aa, Homo Sapiens
GDASAWPKF

SEQ ID NO: 1208548 - protein, 9 aa, Homo Sapiens
FLLLLRRFP

SEQ ID NO: 1208549 - protein, 9 aa, Homo Sapiens
PISSKKFRK

SEQ ID NO: 1208550 - protein, 9 aa, Homo Sapiens
KDLVTESLA

SEQ ID NO: 1208551 - protein, 9 aa, Homo Sapiens
FPSRRGLLL

SEQ ID NO: 1208552 - protein, 9 aa, Homo Sapiens
FTSSLSTED

SEQ ID NO: 1208553 - protein, 9 aa, Homo Sapiens
VLVINVNEC

SEQ ID NO: 1208554 - protein, 9 aa, Homo Sapiens
LMLPMYGIM

SEQ ID NO: 1208555 - protein, 9 aa, Homo Sapiens
QLSHEALRQ

SEQ ID NO: 1208556 - protein, 9 aa, Homo Sapiens
WVCTQRPCP

SEQ ID NO: 1208557 - protein, 9 aa, Homo Sapiens
RYLVGCPGR

SEQ ID NO: 1208558 - protein, 9 aa, Homo Sapiens
HPISSKKFR

SEQ ID NO: 1208559 - protein, 9 aa, Homo Sapiens
WALIYSYQK

SEQ ID NO: 1208560 - protein, 9 aa, Homo Sapiens
GWLHKRGKY

SEQ ID NO: 1208561 - protein, 9 aa, Homo Sapiens
GIAKHLEGL

SEQ ID NO: 1208562 - protein, 9 aa, Homo Sapiens
PSRRGLLLP

SEQ ID NO: 1208563 - protein, 9 aa, Homo Sapiens
VTESLAHQV

SEQ ID NO: 1208564 - protein, 9 aa, Homo Sapiens
RFVPSQHYG

SEQ ID NO: 1208565 - protein, 9 aa, Homo Sapiens
CKGKKVIKE

SEQ ID NO: 1208566 - protein, 9 aa, Homo Sapiens
VSRQQQQHL

SEQ ID NO: 1208567 - protein, 9 aa, Homo Sapiens
VGCPGRRSV

SEQ ID NO: 1208568 - protein, 9 aa, Homo Sapiens
GGFKSKQGI

SEQ ID NO: 1208569 - protein, 9 aa, Homo Sapiens
DLQLSHEAL

SEQ ID NO: 1208570 - protein, 9 aa, Homo Sapiens
EVLVINVNE

SEQ ID NO: 1208571 - protein, 9 aa, Homo Sapiens
TEKSRWSGS

SEQ ID NO: 1208572 - protein, 9 aa, Homo Sapiens
YYEKHSLYL

SEQ ID NO: 1208573 - protein, 9 aa, Homo Sapiens
NVNECDNYT

SEQ ID NO: 1208574 - protein, 9 aa, Homo Sapiens
PSLMLPMYG

SEQ ID NO: 1208575 - protein, 9 aa, Homo Sapiens
LQLSHEALR

SEQ ID NO: 1208576 - protein, 9 aa, Homo Sapiens
HLSLGSQDD

SEQ ID NO: 1208577 - protein, 9 aa, Homo Sapiens
KQGIPKLVA

SEQ ID NO: 1208578 - protein, 9 aa, Homo Sapiens
ATEKSRWSG

SEQ ID NO: 1208579 - protein, 9 aa, Homo Sapiens
FKSKQGIPK

SEQ ID NO: 1208580 - protein, 9 aa, Homo Sapiens
NTLERSEMF

SEQ ID NO: 1208581 - protein, 9 aa, Homo Sapiens
LVINVNECD

SEQ ID NO: 1208582 - protein, 9 aa, Homo Sapiens
QIEKEKLRL

SEQ ID NO: 1208583 - protein, 9 aa, Homo Sapiens
DASAWPKFV

SEQ ID NO: 1208584 - protein, 9 aa, Homo Sapiens
NCKEAINVL

SEQ ID NO: 1208585 - protein, 9 aa, Homo Sapiens
GEKPFACKD

SEQ ID NO: 1208586 - protein, 9 aa, Homo Sapiens
ALRMQLSSL

SEQ ID NO: 1208587 - protein, 9 aa, Homo Sapiens
HGDASAWPK

SEQ ID NO: 1208588 - protein, 9 aa, Homo Sapiens
VSFEHLSLG

SEQ ID NO: 1208589 - protein, 9 aa, Homo Sapiens
AWRTGRPAY

SEQ ID NO: 1208590 - protein, 9 aa, Homo Sapiens
AALWALIYS

SEQ ID NO: 1208591 - protein, 9 aa, Homo Sapiens
RGKDLVTES

SEQ ID NO: 1208592 - protein, 9 aa, Homo Sapiens
CPGRRSVGL

SEQ ID NO: 1208593 - protein, 9 aa, Homo Sapiens
GRWVCTQRP

SEQ ID NO: 1208594 - protein, 9 aa, Homo Sapiens
ASPTSPGGF

SEQ ID NO: 1208595 - protein, 9 aa, Homo Sapiens
ASAWPKFVP

SEQ ID NO: 1208596 - protein, 9 aa, Homo Sapiens
VFIYTHMHT

SEQ ID NO: 1208597 - protein, 9 aa, Homo Sapiens
LQGIAKHLE

SEQ ID NO: 1208598 - protein, 9 aa, Homo Sapiens
DLVTESLAH

SEQ ID NO: 1208599 - protein, 9 aa, Homo Sapiens
HKRGKYIKT

SEQ ID NO: 1208600 - protein, 9 aa, Homo Sapiens
FSAPCFVAA

SEQ ID NO: 1208601 - protein, 9 aa, Homo Sapiens
SLMLPMYGI

SEQ ID NO: 1208602 - protein, 9 aa, Homo Sapiens
VHPISSKKF

SEQ ID NO: 1208603 - protein, 9 aa, Homo Sapiens
KEAINVLSH

SEQ ID NO: 1208604 - protein, 9 aa, Homo Sapiens
KADDDVAQE

SEQ ID NO: 1208605 - protein, 9 aa, Homo Sapiens
SSLCVCNSH

SEQ ID NO: 1208606 - protein, 9 aa, Homo Sapiens
LWALIYSYQ

SEQ ID NO: 1208607 - protein, 9 aa, Homo Sapiens
HSLYLKMRL

SEQ ID NO: 1208608 - protein, 9 aa, Homo Sapiens
LPMYGIMPS

SEQ ID NO: 1208609 - protein, 9 aa, Homo Sapiens
FGLATEKSR

SEQ ID NO: 1208610 - protein, 9 aa, Homo Sapiens
SKQGIPKLV

SEQ ID NO: 1208611 - protein, 9 aa, Homo Sapiens
TFPSRRGLL

SEQ ID NO: 1208612 - protein, 9 aa, Homo Sapiens
TEDSLRSNS

SEQ ID NO: 1208613 - protein, 9 aa, Homo Sapiens
LPSLMLPMY

SEQ ID NO: 1208614 - protein, 9 aa, Homo Sapiens
GFKSKQGIP

SEQ ID NO: 1208615 - protein, 9 aa, Homo Sapiens
RWVCTQRPC

SEQ ID NO: 1208616 - protein, 9 aa, Homo Sapiens
NVLSHLPSH

SEQ ID NO: 1208617 - protein, 9 aa, Homo Sapiens
HMRTQSPPV

SEQ ID NO: 1208618 - protein, 9 aa, Homo Sapiens
PSQHYGTCS

SEQ ID NO: 1208619 - protein, 9 aa, Homo Sapiens
YEKHSLYLK

SEQ ID NO: 1208620 - protein, 9 aa, Homo Sapiens
LRYLVGCPG

SEQ ID NO: 1208621 - protein, 9 aa, Homo Sapiens
MQLSSLCVC

SEQ ID NO: 1208622 - protein, 9 aa, Homo Sapiens
EENCAKALK

SEQ ID NO: 1208623 - protein, 9 aa, Homo Sapiens
MLPMYGIMP

SEQ ID NO: 1208624 - protein, 9 aa, Homo Sapiens
MAAGGLESA

SEQ ID NO: 1208625 - protein, 9 aa, Homo Sapiens
QEYANKVFL

SEQ ID NO: 1208626 - protein, 9 aa, Homo Sapiens
RKKKKRKKL

SEQ ID NO: 1208627 - protein, 9 aa, Homo Sapiens
QMVEPSLSV

SEQ ID NO: 1208628 - protein, 9 aa, Homo Sapiens
KSTREEKEC

SEQ ID NO: 1208629 - protein, 9 aa, Homo Sapiens
KRRKKKKRK

SEQ ID NO: 1208630 - protein, 9 aa, Homo Sapiens
RASAVPERY

SEQ ID NO: 1208631 - protein, 9 aa, Homo Sapiens
FFFFFFPFF

SEQ ID NO: 1208632 - protein, 9 aa, Homo Sapiens
QPALALDES

SEQ ID NO: 1208633 - protein, 9 aa, Homo Sapiens
NMDMNPQCF

SEQ ID NO: 1208634 - protein, 9 aa, Homo Sapiens
AVEASDGGG

SEQ ID NO: 1208635 - protein, 9 aa, Homo Sapiens
LEWDMKINC

SEQ ID NO: 1208636 - protein, 9 aa, Homo Sapiens
LDESKLGDV

SEQ ID NO: 1208637 - protein, 9 aa, Homo Sapiens
DESKLGDVS

SEQ ID NO: 1208638 - protein, 9 aa, Homo Sapiens
QFFFFFFPF

SEQ ID NO: 1208639 - protein, 9 aa, Homo Sapiens
DMNPQCFVS

SEQ ID NO: 1208640 - protein, 9 aa, Homo Sapiens
REDGSRIFQ

SEQ ID NO: 1208641 - protein, 9 aa, Homo Sapiens
ANKVFLCLF

SEQ ID NO: 1208642 - protein, 9 aa, Homo Sapiens
KLEWDMKIN

SEQ ID NO: 1208643 - protein, 9 aa, Homo Sapiens
VGSLMAAGG

SEQ ID NO: 1208644 - protein, 9 aa, Homo Sapiens
SRIFQQVEQ

SEQ ID NO: 1208645 - protein, 9 aa, Homo Sapiens
AGGLESALH

SEQ ID NO: 1208646 - protein, 9 aa, Homo Sapiens
ECWIHSKYE

SEQ ID NO: 1208647 - protein, 9 aa, Homo Sapiens
QSYHMAVEA

SEQ ID NO: 1208648 - protein, 9 aa, Homo Sapiens
QCFVSPRCA

SEQ ID NO: 1208649 - protein, 9 aa, Homo Sapiens
GSLMAAGGL

SEQ ID NO: 1208650 - protein, 9 aa, Homo Sapiens
PQCFVSPRC

SEQ ID NO: 1208651 - protein, 9 aa, Homo Sapiens
PGSQMVEPS

SEQ ID NO: 1208652 - protein, 9 aa, Homo Sapiens
ENMDMNPQC

SEQ ID NO: 1208653 - protein, 9 aa, Homo Sapiens
VFLCLFTVE

SEQ ID NO: 1208654 - protein, 9 aa, Homo Sapiens
DSKKKKKKE

SEQ ID NO: 1208655 - protein, 9 aa, Homo Sapiens
FFKLEWDMK

SEQ ID NO: 1208656 - protein, 9 aa, Homo Sapiens
PVLASPAYA

SEQ ID NO: 1208657 - protein, 9 aa, Homo Sapiens
EDGSRIFQQ

SEQ ID NO: 1208658 - protein, 9 aa, Homo Sapiens
EPSLSVRHP

SEQ ID NO: 1208659 - protein, 9 aa, Homo Sapiens
NKVFLCLFT

SEQ ID NO: 1208660 - protein, 9 aa, Homo Sapiens
LVGSLMAAG

SEQ ID NO: 1208661 - protein, 9 aa, Homo Sapiens
LASPAYAAP

SEQ ID NO: 1208662 - protein, 9 aa, Homo Sapiens
LLVGSLMAA

SEQ ID NO: 1208663 - protein, 9 aa, Homo Sapiens
TEDFFKLEW

SEQ ID NO: 1208664 - protein, 9 aa, Homo Sapiens
EWDMKINCS

SEQ ID NO: 1208665 - protein, 9 aa, Homo Sapiens
FQQVEQSRS

SEQ ID NO: 1208666 - protein, 9 aa, Homo Sapiens
QQFFFFFFP

SEQ ID NO: 1208667 - protein, 9 aa, Homo Sapiens
KECWIHSKY

SEQ ID NO: 1208668 - protein, 9 aa, Homo Sapiens
MNPQCFVSP

SEQ ID NO: 1208669 - protein, 9 aa, Homo Sapiens
IFQQVEQSR

SEQ ID NO: 1208670 - protein, 9 aa, Homo Sapiens
DFFKLEWDM

SEQ ID NO: 1208671 - protein, 9 aa, Homo Sapiens
SKLGDVSPT

SEQ ID NO: 1208672 - protein, 9 aa, Homo Sapiens
LMAAGGLES

SEQ ID NO: 1208673 - protein, 9 aa, Homo Sapiens
FFFPFFFLR

SEQ ID NO: 1208674 - protein, 9 aa, Homo Sapiens
DGSRIFQQV

SEQ ID NO: 1208675 - protein, 9 aa, Homo Sapiens
REEKECWIH

SEQ ID NO: 1208676 - protein, 9 aa, Homo Sapiens
VLASPAYAA

SEQ ID NO: 1208677 - protein, 9 aa, Homo Sapiens
EDFFKLEWD

SEQ ID NO: 1208678 - protein, 9 aa, Homo Sapiens
PALALDESK

SEQ ID NO: 1208679 - protein, 9 aa, Homo Sapiens
ASPAYAAPA

SEQ ID NO: 1208680 - protein, 9 aa, Homo Sapiens
LENMDMNPQ

SEQ ID NO: 1208681 - protein, 9 aa, Homo Sapiens
AVPERYWGR

SEQ ID NO: 1208682 - protein, 9 aa, Homo Sapiens
SQMVEPSLS

SEQ ID NO: 1208683 - protein, 9 aa, Homo Sapiens
FLCLFTVEM

SEQ ID NO: 1208684 - protein, 9 aa, Homo Sapiens
GPALRASAV

SEQ ID NO: 1208685 - protein, 9 aa, Homo Sapiens
EYANKVFLC

SEQ ID NO: 1208686 - protein, 9 aa, Homo Sapiens
AAGGLESAL

SEQ ID NO: 1208687 - protein, 9 aa, Homo Sapiens
EEIQSYHMA

SEQ ID NO: 1208688 - protein, 9 aa, Homo Sapiens
IQSYHMAVE

SEQ ID NO: 1208689 - protein, 9 aa, Homo Sapiens
ESKLGDVSP

SEQ ID NO: 1208690 - protein, 9 aa, Homo Sapiens
YHMAVEASD

SEQ ID NO: 1208691 - protein, 9 aa, Homo Sapiens
ALALDESKL

SEQ ID NO: 1208692 - protein, 9 aa, Homo Sapiens
FFFFFPFFF

SEQ ID NO: 1208693 - protein, 9 aa, Homo Sapiens
MAVEASDGG

SEQ ID NO: 1208694 - protein, 9 aa, Homo Sapiens
SPAYAAPAP

SEQ ID NO: 1208695 - protein, 9 aa, Homo Sapiens
SAVPERYWG

SEQ ID NO: 1208696 - protein, 9 aa, Homo Sapiens
PFFFLRRSL

SEQ ID NO: 1208697 - protein, 9 aa, Homo Sapiens
EIQSYHMAV

SEQ ID NO: 1208698 - protein, 9 aa, Homo Sapiens
TREDGSRIF

SEQ ID NO: 1208699 - protein, 9 aa, Homo Sapiens
PAYAAPAPG

SEQ ID NO: 1208700 - protein, 9 aa, Homo Sapiens
EEKECWIHS

SEQ ID NO: 1208701 - protein, 9 aa, Homo Sapiens
ALDESKLGD

SEQ ID NO: 1208702 - protein, 9 aa, Homo Sapiens
TREEKECWI

SEQ ID NO: 1208703 - protein, 9 aa, Homo Sapiens
HMAVEASDG

SEQ ID NO: 1208704 - protein, 9 aa, Homo Sapiens
IQEYANKVF

SEQ ID NO: 1208705 - protein, 9 aa, Homo Sapiens
FFPFFFLRR

SEQ ID NO: 1208706 - protein, 9 aa, Homo Sapiens
GSQMVEPSL

SEQ ID NO: 1208707 - protein, 9 aa, Homo Sapiens
MDMNPQCFV

SEQ ID NO: 1208708 - protein, 9 aa, Homo Sapiens
PSLSVRHPE

SEQ ID NO: 1208709 - protein, 9 aa, Homo Sapiens
RRKKKKRKK

SEQ ID NO: 1208710 - protein, 9 aa, Homo Sapiens
GSRIFQQVE

SEQ ID NO: 1208711 - protein, 9 aa, Homo Sapiens
VEPSLSVRH

SEQ ID NO: 1208712 - protein, 9 aa, Homo Sapiens
PALRASAVP

SEQ ID NO: 1208713 - protein, 9 aa, Homo Sapiens
ASAVPERYW

SEQ ID NO: 1208714 - protein, 9 aa, Homo Sapiens
ALRASAVPE

SEQ ID NO: 1208715 - protein, 9 aa, Homo Sapiens
YANKVFLCL

SEQ ID NO: 1208716 - protein, 9 aa, Homo Sapiens
DKRRKKKKR

SEQ ID NO: 1208717 - protein, 9 aa, Homo Sapiens
MVEPSLSVR

SEQ ID NO: 1208718 - protein, 9 aa, Homo Sapiens
KVFLCLFTV

SEQ ID NO: 1208719 - protein, 9 aa, Homo Sapiens
LRASAVPER

SEQ ID NO: 1208720 - protein, 9 aa, Homo Sapiens
CWIHSKYEE

SEQ ID NO: 1208721 - protein, 9 aa, Homo Sapiens
VLRVFTQKN

SEQ ID NO: 1208722 - protein, 9 aa, Homo Sapiens
FFFFPFFFL

SEQ ID NO: 1208723 - protein, 9 aa, Homo Sapiens
SLMAAGGLE

SEQ ID NO: 1208724 - protein, 9 aa, Homo Sapiens
HGPALRASA

SEQ ID NO: 1208725 - protein, 9 aa, Homo Sapiens
FPFFFLRRS

SEQ ID NO: 1208726 - protein, 9 aa, Homo Sapiens
STREEKECW

SEQ ID NO: 1208727 - protein, 9 aa, Homo Sapiens
EKECWIHSK

SEQ ID NO: 1208728 - protein, 9 aa, Homo Sapiens
WDMKINCSG

SEQ ID NO: 1208729 - protein, 9 aa, Homo Sapiens
FKLEWDMKI

SEQ ID NO: 1208730 - protein, 9 aa, Homo Sapiens
EPGSQMVEP

SEQ ID NO: 1208731 - protein, 9 aa, Homo Sapiens
NPQCFVSPR

SEQ ID NO: 1208732 - protein, 9 aa, Homo Sapiens
RIFQQVEQS

SEQ ID NO: 1208733 - protein, 9 aa, Homo Sapiens
SYHMAVEAS

SEQ ID NO: 1208734 - protein, 9 aa, Homo Sapiens
LALDESKLG

SEQ ID NO: 1208735 - protein, 9 aa, Homo Sapiens
PALGSPPFR

SEQ ID NO: 1208736 - protein, 9 aa, Homo Sapiens
IDCLGRKKT

SEQ ID NO: 1208737 - protein, 9 aa, Homo Sapiens
SANRVPFDP

SEQ ID NO: 1208738 - protein, 9 aa, Homo Sapiens
DHLNLSGCL

SEQ ID NO: 1208739 - protein, 9 aa, Homo Sapiens
LTGEDIRSL

SEQ ID NO: 1208740 - protein, 9 aa, Homo Sapiens
SAPCDWFGD

SEQ ID NO: 1208741 - protein, 9 aa, Homo Sapiens
IKALFAMET

SEQ ID NO: 1208742 - protein, 9 aa, Homo Sapiens
RERQLHVGG

SEQ ID NO: 1208743 - protein, 9 aa, Homo Sapiens
GNRQDLEEP

SEQ ID NO: 1208744 - protein, 9 aa, Homo Sapiens
DWDKWLSRR

SEQ ID NO: 1208745 - protein, 9 aa, Homo Sapiens
AAHVVCREM

SEQ ID NO: 1208746 - protein, 9 aa, Homo Sapiens
PVQHHEVQG

SEQ ID NO: 1208747 - protein, 9 aa, Homo Sapiens
VLASSRGIV

SEQ ID NO: 1208748 - protein, 9 aa, Homo Sapiens
NGFITLVNV

SEQ ID NO: 1208749 - protein, 9 aa, Homo Sapiens
HNGHGSAST

SEQ ID NO: 1208750 - protein, 9 aa, Homo Sapiens
DFFINMSAA

SEQ ID NO: 1208751 - protein, 9 aa, Homo Sapiens
ECGKSFPST

SEQ ID NO: 1208752 - protein, 9 aa, Homo Sapiens
HDKSPCRSQ

SEQ ID NO: 1208753 - protein, 9 aa, Homo Sapiens
CTYDALNVL

SEQ ID NO: 1208754 - protein, 9 aa, Homo Sapiens
TLPGPGPRL

SEQ ID NO: 1208755 - protein, 9 aa, Homo Sapiens
TLESRVESI

SEQ ID NO: 1208756 - protein, 9 aa, Homo Sapiens
GLPDLEVKE

SEQ ID NO: 1208757 - protein, 9 aa, Homo Sapiens
SSESQAMCY

SEQ ID NO: 1208758 - protein, 9 aa, Homo Sapiens
CMGFFMPYW

SEQ ID NO: 1208759 - protein, 9 aa, Homo Sapiens
THLRDLRHT

SEQ ID NO: 1208760 - protein, 9 aa, Homo Sapiens
NKADLANKC

SEQ ID NO: 1208761 - protein, 9 aa, Homo Sapiens
PISYMRRDG

SEQ ID NO: 1208762 - protein, 9 aa, Homo Sapiens
IVSNSLMGI

SEQ ID NO: 1208763 - protein, 9 aa, Homo Sapiens
RSSSAADLT

SEQ ID NO: 1208764 - protein, 9 aa, Homo Sapiens
DLTGDNSLG

SEQ ID NO: 1208765 - protein, 9 aa, Homo Sapiens
VKHREFHAL

SEQ ID NO: 1208766 - protein, 9 aa, Homo Sapiens
PLPSPKHSA

SEQ ID NO: 1208767 - protein, 9 aa, Homo Sapiens
CTITLLKNN

SEQ ID NO: 1208768 - protein, 9 aa, Homo Sapiens
LHDPKKNRH

SEQ ID NO: 1208769 - protein, 9 aa, Homo Sapiens
WILETDSVS

SEQ ID NO: 1208770 - protein, 9 aa, Homo Sapiens
PPSKASKPS

SEQ ID NO: 1208771 - protein, 9 aa, Homo Sapiens
PQNDLQAQT

SEQ ID NO: 1208772 - protein, 9 aa, Homo Sapiens
GYALCLQKL

SEQ ID NO: 1208773 - protein, 9 aa, Homo Sapiens
TSDDLHNDC

SEQ ID NO: 1208774 - protein, 9 aa, Homo Sapiens
ECGVQSFFF

SEQ ID NO: 1208775 - protein, 9 aa, Homo Sapiens
FGRVGPYTF

SEQ ID NO: 1208776 - protein, 9 aa, Homo Sapiens
VPGHLEHLC

SEQ ID NO: 1208777 - protein, 9 aa, Homo Sapiens
PPLAANGQS

SEQ ID NO: 1208778 - protein, 9 aa, Homo Sapiens
TNMAKLLSD

SEQ ID NO: 1208779 - protein, 9 aa, Homo Sapiens
PLIYQGHLS

SEQ ID NO: 1208780 - protein, 9 aa, Homo Sapiens
PAPHPRPTR

SEQ ID NO: 1208781 - protein, 9 aa, Homo Sapiens
CLPGFSDSN

SEQ ID NO: 1208782 - protein, 9 aa, Homo Sapiens
QLTCKQPRS

SEQ ID NO: 1208783 - protein, 9 aa, Homo Sapiens
QLCDMRASA

SEQ ID NO: 1208784 - protein, 9 aa, Homo Sapiens
EKTDRVKKT

SEQ ID NO: 1208785 - protein, 9 aa, Homo Sapiens
SAPLSSMGG

SEQ ID NO: 1208786 - protein, 9 aa, Homo Sapiens
VKSEEEQSS

SEQ ID NO: 1208787 - protein, 9 aa, Homo Sapiens
CFSPLWLMT

SEQ ID NO: 1208788 - protein, 9 aa, Homo Sapiens
IQRLNELEV

SEQ ID NO: 1208789 - protein, 9 aa, Homo Sapiens
KRPLDTQQN

SEQ ID NO: 1208790 - protein, 9 aa, Homo Sapiens
LGYGYVGFG

SEQ ID NO: 1208791 - protein, 9 aa, Homo Sapiens
EQVKHITLP

SEQ ID NO: 1208792 - protein, 9 aa, Homo Sapiens
LVVCYTNHD

SEQ ID NO: 1208793 - protein, 9 aa, Homo Sapiens
TMYIPSGIC

SEQ ID NO: 1208794 - protein, 9 aa, Homo Sapiens
SLNYLAECL

SEQ ID NO: 1208795 - protein, 9 aa, Homo Sapiens
NIPGPEKML

SEQ ID NO: 1208796 - protein, 9 aa, Homo Sapiens
EPNAREEQP

SEQ ID NO: 1208797 - protein, 9 aa, Homo Sapiens
TQSISACAW

SEQ ID NO: 1208798 - protein, 9 aa, Homo Sapiens
KSYLVALYL

SEQ ID NO: 1208799 - protein, 9 aa, Homo Sapiens
AIKCRTLFS

SEQ ID NO: 1208800 - protein, 9 aa, Homo Sapiens
PHLVPNQHR

SEQ ID NO: 1208801 - protein, 9 aa, Homo Sapiens
RLGHEPVLV

SEQ ID NO: 1208802 - protein, 9 aa, Homo Sapiens
IDAPYEKEV

SEQ ID NO: 1208803 - protein, 9 aa, Homo Sapiens
MGLMFASVY

SEQ ID NO: 1208804 - protein, 9 aa, Homo Sapiens
MDELTLKGV

SEQ ID NO: 1208805 - protein, 9 aa, Homo Sapiens
SSATLPSGA

SEQ ID NO: 1208806 - protein, 9 aa, Homo Sapiens
TIWLWEHNR

SEQ ID NO: 1208807 - protein, 9 aa, Homo Sapiens
FKHFCDGKE

SEQ ID NO: 1208808 - protein, 9 aa, Homo Sapiens
PNEMLSKKP

SEQ ID NO: 1208809 - protein, 9 aa, Homo Sapiens
DSSQECTDS

SEQ ID NO: 1208810 - protein, 9 aa, Homo Sapiens
QDSSSHFKV

SEQ ID NO: 1208811 - protein, 9 aa, Homo Sapiens
WTTPSPHPP

SEQ ID NO: 1208812 - protein, 9 aa, Homo Sapiens
RTLQKRLRE

SEQ ID NO: 1208813 - protein, 9 aa, Homo Sapiens
RHTEKPPES

SEQ ID NO: 1208814 - protein, 9 aa, Homo Sapiens
AQMLLSRLH

SEQ ID NO: 1208815 - protein, 9 aa, Homo Sapiens
CHSKIRSNP

SEQ ID NO: 1208816 - protein, 9 aa, Homo Sapiens
FVSCHTQFS

SEQ ID NO: 1208817 - protein, 9 aa, Homo Sapiens
GLPLYIRLH

SEQ ID NO: 1208818 - protein, 9 aa, Homo Sapiens
MSKEELHVL

SEQ ID NO: 1208819 - protein, 9 aa, Homo Sapiens
MNRTNINVF

SEQ ID NO: 1208820 - protein, 9 aa, Homo Sapiens
HVVDFVPSE

SEQ ID NO: 1208821 - protein, 9 aa, Homo Sapiens
FMTLKNSKT

SEQ ID NO: 1208822 - protein, 9 aa, Homo Sapiens
DTKEEILNA

SEQ ID NO: 1208823 - protein, 9 aa, Homo Sapiens
FQNRQTKWR

SEQ ID NO: 1208824 - protein, 9 aa, Homo Sapiens
TFSDEHRTY

SEQ ID NO: 1208825 - protein, 9 aa, Homo Sapiens
WKNEKHLHA

SEQ ID NO: 1208826 - protein, 9 aa, Homo Sapiens
NSTRVIQCY

SEQ ID NO: 1208827 - protein, 9 aa, Homo Sapiens
WQRLAELEG

SEQ ID NO: 1208828 - protein, 9 aa, Homo Sapiens
IPVPGNLGT

SEQ ID NO: 1208829 - protein, 9 aa, Homo Sapiens
EGYYQCVVT

SEQ ID NO: 1208830 - protein, 9 aa, Homo Sapiens
DMTLIYITL

SEQ ID NO: 1208831 - protein, 9 aa, Homo Sapiens
NLQCEATVI

SEQ ID NO: 1208832 - protein, 9 aa, Homo Sapiens
PSLRILTIG

SEQ ID NO: 1208833 - protein, 9 aa, Homo Sapiens
AEKLHVAAL

SEQ ID NO: 1208834 - protein, 9 aa, Homo Sapiens
NGMYYLEEH

SEQ ID NO: 1208835 - protein, 9 aa, Homo Sapiens
DREGTGRMR

SEQ ID NO: 1208836 - protein, 9 aa, Homo Sapiens
PPPPGYESV

SEQ ID NO: 1208837 - protein, 9 aa, Homo Sapiens
MNLHSPGVH

SEQ ID NO: 1208838 - protein, 9 aa, Homo Sapiens
GPRPRVPLC

SEQ ID NO: 1208839 - protein, 9 aa, Homo Sapiens
CSFHIENKL

SEQ ID NO: 1208840 - protein, 9 aa, Homo Sapiens
SDDDAPCPG

SEQ ID NO: 1208841 - protein, 9 aa, Homo Sapiens
CDLPLGDFE

SEQ ID NO: 1208842 - protein, 9 aa, Homo Sapiens
APVGPVQVG

SEQ ID NO: 1208843 - protein, 9 aa, Homo Sapiens
SSSLIHHYQ

SEQ ID NO: 1208844 - protein, 9 aa, Homo Sapiens
HTIDELVEC

SEQ ID NO: 1208845 - protein, 9 aa, Homo Sapiens
ELKVTEVKE

SEQ ID NO: 1208846 - protein, 9 aa, Homo Sapiens
SWPHWLYSL

SEQ ID NO: 1208847 - protein, 9 aa, Homo Sapiens
YAFFAERKT

SEQ ID NO: 1208848 - protein, 9 aa, Homo Sapiens
IPHPSSPGW

SEQ ID NO: 1208849 - protein, 9 aa, Homo Sapiens
YKPGWQDWT

SEQ ID NO: 1208850 - protein, 9 aa, Homo Sapiens
LVAVLECDT

SEQ ID NO: 1208851 - protein, 9 aa, Homo Sapiens
NLLDHLREC

SEQ ID NO: 1208852 - protein, 9 aa, Homo Sapiens
SGIQHDQPV

SEQ ID NO: 1208853 - protein, 9 aa, Homo Sapiens
ARTMPLCAV

SEQ ID NO: 1208854 - protein, 9 aa, Homo Sapiens
QDPGRLSAN

SEQ ID NO: 1208855 - protein, 9 aa, Homo Sapiens
GPSLADRQC

SEQ ID NO: 1208856 - protein, 9 aa, Homo Sapiens
FLLLPISAF

SEQ ID NO: 1208857 - protein, 9 aa, Homo Sapiens
AEINPVHYP

SEQ ID NO: 1208858 - protein, 9 aa, Homo Sapiens
LPFYPLRGP

SEQ ID NO: 1208859 - protein, 9 aa, Homo Sapiens
ERDTPDYLK

SEQ ID NO: 1208860 - protein, 9 aa, Homo Sapiens
LPKYHMVRC

SEQ ID NO: 1208861 - protein, 9 aa, Homo Sapiens
QEVMQPVEE

SEQ ID NO: 1208862 - protein, 9 aa, Homo Sapiens
SGPEFIQMS

SEQ ID NO: 1208863 - protein, 9 aa, Homo Sapiens
SGPDGQTQK

SEQ ID NO: 1208864 - protein, 9 aa, Homo Sapiens
MLIHVTSSA

SEQ ID NO: 1208865 - protein, 9 aa, Homo Sapiens
LQERGGVAT

SEQ ID NO: 1208866 - protein, 9 aa, Homo Sapiens
IYVFVRDSA

SEQ ID NO: 1208867 - protein, 9 aa, Homo Sapiens
GCGFKHFCD

SEQ ID NO: 1208868 - protein, 9 aa, Homo Sapiens
TTMLASALG

SEQ ID NO: 1208869 - protein, 9 aa, Homo Sapiens
TTKRFEKLM

SEQ ID NO: 1208870 - protein, 9 aa, Homo Sapiens
PSKVDQLQD

SEQ ID NO: 1208871 - protein, 9 aa, Homo Sapiens
PASLNQGIS

SEQ ID NO: 1208872 - protein, 9 aa, Homo Sapiens
PGWERTRKH

SEQ ID NO: 1208873 - protein, 9 aa, Homo Sapiens
WSVPGSFAF

SEQ ID NO: 1208874 - protein, 9 aa, Homo Sapiens
YVAKQLEKR

SEQ ID NO: 1208875 - protein, 9 aa, Homo Sapiens
EVHVPTRFL

SEQ ID NO: 1208876 - protein, 9 aa, Homo Sapiens
SNIPNSELM

SEQ ID NO: 1208877 - protein, 9 aa, Homo Sapiens
FPRPTSLTL

SEQ ID NO: 1208878 - protein, 9 aa, Homo Sapiens
CSIDEPVFE

SEQ ID NO: 1208879 - protein, 9 aa, Homo Sapiens
TISHAGHVL

SEQ ID NO: 1208880 - protein, 9 aa, Homo Sapiens
YNVIDLPVE

SEQ ID NO: 1208881 - protein, 9 aa, Homo Sapiens
VQAFAGGVM

SEQ ID NO: 1208882 - protein, 9 aa, Homo Sapiens
HIRFNVYCF

SEQ ID NO: 1208883 - protein, 9 aa, Homo Sapiens
KAHDGDFEV

SEQ ID NO: 1208884 - protein, 9 aa, Homo Sapiens
SSFVDKIQT

SEQ ID NO: 1208885 - protein, 9 aa, Homo Sapiens
FDTTKCFAK

SEQ ID NO: 1208886 - protein, 9 aa, Homo Sapiens
YVRTGKAHS

SEQ ID NO: 1208887 - protein, 9 aa, Homo Sapiens
MKSYIYVYT

SEQ ID NO: 1208888 - protein, 9 aa, Homo Sapiens
GLPSIVCLK

SEQ ID NO: 1208889 - protein, 9 aa, Homo Sapiens
EEYGKAFRQ

SEQ ID NO: 1208890 - protein, 9 aa, Homo Sapiens
RSSRTWASP

SEQ ID NO: 1208891 - protein, 9 aa, Homo Sapiens
SVSQGFHML

SEQ ID NO: 1208892 - protein, 9 aa, Homo Sapiens
RRESVKSYK

SEQ ID NO: 1208893 - protein, 9 aa, Homo Sapiens
ETYHWSRSH

SEQ ID NO: 1208894 - protein, 9 aa, Homo Sapiens
YCDLPLGDF

SEQ ID NO: 1208895 - protein, 9 aa, Homo Sapiens
LVSTFVVFL

SEQ ID NO: 1208896 - protein, 9 aa, Homo Sapiens
LKKSAFKKP

SEQ ID NO: 1208897 - protein, 9 aa, Homo Sapiens
YPAIILFSR

SEQ ID NO: 1208898 - protein, 9 aa, Homo Sapiens
QPVLVGLFL

SEQ ID NO: 1208899 - protein, 9 aa, Homo Sapiens
VDSSCKTPD

SEQ ID NO: 1208900 - protein, 9 aa, Homo Sapiens
DAREQWLRV

SEQ ID NO: 1208901 - protein, 9 aa, Homo Sapiens
RNGNVIYSI

SEQ ID NO: 1208902 - protein, 9 aa, Homo Sapiens
HEYFNVSVY

SEQ ID NO: 1208903 - protein, 9 aa, Homo Sapiens
DMIPGLPAH

SEQ ID NO: 1208904 - protein, 9 aa, Homo Sapiens
SHRTLKNFE

SEQ ID NO: 1208905 - protein, 9 aa, Homo Sapiens
PQSPAAQPL

SEQ ID NO: 1208906 - protein, 9 aa, Homo Sapiens
YIHVHIQSQ

SEQ ID NO: 1208907 - protein, 9 aa, Homo Sapiens
AGVSHVLNR

SEQ ID NO: 1208908 - protein, 9 aa, Homo Sapiens
SSSLAIPDD

SEQ ID NO: 1208909 - protein, 9 aa, Homo Sapiens
EKAVITETQ

SEQ ID NO: 1208910 - protein, 9 aa, Homo Sapiens
SRKPRTFSK

SEQ ID NO: 1208911 - protein, 9 aa, Homo Sapiens
HFLVFGYTQ

SEQ ID NO: 1208912 - protein, 9 aa, Homo Sapiens
NKNKKKLGQ

SEQ ID NO: 1208913 - protein, 9 aa, Homo Sapiens
LKMVDSFHM

SEQ ID NO: 1208914 - protein, 9 aa, Homo Sapiens
PKKNRHWHW

SEQ ID NO: 1208915 - protein, 9 aa, Homo Sapiens
EDEKPEYIS

SEQ ID NO: 1208916 - protein, 9 aa, Homo Sapiens
KAYPSEKSN

SEQ ID NO: 1208917 - protein, 9 aa, Homo Sapiens
YTLPHAIMR

SEQ ID NO: 1208918 - protein, 9 aa, Homo Sapiens
ERTKIFKHT

SEQ ID NO: 1208919 - protein, 9 aa, Homo Sapiens
QILLYSSTL

SEQ ID NO: 1208920 - protein, 9 aa, Homo Sapiens
AEYVYYKSM

SEQ ID NO: 1208921 - protein, 9 aa, Homo Sapiens
LLLLIMSYC

SEQ ID NO: 1208922 - protein, 9 aa, Homo Sapiens
KCDIGPLQG

SEQ ID NO: 1208923 - protein, 9 aa, Homo Sapiens
STQGPHRHL

SEQ ID NO: 1208924 - protein, 9 aa, Homo Sapiens
THCLRDVQK

SEQ ID NO: 1208925 - protein, 9 aa, Homo Sapiens
CDRDNLEYS

SEQ ID NO: 1208926 - protein, 9 aa, Homo Sapiens
QAEGPLTVI

SEQ ID NO: 1208927 - protein, 9 aa, Homo Sapiens
RTSPSWAAA

SEQ ID NO: 1208928 - protein, 9 aa, Homo Sapiens
NSVAERLHR

SEQ ID NO: 1208929 - protein, 9 aa, Homo Sapiens
CVLVNASLG

SEQ ID NO: 1208930 - protein, 9 aa, Homo Sapiens
GLATVIRCR

SEQ ID NO: 1208931 - protein, 9 aa, Homo Sapiens
KGDCGSCGC

SEQ ID NO: 1208932 - protein, 9 aa, Homo Sapiens
VYVANAGDN

SEQ ID NO: 1208933 - protein, 9 aa, Homo Sapiens
DEPQKSSLS

SEQ ID NO: 1208934 - protein, 9 aa, Homo Sapiens
MTIDFDRII

SEQ ID NO: 1208935 - protein, 9 aa, Homo Sapiens
TKSISLDSG

SEQ ID NO: 1208936 - protein, 9 aa, Homo Sapiens
DLVCQCFLR

SEQ ID NO: 1208937 - protein, 9 aa, Homo Sapiens
SFDLSLTSS

SEQ ID NO: 1208938 - protein, 9 aa, Homo Sapiens
PGLNSMKPQ

SEQ ID NO: 1208939 - protein, 9 aa, Homo Sapiens
RYWRRGTFE

SEQ ID NO: 1208940 - protein, 9 aa, Homo Sapiens
EEQLHQGQN

SEQ ID NO: 1208941 - protein, 9 aa, Homo Sapiens
LERMLTQAD

SEQ ID NO: 1208942 - protein, 9 aa, Homo Sapiens
GREDLPTIV

SEQ ID NO: 1208943 - protein, 9 aa, Homo Sapiens
PKGDVGPNE

SEQ ID NO: 1208944 - protein, 9 aa, Homo Sapiens
LLFIISRTY

SEQ ID NO: 1208945 - protein, 9 aa, Homo Sapiens
LCWCRLQCE

SEQ ID NO: 1208946 - protein, 9 aa, Homo Sapiens
VRLQDNVPL

SEQ ID NO: 1208947 - protein, 9 aa, Homo Sapiens
IKNGLLHCT

SEQ ID NO: 1208948 - protein, 9 aa, Homo Sapiens
PKCNGKGTE

SEQ ID NO: 1208949 - protein, 9 aa, Homo Sapiens
KLDQLKQGF

SEQ ID NO: 1208950 - protein, 9 aa, Homo Sapiens
DHAISMDLL

SEQ ID NO: 1208951 - protein, 9 aa, Homo Sapiens
GLNSANLLK

SEQ ID NO: 1208952 - protein, 9 aa, Homo Sapiens
CICALDVDA

SEQ ID NO: 1208953 - protein, 9 aa, Homo Sapiens
MLIHTSIRP

SEQ ID NO: 1208954 - protein, 9 aa, Homo Sapiens
IPRKDLLVE

SEQ ID NO: 1208955 - protein, 9 aa, Homo Sapiens
TSLMGMALL

SEQ ID NO: 1208956 - protein, 9 aa, Homo Sapiens
AGAPPPPAP

SEQ ID NO: 1208957 - protein, 9 aa, Homo Sapiens
GCSAVIDME

SEQ ID NO: 1208958 - protein, 9 aa, Homo Sapiens
DFGLSFKEC

SEQ ID NO: 1208959 - protein, 9 aa, Homo Sapiens
MPERTSYPP

SEQ ID NO: 1208960 - protein, 9 aa, Homo Sapiens
QCPSGSRTG

SEQ ID NO: 1208961 - protein, 9 aa, Homo Sapiens
PTVTYTTMI

SEQ ID NO: 1208962 - protein, 9 aa, Homo Sapiens
PLALCHLVD

SEQ ID NO: 1208963 - protein, 9 aa, Homo Sapiens
EQLVFCQDQ

SEQ ID NO: 1208964 - protein, 9 aa, Homo Sapiens
QKVFSPQTH

SEQ ID NO: 1208965 - protein, 9 aa, Homo Sapiens
AYAIQKLFA

SEQ ID NO: 1208966 - protein, 9 aa, Homo Sapiens
LGQVWCPSR

SEQ ID NO: 1208967 - protein, 9 aa, Homo Sapiens
TFIKKGCLS

SEQ ID NO: 1208968 - protein, 9 aa, Homo Sapiens
EAEQEMVCM

SEQ ID NO: 1208969 - protein, 9 aa, Homo Sapiens
TPRSQWRCQ

SEQ ID NO: 1208970 - protein, 9 aa, Homo Sapiens
EGRPRNIVS

SEQ ID NO: 1208971 - protein, 9 aa, Homo Sapiens
YFPVIFRKD

SEQ ID NO: 1208972 - protein, 9 aa, Homo Sapiens
FTVLSYMAE

SEQ ID NO: 1208973 - protein, 9 aa, Homo Sapiens
RSSGASQRT

SEQ ID NO: 1208974 - protein, 9 aa, Homo Sapiens
QHTQNTHGL

SEQ ID NO: 1208975 - protein, 9 aa, Homo Sapiens
LGEALVPLS

SEQ ID NO: 1208976 - protein, 9 aa, Homo Sapiens
PTPDVVSSG

SEQ ID NO: 1208977 - protein, 9 aa, Homo Sapiens
ESLVKWLAA

SEQ ID NO: 1208978 - protein, 9 aa, Homo Sapiens
KHVSGITLM

SEQ ID NO: 1208979 - protein, 9 aa, Homo Sapiens
FLTDTEKRV

SEQ ID NO: 1208980 - protein, 9 aa, Homo Sapiens
TYNEAMARV

SEQ ID NO: 1208981 - protein, 9 aa, Homo Sapiens
LSRVQTQLC

SEQ ID NO: 1208982 - protein, 9 aa, Homo Sapiens
KIMGVAGSL

SEQ ID NO: 1208983 - protein, 9 aa, Homo Sapiens
WSLTRPRVF

SEQ ID NO: 1208984 - protein, 9 aa, Homo Sapiens
RTHYYETYI

SEQ ID NO: 1208985 - protein, 9 aa, Homo Sapiens
MNVASSSHS

SEQ ID NO: 1208986 - protein, 9 aa, Homo Sapiens
AGRMGVCIC

SEQ ID NO: 1208987 - protein, 9 aa, Homo Sapiens
YDIDELEND

SEQ ID NO: 1208988 - protein, 9 aa, Homo Sapiens
PSPDVPCLP

SEQ ID NO: 1208989 - protein, 9 aa, Homo Sapiens
TIVTVMCLL

SEQ ID NO: 1208990 - protein, 9 aa, Homo Sapiens
VLAHWSVIF

SEQ ID NO: 1208991 - protein, 9 aa, Homo Sapiens
RCREEGLSK

SEQ ID NO: 1208992 - protein, 9 aa, Homo Sapiens
WASAPSHQA

SEQ ID NO: 1208993 - protein, 9 aa, Homo Sapiens
HTVRYYSKG

SEQ ID NO: 1208994 - protein, 9 aa, Homo Sapiens
SQDHMVPGR

SEQ ID NO: 1208995 - protein, 9 aa, Homo Sapiens
EAMGFFCLM

SEQ ID NO: 1208996 - protein, 9 aa, Homo Sapiens
KLFKLPCLK

SEQ ID NO: 1208997 - protein, 9 aa, Homo Sapiens
FSTALHGES

SEQ ID NO: 1208998 - protein, 9 aa, Homo Sapiens
IPVYIAAGV

SEQ ID NO: 1208999 - protein, 9 aa, Homo Sapiens
ARESEMCTE

SEQ ID NO: 1209000 - protein, 9 aa, Homo Sapiens
NTCMLKGSS

SEQ ID NO: 1209001 - protein, 9 aa, Homo Sapiens
IPSHPTEGS

SEQ ID NO: 1209002 - protein, 9 aa, Homo Sapiens
IFLPIEDNC

SEQ ID NO: 1209003 - protein, 9 aa, Homo Sapiens
INQRRYPRT

SEQ ID NO: 1209004 - protein, 9 aa, Homo Sapiens
LVDAAGGTT

SEQ ID NO: 1209005 - protein, 9 aa, Homo Sapiens
KDFSDYGAV

SEQ ID NO: 1209006 - protein, 9 aa, Homo Sapiens
NCILTNFRV

SEQ ID NO: 1209007 - protein, 9 aa, Homo Sapiens
LQTAGCFVG

SEQ ID NO: 1209008 - protein, 9 aa, Homo Sapiens
DTYIKSCAG

SEQ ID NO: 1209009 - protein, 9 aa, Homo Sapiens
YYGWAVFGG

SEQ ID NO: 1209010 - protein, 9 aa, Homo Sapiens
ESLQLQVAC

SEQ ID NO: 1209011 - protein, 9 aa, Homo Sapiens
LDDEDSDNL

SEQ ID NO: 1209012 - protein, 9 aa, Homo Sapiens
QGQVLRVSD

SEQ ID NO: 1209013 - protein, 9 aa, Homo Sapiens
ARRLGRCSV

SEQ ID NO: 1209014 - protein, 9 aa, Homo Sapiens
LPKSPASAP

SEQ ID NO: 1209015 - protein, 9 aa, Homo Sapiens
GRVHNMELV

SEQ ID NO: 1209016 - protein, 9 aa, Homo Sapiens
SGDPDSIRC

SEQ ID NO: 1209017 - protein, 9 aa, Homo Sapiens
SIRCMNVVH

SEQ ID NO: 1209018 - protein, 9 aa, Homo Sapiens
AQLREKVHE

SEQ ID NO: 1209019 - protein, 9 aa, Homo Sapiens
QTMITEFLL

SEQ ID NO: 1209020 - protein, 9 aa, Homo Sapiens
KGLHQLQTG

SEQ ID NO: 1209021 - protein, 9 aa, Homo Sapiens
VGTLDLVDV

SEQ ID NO: 1209022 - protein, 9 aa, Homo Sapiens
DDRVHEQGY

SEQ ID NO: 1209023 - protein, 9 aa, Homo Sapiens
VITLVFEGI

SEQ ID NO: 1209024 - protein, 9 aa, Homo Sapiens
DKPAPMEGK

SEQ ID NO: 1209025 - protein, 9 aa, Homo Sapiens
YDVKNIKRC

SEQ ID NO: 1209026 - protein, 9 aa, Homo Sapiens
VERVLHNVQ

SEQ ID NO: 1209027 - protein, 9 aa, Homo Sapiens
GDGTSQGCT

SEQ ID NO: 1209028 - protein, 9 aa, Homo Sapiens
ASEDMKLFD

SEQ ID NO: 1209029 - protein, 9 aa, Homo Sapiens
IVLLKGCCM

SEQ ID NO: 1209030 - protein, 9 aa, Homo Sapiens
IERECEMAD

SEQ ID NO: 1209031 - protein, 9 aa, Homo Sapiens
LVLNKGTCL

SEQ ID NO: 1209032 - protein, 9 aa, Homo Sapiens
GFNKWNATN

SEQ ID NO: 1209033 - protein, 9 aa, Homo Sapiens
MWSFCFSPL

SEQ ID NO: 1209034 - protein, 9 aa, Homo Sapiens
NHLRDVPDA

SEQ ID NO: 1209035 - protein, 9 aa, Homo Sapiens
CPFTITHRR

SEQ ID NO: 1209036 - protein, 9 aa, Homo Sapiens
KNVRMAIGL

SEQ ID NO: 1209037 - protein, 9 aa, Homo Sapiens
LVLSGVRAI

SEQ ID NO: 1209038 - protein, 9 aa, Homo Sapiens
RGLQDGSTS

SEQ ID NO: 1209039 - protein, 9 aa, Homo Sapiens
HCPANGAGW

SEQ ID NO: 1209040 - protein, 9 aa, Homo Sapiens
QTVSPREPT

SEQ ID NO: 1209041 - protein, 9 aa, Homo Sapiens
SSDIFDCLE

SEQ ID NO: 1209042 - protein, 9 aa, Homo Sapiens
PWPLPMCCT

SEQ ID NO: 1209043 - protein, 9 aa, Homo Sapiens
KIIYVRNLM

SEQ ID NO: 1209044 - protein, 9 aa, Homo Sapiens
KIPESVGGL

SEQ ID NO: 1209045 - protein, 9 aa, Homo Sapiens
ERESGGHRY

SEQ ID NO: 1209046 - protein, 9 aa, Homo Sapiens
PTADEEEPV

SEQ ID NO: 1209047 - protein, 9 aa, Homo Sapiens
KEWHHLTMF

SEQ ID NO: 1209048 - protein, 9 aa, Homo Sapiens
GMMRHLNIN

SEQ ID NO: 1209049 - protein, 9 aa, Homo Sapiens
SDIIYKKLL

SEQ ID NO: 1209050 - protein, 9 aa, Homo Sapiens
EPDMIIRPS

SEQ ID NO: 1209051 - protein, 9 aa, Homo Sapiens
RQFPPGMPE

SEQ ID NO: 1209052 - protein, 9 aa, Homo Sapiens
SRSTQGGHM

SEQ ID NO: 1209053 - protein, 9 aa, Homo Sapiens
GLFGCMRPV

SEQ ID NO: 1209054 - protein, 9 aa, Homo Sapiens
QNMWHTYLS

SEQ ID NO: 1209055 - protein, 9 aa, Homo Sapiens
LTSGHQSSS

SEQ ID NO: 1209056 - protein, 9 aa, Homo Sapiens
GASDSELMV

SEQ ID NO: 1209057 - protein, 9 aa, Homo Sapiens
ESIFDMDYA

SEQ ID NO: 1209058 - protein, 9 aa, Homo Sapiens
DPEKQNENI

SEQ ID NO: 1209059 - protein, 9 aa, Homo Sapiens
QLRSGTVTC

SEQ ID NO: 1209060 - protein, 9 aa, Homo Sapiens
CNQGNQVER

SEQ ID NO: 1209061 - protein, 9 aa, Homo Sapiens
PLTRVVYAS

SEQ ID NO: 1209062 - protein, 9 aa, Homo Sapiens
WPYKCGECG

SEQ ID NO: 1209063 - protein, 9 aa, Homo Sapiens
RISEGEARS

SEQ ID NO: 1209064 - protein, 9 aa, Homo Sapiens
VLQILLVTH

SEQ ID NO: 1209065 - protein, 9 aa, Homo Sapiens
RQLWAILSF

SEQ ID NO: 1209066 - protein, 9 aa, Homo Sapiens
KIRLIVELA

SEQ ID NO: 1209067 - protein, 9 aa, Homo Sapiens
NHTVCYDLS

SEQ ID NO: 1209068 - protein, 9 aa, Homo Sapiens
PYKRNECGK

SEQ ID NO: 1209069 - protein, 9 aa, Homo Sapiens
TAATSPGSQ

SEQ ID NO: 1209070 - protein, 9 aa, Homo Sapiens
SVCMRHDKI

SEQ ID NO: 1209071 - protein, 9 aa, Homo Sapiens
SRGNLGAKS

SEQ ID NO: 1209072 - protein, 9 aa, Homo Sapiens
GLWDFMIYL

SEQ ID NO: 1209073 - protein, 9 aa, Homo Sapiens
CGEELPWDA

SEQ ID NO: 1209074 - protein, 9 aa, Homo Sapiens
ADHHEVISK

SEQ ID NO: 1209075 - protein, 9 aa, Homo Sapiens
ERPFHCTQC

SEQ ID NO: 1209076 - protein, 9 aa, Homo Sapiens
SSFLTMLKP

SEQ ID NO: 1209077 - protein, 9 aa, Homo Sapiens
LTGQEPAQH

SEQ ID NO: 1209078 - protein, 9 aa, Homo Sapiens
PRAAEDELV

SEQ ID NO: 1209079 - protein, 9 aa, Homo Sapiens
ETNEKSKES

SEQ ID NO: 1209080 - protein, 9 aa, Homo Sapiens
IPYECEECG

SEQ ID NO: 1209081 - protein, 9 aa, Homo Sapiens
GMGPAAGRG

SEQ ID NO: 1209082 - protein, 9 aa, Homo Sapiens
RRADKKKRL

SEQ ID NO: 1209083 - protein, 9 aa, Homo Sapiens
TKCVKKSKQ

SEQ ID NO: 1209084 - protein, 9 aa, Homo Sapiens
QKKEKLHCL

SEQ ID NO: 1209085 - protein, 9 aa, Homo Sapiens
TEKLIEKCQ

SEQ ID NO: 1209086 - protein, 9 aa, Homo Sapiens
SFHWKRRRS

SEQ ID NO: 1209087 - protein, 9 aa, Homo Sapiens
PIHREKVKC

SEQ ID NO: 1209088 - protein, 9 aa, Homo Sapiens
KFRHPAISP

SEQ ID NO: 1209089 - protein, 9 aa, Homo Sapiens
LASAILKRD

SEQ ID NO: 1209090 - protein, 9 aa, Homo Sapiens
NVQPDEPNV

SEQ ID NO: 1209091 - protein, 9 aa, Homo Sapiens
GHQQGVLQK

SEQ ID NO: 1209092 - protein, 9 aa, Homo Sapiens
SHSHGMKKM

SEQ ID NO: 1209093 - protein, 9 aa, Homo Sapiens
TRMVVSVVA

SEQ ID NO: 1209094 - protein, 9 aa, Homo Sapiens
PGHFFALSE

SEQ ID NO: 1209095 - protein, 9 aa, Homo Sapiens
VLVRYSSKE

SEQ ID NO: 1209096 - protein, 9 aa, Homo Sapiens
TPGRGPPLA

SEQ ID NO: 1209097 - protein, 9 aa, Homo Sapiens
LFEMDSSMA

SEQ ID NO: 1209098 - protein, 9 aa, Homo Sapiens
KMALAYALV

SEQ ID NO: 1209099 - protein, 9 aa, Homo Sapiens
ICDYFGVKT

SEQ ID NO: 1209100 - protein, 9 aa, Homo Sapiens
SNKACRFTD

SEQ ID NO: 1209101 - protein, 9 aa, Homo Sapiens
HCKCTECGK

SEQ ID NO: 1209102 - protein, 9 aa, Homo Sapiens
RRIKYLMED

SEQ ID NO: 1209103 - protein, 9 aa, Homo Sapiens
RSVLGLHEK

SEQ ID NO: 1209104 - protein, 9 aa, Homo Sapiens
KLDHPKIAT

SEQ ID NO: 1209105 - protein, 9 aa, Homo Sapiens
LAVPDTVHE

SEQ ID NO: 1209106 - protein, 9 aa, Homo Sapiens
ALDLGLDED

SEQ ID NO: 1209107 - protein, 9 aa, Homo Sapiens
SSVIGESYW

SEQ ID NO: 1209108 - protein, 9 aa, Homo Sapiens
CSLEELPSG

SEQ ID NO: 1209109 - protein, 9 aa, Homo Sapiens
QLRHCLSLV

SEQ ID NO: 1209110 - protein, 9 aa, Homo Sapiens
NITIFFGAL

SEQ ID NO: 1209111 - protein, 9 aa, Homo Sapiens
KALVRYGAD

SEQ ID NO: 1209112 - protein, 9 aa, Homo Sapiens
SVTKSTTTT

SEQ ID NO: 1209113 - protein, 9 aa, Homo Sapiens
AFLSLQCTG

SEQ ID NO: 1209114 - protein, 9 aa, Homo Sapiens
VRVTEGIKE

SEQ ID NO: 1209115 - protein, 9 aa, Homo Sapiens
LNVSSSIQA

SEQ ID NO: 1209116 - protein, 9 aa, Homo Sapiens
NKLMEHERL

SEQ ID NO: 1209117 - protein, 9 aa, Homo Sapiens
TTLKLILVM

SEQ ID NO: 1209118 - protein, 9 aa, Homo Sapiens
GMAYVFGGA

SEQ ID NO: 1209119 - protein, 9 aa, Homo Sapiens
IPSSEQPEL

SEQ ID NO: 1209120 - protein, 9 aa, Homo Sapiens
VLAWMGVIN

SEQ ID NO: 1209121 - protein, 9 aa, Homo Sapiens
DQEPTHTGH

SEQ ID NO: 1209122 - protein, 9 aa, Homo Sapiens
HLPHLYMYL

SEQ ID NO: 1209123 - protein, 9 aa, Homo Sapiens
SGGFCGGNL

SEQ ID NO: 1209124 - protein, 9 aa, Homo Sapiens
LTLAEHLAG

SEQ ID NO: 1209125 - protein, 9 aa, Homo Sapiens
MYIFQNVMV

SEQ ID NO: 1209126 - protein, 9 aa, Homo Sapiens
LPPCFPVKL

SEQ ID NO: 1209127 - protein, 9 aa, Homo Sapiens
VACPRSSST

SEQ ID NO: 1209128 - protein, 9 aa, Homo Sapiens
GVLIVLYIL

SEQ ID NO: 1209129 - protein, 9 aa, Homo Sapiens
KKNRCFICR

SEQ ID NO: 1209130 - protein, 9 aa, Homo Sapiens
YVWAHLNRD

SEQ ID NO: 1209131 - protein, 9 aa, Homo Sapiens
AFQLKKSGE

SEQ ID NO: 1209132 - protein, 9 aa, Homo Sapiens
HHPYGPPGG

SEQ ID NO: 1209133 - protein, 9 aa, Homo Sapiens
GNAKSKVHT

SEQ ID NO: 1209134 - protein, 9 aa, Homo Sapiens
GRQTMHNYS

SEQ ID NO: 1209135 - protein, 9 aa, Homo Sapiens
AIVLGNLKL

SEQ ID NO: 1209136 - protein, 9 aa, Homo Sapiens
TEKERLVRQ

SEQ ID NO: 1209137 - protein, 9 aa, Homo Sapiens
REVALDLPQ

SEQ ID NO: 1209138 - protein, 9 aa, Homo Sapiens
SELMVWDIA

SEQ ID NO: 1209139 - protein, 9 aa, Homo Sapiens
SHAVGVLCY

SEQ ID NO: 1209140 - protein, 9 aa, Homo Sapiens
GVYPVHMQL

SEQ ID NO: 1209141 - protein, 9 aa, Homo Sapiens
VKRSDGFNG

SEQ ID NO: 1209142 - protein, 9 aa, Homo Sapiens
LVPLLVTLL

SEQ ID NO: 1209143 - protein, 9 aa, Homo Sapiens
LLHMCLQDG

SEQ ID NO: 1209144 - protein, 9 aa, Homo Sapiens
GTHDAISSA

SEQ ID NO: 1209145 - protein, 9 aa, Homo Sapiens
LRARWSTSF

SEQ ID NO: 1209146 - protein, 9 aa, Homo Sapiens
GLLKRFRKS

SEQ ID NO: 1209147 - protein, 9 aa, Homo Sapiens
NIKKLSNCL

SEQ ID NO: 1209148 - protein, 9 aa, Homo Sapiens
IYTMKIKPR

SEQ ID NO: 1209149 - protein, 9 aa, Homo Sapiens
VSEEHIPDV

SEQ ID NO: 1209150 - protein, 9 aa, Homo Sapiens
VSSFMYSKA

SEQ ID NO: 1209151 - protein, 9 aa, Homo Sapiens
VPLSQGSSG

SEQ ID NO: 1209152 - protein, 9 aa, Homo Sapiens
LSYFTRKEE

SEQ ID NO: 1209153 - protein, 9 aa, Homo Sapiens
ILTTTDVRK

SEQ ID NO: 1209154 - protein, 9 aa, Homo Sapiens
NTTLAVEKE

SEQ ID NO: 1209155 - protein, 9 aa, Homo Sapiens
HKALDPAHW

SEQ ID NO: 1209156 - protein, 9 aa, Homo Sapiens
LPYHDSTQV

SEQ ID NO: 1209157 - protein, 9 aa, Homo Sapiens
YQGFPFLPP

SEQ ID NO: 1209158 - protein, 9 aa, Homo Sapiens
IPSNSNVVV

SEQ ID NO: 1209159 - protein, 9 aa, Homo Sapiens
QDAQGPRPG

SEQ ID NO: 1209160 - protein, 9 aa, Homo Sapiens
FAIEALKSL

SEQ ID NO: 1209161 - protein, 9 aa, Homo Sapiens
RQRAQKGRY

SEQ ID NO: 1209162 - protein, 9 aa, Homo Sapiens
LQQLHLTQY

SEQ ID NO: 1209163 - protein, 9 aa, Homo Sapiens
STLNVLSLN

SEQ ID NO: 1209164 - protein, 9 aa, Homo Sapiens
LPLSYRLGI

SEQ ID NO: 1209165 - protein, 9 aa, Homo Sapiens
SRDEKNYYQ

SEQ ID NO: 1209166 - protein, 9 aa, Homo Sapiens
TRLRIQAEQ

SEQ ID NO: 1209167 - protein, 9 aa, Homo Sapiens
VLRSVNSRG

SEQ ID NO: 1209168 - protein, 9 aa, Homo Sapiens
LLLSLMATE

SEQ ID NO: 1209169 - protein, 9 aa, Homo Sapiens
KTGKWQKEA

SEQ ID NO: 1209170 - protein, 9 aa, Homo Sapiens
QDLWTVNGH

SEQ ID NO: 1209171 - protein, 9 aa, Homo Sapiens
SQLKSSSKR

SEQ ID NO: 1209172 - protein, 9 aa, Homo Sapiens
RPDVTESEN

SEQ ID NO: 1209173 - protein, 9 aa, Homo Sapiens
VTGQLLSQG

SEQ ID NO: 1209174 - protein, 9 aa, Homo Sapiens
EDLEKEHEE

SEQ ID NO: 1209175 - protein, 9 aa, Homo Sapiens
KLYKRKEIQ

SEQ ID NO: 1209176 - protein, 9 aa, Homo Sapiens
FPVGNVVNE

SEQ ID NO: 1209177 - protein, 9 aa, Homo Sapiens
ANTILGRKY

SEQ ID NO: 1209178 - protein, 9 aa, Homo Sapiens
NSRGLSRII

SEQ ID NO: 1209179 - protein, 9 aa, Homo Sapiens
GNDINNVLF

SEQ ID NO: 1209180 - protein, 9 aa, Homo Sapiens
GQMKDIYHY

SEQ ID NO: 1209181 - protein, 9 aa, Homo Sapiens
ALAEQQRHI

SEQ ID NO: 1209182 - protein, 9 aa, Homo Sapiens
VRYGKDKAP

SEQ ID NO: 1209183 - protein, 9 aa, Homo Sapiens
IKSVLSGAN

SEQ ID NO: 1209184 - protein, 9 aa, Homo Sapiens
CPNCSLLYA

SEQ ID NO: 1209185 - protein, 9 aa, Homo Sapiens
TALAGAGAT

SEQ ID NO: 1209186 - protein, 9 aa, Homo Sapiens
SPPSSSTTT

SEQ ID NO: 1209187 - protein, 9 aa, Homo Sapiens
RGQINTEVM

SEQ ID NO: 1209188 - protein, 9 aa, Homo Sapiens
FFIIQMWSI

SEQ ID NO: 1209189 - protein, 9 aa, Homo Sapiens
LEFFDHNGS

SEQ ID NO: 1209190 - protein, 9 aa, Homo Sapiens
VDGLIFQAF

SEQ ID NO: 1209191 - protein, 9 aa, Homo Sapiens
KDKEKKRKE

SEQ ID NO: 1209192 - protein, 9 aa, Homo Sapiens
QERGGVATP

SEQ ID NO: 1209193 - protein, 9 aa, Homo Sapiens
EHAHIVASF

SEQ ID NO: 1209194 - protein, 9 aa, Homo Sapiens
HFLQNTEGI

SEQ ID NO: 1209195 - protein, 9 aa, Homo Sapiens
PCRSSRTWA

SEQ ID NO: 1209196 - protein, 9 aa, Homo Sapiens
EETRGPDGD

SEQ ID NO: 1209197 - protein, 9 aa, Homo Sapiens
RTMSLAKKV

SEQ ID NO: 1209198 - protein, 9 aa, Homo Sapiens
PRLLINQDL

SEQ ID NO: 1209199 - protein, 9 aa, Homo Sapiens
KQEPCPAQE

SEQ ID NO: 1209200 - protein, 9 aa, Homo Sapiens
LNRWDKLDV

SEQ ID NO: 1209201 - protein, 9 aa, Homo Sapiens
MFSQGSDDE

SEQ ID NO: 1209202 - protein, 9 aa, Homo Sapiens
AARLRKKIL

SEQ ID NO: 1209203 - protein, 9 aa, Homo Sapiens
YAVTLARQD

SEQ ID NO: 1209204 - protein, 9 aa, Homo Sapiens
EVSFLPYTS

SEQ ID NO: 1209205 - protein, 9 aa, Homo Sapiens
PGPEKGPPL

SEQ ID NO: 1209206 - protein, 9 aa, Homo Sapiens
NLIGESTIH

SEQ ID NO: 1209207 - protein, 9 aa, Homo Sapiens
PKGERGEQG

SEQ ID NO: 1209208 - protein, 9 aa, Homo Sapiens
LFDSHDSMC

SEQ ID NO: 1209209 - protein, 9 aa, Homo Sapiens
WEMHHTQTK

SEQ ID NO: 1209210 - protein, 9 aa, Homo Sapiens
SGTRGPGIC

SEQ ID NO: 1209211 - protein, 9 aa, Homo Sapiens
CVVFPLELR

SEQ ID NO: 1209212 - protein, 9 aa, Homo Sapiens
SEGFPTLLT

SEQ ID NO: 1209213 - protein, 9 aa, Homo Sapiens
DAACWARGG

SEQ ID NO: 1209214 - protein, 9 aa, Homo Sapiens
ERVKAWTSQ

SEQ ID NO: 1209215 - protein, 9 aa, Homo Sapiens
RNLMVQAAE

SEQ ID NO: 1209216 - protein, 9 aa, Homo Sapiens
GMGWYQTCS

SEQ ID NO: 1209217 - protein, 9 aa, Homo Sapiens
QLTILHSTA

SEQ ID NO: 1209218 - protein, 9 aa, Homo Sapiens
IKTPQRYKE

SEQ ID NO: 1209219 - protein, 9 aa, Homo Sapiens
SHVARRFLE

SEQ ID NO: 1209220 - protein, 9 aa, Homo Sapiens
LVKRKKRRH

SEQ ID NO: 1209221 - protein, 9 aa, Homo Sapiens
GNLEDTETK

SEQ ID NO: 1209222 - protein, 9 aa, Homo Sapiens
NTAESRPPT

SEQ ID NO: 1209223 - protein, 9 aa, Homo Sapiens
MNIEGELSS

SEQ ID NO: 1209224 - protein, 9 aa, Homo Sapiens
DLRAEAGGS

SEQ ID NO: 1209225 - protein, 9 aa, Homo Sapiens
GERLIFKAF

SEQ ID NO: 1209226 - protein, 9 aa, Homo Sapiens
DARALHHGY

SEQ ID NO: 1209227 - protein, 9 aa, Homo Sapiens
VCRDRGELF

SEQ ID NO: 1209228 - protein, 9 aa, Homo Sapiens
KAKMEKFSS

SEQ ID NO: 1209229 - protein, 9 aa, Homo Sapiens
ENQVIKDKN

SEQ ID NO: 1209230 - protein, 9 aa, Homo Sapiens
RHLFNCGRS

SEQ ID NO: 1209231 - protein, 9 aa, Homo Sapiens
LYPRYPLES

SEQ ID NO: 1209232 - protein, 9 aa, Homo Sapiens
GRPMTKTWT

SEQ ID NO: 1209233 - protein, 9 aa, Homo Sapiens
LEELYMAHN

SEQ ID NO: 1209234 - protein, 9 aa, Homo Sapiens
CLRKNYKCY

SEQ ID NO: 1209235 - protein, 9 aa, Homo Sapiens
RLRLLEDAQ

SEQ ID NO: 1209236 - protein, 9 aa, Homo Sapiens
SPSWAAASP

SEQ ID NO: 1209237 - protein, 9 aa, Homo Sapiens
REQTWLDPD

SEQ ID NO: 1209238 - protein, 9 aa, Homo Sapiens
GRNQEEHLL

SEQ ID NO: 1209239 - protein, 9 aa, Homo Sapiens
GAWSFQPAS

SEQ ID NO: 1209240 - protein, 9 aa, Homo Sapiens
LRSCTVVMS

SEQ ID NO: 1209241 - protein, 9 aa, Homo Sapiens
GYLTSTSEQ

SEQ ID NO: 1209242 - protein, 9 aa, Homo Sapiens
KLCYDQCIS

SEQ ID NO: 1209243 - protein, 9 aa, Homo Sapiens
DSGCDETLF

SEQ ID NO: 1209244 - protein, 9 aa, Homo Sapiens
RVHNMELVK

SEQ ID NO: 1209245 - protein, 9 aa, Homo Sapiens
PIFVRLCYE

SEQ ID NO: 1209246 - protein, 9 aa, Homo Sapiens
LKFVTAFFK

SEQ ID NO: 1209247 - protein, 9 aa, Homo Sapiens
ESAAFQALY

SEQ ID NO: 1209248 - protein, 9 aa, Homo Sapiens
QDRHMEFLV

SEQ ID NO: 1209249 - protein, 9 aa, Homo Sapiens
DHTIGVLFN

SEQ ID NO: 1209250 - protein, 9 aa, Homo Sapiens
TLRCSAAAT

SEQ ID NO: 1209251 - protein, 9 aa, Homo Sapiens
TFGPHGHHW

SEQ ID NO: 1209252 - protein, 9 aa, Homo Sapiens
VSLAGGAWL

SEQ ID NO: 1209253 - protein, 9 aa, Homo Sapiens
LVRQYDVVA

SEQ ID NO: 1209254 - protein, 9 aa, Homo Sapiens
PLPLLKDIP

SEQ ID NO: 1209255 - protein, 9 aa, Homo Sapiens
DDEQEAGSG

SEQ ID NO: 1209256 - protein, 9 aa, Homo Sapiens
YDYKFPIEY

SEQ ID NO: 1209257 - protein, 9 aa, Homo Sapiens
GIRYEFVIF

SEQ ID NO: 1209258 - protein, 9 aa, Homo Sapiens
DGGGWIIFQ

SEQ ID NO: 1209259 - protein, 9 aa, Homo Sapiens
KKSLEDVAI

SEQ ID NO: 1209260 - protein, 9 aa, Homo Sapiens
LPLGDFEAV

SEQ ID NO: 1209261 - protein, 9 aa, Homo Sapiens
GADTGDIVN

SEQ ID NO: 1209262 - protein, 9 aa, Homo Sapiens
LSKVPTMDL

SEQ ID NO: 1209263 - protein, 9 aa, Homo Sapiens
QRIYTMKIK

SEQ ID NO: 1209264 - protein, 9 aa, Homo Sapiens
GLTMPIYCL

SEQ ID NO: 1209265 - protein, 9 aa, Homo Sapiens
PNRLETGED

SEQ ID NO: 1209266 - protein, 9 aa, Homo Sapiens
LLQHQRIHA

SEQ ID NO: 1209267 - protein, 9 aa, Homo Sapiens
ARALVRDPQ

SEQ ID NO: 1209268 - protein, 9 aa, Homo Sapiens
RGLRSCTVV

SEQ ID NO: 1209269 - protein, 9 aa, Homo Sapiens
PSMDAHSEA

SEQ ID NO: 1209270 - protein, 9 aa, Homo Sapiens
LPLLKDIPS

SEQ ID NO: 1209271 - protein, 9 aa, Homo Sapiens
LPAFIKLWI

SEQ ID NO: 1209272 - protein, 9 aa, Homo Sapiens
PEFIVCTHN

SEQ ID NO: 1209273 - protein, 9 aa, Homo Sapiens
AWNERVVNR

SEQ ID NO: 1209274 - protein, 9 aa, Homo Sapiens
NKSIFKESL

SEQ ID NO: 1209275 - protein, 9 aa, Homo Sapiens
AGKFMDDPT

SEQ ID NO: 1209276 - protein, 9 aa, Homo Sapiens
VIIPHPYIK

SEQ ID NO: 1209277 - protein, 9 aa, Homo Sapiens
VYCGYSVSE

SEQ ID NO: 1209278 - protein, 9 aa, Homo Sapiens
PYHSPSNCC

SEQ ID NO: 1209279 - protein, 9 aa, Homo Sapiens
FHRRRAQGH

SEQ ID NO: 1209280 - protein, 9 aa, Homo Sapiens
KLNMCLYCG

SEQ ID NO: 1209281 - protein, 9 aa, Homo Sapiens
HTSSSDDFS

SEQ ID NO: 1209282 - protein, 9 aa, Homo Sapiens
YMCPSSSYN

SEQ ID NO: 1209283 - protein, 9 aa, Homo Sapiens
SHLLMVGMY

SEQ ID NO: 1209284 - protein, 9 aa, Homo Sapiens
FIENSAAVQ

SEQ ID NO: 1209285 - protein, 9 aa, Homo Sapiens
LRALDLFYG

SEQ ID NO: 1209286 - protein, 9 aa, Homo Sapiens
RNPEARLNP

SEQ ID NO: 1209287 - protein, 9 aa, Homo Sapiens
NWGVQIANG

SEQ ID NO: 1209288 - protein, 9 aa, Homo Sapiens
EPAASLIVL

SEQ ID NO: 1209289 - protein, 9 aa, Homo Sapiens
CEIYGRRYH

SEQ ID NO: 1209290 - protein, 9 aa, Homo Sapiens
PTILTPKLF

SEQ ID NO: 1209291 - protein, 9 aa, Homo Sapiens
LAGQILLRD

SEQ ID NO: 1209292 - protein, 9 aa, Homo Sapiens
LGVNEAGKS

SEQ ID NO: 1209293 - protein, 9 aa, Homo Sapiens
GIVSNSLMG

SEQ ID NO: 1209294 - protein, 9 aa, Homo Sapiens
LLTADLCSV

SEQ ID NO: 1209295 - protein, 9 aa, Homo Sapiens
SECHRIKMQ

SEQ ID NO: 1209296 - protein, 9 aa, Homo Sapiens
GSRGSGCRG

SEQ ID NO: 1209297 - protein, 9 aa, Homo Sapiens
MQAMIRSMD

SEQ ID NO: 1209298 - protein, 9 aa, Homo Sapiens
SSQQQATVM

SEQ ID NO: 1209299 - protein, 9 aa, Homo Sapiens
YIQGMSDLL

SEQ ID NO: 1209300 - protein, 9 aa, Homo Sapiens
AAPLIDAPH

SEQ ID NO: 1209301 - protein, 9 aa, Homo Sapiens
SSNQYTFCQ

SEQ ID NO: 1209302 - protein, 9 aa, Homo Sapiens
TGMVECLRN

SEQ ID NO: 1209303 - protein, 9 aa, Homo Sapiens
EPLVGTSEF

SEQ ID NO: 1209304 - protein, 9 aa, Homo Sapiens
STGTFSDPC

SEQ ID NO: 1209305 - protein, 9 aa, Homo Sapiens
KSLQHDNIA

SEQ ID NO: 1209306 - protein, 9 aa, Homo Sapiens
RLTILRNVL

SEQ ID NO: 1209307 - protein, 9 aa, Homo Sapiens
DLIISSAIQ

SEQ ID NO: 1209308 - protein, 9 aa, Homo Sapiens
TKSPLYVPR

SEQ ID NO: 1209309 - protein, 9 aa, Homo Sapiens
LCVMSERQV

SEQ ID NO: 1209310 - protein, 9 aa, Homo Sapiens
NRTVGPRHV

SEQ ID NO: 1209311 - protein, 9 aa, Homo Sapiens
NICRVDFSF

SEQ ID NO: 1209312 - protein, 9 aa, Homo Sapiens
RHAQVAEKL

SEQ ID NO: 1209313 - protein, 9 aa, Homo Sapiens
QRIEVLYTS

SEQ ID NO: 1209314 - protein, 9 aa, Homo Sapiens
IIRRGLFYV

SEQ ID NO: 1209315 - protein, 9 aa, Homo Sapiens
LNVKRSQGS

SEQ ID NO: 1209316 - protein, 9 aa, Homo Sapiens
AIQEPMLNA

SEQ ID NO: 1209317 - protein, 9 aa, Homo Sapiens
SFSLRSYLP

SEQ ID NO: 1209318 - protein, 9 aa, Homo Sapiens
VGAVSTYDG

SEQ ID NO: 1209319 - protein, 9 aa, Homo Sapiens
RTMIENFNA

SEQ ID NO: 1209320 - protein, 9 aa, Homo Sapiens
PASLPRCAP

SEQ ID NO: 1209321 - protein, 9 aa, Homo Sapiens
GMNISLTIS

SEQ ID NO: 1209322 - protein, 9 aa, Homo Sapiens
NILSEIGKE

SEQ ID NO: 1209323 - protein, 9 aa, Homo Sapiens
DLHNTTASM

SEQ ID NO: 1209324 - protein, 9 aa, Homo Sapiens
SDSELLWDI

SEQ ID NO: 1209325 - protein, 9 aa, Homo Sapiens
QYMKYMYPY

SEQ ID NO: 1209326 - protein, 9 aa, Homo Sapiens
QSNLRSIYT

SEQ ID NO: 1209327 - protein, 9 aa, Homo Sapiens
LLTWVRDHH

SEQ ID NO: 1209328 - protein, 9 aa, Homo Sapiens
LNRDQVQKV

SEQ ID NO: 1209329 - protein, 9 aa, Homo Sapiens
FEASNWHGF

SEQ ID NO: 1209330 - protein, 9 aa, Homo Sapiens
EVKKRSRKK

SEQ ID NO: 1209331 - protein, 9 aa, Homo Sapiens
MSEVTGYAS

SEQ ID NO: 1209332 - protein, 9 aa, Homo Sapiens
QLEEVKQAS

SEQ ID NO: 1209333 - protein, 9 aa, Homo Sapiens
LSNTASMSG

SEQ ID NO: 1209334 - protein, 9 aa, Homo Sapiens
MKWCGYALA

SEQ ID NO: 1209335 - protein, 9 aa, Homo Sapiens
YPHLEQVQD

SEQ ID NO: 1209336 - protein, 9 aa, Homo Sapiens
KAVQHQANQ

SEQ ID NO: 1209337 - protein, 9 aa, Homo Sapiens
GCSKGGCGS

SEQ ID NO: 1209338 - protein, 9 aa, Homo Sapiens
PVQDISLPL

SEQ ID NO: 1209339 - protein, 9 aa, Homo Sapiens
NDVVKIPEE

SEQ ID NO: 1209340 - protein, 9 aa, Homo Sapiens
PLTAQQLEM

SEQ ID NO: 1209341 - protein, 9 aa, Homo Sapiens
AKRRDVLYM

SEQ ID NO: 1209342 - protein, 9 aa, Homo Sapiens
VTNSLKDGI

SEQ ID NO: 1209343 - protein, 9 aa, Homo Sapiens
KIQPLNFSS

SEQ ID NO: 1209344 - protein, 9 aa, Homo Sapiens
KIVTMDSLE

SEQ ID NO: 1209345 - protein, 9 aa, Homo Sapiens
EVVPDQTDD

SEQ ID NO: 1209346 - protein, 9 aa, Homo Sapiens
EEEERKEDK

SEQ ID NO: 1209347 - protein, 9 aa, Homo Sapiens
REEIVVWTN

SEQ ID NO: 1209348 - protein, 9 aa, Homo Sapiens
DALNNFLTH

SEQ ID NO: 1209349 - protein, 9 aa, Homo Sapiens
HRGFCATLS

SEQ ID NO: 1209350 - protein, 9 aa, Homo Sapiens
EQITMLNGH

SEQ ID NO: 1209351 - protein, 9 aa, Homo Sapiens
IFKDMFREV

SEQ ID NO: 1209352 - protein, 9 aa, Homo Sapiens
QGEILVICR

SEQ ID NO: 1209353 - protein, 9 aa, Homo Sapiens
EVDSDTIIF

SEQ ID NO: 1209354 - protein, 9 aa, Homo Sapiens
QDRDITLLD

SEQ ID NO: 1209355 - protein, 9 aa, Homo Sapiens
HISNKPKSS

SEQ ID NO: 1209356 - protein, 9 aa, Homo Sapiens
HCQKIACIL

SEQ ID NO: 1209357 - protein, 9 aa, Homo Sapiens
TDEDAGTYW

SEQ ID NO: 1209358 - protein, 9 aa, Homo Sapiens
VYNTGPGTL

SEQ ID NO: 1209359 - protein, 9 aa, Homo Sapiens
KHFVYQKVK

SEQ ID NO: 1209360 - protein, 9 aa, Homo Sapiens
EKCIQEIIE

SEQ ID NO: 1209361 - protein, 9 aa, Homo Sapiens
FTEVTIFIL

SEQ ID NO: 1209362 - protein, 9 aa, Homo Sapiens
VEKPVPRPG

SEQ ID NO: 1209363 - protein, 9 aa, Homo Sapiens
CVVLEARAP

SEQ ID NO: 1209364 - protein, 9 aa, Homo Sapiens
GNLLKVIPV

SEQ ID NO: 1209365 - protein, 9 aa, Homo Sapiens
SLGNGLTPD

SEQ ID NO: 1209366 - protein, 9 aa, Homo Sapiens
LRFLETTHQ

SEQ ID NO: 1209367 - protein, 9 aa, Homo Sapiens
VGQEDGLGD

SEQ ID NO: 1209368 - protein, 9 aa, Homo Sapiens
PDVVPAFHS

SEQ ID NO: 1209369 - protein, 9 aa, Homo Sapiens
AGSEVISWG

SEQ ID NO: 1209370 - protein, 9 aa, Homo Sapiens
HVNGVTVHE

SEQ ID NO: 1209371 - protein, 9 aa, Homo Sapiens
LVNQSKATP

SEQ ID NO: 1209372 - protein, 9 aa, Homo Sapiens
NADKFSGLL

SEQ ID NO: 1209373 - protein, 9 aa, Homo Sapiens
TPPRNLDSQ

SEQ ID NO: 1209374 - protein, 9 aa, Homo Sapiens
CELVMAPGF

SEQ ID NO: 1209375 - protein, 9 aa, Homo Sapiens
VMASTCVNP

SEQ ID NO: 1209376 - protein, 9 aa, Homo Sapiens
VMEELEDSV

SEQ ID NO: 1209377 - protein, 9 aa, Homo Sapiens
SHHGSRGAA

SEQ ID NO: 1209378 - protein, 9 aa, Homo Sapiens
RFLSSHLAL

SEQ ID NO: 1209379 - protein, 9 aa, Homo Sapiens
VSGHQKNTT

SEQ ID NO: 1209380 - protein, 9 aa, Homo Sapiens
EMMGHIKPI

SEQ ID NO: 1209381 - protein, 9 aa, Homo Sapiens
SYVCEHEGC

SEQ ID NO: 1209382 - protein, 9 aa, Homo Sapiens
RDRIVTGNF

SEQ ID NO: 1209383 - protein, 9 aa, Homo Sapiens
SIVGSKVMG

SEQ ID NO: 1209384 - protein, 9 aa, Homo Sapiens
LANNKIMTI

SEQ ID NO: 1209385 - protein, 9 aa, Homo Sapiens
CVLEAHGLK

SEQ ID NO: 1209386 - protein, 9 aa, Homo Sapiens
HQQMMHWLK

SEQ ID NO: 1209387 - protein, 9 aa, Homo Sapiens
AIYPHYPPK

SEQ ID NO: 1209388 - protein, 9 aa, Homo Sapiens
TNRHVWELS

SEQ ID NO: 1209389 - protein, 9 aa, Homo Sapiens
GPVLKISFH

SEQ ID NO: 1209390 - protein, 9 aa, Homo Sapiens
FQARLSHLH

SEQ ID NO: 1209391 - protein, 9 aa, Homo Sapiens
PLSYRLGIW

SEQ ID NO: 1209392 - protein, 9 aa, Homo Sapiens
PVSSGHLEE

SEQ ID NO: 1209393 - protein, 9 aa, Homo Sapiens
DDCSQLMAC

SEQ ID NO: 1209394 - protein, 9 aa, Homo Sapiens
VVPDQTDDI

SEQ ID NO: 1209395 - protein, 9 aa, Homo Sapiens
FLLAGPDMV

SEQ ID NO: 1209396 - protein, 9 aa, Homo Sapiens
GDRDVTYSC

SEQ ID NO: 1209397 - protein, 9 aa, Homo Sapiens
SRDTLPASL

SEQ ID NO: 1209398 - protein, 9 aa, Homo Sapiens
EISRILNNG

SEQ ID NO: 1209399 - protein, 9 aa, Homo Sapiens
GKKRQEVPP

SEQ ID NO: 1209400 - protein, 9 aa, Homo Sapiens
MATYFAPNF

SEQ ID NO: 1209401 - protein, 9 aa, Homo Sapiens
LTLPQLSLT

SEQ ID NO: 1209402 - protein, 9 aa, Homo Sapiens
SNTVSGLWD

SEQ ID NO: 1209403 - protein, 9 aa, Homo Sapiens
TLLVLGSVK

SEQ ID NO: 1209404 - protein, 9 aa, Homo Sapiens
ASDTTIKLN

SEQ ID NO: 1209405 - protein, 9 aa, Homo Sapiens
SCTPYELRM

SEQ ID NO: 1209406 - protein, 9 aa, Homo Sapiens
PWMLVWSQM

SEQ ID NO: 1209407 - protein, 9 aa, Homo Sapiens
NGMPYSAPN

SEQ ID NO: 1209408 - protein, 9 aa, Homo Sapiens
PSKASKPSK

SEQ ID NO: 1209409 - protein, 9 aa, Homo Sapiens
TAQPTKVRR

SEQ ID NO: 1209410 - protein, 9 aa, Homo Sapiens
GQASLVRDL

SEQ ID NO: 1209411 - protein, 9 aa, Homo Sapiens
GYEVWLGTM

SEQ ID NO: 1209412 - protein, 9 aa, Homo Sapiens
GLDNGGKTT

SEQ ID NO: 1209413 - protein, 9 aa, Homo Sapiens
LVLCGRNGV

SEQ ID NO: 1209414 - protein, 9 aa, Homo Sapiens
AVETYSVRP

SEQ ID NO: 1209415 - protein, 9 aa, Homo Sapiens
CDKIFDRIG

SEQ ID NO: 1209416 - protein, 9 aa, Homo Sapiens
QAIMCWASD

SEQ ID NO: 1209417 - protein, 9 aa, Homo Sapiens
EHLSLAVGI

SEQ ID NO: 1209418 - protein, 9 aa, Homo Sapiens
KWAQEPSLV

SEQ ID NO: 1209419 - protein, 9 aa, Homo Sapiens
KGKRGSDYD

SEQ ID NO: 1209420 - protein, 9 aa, Homo Sapiens
MWWAFENPH

SEQ ID NO: 1209421 - protein, 9 aa, Homo Sapiens
IYKYDRMEK

SEQ ID NO: 1209422 - protein, 9 aa, Homo Sapiens
HNQRAGAPC

SEQ ID NO: 1209423 - protein, 9 aa, Homo Sapiens
EMAEMCKQS

SEQ ID NO: 1209424 - protein, 9 aa, Homo Sapiens
DASNGYRTL

SEQ ID NO: 1209425 - protein, 9 aa, Homo Sapiens
IVSLCLVVA

SEQ ID NO: 1209426 - protein, 9 aa, Homo Sapiens
SAPPQGCTW

SEQ ID NO: 1209427 - protein, 9 aa, Homo Sapiens
KQTCFSVLS

SEQ ID NO: 1209428 - protein, 9 aa, Homo Sapiens
DVYDGREHS

SEQ ID NO: 1209429 - protein, 9 aa, Homo Sapiens
QGSHDFSFT

SEQ ID NO: 1209430 - protein, 9 aa, Homo Sapiens
THGRGMVVV

SEQ ID NO: 1209431 - protein, 9 aa, Homo Sapiens
EKSRVNEIL

SEQ ID NO: 1209432 - protein, 9 aa, Homo Sapiens
GLALIHAHW

SEQ ID NO: 1209433 - protein, 9 aa, Homo Sapiens
RLCILPGTE

SEQ ID NO: 1209434 - protein, 9 aa, Homo Sapiens
KTYLDVGSM

SEQ ID NO: 1209435 - protein, 9 aa, Homo Sapiens
VITSNMPIS

SEQ ID NO: 1209436 - protein, 9 aa, Homo Sapiens
RKALKALLR

SEQ ID NO: 1209437 - protein, 9 aa, Homo Sapiens
GGNLYVLKL

SEQ ID NO: 1209438 - protein, 9 aa, Homo Sapiens
YIFRGQINT

SEQ ID NO: 1209439 - protein, 9 aa, Homo Sapiens
QKAARRQWE

SEQ ID NO: 1209440 - protein, 9 aa, Homo Sapiens
LLSTLTRKI

SEQ ID NO: 1209441 - protein, 9 aa, Homo Sapiens
LARSSVRQL

SEQ ID NO: 1209442 - protein, 9 aa, Homo Sapiens
APWEENDPQ

SEQ ID NO: 1209443 - protein, 9 aa, Homo Sapiens
RIIFPLFMK

SEQ ID NO: 1209444 - protein, 9 aa, Homo Sapiens
FICIILTAL

SEQ ID NO: 1209445 - protein, 9 aa, Homo Sapiens
YASKSETHQ

SEQ ID NO: 1209446 - protein, 9 aa, Homo Sapiens
ALGSYTSFH

SEQ ID NO: 1209447 - protein, 9 aa, Homo Sapiens
QDGEVVCEA

SEQ ID NO: 1209448 - protein, 9 aa, Homo Sapiens
APLLFNGCH

SEQ ID NO: 1209449 - protein, 9 aa, Homo Sapiens
AVLGMDMGL

SEQ ID NO: 1209450 - protein, 9 aa, Homo Sapiens
LRSHTGEKS

SEQ ID NO: 1209451 - protein, 9 aa, Homo Sapiens
DDDVFLCGK

SEQ ID NO: 1209452 - protein, 9 aa, Homo Sapiens
WCPCSSCCS

SEQ ID NO: 1209453 - protein, 9 aa, Homo Sapiens
KRYCFGEDL

SEQ ID NO: 1209454 - protein, 9 aa, Homo Sapiens
FMQVGCELK

SEQ ID NO: 1209455 - protein, 9 aa, Homo Sapiens
PLQFLPQGS

SEQ ID NO: 1209456 - protein, 9 aa, Homo Sapiens
DLLTLNGSN

SEQ ID NO: 1209457 - protein, 9 aa, Homo Sapiens
AQDKDRDDH

SEQ ID NO: 1209458 - protein, 9 aa, Homo Sapiens
MEGMLHHFQ

SEQ ID NO: 1209459 - protein, 9 aa, Homo Sapiens
AMPPHIGDQ

SEQ ID NO: 1209460 - protein, 9 aa, Homo Sapiens
NGGNCVEKH

SEQ ID NO: 1209461 - protein, 9 aa, Homo Sapiens
MLHNFPKVS

SEQ ID NO: 1209462 - protein, 9 aa, Homo Sapiens
RRDSAIRKH

SEQ ID NO: 1209463 - protein, 9 aa, Homo Sapiens
GNSNTALHY

SEQ ID NO: 1209464 - protein, 9 aa, Homo Sapiens
SQPLPSQSS

SEQ ID NO: 1209465 - protein, 9 aa, Homo Sapiens
ALFAMETFA

SEQ ID NO: 1209466 - protein, 9 aa, Homo Sapiens
KLFKDLGMP

SEQ ID NO: 1209467 - protein, 9 aa, Homo Sapiens
LGVIAGIVD

SEQ ID NO: 1209468 - protein, 9 aa, Homo Sapiens
LEQASHSAG

SEQ ID NO: 1209469 - protein, 9 aa, Homo Sapiens
KLYQAYTPN

SEQ ID NO: 1209470 - protein, 9 aa, Homo Sapiens
SYDSKKQQE

SEQ ID NO: 1209471 - protein, 9 aa, Homo Sapiens
LRIVHVRKS

SEQ ID NO: 1209472 - protein, 9 aa, Homo Sapiens
NDGYDKYTT

SEQ ID NO: 1209473 - protein, 9 aa, Homo Sapiens
LSVMVSMVT

SEQ ID NO: 1209474 - protein, 9 aa, Homo Sapiens
KIKPPLAPG

SEQ ID NO: 1209475 - protein, 9 aa, Homo Sapiens
ITVPGRHVE

SEQ ID NO: 1209476 - protein, 9 aa, Homo Sapiens
LNMCLYCGT

SEQ ID NO: 1209477 - protein, 9 aa, Homo Sapiens
DIVQNGRLI

SEQ ID NO: 1209478 - protein, 9 aa, Homo Sapiens
NRISSLVKD

SEQ ID NO: 1209479 - protein, 9 aa, Homo Sapiens
ALPPVPGSA

SEQ ID NO: 1209480 - protein, 9 aa, Homo Sapiens
SVVDFVQFE

SEQ ID NO: 1209481 - protein, 9 aa, Homo Sapiens
SSLPKTDCG

SEQ ID NO: 1209482 - protein, 9 aa, Homo Sapiens
CTCLPSKPL

SEQ ID NO: 1209483 - protein, 9 aa, Homo Sapiens
PVSLAAAWD

SEQ ID NO: 1209484 - protein, 9 aa, Homo Sapiens
PTHPFEEGK

SEQ ID NO: 1209485 - protein, 9 aa, Homo Sapiens
APAAEVSGR

SEQ ID NO: 1209486 - protein, 9 aa, Homo Sapiens
HNEEYDEEP

SEQ ID NO: 1209487 - protein, 9 aa, Homo Sapiens
DQVYSVRMR

SEQ ID NO: 1209488 - protein, 9 aa, Homo Sapiens
VHGGEMFSH

SEQ ID NO: 1209489 - protein, 9 aa, Homo Sapiens
KVWLAAVRC

SEQ ID NO: 1209490 - protein, 9 aa, Homo Sapiens
GTLARTVTV

SEQ ID NO: 1209491 - protein, 9 aa, Homo Sapiens
GLDENYTLI

SEQ ID NO: 1209492 - protein, 9 aa, Homo Sapiens
ISSLVKDTR

SEQ ID NO: 1209493 - protein, 9 aa, Homo Sapiens
MCLHRGERP

SEQ ID NO: 1209494 - protein, 9 aa, Homo Sapiens
SLVQKLHPP

SEQ ID NO: 1209495 - protein, 9 aa, Homo Sapiens
VPGSFAFGV

SEQ ID NO: 1209496 - protein, 9 aa, Homo Sapiens
QAKIKAVQH

SEQ ID NO: 1209497 - protein, 9 aa, Homo Sapiens
RCNTQGTWE

SEQ ID NO: 1209498 - protein, 9 aa, Homo Sapiens
QNVQPDEPN

SEQ ID NO: 1209499 - protein, 9 aa, Homo Sapiens
IHISINKAV

SEQ ID NO: 1209500 - protein, 9 aa, Homo Sapiens
WSETNQHIW

SEQ ID NO: 1209501 - protein, 9 aa, Homo Sapiens
PVLPAGPPH

SEQ ID NO: 1209502 - protein, 9 aa, Homo Sapiens
QLKQGFEFW

SEQ ID NO: 1209503 - protein, 9 aa, Homo Sapiens
KEDRAMSQD

SEQ ID NO: 1209504 - protein, 9 aa, Homo Sapiens
NQTMITEFL

SEQ ID NO: 1209505 - protein, 9 aa, Homo Sapiens
QKCKPDIML

SEQ ID NO: 1209506 - protein, 9 aa, Homo Sapiens
KVTLLDFGA

SEQ ID NO: 1209507 - protein, 9 aa, Homo Sapiens
TSLTLTVPG

SEQ ID NO: 1209508 - protein, 9 aa, Homo Sapiens
SPVRLLKVG

SEQ ID NO: 1209509 - protein, 9 aa, Homo Sapiens
PDIQGSGKT

SEQ ID NO: 1209510 - protein, 9 aa, Homo Sapiens
RVQTQLCLR

SEQ ID NO: 1209511 - protein, 9 aa, Homo Sapiens
GTRCYRLCN

SEQ ID NO: 1209512 - protein, 9 aa, Homo Sapiens
HISHQDFAN

SEQ ID NO: 1209513 - protein, 9 aa, Homo Sapiens
TLGSVHTEF

SEQ ID NO: 1209514 - protein, 9 aa, Homo Sapiens
NMASRMEST

SEQ ID NO: 1209515 - protein, 9 aa, Homo Sapiens
LVWIPSECH

SEQ ID NO: 1209516 - protein, 9 aa, Homo Sapiens
EGVQTFLLQ

SEQ ID NO: 1209517 - protein, 9 aa, Homo Sapiens
QRRAGNVVS

SEQ ID NO: 1209518 - protein, 9 aa, Homo Sapiens
AAVWVVVSY

SEQ ID NO: 1209519 - protein, 9 aa, Homo Sapiens
DTDGCRLSG

SEQ ID NO: 1209520 - protein, 9 aa, Homo Sapiens
EVSRKPRNL

SEQ ID NO: 1209521 - protein, 9 aa, Homo Sapiens
GTEEMDIEM

SEQ ID NO: 1209522 - protein, 9 aa, Homo Sapiens
MATVLNVYA

SEQ ID NO: 1209523 - protein, 9 aa, Homo Sapiens
LEAVFIHGM

SEQ ID NO: 1209524 - protein, 9 aa, Homo Sapiens
WEETMSRFC

SEQ ID NO: 1209525 - protein, 9 aa, Homo Sapiens
SHLFLYNKI

SEQ ID NO: 1209526 - protein, 9 aa, Homo Sapiens
QEWILETDS

SEQ ID NO: 1209527 - protein, 9 aa, Homo Sapiens
DVAHVVSEN

SEQ ID NO: 1209528 - protein, 9 aa, Homo Sapiens
VTGSQNEGH

SEQ ID NO: 1209529 - protein, 9 aa, Homo Sapiens
GIGVLNKNR

SEQ ID NO: 1209530 - protein, 9 aa, Homo Sapiens
EIMKWCGYA

SEQ ID NO: 1209531 - protein, 9 aa, Homo Sapiens
EVKAVMSKL

SEQ ID NO: 1209532 - protein, 9 aa, Homo Sapiens
SGVLHKMDS

SEQ ID NO: 1209533 - protein, 9 aa, Homo Sapiens
DFMICISLV

SEQ ID NO: 1209534 - protein, 9 aa, Homo Sapiens
QDTEETVTY

SEQ ID NO: 1209535 - protein, 9 aa, Homo Sapiens
KEMLKEIKP

SEQ ID NO: 1209536 - protein, 9 aa, Homo Sapiens
LQYDLDSPM

SEQ ID NO: 1209537 - protein, 9 aa, Homo Sapiens
CRLLENRED

SEQ ID NO: 1209538 - protein, 9 aa, Homo Sapiens
IPSCRQQWT

SEQ ID NO: 1209539 - protein, 9 aa, Homo Sapiens
EAAPLTLKS

SEQ ID NO: 1209540 - protein, 9 aa, Homo Sapiens
VMEYVHGGE

SEQ ID NO: 1209541 - protein, 9 aa, Homo Sapiens
LEVLRCIAS

SEQ ID NO: 1209542 - protein, 9 aa, Homo Sapiens
LFHPRASNH

SEQ ID NO: 1209543 - protein, 9 aa, Homo Sapiens
KERACFEQA

SEQ ID NO: 1209544 - protein, 9 aa, Homo Sapiens
MFNTILTTR

SEQ ID NO: 1209545 - protein, 9 aa, Homo Sapiens
ENNSYPHFL

SEQ ID NO: 1209546 - protein, 9 aa, Homo Sapiens
LCLSRIQNR

SEQ ID NO: 1209547 - protein, 9 aa, Homo Sapiens
QLLLLGGCL

SEQ ID NO: 1209548 - protein, 9 aa, Homo Sapiens
RWSSHAMES

SEQ ID NO: 1209549 - protein, 9 aa, Homo Sapiens
AVAGSVPLS

SEQ ID NO: 1209550 - protein, 9 aa, Homo Sapiens
IGFTLAPSL

SEQ ID NO: 1209551 - protein, 9 aa, Homo Sapiens
GTASRRVLV

SEQ ID NO: 1209552 - protein, 9 aa, Homo Sapiens
NGPSSAAVL

SEQ ID NO: 1209553 - protein, 9 aa, Homo Sapiens
RRMMDILEI

SEQ ID NO: 1209554 - protein, 9 aa, Homo Sapiens
INTVKREDA

SEQ ID NO: 1209555 - protein, 9 aa, Homo Sapiens
TWKFMDMMQ

SEQ ID NO: 1209556 - protein, 9 aa, Homo Sapiens
VTMALQRQR

SEQ ID NO: 1209557 - protein, 9 aa, Homo Sapiens
MVLEEEEGE

SEQ ID NO: 1209558 - protein, 9 aa, Homo Sapiens
SMSKYDLLA

SEQ ID NO: 1209559 - protein, 9 aa, Homo Sapiens
KDFIIQTGD

SEQ ID NO: 1209560 - protein, 9 aa, Homo Sapiens
LTTHLLVSQ

SEQ ID NO: 1209561 - protein, 9 aa, Homo Sapiens
HFCDDILSS

SEQ ID NO: 1209562 - protein, 9 aa, Homo Sapiens
KCHTAFQNQ

SEQ ID NO: 1209563 - protein, 9 aa, Homo Sapiens
EMEDEEEEE

SEQ ID NO: 1209564 - protein, 9 aa, Homo Sapiens
NCCYLWDVQ

SEQ ID NO: 1209565 - protein, 9 aa, Homo Sapiens
LQGSHVSKM

SEQ ID NO: 1209566 - protein, 9 aa, Homo Sapiens
KSIEEREDE

SEQ ID NO: 1209567 - protein, 9 aa, Homo Sapiens
FRSIIDDTW

SEQ ID NO: 1209568 - protein, 9 aa, Homo Sapiens
IALGSYTSF

SEQ ID NO: 1209569 - protein, 9 aa, Homo Sapiens
LTRGGPSLT

SEQ ID NO: 1209570 - protein, 9 aa, Homo Sapiens
PFDRDKYLK

SEQ ID NO: 1209571 - protein, 9 aa, Homo Sapiens
CLVNWSCTL

SEQ ID NO: 1209572 - protein, 9 aa, Homo Sapiens
DAVYRVFKR

SEQ ID NO: 1209573 - protein, 9 aa, Homo Sapiens
VKCNTNDTI

SEQ ID NO: 1209574 - protein, 9 aa, Homo Sapiens
QVPKCDVTQ

SEQ ID NO: 1209575 - protein, 9 aa, Homo Sapiens
LSELQQHRF

SEQ ID NO: 1209576 - protein, 9 aa, Homo Sapiens
TIENNFTKL

SEQ ID NO: 1209577 - protein, 9 aa, Homo Sapiens
LYKAEGVNI

SEQ ID NO: 1209578 - protein, 9 aa, Homo Sapiens
SAEAQAQHL

SEQ ID NO: 1209579 - protein, 9 aa, Homo Sapiens
IAAVGKPDF

SEQ ID NO: 1209580 - protein, 9 aa, Homo Sapiens
CGKCGKRFS

SEQ ID NO: 1209581 - protein, 9 aa, Homo Sapiens
EPPKEEQKM

SEQ ID NO: 1209582 - protein, 9 aa, Homo Sapiens
LAPKLLQCS

SEQ ID NO: 1209583 - protein, 9 aa, Homo Sapiens
PVCFLPGTL

SEQ ID NO: 1209584 - protein, 9 aa, Homo Sapiens
SENIVCLIR

SEQ ID NO: 1209585 - protein, 9 aa, Homo Sapiens
ASLRRKESS

SEQ ID NO: 1209586 - protein, 9 aa, Homo Sapiens
LPTAECLTV

SEQ ID NO: 1209587 - protein, 9 aa, Homo Sapiens
APLQLPLRG

SEQ ID NO: 1209588 - protein, 9 aa, Homo Sapiens
MNKNSSRSY

SEQ ID NO: 1209589 - protein, 9 aa, Homo Sapiens
CSMVCDPHG

SEQ ID NO: 1209590 - protein, 9 aa, Homo Sapiens
LDETQITTI

SEQ ID NO: 1209591 - protein, 9 aa, Homo Sapiens
CGKAFSAKQ

SEQ ID NO: 1209592 - protein, 9 aa, Homo Sapiens
TYRYEWGSR

SEQ ID NO: 1209593 - protein, 9 aa, Homo Sapiens
PVHYPGPAG

SEQ ID NO: 1209594 - protein, 9 aa, Homo Sapiens
KSHGKDKEC

SEQ ID NO: 1209595 - protein, 9 aa, Homo Sapiens
ILKLYPCME

SEQ ID NO: 1209596 - protein, 9 aa, Homo Sapiens
PRLPLAHLH

SEQ ID NO: 1209597 - protein, 9 aa, Homo Sapiens
GVLPSPGPV

SEQ ID NO: 1209598 - protein, 9 aa, Homo Sapiens
VIVVYTDRE

SEQ ID NO: 1209599 - protein, 9 aa, Homo Sapiens
WLPVSDDTC

SEQ ID NO: 1209600 - protein, 9 aa, Homo Sapiens
GVCTNRLDK

SEQ ID NO: 1209601 - protein, 9 aa, Homo Sapiens
TFSFECSSN

SEQ ID NO: 1209602 - protein, 9 aa, Homo Sapiens
ILDFYNPLV

SEQ ID NO: 1209603 - protein, 9 aa, Homo Sapiens
GWLLSWASA

SEQ ID NO: 1209604 - protein, 9 aa, Homo Sapiens
YGLAYRYYP

SEQ ID NO: 1209605 - protein, 9 aa, Homo Sapiens
AEETFEFVV

SEQ ID NO: 1209606 - protein, 9 aa, Homo Sapiens
LLVGIIIQL

SEQ ID NO: 1209607 - protein, 9 aa, Homo Sapiens
ASVSFHHLA

SEQ ID NO: 1209608 - protein, 9 aa, Homo Sapiens
PRLNTSAEA

SEQ ID NO: 1209609 - protein, 9 aa, Homo Sapiens
TSAPPQGCT

SEQ ID NO: 1209610 - protein, 9 aa, Homo Sapiens
SECHGFEAA

SEQ ID NO: 1209611 - protein, 9 aa, Homo Sapiens
QEHVVVRPY

SEQ ID NO: 1209612 - protein, 9 aa, Homo Sapiens
SPEYASLVR

SEQ ID NO: 1209613 - protein, 9 aa, Homo Sapiens
CWVRQAAFQ

SEQ ID NO: 1209614 - protein, 9 aa, Homo Sapiens
KALWENMGQ

SEQ ID NO: 1209615 - protein, 9 aa, Homo Sapiens
CTSTMPPRE

SEQ ID NO: 1209616 - protein, 9 aa, Homo Sapiens
ATGQRPSAR

SEQ ID NO: 1209617 - protein, 9 aa, Homo Sapiens
SDPIPGDKP

SEQ ID NO: 1209618 - protein, 9 aa, Homo Sapiens
LYRLCPHPS

SEQ ID NO: 1209619 - protein, 9 aa, Homo Sapiens
LTIIKWKGE

SEQ ID NO: 1209620 - protein, 9 aa, Homo Sapiens
MFYDEARNL

SEQ ID NO: 1209621 - protein, 9 aa, Homo Sapiens
EPAQEAPLW

SEQ ID NO: 1209622 - protein, 9 aa, Homo Sapiens
VPPTRSQTN

SEQ ID NO: 1209623 - protein, 9 aa, Homo Sapiens
LVSGEVMHG

SEQ ID NO: 1209624 - protein, 9 aa, Homo Sapiens
KQTPKEGVR

SEQ ID NO: 1209625 - protein, 9 aa, Homo Sapiens
ILDKFGGEH

SEQ ID NO: 1209626 - protein, 9 aa, Homo Sapiens
DLTNHKRIY

SEQ ID NO: 1209627 - protein, 9 aa, Homo Sapiens
FLGFLLLLL

SEQ ID NO: 1209628 - protein, 9 aa, Homo Sapiens
GGSCLSTST

SEQ ID NO: 1209629 - protein, 9 aa, Homo Sapiens
YFQAKREKV

SEQ ID NO: 1209630 - protein, 9 aa, Homo Sapiens
NVLLDLLRS

SEQ ID NO: 1209631 - protein, 9 aa, Homo Sapiens
QMGAFVEIS

SEQ ID NO: 1209632 - protein, 9 aa, Homo Sapiens
IRNIVCSGK

SEQ ID NO: 1209633 - protein, 9 aa, Homo Sapiens
GRIHKCDRV

SEQ ID NO: 1209634 - protein, 9 aa, Homo Sapiens
AGWLLSWAS

SEQ ID NO: 1209635 - protein, 9 aa, Homo Sapiens
SSHDIQPLS

SEQ ID NO: 1209636 - protein, 9 aa, Homo Sapiens
SSNVRTHEM

SEQ ID NO: 1209637 - protein, 9 aa, Homo Sapiens
TRTAHFGSA

SEQ ID NO: 1209638 - protein, 9 aa, Homo Sapiens
NFSAPDPPM

SEQ ID NO: 1209639 - protein, 9 aa, Homo Sapiens
SVTMIGVIL

SEQ ID NO: 1209640 - protein, 9 aa, Homo Sapiens
ITTILREIL

SEQ ID NO: 1209641 - protein, 9 aa, Homo Sapiens
HTLDEIYSW

SEQ ID NO: 1209642 - protein, 9 aa, Homo Sapiens
AWRHVADMN

SEQ ID NO: 1209643 - protein, 9 aa, Homo Sapiens
KKWVLRKAL

SEQ ID NO: 1209644 - protein, 9 aa, Homo Sapiens
VHMSFGVVL

SEQ ID NO: 1209645 - protein, 9 aa, Homo Sapiens
NSIAAVVLQ

SEQ ID NO: 1209646 - protein, 9 aa, Homo Sapiens
HVEIFILAV

SEQ ID NO: 1209647 - protein, 9 aa, Homo Sapiens
RVYIARSQI

SEQ ID NO: 1209648 - protein, 9 aa, Homo Sapiens
VGIFGNNLV

SEQ ID NO: 1209649 - protein, 9 aa, Homo Sapiens
TGAHDQATM

SEQ ID NO: 1209650 - protein, 9 aa, Homo Sapiens
GGDPPRLCT

SEQ ID NO: 1209651 - protein, 9 aa, Homo Sapiens
FYVGLLFFY

SEQ ID NO: 1209652 - protein, 9 aa, Homo Sapiens
DGRQHSYSS

SEQ ID NO: 1209653 - protein, 9 aa, Homo Sapiens
YTVCLFLVQ

SEQ ID NO: 1209654 - protein, 9 aa, Homo Sapiens
LMKLGTVEW

SEQ ID NO: 1209655 - protein, 9 aa, Homo Sapiens
TLLFSCNSP

SEQ ID NO: 1209656 - protein, 9 aa, Homo Sapiens
NTPLASRET

SEQ ID NO: 1209657 - protein, 9 aa, Homo Sapiens
EAHTPSVRK

SEQ ID NO: 1209658 - protein, 9 aa, Homo Sapiens
TKPIQDVQW

SEQ ID NO: 1209659 - protein, 9 aa, Homo Sapiens
AGSPLTSGI

SEQ ID NO: 1209660 - protein, 9 aa, Homo Sapiens
EPGKPFMSV

SEQ ID NO: 1209661 - protein, 9 aa, Homo Sapiens
LNVPKDSVI

SEQ ID NO: 1209662 - protein, 9 aa, Homo Sapiens
ARMFKLLEQ

SEQ ID NO: 1209663 - protein, 9 aa, Homo Sapiens
PYQCGKCGK

SEQ ID NO: 1209664 - protein, 9 aa, Homo Sapiens
LTTAWVLSA

SEQ ID NO: 1209665 - protein, 9 aa, Homo Sapiens
VTQQPMKSP

SEQ ID NO: 1209666 - protein, 9 aa, Homo Sapiens
EVTSMSEIT

SEQ ID NO: 1209667 - protein, 9 aa, Homo Sapiens
HEGVQTFLL

SEQ ID NO: 1209668 - protein, 9 aa, Homo Sapiens
RMSPSNSSN

SEQ ID NO: 1209669 - protein, 9 aa, Homo Sapiens
QNQSKIQLL

SEQ ID NO: 1209670 - protein, 9 aa, Homo Sapiens
FRDKENVLM

SEQ ID NO: 1209671 - protein, 9 aa, Homo Sapiens
GQEDGLGDA

SEQ ID NO: 1209672 - protein, 9 aa, Homo Sapiens
DEPNVLNEC

SEQ ID NO: 1209673 - protein, 9 aa, Homo Sapiens
HYPPGSSQA

SEQ ID NO: 1209674 - protein, 9 aa, Homo Sapiens
AGPEEAAGP

SEQ ID NO: 1209675 - protein, 9 aa, Homo Sapiens
ERIREMQSF

SEQ ID NO: 1209676 - protein, 9 aa, Homo Sapiens
ISMVNHMVE

SEQ ID NO: 1209677 - protein, 9 aa, Homo Sapiens
KKALLFHTS

SEQ ID NO: 1209678 - protein, 9 aa, Homo Sapiens
GNLVVSNPN

SEQ ID NO: 1209679 - protein, 9 aa, Homo Sapiens
ALDFCIAAV

SEQ ID NO: 1209680 - protein, 9 aa, Homo Sapiens
TRWEMHHTQ

SEQ ID NO: 1209681 - protein, 9 aa, Homo Sapiens
FLSLLAKCY

SEQ ID NO: 1209682 - protein, 9 aa, Homo Sapiens
IFPIIRFCH

SEQ ID NO: 1209683 - protein, 9 aa, Homo Sapiens
AFFCKHLGC

SEQ ID NO: 1209684 - protein, 9 aa, Homo Sapiens
QLERESTLL

SEQ ID NO: 1209685 - protein, 9 aa, Homo Sapiens
CGQLMNGSF

SEQ ID NO: 1209686 - protein, 9 aa, Homo Sapiens
AEASILRQH

SEQ ID NO: 1209687 - protein, 9 aa, Homo Sapiens
FSSLHIHTR

SEQ ID NO: 1209688 - protein, 9 aa, Homo Sapiens
TYVMFGGKQ

SEQ ID NO: 1209689 - protein, 9 aa, Homo Sapiens
SALAQNMWH

SEQ ID NO: 1209690 - protein, 9 aa, Homo Sapiens
ALWLCCATP

SEQ ID NO: 1209691 - protein, 9 aa, Homo Sapiens
NQLWHKECF

SEQ ID NO: 1209692 - protein, 9 aa, Homo Sapiens
LLKFNFNTY

SEQ ID NO: 1209693 - protein, 9 aa, Homo Sapiens
TFANSMVFL

SEQ ID NO: 1209694 - protein, 9 aa, Homo Sapiens
TSNALSLKI

SEQ ID NO: 1209695 - protein, 9 aa, Homo Sapiens
RTNIETSGL

SEQ ID NO: 1209696 - protein, 9 aa, Homo Sapiens
SALNAIHAL

SEQ ID NO: 1209697 - protein, 9 aa, Homo Sapiens
QKREAQVDV

SEQ ID NO: 1209698 - protein, 9 aa, Homo Sapiens
TGNGPPTWP

SEQ ID NO: 1209699 - protein, 9 aa, Homo Sapiens
TRSTRAEMG

SEQ ID NO: 1209700 - protein, 9 aa, Homo Sapiens
TFSITSFDG

SEQ ID NO: 1209701 - protein, 9 aa, Homo Sapiens
GKPGGSLFT

SEQ ID NO: 1209702 - protein, 9 aa, Homo Sapiens
YQLECLMQE

SEQ ID NO: 1209703 - protein, 9 aa, Homo Sapiens
VFFFVCSFM

SEQ ID NO: 1209704 - protein, 9 aa, Homo Sapiens
VPVTFDCDC

SEQ ID NO: 1209705 - protein, 9 aa, Homo Sapiens
KASSEMTLY

SEQ ID NO: 1209706 - protein, 9 aa, Homo Sapiens
SLPSSGTES

SEQ ID NO: 1209707 - protein, 9 aa, Homo Sapiens
MKPPVKRQE

SEQ ID NO: 1209708 - protein, 9 aa, Homo Sapiens
VSYLISNKK

SEQ ID NO: 1209709 - protein, 9 aa, Homo Sapiens
GHDLLPPRV

SEQ ID NO: 1209710 - protein, 9 aa, Homo Sapiens
WALHSYKEI

SEQ ID NO: 1209711 - protein, 9 aa, Homo Sapiens
VPCPPPRAP

SEQ ID NO: 1209712 - protein, 9 aa, Homo Sapiens
EEAVYEELP

SEQ ID NO: 1209713 - protein, 9 aa, Homo Sapiens
VLRFRAFQQ

SEQ ID NO: 1209714 - protein, 9 aa, Homo Sapiens
DGGSLLGVL

SEQ ID NO: 1209715 - protein, 9 aa, Homo Sapiens
QAAHSTEAI

SEQ ID NO: 1209716 - protein, 9 aa, Homo Sapiens
DCSQLMACV

SEQ ID NO: 1209717 - protein, 9 aa, Homo Sapiens
PMAVICVVK

SEQ ID NO: 1209718 - protein, 9 aa, Homo Sapiens
ILVLAGNST

SEQ ID NO: 1209719 - protein, 9 aa, Homo Sapiens
KSVMEGASA

SEQ ID NO: 1209720 - protein, 9 aa, Homo Sapiens
SLIHHYQIH

SEQ ID NO: 1209721 - protein, 9 aa, Homo Sapiens
TFPVEADLL

SEQ ID NO: 1209722 - protein, 9 aa, Homo Sapiens
PEQIQALHQ

SEQ ID NO: 1209723 - protein, 9 aa, Homo Sapiens
LMVGAVSTY

SEQ ID NO: 1209724 - protein, 9 aa, Homo Sapiens
VNIPCAAVR

SEQ ID NO: 1209725 - protein, 9 aa, Homo Sapiens
PNHLPQLML

SEQ ID NO: 1209726 - protein, 9 aa, Homo Sapiens
ERMMLMKTV

SEQ ID NO: 1209727 - protein, 9 aa, Homo Sapiens
SWFCDDILY

SEQ ID NO: 1209728 - protein, 9 aa, Homo Sapiens
MANAKETAR

SEQ ID NO: 1209729 - protein, 9 aa, Homo Sapiens
RRFHSTPRV

SEQ ID NO: 1209730 - protein, 9 aa, Homo Sapiens
SDNYEVQAE

SEQ ID NO: 1209731 - protein, 9 aa, Homo Sapiens
HKVECTGYT

SEQ ID NO: 1209732 - protein, 9 aa, Homo Sapiens
NQILLERHM

SEQ ID NO: 1209733 - protein, 9 aa, Homo Sapiens
KHKVEEKRR

SEQ ID NO: 1209734 - protein, 9 aa, Homo Sapiens
VYGIPDFLG

SEQ ID NO: 1209735 - protein, 9 aa, Homo Sapiens
TAFYQVFHL

SEQ ID NO: 1209736 - protein, 9 aa, Homo Sapiens
TAKCLSIWA

SEQ ID NO: 1209737 - protein, 9 aa, Homo Sapiens
CTVTTKDGG

SEQ ID NO: 1209738 - protein, 9 aa, Homo Sapiens
ALNSASASG

SEQ ID NO: 1209739 - protein, 9 aa, Homo Sapiens
TNMKASKPI

SEQ ID NO: 1209740 - protein, 9 aa, Homo Sapiens
TDSLGIYNC

SEQ ID NO: 1209741 - protein, 9 aa, Homo Sapiens
GPLDKWQVL

SEQ ID NO: 1209742 - protein, 9 aa, Homo Sapiens
FVMLLAGVG

SEQ ID NO: 1209743 - protein, 9 aa, Homo Sapiens
YEAHYIRQQ

SEQ ID NO: 1209744 - protein, 9 aa, Homo Sapiens
IKILGTAIC

SEQ ID NO: 1209745 - protein, 9 aa, Homo Sapiens
LTECKNVSV

SEQ ID NO: 1209746 - protein, 9 aa, Homo Sapiens
PGKRGHPGF

SEQ ID NO: 1209747 - protein, 9 aa, Homo Sapiens
HNVVSYAEV

SEQ ID NO: 1209748 - protein, 9 aa, Homo Sapiens
FPFSFHLPV

SEQ ID NO: 1209749 - protein, 9 aa, Homo Sapiens
YTGTHRHTH

SEQ ID NO: 1209750 - protein, 9 aa, Homo Sapiens
SVFDFDHFS

SEQ ID NO: 1209751 - protein, 9 aa, Homo Sapiens
DYHNLNLEQ

SEQ ID NO: 1209752 - protein, 9 aa, Homo Sapiens
EQVHSSPPP

SEQ ID NO: 1209753 - protein, 9 aa, Homo Sapiens
AKAYEQAEM

SEQ ID NO: 1209754 - protein, 9 aa, Homo Sapiens
LDLLRSSLI

SEQ ID NO: 1209755 - protein, 9 aa, Homo Sapiens
GLSYQPNVL

SEQ ID NO: 1209756 - protein, 9 aa, Homo Sapiens
EDCWDQDAD

SEQ ID NO: 1209757 - protein, 9 aa, Homo Sapiens
RIEGTQVDT

SEQ ID NO: 1209758 - protein, 9 aa, Homo Sapiens
SAPDDQGPW

SEQ ID NO: 1209759 - protein, 9 aa, Homo Sapiens
MAPNHGLHL

SEQ ID NO: 1209760 - protein, 9 aa, Homo Sapiens
ALLLALKVN

SEQ ID NO: 1209761 - protein, 9 aa, Homo Sapiens
GVLNSIGIQ

SEQ ID NO: 1209762 - protein, 9 aa, Homo Sapiens
HPKIATWRW

SEQ ID NO: 1209763 - protein, 9 aa, Homo Sapiens
AYSYPMSAA

SEQ ID NO: 1209764 - protein, 9 aa, Homo Sapiens
IVSQGPSPE

SEQ ID NO: 1209765 - protein, 9 aa, Homo Sapiens
VCIDHRCQH

SEQ ID NO: 1209766 - protein, 9 aa, Homo Sapiens
KIHSAVGQG

SEQ ID NO: 1209767 - protein, 9 aa, Homo Sapiens
EEEPEGGFN

SEQ ID NO: 1209768 - protein, 9 aa, Homo Sapiens
LRHQRTHEP

SEQ ID NO: 1209769 - protein, 9 aa, Homo Sapiens
PLAKVNREQ

SEQ ID NO: 1209770 - protein, 9 aa, Homo Sapiens
HLLGSSASS

SEQ ID NO: 1209771 - protein, 9 aa, Homo Sapiens
EALLLQCPE

SEQ ID NO: 1209772 - protein, 9 aa, Homo Sapiens
PGLNNSTDV

SEQ ID NO: 1209773 - protein, 9 aa, Homo Sapiens
CTFFFLHKE

SEQ ID NO: 1209774 - protein, 9 aa, Homo Sapiens
AAEGEGDIF

SEQ ID NO: 1209775 - protein, 9 aa, Homo Sapiens
TFIIIALSY

SEQ ID NO: 1209776 - protein, 9 aa, Homo Sapiens
TGSASSLDN

SEQ ID NO: 1209777 - protein, 9 aa, Homo Sapiens
ANYKYHENG

SEQ ID NO: 1209778 - protein, 9 aa, Homo Sapiens
ENAIQTMKL

SEQ ID NO: 1209779 - protein, 9 aa, Homo Sapiens
IQKQVWEWK

SEQ ID NO: 1209780 - protein, 9 aa, Homo Sapiens
HVNVSILFA

SEQ ID NO: 1209781 - protein, 9 aa, Homo Sapiens
FKATGPRGE

SEQ ID NO: 1209782 - protein, 9 aa, Homo Sapiens
PFRLENLLT

SEQ ID NO: 1209783 - protein, 9 aa, Homo Sapiens
GAFGHEHYE

SEQ ID NO: 1209784 - protein, 9 aa, Homo Sapiens
CVTEVKTDI

SEQ ID NO: 1209785 - protein, 9 aa, Homo Sapiens
WLKKKKSIN

SEQ ID NO: 1209786 - protein, 9 aa, Homo Sapiens
ESPHLSPCS

SEQ ID NO: 1209787 - protein, 9 aa, Homo Sapiens
AATGSLNAG

SEQ ID NO: 1209788 - protein, 9 aa, Homo Sapiens
DIEHITGFT

SEQ ID NO: 1209789 - protein, 9 aa, Homo Sapiens
KLTGVVMHY

SEQ ID NO: 1209790 - protein, 9 aa, Homo Sapiens
THLNSPQLA

SEQ ID NO: 1209791 - protein, 9 aa, Homo Sapiens
ATQLQCLLN

SEQ ID NO: 1209792 - protein, 9 aa, Homo Sapiens
FHVNPVGHL

SEQ ID NO: 1209793 - protein, 9 aa, Homo Sapiens
YLAFAKRHR

SEQ ID NO: 1209794 - protein, 9 aa, Homo Sapiens
GNDTINAQE

SEQ ID NO: 1209795 - protein, 9 aa, Homo Sapiens
EADPSGVVS

SEQ ID NO: 1209796 - protein, 9 aa, Homo Sapiens
MIIVGASVG

SEQ ID NO: 1209797 - protein, 9 aa, Homo Sapiens
IVSGVYDGK

SEQ ID NO: 1209798 - protein, 9 aa, Homo Sapiens
GAAFMAKVM

SEQ ID NO: 1209799 - protein, 9 aa, Homo Sapiens
FAANVLRER

SEQ ID NO: 1209800 - protein, 9 aa, Homo Sapiens
ELHCEDPSF

SEQ ID NO: 1209801 - protein, 9 aa, Homo Sapiens
EDKTNVILL

SEQ ID NO: 1209802 - protein, 9 aa, Homo Sapiens
ILNSPVKAV

SEQ ID NO: 1209803 - protein, 9 aa, Homo Sapiens
TLTKKPDVY

SEQ ID NO: 1209804 - protein, 9 aa, Homo Sapiens
QSKATPQSP

SEQ ID NO: 1209805 - protein, 9 aa, Homo Sapiens
MLFSRVIPE

SEQ ID NO: 1209806 - protein, 9 aa, Homo Sapiens
KHPQHKLFQ

SEQ ID NO: 1209807 - protein, 9 aa, Homo Sapiens
QTDVFVELL

SEQ ID NO: 1209808 - protein, 9 aa, Homo Sapiens
HNPTESIMF

SEQ ID NO: 1209809 - protein, 9 aa, Homo Sapiens
SINFFTGDV

SEQ ID NO: 1209810 - protein, 9 aa, Homo Sapiens
SAIDGVNSI

SEQ ID NO: 1209811 - protein, 9 aa, Homo Sapiens
FLPRIPKVQ

SEQ ID NO: 1209812 - protein, 9 aa, Homo Sapiens
VSPRRMTPL

SEQ ID NO: 1209813 - protein, 9 aa, Homo Sapiens
SGICSLEEL

SEQ ID NO: 1209814 - protein, 9 aa, Homo Sapiens
CPGGRPGQC

SEQ ID NO: 1209815 - protein, 9 aa, Homo Sapiens
NHWRCMLNT

SEQ ID NO: 1209816 - protein, 9 aa, Homo Sapiens
LRSTWTMLL

SEQ ID NO: 1209817 - protein, 9 aa, Homo Sapiens
ENNQFQVEH

SEQ ID NO: 1209818 - protein, 9 aa, Homo Sapiens
KRLDSKVNI

SEQ ID NO: 1209819 - protein, 9 aa, Homo Sapiens
GANPNITDV

SEQ ID NO: 1209820 - protein, 9 aa, Homo Sapiens
GLPPSGELY

SEQ ID NO: 1209821 - protein, 9 aa, Homo Sapiens
ATIWLWEHN

SEQ ID NO: 1209822 - protein, 9 aa, Homo Sapiens
LLMRVLPGV

SEQ ID NO: 1209823 - protein, 9 aa, Homo Sapiens
EVDYYNRLI

SEQ ID NO: 1209824 - protein, 9 aa, Homo Sapiens
TTLEHPDCA

SEQ ID NO: 1209825 - protein, 9 aa, Homo Sapiens
PRPGQHTLT

SEQ ID NO: 1209826 - protein, 9 aa, Homo Sapiens
KLKKVRSLK

SEQ ID NO: 1209827 - protein, 9 aa, Homo Sapiens
AAACPLDQA

SEQ ID NO: 1209828 - protein, 9 aa, Homo Sapiens
GYRLEELEK

SEQ ID NO: 1209829 - protein, 9 aa, Homo Sapiens
FLLLFCMIF

SEQ ID NO: 1209830 - protein, 9 aa, Homo Sapiens
CSILSMVCA

SEQ ID NO: 1209831 - protein, 9 aa, Homo Sapiens
HFMSFHWKR

SEQ ID NO: 1209832 - protein, 9 aa, Homo Sapiens
RRYDLIGLN

SEQ ID NO: 1209833 - protein, 9 aa, Homo Sapiens
PSCQDWKKA

SEQ ID NO: 1209834 - protein, 9 aa, Homo Sapiens
RIPQERKDM

SEQ ID NO: 1209835 - protein, 9 aa, Homo Sapiens
EQQACLISK

SEQ ID NO: 1209836 - protein, 9 aa, Homo Sapiens
HGRATDIWS

SEQ ID NO: 1209837 - protein, 9 aa, Homo Sapiens
RHDSITSVV

SEQ ID NO: 1209838 - protein, 9 aa, Homo Sapiens
KGRGGGLGV

SEQ ID NO: 1209839 - protein, 9 aa, Homo Sapiens
EVEVKNVKS

SEQ ID NO: 1209840 - protein, 9 aa, Homo Sapiens
VTLMQKNWR

SEQ ID NO: 1209841 - protein, 9 aa, Homo Sapiens
TLSWIFSGD

SEQ ID NO: 1209842 - protein, 9 aa, Homo Sapiens
FIDNLKQFY

SEQ ID NO: 1209843 - protein, 9 aa, Homo Sapiens
DGKHQHTNV

SEQ ID NO: 1209844 - protein, 9 aa, Homo Sapiens
KLCQTTGLM

SEQ ID NO: 1209845 - protein, 9 aa, Homo Sapiens
AAVVWKTKQ

SEQ ID NO: 1209846 - protein, 9 aa, Homo Sapiens
TVAFIVFWV

SEQ ID NO: 1209847 - protein, 9 aa, Homo Sapiens
GTSDFTLSN

SEQ ID NO: 1209848 - protein, 9 aa, Homo Sapiens
VYIARSQIF

SEQ ID NO: 1209849 - protein, 9 aa, Homo Sapiens
SMIPSYIRD

SEQ ID NO: 1209850 - protein, 9 aa, Homo Sapiens
FLDDDSPGD

SEQ ID NO: 1209851 - protein, 9 aa, Homo Sapiens
DSIPMSTSL

SEQ ID NO: 1209852 - protein, 9 aa, Homo Sapiens
KIRPVMILT

SEQ ID NO: 1209853 - protein, 9 aa, Homo Sapiens
RDSSQECTD

SEQ ID NO: 1209854 - protein, 9 aa, Homo Sapiens
DLTRLRGVH

SEQ ID NO: 1209855 - protein, 9 aa, Homo Sapiens
GSNVRSNPH

SEQ ID NO: 1209856 - protein, 9 aa, Homo Sapiens
QVVMYVKNR

SEQ ID NO: 1209857 - protein, 9 aa, Homo Sapiens
DKYSVSQDP

SEQ ID NO: 1209858 - protein, 9 aa, Homo Sapiens
DAGHLLYPF

SEQ ID NO: 1209859 - protein, 9 aa, Homo Sapiens
DYGNDFAAT

SEQ ID NO: 1209860 - protein, 9 aa, Homo Sapiens
DTYMLQNLF

SEQ ID NO: 1209861 - protein, 9 aa, Homo Sapiens
GKDKLLEKG

SEQ ID NO: 1209862 - protein, 9 aa, Homo Sapiens
STLCVCRIF

SEQ ID NO: 1209863 - protein, 9 aa, Homo Sapiens
IPWDKNHEA

SEQ ID NO: 1209864 - protein, 9 aa, Homo Sapiens
TVLTIIKWK

SEQ ID NO: 1209865 - protein, 9 aa, Homo Sapiens
TVMRCSAMP

SEQ ID NO: 1209866 - protein, 9 aa, Homo Sapiens
PPYPSRPSV

SEQ ID NO: 1209867 - protein, 9 aa, Homo Sapiens
QGELIPLMN

SEQ ID NO: 1209868 - protein, 9 aa, Homo Sapiens
NKCIMKEPV

SEQ ID NO: 1209869 - protein, 9 aa, Homo Sapiens
LPLWTLESL

SEQ ID NO: 1209870 - protein, 9 aa, Homo Sapiens
VGPDLEVQE

SEQ ID NO: 1209871 - protein, 9 aa, Homo Sapiens
DQDMVNKIG

SEQ ID NO: 1209872 - protein, 9 aa, Homo Sapiens
MQCWRCKCY

SEQ ID NO: 1209873 - protein, 9 aa, Homo Sapiens
KHLLVFINS

SEQ ID NO: 1209874 - protein, 9 aa, Homo Sapiens
CKDLINFML

SEQ ID NO: 1209875 - protein, 9 aa, Homo Sapiens
KWDISEEVQ

SEQ ID NO: 1209876 - protein, 9 aa, Homo Sapiens
KELPLSAVC

SEQ ID NO: 1209877 - protein, 9 aa, Homo Sapiens
GGRPGQCAG

SEQ ID NO: 1209878 - protein, 9 aa, Homo Sapiens
VTQCPSVIT

SEQ ID NO: 1209879 - protein, 9 aa, Homo Sapiens
VGATEDKSA

SEQ ID NO: 1209880 - protein, 9 aa, Homo Sapiens
ENMNVTNVR

SEQ ID NO: 1209881 - protein, 9 aa, Homo Sapiens
SSPVLTKHL

SEQ ID NO: 1209882 - protein, 9 aa, Homo Sapiens
TYRDDVRRV

SEQ ID NO: 1209883 - protein, 9 aa, Homo Sapiens
YRKSWRCCR

SEQ ID NO: 1209884 - protein, 9 aa, Homo Sapiens
MSAADYPIR

SEQ ID NO: 1209885 - protein, 9 aa, Homo Sapiens
YKLKSYLQQ

SEQ ID NO: 1209886 - protein, 9 aa, Homo Sapiens
DTRGKGSMG

SEQ ID NO: 1209887 - protein, 9 aa, Homo Sapiens
LAACRRCMA

SEQ ID NO: 1209888 - protein, 9 aa, Homo Sapiens
RARWSTSFC

SEQ ID NO: 1209889 - protein, 9 aa, Homo Sapiens
VNFSHAISQ

SEQ ID NO: 1209890 - protein, 9 aa, Homo Sapiens
IPPTSRCPM

SEQ ID NO: 1209891 - protein, 9 aa, Homo Sapiens
NEFTDQLPD

SEQ ID NO: 1209892 - protein, 9 aa, Homo Sapiens
SIAGSGKWE

SEQ ID NO: 1209893 - protein, 9 aa, Homo Sapiens
PSLASCASV

SEQ ID NO: 1209894 - protein, 9 aa, Homo Sapiens
FYQRRHGFT

SEQ ID NO: 1209895 - protein, 9 aa, Homo Sapiens
TLQKFMDCP

SEQ ID NO: 1209896 - protein, 9 aa, Homo Sapiens
GCRLSGEMI

SEQ ID NO: 1209897 - protein, 9 aa, Homo Sapiens
WDDSRNKRG

SEQ ID NO: 1209898 - protein, 9 aa, Homo Sapiens
DHSRGLVIM

SEQ ID NO: 1209899 - protein, 9 aa, Homo Sapiens
IGKDCIGRC

SEQ ID NO: 1209900 - protein, 9 aa, Homo Sapiens
GTQVDTRES

SEQ ID NO: 1209901 - protein, 9 aa, Homo Sapiens
NAPCRCSAP

SEQ ID NO: 1209902 - protein, 9 aa, Homo Sapiens
CIPLDRKDQ

SEQ ID NO: 1209903 - protein, 9 aa, Homo Sapiens
KLKFRFDAS

SEQ ID NO: 1209904 - protein, 9 aa, Homo Sapiens
SGRRYDLIG

SEQ ID NO: 1209905 - protein, 9 aa, Homo Sapiens
WNIARLNTI

SEQ ID NO: 1209906 - protein, 9 aa, Homo Sapiens
VLHVLDQFQ

SEQ ID NO: 1209907 - protein, 9 aa, Homo Sapiens
KEATLVYSN

SEQ ID NO: 1209908 - protein, 9 aa, Homo Sapiens
EHITGFTLQ

SEQ ID NO: 1209909 - protein, 9 aa, Homo Sapiens
TKGEIANCE

SEQ ID NO: 1209910 - protein, 9 aa, Homo Sapiens
KISCSNSEG

SEQ ID NO: 1209911 - protein, 9 aa, Homo Sapiens
LNPFGQVIS

SEQ ID NO: 1209912 - protein, 9 aa, Homo Sapiens
CKTPDVSFL

SEQ ID NO: 1209913 - protein, 9 aa, Homo Sapiens
RMRGTKSTP

SEQ ID NO: 1209914 - protein, 9 aa, Homo Sapiens
RIRASFSEA

SEQ ID NO: 1209915 - protein, 9 aa, Homo Sapiens
QDMNAYLVE

SEQ ID NO: 1209916 - protein, 9 aa, Homo Sapiens
FCDGKEYDN

SEQ ID NO: 1209917 - protein, 9 aa, Homo Sapiens
FMESLTLWL

SEQ ID NO: 1209918 - protein, 9 aa, Homo Sapiens
QEAVLGLLS

SEQ ID NO: 1209919 - protein, 9 aa, Homo Sapiens
QDAEDDGEE

SEQ ID NO: 1209920 - protein, 9 aa, Homo Sapiens
MPRHGVYVL

SEQ ID NO: 1209921 - protein, 9 aa, Homo Sapiens
FLMGNGRHC

SEQ ID NO: 1209922 - protein, 9 aa, Homo Sapiens
LILDYHNLN

SEQ ID NO: 1209923 - protein, 9 aa, Homo Sapiens
VVIIHCRGG

SEQ ID NO: 1209924 - protein, 9 aa, Homo Sapiens
PCCGQASAP

SEQ ID NO: 1209925 - protein, 9 aa, Homo Sapiens
KQELPEHVS

SEQ ID NO: 1209926 - protein, 9 aa, Homo Sapiens
YHAVEVDRQ

SEQ ID NO: 1209927 - protein, 9 aa, Homo Sapiens
DVAGEIDPV

SEQ ID NO: 1209928 - protein, 9 aa, Homo Sapiens
YSTLPMYLG

SEQ ID NO: 1209929 - protein, 9 aa, Homo Sapiens
DVHLARDFA

SEQ ID NO: 1209930 - protein, 9 aa, Homo Sapiens
ATFQCFGFW

SEQ ID NO: 1209931 - protein, 9 aa, Homo Sapiens
GVAGSLTNL

SEQ ID NO: 1209932 - protein, 9 aa, Homo Sapiens
FVHKKKCSS

SEQ ID NO: 1209933 - protein, 9 aa, Homo Sapiens
MHMGFDMQM

SEQ ID NO: 1209934 - protein, 9 aa, Homo Sapiens
HNLGLGKKS

SEQ ID NO: 1209935 - protein, 9 aa, Homo Sapiens
GQDRHMEFL

SEQ ID NO: 1209936 - protein, 9 aa, Homo Sapiens
SKKTTKRKC

SEQ ID NO: 1209937 - protein, 9 aa, Homo Sapiens
PMYFMKLHS

SEQ ID NO: 1209938 - protein, 9 aa, Homo Sapiens
MLVRVTEGI

SEQ ID NO: 1209939 - protein, 9 aa, Homo Sapiens
LDRKDQFVI

SEQ ID NO: 1209940 - protein, 9 aa, Homo Sapiens
ARVHYYQSL

SEQ ID NO: 1209941 - protein, 9 aa, Homo Sapiens
YPHFLESEF

SEQ ID NO: 1209942 - protein, 9 aa, Homo Sapiens
LADTLGYTV

SEQ ID NO: 1209943 - protein, 9 aa, Homo Sapiens
SDRLRRCSD

SEQ ID NO: 1209944 - protein, 9 aa, Homo Sapiens
CWTPLTPTP

SEQ ID NO: 1209945 - protein, 9 aa, Homo Sapiens
RRNEHGRHR

SEQ ID NO: 1209946 - protein, 9 aa, Homo Sapiens
DFAWERVWG

SEQ ID NO: 1209947 - protein, 9 aa, Homo Sapiens
FFFGYTPVV

SEQ ID NO: 1209948 - protein, 9 aa, Homo Sapiens
SHRGGGRSF

SEQ ID NO: 1209949 - protein, 9 aa, Homo Sapiens
VRKHGGSSG

SEQ ID NO: 1209950 - protein, 9 aa, Homo Sapiens
QKCEWVKFA

SEQ ID NO: 1209951 - protein, 9 aa, Homo Sapiens
ASKSETHQP

SEQ ID NO: 1209952 - protein, 9 aa, Homo Sapiens
DSRDARWER

SEQ ID NO: 1209953 - protein, 9 aa, Homo Sapiens
QAEINPVHY

SEQ ID NO: 1209954 - protein, 9 aa, Homo Sapiens
GLGNTGPRG

SEQ ID NO: 1209955 - protein, 9 aa, Homo Sapiens
KERRCMLLL

SEQ ID NO: 1209956 - protein, 9 aa, Homo Sapiens
QSLADIENH

SEQ ID NO: 1209957 - protein, 9 aa, Homo Sapiens
AAKVHLELL

SEQ ID NO: 1209958 - protein, 9 aa, Homo Sapiens
WNDINCLGP

SEQ ID NO: 1209959 - protein, 9 aa, Homo Sapiens
HYVVARLLK

SEQ ID NO: 1209960 - protein, 9 aa, Homo Sapiens
MKEVVGLKS

SEQ ID NO: 1209961 - protein, 9 aa, Homo Sapiens
PTLHLHDAG

SEQ ID NO: 1209962 - protein, 9 aa, Homo Sapiens
ECIPSSGIL

SEQ ID NO: 1209963 - protein, 9 aa, Homo Sapiens
IIFLKCSVP

SEQ ID NO: 1209964 - protein, 9 aa, Homo Sapiens
AVRMRLEAT

SEQ ID NO: 1209965 - protein, 9 aa, Homo Sapiens
QYPAQETLN

SEQ ID NO: 1209966 - protein, 9 aa, Homo Sapiens
SLTDDVPLS

SEQ ID NO: 1209967 - protein, 9 aa, Homo Sapiens
SLTPHFSAG

SEQ ID NO: 1209968 - protein, 9 aa, Homo Sapiens
SHLRTPMYF

SEQ ID NO: 1209969 - protein, 9 aa, Homo Sapiens
DQDADARLT

SEQ ID NO: 1209970 - protein, 9 aa, Homo Sapiens
DFRSMEAIF

SEQ ID NO: 1209971 - protein, 9 aa, Homo Sapiens
SSPSHPSSW

SEQ ID NO: 1209972 - protein, 9 aa, Homo Sapiens
SIEGFYQLE

SEQ ID NO: 1209973 - protein, 9 aa, Homo Sapiens
VQWHPVSRE

SEQ ID NO: 1209974 - protein, 9 aa, Homo Sapiens
LQIHFVVDP

SEQ ID NO: 1209975 - protein, 9 aa, Homo Sapiens
HLLPAVTFD

SEQ ID NO: 1209976 - protein, 9 aa, Homo Sapiens
QLEMTTERW

SEQ ID NO: 1209977 - protein, 9 aa, Homo Sapiens
RAGWLQLLN

SEQ ID NO: 1209978 - protein, 9 aa, Homo Sapiens
AELLVKEQG

SEQ ID NO: 1209979 - protein, 9 aa, Homo Sapiens
LPTPWLCRA

SEQ ID NO: 1209980 - protein, 9 aa, Homo Sapiens
PEGYETHWW

SEQ ID NO: 1209981 - protein, 9 aa, Homo Sapiens
YHIDDVDWN

SEQ ID NO: 1209982 - protein, 9 aa, Homo Sapiens
DGLGWRVSS

SEQ ID NO: 1209983 - protein, 9 aa, Homo Sapiens
HHHHHHRRP

SEQ ID NO: 1209984 - protein, 9 aa, Homo Sapiens
TCSSAVRKP

SEQ ID NO: 1209985 - protein, 9 aa, Homo Sapiens
PEHVPQEDG

SEQ ID NO: 1209986 - protein, 9 aa, Homo Sapiens
HPNPPSWLS

SEQ ID NO: 1209987 - protein, 9 aa, Homo Sapiens
PKRLQQNVT

SEQ ID NO: 1209988 - protein, 9 aa, Homo Sapiens
LMDCQARKL

SEQ ID NO: 1209989 - protein, 9 aa, Homo Sapiens
QPNVLPHPT

SEQ ID NO: 1209990 - protein, 9 aa, Homo Sapiens
NISIGYSGL

SEQ ID NO: 1209991 - protein, 9 aa, Homo Sapiens
PGLFEVGFE

SEQ ID NO: 1209992 - protein, 9 aa, Homo Sapiens
DVLYPPECY

SEQ ID NO: 1209993 - protein, 9 aa, Homo Sapiens
EEYARESAD

SEQ ID NO: 1209994 - protein, 9 aa, Homo Sapiens
PVHRFLFLK

SEQ ID NO: 1209995 - protein, 9 aa, Homo Sapiens
IQREQVLLN

SEQ ID NO: 1209996 - protein, 9 aa, Homo Sapiens
LASLIGIAG

SEQ ID NO: 1209997 - protein, 9 aa, Homo Sapiens
VHHAMADDD

SEQ ID NO: 1209998 - protein, 9 aa, Homo Sapiens
QCAGAWGLL

SEQ ID NO: 1209999 - protein, 9 aa, Homo Sapiens
DATAPAGLP

SEQ ID NO: 1210000 - protein, 9 aa, Homo Sapiens
ETRRVTELF

SEQ ID NO: 1210001 - protein, 9 aa, Homo Sapiens
YAKCIPYMD

SEQ ID NO: 1210002 - protein, 9 aa, Homo Sapiens
VRHYRPIYE

SEQ ID NO: 1210003 - protein, 9 aa, Homo Sapiens
IRVGAGHKS

SEQ ID NO: 1210004 - protein, 9 aa, Homo Sapiens
KVTHILNAA

SEQ ID NO: 1210005 - protein, 9 aa, Homo Sapiens
EQGFKGYEC

SEQ ID NO: 1210006 - protein, 9 aa, Homo Sapiens
KSTLVLILV

SEQ ID NO: 1210007 - protein, 9 aa, Homo Sapiens
KQRSHHKSK

SEQ ID NO: 1210008 - protein, 9 aa, Homo Sapiens
YHLLHRYCV

SEQ ID NO: 1210009 - protein, 9 aa, Homo Sapiens
YCGADPRRL

SEQ ID NO: 1210010 - protein, 9 aa, Homo Sapiens
YTNHDLDQF

SEQ ID NO: 1210011 - protein, 9 aa, Homo Sapiens
KLMDQASRT

SEQ ID NO: 1210012 - protein, 9 aa, Homo Sapiens
QSYGPPHGS

SEQ ID NO: 1210013 - protein, 9 aa, Homo Sapiens
HCTPPSPYH

SEQ ID NO: 1210014 - protein, 9 aa, Homo Sapiens
MLTLHTKLS

SEQ ID NO: 1210015 - protein, 9 aa, Homo Sapiens
RSLCTKLSL

SEQ ID NO: 1210016 - protein, 9 aa, Homo Sapiens
EGSGSSEDD

SEQ ID NO: 1210017 - protein, 9 aa, Homo Sapiens
EQREEWKKT

SEQ ID NO: 1210018 - protein, 9 aa, Homo Sapiens
RALRHSTTR

SEQ ID NO: 1210019 - protein, 9 aa, Homo Sapiens
TSLDAELQA

SEQ ID NO: 1210020 - protein, 9 aa, Homo Sapiens
LLTTITRTI

SEQ ID NO: 1210021 - protein, 9 aa, Homo Sapiens
KMEKFSSAL

SEQ ID NO: 1210022 - protein, 9 aa, Homo Sapiens
KYTPKLEIK

SEQ ID NO: 1210023 - protein, 9 aa, Homo Sapiens
GIPGLEKVH

SEQ ID NO: 1210024 - protein, 9 aa, Homo Sapiens
PDHGRDQGR

SEQ ID NO: 1210025 - protein, 9 aa, Homo Sapiens
KDKNDSVDA

SEQ ID NO: 1210026 - protein, 9 aa, Homo Sapiens
PRRPPHSPG

SEQ ID NO: 1210027 - protein, 9 aa, Homo Sapiens
RTFAQAMRM

SEQ ID NO: 1210028 - protein, 9 aa, Homo Sapiens
AEIPTGSEA

SEQ ID NO: 1210029 - protein, 9 aa, Homo Sapiens
GAARPVQDI

SEQ ID NO: 1210030 - protein, 9 aa, Homo Sapiens
PEQTVLLMG

SEQ ID NO: 1210031 - protein, 9 aa, Homo Sapiens
RTTLPTSGS

SEQ ID NO: 1210032 - protein, 9 aa, Homo Sapiens
PESKQDPVK

SEQ ID NO: 1210033 - protein, 9 aa, Homo Sapiens
TSCNGYFVF

SEQ ID NO: 1210034 - protein, 9 aa, Homo Sapiens
GSLPSGTRG

SEQ ID NO: 1210035 - protein, 9 aa, Homo Sapiens
KTVQVTEKT

SEQ ID NO: 1210036 - protein, 9 aa, Homo Sapiens
NDDTKLLVL

SEQ ID NO: 1210037 - protein, 9 aa, Homo Sapiens
RASTPHPLT

SEQ ID NO: 1210038 - protein, 9 aa, Homo Sapiens
RKKILRHGI

SEQ ID NO: 1210039 - protein, 9 aa, Homo Sapiens
QTPNPVDDE

SEQ ID NO: 1210040 - protein, 9 aa, Homo Sapiens
TANMEWIMK

SEQ ID NO: 1210041 - protein, 9 aa, Homo Sapiens
SVASKYAIY

SEQ ID NO: 1210042 - protein, 9 aa, Homo Sapiens
MVFPGGGAS

SEQ ID NO: 1210043 - protein, 9 aa, Homo Sapiens
VIEVELQFS

SEQ ID NO: 1210044 - protein, 9 aa, Homo Sapiens
DVCEEEIPE

SEQ ID NO: 1210045 - protein, 9 aa, Homo Sapiens
PGSTYSMMT

SEQ ID NO: 1210046 - protein, 9 aa, Homo Sapiens
TYSNNESKK

SEQ ID NO: 1210047 - protein, 9 aa, Homo Sapiens
HQGPVHLVQ

SEQ ID NO: 1210048 - protein, 9 aa, Homo Sapiens
VRCITSLLP

SEQ ID NO: 1210049 - protein, 9 aa, Homo Sapiens
SLQPTLSVT

SEQ ID NO: 1210050 - protein, 9 aa, Homo Sapiens
NHSDRPPQN

SEQ ID NO: 1210051 - protein, 9 aa, Homo Sapiens
CETLCEDMG

SEQ ID NO: 1210052 - protein, 9 aa, Homo Sapiens
PHKTHRGLR

SEQ ID NO: 1210053 - protein, 9 aa, Homo Sapiens
DGTMYGNDE

SEQ ID NO: 1210054 - protein, 9 aa, Homo Sapiens
GYRECLANV

SEQ ID NO: 1210055 - protein, 9 aa, Homo Sapiens
GFPFSFHLP

SEQ ID NO: 1210056 - protein, 9 aa, Homo Sapiens
FEEQAKAKD

SEQ ID NO: 1210057 - protein, 9 aa, Homo Sapiens
LIQLFHKKL

SEQ ID NO: 1210058 - protein, 9 aa, Homo Sapiens
LSYVEVLTD

SEQ ID NO: 1210059 - protein, 9 aa, Homo Sapiens
STVAGGKYD

SEQ ID NO: 1210060 - protein, 9 aa, Homo Sapiens
CQVLLDVRA

SEQ ID NO: 1210061 - protein, 9 aa, Homo Sapiens
LAYRYYPEG

SEQ ID NO: 1210062 - protein, 9 aa, Homo Sapiens
VRGSCGWWA

SEQ ID NO: 1210063 - protein, 9 aa, Homo Sapiens
WPLSRTHSE

SEQ ID NO: 1210064 - protein, 9 aa, Homo Sapiens
AACGGRERR

SEQ ID NO: 1210065 - protein, 9 aa, Homo Sapiens
NSRYLSKGV

SEQ ID NO: 1210066 - protein, 9 aa, Homo Sapiens
NRVNIAYLA

SEQ ID NO: 1210067 - protein, 9 aa, Homo Sapiens
NHLAKIFYF

SEQ ID NO: 1210068 - protein, 9 aa, Homo Sapiens
ILKACVRGF

SEQ ID NO: 1210069 - protein, 9 aa, Homo Sapiens
VVHDEYIFI

SEQ ID NO: 1210070 - protein, 9 aa, Homo Sapiens
VLVCPPPPL

SEQ ID NO: 1210071 - protein, 9 aa, Homo Sapiens
KKNFLLSGT

SEQ ID NO: 1210072 - protein, 9 aa, Homo Sapiens
HASRPLPTV

SEQ ID NO: 1210073 - protein, 9 aa, Homo Sapiens
KDKRNSSDN

SEQ ID NO: 1210074 - protein, 9 aa, Homo Sapiens
HVNDIMLVK

SEQ ID NO: 1210075 - protein, 9 aa, Homo Sapiens
TRDADEYYR

SEQ ID NO: 1210076 - protein, 9 aa, Homo Sapiens
LRTDASGTT

SEQ ID NO: 1210077 - protein, 9 aa, Homo Sapiens
ALKKYVWIM

SEQ ID NO: 1210078 - protein, 9 aa, Homo Sapiens
QTQENTEYT

SEQ ID NO: 1210079 - protein, 9 aa, Homo Sapiens
QFAAVIMRI

SEQ ID NO: 1210080 - protein, 9 aa, Homo Sapiens
GEIGRDRIV

SEQ ID NO: 1210081 - protein, 9 aa, Homo Sapiens
KRAFYPNQD

SEQ ID NO: 1210082 - protein, 9 aa, Homo Sapiens
FSDPVFISK

SEQ ID NO: 1210083 - protein, 9 aa, Homo Sapiens
KEVEFLQKL

SEQ ID NO: 1210084 - protein, 9 aa, Homo Sapiens
AMHCPQCQI

SEQ ID NO: 1210085 - protein, 9 aa, Homo Sapiens
MEQKDYDSH

SEQ ID NO: 1210086 - protein, 9 aa, Homo Sapiens
QSALCPGPG

SEQ ID NO: 1210087 - protein, 9 aa, Homo Sapiens
MAAGSRCHG

SEQ ID NO: 1210088 - protein, 9 aa, Homo Sapiens
ALCTCLPSK

SEQ ID NO: 1210089 - protein, 9 aa, Homo Sapiens
YLKDYKPTR

SEQ ID NO: 1210090 - protein, 9 aa, Homo Sapiens
APPEHRELC

SEQ ID NO: 1210091 - protein, 9 aa, Homo Sapiens
RHEYFNVSV

SEQ ID NO: 1210092 - protein, 9 aa, Homo Sapiens
VPDHGRDQG

SEQ ID NO: 1210093 - protein, 9 aa, Homo Sapiens
LKHMDMVLP

SEQ ID NO: 1210094 - protein, 9 aa, Homo Sapiens
CFYVGLLFF

SEQ ID NO: 1210095 - protein, 9 aa, Homo Sapiens
FLPPSWRKI

SEQ ID NO: 1210096 - protein, 9 aa, Homo Sapiens
GKDKECVLE

SEQ ID NO: 1210097 - protein, 9 aa, Homo Sapiens
PRAPSGPHY

SEQ ID NO: 1210098 - protein, 9 aa, Homo Sapiens
KYIFDLPLK

SEQ ID NO: 1210099 - protein, 9 aa, Homo Sapiens
KLWYKPMEQ

SEQ ID NO: 1210100 - protein, 9 aa, Homo Sapiens
LFLTHFTVL

SEQ ID NO: 1210101 - protein, 9 aa, Homo Sapiens
GCCGSFIPA

SEQ ID NO: 1210102 - protein, 9 aa, Homo Sapiens
ESGTRDPHI

SEQ ID NO: 1210103 - protein, 9 aa, Homo Sapiens
TKCATILDI

SEQ ID NO: 1210104 - protein, 9 aa, Homo Sapiens
KGFTTLFTF

SEQ ID NO: 1210105 - protein, 9 aa, Homo Sapiens
ALKLVAAAN

SEQ ID NO: 1210106 - protein, 9 aa, Homo Sapiens
MGNLVNMSF

SEQ ID NO: 1210107 - protein, 9 aa, Homo Sapiens
HRPPHISTD

SEQ ID NO: 1210108 - protein, 9 aa, Homo Sapiens
SSNCTTVSL

SEQ ID NO: 1210109 - protein, 9 aa, Homo Sapiens
TMITKRPAQ

SEQ ID NO: 1210110 - protein, 9 aa, Homo Sapiens
PDAQDITSK

SEQ ID NO: 1210111 - protein, 9 aa, Homo Sapiens
RDTKEAITN

SEQ ID NO: 1210112 - protein, 9 aa, Homo Sapiens
LPRVTRCYR

SEQ ID NO: 1210113 - protein, 9 aa, Homo Sapiens
HFRLTRDIV

SEQ ID NO: 1210114 - protein, 9 aa, Homo Sapiens
CYASGGSHP

SEQ ID NO: 1210115 - protein, 9 aa, Homo Sapiens
GDLMYLLKT

SEQ ID NO: 1210116 - protein, 9 aa, Homo Sapiens
ELLSASVSH

SEQ ID NO: 1210117 - protein, 9 aa, Homo Sapiens
GNQNCSVGA

SEQ ID NO: 1210118 - protein, 9 aa, Homo Sapiens
GVNGLSIGL

SEQ ID NO: 1210119 - protein, 9 aa, Homo Sapiens
HVDLLGAQE

SEQ ID NO: 1210120 - protein, 9 aa, Homo Sapiens
MALAYALVV

SEQ ID NO: 1210121 - protein, 9 aa, Homo Sapiens
LARYDSICQ

SEQ ID NO: 1210122 - protein, 9 aa, Homo Sapiens
DVGSMKTLM

SEQ ID NO: 1210123 - protein, 9 aa, Homo Sapiens
VTSMSEITT

SEQ ID NO: 1210124 - protein, 9 aa, Homo Sapiens
FSSVSASRP

SEQ ID NO: 1210125 - protein, 9 aa, Homo Sapiens
KGDLLRRTP

SEQ ID NO: 1210126 - protein, 9 aa, Homo Sapiens
IVSRDITRG

SEQ ID NO: 1210127 - protein, 9 aa, Homo Sapiens
SSALGPLGS

SEQ ID NO: 1210128 - protein, 9 aa, Homo Sapiens
LSYSTTPGH

SEQ ID NO: 1210129 - protein, 9 aa, Homo Sapiens
IKSLTCSYA

SEQ ID NO: 1210130 - protein, 9 aa, Homo Sapiens
NRIYSDTVQ

SEQ ID NO: 1210131 - protein, 9 aa, Homo Sapiens
LEIFEWFLN

SEQ ID NO: 1210132 - protein, 9 aa, Homo Sapiens
KRWQDIYKQ

SEQ ID NO: 1210133 - protein, 9 aa, Homo Sapiens
EEHLSSSGR

SEQ ID NO: 1210134 - protein, 9 aa, Homo Sapiens
NSQSTGATN

SEQ ID NO: 1210135 - protein, 9 aa, Homo Sapiens
SEAVWRMPE

SEQ ID NO: 1210136 - protein, 9 aa, Homo Sapiens
ITSNMPISS

SEQ ID NO: 1210137 - protein, 9 aa, Homo Sapiens
TMDLTVGVG

SEQ ID NO: 1210138 - protein, 9 aa, Homo Sapiens
CPMTLLSTL

SEQ ID NO: 1210139 - protein, 9 aa, Homo Sapiens
VIMAKEGGA

SEQ ID NO: 1210140 - protein, 9 aa, Homo Sapiens
AYAVMKNFG

SEQ ID NO: 1210141 - protein, 9 aa, Homo Sapiens
KRRQKCEWV

SEQ ID NO: 1210142 - protein, 9 aa, Homo Sapiens
KGIATLAMV

SEQ ID NO: 1210143 - protein, 9 aa, Homo Sapiens
VGFRAIALL

SEQ ID NO: 1210144 - protein, 9 aa, Homo Sapiens
PPASQGRRP

SEQ ID NO: 1210145 - protein, 9 aa, Homo Sapiens
RRPPSGMEH

SEQ ID NO: 1210146 - protein, 9 aa, Homo Sapiens
CKAGEQQET

SEQ ID NO: 1210147 - protein, 9 aa, Homo Sapiens
EEQQLRPQA

SEQ ID NO: 1210148 - protein, 9 aa, Homo Sapiens
TAKQTEDNM

SEQ ID NO: 1210149 - protein, 9 aa, Homo Sapiens
RLETLVCKA

SEQ ID NO: 1210150 - protein, 9 aa, Homo Sapiens
EVMKLVCAD

SEQ ID NO: 1210151 - protein, 9 aa, Homo Sapiens
ETRTSSHLH

SEQ ID NO: 1210152 - protein, 9 aa, Homo Sapiens
KQQKREAEE

SEQ ID NO: 1210153 - protein, 9 aa, Homo Sapiens
SFLTMLKPR

SEQ ID NO: 1210154 - protein, 9 aa, Homo Sapiens
PPMSLSAGA

SEQ ID NO: 1210155 - protein, 9 aa, Homo Sapiens
KQHSSSINV

SEQ ID NO: 1210156 - protein, 9 aa, Homo Sapiens
GQVWCPSRC

SEQ ID NO: 1210157 - protein, 9 aa, Homo Sapiens
CFIYNVDLM

SEQ ID NO: 1210158 - protein, 9 aa, Homo Sapiens
NKHINNDVN

SEQ ID NO: 1210159 - protein, 9 aa, Homo Sapiens
IPYYSNMVF

SEQ ID NO: 1210160 - protein, 9 aa, Homo Sapiens
WLSAGQTDA

SEQ ID NO: 1210161 - protein, 9 aa, Homo Sapiens
YHRSRCGHS

SEQ ID NO: 1210162 - protein, 9 aa, Homo Sapiens
TCCLGMQHR

SEQ ID NO: 1210163 - protein, 9 aa, Homo Sapiens
VRDSAKLFL

SEQ ID NO: 1210164 - protein, 9 aa, Homo Sapiens
DLVISKETD

SEQ ID NO: 1210165 - protein, 9 aa, Homo Sapiens
AARDEHQLM

SEQ ID NO: 1210166 - protein, 9 aa, Homo Sapiens
HGFFGGQQS

SEQ ID NO: 1210167 - protein, 9 aa, Homo Sapiens
LCDLISLSI

SEQ ID NO: 1210168 - protein, 9 aa, Homo Sapiens
PFWYEMRLL

SEQ ID NO: 1210169 - protein, 9 aa, Homo Sapiens
IPVTEDFYS

SEQ ID NO: 1210170 - protein, 9 aa, Homo Sapiens
CFGDGSLIA

SEQ ID NO: 1210171 - protein, 9 aa, Homo Sapiens
KIRMYNVRA

SEQ ID NO: 1210172 - protein, 9 aa, Homo Sapiens
PHISNKPKS

SEQ ID NO: 1210173 - protein, 9 aa, Homo Sapiens
LACSNTRII

SEQ ID NO: 1210174 - protein, 9 aa, Homo Sapiens
QAPGIEEAD

SEQ ID NO: 1210175 - protein, 9 aa, Homo Sapiens
ETQHRGRGR

SEQ ID NO: 1210176 - protein, 9 aa, Homo Sapiens
ACIPLDRKD

SEQ ID NO: 1210177 - protein, 9 aa, Homo Sapiens
LPLTRVVYA

SEQ ID NO: 1210178 - protein, 9 aa, Homo Sapiens
SFKKYQRHH

SEQ ID NO: 1210179 - protein, 9 aa, Homo Sapiens
LARTSAGEP

SEQ ID NO: 1210180 - protein, 9 aa, Homo Sapiens
LCGLAVGIA

SEQ ID NO: 1210181 - protein, 9 aa, Homo Sapiens
HIHIDHIDK

SEQ ID NO: 1210182 - protein, 9 aa, Homo Sapiens
SGHQSFMTP

SEQ ID NO: 1210183 - protein, 9 aa, Homo Sapiens
YHVVGLVVG

SEQ ID NO: 1210184 - protein, 9 aa, Homo Sapiens
ASLPRCAPP

SEQ ID NO: 1210185 - protein, 9 aa, Homo Sapiens
IQVMLDTAH

SEQ ID NO: 1210186 - protein, 9 aa, Homo Sapiens
DSENVPPSN

SEQ ID NO: 1210187 - protein, 9 aa, Homo Sapiens
VSTPDSVTI

SEQ ID NO: 1210188 - protein, 9 aa, Homo Sapiens
DIGPPVSGP

SEQ ID NO: 1210189 - protein, 9 aa, Homo Sapiens
VCSTQGVER

SEQ ID NO: 1210190 - protein, 9 aa, Homo Sapiens
VVDGLRVRE

SEQ ID NO: 1210191 - protein, 9 aa, Homo Sapiens
SGVPPPYPR

SEQ ID NO: 1210192 - protein, 9 aa, Homo Sapiens
ILWCLARDP

SEQ ID NO: 1210193 - protein, 9 aa, Homo Sapiens
VRRSVMRRF

SEQ ID NO: 1210194 - protein, 9 aa, Homo Sapiens
DHFIAICNP

SEQ ID NO: 1210195 - protein, 9 aa, Homo Sapiens
TSLASLCSE

SEQ ID NO: 1210196 - protein, 9 aa, Homo Sapiens
IQRELLSIL

SEQ ID NO: 1210197 - protein, 9 aa, Homo Sapiens
QGYVPDHGR

SEQ ID NO: 1210198 - protein, 9 aa, Homo Sapiens
TPPHRVSRL

SEQ ID NO: 1210199 - protein, 9 aa, Homo Sapiens
WPWHEVEAP

SEQ ID NO: 1210200 - protein, 9 aa, Homo Sapiens
SLIKSHNDF

SEQ ID NO: 1210201 - protein, 9 aa, Homo Sapiens
GNPGLNGRN

SEQ ID NO: 1210202 - protein, 9 aa, Homo Sapiens
TLELFLIDN

SEQ ID NO: 1210203 - protein, 9 aa, Homo Sapiens
LDPDEEHRI

SEQ ID NO: 1210204 - protein, 9 aa, Homo Sapiens
FNMCLTRER

SEQ ID NO: 1210205 - protein, 9 aa, Homo Sapiens
STMKIEIIA

SEQ ID NO: 1210206 - protein, 9 aa, Homo Sapiens
WQRLEDAQL

SEQ ID NO: 1210207 - protein, 9 aa, Homo Sapiens
PALSPKPAV

SEQ ID NO: 1210208 - protein, 9 aa, Homo Sapiens
SKQLPWVRV

SEQ ID NO: 1210209 - protein, 9 aa, Homo Sapiens
IDLLRVVHV

SEQ ID NO: 1210210 - protein, 9 aa, Homo Sapiens
SIFLEVDPM

SEQ ID NO: 1210211 - protein, 9 aa, Homo Sapiens
KPKTLLLDK

SEQ ID NO: 1210212 - protein, 9 aa, Homo Sapiens
VLKEMVVFP

SEQ ID NO: 1210213 - protein, 9 aa, Homo Sapiens
CDSEESGNF

SEQ ID NO: 1210214 - protein, 9 aa, Homo Sapiens
WGECTWDCG

SEQ ID NO: 1210215 - protein, 9 aa, Homo Sapiens
NFSSISMTP

SEQ ID NO: 1210216 - protein, 9 aa, Homo Sapiens
LAGNMWDCG

SEQ ID NO: 1210217 - protein, 9 aa, Homo Sapiens
ICLKASIKG

SEQ ID NO: 1210218 - protein, 9 aa, Homo Sapiens
IKMYILVQY

SEQ ID NO: 1210219 - protein, 9 aa, Homo Sapiens
LLKENDVPT

SEQ ID NO: 1210220 - protein, 9 aa, Homo Sapiens
TQSVLISLF

SEQ ID NO: 1210221 - protein, 9 aa, Homo Sapiens
DTKLALIKE

SEQ ID NO: 1210222 - protein, 9 aa, Homo Sapiens
FRNIYKSML

SEQ ID NO: 1210223 - protein, 9 aa, Homo Sapiens
CPAMVQTED

SEQ ID NO: 1210224 - protein, 9 aa, Homo Sapiens
CHFLPLLEK

SEQ ID NO: 1210225 - protein, 9 aa, Homo Sapiens
LRGARVSLP

SEQ ID NO: 1210226 - protein, 9 aa, Homo Sapiens
SALSGHLGT

SEQ ID NO: 1210227 - protein, 9 aa, Homo Sapiens
QMKDIYHYI

SEQ ID NO: 1210228 - protein, 9 aa, Homo Sapiens
WHEEHCGML

SEQ ID NO: 1210229 - protein, 9 aa, Homo Sapiens
ATSDRIKQE

SEQ ID NO: 1210230 - protein, 9 aa, Homo Sapiens
VVLEARAPH

SEQ ID NO: 1210231 - protein, 9 aa, Homo Sapiens
IAQRCRISK

SEQ ID NO: 1210232 - protein, 9 aa, Homo Sapiens
LYTVGTKPL

SEQ ID NO: 1210233 - protein, 9 aa, Homo Sapiens
PRERLKEML

SEQ ID NO: 1210234 - protein, 9 aa, Homo Sapiens
TTTLKLILV

SEQ ID NO: 1210235 - protein, 9 aa, Homo Sapiens
RPWRTVPGH

SEQ ID NO: 1210236 - protein, 9 aa, Homo Sapiens
TIFLRQLVI

SEQ ID NO: 1210237 - protein, 9 aa, Homo Sapiens
PEVIQVYIG

SEQ ID NO: 1210238 - protein, 9 aa, Homo Sapiens
QPLSVMVSM

SEQ ID NO: 1210239 - protein, 9 aa, Homo Sapiens
FIHHNCAPE

SEQ ID NO: 1210240 - protein, 9 aa, Homo Sapiens
ETMSRFCEA

SEQ ID NO: 1210241 - protein, 9 aa, Homo Sapiens
TGWFTFLLT

SEQ ID NO: 1210242 - protein, 9 aa, Homo Sapiens
HAPPLAANG

SEQ ID NO: 1210243 - protein, 9 aa, Homo Sapiens
GGANVNLQE

SEQ ID NO: 1210244 - protein, 9 aa, Homo Sapiens
RAHAGLPCL

SEQ ID NO: 1210245 - protein, 9 aa, Homo Sapiens
RTYPITTTF

SEQ ID NO: 1210246 - protein, 9 aa, Homo Sapiens
SRRETKMLH

SEQ ID NO: 1210247 - protein, 9 aa, Homo Sapiens
TTPVCTLSA

SEQ ID NO: 1210248 - protein, 9 aa, Homo Sapiens
DLYLESDEV

SEQ ID NO: 1210249 - protein, 9 aa, Homo Sapiens
NAPQVSDGS

SEQ ID NO: 1210250 - protein, 9 aa, Homo Sapiens
SRLITLYPT

SEQ ID NO: 1210251 - protein, 9 aa, Homo Sapiens
HFQSSAVMA

SEQ ID NO: 1210252 - protein, 9 aa, Homo Sapiens
MGSNLTLAK

SEQ ID NO: 1210253 - protein, 9 aa, Homo Sapiens
DSQLVVTLH

SEQ ID NO: 1210254 - protein, 9 aa, Homo Sapiens
SRPDRQPDF

SEQ ID NO: 1210255 - protein, 9 aa, Homo Sapiens
EEVLHILHS

SEQ ID NO: 1210256 - protein, 9 aa, Homo Sapiens
ATMITKRPA

SEQ ID NO: 1210257 - protein, 9 aa, Homo Sapiens
SSLVKDTRQ

SEQ ID NO: 1210258 - protein, 9 aa, Homo Sapiens
PPPSTCLDG

SEQ ID NO: 1210259 - protein, 9 aa, Homo Sapiens
LQVILLSQP

SEQ ID NO: 1210260 - protein, 9 aa, Homo Sapiens
TDCFHCTCL

SEQ ID NO: 1210261 - protein, 9 aa, Homo Sapiens
VTWITSFYN

SEQ ID NO: 1210262 - protein, 9 aa, Homo Sapiens
GKCPAEDDI

SEQ ID NO: 1210263 - protein, 9 aa, Homo Sapiens
AMVHLKVAA

SEQ ID NO: 1210264 - protein, 9 aa, Homo Sapiens
QAKTFSEAC

SEQ ID NO: 1210265 - protein, 9 aa, Homo Sapiens
RVPRDAGHL

SEQ ID NO: 1210266 - protein, 9 aa, Homo Sapiens
YEERCFMCQ

SEQ ID NO: 1210267 - protein, 9 aa, Homo Sapiens
VQNNIPQLN

SEQ ID NO: 1210268 - protein, 9 aa, Homo Sapiens
TVGLVALTR

SEQ ID NO: 1210269 - protein, 9 aa, Homo Sapiens
ALRCGTVRR

SEQ ID NO: 1210270 - protein, 9 aa, Homo Sapiens
YTCNECGNV

SEQ ID NO: 1210271 - protein, 9 aa, Homo Sapiens
CMAIRNPLE

SEQ ID NO: 1210272 - protein, 9 aa, Homo Sapiens
APAASLEVR

SEQ ID NO: 1210273 - protein, 9 aa, Homo Sapiens
LTVSNFSNQ

SEQ ID NO: 1210274 - protein, 9 aa, Homo Sapiens
IKSCAGYCV

SEQ ID NO: 1210275 - protein, 9 aa, Homo Sapiens
VHGLQGVPG

SEQ ID NO: 1210276 - protein, 9 aa, Homo Sapiens
PSVNQIGSG

SEQ ID NO: 1210277 - protein, 9 aa, Homo Sapiens
QSEDDVHRL

SEQ ID NO: 1210278 - protein, 9 aa, Homo Sapiens
RPTRKVAVQ

SEQ ID NO: 1210279 - protein, 9 aa, Homo Sapiens
YPKEWHHLT

SEQ ID NO: 1210280 - protein, 9 aa, Homo Sapiens
RDRGELFCC

SEQ ID NO: 1210281 - protein, 9 aa, Homo Sapiens
SMSTLRSAK

SEQ ID NO: 1210282 - protein, 9 aa, Homo Sapiens
DATRLESSQ

SEQ ID NO: 1210283 - protein, 9 aa, Homo Sapiens
ATTIPPSQV

SEQ ID NO: 1210284 - protein, 9 aa, Homo Sapiens
GATALPLYF

SEQ ID NO: 1210285 - protein, 9 aa, Homo Sapiens
ALPNGLGNT

SEQ ID NO: 1210286 - protein, 9 aa, Homo Sapiens
TVFQWRMDG

SEQ ID NO: 1210287 - protein, 9 aa, Homo Sapiens
NEEGTELQV

SEQ ID NO: 1210288 - protein, 9 aa, Homo Sapiens
QPSRGKSRW

SEQ ID NO: 1210289 - protein, 9 aa, Homo Sapiens
EKAQVVLTE

SEQ ID NO: 1210290 - protein, 9 aa, Homo Sapiens
TEGGQSSTT

SEQ ID NO: 1210291 - protein, 9 aa, Homo Sapiens
LYPCMEVLV

SEQ ID NO: 1210292 - protein, 9 aa, Homo Sapiens
KGSMGPWGT

SEQ ID NO: 1210293 - protein, 9 aa, Homo Sapiens
SIAPKQRPK

SEQ ID NO: 1210294 - protein, 9 aa, Homo Sapiens
ILVSDICAR

SEQ ID NO: 1210295 - protein, 9 aa, Homo Sapiens
SRGTPSGTH

SEQ ID NO: 1210296 - protein, 9 aa, Homo Sapiens
RRVTRMVVS

SEQ ID NO: 1210297 - protein, 9 aa, Homo Sapiens
HVVISLMVA

SEQ ID NO: 1210298 - protein, 9 aa, Homo Sapiens
CTLCIAKKV

SEQ ID NO: 1210299 - protein, 9 aa, Homo Sapiens
TSSNSAFQS

SEQ ID NO: 1210300 - protein, 9 aa, Homo Sapiens
NLDDFDPLE

SEQ ID NO: 1210301 - protein, 9 aa, Homo Sapiens
PISICLGSF

SEQ ID NO: 1210302 - protein, 9 aa, Homo Sapiens
DWNEGKNAT

SEQ ID NO: 1210303 - protein, 9 aa, Homo Sapiens
KTAVRLLLP

SEQ ID NO: 1210304 - protein, 9 aa, Homo Sapiens
GAYTSGTPS

SEQ ID NO: 1210305 - protein, 9 aa, Homo Sapiens
ESTIHRTSE

SEQ ID NO: 1210306 - protein, 9 aa, Homo Sapiens
SPTCQKMSP

SEQ ID NO: 1210307 - protein, 9 aa, Homo Sapiens
INYLPKCIR

SEQ ID NO: 1210308 - protein, 9 aa, Homo Sapiens
KGERGEQGI

SEQ ID NO: 1210309 - protein, 9 aa, Homo Sapiens
EVHLCCELS

SEQ ID NO: 1210310 - protein, 9 aa, Homo Sapiens
KSMTDIYML

SEQ ID NO: 1210311 - protein, 9 aa, Homo Sapiens
AEIKNGLLH

SEQ ID NO: 1210312 - protein, 9 aa, Homo Sapiens
HMLFYTMKP

SEQ ID NO: 1210313 - protein, 9 aa, Homo Sapiens
TCCQCCPGP

SEQ ID NO: 1210314 - protein, 9 aa, Homo Sapiens
LGLAKGRGG

SEQ ID NO: 1210315 - protein, 9 aa, Homo Sapiens
TSFPILLYS

SEQ ID NO: 1210316 - protein, 9 aa, Homo Sapiens
ASEATQVVA

SEQ ID NO: 1210317 - protein, 9 aa, Homo Sapiens
SGIECMGPL

SEQ ID NO: 1210318 - protein, 9 aa, Homo Sapiens
TRICTVSYE

SEQ ID NO: 1210319 - protein, 9 aa, Homo Sapiens
LHSPALPCP

SEQ ID NO: 1210320 - protein, 9 aa, Homo Sapiens
ETEDELDEQ

SEQ ID NO: 1210321 - protein, 9 aa, Homo Sapiens
LTADYGFPD

SEQ ID NO: 1210322 - protein, 9 aa, Homo Sapiens
FECKNADPI

SEQ ID NO: 1210323 - protein, 9 aa, Homo Sapiens
PLTIYHAID

SEQ ID NO: 1210324 - protein, 9 aa, Homo Sapiens
LKKDDVCVN

SEQ ID NO: 1210325 - protein, 9 aa, Homo Sapiens
LEKVHFWVG

SEQ ID NO: 1210326 - protein, 9 aa, Homo Sapiens
SQVIIIVGP

SEQ ID NO: 1210327 - protein, 9 aa, Homo Sapiens
INLWLFLFQ

SEQ ID NO: 1210328 - protein, 9 aa, Homo Sapiens
HSRPYMAHL

SEQ ID NO: 1210329 - protein, 9 aa, Homo Sapiens
RTISMQAIL

SEQ ID NO: 1210330 - protein, 9 aa, Homo Sapiens
TAWRVWRFA

SEQ ID NO: 1210331 - protein, 9 aa, Homo Sapiens
TDWESWCEI

SEQ ID NO: 1210332 - protein, 9 aa, Homo Sapiens
GIGGGGFHS

SEQ ID NO: 1210333 - protein, 9 aa, Homo Sapiens
VFHKYTKGN

SEQ ID NO: 1210334 - protein, 9 aa, Homo Sapiens
PLQLPLRGS

SEQ ID NO: 1210335 - protein, 9 aa, Homo Sapiens
VTVYTFSIE

SEQ ID NO: 1210336 - protein, 9 aa, Homo Sapiens
QRWYVRRSS

SEQ ID NO: 1210337 - protein, 9 aa, Homo Sapiens
EHCGMLRED

SEQ ID NO: 1210338 - protein, 9 aa, Homo Sapiens
KEDNKTLKI

SEQ ID NO: 1210339 - protein, 9 aa, Homo Sapiens
SVGSDEEDE

SEQ ID NO: 1210340 - protein, 9 aa, Homo Sapiens
MTIKENINK

SEQ ID NO: 1210341 - protein, 9 aa, Homo Sapiens
FAHVVDFVP

SEQ ID NO: 1210342 - protein, 9 aa, Homo Sapiens
SKNVMFTRY

SEQ ID NO: 1210343 - protein, 9 aa, Homo Sapiens
PSDWEAFAT

SEQ ID NO: 1210344 - protein, 9 aa, Homo Sapiens
FYTPNSSHW

SEQ ID NO: 1210345 - protein, 9 aa, Homo Sapiens
GDEDYTGAT

SEQ ID NO: 1210346 - protein, 9 aa, Homo Sapiens
ITHTGEKPF

SEQ ID NO: 1210347 - protein, 9 aa, Homo Sapiens
TVIGVFLNL

SEQ ID NO: 1210348 - protein, 9 aa, Homo Sapiens
TVHVCNECG

SEQ ID NO: 1210349 - protein, 9 aa, Homo Sapiens
DSGQNTWLS

SEQ ID NO: 1210350 - protein, 9 aa, Homo Sapiens
WARGGCLPL

SEQ ID NO: 1210351 - protein, 9 aa, Homo Sapiens
MPLHHGLTQ

SEQ ID NO: 1210352 - protein, 9 aa, Homo Sapiens
LECGDQTRS

SEQ ID NO: 1210353 - protein, 9 aa, Homo Sapiens
PVTGTVSGQ

SEQ ID NO: 1210354 - protein, 9 aa, Homo Sapiens
LRNSISAFM

SEQ ID NO: 1210355 - protein, 9 aa, Homo Sapiens
TRKHYECSK

SEQ ID NO: 1210356 - protein, 9 aa, Homo Sapiens
PEEMAEYCN

SEQ ID NO: 1210357 - protein, 9 aa, Homo Sapiens
SEIERHAQV

SEQ ID NO: 1210358 - protein, 9 aa, Homo Sapiens
SVSVRTPEE

SEQ ID NO: 1210359 - protein, 9 aa, Homo Sapiens
LKENPNDLQ

SEQ ID NO: 1210360 - protein, 8 aa, Homo Sapiens
GSNLSPQL

SEQ ID NO: 1210361 - protein, 9 aa, Homo Sapiens
LMVGMYYGA

SEQ ID NO: 1210362 - protein, 9 aa, Homo Sapiens
SLLDLSEGE

SEQ ID NO: 1210363 - protein, 9 aa, Homo Sapiens
NCGDYLVMR

SEQ ID NO: 1210364 - protein, 9 aa, Homo Sapiens
SSLWPCWFG

SEQ ID NO: 1210365 - protein, 9 aa, Homo Sapiens
RIFSYTGDS

SEQ ID NO: 1210366 - protein, 9 aa, Homo Sapiens
AGAREAGRF

SEQ ID NO: 1210367 - protein, 9 aa, Homo Sapiens
VASTQCAGG

SEQ ID NO: 1210368 - protein, 9 aa, Homo Sapiens
DVHKVLSAL

SEQ ID NO: 1210369 - protein, 9 aa, Homo Sapiens
ADMDYVGGY

SEQ ID NO: 1210370 - protein, 9 aa, Homo Sapiens
HNQREFSMT

SEQ ID NO: 1210371 - protein, 9 aa, Homo Sapiens
LVTSEAKVQ

SEQ ID NO: 1210372 - protein, 9 aa, Homo Sapiens
TLKLILVML

SEQ ID NO: 1210373 - protein, 9 aa, Homo Sapiens
LSTRIVGCI

SEQ ID NO: 1210374 - protein, 9 aa, Homo Sapiens
VVFCPLKAD

SEQ ID NO: 1210375 - protein, 9 aa, Homo Sapiens
WYKGQMKDI

SEQ ID NO: 1210376 - protein, 9 aa, Homo Sapiens
EESLVMMVR

SEQ ID NO: 1210377 - protein, 9 aa, Homo Sapiens
TCFIPNRVI

SEQ ID NO: 1210378 - protein, 9 aa, Homo Sapiens
RSALSVYPL

SEQ ID NO: 1210379 - protein, 9 aa, Homo Sapiens
KDKARTLYT

SEQ ID NO: 1210380 - protein, 9 aa, Homo Sapiens
ATLEGGSRV

SEQ ID NO: 1210381 - protein, 9 aa, Homo Sapiens
PPVKFSSEP

SEQ ID NO: 1210382 - protein, 9 aa, Homo Sapiens
GSPKPATKS

SEQ ID NO: 1210383 - protein, 9 aa, Homo Sapiens
GTDCECCLP

SEQ ID NO: 1210384 - protein, 9 aa, Homo Sapiens
ELIDQDDRD

SEQ ID NO: 1210385 - protein, 9 aa, Homo Sapiens
KLMQQALQG

SEQ ID NO: 1210386 - protein, 9 aa, Homo Sapiens
RKGENEYAN

SEQ ID NO: 1210387 - protein, 9 aa, Homo Sapiens
LGTVILGLL

SEQ ID NO: 1210388 - protein, 9 aa, Homo Sapiens
SFLQCIMQT

SEQ ID NO: 1210389 - protein, 9 aa, Homo Sapiens
EVHVTKLID

SEQ ID NO: 1210390 - protein, 9 aa, Homo Sapiens
GNCYQCGKQ

SEQ ID NO: 1210391 - protein, 9 aa, Homo Sapiens
VLGPNAWRP

SEQ ID NO: 1210392 - protein, 9 aa, Homo Sapiens
RLQQEEVQK

SEQ ID NO: 1210393 - protein, 9 aa, Homo Sapiens
AKHNTSILW

SEQ ID NO: 1210394 - protein, 9 aa, Homo Sapiens
SLRGEGHGL

SEQ ID NO: 1210395 - protein, 9 aa, Homo Sapiens
ENEVSMQHL

SEQ ID NO: 1210396 - protein, 9 aa, Homo Sapiens
SNSSVLADK

SEQ ID NO: 1210397 - protein, 9 aa, Homo Sapiens
QHVVTVEAY

SEQ ID NO: 1210398 - protein, 9 aa, Homo Sapiens
PPLRALAEH

SEQ ID NO: 1210399 - protein, 9 aa, Homo Sapiens
SPCSLSAPA

SEQ ID NO: 1210400 - protein, 9 aa, Homo Sapiens
CMVHTSEKL

SEQ ID NO: 1210401 - protein, 9 aa, Homo Sapiens
QENEGVEQA

SEQ ID NO: 1210402 - protein, 9 aa, Homo Sapiens
TWLSYRLLK

SEQ ID NO: 1210403 - protein, 9 aa, Homo Sapiens
LLLLCHLLA

SEQ ID NO: 1210404 - protein, 9 aa, Homo Sapiens
FPLEAPRTQ

SEQ ID NO: 1210405 - protein, 9 aa, Homo Sapiens
EMMQFLNDR

SEQ ID NO: 1210406 - protein, 9 aa, Homo Sapiens
VDILGLRII

SEQ ID NO: 1210407 - protein, 9 aa, Homo Sapiens
IPNDLKKGL

SEQ ID NO: 1210408 - protein, 9 aa, Homo Sapiens
KQHIVLKLM

SEQ ID NO: 1210409 - protein, 9 aa, Homo Sapiens
SRLARAVRE

SEQ ID NO: 1210410 - protein, 9 aa, Homo Sapiens
GPRTRPQKP

SEQ ID NO: 1210411 - protein, 9 aa, Homo Sapiens
LVGDLSIFF

SEQ ID NO: 1210412 - protein, 9 aa, Homo Sapiens
PLSCFTLFE

SEQ ID NO: 1210413 - protein, 9 aa, Homo Sapiens
SPLERTRYS

SEQ ID NO: 1210414 - protein, 9 aa, Homo Sapiens
ELEKIDDYT

SEQ ID NO: 1210415 - protein, 9 aa, Homo Sapiens
KWISHDPKI

SEQ ID NO: 1210416 - protein, 9 aa, Homo Sapiens
GNDFAATRL

SEQ ID NO: 1210417 - protein, 9 aa, Homo Sapiens
RIVDALQTA

SEQ ID NO: 1210418 - protein, 9 aa, Homo Sapiens
SFLECGVQS

SEQ ID NO: 1210419 - protein, 9 aa, Homo Sapiens
SNINSPTKI

SEQ ID NO: 1210420 - protein, 9 aa, Homo Sapiens
LVVFLYMWS

SEQ ID NO: 1210421 - protein, 9 aa, Homo Sapiens
TQVDTRESD

SEQ ID NO: 1210422 - protein, 9 aa, Homo Sapiens
ETEKELAPE

SEQ ID NO: 1210423 - protein, 9 aa, Homo Sapiens
HQPSAPTGI

SEQ ID NO: 1210424 - protein, 9 aa, Homo Sapiens
QIDDYSLCG

SEQ ID NO: 1210425 - protein, 9 aa, Homo Sapiens
LILYISMQL

SEQ ID NO: 1210426 - protein, 9 aa, Homo Sapiens
TITLLKNNK

SEQ ID NO: 1210427 - protein, 9 aa, Homo Sapiens
KITHVDFPP

SEQ ID NO: 1210428 - protein, 9 aa, Homo Sapiens
ATPKIRDNF

SEQ ID NO: 1210429 - protein, 9 aa, Homo Sapiens
ADEQDKEMV

SEQ ID NO: 1210430 - protein, 9 aa, Homo Sapiens
PVEELCVYC

SEQ ID NO: 1210431 - protein, 9 aa, Homo Sapiens
KRWGWNDIN

SEQ ID NO: 1210432 - protein, 9 aa, Homo Sapiens
LMGMALLAA

SEQ ID NO: 1210433 - protein, 9 aa, Homo Sapiens
TFAQAMRMC

SEQ ID NO: 1210434 - protein, 9 aa, Homo Sapiens
SPLQSTPLV

SEQ ID NO: 1210435 - protein, 9 aa, Homo Sapiens
LTALPSSAD

SEQ ID NO: 1210436 - protein, 9 aa, Homo Sapiens
ETLHQLATS

SEQ ID NO: 1210437 - protein, 9 aa, Homo Sapiens
PKDVLGRGT

SEQ ID NO: 1210438 - protein, 9 aa, Homo Sapiens
NAYLVEQSR

SEQ ID NO: 1210439 - protein, 9 aa, Homo Sapiens
APSYESRCQ

SEQ ID NO: 1210440 - protein, 9 aa, Homo Sapiens
VIASVKNKI

SEQ ID NO: 1210441 - protein, 9 aa, Homo Sapiens
GYRWCPKAE

SEQ ID NO: 1210442 - protein, 9 aa, Homo Sapiens
LKLAPLQVT

SEQ ID NO: 1210443 - protein, 9 aa, Homo Sapiens
LCHLLHALS

SEQ ID NO: 1210444 - protein, 9 aa, Homo Sapiens
DFLNRIALM

SEQ ID NO: 1210445 - protein, 9 aa, Homo Sapiens
QMDPNRAFI

SEQ ID NO: 1210446 - protein, 9 aa, Homo Sapiens
VIDINDCPH

SEQ ID NO: 1210447 - protein, 9 aa, Homo Sapiens
NYENNYHEV

SEQ ID NO: 1210448 - protein, 9 aa, Homo Sapiens
HHDAPALCL

SEQ ID NO: 1210449 - protein, 9 aa, Homo Sapiens
MTDNQEDSV

SEQ ID NO: 1210450 - protein, 9 aa, Homo Sapiens
VIQVYIGSF

SEQ ID NO: 1210451 - protein, 9 aa, Homo Sapiens
AHTMAQVDA

SEQ ID NO: 1210452 - protein, 9 aa, Homo Sapiens
NNSTDVQAR

SEQ ID NO: 1210453 - protein, 9 aa, Homo Sapiens
SKPTSNRCT

SEQ ID NO: 1210454 - protein, 9 aa, Homo Sapiens
SAGTIFLID

SEQ ID NO: 1210455 - protein, 9 aa, Homo Sapiens
QRTLASPGP

SEQ ID NO: 1210456 - protein, 9 aa, Homo Sapiens
VGSVPGITK

SEQ ID NO: 1210457 - protein, 9 aa, Homo Sapiens
VSTADRSMR

SEQ ID NO: 1210458 - protein, 9 aa, Homo Sapiens
DRVTDLIML

SEQ ID NO: 1210459 - protein, 9 aa, Homo Sapiens
ANSGARVPP

SEQ ID NO: 1210460 - protein, 9 aa, Homo Sapiens
LATKKYMQA

SEQ ID NO: 1210461 - protein, 9 aa, Homo Sapiens
KYFVLGLPN

SEQ ID NO: 1210462 - protein, 9 aa, Homo Sapiens
KTTMKQLQC

SEQ ID NO: 1210463 - protein, 9 aa, Homo Sapiens
NQARYVSCR

SEQ ID NO: 1210464 - protein, 9 aa, Homo Sapiens
PCPSSSNEH

SEQ ID NO: 1210465 - protein, 9 aa, Homo Sapiens
LYNQALMNM

SEQ ID NO: 1210466 - protein, 9 aa, Homo Sapiens
KQDVHCIHA

SEQ ID NO: 1210467 - protein, 9 aa, Homo Sapiens
EKGKENNKM

SEQ ID NO: 1210468 - protein, 9 aa, Homo Sapiens
GPPRPHVLA

SEQ ID NO: 1210469 - protein, 9 aa, Homo Sapiens
DFCIAAVIK

SEQ ID NO: 1210470 - protein, 9 aa, Homo Sapiens
VGVTRHSGS

SEQ ID NO: 1210471 - protein, 9 aa, Homo Sapiens
RRHDSITSV

SEQ ID NO: 1210472 - protein, 9 aa, Homo Sapiens
MSLTPMIQQ

SEQ ID NO: 1210473 - protein, 9 aa, Homo Sapiens
RTVSLFHLT

SEQ ID NO: 1210474 - protein, 9 aa, Homo Sapiens
CLGSFETYI

SEQ ID NO: 1210475 - protein, 9 aa, Homo Sapiens
MIMQNLEFI

SEQ ID NO: 1210476 - protein, 9 aa, Homo Sapiens
VFVNVQQSN

SEQ ID NO: 1210477 - protein, 9 aa, Homo Sapiens
TMKLRNYFS

SEQ ID NO: 1210478 - protein, 9 aa, Homo Sapiens
NREQCFTSE

SEQ ID NO: 1210479 - protein, 9 aa, Homo Sapiens
DYLHLETLV

SEQ ID NO: 1210480 - protein, 9 aa, Homo Sapiens
CDDILYPNT

SEQ ID NO: 1210481 - protein, 9 aa, Homo Sapiens
KKTLIGTVL

SEQ ID NO: 1210482 - protein, 9 aa, Homo Sapiens
QDDRDLYDA

SEQ ID NO: 1210483 - protein, 9 aa, Homo Sapiens
YNIINALPN

SEQ ID NO: 1210484 - protein, 9 aa, Homo Sapiens
FVTCSSHLT

SEQ ID NO: 1210485 - protein, 9 aa, Homo Sapiens
LYKPSPDYV

SEQ ID NO: 1210486 - protein, 9 aa, Homo Sapiens
QQVLTVHAG

SEQ ID NO: 1210487 - protein, 9 aa, Homo Sapiens
EPESDVFEI

SEQ ID NO: 1210488 - protein, 9 aa, Homo Sapiens
RFAVLGTMV

SEQ ID NO: 1210489 - protein, 9 aa, Homo Sapiens
HYCCALIAL

SEQ ID NO: 1210490 - protein, 9 aa, Homo Sapiens
LMYIFQNVM

SEQ ID NO: 1210491 - protein, 9 aa, Homo Sapiens
AVSSDDKYP

SEQ ID NO: 1210492 - protein, 9 aa, Homo Sapiens
RHNIYVQVI

SEQ ID NO: 1210493 - protein, 9 aa, Homo Sapiens
DRNGSWYPG

SEQ ID NO: 1210494 - protein, 9 aa, Homo Sapiens
YLIRNSESG

SEQ ID NO: 1210495 - protein, 9 aa, Homo Sapiens
TLWIIDCLG

SEQ ID NO: 1210496 - protein, 9 aa, Homo Sapiens
TGSYQCHSW

SEQ ID NO: 1210497 - protein, 9 aa, Homo Sapiens
LVYNSMRTI

SEQ ID NO: 1210498 - protein, 9 aa, Homo Sapiens
MMSSVSRQT

SEQ ID NO: 1210499 - protein, 9 aa, Homo Sapiens
PACPRPSPA

SEQ ID NO: 1210500 - protein, 9 aa, Homo Sapiens
RRERMTFTR

SEQ ID NO: 1210501 - protein, 9 aa, Homo Sapiens
NDTLGSVHT

SEQ ID NO: 1210502 - protein, 9 aa, Homo Sapiens
FVVSGPYIV

SEQ ID NO: 1210503 - protein, 9 aa, Homo Sapiens
HAAGVSRQR

SEQ ID NO: 1210504 - protein, 9 aa, Homo Sapiens
PAAGVQCGV

SEQ ID NO: 1210505 - protein, 9 aa, Homo Sapiens
YNLDFKSPD

SEQ ID NO: 1210506 - protein, 9 aa, Homo Sapiens
GGPGHLHQN

SEQ ID NO: 1210507 - protein, 9 aa, Homo Sapiens
AAAAGILGH

SEQ ID NO: 1210508 - protein, 9 aa, Homo Sapiens
GNDFLQLLL

SEQ ID NO: 1210509 - protein, 9 aa, Homo Sapiens
ELDEKPASP

SEQ ID NO: 1210510 - protein, 9 aa, Homo Sapiens
HVLTERIAN

SEQ ID NO: 1210511 - protein, 9 aa, Homo Sapiens
ADSPPSSPP

SEQ ID NO: 1210512 - protein, 9 aa, Homo Sapiens
LLSSVSSFM

SEQ ID NO: 1210513 - protein, 9 aa, Homo Sapiens
SEGSISALK

SEQ ID NO: 1210514 - protein, 9 aa, Homo Sapiens
IYWLIPSTI

SEQ ID NO: 1210515 - protein, 9 aa, Homo Sapiens
EKKMDIFEF

SEQ ID NO: 1210516 - protein, 9 aa, Homo Sapiens
SSLTSKAQD

SEQ ID NO: 1210517 - protein, 9 aa, Homo Sapiens
SMYLSEKIL

SEQ ID NO: 1210518 - protein, 9 aa, Homo Sapiens
SDAPVTGTV

SEQ ID NO: 1210519 - protein, 9 aa, Homo Sapiens
EDYTMKMSS

SEQ ID NO: 1210520 - protein, 9 aa, Homo Sapiens
YLGGEKRWG

SEQ ID NO: 1210521 - protein, 9 aa, Homo Sapiens
APAAVPLPC

SEQ ID NO: 1210522 - protein, 9 aa, Homo Sapiens
LDGRSRGCG

SEQ ID NO: 1210523 - protein, 9 aa, Homo Sapiens
HKRCQRRGR

SEQ ID NO: 1210524 - protein, 9 aa, Homo Sapiens
GTSSTMRLQ

SEQ ID NO: 1210525 - protein, 9 aa, Homo Sapiens
NPPTQQPIS

SEQ ID NO: 1210526 - protein, 9 aa, Homo Sapiens
TASGWLGWK

SEQ ID NO: 1210527 - protein, 9 aa, Homo Sapiens
IVLKMIVAH

SEQ ID NO: 1210528 - protein, 9 aa, Homo Sapiens
DQKEDRAMS

SEQ ID NO: 1210529 - protein, 9 aa, Homo Sapiens
FCPNHPAIL

SEQ ID NO: 1210530 - protein, 9 aa, Homo Sapiens
GRCCLVNKW

SEQ ID NO: 1210531 - protein, 9 aa, Homo Sapiens
QLHVTATET

SEQ ID NO: 1210532 - protein, 9 aa, Homo Sapiens
RVPDQEPTH

SEQ ID NO: 1210533 - protein, 9 aa, Homo Sapiens
LWKQNSHKL

SEQ ID NO: 1210534 - protein, 9 aa, Homo Sapiens
QTPKKHGLR

SEQ ID NO: 1210535 - protein, 9 aa, Homo Sapiens
DSVSLMRVL

SEQ ID NO: 1210536 - protein, 9 aa, Homo Sapiens
VLDVINLVQ

SEQ ID NO: 1210537 - protein, 9 aa, Homo Sapiens
SWRCCRKCH

SEQ ID NO: 1210538 - protein, 9 aa, Homo Sapiens
ATERRERIG

SEQ ID NO: 1210539 - protein, 9 aa, Homo Sapiens
TCLEAREHC

SEQ ID NO: 1210540 - protein, 9 aa, Homo Sapiens
LNLLKEMSN

SEQ ID NO: 1210541 - protein, 9 aa, Homo Sapiens
LVQLWHLWL

SEQ ID NO: 1210542 - protein, 9 aa, Homo Sapiens
WPLPMCCTP

SEQ ID NO: 1210543 - protein, 9 aa, Homo Sapiens
FFTFKNFFL

SEQ ID NO: 1210544 - protein, 9 aa, Homo Sapiens
KRPLHSSGV

SEQ ID NO: 1210545 - protein, 9 aa, Homo Sapiens
TLEAVVHMN

SEQ ID NO: 1210546 - protein, 9 aa, Homo Sapiens
NDHDNNPAI

SEQ ID NO: 1210547 - protein, 9 aa, Homo Sapiens
KYSSYNNVY

SEQ ID NO: 1210548 - protein, 9 aa, Homo Sapiens
LSVLAHWSV

SEQ ID NO: 1210549 - protein, 9 aa, Homo Sapiens
RQPDFTQID

SEQ ID NO: 1210550 - protein, 9 aa, Homo Sapiens
VELLQSIKD

SEQ ID NO: 1210551 - protein, 9 aa, Homo Sapiens
VNLHFPNQY

SEQ ID NO: 1210552 - protein, 9 aa, Homo Sapiens
TAVWVLNNG

SEQ ID NO: 1210553 - protein, 9 aa, Homo Sapiens
EYDRIAKDW

SEQ ID NO: 1210554 - protein, 9 aa, Homo Sapiens
KQRLNTCGR

SEQ ID NO: 1210555 - protein, 9 aa, Homo Sapiens
KNKRYLNSI

SEQ ID NO: 1210556 - protein, 9 aa, Homo Sapiens
TGRAGRMGV

SEQ ID NO: 1210557 - protein, 9 aa, Homo Sapiens
EQTIISALN

SEQ ID NO: 1210558 - protein, 9 aa, Homo Sapiens
GRSIIVGAG

SEQ ID NO: 1210559 - protein, 9 aa, Homo Sapiens
WFFSADGNT

SEQ ID NO: 1210560 - protein, 9 aa, Homo Sapiens
ILTCIVIPG

SEQ ID NO: 1210561 - protein, 9 aa, Homo Sapiens
KQLSNLCHF

SEQ ID NO: 1210562 - protein, 9 aa, Homo Sapiens
AMRGSPGPL

SEQ ID NO: 1210563 - protein, 9 aa, Homo Sapiens
LHPFGYLQQ

SEQ ID NO: 1210564 - protein, 9 aa, Homo Sapiens
PGRYMGRAV

SEQ ID NO: 1210565 - protein, 9 aa, Homo Sapiens
DTLKGLSSS

SEQ ID NO: 1210566 - protein, 9 aa, Homo Sapiens
TLVTFSDEH

SEQ ID NO: 1210567 - protein, 9 aa, Homo Sapiens
EYGKAFRQS

SEQ ID NO: 1210568 - protein, 9 aa, Homo Sapiens
DEIKFICSH

SEQ ID NO: 1210569 - protein, 9 aa, Homo Sapiens
LVGTSEFLG

SEQ ID NO: 1210570 - protein, 9 aa, Homo Sapiens
IEVGPPESA

SEQ ID NO: 1210571 - protein, 9 aa, Homo Sapiens
CVLIRKWGK

SEQ ID NO: 1210572 - protein, 9 aa, Homo Sapiens
IYEPPQYMS

SEQ ID NO: 1210573 - protein, 9 aa, Homo Sapiens
GRGMVVVGT

SEQ ID NO: 1210574 - protein, 9 aa, Homo Sapiens
ASSEMTLYQ

SEQ ID NO: 1210575 - protein, 9 aa, Homo Sapiens
PVEALKDVK

SEQ ID NO: 1210576 - protein, 9 aa, Homo Sapiens
MTWETILMD

SEQ ID NO: 1210577 - protein, 9 aa, Homo Sapiens
IAIGCWLGC

SEQ ID NO: 1210578 - protein, 9 aa, Homo Sapiens
NLENRLLSK

SEQ ID NO: 1210579 - protein, 9 aa, Homo Sapiens
VEVLATSSN

SEQ ID NO: 1210580 - protein, 9 aa, Homo Sapiens
SLLTTAILG

SEQ ID NO: 1210581 - protein, 9 aa, Homo Sapiens
SVEVKKVMT

SEQ ID NO: 1210582 - protein, 9 aa, Homo Sapiens
AKMEKFSSA

SEQ ID NO: 1210583 - protein, 9 aa, Homo Sapiens
EGKHHPYKM

SEQ ID NO: 1210584 - protein, 9 aa, Homo Sapiens
LPALVAVLR

SEQ ID NO: 1210585 - protein, 9 aa, Homo Sapiens
TEDPRLLHQ

SEQ ID NO: 1210586 - protein, 9 aa, Homo Sapiens
RFGLCLDGD

SEQ ID NO: 1210587 - protein, 9 aa, Homo Sapiens
KTHLGEALV

SEQ ID NO: 1210588 - protein, 9 aa, Homo Sapiens
ILFKKILLG

SEQ ID NO: 1210589 - protein, 9 aa, Homo Sapiens
CSPAGQSNL

SEQ ID NO: 1210590 - protein, 9 aa, Homo Sapiens
HRRRAQGHP

SEQ ID NO: 1210591 - protein, 9 aa, Homo Sapiens
AMKLIVPRK

SEQ ID NO: 1210592 - protein, 9 aa, Homo Sapiens
DVAIQVCSL

SEQ ID NO: 1210593 - protein, 9 aa, Homo Sapiens
QGPVHLVQQ

SEQ ID NO: 1210594 - protein, 9 aa, Homo Sapiens
GMCHQDDAT

SEQ ID NO: 1210595 - protein, 9 aa, Homo Sapiens
TTPSWCLCS

SEQ ID NO: 1210596 - protein, 9 aa, Homo Sapiens
TAAAAAGIL

SEQ ID NO: 1210597 - protein, 9 aa, Homo Sapiens
VRYTGTTRV

SEQ ID NO: 1210598 - protein, 9 aa, Homo Sapiens
SEDHAVLLG

SEQ ID NO: 1210599 - protein, 9 aa, Homo Sapiens
KSNAVLSKS

SEQ ID NO: 1210600 - protein, 9 aa, Homo Sapiens
TYNNRGNEC

SEQ ID NO: 1210601 - protein, 9 aa, Homo Sapiens
LEEQCHWLD

SEQ ID NO: 1210602 - protein, 9 aa, Homo Sapiens
YCKGTYLRV

SEQ ID NO: 1210603 - protein, 9 aa, Homo Sapiens
ALWWQARII

SEQ ID NO: 1210604 - protein, 9 aa, Homo Sapiens
QHHGNSGHL

SEQ ID NO: 1210605 - protein, 9 aa, Homo Sapiens
VPTHFLDRD

SEQ ID NO: 1210606 - protein, 9 aa, Homo Sapiens
GGRPGSGRA

SEQ ID NO: 1210607 - protein, 9 aa, Homo Sapiens
TVVGLMMGI

SEQ ID NO: 1210608 - protein, 9 aa, Homo Sapiens
IFLVQYLCN

SEQ ID NO: 1210609 - protein, 9 aa, Homo Sapiens
HVSFGGHLR

SEQ ID NO: 1210610 - protein, 9 aa, Homo Sapiens
SILAMPLLG

SEQ ID NO: 1210611 - protein, 9 aa, Homo Sapiens
TPLVPQADT

SEQ ID NO: 1210612 - protein, 9 aa, Homo Sapiens
GYTLPHAIM

SEQ ID NO: 1210613 - protein, 9 aa, Homo Sapiens
VLWLDWFLS

SEQ ID NO: 1210614 - protein, 9 aa, Homo Sapiens
VLCIDQLDV

SEQ ID NO: 1210615 - protein, 9 aa, Homo Sapiens
LTFGHMKMV

SEQ ID NO: 1210616 - protein, 9 aa, Homo Sapiens
VIVVLKDAE

SEQ ID NO: 1210617 - protein, 9 aa, Homo Sapiens
VAKSQTAPQ

SEQ ID NO: 1210618 - protein, 9 aa, Homo Sapiens
TTIPAKQTQ

SEQ ID NO: 1210619 - protein, 9 aa, Homo Sapiens
VKSSMPETT

SEQ ID NO: 1210620 - protein, 9 aa, Homo Sapiens
DALAHQVPN

SEQ ID NO: 1210621 - protein, 9 aa, Homo Sapiens
NSLTAQPTK

SEQ ID NO: 1210622 - protein, 9 aa, Homo Sapiens
QSSSHFYVV

SEQ ID NO: 1210623 - protein, 9 aa, Homo Sapiens
FIDCMTALG

SEQ ID NO: 1210624 - protein, 9 aa, Homo Sapiens
IKPARKYRF

SEQ ID NO: 1210625 - protein, 9 aa, Homo Sapiens
DLKKNVMRV

SEQ ID NO: 1210626 - protein, 9 aa, Homo Sapiens
LGTLAGYFN

SEQ ID NO: 1210627 - protein, 9 aa, Homo Sapiens
TKSTSVSGD

SEQ ID NO: 1210628 - protein, 9 aa, Homo Sapiens
VADRLILEL

SEQ ID NO: 1210629 - protein, 9 aa, Homo Sapiens
EKGVLKRRA

SEQ ID NO: 1210630 - protein, 9 aa, Homo Sapiens
LYICLVEIT

SEQ ID NO: 1210631 - protein, 9 aa, Homo Sapiens
APAPARSYQ

SEQ ID NO: 1210632 - protein, 9 aa, Homo Sapiens
REFSMTDFL

SEQ ID NO: 1210633 - protein, 9 aa, Homo Sapiens
VNDLCYQND

SEQ ID NO: 1210634 - protein, 9 aa, Homo Sapiens
YILNEEMSG

SEQ ID NO: 1210635 - protein, 9 aa, Homo Sapiens
IYTHFTCVT

SEQ ID NO: 1210636 - protein, 9 aa, Homo Sapiens
PLVGEETQK

SEQ ID NO: 1210637 - protein, 9 aa, Homo Sapiens
AGGSHQDCH

SEQ ID NO: 1210638 - protein, 9 aa, Homo Sapiens
FKSLALYLL

SEQ ID NO: 1210639 - protein, 9 aa, Homo Sapiens
SHYFLRQPQ

SEQ ID NO: 1210640 - protein, 9 aa, Homo Sapiens
NMWDCGRNV

SEQ ID NO: 1210641 - protein, 9 aa, Homo Sapiens
NQQDEIDIW

SEQ ID NO: 1210642 - protein, 9 aa, Homo Sapiens
YEKTDRVKK

SEQ ID NO: 1210643 - protein, 9 aa, Homo Sapiens
KEMMFEGGP

SEQ ID NO: 1210644 - protein, 9 aa, Homo Sapiens
SIPDSESNM

SEQ ID NO: 1210645 - protein, 9 aa, Homo Sapiens
NYHKHCAFS

SEQ ID NO: 1210646 - protein, 9 aa, Homo Sapiens
TVRDAKNII

SEQ ID NO: 1210647 - protein, 9 aa, Homo Sapiens
FACLVMITY

SEQ ID NO: 1210648 - protein, 9 aa, Homo Sapiens
EIQELHQWQ

SEQ ID NO: 1210649 - protein, 9 aa, Homo Sapiens
HAQVAEKLR

SEQ ID NO: 1210650 - protein, 9 aa, Homo Sapiens
QQIHTGRKP

SEQ ID NO: 1210651 - protein, 9 aa, Homo Sapiens
VMVIGACTC

SEQ ID NO: 1210652 - protein, 9 aa, Homo Sapiens
HVPEEEDLG

SEQ ID NO: 1210653 - protein, 9 aa, Homo Sapiens
CWLLCGCLC

SEQ ID NO: 1210654 - protein, 9 aa, Homo Sapiens
LITKKWGDH

SEQ ID NO: 1210655 - protein, 9 aa, Homo Sapiens
GHVMSCSTE

SEQ ID NO: 1210656 - protein, 9 aa, Homo Sapiens
SWGPLACSC

SEQ ID NO: 1210657 - protein, 9 aa, Homo Sapiens
FLVIAPLPT

SEQ ID NO: 1210658 - protein, 9 aa, Homo Sapiens
FTQKRSLNV

SEQ ID NO: 1210659 - protein, 9 aa, Homo Sapiens
YDQILCDVP

SEQ ID NO: 1210660 - protein, 9 aa, Homo Sapiens
DVMTKTESP

SEQ ID NO: 1210661 - protein, 9 aa, Homo Sapiens
MLQQHIQMH

SEQ ID NO: 1210662 - protein, 9 aa, Homo Sapiens
PDPCCGATE

SEQ ID NO: 1210663 - protein, 9 aa, Homo Sapiens
CYSFRMCQV

SEQ ID NO: 1210664 - protein, 9 aa, Homo Sapiens
DEHQLMLMR

SEQ ID NO: 1210665 - protein, 9 aa, Homo Sapiens
QIADFSDPV

SEQ ID NO: 1210666 - protein, 9 aa, Homo Sapiens
SHTGSYQCH

SEQ ID NO: 1210667 - protein, 9 aa, Homo Sapiens
EVLCQIVNN

SEQ ID NO: 1210668 - protein, 9 aa, Homo Sapiens
HLLLELNAV

SEQ ID NO: 1210669 - protein, 9 aa, Homo Sapiens
NQQMTIQAQ

SEQ ID NO: 1210670 - protein, 9 aa, Homo Sapiens
DVLTLAILM

SEQ ID NO: 1210671 - protein, 9 aa, Homo Sapiens
HMNQEDLAR

SEQ ID NO: 1210672 - protein, 9 aa, Homo Sapiens
NLYKKKLSD

SEQ ID NO: 1210673 - protein, 9 aa, Homo Sapiens
TLYISLNKV

SEQ ID NO: 1210674 - protein, 9 aa, Homo Sapiens
ISWITIVMP

SEQ ID NO: 1210675 - protein, 9 aa, Homo Sapiens
LRNLHCYPQ

SEQ ID NO: 1210676 - protein, 9 aa, Homo Sapiens
PSLPARSGL

SEQ ID NO: 1210677 - protein, 9 aa, Homo Sapiens
QIKTNLFIY

SEQ ID NO: 1210678 - protein, 9 aa, Homo Sapiens
EEPEETLGG

SEQ ID NO: 1210679 - protein, 9 aa, Homo Sapiens
VNAVQPGTV

SEQ ID NO: 1210680 - protein, 9 aa, Homo Sapiens
MEAARDEHQ

SEQ ID NO: 1210681 - protein, 9 aa, Homo Sapiens
EVKLHGFQA

SEQ ID NO: 1210682 - protein, 9 aa, Homo Sapiens
DKCSQGSAG

SEQ ID NO: 1210683 - protein, 9 aa, Homo Sapiens
NTKPNPVTP

SEQ ID NO: 1210684 - protein, 9 aa, Homo Sapiens
NCRYCIKDC

SEQ ID NO: 1210685 - protein, 9 aa, Homo Sapiens
QQLHEVYSH

SEQ ID NO: 1210686 - protein, 9 aa, Homo Sapiens
FTSTEHAHI

SEQ ID NO: 1210687 - protein, 9 aa, Homo Sapiens
DDNHFSSDE

SEQ ID NO: 1210688 - protein, 9 aa, Homo Sapiens
GGDLVIQQK

SEQ ID NO: 1210689 - protein, 9 aa, Homo Sapiens
EQKSKKKKE

SEQ ID NO: 1210690 - protein, 9 aa, Homo Sapiens
TVEGEVTFK

SEQ ID NO: 1210691 - protein, 9 aa, Homo Sapiens
LNNIHITRP

SEQ ID NO: 1210692 - protein, 9 aa, Homo Sapiens
QCKQTSECL

SEQ ID NO: 1210693 - protein, 9 aa, Homo Sapiens
AFGKINFLV

SEQ ID NO: 1210694 - protein, 9 aa, Homo Sapiens
TPAAVGATE

SEQ ID NO: 1210695 - protein, 9 aa, Homo Sapiens
DVPTIFLCT

SEQ ID NO: 1210696 - protein, 9 aa, Homo Sapiens
IAGRSADFV

SEQ ID NO: 1210697 - protein, 9 aa, Homo Sapiens
DYCQQLIVS

SEQ ID NO: 1210698 - protein, 9 aa, Homo Sapiens
DPADVREEV

SEQ ID NO: 1210699 - protein, 9 aa, Homo Sapiens
SSLLNQHAY

SEQ ID NO: 1210700 - protein, 9 aa, Homo Sapiens
CCLGMQHRQ

SEQ ID NO: 1210701 - protein, 9 aa, Homo Sapiens
QEMTVIVNS

SEQ ID NO: 1210702 - protein, 9 aa, Homo Sapiens
PKFSIEGFY

SEQ ID NO: 1210703 - protein, 9 aa, Homo Sapiens
FTFIWFLSS

SEQ ID NO: 1210704 - protein, 9 aa, Homo Sapiens
AGHVSSTYV

SEQ ID NO: 1210705 - protein, 9 aa, Homo Sapiens
NVVLDCLLD

SEQ ID NO: 1210706 - protein, 9 aa, Homo Sapiens
LIMKVNFDI

SEQ ID NO: 1210707 - protein, 9 aa, Homo Sapiens
EPHTAVKNF

SEQ ID NO: 1210708 - protein, 9 aa, Homo Sapiens
REGAHYLMQ

SEQ ID NO: 1210709 - protein, 9 aa, Homo Sapiens
RTPWPLPMC

SEQ ID NO: 1210710 - protein, 9 aa, Homo Sapiens
SVCVFPASK

SEQ ID NO: 1210711 - protein, 9 aa, Homo Sapiens
MVLRRPPRL

SEQ ID NO: 1210712 - protein, 9 aa, Homo Sapiens
RYLIESVCQ

SEQ ID NO: 1210713 - protein, 9 aa, Homo Sapiens
TEDDMLAKT

SEQ ID NO: 1210714 - protein, 9 aa, Homo Sapiens
KNVTVVRNL

SEQ ID NO: 1210715 - protein, 9 aa, Homo Sapiens
GRRSKRPQA

SEQ ID NO: 1210716 - protein, 9 aa, Homo Sapiens
YAFNLKKDD

SEQ ID NO: 1210717 - protein, 9 aa, Homo Sapiens
KRLVELLQS

SEQ ID NO: 1210718 - protein, 9 aa, Homo Sapiens
FPVIVHLPL

SEQ ID NO: 1210719 - protein, 9 aa, Homo Sapiens
KALLVEVHL

SEQ ID NO: 1210720 - protein, 9 aa, Homo Sapiens
ASPCSLSAP

SEQ ID NO: 1210721 - protein, 9 aa, Homo Sapiens
KYLKVNRFD

SEQ ID NO: 1210722 - protein, 9 aa, Homo Sapiens
KDRKSGRTT

SEQ ID NO: 1210723 - protein, 9 aa, Homo Sapiens
VDPSDMHFI

SEQ ID NO: 1210724 - protein, 9 aa, Homo Sapiens
MHPRFCVSL

SEQ ID NO: 1210725 - protein, 9 aa, Homo Sapiens
VGQSKHLEQ

SEQ ID NO: 1210726 - protein, 9 aa, Homo Sapiens
TSTCFDAAQ

SEQ ID NO: 1210727 - protein, 9 aa, Homo Sapiens
GVSAPSVSR

SEQ ID NO: 1210728 - protein, 9 aa, Homo Sapiens
SLGLEQPLT

SEQ ID NO: 1210729 - protein, 9 aa, Homo Sapiens
RPFHLEEWR

SEQ ID NO: 1210730 - protein, 9 aa, Homo Sapiens
LPALVVLAQ

SEQ ID NO: 1210731 - protein, 9 aa, Homo Sapiens
ENFEIQQTG

SEQ ID NO: 1210732 - protein, 9 aa, Homo Sapiens
YEAKLLAYN

SEQ ID NO: 1210733 - protein, 9 aa, Homo Sapiens
EWDSATAYR

SEQ ID NO: 1210734 - protein, 9 aa, Homo Sapiens
GWLQIRALA

SEQ ID NO: 1210735 - protein, 9 aa, Homo Sapiens
HHMYYLKIS

SEQ ID NO: 1210736 - protein, 9 aa, Homo Sapiens
PVHMQLYEA

SEQ ID NO: 1210737 - protein, 9 aa, Homo Sapiens
GLLGQTQKV

SEQ ID NO: 1210738 - protein, 9 aa, Homo Sapiens
LQADISLNK

SEQ ID NO: 1210739 - protein, 9 aa, Homo Sapiens
GKYYISKGH

SEQ ID NO: 1210740 - protein, 9 aa, Homo Sapiens
QEPAMRGSP

SEQ ID NO: 1210741 - protein, 9 aa, Homo Sapiens
TRKDDLVDT

SEQ ID NO: 1210742 - protein, 9 aa, Homo Sapiens
SSTFSQRSS

SEQ ID NO: 1210743 - protein, 9 aa, Homo Sapiens
GFTIKKHMA

SEQ ID NO: 1210744 - protein, 9 aa, Homo Sapiens
KFLASFSTE

SEQ ID NO: 1210745 - protein, 9 aa, Homo Sapiens
IIPTARCCL

SEQ ID NO: 1210746 - protein, 9 aa, Homo Sapiens
CPLSERHAP

SEQ ID NO: 1210747 - protein, 9 aa, Homo Sapiens
DHVPEEEDL

SEQ ID NO: 1210748 - protein, 9 aa, Homo Sapiens
RLMPEKKVS

SEQ ID NO: 1210749 - protein, 9 aa, Homo Sapiens
SFPVSVGVQ

SEQ ID NO: 1210750 - protein, 9 aa, Homo Sapiens
PNLISVDNF

SEQ ID NO: 1210751 - protein, 9 aa, Homo Sapiens
VTTTVTGTK

SEQ ID NO: 1210752 - protein, 9 aa, Homo Sapiens
RGTDVPEIP

SEQ ID NO: 1210753 - protein, 9 aa, Homo Sapiens
EKKYTPGDA

SEQ ID NO: 1210754 - protein, 9 aa, Homo Sapiens
SNLGTGVVH

SEQ ID NO: 1210755 - protein, 9 aa, Homo Sapiens
HLRTPMYFF

SEQ ID NO: 1210756 - protein, 9 aa, Homo Sapiens
GTVQRVTLE

SEQ ID NO: 1210757 - protein, 9 aa, Homo Sapiens
THHAYAEYM

SEQ ID NO: 1210758 - protein, 9 aa, Homo Sapiens
LHCYPQLCL

SEQ ID NO: 1210759 - protein, 9 aa, Homo Sapiens
GTMRRHYED

SEQ ID NO: 1210760 - protein, 9 aa, Homo Sapiens
IGGGGFHSG

SEQ ID NO: 1210761 - protein, 9 aa, Homo Sapiens
PHHMAHRSQ

SEQ ID NO: 1210762 - protein, 9 aa, Homo Sapiens
QREQVLQGE

SEQ ID NO: 1210763 - protein, 9 aa, Homo Sapiens
RYSCKLQDI

SEQ ID NO: 1210764 - protein, 9 aa, Homo Sapiens
ELFEASNWH

SEQ ID NO: 1210765 - protein, 9 aa, Homo Sapiens
LITRGKGVG

SEQ ID NO: 1210766 - protein, 9 aa, Homo Sapiens
SESAVWAFL

SEQ ID NO: 1210767 - protein, 9 aa, Homo Sapiens
DELLEILGS

SEQ ID NO: 1210768 - protein, 9 aa, Homo Sapiens
TLTMPALEP

SEQ ID NO: 1210769 - protein, 9 aa, Homo Sapiens
TLNYSQVAM

SEQ ID NO: 1210770 - protein, 9 aa, Homo Sapiens
KEVTRMAVV

SEQ ID NO: 1210771 - protein, 9 aa, Homo Sapiens
LGVPGEDGR

SEQ ID NO: 1210772 - protein, 9 aa, Homo Sapiens
SSGTFYERK

SEQ ID NO: 1210773 - protein, 9 aa, Homo Sapiens
VEIYIKSLS

SEQ ID NO: 1210774 - protein, 9 aa, Homo Sapiens
KRTGHYLFG

SEQ ID NO: 1210775 - protein, 9 aa, Homo Sapiens
NCIPVDSDV

SEQ ID NO: 1210776 - protein, 9 aa, Homo Sapiens
TMQPWQPLG

SEQ ID NO: 1210777 - protein, 9 aa, Homo Sapiens
EWRKKCHTA

SEQ ID NO: 1210778 - protein, 9 aa, Homo Sapiens
IERWRGMMR

SEQ ID NO: 1210779 - protein, 9 aa, Homo Sapiens
QGPGHACMV

SEQ ID NO: 1210780 - protein, 9 aa, Homo Sapiens
YVKDVQFAV

SEQ ID NO: 1210781 - protein, 9 aa, Homo Sapiens
TSTFSFECS

SEQ ID NO: 1210782 - protein, 9 aa, Homo Sapiens
LKSEKEVLL

SEQ ID NO: 1210783 - protein, 9 aa, Homo Sapiens
SKREKGPND

SEQ ID NO: 1210784 - protein, 9 aa, Homo Sapiens
SSHPWLHAC

SEQ ID NO: 1210785 - protein, 9 aa, Homo Sapiens
ASWLTSTRP

SEQ ID NO: 1210786 - protein, 9 aa, Homo Sapiens
IDYASCKCI

SEQ ID NO: 1210787 - protein, 9 aa, Homo Sapiens
VNFQLYMDA

SEQ ID NO: 1210788 - protein, 9 aa, Homo Sapiens
LPPALGSPP

SEQ ID NO: 1210789 - protein, 9 aa, Homo Sapiens
DTAALALAG

SEQ ID NO: 1210790 - protein, 9 aa, Homo Sapiens
MCSFVTEGG

SEQ ID NO: 1210791 - protein, 9 aa, Homo Sapiens
ALINFSYFH

SEQ ID NO: 1210792 - protein, 9 aa, Homo Sapiens
ALVAVLRGA

SEQ ID NO: 1210793 - protein, 9 aa, Homo Sapiens
RDARALHHG

SEQ ID NO: 1210794 - protein, 9 aa, Homo Sapiens
NSSNQGKYP

SEQ ID NO: 1210795 - protein, 9 aa, Homo Sapiens
THAIRLLLE

SEQ ID NO: 1210796 - protein, 9 aa, Homo Sapiens
QLSLTLPQL

SEQ ID NO: 1210797 - protein, 9 aa, Homo Sapiens
DLQGPPGPP

SEQ ID NO: 1210798 - protein, 9 aa, Homo Sapiens
TALKKCPLD

SEQ ID NO: 1210799 - protein, 9 aa, Homo Sapiens
APCIQEAEV

SEQ ID NO: 1210800 - protein, 9 aa, Homo Sapiens
ALNSDGWLH

SEQ ID NO: 1210801 - protein, 9 aa, Homo Sapiens
IATSDKMQY

SEQ ID NO: 1210802 - protein, 9 aa, Homo Sapiens
RAGGGIEDE

SEQ ID NO: 1210803 - protein, 9 aa, Homo Sapiens
NVIREIQSA

SEQ ID NO: 1210804 - protein, 9 aa, Homo Sapiens
VSPGPRGSP

SEQ ID NO: 1210805 - protein, 9 aa, Homo Sapiens
VQHSPMWDN

SEQ ID NO: 1210806 - protein, 9 aa, Homo Sapiens
DAIDQMRRD

SEQ ID NO: 1210807 - protein, 9 aa, Homo Sapiens
SGLKQIRLC

SEQ ID NO: 1210808 - protein, 9 aa, Homo Sapiens
SKSYVKLRE

SEQ ID NO: 1210809 - protein, 9 aa, Homo Sapiens
GETMSSETT

SEQ ID NO: 1210810 - protein, 9 aa, Homo Sapiens
HSTKARDSE

SEQ ID NO: 1210811 - protein, 9 aa, Homo Sapiens
ESPHGSTKR

SEQ ID NO: 1210812 - protein, 9 aa, Homo Sapiens
PQGPPGLHG

SEQ ID NO: 1210813 - protein, 9 aa, Homo Sapiens
ERFRSMIPS

SEQ ID NO: 1210814 - protein, 9 aa, Homo Sapiens
LCIICAMKA

SEQ ID NO: 1210815 - protein, 9 aa, Homo Sapiens
YILMIRRLR

SEQ ID NO: 1210816 - protein, 9 aa, Homo Sapiens
EELSVMDVY

SEQ ID NO: 1210817 - protein, 9 aa, Homo Sapiens
GSNKVCRDQ

SEQ ID NO: 1210818 - protein, 9 aa, Homo Sapiens
SGSVAGKAL

SEQ ID NO: 1210819 - protein, 9 aa, Homo Sapiens
VSEEPVTNS

SEQ ID NO: 1210820 - protein, 9 aa, Homo Sapiens
ALSSSPAHN

SEQ ID NO: 1210821 - protein, 9 aa, Homo Sapiens
DALWWQARI

SEQ ID NO: 1210822 - protein, 9 aa, Homo Sapiens
IGGLLHDLI

SEQ ID NO: 1210823 - protein, 9 aa, Homo Sapiens
LVCVNFSHW

SEQ ID NO: 1210824 - protein, 9 aa, Homo Sapiens
TVMGIDTSG

SEQ ID NO: 1210825 - protein, 9 aa, Homo Sapiens
PSPPACPRP

SEQ ID NO: 1210826 - protein, 9 aa, Homo Sapiens
HYVDVLTLA

SEQ ID NO: 1210827 - protein, 9 aa, Homo Sapiens
DCLRPTAWR

SEQ ID NO: 1210828 - protein, 9 aa, Homo Sapiens
QVYILTLIL

SEQ ID NO: 1210829 - protein, 9 aa, Homo Sapiens
LGGLVFALR

SEQ ID NO: 1210830 - protein, 9 aa, Homo Sapiens
ARSGGQVGI

SEQ ID NO: 1210831 - protein, 9 aa, Homo Sapiens
TPPIMRIII

SEQ ID NO: 1210832 - protein, 9 aa, Homo Sapiens
IEGHLGQGG

SEQ ID NO: 1210833 - protein, 9 aa, Homo Sapiens
PVLTKHLLG

SEQ ID NO: 1210834 - protein, 9 aa, Homo Sapiens
IHKLGFTGS

SEQ ID NO: 1210835 - protein, 9 aa, Homo Sapiens
HAQPVSSAQ

SEQ ID NO: 1210836 - protein, 9 aa, Homo Sapiens
EHVHTTVLR

SEQ ID NO: 1210837 - protein, 9 aa, Homo Sapiens
DTVHEACDR

SEQ ID NO: 1210838 - protein, 9 aa, Homo Sapiens
LYHVSTHEQ

SEQ ID NO: 1210839 - protein, 9 aa, Homo Sapiens
AAEKHVTIH

SEQ ID NO: 1210840 - protein, 9 aa, Homo Sapiens
NNGSSKGVS

SEQ ID NO: 1210841 - protein, 9 aa, Homo Sapiens
NGSNVAEGH

SEQ ID NO: 1210842 - protein, 9 aa, Homo Sapiens
LYKKMIVFE

SEQ ID NO: 1210843 - protein, 9 aa, Homo Sapiens
RTLKNFELM

SEQ ID NO: 1210844 - protein, 9 aa, Homo Sapiens
VGPGYDALT

SEQ ID NO: 1210845 - protein, 9 aa, Homo Sapiens
SSDVRYKMP

SEQ ID NO: 1210846 - protein, 9 aa, Homo Sapiens
SEEHIPDVS

SEQ ID NO: 1210847 - protein, 9 aa, Homo Sapiens
CECQQCFSS

SEQ ID NO: 1210848 - protein, 9 aa, Homo Sapiens
DQEDHIKPT

SEQ ID NO: 1210849 - protein, 9 aa, Homo Sapiens
STFKQEEMA

SEQ ID NO: 1210850 - protein, 9 aa, Homo Sapiens
GDLLHTIQR

SEQ ID NO: 1210851 - protein, 9 aa, Homo Sapiens
LPWVNPYMD

SEQ ID NO: 1210852 - protein, 9 aa, Homo Sapiens
YCMVSGLDY

SEQ ID NO: 1210853 - protein, 9 aa, Homo Sapiens
LFFLRIVHV

SEQ ID NO: 1210854 - protein, 9 aa, Homo Sapiens
SVYPLNAKV

SEQ ID NO: 1210855 - protein, 9 aa, Homo Sapiens
ATVATSVEQ

SEQ ID NO: 1210856 - protein, 9 aa, Homo Sapiens
ASNTERMQD

SEQ ID NO: 1210857 - protein, 9 aa, Homo Sapiens
LIQPWDPLD

SEQ ID NO: 1210858 - protein, 9 aa, Homo Sapiens
PHFETSCLK

SEQ ID NO: 1210859 - protein, 9 aa, Homo Sapiens
LQKEKKRFS

SEQ ID NO: 1210860 - protein, 9 aa, Homo Sapiens
NMLITCIDS

SEQ ID NO: 1210861 - protein, 9 aa, Homo Sapiens
GTVKVEAGG

SEQ ID NO: 1210862 - protein, 9 aa, Homo Sapiens
RPVCCVEAQ

SEQ ID NO: 1210863 - protein, 9 aa, Homo Sapiens
GRQHSYSSK

SEQ ID NO: 1210864 - protein, 9 aa, Homo Sapiens
AELPRFHEV

SEQ ID NO: 1210865 - protein, 9 aa, Homo Sapiens
LVTVITGGA

SEQ ID NO: 1210866 - protein, 9 aa, Homo Sapiens
SSMPETTAL

SEQ ID NO: 1210867 - protein, 9 aa, Homo Sapiens
CREEGLSKA

SEQ ID NO: 1210868 - protein, 9 aa, Homo Sapiens
EWAIINLGV

SEQ ID NO: 1210869 - protein, 9 aa, Homo Sapiens
WEEMKETKC

SEQ ID NO: 1210870 - protein, 9 aa, Homo Sapiens
PTRMLNIPF

SEQ ID NO: 1210871 - protein, 9 aa, Homo Sapiens
AISCRNTSV

SEQ ID NO: 1210872 - protein, 9 aa, Homo Sapiens
EMGERLVLG

SEQ ID NO: 1210873 - protein, 9 aa, Homo Sapiens
SCSRGRWVM

SEQ ID NO: 1210874 - protein, 9 aa, Homo Sapiens
RTQTSKDDL

SEQ ID NO: 1210875 - protein, 9 aa, Homo Sapiens
DQKAKERNP

SEQ ID NO: 1210876 - protein, 9 aa, Homo Sapiens
MGLRKGHST

SEQ ID NO: 1210877 - protein, 9 aa, Homo Sapiens
TMQAKYREY

SEQ ID NO: 1210878 - protein, 9 aa, Homo Sapiens
GIEEADGEL

SEQ ID NO: 1210879 - protein, 9 aa, Homo Sapiens
AALALALKD

SEQ ID NO: 1210880 - protein, 9 aa, Homo Sapiens
ECVMLCHGV

SEQ ID NO: 1210881 - protein, 9 aa, Homo Sapiens
QALQPQSKN

SEQ ID NO: 1210882 - protein, 9 aa, Homo Sapiens
YVQHIQQPL

SEQ ID NO: 1210883 - protein, 9 aa, Homo Sapiens
CRMCPWTAW

SEQ ID NO: 1210884 - protein, 9 aa, Homo Sapiens
LDKLYKRKE

SEQ ID NO: 1210885 - protein, 9 aa, Homo Sapiens
SYQCDVCDK

SEQ ID NO: 1210886 - protein, 9 aa, Homo Sapiens
IHLTFLKRP

SEQ ID NO: 1210887 - protein, 9 aa, Homo Sapiens
SASASLEVT

SEQ ID NO: 1210888 - protein, 9 aa, Homo Sapiens
WEKATGRYY

SEQ ID NO: 1210889 - protein, 9 aa, Homo Sapiens
PGQLKAAMR

SEQ ID NO: 1210890 - protein, 9 aa, Homo Sapiens
QTHVNDIML

SEQ ID NO: 1210891 - protein, 9 aa, Homo Sapiens
ELREPYGPL

SEQ ID NO: 1210892 - protein, 9 aa, Homo Sapiens
TVNAFEVFD

SEQ ID NO: 1210893 - protein, 9 aa, Homo Sapiens
RYVAHSVQL

SEQ ID NO: 1210894 - protein, 9 aa, Homo Sapiens
SEEDHSAGS

SEQ ID NO: 1210895 - protein, 9 aa, Homo Sapiens
IHWQEELIV

SEQ ID NO: 1210896 - protein, 9 aa, Homo Sapiens
KMDHPVCFL

SEQ ID NO: 1210897 - protein, 9 aa, Homo Sapiens
RSVASDYMP

SEQ ID NO: 1210898 - protein, 9 aa, Homo Sapiens
SCLLPPVGP

SEQ ID NO: 1210899 - protein, 9 aa, Homo Sapiens
NLIKHQQVH

SEQ ID NO: 1210900 - protein, 9 aa, Homo Sapiens
SCTLPERSD

SEQ ID NO: 1210901 - protein, 9 aa, Homo Sapiens
TSQDKEGIA

SEQ ID NO: 1210902 - protein, 9 aa, Homo Sapiens
ILEIAMDQK

SEQ ID NO: 1210903 - protein, 9 aa, Homo Sapiens
LCQAEEEWR

SEQ ID NO: 1210904 - protein, 9 aa, Homo Sapiens
YKYKEDVTY

SEQ ID NO: 1210905 - protein, 9 aa, Homo Sapiens
GMEHIMHMI

SEQ ID NO: 1210906 - protein, 9 aa, Homo Sapiens
MANCSLYMS

SEQ ID NO: 1210907 - protein, 9 aa, Homo Sapiens
KKSARICRN

SEQ ID NO: 1210908 - protein, 9 aa, Homo Sapiens
PEGSKKEDR

SEQ ID NO: 1210909 - protein, 9 aa, Homo Sapiens
SRNQEEGKN

SEQ ID NO: 1210910 - protein, 9 aa, Homo Sapiens
TVEVHPRDV

SEQ ID NO: 1210911 - protein, 9 aa, Homo Sapiens
SSVDTRGRH

SEQ ID NO: 1210912 - protein, 9 aa, Homo Sapiens
VTRMCQVTS

SEQ ID NO: 1210913 - protein, 9 aa, Homo Sapiens
LPVCSITVN

SEQ ID NO: 1210914 - protein, 9 aa, Homo Sapiens
VRPGGSGQE

SEQ ID NO: 1210915 - protein, 9 aa, Homo Sapiens
GPDADALIV

SEQ ID NO: 1210916 - protein, 9 aa, Homo Sapiens
LGGGLPYLD

SEQ ID NO: 1210917 - protein, 9 aa, Homo Sapiens
MWKILYQKE

SEQ ID NO: 1210918 - protein, 9 aa, Homo Sapiens
AHSPSPAVP

SEQ ID NO: 1210919 - protein, 9 aa, Homo Sapiens
FATQRALIS

SEQ ID NO: 1210920 - protein, 9 aa, Homo Sapiens
VTVMCLLLL

SEQ ID NO: 1210921 - protein, 9 aa, Homo Sapiens
VASHLTKDV

SEQ ID NO: 1210922 - protein, 9 aa, Homo Sapiens
PLAFKPLKI

SEQ ID NO: 1210923 - protein, 9 aa, Homo Sapiens
PSEANFLGS

SEQ ID NO: 1210924 - protein, 9 aa, Homo Sapiens
EWDMVTPEA

SEQ ID NO: 1210925 - protein, 9 aa, Homo Sapiens
DAVFMFNAN

SEQ ID NO: 1210926 - protein, 9 aa, Homo Sapiens
EECGKAFEH

SEQ ID NO: 1210927 - protein, 9 aa, Homo Sapiens
CDVCDKIFR

SEQ ID NO: 1210928 - protein, 9 aa, Homo Sapiens
YIEKSLYQE

SEQ ID NO: 1210929 - protein, 9 aa, Homo Sapiens
KAKPVAIAP

SEQ ID NO: 1210930 - protein, 9 aa, Homo Sapiens
EACGMRCKS

SEQ ID NO: 1210931 - protein, 9 aa, Homo Sapiens
RFYWTGRGK

SEQ ID NO: 1210932 - protein, 9 aa, Homo Sapiens
TPEENTAAI

SEQ ID NO: 1210933 - protein, 9 aa, Homo Sapiens
FVTIPVVIF

SEQ ID NO: 1210934 - protein, 9 aa, Homo Sapiens
IYIHVHIQS

SEQ ID NO: 1210935 - protein, 9 aa, Homo Sapiens
HMIEERRNQ

SEQ ID NO: 1210936 - protein, 9 aa, Homo Sapiens
LMGGGRRDH

SEQ ID NO: 1210937 - protein, 9 aa, Homo Sapiens
LKLVAAANC

SEQ ID NO: 1210938 - protein, 9 aa, Homo Sapiens
PERSDSELK

SEQ ID NO: 1210939 - protein, 9 aa, Homo Sapiens
VSILSTFLD

SEQ ID NO: 1210940 - protein, 9 aa, Homo Sapiens
AAGPGQDRH

SEQ ID NO: 1210941 - protein, 9 aa, Homo Sapiens
SDEYHRKAL

SEQ ID NO: 1210942 - protein, 9 aa, Homo Sapiens
LISDPSCWV

SEQ ID NO: 1210943 - protein, 9 aa, Homo Sapiens
GVSVVDFVQ

SEQ ID NO: 1210944 - protein, 9 aa, Homo Sapiens
EIQDLQMKM

SEQ ID NO: 1210945 - protein, 9 aa, Homo Sapiens
EKRLTSPSE

SEQ ID NO: 1210946 - protein, 9 aa, Homo Sapiens
NTMQQTEAR

SEQ ID NO: 1210947 - protein, 9 aa, Homo Sapiens
ANLLIPTVG

SEQ ID NO: 1210948 - protein, 9 aa, Homo Sapiens
IGDFGMSRG

SEQ ID NO: 1210949 - protein, 9 aa, Homo Sapiens
GSFLYHVST

SEQ ID NO: 1210950 - protein, 9 aa, Homo Sapiens
WCGWQSIFY

SEQ ID NO: 1210951 - protein, 9 aa, Homo Sapiens
QLDKKLDCG

SEQ ID NO: 1210952 - protein, 9 aa, Homo Sapiens
SSSKRQALM

SEQ ID NO: 1210953 - protein, 9 aa, Homo Sapiens
GEDGEELDL

SEQ ID NO: 1210954 - protein, 9 aa, Homo Sapiens
MEHERLNEI

SEQ ID NO: 1210955 - protein, 9 aa, Homo Sapiens
DTFVDLEET

SEQ ID NO: 1210956 - protein, 9 aa, Homo Sapiens
YLIVVIFGI

SEQ ID NO: 1210957 - protein, 9 aa, Homo Sapiens
SMAQQENLT

SEQ ID NO: 1210958 - protein, 9 aa, Homo Sapiens
RSPQRSASC

SEQ ID NO: 1210959 - protein, 9 aa, Homo Sapiens
VELRGQEQR

SEQ ID NO: 1210960 - protein, 9 aa, Homo Sapiens
DDGVSGDHG

SEQ ID NO: 1210961 - protein, 9 aa, Homo Sapiens
WDRHRVDFD

SEQ ID NO: 1210962 - protein, 9 aa, Homo Sapiens
IKEVPTHFL

SEQ ID NO: 1210963 - protein, 9 aa, Homo Sapiens
EKEIEAQRL

SEQ ID NO: 1210964 - protein, 9 aa, Homo Sapiens
GWGDSGPHT

SEQ ID NO: 1210965 - protein, 9 aa, Homo Sapiens
IKTDFLVQM

SEQ ID NO: 1210966 - protein, 9 aa, Homo Sapiens
CSLKMEASY

SEQ ID NO: 1210967 - protein, 9 aa, Homo Sapiens
AEKQVTMAL

SEQ ID NO: 1210968 - protein, 9 aa, Homo Sapiens
RHPPQAPLP

SEQ ID NO: 1210969 - protein, 9 aa, Homo Sapiens
LQVLIKHEI

SEQ ID NO: 1210970 - protein, 9 aa, Homo Sapiens
GVQIANGMY

SEQ ID NO: 1210971 - protein, 9 aa, Homo Sapiens
TGATNISKQ

SEQ ID NO: 1210972 - protein, 9 aa, Homo Sapiens
LICGNRQDL

SEQ ID NO: 1210973 - protein, 9 aa, Homo Sapiens
LTIVPHPGV

SEQ ID NO: 1210974 - protein, 9 aa, Homo Sapiens
LLQNGSAPC

SEQ ID NO: 1210975 - protein, 9 aa, Homo Sapiens
GMCSFVTEG

SEQ ID NO: 1210976 - protein, 9 aa, Homo Sapiens
LLAGISLRG

SEQ ID NO: 1210977 - protein, 9 aa, Homo Sapiens
ELATPKIRD

SEQ ID NO: 1210978 - protein, 9 aa, Homo Sapiens
ASELEPISL

SEQ ID NO: 1210979 - protein, 9 aa, Homo Sapiens
VLSLVSENV

SEQ ID NO: 1210980 - protein, 9 aa, Homo Sapiens
SLLITATLE

SEQ ID NO: 1210981 - protein, 9 aa, Homo Sapiens
KLPPKKKCL

SEQ ID NO: 1210982 - protein, 9 aa, Homo Sapiens
SVPCRMEKN

SEQ ID NO: 1210983 - protein, 9 aa, Homo Sapiens
KAVMSKLKS

SEQ ID NO: 1210984 - protein, 9 aa, Homo Sapiens
GVSITFNGQ

SEQ ID NO: 1210985 - protein, 9 aa, Homo Sapiens
ATTVCCYLL

SEQ ID NO: 1210986 - protein, 9 aa, Homo Sapiens
IMRLFPQAA

SEQ ID NO: 1210987 - protein, 9 aa, Homo Sapiens
QQASERDAP

SEQ ID NO: 1210988 - protein, 9 aa, Homo Sapiens
METVKIIYV

SEQ ID NO: 1210989 - protein, 9 aa, Homo Sapiens
TVKPYQPQV

SEQ ID NO: 1210990 - protein, 9 aa, Homo Sapiens
IFPEGICTN

SEQ ID NO: 1210991 - protein, 9 aa, Homo Sapiens
HNPLCSSIS

SEQ ID NO: 1210992 - protein, 9 aa, Homo Sapiens
KRNNIVKKY

SEQ ID NO: 1210993 - protein, 9 aa, Homo Sapiens
KRNQLVREM

SEQ ID NO: 1210994 - protein, 9 aa, Homo Sapiens
DPETRAWSM

SEQ ID NO: 1210995 - protein, 9 aa, Homo Sapiens
CMRRDTSLE

SEQ ID NO: 1210996 - protein, 9 aa, Homo Sapiens
VKHPSAESV

SEQ ID NO: 1210997 - protein, 9 aa, Homo Sapiens
KCPAEDDIP

SEQ ID NO: 1210998 - protein, 9 aa, Homo Sapiens
RGGGSPSRS

SEQ ID NO: 1210999 - protein, 9 aa, Homo Sapiens
RTPQKRCLP

SEQ ID NO: 1211000 - protein, 9 aa, Homo Sapiens
MEGVGGLWH

SEQ ID NO: 1211001 - protein, 9 aa, Homo Sapiens
KCGECGKYY

SEQ ID NO: 1211002 - protein, 9 aa, Homo Sapiens
CNGPAVGTR

SEQ ID NO: 1211003 - protein, 9 aa, Homo Sapiens
TSAEKEATL

SEQ ID NO: 1211004 - protein, 9 aa, Homo Sapiens
DNEHLAIAR

SEQ ID NO: 1211005 - protein, 9 aa, Homo Sapiens
QARAAGHTP

SEQ ID NO: 1211006 - protein, 9 aa, Homo Sapiens
KQMMKRIKQ

SEQ ID NO: 1211007 - protein, 9 aa, Homo Sapiens
NSAAVQHNV

SEQ ID NO: 1211008 - protein, 9 aa, Homo Sapiens
KQSKMYSQG

SEQ ID NO: 1211009 - protein, 9 aa, Homo Sapiens
TYQVDVFCL

SEQ ID NO: 1211010 - protein, 9 aa, Homo Sapiens
SSGSITAIT

SEQ ID NO: 1211011 - protein, 9 aa, Homo Sapiens
VQDLRMARE

SEQ ID NO: 1211012 - protein, 9 aa, Homo Sapiens
NTYHGSQKQ

SEQ ID NO: 1211013 - protein, 9 aa, Homo Sapiens
MKRLEKEYT

SEQ ID NO: 1211014 - protein, 9 aa, Homo Sapiens
DMSTREEIV

SEQ ID NO: 1211015 - protein, 9 aa, Homo Sapiens
MMYATIWLW

SEQ ID NO: 1211016 - protein, 9 aa, Homo Sapiens
ALLGASAPC

SEQ ID NO: 1211017 - protein, 9 aa, Homo Sapiens
TFIGFLSSV

SEQ ID NO: 1211018 - protein, 9 aa, Homo Sapiens
ELQVTKQRG

SEQ ID NO: 1211019 - protein, 9 aa, Homo Sapiens
AKDAGDDEA

SEQ ID NO: 1211020 - protein, 9 aa, Homo Sapiens
LEDTETKDL

SEQ ID NO: 1211021 - protein, 9 aa, Homo Sapiens
LVWQLQLEA

SEQ ID NO: 1211022 - protein, 9 aa, Homo Sapiens
GQRCNYAHA

SEQ ID NO: 1211023 - protein, 9 aa, Homo Sapiens
FATSLWSDG

SEQ ID NO: 1211024 - protein, 9 aa, Homo Sapiens
RSKHWPAVT

SEQ ID NO: 1211025 - protein, 9 aa, Homo Sapiens
NAETFAEKL

SEQ ID NO: 1211026 - protein, 9 aa, Homo Sapiens
KDKAPIQDI

SEQ ID NO: 1211027 - protein, 9 aa, Homo Sapiens
GKCFMVKDL

SEQ ID NO: 1211028 - protein, 9 aa, Homo Sapiens
RTNFKSIHS

SEQ ID NO: 1211029 - protein, 9 aa, Homo Sapiens
TCLTHPMPT

SEQ ID NO: 1211030 - protein, 9 aa, Homo Sapiens
VEADLLRRS

SEQ ID NO: 1211031 - protein, 9 aa, Homo Sapiens
LFKQQVWLR

SEQ ID NO: 1211032 - protein, 9 aa, Homo Sapiens
WLQIRALAT

SEQ ID NO: 1211033 - protein, 9 aa, Homo Sapiens
AHSGTRCHT

SEQ ID NO: 1211034 - protein, 9 aa, Homo Sapiens
GSHISMSNL

SEQ ID NO: 1211035 - protein, 9 aa, Homo Sapiens
SQLMACVRY

SEQ ID NO: 1211036 - protein, 9 aa, Homo Sapiens
RHKGGCDSK

SEQ ID NO: 1211037 - protein, 9 aa, Homo Sapiens
LFAMETFAM

SEQ ID NO: 1211038 - protein, 9 aa, Homo Sapiens
EVLATSSNS

SEQ ID NO: 1211039 - protein, 9 aa, Homo Sapiens
HTPKTACVD

SEQ ID NO: 1211040 - protein, 9 aa, Homo Sapiens
RGHAPPLAA

SEQ ID NO: 1211041 - protein, 9 aa, Homo Sapiens
EMTHSEEKS

SEQ ID NO: 1211042 - protein, 9 aa, Homo Sapiens
QRMLPTRPD

SEQ ID NO: 1211043 - protein, 9 aa, Homo Sapiens
EKLHVAALV

SEQ ID NO: 1211044 - protein, 9 aa, Homo Sapiens
ESGGHRYVN

SEQ ID NO: 1211045 - protein, 9 aa, Homo Sapiens
FPPSLLHPH

SEQ ID NO: 1211046 - protein, 9 aa, Homo Sapiens
TVMCLLLLL

SEQ ID NO: 1211047 - protein, 9 aa, Homo Sapiens
NFLPEFLVL

SEQ ID NO: 1211048 - protein, 9 aa, Homo Sapiens
EFQTVKNVV

SEQ ID NO: 1211049 - protein, 9 aa, Homo Sapiens
LQDDLQCYR

SEQ ID NO: 1211050 - protein, 9 aa, Homo Sapiens
IYIKSLSAP

SEQ ID NO: 1211051 - protein, 9 aa, Homo Sapiens
ANIAHSNSS

SEQ ID NO: 1211052 - protein, 9 aa, Homo Sapiens
TTTLSSSVI

SEQ ID NO: 1211053 - protein, 9 aa, Homo Sapiens
FSLGSMFQN

SEQ ID NO: 1211054 - protein, 9 aa, Homo Sapiens
KMKETALIY

SEQ ID NO: 1211055 - protein, 9 aa, Homo Sapiens
EQSLRSSGA

SEQ ID NO: 1211056 - protein, 9 aa, Homo Sapiens
PECKHCFKK

SEQ ID NO: 1211057 - protein, 9 aa, Homo Sapiens
TAPAGRSSG

SEQ ID NO: 1211058 - protein, 9 aa, Homo Sapiens
LVTPPQGPA

SEQ ID NO: 1211059 - protein, 9 aa, Homo Sapiens
RKEDKEEKA

SEQ ID NO: 1211060 - protein, 9 aa, Homo Sapiens
KSSICLLHG

SEQ ID NO: 1211061 - protein, 9 aa, Homo Sapiens
VECTGYTLG

SEQ ID NO: 1211062 - protein, 9 aa, Homo Sapiens
DHGSGSVAE

SEQ ID NO: 1211063 - protein, 9 aa, Homo Sapiens
IYMGPWRPV

SEQ ID NO: 1211064 - protein, 9 aa, Homo Sapiens
EIACLPQTI

SEQ ID NO: 1211065 - protein, 9 aa, Homo Sapiens
KECIRLYAP

SEQ ID NO: 1211066 - protein, 9 aa, Homo Sapiens
DLRLAAEDV

SEQ ID NO: 1211067 - protein, 9 aa, Homo Sapiens
DGKEKTGAL

SEQ ID NO: 1211068 - protein, 9 aa, Homo Sapiens
PTPRSGTTP

SEQ ID NO: 1211069 - protein, 9 aa, Homo Sapiens
LILEVMNPH

SEQ ID NO: 1211070 - protein, 9 aa, Homo Sapiens
YDSVSNYQR

SEQ ID NO: 1211071 - protein, 9 aa, Homo Sapiens
STNLIVYIT

SEQ ID NO: 1211072 - protein, 9 aa, Homo Sapiens
EQASVLVES

SEQ ID NO: 1211073 - protein, 9 aa, Homo Sapiens
FKLTMVKCN

SEQ ID NO: 1211074 - protein, 9 aa, Homo Sapiens
ETCKAHDGD

SEQ ID NO: 1211075 - protein, 9 aa, Homo Sapiens
ANQFLCLKR

SEQ ID NO: 1211076 - protein, 9 aa, Homo Sapiens
LLCFLVPTF

SEQ ID NO: 1211077 - protein, 9 aa, Homo Sapiens
EINTAHAIL

SEQ ID NO: 1211078 - protein, 9 aa, Homo Sapiens
WEVDTCWGH

SEQ ID NO: 1211079 - protein, 9 aa, Homo Sapiens
AVFMFNANI

SEQ ID NO: 1211080 - protein, 9 aa, Homo Sapiens
IATLLFCLL

SEQ ID NO: 1211081 - protein, 9 aa, Homo Sapiens
ARLCVCCAE

SEQ ID NO: 1211082 - protein, 9 aa, Homo Sapiens
NTSSLVFNQ

SEQ ID NO: 1211083 - protein, 9 aa, Homo Sapiens
GDKAQIEKC

SEQ ID NO: 1211084 - protein, 9 aa, Homo Sapiens
HEGTVHFKC

SEQ ID NO: 1211085 - protein, 9 aa, Homo Sapiens
TIGAAFMAK

SEQ ID NO: 1211086 - protein, 9 aa, Homo Sapiens
DEDPQAYTS

SEQ ID NO: 1211087 - protein, 9 aa, Homo Sapiens
RKTINGEDV

SEQ ID NO: 1211088 - protein, 9 aa, Homo Sapiens
PFSSWGEVL

SEQ ID NO: 1211089 - protein, 9 aa, Homo Sapiens
EHRELCLEI

SEQ ID NO: 1211090 - protein, 9 aa, Homo Sapiens
RGAGHVSST

SEQ ID NO: 1211091 - protein, 9 aa, Homo Sapiens
QFTSQANVV

SEQ ID NO: 1211092 - protein, 9 aa, Homo Sapiens
QASAPLSSM

SEQ ID NO: 1211093 - protein, 9 aa, Homo Sapiens
WMRPHTPGR

SEQ ID NO: 1211094 - protein, 9 aa, Homo Sapiens
QDVTVQYPI

SEQ ID NO: 1211095 - protein, 9 aa, Homo Sapiens
GAPYWMAPE

SEQ ID NO: 1211096 - protein, 9 aa, Homo Sapiens
VKRLKHGYL

SEQ ID NO: 1211097 - protein, 9 aa, Homo Sapiens
PAHESILPT

SEQ ID NO: 1211098 - protein, 9 aa, Homo Sapiens
AHYGRLADP

SEQ ID NO: 1211099 - protein, 9 aa, Homo Sapiens
KERGLDILK

SEQ ID NO: 1211100 - protein, 9 aa, Homo Sapiens
NATKPGPVL

SEQ ID NO: 1211101 - protein, 9 aa, Homo Sapiens
ITLHDEEAN

SEQ ID NO: 1211102 - protein, 9 aa, Homo Sapiens
NSINFFTGD

SEQ ID NO: 1211103 - protein, 9 aa, Homo Sapiens
WKMEHQLYT

SEQ ID NO: 1211104 - protein, 9 aa, Homo Sapiens
STLWKSKLL

SEQ ID NO: 1211105 - protein, 9 aa, Homo Sapiens
RGSPAFPDS

SEQ ID NO: 1211106 - protein, 9 aa, Homo Sapiens
ECIYYADVK

SEQ ID NO: 1211107 - protein, 9 aa, Homo Sapiens
STGTYTLTL

SEQ ID NO: 1211108 - protein, 9 aa, Homo Sapiens
RFSPQGGQM

SEQ ID NO: 1211109 - protein, 9 aa, Homo Sapiens
VSQASKDLF

SEQ ID NO: 1211110 - protein, 9 aa, Homo Sapiens
LGPDGATLC

SEQ ID NO: 1211111 - protein, 9 aa, Homo Sapiens
EMANAKETA

SEQ ID NO: 1211112 - protein, 9 aa, Homo Sapiens
CRTTYSNQE

SEQ ID NO: 1211113 - protein, 9 aa, Homo Sapiens
DINNVLFTT

SEQ ID NO: 1211114 - protein, 9 aa, Homo Sapiens
TEYTVCLFL

SEQ ID NO: 1211115 - protein, 9 aa, Homo Sapiens
YNIHLQTGC

SEQ ID NO: 1211116 - protein, 9 aa, Homo Sapiens
TEVTWTWAR

SEQ ID NO: 1211117 - protein, 9 aa, Homo Sapiens
AAMAYDHFI

SEQ ID NO: 1211118 - protein, 9 aa, Homo Sapiens
NMTPANSEA

SEQ ID NO: 1211119 - protein, 9 aa, Homo Sapiens
QMESAAFQA

SEQ ID NO: 1211120 - protein, 9 aa, Homo Sapiens
RKLDHILPS

SEQ ID NO: 1211121 - protein, 9 aa, Homo Sapiens
GVRAGGGIE

SEQ ID NO: 1211122 - protein, 9 aa, Homo Sapiens
VEELVGKPV

SEQ ID NO: 1211123 - protein, 9 aa, Homo Sapiens
EEMDWLQIC

SEQ ID NO: 1211124 - protein, 9 aa, Homo Sapiens
KFRNTIGNS

SEQ ID NO: 1211125 - protein, 9 aa, Homo Sapiens
LQRHVIAWG

SEQ ID NO: 1211126 - protein, 9 aa, Homo Sapiens
KSMKSLYLG

SEQ ID NO: 1211127 - protein, 9 aa, Homo Sapiens
TKSTPWQPT

SEQ ID NO: 1211128 - protein, 9 aa, Homo Sapiens
IVSISSQYW

SEQ ID NO: 1211129 - protein, 9 aa, Homo Sapiens
DLMCAQLQL

SEQ ID NO: 1211130 - protein, 9 aa, Homo Sapiens
AVVRAGAQA

SEQ ID NO: 1211131 - protein, 9 aa, Homo Sapiens
NMNVTNVRR

SEQ ID NO: 1211132 - protein, 9 aa, Homo Sapiens
EDKSQSKHR

SEQ ID NO: 1211133 - protein, 9 aa, Homo Sapiens
WGLLRAQGL

SEQ ID NO: 1211134 - protein, 9 aa, Homo Sapiens
LHGPSGAAD

SEQ ID NO: 1211135 - protein, 9 aa, Homo Sapiens
VAGVEMQLM

SEQ ID NO: 1211136 - protein, 9 aa, Homo Sapiens
ASIYKNILS

SEQ ID NO: 1211137 - protein, 9 aa, Homo Sapiens
ASLAILEET

SEQ ID NO: 1211138 - protein, 9 aa, Homo Sapiens
PVSRTPTLV

SEQ ID NO: 1211139 - protein, 9 aa, Homo Sapiens
LSELEGMGL

SEQ ID NO: 1211140 - protein, 9 aa, Homo Sapiens
APAASLMAT

SEQ ID NO: 1211141 - protein, 9 aa, Homo Sapiens
PFKHDIFLL

SEQ ID NO: 1211142 - protein, 9 aa, Homo Sapiens
RGKGVGTPN

SEQ ID NO: 1211143 - protein, 9 aa, Homo Sapiens
FFTALMVNG

SEQ ID NO: 1211144 - protein, 9 aa, Homo Sapiens
AVNMWRKNL

SEQ ID NO: 1211145 - protein, 9 aa, Homo Sapiens
PHQAKQDVH

SEQ ID NO: 1211146 - protein, 9 aa, Homo Sapiens
CYCTDTGVL

SEQ ID NO: 1211147 - protein, 9 aa, Homo Sapiens
NGRRDARAL

SEQ ID NO: 1211148 - protein, 9 aa, Homo Sapiens
AKVAWHEGQ

SEQ ID NO: 1211149 - protein, 9 aa, Homo Sapiens
YAPINVNAI

SEQ ID NO: 1211150 - protein, 9 aa, Homo Sapiens
VICKDQCLP

SEQ ID NO: 1211151 - protein, 9 aa, Homo Sapiens
CVICWMNMN

SEQ ID NO: 1211152 - protein, 9 aa, Homo Sapiens
SHLEARLNI

SEQ ID NO: 1211153 - protein, 9 aa, Homo Sapiens
MVICKKDLI

SEQ ID NO: 1211154 - protein, 9 aa, Homo Sapiens
PWTPSPSHM

SEQ ID NO: 1211155 - protein, 9 aa, Homo Sapiens
KHSVMVDAT

SEQ ID NO: 1211156 - protein, 9 aa, Homo Sapiens
DGETPPVDG

SEQ ID NO: 1211157 - protein, 9 aa, Homo Sapiens
LIAIPSHPT

SEQ ID NO: 1211158 - protein, 9 aa, Homo Sapiens
ATNVILMEQ

SEQ ID NO: 1211159 - protein, 9 aa, Homo Sapiens
PLIHVFFNP

SEQ ID NO: 1211160 - protein, 9 aa, Homo Sapiens
ALIYWVSVC

SEQ ID NO: 1211161 - protein, 9 aa, Homo Sapiens
PRGTVRVCD

SEQ ID NO: 1211162 - protein, 9 aa, Homo Sapiens
RGFQARLSH

SEQ ID NO: 1211163 - protein, 9 aa, Homo Sapiens
CIPYMDSPQ

SEQ ID NO: 1211164 - protein, 9 aa, Homo Sapiens
IGQVGRLHG

SEQ ID NO: 1211165 - protein, 9 aa, Homo Sapiens
LAEPNKKGW

SEQ ID NO: 1211166 - protein, 9 aa, Homo Sapiens
EPRTTVDSV

SEQ ID NO: 1211167 - protein, 9 aa, Homo Sapiens
EGKPTPPVP

SEQ ID NO: 1211168 - protein, 9 aa, Homo Sapiens
VKGTMKDIC

SEQ ID NO: 1211169 - protein, 9 aa, Homo Sapiens
GYQAGQTIK

SEQ ID NO: 1211170 - protein, 9 aa, Homo Sapiens
PAQCLALRV

SEQ ID NO: 1211171 - protein, 9 aa, Homo Sapiens
LDENYTLIR

SEQ ID NO: 1211172 - protein, 9 aa, Homo Sapiens
AAQDQEARC

SEQ ID NO: 1211173 - protein, 9 aa, Homo Sapiens
NIVVIGHMD

SEQ ID NO: 1211174 - protein, 9 aa, Homo Sapiens
LLVMEDDIP

SEQ ID NO: 1211175 - protein, 9 aa, Homo Sapiens
MRGTKSTPW

SEQ ID NO: 1211176 - protein, 9 aa, Homo Sapiens
AVNDLCYQN

SEQ ID NO: 1211177 - protein, 9 aa, Homo Sapiens
HGYHNWGHQ

SEQ ID NO: 1211178 - protein, 9 aa, Homo Sapiens
MFSIWCFAW

SEQ ID NO: 1211179 - protein, 9 aa, Homo Sapiens
TRPTDAQDC

SEQ ID NO: 1211180 - protein, 9 aa, Homo Sapiens
PTALLHVLR

SEQ ID NO: 1211181 - protein, 9 aa, Homo Sapiens
ELKERERHL

SEQ ID NO: 1211182 - protein, 9 aa, Homo Sapiens
EFSLEIFEW

SEQ ID NO: 1211183 - protein, 9 aa, Homo Sapiens
HVFPPSDQL

SEQ ID NO: 1211184 - protein, 9 aa, Homo Sapiens
MLDQMDHEQ

SEQ ID NO: 1211185 - protein, 9 aa, Homo Sapiens
IQFEDFVCY

SEQ ID NO: 1211186 - protein, 9 aa, Homo Sapiens
GPVFLPFLI

SEQ ID NO: 1211187 - protein, 9 aa, Homo Sapiens
PQRELPSAQ

SEQ ID NO: 1211188 - protein, 9 aa, Homo Sapiens
QEGKMQYLQ

SEQ ID NO: 1211189 - protein, 9 aa, Homo Sapiens
REKVKCYII

SEQ ID NO: 1211190 - protein, 9 aa, Homo Sapiens
MFLCDECCS

SEQ ID NO: 1211191 - protein, 9 aa, Homo Sapiens
AFMYMCPSS

SEQ ID NO: 1211192 - protein, 9 aa, Homo Sapiens
GGSLPSVNQ

SEQ ID NO: 1211193 - protein, 9 aa, Homo Sapiens
EVSEKVLEM

SEQ ID NO: 1211194 - protein, 9 aa, Homo Sapiens
HSPMWDNPG

SEQ ID NO: 1211195 - protein, 9 aa, Homo Sapiens
GLEMVFKNQ

SEQ ID NO: 1211196 - protein, 9 aa, Homo Sapiens
RFTADSWEH

SEQ ID NO: 1211197 - protein, 9 aa, Homo Sapiens
PTSSRTSTF

SEQ ID NO: 1211198 - protein, 9 aa, Homo Sapiens
RGELFCCDT

SEQ ID NO: 1211199 - protein, 9 aa, Homo Sapiens
EIHIAMCDD

SEQ ID NO: 1211200 - protein, 9 aa, Homo Sapiens
ALNGIIQGF

SEQ ID NO: 1211201 - protein, 9 aa, Homo Sapiens
IAPMMLWGL

SEQ ID NO: 1211202 - protein, 9 aa, Homo Sapiens
QGGCSAVID

SEQ ID NO: 1211203 - protein, 9 aa, Homo Sapiens
SRMLKQAAL

SEQ ID NO: 1211204 - protein, 9 aa, Homo Sapiens
RNEVRHIYT

SEQ ID NO: 1211205 - protein, 9 aa, Homo Sapiens
AQGNNRLKL

SEQ ID NO: 1211206 - protein, 9 aa, Homo Sapiens
GMFVNVMNK

SEQ ID NO: 1211207 - protein, 9 aa, Homo Sapiens
ISEGNHPGT

SEQ ID NO: 1211208 - protein, 9 aa, Homo Sapiens
VSTFVVFLV

SEQ ID NO: 1211209 - protein, 9 aa, Homo Sapiens
ILGRKYGVA

SEQ ID NO: 1211210 - protein, 9 aa, Homo Sapiens
REKVHELQA

SEQ ID NO: 1211211 - protein, 9 aa, Homo Sapiens
GLAPFPRAA

SEQ ID NO: 1211212 - protein, 9 aa, Homo Sapiens
VWFKANRVY

SEQ ID NO: 1211213 - protein, 9 aa, Homo Sapiens
ACVRYIKER

SEQ ID NO: 1211214 - protein, 9 aa, Homo Sapiens
LGRKYGVAT

SEQ ID NO: 1211215 - protein, 9 aa, Homo Sapiens
PDQEPTHTG

SEQ ID NO: 1211216 - protein, 9 aa, Homo Sapiens
LRYLHSNCL

SEQ ID NO: 1211217 - protein, 9 aa, Homo Sapiens
ARYPKMYLD

SEQ ID NO: 1211218 - protein, 9 aa, Homo Sapiens
ENEHMRLEL

SEQ ID NO: 1211219 - protein, 9 aa, Homo Sapiens
SRGIVSFVC

SEQ ID NO: 1211220 - protein, 9 aa, Homo Sapiens
GKSEKIVLP

SEQ ID NO: 1211221 - protein, 9 aa, Homo Sapiens
VASFETNFF

SEQ ID NO: 1211222 - protein, 9 aa, Homo Sapiens
NPSTAFYQV

SEQ ID NO: 1211223 - protein, 9 aa, Homo Sapiens
EWRIFQLHM

SEQ ID NO: 1211224 - protein, 9 aa, Homo Sapiens
EHLELHKKY

SEQ ID NO: 1211225 - protein, 9 aa, Homo Sapiens
FHHYRSHNP

SEQ ID NO: 1211226 - protein, 9 aa, Homo Sapiens
AVSAVVGPV

SEQ ID NO: 1211227 - protein, 9 aa, Homo Sapiens
ILKNPQLHA

SEQ ID NO: 1211228 - protein, 9 aa, Homo Sapiens
MSRGREKCH

SEQ ID NO: 1211229 - protein, 9 aa, Homo Sapiens
SIHTTAFPS

SEQ ID NO: 1211230 - protein, 9 aa, Homo Sapiens
DPWSVSAAS

SEQ ID NO: 1211231 - protein, 9 aa, Homo Sapiens
PLPDIDHVP

SEQ ID NO: 1211232 - protein, 9 aa, Homo Sapiens
LIYQGHLLQ

SEQ ID NO: 1211233 - protein, 9 aa, Homo Sapiens
VIIVGLDNG

SEQ ID NO: 1211234 - protein, 9 aa, Homo Sapiens
NSYFYRSSF

SEQ ID NO: 1211235 - protein, 9 aa, Homo Sapiens
PGHQALGGD

SEQ ID NO: 1211236 - protein, 9 aa, Homo Sapiens
GHQKNTTVS

SEQ ID NO: 1211237 - protein, 9 aa, Homo Sapiens
GPPGVHGLQ

SEQ ID NO: 1211238 - protein, 9 aa, Homo Sapiens
NSGCSAVSG

SEQ ID NO: 1211239 - protein, 9 aa, Homo Sapiens
PTSKYNHDN

SEQ ID NO: 1211240 - protein, 9 aa, Homo Sapiens
EGSAEIPTG

SEQ ID NO: 1211241 - protein, 9 aa, Homo Sapiens
HLPQLMLQS

SEQ ID NO: 1211242 - protein, 9 aa, Homo Sapiens
DSFQVKRPG

SEQ ID NO: 1211243 - protein, 9 aa, Homo Sapiens
LLSAVFYLL

SEQ ID NO: 1211244 - protein, 9 aa, Homo Sapiens
RMNTIDQDD

SEQ ID NO: 1211245 - protein, 9 aa, Homo Sapiens
EEAGKFMDD

SEQ ID NO: 1211246 - protein, 9 aa, Homo Sapiens
NLMAYDFHD

SEQ ID NO: 1211247 - protein, 9 aa, Homo Sapiens
LGIETRCDD

SEQ ID NO: 1211248 - protein, 9 aa, Homo Sapiens
ISVDNFEDC

SEQ ID NO: 1211249 - protein, 9 aa, Homo Sapiens
ICLKEISQD

SEQ ID NO: 1211250 - protein, 9 aa, Homo Sapiens
ATLAYVNSL

SEQ ID NO: 1211251 - protein, 9 aa, Homo Sapiens
TRMVDIPCG

SEQ ID NO: 1211252 - protein, 9 aa, Homo Sapiens
VFGFEQAVR

SEQ ID NO: 1211253 - protein, 9 aa, Homo Sapiens
NPGSLHNFH

SEQ ID NO: 1211254 - protein, 9 aa, Homo Sapiens
EFRVMLLAW

SEQ ID NO: 1211255 - protein, 9 aa, Homo Sapiens
PVRSSSIEQ

SEQ ID NO: 1211256 - protein, 9 aa, Homo Sapiens
DQVTGDDTI

SEQ ID NO: 1211257 - protein, 9 aa, Homo Sapiens
QKFFFDRSP

SEQ ID NO: 1211258 - protein, 9 aa, Homo Sapiens
LKAMFSGHM

SEQ ID NO: 1211259 - protein, 9 aa, Homo Sapiens
YTLGFMSLD

SEQ ID NO: 1211260 - protein, 9 aa, Homo Sapiens
KRQTLREDR

SEQ ID NO: 1211261 - protein, 9 aa, Homo Sapiens
FLTLWPDQQ

SEQ ID NO: 1211262 - protein, 9 aa, Homo Sapiens
VGPPESAES

SEQ ID NO: 1211263 - protein, 9 aa, Homo Sapiens
HGVVSFSLG

SEQ ID NO: 1211264 - protein, 9 aa, Homo Sapiens
PTLLATQAG

SEQ ID NO: 1211265 - protein, 9 aa, Homo Sapiens
LHMDTIYNR

SEQ ID NO: 1211266 - protein, 9 aa, Homo Sapiens
KPESRMLKQ

SEQ ID NO: 1211267 - protein, 9 aa, Homo Sapiens
QHRGRGRRP

SEQ ID NO: 1211268 - protein, 9 aa, Homo Sapiens
FLPMWMRSL

SEQ ID NO: 1211269 - protein, 9 aa, Homo Sapiens
LPWRPNTYY

SEQ ID NO: 1211270 - protein, 9 aa, Homo Sapiens
GGLNFETTE

SEQ ID NO: 1211271 - protein, 9 aa, Homo Sapiens
PPTPGSCPV

SEQ ID NO: 1211272 - protein, 9 aa, Homo Sapiens
SVLVTPELL

SEQ ID NO: 1211273 - protein, 9 aa, Homo Sapiens
KKVLPELIY

SEQ ID NO: 1211274 - protein, 9 aa, Homo Sapiens
DPSSIVSLL

SEQ ID NO: 1211275 - protein, 9 aa, Homo Sapiens
PSDIIVKAC

SEQ ID NO: 1211276 - protein, 9 aa, Homo Sapiens
TFILRNVIK

SEQ ID NO: 1211277 - protein, 9 aa, Homo Sapiens
SDTLACLKE

SEQ ID NO: 1211278 - protein, 9 aa, Homo Sapiens
DIPALGVSI

SEQ ID NO: 1211279 - protein, 9 aa, Homo Sapiens
KKLIGIYRL

SEQ ID NO: 1211280 - protein, 9 aa, Homo Sapiens
LPRFHEVPL

SEQ ID NO: 1211281 - protein, 9 aa, Homo Sapiens
SWSLSWPPG

SEQ ID NO: 1211282 - protein, 9 aa, Homo Sapiens
KFGYKLMMV

SEQ ID NO: 1211283 - protein, 9 aa, Homo Sapiens
HGFTSFRWW

SEQ ID NO: 1211284 - protein, 9 aa, Homo Sapiens
PRAPDSRDA

SEQ ID NO: 1211285 - protein, 9 aa, Homo Sapiens
DTRGKYSDL

SEQ ID NO: 1211286 - protein, 9 aa, Homo Sapiens
LLYATVLVL

SEQ ID NO: 1211287 - protein, 9 aa, Homo Sapiens
VHRFLFLKI

SEQ ID NO: 1211288 - protein, 9 aa, Homo Sapiens
LEDERKQHA

SEQ ID NO: 1211289 - protein, 9 aa, Homo Sapiens
YRCEEYGKA

SEQ ID NO: 1211290 - protein, 9 aa, Homo Sapiens
ISRILNNGL

SEQ ID NO: 1211291 - protein, 9 aa, Homo Sapiens
PHGVKKPNK

SEQ ID NO: 1211292 - protein, 9 aa, Homo Sapiens
LLVTVAFIV

SEQ ID NO: 1211293 - protein, 9 aa, Homo Sapiens
LILDWIPYI

SEQ ID NO: 1211294 - protein, 9 aa, Homo Sapiens
LEVAGTKVI

SEQ ID NO: 1211295 - protein, 9 aa, Homo Sapiens
NDIMLVKLN

SEQ ID NO: 1211296 - protein, 9 aa, Homo Sapiens
HLNLPHGNV

SEQ ID NO: 1211297 - protein, 9 aa, Homo Sapiens
PQALMLPPW

SEQ ID NO: 1211298 - protein, 9 aa, Homo Sapiens
SPGSHGQEQ

SEQ ID NO: 1211299 - protein, 9 aa, Homo Sapiens
GPWLRMCPW

SEQ ID NO: 1211300 - protein, 9 aa, Homo Sapiens
HLAVLQHLR

SEQ ID NO: 1211301 - protein, 9 aa, Homo Sapiens
RNKEVKAVM

SEQ ID NO: 1211302 - protein, 9 aa, Homo Sapiens
INCLGPQRS

SEQ ID NO: 1211303 - protein, 9 aa, Homo Sapiens
CAMREMNGK

SEQ ID NO: 1211304 - protein, 9 aa, Homo Sapiens
CYRQCGLHD

SEQ ID NO: 1211305 - protein, 9 aa, Homo Sapiens
HHHGQLIFC

SEQ ID NO: 1211306 - protein, 9 aa, Homo Sapiens
KKVGDLILA

SEQ ID NO: 1211307 - protein, 9 aa, Homo Sapiens
SVDDLRINL

SEQ ID NO: 1211308 - protein, 9 aa, Homo Sapiens
SPVDALKGL

SEQ ID NO: 1211309 - protein, 9 aa, Homo Sapiens
PYVKACLLP

SEQ ID NO: 1211310 - protein, 9 aa, Homo Sapiens
GGILASLQI

SEQ ID NO: 1211311 - protein, 9 aa, Homo Sapiens
SSPSQESGS

SEQ ID NO: 1211312 - protein, 9 aa, Homo Sapiens
QDNVPLLHG

SEQ ID NO: 1211313 - protein, 9 aa, Homo Sapiens
KKRISNHFQ

SEQ ID NO: 1211314 - protein, 9 aa, Homo Sapiens
LTADLCSVQ

SEQ ID NO: 1211315 - protein, 9 aa, Homo Sapiens
SSMICVPLV

SEQ ID NO: 1211316 - protein, 9 aa, Homo Sapiens
APARSYQGV

SEQ ID NO: 1211317 - protein, 9 aa, Homo Sapiens
VPLKGCLLH

SEQ ID NO: 1211318 - protein, 9 aa, Homo Sapiens
GDAVYRVFK

SEQ ID NO: 1211319 - protein, 9 aa, Homo Sapiens
QLLAMTLRL

SEQ ID NO: 1211320 - protein, 9 aa, Homo Sapiens
GRRPYKGDL

SEQ ID NO: 1211321 - protein, 9 aa, Homo Sapiens
VPDQTDDIP

SEQ ID NO: 1211322 - protein, 9 aa, Homo Sapiens
QASLVRDLQ

SEQ ID NO: 1211323 - protein, 9 aa, Homo Sapiens
ILKNIFKAD

SEQ ID NO: 1211324 - protein, 9 aa, Homo Sapiens
DAIDGGRAS

SEQ ID NO: 1211325 - protein, 9 aa, Homo Sapiens
SMKHPARNV

SEQ ID NO: 1211326 - protein, 9 aa, Homo Sapiens
AKTHLGDSE

SEQ ID NO: 1211327 - protein, 9 aa, Homo Sapiens
SVIMFDQSF

SEQ ID NO: 1211328 - protein, 9 aa, Homo Sapiens
DSSVFGVIY

SEQ ID NO: 1211329 - protein, 9 aa, Homo Sapiens
LLLHEVLAK

SEQ ID NO: 1211330 - protein, 9 aa, Homo Sapiens
NVLIGRQGN

SEQ ID NO: 1211331 - protein, 9 aa, Homo Sapiens
PMAHLSEDQ

SEQ ID NO: 1211332 - protein, 9 aa, Homo Sapiens
HLLQFQEEV

SEQ ID NO: 1211333 - protein, 9 aa, Homo Sapiens
EGSMQTLTK

SEQ ID NO: 1211334 - protein, 9 aa, Homo Sapiens
ARPVQDISL

SEQ ID NO: 1211335 - protein, 9 aa, Homo Sapiens
IYVRNLMIE

SEQ ID NO: 1211336 - protein, 9 aa, Homo Sapiens
SDTPIMRSL

SEQ ID NO: 1211337 - protein, 9 aa, Homo Sapiens
HLGCKEDYA

SEQ ID NO: 1211338 - protein, 9 aa, Homo Sapiens
WSQCSRSCE

SEQ ID NO: 1211339 - protein, 9 aa, Homo Sapiens
LGLEEWPEL

SEQ ID NO: 1211340 - protein, 9 aa, Homo Sapiens
CPKCDKIFD

SEQ ID NO: 1211341 - protein, 9 aa, Homo Sapiens
SNDGFCKMS

SEQ ID NO: 1211342 - protein, 9 aa, Homo Sapiens
GVADVLARR

SEQ ID NO: 1211343 - protein, 9 aa, Homo Sapiens
QHSYSSKPP

SEQ ID NO: 1211344 - protein, 9 aa, Homo Sapiens
GDMGGTRTL

SEQ ID NO: 1211345 - protein, 9 aa, Homo Sapiens
SHIIVHIRT

SEQ ID NO: 1211346 - protein, 9 aa, Homo Sapiens
GDSACQDVN

SEQ ID NO: 1211347 - protein, 9 aa, Homo Sapiens
MQSQITRIP

SEQ ID NO: 1211348 - protein, 9 aa, Homo Sapiens
KAGHSYDSK

SEQ ID NO: 1211349 - protein, 9 aa, Homo Sapiens
SIPCCFSWS

SEQ ID NO: 1211350 - protein, 9 aa, Homo Sapiens
SMRAQDRYY

SEQ ID NO: 1211351 - protein, 9 aa, Homo Sapiens
EDPQAYTSL

SEQ ID NO: 1211352 - protein, 9 aa, Homo Sapiens
SETSKKHSN

SEQ ID NO: 1211353 - protein, 9 aa, Homo Sapiens
GWERTRKHS

SEQ ID NO: 1211354 - protein, 9 aa, Homo Sapiens
KATVPFKYE

SEQ ID NO: 1211355 - protein, 9 aa, Homo Sapiens
TGTVQRVTL

SEQ ID NO: 1211356 - protein, 9 aa, Homo Sapiens
GFSFSFSPG

SEQ ID NO: 1211357 - protein, 9 aa, Homo Sapiens
PRGSRTHIT

SEQ ID NO: 1211358 - protein, 9 aa, Homo Sapiens
AANDYNQKL

SEQ ID NO: 1211359 - protein, 9 aa, Homo Sapiens
PPSSDVLRI

SEQ ID NO: 1211360 - protein, 9 aa, Homo Sapiens
GKCWEMKSV

SEQ ID NO: 1211361 - protein, 9 aa, Homo Sapiens
NSLIRNLLE

SEQ ID NO: 1211362 - protein, 9 aa, Homo Sapiens
NSTDVQARI

SEQ ID NO: 1211363 - protein, 9 aa, Homo Sapiens
ASNPESAAS

SEQ ID NO: 1211364 - protein, 9 aa, Homo Sapiens
WESCCRTTP

SEQ ID NO: 1211365 - protein, 9 aa, Homo Sapiens
TLGIIVRAF

SEQ ID NO: 1211366 - protein, 9 aa, Homo Sapiens
RDPQVLILD

SEQ ID NO: 1211367 - protein, 9 aa, Homo Sapiens
AALLGDLIQ

SEQ ID NO: 1211368 - protein, 9 aa, Homo Sapiens
KASCEICVL

SEQ ID NO: 1211369 - protein, 9 aa, Homo Sapiens
LVDQVTGDD

SEQ ID NO: 1211370 - protein, 9 aa, Homo Sapiens
KMCQPELES

SEQ ID NO: 1211371 - protein, 9 aa, Homo Sapiens
HPPPPAGLG

SEQ ID NO: 1211372 - protein, 9 aa, Homo Sapiens
MCENENGEE

SEQ ID NO: 1211373 - protein, 9 aa, Homo Sapiens
APIRRHSSN

SEQ ID NO: 1211374 - protein, 9 aa, Homo Sapiens
AQLHAQDYP

SEQ ID NO: 1211375 - protein, 9 aa, Homo Sapiens
VQVQSLKEE

SEQ ID NO: 1211376 - protein, 9 aa, Homo Sapiens
WIGVHYDEP

SEQ ID NO: 1211377 - protein, 9 aa, Homo Sapiens
KKAAATSSK

SEQ ID NO: 1211378 - protein, 9 aa, Homo Sapiens
NMEIDNSAT

SEQ ID NO: 1211379 - protein, 9 aa, Homo Sapiens
LSGDNYLWS

SEQ ID NO: 1211380 - protein, 9 aa, Homo Sapiens
SRPSRQLLR

SEQ ID NO: 1211381 - protein, 9 aa, Homo Sapiens
KAPDSTSNL

SEQ ID NO: 1211382 - protein, 9 aa, Homo Sapiens
LVCEIGLHC

SEQ ID NO: 1211383 - protein, 9 aa, Homo Sapiens
EPYRLVEGQ

SEQ ID NO: 1211384 - protein, 9 aa, Homo Sapiens
QSLEFQTEY

SEQ ID NO: 1211385 - protein, 9 aa, Homo Sapiens
VEGGHTQDL

SEQ ID NO: 1211386 - protein, 9 aa, Homo Sapiens
AGCWTVRGS

SEQ ID NO: 1211387 - protein, 9 aa, Homo Sapiens
GATAAPPES

SEQ ID NO: 1211388 - protein, 9 aa, Homo Sapiens
SHFGYGVAS

SEQ ID NO: 1211389 - protein, 9 aa, Homo Sapiens
RSVDPGENS

SEQ ID NO: 1211390 - protein, 9 aa, Homo Sapiens
TNHSDRPPQ

SEQ ID NO: 1211391 - protein, 9 aa, Homo Sapiens
GKAHEIPVP

SEQ ID NO: 1211392 - protein, 9 aa, Homo Sapiens
YVGTLDLVD

SEQ ID NO: 1211393 - protein, 9 aa, Homo Sapiens
RGRLDFKHL

SEQ ID NO: 1211394 - protein, 9 aa, Homo Sapiens
AVPGRLFVT

SEQ ID NO: 1211395 - protein, 9 aa, Homo Sapiens
AMTMDQYPF

SEQ ID NO: 1211396 - protein, 9 aa, Homo Sapiens
KTIWQDLIC

SEQ ID NO: 1211397 - protein, 9 aa, Homo Sapiens
ADLDVTVKT

SEQ ID NO: 1211398 - protein, 9 aa, Homo Sapiens
SLSENNMSD

SEQ ID NO: 1211399 - protein, 9 aa, Homo Sapiens
PLFFPRRFV

SEQ ID NO: 1211400 - protein, 9 aa, Homo Sapiens
RRIPAGRRS

SEQ ID NO: 1211401 - protein, 9 aa, Homo Sapiens
STRPAAGVG

SEQ ID NO: 1211402 - protein, 9 aa, Homo Sapiens
QQERSFLDL

SEQ ID NO: 1211403 - protein, 9 aa, Homo Sapiens
YPEARKKDT

SEQ ID NO: 1211404 - protein, 9 aa, Homo Sapiens
KKLHHLGND

SEQ ID NO: 1211405 - protein, 9 aa, Homo Sapiens
DFNKLPKKL

SEQ ID NO: 1211406 - protein, 9 aa, Homo Sapiens
LTMNRTNIN

SEQ ID NO: 1211407 - protein, 9 aa, Homo Sapiens
TSLNHPPYM

SEQ ID NO: 1211408 - protein, 9 aa, Homo Sapiens
KCSSASVDN

SEQ ID NO: 1211409 - protein, 9 aa, Homo Sapiens
QSKEKHVMK

SEQ ID NO: 1211410 - protein, 9 aa, Homo Sapiens
PPQGDVEAV

SEQ ID NO: 1211411 - protein, 9 aa, Homo Sapiens
SVNRGMFLC

SEQ ID NO: 1211412 - protein, 9 aa, Homo Sapiens
GNNLVYSAP

SEQ ID NO: 1211413 - protein, 9 aa, Homo Sapiens
KIKQQQYAG

SEQ ID NO: 1211414 - protein, 9 aa, Homo Sapiens
LVGICWYQC

SEQ ID NO: 1211415 - protein, 9 aa, Homo Sapiens
SYISICNRD

SEQ ID NO: 1211416 - protein, 9 aa, Homo Sapiens
RLLKCMVII

SEQ ID NO: 1211417 - protein, 9 aa, Homo Sapiens
STTAVRHGS

SEQ ID NO: 1211418 - protein, 9 aa, Homo Sapiens
TGQKVGTLR

SEQ ID NO: 1211419 - protein, 9 aa, Homo Sapiens
RLLRDISER

SEQ ID NO: 1211420 - protein, 9 aa, Homo Sapiens
AGLIIVHAT

SEQ ID NO: 1211421 - protein, 9 aa, Homo Sapiens
HLEEWRTLV

SEQ ID NO: 1211422 - protein, 9 aa, Homo Sapiens
QSCIQFQPN

SEQ ID NO: 1211423 - protein, 9 aa, Homo Sapiens
DKALNALNN

SEQ ID NO: 1211424 - protein, 9 aa, Homo Sapiens
AQGRNQEEH

SEQ ID NO: 1211425 - protein, 9 aa, Homo Sapiens
FFIIGVIIG

SEQ ID NO: 1211426 - protein, 9 aa, Homo Sapiens
FIPLSNFVT

SEQ ID NO: 1211427 - protein, 9 aa, Homo Sapiens
RLNQLKFRK

SEQ ID NO: 1211428 - protein, 9 aa, Homo Sapiens
PDKLKNIFM

SEQ ID NO: 1211429 - protein, 9 aa, Homo Sapiens
TPPSYIGIP

SEQ ID NO: 1211430 - protein, 9 aa, Homo Sapiens
FAIKQEVIT

SEQ ID NO: 1211431 - protein, 9 aa, Homo Sapiens
HVMKQEVLP

SEQ ID NO: 1211432 - protein, 9 aa, Homo Sapiens
ISNHFQGLS

SEQ ID NO: 1211433 - protein, 9 aa, Homo Sapiens
DIGTFDIYV

SEQ ID NO: 1211434 - protein, 9 aa, Homo Sapiens
AKKVTHILK

SEQ ID NO: 1211435 - protein, 9 aa, Homo Sapiens
HVVVRPYPQ

SEQ ID NO: 1211436 - protein, 9 aa, Homo Sapiens
GKCLKQSGH

SEQ ID NO: 1211437 - protein, 9 aa, Homo Sapiens
IDHIDKKDV

SEQ ID NO: 1211438 - protein, 9 aa, Homo Sapiens
STLLHHRRS

SEQ ID NO: 1211439 - protein, 9 aa, Homo Sapiens
SDWGKHCVD

SEQ ID NO: 1211440 - protein, 9 aa, Homo Sapiens
DIEKKLTSL

SEQ ID NO: 1211441 - protein, 9 aa, Homo Sapiens
ETVKIIYVR

SEQ ID NO: 1211442 - protein, 9 aa, Homo Sapiens
QHPDYGQRF

SEQ ID NO: 1211443 - protein, 9 aa, Homo Sapiens
REHLSLAVG

SEQ ID NO: 1211444 - protein, 9 aa, Homo Sapiens
LQVHMALQL

SEQ ID NO: 1211445 - protein, 9 aa, Homo Sapiens
GVTYETHHM

SEQ ID NO: 1211446 - protein, 9 aa, Homo Sapiens
EELLAEASI

SEQ ID NO: 1211447 - protein, 9 aa, Homo Sapiens
EWPFRCVDC

SEQ ID NO: 1211448 - protein, 9 aa, Homo Sapiens
SDVFEITDF

SEQ ID NO: 1211449 - protein, 9 aa, Homo Sapiens
DIETVKAGH

SEQ ID NO: 1211450 - protein, 9 aa, Homo Sapiens
ETCSVRSFM

SEQ ID NO: 1211451 - protein, 9 aa, Homo Sapiens
VLLCKEILH

SEQ ID NO: 1211452 - protein, 9 aa, Homo Sapiens
SKTYINSLT

SEQ ID NO: 1211453 - protein, 9 aa, Homo Sapiens
PAKECTAPT

SEQ ID NO: 1211454 - protein, 9 aa, Homo Sapiens
FHCQEQTDP

SEQ ID NO: 1211455 - protein, 9 aa, Homo Sapiens
GRRPRTQAM

SEQ ID NO: 1211456 - protein, 9 aa, Homo Sapiens
VWRMPEFGD

SEQ ID NO: 1211457 - protein, 9 aa, Homo Sapiens
EYKFGPIFV

SEQ ID NO: 1211458 - protein, 9 aa, Homo Sapiens
FNHSAQLDV

SEQ ID NO: 1211459 - protein, 9 aa, Homo Sapiens
ILLRDQALS

SEQ ID NO: 1211460 - protein, 9 aa, Homo Sapiens
SIQSKLSPK

SEQ ID NO: 1211461 - protein, 9 aa, Homo Sapiens
FNAFKTVMG

SEQ ID NO: 1211462 - protein, 9 aa, Homo Sapiens
FGQVCALSI

SEQ ID NO: 1211463 - protein, 9 aa, Homo Sapiens
GTPRLQTTV

SEQ ID NO: 1211464 - protein, 9 aa, Homo Sapiens
LLTLVLELL

SEQ ID NO: 1211465 - protein, 9 aa, Homo Sapiens
GRFAVLGTM

SEQ ID NO: 1211466 - protein, 9 aa, Homo Sapiens
EAVCKYFQL

SEQ ID NO: 1211467 - protein, 9 aa, Homo Sapiens
QIKTAHTTM

SEQ ID NO: 1211468 - protein, 9 aa, Homo Sapiens
VNKRKKCIL

SEQ ID NO: 1211469 - protein, 9 aa, Homo Sapiens
FICRKKVGL

SEQ ID NO: 1211470 - protein, 9 aa, Homo Sapiens
STGNGPPTW

SEQ ID NO: 1211471 - protein, 9 aa, Homo Sapiens
RLPGADVGV

SEQ ID NO: 1211472 - protein, 9 aa, Homo Sapiens
TNYRLRMHL

SEQ ID NO: 1211473 - protein, 9 aa, Homo Sapiens
IVFVTIPVV

SEQ ID NO: 1211474 - protein, 9 aa, Homo Sapiens
SLLKEGHRR

SEQ ID NO: 1211475 - protein, 9 aa, Homo Sapiens
QSTCQKENQ

SEQ ID NO: 1211476 - protein, 9 aa, Homo Sapiens
CWLGCLAGP

SEQ ID NO: 1211477 - protein, 9 aa, Homo Sapiens
AMTLRLRES

SEQ ID NO: 1211478 - protein, 9 aa, Homo Sapiens
HKKLSLRFE

SEQ ID NO: 1211479 - protein, 9 aa, Homo Sapiens
PFRQGMQLE

SEQ ID NO: 1211480 - protein, 9 aa, Homo Sapiens
LSMDPTFAL

SEQ ID NO: 1211481 - protein, 9 aa, Homo Sapiens
KDWKKEKLR

SEQ ID NO: 1211482 - protein, 9 aa, Homo Sapiens
CHLETHDDC

SEQ ID NO: 1211483 - protein, 9 aa, Homo Sapiens
WSKVYNPLY

SEQ ID NO: 1211484 - protein, 9 aa, Homo Sapiens
VGLEVSNNG

SEQ ID NO: 1211485 - protein, 9 aa, Homo Sapiens
VGILIAHYI

SEQ ID NO: 1211486 - protein, 9 aa, Homo Sapiens
EGVLAIINH

SEQ ID NO: 1211487 - protein, 9 aa, Homo Sapiens
GRGTGGTFV

SEQ ID NO: 1211488 - protein, 9 aa, Homo Sapiens
ATKSISASA

SEQ ID NO: 1211489 - protein, 9 aa, Homo Sapiens
VWYQQPRWV

SEQ ID NO: 1211490 - protein, 9 aa, Homo Sapiens
CPLLCTMEK

SEQ ID NO: 1211491 - protein, 9 aa, Homo Sapiens
QLCLRIQTR

SEQ ID NO: 1211492 - protein, 9 aa, Homo Sapiens
PGATVMPGA

SEQ ID NO: 1211493 - protein, 9 aa, Homo Sapiens
ALGFENVTQ

SEQ ID NO: 1211494 - protein, 9 aa, Homo Sapiens
SPFYQWMDT

SEQ ID NO: 1211495 - protein, 9 aa, Homo Sapiens
FRMEQLVFC

SEQ ID NO: 1211496 - protein, 9 aa, Homo Sapiens
DYELIDQDD

SEQ ID NO: 1211497 - protein, 9 aa, Homo Sapiens
IYAREMLAM

SEQ ID NO: 1211498 - protein, 9 aa, Homo Sapiens
SYVLRSTWT

SEQ ID NO: 1211499 - protein, 9 aa, Homo Sapiens
RMFDAEKIR

SEQ ID NO: 1211500 - protein, 9 aa, Homo Sapiens
LEIMTVVIL

SEQ ID NO: 1211501 - protein, 9 aa, Homo Sapiens
SCASRLMRR

SEQ ID NO: 1211502 - protein, 9 aa, Homo Sapiens
ITSIFSLAI

SEQ ID NO: 1211503 - protein, 9 aa, Homo Sapiens
TSWHCSMAA

SEQ ID NO: 1211504 - protein, 9 aa, Homo Sapiens
LCSSISPGT

SEQ ID NO: 1211505 - protein, 9 aa, Homo Sapiens
FSMEQVQAY

SEQ ID NO: 1211506 - protein, 9 aa, Homo Sapiens
LESGHFPSM

SEQ ID NO: 1211507 - protein, 9 aa, Homo Sapiens
NSSSATSGY

SEQ ID NO: 1211508 - protein, 9 aa, Homo Sapiens
VGPPCRSSR

SEQ ID NO: 1211509 - protein, 9 aa, Homo Sapiens
EDNEFHCQE

SEQ ID NO: 1211510 - protein, 9 aa, Homo Sapiens
PPEAPLTPR

SEQ ID NO: 1211511 - protein, 9 aa, Homo Sapiens
ASLDIGDFT

SEQ ID NO: 1211512 - protein, 9 aa, Homo Sapiens
GSVGDATAP

SEQ ID NO: 1211513 - protein, 9 aa, Homo Sapiens
SENTPFHLS

SEQ ID NO: 1211514 - protein, 9 aa, Homo Sapiens
KSEDQGLQG

SEQ ID NO: 1211515 - protein, 9 aa, Homo Sapiens
DVHRLFEAF

SEQ ID NO: 1211516 - protein, 9 aa, Homo Sapiens
CQQQKDFID

SEQ ID NO: 1211517 - protein, 9 aa, Homo Sapiens
DYEKGAILK

SEQ ID NO: 1211518 - protein, 9 aa, Homo Sapiens
PRRLSQHQP

SEQ ID NO: 1211519 - protein, 9 aa, Homo Sapiens
DICPLFQTP

SEQ ID NO: 1211520 - protein, 9 aa, Homo Sapiens
SSKRQALMP

SEQ ID NO: 1211521 - protein, 9 aa, Homo Sapiens
RSPSTSAYL

SEQ ID NO: 1211522 - protein, 9 aa, Homo Sapiens
GGPPTETNS

SEQ ID NO: 1211523 - protein, 9 aa, Homo Sapiens
DDPMYGMCP

SEQ ID NO: 1211524 - protein, 9 aa, Homo Sapiens
SLESHLNSD

SEQ ID NO: 1211525 - protein, 9 aa, Homo Sapiens
VFFFTFMAQ

SEQ ID NO: 1211526 - protein, 9 aa, Homo Sapiens
LRTMGIRQP

SEQ ID NO: 1211527 - protein, 9 aa, Homo Sapiens
LVTEEGKHH

SEQ ID NO: 1211528 - protein, 9 aa, Homo Sapiens
QEDTQYMTM

SEQ ID NO: 1211529 - protein, 9 aa, Homo Sapiens
EKTIWQDLI

SEQ ID NO: 1211530 - protein, 9 aa, Homo Sapiens
VGMLNGGHR

SEQ ID NO: 1211531 - protein, 9 aa, Homo Sapiens
HPRLLIVHI

SEQ ID NO: 1211532 - protein, 9 aa, Homo Sapiens
TLAMVLGAF

SEQ ID NO: 1211533 - protein, 9 aa, Homo Sapiens
ARSSVRQLD

SEQ ID NO: 1211534 - protein, 9 aa, Homo Sapiens
FTKTHHAYA

SEQ ID NO: 1211535 - protein, 9 aa, Homo Sapiens
PAPCHDQVL

SEQ ID NO: 1211536 - protein, 9 aa, Homo Sapiens
FQRSQHPHT

SEQ ID NO: 1211537 - protein, 9 aa, Homo Sapiens
GSSDHPISA

SEQ ID NO: 1211538 - protein, 9 aa, Homo Sapiens
HHPFIKNAK

SEQ ID NO: 1211539 - protein, 9 aa, Homo Sapiens
KGMQRFAGL

SEQ ID NO: 1211540 - protein, 9 aa, Homo Sapiens
LMFKVDQDL

SEQ ID NO: 1211541 - protein, 9 aa, Homo Sapiens
HLNGVTVKT

SEQ ID NO: 1211542 - protein, 9 aa, Homo Sapiens
KTSGTKSSR

SEQ ID NO: 1211543 - protein, 9 aa, Homo Sapiens
DDVNVYFSK

SEQ ID NO: 1211544 - protein, 9 aa, Homo Sapiens
TISFLQCIM

SEQ ID NO: 1211545 - protein, 9 aa, Homo Sapiens
MKGLFQNPT

SEQ ID NO: 1211546 - protein, 9 aa, Homo Sapiens
TVKKSSVMC

SEQ ID NO: 1211547 - protein, 9 aa, Homo Sapiens
DPSAIMSPF

SEQ ID NO: 1211548 - protein, 9 aa, Homo Sapiens
YESHLLHID

SEQ ID NO: 1211549 - protein, 9 aa, Homo Sapiens
VTIGLAAAL

SEQ ID NO: 1211550 - protein, 9 aa, Homo Sapiens
MGHITLAKK

SEQ ID NO: 1211551 - protein, 9 aa, Homo Sapiens
IFPPSGMGY

SEQ ID NO: 1211552 - protein, 9 aa, Homo Sapiens
WRRPPDDDF

SEQ ID NO: 1211553 - protein, 9 aa, Homo Sapiens
SLTPPTSSR

SEQ ID NO: 1211554 - protein, 9 aa, Homo Sapiens
ISEQTVVTL

SEQ ID NO: 1211555 - protein, 9 aa, Homo Sapiens
AAKYGYALC

SEQ ID NO: 1211556 - protein, 9 aa, Homo Sapiens
NTWPICWGG

SEQ ID NO: 1211557 - protein, 9 aa, Homo Sapiens
GDGMMERRE

SEQ ID NO: 1211558 - protein, 9 aa, Homo Sapiens
CAFKLYSLH

SEQ ID NO: 1211559 - protein, 9 aa, Homo Sapiens
ACMARLCVC

SEQ ID NO: 1211560 - protein, 9 aa, Homo Sapiens
EVSFLETSS

SEQ ID NO: 1211561 - protein, 9 aa, Homo Sapiens
QENVKAAII

SEQ ID NO: 1211562 - protein, 9 aa, Homo Sapiens
IVSVAMVQA

SEQ ID NO: 1211563 - protein, 9 aa, Homo Sapiens
ALVISWGTL

SEQ ID NO: 1211564 - protein, 9 aa, Homo Sapiens
PAFAGTSPV

SEQ ID NO: 1211565 - protein, 9 aa, Homo Sapiens
NSMKPQSLQ

SEQ ID NO: 1211566 - protein, 9 aa, Homo Sapiens
PCPRERLKE

SEQ ID NO: 1211567 - protein, 9 aa, Homo Sapiens
GHSKTFDWA

SEQ ID NO: 1211568 - protein, 9 aa, Homo Sapiens
HSEPEDPDT

SEQ ID NO: 1211569 - protein, 9 aa, Homo Sapiens
FLQLQETRC

SEQ ID NO: 1211570 - protein, 9 aa, Homo Sapiens
EGERQAALG

SEQ ID NO: 1211571 - protein, 9 aa, Homo Sapiens
EINFSVIDQ

SEQ ID NO: 1211572 - protein, 9 aa, Homo Sapiens
RIKLAFKMS

SEQ ID NO: 1211573 - protein, 9 aa, Homo Sapiens
CNYDSGDCC

SEQ ID NO: 1211574 - protein, 9 aa, Homo Sapiens
PKGLHQLQT

SEQ ID NO: 1211575 - protein, 9 aa, Homo Sapiens
SQSMRITTM

SEQ ID NO: 1211576 - protein, 9 aa, Homo Sapiens
LGVAAILGI

SEQ ID NO: 1211577 - protein, 9 aa, Homo Sapiens
TYTTMIHTP

SEQ ID NO: 1211578 - protein, 9 aa, Homo Sapiens
YSVSQDPFT

SEQ ID NO: 1211579 - protein, 9 aa, Homo Sapiens
EILVWRPEA

SEQ ID NO: 1211580 - protein, 9 aa, Homo Sapiens
NLGVYRRES

SEQ ID NO: 1211581 - protein, 9 aa, Homo Sapiens
MIDVFDGNS

SEQ ID NO: 1211582 - protein, 9 aa, Homo Sapiens
VDEFLLDLG

SEQ ID NO: 1211583 - protein, 9 aa, Homo Sapiens
VVGLEMVFK

SEQ ID NO: 1211584 - protein, 9 aa, Homo Sapiens
EERNGVNDV

SEQ ID NO: 1211585 - protein, 9 aa, Homo Sapiens
GYFQQLEDK

SEQ ID NO: 1211586 - protein, 9 aa, Homo Sapiens
TNQRINKHI

SEQ ID NO: 1211587 - protein, 9 aa, Homo Sapiens
FLILYISMQ

SEQ ID NO: 1211588 - protein, 9 aa, Homo Sapiens
LEHHHGQGA

SEQ ID NO: 1211589 - protein, 9 aa, Homo Sapiens
FILAVMAFD

SEQ ID NO: 1211590 - protein, 9 aa, Homo Sapiens
NFYAVLKGT

SEQ ID NO: 1211591 - protein, 9 aa, Homo Sapiens
YEGSEHKLS

SEQ ID NO: 1211592 - protein, 9 aa, Homo Sapiens
FSWEDSRTH

SEQ ID NO: 1211593 - protein, 9 aa, Homo Sapiens
GYCVPHTDK

SEQ ID NO: 1211594 - protein, 9 aa, Homo Sapiens
WLQFWSKYK

SEQ ID NO: 1211595 - protein, 9 aa, Homo Sapiens
CSRACSCGH

SEQ ID NO: 1211596 - protein, 9 aa, Homo Sapiens
ITALVKETT

SEQ ID NO: 1211597 - protein, 9 aa, Homo Sapiens
LTSALENLQ

SEQ ID NO: 1211598 - protein, 9 aa, Homo Sapiens
KTYINSLTI

SEQ ID NO: 1211599 - protein, 9 aa, Homo Sapiens
DRQKAMKCL

SEQ ID NO: 1211600 - protein, 9 aa, Homo Sapiens
EEDMLDGHS

SEQ ID NO: 1211601 - protein, 9 aa, Homo Sapiens
SVNGLNALH

SEQ ID NO: 1211602 - protein, 9 aa, Homo Sapiens
NCKKNDETN

SEQ ID NO: 1211603 - protein, 9 aa, Homo Sapiens
MDRCFDVLA

SEQ ID NO: 1211604 - protein, 9 aa, Homo Sapiens
CRRRRLPYP

SEQ ID NO: 1211605 - protein, 9 aa, Homo Sapiens
VKILGKKKG

SEQ ID NO: 1211606 - protein, 9 aa, Homo Sapiens
MYKRIGVSA

SEQ ID NO: 1211607 - protein, 9 aa, Homo Sapiens
VKEVKKSIQ

SEQ ID NO: 1211608 - protein, 9 aa, Homo Sapiens
DVYEISYGN

SEQ ID NO: 1211609 - protein, 9 aa, Homo Sapiens
QGKGVALKF

SEQ ID NO: 1211610 - protein, 9 aa, Homo Sapiens
MLRDDAIGT

SEQ ID NO: 1211611 - protein, 9 aa, Homo Sapiens
RLRIQAEQT

SEQ ID NO: 1211612 - protein, 9 aa, Homo Sapiens
AASLIVLKN

SEQ ID NO: 1211613 - protein, 9 aa, Homo Sapiens
WRGDDCSSD

SEQ ID NO: 1211614 - protein, 9 aa, Homo Sapiens
LFTFDSEGN

SEQ ID NO: 1211615 - protein, 9 aa, Homo Sapiens
VPRLLAPCL

SEQ ID NO: 1211616 - protein, 9 aa, Homo Sapiens
LNLDFNHIT

SEQ ID NO: 1211617 - protein, 9 aa, Homo Sapiens
VMVMILVVD

SEQ ID NO: 1211618 - protein, 9 aa, Homo Sapiens
PPGDQQLHE

SEQ ID NO: 1211619 - protein, 9 aa, Homo Sapiens
QLTVSNFSN

SEQ ID NO: 1211620 - protein, 9 aa, Homo Sapiens
IVICDYDHV

SEQ ID NO: 1211621 - protein, 9 aa, Homo Sapiens
MKTGKCIHC

SEQ ID NO: 1211622 - protein, 9 aa, Homo Sapiens
KCTVENIKD

SEQ ID NO: 1211623 - protein, 9 aa, Homo Sapiens
IEHPDVNNR

SEQ ID NO: 1211624 - protein, 9 aa, Homo Sapiens
KLQQLHLTQ

SEQ ID NO: 1211625 - protein, 9 aa, Homo Sapiens
ISMTPFGGS

SEQ ID NO: 1211626 - protein, 9 aa, Homo Sapiens
LQRSPALRA

SEQ ID NO: 1211627 - protein, 9 aa, Homo Sapiens
SCTAVVYRP

SEQ ID NO: 1211628 - protein, 9 aa, Homo Sapiens
PRLCTVGLS

SEQ ID NO: 1211629 - protein, 9 aa, Homo Sapiens
VHTDGNEQI

SEQ ID NO: 1211630 - protein, 9 aa, Homo Sapiens
PPARRSGRS

SEQ ID NO: 1211631 - protein, 9 aa, Homo Sapiens
ATQKEVSLT

SEQ ID NO: 1211632 - protein, 9 aa, Homo Sapiens
TTYVMFGGK

SEQ ID NO: 1211633 - protein, 9 aa, Homo Sapiens
LSGHLGTVI

SEQ ID NO: 1211634 - protein, 9 aa, Homo Sapiens
CPYCHRCKD

SEQ ID NO: 1211635 - protein, 9 aa, Homo Sapiens
QRLPWPCCL

SEQ ID NO: 1211636 - protein, 9 aa, Homo Sapiens
PMANCSLYM

SEQ ID NO: 1211637 - protein, 9 aa, Homo Sapiens
HFHIESAQD

SEQ ID NO: 1211638 - protein, 9 aa, Homo Sapiens
CSNFWGALS

SEQ ID NO: 1211639 - protein, 9 aa, Homo Sapiens
KLLIKMKQM

SEQ ID NO: 1211640 - protein, 9 aa, Homo Sapiens
HYERKLDRA

SEQ ID NO: 1211641 - protein, 9 aa, Homo Sapiens
VNHMVENSS

SEQ ID NO: 1211642 - protein, 9 aa, Homo Sapiens
PAETVGHFS

SEQ ID NO: 1211643 - protein, 9 aa, Homo Sapiens
TPSDIIVKA

SEQ ID NO: 1211644 - protein, 9 aa, Homo Sapiens
MSQGHCTDW

SEQ ID NO: 1211645 - protein, 9 aa, Homo Sapiens
TSVIYTDTL

SEQ ID NO: 1211646 - protein, 9 aa, Homo Sapiens
LHSNCLDQV

SEQ ID NO: 1211647 - protein, 9 aa, Homo Sapiens
VHAAVTAAA

SEQ ID NO: 1211648 - protein, 9 aa, Homo Sapiens
TKQDIMLSL

SEQ ID NO: 1211649 - protein, 9 aa, Homo Sapiens
IPLMETVED

SEQ ID NO: 1211650 - protein, 9 aa, Homo Sapiens
AMGLVRRDC

SEQ ID NO: 1211651 - protein, 9 aa, Homo Sapiens
TSCCERGFT

SEQ ID NO: 1211652 - protein, 9 aa, Homo Sapiens
EEKDFLMSH

SEQ ID NO: 1211653 - protein, 9 aa, Homo Sapiens
KHGTYVMTV

SEQ ID NO: 1211654 - protein, 9 aa, Homo Sapiens
YRSLQHPNA

SEQ ID NO: 1211655 - protein, 9 aa, Homo Sapiens
GTIAIKRYF

SEQ ID NO: 1211656 - protein, 9 aa, Homo Sapiens
NPMEYANHM

SEQ ID NO: 1211657 - protein, 9 aa, Homo Sapiens
TQKEVSLTL

SEQ ID NO: 1211658 - protein, 9 aa, Homo Sapiens
SHAQMLLSR

SEQ ID NO: 1211659 - protein, 9 aa, Homo Sapiens
RGDTCHRTC

SEQ ID NO: 1211660 - protein, 9 aa, Homo Sapiens
TWSFLTAKW

SEQ ID NO: 1211661 - protein, 9 aa, Homo Sapiens
CDSIHFAVD

SEQ ID NO: 1211662 - protein, 9 aa, Homo Sapiens
QKNYNKEFL

SEQ ID NO: 1211663 - protein, 9 aa, Homo Sapiens
VDVVPSSFY

SEQ ID NO: 1211664 - protein, 9 aa, Homo Sapiens
HQDVVSVGW

SEQ ID NO: 1211665 - protein, 9 aa, Homo Sapiens
WTWARPGEI

SEQ ID NO: 1211666 - protein, 9 aa, Homo Sapiens
IQGFRVIYW

SEQ ID NO: 1211667 - protein, 9 aa, Homo Sapiens
DYLYNFSYI

SEQ ID NO: 1211668 - protein, 9 aa, Homo Sapiens
NHFMLCISE

SEQ ID NO: 1211669 - protein, 9 aa, Homo Sapiens
VYDDRGQLI

SEQ ID NO: 1211670 - protein, 9 aa, Homo Sapiens
GDPGNRGTD

SEQ ID NO: 1211671 - protein, 9 aa, Homo Sapiens
CGIYGYRLH

SEQ ID NO: 1211672 - protein, 9 aa, Homo Sapiens
CTNGHSSHR

SEQ ID NO: 1211673 - protein, 9 aa, Homo Sapiens
WFCDDILYP

SEQ ID NO: 1211674 - protein, 9 aa, Homo Sapiens
RQKYKRSID

SEQ ID NO: 1211675 - protein, 9 aa, Homo Sapiens
YTYLHPRSL

SEQ ID NO: 1211676 - protein, 9 aa, Homo Sapiens
IRCRQDDDQ

SEQ ID NO: 1211677 - protein, 9 aa, Homo Sapiens
STHNAMVPL

SEQ ID NO: 1211678 - protein, 9 aa, Homo Sapiens
PEIQRVSLE

SEQ ID NO: 1211679 - protein, 9 aa, Homo Sapiens
FISYGSCIF

SEQ ID NO: 1211680 - protein, 9 aa, Homo Sapiens
CLLHGKIYD

SEQ ID NO: 1211681 - protein, 9 aa, Homo Sapiens
SPSRSSSAA

SEQ ID NO: 1211682 - protein, 9 aa, Homo Sapiens
SAPHHMAHR

SEQ ID NO: 1211683 - protein, 9 aa, Homo Sapiens
PETLFLLYI

SEQ ID NO: 1211684 - protein, 9 aa, Homo Sapiens
PLGPELSPP

SEQ ID NO: 1211685 - protein, 9 aa, Homo Sapiens
AEAQAQHLA

SEQ ID NO: 1211686 - protein, 9 aa, Homo Sapiens
PCTNGHSSH

SEQ ID NO: 1211687 - protein, 9 aa, Homo Sapiens
GVTDSTDTQ

SEQ ID NO: 1211688 - protein, 9 aa, Homo Sapiens
LALALKDVA

SEQ ID NO: 1211689 - protein, 9 aa, Homo Sapiens
KVMTCPRCI

SEQ ID NO: 1211690 - protein, 9 aa, Homo Sapiens
LHCAFAHCP

SEQ ID NO: 1211691 - protein, 9 aa, Homo Sapiens
LTHAIRLLL

SEQ ID NO: 1211692 - protein, 9 aa, Homo Sapiens
NIHYGRENV

SEQ ID NO: 1211693 - protein, 9 aa, Homo Sapiens
LCHFCDDIL

SEQ ID NO: 1211694 - protein, 9 aa, Homo Sapiens
QWNRCQYCR

SEQ ID NO: 1211695 - protein, 9 aa, Homo Sapiens
VNRRTTTSP

SEQ ID NO: 1211696 - protein, 9 aa, Homo Sapiens
MHWMKVTVE

SEQ ID NO: 1211697 - protein, 9 aa, Homo Sapiens
KNKCLSRKN

SEQ ID NO: 1211698 - protein, 9 aa, Homo Sapiens
RDTQAAIKE

SEQ ID NO: 1211699 - protein, 9 aa, Homo Sapiens
DGKYLSFTE

SEQ ID NO: 1211700 - protein, 9 aa, Homo Sapiens
FKKHLNEHM

SEQ ID NO: 1211701 - protein, 9 aa, Homo Sapiens
SSQNRTHSF

SEQ ID NO: 1211702 - protein, 9 aa, Homo Sapiens
VLCPTVLMT

SEQ ID NO: 1211703 - protein, 9 aa, Homo Sapiens
KRMDVGQQA

SEQ ID NO: 1211704 - protein, 9 aa, Homo Sapiens
PSSKRHKTI

SEQ ID NO: 1211705 - protein, 9 aa, Homo Sapiens
PSKIQLIVM

SEQ ID NO: 1211706 - protein, 9 aa, Homo Sapiens
KQRSDISRE

SEQ ID NO: 1211707 - protein, 9 aa, Homo Sapiens
NIINALPNT

SEQ ID NO: 1211708 - protein, 9 aa, Homo Sapiens
QLLYFFPRP

SEQ ID NO: 1211709 - protein, 9 aa, Homo Sapiens
DSPKCFDVE

SEQ ID NO: 1211710 - protein, 9 aa, Homo Sapiens
TSDILTLLG

SEQ ID NO: 1211711 - protein, 9 aa, Homo Sapiens
FPVEADLLR

SEQ ID NO: 1211712 - protein, 9 aa, Homo Sapiens
PHSSGLALC

SEQ ID NO: 1211713 - protein, 9 aa, Homo Sapiens
AELQGAVWT

SEQ ID NO: 1211714 - protein, 9 aa, Homo Sapiens
DVLYECSCA

SEQ ID NO: 1211715 - protein, 9 aa, Homo Sapiens
SLKTNILAA

SEQ ID NO: 1211716 - protein, 9 aa, Homo Sapiens
SVPSVAERL

SEQ ID NO: 1211717 - protein, 9 aa, Homo Sapiens
TAGEADASS

SEQ ID NO: 1211718 - protein, 9 aa, Homo Sapiens
EGGRRPYKG

SEQ ID NO: 1211719 - protein, 9 aa, Homo Sapiens
IEDVQCPYI

SEQ ID NO: 1211720 - protein, 9 aa, Homo Sapiens
HIQLNEMHS

SEQ ID NO: 1211721 - protein, 9 aa, Homo Sapiens
TLCHFLPLL

SEQ ID NO: 1211722 - protein, 9 aa, Homo Sapiens
RYIDVCKPL

SEQ ID NO: 1211723 - protein, 9 aa, Homo Sapiens
NDGNMGHES

SEQ ID NO: 1211724 - protein, 9 aa, Homo Sapiens
SEDMKLFDA

SEQ ID NO: 1211725 - protein, 9 aa, Homo Sapiens
ALADGPGAE

SEQ ID NO: 1211726 - protein, 9 aa, Homo Sapiens
TGTDCECCL

SEQ ID NO: 1211727 - protein, 9 aa, Homo Sapiens
DGLKVFMYP

SEQ ID NO: 1211728 - protein, 9 aa, Homo Sapiens
GLVALTRLA

SEQ ID NO: 1211729 - protein, 9 aa, Homo Sapiens
PLKGGLSWA

SEQ ID NO: 1211730 - protein, 9 aa, Homo Sapiens
THCDTNKKE

SEQ ID NO: 1211731 - protein, 9 aa, Homo Sapiens
PLDILSEEL

SEQ ID NO: 1211732 - protein, 9 aa, Homo Sapiens
KLFIPDIDL

SEQ ID NO: 1211733 - protein, 9 aa, Homo Sapiens
GMHAKHIRA

SEQ ID NO: 1211734 - protein, 9 aa, Homo Sapiens
FAERKTNKW

SEQ ID NO: 1211735 - protein, 9 aa, Homo Sapiens
SGGITFCNQ

SEQ ID NO: 1211736 - protein, 9 aa, Homo Sapiens
IPLSEYEAK

SEQ ID NO: 1211737 - protein, 9 aa, Homo Sapiens
KFPPSLLCE

SEQ ID NO: 1211738 - protein, 9 aa, Homo Sapiens
HHYPHLEQV

SEQ ID NO: 1211739 - protein, 9 aa, Homo Sapiens
SLQCTGSGG

SEQ ID NO: 1211740 - protein, 9 aa, Homo Sapiens
TIMHIQIKQ

SEQ ID NO: 1211741 - protein, 9 aa, Homo Sapiens
RVCASITGQ

SEQ ID NO: 1211742 - protein, 9 aa, Homo Sapiens
IQVYIGSFW

SEQ ID NO: 1211743 - protein, 9 aa, Homo Sapiens
PVTLYNQAL

SEQ ID NO: 1211744 - protein, 9 aa, Homo Sapiens
DRAAIISRW

SEQ ID NO: 1211745 - protein, 9 aa, Homo Sapiens
SNAGAGDSS

SEQ ID NO: 1211746 - protein, 9 aa, Homo Sapiens
YNRANRVMA

SEQ ID NO: 1211747 - protein, 9 aa, Homo Sapiens
QRHTENRRG

SEQ ID NO: 1211748 - protein, 9 aa, Homo Sapiens
HAPTKSAPA

SEQ ID NO: 1211749 - protein, 9 aa, Homo Sapiens
RLVKASTPA

SEQ ID NO: 1211750 - protein, 9 aa, Homo Sapiens
VIEEAGKFM

SEQ ID NO: 1211751 - protein, 9 aa, Homo Sapiens
SEPWVDKKG

SEQ ID NO: 1211752 - protein, 9 aa, Homo Sapiens
YWNEGDHSF

SEQ ID NO: 1211753 - protein, 9 aa, Homo Sapiens
RICRGIRGG

SEQ ID NO: 1211754 - protein, 9 aa, Homo Sapiens
YNNRTYHID

SEQ ID NO: 1211755 - protein, 9 aa, Homo Sapiens
NCRYRCFTK

SEQ ID NO: 1211756 - protein, 9 aa, Homo Sapiens
VVLLMGLMF

SEQ ID NO: 1211757 - protein, 9 aa, Homo Sapiens
YDEFMVQAP

SEQ ID NO: 1211758 - protein, 9 aa, Homo Sapiens
GNGSVFQTG

SEQ ID NO: 1211759 - protein, 9 aa, Homo Sapiens
ETYRHIVKV

SEQ ID NO: 1211760 - protein, 9 aa, Homo Sapiens
DQVAFIFHC

SEQ ID NO: 1211761 - protein, 9 aa, Homo Sapiens
AKPRSTRCC

SEQ ID NO: 1211762 - protein, 9 aa, Homo Sapiens
GGINGHFEL

SEQ ID NO: 1211763 - protein, 9 aa, Homo Sapiens
QCDKKKEAQ

SEQ ID NO: 1211764 - protein, 9 aa, Homo Sapiens
EYSVTTLSD

SEQ ID NO: 1211765 - protein, 9 aa, Homo Sapiens
KLKCDICGM

SEQ ID NO: 1211766 - protein, 9 aa, Homo Sapiens
SIDVQVEED

SEQ ID NO: 1211767 - protein, 9 aa, Homo Sapiens
DTADRLTSL

SEQ ID NO: 1211768 - protein, 9 aa, Homo Sapiens
SAGTMLKPH

SEQ ID NO: 1211769 - protein, 9 aa, Homo Sapiens
KFIENSAAV

SEQ ID NO: 1211770 - protein, 9 aa, Homo Sapiens
FWAKMCYHM

SEQ ID NO: 1211771 - protein, 9 aa, Homo Sapiens
ARARVGVAT

SEQ ID NO: 1211772 - protein, 9 aa, Homo Sapiens
ILSEIGKEC

SEQ ID NO: 1211773 - protein, 9 aa, Homo Sapiens
SFGVTLLFA

SEQ ID NO: 1211774 - protein, 9 aa, Homo Sapiens
EAGKFMDDP

SEQ ID NO: 1211775 - protein, 9 aa, Homo Sapiens
PPATLRFLA

SEQ ID NO: 1211776 - protein, 9 aa, Homo Sapiens
GWFTFLLTM

SEQ ID NO: 1211777 - protein, 9 aa, Homo Sapiens
HLGYFPSSI

SEQ ID NO: 1211778 - protein, 9 aa, Homo Sapiens
CNPFHHSLP

SEQ ID NO: 1211779 - protein, 9 aa, Homo Sapiens
SNDSPDVLN

SEQ ID NO: 1211780 - protein, 9 aa, Homo Sapiens
GGMSTDVSR

SEQ ID NO: 1211781 - protein, 9 aa, Homo Sapiens
NVRNPASPN

SEQ ID NO: 1211782 - protein, 9 aa, Homo Sapiens
NNLSPEVPS

SEQ ID NO: 1211783 - protein, 9 aa, Homo Sapiens
INLISDPSC

SEQ ID NO: 1211784 - protein, 9 aa, Homo Sapiens
IKEGCAYIA

SEQ ID NO: 1211785 - protein, 9 aa, Homo Sapiens
SKSKSSSYS

SEQ ID NO: 1211786 - protein, 9 aa, Homo Sapiens
VRVGCLQVS

SEQ ID NO: 1211787 - protein, 9 aa, Homo Sapiens
KLGAINNTL

SEQ ID NO: 1211788 - protein, 9 aa, Homo Sapiens
VHGSLEELS

SEQ ID NO: 1211789 - protein, 9 aa, Homo Sapiens
HKCDRVLAV

SEQ ID NO: 1211790 - protein, 9 aa, Homo Sapiens
GSVVKKVVV

SEQ ID NO: 1211791 - protein, 9 aa, Homo Sapiens
TASINGSVR

SEQ ID NO: 1211792 - protein, 9 aa, Homo Sapiens
THITCRLCS

SEQ ID NO: 1211793 - protein, 9 aa, Homo Sapiens
GTPCLCPCW

SEQ ID NO: 1211794 - protein, 9 aa, Homo Sapiens
DDQHWHSIL

SEQ ID NO: 1211795 - protein, 9 aa, Homo Sapiens
IGHQKCKPD

SEQ ID NO: 1211796 - protein, 9 aa, Homo Sapiens
ALYKNLVSE

SEQ ID NO: 1211797 - protein, 9 aa, Homo Sapiens
VKPLLQIEV

SEQ ID NO: 1211798 - protein, 9 aa, Homo Sapiens
FRHVLQPPN

SEQ ID NO: 1211799 - protein, 9 aa, Homo Sapiens
CENPELSDL

SEQ ID NO: 1211800 - protein, 9 aa, Homo Sapiens
TESCEQIVV

SEQ ID NO: 1211801 - protein, 9 aa, Homo Sapiens
PSATLCSTC

SEQ ID NO: 1211802 - protein, 9 aa, Homo Sapiens
ENCNKAKAQ

SEQ ID NO: 1211803 - protein, 9 aa, Homo Sapiens
AKKQFKKVS

SEQ ID NO: 1211804 - protein, 9 aa, Homo Sapiens
SASCKTGPG

SEQ ID NO: 1211805 - protein, 9 aa, Homo Sapiens
SQGVSVNPE

SEQ ID NO: 1211806 - protein, 9 aa, Homo Sapiens
PPFRLHLLP

SEQ ID NO: 1211807 - protein, 9 aa, Homo Sapiens
SDIAQRCRI

SEQ ID NO: 1211808 - protein, 9 aa, Homo Sapiens
QISRILLSS

SEQ ID NO: 1211809 - protein, 9 aa, Homo Sapiens
YTYSTSVGD

SEQ ID NO: 1211810 - protein, 9 aa, Homo Sapiens
EWHHLTMFI

SEQ ID NO: 1211811 - protein, 9 aa, Homo Sapiens
YISVPPSPT

SEQ ID NO: 1211812 - protein, 9 aa, Homo Sapiens
STVSHTDAD

SEQ ID NO: 1211813 - protein, 9 aa, Homo Sapiens
ALCKERACF

SEQ ID NO: 1211814 - protein, 9 aa, Homo Sapiens
CMDNFNLGR

SEQ ID NO: 1211815 - protein, 9 aa, Homo Sapiens
DEDGDKLSE

SEQ ID NO: 1211816 - protein, 9 aa, Homo Sapiens
SVLRAYNSD

SEQ ID NO: 1211817 - protein, 9 aa, Homo Sapiens
YCFEEKSLA

SEQ ID NO: 1211818 - protein, 9 aa, Homo Sapiens
DILNTIKRV

SEQ ID NO: 1211819 - protein, 9 aa, Homo Sapiens
RCSAPANQP

SEQ ID NO: 1211820 - protein, 9 aa, Homo Sapiens
SFRQTMWWA

SEQ ID NO: 1211821 - protein, 9 aa, Homo Sapiens
NQNCSVGAT

SEQ ID NO: 1211822 - protein, 9 aa, Homo Sapiens
IYHWFTCMF

SEQ ID NO: 1211823 - protein, 9 aa, Homo Sapiens
KHRQRKSRR

SEQ ID NO: 1211824 - protein, 9 aa, Homo Sapiens
ICNWLFCGK

SEQ ID NO: 1211825 - protein, 9 aa, Homo Sapiens
SHLTEHLIT

SEQ ID NO: 1211826 - protein, 9 aa, Homo Sapiens
EESYKDRTS

SEQ ID NO: 1211827 - protein, 9 aa, Homo Sapiens
FYECCIRGA

SEQ ID NO: 1211828 - protein, 9 aa, Homo Sapiens
PLTNVRIAR

SEQ ID NO: 1211829 - protein, 9 aa, Homo Sapiens
SAAERQAVN

SEQ ID NO: 1211830 - protein, 9 aa, Homo Sapiens
GEHKNQGTG

SEQ ID NO: 1211831 - protein, 9 aa, Homo Sapiens
DYSCNTRFH

SEQ ID NO: 1211832 - protein, 9 aa, Homo Sapiens
MATPLGRSK

SEQ ID NO: 1211833 - protein, 9 aa, Homo Sapiens
PHSPGMEPP

SEQ ID NO: 1211834 - protein, 9 aa, Homo Sapiens
IRNFEVVLS

SEQ ID NO: 1211835 - protein, 9 aa, Homo Sapiens
FVGSISTVH

SEQ ID NO: 1211836 - protein, 9 aa, Homo Sapiens
FSQARTRAG

SEQ ID NO: 1211837 - protein, 9 aa, Homo Sapiens
VLDKPLFHI

SEQ ID NO: 1211838 - protein, 9 aa, Homo Sapiens
FLIDNDSYP

SEQ ID NO: 1211839 - protein, 9 aa, Homo Sapiens
VVVDRVPQH

SEQ ID NO: 1211840 - protein, 9 aa, Homo Sapiens
STQTHVNDI

SEQ ID NO: 1211841 - protein, 9 aa, Homo Sapiens
EGKEDWEMK

SEQ ID NO: 1211842 - protein, 9 aa, Homo Sapiens
EEYQRIYTM

SEQ ID NO: 1211843 - protein, 9 aa, Homo Sapiens
RLEEAIGIG

SEQ ID NO: 1211844 - protein, 9 aa, Homo Sapiens
FTMVITVEL

SEQ ID NO: 1211845 - protein, 9 aa, Homo Sapiens
LAETLLQAG

SEQ ID NO: 1211846 - protein, 9 aa, Homo Sapiens
ADLLANEHE

SEQ ID NO: 1211847 - protein, 9 aa, Homo Sapiens
VAFHDPHHC

SEQ ID NO: 1211848 - protein, 9 aa, Homo Sapiens
TCVECEDPF

SEQ ID NO: 1211849 - protein, 9 aa, Homo Sapiens
EVYDTLIKD

SEQ ID NO: 1211850 - protein, 9 aa, Homo Sapiens
DASSVPTGG

SEQ ID NO: 1211851 - protein, 9 aa, Homo Sapiens
YVKILGKKK

SEQ ID NO: 1211852 - protein, 9 aa, Homo Sapiens
QRALISKFP

SEQ ID NO: 1211853 - protein, 9 aa, Homo Sapiens
NKFVKTLKW

SEQ ID NO: 1211854 - protein, 9 aa, Homo Sapiens
GQMTSYPLT

SEQ ID NO: 1211855 - protein, 9 aa, Homo Sapiens
YSENTPFHL

SEQ ID NO: 1211856 - protein, 9 aa, Homo Sapiens
ETNVKTVFF

SEQ ID NO: 1211857 - protein, 9 aa, Homo Sapiens
NLPHGNVLV

SEQ ID NO: 1211858 - protein, 9 aa, Homo Sapiens
VSSWGCNVS

SEQ ID NO: 1211859 - protein, 9 aa, Homo Sapiens
FKLIKGEMK

SEQ ID NO: 1211860 - protein, 9 aa, Homo Sapiens
TFDVVVASE

SEQ ID NO: 1211861 - protein, 9 aa, Homo Sapiens
NDACGQPVH

SEQ ID NO: 1211862 - protein, 9 aa, Homo Sapiens
KKHKLEIKV

SEQ ID NO: 1211863 - protein, 9 aa, Homo Sapiens
SHFSLNLLC

SEQ ID NO: 1211864 - protein, 9 aa, Homo Sapiens
FFGVEFVNM

SEQ ID NO: 1211865 - protein, 9 aa, Homo Sapiens
ISRTYPITT

SEQ ID NO: 1211866 - protein, 9 aa, Homo Sapiens
YGIEALPHT

SEQ ID NO: 1211867 - protein, 9 aa, Homo Sapiens
PQIKCGKRR

SEQ ID NO: 1211868 - protein, 9 aa, Homo Sapiens
LCPPPSPSV

SEQ ID NO: 1211869 - protein, 9 aa, Homo Sapiens
INRYISDTF

SEQ ID NO: 1211870 - protein, 9 aa, Homo Sapiens
QAPLHPQPA

SEQ ID NO: 1211871 - protein, 9 aa, Homo Sapiens
FGEIMKWCG

SEQ ID NO: 1211872 - protein, 9 aa, Homo Sapiens
WPPRLNTSA

SEQ ID NO: 1211873 - protein, 9 aa, Homo Sapiens
QHEKILCGL

SEQ ID NO: 1211874 - protein, 9 aa, Homo Sapiens
GLREARTIK

SEQ ID NO: 1211875 - protein, 9 aa, Homo Sapiens
SSVDLSYCS

SEQ ID NO: 1211876 - protein, 9 aa, Homo Sapiens
AADDRVHEQ

SEQ ID NO: 1211877 - protein, 9 aa, Homo Sapiens
SRCPMTLLS

SEQ ID NO: 1211878 - protein, 9 aa, Homo Sapiens
DITEVLEQC

SEQ ID NO: 1211879 - protein, 9 aa, Homo Sapiens
MIKQFHIQL

SEQ ID NO: 1211880 - protein, 9 aa, Homo Sapiens
WSDQPHITK

SEQ ID NO: 1211881 - protein, 9 aa, Homo Sapiens
IQPHLDMKY

SEQ ID NO: 1211882 - protein, 9 aa, Homo Sapiens
SLVKDTRQS

SEQ ID NO: 1211883 - protein, 9 aa, Homo Sapiens
GTLLKAVKD

SEQ ID NO: 1211884 - protein, 9 aa, Homo Sapiens
KYDLLAWFE

SEQ ID NO: 1211885 - protein, 9 aa, Homo Sapiens
CGKAFTDMS

SEQ ID NO: 1211886 - protein, 9 aa, Homo Sapiens
AGKVPLSLR

SEQ ID NO: 1211887 - protein, 9 aa, Homo Sapiens
VSHLNVNIK

SEQ ID NO: 1211888 - protein, 9 aa, Homo Sapiens
GHRFTMGER

SEQ ID NO: 1211889 - protein, 9 aa, Homo Sapiens
IGVLNKNRH

SEQ ID NO: 1211890 - protein, 9 aa, Homo Sapiens
EPLEAEPQV

SEQ ID NO: 1211891 - protein, 9 aa, Homo Sapiens
CRNILDRNQ

SEQ ID NO: 1211892 - protein, 9 aa, Homo Sapiens
KVTHILKSN

SEQ ID NO: 1211893 - protein, 9 aa, Homo Sapiens
KRWGCVSAP

SEQ ID NO: 1211894 - protein, 9 aa, Homo Sapiens
TLGESWLRT

SEQ ID NO: 1211895 - protein, 9 aa, Homo Sapiens
IADFSDPVF

SEQ ID NO: 1211896 - protein, 9 aa, Homo Sapiens
HYYRSHNDG

SEQ ID NO: 1211897 - protein, 9 aa, Homo Sapiens
PASSCSSSP

SEQ ID NO: 1211898 - protein, 9 aa, Homo Sapiens
QQLAQTDQH

SEQ ID NO: 1211899 - protein, 9 aa, Homo Sapiens
RLKTKAVCM

SEQ ID NO: 1211900 - protein, 9 aa, Homo Sapiens
KKEGHIDDL

SEQ ID NO: 1211901 - protein, 9 aa, Homo Sapiens
YLLVGTGSN

SEQ ID NO: 1211902 - protein, 9 aa, Homo Sapiens
APCDWFGDF

SEQ ID NO: 1211903 - protein, 9 aa, Homo Sapiens
TMKMSSGQE

SEQ ID NO: 1211904 - protein, 9 aa, Homo Sapiens
NCYSERKKT

SEQ ID NO: 1211905 - protein, 9 aa, Homo Sapiens
MPLSGRLVK

SEQ ID NO: 1211906 - protein, 9 aa, Homo Sapiens
ENQKAQKTP

SEQ ID NO: 1211907 - protein, 9 aa, Homo Sapiens
GWTHGRGMV

SEQ ID NO: 1211908 - protein, 9 aa, Homo Sapiens
GPRYLLDDS

SEQ ID NO: 1211909 - protein, 9 aa, Homo Sapiens
MMLALSLQI

SEQ ID NO: 1211910 - protein, 9 aa, Homo Sapiens
RKTHHISPQ

SEQ ID NO: 1211911 - protein, 9 aa, Homo Sapiens
WSGHLCDIR

SEQ ID NO: 1211912 - protein, 9 aa, Homo Sapiens
QLNGLGLNQ

SEQ ID NO: 1211913 - protein, 9 aa, Homo Sapiens
MVIGACTCH

SEQ ID NO: 1211914 - protein, 9 aa, Homo Sapiens
AIRISQNFL

SEQ ID NO: 1211915 - protein, 9 aa, Homo Sapiens
VCITVDSLV

SEQ ID NO: 1211916 - protein, 9 aa, Homo Sapiens
PTMFQYGRT

SEQ ID NO: 1211917 - protein, 9 aa, Homo Sapiens
DSVSWPGCC

SEQ ID NO: 1211918 - protein, 9 aa, Homo Sapiens
YIKMYILVQ

SEQ ID NO: 1211919 - protein, 9 aa, Homo Sapiens
PRTTVDSVE

SEQ ID NO: 1211920 - protein, 9 aa, Homo Sapiens
FVGHATTLI

SEQ ID NO: 1211921 - protein, 9 aa, Homo Sapiens
GHMELRDNN

SEQ ID NO: 1211922 - protein, 9 aa, Homo Sapiens
CKLNFNGEG

SEQ ID NO: 1211923 - protein, 9 aa, Homo Sapiens
KTCSCVGPD

SEQ ID NO: 1211924 - protein, 9 aa, Homo Sapiens
SAGLSAAQS

SEQ ID NO: 1211925 - protein, 9 aa, Homo Sapiens
IANGAITKG

SEQ ID NO: 1211926 - protein, 9 aa, Homo Sapiens
TSTTPACCK

SEQ ID NO: 1211927 - protein, 9 aa, Homo Sapiens
NGSGQSYRL

SEQ ID NO: 1211928 - protein, 9 aa, Homo Sapiens
MQCQPQQGP

SEQ ID NO: 1211929 - protein, 9 aa, Homo Sapiens
YCSLEHLPA

SEQ ID NO: 1211930 - protein, 9 aa, Homo Sapiens
VASIISFDI

SEQ ID NO: 1211931 - protein, 9 aa, Homo Sapiens
CGQPNRHGV

SEQ ID NO: 1211932 - protein, 9 aa, Homo Sapiens
LNVFITMAN

SEQ ID NO: 1211933 - protein, 9 aa, Homo Sapiens
MTGTVQRVT

SEQ ID NO: 1211934 - protein, 9 aa, Homo Sapiens
GLYQDQVNL

SEQ ID NO: 1211935 - protein, 9 aa, Homo Sapiens
LLLEWCGWQ

SEQ ID NO: 1211936 - protein, 9 aa, Homo Sapiens
LNLLVSTFV

SEQ ID NO: 1211937 - protein, 9 aa, Homo Sapiens
IHRQCKEGE

SEQ ID NO: 1211938 - protein, 9 aa, Homo Sapiens
HCCHCPPLL

SEQ ID NO: 1211939 - protein, 9 aa, Homo Sapiens
IHGMHAKHI

SEQ ID NO: 1211940 - protein, 9 aa, Homo Sapiens
LTSLARDAL

SEQ ID NO: 1211941 - protein, 9 aa, Homo Sapiens
LSGAAGDSA

SEQ ID NO: 1211942 - protein, 9 aa, Homo Sapiens
DSGDQASSD

SEQ ID NO: 1211943 - protein, 9 aa, Homo Sapiens
HWDPPEEEI

SEQ ID NO: 1211944 - protein, 9 aa, Homo Sapiens
TSECLRYED

SEQ ID NO: 1211945 - protein, 9 aa, Homo Sapiens
ISRSLRFIG

SEQ ID NO: 1211946 - protein, 9 aa, Homo Sapiens
EQAAAHTHH

SEQ ID NO: 1211947 - protein, 9 aa, Homo Sapiens
CIILTALIK

SEQ ID NO: 1211948 - protein, 9 aa, Homo Sapiens
EAMGLVRRD

SEQ ID NO: 1211949 - protein, 9 aa, Homo Sapiens
MMSQQKRFL

SEQ ID NO: 1211950 - protein, 9 aa, Homo Sapiens
PSKCMVEKI

SEQ ID NO: 1211951 - protein, 9 aa, Homo Sapiens
LGHEPVLVQ

SEQ ID NO: 1211952 - protein, 9 aa, Homo Sapiens
AFFAERKTN

SEQ ID NO: 1211953 - protein, 9 aa, Homo Sapiens
IIIADLNEL

SEQ ID NO: 1211954 - protein, 9 aa, Homo Sapiens
EKIATIAEK

SEQ ID NO: 1211955 - protein, 9 aa, Homo Sapiens
HLDLEKGKE

SEQ ID NO: 1211956 - protein, 9 aa, Homo Sapiens
PKDSPPFEG

SEQ ID NO: 1211957 - protein, 9 aa, Homo Sapiens
VAADSAQKE

SEQ ID NO: 1211958 - protein, 9 aa, Homo Sapiens
ASLELGECE

SEQ ID NO: 1211959 - protein, 9 aa, Homo Sapiens
AVKMLKENT

SEQ ID NO: 1211960 - protein, 9 aa, Homo Sapiens
VQTFLLQDQ

SEQ ID NO: 1211961 - protein, 9 aa, Homo Sapiens
APYRECVEF

SEQ ID NO: 1211962 - protein, 9 aa, Homo Sapiens
SEENSSNLW

SEQ ID NO: 1211963 - protein, 9 aa, Homo Sapiens
GWDLHDAAV

SEQ ID NO: 1211964 - protein, 9 aa, Homo Sapiens
PRHGVYVLL

SEQ ID NO: 1211965 - protein, 9 aa, Homo Sapiens
NMVKTCDSE

SEQ ID NO: 1211966 - protein, 9 aa, Homo Sapiens
TLYPTMLVT

SEQ ID NO: 1211967 - protein, 9 aa, Homo Sapiens
RLFTFDSEG

SEQ ID NO: 1211968 - protein, 9 aa, Homo Sapiens
VNDGCLYVF

SEQ ID NO: 1211969 - protein, 9 aa, Homo Sapiens
LPETGVWLL

SEQ ID NO: 1211970 - protein, 9 aa, Homo Sapiens
RPTVKAAEM

SEQ ID NO: 1211971 - protein, 9 aa, Homo Sapiens
GKRHHAHIN

SEQ ID NO: 1211972 - protein, 9 aa, Homo Sapiens
CSADIWDCD

SEQ ID NO: 1211973 - protein, 9 aa, Homo Sapiens
FSSHDIQPL

SEQ ID NO: 1211974 - protein, 9 aa, Homo Sapiens
GQHTLTMPA

SEQ ID NO: 1211975 - protein, 9 aa, Homo Sapiens
KALFAMETF

SEQ ID NO: 1211976 - protein, 9 aa, Homo Sapiens
RTDASGTTA

SEQ ID NO: 1211977 - protein, 9 aa, Homo Sapiens
QELYCMVVP

SEQ ID NO: 1211978 - protein, 9 aa, Homo Sapiens
YECYDVYEI

SEQ ID NO: 1211979 - protein, 9 aa, Homo Sapiens
SILMGLDAM

SEQ ID NO: 1211980 - protein, 9 aa, Homo Sapiens
GRHCALGRE

SEQ ID NO: 1211981 - protein, 9 aa, Homo Sapiens
PTTPSAATF

SEQ ID NO: 1211982 - protein, 9 aa, Homo Sapiens
HISSMFRED

SEQ ID NO: 1211983 - protein, 9 aa, Homo Sapiens
KASEPGIFS

SEQ ID NO: 1211984 - protein, 9 aa, Homo Sapiens
TKGHLDTEL

SEQ ID NO: 1211985 - protein, 9 aa, Homo Sapiens
IEAQRLDVR

SEQ ID NO: 1211986 - protein, 9 aa, Homo Sapiens
TDIFRHYDT

SEQ ID NO: 1211987 - protein, 9 aa, Homo Sapiens
RVVFDDNYD

SEQ ID NO: 1211988 - protein, 9 aa, Homo Sapiens
IIAPMMLWG

SEQ ID NO: 1211989 - protein, 9 aa, Homo Sapiens
IEVIPFVIE

SEQ ID NO: 1211990 - protein, 9 aa, Homo Sapiens
TSIDNHPMN

SEQ ID NO: 1211991 - protein, 9 aa, Homo Sapiens
MDEINHAFP

SEQ ID NO: 1211992 - protein, 9 aa, Homo Sapiens
GMWVQEGMR

SEQ ID NO: 1211993 - protein, 9 aa, Homo Sapiens
HKGGGYSVL

SEQ ID NO: 1211994 - protein, 9 aa, Homo Sapiens
IEPALYRVI

SEQ ID NO: 1211995 - protein, 9 aa, Homo Sapiens
SMVDEVSEK

SEQ ID NO: 1211996 - protein, 9 aa, Homo Sapiens
WNCRTIQGR

SEQ ID NO: 1211997 - protein, 9 aa, Homo Sapiens
KPIWLPVFS

SEQ ID NO: 1211998 - protein, 9 aa, Homo Sapiens
KTCDSEESG

SEQ ID NO: 1211999 - protein, 9 aa, Homo Sapiens
ILDSYDQNT

SEQ ID NO: 1212000 - protein, 9 aa, Homo Sapiens
NWGVCRRSL

SEQ ID NO: 1212001 - protein, 9 aa, Homo Sapiens
HTHGGKWTV

SEQ ID NO: 1212002 - protein, 9 aa, Homo Sapiens
AGELKWETD

SEQ ID NO: 1212003 - protein, 9 aa, Homo Sapiens
GSQKQPKCY

SEQ ID NO: 1212004 - protein, 9 aa, Homo Sapiens
VHLELLPPC

SEQ ID NO: 1212005 - protein, 9 aa, Homo Sapiens
CSRGRWVMI

SEQ ID NO: 1212006 - protein, 9 aa, Homo Sapiens
PAHASRPLP

SEQ ID NO: 1212007 - protein, 9 aa, Homo Sapiens
ECAWGCCGS

SEQ ID NO: 1212008 - protein, 9 aa, Homo Sapiens
TLLAIIRHL

SEQ ID NO: 1212009 - protein, 9 aa, Homo Sapiens
NSIMKNQWL

SEQ ID NO: 1212010 - protein, 9 aa, Homo Sapiens
VWVLNNGQY

SEQ ID NO: 1212011 - protein, 9 aa, Homo Sapiens
KDLGMPARA

SEQ ID NO: 1212012 - protein, 9 aa, Homo Sapiens
LPNTIIHGI

SEQ ID NO: 1212013 - protein, 9 aa, Homo Sapiens
TTTRSLATK

SEQ ID NO: 1212014 - protein, 9 aa, Homo Sapiens
GRHPVRVPD

SEQ ID NO: 1212015 - protein, 9 aa, Homo Sapiens
TVLAFKREG

SEQ ID NO: 1212016 - protein, 9 aa, Homo Sapiens
FLVFGYTQR

SEQ ID NO: 1212017 - protein, 9 aa, Homo Sapiens
QWNRIYSDT

SEQ ID NO: 1212018 - protein, 9 aa, Homo Sapiens
THPRSPFNL

SEQ ID NO: 1212019 - protein, 9 aa, Homo Sapiens
PMSTSLLGD

SEQ ID NO: 1212020 - protein, 9 aa, Homo Sapiens
IARRAGDPE

SEQ ID NO: 1212021 - protein, 9 aa, Homo Sapiens
IPITPENPC

SEQ ID NO: 1212022 - protein, 9 aa, Homo Sapiens
ENISILDQI

SEQ ID NO: 1212023 - protein, 9 aa, Homo Sapiens
SSPLEKCLS

SEQ ID NO: 1212024 - protein, 9 aa, Homo Sapiens
KMLSPDDAD

SEQ ID NO: 1212025 - protein, 9 aa, Homo Sapiens
DRLILELGF

SEQ ID NO: 1212026 - protein, 9 aa, Homo Sapiens
CVNDGMFGR

SEQ ID NO: 1212027 - protein, 9 aa, Homo Sapiens
NIIVTQNGE

SEQ ID NO: 1212028 - protein, 9 aa, Homo Sapiens
TQFTVISPI

SEQ ID NO: 1212029 - protein, 9 aa, Homo Sapiens
EPNRIPSSR

SEQ ID NO: 1212030 - protein, 9 aa, Homo Sapiens
SGMTWPPLF

SEQ ID NO: 1212031 - protein, 9 aa, Homo Sapiens
ESVFAVTDV

SEQ ID NO: 1212032 - protein, 9 aa, Homo Sapiens
VAVKAAQGL

SEQ ID NO: 1212033 - protein, 9 aa, Homo Sapiens
QHWPVLQKW

SEQ ID NO: 1212034 - protein, 9 aa, Homo Sapiens
PLFLLLAGI

SEQ ID NO: 1212035 - protein, 9 aa, Homo Sapiens
VAQMLVENL

SEQ ID NO: 1212036 - protein, 9 aa, Homo Sapiens
LIHVCDELR

SEQ ID NO: 1212037 - protein, 9 aa, Homo Sapiens
GTTGMCHQD

SEQ ID NO: 1212038 - protein, 9 aa, Homo Sapiens
PWLIGRMMQ

SEQ ID NO: 1212039 - protein, 9 aa, Homo Sapiens
CYRLCNECL

SEQ ID NO: 1212040 - protein, 9 aa, Homo Sapiens
PQCFCRICA

SEQ ID NO: 1212041 - protein, 9 aa, Homo Sapiens
LDVYQPEAS

SEQ ID NO: 1212042 - protein, 9 aa, Homo Sapiens
PTRRGAPRP

SEQ ID NO: 1212043 - protein, 9 aa, Homo Sapiens
HRASNEKES

SEQ ID NO: 1212044 - protein, 9 aa, Homo Sapiens
PCLLVETNE

SEQ ID NO: 1212045 - protein, 9 aa, Homo Sapiens
AATMLPAQE

SEQ ID NO: 1212046 - protein, 9 aa, Homo Sapiens
KRFVAGKYL

SEQ ID NO: 1212047 - protein, 9 aa, Homo Sapiens
LVSLSLKGA

SEQ ID NO: 1212048 - protein, 9 aa, Homo Sapiens
HDLDQFLEG

SEQ ID NO: 1212049 - protein, 9 aa, Homo Sapiens
SWMATEAGP

SEQ ID NO: 1212050 - protein, 9 aa, Homo Sapiens
QEMLVRVTE

SEQ ID NO: 1212051 - protein, 9 aa, Homo Sapiens
ELLWGWRPY

SEQ ID NO: 1212052 - protein, 9 aa, Homo Sapiens
RDPPATATA

SEQ ID NO: 1212053 - protein, 9 aa, Homo Sapiens
EKASIMLPS

SEQ ID NO: 1212054 - protein, 9 aa, Homo Sapiens
VAAANCQVS

SEQ ID NO: 1212055 - protein, 9 aa, Homo Sapiens
MIFNGSLGL

SEQ ID NO: 1212056 - protein, 9 aa, Homo Sapiens
ELQEYLAFA

SEQ ID NO: 1212057 - protein, 9 aa, Homo Sapiens
EHIYALRWK

SEQ ID NO: 1212058 - protein, 9 aa, Homo Sapiens
AIKPCHPMT

SEQ ID NO: 1212059 - protein, 9 aa, Homo Sapiens
ILNLCVISI

SEQ ID NO: 1212060 - protein, 9 aa, Homo Sapiens
PTQTWTRLP

SEQ ID NO: 1212061 - protein, 9 aa, Homo Sapiens
YRYLIESVC

SEQ ID NO: 1212062 - protein, 9 aa, Homo Sapiens
LGDCTRSPG

SEQ ID NO: 1212063 - protein, 9 aa, Homo Sapiens
SGLDLCSVV

SEQ ID NO: 1212064 - protein, 9 aa, Homo Sapiens
GEPWELNSG

SEQ ID NO: 1212065 - protein, 9 aa, Homo Sapiens
VCSSDGLMY

SEQ ID NO: 1212066 - protein, 9 aa, Homo Sapiens
GPDSFGGPG

SEQ ID NO: 1212067 - protein, 9 aa, Homo Sapiens
DDVLYECSC

SEQ ID NO: 1212068 - protein, 9 aa, Homo Sapiens
ALREAQILA

SEQ ID NO: 1212069 - protein, 9 aa, Homo Sapiens
GLEVSNNGS

SEQ ID NO: 1212070 - protein, 9 aa, Homo Sapiens
RYTAAVSYR

SEQ ID NO: 1212071 - protein, 9 aa, Homo Sapiens
NCYQCGKQG

SEQ ID NO: 1212072 - protein, 9 aa, Homo Sapiens
ECLTFTSGI

SEQ ID NO: 1212073 - protein, 9 aa, Homo Sapiens
LNVKQGAEN

SEQ ID NO: 1212074 - protein, 9 aa, Homo Sapiens
DPKKNRHWH

SEQ ID NO: 1212075 - protein, 9 aa, Homo Sapiens
LEGSGGRLQ

SEQ ID NO: 1212076 - protein, 9 aa, Homo Sapiens
SSTVWLSRP

SEQ ID NO: 1212077 - protein, 9 aa, Homo Sapiens
GIFRRWNES

SEQ ID NO: 1212078 - protein, 9 aa, Homo Sapiens
QNQVNISAS

SEQ ID NO: 1212079 - protein, 9 aa, Homo Sapiens
VEPLHAEIM

SEQ ID NO: 1212080 - protein, 9 aa, Homo Sapiens
WCHLETHDD

SEQ ID NO: 1212081 - protein, 9 aa, Homo Sapiens
IVGTASRRV

SEQ ID NO: 1212082 - protein, 9 aa, Homo Sapiens
QLTALPSSA

SEQ ID NO: 1212083 - protein, 9 aa, Homo Sapiens
AEVRRIVDA

SEQ ID NO: 1212084 - protein, 9 aa, Homo Sapiens
TYTFSITSF

SEQ ID NO: 1212085 - protein, 9 aa, Homo Sapiens
DMTKNMGGD

SEQ ID NO: 1212086 - protein, 9 aa, Homo Sapiens
HRAKRRNME

SEQ ID NO: 1212087 - protein, 9 aa, Homo Sapiens
GKAMPTTQS

SEQ ID NO: 1212088 - protein, 9 aa, Homo Sapiens
DCYHCVSGL

SEQ ID NO: 1212089 - protein, 9 aa, Homo Sapiens
KVWFQNRQT

SEQ ID NO: 1212090 - protein, 9 aa, Homo Sapiens
ASGQLIDKC

SEQ ID NO: 1212091 - protein, 9 aa, Homo Sapiens
SPTPDVVSS

SEQ ID NO: 1212092 - protein, 9 aa, Homo Sapiens
LRFPQHVKN

SEQ ID NO: 1212093 - protein, 9 aa, Homo Sapiens
DEDAFWALT

SEQ ID NO: 1212094 - protein, 9 aa, Homo Sapiens
VNCQAEAAP

SEQ ID NO: 1212095 - protein, 9 aa, Homo Sapiens
LAFSLLSAV

SEQ ID NO: 1212096 - protein, 9 aa, Homo Sapiens
TLGPLVPRL

SEQ ID NO: 1212097 - protein, 9 aa, Homo Sapiens
DLLKTGSSG

SEQ ID NO: 1212098 - protein, 9 aa, Homo Sapiens
EKNTASINI

SEQ ID NO: 1212099 - protein, 9 aa, Homo Sapiens
IAAVVCLGS

SEQ ID NO: 1212100 - protein, 9 aa, Homo Sapiens
LFSSVSASR

SEQ ID NO: 1212101 - protein, 9 aa, Homo Sapiens
PDGATLCMG

SEQ ID NO: 1212102 - protein, 9 aa, Homo Sapiens
GEPRAHTMA

SEQ ID NO: 1212103 - protein, 9 aa, Homo Sapiens
IPIEDFITH

SEQ ID NO: 1212104 - protein, 9 aa, Homo Sapiens
APCISLIKE

SEQ ID NO: 1212105 - protein, 9 aa, Homo Sapiens
GDSLEVVYT

SEQ ID NO: 1212106 - protein, 9 aa, Homo Sapiens
AHEADDAPS

SEQ ID NO: 1212107 - protein, 9 aa, Homo Sapiens
TMDPQEMVV

SEQ ID NO: 1212108 - protein, 9 aa, Homo Sapiens
CIGWLDDFL

SEQ ID NO: 1212109 - protein, 9 aa, Homo Sapiens
DNHFSSDEL

SEQ ID NO: 1212110 - protein, 9 aa, Homo Sapiens
PPSTCLDGA

SEQ ID NO: 1212111 - protein, 9 aa, Homo Sapiens
NLFWQILLI

SEQ ID NO: 1212112 - protein, 9 aa, Homo Sapiens
DRLTILRNV

SEQ ID NO: 1212113 - protein, 9 aa, Homo Sapiens
DSGHDSTSV

SEQ ID NO: 1212114 - protein, 9 aa, Homo Sapiens
QILCDVPCS

SEQ ID NO: 1212115 - protein, 9 aa, Homo Sapiens
AICLICGNR

SEQ ID NO: 1212116 - protein, 9 aa, Homo Sapiens
GDVAHVCNP

SEQ ID NO: 1212117 - protein, 9 aa, Homo Sapiens
GDRVGHCVI

SEQ ID NO: 1212118 - protein, 9 aa, Homo Sapiens
GGLPYLDHL

SEQ ID NO: 1212119 - protein, 9 aa, Homo Sapiens
QMMEGKAFL

SEQ ID NO: 1212120 - protein, 9 aa, Homo Sapiens
ALLVEVHLL

SEQ ID NO: 1212121 - protein, 9 aa, Homo Sapiens
QMLQSYKIS

SEQ ID NO: 1212122 - protein, 9 aa, Homo Sapiens
CPLSSSSLA

SEQ ID NO: 1212123 - protein, 9 aa, Homo Sapiens
HKIYIQRHV

SEQ ID NO: 1212124 - protein, 9 aa, Homo Sapiens
LPPTFEDTV

SEQ ID NO: 1212125 - protein, 9 aa, Homo Sapiens
DVLNHSDHH

SEQ ID NO: 1212126 - protein, 9 aa, Homo Sapiens
GVGADRSYG

SEQ ID NO: 1212127 - protein, 9 aa, Homo Sapiens
CLHKTHRLK

SEQ ID NO: 1212128 - protein, 9 aa, Homo Sapiens
IPLEQHPDY

SEQ ID NO: 1212129 - protein, 9 aa, Homo Sapiens
RVFYIGRED

SEQ ID NO: 1212130 - protein, 9 aa, Homo Sapiens
LTRTGIIVT

SEQ ID NO: 1212131 - protein, 9 aa, Homo Sapiens
QGHTTASCL

SEQ ID NO: 1212132 - protein, 9 aa, Homo Sapiens
GKKAAATSS

SEQ ID NO: 1212133 - protein, 9 aa, Homo Sapiens
PKWRRRIPA

SEQ ID NO: 1212134 - protein, 9 aa, Homo Sapiens
DPEEMAEYC

SEQ ID NO: 1212135 - protein, 9 aa, Homo Sapiens
TELDAYMAQ

SEQ ID NO: 1212136 - protein, 9 aa, Homo Sapiens
DCGSCGCSK

SEQ ID NO: 1212137 - protein, 9 aa, Homo Sapiens
MLGLPLKGG

SEQ ID NO: 1212138 - protein, 9 aa, Homo Sapiens
NHAKYSAEN

SEQ ID NO: 1212139 - protein, 9 aa, Homo Sapiens
LNDGGFHVL

SEQ ID NO: 1212140 - protein, 9 aa, Homo Sapiens
GGNLLHFSV

SEQ ID NO: 1212141 - protein, 9 aa, Homo Sapiens
GPLCKRSVP

SEQ ID NO: 1212142 - protein, 9 aa, Homo Sapiens
KKDDVCVNP

SEQ ID NO: 1212143 - protein, 9 aa, Homo Sapiens
SILTSALEN

SEQ ID NO: 1212144 - protein, 9 aa, Homo Sapiens
VWCPSRCLV

SEQ ID NO: 1212145 - protein, 9 aa, Homo Sapiens
QQASVVIRS

SEQ ID NO: 1212146 - protein, 9 aa, Homo Sapiens
TGVTMGSLI

SEQ ID NO: 1212147 - protein, 9 aa, Homo Sapiens
GGSLFTSAA

SEQ ID NO: 1212148 - protein, 9 aa, Homo Sapiens
FIAQSIVCA

SEQ ID NO: 1212149 - protein, 9 aa, Homo Sapiens
WLEELQLAN

SEQ ID NO: 1212150 - protein, 9 aa, Homo Sapiens
NQKQEPCPA

SEQ ID NO: 1212151 - protein, 9 aa, Homo Sapiens
HCRHVSLRV

SEQ ID NO: 1212152 - protein, 9 aa, Homo Sapiens
EAHYPDIYA

SEQ ID NO: 1212153 - protein, 9 aa, Homo Sapiens
LLLPPAPKW

SEQ ID NO: 1212154 - protein, 9 aa, Homo Sapiens
LVAAAQRIG

SEQ ID NO: 1212155 - protein, 9 aa, Homo Sapiens
VVQSSPPTL

SEQ ID NO: 1212156 - protein, 9 aa, Homo Sapiens
LVALKVCYP

SEQ ID NO: 1212157 - protein, 9 aa, Homo Sapiens
DSVFTMLPG

SEQ ID NO: 1212158 - protein, 9 aa, Homo Sapiens
HIIVHIRTH

SEQ ID NO: 1212159 - protein, 9 aa, Homo Sapiens
IQIIHIPKN

SEQ ID NO: 1212160 - protein, 9 aa, Homo Sapiens
QAAPLIDAP

SEQ ID NO: 1212161 - protein, 9 aa, Homo Sapiens
EQMGEQVTN

SEQ ID NO: 1212162 - protein, 9 aa, Homo Sapiens
KRAEQLKKA

SEQ ID NO: 1212163 - protein, 9 aa, Homo Sapiens
TKVTFVGSI

SEQ ID NO: 1212164 - protein, 9 aa, Homo Sapiens
MSNYQEYLK

SEQ ID NO: 1212165 - protein, 9 aa, Homo Sapiens
YIFGKQTAF

SEQ ID NO: 1212166 - protein, 9 aa, Homo Sapiens
CKGDKKLLH

SEQ ID NO: 1212167 - protein, 9 aa, Homo Sapiens
EMEQFFSMF

SEQ ID NO: 1212168 - protein, 9 aa, Homo Sapiens
KKKECQEEA

SEQ ID NO: 1212169 - protein, 9 aa, Homo Sapiens
VFLTHALLG

SEQ ID NO: 1212170 - protein, 9 aa, Homo Sapiens
VAYREEREC

SEQ ID NO: 1212171 - protein, 9 aa, Homo Sapiens
FKPLKILAY

SEQ ID NO: 1212172 - protein, 9 aa, Homo Sapiens
ILGADPHFG

SEQ ID NO: 1212173 - protein, 9 aa, Homo Sapiens
PGTETSDMV

SEQ ID NO: 1212174 - protein, 9 aa, Homo Sapiens
APEPGSTCL

SEQ ID NO: 1212175 - protein, 9 aa, Homo Sapiens
PDEEHRIRI

SEQ ID NO: 1212176 - protein, 9 aa, Homo Sapiens
NVIKGQGVE

SEQ ID NO: 1212177 - protein, 9 aa, Homo Sapiens
HERCPWRIW

SEQ ID NO: 1212178 - protein, 9 aa, Homo Sapiens
QEREKQLRA

SEQ ID NO: 1212179 - protein, 9 aa, Homo Sapiens
SDKRATQGT

SEQ ID NO: 1212180 - protein, 9 aa, Homo Sapiens
NGFALSDQR

SEQ ID NO: 1212181 - protein, 9 aa, Homo Sapiens
CLASLSIIV

SEQ ID NO: 1212182 - protein, 9 aa, Homo Sapiens
LAVKLLQKC

SEQ ID NO: 1212183 - protein, 9 aa, Homo Sapiens
CLQSSVNRH

SEQ ID NO: 1212184 - protein, 9 aa, Homo Sapiens
RHCMVHTSE

SEQ ID NO: 1212185 - protein, 9 aa, Homo Sapiens
AKPESKQDP

SEQ ID NO: 1212186 - protein, 9 aa, Homo Sapiens
ASQPCTPSP

SEQ ID NO: 1212187 - protein, 9 aa, Homo Sapiens
ILNAFRLFD

SEQ ID NO: 1212188 - protein, 9 aa, Homo Sapiens
KSYNCKVCG

SEQ ID NO: 1212189 - protein, 9 aa, Homo Sapiens
DIFRRLREN

SEQ ID NO: 1212190 - protein, 9 aa, Homo Sapiens
EFCGEGSLQ

SEQ ID NO: 1212191 - protein, 9 aa, Homo Sapiens
TTSDILTLL

SEQ ID NO: 1212192 - protein, 9 aa, Homo Sapiens
PNIQSGYEI

SEQ ID NO: 1212193 - protein, 9 aa, Homo Sapiens
EQRYHSLIL

SEQ ID NO: 1212194 - protein, 9 aa, Homo Sapiens
DLELDKEGV

SEQ ID NO: 1212195 - protein, 9 aa, Homo Sapiens
WEKIRLQNN

SEQ ID NO: 1212196 - protein, 9 aa, Homo Sapiens
SFMTPSCSV

SEQ ID NO: 1212197 - protein, 9 aa, Homo Sapiens
LKIELVLID

SEQ ID NO: 1212198 - protein, 9 aa, Homo Sapiens
PSLGYFRGD

SEQ ID NO: 1212199 - protein, 9 aa, Homo Sapiens
LSANSGCSA

SEQ ID NO: 1212200 - protein, 9 aa, Homo Sapiens
HISTDPVLT

SEQ ID NO: 1212201 - protein, 9 aa, Homo Sapiens
RFHLNLKVR

SEQ ID NO: 1212202 - protein, 9 aa, Homo Sapiens
RPPHSPGME

SEQ ID NO: 1212203 - protein, 9 aa, Homo Sapiens
LQPGCTNVC

SEQ ID NO: 1212204 - protein, 9 aa, Homo Sapiens
ISLDSGFSS

SEQ ID NO: 1212205 - protein, 9 aa, Homo Sapiens
SSLQTNWTT

SEQ ID NO: 1212206 - protein, 9 aa, Homo Sapiens
LREKIYRAF

SEQ ID NO: 1212207 - protein, 9 aa, Homo Sapiens
GQAGMAPVG

SEQ ID NO: 1212208 - protein, 9 aa, Homo Sapiens
TRNLRQQSG

SEQ ID NO: 1212209 - protein, 9 aa, Homo Sapiens
SDLDLLVPA

SEQ ID NO: 1212210 - protein, 9 aa, Homo Sapiens
DGCVTDHFS

SEQ ID NO: 1212211 - protein, 9 aa, Homo Sapiens
ERKEDKEEK

SEQ ID NO: 1212212 - protein, 9 aa, Homo Sapiens
HLGATILDR

SEQ ID NO: 1212213 - protein, 9 aa, Homo Sapiens
EKPYQCGKC

SEQ ID NO: 1212214 - protein, 9 aa, Homo Sapiens
AIVICDYDH

SEQ ID NO: 1212215 - protein, 9 aa, Homo Sapiens
CSTQGVERT

SEQ ID NO: 1212216 - protein, 9 aa, Homo Sapiens
PIEPCRELL

SEQ ID NO: 1212217 - protein, 9 aa, Homo Sapiens
PTQAFTNYN

SEQ ID NO: 1212218 - protein, 9 aa, Homo Sapiens
NNNLSKLQL

SEQ ID NO: 1212219 - protein, 9 aa, Homo Sapiens
ELVNQSKAT

SEQ ID NO: 1212220 - protein, 9 aa, Homo Sapiens
QPFCTVCNR

SEQ ID NO: 1212221 - protein, 9 aa, Homo Sapiens
GEAMGLVRR

SEQ ID NO: 1212222 - protein, 9 aa, Homo Sapiens
LDLNQWLTM

SEQ ID NO: 1212223 - protein, 9 aa, Homo Sapiens
SPMLPAQFK

SEQ ID NO: 1212224 - protein, 9 aa, Homo Sapiens
YTDVEEGSE

SEQ ID NO: 1212225 - protein, 9 aa, Homo Sapiens
PGPGIQGDT

SEQ ID NO: 1212226 - protein, 9 aa, Homo Sapiens
KSFSTRGFP

SEQ ID NO: 1212227 - protein, 9 aa, Homo Sapiens
AMRVARSLG

SEQ ID NO: 1212228 - protein, 9 aa, Homo Sapiens
QSSVNRHRH

SEQ ID NO: 1212229 - protein, 9 aa, Homo Sapiens
VAVELELND

SEQ ID NO: 1212230 - protein, 9 aa, Homo Sapiens
GEIANCEKY

SEQ ID NO: 1212231 - protein, 9 aa, Homo Sapiens
RKNETLIRR

SEQ ID NO: 1212232 - protein, 9 aa, Homo Sapiens
RIGAMARLE

SEQ ID NO: 1212233 - protein, 9 aa, Homo Sapiens
LCILPGTEQ

SEQ ID NO: 1212234 - protein, 9 aa, Homo Sapiens
PAIGFTLAP

SEQ ID NO: 1212235 - protein, 9 aa, Homo Sapiens
PSRSGGVPG

SEQ ID NO: 1212236 - protein, 9 aa, Homo Sapiens
WAKMCYHMP

SEQ ID NO: 1212237 - protein, 9 aa, Homo Sapiens
NTIKRVGYW

SEQ ID NO: 1212238 - protein, 9 aa, Homo Sapiens
QSLNHGMSL

SEQ ID NO: 1212239 - protein, 9 aa, Homo Sapiens
WRGKKLVVA

SEQ ID NO: 1212240 - protein, 9 aa, Homo Sapiens
NIKAAAKAK

SEQ ID NO: 1212241 - protein, 9 aa, Homo Sapiens
LANVSWAAR

SEQ ID NO: 1212242 - protein, 9 aa, Homo Sapiens
TTISQTKQK

SEQ ID NO: 1212243 - protein, 9 aa, Homo Sapiens
DLSLCDHLS

SEQ ID NO: 1212244 - protein, 9 aa, Homo Sapiens
QAAPAPTPD

SEQ ID NO: 1212245 - protein, 9 aa, Homo Sapiens
TSCKTPFLV

SEQ ID NO: 1212246 - protein, 9 aa, Homo Sapiens
CRVTDSQLV

SEQ ID NO: 1212247 - protein, 9 aa, Homo Sapiens
QLLVQDKFE

SEQ ID NO: 1212248 - protein, 9 aa, Homo Sapiens
SQQRKILLE

SEQ ID NO: 1212249 - protein, 9 aa, Homo Sapiens
DAQDPDLQR

SEQ ID NO: 1212250 - protein, 9 aa, Homo Sapiens
FTASKDPTV

SEQ ID NO: 1212251 - protein, 9 aa, Homo Sapiens
LFLLYISLA

SEQ ID NO: 1212252 - protein, 9 aa, Homo Sapiens
QLNGLLLFI

SEQ ID NO: 1212253 - protein, 9 aa, Homo Sapiens
TNYNINQSR

SEQ ID NO: 1212254 - protein, 9 aa, Homo Sapiens
YQDQVNLRT

SEQ ID NO: 1212255 - protein, 9 aa, Homo Sapiens
PSWTMDPQE

SEQ ID NO: 1212256 - protein, 9 aa, Homo Sapiens
FFGYTPVVW

SEQ ID NO: 1212257 - protein, 9 aa, Homo Sapiens
IHDVPSTLW

SEQ ID NO: 1212258 - protein, 9 aa, Homo Sapiens
VGECDGTAC

SEQ ID NO: 1212259 - protein, 9 aa, Homo Sapiens
EIFILAVMA

SEQ ID NO: 1212260 - protein, 9 aa, Homo Sapiens
EIIMLNTAC

SEQ ID NO: 1212261 - protein, 9 aa, Homo Sapiens
MCPECKHCF

SEQ ID NO: 1212262 - protein, 9 aa, Homo Sapiens
PRLPLRPQR

SEQ ID NO: 1212263 - protein, 9 aa, Homo Sapiens
ITKSAHDCH

SEQ ID NO: 1212264 - protein, 9 aa, Homo Sapiens
LLEDRYNVY

SEQ ID NO: 1212265 - protein, 9 aa, Homo Sapiens
IDYEGHSDG

SEQ ID NO: 1212266 - protein, 9 aa, Homo Sapiens
CPECKHCFK

SEQ ID NO: 1212267 - protein, 9 aa, Homo Sapiens
SPCELREPG

SEQ ID NO: 1212268 - protein, 9 aa, Homo Sapiens
LLLVLMANP

SEQ ID NO: 1212269 - protein, 9 aa, Homo Sapiens
HCGHSQPQY

SEQ ID NO: 1212270 - protein, 9 aa, Homo Sapiens
ETQITTILR

SEQ ID NO: 1212271 - protein, 9 aa, Homo Sapiens
EMSLTPMIQ

SEQ ID NO: 1212272 - protein, 9 aa, Homo Sapiens
PSIRSQVVR

SEQ ID NO: 1212273 - protein, 9 aa, Homo Sapiens
VEVHPRDVM

SEQ ID NO: 1212274 - protein, 9 aa, Homo Sapiens
QDYMLTLHT

SEQ ID NO: 1212275 - protein, 9 aa, Homo Sapiens
VKKYDLCAL

SEQ ID NO: 1212276 - protein, 9 aa, Homo Sapiens
ETFTSASGT

SEQ ID NO: 1212277 - protein, 9 aa, Homo Sapiens
QTLCKTPPM

SEQ ID NO: 1212278 - protein, 9 aa, Homo Sapiens
ADVIGIQHA

SEQ ID NO: 1212279 - protein, 9 aa, Homo Sapiens
EVLRELRVE

SEQ ID NO: 1212280 - protein, 9 aa, Homo Sapiens
VKRLTGGDW

SEQ ID NO: 1212281 - protein, 9 aa, Homo Sapiens
DVEAVYPAL

SEQ ID NO: 1212282 - protein, 9 aa, Homo Sapiens
RRSYETIAK

SEQ ID NO: 1212283 - protein, 9 aa, Homo Sapiens
HWTIQKVFY

SEQ ID NO: 1212284 - protein, 9 aa, Homo Sapiens
ESVPSYTIK

SEQ ID NO: 1212285 - protein, 9 aa, Homo Sapiens
LAFLKKISF

SEQ ID NO: 1212286 - protein, 9 aa, Homo Sapiens
FIFWGPISY

SEQ ID NO: 1212287 - protein, 9 aa, Homo Sapiens
LSSLVFKRM

SEQ ID NO: 1212288 - protein, 9 aa, Homo Sapiens
EKGPSPIPT

SEQ ID NO: 1212289 - protein, 9 aa, Homo Sapiens
AKMDHPVCF

SEQ ID NO: 1212290 - protein, 9 aa, Homo Sapiens
MGQAYAFAR

SEQ ID NO: 1212291 - protein, 9 aa, Homo Sapiens
SWLERDTPD

SEQ ID NO: 1212292 - protein, 9 aa, Homo Sapiens
DQCLPGFSD

SEQ ID NO: 1212293 - protein, 9 aa, Homo Sapiens
VYRCTIHNG

SEQ ID NO: 1212294 - protein, 9 aa, Homo Sapiens
AVSSIQREY

SEQ ID NO: 1212295 - protein, 9 aa, Homo Sapiens
PNDLQFWLG

SEQ ID NO: 1212296 - protein, 9 aa, Homo Sapiens
EPEILVWRP

SEQ ID NO: 1212297 - protein, 9 aa, Homo Sapiens
EWMQKKRRG

SEQ ID NO: 1212298 - protein, 9 aa, Homo Sapiens
QCETLIYPN

SEQ ID NO: 1212299 - protein, 9 aa, Homo Sapiens
DTPIMRSLK

SEQ ID NO: 1212300 - protein, 9 aa, Homo Sapiens
FSYDKPLNN

SEQ ID NO: 1212301 - protein, 9 aa, Homo Sapiens
RMPGQASLV

SEQ ID NO: 1212302 - protein, 9 aa, Homo Sapiens
MKTHLLRMS

SEQ ID NO: 1212303 - protein, 9 aa, Homo Sapiens
PGERGPTGP

SEQ ID NO: 1212304 - protein, 9 aa, Homo Sapiens
RQLRHCLSL

SEQ ID NO: 1212305 - protein, 9 aa, Homo Sapiens
EPSLSSFGM

SEQ ID NO: 1212306 - protein, 9 aa, Homo Sapiens
VTISKATEH

SEQ ID NO: 1212307 - protein, 9 aa, Homo Sapiens
GRLLGDQRR

SEQ ID NO: 1212308 - protein, 9 aa, Homo Sapiens
GGLWHWVLG

SEQ ID NO: 1212309 - protein, 9 aa, Homo Sapiens
FFALSEPYH

SEQ ID NO: 1212310 - protein, 9 aa, Homo Sapiens
YGPPHGSSF

SEQ ID NO: 1212311 - protein, 9 aa, Homo Sapiens
EGSSGNSGR

SEQ ID NO: 1212312 - protein, 9 aa, Homo Sapiens
LVLVGTHDA

SEQ ID NO: 1212313 - protein, 9 aa, Homo Sapiens
HVPGPGKLA

SEQ ID NO: 1212314 - protein, 9 aa, Homo Sapiens
TTLEAVVHM

SEQ ID NO: 1212315 - protein, 9 aa, Homo Sapiens
RVDRLLKQD

SEQ ID NO: 1212316 - protein, 9 aa, Homo Sapiens
PSCRREDPE

SEQ ID NO: 1212317 - protein, 9 aa, Homo Sapiens
AGAPCIQEA

SEQ ID NO: 1212318 - protein, 9 aa, Homo Sapiens
NAVVGAGYP

SEQ ID NO: 1212319 - protein, 9 aa, Homo Sapiens
LIDKSEMPH

SEQ ID NO: 1212320 - protein, 9 aa, Homo Sapiens
SWAAASPSW

SEQ ID NO: 1212321 - protein, 9 aa, Homo Sapiens
YVQLMGINL

SEQ ID NO: 1212322 - protein, 9 aa, Homo Sapiens
RSRDRRNQD

SEQ ID NO: 1212323 - protein, 9 aa, Homo Sapiens
DGFVKLGLI

SEQ ID NO: 1212324 - protein, 9 aa, Homo Sapiens
LETQDGKLE

SEQ ID NO: 1212325 - protein, 9 aa, Homo Sapiens
GSLRKEHVF

SEQ ID NO: 1212326 - protein, 9 aa, Homo Sapiens
EIEAQRLDV

SEQ ID NO: 1212327 - protein, 9 aa, Homo Sapiens
DHTFGNAPG

SEQ ID NO: 1212328 - protein, 9 aa, Homo Sapiens
SILRVKAAD

SEQ ID NO: 1212329 - protein, 9 aa, Homo Sapiens
HNDAHVPII

SEQ ID NO: 1212330 - protein, 9 aa, Homo Sapiens
VLGGVNDGC

SEQ ID NO: 1212331 - protein, 9 aa, Homo Sapiens
IVSTSSHLI

SEQ ID NO: 1212332 - protein, 9 aa, Homo Sapiens
FTLHIYHYR

SEQ ID NO: 1212333 - protein, 9 aa, Homo Sapiens
MLLTDMWIG

SEQ ID NO: 1212334 - protein, 9 aa, Homo Sapiens
KNVKSEEEQ

SEQ ID NO: 1212335 - protein, 9 aa, Homo Sapiens
PSFSDMRRA

SEQ ID NO: 1212336 - protein, 9 aa, Homo Sapiens
TGTPCLCPC

SEQ ID NO: 1212337 - protein, 9 aa, Homo Sapiens
APFLILTFL

SEQ ID NO: 1212338 - protein, 9 aa, Homo Sapiens
CTRSPGSLQ

SEQ ID NO: 1212339 - protein, 9 aa, Homo Sapiens
GPELWALQS

SEQ ID NO: 1212340 - protein, 9 aa, Homo Sapiens
DSEEQQLRP

SEQ ID NO: 1212341 - protein, 9 aa, Homo Sapiens
PSRCFAFVR

SEQ ID NO: 1212342 - protein, 9 aa, Homo Sapiens
QSLCVSRGT

SEQ ID NO: 1212343 - protein, 9 aa, Homo Sapiens
VIKNATYIK

SEQ ID NO: 1212344 - protein, 9 aa, Homo Sapiens
DPDLQRRPR

SEQ ID NO: 1212345 - protein, 9 aa, Homo Sapiens
VRVPYHVVG

SEQ ID NO: 1212346 - protein, 9 aa, Homo Sapiens
NQRATSFGI

SEQ ID NO: 1212347 - protein, 9 aa, Homo Sapiens
KQLEKRHRE

SEQ ID NO: 1212348 - protein, 9 aa, Homo Sapiens
FVADRLILE

SEQ ID NO: 1212349 - protein, 9 aa, Homo Sapiens
CSEQSNGSV

SEQ ID NO: 1212350 - protein, 9 aa, Homo Sapiens
SLQEKAQVV

SEQ ID NO: 1212351 - protein, 9 aa, Homo Sapiens
VVAQNGMAK

SEQ ID NO: 1212352 - protein, 9 aa, Homo Sapiens
PGADHMASL

SEQ ID NO: 1212353 - protein, 9 aa, Homo Sapiens
AEKNKDPSP

SEQ ID NO: 1212354 - protein, 9 aa, Homo Sapiens
GHAKKMRQG

SEQ ID NO: 1212355 - protein, 9 aa, Homo Sapiens
LGVTIGLAA

SEQ ID NO: 1212356 - protein, 9 aa, Homo Sapiens
GESWPDIES

SEQ ID NO: 1212357 - protein, 9 aa, Homo Sapiens
FQVSVAADS

SEQ ID NO: 1212358 - protein, 9 aa, Homo Sapiens
CHTQFSIIQ

SEQ ID NO: 1212359 - protein, 9 aa, Homo Sapiens
IASTDTPST

SEQ ID NO: 1212360 - protein, 9 aa, Homo Sapiens
QLMIMQNLE

SEQ ID NO: 1212361 - protein, 9 aa, Homo Sapiens
SRQQGCISE

SEQ ID NO: 1212362 - protein, 9 aa, Homo Sapiens
RYFPVGNVV

SEQ ID NO: 1212363 - protein, 9 aa, Homo Sapiens
FSVLMLPVC

SEQ ID NO: 1212364 - protein, 9 aa, Homo Sapiens
TCYSFRMCQ

SEQ ID NO: 1212365 - protein, 9 aa, Homo Sapiens
IFNFLYLHS

SEQ ID NO: 1212366 - protein, 9 aa, Homo Sapiens
TAILLPGAP

SEQ ID NO: 1212367 - protein, 9 aa, Homo Sapiens
KHFNSLYIP

SEQ ID NO: 1212368 - protein, 9 aa, Homo Sapiens
VNSSRFGKY

SEQ ID NO: 1212369 - protein, 9 aa, Homo Sapiens
VQAWLRFSI

SEQ ID NO: 1212370 - protein, 9 aa, Homo Sapiens
DVVSSGLND

SEQ ID NO: 1212371 - protein, 9 aa, Homo Sapiens
PTERTALAG

SEQ ID NO: 1212372 - protein, 9 aa, Homo Sapiens
PGAALDFCI

SEQ ID NO: 1212373 - protein, 9 aa, Homo Sapiens
AFTDMSNLN

SEQ ID NO: 1212374 - protein, 9 aa, Homo Sapiens
SDWEAFATS

SEQ ID NO: 1212375 - protein, 9 aa, Homo Sapiens
HYIIISVIQ

SEQ ID NO: 1212376 - protein, 9 aa, Homo Sapiens
TKDSVASTI

SEQ ID NO: 1212377 - protein, 9 aa, Homo Sapiens
GRGEHPNPP

SEQ ID NO: 1212378 - protein, 9 aa, Homo Sapiens
KLSPESTEE

SEQ ID NO: 1212379 - protein, 9 aa, Homo Sapiens
VTEGNCSNY

SEQ ID NO: 1212380 - protein, 9 aa, Homo Sapiens
DLRDCIATG

SEQ ID NO: 1212381 - protein, 9 aa, Homo Sapiens
QLMYTVEYS

SEQ ID NO: 1212382 - protein, 9 aa, Homo Sapiens
GTRKGYMSK

SEQ ID NO: 1212383 - protein, 9 aa, Homo Sapiens
LSENNMSDV

SEQ ID NO: 1212384 - protein, 9 aa, Homo Sapiens
GWAWIRVAL

SEQ ID NO: 1212385 - protein, 9 aa, Homo Sapiens
WHLLRTSPS

SEQ ID NO: 1212386 - protein, 9 aa, Homo Sapiens
SFAYPNHPD

SEQ ID NO: 1212387 - protein, 9 aa, Homo Sapiens
VTIIITFII

SEQ ID NO: 1212388 - protein, 9 aa, Homo Sapiens
IALVIQVAP

SEQ ID NO: 1212389 - protein, 9 aa, Homo Sapiens
TKLKLMAHY

SEQ ID NO: 1212390 - protein, 9 aa, Homo Sapiens
TLRIPCTQA

SEQ ID NO: 1212391 - protein, 9 aa, Homo Sapiens
TTSPDSGVL

SEQ ID NO: 1212392 - protein, 9 aa, Homo Sapiens
YKCYQYGKN

SEQ ID NO: 1212393 - protein, 9 aa, Homo Sapiens
PRSPASPLH

SEQ ID NO: 1212394 - protein, 9 aa, Homo Sapiens
KVRGRSEGF

SEQ ID NO: 1212395 - protein, 9 aa, Homo Sapiens
KFHHYRSHN

SEQ ID NO: 1212396 - protein, 9 aa, Homo Sapiens
LIWTAPRGP

SEQ ID NO: 1212397 - protein, 9 aa, Homo Sapiens
PTITEGVAT

SEQ ID NO: 1212398 - protein, 9 aa, Homo Sapiens
LTKCVKKSK

SEQ ID NO: 1212399 - protein, 9 aa, Homo Sapiens
MVQAAEPPL

SEQ ID NO: 1212400 - protein, 9 aa, Homo Sapiens
RYILHPQVI

SEQ ID NO: 1212401 - protein, 9 aa, Homo Sapiens
RWDIIAQRA

SEQ ID NO: 1212402 - protein, 9 aa, Homo Sapiens
TTDAILWQW

SEQ ID NO: 1212403 - protein, 9 aa, Homo Sapiens
EVQAEKNQG

SEQ ID NO: 1212404 - protein, 9 aa, Homo Sapiens
DILRMKVQD

SEQ ID NO: 1212405 - protein, 9 aa, Homo Sapiens
RLSRVTHLE

SEQ ID NO: 1212406 - protein, 9 aa, Homo Sapiens
LPHTHESQA

SEQ ID NO: 1212407 - protein, 9 aa, Homo Sapiens
KQGRIMSRM

SEQ ID NO: 1212408 - protein, 9 aa, Homo Sapiens
RILGADTFV

SEQ ID NO: 1212409 - protein, 9 aa, Homo Sapiens
DGMAVATSS

SEQ ID NO: 1212410 - protein, 9 aa, Homo Sapiens
TEVEEPESL

SEQ ID NO: 1212411 - protein, 9 aa, Homo Sapiens
VFLLMINGQ

SEQ ID NO: 1212412 - protein, 9 aa, Homo Sapiens
KREWEMLHN

SEQ ID NO: 1212413 - protein, 9 aa, Homo Sapiens
PMIIHMWPM

SEQ ID NO: 1212414 - protein, 9 aa, Homo Sapiens
VSFAYPNHP

SEQ ID NO: 1212415 - protein, 9 aa, Homo Sapiens
SRGWGRGLV

SEQ ID NO: 1212416 - protein, 9 aa, Homo Sapiens
DAHAEMHDD

SEQ ID NO: 1212417 - protein, 9 aa, Homo Sapiens
HMMLALSLQ

SEQ ID NO: 1212418 - protein, 9 aa, Homo Sapiens
DCLTQCASR

SEQ ID NO: 1212419 - protein, 9 aa, Homo Sapiens
AEQQRHILQ

SEQ ID NO: 1212420 - protein, 9 aa, Homo Sapiens
LNTACAVGN

SEQ ID NO: 1212421 - protein, 9 aa, Homo Sapiens
DTQGFMGLF

SEQ ID NO: 1212422 - protein, 9 aa, Homo Sapiens
GGQMGRPHS

SEQ ID NO: 1212423 - protein, 9 aa, Homo Sapiens
TDRFKLPPG

SEQ ID NO: 1212424 - protein, 9 aa, Homo Sapiens
TRPRRLSQH

SEQ ID NO: 1212425 - protein, 9 aa, Homo Sapiens
GHQSDTEAN

SEQ ID NO: 1212426 - protein, 9 aa, Homo Sapiens
GNAGVRGKF

SEQ ID NO: 1212427 - protein, 9 aa, Homo Sapiens
CLLEVYNWV

SEQ ID NO: 1212428 - protein, 9 aa, Homo Sapiens
PSCWVRQAA

SEQ ID NO: 1212429 - protein, 9 aa, Homo Sapiens
SGEKPYQCG

SEQ ID NO: 1212430 - protein, 9 aa, Homo Sapiens
CCATPAHAL

SEQ ID NO: 1212431 - protein, 9 aa, Homo Sapiens
AKYSAENEE

SEQ ID NO: 1212432 - protein, 9 aa, Homo Sapiens
SPYEFFAHD

SEQ ID NO: 1212433 - protein, 9 aa, Homo Sapiens
GLRGLTNLG

SEQ ID NO: 1212434 - protein, 9 aa, Homo Sapiens
VISKETDAF

SEQ ID NO: 1212435 - protein, 9 aa, Homo Sapiens
PSAPSPMLP

SEQ ID NO: 1212436 - protein, 9 aa, Homo Sapiens
GIPLNITLD

SEQ ID NO: 1212437 - protein, 9 aa, Homo Sapiens
MCLAFHPTE

SEQ ID NO: 1212438 - protein, 9 aa, Homo Sapiens
YVVPYLRNR

SEQ ID NO: 1212439 - protein, 9 aa, Homo Sapiens
TIHSVLNRS

SEQ ID NO: 1212440 - protein, 9 aa, Homo Sapiens
IRLLCRVAV

SEQ ID NO: 1212441 - protein, 9 aa, Homo Sapiens
ESESITFLK

SEQ ID NO: 1212442 - protein, 9 aa, Homo Sapiens
TVYQIHKQN

SEQ ID NO: 1212443 - protein, 9 aa, Homo Sapiens
SKADYLKRY

SEQ ID NO: 1212444 - protein, 9 aa, Homo Sapiens
LVWEKATGR

SEQ ID NO: 1212445 - protein, 9 aa, Homo Sapiens
PVRAELLVF

SEQ ID NO: 1212446 - protein, 9 aa, Homo Sapiens
TNFKSIHSI

SEQ ID NO: 1212447 - protein, 9 aa, Homo Sapiens
WGKLPGPTL

SEQ ID NO: 1212448 - protein, 9 aa, Homo Sapiens
EVKVKIATL

SEQ ID NO: 1212449 - protein, 9 aa, Homo Sapiens
TVKNVVLDC

SEQ ID NO: 1212450 - protein, 9 aa, Homo Sapiens
ILYIPVVKS

SEQ ID NO: 1212451 - protein, 9 aa, Homo Sapiens
DLWSEQGIK

SEQ ID NO: 1212452 - protein, 9 aa, Homo Sapiens
RLVDEDLLF

SEQ ID NO: 1212453 - protein, 9 aa, Homo Sapiens
NKLPLTRVV

SEQ ID NO: 1212454 - protein, 9 aa, Homo Sapiens
GKLRGARVS

SEQ ID NO: 1212455 - protein, 9 aa, Homo Sapiens
TTILREILK

SEQ ID NO: 1212456 - protein, 9 aa, Homo Sapiens
FSFHFLFGI

SEQ ID NO: 1212457 - protein, 9 aa, Homo Sapiens
VGHQYVKDV

SEQ ID NO: 1212458 - protein, 9 aa, Homo Sapiens
MGSKAISHD

SEQ ID NO: 1212459 - protein, 9 aa, Homo Sapiens
PGRRAPLQL

SEQ ID NO: 1212460 - protein, 9 aa, Homo Sapiens
TMITEFLLL

SEQ ID NO: 1212461 - protein, 9 aa, Homo Sapiens
ITSTGDQTL

SEQ ID NO: 1212462 - protein, 9 aa, Homo Sapiens
ECDQFSQES

SEQ ID NO: 1212463 - protein, 9 aa, Homo Sapiens
TRDSVGNTV

SEQ ID NO: 1212464 - protein, 9 aa, Homo Sapiens
WDCGGGLQT

SEQ ID NO: 1212465 - protein, 9 aa, Homo Sapiens
RPLLPRAPP

SEQ ID NO: 1212466 - protein, 9 aa, Homo Sapiens
PWVPAIGFT

SEQ ID NO: 1212467 - protein, 9 aa, Homo Sapiens
FTTQQTTLR

SEQ ID NO: 1212468 - protein, 9 aa, Homo Sapiens
WLMLTSYIA

SEQ ID NO: 1212469 - protein, 9 aa, Homo Sapiens
PSMCKRICI

SEQ ID NO: 1212470 - protein, 9 aa, Homo Sapiens
HYANLFIHI

SEQ ID NO: 1212471 - protein, 9 aa, Homo Sapiens
SPSHQRQKA

SEQ ID NO: 1212472 - protein, 9 aa, Homo Sapiens
IGNAEHKPY

SEQ ID NO: 1212473 - protein, 9 aa, Homo Sapiens
MAPGFARLP

SEQ ID NO: 1212474 - protein, 9 aa, Homo Sapiens
QENQKAQKT

SEQ ID NO: 1212475 - protein, 9 aa, Homo Sapiens
GTATSQGFF

SEQ ID NO: 1212476 - protein, 9 aa, Homo Sapiens
QTAQLLTLV

SEQ ID NO: 1212477 - protein, 9 aa, Homo Sapiens
AMVCTFFDT

SEQ ID NO: 1212478 - protein, 9 aa, Homo Sapiens
IERLNAELV

SEQ ID NO: 1212479 - protein, 9 aa, Homo Sapiens
IISAPDSGM

SEQ ID NO: 1212480 - protein, 9 aa, Homo Sapiens
TKLSPDSLG

SEQ ID NO: 1212481 - protein, 9 aa, Homo Sapiens
SNRCTSDLE

SEQ ID NO: 1212482 - protein, 9 aa, Homo Sapiens
NYDLREDDL

SEQ ID NO: 1212483 - protein, 9 aa, Homo Sapiens
WSVSAASSL

SEQ ID NO: 1212484 - protein, 9 aa, Homo Sapiens
FSRDPKCYV

SEQ ID NO: 1212485 - protein, 9 aa, Homo Sapiens
CVFPTRTAH

SEQ ID NO: 1212486 - protein, 9 aa, Homo Sapiens
HAEIMRLFP

SEQ ID NO: 1212487 - protein, 9 aa, Homo Sapiens
AQPTKVRRF

SEQ ID NO: 1212488 - protein, 9 aa, Homo Sapiens
TENTDTSRQ

SEQ ID NO: 1212489 - protein, 9 aa, Homo Sapiens
YFSKEEWET

SEQ ID NO: 1212490 - protein, 9 aa, Homo Sapiens
SEVSNGMSR

SEQ ID NO: 1212491 - protein, 9 aa, Homo Sapiens
DLITCLEQI

SEQ ID NO: 1212492 - protein, 9 aa, Homo Sapiens
LQEIKECFT

SEQ ID NO: 1212493 - protein, 9 aa, Homo Sapiens
TQAAIKEQN

SEQ ID NO: 1212494 - protein, 9 aa, Homo Sapiens
QGECVRGLK

SEQ ID NO: 1212495 - protein, 9 aa, Homo Sapiens
STKNFRPTG

SEQ ID NO: 1212496 - protein, 9 aa, Homo Sapiens
DRYSGYRWC

SEQ ID NO: 1212497 - protein, 9 aa, Homo Sapiens
ITVASSSLT

SEQ ID NO: 1212498 - protein, 9 aa, Homo Sapiens
AGSSGNKHL

SEQ ID NO: 1212499 - protein, 9 aa, Homo Sapiens
GEPWMHPCC

SEQ ID NO: 1212500 - protein, 9 aa, Homo Sapiens
LREKVHELQ

SEQ ID NO: 1212501 - protein, 9 aa, Homo Sapiens
SQPAAKDPS

SEQ ID NO: 1212502 - protein, 9 aa, Homo Sapiens
KKLKLAPLQ

SEQ ID NO: 1212503 - protein, 9 aa, Homo Sapiens
FTIKKHMAM

SEQ ID NO: 1212504 - protein, 9 aa, Homo Sapiens
YPQLCLQGR

SEQ ID NO: 1212505 - protein, 9 aa, Homo Sapiens
QQMDPNRAF

SEQ ID NO: 1212506 - protein, 9 aa, Homo Sapiens
VCELVMAPG

SEQ ID NO: 1212507 - protein, 9 aa, Homo Sapiens
EEKQEHVVV

SEQ ID NO: 1212508 - protein, 9 aa, Homo Sapiens
GEEVEGGVR

SEQ ID NO: 1212509 - protein, 9 aa, Homo Sapiens
PKPNVFPKT

SEQ ID NO: 1212510 - protein, 9 aa, Homo Sapiens
SVTSLDAEL

SEQ ID NO: 1212511 - protein, 9 aa, Homo Sapiens
EKHPAERHM

SEQ ID NO: 1212512 - protein, 9 aa, Homo Sapiens
SSAWTDSNS

SEQ ID NO: 1212513 - protein, 9 aa, Homo Sapiens
KPGEGTYAT

SEQ ID NO: 1212514 - protein, 9 aa, Homo Sapiens
IWLGPNTVL

SEQ ID NO: 1212515 - protein, 9 aa, Homo Sapiens
SLQYTLKQH

SEQ ID NO: 1212516 - protein, 9 aa, Homo Sapiens
VYTYLHPRS

SEQ ID NO: 1212517 - protein, 9 aa, Homo Sapiens
YVALSYINI

SEQ ID NO: 1212518 - protein, 9 aa, Homo Sapiens
LGIYNCWEF

SEQ ID NO: 1212519 - protein, 9 aa, Homo Sapiens
HGPREALTQ

SEQ ID NO: 1212520 - protein, 9 aa, Homo Sapiens
EAIHILTSI

SEQ ID NO: 1212521 - protein, 9 aa, Homo Sapiens
FSRWCSYIA

SEQ ID NO: 1212522 - protein, 9 aa, Homo Sapiens
ALAHQVPNA

SEQ ID NO: 1212523 - protein, 9 aa, Homo Sapiens
FVPGMFGTS

SEQ ID NO: 1212524 - protein, 9 aa, Homo Sapiens
IENGVAEWQ

SEQ ID NO: 1212525 - protein, 9 aa, Homo Sapiens
LVETNEKSK

SEQ ID NO: 1212526 - protein, 9 aa, Homo Sapiens
SIDAENSPY

SEQ ID NO: 1212527 - protein, 9 aa, Homo Sapiens
PVLTIVPHP

SEQ ID NO: 1212528 - protein, 9 aa, Homo Sapiens
SPRHSPHHM

SEQ ID NO: 1212529 - protein, 9 aa, Homo Sapiens
TTRVQTTRT

SEQ ID NO: 1212530 - protein, 9 aa, Homo Sapiens
DGSQDTEND

SEQ ID NO: 1212531 - protein, 9 aa, Homo Sapiens
PEEFGFSFS

SEQ ID NO: 1212532 - protein, 9 aa, Homo Sapiens
CVWDEDDDI

SEQ ID NO: 1212533 - protein, 9 aa, Homo Sapiens
QWGCCGEQD

SEQ ID NO: 1212534 - protein, 9 aa, Homo Sapiens
TYLDVGSMK

SEQ ID NO: 1212535 - protein, 9 aa, Homo Sapiens
NPLIHVFFN

SEQ ID NO: 1212536 - protein, 9 aa, Homo Sapiens
TLLATQAGS

SEQ ID NO: 1212537 - protein, 9 aa, Homo Sapiens
QKDFIIQTG

SEQ ID NO: 1212538 - protein, 9 aa, Homo Sapiens
MIVTTHFAL

SEQ ID NO: 1212539 - protein, 9 aa, Homo Sapiens
VTSNLTVLV

SEQ ID NO: 1212540 - protein, 9 aa, Homo Sapiens
TPAENKMNL

SEQ ID NO: 1212541 - protein, 9 aa, Homo Sapiens
FIIGVIIGK

SEQ ID NO: 1212542 - protein, 9 aa, Homo Sapiens
KLEHLDHVL

SEQ ID NO: 1212543 - protein, 9 aa, Homo Sapiens
NTQGTWEPS

SEQ ID NO: 1212544 - protein, 9 aa, Homo Sapiens
VNVDSLNNP

SEQ ID NO: 1212545 - protein, 9 aa, Homo Sapiens
ISVMRYSPD

SEQ ID NO: 1212546 - protein, 9 aa, Homo Sapiens
LEKRHREYN

SEQ ID NO: 1212547 - protein, 9 aa, Homo Sapiens
IGKSKPKAQ

SEQ ID NO: 1212548 - protein, 9 aa, Homo Sapiens
FCCFHDYNV

SEQ ID NO: 1212549 - protein, 9 aa, Homo Sapiens
REDDDEDPD

SEQ ID NO: 1212550 - protein, 9 aa, Homo Sapiens
LVLSPAQVI

SEQ ID NO: 1212551 - protein, 9 aa, Homo Sapiens
RPQSPGANL

SEQ ID NO: 1212552 - protein, 9 aa, Homo Sapiens
GRFKDMPNF

SEQ ID NO: 1212553 - protein, 9 aa, Homo Sapiens
EVNTELNAQ

SEQ ID NO: 1212554 - protein, 9 aa, Homo Sapiens
YCIYSVGYL

SEQ ID NO: 1212555 - protein, 9 aa, Homo Sapiens
NDMGYVRMI

SEQ ID NO: 1212556 - protein, 9 aa, Homo Sapiens
TAMYFAWLG

SEQ ID NO: 1212557 - protein, 9 aa, Homo Sapiens
TTLRLVWIL

SEQ ID NO: 1212558 - protein, 9 aa, Homo Sapiens
GEPPTQSIS

SEQ ID NO: 1212559 - protein, 9 aa, Homo Sapiens
LKVLMMMSL

SEQ ID NO: 1212560 - protein, 9 aa, Homo Sapiens
GESWLRTDC

SEQ ID NO: 1212561 - protein, 9 aa, Homo Sapiens
DLANKCMVE

SEQ ID NO: 1212562 - protein, 9 aa, Homo Sapiens
CGPCITSPS

SEQ ID NO: 1212563 - protein, 9 aa, Homo Sapiens
AEHIIEATS

SEQ ID NO: 1212564 - protein, 9 aa, Homo Sapiens
KVHFWVGFP

SEQ ID NO: 1212565 - protein, 9 aa, Homo Sapiens
PLPADLPHS

SEQ ID NO: 1212566 - protein, 9 aa, Homo Sapiens
PMWDDSRNK

SEQ ID NO: 1212567 - protein, 9 aa, Homo Sapiens
RVPFDPLSF

SEQ ID NO: 1212568 - protein, 9 aa, Homo Sapiens
DLVKEELNT

SEQ ID NO: 1212569 - protein, 9 aa, Homo Sapiens
QKKCKMSLL

SEQ ID NO: 1212570 - protein, 9 aa, Homo Sapiens
FNALIHKNR

SEQ ID NO: 1212571 - protein, 9 aa, Homo Sapiens
LDTTGMVEC

SEQ ID NO: 1212572 - protein, 9 aa, Homo Sapiens
GPGKLALSK

SEQ ID NO: 1212573 - protein, 9 aa, Homo Sapiens
ANDYSDCKN

SEQ ID NO: 1212574 - protein, 9 aa, Homo Sapiens
APMGPYARG

SEQ ID NO: 1212575 - protein, 9 aa, Homo Sapiens
QLLLLNLLK

SEQ ID NO: 1212576 - protein, 9 aa, Homo Sapiens
AASTTRVQT

SEQ ID NO: 1212577 - protein, 9 aa, Homo Sapiens
AHIFPVCSS

SEQ ID NO: 1212578 - protein, 9 aa, Homo Sapiens
DNCRCLRCF

SEQ ID NO: 1212579 - protein, 9 aa, Homo Sapiens
ATTYSSGTF

SEQ ID NO: 1212580 - protein, 9 aa, Homo Sapiens
CCWCSLTVW

SEQ ID NO: 1212581 - protein, 9 aa, Homo Sapiens
LSVFGSLRD

SEQ ID NO: 1212582 - protein, 9 aa, Homo Sapiens
WITSALSTG

SEQ ID NO: 1212583 - protein, 9 aa, Homo Sapiens
VKCNNQTIF

SEQ ID NO: 1212584 - protein, 9 aa, Homo Sapiens
LLCYAALSL

SEQ ID NO: 1212585 - protein, 9 aa, Homo Sapiens
FTNRQRMNK

SEQ ID NO: 1212586 - protein, 9 aa, Homo Sapiens
LFQHHEHLP

SEQ ID NO: 1212587 - protein, 9 aa, Homo Sapiens
EHIMHMISP

SEQ ID NO: 1212588 - protein, 9 aa, Homo Sapiens
TSSSDDFSD

SEQ ID NO: 1212589 - protein, 9 aa, Homo Sapiens
SYKQDRDIT

SEQ ID NO: 1212590 - protein, 9 aa, Homo Sapiens
RAAGRHLCF

SEQ ID NO: 1212591 - protein, 9 aa, Homo Sapiens
LIIGFVISG

SEQ ID NO: 1212592 - protein, 9 aa, Homo Sapiens
SKAASQQRK

SEQ ID NO: 1212593 - protein, 9 aa, Homo Sapiens
GDKPLPVPP

SEQ ID NO: 1212594 - protein, 9 aa, Homo Sapiens
LGVVVVFAA

SEQ ID NO: 1212595 - protein, 9 aa, Homo Sapiens
YYGDLAAHL

SEQ ID NO: 1212596 - protein, 9 aa, Homo Sapiens
SFKECNQDV

SEQ ID NO: 1212597 - protein, 9 aa, Homo Sapiens
GIMAVTLAM

SEQ ID NO: 1212598 - protein, 9 aa, Homo Sapiens
IINYLYETT

SEQ ID NO: 1212599 - protein, 9 aa, Homo Sapiens
GTGKTTLTR

SEQ ID NO: 1212600 - protein, 9 aa, Homo Sapiens
IVIHIHNKI

SEQ ID NO: 1212601 - protein, 9 aa, Homo Sapiens
ELEPISLSS

SEQ ID NO: 1212602 - protein, 9 aa, Homo Sapiens
RVCQEILER

SEQ ID NO: 1212603 - protein, 9 aa, Homo Sapiens
STPYISVPP

SEQ ID NO: 1212604 - protein, 9 aa, Homo Sapiens
KVMLGETMS

SEQ ID NO: 1212605 - protein, 9 aa, Homo Sapiens
SASIHDMND

SEQ ID NO: 1212606 - protein, 9 aa, Homo Sapiens
RPSPAQVLS

SEQ ID NO: 1212607 - protein, 9 aa, Homo Sapiens
DAAAIQDET

SEQ ID NO: 1212608 - protein, 9 aa, Homo Sapiens
KAVMKFRNT

SEQ ID NO: 1212609 - protein, 9 aa, Homo Sapiens
PTHTQVYIR

SEQ ID NO: 1212610 - protein, 9 aa, Homo Sapiens
PFLILTFLA

SEQ ID NO: 1212611 - protein, 9 aa, Homo Sapiens
LTQCASRRL

SEQ ID NO: 1212612 - protein, 9 aa, Homo Sapiens
NAQLHAQDY

SEQ ID NO: 1212613 - protein, 9 aa, Homo Sapiens
FIHLWALLA

SEQ ID NO: 1212614 - protein, 9 aa, Homo Sapiens
REQGPGHAC

SEQ ID NO: 1212615 - protein, 9 aa, Homo Sapiens
LTGLGREDL

SEQ ID NO: 1212616 - protein, 9 aa, Homo Sapiens
RLNELEVQT

SEQ ID NO: 1212617 - protein, 9 aa, Homo Sapiens
CRYYIHRQC

SEQ ID NO: 1212618 - protein, 9 aa, Homo Sapiens
TSKVTEQAL

SEQ ID NO: 1212619 - protein, 9 aa, Homo Sapiens
AEIFKEINT

SEQ ID NO: 1212620 - protein, 9 aa, Homo Sapiens
LSSDGKEVP

SEQ ID NO: 1212621 - protein, 9 aa, Homo Sapiens
KYSYMTICK

SEQ ID NO: 1212622 - protein, 9 aa, Homo Sapiens
INQLEQLRQ

SEQ ID NO: 1212623 - protein, 9 aa, Homo Sapiens
TYSCIVSNP

SEQ ID NO: 1212624 - protein, 9 aa, Homo Sapiens
VICHHGTTG

SEQ ID NO: 1212625 - protein, 9 aa, Homo Sapiens
QRRRVQLMW

SEQ ID NO: 1212626 - protein, 9 aa, Homo Sapiens
KLIMLPSSS

SEQ ID NO: 1212627 - protein, 9 aa, Homo Sapiens
HRTYGAKSD

SEQ ID NO: 1212628 - protein, 9 aa, Homo Sapiens
SLMFGGNIL

SEQ ID NO: 1212629 - protein, 9 aa, Homo Sapiens
KECPEYTVW

SEQ ID NO: 1212630 - protein, 9 aa, Homo Sapiens
VVPVPSMDA

SEQ ID NO: 1212631 - protein, 9 aa, Homo Sapiens
SISGGGGST

SEQ ID NO: 1212632 - protein, 9 aa, Homo Sapiens
SVSEDEFVG

SEQ ID NO: 1212633 - protein, 9 aa, Homo Sapiens
CMVRAATLI

SEQ ID NO: 1212634 - protein, 9 aa, Homo Sapiens
DPQGPNLEW

SEQ ID NO: 1212635 - protein, 9 aa, Homo Sapiens
LKTEDSART

SEQ ID NO: 1212636 - protein, 9 aa, Homo Sapiens
SQNKGKISE

SEQ ID NO: 1212637 - protein, 9 aa, Homo Sapiens
AQILAFTGL

SEQ ID NO: 1212638 - protein, 9 aa, Homo Sapiens
TSWPHWLYS

SEQ ID NO: 1212639 - protein, 9 aa, Homo Sapiens
PSMNRLTDV

SEQ ID NO: 1212640 - protein, 9 aa, Homo Sapiens
TEECVQPEY

SEQ ID NO: 1212641 - protein, 9 aa, Homo Sapiens
PNKKGWLPL

SEQ ID NO: 1212642 - protein, 9 aa, Homo Sapiens
PLVTINVFD

SEQ ID NO: 1212643 - protein, 9 aa, Homo Sapiens
YRQVAFHVG

SEQ ID NO: 1212644 - protein, 9 aa, Homo Sapiens
SREYSLGPF

SEQ ID NO: 1212645 - protein, 9 aa, Homo Sapiens
KGFPTLFTF

SEQ ID NO: 1212646 - protein, 9 aa, Homo Sapiens
GPVAVLDFW

SEQ ID NO: 1212647 - protein, 9 aa, Homo Sapiens
YSDLNEYGT

SEQ ID NO: 1212648 - protein, 9 aa, Homo Sapiens
WPHWLYSLY

SEQ ID NO: 1212649 - protein, 9 aa, Homo Sapiens
FLILTFLAL

SEQ ID NO: 1212650 - protein, 9 aa, Homo Sapiens
LYHLSLEAS

SEQ ID NO: 1212651 - protein, 9 aa, Homo Sapiens
RPGGGSKDL

SEQ ID NO: 1212652 - protein, 9 aa, Homo Sapiens
KLRDRDYDR

SEQ ID NO: 1212653 - protein, 9 aa, Homo Sapiens
RTDCFHCTC

SEQ ID NO: 1212654 - protein, 9 aa, Homo Sapiens
TSSDFASLT

SEQ ID NO: 1212655 - protein, 9 aa, Homo Sapiens
DAPVGTQAS

SEQ ID NO: 1212656 - protein, 9 aa, Homo Sapiens
KIIIADLNE

SEQ ID NO: 1212657 - protein, 9 aa, Homo Sapiens
YVDVLTLAI

SEQ ID NO: 1212658 - protein, 9 aa, Homo Sapiens
PCQTTCYRP

SEQ ID NO: 1212659 - protein, 9 aa, Homo Sapiens
YFNLESSYL

SEQ ID NO: 1212660 - protein, 9 aa, Homo Sapiens
FRLSTDSHF

SEQ ID NO: 1212661 - protein, 9 aa, Homo Sapiens
HKLSHGSVV

SEQ ID NO: 1212662 - protein, 9 aa, Homo Sapiens
EKTRWLSSP

SEQ ID NO: 1212663 - protein, 9 aa, Homo Sapiens
RLRKKHRQR

SEQ ID NO: 1212664 - protein, 9 aa, Homo Sapiens
DYKITYWPK

SEQ ID NO: 1212665 - protein, 9 aa, Homo Sapiens
SRLSACGWR

SEQ ID NO: 1212666 - protein, 9 aa, Homo Sapiens
ESDIYTDVR

SEQ ID NO: 1212667 - protein, 9 aa, Homo Sapiens
NNVCAYDPV

SEQ ID NO: 1212668 - protein, 9 aa, Homo Sapiens
IISRANTIP

SEQ ID NO: 1212669 - protein, 9 aa, Homo Sapiens
IPPAGYVSQ

SEQ ID NO: 1212670 - protein, 9 aa, Homo Sapiens
GISAIDGVN

SEQ ID NO: 1212671 - protein, 9 aa, Homo Sapiens
TLPGMHPPT

SEQ ID NO: 1212672 - protein, 9 aa, Homo Sapiens
RPRVPLCPS

SEQ ID NO: 1212673 - protein, 9 aa, Homo Sapiens
SLGYPGIQA

SEQ ID NO: 1212674 - protein, 9 aa, Homo Sapiens
EMASFSENH

SEQ ID NO: 1212675 - protein, 9 aa, Homo Sapiens
TQYENISIL

SEQ ID NO: 1212676 - protein, 9 aa, Homo Sapiens
REMGYVEAK

SEQ ID NO: 1212677 - protein, 9 aa, Homo Sapiens
GPQDLKESG

SEQ ID NO: 1212678 - protein, 9 aa, Homo Sapiens
GDAIDQMRR

SEQ ID NO: 1212679 - protein, 9 aa, Homo Sapiens
NQECQVLLD

SEQ ID NO: 1212680 - protein, 9 aa, Homo Sapiens
KARHRKTGR

SEQ ID NO: 1212681 - protein, 9 aa, Homo Sapiens
NPRHGKCLP

SEQ ID NO: 1212682 - protein, 9 aa, Homo Sapiens
GYQVTAEDL

SEQ ID NO: 1212683 - protein, 9 aa, Homo Sapiens
KSSKPKDSP

SEQ ID NO: 1212684 - protein, 9 aa, Homo Sapiens
QPRSDTSLT

SEQ ID NO: 1212685 - protein, 9 aa, Homo Sapiens
ELQRHVDEF

SEQ ID NO: 1212686 - protein, 9 aa, Homo Sapiens
RSCSQEECI

SEQ ID NO: 1212687 - protein, 9 aa, Homo Sapiens
GLRSCTVVM

SEQ ID NO: 1212688 - protein, 9 aa, Homo Sapiens
QRAGAPCIQ

SEQ ID NO: 1212689 - protein, 9 aa, Homo Sapiens
LEQGQQCLT

SEQ ID NO: 1212690 - protein, 9 aa, Homo Sapiens
SYIYVYTVS

SEQ ID NO: 1212691 - protein, 9 aa, Homo Sapiens
FKRAFYPNQ

SEQ ID NO: 1212692 - protein, 9 aa, Homo Sapiens
NGPDSIMNS

SEQ ID NO: 1212693 - protein, 9 aa, Homo Sapiens
GNCVEKHNG

SEQ ID NO: 1212694 - protein, 9 aa, Homo Sapiens
GLLKPQTPN

SEQ ID NO: 1212695 - protein, 9 aa, Homo Sapiens
VSVGVQSAP

SEQ ID NO: 1212696 - protein, 9 aa, Homo Sapiens
HEIPVPGNL

SEQ ID NO: 1212697 - protein, 9 aa, Homo Sapiens
MEKVSNKTY

SEQ ID NO: 1212698 - protein, 9 aa, Homo Sapiens
SNSVFTLGN

SEQ ID NO: 1212699 - protein, 9 aa, Homo Sapiens
MTKTWTLTQ

SEQ ID NO: 1212700 - protein, 9 aa, Homo Sapiens
ALVELHIME

SEQ ID NO: 1212701 - protein, 9 aa, Homo Sapiens
ICYDAFGED

SEQ ID NO: 1212702 - protein, 9 aa, Homo Sapiens
LLQCSQKDL

SEQ ID NO: 1212703 - protein, 9 aa, Homo Sapiens
IFNLHLDQM

SEQ ID NO: 1212704 - protein, 9 aa, Homo Sapiens
DKRQWNRCQ

SEQ ID NO: 1212705 - protein, 9 aa, Homo Sapiens
LHVQLGGLE

SEQ ID NO: 1212706 - protein, 9 aa, Homo Sapiens
QRQLKRPRH

SEQ ID NO: 1212707 - protein, 9 aa, Homo Sapiens
DTLACLKES

SEQ ID NO: 1212708 - protein, 9 aa, Homo Sapiens
CTGYTLGFM

SEQ ID NO: 1212709 - protein, 9 aa, Homo Sapiens
SDWGSPFHR

SEQ ID NO: 1212710 - protein, 9 aa, Homo Sapiens
LIDMVPRMR

SEQ ID NO: 1212711 - protein, 9 aa, Homo Sapiens
GLQALTRSN

SEQ ID NO: 1212712 - protein, 9 aa, Homo Sapiens
KEAQAAVPA

SEQ ID NO: 1212713 - protein, 9 aa, Homo Sapiens
VTDSQLVVT

SEQ ID NO: 1212714 - protein, 9 aa, Homo Sapiens
CGPSLGLVA

SEQ ID NO: 1212715 - protein, 9 aa, Homo Sapiens
PHLVYCYPV

SEQ ID NO: 1212716 - protein, 9 aa, Homo Sapiens
DLIKLKTPR

SEQ ID NO: 1212717 - protein, 9 aa, Homo Sapiens
YHSDSDIFT

SEQ ID NO: 1212718 - protein, 9 aa, Homo Sapiens
VFPHGSGAG

SEQ ID NO: 1212719 - protein, 9 aa, Homo Sapiens
HTEAKKKAY

SEQ ID NO: 1212720 - protein, 9 aa, Homo Sapiens
DEEVHTGLG

SEQ ID NO: 1212721 - protein, 9 aa, Homo Sapiens
THSISTATP

SEQ ID NO: 1212722 - protein, 9 aa, Homo Sapiens
MHSRSLMLG

SEQ ID NO: 1212723 - protein, 9 aa, Homo Sapiens
PIQISRLPL

SEQ ID NO: 1212724 - protein, 9 aa, Homo Sapiens
IVCSTQGVE

SEQ ID NO: 1212725 - protein, 9 aa, Homo Sapiens
ALRSVAVHR

SEQ ID NO: 1212726 - protein, 9 aa, Homo Sapiens
RPTRRGAPR

SEQ ID NO: 1212727 - protein, 9 aa, Homo Sapiens
CSQTVAMQG

SEQ ID NO: 1212728 - protein, 9 aa, Homo Sapiens
NTHQLLAMT

SEQ ID NO: 1212729 - protein, 9 aa, Homo Sapiens
TVGTKPLLY

SEQ ID NO: 1212730 - protein, 9 aa, Homo Sapiens
TSQKTSGTK

SEQ ID NO: 1212731 - protein, 9 aa, Homo Sapiens
VYNGISRIN

SEQ ID NO: 1212732 - protein, 9 aa, Homo Sapiens
SQPKESQLT

SEQ ID NO: 1212733 - protein, 9 aa, Homo Sapiens
FGKNFRIYK

SEQ ID NO: 1212734 - protein, 9 aa, Homo Sapiens
SASQLTLVN

SEQ ID NO: 1212735 - protein, 9 aa, Homo Sapiens
VQSMISNPD

SEQ ID NO: 1212736 - protein, 9 aa, Homo Sapiens
PYWAGLPPI

SEQ ID NO: 1212737 - protein, 9 aa, Homo Sapiens
PLLKDIPSS

SEQ ID NO: 1212738 - protein, 9 aa, Homo Sapiens
IQLISELAA

SEQ ID NO: 1212739 - protein, 9 aa, Homo Sapiens
PDNFLMGNG

SEQ ID NO: 1212740 - protein, 9 aa, Homo Sapiens
YIINEKTVL

SEQ ID NO: 1212741 - protein, 9 aa, Homo Sapiens
KLHLLGATA

SEQ ID NO: 1212742 - protein, 9 aa, Homo Sapiens
DQLNSIAAV

SEQ ID NO: 1212743 - protein, 9 aa, Homo Sapiens
CLACTDTRA

SEQ ID NO: 1212744 - protein, 9 aa, Homo Sapiens
YAFYDNCRC

SEQ ID NO: 1212745 - protein, 9 aa, Homo Sapiens
SEASIYKNI

SEQ ID NO: 1212746 - protein, 9 aa, Homo Sapiens
IVHQFKMQL

SEQ ID NO: 1212747 - protein, 9 aa, Homo Sapiens
QITALATKD

SEQ ID NO: 1212748 - protein, 9 aa, Homo Sapiens
WLENKPIIT

SEQ ID NO: 1212749 - protein, 9 aa, Homo Sapiens
RACGTPDHP

SEQ ID NO: 1212750 - protein, 9 aa, Homo Sapiens
ILANQRYSI

SEQ ID NO: 1212751 - protein, 9 aa, Homo Sapiens
IHLQTGCFC

SEQ ID NO: 1212752 - protein, 9 aa, Homo Sapiens
SHQMNDSKG

SEQ ID NO: 1212753 - protein, 9 aa, Homo Sapiens
KQNLEMNVM

SEQ ID NO: 1212754 - protein, 9 aa, Homo Sapiens
ECGKSFNHV

SEQ ID NO: 1212755 - protein, 9 aa, Homo Sapiens
ATTLYRHNL

SEQ ID NO: 1212756 - protein, 9 aa, Homo Sapiens
YHVTSSVTT

SEQ ID NO: 1212757 - protein, 9 aa, Homo Sapiens
QVFECLVDV

SEQ ID NO: 1212758 - protein, 9 aa, Homo Sapiens
LKNKDPKMY

SEQ ID NO: 1212759 - protein, 9 aa, Homo Sapiens
NQPVDSDES

SEQ ID NO: 1212760 - protein, 9 aa, Homo Sapiens
YLWDVQSTQ

SEQ ID NO: 1212761 - protein, 9 aa, Homo Sapiens
TFKQEEMAV

SEQ ID NO: 1212762 - protein, 9 aa, Homo Sapiens
RMRSKGVRV

SEQ ID NO: 1212763 - protein, 9 aa, Homo Sapiens
SWGCGLESN

SEQ ID NO: 1212764 - protein, 9 aa, Homo Sapiens
TFTSGILTP

SEQ ID NO: 1212765 - protein, 9 aa, Homo Sapiens
QGNDFDNDC

SEQ ID NO: 1212766 - protein, 9 aa, Homo Sapiens
MHRMIGLGL

SEQ ID NO: 1212767 - protein, 9 aa, Homo Sapiens
STEILLSRN

SEQ ID NO: 1212768 - protein, 9 aa, Homo Sapiens
QKIKEVPTH

SEQ ID NO: 1212769 - protein, 9 aa, Homo Sapiens
STLVLILVF

SEQ ID NO: 1212770 - protein, 9 aa, Homo Sapiens
EGTELQVIV

SEQ ID NO: 1212771 - protein, 9 aa, Homo Sapiens
EDAKKNLRT

SEQ ID NO: 1212772 - protein, 9 aa, Homo Sapiens
LAPQPLLGA

SEQ ID NO: 1212773 - protein, 9 aa, Homo Sapiens
RDGLCTLCI

SEQ ID NO: 1212774 - protein, 9 aa, Homo Sapiens
NIFMTDAAR

SEQ ID NO: 1212775 - protein, 9 aa, Homo Sapiens
GQVTQSSVI

SEQ ID NO: 1212776 - protein, 9 aa, Homo Sapiens
KLPQGQRCN

SEQ ID NO: 1212777 - protein, 9 aa, Homo Sapiens
MFKVDQDLI

SEQ ID NO: 1212778 - protein, 9 aa, Homo Sapiens
AIKHFLDYY

SEQ ID NO: 1212779 - protein, 9 aa, Homo Sapiens
VINYPTVPR

SEQ ID NO: 1212780 - protein, 9 aa, Homo Sapiens
FARDKNPIV

SEQ ID NO: 1212781 - protein, 9 aa, Homo Sapiens
GPRNCICQK

SEQ ID NO: 1212782 - protein, 9 aa, Homo Sapiens
PTLFTFIRL

SEQ ID NO: 1212783 - protein, 9 aa, Homo Sapiens
GKEHVHLLS

SEQ ID NO: 1212784 - protein, 9 aa, Homo Sapiens
PNEQPGPMG

SEQ ID NO: 1212785 - protein, 9 aa, Homo Sapiens
NCFVTRIHL

SEQ ID NO: 1212786 - protein, 9 aa, Homo Sapiens
FQHHEHLPS

SEQ ID NO: 1212787 - protein, 9 aa, Homo Sapiens
VTKSTTTTR

SEQ ID NO: 1212788 - protein, 9 aa, Homo Sapiens
PVAELPRFH

SEQ ID NO: 1212789 - protein, 9 aa, Homo Sapiens
MEHINRYIS

SEQ ID NO: 1212790 - protein, 9 aa, Homo Sapiens
IKEVKENYV

SEQ ID NO: 1212791 - protein, 9 aa, Homo Sapiens
KDIRKLLQQ

SEQ ID NO: 1212792 - protein, 9 aa, Homo Sapiens
RRSRSDNTL

SEQ ID NO: 1212793 - protein, 9 aa, Homo Sapiens
YTSGKQTGI

SEQ ID NO: 1212794 - protein, 9 aa, Homo Sapiens
AHSEPEDPD

SEQ ID NO: 1212795 - protein, 9 aa, Homo Sapiens
HCRTYYVLC

SEQ ID NO: 1212796 - protein, 9 aa, Homo Sapiens
VVSLTNTLI

SEQ ID NO: 1212797 - protein, 9 aa, Homo Sapiens
GRLAARNAN

SEQ ID NO: 1212798 - protein, 9 aa, Homo Sapiens
APDGRALRD

SEQ ID NO: 1212799 - protein, 9 aa, Homo Sapiens
RYVGQYDNR

SEQ ID NO: 1212800 - protein, 9 aa, Homo Sapiens
ALAVVKRSH

SEQ ID NO: 1212801 - protein, 9 aa, Homo Sapiens
SPLTLYPLA

SEQ ID NO: 1212802 - protein, 9 aa, Homo Sapiens
DVYNLAATL

SEQ ID NO: 1212803 - protein, 9 aa, Homo Sapiens
LHQLATSYF

SEQ ID NO: 1212804 - protein, 9 aa, Homo Sapiens
LILVFGVHY

SEQ ID NO: 1212805 - protein, 9 aa, Homo Sapiens
LNGSNVAEG

SEQ ID NO: 1212806 - protein, 9 aa, Homo Sapiens
PEVRRATVH

SEQ ID NO: 1212807 - protein, 9 aa, Homo Sapiens
FFIRPFYKT

SEQ ID NO: 1212808 - protein, 9 aa, Homo Sapiens
MVVSVVALF

SEQ ID NO: 1212809 - protein, 9 aa, Homo Sapiens
AGAHEQRVA

SEQ ID NO: 1212810 - protein, 9 aa, Homo Sapiens
AAAEQLQQS

SEQ ID NO: 1212811 - protein, 9 aa, Homo Sapiens
ENSAAVQHN

SEQ ID NO: 1212812 - protein, 9 aa, Homo Sapiens
SSKTAQLKS

SEQ ID NO: 1212813 - protein, 9 aa, Homo Sapiens
DKFKLIKGE

SEQ ID NO: 1212814 - protein, 9 aa, Homo Sapiens
HAVLAYSQS

SEQ ID NO: 1212815 - protein, 9 aa, Homo Sapiens
KKKKTRTSP

SEQ ID NO: 1212816 - protein, 9 aa, Homo Sapiens
RGRQLRHCL

SEQ ID NO: 1212817 - protein, 9 aa, Homo Sapiens
CPSCRREDP

SEQ ID NO: 1212818 - protein, 9 aa, Homo Sapiens
MTLYQKKHG

SEQ ID NO: 1212819 - protein, 9 aa, Homo Sapiens
PGPTSPSLA

SEQ ID NO: 1212820 - protein, 9 aa, Homo Sapiens
EKPASPTPV

SEQ ID NO: 1212821 - protein, 9 aa, Homo Sapiens
NIAHSNSSV

SEQ ID NO: 1212822 - protein, 9 aa, Homo Sapiens
GHRGFSDLQ

SEQ ID NO: 1212823 - protein, 9 aa, Homo Sapiens
VYPEARKKD

SEQ ID NO: 1212824 - protein, 9 aa, Homo Sapiens
GHFSQARTR

SEQ ID NO: 1212825 - protein, 9 aa, Homo Sapiens
KSLMIILTL

SEQ ID NO: 1212826 - protein, 9 aa, Homo Sapiens
YLITSLAVT

SEQ ID NO: 1212827 - protein, 9 aa, Homo Sapiens
VFEPYQASQ

SEQ ID NO: 1212828 - protein, 9 aa, Homo Sapiens
FFTKLPIGT

SEQ ID NO: 1212829 - protein, 9 aa, Homo Sapiens
KSLSSLVVH

SEQ ID NO: 1212830 - protein, 9 aa, Homo Sapiens
DERPPRAHV

SEQ ID NO: 1212831 - protein, 9 aa, Homo Sapiens
WDISEEVQL

SEQ ID NO: 1212832 - protein, 9 aa, Homo Sapiens
HPGASIQET

SEQ ID NO: 1212833 - protein, 9 aa, Homo Sapiens
SKFRQGYQA

SEQ ID NO: 1212834 - protein, 9 aa, Homo Sapiens
ESMELNKIY

SEQ ID NO: 1212835 - protein, 9 aa, Homo Sapiens
LLLFSLHRM

SEQ ID NO: 1212836 - protein, 9 aa, Homo Sapiens
QPSVVVLQC

SEQ ID NO: 1212837 - protein, 9 aa, Homo Sapiens
HTIGVLFNN

SEQ ID NO: 1212838 - protein, 9 aa, Homo Sapiens
VTFALDNAT

SEQ ID NO: 1212839 - protein, 9 aa, Homo Sapiens
CDGLDWCNA

SEQ ID NO: 1212840 - protein, 9 aa, Homo Sapiens
EKDFSLKTI

SEQ ID NO: 1212841 - protein, 9 aa, Homo Sapiens
LTRLYQSVL

SEQ ID NO: 1212842 - protein, 9 aa, Homo Sapiens
KCVCSFDHH

SEQ ID NO: 1212843 - protein, 9 aa, Homo Sapiens
LHSQFPRGR

SEQ ID NO: 1212844 - protein, 9 aa, Homo Sapiens
TKALGTCGS

SEQ ID NO: 1212845 - protein, 9 aa, Homo Sapiens
QCISGHHLM

SEQ ID NO: 1212846 - protein, 9 aa, Homo Sapiens
AGAWGLLPG

SEQ ID NO: 1212847 - protein, 9 aa, Homo Sapiens
NTTVNYTLF

SEQ ID NO: 1212848 - protein, 9 aa, Homo Sapiens
TTSLENTKP

SEQ ID NO: 1212849 - protein, 9 aa, Homo Sapiens
SIKQTCFSV

SEQ ID NO: 1212850 - protein, 9 aa, Homo Sapiens
VATLVQYIP

SEQ ID NO: 1212851 - protein, 9 aa, Homo Sapiens
SAAGTPHHI

SEQ ID NO: 1212852 - protein, 9 aa, Homo Sapiens
PWRGPWMLV

SEQ ID NO: 1212853 - protein, 9 aa, Homo Sapiens
KCVNKKKDK

SEQ ID NO: 1212854 - protein, 9 aa, Homo Sapiens
NVFQCEAHR

SEQ ID NO: 1212855 - protein, 9 aa, Homo Sapiens
HPFKHDIFL

SEQ ID NO: 1212856 - protein, 9 aa, Homo Sapiens
NSATFKPFE

SEQ ID NO: 1212857 - protein, 9 aa, Homo Sapiens
EDLSKKTLI

SEQ ID NO: 1212858 - protein, 9 aa, Homo Sapiens
ASCASVAIG

SEQ ID NO: 1212859 - protein, 9 aa, Homo Sapiens
GVLVVLDVI

SEQ ID NO: 1212860 - protein, 9 aa, Homo Sapiens
EERLWEQEG

SEQ ID NO: 1212861 - protein, 9 aa, Homo Sapiens
DAARDLGLL

SEQ ID NO: 1212862 - protein, 9 aa, Homo Sapiens
PTPMPPMLM

SEQ ID NO: 1212863 - protein, 9 aa, Homo Sapiens
REDEYQRVR

SEQ ID NO: 1212864 - protein, 9 aa, Homo Sapiens
NHFQGLSHR

SEQ ID NO: 1212865 - protein, 9 aa, Homo Sapiens
PAPEWAIIN

SEQ ID NO: 1212866 - protein, 9 aa, Homo Sapiens
ERCVLVNAS

SEQ ID NO: 1212867 - protein, 9 aa, Homo Sapiens
QGQEMLVRV

SEQ ID NO: 1212868 - protein, 9 aa, Homo Sapiens
EYFWGKPHS

SEQ ID NO: 1212869 - protein, 9 aa, Homo Sapiens
VIPHQKDPV

SEQ ID NO: 1212870 - protein, 9 aa, Homo Sapiens
CHCCHCPPL

SEQ ID NO: 1212871 - protein, 9 aa, Homo Sapiens
ADWLQFWSK

SEQ ID NO: 1212872 - protein, 9 aa, Homo Sapiens
AHDGKIKVW

SEQ ID NO: 1212873 - protein, 9 aa, Homo Sapiens
IDSCTRRNL

SEQ ID NO: 1212874 - protein, 9 aa, Homo Sapiens
SAILLKVKD

SEQ ID NO: 1212875 - protein, 9 aa, Homo Sapiens
GQQKREAQV

SEQ ID NO: 1212876 - protein, 9 aa, Homo Sapiens
RTLQVLIKH

SEQ ID NO: 1212877 - protein, 9 aa, Homo Sapiens
CPAEDDIPR

SEQ ID NO: 1212878 - protein, 9 aa, Homo Sapiens
RGEHDLIED

SEQ ID NO: 1212879 - protein, 9 aa, Homo Sapiens
ITSFDGVQE

SEQ ID NO: 1212880 - protein, 9 aa, Homo Sapiens
RYEFVIFNQ

SEQ ID NO: 1212881 - protein, 9 aa, Homo Sapiens
ESHLNSDLC

SEQ ID NO: 1212882 - protein, 9 aa, Homo Sapiens
PSCARSRRS

SEQ ID NO: 1212883 - protein, 9 aa, Homo Sapiens
PGQTLVTMV

SEQ ID NO: 1212884 - protein, 9 aa, Homo Sapiens
RMSSGLTDL

SEQ ID NO: 1212885 - protein, 9 aa, Homo Sapiens
EHLDHVLYE

SEQ ID NO: 1212886 - protein, 9 aa, Homo Sapiens
FPTLVSSVP

SEQ ID NO: 1212887 - protein, 9 aa, Homo Sapiens
PRLSRVTHL

SEQ ID NO: 1212888 - protein, 9 aa, Homo Sapiens
ILNAAYGVE

SEQ ID NO: 1212889 - protein, 9 aa, Homo Sapiens
SSCSSSWTN

SEQ ID NO: 1212890 - protein, 9 aa, Homo Sapiens
HYIRQQDLK

SEQ ID NO: 1212891 - protein, 9 aa, Homo Sapiens
PLLEMYSKL

SEQ ID NO: 1212892 - protein, 9 aa, Homo Sapiens
TGTKDSVAS

SEQ ID NO: 1212893 - protein, 9 aa, Homo Sapiens
GPDGSGQYT

SEQ ID NO: 1212894 - protein, 9 aa, Homo Sapiens
CGSVREVML

SEQ ID NO: 1212895 - protein, 9 aa, Homo Sapiens
QIPLDLLPD

SEQ ID NO: 1212896 - protein, 9 aa, Homo Sapiens
STDLNGQAV

SEQ ID NO: 1212897 - protein, 9 aa, Homo Sapiens
YDIATPKGS

SEQ ID NO: 1212898 - protein, 9 aa, Homo Sapiens
TRGRQPHVD

SEQ ID NO: 1212899 - protein, 9 aa, Homo Sapiens
APGSQDHQC

SEQ ID NO: 1212900 - protein, 9 aa, Homo Sapiens
CGHVYVRRG

SEQ ID NO: 1212901 - protein, 9 aa, Homo Sapiens
SQMDLMCAQ

SEQ ID NO: 1212902 - protein, 9 aa, Homo Sapiens
VLAYSFSRW

SEQ ID NO: 1212903 - protein, 9 aa, Homo Sapiens
LLDLPSIRS

SEQ ID NO: 1212904 - protein, 9 aa, Homo Sapiens
LLLLHEVLA

SEQ ID NO: 1212905 - protein, 9 aa, Homo Sapiens
GEQINNDNC

SEQ ID NO: 1212906 - protein, 9 aa, Homo Sapiens
GRTIGIVMD

SEQ ID NO: 1212907 - protein, 9 aa, Homo Sapiens
LLGASAPCG

SEQ ID NO: 1212908 - protein, 9 aa, Homo Sapiens
AMKIGGVSL

SEQ ID NO: 1212909 - protein, 9 aa, Homo Sapiens
KLELQRCSL

SEQ ID NO: 1212910 - protein, 9 aa, Homo Sapiens
CLSPTVCTT

SEQ ID NO: 1212911 - protein, 9 aa, Homo Sapiens
YSGYIQKFE

SEQ ID NO: 1212912 - protein, 9 aa, Homo Sapiens
EEALRQREW

SEQ ID NO: 1212913 - protein, 9 aa, Homo Sapiens
TKCQQICRW

SEQ ID NO: 1212914 - protein, 9 aa, Homo Sapiens
GAREAGRFA

SEQ ID NO: 1212915 - protein, 9 aa, Homo Sapiens
NLCYTQADG

SEQ ID NO: 1212916 - protein, 9 aa, Homo Sapiens
THPKTGKWQ

SEQ ID NO: 1212917 - protein, 9 aa, Homo Sapiens
ECNQDVKYI

SEQ ID NO: 1212918 - protein, 9 aa, Homo Sapiens
YIDLGTLAG

SEQ ID NO: 1212919 - protein, 9 aa, Homo Sapiens
HTNAEVKLH

SEQ ID NO: 1212920 - protein, 9 aa, Homo Sapiens
LPSSADDNI

SEQ ID NO: 1212921 - protein, 9 aa, Homo Sapiens
NSMQSECRE

SEQ ID NO: 1212922 - protein, 9 aa, Homo Sapiens
VIEDVQCPY

SEQ ID NO: 1212923 - protein, 9 aa, Homo Sapiens
EPEPDGRSH

SEQ ID NO: 1212924 - protein, 9 aa, Homo Sapiens
VWVVVSYVV

SEQ ID NO: 1212925 - protein, 9 aa, Homo Sapiens
GHQYVKDVQ

SEQ ID NO: 1212926 - protein, 9 aa, Homo Sapiens
PLPLPPPVT

SEQ ID NO: 1212927 - protein, 9 aa, Homo Sapiens
APHGVVWDS

SEQ ID NO: 1212928 - protein, 9 aa, Homo Sapiens
AQPESICSD

SEQ ID NO: 1212929 - protein, 9 aa, Homo Sapiens
NQVVCHDYD

SEQ ID NO: 1212930 - protein, 9 aa, Homo Sapiens
IICHRGTRP

SEQ ID NO: 1212931 - protein, 9 aa, Homo Sapiens
SLMATEIER

SEQ ID NO: 1212932 - protein, 9 aa, Homo Sapiens
CNKKIAMTM

SEQ ID NO: 1212933 - protein, 9 aa, Homo Sapiens
LREQWKKVV

SEQ ID NO: 1212934 - protein, 9 aa, Homo Sapiens
RQERLMGSH

SEQ ID NO: 1212935 - protein, 9 aa, Homo Sapiens
VEKGISEQT

SEQ ID NO: 1212936 - protein, 9 aa, Homo Sapiens
DPRPRGNQG

SEQ ID NO: 1212937 - protein, 9 aa, Homo Sapiens
VSILLCNPF

SEQ ID NO: 1212938 - protein, 9 aa, Homo Sapiens
EQVLLNARS

SEQ ID NO: 1212939 - protein, 9 aa, Homo Sapiens
VDQVTGDDT

SEQ ID NO: 1212940 - protein, 9 aa, Homo Sapiens
KSPGMMRHL

SEQ ID NO: 1212941 - protein, 9 aa, Homo Sapiens
DPKKTHTPC

SEQ ID NO: 1212942 - protein, 9 aa, Homo Sapiens
CVVTVESLG

SEQ ID NO: 1212943 - protein, 9 aa, Homo Sapiens
NFLGFLLLL

SEQ ID NO: 1212944 - protein, 9 aa, Homo Sapiens
QSAPSSLPY

SEQ ID NO: 1212945 - protein, 9 aa, Homo Sapiens
ALVMAMFKL

SEQ ID NO: 1212946 - protein, 9 aa, Homo Sapiens
AGWPCPAVP

SEQ ID NO: 1212947 - protein, 9 aa, Homo Sapiens
LPERKCFPG

SEQ ID NO: 1212948 - protein, 9 aa, Homo Sapiens
LLWNMTSSW

SEQ ID NO: 1212949 - protein, 9 aa, Homo Sapiens
YLHSRGILR

SEQ ID NO: 1212950 - protein, 9 aa, Homo Sapiens
NTLISFFDA

SEQ ID NO: 1212951 - protein, 9 aa, Homo Sapiens
LKISEGNHP

SEQ ID NO: 1212952 - protein, 9 aa, Homo Sapiens
GGSDGGSMM

SEQ ID NO: 1212953 - protein, 9 aa, Homo Sapiens
SQPHLDTDP

SEQ ID NO: 1212954 - protein, 9 aa, Homo Sapiens
MKQALDFQL

SEQ ID NO: 1212955 - protein, 9 aa, Homo Sapiens
EMFQPSVVV

SEQ ID NO: 1212956 - protein, 9 aa, Homo Sapiens
HHEIEGTGL

SEQ ID NO: 1212957 - protein, 9 aa, Homo Sapiens
PQHKGVAVR

SEQ ID NO: 1212958 - protein, 9 aa, Homo Sapiens
NTDVLVAPR

SEQ ID NO: 1212959 - protein, 9 aa, Homo Sapiens
QELNRTYRA

SEQ ID NO: 1212960 - protein, 9 aa, Homo Sapiens
LLAKCYEEK

SEQ ID NO: 1212961 - protein, 9 aa, Homo Sapiens
AVSTYDGLA

SEQ ID NO: 1212962 - protein, 9 aa, Homo Sapiens
VIITVTDLG

SEQ ID NO: 1212963 - protein, 9 aa, Homo Sapiens
LKTFLYNFD

SEQ ID NO: 1212964 - protein, 9 aa, Homo Sapiens
VREEVMLST

SEQ ID NO: 1212965 - protein, 9 aa, Homo Sapiens
DRIAKDWTQ

SEQ ID NO: 1212966 - protein, 9 aa, Homo Sapiens
LTGAHLRLR

SEQ ID NO: 1212967 - protein, 9 aa, Homo Sapiens
HFGLIKAWS

SEQ ID NO: 1212968 - protein, 9 aa, Homo Sapiens
LLPRTPRSL

SEQ ID NO: 1212969 - protein, 9 aa, Homo Sapiens
VLLLVLDED

SEQ ID NO: 1212970 - protein, 9 aa, Homo Sapiens
EGVVTKIRP

SEQ ID NO: 1212971 - protein, 9 aa, Homo Sapiens
CVTNKANVV

SEQ ID NO: 1212972 - protein, 9 aa, Homo Sapiens
TKSTTTTRS

SEQ ID NO: 1212973 - protein, 9 aa, Homo Sapiens
YGNECHLCA

SEQ ID NO: 1212974 - protein, 9 aa, Homo Sapiens
GRRMADVPV

SEQ ID NO: 1212975 - protein, 9 aa, Homo Sapiens
ISPAQLDPF

SEQ ID NO: 1212976 - protein, 9 aa, Homo Sapiens
GKCLQAKGR

SEQ ID NO: 1212977 - protein, 9 aa, Homo Sapiens
LGTPTERTA

SEQ ID NO: 1212978 - protein, 9 aa, Homo Sapiens
TITKRTGHY

SEQ ID NO: 1212979 - protein, 9 aa, Homo Sapiens
VGMGPAAGR

SEQ ID NO: 1212980 - protein, 9 aa, Homo Sapiens
TLGLFSNYI

SEQ ID NO: 1212981 - protein, 9 aa, Homo Sapiens
AAFKKANWK

SEQ ID NO: 1212982 - protein, 9 aa, Homo Sapiens
RPTTGTLHI

SEQ ID NO: 1212983 - protein, 9 aa, Homo Sapiens
SVLAHWSVI

SEQ ID NO: 1212984 - protein, 9 aa, Homo Sapiens
RCRETAVSA

SEQ ID NO: 1212985 - protein, 9 aa, Homo Sapiens
YICHCPPET

SEQ ID NO: 1212986 - protein, 9 aa, Homo Sapiens
WGCVSAPGA

SEQ ID NO: 1212987 - protein, 9 aa, Homo Sapiens
NEWIMQKKT

SEQ ID NO: 1212988 - protein, 9 aa, Homo Sapiens
FKASEPGIF

SEQ ID NO: 1212989 - protein, 9 aa, Homo Sapiens
RVVITGQKV

SEQ ID NO: 1212990 - protein, 9 aa, Homo Sapiens
NWPSMDFDA

SEQ ID NO: 1212991 - protein, 9 aa, Homo Sapiens
FGKLYPHRV

SEQ ID NO: 1212992 - protein, 9 aa, Homo Sapiens
AANGQILES

SEQ ID NO: 1212993 - protein, 9 aa, Homo Sapiens
EKERIQNAS

SEQ ID NO: 1212994 - protein, 9 aa, Homo Sapiens
ASRLPMSVI

SEQ ID NO: 1212995 - protein, 9 aa, Homo Sapiens
ILMYIFQNV

SEQ ID NO: 1212996 - protein, 9 aa, Homo Sapiens
FEGRTNIET

SEQ ID NO: 1212997 - protein, 9 aa, Homo Sapiens
NQYTFCQPE

SEQ ID NO: 1212998 - protein, 9 aa, Homo Sapiens
PYMNHSPFT

SEQ ID NO: 1212999 - protein, 9 aa, Homo Sapiens
EGDNDYFTY

SEQ ID NO: 1213000 - protein, 9 aa, Homo Sapiens
DVDHQKSEK

SEQ ID NO: 1213001 - protein, 9 aa, Homo Sapiens
WLTLRRTGQ

SEQ ID NO: 1213002 - protein, 9 aa, Homo Sapiens
VGTIIALIS

SEQ ID NO: 1213003 - protein, 9 aa, Homo Sapiens
VTQALGRAA

SEQ ID NO: 1213004 - protein, 9 aa, Homo Sapiens
PIKVMVTCL

SEQ ID NO: 1213005 - protein, 9 aa, Homo Sapiens
HYLMQAAGL

SEQ ID NO: 1213006 - protein, 9 aa, Homo Sapiens
LLSCIDDKN

SEQ ID NO: 1213007 - protein, 9 aa, Homo Sapiens
PFRAHSEPE

SEQ ID NO: 1213008 - protein, 9 aa, Homo Sapiens
QKERNEMQA

SEQ ID NO: 1213009 - protein, 9 aa, Homo Sapiens
ACVDRIIKT

SEQ ID NO: 1213010 - protein, 9 aa, Homo Sapiens
RPATDLSTT

SEQ ID NO: 1213011 - protein, 9 aa, Homo Sapiens
RLTTSVDLP

SEQ ID NO: 1213012 - protein, 9 aa, Homo Sapiens
LVGKPHFET

SEQ ID NO: 1213013 - protein, 9 aa, Homo Sapiens
LTTHKRIYT

SEQ ID NO: 1213014 - protein, 9 aa, Homo Sapiens
EFVKSMGNL

SEQ ID NO: 1213015 - protein, 9 aa, Homo Sapiens
KRHRMRSKG

SEQ ID NO: 1213016 - protein, 9 aa, Homo Sapiens
SGIPLNITL

SEQ ID NO: 1213017 - protein, 9 aa, Homo Sapiens
RPQQPPPRL

SEQ ID NO: 1213018 - protein, 9 aa, Homo Sapiens
KIEIIAPPE

SEQ ID NO: 1213019 - protein, 9 aa, Homo Sapiens
RPTYLWLKQ

SEQ ID NO: 1213020 - protein, 9 aa, Homo Sapiens
GADVGVPQV

SEQ ID NO: 1213021 - protein, 9 aa, Homo Sapiens
LRRKNETLI

SEQ ID NO: 1213022 - protein, 9 aa, Homo Sapiens
IMGGAKQIE

SEQ ID NO: 1213023 - protein, 9 aa, Homo Sapiens
VFTKVYKVK

SEQ ID NO: 1213024 - protein, 9 aa, Homo Sapiens
VVQEGTRCY

SEQ ID NO: 1213025 - protein, 9 aa, Homo Sapiens
KRSIDAENS

SEQ ID NO: 1213026 - protein, 9 aa, Homo Sapiens
VFQCEAHRI

SEQ ID NO: 1213027 - protein, 9 aa, Homo Sapiens
TCSDSSGVI

SEQ ID NO: 1213028 - protein, 9 aa, Homo Sapiens
SSKAMCIMN

SEQ ID NO: 1213029 - protein, 9 aa, Homo Sapiens
AIQDETMQP

SEQ ID NO: 1213030 - protein, 9 aa, Homo Sapiens
NVLHCKIPF

SEQ ID NO: 1213031 - protein, 9 aa, Homo Sapiens
YPEGKDVLQ

SEQ ID NO: 1213032 - protein, 9 aa, Homo Sapiens
AVVVVTELG

SEQ ID NO: 1213033 - protein, 9 aa, Homo Sapiens
KEIFTKPLK

SEQ ID NO: 1213034 - protein, 9 aa, Homo Sapiens
APGPGGGRG

SEQ ID NO: 1213035 - protein, 9 aa, Homo Sapiens
SILLFLTHF

SEQ ID NO: 1213036 - protein, 9 aa, Homo Sapiens
YGWAVFGGQ

SEQ ID NO: 1213037 - protein, 9 aa, Homo Sapiens
SGLYQDQVN

SEQ ID NO: 1213038 - protein, 9 aa, Homo Sapiens
RWGLLRAQG

SEQ ID NO: 1213039 - protein, 9 aa, Homo Sapiens
GQEQRSAQV

SEQ ID NO: 1213040 - protein, 9 aa, Homo Sapiens
VGRKGDLLR

SEQ ID NO: 1213041 - protein, 9 aa, Homo Sapiens
TPPTSSRTS

SEQ ID NO: 1213042 - protein, 9 aa, Homo Sapiens
VPELGRSHE

SEQ ID NO: 1213043 - protein, 9 aa, Homo Sapiens
EEHVLFQSS

SEQ ID NO: 1213044 - protein, 9 aa, Homo Sapiens
TDTNKTKGG

SEQ ID NO: 1213045 - protein, 9 aa, Homo Sapiens
KDDCLLMIW

SEQ ID NO: 1213046 - protein, 9 aa, Homo Sapiens
LMEHERLNE

SEQ ID NO: 1213047 - protein, 9 aa, Homo Sapiens
TIKKHMAMC

SEQ ID NO: 1213048 - protein, 9 aa, Homo Sapiens
RIEGHLGQG

SEQ ID NO: 1213049 - protein, 9 aa, Homo Sapiens
CSPSERRHH

SEQ ID NO: 1213050 - protein, 9 aa, Homo Sapiens
HWPVLQKWS

SEQ ID NO: 1213051 - protein, 9 aa, Homo Sapiens
PMSPLRTVM

SEQ ID NO: 1213052 - protein, 9 aa, Homo Sapiens
GPEFEAMIR

SEQ ID NO: 1213053 - protein, 9 aa, Homo Sapiens
CSPSERRHC

SEQ ID NO: 1213054 - protein, 9 aa, Homo Sapiens
CVVHLLNDQ

SEQ ID NO: 1213055 - protein, 9 aa, Homo Sapiens
AYTHIVFTD

SEQ ID NO: 1213056 - protein, 9 aa, Homo Sapiens
TQISQPLPS

SEQ ID NO: 1213057 - protein, 9 aa, Homo Sapiens
MTAMWLSAS

SEQ ID NO: 1213058 - protein, 9 aa, Homo Sapiens
CKVKLHNDS

SEQ ID NO: 1213059 - protein, 9 aa, Homo Sapiens
YEWGSRDTY

SEQ ID NO: 1213060 - protein, 9 aa, Homo Sapiens
GIKWVTGGQ

SEQ ID NO: 1213061 - protein, 9 aa, Homo Sapiens
PSSHSTTPS

SEQ ID NO: 1213062 - protein, 9 aa, Homo Sapiens
SQQGLTEIP

SEQ ID NO: 1213063 - protein, 9 aa, Homo Sapiens
EYFNMYGGN

SEQ ID NO: 1213064 - protein, 9 aa, Homo Sapiens
CLCMCWKQM

SEQ ID NO: 1213065 - protein, 9 aa, Homo Sapiens
HEVSTVSHT

SEQ ID NO: 1213066 - protein, 9 aa, Homo Sapiens
YGYEEYYDD

SEQ ID NO: 1213067 - protein, 9 aa, Homo Sapiens
LQVQKKSLL

SEQ ID NO: 1213068 - protein, 9 aa, Homo Sapiens
KLHNDSSIL

SEQ ID NO: 1213069 - protein, 9 aa, Homo Sapiens
FLPFLIIII

SEQ ID NO: 1213070 - protein, 9 aa, Homo Sapiens
ALESVSLHF

SEQ ID NO: 1213071 - protein, 9 aa, Homo Sapiens
SPGCRDTSL

SEQ ID NO: 1213072 - protein, 9 aa, Homo Sapiens
HYGWHPATV

SEQ ID NO: 1213073 - protein, 9 aa, Homo Sapiens
ESLEMRTKL

SEQ ID NO: 1213074 - protein, 9 aa, Homo Sapiens
PRNCICQKF

SEQ ID NO: 1213075 - protein, 9 aa, Homo Sapiens
RVPGTTRPQ

SEQ ID NO: 1213076 - protein, 9 aa, Homo Sapiens
EIPEESDEC

SEQ ID NO: 1213077 - protein, 9 aa, Homo Sapiens
ARYSEPLHV

SEQ ID NO: 1213078 - protein, 9 aa, Homo Sapiens
GFEEHRFRN

SEQ ID NO: 1213079 - protein, 9 aa, Homo Sapiens
IVLGIETRC

SEQ ID NO: 1213080 - protein, 9 aa, Homo Sapiens
CSLHHKQQL

SEQ ID NO: 1213081 - protein, 9 aa, Homo Sapiens
PRRRPGPHR

SEQ ID NO: 1213082 - protein, 9 aa, Homo Sapiens
LCYAALSLL

SEQ ID NO: 1213083 - protein, 9 aa, Homo Sapiens
RVVEEMAGL

SEQ ID NO: 1213084 - protein, 9 aa, Homo Sapiens
QVGKSNTGD

SEQ ID NO: 1213085 - protein, 9 aa, Homo Sapiens
SENDKKNKS

SEQ ID NO: 1213086 - protein, 9 aa, Homo Sapiens
RSECRKTFS

SEQ ID NO: 1213087 - protein, 9 aa, Homo Sapiens
MAKITHVDF

SEQ ID NO: 1213088 - protein, 9 aa, Homo Sapiens
SQISGQHVS

SEQ ID NO: 1213089 - protein, 9 aa, Homo Sapiens
HAVLLGCQD

SEQ ID NO: 1213090 - protein, 9 aa, Homo Sapiens
ITLAGNMWD

SEQ ID NO: 1213091 - protein, 9 aa, Homo Sapiens
RALAEHLAR

SEQ ID NO: 1213092 - protein, 9 aa, Homo Sapiens
LVTTMLASA

SEQ ID NO: 1213093 - protein, 9 aa, Homo Sapiens
SKTMGRKEY

SEQ ID NO: 1213094 - protein, 9 aa, Homo Sapiens
HLRVLRCTN

SEQ ID NO: 1213095 - protein, 9 aa, Homo Sapiens
VPPQEAILV

SEQ ID NO: 1213096 - protein, 9 aa, Homo Sapiens
EGPGGDLVI

SEQ ID NO: 1213097 - protein, 9 aa, Homo Sapiens
GNNDNEHLA

SEQ ID NO: 1213098 - protein, 9 aa, Homo Sapiens
TNQRATSFG

SEQ ID NO: 1213099 - protein, 9 aa, Homo Sapiens
EIVNTTFEA

SEQ ID NO: 1213100 - protein, 9 aa, Homo Sapiens
RDVQKVLCA

SEQ ID NO: 1213101 - protein, 9 aa, Homo Sapiens
TPPVDGLGA

SEQ ID NO: 1213102 - protein, 9 aa, Homo Sapiens
QIVNNLSPE

SEQ ID NO: 1213103 - protein, 9 aa, Homo Sapiens
FFWDYDNAF

SEQ ID NO: 1213104 - protein, 9 aa, Homo Sapiens
CIYYADVKD

SEQ ID NO: 1213105 - protein, 9 aa, Homo Sapiens
HHRNIPNGL

SEQ ID NO: 1213106 - protein, 9 aa, Homo Sapiens
DLMFGEGMT

SEQ ID NO: 1213107 - protein, 9 aa, Homo Sapiens
LRETLLGGR

SEQ ID NO: 1213108 - protein, 9 aa, Homo Sapiens
VPKSGVKLD

SEQ ID NO: 1213109 - protein, 9 aa, Homo Sapiens
QQYAVNRRL

SEQ ID NO: 1213110 - protein, 9 aa, Homo Sapiens
PRGRRALWP

SEQ ID NO: 1213111 - protein, 9 aa, Homo Sapiens
TNISKQLPW

SEQ ID NO: 1213112 - protein, 9 aa, Homo Sapiens
TIGLRGLTN

SEQ ID NO: 1213113 - protein, 9 aa, Homo Sapiens
QLQAQGQIQ

SEQ ID NO: 1213114 - protein, 9 aa, Homo Sapiens
WVSSMRSWS

SEQ ID NO: 1213115 - protein, 9 aa, Homo Sapiens
SEVCFNMGH

SEQ ID NO: 1213116 - protein, 9 aa, Homo Sapiens
WSCSRGRWV

SEQ ID NO: 1213117 - protein, 9 aa, Homo Sapiens
QLQAPMAHL

SEQ ID NO: 1213118 - protein, 9 aa, Homo Sapiens
SACHGPLLT

SEQ ID NO: 1213119 - protein, 9 aa, Homo Sapiens
LASLSIIVL

SEQ ID NO: 1213120 - protein, 9 aa, Homo Sapiens
KCLPSQHKM

SEQ ID NO: 1213121 - protein, 9 aa, Homo Sapiens
RKAFQLQQF

SEQ ID NO: 1213122 - protein, 9 aa, Homo Sapiens
AGKCPAEDD

SEQ ID NO: 1213123 - protein, 9 aa, Homo Sapiens
VLRLQFASD

SEQ ID NO: 1213124 - protein, 9 aa, Homo Sapiens
KIYYLLETL

SEQ ID NO: 1213125 - protein, 9 aa, Homo Sapiens
DAFLSYCPG

SEQ ID NO: 1213126 - protein, 9 aa, Homo Sapiens
TSGISSSIT

SEQ ID NO: 1213127 - protein, 9 aa, Homo Sapiens
VLEWDVGRL

SEQ ID NO: 1213128 - protein, 9 aa, Homo Sapiens
ENGKQQYSK

SEQ ID NO: 1213129 - protein, 9 aa, Homo Sapiens
PTETSIAPK

SEQ ID NO: 1213130 - protein, 9 aa, Homo Sapiens
VRGSAAASL

SEQ ID NO: 1213131 - protein, 9 aa, Homo Sapiens
CLDDFKGNF

SEQ ID NO: 1213132 - protein, 9 aa, Homo Sapiens
TGLPTDANI

SEQ ID NO: 1213133 - protein, 9 aa, Homo Sapiens
PELFQCHGA

SEQ ID NO: 1213134 - protein, 9 aa, Homo Sapiens
KMIVAHAVE

SEQ ID NO: 1213135 - protein, 9 aa, Homo Sapiens
NSNEVTKLV

SEQ ID NO: 1213136 - protein, 9 aa, Homo Sapiens
KVTADTVKE

SEQ ID NO: 1213137 - protein, 9 aa, Homo Sapiens
EAALDTRFL

SEQ ID NO: 1213138 - protein, 9 aa, Homo Sapiens
APPSATRAR

SEQ ID NO: 1213139 - protein, 9 aa, Homo Sapiens
GLKQIRLCI

SEQ ID NO: 1213140 - protein, 9 aa, Homo Sapiens
ETSAEEDHA

SEQ ID NO: 1213141 - protein, 9 aa, Homo Sapiens
DLPSIRSQV

SEQ ID NO: 1213142 - protein, 9 aa, Homo Sapiens
PFNPLDFEI

SEQ ID NO: 1213143 - protein, 9 aa, Homo Sapiens
VLEGMTFAG

SEQ ID NO: 1213144 - protein, 9 aa, Homo Sapiens
DTSLETALN

SEQ ID NO: 1213145 - protein, 9 aa, Homo Sapiens
LSFLPIKSG

SEQ ID NO: 1213146 - protein, 9 aa, Homo Sapiens
AYIFHDEFV

SEQ ID NO: 1213147 - protein, 9 aa, Homo Sapiens
VERGQQYFS

SEQ ID NO: 1213148 - protein, 9 aa, Homo Sapiens
KRLQQNVTE

SEQ ID NO: 1213149 - protein, 9 aa, Homo Sapiens
VAAVVWKTK

SEQ ID NO: 1213150 - protein, 9 aa, Homo Sapiens
NMDAWSREL

SEQ ID NO: 1213151 - protein, 9 aa, Homo Sapiens
VTNMKASKP

SEQ ID NO: 1213152 - protein, 9 aa, Homo Sapiens
FGHDVLRVV

SEQ ID NO: 1213153 - protein, 9 aa, Homo Sapiens
GKLALLGAS

SEQ ID NO: 1213154 - protein, 9 aa, Homo Sapiens
SLLEEYQSS

SEQ ID NO: 1213155 - protein, 9 aa, Homo Sapiens
SRLPLESVL

SEQ ID NO: 1213156 - protein, 9 aa, Homo Sapiens
FSHAISQDV

SEQ ID NO: 1213157 - protein, 9 aa, Homo Sapiens
LPMWMRSLK

SEQ ID NO: 1213158 - protein, 9 aa, Homo Sapiens
NGSHLPAIP

SEQ ID NO: 1213159 - protein, 9 aa, Homo Sapiens
YSPVCSSDG

SEQ ID NO: 1213160 - protein, 9 aa, Homo Sapiens
QFLKIKPPL

SEQ ID NO: 1213161 - protein, 9 aa, Homo Sapiens
CLGTKKYIL

SEQ ID NO: 1213162 - protein, 9 aa, Homo Sapiens
VHQCYDSEL

SEQ ID NO: 1213163 - protein, 9 aa, Homo Sapiens
PSPLTLYPL

SEQ ID NO: 1213164 - protein, 9 aa, Homo Sapiens
ASYPASLPR

SEQ ID NO: 1213165 - protein, 9 aa, Homo Sapiens
LYFWVKEAR

SEQ ID NO: 1213166 - protein, 9 aa, Homo Sapiens
DLEKKEGHI

SEQ ID NO: 1213167 - protein, 9 aa, Homo Sapiens
SPGEEVEGG

SEQ ID NO: 1213168 - protein, 9 aa, Homo Sapiens
QPMMQAHLD

SEQ ID NO: 1213169 - protein, 9 aa, Homo Sapiens
ATRMEVPLL

SEQ ID NO: 1213170 - protein, 9 aa, Homo Sapiens
NHSAQLDVH

SEQ ID NO: 1213171 - protein, 9 aa, Homo Sapiens
QLLRQRGIL

SEQ ID NO: 1213172 - protein, 9 aa, Homo Sapiens
HTQAYTLTY

SEQ ID NO: 1213173 - protein, 9 aa, Homo Sapiens
GHVLAPKDK

SEQ ID NO: 1213174 - protein, 9 aa, Homo Sapiens
LEMTIKENI

SEQ ID NO: 1213175 - protein, 9 aa, Homo Sapiens
RGSGCRGCG

SEQ ID NO: 1213176 - protein, 9 aa, Homo Sapiens
LDRFYWNDG

SEQ ID NO: 1213177 - protein, 9 aa, Homo Sapiens
EEETEKELA

SEQ ID NO: 1213178 - protein, 9 aa, Homo Sapiens
HGAADELVL

SEQ ID NO: 1213179 - protein, 9 aa, Homo Sapiens
HIYHYRMEK

SEQ ID NO: 1213180 - protein, 9 aa, Homo Sapiens
MGPYARGPH

SEQ ID NO: 1213181 - protein, 9 aa, Homo Sapiens
GMGVLFSLV

SEQ ID NO: 1213182 - protein, 9 aa, Homo Sapiens
NGIERNKGF

SEQ ID NO: 1213183 - protein, 9 aa, Homo Sapiens
ELNRDQVQK

SEQ ID NO: 1213184 - protein, 9 aa, Homo Sapiens
WNTSSLVFN

SEQ ID NO: 1213185 - protein, 9 aa, Homo Sapiens
CRGFRITCS

SEQ ID NO: 1213186 - protein, 9 aa, Homo Sapiens
WSSLSLRVR

SEQ ID NO: 1213187 - protein, 9 aa, Homo Sapiens
AEEKKQALS

SEQ ID NO: 1213188 - protein, 9 aa, Homo Sapiens
KDMCTAKFG

SEQ ID NO: 1213189 - protein, 9 aa, Homo Sapiens
DEGLCPADQ

SEQ ID NO: 1213190 - protein, 9 aa, Homo Sapiens
KTSRWSSHA

SEQ ID NO: 1213191 - protein, 9 aa, Homo Sapiens
PIIRFCHPN

SEQ ID NO: 1213192 - protein, 9 aa, Homo Sapiens
YSLNYENNH

SEQ ID NO: 1213193 - protein, 9 aa, Homo Sapiens
EAPLTPREQ

SEQ ID NO: 1213194 - protein, 9 aa, Homo Sapiens
VNENFEIQQ

SEQ ID NO: 1213195 - protein, 9 aa, Homo Sapiens
GKYDVAHVV

SEQ ID NO: 1213196 - protein, 9 aa, Homo Sapiens
GQQYFSDLF

SEQ ID NO: 1213197 - protein, 9 aa, Homo Sapiens
LDDFKGNFP

SEQ ID NO: 1213198 - protein, 9 aa, Homo Sapiens
IYMPKVGEV

SEQ ID NO: 1213199 - protein, 9 aa, Homo Sapiens
RRSSVKRTH

SEQ ID NO: 1213200 - protein, 9 aa, Homo Sapiens
CHIQPLIPL

SEQ ID NO: 1213201 - protein, 9 aa, Homo Sapiens
IRKHLVKNE

SEQ ID NO: 1213202 - protein, 9 aa, Homo Sapiens
DLLLSVFGS

SEQ ID NO: 1213203 - protein, 9 aa, Homo Sapiens
SHTIRCTRM

SEQ ID NO: 1213204 - protein, 9 aa, Homo Sapiens
LQPTLSVTS

SEQ ID NO: 1213205 - protein, 9 aa, Homo Sapiens
YGGQKCSTC

SEQ ID NO: 1213206 - protein, 9 aa, Homo Sapiens
PGVFGGPDS

SEQ ID NO: 1213207 - protein, 9 aa, Homo Sapiens
YQAGQTIKV

SEQ ID NO: 1213208 - protein, 9 aa, Homo Sapiens
RMRQLQSSH

SEQ ID NO: 1213209 - protein, 9 aa, Homo Sapiens
ADSVLEIFK

SEQ ID NO: 1213210 - protein, 9 aa, Homo Sapiens
YAVSSDRFH

SEQ ID NO: 1213211 - protein, 9 aa, Homo Sapiens
VPSMDAHSE

SEQ ID NO: 1213212 - protein, 9 aa, Homo Sapiens
SLERDPSNH

SEQ ID NO: 1213213 - protein, 9 aa, Homo Sapiens
QNLGMWVQE

SEQ ID NO: 1213214 - protein, 9 aa, Homo Sapiens
DNEEEDDDE

SEQ ID NO: 1213215 - protein, 9 aa, Homo Sapiens
NLSKLQLGQ

SEQ ID NO: 1213216 - protein, 9 aa, Homo Sapiens
LKGLIHHYR

SEQ ID NO: 1213217 - protein, 9 aa, Homo Sapiens
GEKTYGCNE

SEQ ID NO: 1213218 - protein, 9 aa, Homo Sapiens
ARSSWLPTL

SEQ ID NO: 1213219 - protein, 9 aa, Homo Sapiens
DPKMYRVAL

SEQ ID NO: 1213220 - protein, 9 aa, Homo Sapiens
KNVSVSISH

SEQ ID NO: 1213221 - protein, 9 aa, Homo Sapiens
IARLNTILD

SEQ ID NO: 1213222 - protein, 9 aa, Homo Sapiens
NAGIIRTLQ

SEQ ID NO: 1213223 - protein, 9 aa, Homo Sapiens
RGQKKCDIG

SEQ ID NO: 1213224 - protein, 9 aa, Homo Sapiens
QPDLKYLRF

SEQ ID NO: 1213225 - protein, 9 aa, Homo Sapiens
ECDRQKEQK

SEQ ID NO: 1213226 - protein, 9 aa, Homo Sapiens
GGGGGPGPA

SEQ ID NO: 1213227 - protein, 9 aa, Homo Sapiens
TCQSDMDEC

SEQ ID NO: 1213228 - protein, 9 aa, Homo Sapiens
RVLEYLFKF

SEQ ID NO: 1213229 - protein, 9 aa, Homo Sapiens
FITNHSDRP

SEQ ID NO: 1213230 - protein, 9 aa, Homo Sapiens
CFGLLGVNE

SEQ ID NO: 1213231 - protein, 9 aa, Homo Sapiens
NYKYHENGT

SEQ ID NO: 1213232 - protein, 9 aa, Homo Sapiens
GLNYHKHCA

SEQ ID NO: 1213233 - protein, 9 aa, Homo Sapiens
RWVALPCSP

SEQ ID NO: 1213234 - protein, 9 aa, Homo Sapiens
FAHVYFPEE

SEQ ID NO: 1213235 - protein, 9 aa, Homo Sapiens
CLVTSFYWC

SEQ ID NO: 1213236 - protein, 9 aa, Homo Sapiens
NSDETKAPQ

SEQ ID NO: 1213237 - protein, 9 aa, Homo Sapiens
ETKLKLMAH

SEQ ID NO: 1213238 - protein, 9 aa, Homo Sapiens
CWMNMNKTN

SEQ ID NO: 1213239 - protein, 9 aa, Homo Sapiens
AEATSWSCQ

SEQ ID NO: 1213240 - protein, 9 aa, Homo Sapiens
FSSISMTPF

SEQ ID NO: 1213241 - protein, 9 aa, Homo Sapiens
KWRRRIPAG

SEQ ID NO: 1213242 - protein, 9 aa, Homo Sapiens
YVKNRNPRA

SEQ ID NO: 1213243 - protein, 9 aa, Homo Sapiens
CHLCAESLK

SEQ ID NO: 1213244 - protein, 9 aa, Homo Sapiens
LVRQRQLYK

SEQ ID NO: 1213245 - protein, 9 aa, Homo Sapiens
PKGSNKVNE

SEQ ID NO: 1213246 - protein, 9 aa, Homo Sapiens
IYPNPDCPL

SEQ ID NO: 1213247 - protein, 9 aa, Homo Sapiens
KKSNWIQEE

SEQ ID NO: 1213248 - protein, 9 aa, Homo Sapiens
EPCPTPGAA

SEQ ID NO: 1213249 - protein, 9 aa, Homo Sapiens
KRDVRFERA

SEQ ID NO: 1213250 - protein, 9 aa, Homo Sapiens
SGFFNTTWQ

SEQ ID NO: 1213251 - protein, 9 aa, Homo Sapiens
YCLIHNVQK

SEQ ID NO: 1213252 - protein, 9 aa, Homo Sapiens
RLILDWIPY

SEQ ID NO: 1213253 - protein, 9 aa, Homo Sapiens
LFIYNKDGP

SEQ ID NO: 1213254 - protein, 9 aa, Homo Sapiens
VRELLSEAK

SEQ ID NO: 1213255 - protein, 9 aa, Homo Sapiens
TGYCVCILG

SEQ ID NO: 1213256 - protein, 9 aa, Homo Sapiens
NDENIMGLF

SEQ ID NO: 1213257 - protein, 9 aa, Homo Sapiens
WDGSPDIGP

SEQ ID NO: 1213258 - protein, 9 aa, Homo Sapiens
KREREAAAK

SEQ ID NO: 1213259 - protein, 9 aa, Homo Sapiens
YISDTTDLA

SEQ ID NO: 1213260 - protein, 9 aa, Homo Sapiens
CPLTTEKKE

SEQ ID NO: 1213261 - protein, 9 aa, Homo Sapiens
PAQVIVVYT

SEQ ID NO: 1213262 - protein, 9 aa, Homo Sapiens
YLFMYNRVQ

SEQ ID NO: 1213263 - protein, 9 aa, Homo Sapiens
VFPVFVTSC

SEQ ID NO: 1213264 - protein, 9 aa, Homo Sapiens
MSTEGLMKS

SEQ ID NO: 1213265 - protein, 9 aa, Homo Sapiens
QGEEQESLV

SEQ ID NO: 1213266 - protein, 9 aa, Homo Sapiens
ADISTRDSV

SEQ ID NO: 1213267 - protein, 9 aa, Homo Sapiens
DFIPVACLI

SEQ ID NO: 1213268 - protein, 9 aa, Homo Sapiens
TLVKRKKRR

SEQ ID NO: 1213269 - protein, 9 aa, Homo Sapiens
VHRAFLSDM

SEQ ID NO: 1213270 - protein, 9 aa, Homo Sapiens
LDTAHQNLY

SEQ ID NO: 1213271 - protein, 9 aa, Homo Sapiens
ECVNMEDSY

SEQ ID NO: 1213272 - protein, 9 aa, Homo Sapiens
LHVPNVVVR

SEQ ID NO: 1213273 - protein, 9 aa, Homo Sapiens
RSEENSSNL

SEQ ID NO: 1213274 - protein, 9 aa, Homo Sapiens
VQDKCVNSF

SEQ ID NO: 1213275 - protein, 9 aa, Homo Sapiens
TGSLIIGSI

SEQ ID NO: 1213276 - protein, 9 aa, Homo Sapiens
VCTCLVTLM

SEQ ID NO: 1213277 - protein, 9 aa, Homo Sapiens
VMYYFTYDP

SEQ ID NO: 1213278 - protein, 9 aa, Homo Sapiens
SRNQLVTTE

SEQ ID NO: 1213279 - protein, 9 aa, Homo Sapiens
APSHQALGL

SEQ ID NO: 1213280 - protein, 9 aa, Homo Sapiens
EWPYKCGEC

SEQ ID NO: 1213281 - protein, 9 aa, Homo Sapiens
PPGVDLYHL

SEQ ID NO: 1213282 - protein, 9 aa, Homo Sapiens
ETVVMKEKC

SEQ ID NO: 1213283 - protein, 9 aa, Homo Sapiens
RTDPPLVRV

SEQ ID NO: 1213284 - protein, 9 aa, Homo Sapiens
QPASSHHGS

SEQ ID NO: 1213285 - protein, 9 aa, Homo Sapiens
RACSCGHPW

SEQ ID NO: 1213286 - protein, 9 aa, Homo Sapiens
GIGHQKCKP

SEQ ID NO: 1213287 - protein, 9 aa, Homo Sapiens
TDTPSTIFI

SEQ ID NO: 1213288 - protein, 9 aa, Homo Sapiens
FTDQLPDCS

SEQ ID NO: 1213289 - protein, 9 aa, Homo Sapiens
ASMGTCLIA

SEQ ID NO: 1213290 - protein, 9 aa, Homo Sapiens
QEENIYAAV

SEQ ID NO: 1213291 - protein, 9 aa, Homo Sapiens
EKQEHVVVR

SEQ ID NO: 1213292 - protein, 9 aa, Homo Sapiens
LAKTHLGDS

SEQ ID NO: 1213293 - protein, 9 aa, Homo Sapiens
SIDNHPMNR

SEQ ID NO: 1213294 - protein, 9 aa, Homo Sapiens
THNYFGLMS

SEQ ID NO: 1213295 - protein, 9 aa, Homo Sapiens
EVAGTKVIV

SEQ ID NO: 1213296 - protein, 9 aa, Homo Sapiens
IGLLKRFRK

SEQ ID NO: 1213297 - protein, 9 aa, Homo Sapiens
LQSGSGPHD

SEQ ID NO: 1213298 - protein, 9 aa, Homo Sapiens
HLFRGVCVT

SEQ ID NO: 1213299 - protein, 9 aa, Homo Sapiens
RPMTKTWTL

SEQ ID NO: 1213300 - protein, 9 aa, Homo Sapiens
THLGDSENK

SEQ ID NO: 1213301 - protein, 9 aa, Homo Sapiens
SHLSVIALF

SEQ ID NO: 1213302 - protein, 9 aa, Homo Sapiens
TLETVNCMS

SEQ ID NO: 1213303 - protein, 9 aa, Homo Sapiens
TLHKKNFLL

SEQ ID NO: 1213304 - protein, 9 aa, Homo Sapiens
EVTRMAVVM

SEQ ID NO: 1213305 - protein, 9 aa, Homo Sapiens
GARKQPWGA

SEQ ID NO: 1213306 - protein, 9 aa, Homo Sapiens
SSWNRITTA

SEQ ID NO: 1213307 - protein, 9 aa, Homo Sapiens
SEGKKQGKS

SEQ ID NO: 1213308 - protein, 9 aa, Homo Sapiens
VMRVWFCNQ

SEQ ID NO: 1213309 - protein, 9 aa, Homo Sapiens
TSDDLAHKH

SEQ ID NO: 1213310 - protein, 9 aa, Homo Sapiens
IYHYITSYV

SEQ ID NO: 1213311 - protein, 9 aa, Homo Sapiens
GENKKTKPV

SEQ ID NO: 1213312 - protein, 9 aa, Homo Sapiens
RATKSGTPF

SEQ ID NO: 1213313 - protein, 9 aa, Homo Sapiens
KNKNVRFIG

SEQ ID NO: 1213314 - protein, 9 aa, Homo Sapiens
SYCIFTIYL

SEQ ID NO: 1213315 - protein, 9 aa, Homo Sapiens
VATFPDPNV

SEQ ID NO: 1213316 - protein, 9 aa, Homo Sapiens
HTSGFTGGH

SEQ ID NO: 1213317 - protein, 9 aa, Homo Sapiens
PWKPIWLPV

SEQ ID NO: 1213318 - protein, 9 aa, Homo Sapiens
ALLEAVLFG

SEQ ID NO: 1213319 - protein, 9 aa, Homo Sapiens
ALGRWGYGK

SEQ ID NO: 1213320 - protein, 9 aa, Homo Sapiens
IDNLKQFYK

SEQ ID NO: 1213321 - protein, 9 aa, Homo Sapiens
DKSSPVDAL

SEQ ID NO: 1213322 - protein, 9 aa, Homo Sapiens
IQRNHTVCY

SEQ ID NO: 1213323 - protein, 9 aa, Homo Sapiens
VLTVKSLPP

SEQ ID NO: 1213324 - protein, 9 aa, Homo Sapiens
GDWQHTQNI

SEQ ID NO: 1213325 - protein, 9 aa, Homo Sapiens
SSEGASQSR

SEQ ID NO: 1213326 - protein, 9 aa, Homo Sapiens
MAQAEGIPK

SEQ ID NO: 1213327 - protein, 9 aa, Homo Sapiens
MITIEGPRF

SEQ ID NO: 1213328 - protein, 9 aa, Homo Sapiens
HWISRLSAC

SEQ ID NO: 1213329 - protein, 9 aa, Homo Sapiens
YSYMGHFDL

SEQ ID NO: 1213330 - protein, 9 aa, Homo Sapiens
HLHDAGLHR

SEQ ID NO: 1213331 - protein, 9 aa, Homo Sapiens
AQSSATLPS

SEQ ID NO: 1213332 - protein, 9 aa, Homo Sapiens
IMLICTTVP

SEQ ID NO: 1213333 - protein, 9 aa, Homo Sapiens
PTSMQSQIT

SEQ ID NO: 1213334 - protein, 9 aa, Homo Sapiens
FPKQCCMLL

SEQ ID NO: 1213335 - protein, 9 aa, Homo Sapiens
LPLWPLMLL

SEQ ID NO: 1213336 - protein, 9 aa, Homo Sapiens
QPLPRSTCT

SEQ ID NO: 1213337 - protein, 9 aa, Homo Sapiens
PQADISISP

SEQ ID NO: 1213338 - protein, 9 aa, Homo Sapiens
LSRRRVITL

SEQ ID NO: 1213339 - protein, 9 aa, Homo Sapiens
REDRLQEYT

SEQ ID NO: 1213340 - protein, 9 aa, Homo Sapiens
AVSPSSVRG

SEQ ID NO: 1213341 - protein, 9 aa, Homo Sapiens
ENMANADRP

SEQ ID NO: 1213342 - protein, 9 aa, Homo Sapiens
TFQLHEDLM

SEQ ID NO: 1213343 - protein, 9 aa, Homo Sapiens
VLISCIFVL

SEQ ID NO: 1213344 - protein, 9 aa, Homo Sapiens
HPSSPRLSR

SEQ ID NO: 1213345 - protein, 9 aa, Homo Sapiens
AFAGGVMGA

SEQ ID NO: 1213346 - protein, 9 aa, Homo Sapiens
YACVRGDEV

SEQ ID NO: 1213347 - protein, 9 aa, Homo Sapiens
GSKKNRNND

SEQ ID NO: 1213348 - protein, 9 aa, Homo Sapiens
MSSDSHKDL

SEQ ID NO: 1213349 - protein, 9 aa, Homo Sapiens
PSWSCPSSP

SEQ ID NO: 1213350 - protein, 9 aa, Homo Sapiens
IDRWCSIVR

SEQ ID NO: 1213351 - protein, 9 aa, Homo Sapiens
NHTQGDLFP

SEQ ID NO: 1213352 - protein, 9 aa, Homo Sapiens
IITVFTSRA

SEQ ID NO: 1213353 - protein, 9 aa, Homo Sapiens
KEYQIFPPT

SEQ ID NO: 1213354 - protein, 9 aa, Homo Sapiens
SYRLVLYEK

SEQ ID NO: 1213355 - protein, 9 aa, Homo Sapiens
WDHRPPHIS

SEQ ID NO: 1213356 - protein, 9 aa, Homo Sapiens
VTLEGRPGH

SEQ ID NO: 1213357 - protein, 9 aa, Homo Sapiens
HPPPGFTPF

SEQ ID NO: 1213358 - protein, 9 aa, Homo Sapiens
KHDIFLLEK

SEQ ID NO: 1213359 - protein, 9 aa, Homo Sapiens
RPYMAHLQI

SEQ ID NO: 1213360 - protein, 9 aa, Homo Sapiens
YNPIYDIDE

SEQ ID NO: 1213361 - protein, 9 aa, Homo Sapiens
KWVSVMERS

SEQ ID NO: 1213362 - protein, 9 aa, Homo Sapiens
RQLPTALLH

SEQ ID NO: 1213363 - protein, 9 aa, Homo Sapiens
CPDGHIVSV

SEQ ID NO: 1213364 - protein, 9 aa, Homo Sapiens
GSNVAEGHK

SEQ ID NO: 1213365 - protein, 9 aa, Homo Sapiens
EQISVMRYS

SEQ ID NO: 1213366 - protein, 9 aa, Homo Sapiens
LMEDISQMK

SEQ ID NO: 1213367 - protein, 9 aa, Homo Sapiens
KGLGQTKKL

SEQ ID NO: 1213368 - protein, 9 aa, Homo Sapiens
KTGRLQQEE

SEQ ID NO: 1213369 - protein, 9 aa, Homo Sapiens
IRSMDTLRI

SEQ ID NO: 1213370 - protein, 9 aa, Homo Sapiens
TVHEATPLF

SEQ ID NO: 1213371 - protein, 9 aa, Homo Sapiens
HEEVNTELN

SEQ ID NO: 1213372 - protein, 9 aa, Homo Sapiens
LFNMCLTRE

SEQ ID NO: 1213373 - protein, 9 aa, Homo Sapiens
GEGRPRNIV

SEQ ID NO: 1213374 - protein, 9 aa, Homo Sapiens
NRAGMGWYQ

SEQ ID NO: 1213375 - protein, 9 aa, Homo Sapiens
KKGTWRHRR

SEQ ID NO: 1213376 - protein, 9 aa, Homo Sapiens
PGSDYIINE

SEQ ID NO: 1213377 - protein, 9 aa, Homo Sapiens
ELLSELQQH

SEQ ID NO: 1213378 - protein, 9 aa, Homo Sapiens
TLGLELAVS

SEQ ID NO: 1213379 - protein, 9 aa, Homo Sapiens
DQIIEDQYK

SEQ ID NO: 1213380 - protein, 9 aa, Homo Sapiens
VHAQPYHML

SEQ ID NO: 1213381 - protein, 9 aa, Homo Sapiens
TTCYRPRTS

SEQ ID NO: 1213382 - protein, 9 aa, Homo Sapiens
PYMAHLQIQ

SEQ ID NO: 1213383 - protein, 9 aa, Homo Sapiens
GNMIRGIGE

SEQ ID NO: 1213384 - protein, 9 aa, Homo Sapiens
DVGAPGVQG

SEQ ID NO: 1213385 - protein, 9 aa, Homo Sapiens
DFSKHILNV

SEQ ID NO: 1213386 - protein, 9 aa, Homo Sapiens
HVSSGGKPQ

SEQ ID NO: 1213387 - protein, 9 aa, Homo Sapiens
NAWRHVADM

SEQ ID NO: 1213388 - protein, 9 aa, Homo Sapiens
WGWGNMQSL

SEQ ID NO: 1213389 - protein, 9 aa, Homo Sapiens
VVTKPSQVL

SEQ ID NO: 1213390 - protein, 9 aa, Homo Sapiens
TLRSNHPPS

SEQ ID NO: 1213391 - protein, 9 aa, Homo Sapiens
QAPAPARSY

SEQ ID NO: 1213392 - protein, 9 aa, Homo Sapiens
VLSQESSEP

SEQ ID NO: 1213393 - protein, 9 aa, Homo Sapiens
NYQSFLTEH

SEQ ID NO: 1213394 - protein, 9 aa, Homo Sapiens
CRMEKNILT

SEQ ID NO: 1213395 - protein, 9 aa, Homo Sapiens
LFDEYFNDN

SEQ ID NO: 1213396 - protein, 9 aa, Homo Sapiens
NAPVKYEED

SEQ ID NO: 1213397 - protein, 9 aa, Homo Sapiens
GVPEDHIKT

SEQ ID NO: 1213398 - protein, 9 aa, Homo Sapiens
YCTWNPFRS

SEQ ID NO: 1213399 - protein, 9 aa, Homo Sapiens
AKLIPTCRD

SEQ ID NO: 1213400 - protein, 9 aa, Homo Sapiens
SMGPWGTGK

SEQ ID NO: 1213401 - protein, 9 aa, Homo Sapiens
PHITKDVIC

SEQ ID NO: 1213402 - protein, 9 aa, Homo Sapiens
EELTLEGIH

SEQ ID NO: 1213403 - protein, 9 aa, Homo Sapiens
RHADNLRTG

SEQ ID NO: 1213404 - protein, 9 aa, Homo Sapiens
HLRRQFTSQ

SEQ ID NO: 1213405 - protein, 9 aa, Homo Sapiens
HGVSAPSVS

SEQ ID NO: 1213406 - protein, 9 aa, Homo Sapiens
TCDCYMTSY

SEQ ID NO: 1213407 - protein, 9 aa, Homo Sapiens
SGFGCGYGG

SEQ ID NO: 1213408 - protein, 9 aa, Homo Sapiens
VTLQNLFTG

SEQ ID NO: 1213409 - protein, 9 aa, Homo Sapiens
RKKSTRPAA

SEQ ID NO: 1213410 - protein, 9 aa, Homo Sapiens
DPKTWKVNF

SEQ ID NO: 1213411 - protein, 9 aa, Homo Sapiens
HSSHRLCIL

SEQ ID NO: 1213412 - protein, 9 aa, Homo Sapiens
SAQPIEKIV

SEQ ID NO: 1213413 - protein, 9 aa, Homo Sapiens
PPSSTVWLS

SEQ ID NO: 1213414 - protein, 9 aa, Homo Sapiens
RLIVGTASR

SEQ ID NO: 1213415 - protein, 9 aa, Homo Sapiens
QALESVSLH

SEQ ID NO: 1213416 - protein, 9 aa, Homo Sapiens
IEDWFTTET

SEQ ID NO: 1213417 - protein, 9 aa, Homo Sapiens
SILGDEGMP

SEQ ID NO: 1213418 - protein, 9 aa, Homo Sapiens
DTCQCVNGG

SEQ ID NO: 1213419 - protein, 9 aa, Homo Sapiens
AFLPERKCF

SEQ ID NO: 1213420 - protein, 9 aa, Homo Sapiens
HAILFKKIL

SEQ ID NO: 1213421 - protein, 9 aa, Homo Sapiens
QSAHIKMEE

SEQ ID NO: 1213422 - protein, 9 aa, Homo Sapiens
PISPSRSSS

SEQ ID NO: 1213423 - protein, 9 aa, Homo Sapiens
TLHLDLEKG

SEQ ID NO: 1213424 - protein, 9 aa, Homo Sapiens
QADAPHGVV

SEQ ID NO: 1213425 - protein, 9 aa, Homo Sapiens
RQTQVGLES

SEQ ID NO: 1213426 - protein, 9 aa, Homo Sapiens
MEECCMLPY

SEQ ID NO: 1213427 - protein, 9 aa, Homo Sapiens
SIYVFVRDS

SEQ ID NO: 1213428 - protein, 9 aa, Homo Sapiens
IVYVQEVMQ

SEQ ID NO: 1213429 - protein, 9 aa, Homo Sapiens
YIEKHQQVR

SEQ ID NO: 1213430 - protein, 9 aa, Homo Sapiens
RISNHFQGL

SEQ ID NO: 1213431 - protein, 9 aa, Homo Sapiens
GYIVTFKPF

SEQ ID NO: 1213432 - protein, 9 aa, Homo Sapiens
LIACVEKHL

SEQ ID NO: 1213433 - protein, 9 aa, Homo Sapiens
PIVKKGEEG

SEQ ID NO: 1213434 - protein, 9 aa, Homo Sapiens
TSIDSLANV

SEQ ID NO: 1213435 - protein, 9 aa, Homo Sapiens
FMASSIIAV

SEQ ID NO: 1213436 - protein, 9 aa, Homo Sapiens
TNHEEIFPQ

SEQ ID NO: 1213437 - protein, 9 aa, Homo Sapiens
TFSGLRDTM

SEQ ID NO: 1213438 - protein, 9 aa, Homo Sapiens
HIFYQLLLL

SEQ ID NO: 1213439 - protein, 9 aa, Homo Sapiens
SYIVVMVDE

SEQ ID NO: 1213440 - protein, 9 aa, Homo Sapiens
EKQQKREAE

SEQ ID NO: 1213441 - protein, 9 aa, Homo Sapiens
PEYVWIVQP

SEQ ID NO: 1213442 - protein, 9 aa, Homo Sapiens
QVVCHDYDI

SEQ ID NO: 1213443 - protein, 9 aa, Homo Sapiens
YRKLLEAHT

SEQ ID NO: 1213444 - protein, 9 aa, Homo Sapiens
DTLQRTDPP

SEQ ID NO: 1213445 - protein, 9 aa, Homo Sapiens
HFRHGAASL

SEQ ID NO: 1213446 - protein, 9 aa, Homo Sapiens
FFYSCFYHY

SEQ ID NO: 1213447 - protein, 9 aa, Homo Sapiens
NPCGSMSFT

SEQ ID NO: 1213448 - protein, 9 aa, Homo Sapiens
KRSIQTQNK

SEQ ID NO: 1213449 - protein, 9 aa, Homo Sapiens
NEPSTKVQH

SEQ ID NO: 1213450 - protein, 9 aa, Homo Sapiens
TQYMTMRQQ

SEQ ID NO: 1213451 - protein, 9 aa, Homo Sapiens
WISVCVFPA

SEQ ID NO: 1213452 - protein, 9 aa, Homo Sapiens
YATPHFICI

SEQ ID NO: 1213453 - protein, 9 aa, Homo Sapiens
EQEQMWKIL

SEQ ID NO: 1213454 - protein, 9 aa, Homo Sapiens
ICPLFQTPR

SEQ ID NO: 1213455 - protein, 9 aa, Homo Sapiens
VFAHVYFPE

SEQ ID NO: 1213456 - protein, 9 aa, Homo Sapiens
LIWQDISLL

SEQ ID NO: 1213457 - protein, 9 aa, Homo Sapiens
LYEAAPGRG

SEQ ID NO: 1213458 - protein, 9 aa, Homo Sapiens
HWTLKAILQ

SEQ ID NO: 1213459 - protein, 9 aa, Homo Sapiens
DRDSMRCGL

SEQ ID NO: 1213460 - protein, 9 aa, Homo Sapiens
IEVNNATTR

SEQ ID NO: 1213461 - protein, 9 aa, Homo Sapiens
EKKNKAVNM

SEQ ID NO: 1213462 - protein, 9 aa, Homo Sapiens
MKIGGVSLT

SEQ ID NO: 1213463 - protein, 9 aa, Homo Sapiens
TQPENTAES

SEQ ID NO: 1213464 - protein, 9 aa, Homo Sapiens
FSAPCCWRL

SEQ ID NO: 1213465 - protein, 9 aa, Homo Sapiens
ASVAVTTPG

SEQ ID NO: 1213466 - protein, 9 aa, Homo Sapiens
HLLQHQSPH

SEQ ID NO: 1213467 - protein, 9 aa, Homo Sapiens
DDLNVCCES

SEQ ID NO: 1213468 - protein, 9 aa, Homo Sapiens
AAGTGCVMT

SEQ ID NO: 1213469 - protein, 9 aa, Homo Sapiens
QFWLGDMYT

SEQ ID NO: 1213470 - protein, 9 aa, Homo Sapiens
ELESKQQVS

SEQ ID NO: 1213471 - protein, 9 aa, Homo Sapiens
FMICISLVA

SEQ ID NO: 1213472 - protein, 9 aa, Homo Sapiens
KWKLERERP

SEQ ID NO: 1213473 - protein, 9 aa, Homo Sapiens
ATATRVTTP

SEQ ID NO: 1213474 - protein, 9 aa, Homo Sapiens
AIENCNKAK

SEQ ID NO: 1213475 - protein, 9 aa, Homo Sapiens
FQSEADWLQ

SEQ ID NO: 1213476 - protein, 9 aa, Homo Sapiens
HTQTMSCLN

SEQ ID NO: 1213477 - protein, 9 aa, Homo Sapiens
IPHSDEYSK

SEQ ID NO: 1213478 - protein, 9 aa, Homo Sapiens
PHFLESEFY

SEQ ID NO: 1213479 - protein, 9 aa, Homo Sapiens
NDNHPTFPH

SEQ ID NO: 1213480 - protein, 9 aa, Homo Sapiens
TKSISASAL

SEQ ID NO: 1213481 - protein, 9 aa, Homo Sapiens
LVLIDFGFL

SEQ ID NO: 1213482 - protein, 9 aa, Homo Sapiens
DCGPSLGLV

SEQ ID NO: 1213483 - protein, 9 aa, Homo Sapiens
TLIYPNPDC

SEQ ID NO: 1213484 - protein, 9 aa, Homo Sapiens
EAEMEAARD

SEQ ID NO: 1213485 - protein, 9 aa, Homo Sapiens
LLQGYRFTA

SEQ ID NO: 1213486 - protein, 9 aa, Homo Sapiens
LHALEEQGA

SEQ ID NO: 1213487 - protein, 9 aa, Homo Sapiens
CWVIGNQSS

SEQ ID NO: 1213488 - protein, 9 aa, Homo Sapiens
WCDGLDWCN

SEQ ID NO: 1213489 - protein, 9 aa, Homo Sapiens
LFPREAPDR

SEQ ID NO: 1213490 - protein, 9 aa, Homo Sapiens
NLVNALRDD

SEQ ID NO: 1213491 - protein, 9 aa, Homo Sapiens
TSYIFGKQT

SEQ ID NO: 1213492 - protein, 9 aa, Homo Sapiens
IMGLQTRTQ

SEQ ID NO: 1213493 - protein, 9 aa, Homo Sapiens
FITPLSLAK

SEQ ID NO: 1213494 - protein, 9 aa, Homo Sapiens
TKRHYCCAL

SEQ ID NO: 1213495 - protein, 9 aa, Homo Sapiens
HRDTHGGEA

SEQ ID NO: 1213496 - protein, 9 aa, Homo Sapiens
TSYPLTLVR

SEQ ID NO: 1213497 - protein, 9 aa, Homo Sapiens
PQHKLFQEI

SEQ ID NO: 1213498 - protein, 9 aa, Homo Sapiens
WEGLDGSCV

SEQ ID NO: 1213499 - protein, 9 aa, Homo Sapiens
TIHVQWQPV

SEQ ID NO: 1213500 - protein, 9 aa, Homo Sapiens
WELLLTTIT

SEQ ID NO: 1213501 - protein, 9 aa, Homo Sapiens
RDDAIGTTP

SEQ ID NO: 1213502 - protein, 9 aa, Homo Sapiens
DVGPTTIHV

SEQ ID NO: 1213503 - protein, 9 aa, Homo Sapiens
GSCGWWAPA

SEQ ID NO: 1213504 - protein, 9 aa, Homo Sapiens
FSENHALRL

SEQ ID NO: 1213505 - protein, 9 aa, Homo Sapiens
WSLQSCWHL

SEQ ID NO: 1213506 - protein, 9 aa, Homo Sapiens
NLQTVDMKI

SEQ ID NO: 1213507 - protein, 9 aa, Homo Sapiens
VKGLVTVIT

SEQ ID NO: 1213508 - protein, 9 aa, Homo Sapiens
HIFAVEWMQ

SEQ ID NO: 1213509 - protein, 9 aa, Homo Sapiens
EQISPGGAG

SEQ ID NO: 1213510 - protein, 9 aa, Homo Sapiens
CFPTLTAFI

SEQ ID NO: 1213511 - protein, 9 aa, Homo Sapiens
SRATKSGTP

SEQ ID NO: 1213512 - protein, 9 aa, Homo Sapiens
TVVNLENRL

SEQ ID NO: 1213513 - protein, 9 aa, Homo Sapiens
GTHRHIHSR

SEQ ID NO: 1213514 - protein, 9 aa, Homo Sapiens
GVKQEYCTW

SEQ ID NO: 1213515 - protein, 9 aa, Homo Sapiens
EQTEAAINA

SEQ ID NO: 1213516 - protein, 9 aa, Homo Sapiens
VFPASKEGK

SEQ ID NO: 1213517 - protein, 9 aa, Homo Sapiens
IDLGTLAGY

SEQ ID NO: 1213518 - protein, 9 aa, Homo Sapiens
YKCLHKHCR

SEQ ID NO: 1213519 - protein, 9 aa, Homo Sapiens
NTWLSYRLL

SEQ ID NO: 1213520 - protein, 9 aa, Homo Sapiens
SVLFLVAWL

SEQ ID NO: 1213521 - protein, 9 aa, Homo Sapiens
HWHSILIEL

SEQ ID NO: 1213522 - protein, 9 aa, Homo Sapiens
PQRVSGLHG

SEQ ID NO: 1213523 - protein, 9 aa, Homo Sapiens
AFAHNSTRV

SEQ ID NO: 1213524 - protein, 9 aa, Homo Sapiens
FSHWSLQTK

SEQ ID NO: 1213525 - protein, 9 aa, Homo Sapiens
MGTRGESPP

SEQ ID NO: 1213526 - protein, 9 aa, Homo Sapiens
GMPTILQES

SEQ ID NO: 1213527 - protein, 9 aa, Homo Sapiens
KRFQKKLYV

SEQ ID NO: 1213528 - protein, 9 aa, Homo Sapiens
LSCIDDKNP

SEQ ID NO: 1213529 - protein, 9 aa, Homo Sapiens
HQPRFPKCE

SEQ ID NO: 1213530 - protein, 9 aa, Homo Sapiens
FVLLGITQA

SEQ ID NO: 1213531 - protein, 9 aa, Homo Sapiens
AFPMFPPNA

SEQ ID NO: 1213532 - protein, 9 aa, Homo Sapiens
DMHFIFTIF

SEQ ID NO: 1213533 - protein, 9 aa, Homo Sapiens
FLLQHTQNT

SEQ ID NO: 1213534 - protein, 9 aa, Homo Sapiens
LMNIEGELS

SEQ ID NO: 1213535 - protein, 9 aa, Homo Sapiens
KCLQAKGRG

SEQ ID NO: 1213536 - protein, 9 aa, Homo Sapiens
NHVVSLTNT

SEQ ID NO: 1213537 - protein, 9 aa, Homo Sapiens
NPRGSKDIN

SEQ ID NO: 1213538 - protein, 9 aa, Homo Sapiens
SHLNSDLCV

SEQ ID NO: 1213539 - protein, 9 aa, Homo Sapiens
QWGGCRDNL

SEQ ID NO: 1213540 - protein, 9 aa, Homo Sapiens
MWPPSSTVW

SEQ ID NO: 1213541 - protein, 9 aa, Homo Sapiens
LDAGLSVLS

SEQ ID NO: 1213542 - protein, 9 aa, Homo Sapiens
NRQKIHSLD

SEQ ID NO: 1213543 - protein, 9 aa, Homo Sapiens
SYKHVCVQH

SEQ ID NO: 1213544 - protein, 9 aa, Homo Sapiens
EAARRIKTD

SEQ ID NO: 1213545 - protein, 9 aa, Homo Sapiens
QTAFLFASG

SEQ ID NO: 1213546 - protein, 9 aa, Homo Sapiens
ADAQEENIY

SEQ ID NO: 1213547 - protein, 9 aa, Homo Sapiens
LFEVGFEPF

SEQ ID NO: 1213548 - protein, 9 aa, Homo Sapiens
PPLSKADYL

SEQ ID NO: 1213549 - protein, 9 aa, Homo Sapiens
TYRAMQQRV

SEQ ID NO: 1213550 - protein, 9 aa, Homo Sapiens
ITMLVATTV

SEQ ID NO: 1213551 - protein, 9 aa, Homo Sapiens
EKSFGERLI

SEQ ID NO: 1213552 - protein, 9 aa, Homo Sapiens
HPMSAMNIK

SEQ ID NO: 1213553 - protein, 9 aa, Homo Sapiens
VADSDESYI

SEQ ID NO: 1213554 - protein, 9 aa, Homo Sapiens
FSDYPHLQK

SEQ ID NO: 1213555 - protein, 9 aa, Homo Sapiens
QKPQVKLCR

SEQ ID NO: 1213556 - protein, 9 aa, Homo Sapiens
CQCINTDEL

SEQ ID NO: 1213557 - protein, 9 aa, Homo Sapiens
SIKEVKENY

SEQ ID NO: 1213558 - protein, 9 aa, Homo Sapiens
AAPQSFIFL

SEQ ID NO: 1213559 - protein, 9 aa, Homo Sapiens
ESRCQNQDR

SEQ ID NO: 1213560 - protein, 9 aa, Homo Sapiens
KESGDDSLP

SEQ ID NO: 1213561 - protein, 9 aa, Homo Sapiens
SWCLCSQPR

SEQ ID NO: 1213562 - protein, 9 aa, Homo Sapiens
LKATVPFKY

SEQ ID NO: 1213563 - protein, 9 aa, Homo Sapiens
RNPPKQEVH

SEQ ID NO: 1213564 - protein, 9 aa, Homo Sapiens
PLRRVLAEP

SEQ ID NO: 1213565 - protein, 9 aa, Homo Sapiens
YTVIQAGRE

SEQ ID NO: 1213566 - protein, 9 aa, Homo Sapiens
VPGQSGCQD

SEQ ID NO: 1213567 - protein, 9 aa, Homo Sapiens
TVCTHEELL

SEQ ID NO: 1213568 - protein, 9 aa, Homo Sapiens
GVDELLEIL

SEQ ID NO: 1213569 - protein, 9 aa, Homo Sapiens
PQFCQNPAP

SEQ ID NO: 1213570 - protein, 9 aa, Homo Sapiens
LGAASRGHR

SEQ ID NO: 1213571 - protein, 9 aa, Homo Sapiens
QTSDASFLT

SEQ ID NO: 1213572 - protein, 9 aa, Homo Sapiens
LVDAPPQDP

SEQ ID NO: 1213573 - protein, 9 aa, Homo Sapiens
QGIGPAGEP

SEQ ID NO: 1213574 - protein, 9 aa, Homo Sapiens
VNGLSIGLQ

SEQ ID NO: 1213575 - protein, 9 aa, Homo Sapiens
TSSDADGEC

SEQ ID NO: 1213576 - protein, 9 aa, Homo Sapiens
MCIMNSFVN

SEQ ID NO: 1213577 - protein, 9 aa, Homo Sapiens
VLSMTTRIF

SEQ ID NO: 1213578 - protein, 9 aa, Homo Sapiens
TMKEVIDAF

SEQ ID NO: 1213579 - protein, 9 aa, Homo Sapiens
RHPRPQLSL

SEQ ID NO: 1213580 - protein, 9 aa, Homo Sapiens
HLSPSRECW

SEQ ID NO: 1213581 - protein, 9 aa, Homo Sapiens
GPAQAPLHP

SEQ ID NO: 1213582 - protein, 9 aa, Homo Sapiens
QHSSCQPAC

SEQ ID NO: 1213583 - protein, 9 aa, Homo Sapiens
VSEDEFVGE

SEQ ID NO: 1213584 - protein, 9 aa, Homo Sapiens
EEGIQGHPD

SEQ ID NO: 1213585 - protein, 9 aa, Homo Sapiens
LANPGSDQI

SEQ ID NO: 1213586 - protein, 9 aa, Homo Sapiens
SEWRYVQRG

SEQ ID NO: 1213587 - protein, 9 aa, Homo Sapiens
DCHIQPLIP

SEQ ID NO: 1213588 - protein, 9 aa, Homo Sapiens
SHVVDRLFE

SEQ ID NO: 1213589 - protein, 9 aa, Homo Sapiens
DRCDNTAGS

SEQ ID NO: 1213590 - protein, 9 aa, Homo Sapiens
ESHILVCFL

SEQ ID NO: 1213591 - protein, 9 aa, Homo Sapiens
SHFYVVMWK

SEQ ID NO: 1213592 - protein, 9 aa, Homo Sapiens
TAQQLEMTT

SEQ ID NO: 1213593 - protein, 9 aa, Homo Sapiens
MRKVSGHPN

SEQ ID NO: 1213594 - protein, 9 aa, Homo Sapiens
VEECLVDAA

SEQ ID NO: 1213595 - protein, 9 aa, Homo Sapiens
KGNLGAEHI

SEQ ID NO: 1213596 - protein, 9 aa, Homo Sapiens
TLLIEHLMG

SEQ ID NO: 1213597 - protein, 9 aa, Homo Sapiens
KPYKRNECG

SEQ ID NO: 1213598 - protein, 9 aa, Homo Sapiens
ADFSDPVFI

SEQ ID NO: 1213599 - protein, 9 aa, Homo Sapiens
IHMWPMARG

SEQ ID NO: 1213600 - protein, 9 aa, Homo Sapiens
GANVNLQEE

SEQ ID NO: 1213601 - protein, 9 aa, Homo Sapiens
SPSSHSTTP

SEQ ID NO: 1213602 - protein, 9 aa, Homo Sapiens
VCVWDEDDD

SEQ ID NO: 1213603 - protein, 9 aa, Homo Sapiens
KVPTMDLTV

SEQ ID NO: 1213604 - protein, 9 aa, Homo Sapiens
ASESAVWAF

SEQ ID NO: 1213605 - protein, 9 aa, Homo Sapiens
HFLSPYISP

SEQ ID NO: 1213606 - protein, 9 aa, Homo Sapiens
ITVGAVIVE

SEQ ID NO: 1213607 - protein, 9 aa, Homo Sapiens
KAHTVWLGC

SEQ ID NO: 1213608 - protein, 9 aa, Homo Sapiens
VEVDSDTII

SEQ ID NO: 1213609 - protein, 9 aa, Homo Sapiens
CDLISLSIN

SEQ ID NO: 1213610 - protein, 9 aa, Homo Sapiens
WGEVLFLML

SEQ ID NO: 1213611 - protein, 9 aa, Homo Sapiens
WMNLYQVFV

SEQ ID NO: 1213612 - protein, 9 aa, Homo Sapiens
TTSMRIGLM

SEQ ID NO: 1213613 - protein, 9 aa, Homo Sapiens
KWKPAWTDR

SEQ ID NO: 1213614 - protein, 9 aa, Homo Sapiens
VFKNQPQAT

SEQ ID NO: 1213615 - protein, 9 aa, Homo Sapiens
MELLFRNGA

SEQ ID NO: 1213616 - protein, 9 aa, Homo Sapiens
YPNHRHRSR

SEQ ID NO: 1213617 - protein, 9 aa, Homo Sapiens
LYIDSCTRR

SEQ ID NO: 1213618 - protein, 9 aa, Homo Sapiens
RNLGLDSYF

SEQ ID NO: 1213619 - protein, 9 aa, Homo Sapiens
RQKVWFFSA

SEQ ID NO: 1213620 - protein, 9 aa, Homo Sapiens
YTHFTCVTD

SEQ ID NO: 1213621 - protein, 9 aa, Homo Sapiens
VLHNVQEVE

SEQ ID NO: 1213622 - protein, 9 aa, Homo Sapiens
PAIIYLFFD

SEQ ID NO: 1213623 - protein, 9 aa, Homo Sapiens
SSATSSPRP

SEQ ID NO: 1213624 - protein, 9 aa, Homo Sapiens
PRPVSLGLR

SEQ ID NO: 1213625 - protein, 9 aa, Homo Sapiens
EARTIKSIA

SEQ ID NO: 1213626 - protein, 9 aa, Homo Sapiens
TTALIVLHT

SEQ ID NO: 1213627 - protein, 9 aa, Homo Sapiens
KASIMLPSQ

SEQ ID NO: 1213628 - protein, 9 aa, Homo Sapiens
SRSRPPARR

SEQ ID NO: 1213629 - protein, 9 aa, Homo Sapiens
EVGPVAVLD

SEQ ID NO: 1213630 - protein, 9 aa, Homo Sapiens
LSINTVKRE

SEQ ID NO: 1213631 - protein, 9 aa, Homo Sapiens
DLAIMGQAY

SEQ ID NO: 1213632 - protein, 9 aa, Homo Sapiens
ETRGPDGDW

SEQ ID NO: 1213633 - protein, 9 aa, Homo Sapiens
RRERERYPD

SEQ ID NO: 1213634 - protein, 9 aa, Homo Sapiens
HIINRKVEM

SEQ ID NO: 1213635 - protein, 9 aa, Homo Sapiens
LDRYIDVCK

SEQ ID NO: 1213636 - protein, 9 aa, Homo Sapiens
PDQCSPLSC

SEQ ID NO: 1213637 - protein, 9 aa, Homo Sapiens
FPVPPECAL

SEQ ID NO: 1213638 - protein, 9 aa, Homo Sapiens
GVLADLALH

SEQ ID NO: 1213639 - protein, 9 aa, Homo Sapiens
PPISKQATK

SEQ ID NO: 1213640 - protein, 9 aa, Homo Sapiens
SVSDWWPTV

SEQ ID NO: 1213641 - protein, 9 aa, Homo Sapiens
TKQTCWASR

SEQ ID NO: 1213642 - protein, 9 aa, Homo Sapiens
CINTDELCS

SEQ ID NO: 1213643 - protein, 9 aa, Homo Sapiens
LPKELLTWV

SEQ ID NO: 1213644 - protein, 9 aa, Homo Sapiens
LGGSLYENC

SEQ ID NO: 1213645 - protein, 9 aa, Homo Sapiens
AATKVMCIG

SEQ ID NO: 1213646 - protein, 9 aa, Homo Sapiens
SRAIGNAEH

SEQ ID NO: 1213647 - protein, 9 aa, Homo Sapiens
PSVWEADAS

SEQ ID NO: 1213648 - protein, 9 aa, Homo Sapiens
LLKVIPVAA

SEQ ID NO: 1213649 - protein, 9 aa, Homo Sapiens
DDIAVYFSQ

SEQ ID NO: 1213650 - protein, 9 aa, Homo Sapiens
GMTVAEKLH

SEQ ID NO: 1213651 - protein, 9 aa, Homo Sapiens
LRLIAMLEV

SEQ ID NO: 1213652 - protein, 9 aa, Homo Sapiens
DGATGDRGE

SEQ ID NO: 1213653 - protein, 9 aa, Homo Sapiens
APRPGQHTL

SEQ ID NO: 1213654 - protein, 9 aa, Homo Sapiens
PGKVGTAEA

SEQ ID NO: 1213655 - protein, 9 aa, Homo Sapiens
SMQSECREK

SEQ ID NO: 1213656 - protein, 9 aa, Homo Sapiens
CGNEDHCEC

SEQ ID NO: 1213657 - protein, 9 aa, Homo Sapiens
NKTYDSFLN

SEQ ID NO: 1213658 - protein, 9 aa, Homo Sapiens
DVPCLPVKR

SEQ ID NO: 1213659 - protein, 9 aa, Homo Sapiens
KWTTFLKVR

SEQ ID NO: 1213660 - protein, 9 aa, Homo Sapiens
SGKWIPTSL

SEQ ID NO: 1213661 - protein, 9 aa, Homo Sapiens
TLVSSVPKP

SEQ ID NO: 1213662 - protein, 9 aa, Homo Sapiens
RAVRRVAQV

SEQ ID NO: 1213663 - protein, 9 aa, Homo Sapiens
YHLFRGVCV

SEQ ID NO: 1213664 - protein, 9 aa, Homo Sapiens
VSLTNTLIG

SEQ ID NO: 1213665 - protein, 9 aa, Homo Sapiens
YLVALYLVR

SEQ ID NO: 1213666 - protein, 9 aa, Homo Sapiens
LQDNIFDLN

SEQ ID NO: 1213667 - protein, 9 aa, Homo Sapiens
YTSCLYIMK

SEQ ID NO: 1213668 - protein, 9 aa, Homo Sapiens
LHVGGPVPR

SEQ ID NO: 1213669 - protein, 9 aa, Homo Sapiens
FNHITGKGI

SEQ ID NO: 1213670 - protein, 9 aa, Homo Sapiens
IEKHPAERH

SEQ ID NO: 1213671 - protein, 9 aa, Homo Sapiens
VTTRDVQKV

SEQ ID NO: 1213672 - protein, 9 aa, Homo Sapiens
HWENYNTGI

SEQ ID NO: 1213673 - protein, 9 aa, Homo Sapiens
PDSAVSNTP

SEQ ID NO: 1213674 - protein, 9 aa, Homo Sapiens
PLDQALWAG

SEQ ID NO: 1213675 - protein, 9 aa, Homo Sapiens
LCQLLQRFK

SEQ ID NO: 1213676 - protein, 9 aa, Homo Sapiens
PWLLLGSLP

SEQ ID NO: 1213677 - protein, 9 aa, Homo Sapiens
LDFEIFDLP

SEQ ID NO: 1213678 - protein, 9 aa, Homo Sapiens
RKSLAQPPG

SEQ ID NO: 1213679 - protein, 9 aa, Homo Sapiens
PQTPNYNHH

SEQ ID NO: 1213680 - protein, 9 aa, Homo Sapiens
HFHRLILTP

SEQ ID NO: 1213681 - protein, 9 aa, Homo Sapiens
MCRIIAEDP

SEQ ID NO: 1213682 - protein, 9 aa, Homo Sapiens
ITIVSATST

SEQ ID NO: 1213683 - protein, 9 aa, Homo Sapiens
LAFKPLKIL

SEQ ID NO: 1213684 - protein, 9 aa, Homo Sapiens
LTEIPSHLP

SEQ ID NO: 1213685 - protein, 9 aa, Homo Sapiens
AEHLAGCTF

SEQ ID NO: 1213686 - protein, 9 aa, Homo Sapiens
PLGHVPLTK

SEQ ID NO: 1213687 - protein, 9 aa, Homo Sapiens
HFMLCISEL

SEQ ID NO: 1213688 - protein, 9 aa, Homo Sapiens
LSVRPVSSA

SEQ ID NO: 1213689 - protein, 9 aa, Homo Sapiens
QDLLQELFS

SEQ ID NO: 1213690 - protein, 9 aa, Homo Sapiens
HAILTCIVI

SEQ ID NO: 1213691 - protein, 9 aa, Homo Sapiens
GEVRFSIHL

SEQ ID NO: 1213692 - protein, 9 aa, Homo Sapiens
MKLRNYFSL

SEQ ID NO: 1213693 - protein, 9 aa, Homo Sapiens
LLHDRIFSY

SEQ ID NO: 1213694 - protein, 9 aa, Homo Sapiens
RAPHVCQDI

SEQ ID NO: 1213695 - protein, 9 aa, Homo Sapiens
CTLPWGMLS

SEQ ID NO: 1213696 - protein, 9 aa, Homo Sapiens
SFSEAKNKA

SEQ ID NO: 1213697 - protein, 9 aa, Homo Sapiens
CRLILPQMS

SEQ ID NO: 1213698 - protein, 9 aa, Homo Sapiens
MAQQENLTI

SEQ ID NO: 1213699 - protein, 9 aa, Homo Sapiens
AVGVCWWLP

SEQ ID NO: 1213700 - protein, 9 aa, Homo Sapiens
KGPNGYGSH

SEQ ID NO: 1213701 - protein, 9 aa, Homo Sapiens
HHSDHKPYL

SEQ ID NO: 1213702 - protein, 9 aa, Homo Sapiens
GSCAASCVL

SEQ ID NO: 1213703 - protein, 9 aa, Homo Sapiens
ETKAPQTPS

SEQ ID NO: 1213704 - protein, 9 aa, Homo Sapiens
WIIDCLGRK

SEQ ID NO: 1213705 - protein, 9 aa, Homo Sapiens
KAISHDSIF

SEQ ID NO: 1213706 - protein, 9 aa, Homo Sapiens
HLQITRTLV

SEQ ID NO: 1213707 - protein, 9 aa, Homo Sapiens
PSRICSSAH

SEQ ID NO: 1213708 - protein, 9 aa, Homo Sapiens
LFNISVPRH

SEQ ID NO: 1213709 - protein, 9 aa, Homo Sapiens
IVGSKVMGG

SEQ ID NO: 1213710 - protein, 9 aa, Homo Sapiens
LLLLNLLKE

SEQ ID NO: 1213711 - protein, 9 aa, Homo Sapiens
VPNDEEKMI

SEQ ID NO: 1213712 - protein, 9 aa, Homo Sapiens
RKKFFSTCA

SEQ ID NO: 1213713 - protein, 9 aa, Homo Sapiens
RPRRLSQHQ

SEQ ID NO: 1213714 - protein, 9 aa, Homo Sapiens
SQTYVDPSD

SEQ ID NO: 1213715 - protein, 9 aa, Homo Sapiens
PALPPVPGS

SEQ ID NO: 1213716 - protein, 9 aa, Homo Sapiens
LVNLVCALS

SEQ ID NO: 1213717 - protein, 9 aa, Homo Sapiens
TECKNVSVS

SEQ ID NO: 1213718 - protein, 9 aa, Homo Sapiens
AHTVWLGCP

SEQ ID NO: 1213719 - protein, 9 aa, Homo Sapiens
TVNYFGKHF

SEQ ID NO: 1213720 - protein, 9 aa, Homo Sapiens
VPPECALGI

SEQ ID NO: 1213721 - protein, 9 aa, Homo Sapiens
MHLDEHLLC

SEQ ID NO: 1213722 - protein, 9 aa, Homo Sapiens
LFVIFFIGI

SEQ ID NO: 1213723 - protein, 9 aa, Homo Sapiens
SQRDYANGF

SEQ ID NO: 1213724 - protein, 9 aa, Homo Sapiens
IVLGPIQLQ

SEQ ID NO: 1213725 - protein, 9 aa, Homo Sapiens
IGPPVSGPP

SEQ ID NO: 1213726 - protein, 9 aa, Homo Sapiens
DPFEKPIIS

SEQ ID NO: 1213727 - protein, 9 aa, Homo Sapiens
PVPLAEPAA

SEQ ID NO: 1213728 - protein, 9 aa, Homo Sapiens
SKVYNPLYC

SEQ ID NO: 1213729 - protein, 9 aa, Homo Sapiens
SPLLSRRTL

SEQ ID NO: 1213730 - protein, 9 aa, Homo Sapiens
NRNETELTE

SEQ ID NO: 1213731 - protein, 9 aa, Homo Sapiens
GVVDIVSWK

SEQ ID NO: 1213732 - protein, 9 aa, Homo Sapiens
DYSDCKNLN

SEQ ID NO: 1213733 - protein, 9 aa, Homo Sapiens
VIAWGHAFV

SEQ ID NO: 1213734 - protein, 9 aa, Homo Sapiens
VIRRNESHL

SEQ ID NO: 1213735 - protein, 9 aa, Homo Sapiens
VSTYLKMTP

SEQ ID NO: 1213736 - protein, 9 aa, Homo Sapiens
KGVLNSIGI

SEQ ID NO: 1213737 - protein, 9 aa, Homo Sapiens
ADKILQELN

SEQ ID NO: 1213738 - protein, 9 aa, Homo Sapiens
YKYDRMEKS

SEQ ID NO: 1213739 - protein, 9 aa, Homo Sapiens
RMLCQLLQR

SEQ ID NO: 1213740 - protein, 9 aa, Homo Sapiens
GPCPRICRG

SEQ ID NO: 1213741 - protein, 9 aa, Homo Sapiens
LSFRKVQEH

SEQ ID NO: 1213742 - protein, 9 aa, Homo Sapiens
AMHYLDRFL

SEQ ID NO: 1213743 - protein, 9 aa, Homo Sapiens
LAFRGTPGA

SEQ ID NO: 1213744 - protein, 9 aa, Homo Sapiens
ADEGVESVS

SEQ ID NO: 1213745 - protein, 9 aa, Homo Sapiens
TRYHIVKKT

SEQ ID NO: 1213746 - protein, 9 aa, Homo Sapiens
HPTFPHASY

SEQ ID NO: 1213747 - protein, 9 aa, Homo Sapiens
VTFNPKYGT

SEQ ID NO: 1213748 - protein, 9 aa, Homo Sapiens
VSCGRGNQA

SEQ ID NO: 1213749 - protein, 9 aa, Homo Sapiens
DAPVFSTST

SEQ ID NO: 1213750 - protein, 9 aa, Homo Sapiens
KDIQWALHS

SEQ ID NO: 1213751 - protein, 9 aa, Homo Sapiens
RNEMQAQIA

SEQ ID NO: 1213752 - protein, 9 aa, Homo Sapiens
DHTDRTKAK

SEQ ID NO: 1213753 - protein, 9 aa, Homo Sapiens
GIFSVGLHT

SEQ ID NO: 1213754 - protein, 9 aa, Homo Sapiens
SPCQTTCYR

SEQ ID NO: 1213755 - protein, 9 aa, Homo Sapiens
SSSFQELYC

SEQ ID NO: 1213756 - protein, 9 aa, Homo Sapiens
IVVLAEEKI

SEQ ID NO: 1213757 - protein, 9 aa, Homo Sapiens
SECREKNVE

SEQ ID NO: 1213758 - protein, 9 aa, Homo Sapiens
EWHRGYIIR

SEQ ID NO: 1213759 - protein, 9 aa, Homo Sapiens
THTHKQIAQ

SEQ ID NO: 1213760 - protein, 9 aa, Homo Sapiens
DHRPPHIST

SEQ ID NO: 1213761 - protein, 9 aa, Homo Sapiens
PDALPEEKK

SEQ ID NO: 1213762 - protein, 9 aa, Homo Sapiens
YTKLSYCVV

SEQ ID NO: 1213763 - protein, 9 aa, Homo Sapiens
PGQSGCQDI

SEQ ID NO: 1213764 - protein, 9 aa, Homo Sapiens
ETAATRLKG

SEQ ID NO: 1213765 - protein, 9 aa, Homo Sapiens
PSSGILVSL

SEQ ID NO: 1213766 - protein, 9 aa, Homo Sapiens
FAEKYDSDH

SEQ ID NO: 1213767 - protein, 9 aa, Homo Sapiens
LPGQVHPAP

SEQ ID NO: 1213768 - protein, 9 aa, Homo Sapiens
NVRSNPHTI

SEQ ID NO: 1213769 - protein, 9 aa, Homo Sapiens
GKKEVYDTL

SEQ ID NO: 1213770 - protein, 9 aa, Homo Sapiens
CVCILGVMW

SEQ ID NO: 1213771 - protein, 9 aa, Homo Sapiens
QMAVPCPPP

SEQ ID NO: 1213772 - protein, 9 aa, Homo Sapiens
LTYHDISMN

SEQ ID NO: 1213773 - protein, 9 aa, Homo Sapiens
PLDETQITT

SEQ ID NO: 1213774 - protein, 9 aa, Homo Sapiens
GELVIAHIL

SEQ ID NO: 1213775 - protein, 9 aa, Homo Sapiens
DVKAAFKKA

SEQ ID NO: 1213776 - protein, 9 aa, Homo Sapiens
RLRPGLGEC

SEQ ID NO: 1213777 - protein, 9 aa, Homo Sapiens
TFSKKFVLD

SEQ ID NO: 1213778 - protein, 9 aa, Homo Sapiens
VIVIDSDNE

SEQ ID NO: 1213779 - protein, 9 aa, Homo Sapiens
NLHCYPQLC

SEQ ID NO: 1213780 - protein, 9 aa, Homo Sapiens
CLRCFPQPP

SEQ ID NO: 1213781 - protein, 9 aa, Homo Sapiens
NKRIVSGVY

SEQ ID NO: 1213782 - protein, 9 aa, Homo Sapiens
KKKSINPWE

SEQ ID NO: 1213783 - protein, 9 aa, Homo Sapiens
RHLIHNYNL

SEQ ID NO: 1213784 - protein, 9 aa, Homo Sapiens
KGGKVMKIL

SEQ ID NO: 1213785 - protein, 9 aa, Homo Sapiens
VAGLMIGAG

SEQ ID NO: 1213786 - protein, 9 aa, Homo Sapiens
FDMQMVAQP

SEQ ID NO: 1213787 - protein, 9 aa, Homo Sapiens
TDIYMLNLA

SEQ ID NO: 1213788 - protein, 9 aa, Homo Sapiens
KGNPALCPN

SEQ ID NO: 1213789 - protein, 9 aa, Homo Sapiens
VVMGGKEDN

SEQ ID NO: 1213790 - protein, 9 aa, Homo Sapiens
SSSHSRSDL

SEQ ID NO: 1213791 - protein, 9 aa, Homo Sapiens
FQWRMDGSV

SEQ ID NO: 1213792 - protein, 9 aa, Homo Sapiens
LDPVTLYNQ

SEQ ID NO: 1213793 - protein, 9 aa, Homo Sapiens
QQLEMTTER

SEQ ID NO: 1213794 - protein, 9 aa, Homo Sapiens
TFCVEHNTF

SEQ ID NO: 1213795 - protein, 9 aa, Homo Sapiens
KYILVSCGE

SEQ ID NO: 1213796 - protein, 9 aa, Homo Sapiens
EYEAKVCMV

SEQ ID NO: 1213797 - protein, 9 aa, Homo Sapiens
MDYDIIKCV

SEQ ID NO: 1213798 - protein, 9 aa, Homo Sapiens
KDEDMKVME

SEQ ID NO: 1213799 - protein, 9 aa, Homo Sapiens
NWGHQSDTE

SEQ ID NO: 1213800 - protein, 9 aa, Homo Sapiens
LEEIKEAFE

SEQ ID NO: 1213801 - protein, 9 aa, Homo Sapiens
CPPPSPSVA

SEQ ID NO: 1213802 - protein, 9 aa, Homo Sapiens
GRLDFKHLD

SEQ ID NO: 1213803 - protein, 9 aa, Homo Sapiens
WPSSVLPTL

SEQ ID NO: 1213804 - protein, 9 aa, Homo Sapiens
CDKAFNCSS

SEQ ID NO: 1213805 - protein, 9 aa, Homo Sapiens
TTLPTSGSS

SEQ ID NO: 1213806 - protein, 9 aa, Homo Sapiens
PWLCRAPAA

SEQ ID NO: 1213807 - protein, 9 aa, Homo Sapiens
LEGEVIPSM

SEQ ID NO: 1213808 - protein, 9 aa, Homo Sapiens
ELDNEVNNM

SEQ ID NO: 1213809 - protein, 9 aa, Homo Sapiens
VVILKLYPC

SEQ ID NO: 1213810 - protein, 9 aa, Homo Sapiens
IVILFYSMT

SEQ ID NO: 1213811 - protein, 9 aa, Homo Sapiens
QCWRCKCYG

SEQ ID NO: 1213812 - protein, 9 aa, Homo Sapiens
PHPRPTRRG

SEQ ID NO: 1213813 - protein, 9 aa, Homo Sapiens
SCTGPSCAR

SEQ ID NO: 1213814 - protein, 9 aa, Homo Sapiens
TGDNSLGLE

SEQ ID NO: 1213815 - protein, 9 aa, Homo Sapiens
CEIAFSQKS

SEQ ID NO: 1213816 - protein, 9 aa, Homo Sapiens
EPEKLHLKE

SEQ ID NO: 1213817 - protein, 9 aa, Homo Sapiens
RLKNLPSKV

SEQ ID NO: 1213818 - protein, 9 aa, Homo Sapiens
MVCLALIGC

SEQ ID NO: 1213819 - protein, 9 aa, Homo Sapiens
MGVLLYEMI

SEQ ID NO: 1213820 - protein, 9 aa, Homo Sapiens
QVYNTGPGT

SEQ ID NO: 1213821 - protein, 9 aa, Homo Sapiens
VKISSVVLK

SEQ ID NO: 1213822 - protein, 9 aa, Homo Sapiens
TQRTLASPG

SEQ ID NO: 1213823 - protein, 9 aa, Homo Sapiens
SGAAGDSAC

SEQ ID NO: 1213824 - protein, 9 aa, Homo Sapiens
PTSKVTEQA

SEQ ID NO: 1213825 - protein, 9 aa, Homo Sapiens
TISKATEHL

SEQ ID NO: 1213826 - protein, 9 aa, Homo Sapiens
CLQGRLAAR

SEQ ID NO: 1213827 - protein, 9 aa, Homo Sapiens
AYISKIWNE

SEQ ID NO: 1213828 - protein, 9 aa, Homo Sapiens
RAQKGRYVG

SEQ ID NO: 1213829 - protein, 9 aa, Homo Sapiens
ARGGCLPLL

SEQ ID NO: 1213830 - protein, 9 aa, Homo Sapiens
DWQHTQNIM

SEQ ID NO: 1213831 - protein, 9 aa, Homo Sapiens
LSFSRDPKC

SEQ ID NO: 1213832 - protein, 9 aa, Homo Sapiens
PQILLYSST

SEQ ID NO: 1213833 - protein, 9 aa, Homo Sapiens
RRKQSQRLP

SEQ ID NO: 1213834 - protein, 9 aa, Homo Sapiens
QRPAFAANV

SEQ ID NO: 1213835 - protein, 9 aa, Homo Sapiens
EQMWKILYQ

SEQ ID NO: 1213836 - protein, 9 aa, Homo Sapiens
SPTCSKDLQ

SEQ ID NO: 1213837 - protein, 9 aa, Homo Sapiens
YSRLEHVDF

SEQ ID NO: 1213838 - protein, 9 aa, Homo Sapiens
DETQITTIL

SEQ ID NO: 1213839 - protein, 9 aa, Homo Sapiens
FDSPVAAIK

SEQ ID NO: 1213840 - protein, 9 aa, Homo Sapiens
SQGCTVPVE

SEQ ID NO: 1213841 - protein, 9 aa, Homo Sapiens
ETIQGQLTH

SEQ ID NO: 1213842 - protein, 9 aa, Homo Sapiens
EWQRSLFVV

SEQ ID NO: 1213843 - protein, 9 aa, Homo Sapiens
ENQDLNIIS

SEQ ID NO: 1213844 - protein, 9 aa, Homo Sapiens
MGRLLGDQR

SEQ ID NO: 1213845 - protein, 9 aa, Homo Sapiens
LSAMARGTD

SEQ ID NO: 1213846 - protein, 9 aa, Homo Sapiens
WQRSLFVVV

SEQ ID NO: 1213847 - protein, 9 aa, Homo Sapiens
AISGIALSF

SEQ ID NO: 1213848 - protein, 9 aa, Homo Sapiens
EWRRPPDDD

SEQ ID NO: 1213849 - protein, 9 aa, Homo Sapiens
TQRQWRMLE

SEQ ID NO: 1213850 - protein, 9 aa, Homo Sapiens
IRDILIQQG

SEQ ID NO: 1213851 - protein, 9 aa, Homo Sapiens
LPMCCTPAS

SEQ ID NO: 1213852 - protein, 9 aa, Homo Sapiens
QGHHPESMG

SEQ ID NO: 1213853 - protein, 9 aa, Homo Sapiens
TSQLMPPSM

SEQ ID NO: 1213854 - protein, 9 aa, Homo Sapiens
KCKEKMSQQ

SEQ ID NO: 1213855 - protein, 9 aa, Homo Sapiens
GLVAGIPLL

SEQ ID NO: 1213856 - protein, 9 aa, Homo Sapiens
PQTLLNGPS

SEQ ID NO: 1213857 - protein, 9 aa, Homo Sapiens
SGQHVSLQH

SEQ ID NO: 1213858 - protein, 9 aa, Homo Sapiens
ASPGTSSEL

SEQ ID NO: 1213859 - protein, 9 aa, Homo Sapiens
AELESEARI

SEQ ID NO: 1213860 - protein, 9 aa, Homo Sapiens
SLNQGISLL

SEQ ID NO: 1213861 - protein, 9 aa, Homo Sapiens
PREGLMVKR

SEQ ID NO: 1213862 - protein, 9 aa, Homo Sapiens
VIPLLLELQ

SEQ ID NO: 1213863 - protein, 9 aa, Homo Sapiens
FEGDTHCLR

SEQ ID NO: 1213864 - protein, 9 aa, Homo Sapiens
NIATSQRDL

SEQ ID NO: 1213865 - protein, 9 aa, Homo Sapiens
SPCKECGPK

SEQ ID NO: 1213866 - protein, 9 aa, Homo Sapiens
RFQYANARD

SEQ ID NO: 1213867 - protein, 9 aa, Homo Sapiens
RGEGTHDEE

SEQ ID NO: 1213868 - protein, 9 aa, Homo Sapiens
LPAQGHRLG

SEQ ID NO: 1213869 - protein, 9 aa, Homo Sapiens
NPTPIVQRM

SEQ ID NO: 1213870 - protein, 9 aa, Homo Sapiens
VSTYSFMPT

SEQ ID NO: 1213871 - protein, 9 aa, Homo Sapiens
DQQLWGAGQ

SEQ ID NO: 1213872 - protein, 9 aa, Homo Sapiens
LKAILQFQK

SEQ ID NO: 1213873 - protein, 9 aa, Homo Sapiens
TYKKEMASF

SEQ ID NO: 1213874 - protein, 9 aa, Homo Sapiens
SGPGNVLHC

SEQ ID NO: 1213875 - protein, 9 aa, Homo Sapiens
GIVCSPTPF

SEQ ID NO: 1213876 - protein, 9 aa, Homo Sapiens
EFQVVKVGA

SEQ ID NO: 1213877 - protein, 9 aa, Homo Sapiens
NKYNVMLVR

SEQ ID NO: 1213878 - protein, 9 aa, Homo Sapiens
ICAMKALQK

SEQ ID NO: 1213879 - protein, 9 aa, Homo Sapiens
CVFRPETVA

SEQ ID NO: 1213880 - protein, 9 aa, Homo Sapiens
GVKGTYRLV

SEQ ID NO: 1213881 - protein, 9 aa, Homo Sapiens
FFVCSFMEP

SEQ ID NO: 1213882 - protein, 9 aa, Homo Sapiens
ILIVEGLLM

SEQ ID NO: 1213883 - protein, 9 aa, Homo Sapiens
YMRMSTCTI

SEQ ID NO: 1213884 - protein, 9 aa, Homo Sapiens
LRQKNDGIY

SEQ ID NO: 1213885 - protein, 9 aa, Homo Sapiens
ESAALGATG

SEQ ID NO: 1213886 - protein, 9 aa, Homo Sapiens
SQPMGPRII

SEQ ID NO: 1213887 - protein, 9 aa, Homo Sapiens
ETMKVSEKI

SEQ ID NO: 1213888 - protein, 9 aa, Homo Sapiens
ERTPPIMRI

SEQ ID NO: 1213889 - protein, 9 aa, Homo Sapiens
PLKEMGKEE

SEQ ID NO: 1213890 - protein, 9 aa, Homo Sapiens
PSAPVPLAE

SEQ ID NO: 1213891 - protein, 9 aa, Homo Sapiens
QCYCTDTGV

SEQ ID NO: 1213892 - protein, 9 aa, Homo Sapiens
CAGAWGLLP

SEQ ID NO: 1213893 - protein, 9 aa, Homo Sapiens
RAAIHYRIL

SEQ ID NO: 1213894 - protein, 9 aa, Homo Sapiens
WVLSAAERQ

SEQ ID NO: 1213895 - protein, 9 aa, Homo Sapiens
LTLLNPMKP

SEQ ID NO: 1213896 - protein, 9 aa, Homo Sapiens
NYVRSLRMD

SEQ ID NO: 1213897 - protein, 9 aa, Homo Sapiens
EFHCQEQTD

SEQ ID NO: 1213898 - protein, 9 aa, Homo Sapiens
DRHQVPRAE

SEQ ID NO: 1213899 - protein, 9 aa, Homo Sapiens
NKRFTQKRS

SEQ ID NO: 1213900 - protein, 9 aa, Homo Sapiens
RIEYDAYHT

SEQ ID NO: 1213901 - protein, 9 aa, Homo Sapiens
EEDRVSTLT

SEQ ID NO: 1213902 - protein, 9 aa, Homo Sapiens
SWFKDVMTK

SEQ ID NO: 1213903 - protein, 9 aa, Homo Sapiens
KRKKNPRKR

SEQ ID NO: 1213904 - protein, 9 aa, Homo Sapiens
VGDTVHFIQ

SEQ ID NO: 1213905 - protein, 9 aa, Homo Sapiens
SKKGRCKVF

SEQ ID NO: 1213906 - protein, 9 aa, Homo Sapiens
TDRILYRSR

SEQ ID NO: 1213907 - protein, 9 aa, Homo Sapiens
IPSECHGFE

SEQ ID NO: 1213908 - protein, 9 aa, Homo Sapiens
TQKRSFRTS

SEQ ID NO: 1213909 - protein, 9 aa, Homo Sapiens
TFKDVAINF

SEQ ID NO: 1213910 - protein, 9 aa, Homo Sapiens
ECLDDFKGN

SEQ ID NO: 1213911 - protein, 9 aa, Homo Sapiens
EFVADRLIL

SEQ ID NO: 1213912 - protein, 9 aa, Homo Sapiens
YASIKADST

SEQ ID NO: 1213913 - protein, 9 aa, Homo Sapiens
VLQDLEELA

SEQ ID NO: 1213914 - protein, 9 aa, Homo Sapiens
QMSLSRQCS

SEQ ID NO: 1213915 - protein, 9 aa, Homo Sapiens
FFPRRFVLV

SEQ ID NO: 1213916 - protein, 9 aa, Homo Sapiens
VNIPGPEKM

SEQ ID NO: 1213917 - protein, 9 aa, Homo Sapiens
HVELNVKQG

SEQ ID NO: 1213918 - protein, 9 aa, Homo Sapiens
IPYLTTYRQ

SEQ ID NO: 1213919 - protein, 9 aa, Homo Sapiens
MKLTLAVLP

SEQ ID NO: 1213920 - protein, 9 aa, Homo Sapiens
HITGFTLQF

SEQ ID NO: 1213921 - protein, 9 aa, Homo Sapiens
VEAGGGWEG

SEQ ID NO: 1213922 - protein, 9 aa, Homo Sapiens
VEEAEEGHA

SEQ ID NO: 1213923 - protein, 9 aa, Homo Sapiens
HIEMGHLIT

SEQ ID NO: 1213924 - protein, 9 aa, Homo Sapiens
RFIMPTLFD

SEQ ID NO: 1213925 - protein, 9 aa, Homo Sapiens
ILSQTEVIT

SEQ ID NO: 1213926 - protein, 9 aa, Homo Sapiens
RLGRRSKRP

SEQ ID NO: 1213927 - protein, 9 aa, Homo Sapiens
VIPLDHDNK

SEQ ID NO: 1213928 - protein, 9 aa, Homo Sapiens
TAPEMLIYF

SEQ ID NO: 1213929 - protein, 9 aa, Homo Sapiens
RSREPPGGD

SEQ ID NO: 1213930 - protein, 9 aa, Homo Sapiens
FPTLSWSPP

SEQ ID NO: 1213931 - protein, 9 aa, Homo Sapiens
QEEKYTDVE

SEQ ID NO: 1213932 - protein, 9 aa, Homo Sapiens
NGSSTENPK

SEQ ID NO: 1213933 - protein, 9 aa, Homo Sapiens
SPAGQSNLK

SEQ ID NO: 1213934 - protein, 9 aa, Homo Sapiens
ESTVSTVGI

SEQ ID NO: 1213935 - protein, 9 aa, Homo Sapiens
ACVHDSTMH

SEQ ID NO: 1213936 - protein, 9 aa, Homo Sapiens
RPLLEFALH

SEQ ID NO: 1213937 - protein, 9 aa, Homo Sapiens
EAKRFEITR

SEQ ID NO: 1213938 - protein, 9 aa, Homo Sapiens
LRPGCFDRQ

SEQ ID NO: 1213939 - protein, 9 aa, Homo Sapiens
PDGRYYNEA

SEQ ID NO: 1213940 - protein, 9 aa, Homo Sapiens
GKHVPKSGV

SEQ ID NO: 1213941 - protein, 9 aa, Homo Sapiens
ETSILSKQV

SEQ ID NO: 1213942 - protein, 9 aa, Homo Sapiens
SDIETVKAG

SEQ ID NO: 1213943 - protein, 9 aa, Homo Sapiens
CRTIQGRTF

SEQ ID NO: 1213944 - protein, 9 aa, Homo Sapiens
RGVVVDMIP

SEQ ID NO: 1213945 - protein, 9 aa, Homo Sapiens
TFKLTRRVA

SEQ ID NO: 1213946 - protein, 9 aa, Homo Sapiens
QRPIFCPVH

SEQ ID NO: 1213947 - protein, 9 aa, Homo Sapiens
EHMAYIWDY

SEQ ID NO: 1213948 - protein, 9 aa, Homo Sapiens
VQVNSIEFD

SEQ ID NO: 1213949 - protein, 9 aa, Homo Sapiens
EVPSDQKQH

SEQ ID NO: 1213950 - protein, 9 aa, Homo Sapiens
ISKIWNEAV

SEQ ID NO: 1213951 - protein, 9 aa, Homo Sapiens
AEQQLATLE

SEQ ID NO: 1213952 - protein, 9 aa, Homo Sapiens
PHLQKVLFV

SEQ ID NO: 1213953 - protein, 9 aa, Homo Sapiens
RCSAAATTS

SEQ ID NO: 1213954 - protein, 9 aa, Homo Sapiens
HKHLSKKSQ

SEQ ID NO: 1213955 - protein, 9 aa, Homo Sapiens
WGMYEGQQP

SEQ ID NO: 1213956 - protein, 9 aa, Homo Sapiens
EAEQEQMWK

SEQ ID NO: 1213957 - protein, 9 aa, Homo Sapiens
MKTTNLEET

SEQ ID NO: 1213958 - protein, 9 aa, Homo Sapiens
PLWLMTAMW

SEQ ID NO: 1213959 - protein, 9 aa, Homo Sapiens
ARSKHWPAV

SEQ ID NO: 1213960 - protein, 9 aa, Homo Sapiens
ELLVKEQGT

SEQ ID NO: 1213961 - protein, 9 aa, Homo Sapiens
GKGQGWWEF

SEQ ID NO: 1213962 - protein, 9 aa, Homo Sapiens
FPTKVTFVG

SEQ ID NO: 1213963 - protein, 9 aa, Homo Sapiens
EPYFLYLET

SEQ ID NO: 1213964 - protein, 9 aa, Homo Sapiens
NSSVNHIIY

SEQ ID NO: 1213965 - protein, 9 aa, Homo Sapiens
RPLDRAISC

SEQ ID NO: 1213966 - protein, 9 aa, Homo Sapiens
GVLEEQCHW

SEQ ID NO: 1213967 - protein, 9 aa, Homo Sapiens
CQIVNNLSP

SEQ ID NO: 1213968 - protein, 9 aa, Homo Sapiens
QNKGKISEC

SEQ ID NO: 1213969 - protein, 9 aa, Homo Sapiens
LNDNRLTRA

SEQ ID NO: 1213970 - protein, 9 aa, Homo Sapiens
SKKSNWIQE

SEQ ID NO: 1213971 - protein, 9 aa, Homo Sapiens
LVAASWVIC

SEQ ID NO: 1213972 - protein, 9 aa, Homo Sapiens
KTWHSAEQF

SEQ ID NO: 1213973 - protein, 9 aa, Homo Sapiens
RDNLEYSAM

SEQ ID NO: 1213974 - protein, 9 aa, Homo Sapiens
VKAEKKLLV

SEQ ID NO: 1213975 - protein, 9 aa, Homo Sapiens
PAHYTTPED

SEQ ID NO: 1213976 - protein, 9 aa, Homo Sapiens
YRLGIWVLV

SEQ ID NO: 1213977 - protein, 9 aa, Homo Sapiens
QGGEETQCY

SEQ ID NO: 1213978 - protein, 9 aa, Homo Sapiens
SCGKHVEDF

SEQ ID NO: 1213979 - protein, 9 aa, Homo Sapiens
FNMGHITLA

SEQ ID NO: 1213980 - protein, 9 aa, Homo Sapiens
KKDKLHLLG

SEQ ID NO: 1213981 - protein, 9 aa, Homo Sapiens
TPPAHSSAF

SEQ ID NO: 1213982 - protein, 9 aa, Homo Sapiens
LCRAPAASQ

SEQ ID NO: 1213983 - protein, 9 aa, Homo Sapiens
DTADDTAHH

SEQ ID NO: 1213984 - protein, 9 aa, Homo Sapiens
DIYKQFDTD

SEQ ID NO: 1213985 - protein, 9 aa, Homo Sapiens
GRLFVTVKP

SEQ ID NO: 1213986 - protein, 9 aa, Homo Sapiens
DYVCAMREM

SEQ ID NO: 1213987 - protein, 9 aa, Homo Sapiens
NGKGNEPST

SEQ ID NO: 1213988 - protein, 9 aa, Homo Sapiens
SLYTVGTKP

SEQ ID NO: 1213989 - protein, 9 aa, Homo Sapiens
VNDDSIRII

SEQ ID NO: 1213990 - protein, 9 aa, Homo Sapiens
AISQKIFLW

SEQ ID NO: 1213991 - protein, 9 aa, Homo Sapiens
AEPCQSSVS

SEQ ID NO: 1213992 - protein, 9 aa, Homo Sapiens
MTVIVNSMD

SEQ ID NO: 1213993 - protein, 9 aa, Homo Sapiens
TDDIVEKIL

SEQ ID NO: 1213994 - protein, 9 aa, Homo Sapiens
ERHFHPVAA

SEQ ID NO: 1213995 - protein, 9 aa, Homo Sapiens
MSVQAEEQK

SEQ ID NO: 1213996 - protein, 9 aa, Homo Sapiens
NDYSDCKNL

SEQ ID NO: 1213997 - protein, 9 aa, Homo Sapiens
VHIINRKVE

SEQ ID NO: 1213998 - protein, 9 aa, Homo Sapiens
HFAEWCHAH

SEQ ID NO: 1213999 - protein, 9 aa, Homo Sapiens
HIYVSLESV

SEQ ID NO: 1214000 - protein, 9 aa, Homo Sapiens
YPEGVHKEY

SEQ ID NO: 1214001 - protein, 9 aa, Homo Sapiens
SFLTQWKDS

SEQ ID NO: 1214002 - protein, 9 aa, Homo Sapiens
RGHARESEM

SEQ ID NO: 1214003 - protein, 9 aa, Homo Sapiens
ASRRLGPGG

SEQ ID NO: 1214004 - protein, 9 aa, Homo Sapiens
ENIQGGCSA

SEQ ID NO: 1214005 - protein, 9 aa, Homo Sapiens
TIGIKRAWD

SEQ ID NO: 1214006 - protein, 9 aa, Homo Sapiens
PPAAEEGPV

SEQ ID NO: 1214007 - protein, 9 aa, Homo Sapiens
VVGPVAEAK

SEQ ID NO: 1214008 - protein, 9 aa, Homo Sapiens
EGTIREEHE

SEQ ID NO: 1214009 - protein, 9 aa, Homo Sapiens
GRLTQARGA

SEQ ID NO: 1214010 - protein, 9 aa, Homo Sapiens
ASLGSTPYI

SEQ ID NO: 1214011 - protein, 9 aa, Homo Sapiens
SMILFFKGI

SEQ ID NO: 1214012 - protein, 9 aa, Homo Sapiens
QLRPQAKAV

SEQ ID NO: 1214013 - protein, 9 aa, Homo Sapiens
IAMTMDQYP

SEQ ID NO: 1214014 - protein, 9 aa, Homo Sapiens
NRHWHWSSG

SEQ ID NO: 1214015 - protein, 9 aa, Homo Sapiens
QECTDSTGI

SEQ ID NO: 1214016 - protein, 9 aa, Homo Sapiens
AAPLTLKSS

SEQ ID NO: 1214017 - protein, 9 aa, Homo Sapiens
TTTGVSIIM

SEQ ID NO: 1214018 - protein, 9 aa, Homo Sapiens
ILVGPICLV

SEQ ID NO: 1214019 - protein, 9 aa, Homo Sapiens
EGAHYLMQA

SEQ ID NO: 1214020 - protein, 9 aa, Homo Sapiens
GRSFYQFVH

SEQ ID NO: 1214021 - protein, 9 aa, Homo Sapiens
LYAIKMTVS

SEQ ID NO: 1214022 - protein, 9 aa, Homo Sapiens
ETSTEAATH

SEQ ID NO: 1214023 - protein, 9 aa, Homo Sapiens
TWTAAAMYQ

SEQ ID NO: 1214024 - protein, 9 aa, Homo Sapiens
KMLFLAVLN

SEQ ID NO: 1214025 - protein, 9 aa, Homo Sapiens
KKLVVAASP

SEQ ID NO: 1214026 - protein, 9 aa, Homo Sapiens
LGFYLPLES

SEQ ID NO: 1214027 - protein, 9 aa, Homo Sapiens
DRHMEFLVE

SEQ ID NO: 1214028 - protein, 9 aa, Homo Sapiens
FLILMDMAF

SEQ ID NO: 1214029 - protein, 9 aa, Homo Sapiens
RTVTVTSRF

SEQ ID NO: 1214030 - protein, 9 aa, Homo Sapiens
LVWSKVGPY

SEQ ID NO: 1214031 - protein, 9 aa, Homo Sapiens
KNQPQATGE

SEQ ID NO: 1214032 - protein, 9 aa, Homo Sapiens
LRGSAGHWI

SEQ ID NO: 1214033 - protein, 9 aa, Homo Sapiens
GNTVNMASR

SEQ ID NO: 1214034 - protein, 9 aa, Homo Sapiens
CLEENNQFQ

SEQ ID NO: 1214035 - protein, 9 aa, Homo Sapiens
KLREFVLVK

SEQ ID NO: 1214036 - protein, 9 aa, Homo Sapiens
IMDSDLLRL

SEQ ID NO: 1214037 - protein, 9 aa, Homo Sapiens
DVLDEAEST

SEQ ID NO: 1214038 - protein, 9 aa, Homo Sapiens
GRIWPDELG

SEQ ID NO: 1214039 - protein, 9 aa, Homo Sapiens
DVPVPPPVD

SEQ ID NO: 1214040 - protein, 9 aa, Homo Sapiens
PQLQVILLS

SEQ ID NO: 1214041 - protein, 9 aa, Homo Sapiens
PTSFIKILW

SEQ ID NO: 1214042 - protein, 9 aa, Homo Sapiens
AILKVEDFE

SEQ ID NO: 1214043 - protein, 9 aa, Homo Sapiens
SSSLTPHFS

SEQ ID NO: 1214044 - protein, 9 aa, Homo Sapiens
LLTFIKCAY

SEQ ID NO: 1214045 - protein, 9 aa, Homo Sapiens
IPAQHAPQP

SEQ ID NO: 1214046 - protein, 9 aa, Homo Sapiens
IIVSISSQY

SEQ ID NO: 1214047 - protein, 9 aa, Homo Sapiens
LCSTCSRAC

SEQ ID NO: 1214048 - protein, 9 aa, Homo Sapiens
QQQHPNDKT

SEQ ID NO: 1214049 - protein, 9 aa, Homo Sapiens
TSKTERIND

SEQ ID NO: 1214050 - protein, 9 aa, Homo Sapiens
EIDPVTSSG

SEQ ID NO: 1214051 - protein, 9 aa, Homo Sapiens
IIHCGKCYE

SEQ ID NO: 1214052 - protein, 9 aa, Homo Sapiens
LQTATSTCF

SEQ ID NO: 1214053 - protein, 9 aa, Homo Sapiens
QHIHVYENG

SEQ ID NO: 1214054 - protein, 9 aa, Homo Sapiens
DLVDTNLHD

SEQ ID NO: 1214055 - protein, 9 aa, Homo Sapiens
QALMLPPWL

SEQ ID NO: 1214056 - protein, 9 aa, Homo Sapiens
KMNYENSHS

SEQ ID NO: 1214057 - protein, 9 aa, Homo Sapiens
QSKYTVNAF

SEQ ID NO: 1214058 - protein, 9 aa, Homo Sapiens
EIKPSFFVL

SEQ ID NO: 1214059 - protein, 9 aa, Homo Sapiens
YRYPVPGYC

SEQ ID NO: 1214060 - protein, 9 aa, Homo Sapiens
ITWSLYYLF

SEQ ID NO: 1214061 - protein, 9 aa, Homo Sapiens
MQTLTKGEL

SEQ ID NO: 1214062 - protein, 9 aa, Homo Sapiens
VPRGRLFTF

SEQ ID NO: 1214063 - protein, 9 aa, Homo Sapiens
DLDPHRVRG

SEQ ID NO: 1214064 - protein, 9 aa, Homo Sapiens
KECGPKPEH

SEQ ID NO: 1214065 - protein, 9 aa, Homo Sapiens
YGYRLHRKW

SEQ ID NO: 1214066 - protein, 9 aa, Homo Sapiens
KRGNHITGL

SEQ ID NO: 1214067 - protein, 9 aa, Homo Sapiens
PIISAPDSG

SEQ ID NO: 1214068 - protein, 9 aa, Homo Sapiens
RLPNKIHMH

SEQ ID NO: 1214069 - protein, 9 aa, Homo Sapiens
VGPMNHDEL

SEQ ID NO: 1214070 - protein, 9 aa, Homo Sapiens
PLEDKLEHK

SEQ ID NO: 1214071 - protein, 9 aa, Homo Sapiens
QNCLNLQVT

SEQ ID NO: 1214072 - protein, 9 aa, Homo Sapiens
ENLGAANGQ

SEQ ID NO: 1214073 - protein, 9 aa, Homo Sapiens
EAFNSCRYD

SEQ ID NO: 1214074 - protein, 9 aa, Homo Sapiens
AAGQREVRP

SEQ ID NO: 1214075 - protein, 9 aa, Homo Sapiens
FYQVFHLNT

SEQ ID NO: 1214076 - protein, 9 aa, Homo Sapiens
QCQTLRKMV

SEQ ID NO: 1214077 - protein, 9 aa, Homo Sapiens
VRGCHRYLC

SEQ ID NO: 1214078 - protein, 9 aa, Homo Sapiens
FCAEGHKCG

SEQ ID NO: 1214079 - protein, 9 aa, Homo Sapiens
RCRKQGAGS

SEQ ID NO: 1214080 - protein, 9 aa, Homo Sapiens
HPRSPFNLV

SEQ ID NO: 1214081 - protein, 9 aa, Homo Sapiens
SKEEWETMK

SEQ ID NO: 1214082 - protein, 9 aa, Homo Sapiens
QMLLTDMWI

SEQ ID NO: 1214083 - protein, 9 aa, Homo Sapiens
EQFFSMFGE

SEQ ID NO: 1214084 - protein, 9 aa, Homo Sapiens
RIKVFEGRT

SEQ ID NO: 1214085 - protein, 9 aa, Homo Sapiens
STCLDGAKL

SEQ ID NO: 1214086 - protein, 9 aa, Homo Sapiens
FKDSLIVPV

SEQ ID NO: 1214087 - protein, 9 aa, Homo Sapiens
AAVFPHGSG

SEQ ID NO: 1214088 - protein, 9 aa, Homo Sapiens
LSYPSDDMA

SEQ ID NO: 1214089 - protein, 9 aa, Homo Sapiens
RYLNSILPV

SEQ ID NO: 1214090 - protein, 9 aa, Homo Sapiens
TQYHISLQF

SEQ ID NO: 1214091 - protein, 9 aa, Homo Sapiens
QSIIWSWDQ

SEQ ID NO: 1214092 - protein, 9 aa, Homo Sapiens
ALISKFPEL

SEQ ID NO: 1214093 - protein, 9 aa, Homo Sapiens
GREEILRIS

SEQ ID NO: 1214094 - protein, 9 aa, Homo Sapiens
VRCNPQKTV

SEQ ID NO: 1214095 - protein, 9 aa, Homo Sapiens
SSKTTAAHY

SEQ ID NO: 1214096 - protein, 9 aa, Homo Sapiens
ACGTMECFP

SEQ ID NO: 1214097 - protein, 9 aa, Homo Sapiens
GHKCGENSE

SEQ ID NO: 1214098 - protein, 9 aa, Homo Sapiens
LPRRSCCSR

SEQ ID NO: 1214099 - protein, 9 aa, Homo Sapiens
ACPQHTCPE

SEQ ID NO: 1214100 - protein, 9 aa, Homo Sapiens
SFQKVKTGS

SEQ ID NO: 1214101 - protein, 9 aa, Homo Sapiens
DQYVDYLVK

SEQ ID NO: 1214102 - protein, 9 aa, Homo Sapiens
LGCTQKTAV

SEQ ID NO: 1214103 - protein, 9 aa, Homo Sapiens
PPSGNGSQK

SEQ ID NO: 1214104 - protein, 9 aa, Homo Sapiens
KGTMETMPL

SEQ ID NO: 1214105 - protein, 9 aa, Homo Sapiens
SSETAGSLS

SEQ ID NO: 1214106 - protein, 9 aa, Homo Sapiens
HTGLGELLR

SEQ ID NO: 1214107 - protein, 9 aa, Homo Sapiens
QKHFLSRDY

SEQ ID NO: 1214108 - protein, 9 aa, Homo Sapiens
MYMSEAGEE

SEQ ID NO: 1214109 - protein, 9 aa, Homo Sapiens
RKVAVQPEL

SEQ ID NO: 1214110 - protein, 9 aa, Homo Sapiens
PEYDAITAL

SEQ ID NO: 1214111 - protein, 9 aa, Homo Sapiens
ATDGGFMSL

SEQ ID NO: 1214112 - protein, 9 aa, Homo Sapiens
PDIHKLGFT

SEQ ID NO: 1214113 - protein, 9 aa, Homo Sapiens
KFDMDELNF

SEQ ID NO: 1214114 - protein, 9 aa, Homo Sapiens
RTKIFKHTA

SEQ ID NO: 1214115 - protein, 9 aa, Homo Sapiens
PGLYMAQTC

SEQ ID NO: 1214116 - protein, 9 aa, Homo Sapiens
METTAQRVP

SEQ ID NO: 1214117 - protein, 9 aa, Homo Sapiens
GLSWRSDPI

SEQ ID NO: 1214118 - protein, 9 aa, Homo Sapiens
SEMADEKFC

SEQ ID NO: 1214119 - protein, 9 aa, Homo Sapiens
WGGPRKADG

SEQ ID NO: 1214120 - protein, 9 aa, Homo Sapiens
MSPLHKRCQ

SEQ ID NO: 1214121 - protein, 9 aa, Homo Sapiens
RDHSLIKPY

SEQ ID NO: 1214122 - protein, 9 aa, Homo Sapiens
EFTDQLPDC

SEQ ID NO: 1214123 - protein, 9 aa, Homo Sapiens
GELAKGIRK

SEQ ID NO: 1214124 - protein, 9 aa, Homo Sapiens
LRNLSMDPT

SEQ ID NO: 1214125 - protein, 9 aa, Homo Sapiens
GHAPPLAAN

SEQ ID NO: 1214126 - protein, 9 aa, Homo Sapiens
EGSLSDEQD

SEQ ID NO: 1214127 - protein, 9 aa, Homo Sapiens
VPAKMYPAN

SEQ ID NO: 1214128 - protein, 9 aa, Homo Sapiens
LVLSVETDY

SEQ ID NO: 1214129 - protein, 9 aa, Homo Sapiens
QNNIPQLNN

SEQ ID NO: 1214130 - protein, 9 aa, Homo Sapiens
CLLILDYHN

SEQ ID NO: 1214131 - protein, 9 aa, Homo Sapiens
KGQMKDIYH

SEQ ID NO: 1214132 - protein, 9 aa, Homo Sapiens
LAMCIVGHL

SEQ ID NO: 1214133 - protein, 9 aa, Homo Sapiens
APVSSTSPV

SEQ ID NO: 1214134 - protein, 9 aa, Homo Sapiens
DISFLKSCH

SEQ ID NO: 1214135 - protein, 9 aa, Homo Sapiens
MLPTRPDLK

SEQ ID NO: 1214136 - protein, 9 aa, Homo Sapiens
ALQHWPVLQ

SEQ ID NO: 1214137 - protein, 9 aa, Homo Sapiens
RKQDTWQTA

SEQ ID NO: 1214138 - protein, 9 aa, Homo Sapiens
AEDICRRSL

SEQ ID NO: 1214139 - protein, 9 aa, Homo Sapiens
RDQDREGTG

SEQ ID NO: 1214140 - protein, 9 aa, Homo Sapiens
RPKALKLLV

SEQ ID NO: 1214141 - protein, 9 aa, Homo Sapiens
WLCRAPAAS

SEQ ID NO: 1214142 - protein, 9 aa, Homo Sapiens
FPCCLLVQR

SEQ ID NO: 1214143 - protein, 9 aa, Homo Sapiens
TRIKLIYNL

SEQ ID NO: 1214144 - protein, 9 aa, Homo Sapiens
KRVFRELKV

SEQ ID NO: 1214145 - protein, 9 aa, Homo Sapiens
LELFGDMYT

SEQ ID NO: 1214146 - protein, 9 aa, Homo Sapiens
TQIDQQHPR

SEQ ID NO: 1214147 - protein, 9 aa, Homo Sapiens
AVKLLQKCI

SEQ ID NO: 1214148 - protein, 9 aa, Homo Sapiens
TSSYQQSTS

SEQ ID NO: 1214149 - protein, 9 aa, Homo Sapiens
FTVGALLAS

SEQ ID NO: 1214150 - protein, 9 aa, Homo Sapiens
DGQQVLTVH

SEQ ID NO: 1214151 - protein, 9 aa, Homo Sapiens
QVTAGHHGD

SEQ ID NO: 1214152 - protein, 9 aa, Homo Sapiens
MTLLFLDTT

SEQ ID NO: 1214153 - protein, 9 aa, Homo Sapiens
PVEEHWTLK

SEQ ID NO: 1214154 - protein, 9 aa, Homo Sapiens
AQDQEARCR

SEQ ID NO: 1214155 - protein, 9 aa, Homo Sapiens
SLITLTFQD

SEQ ID NO: 1214156 - protein, 9 aa, Homo Sapiens
MLVDVATDG

SEQ ID NO: 1214157 - protein, 9 aa, Homo Sapiens
ARDGLCTLC

SEQ ID NO: 1214158 - protein, 9 aa, Homo Sapiens
RAAELLVKE

SEQ ID NO: 1214159 - protein, 9 aa, Homo Sapiens
ESAESDTMK

SEQ ID NO: 1214160 - protein, 9 aa, Homo Sapiens
IRLQNNQCY

SEQ ID NO: 1214161 - protein, 9 aa, Homo Sapiens
NTPFDRIAE

SEQ ID NO: 1214162 - protein, 9 aa, Homo Sapiens
QQHFVLRFR

SEQ ID NO: 1214163 - protein, 9 aa, Homo Sapiens
KDIPKMNQE

SEQ ID NO: 1214164 - protein, 9 aa, Homo Sapiens
SPSSVRGSA

SEQ ID NO: 1214165 - protein, 9 aa, Homo Sapiens
LHQVFPLTM

SEQ ID NO: 1214166 - protein, 9 aa, Homo Sapiens
MTFAGFVSE

SEQ ID NO: 1214167 - protein, 9 aa, Homo Sapiens
HPCANGITC

SEQ ID NO: 1214168 - protein, 9 aa, Homo Sapiens
TSYWESTDV

SEQ ID NO: 1214169 - protein, 9 aa, Homo Sapiens
QATVSRAFN

SEQ ID NO: 1214170 - protein, 9 aa, Homo Sapiens
AGKPKTIAG

SEQ ID NO: 1214171 - protein, 9 aa, Homo Sapiens
LHLEPLVLQ

SEQ ID NO: 1214172 - protein, 9 aa, Homo Sapiens
PILIKVKVK

SEQ ID NO: 1214173 - protein, 9 aa, Homo Sapiens
DAHQQRFAH

SEQ ID NO: 1214174 - protein, 9 aa, Homo Sapiens
IQTVPTFMP

SEQ ID NO: 1214175 - protein, 9 aa, Homo Sapiens
HWVLGLLSL

SEQ ID NO: 1214176 - protein, 9 aa, Homo Sapiens
LYAYSGLLS

SEQ ID NO: 1214177 - protein, 9 aa, Homo Sapiens
ITPDNMCMG

SEQ ID NO: 1214178 - protein, 9 aa, Homo Sapiens
GGIGGILWY

SEQ ID NO: 1214179 - protein, 9 aa, Homo Sapiens
MKVTVESSV

SEQ ID NO: 1214180 - protein, 9 aa, Homo Sapiens
EEGYDGKEP

SEQ ID NO: 1214181 - protein, 9 aa, Homo Sapiens
SSGRLAKNL

SEQ ID NO: 1214182 - protein, 9 aa, Homo Sapiens
TQDLNNELR

SEQ ID NO: 1214183 - protein, 9 aa, Homo Sapiens
RSALGDLTG

SEQ ID NO: 1214184 - protein, 9 aa, Homo Sapiens
ALVTSEAKV

SEQ ID NO: 1214185 - protein, 9 aa, Homo Sapiens
AHLRLRLDG

SEQ ID NO: 1214186 - protein, 9 aa, Homo Sapiens
PTLLCAGWW

SEQ ID NO: 1214187 - protein, 9 aa, Homo Sapiens
SLIVPVTFD

SEQ ID NO: 1214188 - protein, 9 aa, Homo Sapiens
SPIPTCLAS

SEQ ID NO: 1214189 - protein, 9 aa, Homo Sapiens
IDYEAIVKR

SEQ ID NO: 1214190 - protein, 9 aa, Homo Sapiens
ETLQEFNGN

SEQ ID NO: 1214191 - protein, 9 aa, Homo Sapiens
QPFEEGLRH

SEQ ID NO: 1214192 - protein, 9 aa, Homo Sapiens
ANLKKHMCL

SEQ ID NO: 1214193 - protein, 9 aa, Homo Sapiens
TVSPREPTS

SEQ ID NO: 1214194 - protein, 9 aa, Homo Sapiens
LTTSAETSL

SEQ ID NO: 1214195 - protein, 9 aa, Homo Sapiens
QVWCPSRCL

SEQ ID NO: 1214196 - protein, 9 aa, Homo Sapiens
AREDRLQEY

SEQ ID NO: 1214197 - protein, 9 aa, Homo Sapiens
VYTIKWHKW

SEQ ID NO: 1214198 - protein, 9 aa, Homo Sapiens
VQKVLCAEF

SEQ ID NO: 1214199 - protein, 9 aa, Homo Sapiens
WFCPKCVNK

SEQ ID NO: 1214200 - protein, 9 aa, Homo Sapiens
EHVYIEMVG

SEQ ID NO: 1214201 - protein, 9 aa, Homo Sapiens
QEFLPKTIS

SEQ ID NO: 1214202 - protein, 9 aa, Homo Sapiens
GTWRHRRSI

SEQ ID NO: 1214203 - protein, 9 aa, Homo Sapiens
MTEVPPGPS

SEQ ID NO: 1214204 - protein, 9 aa, Homo Sapiens
LNAPVKYEE

SEQ ID NO: 1214205 - protein, 9 aa, Homo Sapiens
AELLVFLTH

SEQ ID NO: 1214206 - protein, 9 aa, Homo Sapiens
TFDDIAVYF

SEQ ID NO: 1214207 - protein, 9 aa, Homo Sapiens
TVTFALDNA

SEQ ID NO: 1214208 - protein, 9 aa, Homo Sapiens
EVHQGPRGS

SEQ ID NO: 1214209 - protein, 9 aa, Homo Sapiens
PEPGSTCLL

SEQ ID NO: 1214210 - protein, 9 aa, Homo Sapiens
ADEEVQLHV

SEQ ID NO: 1214211 - protein, 9 aa, Homo Sapiens
QKTQTQLLQ

SEQ ID NO: 1214212 - protein, 9 aa, Homo Sapiens
PHLAVPPHG

SEQ ID NO: 1214213 - protein, 9 aa, Homo Sapiens
VAVLRGAVR

SEQ ID NO: 1214214 - protein, 9 aa, Homo Sapiens
NEYKSDSGK

SEQ ID NO: 1214215 - protein, 9 aa, Homo Sapiens
EPFVFASMR

SEQ ID NO: 1214216 - protein, 9 aa, Homo Sapiens
TYGVSAFFS

SEQ ID NO: 1214217 - protein, 9 aa, Homo Sapiens
LQDEVTKMN

SEQ ID NO: 1214218 - protein, 9 aa, Homo Sapiens
IVNNLSPEV

SEQ ID NO: 1214219 - protein, 9 aa, Homo Sapiens
CHSLDFQAT

SEQ ID NO: 1214220 - protein, 9 aa, Homo Sapiens
KNSKSHKHL

SEQ ID NO: 1214221 - protein, 9 aa, Homo Sapiens
LGITQASCQ

SEQ ID NO: 1214222 - protein, 9 aa, Homo Sapiens
WTAHIFPVC

SEQ ID NO: 1214223 - protein, 9 aa, Homo Sapiens
KLQGECVRG

SEQ ID NO: 1214224 - protein, 9 aa, Homo Sapiens
TLLNGPSSA

SEQ ID NO: 1214225 - protein, 9 aa, Homo Sapiens
IMSDPDSSI

SEQ ID NO: 1214226 - protein, 9 aa, Homo Sapiens
PRNTPSGPV

SEQ ID NO: 1214227 - protein, 9 aa, Homo Sapiens
EYNNGPDGC

SEQ ID NO: 1214228 - protein, 9 aa, Homo Sapiens
LWTWMTCTS

SEQ ID NO: 1214229 - protein, 9 aa, Homo Sapiens
LLRHPPQAP

SEQ ID NO: 1214230 - protein, 9 aa, Homo Sapiens
KQEVHRHTN

SEQ ID NO: 1214231 - protein, 9 aa, Homo Sapiens
YRCPRCMQY

SEQ ID NO: 1214232 - protein, 9 aa, Homo Sapiens
MGKKCDGQF

SEQ ID NO: 1214233 - protein, 9 aa, Homo Sapiens
SLTKTVEEP

SEQ ID NO: 1214234 - protein, 9 aa, Homo Sapiens
NTSQIKQML

SEQ ID NO: 1214235 - protein, 9 aa, Homo Sapiens
AAKNINLWL

SEQ ID NO: 1214236 - protein, 9 aa, Homo Sapiens
IGKKQSSGP

SEQ ID NO: 1214237 - protein, 9 aa, Homo Sapiens
KWGLYIAVI

SEQ ID NO: 1214238 - protein, 9 aa, Homo Sapiens
GWGWGNMQS

SEQ ID NO: 1214239 - protein, 9 aa, Homo Sapiens
RLLDKHFKM

SEQ ID NO: 1214240 - protein, 9 aa, Homo Sapiens
LDGFLAALQ

SEQ ID NO: 1214241 - protein, 9 aa, Homo Sapiens
MASVPPVFG

SEQ ID NO: 1214242 - protein, 9 aa, Homo Sapiens
QLHYFRNRH

SEQ ID NO: 1214243 - protein, 9 aa, Homo Sapiens
KGPSPIPTC

SEQ ID NO: 1214244 - protein, 9 aa, Homo Sapiens
QSAASITID

SEQ ID NO: 1214245 - protein, 9 aa, Homo Sapiens
TKYIVSVGY

SEQ ID NO: 1214246 - protein, 9 aa, Homo Sapiens
NLKNNVMQL

SEQ ID NO: 1214247 - protein, 9 aa, Homo Sapiens
ICRYYIHRQ

SEQ ID NO: 1214248 - protein, 9 aa, Homo Sapiens
NEIQDLQMK

SEQ ID NO: 1214249 - protein, 9 aa, Homo Sapiens
LGLHEKETI

SEQ ID NO: 1214250 - protein, 9 aa, Homo Sapiens
IWQKTLTLL

SEQ ID NO: 1214251 - protein, 9 aa, Homo Sapiens
RKKEKASML

SEQ ID NO: 1214252 - protein, 9 aa, Homo Sapiens
TGKGASGAF

SEQ ID NO: 1214253 - protein, 9 aa, Homo Sapiens
EYCNGAGLV

SEQ ID NO: 1214254 - protein, 9 aa, Homo Sapiens
LHLKEEDGK

SEQ ID NO: 1214255 - protein, 9 aa, Homo Sapiens
DAIRISQNF

SEQ ID NO: 1214256 - protein, 9 aa, Homo Sapiens
LLSASVSHG

SEQ ID NO: 1214257 - protein, 9 aa, Homo Sapiens
HVVTVEAYT

SEQ ID NO: 1214258 - protein, 9 aa, Homo Sapiens
HEAAVRMRL

SEQ ID NO: 1214259 - protein, 9 aa, Homo Sapiens
DYDTFKNSF

SEQ ID NO: 1214260 - protein, 9 aa, Homo Sapiens
HPDADSMYV

SEQ ID NO: 1214261 - protein, 9 aa, Homo Sapiens
DDLRDCIAT

SEQ ID NO: 1214262 - protein, 9 aa, Homo Sapiens
MSGEITMCE

SEQ ID NO: 1214263 - protein, 9 aa, Homo Sapiens
SSYSHQQRD

SEQ ID NO: 1214264 - protein, 9 aa, Homo Sapiens
RGPNQPVDS

SEQ ID NO: 1214265 - protein, 9 aa, Homo Sapiens
GISGQDGPP

SEQ ID NO: 1214266 - protein, 9 aa, Homo Sapiens
LDIFRRLRE

SEQ ID NO: 1214267 - protein, 9 aa, Homo Sapiens
HGIYVDDVN

SEQ ID NO: 1214268 - protein, 9 aa, Homo Sapiens
ERMGSGIEC

SEQ ID NO: 1214269 - protein, 9 aa, Homo Sapiens
EAGVFVNVQ

SEQ ID NO: 1214270 - protein, 9 aa, Homo Sapiens
GGELVIAHI

SEQ ID NO: 1214271 - protein, 9 aa, Homo Sapiens
GKTRRVNTS

SEQ ID NO: 1214272 - protein, 9 aa, Homo Sapiens
YDYRRRSPP

SEQ ID NO: 1214273 - protein, 9 aa, Homo Sapiens
HVYKTLERQ

SEQ ID NO: 1214274 - protein, 9 aa, Homo Sapiens
KAEFRVFHL

SEQ ID NO: 1214275 - protein, 9 aa, Homo Sapiens
LEMNVMVQN

SEQ ID NO: 1214276 - protein, 9 aa, Homo Sapiens
PRSQWRCQC

SEQ ID NO: 1214277 - protein, 9 aa, Homo Sapiens
DRETERIIP

SEQ ID NO: 1214278 - protein, 9 aa, Homo Sapiens
QHTFRVNIF

SEQ ID NO: 1214279 - protein, 9 aa, Homo Sapiens
HAGLPCLAP

SEQ ID NO: 1214280 - protein, 9 aa, Homo Sapiens
TALFQEASS

SEQ ID NO: 1214281 - protein, 9 aa, Homo Sapiens
CQSNGEGIG

SEQ ID NO: 1214282 - protein, 9 aa, Homo Sapiens
AELMITVHE

SEQ ID NO: 1214283 - protein, 9 aa, Homo Sapiens
TPQTGPQFC

SEQ ID NO: 1214284 - protein, 9 aa, Homo Sapiens
TPIVQRMPA

SEQ ID NO: 1214285 - protein, 9 aa, Homo Sapiens
YRTTISQTK

SEQ ID NO: 1214286 - protein, 9 aa, Homo Sapiens
SLNSGGGAT

SEQ ID NO: 1214287 - protein, 9 aa, Homo Sapiens
ANKLGAINN

SEQ ID NO: 1214288 - protein, 9 aa, Homo Sapiens
RPKPNVFPK

SEQ ID NO: 1214289 - protein, 9 aa, Homo Sapiens
SSLTLHQRF

SEQ ID NO: 1214290 - protein, 9 aa, Homo Sapiens
CLVMITYGV

SEQ ID NO: 1214291 - protein, 9 aa, Homo Sapiens
TAQLLTLVL

SEQ ID NO: 1214292 - protein, 9 aa, Homo Sapiens
DADTRRAMG

SEQ ID NO: 1214293 - protein, 9 aa, Homo Sapiens
KEKKSRKNE

SEQ ID NO: 1214294 - protein, 9 aa, Homo Sapiens
VTYQFGSVG

SEQ ID NO: 1214295 - protein, 9 aa, Homo Sapiens
RQEFGGVAP

SEQ ID NO: 1214296 - protein, 9 aa, Homo Sapiens
PNQPVDSDE

SEQ ID NO: 1214297 - protein, 9 aa, Homo Sapiens
HNRKDMNDT

SEQ ID NO: 1214298 - protein, 9 aa, Homo Sapiens
HLKFIPEGE

SEQ ID NO: 1214299 - protein, 9 aa, Homo Sapiens
VMGNLVNMS

SEQ ID NO: 1214300 - protein, 9 aa, Homo Sapiens
LSVVIHTMA

SEQ ID NO: 1214301 - protein, 9 aa, Homo Sapiens
EANFLGSGT

SEQ ID NO: 1214302 - protein, 9 aa, Homo Sapiens
KQLHENQKK

SEQ ID NO: 1214303 - protein, 9 aa, Homo Sapiens
RNALQHWPV

SEQ ID NO: 1214304 - protein, 9 aa, Homo Sapiens
YTFSIENFK

SEQ ID NO: 1214305 - protein, 9 aa, Homo Sapiens
GSSPPTVVA

SEQ ID NO: 1214306 - protein, 9 aa, Homo Sapiens
RKNYKCYIK

SEQ ID NO: 1214307 - protein, 9 aa, Homo Sapiens
KHVPKSGVK

SEQ ID NO: 1214308 - protein, 9 aa, Homo Sapiens
AHDCHEFGN

SEQ ID NO: 1214309 - protein, 9 aa, Homo Sapiens
DSANRVPFD

SEQ ID NO: 1214310 - protein, 9 aa, Homo Sapiens
PSGSRTGPV

SEQ ID NO: 1214311 - protein, 9 aa, Homo Sapiens
KQGFEFWYP

SEQ ID NO: 1214312 - protein, 9 aa, Homo Sapiens
QTAPQENVC

SEQ ID NO: 1214313 - protein, 9 aa, Homo Sapiens
VKFDVQSNQ

SEQ ID NO: 1214314 - protein, 9 aa, Homo Sapiens
LLGNGGAAK

SEQ ID NO: 1214315 - protein, 9 aa, Homo Sapiens
RRKQTGHRR

SEQ ID NO: 1214316 - protein, 9 aa, Homo Sapiens
GLARTSAGE

SEQ ID NO: 1214317 - protein, 9 aa, Homo Sapiens
KDEKWKLER

SEQ ID NO: 1214318 - protein, 9 aa, Homo Sapiens
DVDLKKLFT

SEQ ID NO: 1214319 - protein, 9 aa, Homo Sapiens
ALLQVEVLS

SEQ ID NO: 1214320 - protein, 9 aa, Homo Sapiens
NMLETIQGQ

SEQ ID NO: 1214321 - protein, 9 aa, Homo Sapiens
TMGRKEYEE

SEQ ID NO: 1214322 - protein, 9 aa, Homo Sapiens
SAESVVQCE

SEQ ID NO: 1214323 - protein, 9 aa, Homo Sapiens
SMFQNVTEE

SEQ ID NO: 1214324 - protein, 9 aa, Homo Sapiens
FKLTIDMGD

SEQ ID NO: 1214325 - protein, 9 aa, Homo Sapiens
EKSNTTTLA

SEQ ID NO: 1214326 - protein, 9 aa, Homo Sapiens
IIWSWDQGF

SEQ ID NO: 1214327 - protein, 9 aa, Homo Sapiens
SYGRDIVEA

SEQ ID NO: 1214328 - protein, 9 aa, Homo Sapiens
FCATLIYYF

SEQ ID NO: 1214329 - protein, 9 aa, Homo Sapiens
RKGHSTLGQ

SEQ ID NO: 1214330 - protein, 9 aa, Homo Sapiens
SEPRRIKYL

SEQ ID NO: 1214331 - protein, 9 aa, Homo Sapiens
ICWDTTSSQ

SEQ ID NO: 1214332 - protein, 9 aa, Homo Sapiens
SSRVRTSFF

SEQ ID NO: 1214333 - protein, 9 aa, Homo Sapiens
EGRTNIETS

SEQ ID NO: 1214334 - protein, 9 aa, Homo Sapiens
LDFQLKKAQ

SEQ ID NO: 1214335 - protein, 9 aa, Homo Sapiens
DVLARRGEV

SEQ ID NO: 1214336 - protein, 9 aa, Homo Sapiens
HLKEEDGKE

SEQ ID NO: 1214337 - protein, 9 aa, Homo Sapiens
DISPGPTSP

SEQ ID NO: 1214338 - protein, 9 aa, Homo Sapiens
VAARKRSST

SEQ ID NO: 1214339 - protein, 9 aa, Homo Sapiens
IDPVTSSGT

SEQ ID NO: 1214340 - protein, 9 aa, Homo Sapiens
SRTLKSARS

SEQ ID NO: 1214341 - protein, 9 aa, Homo Sapiens
PSHQALGLR

SEQ ID NO: 1214342 - protein, 9 aa, Homo Sapiens
PVQQTQFTV

SEQ ID NO: 1214343 - protein, 9 aa, Homo Sapiens
VNRRLHALE

SEQ ID NO: 1214344 - protein, 9 aa, Homo Sapiens
SSQLQVHMA

SEQ ID NO: 1214345 - protein, 9 aa, Homo Sapiens
RELRVNQGL

SEQ ID NO: 1214346 - protein, 9 aa, Homo Sapiens
DLYVNITKQ

SEQ ID NO: 1214347 - protein, 9 aa, Homo Sapiens
DPQQHKVTL

SEQ ID NO: 1214348 - protein, 9 aa, Homo Sapiens
LITCLEQIK

SEQ ID NO: 1214349 - protein, 9 aa, Homo Sapiens
TADYGFPDV

SEQ ID NO: 1214350 - protein, 9 aa, Homo Sapiens
VTSSPSHPS

SEQ ID NO: 1214351 - protein, 9 aa, Homo Sapiens
AASSLLHDG

SEQ ID NO: 1214352 - protein, 9 aa, Homo Sapiens
AVLEWDVGR

SEQ ID NO: 1214353 - protein, 9 aa, Homo Sapiens
ALSSGSITA

SEQ ID NO: 1214354 - protein, 9 aa, Homo Sapiens
VLPASMIGI

SEQ ID NO: 1214355 - protein, 9 aa, Homo Sapiens
LAGRGRPGA

SEQ ID NO: 1214356 - protein, 9 aa, Homo Sapiens
TLDHYPMSK

SEQ ID NO: 1214357 - protein, 9 aa, Homo Sapiens
ESSGRLYRL

SEQ ID NO: 1214358 - protein, 9 aa, Homo Sapiens
QYYRFHEYW

SEQ ID NO: 1214359 - protein, 9 aa, Homo Sapiens
IKVMVTCLP

SEQ ID NO: 1214360 - protein, 9 aa, Homo Sapiens
RLPRVETHS

SEQ ID NO: 1214361 - protein, 9 aa, Homo Sapiens
QTTCYRPRT

SEQ ID NO: 1214362 - protein, 9 aa, Homo Sapiens
CNKRFTQKR

SEQ ID NO: 1214363 - protein, 9 aa, Homo Sapiens
GMGLSDTAT

SEQ ID NO: 1214364 - protein, 9 aa, Homo Sapiens
ISLLLHELL

SEQ ID NO: 1214365 - protein, 9 aa, Homo Sapiens
RKKHRQRKS

SEQ ID NO: 1214366 - protein, 9 aa, Homo Sapiens
ETHTLGSLP

SEQ ID NO: 1214367 - protein, 9 aa, Homo Sapiens
YKFPIEYAS

SEQ ID NO: 1214368 - protein, 9 aa, Homo Sapiens
IMMVYITEF

SEQ ID NO: 1214369 - protein, 9 aa, Homo Sapiens
YMPNAIPKR

SEQ ID NO: 1214370 - protein, 9 aa, Homo Sapiens
TALDAFLSY

SEQ ID NO: 1214371 - protein, 9 aa, Homo Sapiens
SFEKSLGNM

SEQ ID NO: 1214372 - protein, 9 aa, Homo Sapiens
RISSSLQLP

SEQ ID NO: 1214373 - protein, 9 aa, Homo Sapiens
PPPTPPSYI

SEQ ID NO: 1214374 - protein, 9 aa, Homo Sapiens
HQQRFAHFT

SEQ ID NO: 1214375 - protein, 9 aa, Homo Sapiens
RFVHIRQTR

SEQ ID NO: 1214376 - protein, 9 aa, Homo Sapiens
QGDIEVLGH

SEQ ID NO: 1214377 - protein, 9 aa, Homo Sapiens
PDYPGFFLS

SEQ ID NO: 1214378 - protein, 9 aa, Homo Sapiens
RRCKTNIVT

SEQ ID NO: 1214379 - protein, 9 aa, Homo Sapiens
QFKSLALYL

SEQ ID NO: 1214380 - protein, 9 aa, Homo Sapiens
YMETQSMIV

SEQ ID NO: 1214381 - protein, 9 aa, Homo Sapiens
DHVDEVMCL

SEQ ID NO: 1214382 - protein, 9 aa, Homo Sapiens
VFMVCLALI

SEQ ID NO: 1214383 - protein, 9 aa, Homo Sapiens
RKVTGLGMW

SEQ ID NO: 1214384 - protein, 9 aa, Homo Sapiens
PVHWEHCCP

SEQ ID NO: 1214385 - protein, 9 aa, Homo Sapiens
MFSGHMEVL

SEQ ID NO: 1214386 - protein, 9 aa, Homo Sapiens
HVLRGRLRP

SEQ ID NO: 1214387 - protein, 9 aa, Homo Sapiens
IRETLPSGR

SEQ ID NO: 1214388 - protein, 9 aa, Homo Sapiens
RLPPPGALM

SEQ ID NO: 1214389 - protein, 9 aa, Homo Sapiens
KCDKIFDRI

SEQ ID NO: 1214390 - protein, 9 aa, Homo Sapiens
SEEHVLFQS

SEQ ID NO: 1214391 - protein, 9 aa, Homo Sapiens
RLIGELAKG

SEQ ID NO: 1214392 - protein, 9 aa, Homo Sapiens
LFLLNGSSL

SEQ ID NO: 1214393 - protein, 9 aa, Homo Sapiens
IVMQPIPAP

SEQ ID NO: 1214394 - protein, 9 aa, Homo Sapiens
DFSDYGAVF

SEQ ID NO: 1214395 - protein, 9 aa, Homo Sapiens
FNSLYIPKA

SEQ ID NO: 1214396 - protein, 9 aa, Homo Sapiens
PAACETPGR

SEQ ID NO: 1214397 - protein, 9 aa, Homo Sapiens
KMEHQLYTR

SEQ ID NO: 1214398 - protein, 9 aa, Homo Sapiens
DIPSSEQPE

SEQ ID NO: 1214399 - protein, 9 aa, Homo Sapiens
VSFQNYTPK

SEQ ID NO: 1214400 - protein, 9 aa, Homo Sapiens
GLILPAVLG

SEQ ID NO: 1214401 - protein, 9 aa, Homo Sapiens
QLHQGQNVI

SEQ ID NO: 1214402 - protein, 9 aa, Homo Sapiens
IDHVPEEED

SEQ ID NO: 1214403 - protein, 9 aa, Homo Sapiens
VSLQHLDGH

SEQ ID NO: 1214404 - protein, 9 aa, Homo Sapiens
DPATFRRKI

SEQ ID NO: 1214405 - protein, 9 aa, Homo Sapiens
HKTHRGLRK

SEQ ID NO: 1214406 - protein, 9 aa, Homo Sapiens
HCDICDTSF

SEQ ID NO: 1214407 - protein, 9 aa, Homo Sapiens
QRQGREHPS

SEQ ID NO: 1214408 - protein, 9 aa, Homo Sapiens
KLFYNCALV

SEQ ID NO: 1214409 - protein, 9 aa, Homo Sapiens
EDRMTEKLE

SEQ ID NO: 1214410 - protein, 9 aa, Homo Sapiens
FAHQMQQQN

SEQ ID NO: 1214411 - protein, 9 aa, Homo Sapiens
QDQRPIHPV

SEQ ID NO: 1214412 - protein, 9 aa, Homo Sapiens
GKWIPTSLA

SEQ ID NO: 1214413 - protein, 9 aa, Homo Sapiens
SPITPETLI

SEQ ID NO: 1214414 - protein, 9 aa, Homo Sapiens
YGEANDYSD

SEQ ID NO: 1214415 - protein, 9 aa, Homo Sapiens
PRCAPPPPP

SEQ ID NO: 1214416 - protein, 9 aa, Homo Sapiens
VDYQYQLLR

SEQ ID NO: 1214417 - protein, 9 aa, Homo Sapiens
ACGGRERRD

SEQ ID NO: 1214418 - protein, 9 aa, Homo Sapiens
CFMCQACRP

SEQ ID NO: 1214419 - protein, 9 aa, Homo Sapiens
RGSDYDTFK

SEQ ID NO: 1214420 - protein, 9 aa, Homo Sapiens
IAIVWLAGY

SEQ ID NO: 1214421 - protein, 9 aa, Homo Sapiens
NFLYLHSRG

SEQ ID NO: 1214422 - protein, 9 aa, Homo Sapiens
IIVGPGYDA

SEQ ID NO: 1214423 - protein, 9 aa, Homo Sapiens
VVNNHRAST

SEQ ID NO: 1214424 - protein, 9 aa, Homo Sapiens
LLPGEAAPS

SEQ ID NO: 1214425 - protein, 9 aa, Homo Sapiens
EEKELELSN

SEQ ID NO: 1214426 - protein, 9 aa, Homo Sapiens
RQPSCKNVC

SEQ ID NO: 1214427 - protein, 9 aa, Homo Sapiens
VFLQIYKVW

SEQ ID NO: 1214428 - protein, 9 aa, Homo Sapiens
SPSRQQGCI

SEQ ID NO: 1214429 - protein, 9 aa, Homo Sapiens
HTQNTHGLR

SEQ ID NO: 1214430 - protein, 9 aa, Homo Sapiens
KGPSRLRLD

SEQ ID NO: 1214431 - protein, 9 aa, Homo Sapiens
PVLDTNGSL

SEQ ID NO: 1214432 - protein, 9 aa, Homo Sapiens
RLVGPMNHD

SEQ ID NO: 1214433 - protein, 9 aa, Homo Sapiens
SPTLLFSCN

SEQ ID NO: 1214434 - protein, 9 aa, Homo Sapiens
LVPNQHRST

SEQ ID NO: 1214435 - protein, 9 aa, Homo Sapiens
FPDTMLQTA

SEQ ID NO: 1214436 - protein, 9 aa, Homo Sapiens
KPDSILVPA

SEQ ID NO: 1214437 - protein, 9 aa, Homo Sapiens
KTFSTYASH

SEQ ID NO: 1214438 - protein, 9 aa, Homo Sapiens
ERLHRNRED

SEQ ID NO: 1214439 - protein, 9 aa, Homo Sapiens
LNALHVDYR

SEQ ID NO: 1214440 - protein, 9 aa, Homo Sapiens
LRAESFRKV

SEQ ID NO: 1214441 - protein, 9 aa, Homo Sapiens
DFSVYHPAD

SEQ ID NO: 1214442 - protein, 9 aa, Homo Sapiens
VKIIYVRNL

SEQ ID NO: 1214443 - protein, 9 aa, Homo Sapiens
HVLNRLTFA

SEQ ID NO: 1214444 - protein, 9 aa, Homo Sapiens
QRYLCVMSE

SEQ ID NO: 1214445 - protein, 9 aa, Homo Sapiens
GQLLSQGVI

SEQ ID NO: 1214446 - protein, 9 aa, Homo Sapiens
ICFTISALH

SEQ ID NO: 1214447 - protein, 9 aa, Homo Sapiens
SSHHGSRGA

SEQ ID NO: 1214448 - protein, 9 aa, Homo Sapiens
SPRSPAGVK

SEQ ID NO: 1214449 - protein, 9 aa, Homo Sapiens
RDAPSIEQR

SEQ ID NO: 1214450 - protein, 9 aa, Homo Sapiens
GIHQFYINV

SEQ ID NO: 1214451 - protein, 9 aa, Homo Sapiens
RKRELHQHE

SEQ ID NO: 1214452 - protein, 9 aa, Homo Sapiens
HVGGPVPRT

SEQ ID NO: 1214453 - protein, 9 aa, Homo Sapiens
LSLWTAHIF

SEQ ID NO: 1214454 - protein, 9 aa, Homo Sapiens
QECTLRIPC

SEQ ID NO: 1214455 - protein, 9 aa, Homo Sapiens
GVICKDQCL

SEQ ID NO: 1214456 - protein, 9 aa, Homo Sapiens
STSQIIYRR

SEQ ID NO: 1214457 - protein, 9 aa, Homo Sapiens
HLLMVGMYY

SEQ ID NO: 1214458 - protein, 9 aa, Homo Sapiens
GQAPGIEEA

SEQ ID NO: 1214459 - protein, 9 aa, Homo Sapiens
HGWNWRSLS

SEQ ID NO: 1214460 - protein, 9 aa, Homo Sapiens
GNGGAAKQG

SEQ ID NO: 1214461 - protein, 9 aa, Homo Sapiens
QQENEGVEQ

SEQ ID NO: 1214462 - protein, 9 aa, Homo Sapiens
RLVPSFSFH

SEQ ID NO: 1214463 - protein, 9 aa, Homo Sapiens
RELQAELGL

SEQ ID NO: 1214464 - protein, 9 aa, Homo Sapiens
LGFGKLYPH

SEQ ID NO: 1214465 - protein, 9 aa, Homo Sapiens
HPIESLSLI

SEQ ID NO: 1214466 - protein, 9 aa, Homo Sapiens
PSSTSSSGS

SEQ ID NO: 1214467 - protein, 9 aa, Homo Sapiens
SCWHLLRTS

SEQ ID NO: 1214468 - protein, 9 aa, Homo Sapiens
VTKALSDLI

SEQ ID NO: 1214469 - protein, 9 aa, Homo Sapiens
EQSQKRGLQ

SEQ ID NO: 1214470 - protein, 9 aa, Homo Sapiens
FSWQGKLRL

SEQ ID NO: 1214471 - protein, 9 aa, Homo Sapiens
LHVHFTTLG

SEQ ID NO: 1214472 - protein, 9 aa, Homo Sapiens
AEASGFCVE

SEQ ID NO: 1214473 - protein, 9 aa, Homo Sapiens
VLAARYMCD

SEQ ID NO: 1214474 - protein, 9 aa, Homo Sapiens
RIIVCSTQG

SEQ ID NO: 1214475 - protein, 9 aa, Homo Sapiens
GRLGHLARE

SEQ ID NO: 1214476 - protein, 9 aa, Homo Sapiens
KEQHPAAEE

SEQ ID NO: 1214477 - protein, 9 aa, Homo Sapiens
IQIKQEDPK

SEQ ID NO: 1214478 - protein, 9 aa, Homo Sapiens
LHWLYLSEN

SEQ ID NO: 1214479 - protein, 9 aa, Homo Sapiens
GTLFKDMPL

SEQ ID NO: 1214480 - protein, 9 aa, Homo Sapiens
HQGTLPPVP

SEQ ID NO: 1214481 - protein, 9 aa, Homo Sapiens
MEMGQIYAG

SEQ ID NO: 1214482 - protein, 9 aa, Homo Sapiens
DEVVKKLEE

SEQ ID NO: 1214483 - protein, 9 aa, Homo Sapiens
GRSLGLLMR

SEQ ID NO: 1214484 - protein, 9 aa, Homo Sapiens
QIVLLKGCC

SEQ ID NO: 1214485 - protein, 9 aa, Homo Sapiens
LWLMTAMWL

SEQ ID NO: 1214486 - protein, 9 aa, Homo Sapiens
VTATYADSG

SEQ ID NO: 1214487 - protein, 9 aa, Homo Sapiens
VTGTKDSVA

SEQ ID NO: 1214488 - protein, 9 aa, Homo Sapiens
EKTLLVLGS

SEQ ID NO: 1214489 - protein, 9 aa, Homo Sapiens
QLEEMCKRE

SEQ ID NO: 1214490 - protein, 9 aa, Homo Sapiens
VVSAIQDIG

SEQ ID NO: 1214491 - protein, 9 aa, Homo Sapiens
SVMVDATTR

SEQ ID NO: 1214492 - protein, 9 aa, Homo Sapiens
RLKTPIAFR

SEQ ID NO: 1214493 - protein, 9 aa, Homo Sapiens
HTAGGGGGP

SEQ ID NO: 1214494 - protein, 9 aa, Homo Sapiens
KDDTDGETE

SEQ ID NO: 1214495 - protein, 9 aa, Homo Sapiens
SVPGSFAFG

SEQ ID NO: 1214496 - protein, 9 aa, Homo Sapiens
FTQVSRQWK

SEQ ID NO: 1214497 - protein, 9 aa, Homo Sapiens
MCPSSSYNP

SEQ ID NO: 1214498 - protein, 9 aa, Homo Sapiens
RETLLGGRC

SEQ ID NO: 1214499 - protein, 9 aa, Homo Sapiens
DLFEAQGNN

SEQ ID NO: 1214500 - protein, 9 aa, Homo Sapiens
AIVKAMGTL

SEQ ID NO: 1214501 - protein, 9 aa, Homo Sapiens
VNNLSPEVP

SEQ ID NO: 1214502 - protein, 9 aa, Homo Sapiens
EDSTPAFAI

SEQ ID NO: 1214503 - protein, 9 aa, Homo Sapiens
YEFVIFNQK

SEQ ID NO: 1214504 - protein, 9 aa, Homo Sapiens
FINSLLNEE

SEQ ID NO: 1214505 - protein, 9 aa, Homo Sapiens
ARMRHIPLT

SEQ ID NO: 1214506 - protein, 9 aa, Homo Sapiens
QVYSVRMRQ

SEQ ID NO: 1214507 - protein, 9 aa, Homo Sapiens
LTEARTECD

SEQ ID NO: 1214508 - protein, 9 aa, Homo Sapiens
SEKRYVQPQ

SEQ ID NO: 1214509 - protein, 9 aa, Homo Sapiens
DCKFIENSA

SEQ ID NO: 1214510 - protein, 9 aa, Homo Sapiens
STHGSGPCS

SEQ ID NO: 1214511 - protein, 9 aa, Homo Sapiens
QNLEMNVMV

SEQ ID NO: 1214512 - protein, 9 aa, Homo Sapiens
YWLQFDFQE

SEQ ID NO: 1214513 - protein, 9 aa, Homo Sapiens
FNSYRTMEK

SEQ ID NO: 1214514 - protein, 9 aa, Homo Sapiens
ERIKNLYKK

SEQ ID NO: 1214515 - protein, 9 aa, Homo Sapiens
GIALSFLDM

SEQ ID NO: 1214516 - protein, 9 aa, Homo Sapiens
LTTITRTIN

SEQ ID NO: 1214517 - protein, 9 aa, Homo Sapiens
LLIDMVPRM

SEQ ID NO: 1214518 - protein, 9 aa, Homo Sapiens
CCHCPPLLP

SEQ ID NO: 1214519 - protein, 9 aa, Homo Sapiens
ASLCFLAYS

SEQ ID NO: 1214520 - protein, 9 aa, Homo Sapiens
LVSINADNS

SEQ ID NO: 1214521 - protein, 9 aa, Homo Sapiens
NMRGFLYAG

SEQ ID NO: 1214522 - protein, 9 aa, Homo Sapiens
MIRQTNTHI

SEQ ID NO: 1214523 - protein, 9 aa, Homo Sapiens
VGIPLSEYE

SEQ ID NO: 1214524 - protein, 9 aa, Homo Sapiens
EYSAMDCED

SEQ ID NO: 1214525 - protein, 9 aa, Homo Sapiens
MIRSMDTLR

SEQ ID NO: 1214526 - protein, 9 aa, Homo Sapiens
HQNLYRNVM

SEQ ID NO: 1214527 - protein, 9 aa, Homo Sapiens
LWIGASLCF

SEQ ID NO: 1214528 - protein, 9 aa, Homo Sapiens
LFQCHGAAD

SEQ ID NO: 1214529 - protein, 9 aa, Homo Sapiens
YNSDGLAAF

SEQ ID NO: 1214530 - protein, 9 aa, Homo Sapiens
QNPGAALDF

SEQ ID NO: 1214531 - protein, 9 aa, Homo Sapiens
TEAKKKAYP

SEQ ID NO: 1214532 - protein, 9 aa, Homo Sapiens
RLIKESGAW

SEQ ID NO: 1214533 - protein, 9 aa, Homo Sapiens
QTADISTRD

SEQ ID NO: 1214534 - protein, 9 aa, Homo Sapiens
IGPKRDHAT

SEQ ID NO: 1214535 - protein, 9 aa, Homo Sapiens
MLDGTVKMI

SEQ ID NO: 1214536 - protein, 9 aa, Homo Sapiens
EFHALIKGG

SEQ ID NO: 1214537 - protein, 9 aa, Homo Sapiens
FLCKLSFEY

SEQ ID NO: 1214538 - protein, 9 aa, Homo Sapiens
GGQVGIRAR

SEQ ID NO: 1214539 - protein, 9 aa, Homo Sapiens
WFLSSVSSF

SEQ ID NO: 1214540 - protein, 9 aa, Homo Sapiens
LRKKILRHG

SEQ ID NO: 1214541 - protein, 9 aa, Homo Sapiens
YKASSEMTL

SEQ ID NO: 1214542 - protein, 9 aa, Homo Sapiens
NRPDLIDFD

SEQ ID NO: 1214543 - protein, 9 aa, Homo Sapiens
YQVDVFCLP

SEQ ID NO: 1214544 - protein, 9 aa, Homo Sapiens
ICRAAIHYR

SEQ ID NO: 1214545 - protein, 9 aa, Homo Sapiens
ARLETLVCK

SEQ ID NO: 1214546 - protein, 9 aa, Homo Sapiens
KQYSNTYCF

SEQ ID NO: 1214547 - protein, 9 aa, Homo Sapiens
SSEEVHQAI

SEQ ID NO: 1214548 - protein, 9 aa, Homo Sapiens
TKRDIALIT

SEQ ID NO: 1214549 - protein, 9 aa, Homo Sapiens
NVCLLEVYN

SEQ ID NO: 1214550 - protein, 9 aa, Homo Sapiens
KAAMRRYKT

SEQ ID NO: 1214551 - protein, 9 aa, Homo Sapiens
PLKKRGNHI

SEQ ID NO: 1214552 - protein, 9 aa, Homo Sapiens
AIADLLANE

SEQ ID NO: 1214553 - protein, 9 aa, Homo Sapiens
CANLTSWPH

SEQ ID NO: 1214554 - protein, 9 aa, Homo Sapiens
RHNPALPPG

SEQ ID NO: 1214555 - protein, 9 aa, Homo Sapiens
HLLGGSGDN

SEQ ID NO: 1214556 - protein, 9 aa, Homo Sapiens
CKQELPEHV

SEQ ID NO: 1214557 - protein, 9 aa, Homo Sapiens
MEERSGLIC

SEQ ID NO: 1214558 - protein, 9 aa, Homo Sapiens
SEARIILEP

SEQ ID NO: 1214559 - protein, 9 aa, Homo Sapiens
GVINVTDAD

SEQ ID NO: 1214560 - protein, 9 aa, Homo Sapiens
NLPKRWDLL

SEQ ID NO: 1214561 - protein, 9 aa, Homo Sapiens
WLCGPATWG

SEQ ID NO: 1214562 - protein, 9 aa, Homo Sapiens
TFDRPTYLW

SEQ ID NO: 1214563 - protein, 9 aa, Homo Sapiens
ISSKAMCIM

SEQ ID NO: 1214564 - protein, 9 aa, Homo Sapiens
VACIHFTVE

SEQ ID NO: 1214565 - protein, 9 aa, Homo Sapiens
RCQEQKAKM

SEQ ID NO: 1214566 - protein, 9 aa, Homo Sapiens
LTIPGVKVH

SEQ ID NO: 1214567 - protein, 9 aa, Homo Sapiens
TKTPSDHLL

SEQ ID NO: 1214568 - protein, 9 aa, Homo Sapiens
FGDSPRRLH

SEQ ID NO: 1214569 - protein, 9 aa, Homo Sapiens
KKHTLQHDE

SEQ ID NO: 1214570 - protein, 9 aa, Homo Sapiens
IHVSHLNVN

SEQ ID NO: 1214571 - protein, 9 aa, Homo Sapiens
EAKSYWDAL

SEQ ID NO: 1214572 - protein, 9 aa, Homo Sapiens
CLKLLTAVH

SEQ ID NO: 1214573 - protein, 9 aa, Homo Sapiens
MTTRIFLNK

SEQ ID NO: 1214574 - protein, 9 aa, Homo Sapiens
AHPLSFADE

SEQ ID NO: 1214575 - protein, 9 aa, Homo Sapiens
IAIVSFQNY

SEQ ID NO: 1214576 - protein, 9 aa, Homo Sapiens
ERHAPPGSC

SEQ ID NO: 1214577 - protein, 9 aa, Homo Sapiens
LVSQSLVNV

SEQ ID NO: 1214578 - protein, 9 aa, Homo Sapiens
TFETFTSAS

SEQ ID NO: 1214579 - protein, 9 aa, Homo Sapiens
SSSKKQASS

SEQ ID NO: 1214580 - protein, 9 aa, Homo Sapiens
FLLLATVFC

SEQ ID NO: 1214581 - protein, 9 aa, Homo Sapiens
PMLPAQFKQ

SEQ ID NO: 1214582 - protein, 9 aa, Homo Sapiens
SKGTPSYDA

SEQ ID NO: 1214583 - protein, 9 aa, Homo Sapiens
CFQHVVTVE

SEQ ID NO: 1214584 - protein, 9 aa, Homo Sapiens
SEKAVAFST

SEQ ID NO: 1214585 - protein, 9 aa, Homo Sapiens
AKIKAVQHQ

SEQ ID NO: 1214586 - protein, 9 aa, Homo Sapiens
YLQQEMGPV

SEQ ID NO: 1214587 - protein, 9 aa, Homo Sapiens
PMDLTIRIG

SEQ ID NO: 1214588 - protein, 9 aa, Homo Sapiens
ICQKFAVME

SEQ ID NO: 1214589 - protein, 9 aa, Homo Sapiens
SDHPISAPQ

SEQ ID NO: 1214590 - protein, 9 aa, Homo Sapiens
ASPPASSCS

SEQ ID NO: 1214591 - protein, 9 aa, Homo Sapiens
RNLASEDIP

SEQ ID NO: 1214592 - protein, 9 aa, Homo Sapiens
ASKPSKGKD

SEQ ID NO: 1214593 - protein, 9 aa, Homo Sapiens
QPRRSAPKG

SEQ ID NO: 1214594 - protein, 9 aa, Homo Sapiens
SPCLDVEYN

SEQ ID NO: 1214595 - protein, 9 aa, Homo Sapiens
HAMPCSRPR

SEQ ID NO: 1214596 - protein, 9 aa, Homo Sapiens
VRHGSCSSF

SEQ ID NO: 1214597 - protein, 9 aa, Homo Sapiens
MSLSSQVTV

SEQ ID NO: 1214598 - protein, 9 aa, Homo Sapiens
ISSQYWISV

SEQ ID NO: 1214599 - protein, 9 aa, Homo Sapiens
LQRTLSVLA

SEQ ID NO: 1214600 - protein, 9 aa, Homo Sapiens
FGIPGTSIP

SEQ ID NO: 1214601 - protein, 9 aa, Homo Sapiens
IMVVVVPAK

SEQ ID NO: 1214602 - protein, 9 aa, Homo Sapiens
ICLLTFIKC

SEQ ID NO: 1214603 - protein, 9 aa, Homo Sapiens
LLWNLGGSR

SEQ ID NO: 1214604 - protein, 9 aa, Homo Sapiens
GRRSGGRMR

SEQ ID NO: 1214605 - protein, 9 aa, Homo Sapiens
CCYLWDVQS

SEQ ID NO: 1214606 - protein, 9 aa, Homo Sapiens
MWGLPPSPL

SEQ ID NO: 1214607 - protein, 9 aa, Homo Sapiens
KHMDMVLPE

SEQ ID NO: 1214608 - protein, 9 aa, Homo Sapiens
MILVVDTKI

SEQ ID NO: 1214609 - protein, 9 aa, Homo Sapiens
ADAGRQTMH

SEQ ID NO: 1214610 - protein, 9 aa, Homo Sapiens
IPLDHDNKE

SEQ ID NO: 1214611 - protein, 9 aa, Homo Sapiens
LQATIARKS

SEQ ID NO: 1214612 - protein, 9 aa, Homo Sapiens
KMAFLCAVC

SEQ ID NO: 1214613 - protein, 9 aa, Homo Sapiens
RVVYYDDRF

SEQ ID NO: 1214614 - protein, 9 aa, Homo Sapiens
LSVMCPGAG

SEQ ID NO: 1214615 - protein, 9 aa, Homo Sapiens
IVDQVVTEE

SEQ ID NO: 1214616 - protein, 9 aa, Homo Sapiens
DAFTTFCGG

SEQ ID NO: 1214617 - protein, 9 aa, Homo Sapiens
VLPELIYYI

SEQ ID NO: 1214618 - protein, 9 aa, Homo Sapiens
DLILATSAI

SEQ ID NO: 1214619 - protein, 9 aa, Homo Sapiens
AGAWSFQPA

SEQ ID NO: 1214620 - protein, 9 aa, Homo Sapiens
VRAKSHSEF

SEQ ID NO: 1214621 - protein, 9 aa, Homo Sapiens
KPGYWIGVH

SEQ ID NO: 1214622 - protein, 9 aa, Homo Sapiens
LEILVSSYL

SEQ ID NO: 1214623 - protein, 9 aa, Homo Sapiens
LLHGKIYDA

SEQ ID NO: 1214624 - protein, 9 aa, Homo Sapiens
ENGRYGRHK

SEQ ID NO: 1214625 - protein, 9 aa, Homo Sapiens
LANKCMVEY

SEQ ID NO: 1214626 - protein, 9 aa, Homo Sapiens
KKRHTEKPP

SEQ ID NO: 1214627 - protein, 9 aa, Homo Sapiens
SHPNVVIYY

SEQ ID NO: 1214628 - protein, 9 aa, Homo Sapiens
DEVMCLAFH

SEQ ID NO: 1214629 - protein, 9 aa, Homo Sapiens
DVCKGRTKA

SEQ ID NO: 1214630 - protein, 9 aa, Homo Sapiens
TMETMPLES

SEQ ID NO: 1214631 - protein, 9 aa, Homo Sapiens
GKDVLQETI

SEQ ID NO: 1214632 - protein, 9 aa, Homo Sapiens
KIAAVVCLG

SEQ ID NO: 1214633 - protein, 9 aa, Homo Sapiens
MRYHLFRGV

SEQ ID NO: 1214634 - protein, 9 aa, Homo Sapiens
MSKNTKLLS

SEQ ID NO: 1214635 - protein, 9 aa, Homo Sapiens
DSSTNIHKL

SEQ ID NO: 1214636 - protein, 9 aa, Homo Sapiens
VVNVRHDQS

SEQ ID NO: 1214637 - protein, 9 aa, Homo Sapiens
GLNAPVKYE

SEQ ID NO: 1214638 - protein, 9 aa, Homo Sapiens
KTWTLTQSP

SEQ ID NO: 1214639 - protein, 9 aa, Homo Sapiens
DLQVLDRFY

SEQ ID NO: 1214640 - protein, 9 aa, Homo Sapiens
DLAPKLLQC

SEQ ID NO: 1214641 - protein, 9 aa, Homo Sapiens
PLTPTPTPS

SEQ ID NO: 1214642 - protein, 9 aa, Homo Sapiens
HHYQIHTEV

SEQ ID NO: 1214643 - protein, 9 aa, Homo Sapiens
IREEHEYEE

SEQ ID NO: 1214644 - protein, 9 aa, Homo Sapiens
HMALQLCPV

SEQ ID NO: 1214645 - protein, 9 aa, Homo Sapiens
NLCLESQQL

SEQ ID NO: 1214646 - protein, 9 aa, Homo Sapiens
LLGKCCDVP

SEQ ID NO: 1214647 - protein, 9 aa, Homo Sapiens
LCMGGCSGQ

SEQ ID NO: 1214648 - protein, 9 aa, Homo Sapiens
GEDFDNRLM

SEQ ID NO: 1214649 - protein, 9 aa, Homo Sapiens
SSRSYCIFT

SEQ ID NO: 1214650 - protein, 9 aa, Homo Sapiens
IFCKFCMMK

SEQ ID NO: 1214651 - protein, 9 aa, Homo Sapiens
KKKHFVYQK

SEQ ID NO: 1214652 - protein, 9 aa, Homo Sapiens
ISRKSPLAE

SEQ ID NO: 1214653 - protein, 9 aa, Homo Sapiens
EGYLQHAAQ

SEQ ID NO: 1214654 - protein, 9 aa, Homo Sapiens
YDQQVLYMV

SEQ ID NO: 1214655 - protein, 9 aa, Homo Sapiens
ASEESLHTS

SEQ ID NO: 1214656 - protein, 9 aa, Homo Sapiens
ARLEKAKND

SEQ ID NO: 1214657 - protein, 9 aa, Homo Sapiens
TRTPTMGWL

SEQ ID NO: 1214658 - protein, 9 aa, Homo Sapiens
NNVPMLKLS

SEQ ID NO: 1214659 - protein, 9 aa, Homo Sapiens
LNGEQTEAA

SEQ ID NO: 1214660 - protein, 9 aa, Homo Sapiens
DAPVTGTVS

SEQ ID NO: 1214661 - protein, 9 aa, Homo Sapiens
CRAVSEVAR

SEQ ID NO: 1214662 - protein, 9 aa, Homo Sapiens
TYLARFEAD

SEQ ID NO: 1214663 - protein, 9 aa, Homo Sapiens
SENNMSDVS

SEQ ID NO: 1214664 - protein, 9 aa, Homo Sapiens
DGHPSSFSP

SEQ ID NO: 1214665 - protein, 9 aa, Homo Sapiens
ADIRVIEEC

SEQ ID NO: 1214666 - protein, 9 aa, Homo Sapiens
SSIQAQPLN

SEQ ID NO: 1214667 - protein, 9 aa, Homo Sapiens
TVTPSEASV

SEQ ID NO: 1214668 - protein, 9 aa, Homo Sapiens
GSPEPPPAH

SEQ ID NO: 1214669 - protein, 9 aa, Homo Sapiens
GVHPEVENR

SEQ ID NO: 1214670 - protein, 9 aa, Homo Sapiens
YVDDVNVYF

SEQ ID NO: 1214671 - protein, 9 aa, Homo Sapiens
LEKYKCKVS

SEQ ID NO: 1214672 - protein, 9 aa, Homo Sapiens
ENTAESRPP

SEQ ID NO: 1214673 - protein, 9 aa, Homo Sapiens
GGPLLYRHR

SEQ ID NO: 1214674 - protein, 9 aa, Homo Sapiens
ESENGSPEY

SEQ ID NO: 1214675 - protein, 9 aa, Homo Sapiens
LLKMVALGI

SEQ ID NO: 1214676 - protein, 9 aa, Homo Sapiens
INLVQDSLD

SEQ ID NO: 1214677 - protein, 9 aa, Homo Sapiens
VQCTGQPLP

SEQ ID NO: 1214678 - protein, 9 aa, Homo Sapiens
SENTENKFQ

SEQ ID NO: 1214679 - protein, 9 aa, Homo Sapiens
FILSHWENY

SEQ ID NO: 1214680 - protein, 9 aa, Homo Sapiens
QEAMRVLEY

SEQ ID NO: 1214681 - protein, 9 aa, Homo Sapiens
KRVVYYDDR

SEQ ID NO: 1214682 - protein, 9 aa, Homo Sapiens
SKALFRKKV

SEQ ID NO: 1214683 - protein, 9 aa, Homo Sapiens
YYQVLMNSE

SEQ ID NO: 1214684 - protein, 9 aa, Homo Sapiens
GKATTIPPS

SEQ ID NO: 1214685 - protein, 9 aa, Homo Sapiens
SVATLVQYI

SEQ ID NO: 1214686 - protein, 9 aa, Homo Sapiens
IYSQINISK

SEQ ID NO: 1214687 - protein, 9 aa, Homo Sapiens
CGIVSTSSH

SEQ ID NO: 1214688 - protein, 9 aa, Homo Sapiens
NVGNQNCSV

SEQ ID NO: 1214689 - protein, 9 aa, Homo Sapiens
ELYMSSNFI

SEQ ID NO: 1214690 - protein, 9 aa, Homo Sapiens
RFGSAVNLH

SEQ ID NO: 1214691 - protein, 9 aa, Homo Sapiens
RWTGHEVKG

SEQ ID NO: 1214692 - protein, 9 aa, Homo Sapiens
AHVCRETPK

SEQ ID NO: 1214693 - protein, 9 aa, Homo Sapiens
RFRNFFNAF

SEQ ID NO: 1214694 - protein, 9 aa, Homo Sapiens
SYQGVRVKE

SEQ ID NO: 1214695 - protein, 9 aa, Homo Sapiens
PRYLLDDSV

SEQ ID NO: 1214696 - protein, 9 aa, Homo Sapiens
HVEFQLSEP

SEQ ID NO: 1214697 - protein, 9 aa, Homo Sapiens
IHASLKLKL

SEQ ID NO: 1214698 - protein, 9 aa, Homo Sapiens
DKHVFTVGR

SEQ ID NO: 1214699 - protein, 9 aa, Homo Sapiens
PQQHKVTLL

SEQ ID NO: 1214700 - protein, 9 aa, Homo Sapiens
SNSKATFQL

SEQ ID NO: 1214701 - protein, 9 aa, Homo Sapiens
TLIGSLTAD

SEQ ID NO: 1214702 - protein, 9 aa, Homo Sapiens
TWAGSRPQS

SEQ ID NO: 1214703 - protein, 9 aa, Homo Sapiens
DLEMRVIRW

SEQ ID NO: 1214704 - protein, 9 aa, Homo Sapiens
LEILQYCFE

SEQ ID NO: 1214705 - protein, 9 aa, Homo Sapiens
SRKAIDTAT

SEQ ID NO: 1214706 - protein, 9 aa, Homo Sapiens
ISKEGNHLL

SEQ ID NO: 1214707 - protein, 9 aa, Homo Sapiens
SAPQIGVIN

SEQ ID NO: 1214708 - protein, 9 aa, Homo Sapiens
YGEMWGMYE

SEQ ID NO: 1214709 - protein, 9 aa, Homo Sapiens
DVNPSWTTR

SEQ ID NO: 1214710 - protein, 9 aa, Homo Sapiens
RKGTDVNMF

SEQ ID NO: 1214711 - protein, 9 aa, Homo Sapiens
SQHQPRSDT

SEQ ID NO: 1214712 - protein, 9 aa, Homo Sapiens
PPPACHSFC

SEQ ID NO: 1214713 - protein, 9 aa, Homo Sapiens
MTFGPHGHH

SEQ ID NO: 1214714 - protein, 9 aa, Homo Sapiens
DTESGDAND

SEQ ID NO: 1214715 - protein, 9 aa, Homo Sapiens
RCSVSDCSD

SEQ ID NO: 1214716 - protein, 9 aa, Homo Sapiens
VTDTPGFGE

SEQ ID NO: 1214717 - protein, 9 aa, Homo Sapiens
SSKGVSAQC

SEQ ID NO: 1214718 - protein, 9 aa, Homo Sapiens
TRTLEPPAE

SEQ ID NO: 1214719 - protein, 9 aa, Homo Sapiens
DTTHLKWFG

SEQ ID NO: 1214720 - protein, 9 aa, Homo Sapiens
ADLEILVSS

SEQ ID NO: 1214721 - protein, 9 aa, Homo Sapiens
RGCTLSSWL

SEQ ID NO: 1214722 - protein, 9 aa, Homo Sapiens
RMFKLLEQA

SEQ ID NO: 1214723 - protein, 9 aa, Homo Sapiens
KVSQASKDL

SEQ ID NO: 1214724 - protein, 9 aa, Homo Sapiens
QCPKCDKIF

SEQ ID NO: 1214725 - protein, 9 aa, Homo Sapiens
IPTCLASWL

SEQ ID NO: 1214726 - protein, 9 aa, Homo Sapiens
KESPVFAHV

SEQ ID NO: 1214727 - protein, 9 aa, Homo Sapiens
ICHKNSINF

SEQ ID NO: 1214728 - protein, 9 aa, Homo Sapiens
GVRPWLPPR

SEQ ID NO: 1214729 - protein, 9 aa, Homo Sapiens
VLELRRPMY

SEQ ID NO: 1214730 - protein, 9 aa, Homo Sapiens
EEAKLGVVT

SEQ ID NO: 1214731 - protein, 9 aa, Homo Sapiens
LGMPARAVS

SEQ ID NO: 1214732 - protein, 9 aa, Homo Sapiens
CEAVRSGHE

SEQ ID NO: 1214733 - protein, 9 aa, Homo Sapiens
VPKTEKSFG

SEQ ID NO: 1214734 - protein, 9 aa, Homo Sapiens
YKQDRDITL

SEQ ID NO: 1214735 - protein, 9 aa, Homo Sapiens
PPQRGIPPS

SEQ ID NO: 1214736 - protein, 9 aa, Homo Sapiens
ETLLGGRCG

SEQ ID NO: 1214737 - protein, 9 aa, Homo Sapiens
ICGPQMLVF

SEQ ID NO: 1214738 - protein, 9 aa, Homo Sapiens
VIVQHPEIV

SEQ ID NO: 1214739 - protein, 9 aa, Homo Sapiens
KCENPELSD

SEQ ID NO: 1214740 - protein, 9 aa, Homo Sapiens
EGSRREEHS

SEQ ID NO: 1214741 - protein, 9 aa, Homo Sapiens
EETLGGQDE

SEQ ID NO: 1214742 - protein, 9 aa, Homo Sapiens
CQDRVHDFD

SEQ ID NO: 1214743 - protein, 9 aa, Homo Sapiens
WMVSRSLGA

SEQ ID NO: 1214744 - protein, 9 aa, Homo Sapiens
QGKFTRVNM

SEQ ID NO: 1214745 - protein, 9 aa, Homo Sapiens
SSYHTLDEI

SEQ ID NO: 1214746 - protein, 9 aa, Homo Sapiens
GDSPRRLHL

SEQ ID NO: 1214747 - protein, 9 aa, Homo Sapiens
GDDNFRYFL

SEQ ID NO: 1214748 - protein, 9 aa, Homo Sapiens
HGWWAGFRR

SEQ ID NO: 1214749 - protein, 9 aa, Homo Sapiens
RWVMILKLP

SEQ ID NO: 1214750 - protein, 9 aa, Homo Sapiens
RDVPDAISE

SEQ ID NO: 1214751 - protein, 9 aa, Homo Sapiens
RCSMVCDPH

SEQ ID NO: 1214752 - protein, 9 aa, Homo Sapiens
QGTLPPVPL

SEQ ID NO: 1214753 - protein, 9 aa, Homo Sapiens
PLDHDNKEL

SEQ ID NO: 1214754 - protein, 9 aa, Homo Sapiens
RSYQGVRVK

SEQ ID NO: 1214755 - protein, 9 aa, Homo Sapiens
KLVEEHTQA

SEQ ID NO: 1214756 - protein, 9 aa, Homo Sapiens
KYFSAFINL

SEQ ID NO: 1214757 - protein, 9 aa, Homo Sapiens
FGGPDSFGG

SEQ ID NO: 1214758 - protein, 9 aa, Homo Sapiens
TFLTKEDYA

SEQ ID NO: 1214759 - protein, 9 aa, Homo Sapiens
RREYSHFEK

SEQ ID NO: 1214760 - protein, 9 aa, Homo Sapiens
WRERVDRLL

SEQ ID NO: 1214761 - protein, 9 aa, Homo Sapiens
GDQEYSPEI

SEQ ID NO: 1214762 - protein, 9 aa, Homo Sapiens
EKSEPWVDK

SEQ ID NO: 1214763 - protein, 9 aa, Homo Sapiens
QEILERSRD

SEQ ID NO: 1214764 - protein, 9 aa, Homo Sapiens
LRTHTGSNI

SEQ ID NO: 1214765 - protein, 9 aa, Homo Sapiens
SPSHPSSWE

SEQ ID NO: 1214766 - protein, 9 aa, Homo Sapiens
LCVSRGTFS

SEQ ID NO: 1214767 - protein, 9 aa, Homo Sapiens
CRSSLKAYG

SEQ ID NO: 1214768 - protein, 9 aa, Homo Sapiens
NPNDLQFWL

SEQ ID NO: 1214769 - protein, 9 aa, Homo Sapiens
KCYEEKTQK

SEQ ID NO: 1214770 - protein, 9 aa, Homo Sapiens
KKKEAQAAV

SEQ ID NO: 1214771 - protein, 9 aa, Homo Sapiens
YCIFTIYLE

SEQ ID NO: 1214772 - protein, 9 aa, Homo Sapiens
SPDSVSWPG

SEQ ID NO: 1214773 - protein, 9 aa, Homo Sapiens
GYTPVVWGV

SEQ ID NO: 1214774 - protein, 9 aa, Homo Sapiens
SIEEREDEY

SEQ ID NO: 1214775 - protein, 9 aa, Homo Sapiens
ACRVEMSEV

SEQ ID NO: 1214776 - protein, 9 aa, Homo Sapiens
SRVRTSFFG

SEQ ID NO: 1214777 - protein, 9 aa, Homo Sapiens
PRSTCTLWT

SEQ ID NO: 1214778 - protein, 9 aa, Homo Sapiens
AMKILNKWD

SEQ ID NO: 1214779 - protein, 9 aa, Homo Sapiens
FSMFGELTV

SEQ ID NO: 1214780 - protein, 9 aa, Homo Sapiens
GQINTEVME

SEQ ID NO: 1214781 - protein, 9 aa, Homo Sapiens
TFQDQRYSV

SEQ ID NO: 1214782 - protein, 9 aa, Homo Sapiens
ESKRKRELH

SEQ ID NO: 1214783 - protein, 9 aa, Homo Sapiens
STPLVYEAT

SEQ ID NO: 1214784 - protein, 9 aa, Homo Sapiens
KFYLETQDG

SEQ ID NO: 1214785 - protein, 9 aa, Homo Sapiens
FDAFFTSSK

SEQ ID NO: 1214786 - protein, 9 aa, Homo Sapiens
DVRKIMNCG

SEQ ID NO: 1214787 - protein, 9 aa, Homo Sapiens
PFPAACETP

SEQ ID NO: 1214788 - protein, 9 aa, Homo Sapiens
IGQPRKTTI

SEQ ID NO: 1214789 - protein, 9 aa, Homo Sapiens
CVNTMGSYI

SEQ ID NO: 1214790 - protein, 9 aa, Homo Sapiens
QPVTEDWSA

SEQ ID NO: 1214791 - protein, 9 aa, Homo Sapiens
QRGQQMDPN

SEQ ID NO: 1214792 - protein, 9 aa, Homo Sapiens
DSDNLEAPL

SEQ ID NO: 1214793 - protein, 9 aa, Homo Sapiens
NHVSKVGSR

SEQ ID NO: 1214794 - protein, 9 aa, Homo Sapiens
YMEIHGAVY

SEQ ID NO: 1214795 - protein, 9 aa, Homo Sapiens
SLHDAHEFS

SEQ ID NO: 1214796 - protein, 9 aa, Homo Sapiens
LTAFLAETL

SEQ ID NO: 1214797 - protein, 9 aa, Homo Sapiens
QIGNDMGYV

SEQ ID NO: 1214798 - protein, 9 aa, Homo Sapiens
HIHTGNKPH

SEQ ID NO: 1214799 - protein, 9 aa, Homo Sapiens
TGTVYRYTL

SEQ ID NO: 1214800 - protein, 9 aa, Homo Sapiens
IPDVFSLPL

SEQ ID NO: 1214801 - protein, 9 aa, Homo Sapiens
AHQNLYRNV

SEQ ID NO: 1214802 - protein, 9 aa, Homo Sapiens
ELFQCHGAA

SEQ ID NO: 1214803 - protein, 9 aa, Homo Sapiens
GFIISNAMY

SEQ ID NO: 1214804 - protein, 9 aa, Homo Sapiens
YPCMEVLVK

SEQ ID NO: 1214805 - protein, 9 aa, Homo Sapiens
HFSAHFTLG

SEQ ID NO: 1214806 - protein, 9 aa, Homo Sapiens
ETSRRYNPE

SEQ ID NO: 1214807 - protein, 9 aa, Homo Sapiens
QEMELVMQE

SEQ ID NO: 1214808 - protein, 9 aa, Homo Sapiens
RGFSEEQLH

SEQ ID NO: 1214809 - protein, 9 aa, Homo Sapiens
HSLEVARTT

SEQ ID NO: 1214810 - protein, 9 aa, Homo Sapiens
LGTPITVRE

SEQ ID NO: 1214811 - protein, 9 aa, Homo Sapiens
SPHPPPACH

SEQ ID NO: 1214812 - protein, 9 aa, Homo Sapiens
TFLYLLGHD

SEQ ID NO: 1214813 - protein, 9 aa, Homo Sapiens
VLDRFYWND

SEQ ID NO: 1214814 - protein, 9 aa, Homo Sapiens
AMEMLLKMV

SEQ ID NO: 1214815 - protein, 9 aa, Homo Sapiens
HSWLEPTPG

SEQ ID NO: 1214816 - protein, 9 aa, Homo Sapiens
LIESVCQRD

SEQ ID NO: 1214817 - protein, 9 aa, Homo Sapiens
VHIANMCAA

SEQ ID NO: 1214818 - protein, 9 aa, Homo Sapiens
DVTPYMNHS

SEQ ID NO: 1214819 - protein, 9 aa, Homo Sapiens
KATPQSPSV

SEQ ID NO: 1214820 - protein, 9 aa, Homo Sapiens
EVDVIAKAL

SEQ ID NO: 1214821 - protein, 9 aa, Homo Sapiens
SISTVHYPV

SEQ ID NO: 1214822 - protein, 9 aa, Homo Sapiens
AQCVVLEAR

SEQ ID NO: 1214823 - protein, 9 aa, Homo Sapiens
DVSGTDGKV

SEQ ID NO: 1214824 - protein, 9 aa, Homo Sapiens
SESSTLLHH

SEQ ID NO: 1214825 - protein, 9 aa, Homo Sapiens
QALSAHTIL

SEQ ID NO: 1214826 - protein, 9 aa, Homo Sapiens
RQSGGATAL

SEQ ID NO: 1214827 - protein, 9 aa, Homo Sapiens
PQLQAPMAH

SEQ ID NO: 1214828 - protein, 9 aa, Homo Sapiens
FREPKHERC

SEQ ID NO: 1214829 - protein, 9 aa, Homo Sapiens
AAALWTWEM

SEQ ID NO: 1214830 - protein, 9 aa, Homo Sapiens
SVAVDAISI

SEQ ID NO: 1214831 - protein, 9 aa, Homo Sapiens
VAAAVLEKR

SEQ ID NO: 1214832 - protein, 9 aa, Homo Sapiens
LKLLVMEDD

SEQ ID NO: 1214833 - protein, 9 aa, Homo Sapiens
VAVQPELLK

SEQ ID NO: 1214834 - protein, 9 aa, Homo Sapiens
EGSLDSKHQ

SEQ ID NO: 1214835 - protein, 9 aa, Homo Sapiens
KNVMFTRYI

SEQ ID NO: 1214836 - protein, 9 aa, Homo Sapiens
LKKCPLDVT

SEQ ID NO: 1214837 - protein, 9 aa, Homo Sapiens
CMPRKVCID

SEQ ID NO: 1214838 - protein, 9 aa, Homo Sapiens
TEEQVQSTA

SEQ ID NO: 1214839 - protein, 9 aa, Homo Sapiens
RFLEKDRDN

SEQ ID NO: 1214840 - protein, 9 aa, Homo Sapiens
CEQIVVQVN

SEQ ID NO: 1214841 - protein, 9 aa, Homo Sapiens
IFVLFFGDG

SEQ ID NO: 1214842 - protein, 9 aa, Homo Sapiens
LPASMIGIV

SEQ ID NO: 1214843 - protein, 9 aa, Homo Sapiens
NTDHHILHV

SEQ ID NO: 1214844 - protein, 9 aa, Homo Sapiens
PLDTFGNMQ

SEQ ID NO: 1214845 - protein, 9 aa, Homo Sapiens
YPSEHRPSF

SEQ ID NO: 1214846 - protein, 9 aa, Homo Sapiens
IIVGLDNGG

SEQ ID NO: 1214847 - protein, 9 aa, Homo Sapiens
NHSATAEYS

SEQ ID NO: 1214848 - protein, 9 aa, Homo Sapiens
RRPALQAQA

SEQ ID NO: 1214849 - protein, 9 aa, Homo Sapiens
SLTKEKEEM

SEQ ID NO: 1214850 - protein, 9 aa, Homo Sapiens
VAVQHIRPV

SEQ ID NO: 1214851 - protein, 9 aa, Homo Sapiens
PALVVLAQG

SEQ ID NO: 1214852 - protein, 9 aa, Homo Sapiens
SKLHQAEGA

SEQ ID NO: 1214853 - protein, 9 aa, Homo Sapiens
EAQGNNRLK

SEQ ID NO: 1214854 - protein, 9 aa, Homo Sapiens
TVLLASSMV

SEQ ID NO: 1214855 - protein, 9 aa, Homo Sapiens
ELNSGRRYD

SEQ ID NO: 1214856 - protein, 9 aa, Homo Sapiens
RYLSKGVEA

SEQ ID NO: 1214857 - protein, 9 aa, Homo Sapiens
YETYMSVDD

SEQ ID NO: 1214858 - protein, 9 aa, Homo Sapiens
APVFSTSTL

SEQ ID NO: 1214859 - protein, 9 aa, Homo Sapiens
TYMLQNLFW

SEQ ID NO: 1214860 - protein, 9 aa, Homo Sapiens
EAEPQVVVG

SEQ ID NO: 1214861 - protein, 9 aa, Homo Sapiens
LEGVVTKIR

SEQ ID NO: 1214862 - protein, 9 aa, Homo Sapiens
GTVNSEIWN

SEQ ID NO: 1214863 - protein, 9 aa, Homo Sapiens
VYTVSLDKG

SEQ ID NO: 1214864 - protein, 9 aa, Homo Sapiens
SCPTIRIPN

SEQ ID NO: 1214865 - protein, 9 aa, Homo Sapiens
SKVRGRSEG

SEQ ID NO: 1214866 - protein, 9 aa, Homo Sapiens
RGKDGQGHT

SEQ ID NO: 1214867 - protein, 9 aa, Homo Sapiens
CSQGSAGSN

SEQ ID NO: 1214868 - protein, 9 aa, Homo Sapiens
PTDTKKSSM

SEQ ID NO: 1214869 - protein, 9 aa, Homo Sapiens
GPCLPRRAP

SEQ ID NO: 1214870 - protein, 9 aa, Homo Sapiens
TVFRNLASE

SEQ ID NO: 1214871 - protein, 9 aa, Homo Sapiens
LVAWLGLNV

SEQ ID NO: 1214872 - protein, 9 aa, Homo Sapiens
VIQVAPSRR

SEQ ID NO: 1214873 - protein, 9 aa, Homo Sapiens
NNLTDAKYS

SEQ ID NO: 1214874 - protein, 9 aa, Homo Sapiens
NLVLAAGDY

SEQ ID NO: 1214875 - protein, 9 aa, Homo Sapiens
ITDMELPPL

SEQ ID NO: 1214876 - protein, 9 aa, Homo Sapiens
IHVYENGGS

SEQ ID NO: 1214877 - protein, 9 aa, Homo Sapiens
VPGRLFVTV

SEQ ID NO: 1214878 - protein, 9 aa, Homo Sapiens
LHILKKEHT

SEQ ID NO: 1214879 - protein, 9 aa, Homo Sapiens
KGAVLFLQQ

SEQ ID NO: 1214880 - protein, 9 aa, Homo Sapiens
ESPEMAENE

SEQ ID NO: 1214881 - protein, 9 aa, Homo Sapiens
REHYERKLD

SEQ ID NO: 1214882 - protein, 9 aa, Homo Sapiens
LVCHLLVMA

SEQ ID NO: 1214883 - protein, 9 aa, Homo Sapiens
GLSKAMSTL

SEQ ID NO: 1214884 - protein, 9 aa, Homo Sapiens
VCTNRLDKP

SEQ ID NO: 1214885 - protein, 9 aa, Homo Sapiens
CWHLLRTSP

SEQ ID NO: 1214886 - protein, 9 aa, Homo Sapiens
PRKTTISPA

SEQ ID NO: 1214887 - protein, 9 aa, Homo Sapiens
EIFQESSQL

SEQ ID NO: 1214888 - protein, 9 aa, Homo Sapiens
EQCSIDEPV

SEQ ID NO: 1214889 - protein, 9 aa, Homo Sapiens
SILVPAVTS

SEQ ID NO: 1214890 - protein, 9 aa, Homo Sapiens
AAIDSFQDD

SEQ ID NO: 1214891 - protein, 9 aa, Homo Sapiens
KEMGKEETK

SEQ ID NO: 1214892 - protein, 9 aa, Homo Sapiens
QVFPLTMIR

SEQ ID NO: 1214893 - protein, 9 aa, Homo Sapiens
LLPLIPVRE

SEQ ID NO: 1214894 - protein, 9 aa, Homo Sapiens
GQQTNMMIQ

SEQ ID NO: 1214895 - protein, 9 aa, Homo Sapiens
IWQDISLLS

SEQ ID NO: 1214896 - protein, 9 aa, Homo Sapiens
TYSVRPGGS

SEQ ID NO: 1214897 - protein, 9 aa, Homo Sapiens
GNRKTVLFL

SEQ ID NO: 1214898 - protein, 9 aa, Homo Sapiens
GHAFSQRSN

SEQ ID NO: 1214899 - protein, 9 aa, Homo Sapiens
PITPSTYVC

SEQ ID NO: 1214900 - protein, 9 aa, Homo Sapiens
LVALNADKF

SEQ ID NO: 1214901 - protein, 9 aa, Homo Sapiens
RDVVDFDVR

SEQ ID NO: 1214902 - protein, 9 aa, Homo Sapiens
EADAFMFEG

SEQ ID NO: 1214903 - protein, 9 aa, Homo Sapiens
FRIHVEFQL

SEQ ID NO: 1214904 - protein, 9 aa, Homo Sapiens
NVQKDFIIQ

SEQ ID NO: 1214905 - protein, 9 aa, Homo Sapiens
LFYYHLLLV

SEQ ID NO: 1214906 - protein, 9 aa, Homo Sapiens
TAIWRIGSV

SEQ ID NO: 1214907 - protein, 9 aa, Homo Sapiens
GGKKIPLVL

SEQ ID NO: 1214908 - protein, 9 aa, Homo Sapiens
VDRHLHSPM

SEQ ID NO: 1214909 - protein, 9 aa, Homo Sapiens
ADQDEGINS

SEQ ID NO: 1214910 - protein, 9 aa, Homo Sapiens
GSKQIRCNT

SEQ ID NO: 1214911 - protein, 9 aa, Homo Sapiens
MALGEGAEL

SEQ ID NO: 1214912 - protein, 9 aa, Homo Sapiens
ADEEEEVET

SEQ ID NO: 1214913 - protein, 9 aa, Homo Sapiens
NEDNSKWDI

SEQ ID NO: 1214914 - protein, 9 aa, Homo Sapiens
WQARIISDP

SEQ ID NO: 1214915 - protein, 9 aa, Homo Sapiens
AHDKSPCRS

SEQ ID NO: 1214916 - protein, 9 aa, Homo Sapiens
HEQRVAQAS

SEQ ID NO: 1214917 - protein, 9 aa, Homo Sapiens
PYELRMIDV

SEQ ID NO: 1214918 - protein, 9 aa, Homo Sapiens
SFYWCLRKR

SEQ ID NO: 1214919 - protein, 9 aa, Homo Sapiens
TFLDFSSGE

SEQ ID NO: 1214920 - protein, 9 aa, Homo Sapiens
RTIYTIDGF

SEQ ID NO: 1214921 - protein, 9 aa, Homo Sapiens
GNLIKHQQV

SEQ ID NO: 1214922 - protein, 9 aa, Homo Sapiens
KAGVTQDLN

SEQ ID NO: 1214923 - protein, 9 aa, Homo Sapiens
IPCRVTDSQ

SEQ ID NO: 1214924 - protein, 9 aa, Homo Sapiens
EVPSPVWDV

SEQ ID NO: 1214925 - protein, 9 aa, Homo Sapiens
PCLDVEYNN

SEQ ID NO: 1214926 - protein, 9 aa, Homo Sapiens
LPRPVSLGL

SEQ ID NO: 1214927 - protein, 9 aa, Homo Sapiens
LKNKRRRMQ

SEQ ID NO: 1214928 - protein, 9 aa, Homo Sapiens
VVVCTCLVT

SEQ ID NO: 1214929 - protein, 9 aa, Homo Sapiens
DGGSMMGGE

SEQ ID NO: 1214930 - protein, 9 aa, Homo Sapiens
FNAIFEHEM

SEQ ID NO: 1214931 - protein, 9 aa, Homo Sapiens
EGHSIVGFV

SEQ ID NO: 1214932 - protein, 9 aa, Homo Sapiens
NYWTEVMDL

SEQ ID NO: 1214933 - protein, 9 aa, Homo Sapiens
ECIRLYAPV

SEQ ID NO: 1214934 - protein, 9 aa, Homo Sapiens
PLKNAVVRA

SEQ ID NO: 1214935 - protein, 9 aa, Homo Sapiens
YTVLAMISV

SEQ ID NO: 1214936 - protein, 9 aa, Homo Sapiens
DPEMATLPL

SEQ ID NO: 1214937 - protein, 9 aa, Homo Sapiens
QRPHSFSET

SEQ ID NO: 1214938 - protein, 9 aa, Homo Sapiens
DVWSLGCAM

SEQ ID NO: 1214939 - protein, 9 aa, Homo Sapiens
VGVCWWLPY

SEQ ID NO: 1214940 - protein, 9 aa, Homo Sapiens
EVDNGLRNP

SEQ ID NO: 1214941 - protein, 9 aa, Homo Sapiens
EMVFKNQPQ

SEQ ID NO: 1214942 - protein, 9 aa, Homo Sapiens
GGTRTLQRK

SEQ ID NO: 1214943 - protein, 9 aa, Homo Sapiens
CTPASSQCP

SEQ ID NO: 1214944 - protein, 9 aa, Homo Sapiens
LECRCQGST

SEQ ID NO: 1214945 - protein, 9 aa, Homo Sapiens
DLLTPGEDP

SEQ ID NO: 1214946 - protein, 9 aa, Homo Sapiens
LATTYSSGT

SEQ ID NO: 1214947 - protein, 9 aa, Homo Sapiens
SFVNNCFST

SEQ ID NO: 1214948 - protein, 9 aa, Homo Sapiens
RHTGIHTDT

SEQ ID NO: 1214949 - protein, 9 aa, Homo Sapiens
YGLEPQNKC

SEQ ID NO: 1214950 - protein, 9 aa, Homo Sapiens
LREGVTRMS

SEQ ID NO: 1214951 - protein, 9 aa, Homo Sapiens
LKMIVAHAV

SEQ ID NO: 1214952 - protein, 9 aa, Homo Sapiens
RDVKPENVL

SEQ ID NO: 1214953 - protein, 9 aa, Homo Sapiens
KSEPLPKSP

SEQ ID NO: 1214954 - protein, 9 aa, Homo Sapiens
YEWNDSGPE

SEQ ID NO: 1214955 - protein, 9 aa, Homo Sapiens
FAISFLTPM

SEQ ID NO: 1214956 - protein, 9 aa, Homo Sapiens
EFLFNMCLT

SEQ ID NO: 1214957 - protein, 9 aa, Homo Sapiens
LRESKQRED

SEQ ID NO: 1214958 - protein, 9 aa, Homo Sapiens
TKMYELSWR

SEQ ID NO: 1214959 - protein, 9 aa, Homo Sapiens
ELHQHEGFP

SEQ ID NO: 1214960 - protein, 9 aa, Homo Sapiens
IPVREQYKT

SEQ ID NO: 1214961 - protein, 9 aa, Homo Sapiens
VQVPQCKLF

SEQ ID NO: 1214962 - protein, 9 aa, Homo Sapiens
KISKSAGTM

SEQ ID NO: 1214963 - protein, 9 aa, Homo Sapiens
ISFHRNDPM

SEQ ID NO: 1214964 - protein, 9 aa, Homo Sapiens
GKKIPLVLS

SEQ ID NO: 1214965 - protein, 9 aa, Homo Sapiens
TMLPAQEAA

SEQ ID NO: 1214966 - protein, 9 aa, Homo Sapiens
TEATFDTLQ

SEQ ID NO: 1214967 - protein, 9 aa, Homo Sapiens
LEYKHRIKE

SEQ ID NO: 1214968 - protein, 9 aa, Homo Sapiens
RLQDNVPLL

SEQ ID NO: 1214969 - protein, 9 aa, Homo Sapiens
RFEKLMKIK

SEQ ID NO: 1214970 - protein, 9 aa, Homo Sapiens
IFQNVMVMI

SEQ ID NO: 1214971 - protein, 9 aa, Homo Sapiens
LDPDPANAP

SEQ ID NO: 1214972 - protein, 9 aa, Homo Sapiens
TSLNLDFNH

SEQ ID NO: 1214973 - protein, 9 aa, Homo Sapiens
GQEVLLQGY

SEQ ID NO: 1214974 - protein, 9 aa, Homo Sapiens
HIQMHMGGQ

SEQ ID NO: 1214975 - protein, 9 aa, Homo Sapiens
LLSELQQHR

SEQ ID NO: 1214976 - protein, 9 aa, Homo Sapiens
LRLLQRMKW

SEQ ID NO: 1214977 - protein, 9 aa, Homo Sapiens
NIYKSMLEK

SEQ ID NO: 1214978 - protein, 9 aa, Homo Sapiens
QRYLADLLL

SEQ ID NO: 1214979 - protein, 9 aa, Homo Sapiens
FDILEREKH

SEQ ID NO: 1214980 - protein, 9 aa, Homo Sapiens
RILDDKGGL

SEQ ID NO: 1214981 - protein, 9 aa, Homo Sapiens
LRGEGHGLV

SEQ ID NO: 1214982 - protein, 9 aa, Homo Sapiens
QIVAGGSTG

SEQ ID NO: 1214983 - protein, 9 aa, Homo Sapiens
FSMFLSMYL

SEQ ID NO: 1214984 - protein, 9 aa, Homo Sapiens
TPVQNTLLE

SEQ ID NO: 1214985 - protein, 9 aa, Homo Sapiens
PEGVPQVNG

SEQ ID NO: 1214986 - protein, 9 aa, Homo Sapiens
IFTRKDDLV

SEQ ID NO: 1214987 - protein, 9 aa, Homo Sapiens
ALGYNYKSK

SEQ ID NO: 1214988 - protein, 9 aa, Homo Sapiens
EVISWGGPR

SEQ ID NO: 1214989 - protein, 9 aa, Homo Sapiens
ILKMWVIEA

SEQ ID NO: 1214990 - protein, 9 aa, Homo Sapiens
IKDQLHKYV

SEQ ID NO: 1214991 - protein, 9 aa, Homo Sapiens
EAVYPALPP

SEQ ID NO: 1214992 - protein, 9 aa, Homo Sapiens
GGIDEHDIN

SEQ ID NO: 1214993 - protein, 9 aa, Homo Sapiens
VLMATVLNV

SEQ ID NO: 1214994 - protein, 9 aa, Homo Sapiens
VMGWLASGK

SEQ ID NO: 1214995 - protein, 9 aa, Homo Sapiens
ETRRISEGE

SEQ ID NO: 1214996 - protein, 9 aa, Homo Sapiens
GYGAPSTDK

SEQ ID NO: 1214997 - protein, 9 aa, Homo Sapiens
HCEAPRGYP

SEQ ID NO: 1214998 - protein, 9 aa, Homo Sapiens
YKQRLNTCG

SEQ ID NO: 1214999 - protein, 9 aa, Homo Sapiens
LQKVIVHHA

SEQ ID NO: 1215000 - protein, 9 aa, Homo Sapiens
SCHRPFHLE

SEQ ID NO: 1215001 - protein, 9 aa, Homo Sapiens
PPTVTIWMC

SEQ ID NO: 1215002 - protein, 9 aa, Homo Sapiens
NFLPMWMRS

SEQ ID NO: 1215003 - protein, 9 aa, Homo Sapiens
SASSLTLSS

SEQ ID NO: 1215004 - protein, 9 aa, Homo Sapiens
CSAPANQPR

SEQ ID NO: 1215005 - protein, 9 aa, Homo Sapiens
LEARLNIAI

SEQ ID NO: 1215006 - protein, 9 aa, Homo Sapiens
QVIPMVHII

SEQ ID NO: 1215007 - protein, 9 aa, Homo Sapiens
TYLQAAIDV

SEQ ID NO: 1215008 - protein, 9 aa, Homo Sapiens
GLRVREGSL

SEQ ID NO: 1215009 - protein, 9 aa, Homo Sapiens
IIGKDSTHV

SEQ ID NO: 1215010 - protein, 9 aa, Homo Sapiens
KLLHVLASA

SEQ ID NO: 1215011 - protein, 9 aa, Homo Sapiens
PGGPGFLKT

SEQ ID NO: 1215012 - protein, 9 aa, Homo Sapiens
TDGEGGTYT

SEQ ID NO: 1215013 - protein, 9 aa, Homo Sapiens
GDNRAIIVR

SEQ ID NO: 1215014 - protein, 9 aa, Homo Sapiens
IAIVRLIMV

SEQ ID NO: 1215015 - protein, 9 aa, Homo Sapiens
MRPLQRRLP

SEQ ID NO: 1215016 - protein, 9 aa, Homo Sapiens
ITGMHHHGQ

SEQ ID NO: 1215017 - protein, 9 aa, Homo Sapiens
IQMGKKCDG

SEQ ID NO: 1215018 - protein, 9 aa, Homo Sapiens
GGWTEEGRT

SEQ ID NO: 1215019 - protein, 9 aa, Homo Sapiens
LVVGCVSCF

SEQ ID NO: 1215020 - protein, 9 aa, Homo Sapiens
VSLDDVLYE

SEQ ID NO: 1215021 - protein, 9 aa, Homo Sapiens
DLEKEHEEK

SEQ ID NO: 1215022 - protein, 9 aa, Homo Sapiens
QPYASSLEK

SEQ ID NO: 1215023 - protein, 9 aa, Homo Sapiens
SHILEKKPV

SEQ ID NO: 1215024 - protein, 9 aa, Homo Sapiens
IIERPSYHL

SEQ ID NO: 1215025 - protein, 9 aa, Homo Sapiens
EMGYVEAKS

SEQ ID NO: 1215026 - protein, 9 aa, Homo Sapiens
KRSGMQVSQ

SEQ ID NO: 1215027 - protein, 9 aa, Homo Sapiens
RASATINMI

SEQ ID NO: 1215028 - protein, 9 aa, Homo Sapiens
GNHASESAV

SEQ ID NO: 1215029 - protein, 9 aa, Homo Sapiens
FFGGQQSHH

SEQ ID NO: 1215030 - protein, 9 aa, Homo Sapiens
TWPICWGGR

SEQ ID NO: 1215031 - protein, 9 aa, Homo Sapiens
IDNDSYPIP

SEQ ID NO: 1215032 - protein, 9 aa, Homo Sapiens
EVTDRFKLP

SEQ ID NO: 1215033 - protein, 9 aa, Homo Sapiens
STGIRDPLL

SEQ ID NO: 1215034 - protein, 9 aa, Homo Sapiens
LQLCLSEVD

SEQ ID NO: 1215035 - protein, 9 aa, Homo Sapiens
DAQAENKKS

SEQ ID NO: 1215036 - protein, 9 aa, Homo Sapiens
IHCFEGVTS

SEQ ID NO: 1215037 - protein, 9 aa, Homo Sapiens
ERNQESPNT

SEQ ID NO: 1215038 - protein, 9 aa, Homo Sapiens
NTSPSELRD

SEQ ID NO: 1215039 - protein, 9 aa, Homo Sapiens
TRCDDTAAA

SEQ ID NO: 1215040 - protein, 9 aa, Homo Sapiens
SVNCSILPC

SEQ ID NO: 1215041 - protein, 9 aa, Homo Sapiens
DTRLRIQAE

SEQ ID NO: 1215042 - protein, 9 aa, Homo Sapiens
ESVLQDNIF

SEQ ID NO: 1215043 - protein, 9 aa, Homo Sapiens
LLILVSQLR

SEQ ID NO: 1215044 - protein, 9 aa, Homo Sapiens
SVSSFMISN

SEQ ID NO: 1215045 - protein, 9 aa, Homo Sapiens
FAYTGRIAQ

SEQ ID NO: 1215046 - protein, 9 aa, Homo Sapiens
NSNLQHVVI

SEQ ID NO: 1215047 - protein, 9 aa, Homo Sapiens
KDAGPIAGL

SEQ ID NO: 1215048 - protein, 9 aa, Homo Sapiens
ADTRRAMGE

SEQ ID NO: 1215049 - protein, 9 aa, Homo Sapiens
TQQRRMSLG

SEQ ID NO: 1215050 - protein, 9 aa, Homo Sapiens
NFCGWASLS

SEQ ID NO: 1215051 - protein, 9 aa, Homo Sapiens
SEESLHTSE

SEQ ID NO: 1215052 - protein, 9 aa, Homo Sapiens
GLGWRVSSK

SEQ ID NO: 1215053 - protein, 9 aa, Homo Sapiens
AKPKDIATN

SEQ ID NO: 1215054 - protein, 9 aa, Homo Sapiens
YDSFLNYPS

SEQ ID NO: 1215055 - protein, 9 aa, Homo Sapiens
KREPLLSFL

SEQ ID NO: 1215056 - protein, 9 aa, Homo Sapiens
ADDSVGHIP

SEQ ID NO: 1215057 - protein, 9 aa, Homo Sapiens
GRPRWRDYK

SEQ ID NO: 1215058 - protein, 9 aa, Homo Sapiens
RSRGCGRGH

SEQ ID NO: 1215059 - protein, 9 aa, Homo Sapiens
GVDHVRCSV

SEQ ID NO: 1215060 - protein, 9 aa, Homo Sapiens
FFFLHKEFL

SEQ ID NO: 1215061 - protein, 9 aa, Homo Sapiens
TPSPHPPPA

SEQ ID NO: 1215062 - protein, 9 aa, Homo Sapiens
LFTFIWFLS

SEQ ID NO: 1215063 - protein, 9 aa, Homo Sapiens
IDECRIIPE

SEQ ID NO: 1215064 - protein, 9 aa, Homo Sapiens
HVFTVGRIC

SEQ ID NO: 1215065 - protein, 9 aa, Homo Sapiens
VAFVVTQHP

SEQ ID NO: 1215066 - protein, 9 aa, Homo Sapiens
RPTILTYHD

SEQ ID NO: 1215067 - protein, 9 aa, Homo Sapiens
QSQKCKSEE

SEQ ID NO: 1215068 - protein, 9 aa, Homo Sapiens
YSKGTPSYD

SEQ ID NO: 1215069 - protein, 9 aa, Homo Sapiens
PQPHWITSP

SEQ ID NO: 1215070 - protein, 9 aa, Homo Sapiens
TSTRKRPYE

SEQ ID NO: 1215071 - protein, 9 aa, Homo Sapiens
PEDNNSTSA

SEQ ID NO: 1215072 - protein, 9 aa, Homo Sapiens
TTFDRPTYL

SEQ ID NO: 1215073 - protein, 9 aa, Homo Sapiens
ISSVDLSYC

SEQ ID NO: 1215074 - protein, 9 aa, Homo Sapiens
MWMRSLKPW

SEQ ID NO: 1215075 - protein, 9 aa, Homo Sapiens
LHIMDPGCL

SEQ ID NO: 1215076 - protein, 9 aa, Homo Sapiens
LTETRVQVW

SEQ ID NO: 1215077 - protein, 9 aa, Homo Sapiens
LLVFILLFS

SEQ ID NO: 1215078 - protein, 9 aa, Homo Sapiens
YNHDNEKVQ

SEQ ID NO: 1215079 - protein, 9 aa, Homo Sapiens
KQEIAKYHK

SEQ ID NO: 1215080 - protein, 9 aa, Homo Sapiens
YLVAIVICD

SEQ ID NO: 1215081 - protein, 9 aa, Homo Sapiens
ITIAVMGWL

SEQ ID NO: 1215082 - protein, 9 aa, Homo Sapiens
PPECALGIG

SEQ ID NO: 1215083 - protein, 9 aa, Homo Sapiens
LIYIIRQKK

SEQ ID NO: 1215084 - protein, 9 aa, Homo Sapiens
EREDEYQRV

SEQ ID NO: 1215085 - protein, 9 aa, Homo Sapiens
YIFDLLHKN

SEQ ID NO: 1215086 - protein, 9 aa, Homo Sapiens
VSSMESFPS

SEQ ID NO: 1215087 - protein, 9 aa, Homo Sapiens
LHRTVQKCQ

SEQ ID NO: 1215088 - protein, 9 aa, Homo Sapiens
QLEQFEKDN

SEQ ID NO: 1215089 - protein, 9 aa, Homo Sapiens
KEHEEKERI

SEQ ID NO: 1215090 - protein, 9 aa, Homo Sapiens
RNFDDILRV

SEQ ID NO: 1215091 - protein, 9 aa, Homo Sapiens
HNIKAAAKA

SEQ ID NO: 1215092 - protein, 9 aa, Homo Sapiens
KLSGGLEPK

SEQ ID NO: 1215093 - protein, 9 aa, Homo Sapiens
NTFVKNVEY

SEQ ID NO: 1215094 - protein, 9 aa, Homo Sapiens
EGTTGNGLD

SEQ ID NO: 1215095 - protein, 9 aa, Homo Sapiens
ARQNSVTDT

SEQ ID NO: 1215096 - protein, 9 aa, Homo Sapiens
VPDIQGSGK

SEQ ID NO: 1215097 - protein, 9 aa, Homo Sapiens
GTLAKSTGT

SEQ ID NO: 1215098 - protein, 9 aa, Homo Sapiens
GLDSGADTG

SEQ ID NO: 1215099 - protein, 9 aa, Homo Sapiens
RFMLLFSWQ

SEQ ID NO: 1215100 - protein, 9 aa, Homo Sapiens
QENDAELDR

SEQ ID NO: 1215101 - protein, 9 aa, Homo Sapiens
KLMAHYGRL

SEQ ID NO: 1215102 - protein, 9 aa, Homo Sapiens
YDKGVEIYE

SEQ ID NO: 1215103 - protein, 9 aa, Homo Sapiens
IMSVIITIL

SEQ ID NO: 1215104 - protein, 9 aa, Homo Sapiens
HLAKIFYFL

SEQ ID NO: 1215105 - protein, 9 aa, Homo Sapiens
VYPGLELPL

SEQ ID NO: 1215106 - protein, 9 aa, Homo Sapiens
QDLSCTLGS

SEQ ID NO: 1215107 - protein, 9 aa, Homo Sapiens
GPHGHHWQG

SEQ ID NO: 1215108 - protein, 9 aa, Homo Sapiens
GNVFSRREN

SEQ ID NO: 1215109 - protein, 9 aa, Homo Sapiens
STLVISLAS

SEQ ID NO: 1215110 - protein, 9 aa, Homo Sapiens
DVNMFNTIL

SEQ ID NO: 1215111 - protein, 9 aa, Homo Sapiens
PTWRNSMST

SEQ ID NO: 1215112 - protein, 9 aa, Homo Sapiens
LVSDICARV

SEQ ID NO: 1215113 - protein, 9 aa, Homo Sapiens
IANGMYYLE

SEQ ID NO: 1215114 - protein, 9 aa, Homo Sapiens
TVDFLVSLT

SEQ ID NO: 1215115 - protein, 9 aa, Homo Sapiens
ECCMCNLRG

SEQ ID NO: 1215116 - protein, 9 aa, Homo Sapiens
SVSWPGCCS

SEQ ID NO: 1215117 - protein, 9 aa, Homo Sapiens
VCQGHWQIV

SEQ ID NO: 1215118 - protein, 9 aa, Homo Sapiens
RAYANDTFT

SEQ ID NO: 1215119 - protein, 9 aa, Homo Sapiens
KENYVIFNN

SEQ ID NO: 1215120 - protein, 9 aa, Homo Sapiens
TRSPLLSRR

SEQ ID NO: 1215121 - protein, 9 aa, Homo Sapiens
TSPDLQITV

SEQ ID NO: 1215122 - protein, 9 aa, Homo Sapiens
INSFLTDAN

SEQ ID NO: 1215123 - protein, 9 aa, Homo Sapiens
CHLYNRCFG

SEQ ID NO: 1215124 - protein, 9 aa, Homo Sapiens
VISYLEKTF

SEQ ID NO: 1215125 - protein, 9 aa, Homo Sapiens
ENTDASASA

SEQ ID NO: 1215126 - protein, 9 aa, Homo Sapiens
GTVFDGHPI

SEQ ID NO: 1215127 - protein, 9 aa, Homo Sapiens
SCHTQFSII

SEQ ID NO: 1215128 - protein, 9 aa, Homo Sapiens
VLWEVLRKM

SEQ ID NO: 1215129 - protein, 9 aa, Homo Sapiens
YRPCCWATT

SEQ ID NO: 1215130 - protein, 9 aa, Homo Sapiens
PVLLTLPMA

SEQ ID NO: 1215131 - protein, 9 aa, Homo Sapiens
DIDKQGRIM

SEQ ID NO: 1215132 - protein, 9 aa, Homo Sapiens
RKDMTIDFD

SEQ ID NO: 1215133 - protein, 9 aa, Homo Sapiens
KDAKKQFKK

SEQ ID NO: 1215134 - protein, 9 aa, Homo Sapiens
VLRKMGLRP

SEQ ID NO: 1215135 - protein, 9 aa, Homo Sapiens
HSPLQSTPL

SEQ ID NO: 1215136 - protein, 9 aa, Homo Sapiens
VSWSSINPK

SEQ ID NO: 1215137 - protein, 9 aa, Homo Sapiens
LKCNATSLQ

SEQ ID NO: 1215138 - protein, 9 aa, Homo Sapiens
HQLLHTGEW

SEQ ID NO: 1215139 - protein, 9 aa, Homo Sapiens
VCHVLAFLG

SEQ ID NO: 1215140 - protein, 9 aa, Homo Sapiens
RVKAWTSQY

SEQ ID NO: 1215141 - protein, 9 aa, Homo Sapiens
MFSDWDKWL

SEQ ID NO: 1215142 - protein, 9 aa, Homo Sapiens
VCDKIFRKN

SEQ ID NO: 1215143 - protein, 9 aa, Homo Sapiens
VISLASTQA

SEQ ID NO: 1215144 - protein, 9 aa, Homo Sapiens
LFLDTTGSP

SEQ ID NO: 1215145 - protein, 9 aa, Homo Sapiens
PEKEEDSSE

SEQ ID NO: 1215146 - protein, 9 aa, Homo Sapiens
LEKCLHKTH

SEQ ID NO: 1215147 - protein, 9 aa, Homo Sapiens
TYESHILVC

SEQ ID NO: 1215148 - protein, 9 aa, Homo Sapiens
AMLTLACMD

SEQ ID NO: 1215149 - protein, 9 aa, Homo Sapiens
VMTCQEYVY

SEQ ID NO: 1215150 - protein, 9 aa, Homo Sapiens
LFLAVVGIT

SEQ ID NO: 1215151 - protein, 9 aa, Homo Sapiens
EKAVAAMDK

SEQ ID NO: 1215152 - protein, 9 aa, Homo Sapiens
SAAATTSPT

SEQ ID NO: 1215153 - protein, 9 aa, Homo Sapiens
FVHSDAANK

SEQ ID NO: 1215154 - protein, 9 aa, Homo Sapiens
SSDSELLWD

SEQ ID NO: 1215155 - protein, 9 aa, Homo Sapiens
PCYYRGHMS

SEQ ID NO: 1215156 - protein, 9 aa, Homo Sapiens
MRQGEATLS

SEQ ID NO: 1215157 - protein, 9 aa, Homo Sapiens
PMPRPVSLS

SEQ ID NO: 1215158 - protein, 9 aa, Homo Sapiens
SDSHLRTPM

SEQ ID NO: 1215159 - protein, 9 aa, Homo Sapiens
DVCVKTCSC

SEQ ID NO: 1215160 - protein, 9 aa, Homo Sapiens
KELELSNLD

SEQ ID NO: 1215161 - protein, 9 aa, Homo Sapiens
HQLLEPCPP

SEQ ID NO: 1215162 - protein, 9 aa, Homo Sapiens
EKFFFWDYD

SEQ ID NO: 1215163 - protein, 9 aa, Homo Sapiens
NRPQQPPPR

SEQ ID NO: 1215164 - protein, 9 aa, Homo Sapiens
VMFRIHVEF

SEQ ID NO: 1215165 - protein, 9 aa, Homo Sapiens
LQLMIMQNL

SEQ ID NO: 1215166 - protein, 9 aa, Homo Sapiens
AKCVLEAHG

SEQ ID NO: 1215167 - protein, 9 aa, Homo Sapiens
EDMKVMEER

SEQ ID NO: 1215168 - protein, 9 aa, Homo Sapiens
GDQTVQAPA

SEQ ID NO: 1215169 - protein, 9 aa, Homo Sapiens
LPQRPAFAA

SEQ ID NO: 1215170 - protein, 9 aa, Homo Sapiens
HYPVFLDKQ

SEQ ID NO: 1215171 - protein, 9 aa, Homo Sapiens
SVEVFLPVF

SEQ ID NO: 1215172 - protein, 9 aa, Homo Sapiens
LSKAMSTLS

SEQ ID NO: 1215173 - protein, 9 aa, Homo Sapiens
HVSPCTRFN

SEQ ID NO: 1215174 - protein, 9 aa, Homo Sapiens
NQKKTLIGT

SEQ ID NO: 1215175 - protein, 9 aa, Homo Sapiens
EVTKLVNTL

SEQ ID NO: 1215176 - protein, 9 aa, Homo Sapiens
NHTIHGMSQ

SEQ ID NO: 1215177 - protein, 9 aa, Homo Sapiens
CLLPVLAIS

SEQ ID NO: 1215178 - protein, 9 aa, Homo Sapiens
EKKGDENFT

SEQ ID NO: 1215179 - protein, 9 aa, Homo Sapiens
DDFANGTAQ

SEQ ID NO: 1215180 - protein, 9 aa, Homo Sapiens
KEVPTHFLD

SEQ ID NO: 1215181 - protein, 9 aa, Homo Sapiens
VDFNEFILF

SEQ ID NO: 1215182 - protein, 9 aa, Homo Sapiens
TAHAIILDF

SEQ ID NO: 1215183 - protein, 9 aa, Homo Sapiens
VFALRANTD

SEQ ID NO: 1215184 - protein, 9 aa, Homo Sapiens
GLYVYDDLK

SEQ ID NO: 1215185 - protein, 9 aa, Homo Sapiens
DKDRDDHSF

SEQ ID NO: 1215186 - protein, 9 aa, Homo Sapiens
QPLVGEETQ

SEQ ID NO: 1215187 - protein, 9 aa, Homo Sapiens
HQAALLGDL

SEQ ID NO: 1215188 - protein, 9 aa, Homo Sapiens
SVIDQYVDY

SEQ ID NO: 1215189 - protein, 9 aa, Homo Sapiens
ECGKAFTDM

SEQ ID NO: 1215190 - protein, 9 aa, Homo Sapiens
RYYPEGVHK

SEQ ID NO: 1215191 - protein, 9 aa, Homo Sapiens
GSASTHRHP

SEQ ID NO: 1215192 - protein, 9 aa, Homo Sapiens
QVWDHRPPH

SEQ ID NO: 1215193 - protein, 9 aa, Homo Sapiens
MKVLEGMTF

SEQ ID NO: 1215194 - protein, 9 aa, Homo Sapiens
KRQPLLWNM

SEQ ID NO: 1215195 - protein, 9 aa, Homo Sapiens
PVGYFVSND

SEQ ID NO: 1215196 - protein, 9 aa, Homo Sapiens
RPYMTPERI

SEQ ID NO: 1215197 - protein, 9 aa, Homo Sapiens
LEGYGMQEL

SEQ ID NO: 1215198 - protein, 9 aa, Homo Sapiens
RLFKATGPR

SEQ ID NO: 1215199 - protein, 9 aa, Homo Sapiens
SDICARVRD

SEQ ID NO: 1215200 - protein, 9 aa, Homo Sapiens
EEATRLPTS

SEQ ID NO: 1215201 - protein, 9 aa, Homo Sapiens
VSGDGAQGE

SEQ ID NO: 1215202 - protein, 9 aa, Homo Sapiens
HGGIAGRSA

SEQ ID NO: 1215203 - protein, 9 aa, Homo Sapiens
HLFHTSYWE

SEQ ID NO: 1215204 - protein, 9 aa, Homo Sapiens
PEEHGHQSH

SEQ ID NO: 1215205 - protein, 9 aa, Homo Sapiens
NKAVNMIFA

SEQ ID NO: 1215206 - protein, 9 aa, Homo Sapiens
TESIMFMGR

SEQ ID NO: 1215207 - protein, 9 aa, Homo Sapiens
KKTKNISHD

SEQ ID NO: 1215208 - protein, 9 aa, Homo Sapiens
GAAFHLAIY

SEQ ID NO: 1215209 - protein, 9 aa, Homo Sapiens
KTRNGSFHI

SEQ ID NO: 1215210 - protein, 9 aa, Homo Sapiens
TFSIINIYK

SEQ ID NO: 1215211 - protein, 9 aa, Homo Sapiens
TPHQAKQDV

SEQ ID NO: 1215212 - protein, 9 aa, Homo Sapiens
ESDVFEITD

SEQ ID NO: 1215213 - protein, 9 aa, Homo Sapiens
GSPLILIAP

SEQ ID NO: 1215214 - protein, 9 aa, Homo Sapiens
FGFWASYHI

SEQ ID NO: 1215215 - protein, 9 aa, Homo Sapiens
PVNRRTTTS

SEQ ID NO: 1215216 - protein, 9 aa, Homo Sapiens
QHLEGEFCD

SEQ ID NO: 1215217 - protein, 9 aa, Homo Sapiens
CFLCKLSFE

SEQ ID NO: 1215218 - protein, 9 aa, Homo Sapiens
APCTTAEFP

SEQ ID NO: 1215219 - protein, 9 aa, Homo Sapiens
EIKLFSKEL

SEQ ID NO: 1215220 - protein, 9 aa, Homo Sapiens
KRGAFGHEH

SEQ ID NO: 1215221 - protein, 9 aa, Homo Sapiens
PCSSCTGPS

SEQ ID NO: 1215222 - protein, 9 aa, Homo Sapiens
GQCMETTAQ

SEQ ID NO: 1215223 - protein, 9 aa, Homo Sapiens
CSQPRRPKP

SEQ ID NO: 1215224 - protein, 9 aa, Homo Sapiens
HFRKVSEFL

SEQ ID NO: 1215225 - protein, 9 aa, Homo Sapiens
HLWKHYSDY

SEQ ID NO: 1215226 - protein, 9 aa, Homo Sapiens
RLNAELVVF

SEQ ID NO: 1215227 - protein, 9 aa, Homo Sapiens
YQCGKQGHW

SEQ ID NO: 1215228 - protein, 9 aa, Homo Sapiens
AGLLQLTAA

SEQ ID NO: 1215229 - protein, 9 aa, Homo Sapiens
LSAHTILPE

SEQ ID NO: 1215230 - protein, 9 aa, Homo Sapiens
LTPREQTWL

SEQ ID NO: 1215231 - protein, 9 aa, Homo Sapiens
RLARAVREG

SEQ ID NO: 1215232 - protein, 9 aa, Homo Sapiens
GHVSPCTRF

SEQ ID NO: 1215233 - protein, 9 aa, Homo Sapiens
RSQGLHEEA

SEQ ID NO: 1215234 - protein, 9 aa, Homo Sapiens
IMKEKKKAW

SEQ ID NO: 1215235 - protein, 9 aa, Homo Sapiens
DKTFPQSSL

SEQ ID NO: 1215236 - protein, 9 aa, Homo Sapiens
CMIAIVLAI

SEQ ID NO: 1215237 - protein, 9 aa, Homo Sapiens
PNDEEKMIL

SEQ ID NO: 1215238 - protein, 9 aa, Homo Sapiens
IYTVTGQSW

SEQ ID NO: 1215239 - protein, 9 aa, Homo Sapiens
ATHRAGGLP

SEQ ID NO: 1215240 - protein, 9 aa, Homo Sapiens
PYAYQGFPF

SEQ ID NO: 1215241 - protein, 9 aa, Homo Sapiens
TLQWNAGSG

SEQ ID NO: 1215242 - protein, 9 aa, Homo Sapiens
YILSQTEVI

SEQ ID NO: 1215243 - protein, 9 aa, Homo Sapiens
RFSVTYIEH

SEQ ID NO: 1215244 - protein, 9 aa, Homo Sapiens
IRPYQCHIC

SEQ ID NO: 1215245 - protein, 9 aa, Homo Sapiens
ASSEKASSI

SEQ ID NO: 1215246 - protein, 9 aa, Homo Sapiens
EEHTIITDM

SEQ ID NO: 1215247 - protein, 9 aa, Homo Sapiens
IYKAPSFTS

SEQ ID NO: 1215248 - protein, 9 aa, Homo Sapiens
IIQMWSIWD

SEQ ID NO: 1215249 - protein, 9 aa, Homo Sapiens
KGPPLAPSP

SEQ ID NO: 1215250 - protein, 9 aa, Homo Sapiens
NKAIDQLQL

SEQ ID NO: 1215251 - protein, 9 aa, Homo Sapiens
PDFHPHPGP

SEQ ID NO: 1215252 - protein, 9 aa, Homo Sapiens
EEFQVVKVG

SEQ ID NO: 1215253 - protein, 9 aa, Homo Sapiens
DPFLHPGFC

SEQ ID NO: 1215254 - protein, 9 aa, Homo Sapiens
KFRFDASDK

SEQ ID NO: 1215255 - protein, 9 aa, Homo Sapiens
VLPDRKVWS

SEQ ID NO: 1215256 - protein, 9 aa, Homo Sapiens
LPQTILHKY

SEQ ID NO: 1215257 - protein, 9 aa, Homo Sapiens
LIGISIVSL

SEQ ID NO: 1215258 - protein, 9 aa, Homo Sapiens
GLSHGGSWS

SEQ ID NO: 1215259 - protein, 9 aa, Homo Sapiens
KSISLDSGF

SEQ ID NO: 1215260 - protein, 9 aa, Homo Sapiens
HQQQQHLLQ

SEQ ID NO: 1215261 - protein, 9 aa, Homo Sapiens
LPALCLHLD

SEQ ID NO: 1215262 - protein, 9 aa, Homo Sapiens
MLHLEVVGL

SEQ ID NO: 1215263 - protein, 9 aa, Homo Sapiens
DYECYDVYE

SEQ ID NO: 1215264 - protein, 9 aa, Homo Sapiens
PPPPHGPPP

SEQ ID NO: 1215265 - protein, 9 aa, Homo Sapiens
RSYGRDIVE

SEQ ID NO: 1215266 - protein, 9 aa, Homo Sapiens
FYNCALVIF

SEQ ID NO: 1215267 - protein, 9 aa, Homo Sapiens
KKEPSCKAK

SEQ ID NO: 1215268 - protein, 9 aa, Homo Sapiens
LCHGVKIGF

SEQ ID NO: 1215269 - protein, 9 aa, Homo Sapiens
LVLAGNSTS

SEQ ID NO: 1215270 - protein, 9 aa, Homo Sapiens
HGAEANIKA

SEQ ID NO: 1215271 - protein, 9 aa, Homo Sapiens
LQHLDGHQQ

SEQ ID NO: 1215272 - protein, 9 aa, Homo Sapiens
AAGASVAAR

SEQ ID NO: 1215273 - protein, 9 aa, Homo Sapiens
VGLVALTRL

SEQ ID NO: 1215274 - protein, 9 aa, Homo Sapiens
VFMSDTELF

SEQ ID NO: 1215275 - protein, 9 aa, Homo Sapiens
RAFTVCWLP

SEQ ID NO: 1215276 - protein, 9 aa, Homo Sapiens
HLELREGVT

SEQ ID NO: 1215277 - protein, 9 aa, Homo Sapiens
SRPAHASRP

SEQ ID NO: 1215278 - protein, 9 aa, Homo Sapiens
LKESGDDSL

SEQ ID NO: 1215279 - protein, 9 aa, Homo Sapiens
TTPSWCEEP

SEQ ID NO: 1215280 - protein, 9 aa, Homo Sapiens
APAPAAVPL

SEQ ID NO: 1215281 - protein, 9 aa, Homo Sapiens
GAAFPSKAM

SEQ ID NO: 1215282 - protein, 9 aa, Homo Sapiens
YERKLDRAN

SEQ ID NO: 1215283 - protein, 9 aa, Homo Sapiens
VIIGKDQEV

SEQ ID NO: 1215284 - protein, 9 aa, Homo Sapiens
LSKCPWNEY

SEQ ID NO: 1215285 - protein, 9 aa, Homo Sapiens
IYNVDLMNC

SEQ ID NO: 1215286 - protein, 9 aa, Homo Sapiens
GPTNYRLRM

SEQ ID NO: 1215287 - protein, 9 aa, Homo Sapiens
AQLLEAHAL

SEQ ID NO: 1215288 - protein, 9 aa, Homo Sapiens
KASEESLHT

SEQ ID NO: 1215289 - protein, 9 aa, Homo Sapiens
ALKDVAIVV

SEQ ID NO: 1215290 - protein, 9 aa, Homo Sapiens
HIRTHTGSN

SEQ ID NO: 1215291 - protein, 9 aa, Homo Sapiens
KEIAKKVQE

SEQ ID NO: 1215292 - protein, 9 aa, Homo Sapiens
TCMFAFFRN

SEQ ID NO: 1215293 - protein, 9 aa, Homo Sapiens
TEKLLALDE

SEQ ID NO: 1215294 - protein, 9 aa, Homo Sapiens
ELEGMLNPF

SEQ ID NO: 1215295 - protein, 9 aa, Homo Sapiens
THTGEKHCK

SEQ ID NO: 1215296 - protein, 9 aa, Homo Sapiens
KLCTLAWSV

SEQ ID NO: 1215297 - protein, 9 aa, Homo Sapiens
APCGAAGAR

SEQ ID NO: 1215298 - protein, 9 aa, Homo Sapiens
CQPQQGPPS

SEQ ID NO: 1215299 - protein, 9 aa, Homo Sapiens
STCTLWTWM

SEQ ID NO: 1215300 - protein, 9 aa, Homo Sapiens
HDYIFKDMF

SEQ ID NO: 1215301 - protein, 9 aa, Homo Sapiens
QRFMASWAL

SEQ ID NO: 1215302 - protein, 9 aa, Homo Sapiens
SEGESWPDI

SEQ ID NO: 1215303 - protein, 9 aa, Homo Sapiens
PPVGGDLTS

SEQ ID NO: 1215304 - protein, 9 aa, Homo Sapiens
KYGPTLLCA

SEQ ID NO: 1215305 - protein, 9 aa, Homo Sapiens
ANDTFTPSE

SEQ ID NO: 1215306 - protein, 9 aa, Homo Sapiens
PEPGLQVRA

SEQ ID NO: 1215307 - protein, 9 aa, Homo Sapiens
VCQCFLRSG

SEQ ID NO: 1215308 - protein, 9 aa, Homo Sapiens
DAFMFEGHD

SEQ ID NO: 1215309 - protein, 9 aa, Homo Sapiens
PLQLMIMQN

SEQ ID NO: 1215310 - protein, 9 aa, Homo Sapiens
GPGVFGGPD

SEQ ID NO: 1215311 - protein, 9 aa, Homo Sapiens
GDANDARND

SEQ ID NO: 1215312 - protein, 9 aa, Homo Sapiens
MDASNGYRT

SEQ ID NO: 1215313 - protein, 9 aa, Homo Sapiens
PLHLINIRH

SEQ ID NO: 1215314 - protein, 9 aa, Homo Sapiens
EKLDITGNG

SEQ ID NO: 1215315 - protein, 9 aa, Homo Sapiens
LPCLKRGAK

SEQ ID NO: 1215316 - protein, 9 aa, Homo Sapiens
TQDLAEAGR

SEQ ID NO: 1215317 - protein, 9 aa, Homo Sapiens
LPSDWEAFA

SEQ ID NO: 1215318 - protein, 9 aa, Homo Sapiens
DNAEASGFC

SEQ ID NO: 1215319 - protein, 9 aa, Homo Sapiens
AGSQEYVKV

SEQ ID NO: 1215320 - protein, 9 aa, Homo Sapiens
IGESTIHRT

SEQ ID NO: 1215321 - protein, 9 aa, Homo Sapiens
AAGGPCLPR

SEQ ID NO: 1215322 - protein, 9 aa, Homo Sapiens
HRELCLEIP

SEQ ID NO: 1215323 - protein, 9 aa, Homo Sapiens
WIIKESNIL

SEQ ID NO: 1215324 - protein, 9 aa, Homo Sapiens
LNAHSDCCI

SEQ ID NO: 1215325 - protein, 9 aa, Homo Sapiens
LGRHASCYI

SEQ ID NO: 1215326 - protein, 9 aa, Homo Sapiens
QSWSGTEKL

SEQ ID NO: 1215327 - protein, 9 aa, Homo Sapiens
FCGRLNMHI

SEQ ID NO: 1215328 - protein, 9 aa, Homo Sapiens
SAVSNTPLV

SEQ ID NO: 1215329 - protein, 9 aa, Homo Sapiens
FSTLCVCRI

SEQ ID NO: 1215330 - protein, 9 aa, Homo Sapiens
ASINIHAGS

SEQ ID NO: 1215331 - protein, 9 aa, Homo Sapiens
FKLTFVKVN

SEQ ID NO: 1215332 - protein, 9 aa, Homo Sapiens
GLRGEKRKQ

SEQ ID NO: 1215333 - protein, 9 aa, Homo Sapiens
LQDEDYQVS

SEQ ID NO: 1215334 - protein, 9 aa, Homo Sapiens
QNNYTINNK

SEQ ID NO: 1215335 - protein, 9 aa, Homo Sapiens
DSQRRPLVQ

SEQ ID NO: 1215336 - protein, 9 aa, Homo Sapiens
MFIDAPYEK

SEQ ID NO: 1215337 - protein, 9 aa, Homo Sapiens
NCNGFALSD

SEQ ID NO: 1215338 - protein, 9 aa, Homo Sapiens
EVLESGPMR

SEQ ID NO: 1215339 - protein, 9 aa, Homo Sapiens
TPWQPTRPF

SEQ ID NO: 1215340 - protein, 9 aa, Homo Sapiens
YLLSKLSSD

SEQ ID NO: 1215341 - protein, 9 aa, Homo Sapiens
GVRTRELES

SEQ ID NO: 1215342 - protein, 9 aa, Homo Sapiens
FSVNCSILP

SEQ ID NO: 1215343 - protein, 9 aa, Homo Sapiens
HTSIRPYQC

SEQ ID NO: 1215344 - protein, 9 aa, Homo Sapiens
FSFSFSPGG

SEQ ID NO: 1215345 - protein, 9 aa, Homo Sapiens
ARIISDPAT

SEQ ID NO: 1215346 - protein, 9 aa, Homo Sapiens
RLTRTGIIV

SEQ ID NO: 1215347 - protein, 9 aa, Homo Sapiens
KVLCIDQLD

SEQ ID NO: 1215348 - protein, 9 aa, Homo Sapiens
SFMISNGIE

SEQ ID NO: 1215349 - protein, 9 aa, Homo Sapiens
VAFSTTSNE

SEQ ID NO: 1215350 - protein, 9 aa, Homo Sapiens
GMWGLPPSP

SEQ ID NO: 1215351 - protein, 9 aa, Homo Sapiens
DMCTAKFGS

SEQ ID NO: 1215352 - protein, 9 aa, Homo Sapiens
IEKCIQEII

SEQ ID NO: 1215353 - protein, 9 aa, Homo Sapiens
QFLPQGSQY

SEQ ID NO: 1215354 - protein, 9 aa, Homo Sapiens
KALGYNYKS

SEQ ID NO: 1215355 - protein, 9 aa, Homo Sapiens
PVAIAPIPG

SEQ ID NO: 1215356 - protein, 9 aa, Homo Sapiens
GHPGFKGSE

SEQ ID NO: 1215357 - protein, 9 aa, Homo Sapiens
TPVTQCPSV

SEQ ID NO: 1215358 - protein, 9 aa, Homo Sapiens
ALDPAHWTI

SEQ ID NO: 1215359 - protein, 9 aa, Homo Sapiens
LLVSTFVVF

SEQ ID NO: 1215360 - protein, 9 aa, Homo Sapiens
EERQRCRKQ

SEQ ID NO: 1215361 - protein, 9 aa, Homo Sapiens
DILSYNMLI

SEQ ID NO: 1215362 - protein, 9 aa, Homo Sapiens
RAALDECYH

SEQ ID NO: 1215363 - protein, 9 aa, Homo Sapiens
LRKIQSAHI

SEQ ID NO: 1215364 - protein, 9 aa, Homo Sapiens
VKTKVFQPK

SEQ ID NO: 1215365 - protein, 9 aa, Homo Sapiens
LTTGTPCLC

SEQ ID NO: 1215366 - protein, 9 aa, Homo Sapiens
IEKCQGAKT

SEQ ID NO: 1215367 - protein, 9 aa, Homo Sapiens
DIENHNDIV

SEQ ID NO: 1215368 - protein, 9 aa, Homo Sapiens
IINEKTVLL

SEQ ID NO: 1215369 - protein, 9 aa, Homo Sapiens
KIATWRWSR

SEQ ID NO: 1215370 - protein, 9 aa, Homo Sapiens
MTINGLNKL

SEQ ID NO: 1215371 - protein, 9 aa, Homo Sapiens
CLASWLTST

SEQ ID NO: 1215372 - protein, 9 aa, Homo Sapiens
LASRLLPDV

SEQ ID NO: 1215373 - protein, 9 aa, Homo Sapiens
RLLLLAISF

SEQ ID NO: 1215374 - protein, 9 aa, Homo Sapiens
HLFIESRAR

SEQ ID NO: 1215375 - protein, 9 aa, Homo Sapiens
NFEIQQTGP

SEQ ID NO: 1215376 - protein, 9 aa, Homo Sapiens
LRIQTRSFL

SEQ ID NO: 1215377 - protein, 9 aa, Homo Sapiens
PECSCAVIE

SEQ ID NO: 1215378 - protein, 9 aa, Homo Sapiens
DERKTMIEK

SEQ ID NO: 1215379 - protein, 9 aa, Homo Sapiens
PNTFECIAP

SEQ ID NO: 1215380 - protein, 9 aa, Homo Sapiens
DKSTCTKMV

SEQ ID NO: 1215381 - protein, 9 aa, Homo Sapiens
GGEAFQSGQ

SEQ ID NO: 1215382 - protein, 9 aa, Homo Sapiens
AASKAASQQ

SEQ ID NO: 1215383 - protein, 9 aa, Homo Sapiens
FQRWYVRRS

SEQ ID NO: 1215384 - protein, 9 aa, Homo Sapiens
IHRKTTSST

SEQ ID NO: 1215385 - protein, 9 aa, Homo Sapiens
PYVITLVFE

SEQ ID NO: 1215386 - protein, 9 aa, Homo Sapiens
TLPKYIFDL

SEQ ID NO: 1215387 - protein, 9 aa, Homo Sapiens
TKSVVVYRL

SEQ ID NO: 1215388 - protein, 9 aa, Homo Sapiens
LDLTLTHPP

SEQ ID NO: 1215389 - protein, 9 aa, Homo Sapiens
VDGAEKRKT

SEQ ID NO: 1215390 - protein, 9 aa, Homo Sapiens
FKILDEVVA

SEQ ID NO: 1215391 - protein, 9 aa, Homo Sapiens
KVFNKKTNL

SEQ ID NO: 1215392 - protein, 9 aa, Homo Sapiens
CHLSPSREC

SEQ ID NO: 1215393 - protein, 9 aa, Homo Sapiens
YLDRNGSWY

SEQ ID NO: 1215394 - protein, 9 aa, Homo Sapiens
GKNFVAQML

SEQ ID NO: 1215395 - protein, 9 aa, Homo Sapiens
PPGPGLPTG

SEQ ID NO: 1215396 - protein, 9 aa, Homo Sapiens
HAAWCDGLD

SEQ ID NO: 1215397 - protein, 9 aa, Homo Sapiens
GPEKGPPLA

SEQ ID NO: 1215398 - protein, 9 aa, Homo Sapiens
AGLHAVAPY

SEQ ID NO: 1215399 - protein, 9 aa, Homo Sapiens
DPLLLPCTH

SEQ ID NO: 1215400 - protein, 9 aa, Homo Sapiens
TAQLKHDGK

SEQ ID NO: 1215401 - protein, 9 aa, Homo Sapiens
GHLITGATS

SEQ ID NO: 1215402 - protein, 9 aa, Homo Sapiens
GFMGLFLAL

SEQ ID NO: 1215403 - protein, 9 aa, Homo Sapiens
LGWVFIPVY

SEQ ID NO: 1215404 - protein, 9 aa, Homo Sapiens
GFGNVCVNT

SEQ ID NO: 1215405 - protein, 9 aa, Homo Sapiens
GDFGMSRGI

SEQ ID NO: 1215406 - protein, 9 aa, Homo Sapiens
HLRGGGSPS

SEQ ID NO: 1215407 - protein, 9 aa, Homo Sapiens
DTLPLKKRH

SEQ ID NO: 1215408 - protein, 9 aa, Homo Sapiens
VKQEVQNFI

SEQ ID NO: 1215409 - protein, 9 aa, Homo Sapiens
EIKNGLLHC

SEQ ID NO: 1215410 - protein, 9 aa, Homo Sapiens
TDLSTTEAT

SEQ ID NO: 1215411 - protein, 9 aa, Homo Sapiens
LDRSVNDLH

SEQ ID NO: 1215412 - protein, 9 aa, Homo Sapiens
EEKAVITET

SEQ ID NO: 1215413 - protein, 9 aa, Homo Sapiens
QCDGGWLTD

SEQ ID NO: 1215414 - protein, 9 aa, Homo Sapiens
LLINGSGQN

SEQ ID NO: 1215415 - protein, 9 aa, Homo Sapiens
IGIRGCTLS

SEQ ID NO: 1215416 - protein, 9 aa, Homo Sapiens
SSAWPPTVT

SEQ ID NO: 1215417 - protein, 9 aa, Homo Sapiens
GTWLDQYSD

SEQ ID NO: 1215418 - protein, 9 aa, Homo Sapiens
RVKKTALCN

SEQ ID NO: 1215419 - protein, 9 aa, Homo Sapiens
LQKRMNFLH

SEQ ID NO: 1215420 - protein, 9 aa, Homo Sapiens
VIHNDDTKL

SEQ ID NO: 1215421 - protein, 9 aa, Homo Sapiens
ARVSLPSEI

SEQ ID NO: 1215422 - protein, 9 aa, Homo Sapiens
RPDFRESQE

SEQ ID NO: 1215423 - protein, 9 aa, Homo Sapiens
LDDFLMGMD

SEQ ID NO: 1215424 - protein, 9 aa, Homo Sapiens
VEITKKYTK

SEQ ID NO: 1215425 - protein, 9 aa, Homo Sapiens
VVLTFITTM

SEQ ID NO: 1215426 - protein, 9 aa, Homo Sapiens
QTTLRLVWI

SEQ ID NO: 1215427 - protein, 9 aa, Homo Sapiens
DSERSESSV

SEQ ID NO: 1215428 - protein, 9 aa, Homo Sapiens
GIQGDTHFD

SEQ ID NO: 1215429 - protein, 9 aa, Homo Sapiens
TENIDIKNT

SEQ ID NO: 1215430 - protein, 9 aa, Homo Sapiens
MQREWRIFQ

SEQ ID NO: 1215431 - protein, 9 aa, Homo Sapiens
HKCGENSEC

SEQ ID NO: 1215432 - protein, 9 aa, Homo Sapiens
KLDDSRLIK

SEQ ID NO: 1215433 - protein, 9 aa, Homo Sapiens
LLASGIGII

SEQ ID NO: 1215434 - protein, 9 aa, Homo Sapiens
NTASGWLGW

SEQ ID NO: 1215435 - protein, 9 aa, Homo Sapiens
EGLCPADQL

SEQ ID NO: 1215436 - protein, 9 aa, Homo Sapiens
MILSFLPIK

SEQ ID NO: 1215437 - protein, 9 aa, Homo Sapiens
ISKPGTLEC

SEQ ID NO: 1215438 - protein, 9 aa, Homo Sapiens
QTNGHPHCM

SEQ ID NO: 1215439 - protein, 9 aa, Homo Sapiens
ERVVNRVSA

SEQ ID NO: 1215440 - protein, 9 aa, Homo Sapiens
FLNEEMLSL

SEQ ID NO: 1215441 - protein, 9 aa, Homo Sapiens
LVSLEWLMP

SEQ ID NO: 1215442 - protein, 9 aa, Homo Sapiens
LKFIPEGEN

SEQ ID NO: 1215443 - protein, 9 aa, Homo Sapiens
RKGDVMIAI

SEQ ID NO: 1215444 - protein, 9 aa, Homo Sapiens
WDKSSPVDA

SEQ ID NO: 1215445 - protein, 9 aa, Homo Sapiens
RPGLGECVT

SEQ ID NO: 1215446 - protein, 9 aa, Homo Sapiens
VTSCNGYFV

SEQ ID NO: 1215447 - protein, 9 aa, Homo Sapiens
LTQKMISET

SEQ ID NO: 1215448 - protein, 9 aa, Homo Sapiens
SGCHVVNIG

SEQ ID NO: 1215449 - protein, 9 aa, Homo Sapiens
GTRPPPPAT

SEQ ID NO: 1215450 - protein, 9 aa, Homo Sapiens
GHIPESEDK

SEQ ID NO: 1215451 - protein, 9 aa, Homo Sapiens
EVIVKRAGS

SEQ ID NO: 1215452 - protein, 9 aa, Homo Sapiens
YPHYPPKVV

SEQ ID NO: 1215453 - protein, 9 aa, Homo Sapiens
RCPMTLLST

SEQ ID NO: 1215454 - protein, 9 aa, Homo Sapiens
NDGGFHVLS

SEQ ID NO: 1215455 - protein, 9 aa, Homo Sapiens
GPADQSSDG

SEQ ID NO: 1215456 - protein, 9 aa, Homo Sapiens
CYHMPVKNS

SEQ ID NO: 1215457 - protein, 9 aa, Homo Sapiens
PESLKPSTS

SEQ ID NO: 1215458 - protein, 9 aa, Homo Sapiens
TSKDDLDLI

SEQ ID NO: 1215459 - protein, 9 aa, Homo Sapiens
QLMAAMSFL

SEQ ID NO: 1215460 - protein, 9 aa, Homo Sapiens
ISEQLQNNG

SEQ ID NO: 1215461 - protein, 9 aa, Homo Sapiens
VNFMKDAAE

SEQ ID NO: 1215462 - protein, 9 aa, Homo Sapiens
LLHQSIIWS

SEQ ID NO: 1215463 - protein, 9 aa, Homo Sapiens
YLHSHFIGE

SEQ ID NO: 1215464 - protein, 9 aa, Homo Sapiens
RLKEMLKEI

SEQ ID NO: 1215465 - protein, 9 aa, Homo Sapiens
GPRPGGGSK

SEQ ID NO: 1215466 - protein, 9 aa, Homo Sapiens
SLLEDILHF

SEQ ID NO: 1215467 - protein, 9 aa, Homo Sapiens
STLPMYLGE

SEQ ID NO: 1215468 - protein, 9 aa, Homo Sapiens
IWTRFLTTP

SEQ ID NO: 1215469 - protein, 9 aa, Homo Sapiens
SDAHQCTKM

SEQ ID NO: 1215470 - protein, 9 aa, Homo Sapiens
ALWELTGSL

SEQ ID NO: 1215471 - protein, 9 aa, Homo Sapiens
YIMEKTVQA

SEQ ID NO: 1215472 - protein, 9 aa, Homo Sapiens
DQVKEVKKS

SEQ ID NO: 1215473 - protein, 9 aa, Homo Sapiens
HLQIQSPAG

SEQ ID NO: 1215474 - protein, 9 aa, Homo Sapiens
LGYAITFPY

SEQ ID NO: 1215475 - protein, 9 aa, Homo Sapiens
QDEDYQVSL

SEQ ID NO: 1215476 - protein, 9 aa, Homo Sapiens
NTLKLIPRK

SEQ ID NO: 1215477 - protein, 9 aa, Homo Sapiens
LLLEAGGGS

SEQ ID NO: 1215478 - protein, 9 aa, Homo Sapiens
GEEQESLVA

SEQ ID NO: 1215479 - protein, 9 aa, Homo Sapiens
LTNIDSDKN

SEQ ID NO: 1215480 - protein, 9 aa, Homo Sapiens
AYREERECK

SEQ ID NO: 1215481 - protein, 9 aa, Homo Sapiens
ISQKIFLWS

SEQ ID NO: 1215482 - protein, 9 aa, Homo Sapiens
AEEWFECKN

SEQ ID NO: 1215483 - protein, 9 aa, Homo Sapiens
YHGSQKQPK

SEQ ID NO: 1215484 - protein, 9 aa, Homo Sapiens
KMWVIEAKD

SEQ ID NO: 1215485 - protein, 9 aa, Homo Sapiens
IMGTRGESP

SEQ ID NO: 1215486 - protein, 9 aa, Homo Sapiens
FQGLDALKS

SEQ ID NO: 1215487 - protein, 9 aa, Homo Sapiens
ERLWEQEGK

SEQ ID NO: 1215488 - protein, 9 aa, Homo Sapiens
RHKFCPLLC

SEQ ID NO: 1215489 - protein, 9 aa, Homo Sapiens
PSAPRRGCG

SEQ ID NO: 1215490 - protein, 9 aa, Homo Sapiens
LRNHQGTLP

SEQ ID NO: 1215491 - protein, 9 aa, Homo Sapiens
VGPICLVLV

SEQ ID NO: 1215492 - protein, 9 aa, Homo Sapiens
TSGFTGGHH

SEQ ID NO: 1215493 - protein, 9 aa, Homo Sapiens
LQTEECVQP

SEQ ID NO: 1215494 - protein, 9 aa, Homo Sapiens
KTIAFAHNS

SEQ ID NO: 1215495 - protein, 9 aa, Homo Sapiens
SGTPFLSSL

SEQ ID NO: 1215496 - protein, 9 aa, Homo Sapiens
VQAYVMRYF

SEQ ID NO: 1215497 - protein, 9 aa, Homo Sapiens
PQPAPAGAW

SEQ ID NO: 1215498 - protein, 9 aa, Homo Sapiens
ITITWKFDS

SEQ ID NO: 1215499 - protein, 9 aa, Homo Sapiens
SDGGSMMGG

SEQ ID NO: 1215500 - protein, 9 aa, Homo Sapiens
TVATSVEQY

SEQ ID NO: 1215501 - protein, 9 aa, Homo Sapiens
WHLGAASRG

SEQ ID NO: 1215502 - protein, 9 aa, Homo Sapiens
VEQACPQHT

SEQ ID NO: 1215503 - protein, 9 aa, Homo Sapiens
NHYQLPIYC

SEQ ID NO: 1215504 - protein, 9 aa, Homo Sapiens
KEETCINIC

SEQ ID NO: 1215505 - protein, 9 aa, Homo Sapiens
LPKRLQQNV

SEQ ID NO: 1215506 - protein, 9 aa, Homo Sapiens
HSSSCSGPS

SEQ ID NO: 1215507 - protein, 9 aa, Homo Sapiens
ILNHLAKIF

SEQ ID NO: 1215508 - protein, 9 aa, Homo Sapiens
FQIDDYSLC

SEQ ID NO: 1215509 - protein, 9 aa, Homo Sapiens
IPASLNQGI

SEQ ID NO: 1215510 - protein, 9 aa, Homo Sapiens
SLDLGHAPM

SEQ ID NO: 1215511 - protein, 9 aa, Homo Sapiens
EKVHELQAR

SEQ ID NO: 1215512 - protein, 9 aa, Homo Sapiens
EYQTTSPVQ

SEQ ID NO: 1215513 - protein, 9 aa, Homo Sapiens
VSEKTIWQD

SEQ ID NO: 1215514 - protein, 9 aa, Homo Sapiens
ADGLDSGAD

SEQ ID NO: 1215515 - protein, 9 aa, Homo Sapiens
SENILPQQK

SEQ ID NO: 1215516 - protein, 9 aa, Homo Sapiens
EHEKQMILT

SEQ ID NO: 1215517 - protein, 9 aa, Homo Sapiens
SDHKPYLLS

SEQ ID NO: 1215518 - protein, 9 aa, Homo Sapiens
EPVLPNNKC

SEQ ID NO: 1215519 - protein, 9 aa, Homo Sapiens
AYNTWPICW

SEQ ID NO: 1215520 - protein, 9 aa, Homo Sapiens
YACGDCGHA

SEQ ID NO: 1215521 - protein, 9 aa, Homo Sapiens
VLAGEPLEA

SEQ ID NO: 1215522 - protein, 9 aa, Homo Sapiens
ECGKCFICR

SEQ ID NO: 1215523 - protein, 9 aa, Homo Sapiens
VAVLECDTL

SEQ ID NO: 1215524 - protein, 9 aa, Homo Sapiens
GGPVPRTDL

SEQ ID NO: 1215525 - protein, 9 aa, Homo Sapiens
AMVLLLSVL

SEQ ID NO: 1215526 - protein, 9 aa, Homo Sapiens
SRLKELATP

SEQ ID NO: 1215527 - protein, 9 aa, Homo Sapiens
LTMKEVIDA

SEQ ID NO: 1215528 - protein, 9 aa, Homo Sapiens
FNYLSVSKS

SEQ ID NO: 1215529 - protein, 9 aa, Homo Sapiens
DLFVIAKDS

SEQ ID NO: 1215530 - protein, 9 aa, Homo Sapiens
SAATFQCFG

SEQ ID NO: 1215531 - protein, 9 aa, Homo Sapiens
MMQAHLDEL

SEQ ID NO: 1215532 - protein, 9 aa, Homo Sapiens
AICNYCKKT

SEQ ID NO: 1215533 - protein, 9 aa, Homo Sapiens
LKILAYLRL

SEQ ID NO: 1215534 - protein, 9 aa, Homo Sapiens
TTLAEFGKY

SEQ ID NO: 1215535 - protein, 9 aa, Homo Sapiens
IQRFQYANA

SEQ ID NO: 1215536 - protein, 9 aa, Homo Sapiens
LGADDGVAD

SEQ ID NO: 1215537 - protein, 9 aa, Homo Sapiens
PYRECVEFL

SEQ ID NO: 1215538 - protein, 9 aa, Homo Sapiens
GSLTADYGF

SEQ ID NO: 1215539 - protein, 9 aa, Homo Sapiens
LLEGSAEIP

SEQ ID NO: 1215540 - protein, 9 aa, Homo Sapiens
DHHHPSAPH

SEQ ID NO: 1215541 - protein, 9 aa, Homo Sapiens
EPALYRVIM

SEQ ID NO: 1215542 - protein, 9 aa, Homo Sapiens
KKTLIRFWL

SEQ ID NO: 1215543 - protein, 9 aa, Homo Sapiens
PLAPQPLLG

SEQ ID NO: 1215544 - protein, 9 aa, Homo Sapiens
ASLKEAHCL

SEQ ID NO: 1215545 - protein, 9 aa, Homo Sapiens
QVFLLLSSV

SEQ ID NO: 1215546 - protein, 9 aa, Homo Sapiens
KSEAVWRMP

SEQ ID NO: 1215547 - protein, 9 aa, Homo Sapiens
LYNKIRYLD

SEQ ID NO: 1215548 - protein, 9 aa, Homo Sapiens
ARKQDTWQT

SEQ ID NO: 1215549 - protein, 9 aa, Homo Sapiens
SVSFHHLAF

SEQ ID NO: 1215550 - protein, 9 aa, Homo Sapiens
FVEVLATSS

SEQ ID NO: 1215551 - protein, 9 aa, Homo Sapiens
RKEILFYDQ

SEQ ID NO: 1215552 - protein, 9 aa, Homo Sapiens
KCFDVEVSV

SEQ ID NO: 1215553 - protein, 9 aa, Homo Sapiens
DFIISDFES

SEQ ID NO: 1215554 - protein, 9 aa, Homo Sapiens
QLRDEEVHT

SEQ ID NO: 1215555 - protein, 9 aa, Homo Sapiens
HPDGGSMAH

SEQ ID NO: 1215556 - protein, 9 aa, Homo Sapiens
PLVGDLSIF

SEQ ID NO: 1215557 - protein, 9 aa, Homo Sapiens
GKSFNHVSN

SEQ ID NO: 1215558 - protein, 9 aa, Homo Sapiens
PHLDTDPSN

SEQ ID NO: 1215559 - protein, 9 aa, Homo Sapiens
REMSKGLKP

SEQ ID NO: 1215560 - protein, 9 aa, Homo Sapiens
SHEGTVHFK

SEQ ID NO: 1215561 - protein, 9 aa, Homo Sapiens
DLSWSFRNI

SEQ ID NO: 1215562 - protein, 9 aa, Homo Sapiens
REGVNCRYR

SEQ ID NO: 1215563 - protein, 9 aa, Homo Sapiens
RNLHCYPQL

SEQ ID NO: 1215564 - protein, 9 aa, Homo Sapiens
FGPIFVRLC

SEQ ID NO: 1215565 - protein, 9 aa, Homo Sapiens
QNISWDVAV

SEQ ID NO: 1215566 - protein, 9 aa, Homo Sapiens
ASAPAPPGR

SEQ ID NO: 1215567 - protein, 9 aa, Homo Sapiens
LEPQNKCIM

SEQ ID NO: 1215568 - protein, 9 aa, Homo Sapiens
SNLCHFCDD

SEQ ID NO: 1215569 - protein, 9 aa, Homo Sapiens
LASLALIYW

SEQ ID NO: 1215570 - protein, 9 aa, Homo Sapiens
FNEDFLKCN

SEQ ID NO: 1215571 - protein, 9 aa, Homo Sapiens
HFLRTNTLL

SEQ ID NO: 1215572 - protein, 9 aa, Homo Sapiens
KSAAQNSKL

SEQ ID NO: 1215573 - protein, 9 aa, Homo Sapiens
DSGPEFIQM

SEQ ID NO: 1215574 - protein, 9 aa, Homo Sapiens
GGVNDGCLY

SEQ ID NO: 1215575 - protein, 9 aa, Homo Sapiens
ADDWIIAMT

SEQ ID NO: 1215576 - protein, 9 aa, Homo Sapiens
LATGAHDGK

SEQ ID NO: 1215577 - protein, 9 aa, Homo Sapiens
GEFAPDSRH

SEQ ID NO: 1215578 - protein, 9 aa, Homo Sapiens
EVQLHVTAT

SEQ ID NO: 1215579 - protein, 9 aa, Homo Sapiens
QPKESQLTC

SEQ ID NO: 1215580 - protein, 9 aa, Homo Sapiens
AYATPHFIC

SEQ ID NO: 1215581 - protein, 9 aa, Homo Sapiens
LLLLGGCLA

SEQ ID NO: 1215582 - protein, 9 aa, Homo Sapiens
TSPTSKYNH

SEQ ID NO: 1215583 - protein, 9 aa, Homo Sapiens
PVLKISFHR

SEQ ID NO: 1215584 - protein, 9 aa, Homo Sapiens
LGNDTPVTS

SEQ ID NO: 1215585 - protein, 9 aa, Homo Sapiens
NIRDILIQQ

SEQ ID NO: 1215586 - protein, 9 aa, Homo Sapiens
WSRTLASMV

SEQ ID NO: 1215587 - protein, 9 aa, Homo Sapiens
SHWRKALRV

SEQ ID NO: 1215588 - protein, 9 aa, Homo Sapiens
HVYIEMVGD

SEQ ID NO: 1215589 - protein, 9 aa, Homo Sapiens
LVFILLFSL

SEQ ID NO: 1215590 - protein, 9 aa, Homo Sapiens
QAIKQGDLP

SEQ ID NO: 1215591 - protein, 9 aa, Homo Sapiens
PMREVDFDA

SEQ ID NO: 1215592 - protein, 9 aa, Homo Sapiens
LGTSAFSKG

SEQ ID NO: 1215593 - protein, 9 aa, Homo Sapiens
EALKDVKKE

SEQ ID NO: 1215594 - protein, 9 aa, Homo Sapiens
TGGPGFPGA

SEQ ID NO: 1215595 - protein, 9 aa, Homo Sapiens
RVSQGKEHV

SEQ ID NO: 1215596 - protein, 9 aa, Homo Sapiens
TRVSSIPSN

SEQ ID NO: 1215597 - protein, 9 aa, Homo Sapiens
KRMDSAPAG

SEQ ID NO: 1215598 - protein, 9 aa, Homo Sapiens
LYLDPGQTL

SEQ ID NO: 1215599 - protein, 9 aa, Homo Sapiens
PTDVSSESD

SEQ ID NO: 1215600 - protein, 9 aa, Homo Sapiens
ALRELWQRL

SEQ ID NO: 1215601 - protein, 9 aa, Homo Sapiens
LTSALFNTA

SEQ ID NO: 1215602 - protein, 9 aa, Homo Sapiens
LLKEMSNIN

SEQ ID NO: 1215603 - protein, 9 aa, Homo Sapiens
NGCISPLAR

SEQ ID NO: 1215604 - protein, 9 aa, Homo Sapiens
TLPMAYLIY

SEQ ID NO: 1215605 - protein, 9 aa, Homo Sapiens
ILGYSQNLA

SEQ ID NO: 1215606 - protein, 9 aa, Homo Sapiens
AVAILQGTL

SEQ ID NO: 1215607 - protein, 9 aa, Homo Sapiens
EECDKAFNC

SEQ ID NO: 1215608 - protein, 9 aa, Homo Sapiens
VPGPGKLAL

SEQ ID NO: 1215609 - protein, 9 aa, Homo Sapiens
YLLAIYQDK

SEQ ID NO: 1215610 - protein, 9 aa, Homo Sapiens
IHVIHHCLN

SEQ ID NO: 1215611 - protein, 9 aa, Homo Sapiens
SKNLKNNVM

SEQ ID NO: 1215612 - protein, 9 aa, Homo Sapiens
YVSAPWEFR

SEQ ID NO: 1215613 - protein, 9 aa, Homo Sapiens
KILKACVRG

SEQ ID NO: 1215614 - protein, 9 aa, Homo Sapiens
LNEHMKLHS

SEQ ID NO: 1215615 - protein, 9 aa, Homo Sapiens
RIVIARALL

SEQ ID NO: 1215616 - protein, 9 aa, Homo Sapiens
LLHEVLAKH

SEQ ID NO: 1215617 - protein, 9 aa, Homo Sapiens
KQMILTEFE

SEQ ID NO: 1215618 - protein, 9 aa, Homo Sapiens
NRENRIWEL

SEQ ID NO: 1215619 - protein, 9 aa, Homo Sapiens
IAEHRISQH

SEQ ID NO: 1215620 - protein, 9 aa, Homo Sapiens
LNTDGSFHC

SEQ ID NO: 1215621 - protein, 9 aa, Homo Sapiens
PMQEDPPLM

SEQ ID NO: 1215622 - protein, 9 aa, Homo Sapiens
IHIQKGPHG

SEQ ID NO: 1215623 - protein, 9 aa, Homo Sapiens
FNFLYLHSR

SEQ ID NO: 1215624 - protein, 9 aa, Homo Sapiens
ESVAPGAHF

SEQ ID NO: 1215625 - protein, 9 aa, Homo Sapiens
LAEPAAQPG

SEQ ID NO: 1215626 - protein, 9 aa, Homo Sapiens
DKENVLMPN

SEQ ID NO: 1215627 - protein, 9 aa, Homo Sapiens
EKQVTMALQ

SEQ ID NO: 1215628 - protein, 9 aa, Homo Sapiens
PKSPASAPP

SEQ ID NO: 1215629 - protein, 9 aa, Homo Sapiens
ADPSFITAV

SEQ ID NO: 1215630 - protein, 9 aa, Homo Sapiens
LFYFTVDIV

SEQ ID NO: 1215631 - protein, 9 aa, Homo Sapiens
KAFQLQQFE

SEQ ID NO: 1215632 - protein, 9 aa, Homo Sapiens
EDVQCPYIM

SEQ ID NO: 1215633 - protein, 9 aa, Homo Sapiens
GHRGAHRSP

SEQ ID NO: 1215634 - protein, 9 aa, Homo Sapiens
QERKDMTID

SEQ ID NO: 1215635 - protein, 9 aa, Homo Sapiens
PFGIPGTSI

SEQ ID NO: 1215636 - protein, 9 aa, Homo Sapiens
PDVDLKKLF

SEQ ID NO: 1215637 - protein, 9 aa, Homo Sapiens
KEIEAQRLD

SEQ ID NO: 1215638 - protein, 9 aa, Homo Sapiens
KQMLSDLNR

SEQ ID NO: 1215639 - protein, 9 aa, Homo Sapiens
DAQVVQVIL

SEQ ID NO: 1215640 - protein, 9 aa, Homo Sapiens
TADDTAHHP

SEQ ID NO: 1215641 - protein, 9 aa, Homo Sapiens
VLHCKIPFL

SEQ ID NO: 1215642 - protein, 9 aa, Homo Sapiens
PEQRNLYRN

SEQ ID NO: 1215643 - protein, 9 aa, Homo Sapiens
NSDGLAAFN

SEQ ID NO: 1215644 - protein, 9 aa, Homo Sapiens
LHMTTADDM

SEQ ID NO: 1215645 - protein, 9 aa, Homo Sapiens
NLRFAHNYI

SEQ ID NO: 1215646 - protein, 9 aa, Homo Sapiens
RRLLHEELA

SEQ ID NO: 1215647 - protein, 9 aa, Homo Sapiens
DEGMPVQVD

SEQ ID NO: 1215648 - protein, 9 aa, Homo Sapiens
VTEGIKEYI

SEQ ID NO: 1215649 - protein, 9 aa, Homo Sapiens
SGIDITYFQ

SEQ ID NO: 1215650 - protein, 9 aa, Homo Sapiens
LTPTPTPSW

SEQ ID NO: 1215651 - protein, 9 aa, Homo Sapiens
YDIIKCVLR

SEQ ID NO: 1215652 - protein, 9 aa, Homo Sapiens
QPKTKGEIA

SEQ ID NO: 1215653 - protein, 9 aa, Homo Sapiens
FSSVFYSFH

SEQ ID NO: 1215654 - protein, 9 aa, Homo Sapiens
SSNEPYRLV

SEQ ID NO: 1215655 - protein, 9 aa, Homo Sapiens
TNFFLSLIR

SEQ ID NO: 1215656 - protein, 9 aa, Homo Sapiens
GAKVALVIL

SEQ ID NO: 1215657 - protein, 9 aa, Homo Sapiens
HHFYSKHLR

SEQ ID NO: 1215658 - protein, 9 aa, Homo Sapiens
AKEIAKKVQ

SEQ ID NO: 1215659 - protein, 9 aa, Homo Sapiens
RFRYQEVAG

SEQ ID NO: 1215660 - protein, 9 aa, Homo Sapiens
ASVNRGMFL

SEQ ID NO: 1215661 - protein, 9 aa, Homo Sapiens
KWYLQAASN

SEQ ID NO: 1215662 - protein, 9 aa, Homo Sapiens
VYEAKLLAY

SEQ ID NO: 1215663 - protein, 9 aa, Homo Sapiens
NTNDTIGDL

SEQ ID NO: 1215664 - protein, 9 aa, Homo Sapiens
LLPISAFHG

SEQ ID NO: 1215665 - protein, 9 aa, Homo Sapiens
GRVVENSDA

SEQ ID NO: 1215666 - protein, 9 aa, Homo Sapiens
LLVEFEFHT

SEQ ID NO: 1215667 - protein, 9 aa, Homo Sapiens
KKISFKRKS

SEQ ID NO: 1215668 - protein, 9 aa, Homo Sapiens
QRRAALDGF

SEQ ID NO: 1215669 - protein, 9 aa, Homo Sapiens
TVFCIWKSH

SEQ ID NO: 1215670 - protein, 9 aa, Homo Sapiens
GAGEALGIS

SEQ ID NO: 1215671 - protein, 9 aa, Homo Sapiens
RGGPSLTPT

SEQ ID NO: 1215672 - protein, 9 aa, Homo Sapiens
TAIFIPSTP

SEQ ID NO: 1215673 - protein, 9 aa, Homo Sapiens
LKNGPDSIM

SEQ ID NO: 1215674 - protein, 9 aa, Homo Sapiens
HIKKTIQGD

SEQ ID NO: 1215675 - protein, 9 aa, Homo Sapiens
ILILIMKVN

SEQ ID NO: 1215676 - protein, 9 aa, Homo Sapiens
PNYNHHTRL

SEQ ID NO: 1215677 - protein, 9 aa, Homo Sapiens
PAPLRHADN

SEQ ID NO: 1215678 - protein, 9 aa, Homo Sapiens
AAHYLVGTP

SEQ ID NO: 1215679 - protein, 9 aa, Homo Sapiens
DRSLLEDIL

SEQ ID NO: 1215680 - protein, 9 aa, Homo Sapiens
ECLRYEDTL

SEQ ID NO: 1215681 - protein, 9 aa, Homo Sapiens
RIIIDHFVD

SEQ ID NO: 1215682 - protein, 9 aa, Homo Sapiens
TPSKKKLKL

SEQ ID NO: 1215683 - protein, 9 aa, Homo Sapiens
EATKNEISA

SEQ ID NO: 1215684 - protein, 9 aa, Homo Sapiens
RRCRNGENT

SEQ ID NO: 1215685 - protein, 9 aa, Homo Sapiens
WITIVMPLL

SEQ ID NO: 1215686 - protein, 9 aa, Homo Sapiens
FSTEGKRCP

SEQ ID NO: 1215687 - protein, 9 aa, Homo Sapiens
RTHRGEKSY

SEQ ID NO: 1215688 - protein, 9 aa, Homo Sapiens
ISCRNTSVV

SEQ ID NO: 1215689 - protein, 9 aa, Homo Sapiens
PLQEGKMQY

SEQ ID NO: 1215690 - protein, 9 aa, Homo Sapiens
EWRGAMGIW

SEQ ID NO: 1215691 - protein, 9 aa, Homo Sapiens
PAPRSPASP

SEQ ID NO: 1215692 - protein, 9 aa, Homo Sapiens
VHRLFEAFG

SEQ ID NO: 1215693 - protein, 9 aa, Homo Sapiens
PLPVSATSG

SEQ ID NO: 1215694 - protein, 9 aa, Homo Sapiens
IPGMAFALM

SEQ ID NO: 1215695 - protein, 9 aa, Homo Sapiens
NVIKSLTCS

SEQ ID NO: 1215696 - protein, 9 aa, Homo Sapiens
VRDPQVLIL

SEQ ID NO: 1215697 - protein, 9 aa, Homo Sapiens
SADSGLSMS

SEQ ID NO: 1215698 - protein, 9 aa, Homo Sapiens
VTDSLCHMM

SEQ ID NO: 1215699 - protein, 9 aa, Homo Sapiens
DDKYPTRNS

SEQ ID NO: 1215700 - protein, 9 aa, Homo Sapiens
PPCFPVKLD

SEQ ID NO: 1215701 - protein, 9 aa, Homo Sapiens
VVNNFFVTE

SEQ ID NO: 1215702 - protein, 9 aa, Homo Sapiens
ECSKTCCLG

SEQ ID NO: 1215703 - protein, 9 aa, Homo Sapiens
IATNSKATT

SEQ ID NO: 1215704 - protein, 9 aa, Homo Sapiens
LVGLFLSMY

SEQ ID NO: 1215705 - protein, 9 aa, Homo Sapiens
NHKRIYTGE

SEQ ID NO: 1215706 - protein, 9 aa, Homo Sapiens
FSNPNGCIS

SEQ ID NO: 1215707 - protein, 9 aa, Homo Sapiens
ISITSQPMG

SEQ ID NO: 1215708 - protein, 9 aa, Homo Sapiens
IFFTIWHII

SEQ ID NO: 1215709 - protein, 9 aa, Homo Sapiens
CQCDKKKEA

SEQ ID NO: 1215710 - protein, 9 aa, Homo Sapiens
SLLEHHHGQ

SEQ ID NO: 1215711 - protein, 9 aa, Homo Sapiens
HTKKLPHKT

SEQ ID NO: 1215712 - protein, 9 aa, Homo Sapiens
EVKQASIQH

SEQ ID NO: 1215713 - protein, 9 aa, Homo Sapiens
ETVTPSEAS

SEQ ID NO: 1215714 - protein, 9 aa, Homo Sapiens
GTVEWRGAM

SEQ ID NO: 1215715 - protein, 9 aa, Homo Sapiens
NTMFTNCHI

SEQ ID NO: 1215716 - protein, 9 aa, Homo Sapiens
QQMTIQAQP

SEQ ID NO: 1215717 - protein, 9 aa, Homo Sapiens
PQQQQIDPN

SEQ ID NO: 1215718 - protein, 9 aa, Homo Sapiens
IATWRWSRK

SEQ ID NO: 1215719 - protein, 9 aa, Homo Sapiens
FIDFASLRI

SEQ ID NO: 1215720 - protein, 9 aa, Homo Sapiens
RLRYLLDVH

SEQ ID NO: 1215721 - protein, 9 aa, Homo Sapiens
GFGARIPPT

SEQ ID NO: 1215722 - protein, 9 aa, Homo Sapiens
INCNGFALS

SEQ ID NO: 1215723 - protein, 9 aa, Homo Sapiens
AKRAALDEC

SEQ ID NO: 1215724 - protein, 9 aa, Homo Sapiens
YGQRGPGPP

SEQ ID NO: 1215725 - protein, 9 aa, Homo Sapiens
GVNCRYRCF

SEQ ID NO: 1215726 - protein, 9 aa, Homo Sapiens
VIGIQHAKA

SEQ ID NO: 1215727 - protein, 9 aa, Homo Sapiens
PPQPTLARE

SEQ ID NO: 1215728 - protein, 9 aa, Homo Sapiens
ITDILYTVA

SEQ ID NO: 1215729 - protein, 9 aa, Homo Sapiens
SLRSYLPDH

SEQ ID NO: 1215730 - protein, 9 aa, Homo Sapiens
QLEQMYQWA

SEQ ID NO: 1215731 - protein, 9 aa, Homo Sapiens
IDLSLCDHL

SEQ ID NO: 1215732 - protein, 9 aa, Homo Sapiens
SLSIIVLLL

SEQ ID NO: 1215733 - protein, 9 aa, Homo Sapiens
PCKYDWDSD

SEQ ID NO: 1215734 - protein, 9 aa, Homo Sapiens
GPSKVDQLQ

SEQ ID NO: 1215735 - protein, 9 aa, Homo Sapiens
NQHAYAVMK

SEQ ID NO: 1215736 - protein, 9 aa, Homo Sapiens
CRLRYLLDV

SEQ ID NO: 1215737 - protein, 9 aa, Homo Sapiens
VDDLRINLW

SEQ ID NO: 1215738 - protein, 9 aa, Homo Sapiens
EARKTLFPR

SEQ ID NO: 1215739 - protein, 9 aa, Homo Sapiens
WPSMDFDAL

SEQ ID NO: 1215740 - protein, 9 aa, Homo Sapiens
TIDTSSYQQ

SEQ ID NO: 1215741 - protein, 9 aa, Homo Sapiens
EWKKTMELT

SEQ ID NO: 1215742 - protein, 9 aa, Homo Sapiens
AVYPFVDDF

SEQ ID NO: 1215743 - protein, 9 aa, Homo Sapiens
DKTNVILLG

SEQ ID NO: 1215744 - protein, 9 aa, Homo Sapiens
STNIFTKRD

SEQ ID NO: 1215745 - protein, 9 aa, Homo Sapiens
LQNKVGAVF

SEQ ID NO: 1215746 - protein, 9 aa, Homo Sapiens
GVEFVNMFK

SEQ ID NO: 1215747 - protein, 9 aa, Homo Sapiens
VEQAEDLKA

SEQ ID NO: 1215748 - protein, 9 aa, Homo Sapiens
GELSSTLNL

SEQ ID NO: 1215749 - protein, 9 aa, Homo Sapiens
VVACPRSSS

SEQ ID NO: 1215750 - protein, 9 aa, Homo Sapiens
CARTQLRNE

SEQ ID NO: 1215751 - protein, 9 aa, Homo Sapiens
ACTRWKQRG

SEQ ID NO: 1215752 - protein, 9 aa, Homo Sapiens
RQDGGIGKA

SEQ ID NO: 1215753 - protein, 9 aa, Homo Sapiens
DEGSPAAGD

SEQ ID NO: 1215754 - protein, 9 aa, Homo Sapiens
TMLVATTVC

SEQ ID NO: 1215755 - protein, 9 aa, Homo Sapiens
FVETPRTTW

SEQ ID NO: 1215756 - protein, 9 aa, Homo Sapiens
TLKYTLELQ

SEQ ID NO: 1215757 - protein, 9 aa, Homo Sapiens
LYISDQVAF

SEQ ID NO: 1215758 - protein, 9 aa, Homo Sapiens
MSFTTSKFS

SEQ ID NO: 1215759 - protein, 9 aa, Homo Sapiens
HYSWSTSFW

SEQ ID NO: 1215760 - protein, 9 aa, Homo Sapiens
TYSNQEVLQ

SEQ ID NO: 1215761 - protein, 9 aa, Homo Sapiens
VEHILKMWV

SEQ ID NO: 1215762 - protein, 9 aa, Homo Sapiens
TLSCLERDG

SEQ ID NO: 1215763 - protein, 9 aa, Homo Sapiens
GSCGCSKGG

SEQ ID NO: 1215764 - protein, 9 aa, Homo Sapiens
ALGKYGPTL

SEQ ID NO: 1215765 - protein, 9 aa, Homo Sapiens
VGESVQDYD

SEQ ID NO: 1215766 - protein, 9 aa, Homo Sapiens
NVVHDKVWC

SEQ ID NO: 1215767 - protein, 9 aa, Homo Sapiens
DGLDDSLLD

SEQ ID NO: 1215768 - protein, 9 aa, Homo Sapiens
ARAGLDGRS

SEQ ID NO: 1215769 - protein, 9 aa, Homo Sapiens
LTDGSVRFP

SEQ ID NO: 1215770 - protein, 9 aa, Homo Sapiens
ILIQQGYAE

SEQ ID NO: 1215771 - protein, 9 aa, Homo Sapiens
AMHQLAGLL

SEQ ID NO: 1215772 - protein, 9 aa, Homo Sapiens
QRGGLSPGA

SEQ ID NO: 1215773 - protein, 9 aa, Homo Sapiens
MFSNAMLFA

SEQ ID NO: 1215774 - protein, 9 aa, Homo Sapiens
VSQGFHMLF

SEQ ID NO: 1215775 - protein, 9 aa, Homo Sapiens
EKVAAEARS

SEQ ID NO: 1215776 - protein, 9 aa, Homo Sapiens
EQDVIVSGT

SEQ ID NO: 1215777 - protein, 9 aa, Homo Sapiens
TTLIQSLDS

SEQ ID NO: 1215778 - protein, 9 aa, Homo Sapiens
LNRDLGPNM

SEQ ID NO: 1215779 - protein, 9 aa, Homo Sapiens
VYTTTGGLT

SEQ ID NO: 1215780 - protein, 9 aa, Homo Sapiens
LDEIYSWID

SEQ ID NO: 1215781 - protein, 9 aa, Homo Sapiens
SMELNKIYY

SEQ ID NO: 1215782 - protein, 9 aa, Homo Sapiens
VKASTPALA

SEQ ID NO: 1215783 - protein, 9 aa, Homo Sapiens
TDIRAKKWV

SEQ ID NO: 1215784 - protein, 9 aa, Homo Sapiens
KADYLKRYL

SEQ ID NO: 1215785 - protein, 9 aa, Homo Sapiens
LGGCLACDN

SEQ ID NO: 1215786 - protein, 9 aa, Homo Sapiens
SIKDKALNA

SEQ ID NO: 1215787 - protein, 9 aa, Homo Sapiens
TNVRLHFLR

SEQ ID NO: 1215788 - protein, 9 aa, Homo Sapiens
AGVRGKFER

SEQ ID NO: 1215789 - protein, 9 aa, Homo Sapiens
PLEKCLSSA

SEQ ID NO: 1215790 - protein, 9 aa, Homo Sapiens
DKSEKELKV

SEQ ID NO: 1215791 - protein, 9 aa, Homo Sapiens
DEAWNERVV

SEQ ID NO: 1215792 - protein, 9 aa, Homo Sapiens
PLHAEIMRL

SEQ ID NO: 1215793 - protein, 9 aa, Homo Sapiens
MECHDGIEK

SEQ ID NO: 1215794 - protein, 9 aa, Homo Sapiens
VSVLTLLYL

SEQ ID NO: 1215795 - protein, 9 aa, Homo Sapiens
DLSYLDQCH

SEQ ID NO: 1215796 - protein, 9 aa, Homo Sapiens
LRAHMAQRL

SEQ ID NO: 1215797 - protein, 9 aa, Homo Sapiens
QPHITKDVI

SEQ ID NO: 1215798 - protein, 9 aa, Homo Sapiens
KRQELTETA

SEQ ID NO: 1215799 - protein, 9 aa, Homo Sapiens
FDVVVASEV

SEQ ID NO: 1215800 - protein, 9 aa, Homo Sapiens
ISDIETVKA

SEQ ID NO: 1215801 - protein, 9 aa, Homo Sapiens
VDHVRCSVM

SEQ ID NO: 1215802 - protein, 9 aa, Homo Sapiens
TNKFQGMVF

SEQ ID NO: 1215803 - protein, 9 aa, Homo Sapiens
FIYYQVLMN

SEQ ID NO: 1215804 - protein, 9 aa, Homo Sapiens
QSDGVIEPN

SEQ ID NO: 1215805 - protein, 9 aa, Homo Sapiens
MTDFLLETT

SEQ ID NO: 1215806 - protein, 9 aa, Homo Sapiens
CEQLVTVLC

SEQ ID NO: 1215807 - protein, 9 aa, Homo Sapiens
KTMISFALE

SEQ ID NO: 1215808 - protein, 9 aa, Homo Sapiens
TISQTKQKL

SEQ ID NO: 1215809 - protein, 9 aa, Homo Sapiens
MVTGRQEDV

SEQ ID NO: 1215810 - protein, 9 aa, Homo Sapiens
TMSPLHKRC

SEQ ID NO: 1215811 - protein, 9 aa, Homo Sapiens
NVFQEDSVT

SEQ ID NO: 1215812 - protein, 9 aa, Homo Sapiens
YDHFIAICN

SEQ ID NO: 1215813 - protein, 9 aa, Homo Sapiens
QLHARQILH

SEQ ID NO: 1215814 - protein, 9 aa, Homo Sapiens
VKKEVKKRS

SEQ ID NO: 1215815 - protein, 9 aa, Homo Sapiens
HDANSASVN

SEQ ID NO: 1215816 - protein, 9 aa, Homo Sapiens
PRGGMRSRG

SEQ ID NO: 1215817 - protein, 9 aa, Homo Sapiens
PRVPLCPSG

SEQ ID NO: 1215818 - protein, 9 aa, Homo Sapiens
LHPSRSGGV

SEQ ID NO: 1215819 - protein, 9 aa, Homo Sapiens
QDVTLGPTA

SEQ ID NO: 1215820 - protein, 9 aa, Homo Sapiens
AEICQYVIT

SEQ ID NO: 1215821 - protein, 9 aa, Homo Sapiens
SQDHQCFFL

SEQ ID NO: 1215822 - protein, 9 aa, Homo Sapiens
EGLVQLWHL

SEQ ID NO: 1215823 - protein, 9 aa, Homo Sapiens
LKGCLLHTY

SEQ ID NO: 1215824 - protein, 9 aa, Homo Sapiens
MQDIRFHYG

SEQ ID NO: 1215825 - protein, 9 aa, Homo Sapiens
VVVMAKESV

SEQ ID NO: 1215826 - protein, 9 aa, Homo Sapiens
DLQAQTRCH

SEQ ID NO: 1215827 - protein, 9 aa, Homo Sapiens
FHKQITALA

SEQ ID NO: 1215828 - protein, 9 aa, Homo Sapiens
LDELMKNDE

SEQ ID NO: 1215829 - protein, 9 aa, Homo Sapiens
LALCGIVST

SEQ ID NO: 1215830 - protein, 9 aa, Homo Sapiens
SKKQASSMA

SEQ ID NO: 1215831 - protein, 9 aa, Homo Sapiens
NSSNLWKQN

SEQ ID NO: 1215832 - protein, 9 aa, Homo Sapiens
QRKISQENV

SEQ ID NO: 1215833 - protein, 9 aa, Homo Sapiens
SPESTMDNS

SEQ ID NO: 1215834 - protein, 9 aa, Homo Sapiens
LSRVTHLEF

SEQ ID NO: 1215835 - protein, 9 aa, Homo Sapiens
WIVSRRTSQ

SEQ ID NO: 1215836 - protein, 9 aa, Homo Sapiens
LYGIEALPH

SEQ ID NO: 1215837 - protein, 9 aa, Homo Sapiens
STLDAFGKI

SEQ ID NO: 1215838 - protein, 9 aa, Homo Sapiens
DGEVVCEAI

SEQ ID NO: 1215839 - protein, 9 aa, Homo Sapiens
ETDGEGGTY

SEQ ID NO: 1215840 - protein, 9 aa, Homo Sapiens
IFLDSGFQT

SEQ ID NO: 1215841 - protein, 9 aa, Homo Sapiens
LYNRCFGQQ

SEQ ID NO: 1215842 - protein, 9 aa, Homo Sapiens
TLDAQSTED

SEQ ID NO: 1215843 - protein, 9 aa, Homo Sapiens
DQTSEWDSE

SEQ ID NO: 1215844 - protein, 9 aa, Homo Sapiens
EVRHFTLRH

SEQ ID NO: 1215845 - protein, 9 aa, Homo Sapiens
VRQQVFTAF

SEQ ID NO: 1215846 - protein, 9 aa, Homo Sapiens
ECHDGIEKV

SEQ ID NO: 1215847 - protein, 9 aa, Homo Sapiens
TQIPQGCLP

SEQ ID NO: 1215848 - protein, 9 aa, Homo Sapiens
KGQNISWDV

SEQ ID NO: 1215849 - protein, 9 aa, Homo Sapiens
TTTTEEQVS

SEQ ID NO: 1215850 - protein, 9 aa, Homo Sapiens
DYHRALCTC

SEQ ID NO: 1215851 - protein, 9 aa, Homo Sapiens
LDFSVIMMV

SEQ ID NO: 1215852 - protein, 9 aa, Homo Sapiens
ECGNVFSRR

SEQ ID NO: 1215853 - protein, 9 aa, Homo Sapiens
QEAEAIHIL

SEQ ID NO: 1215854 - protein, 9 aa, Homo Sapiens
VNREQCFTS

SEQ ID NO: 1215855 - protein, 9 aa, Homo Sapiens
ACIHFTVEG

SEQ ID NO: 1215856 - protein, 9 aa, Homo Sapiens
AAAPGFSFS

SEQ ID NO: 1215857 - protein, 9 aa, Homo Sapiens
CLVDVICEK

SEQ ID NO: 1215858 - protein, 9 aa, Homo Sapiens
FCVNGGKCF

SEQ ID NO: 1215859 - protein, 9 aa, Homo Sapiens
PRGLRSCTV

SEQ ID NO: 1215860 - protein, 9 aa, Homo Sapiens
RPLGPELSP

SEQ ID NO: 1215861 - protein, 9 aa, Homo Sapiens
GVVVVFAAL

SEQ ID NO: 1215862 - protein, 9 aa, Homo Sapiens
WKRMDVGQQ

SEQ ID NO: 1215863 - protein, 9 aa, Homo Sapiens
ALVTFVALL

SEQ ID NO: 1215864 - protein, 9 aa, Homo Sapiens
LPDRGLDHI

SEQ ID NO: 1215865 - protein, 9 aa, Homo Sapiens
HVPNVVVRD

SEQ ID NO: 1215866 - protein, 9 aa, Homo Sapiens
RTVGPRHVQ

SEQ ID NO: 1215867 - protein, 9 aa, Homo Sapiens
HEATPLFNA

SEQ ID NO: 1215868 - protein, 9 aa, Homo Sapiens
YGVASYFIF

SEQ ID NO: 1215869 - protein, 9 aa, Homo Sapiens
AVSSDRFHS

SEQ ID NO: 1215870 - protein, 9 aa, Homo Sapiens
EMLVRVTEG

SEQ ID NO: 1215871 - protein, 9 aa, Homo Sapiens
DPANQFLCL

SEQ ID NO: 1215872 - protein, 9 aa, Homo Sapiens
ISLSLAHRR

SEQ ID NO: 1215873 - protein, 9 aa, Homo Sapiens
VSDDTCYRE

SEQ ID NO: 1215874 - protein, 9 aa, Homo Sapiens
DDQVITISN

SEQ ID NO: 1215875 - protein, 9 aa, Homo Sapiens
KTQRNEFTD

SEQ ID NO: 1215876 - protein, 9 aa, Homo Sapiens
GTAIFIPST

SEQ ID NO: 1215877 - protein, 9 aa, Homo Sapiens
YHLEKLSSS

SEQ ID NO: 1215878 - protein, 9 aa, Homo Sapiens
RTGKAHSVQ

SEQ ID NO: 1215879 - protein, 9 aa, Homo Sapiens
KKRFVAGKY

SEQ ID NO: 1215880 - protein, 9 aa, Homo Sapiens
QDESPEMAE

SEQ ID NO: 1215881 - protein, 9 aa, Homo Sapiens
FRKVQEHQG

SEQ ID NO: 1215882 - protein, 9 aa, Homo Sapiens
TPPQGPAQA

SEQ ID NO: 1215883 - protein, 9 aa, Homo Sapiens
TPVDSLMFG

SEQ ID NO: 1215884 - protein, 9 aa, Homo Sapiens
IAFRMNVAP

SEQ ID NO: 1215885 - protein, 9 aa, Homo Sapiens
LRRHMVVQC

SEQ ID NO: 1215886 - protein, 9 aa, Homo Sapiens
CVHPISTQN

SEQ ID NO: 1215887 - protein, 9 aa, Homo Sapiens
LYMPGFLAG

SEQ ID NO: 1215888 - protein, 9 aa, Homo Sapiens
ASMIGIVCS

SEQ ID NO: 1215889 - protein, 9 aa, Homo Sapiens
EDFHASDCG

SEQ ID NO: 1215890 - protein, 9 aa, Homo Sapiens
LMNADCSSG

SEQ ID NO: 1215891 - protein, 9 aa, Homo Sapiens
YQEKQQKRE

SEQ ID NO: 1215892 - protein, 9 aa, Homo Sapiens
GVINCNGFA

SEQ ID NO: 1215893 - protein, 9 aa, Homo Sapiens
DLISREYSL

SEQ ID NO: 1215894 - protein, 9 aa, Homo Sapiens
APEFQANEV

SEQ ID NO: 1215895 - protein, 9 aa, Homo Sapiens
AHVVDFVPS

SEQ ID NO: 1215896 - protein, 9 aa, Homo Sapiens
IQASLDIGD

SEQ ID NO: 1215897 - protein, 9 aa, Homo Sapiens
RRRAQGHPA

SEQ ID NO: 1215898 - protein, 9 aa, Homo Sapiens
VVQIIFYCD

SEQ ID NO: 1215899 - protein, 9 aa, Homo Sapiens
PHSRPYMAH

SEQ ID NO: 1215900 - protein, 9 aa, Homo Sapiens
TLYRLCPHP

SEQ ID NO: 1215901 - protein, 9 aa, Homo Sapiens
KHKRGDDDE

SEQ ID NO: 1215902 - protein, 9 aa, Homo Sapiens
FTALMVNGV

SEQ ID NO: 1215903 - protein, 9 aa, Homo Sapiens
DKCGLTPLA

SEQ ID NO: 1215904 - protein, 9 aa, Homo Sapiens
SYSPRPTYS

SEQ ID NO: 1215905 - protein, 9 aa, Homo Sapiens
FESMEDDTN

SEQ ID NO: 1215906 - protein, 9 aa, Homo Sapiens
SFLVRNPGG

SEQ ID NO: 1215907 - protein, 9 aa, Homo Sapiens
AIIWDAQDL

SEQ ID NO: 1215908 - protein, 9 aa, Homo Sapiens
RNNIVKKYG

SEQ ID NO: 1215909 - protein, 9 aa, Homo Sapiens
KQEGLSHIS

SEQ ID NO: 1215910 - protein, 9 aa, Homo Sapiens
VLFLQQGSS

SEQ ID NO: 1215911 - protein, 9 aa, Homo Sapiens
HTDTDTHSH

SEQ ID NO: 1215912 - protein, 9 aa, Homo Sapiens
MNLTLDFHR

SEQ ID NO: 1215913 - protein, 9 aa, Homo Sapiens
LRDTANHLR

SEQ ID NO: 1215914 - protein, 9 aa, Homo Sapiens
EIQESSDAL

SEQ ID NO: 1215915 - protein, 9 aa, Homo Sapiens
EGHGLVCDL

SEQ ID NO: 1215916 - protein, 9 aa, Homo Sapiens
WEALATHTL

SEQ ID NO: 1215917 - protein, 9 aa, Homo Sapiens
VAIASIQSV

SEQ ID NO: 1215918 - protein, 9 aa, Homo Sapiens
NIAIVWLAG

SEQ ID NO: 1215919 - protein, 9 aa, Homo Sapiens
KIQKFTGCG

SEQ ID NO: 1215920 - protein, 9 aa, Homo Sapiens
AIMSPFYQW

SEQ ID NO: 1215921 - protein, 9 aa, Homo Sapiens
KKYMQAGNK

SEQ ID NO: 1215922 - protein, 9 aa, Homo Sapiens
INHVSKVGS

SEQ ID NO: 1215923 - protein, 9 aa, Homo Sapiens
AASSSQGVS

SEQ ID NO: 1215924 - protein, 9 aa, Homo Sapiens
SSKKQASSM

SEQ ID NO: 1215925 - protein, 9 aa, Homo Sapiens
ETKMLHLEV

SEQ ID NO: 1215926 - protein, 9 aa, Homo Sapiens
IEYANLTGI

SEQ ID NO: 1215927 - protein, 9 aa, Homo Sapiens
RHQDLLCSV

SEQ ID NO: 1215928 - protein, 9 aa, Homo Sapiens
LTQKTYGAD

SEQ ID NO: 1215929 - protein, 9 aa, Homo Sapiens
YKNILSEIG

SEQ ID NO: 1215930 - protein, 9 aa, Homo Sapiens
LLEAGGGSA

SEQ ID NO: 1215931 - protein, 9 aa, Homo Sapiens
ERRVNHMVV

SEQ ID NO: 1215932 - protein, 9 aa, Homo Sapiens
GYNKGYKGL

SEQ ID NO: 1215933 - protein, 9 aa, Homo Sapiens
ESFPYPGFN

SEQ ID NO: 1215934 - protein, 9 aa, Homo Sapiens
QTLFSVLVC

SEQ ID NO: 1215935 - protein, 9 aa, Homo Sapiens
RWKRLVELL

SEQ ID NO: 1215936 - protein, 9 aa, Homo Sapiens
GYQALSEMI

SEQ ID NO: 1215937 - protein, 9 aa, Homo Sapiens
SKVFGRGEH

SEQ ID NO: 1215938 - protein, 9 aa, Homo Sapiens
HTHTHRYTH

SEQ ID NO: 1215939 - protein, 9 aa, Homo Sapiens
GCGENIGLD

SEQ ID NO: 1215940 - protein, 9 aa, Homo Sapiens
DVQSTQDSE

SEQ ID NO: 1215941 - protein, 9 aa, Homo Sapiens
KSGRTTLHL

SEQ ID NO: 1215942 - protein, 9 aa, Homo Sapiens
GPSPFSSKR

SEQ ID NO: 1215943 - protein, 9 aa, Homo Sapiens
DQALIGMSD

SEQ ID NO: 1215944 - protein, 9 aa, Homo Sapiens
ASTTRVQTT

SEQ ID NO: 1215945 - protein, 9 aa, Homo Sapiens
MSYHSDSDI

SEQ ID NO: 1215946 - protein, 9 aa, Homo Sapiens
NKDQLEEIK

SEQ ID NO: 1215947 - protein, 9 aa, Homo Sapiens
KKRLRNMLS

SEQ ID NO: 1215948 - protein, 9 aa, Homo Sapiens
EYQHHSLRA

SEQ ID NO: 1215949 - protein, 9 aa, Homo Sapiens
DPRLLHQQS

SEQ ID NO: 1215950 - protein, 9 aa, Homo Sapiens
CRKFQGDQE

SEQ ID NO: 1215951 - protein, 9 aa, Homo Sapiens
HDKHVFTVG

SEQ ID NO: 1215952 - protein, 9 aa, Homo Sapiens
QIIEDQYKN

SEQ ID NO: 1215953 - protein, 9 aa, Homo Sapiens
AVPEMNSSF

SEQ ID NO: 1215954 - protein, 9 aa, Homo Sapiens
YTTEQAFVR

SEQ ID NO: 1215955 - protein, 9 aa, Homo Sapiens
GLTREGDTL

SEQ ID NO: 1215956 - protein, 9 aa, Homo Sapiens
AYNHAKYSA

SEQ ID NO: 1215957 - protein, 9 aa, Homo Sapiens
LLGQTQKVF

SEQ ID NO: 1215958 - protein, 9 aa, Homo Sapiens
MGWYQTCSN

SEQ ID NO: 1215959 - protein, 9 aa, Homo Sapiens
GYSGYIQKF

SEQ ID NO: 1215960 - protein, 9 aa, Homo Sapiens
SKVPAPKDA

SEQ ID NO: 1215961 - protein, 9 aa, Homo Sapiens
TKQYSNTYC

SEQ ID NO: 1215962 - protein, 9 aa, Homo Sapiens
TWKFDSPER

SEQ ID NO: 1215963 - protein, 9 aa, Homo Sapiens
EQASSYSHQ

SEQ ID NO: 1215964 - protein, 9 aa, Homo Sapiens
RQSALCPGP

SEQ ID NO: 1215965 - protein, 9 aa, Homo Sapiens
YDCRQVTRA

SEQ ID NO: 1215966 - protein, 9 aa, Homo Sapiens
QKTYNEAMA

SEQ ID NO: 1215967 - protein, 9 aa, Homo Sapiens
YFNDNSIET

SEQ ID NO: 1215968 - protein, 9 aa, Homo Sapiens
MFWIGWGPW

SEQ ID NO: 1215969 - protein, 9 aa, Homo Sapiens
IGECALQSP

SEQ ID NO: 1215970 - protein, 9 aa, Homo Sapiens
DPHHCGHSQ

SEQ ID NO: 1215971 - protein, 9 aa, Homo Sapiens
GMGYCRTGS

SEQ ID NO: 1215972 - protein, 9 aa, Homo Sapiens
TSFTDHAIS

SEQ ID NO: 1215973 - protein, 9 aa, Homo Sapiens
LFYGMVSKK

SEQ ID NO: 1215974 - protein, 9 aa, Homo Sapiens
CTNEPSQAV

SEQ ID NO: 1215975 - protein, 9 aa, Homo Sapiens
LKQGFEFWY

SEQ ID NO: 1215976 - protein, 9 aa, Homo Sapiens
LRSRKLVSF

SEQ ID NO: 1215977 - protein, 9 aa, Homo Sapiens
GRDLYRFGY

SEQ ID NO: 1215978 - protein, 9 aa, Homo Sapiens
AANLEARAH

SEQ ID NO: 1215979 - protein, 9 aa, Homo Sapiens
NVKQGAENM

SEQ ID NO: 1215980 - protein, 9 aa, Homo Sapiens
LHLKFLEHF

SEQ ID NO: 1215981 - protein, 9 aa, Homo Sapiens
QWMDKETTQ

SEQ ID NO: 1215982 - protein, 9 aa, Homo Sapiens
LFGDMYTPP

SEQ ID NO: 1215983 - protein, 9 aa, Homo Sapiens
VLQRMLPTR

SEQ ID NO: 1215984 - protein, 9 aa, Homo Sapiens
PEETLGGQD

SEQ ID NO: 1215985 - protein, 9 aa, Homo Sapiens
RGIPPSSVL

SEQ ID NO: 1215986 - protein, 9 aa, Homo Sapiens
EHLKRDHSL

SEQ ID NO: 1215987 - protein, 9 aa, Homo Sapiens
SNLERMLTQ

SEQ ID NO: 1215988 - protein, 9 aa, Homo Sapiens
EAIGIGGFG

SEQ ID NO: 1215989 - protein, 9 aa, Homo Sapiens
ACSCGHPWV

SEQ ID NO: 1215990 - protein, 9 aa, Homo Sapiens
VMVSMVTKD

SEQ ID NO: 1215991 - protein, 9 aa, Homo Sapiens
KMQEDEEES

SEQ ID NO: 1215992 - protein, 9 aa, Homo Sapiens
PSSEKIATI

SEQ ID NO: 1215993 - protein, 9 aa, Homo Sapiens
ATQRALISK

SEQ ID NO: 1215994 - protein, 9 aa, Homo Sapiens
RREPVELGK

SEQ ID NO: 1215995 - protein, 9 aa, Homo Sapiens
LLQVEVLSR

SEQ ID NO: 1215996 - protein, 9 aa, Homo Sapiens
QTLPVMSGD

SEQ ID NO: 1215997 - protein, 9 aa, Homo Sapiens
KYMQAGNKL

SEQ ID NO: 1215998 - protein, 9 aa, Homo Sapiens
MFCTRKDPR

SEQ ID NO: 1215999 - protein, 9 aa, Homo Sapiens
HHLTMFILL

SEQ ID NO: 1216000 - protein, 9 aa, Homo Sapiens
EDEVLTIPG

SEQ ID NO: 1216001 - protein, 9 aa, Homo Sapiens
SSYALHVHK

SEQ ID NO: 1216002 - protein, 9 aa, Homo Sapiens
PTAASVSTD

SEQ ID NO: 1216003 - protein, 9 aa, Homo Sapiens
CIQFQPNSP

SEQ ID NO: 1216004 - protein, 9 aa, Homo Sapiens
IEEEYARES

SEQ ID NO: 1216005 - protein, 9 aa, Homo Sapiens
CEDQIVLLK

SEQ ID NO: 1216006 - protein, 9 aa, Homo Sapiens
SCGSRGSGC

SEQ ID NO: 1216007 - protein, 9 aa, Homo Sapiens
KSSVMCENE

SEQ ID NO: 1216008 - protein, 9 aa, Homo Sapiens
RTMHGTSIS

SEQ ID NO: 1216009 - protein, 9 aa, Homo Sapiens
LGMAKITHV

SEQ ID NO: 1216010 - protein, 9 aa, Homo Sapiens
EAPDGRALR

SEQ ID NO: 1216011 - protein, 9 aa, Homo Sapiens
VYHFCDVKD

SEQ ID NO: 1216012 - protein, 9 aa, Homo Sapiens
GGKCFMVKD

SEQ ID NO: 1216013 - protein, 9 aa, Homo Sapiens
IGAMARLEC

SEQ ID NO: 1216014 - protein, 9 aa, Homo Sapiens
FQKKLYVEE

SEQ ID NO: 1216015 - protein, 9 aa, Homo Sapiens
IGPWIQVKV

SEQ ID NO: 1216016 - protein, 9 aa, Homo Sapiens
SDYETYMSV

SEQ ID NO: 1216017 - protein, 9 aa, Homo Sapiens
HDPKKNRHW

SEQ ID NO: 1216018 - protein, 9 aa, Homo Sapiens
AKCCECEAF

SEQ ID NO: 1216019 - protein, 9 aa, Homo Sapiens
AVSIVKSLE

SEQ ID NO: 1216020 - protein, 9 aa, Homo Sapiens
VIITVFTSR

SEQ ID NO: 1216021 - protein, 9 aa, Homo Sapiens
SASILSQKL

SEQ ID NO: 1216022 - protein, 9 aa, Homo Sapiens
ESAIMPFIN

SEQ ID NO: 1216023 - protein, 9 aa, Homo Sapiens
RSRNLLMVN

SEQ ID NO: 1216024 - protein, 9 aa, Homo Sapiens
IHTDTHRNT

SEQ ID NO: 1216025 - protein, 9 aa, Homo Sapiens
QVSPGPRGS

SEQ ID NO: 1216026 - protein, 9 aa, Homo Sapiens
RFCKLELRL

SEQ ID NO: 1216027 - protein, 9 aa, Homo Sapiens
PRPTNKFQG

SEQ ID NO: 1216028 - protein, 9 aa, Homo Sapiens
GPGREPLVG

SEQ ID NO: 1216029 - protein, 9 aa, Homo Sapiens
GVSHRTQPL

SEQ ID NO: 1216030 - protein, 9 aa, Homo Sapiens
EDVAIDIQS

SEQ ID NO: 1216031 - protein, 9 aa, Homo Sapiens
PVPQCLPSL

SEQ ID NO: 1216032 - protein, 9 aa, Homo Sapiens
NPSMCKRIC

SEQ ID NO: 1216033 - protein, 9 aa, Homo Sapiens
RIHLLDSNV

SEQ ID NO: 1216034 - protein, 9 aa, Homo Sapiens
KTLLKAPDS

SEQ ID NO: 1216035 - protein, 9 aa, Homo Sapiens
LTEREECLH

SEQ ID NO: 1216036 - protein, 9 aa, Homo Sapiens
SVFKCPNCS

SEQ ID NO: 1216037 - protein, 9 aa, Homo Sapiens
SSPRGTVRV

SEQ ID NO: 1216038 - protein, 9 aa, Homo Sapiens
AEEEWRQVT

SEQ ID NO: 1216039 - protein, 9 aa, Homo Sapiens
STSTTPACC

SEQ ID NO: 1216040 - protein, 9 aa, Homo Sapiens
ELREGVTRM

SEQ ID NO: 1216041 - protein, 9 aa, Homo Sapiens
YEFFAHDPV

SEQ ID NO: 1216042 - protein, 9 aa, Homo Sapiens
DPQSRDAHQ

SEQ ID NO: 1216043 - protein, 9 aa, Homo Sapiens
DILDCLYGP

SEQ ID NO: 1216044 - protein, 9 aa, Homo Sapiens
SHGPVKVRE

SEQ ID NO: 1216045 - protein, 9 aa, Homo Sapiens
GHVFPPSDQ

SEQ ID NO: 1216046 - protein, 9 aa, Homo Sapiens
PPSEEHVLF

SEQ ID NO: 1216047 - protein, 9 aa, Homo Sapiens
VLLMEKLEQ

SEQ ID NO: 1216048 - protein, 9 aa, Homo Sapiens
LMPPSMGTS

SEQ ID NO: 1216049 - protein, 9 aa, Homo Sapiens
HFSVLMLPV

SEQ ID NO: 1216050 - protein, 9 aa, Homo Sapiens
EMLTLAEYH

SEQ ID NO: 1216051 - protein, 9 aa, Homo Sapiens
KHRIKELSS

SEQ ID NO: 1216052 - protein, 9 aa, Homo Sapiens
LAAREDRLQ

SEQ ID NO: 1216053 - protein, 9 aa, Homo Sapiens
FLRRYDEFM

SEQ ID NO: 1216054 - protein, 9 aa, Homo Sapiens
KFGVNAILG

SEQ ID NO: 1216055 - protein, 9 aa, Homo Sapiens
KRIRVKLDD

SEQ ID NO: 1216056 - protein, 9 aa, Homo Sapiens
TIPGVKVHS

SEQ ID NO: 1216057 - protein, 9 aa, Homo Sapiens
QGVLQKVIV

SEQ ID NO: 1216058 - protein, 9 aa, Homo Sapiens
IHYGRENVT

SEQ ID NO: 1216059 - protein, 9 aa, Homo Sapiens
TSPDSGVLF

SEQ ID NO: 1216060 - protein, 9 aa, Homo Sapiens
KTRWLSSPN

SEQ ID NO: 1216061 - protein, 9 aa, Homo Sapiens
CVEHNTFGR

SEQ ID NO: 1216062 - protein, 9 aa, Homo Sapiens
MLLAWKFQA

SEQ ID NO: 1216063 - protein, 9 aa, Homo Sapiens
SQSRPHRTP

SEQ ID NO: 1216064 - protein, 9 aa, Homo Sapiens
MIERTPSCQ

SEQ ID NO: 1216065 - protein, 9 aa, Homo Sapiens
SNTPLVPQA

SEQ ID NO: 1216066 - protein, 9 aa, Homo Sapiens
KAFCVGGDI

SEQ ID NO: 1216067 - protein, 9 aa, Homo Sapiens
ALPVLMNAD

SEQ ID NO: 1216068 - protein, 9 aa, Homo Sapiens
MGYGIVCDA

SEQ ID NO: 1216069 - protein, 9 aa, Homo Sapiens
NSELMPFLQ

SEQ ID NO: 1216070 - protein, 9 aa, Homo Sapiens
AFSAKQKLI

SEQ ID NO: 1216071 - protein, 9 aa, Homo Sapiens
LVKVTYHVT

SEQ ID NO: 1216072 - protein, 9 aa, Homo Sapiens
GRVDFDEFV

SEQ ID NO: 1216073 - protein, 9 aa, Homo Sapiens
GNGPPTWPT

SEQ ID NO: 1216074 - protein, 9 aa, Homo Sapiens
VISDIDGII

SEQ ID NO: 1216075 - protein, 9 aa, Homo Sapiens
DASGTTAVP

SEQ ID NO: 1216076 - protein, 9 aa, Homo Sapiens
MNSAQSSIK

SEQ ID NO: 1216077 - protein, 9 aa, Homo Sapiens
KPSLSYHQH

SEQ ID NO: 1216078 - protein, 9 aa, Homo Sapiens
NEISAPFKE

SEQ ID NO: 1216079 - protein, 9 aa, Homo Sapiens
SDNLAKTHL

SEQ ID NO: 1216080 - protein, 9 aa, Homo Sapiens
SSTRKVSLA

SEQ ID NO: 1216081 - protein, 9 aa, Homo Sapiens
DQGPWRPLH

SEQ ID NO: 1216082 - protein, 9 aa, Homo Sapiens
RMLDGTVKM

SEQ ID NO: 1216083 - protein, 9 aa, Homo Sapiens
LNNFLTHCL

SEQ ID NO: 1216084 - protein, 9 aa, Homo Sapiens
KPSIKQTCF

SEQ ID NO: 1216085 - protein, 9 aa, Homo Sapiens
IRMYNVRAP

SEQ ID NO: 1216086 - protein, 9 aa, Homo Sapiens
KKAFVTCSS

SEQ ID NO: 1216087 - protein, 9 aa, Homo Sapiens
PLTLYPLAS

SEQ ID NO: 1216088 - protein, 9 aa, Homo Sapiens
VGHAGLELL

SEQ ID NO: 1216089 - protein, 9 aa, Homo Sapiens
HCECQQCFS

SEQ ID NO: 1216090 - protein, 9 aa, Homo Sapiens
LKNIFKADK

SEQ ID NO: 1216091 - protein, 9 aa, Homo Sapiens
YRCQRGLSW

SEQ ID NO: 1216092 - protein, 9 aa, Homo Sapiens
LQRANPSNF

SEQ ID NO: 1216093 - protein, 9 aa, Homo Sapiens
RTIGIVMDS

SEQ ID NO: 1216094 - protein, 9 aa, Homo Sapiens
HTILPEAST

SEQ ID NO: 1216095 - protein, 9 aa, Homo Sapiens
AYVQWHPVS

SEQ ID NO: 1216096 - protein, 9 aa, Homo Sapiens
NKYMEIHGA

SEQ ID NO: 1216097 - protein, 9 aa, Homo Sapiens
YQPNVLPHP

SEQ ID NO: 1216098 - protein, 9 aa, Homo Sapiens
SAMSFIHHH

SEQ ID NO: 1216099 - protein, 9 aa, Homo Sapiens
QREKTRWLS

SEQ ID NO: 1216100 - protein, 9 aa, Homo Sapiens
ETFRPNPAL

SEQ ID NO: 1216101 - protein, 9 aa, Homo Sapiens
VNISASEKG

SEQ ID NO: 1216102 - protein, 9 aa, Homo Sapiens
INKMMDKLK

SEQ ID NO: 1216103 - protein, 9 aa, Homo Sapiens
SALKLVAAA

SEQ ID NO: 1216104 - protein, 9 aa, Homo Sapiens
VYYDDRFIV

SEQ ID NO: 1216105 - protein, 9 aa, Homo Sapiens
VCMAIRNPL

SEQ ID NO: 1216106 - protein, 9 aa, Homo Sapiens
LADLQVNNG

SEQ ID NO: 1216107 - protein, 9 aa, Homo Sapiens
NVYTAQNPS

SEQ ID NO: 1216108 - protein, 9 aa, Homo Sapiens
KMFCTRKDP

SEQ ID NO: 1216109 - protein, 9 aa, Homo Sapiens
SEPGIFSVG

SEQ ID NO: 1216110 - protein, 9 aa, Homo Sapiens
SGILPEPVI

SEQ ID NO: 1216111 - protein, 9 aa, Homo Sapiens
PGLEKVHFW

SEQ ID NO: 1216112 - protein, 9 aa, Homo Sapiens
LVKLFKLPC

SEQ ID NO: 1216113 - protein, 9 aa, Homo Sapiens
GSQPHLDTD

SEQ ID NO: 1216114 - protein, 9 aa, Homo Sapiens
RPSSIEVIP

SEQ ID NO: 1216115 - protein, 9 aa, Homo Sapiens
SRLRDTPVG

SEQ ID NO: 1216116 - protein, 9 aa, Homo Sapiens
GQSLNHGMS

SEQ ID NO: 1216117 - protein, 9 aa, Homo Sapiens
AMDQKGLTN

SEQ ID NO: 1216118 - protein, 9 aa, Homo Sapiens
MCLYCGTGG

SEQ ID NO: 1216119 - protein, 9 aa, Homo Sapiens
SRLDVHKVL

SEQ ID NO: 1216120 - protein, 9 aa, Homo Sapiens
PWAIFPVWS

SEQ ID NO: 1216121 - protein, 9 aa, Homo Sapiens
DDERSHFSL

SEQ ID NO: 1216122 - protein, 9 aa, Homo Sapiens
AVTVGGING

SEQ ID NO: 1216123 - protein, 9 aa, Homo Sapiens
NPYQVPKED

SEQ ID NO: 1216124 - protein, 9 aa, Homo Sapiens
LEKLDITGN

SEQ ID NO: 1216125 - protein, 9 aa, Homo Sapiens
FFVMPLHHG

SEQ ID NO: 1216126 - protein, 9 aa, Homo Sapiens
FLGTSQDVT

SEQ ID NO: 1216127 - protein, 9 aa, Homo Sapiens
QEGDKFKLI

SEQ ID NO: 1216128 - protein, 9 aa, Homo Sapiens
IRAMRVARS

SEQ ID NO: 1216129 - protein, 9 aa, Homo Sapiens
GGEETQCYC

SEQ ID NO: 1216130 - protein, 9 aa, Homo Sapiens
AEQSLRSSG

SEQ ID NO: 1216131 - protein, 9 aa, Homo Sapiens
ALLIFLEKC

SEQ ID NO: 1216132 - protein, 9 aa, Homo Sapiens
RTGINEKKI

SEQ ID NO: 1216133 - protein, 9 aa, Homo Sapiens
LDEDDVYNL

SEQ ID NO: 1216134 - protein, 9 aa, Homo Sapiens
FRCERFDQP

SEQ ID NO: 1216135 - protein, 9 aa, Homo Sapiens
PLLYRHRLS

SEQ ID NO: 1216136 - protein, 9 aa, Homo Sapiens
ILDSVGHVV

SEQ ID NO: 1216137 - protein, 9 aa, Homo Sapiens
PGHAFFLEG

SEQ ID NO: 1216138 - protein, 9 aa, Homo Sapiens
ACVRGDEVM

SEQ ID NO: 1216139 - protein, 9 aa, Homo Sapiens
AATAAAAAY

SEQ ID NO: 1216140 - protein, 9 aa, Homo Sapiens
LNVEKTEKI

SEQ ID NO: 1216141 - protein, 9 aa, Homo Sapiens
VLLVFWDAR

SEQ ID NO: 1216142 - protein, 9 aa, Homo Sapiens
IGAVPATCF

SEQ ID NO: 1216143 - protein, 9 aa, Homo Sapiens
TLMNAISPL

SEQ ID NO: 1216144 - protein, 9 aa, Homo Sapiens
GEETQCYCT

SEQ ID NO: 1216145 - protein, 9 aa, Homo Sapiens
PLPRKAHRD

SEQ ID NO: 1216146 - protein, 9 aa, Homo Sapiens
PSAKGREEI

SEQ ID NO: 1216147 - protein, 9 aa, Homo Sapiens
VNQRHTENR

SEQ ID NO: 1216148 - protein, 9 aa, Homo Sapiens
YRRSIARCL

SEQ ID NO: 1216149 - protein, 9 aa, Homo Sapiens
AQNMWHTYL

SEQ ID NO: 1216150 - protein, 9 aa, Homo Sapiens
AVHRLLVRV

SEQ ID NO: 1216151 - protein, 9 aa, Homo Sapiens
GYGSHLHGE

SEQ ID NO: 1216152 - protein, 9 aa, Homo Sapiens
AGSLGSLLE

SEQ ID NO: 1216153 - protein, 9 aa, Homo Sapiens
NGTEGQPQV

SEQ ID NO: 1216154 - protein, 9 aa, Homo Sapiens
MLHCIYETQ

SEQ ID NO: 1216155 - protein, 9 aa, Homo Sapiens
SDSPTSLSE

SEQ ID NO: 1216156 - protein, 9 aa, Homo Sapiens
VICFTISAL

SEQ ID NO: 1216157 - protein, 9 aa, Homo Sapiens
IFYVHAYIS

SEQ ID NO: 1216158 - protein, 9 aa, Homo Sapiens
GGVRPWLPP

SEQ ID NO: 1216159 - protein, 9 aa, Homo Sapiens
PLREEGIEI

SEQ ID NO: 1216160 - protein, 9 aa, Homo Sapiens
EVTWGINQF

SEQ ID NO: 1216161 - protein, 9 aa, Homo Sapiens
LLLACSRDT

SEQ ID NO: 1216162 - protein, 9 aa, Homo Sapiens
KHCKCTECG

SEQ ID NO: 1216163 - protein, 9 aa, Homo Sapiens
RHVILDPAD

SEQ ID NO: 1216164 - protein, 9 aa, Homo Sapiens
VQRHHIRGP

SEQ ID NO: 1216165 - protein, 9 aa, Homo Sapiens
KYPDIVHQF

SEQ ID NO: 1216166 - protein, 9 aa, Homo Sapiens
AKCLSIWAL

SEQ ID NO: 1216167 - protein, 9 aa, Homo Sapiens
GNHLLGGSG

SEQ ID NO: 1216168 - protein, 9 aa, Homo Sapiens
FTKPVLSVC

SEQ ID NO: 1216169 - protein, 9 aa, Homo Sapiens
SVLQSRWHS

SEQ ID NO: 1216170 - protein, 9 aa, Homo Sapiens
FGNTIDTSS

SEQ ID NO: 1216171 - protein, 9 aa, Homo Sapiens
NMNNNSIHF

SEQ ID NO: 1216172 - protein, 9 aa, Homo Sapiens
RAESFRKVL

SEQ ID NO: 1216173 - protein, 9 aa, Homo Sapiens
WDVAVVLKA

SEQ ID NO: 1216174 - protein, 9 aa, Homo Sapiens
IHIDHIDKK

SEQ ID NO: 1216175 - protein, 9 aa, Homo Sapiens
KASKPIVHS

SEQ ID NO: 1216176 - protein, 9 aa, Homo Sapiens
KKTFPEIIN

SEQ ID NO: 1216177 - protein, 9 aa, Homo Sapiens
DKRATQGTY

SEQ ID NO: 1216178 - protein, 9 aa, Homo Sapiens
CIEVRVVRR

SEQ ID NO: 1216179 - protein, 9 aa, Homo Sapiens
RSTRCCWCS

SEQ ID NO: 1216180 - protein, 9 aa, Homo Sapiens
MERRETLAL

SEQ ID NO: 1216181 - protein, 9 aa, Homo Sapiens
PGSDSDISE

SEQ ID NO: 1216182 - protein, 9 aa, Homo Sapiens
FFVSVSFLL

SEQ ID NO: 1216183 - protein, 9 aa, Homo Sapiens
LVYTIKWHK

SEQ ID NO: 1216184 - protein, 9 aa, Homo Sapiens
PIWLWKLMI

SEQ ID NO: 1216185 - protein, 9 aa, Homo Sapiens
EDQNQSKIQ

SEQ ID NO: 1216186 - protein, 9 aa, Homo Sapiens
FWIGWGPWE

SEQ ID NO: 1216187 - protein, 9 aa, Homo Sapiens
LPVLAISGK

SEQ ID NO: 1216188 - protein, 9 aa, Homo Sapiens
VVFDDNYDR

SEQ ID NO: 1216189 - protein, 9 aa, Homo Sapiens
TAYDQRYSG

SEQ ID NO: 1216190 - protein, 9 aa, Homo Sapiens
ASKELKQMF

SEQ ID NO: 1216191 - protein, 9 aa, Homo Sapiens
GEVMHGSSF

SEQ ID NO: 1216192 - protein, 9 aa, Homo Sapiens
RDLYRFGYG

SEQ ID NO: 1216193 - protein, 9 aa, Homo Sapiens
LTQARGAAK

SEQ ID NO: 1216194 - protein, 9 aa, Homo Sapiens
HSEWARQGA

SEQ ID NO: 1216195 - protein, 9 aa, Homo Sapiens
KESYKTAVI

SEQ ID NO: 1216196 - protein, 9 aa, Homo Sapiens
SICLEENNQ

SEQ ID NO: 1216197 - protein, 9 aa, Homo Sapiens
MPVVKSEGD

SEQ ID NO: 1216198 - protein, 9 aa, Homo Sapiens
NKNSSRSYC

SEQ ID NO: 1216199 - protein, 9 aa, Homo Sapiens
KQMTTILEI

SEQ ID NO: 1216200 - protein, 9 aa, Homo Sapiens
FRVQFLVVT

SEQ ID NO: 1216201 - protein, 9 aa, Homo Sapiens
QHQLLEPCP

SEQ ID NO: 1216202 - protein, 9 aa, Homo Sapiens
STPPAHSSA

SEQ ID NO: 1216203 - protein, 9 aa, Homo Sapiens
DFSVIMMVY

SEQ ID NO: 1216204 - protein, 9 aa, Homo Sapiens
VTYETHHMY

SEQ ID NO: 1216205 - protein, 9 aa, Homo Sapiens
SLSAPGKWN

SEQ ID NO: 1216206 - protein, 9 aa, Homo Sapiens
GQVHPAPTP

SEQ ID NO: 1216207 - protein, 9 aa, Homo Sapiens
GYPEKRTQY

SEQ ID NO: 1216208 - protein, 9 aa, Homo Sapiens
QMKLIYQGH

SEQ ID NO: 1216209 - protein, 9 aa, Homo Sapiens
PLLQIEVGP

SEQ ID NO: 1216210 - protein, 9 aa, Homo Sapiens
PQVISYLEK

SEQ ID NO: 1216211 - protein, 9 aa, Homo Sapiens
MKNMDDNTF

SEQ ID NO: 1216212 - protein, 9 aa, Homo Sapiens
GIAGRSADF

SEQ ID NO: 1216213 - protein, 9 aa, Homo Sapiens
EPPLVTINV

SEQ ID NO: 1216214 - protein, 9 aa, Homo Sapiens
KKALVTSEA

SEQ ID NO: 1216215 - protein, 9 aa, Homo Sapiens
DVGLLEGSA

SEQ ID NO: 1216216 - protein, 9 aa, Homo Sapiens
QEVITPDNM

SEQ ID NO: 1216217 - protein, 9 aa, Homo Sapiens
RMVHMPGDV

SEQ ID NO: 1216218 - protein, 9 aa, Homo Sapiens
IATIAEKLD

SEQ ID NO: 1216219 - protein, 9 aa, Homo Sapiens
NDTANSSEI

SEQ ID NO: 1216220 - protein, 9 aa, Homo Sapiens
SYHQHFGRP

SEQ ID NO: 1216221 - protein, 9 aa, Homo Sapiens
ENLPRVCHV

SEQ ID NO: 1216222 - protein, 9 aa, Homo Sapiens
GFDALLTHR

SEQ ID NO: 1216223 - protein, 9 aa, Homo Sapiens
ADLLLSVFG

SEQ ID NO: 1216224 - protein, 9 aa, Homo Sapiens
VAPQQCVVC

SEQ ID NO: 1216225 - protein, 9 aa, Homo Sapiens
GVLVRHNRC

SEQ ID NO: 1216226 - protein, 9 aa, Homo Sapiens
MWDCGRNVC

SEQ ID NO: 1216227 - protein, 9 aa, Homo Sapiens
SGAAEKHVT

SEQ ID NO: 1216228 - protein, 9 aa, Homo Sapiens
PSRPTAVGT

SEQ ID NO: 1216229 - protein, 9 aa, Homo Sapiens
ALDVLTNVF

SEQ ID NO: 1216230 - protein, 9 aa, Homo Sapiens
RRCLREFQN

SEQ ID NO: 1216231 - protein, 9 aa, Homo Sapiens
CGVSKPTTF

SEQ ID NO: 1216232 - protein, 9 aa, Homo Sapiens
VAWSWSLDD

SEQ ID NO: 1216233 - protein, 9 aa, Homo Sapiens
IKDVTKALS

SEQ ID NO: 1216234 - protein, 9 aa, Homo Sapiens
PAKCCECEA

SEQ ID NO: 1216235 - protein, 9 aa, Homo Sapiens
PRDAGHLLY

SEQ ID NO: 1216236 - protein, 9 aa, Homo Sapiens
TVEEPRTTV

SEQ ID NO: 1216237 - protein, 9 aa, Homo Sapiens
SSMPPVTSI

SEQ ID NO: 1216238 - protein, 9 aa, Homo Sapiens
SVRGSAAAS

SEQ ID NO: 1216239 - protein, 9 aa, Homo Sapiens
KSFPSTAQL

SEQ ID NO: 1216240 - protein, 9 aa, Homo Sapiens
HVDEFLLDL

SEQ ID NO: 1216241 - protein, 9 aa, Homo Sapiens
LTQGMNIQW

SEQ ID NO: 1216242 - protein, 9 aa, Homo Sapiens
IQETHRQPM

SEQ ID NO: 1216243 - protein, 9 aa, Homo Sapiens
VFEDQCSFD

SEQ ID NO: 1216244 - protein, 9 aa, Homo Sapiens
DFEESLVMM

SEQ ID NO: 1216245 - protein, 9 aa, Homo Sapiens
NVGHQYVKD

SEQ ID NO: 1216246 - protein, 9 aa, Homo Sapiens
LRNKEVKAV

SEQ ID NO: 1216247 - protein, 9 aa, Homo Sapiens
LLCLPDEDA

SEQ ID NO: 1216248 - protein, 9 aa, Homo Sapiens
YFSAFINLV

SEQ ID NO: 1216249 - protein, 9 aa, Homo Sapiens
TLARQDGEV

SEQ ID NO: 1216250 - protein, 9 aa, Homo Sapiens
YFKRTGTGT

SEQ ID NO: 1216251 - protein, 9 aa, Homo Sapiens
IWVLVTAAR

SEQ ID NO: 1216252 - protein, 9 aa, Homo Sapiens
ANQRYSISK

SEQ ID NO: 1216253 - protein, 9 aa, Homo Sapiens
HQHATQKEV

SEQ ID NO: 1216254 - protein, 9 aa, Homo Sapiens
CRQQQQLLI

SEQ ID NO: 1216255 - protein, 9 aa, Homo Sapiens
VHEDYTMKM

SEQ ID NO: 1216256 - protein, 9 aa, Homo Sapiens
MIRQQELIK

SEQ ID NO: 1216257 - protein, 9 aa, Homo Sapiens
GKIYKYDRM

SEQ ID NO: 1216258 - protein, 9 aa, Homo Sapiens
RLIVELADH

SEQ ID NO: 1216259 - protein, 9 aa, Homo Sapiens
ELEVQTRVK

SEQ ID NO: 1216260 - protein, 9 aa, Homo Sapiens
TQQTTLRLV

SEQ ID NO: 1216261 - protein, 9 aa, Homo Sapiens
LEKLSRFHV

SEQ ID NO: 1216262 - protein, 9 aa, Homo Sapiens
INLADGNSN

SEQ ID NO: 1216263 - protein, 9 aa, Homo Sapiens
CHIFTRCIQ

SEQ ID NO: 1216264 - protein, 9 aa, Homo Sapiens
AAMRRYKTF

SEQ ID NO: 1216265 - protein, 9 aa, Homo Sapiens
GEWSDQPHI

SEQ ID NO: 1216266 - protein, 9 aa, Homo Sapiens
EYQSSLHLV

SEQ ID NO: 1216267 - protein, 9 aa, Homo Sapiens
MHKGEHLGE

SEQ ID NO: 1216268 - protein, 9 aa, Homo Sapiens
DSRTHTILW

SEQ ID NO: 1216269 - protein, 9 aa, Homo Sapiens
VCHAPETPE

SEQ ID NO: 1216270 - protein, 9 aa, Homo Sapiens
KNELQVSLF

SEQ ID NO: 1216271 - protein, 9 aa, Homo Sapiens
VKSTLDAFG

SEQ ID NO: 1216272 - protein, 9 aa, Homo Sapiens
SENRISSLV

SEQ ID NO: 1216273 - protein, 9 aa, Homo Sapiens
WGPCPRICR

SEQ ID NO: 1216274 - protein, 9 aa, Homo Sapiens
LCQCDKKKE

SEQ ID NO: 1216275 - protein, 9 aa, Homo Sapiens
GQPVHWEHC

SEQ ID NO: 1216276 - protein, 9 aa, Homo Sapiens
SPTWRNSMS

SEQ ID NO: 1216277 - protein, 9 aa, Homo Sapiens
MCIKECIRL

SEQ ID NO: 1216278 - protein, 9 aa, Homo Sapiens
NTQVYLKAF

SEQ ID NO: 1216279 - protein, 9 aa, Homo Sapiens
NSTGIRDPL

SEQ ID NO: 1216280 - protein, 9 aa, Homo Sapiens
DTTPVCTLS

SEQ ID NO: 1216281 - protein, 9 aa, Homo Sapiens
DGVPMLSIQ

SEQ ID NO: 1216282 - protein, 9 aa, Homo Sapiens
FSDMRRAEA

SEQ ID NO: 1216283 - protein, 9 aa, Homo Sapiens
GGSHPLSYK

SEQ ID NO: 1216284 - protein, 9 aa, Homo Sapiens
LESGPMRGA

SEQ ID NO: 1216285 - protein, 9 aa, Homo Sapiens
NWAGHGGTV

SEQ ID NO: 1216286 - protein, 9 aa, Homo Sapiens
TYGVLCADT

SEQ ID NO: 1216287 - protein, 9 aa, Homo Sapiens
AVPIVPQSP

SEQ ID NO: 1216288 - protein, 9 aa, Homo Sapiens
LSHISRKFT

SEQ ID NO: 1216289 - protein, 9 aa, Homo Sapiens
WFIKTTFIN

SEQ ID NO: 1216290 - protein, 9 aa, Homo Sapiens
KHGLRRRQT

SEQ ID NO: 1216291 - protein, 9 aa, Homo Sapiens
LRSDIAVLI

SEQ ID NO: 1216292 - protein, 9 aa, Homo Sapiens
WMLHNNGFR

SEQ ID NO: 1216293 - protein, 9 aa, Homo Sapiens
MSLSAGAIE

SEQ ID NO: 1216294 - protein, 9 aa, Homo Sapiens
EEDIDTSEP

SEQ ID NO: 1216295 - protein, 9 aa, Homo Sapiens
IEDYKITYW

SEQ ID NO: 1216296 - protein, 9 aa, Homo Sapiens
VAIPSSGMT

SEQ ID NO: 1216297 - protein, 9 aa, Homo Sapiens
ELPSIGEDT

SEQ ID NO: 1216298 - protein, 9 aa, Homo Sapiens
KYSKPSIKQ

SEQ ID NO: 1216299 - protein, 9 aa, Homo Sapiens
TNLFTKLTF

SEQ ID NO: 1216300 - protein, 9 aa, Homo Sapiens
EDERKQHAL

SEQ ID NO: 1216301 - protein, 9 aa, Homo Sapiens
TGGQAFFGA

SEQ ID NO: 1216302 - protein, 9 aa, Homo Sapiens
FSHLQNLTE

SEQ ID NO: 1216303 - protein, 9 aa, Homo Sapiens
SPKCFDVEV

SEQ ID NO: 1216304 - protein, 9 aa, Homo Sapiens
SSHLIRHRH

SEQ ID NO: 1216305 - protein, 9 aa, Homo Sapiens
IKELSSIDT

SEQ ID NO: 1216306 - protein, 9 aa, Homo Sapiens
IHTTAFPSS

SEQ ID NO: 1216307 - protein, 9 aa, Homo Sapiens
DITLDIQAA

SEQ ID NO: 1216308 - protein, 9 aa, Homo Sapiens
LELTNAEKH

SEQ ID NO: 1216309 - protein, 9 aa, Homo Sapiens
QMFQRLDCI

SEQ ID NO: 1216310 - protein, 9 aa, Homo Sapiens
RVPRLLAPC

SEQ ID NO: 1216311 - protein, 9 aa, Homo Sapiens
GHHPESMGL

SEQ ID NO: 1216312 - protein, 9 aa, Homo Sapiens
YFFPRPTSL

SEQ ID NO: 1216313 - protein, 9 aa, Homo Sapiens
PPLAFRGTP

SEQ ID NO: 1216314 - protein, 9 aa, Homo Sapiens
LEVQTRVKL

SEQ ID NO: 1216315 - protein, 9 aa, Homo Sapiens
TFAEVTELD

SEQ ID NO: 1216316 - protein, 9 aa, Homo Sapiens
TIHNGHGSA

SEQ ID NO: 1216317 - protein, 9 aa, Homo Sapiens
GFWASYHIS

SEQ ID NO: 1216318 - protein, 9 aa, Homo Sapiens
HNNGFRNYN

SEQ ID NO: 1216319 - protein, 9 aa, Homo Sapiens
TILHKYYER

SEQ ID NO: 1216320 - protein, 9 aa, Homo Sapiens
CVLLLVLDE

SEQ ID NO: 1216321 - protein, 9 aa, Homo Sapiens
TECDLKVEM

SEQ ID NO: 1216322 - protein, 9 aa, Homo Sapiens
REDPEEQSP

SEQ ID NO: 1216323 - protein, 9 aa, Homo Sapiens
GAHDGKIKV

SEQ ID NO: 1216324 - protein, 9 aa, Homo Sapiens
HAYTRECLG

SEQ ID NO: 1216325 - protein, 9 aa, Homo Sapiens
VVLDVINLV

SEQ ID NO: 1216326 - protein, 9 aa, Homo Sapiens
RTMRALAKT

SEQ ID NO: 1216327 - protein, 9 aa, Homo Sapiens
ISDPYVCIP

SEQ ID NO: 1216328 - protein, 9 aa, Homo Sapiens
RHGSCSSFA

SEQ ID NO: 1216329 - protein, 9 aa, Homo Sapiens
QLDEEHLEL

SEQ ID NO: 1216330 - protein, 9 aa, Homo Sapiens
WVICFTISA

SEQ ID NO: 1216331 - protein, 9 aa, Homo Sapiens
YHEVSVFVS

SEQ ID NO: 1216332 - protein, 9 aa, Homo Sapiens
TNYVKEFSP

SEQ ID NO: 1216333 - protein, 9 aa, Homo Sapiens
IRVSQGKEH

SEQ ID NO: 1216334 - protein, 9 aa, Homo Sapiens
FAHADPSFI

SEQ ID NO: 1216335 - protein, 9 aa, Homo Sapiens
CIVFVTIPV

SEQ ID NO: 1216336 - protein, 9 aa, Homo Sapiens
ALDPVPFDQ

SEQ ID NO: 1216337 - protein, 9 aa, Homo Sapiens
QIPKKFRHP

SEQ ID NO: 1216338 - protein, 9 aa, Homo Sapiens
ECLQPKAAE

SEQ ID NO: 1216339 - protein, 9 aa, Homo Sapiens
LKLLTAVHG

SEQ ID NO: 1216340 - protein, 9 aa, Homo Sapiens
PNAKKVTHI

SEQ ID NO: 1216341 - protein, 9 aa, Homo Sapiens
WDDNHFSSD

SEQ ID NO: 1216342 - protein, 9 aa, Homo Sapiens
PGPSLGYFR

SEQ ID NO: 1216343 - protein, 9 aa, Homo Sapiens
KWPSTLYTT

SEQ ID NO: 1216344 - protein, 9 aa, Homo Sapiens
IKTDVNKAI

SEQ ID NO: 1216345 - protein, 9 aa, Homo Sapiens
GGKTTILYR

SEQ ID NO: 1216346 - protein, 9 aa, Homo Sapiens
TNQPVKMAP

SEQ ID NO: 1216347 - protein, 9 aa, Homo Sapiens
FGSSGGSDG

SEQ ID NO: 1216348 - protein, 9 aa, Homo Sapiens
YSQKVSQAS

SEQ ID NO: 1216349 - protein, 9 aa, Homo Sapiens
ANSMILFFK

SEQ ID NO: 1216350 - protein, 9 aa, Homo Sapiens
AGFITPLSL

SEQ ID NO: 1216351 - protein, 9 aa, Homo Sapiens
RLYLEAFCL

SEQ ID NO: 1216352 - protein, 9 aa, Homo Sapiens
PIITPSEAK

SEQ ID NO: 1216353 - protein, 9 aa, Homo Sapiens
TLKNSKTGS

SEQ ID NO: 1216354 - protein, 9 aa, Homo Sapiens
LRRVLAEPN

SEQ ID NO: 1216355 - protein, 9 aa, Homo Sapiens
HQGQHLFIE

SEQ ID NO: 1216356 - protein, 9 aa, Homo Sapiens
HSGTISQPQ

SEQ ID NO: 1216357 - protein, 9 aa, Homo Sapiens
TLSDDDTVL

SEQ ID NO: 1216358 - protein, 9 aa, Homo Sapiens
KCVLRANSG

SEQ ID NO: 1216359 - protein, 9 aa, Homo Sapiens
EIAAPQSFI

SEQ ID NO: 1216360 - protein, 9 aa, Homo Sapiens
DGEELDLRL

SEQ ID NO: 1216361 - protein, 9 aa, Homo Sapiens
PIGHRCEGD

SEQ ID NO: 1216362 - protein, 9 aa, Homo Sapiens
LMLPVCSIT

SEQ ID NO: 1216363 - protein, 9 aa, Homo Sapiens
TPVVWGVVL

SEQ ID NO: 1216364 - protein, 9 aa, Homo Sapiens
KTTSSTRKV

SEQ ID NO: 1216365 - protein, 9 aa, Homo Sapiens
ERYRQLRFL

SEQ ID NO: 1216366 - protein, 9 aa, Homo Sapiens
LQERAEGIP

SEQ ID NO: 1216367 - protein, 9 aa, Homo Sapiens
VLYECSCAP

SEQ ID NO: 1216368 - protein, 9 aa, Homo Sapiens
PSYIGIPIT

SEQ ID NO: 1216369 - protein, 9 aa, Homo Sapiens
TKKAVDNTT

SEQ ID NO: 1216370 - protein, 9 aa, Homo Sapiens
AVAFSTTSN

SEQ ID NO: 1216371 - protein, 9 aa, Homo Sapiens
HSSPGYPQE

SEQ ID NO: 1216372 - protein, 9 aa, Homo Sapiens
QKKPGKGIG

SEQ ID NO: 1216373 - protein, 9 aa, Homo Sapiens
LMYDVTKEV

SEQ ID NO: 1216374 - protein, 9 aa, Homo Sapiens
GMHHHGQLI

SEQ ID NO: 1216375 - protein, 9 aa, Homo Sapiens
NVNFFTKLP

SEQ ID NO: 1216376 - protein, 9 aa, Homo Sapiens
YIMSVQAEE

SEQ ID NO: 1216377 - protein, 9 aa, Homo Sapiens
CHLLVMAST

SEQ ID NO: 1216378 - protein, 9 aa, Homo Sapiens
VLHILHSLG

SEQ ID NO: 1216379 - protein, 9 aa, Homo Sapiens
ALNAIHALM

SEQ ID NO: 1216380 - protein, 9 aa, Homo Sapiens
SSTFKQEEM

SEQ ID NO: 1216381 - protein, 9 aa, Homo Sapiens
APGSAGPDC

SEQ ID NO: 1216382 - protein, 9 aa, Homo Sapiens
FPILLYSLM

SEQ ID NO: 1216383 - protein, 9 aa, Homo Sapiens
FQENDRLFI

SEQ ID NO: 1216384 - protein, 9 aa, Homo Sapiens
GNEPSTKVQ

SEQ ID NO: 1216385 - protein, 9 aa, Homo Sapiens
EIAMDQKGL

SEQ ID NO: 1216386 - protein, 9 aa, Homo Sapiens
NTELNAQIM

SEQ ID NO: 1216387 - protein, 9 aa, Homo Sapiens
STEKAVAAM

SEQ ID NO: 1216388 - protein, 9 aa, Homo Sapiens
TGLGMWGLP

SEQ ID NO: 1216389 - protein, 9 aa, Homo Sapiens
INDHYPVFL

SEQ ID NO: 1216390 - protein, 9 aa, Homo Sapiens
FRRHDSITS

SEQ ID NO: 1216391 - protein, 9 aa, Homo Sapiens
ILASLQIRI

SEQ ID NO: 1216392 - protein, 9 aa, Homo Sapiens
RIQAEQTSD

SEQ ID NO: 1216393 - protein, 9 aa, Homo Sapiens
YNGVIEEFW

SEQ ID NO: 1216394 - protein, 9 aa, Homo Sapiens
DEDEQESMR

SEQ ID NO: 1216395 - protein, 9 aa, Homo Sapiens
EEWKKTMEL

SEQ ID NO: 1216396 - protein, 9 aa, Homo Sapiens
LLDMEGANS

SEQ ID NO: 1216397 - protein, 9 aa, Homo Sapiens
RKIQSAHIK

SEQ ID NO: 1216398 - protein, 9 aa, Homo Sapiens
QVQLQHLGT

SEQ ID NO: 1216399 - protein, 9 aa, Homo Sapiens
GQTKSVVVY

SEQ ID NO: 1216400 - protein, 9 aa, Homo Sapiens
VDSDESLGG

SEQ ID NO: 1216401 - protein, 9 aa, Homo Sapiens
LMPEKKVSE

SEQ ID NO: 1216402 - protein, 9 aa, Homo Sapiens
MFTNCHIYN

SEQ ID NO: 1216403 - protein, 9 aa, Homo Sapiens
RRELGGRAF

SEQ ID NO: 1216404 - protein, 9 aa, Homo Sapiens
GHCVIKNAT

SEQ ID NO: 1216405 - protein, 9 aa, Homo Sapiens
ITVDRHLHS

SEQ ID NO: 1216406 - protein, 9 aa, Homo Sapiens
VSQGKEHVH

SEQ ID NO: 1216407 - protein, 9 aa, Homo Sapiens
KSKEELHHL

SEQ ID NO: 1216408 - protein, 9 aa, Homo Sapiens
AKYSMDHGV

SEQ ID NO: 1216409 - protein, 9 aa, Homo Sapiens
DASFTENTD

SEQ ID NO: 1216410 - protein, 9 aa, Homo Sapiens
MGWLASGKY

SEQ ID NO: 1216411 - protein, 9 aa, Homo Sapiens
NSVTDTNKT

SEQ ID NO: 1216412 - protein, 9 aa, Homo Sapiens
TPKIRDNFW

SEQ ID NO: 1216413 - protein, 9 aa, Homo Sapiens
IFTSVTYLY

SEQ ID NO: 1216414 - protein, 9 aa, Homo Sapiens
EECHLSPSR

SEQ ID NO: 1216415 - protein, 9 aa, Homo Sapiens
DSRRETKML

SEQ ID NO: 1216416 - protein, 9 aa, Homo Sapiens
VDLSLPTIG

SEQ ID NO: 1216417 - protein, 9 aa, Homo Sapiens
FIFHCKRDA

SEQ ID NO: 1216418 - protein, 9 aa, Homo Sapiens
LPPISPSRS

SEQ ID NO: 1216419 - protein, 9 aa, Homo Sapiens
MYNSKGTDF

SEQ ID NO: 1216420 - protein, 9 aa, Homo Sapiens
HQPKKYMNS

SEQ ID NO: 1216421 - protein, 9 aa, Homo Sapiens
LKKDQKAKE

SEQ ID NO: 1216422 - protein, 9 aa, Homo Sapiens
CIQDAMEVT

SEQ ID NO: 1216423 - protein, 9 aa, Homo Sapiens
QHQRSPSLS

SEQ ID NO: 1216424 - protein, 9 aa, Homo Sapiens
DQERIIPCL

SEQ ID NO: 1216425 - protein, 9 aa, Homo Sapiens
ELRGQEQRS

SEQ ID NO: 1216426 - protein, 9 aa, Homo Sapiens
VGIIIQLRA

SEQ ID NO: 1216427 - protein, 9 aa, Homo Sapiens
KLEQQACLI

SEQ ID NO: 1216428 - protein, 9 aa, Homo Sapiens
HKHVFLTVT

SEQ ID NO: 1216429 - protein, 9 aa, Homo Sapiens
SMKSERADR

SEQ ID NO: 1216430 - protein, 9 aa, Homo Sapiens
LLFNGCHSG

SEQ ID NO: 1216431 - protein, 9 aa, Homo Sapiens
YGIQPHLDM

SEQ ID NO: 1216432 - protein, 9 aa, Homo Sapiens
LSYNMLITC

SEQ ID NO: 1216433 - protein, 9 aa, Homo Sapiens
WWWGEGGRR

SEQ ID NO: 1216434 - protein, 9 aa, Homo Sapiens
AATRPTDAQ

SEQ ID NO: 1216435 - protein, 9 aa, Homo Sapiens
NWQNNLTDA

SEQ ID NO: 1216436 - protein, 9 aa, Homo Sapiens
AWTDSNSQS

SEQ ID NO: 1216437 - protein, 9 aa, Homo Sapiens
PYTSCLYIM

SEQ ID NO: 1216438 - protein, 9 aa, Homo Sapiens
GIATLAMVL

SEQ ID NO: 1216439 - protein, 9 aa, Homo Sapiens
TIMGKLRGV

SEQ ID NO: 1216440 - protein, 9 aa, Homo Sapiens
LKSLSKEDL

SEQ ID NO: 1216441 - protein, 9 aa, Homo Sapiens
TDVRELVSL

SEQ ID NO: 1216442 - protein, 9 aa, Homo Sapiens
PLRTMHGTS

SEQ ID NO: 1216443 - protein, 9 aa, Homo Sapiens
LVVFGQVCA

SEQ ID NO: 1216444 - protein, 9 aa, Homo Sapiens
LNSMKPQSL

SEQ ID NO: 1216445 - protein, 9 aa, Homo Sapiens
SPRRMTPLS

SEQ ID NO: 1216446 - protein, 9 aa, Homo Sapiens
IVWMPRMRQ

SEQ ID NO: 1216447 - protein, 9 aa, Homo Sapiens
FVIIVSISS

SEQ ID NO: 1216448 - protein, 9 aa, Homo Sapiens
SGNSPMARL

SEQ ID NO: 1216449 - protein, 9 aa, Homo Sapiens
RHLRNLLKP

SEQ ID NO: 1216450 - protein, 9 aa, Homo Sapiens
RAGVSHVLN

SEQ ID NO: 1216451 - protein, 9 aa, Homo Sapiens
KTLLVLGSV

SEQ ID NO: 1216452 - protein, 9 aa, Homo Sapiens
INHSLSADV

SEQ ID NO: 1216453 - protein, 9 aa, Homo Sapiens
KTVQHKEVE

SEQ ID NO: 1216454 - protein, 9 aa, Homo Sapiens
LPFPSHMLP

SEQ ID NO: 1216455 - protein, 9 aa, Homo Sapiens
LLHAEPYPT

SEQ ID NO: 1216456 - protein, 9 aa, Homo Sapiens
YYLPLTNVR

SEQ ID NO: 1216457 - protein, 9 aa, Homo Sapiens
RKQSQRLPW

SEQ ID NO: 1216458 - protein, 9 aa, Homo Sapiens
LISVDNFED

SEQ ID NO: 1216459 - protein, 9 aa, Homo Sapiens
SFDNNKTVL

SEQ ID NO: 1216460 - protein, 9 aa, Homo Sapiens
VQPILVECQ

SEQ ID NO: 1216461 - protein, 9 aa, Homo Sapiens
QTLCVAYAD

SEQ ID NO: 1216462 - protein, 9 aa, Homo Sapiens
DQDMNAYLV

SEQ ID NO: 1216463 - protein, 9 aa, Homo Sapiens
ICNICHILL

SEQ ID NO: 1216464 - protein, 9 aa, Homo Sapiens
YIEHPDVNN

SEQ ID NO: 1216465 - protein, 9 aa, Homo Sapiens
ALNDTCLVY

SEQ ID NO: 1216466 - protein, 9 aa, Homo Sapiens
VKDKDTTEN

SEQ ID NO: 1216467 - protein, 9 aa, Homo Sapiens
IWSKVYNPL

SEQ ID NO: 1216468 - protein, 9 aa, Homo Sapiens
QTVKNVVLD

SEQ ID NO: 1216469 - protein, 9 aa, Homo Sapiens
HNPTLHHSH

SEQ ID NO: 1216470 - protein, 9 aa, Homo Sapiens
RLHERKQLV

SEQ ID NO: 1216471 - protein, 9 aa, Homo Sapiens
EGVVTKSQP

SEQ ID NO: 1216472 - protein, 9 aa, Homo Sapiens
YKCYIKNHE

SEQ ID NO: 1216473 - protein, 9 aa, Homo Sapiens
LLSILVLAG

SEQ ID NO: 1216474 - protein, 9 aa, Homo Sapiens
LEHKTKSGL

SEQ ID NO: 1216475 - protein, 9 aa, Homo Sapiens
EEDPYFTDI

SEQ ID NO: 1216476 - protein, 9 aa, Homo Sapiens
VHDSTHVSC

SEQ ID NO: 1216477 - protein, 9 aa, Homo Sapiens
IRHLRDVRK

SEQ ID NO: 1216478 - protein, 9 aa, Homo Sapiens
LKTSIDSLA

SEQ ID NO: 1216479 - protein, 9 aa, Homo Sapiens
QQIDPNNPA

SEQ ID NO: 1216480 - protein, 9 aa, Homo Sapiens
SRDSSQECT

SEQ ID NO: 1216481 - protein, 9 aa, Homo Sapiens
NHMVVIHAE

SEQ ID NO: 1216482 - protein, 9 aa, Homo Sapiens
VKSKKDSCS

SEQ ID NO: 1216483 - protein, 9 aa, Homo Sapiens
KFTRVNMGV

SEQ ID NO: 1216484 - protein, 9 aa, Homo Sapiens
ASGNLRSRK

SEQ ID NO: 1216485 - protein, 9 aa, Homo Sapiens
ICGHNYLLT

SEQ ID NO: 1216486 - protein, 9 aa, Homo Sapiens
PSAQIRCPK

SEQ ID NO: 1216487 - protein, 9 aa, Homo Sapiens
AVAMDFSQA

SEQ ID NO: 1216488 - protein, 9 aa, Homo Sapiens
GCHRYLCYL

SEQ ID NO: 1216489 - protein, 9 aa, Homo Sapiens
FFGDVPASL

SEQ ID NO: 1216490 - protein, 9 aa, Homo Sapiens
TVVMSAGAI

SEQ ID NO: 1216491 - protein, 9 aa, Homo Sapiens
CKHLGCTQK

SEQ ID NO: 1216492 - protein, 9 aa, Homo Sapiens
SSPAPRTKQ

SEQ ID NO: 1216493 - protein, 9 aa, Homo Sapiens
TKLLSTSAK

SEQ ID NO: 1216494 - protein, 9 aa, Homo Sapiens
MIVAHAVEV

SEQ ID NO: 1216495 - protein, 9 aa, Homo Sapiens
IFQESSQLA

SEQ ID NO: 1216496 - protein, 9 aa, Homo Sapiens
NEHLRRQFT

SEQ ID NO: 1216497 - protein, 9 aa, Homo Sapiens
LSSSPAHNG

SEQ ID NO: 1216498 - protein, 9 aa, Homo Sapiens
LMFGEGMTC

SEQ ID NO: 1216499 - protein, 9 aa, Homo Sapiens
QCQPQQGPP

SEQ ID NO: 1216500 - protein, 9 aa, Homo Sapiens
HQDLLCSVK

SEQ ID NO: 1216501 - protein, 9 aa, Homo Sapiens
HERAITFRM

SEQ ID NO: 1216502 - protein, 9 aa, Homo Sapiens
NTYYKVASN

SEQ ID NO: 1216503 - protein, 9 aa, Homo Sapiens
KLRSDIAVL

SEQ ID NO: 1216504 - protein, 9 aa, Homo Sapiens
LNGPSSAAV

SEQ ID NO: 1216505 - protein, 9 aa, Homo Sapiens
LSIPWTQIP

SEQ ID NO: 1216506 - protein, 9 aa, Homo Sapiens
VALFNSMHH

SEQ ID NO: 1216507 - protein, 9 aa, Homo Sapiens
PRICRGIRG

SEQ ID NO: 1216508 - protein, 9 aa, Homo Sapiens
DIHKMLSPD

SEQ ID NO: 1216509 - protein, 9 aa, Homo Sapiens
LSQQLVAAG

SEQ ID NO: 1216510 - protein, 9 aa, Homo Sapiens
SLALYLLFT

SEQ ID NO: 1216511 - protein, 9 aa, Homo Sapiens
KGMSLKSNA

SEQ ID NO: 1216512 - protein, 9 aa, Homo Sapiens
HADPSFITA

SEQ ID NO: 1216513 - protein, 9 aa, Homo Sapiens
GDEVMVQML

SEQ ID NO: 1216514 - protein, 9 aa, Homo Sapiens
APPAKECTA

SEQ ID NO: 1216515 - protein, 9 aa, Homo Sapiens
QPLDDDDVF

SEQ ID NO: 1216516 - protein, 9 aa, Homo Sapiens
ENNFTKLIT

SEQ ID NO: 1216517 - protein, 9 aa, Homo Sapiens
PKCYVQDLL

SEQ ID NO: 1216518 - protein, 9 aa, Homo Sapiens
KKQDKKNGA

SEQ ID NO: 1216519 - protein, 9 aa, Homo Sapiens
FLLRMRRTL

SEQ ID NO: 1216520 - protein, 9 aa, Homo Sapiens
EGADIHKML

SEQ ID NO: 1216521 - protein, 9 aa, Homo Sapiens
KNAVVRAGA

SEQ ID NO: 1216522 - protein, 9 aa, Homo Sapiens
PAAGDVLNH

SEQ ID NO: 1216523 - protein, 9 aa, Homo Sapiens
SLVVHLLQF

SEQ ID NO: 1216524 - protein, 9 aa, Homo Sapiens
PMSTNQAQA

SEQ ID NO: 1216525 - protein, 9 aa, Homo Sapiens
EPAQAETEV

SEQ ID NO: 1216526 - protein, 9 aa, Homo Sapiens
DYIINEKTV

SEQ ID NO: 1216527 - protein, 9 aa, Homo Sapiens
CLPRRAPQG

SEQ ID NO: 1216528 - protein, 9 aa, Homo Sapiens
KETFPVEAD

SEQ ID NO: 1216529 - protein, 9 aa, Homo Sapiens
TISQPQILL

SEQ ID NO: 1216530 - protein, 9 aa, Homo Sapiens
FVHTSGFTG

SEQ ID NO: 1216531 - protein, 9 aa, Homo Sapiens
VRLHFLRTN

SEQ ID NO: 1216532 - protein, 9 aa, Homo Sapiens
GHLVIYMPK

SEQ ID NO: 1216533 - protein, 9 aa, Homo Sapiens
THLVTQQPM

SEQ ID NO: 1216534 - protein, 9 aa, Homo Sapiens
VIYMPKVGE

SEQ ID NO: 1216535 - protein, 9 aa, Homo Sapiens
RSPSRDKVV

SEQ ID NO: 1216536 - protein, 9 aa, Homo Sapiens
RADLCHQHA

SEQ ID NO: 1216537 - protein, 9 aa, Homo Sapiens
KQVTDTVLI

SEQ ID NO: 1216538 - protein, 9 aa, Homo Sapiens
RTCEDLKDQ

SEQ ID NO: 1216539 - protein, 9 aa, Homo Sapiens
SGGQVGIRA

SEQ ID NO: 1216540 - protein, 9 aa, Homo Sapiens
SEDTLNNFQ

SEQ ID NO: 1216541 - protein, 9 aa, Homo Sapiens
TLWLLDCPG

SEQ ID NO: 1216542 - protein, 9 aa, Homo Sapiens
TSTRPLISI

SEQ ID NO: 1216543 - protein, 9 aa, Homo Sapiens
STIFLYVRT

SEQ ID NO: 1216544 - protein, 9 aa, Homo Sapiens
KNFELMMHT

SEQ ID NO: 1216545 - protein, 9 aa, Homo Sapiens
DGLCTLCIA

SEQ ID NO: 1216546 - protein, 9 aa, Homo Sapiens
PYRLVEGQV

SEQ ID NO: 1216547 - protein, 9 aa, Homo Sapiens
HEKIQLISE

SEQ ID NO: 1216548 - protein, 9 aa, Homo Sapiens
KQITALATK

SEQ ID NO: 1216549 - protein, 9 aa, Homo Sapiens
EEQCHWLDP

SEQ ID NO: 1216550 - protein, 9 aa, Homo Sapiens
NEIEAFSEP

SEQ ID NO: 1216551 - protein, 9 aa, Homo Sapiens
VSTPLLPEV

SEQ ID NO: 1216552 - protein, 9 aa, Homo Sapiens
TINGEDVLF

SEQ ID NO: 1216553 - protein, 9 aa, Homo Sapiens
NNAHYFIGF

SEQ ID NO: 1216554 - protein, 9 aa, Homo Sapiens
ATNISKQLP

SEQ ID NO: 1216555 - protein, 9 aa, Homo Sapiens
EKDLGCCIK

SEQ ID NO: 1216556 - protein, 9 aa, Homo Sapiens
KDPSDYVCA

SEQ ID NO: 1216557 - protein, 9 aa, Homo Sapiens
IIPHPYIKM

SEQ ID NO: 1216558 - protein, 9 aa, Homo Sapiens
NECGNVFSR

SEQ ID NO: 1216559 - protein, 9 aa, Homo Sapiens
LTLQPHSCL

SEQ ID NO: 1216560 - protein, 9 aa, Homo Sapiens
ICVIGLFYG

SEQ ID NO: 1216561 - protein, 9 aa, Homo Sapiens
HTVCYDLSP

SEQ ID NO: 1216562 - protein, 9 aa, Homo Sapiens
EETQCYCTD

SEQ ID NO: 1216563 - protein, 9 aa, Homo Sapiens
AGSSALGPL

SEQ ID NO: 1216564 - protein, 9 aa, Homo Sapiens
NRLGPEADV

SEQ ID NO: 1216565 - protein, 9 aa, Homo Sapiens
VAIQALWVG

SEQ ID NO: 1216566 - protein, 9 aa, Homo Sapiens
PRTPRSLIP

SEQ ID NO: 1216567 - protein, 9 aa, Homo Sapiens
ASQGIGPAG

SEQ ID NO: 1216568 - protein, 9 aa, Homo Sapiens
TVQLTSVDA

SEQ ID NO: 1216569 - protein, 9 aa, Homo Sapiens
LVIPFDPKD

SEQ ID NO: 1216570 - protein, 9 aa, Homo Sapiens
TEAKSYWDA

SEQ ID NO: 1216571 - protein, 9 aa, Homo Sapiens
MHHTQTKFE

SEQ ID NO: 1216572 - protein, 9 aa, Homo Sapiens
LRSVNSRGL

SEQ ID NO: 1216573 - protein, 9 aa, Homo Sapiens
RKNASISMR

SEQ ID NO: 1216574 - protein, 9 aa, Homo Sapiens
MIGIVCSPT

SEQ ID NO: 1216575 - protein, 9 aa, Homo Sapiens
LECQKRIDT

SEQ ID NO: 1216576 - protein, 9 aa, Homo Sapiens
HSEPLPPSA

SEQ ID NO: 1216577 - protein, 9 aa, Homo Sapiens
LNSDGWLHT

SEQ ID NO: 1216578 - protein, 9 aa, Homo Sapiens
RTQEVIPLL

SEQ ID NO: 1216579 - protein, 9 aa, Homo Sapiens
AILEHCRSL

SEQ ID NO: 1216580 - protein, 9 aa, Homo Sapiens
ICRMLSDLC

SEQ ID NO: 1216581 - protein, 9 aa, Homo Sapiens
GGIGVLNKN

SEQ ID NO: 1216582 - protein, 9 aa, Homo Sapiens
SSLLHDGGR

SEQ ID NO: 1216583 - protein, 9 aa, Homo Sapiens
VASSSLTPH

SEQ ID NO: 1216584 - protein, 9 aa, Homo Sapiens
EENSHCTFA

SEQ ID NO: 1216585 - protein, 9 aa, Homo Sapiens
ILEPVLRTD

SEQ ID NO: 1216586 - protein, 9 aa, Homo Sapiens
VNFDILERE

SEQ ID NO: 1216587 - protein, 9 aa, Homo Sapiens
SNYRDGMII

SEQ ID NO: 1216588 - protein, 9 aa, Homo Sapiens
YHVARAHKQ

SEQ ID NO: 1216589 - protein, 9 aa, Homo Sapiens
FLPGAIPLA

SEQ ID NO: 1216590 - protein, 9 aa, Homo Sapiens
QNKVGAVFY

SEQ ID NO: 1216591 - protein, 9 aa, Homo Sapiens
PPSYIGIPI

SEQ ID NO: 1216592 - protein, 9 aa, Homo Sapiens
AESLKSNGR

SEQ ID NO: 1216593 - protein, 9 aa, Homo Sapiens
TTVGVTTTQ

SEQ ID NO: 1216594 - protein, 9 aa, Homo Sapiens
KLDFRNDIL

SEQ ID NO: 1216595 - protein, 9 aa, Homo Sapiens
CKKNGEEIH

SEQ ID NO: 1216596 - protein, 9 aa, Homo Sapiens
IRLIRQVER

SEQ ID NO: 1216597 - protein, 9 aa, Homo Sapiens
EGTRKMERT

SEQ ID NO: 1216598 - protein, 9 aa, Homo Sapiens
QEETETVSD

SEQ ID NO: 1216599 - protein, 9 aa, Homo Sapiens
VEENRIDVD

SEQ ID NO: 1216600 - protein, 9 aa, Homo Sapiens
QRTHEPPRP

SEQ ID NO: 1216601 - protein, 9 aa, Homo Sapiens
GDMPLVGDL

SEQ ID NO: 1216602 - protein, 9 aa, Homo Sapiens
MEDISQMKS

SEQ ID NO: 1216603 - protein, 9 aa, Homo Sapiens
PATRPKPNV

SEQ ID NO: 1216604 - protein, 9 aa, Homo Sapiens
IHTRKHYEC

SEQ ID NO: 1216605 - protein, 9 aa, Homo Sapiens
KGQVKNEVL

SEQ ID NO: 1216606 - protein, 9 aa, Homo Sapiens
ENPPGPWGW

SEQ ID NO: 1216607 - protein, 9 aa, Homo Sapiens
DITGNGHEE

SEQ ID NO: 1216608 - protein, 9 aa, Homo Sapiens
ILSGFFNTT

SEQ ID NO: 1216609 - protein, 9 aa, Homo Sapiens
RRRPRGMMK

SEQ ID NO: 1216610 - protein, 9 aa, Homo Sapiens
HNLNLEQWL

SEQ ID NO: 1216611 - protein, 9 aa, Homo Sapiens
QIEVGPPES

SEQ ID NO: 1216612 - protein, 9 aa, Homo Sapiens
KSYEDALLP

SEQ ID NO: 1216613 - protein, 9 aa, Homo Sapiens
KEINTAHAI

SEQ ID NO: 1216614 - protein, 9 aa, Homo Sapiens
APPATLRFL

SEQ ID NO: 1216615 - protein, 9 aa, Homo Sapiens
VHAVLAYSQ

SEQ ID NO: 1216616 - protein, 9 aa, Homo Sapiens
PEYLRERSM

SEQ ID NO: 1216617 - protein, 9 aa, Homo Sapiens
LLTPGEDPP

SEQ ID NO: 1216618 - protein, 9 aa, Homo Sapiens
SYFSFEMSL

SEQ ID NO: 1216619 - protein, 9 aa, Homo Sapiens
AIFIPSTPV

SEQ ID NO: 1216620 - protein, 9 aa, Homo Sapiens
ACLNLDTMT

SEQ ID NO: 1216621 - protein, 9 aa, Homo Sapiens
SLLGVIAGI

SEQ ID NO: 1216622 - protein, 9 aa, Homo Sapiens
YSAPNVPVV

SEQ ID NO: 1216623 - protein, 9 aa, Homo Sapiens
KAIMGCIAY

SEQ ID NO: 1216624 - protein, 9 aa, Homo Sapiens
KFPIEYASN

SEQ ID NO: 1216625 - protein, 9 aa, Homo Sapiens
GSDYIINEK

SEQ ID NO: 1216626 - protein, 9 aa, Homo Sapiens
GTSFGVNVD

SEQ ID NO: 1216627 - protein, 9 aa, Homo Sapiens
SVSAASSLH

SEQ ID NO: 1216628 - protein, 9 aa, Homo Sapiens
DNYEVQAEK

SEQ ID NO: 1216629 - protein, 9 aa, Homo Sapiens
HVQAWLRFS

SEQ ID NO: 1216630 - protein, 9 aa, Homo Sapiens
YNYKSKSAG

SEQ ID NO: 1216631 - protein, 9 aa, Homo Sapiens
DLFYGMVSK

SEQ ID NO: 1216632 - protein, 9 aa, Homo Sapiens
LPRVCHVLA

SEQ ID NO: 1216633 - protein, 9 aa, Homo Sapiens
SNMPISSHV

SEQ ID NO: 1216634 - protein, 9 aa, Homo Sapiens
RAAGHTPKT

SEQ ID NO: 1216635 - protein, 9 aa, Homo Sapiens
GGRQKYKRS

SEQ ID NO: 1216636 - protein, 9 aa, Homo Sapiens
NNCFSTTVP

SEQ ID NO: 1216637 - protein, 9 aa, Homo Sapiens
CVRNVKESA

SEQ ID NO: 1216638 - protein, 9 aa, Homo Sapiens
SYLLKESSG

SEQ ID NO: 1216639 - protein, 9 aa, Homo Sapiens
VCFLAVGLV

SEQ ID NO: 1216640 - protein, 9 aa, Homo Sapiens
VPLSLRLTG

SEQ ID NO: 1216641 - protein, 9 aa, Homo Sapiens
RLDQQLWGA

SEQ ID NO: 1216642 - protein, 9 aa, Homo Sapiens
TNFRVMNIG

SEQ ID NO: 1216643 - protein, 9 aa, Homo Sapiens
EQCFTSEVV

SEQ ID NO: 1216644 - protein, 9 aa, Homo Sapiens
LELESKQQV

SEQ ID NO: 1216645 - protein, 9 aa, Homo Sapiens
TYSIGRIFD

SEQ ID NO: 1216646 - protein, 9 aa, Homo Sapiens
NTYESHILV

SEQ ID NO: 1216647 - protein, 9 aa, Homo Sapiens
YGVAQHYKK

SEQ ID NO: 1216648 - protein, 9 aa, Homo Sapiens
SEEVHQAIL

SEQ ID NO: 1216649 - protein, 9 aa, Homo Sapiens
IICTYHPNC

SEQ ID NO: 1216650 - protein, 9 aa, Homo Sapiens
FSVYHPADG

SEQ ID NO: 1216651 - protein, 9 aa, Homo Sapiens
WLLEYVKWR

SEQ ID NO: 1216652 - protein, 9 aa, Homo Sapiens
DLTVGVGTV

SEQ ID NO: 1216653 - protein, 9 aa, Homo Sapiens
FLVLTNLSH

SEQ ID NO: 1216654 - protein, 9 aa, Homo Sapiens
SDDMAVAVA

SEQ ID NO: 1216655 - protein, 9 aa, Homo Sapiens
VLVGMGPAA

SEQ ID NO: 1216656 - protein, 9 aa, Homo Sapiens
HHVTPGHFF

SEQ ID NO: 1216657 - protein, 9 aa, Homo Sapiens
LLPWQRWGL

SEQ ID NO: 1216658 - protein, 9 aa, Homo Sapiens
NQPIVKKGE

SEQ ID NO: 1216659 - protein, 9 aa, Homo Sapiens
LESVSVVLL

SEQ ID NO: 1216660 - protein, 9 aa, Homo Sapiens
PGPPGKRGH

SEQ ID NO: 1216661 - protein, 9 aa, Homo Sapiens
VIRSPQPGF

SEQ ID NO: 1216662 - protein, 9 aa, Homo Sapiens
VGKPDFFSS

SEQ ID NO: 1216663 - protein, 9 aa, Homo Sapiens
LTSRIVGGQ

SEQ ID NO: 1216664 - protein, 9 aa, Homo Sapiens
SSHRDKLCL

SEQ ID NO: 1216665 - protein, 9 aa, Homo Sapiens
SYPHFLESE

SEQ ID NO: 1216666 - protein, 9 aa, Homo Sapiens
KSTSVSGDM

SEQ ID NO: 1216667 - protein, 9 aa, Homo Sapiens
PSSLGEVIV

SEQ ID NO: 1216668 - protein, 9 aa, Homo Sapiens
VSLSRPAHA

SEQ ID NO: 1216669 - protein, 9 aa, Homo Sapiens
NPPPISKQA

SEQ ID NO: 1216670 - protein, 9 aa, Homo Sapiens
QPLTKSISL

SEQ ID NO: 1216671 - protein, 9 aa, Homo Sapiens
RSKFRQGYQ

SEQ ID NO: 1216672 - protein, 9 aa, Homo Sapiens
WCFAWRKSI

SEQ ID NO: 1216673 - protein, 9 aa, Homo Sapiens
SQKRYHRSR

SEQ ID NO: 1216674 - protein, 9 aa, Homo Sapiens
RKTTSSTRK

SEQ ID NO: 1216675 - protein, 9 aa, Homo Sapiens
VQKDFIIQT

SEQ ID NO: 1216676 - protein, 9 aa, Homo Sapiens
RLSSIKTRC

SEQ ID NO: 1216677 - protein, 9 aa, Homo Sapiens
EKRKTTMKQ

SEQ ID NO: 1216678 - protein, 9 aa, Homo Sapiens
IVHVRKSRP

SEQ ID NO: 1216679 - protein, 9 aa, Homo Sapiens
HLFNCGRSG

SEQ ID NO: 1216680 - protein, 9 aa, Homo Sapiens
EMVCMVRAA

SEQ ID NO: 1216681 - protein, 9 aa, Homo Sapiens
EQRHKFCPL

SEQ ID NO: 1216682 - protein, 9 aa, Homo Sapiens
DAQEENIYA

SEQ ID NO: 1216683 - protein, 9 aa, Homo Sapiens
SRHEGVQTF

SEQ ID NO: 1216684 - protein, 9 aa, Homo Sapiens
ETLIRRYQE

SEQ ID NO: 1216685 - protein, 9 aa, Homo Sapiens
NFMNNGFFL

SEQ ID NO: 1216686 - protein, 9 aa, Homo Sapiens
KATRMTKGF

SEQ ID NO: 1216687 - protein, 9 aa, Homo Sapiens
PDIVHQFKM

SEQ ID NO: 1216688 - protein, 9 aa, Homo Sapiens
PCSSLPKTD

SEQ ID NO: 1216689 - protein, 9 aa, Homo Sapiens
NLAFLKKIS

SEQ ID NO: 1216690 - protein, 9 aa, Homo Sapiens
EGEDVHLAR

SEQ ID NO: 1216691 - protein, 9 aa, Homo Sapiens
YPDRSWERE

SEQ ID NO: 1216692 - protein, 9 aa, Homo Sapiens
YTMKMSSGQ

SEQ ID NO: 1216693 - protein, 9 aa, Homo Sapiens
AFILVGPIC

SEQ ID NO: 1216694 - protein, 9 aa, Homo Sapiens
TAPCTTAEF

SEQ ID NO: 1216695 - protein, 9 aa, Homo Sapiens
DISEDPCHP

SEQ ID NO: 1216696 - protein, 9 aa, Homo Sapiens
DEDEMEDEE

SEQ ID NO: 1216697 - protein, 9 aa, Homo Sapiens
VSNDSPDVL

SEQ ID NO: 1216698 - protein, 9 aa, Homo Sapiens
FLIPYVITL

SEQ ID NO: 1216699 - protein, 9 aa, Homo Sapiens
PEPSTRTLE

SEQ ID NO: 1216700 - protein, 9 aa, Homo Sapiens
IACVEKHLL

SEQ ID NO: 1216701 - protein, 9 aa, Homo Sapiens
LTAKVSTDL

SEQ ID NO: 1216702 - protein, 9 aa, Homo Sapiens
QSMVDEVSE

SEQ ID NO: 1216703 - protein, 9 aa, Homo Sapiens
CGKQGHWKA

SEQ ID NO: 1216704 - protein, 9 aa, Homo Sapiens
LPMDAYTHV

SEQ ID NO: 1216705 - protein, 9 aa, Homo Sapiens
YATEVTWTW

SEQ ID NO: 1216706 - protein, 9 aa, Homo Sapiens
GVVWDSKKH

SEQ ID NO: 1216707 - protein, 9 aa, Homo Sapiens
YVRYNFMNN

SEQ ID NO: 1216708 - protein, 9 aa, Homo Sapiens
LCKTPPMSL

SEQ ID NO: 1216709 - protein, 9 aa, Homo Sapiens
TGFCSWSII

SEQ ID NO: 1216710 - protein, 9 aa, Homo Sapiens
NELQRHVDE

SEQ ID NO: 1216711 - protein, 9 aa, Homo Sapiens
IRASQVACW

SEQ ID NO: 1216712 - protein, 9 aa, Homo Sapiens
SKSHKHLSK

SEQ ID NO: 1216713 - protein, 9 aa, Homo Sapiens
FLALIQVCM

SEQ ID NO: 1216714 - protein, 9 aa, Homo Sapiens
ALGCRTTYS

SEQ ID NO: 1216715 - protein, 9 aa, Homo Sapiens
SILRQHKSR

SEQ ID NO: 1216716 - protein, 9 aa, Homo Sapiens
LSSYYFCIT

SEQ ID NO: 1216717 - protein, 9 aa, Homo Sapiens
SVYLSCRRW

SEQ ID NO: 1216718 - protein, 9 aa, Homo Sapiens
EGDEDYTGA

SEQ ID NO: 1216719 - protein, 9 aa, Homo Sapiens
YNEEMNEKI

SEQ ID NO: 1216720 - protein, 9 aa, Homo Sapiens
DGMGGIWAM

SEQ ID NO: 1216721 - protein, 9 aa, Homo Sapiens
PLQVTTTLK

SEQ ID NO: 1216722 - protein, 9 aa, Homo Sapiens
SVSTLHNLG

SEQ ID NO: 1216723 - protein, 9 aa, Homo Sapiens
RQENFFCAP

SEQ ID NO: 1216724 - protein, 9 aa, Homo Sapiens
VIVHLPLYA

SEQ ID NO: 1216725 - protein, 9 aa, Homo Sapiens
KGFVPGMFG

SEQ ID NO: 1216726 - protein, 9 aa, Homo Sapiens
IVVVMAKES

SEQ ID NO: 1216727 - protein, 9 aa, Homo Sapiens
NSGTVSSVS

SEQ ID NO: 1216728 - protein, 9 aa, Homo Sapiens
CTDSTGIDL

SEQ ID NO: 1216729 - protein, 9 aa, Homo Sapiens
CGECGKYYI

SEQ ID NO: 1216730 - protein, 9 aa, Homo Sapiens
VAMSPLNFC

SEQ ID NO: 1216731 - protein, 9 aa, Homo Sapiens
GNHGYNNDF

SEQ ID NO: 1216732 - protein, 9 aa, Homo Sapiens
IRLRALDLF

SEQ ID NO: 1216733 - protein, 9 aa, Homo Sapiens
SSWVTWMIL

SEQ ID NO: 1216734 - protein, 9 aa, Homo Sapiens
NYLYETTLP

SEQ ID NO: 1216735 - protein, 9 aa, Homo Sapiens
IRGIGETPI

SEQ ID NO: 1216736 - protein, 9 aa, Homo Sapiens
KCIPYMDSP

SEQ ID NO: 1216737 - protein, 9 aa, Homo Sapiens
LVLQILLVT

SEQ ID NO: 1216738 - protein, 9 aa, Homo Sapiens
TAWGRLFGI

SEQ ID NO: 1216739 - protein, 9 aa, Homo Sapiens
HLNLEEENK

SEQ ID NO: 1216740 - protein, 9 aa, Homo Sapiens
VISIILVPQ

SEQ ID NO: 1216741 - protein, 9 aa, Homo Sapiens
DRRPGPSRA

SEQ ID NO: 1216742 - protein, 9 aa, Homo Sapiens
EKIGETVVN

SEQ ID NO: 1216743 - protein, 9 aa, Homo Sapiens
ITCSFPRRD

SEQ ID NO: 1216744 - protein, 9 aa, Homo Sapiens
VIRLAQDAD

SEQ ID NO: 1216745 - protein, 9 aa, Homo Sapiens
HDNKELKAF

SEQ ID NO: 1216746 - protein, 9 aa, Homo Sapiens
MTCTSLSKS

SEQ ID NO: 1216747 - protein, 9 aa, Homo Sapiens
EAKYQEKQQ

SEQ ID NO: 1216748 - protein, 9 aa, Homo Sapiens
VHLFYFFYD

SEQ ID NO: 1216749 - protein, 9 aa, Homo Sapiens
VTQDLAEAG

SEQ ID NO: 1216750 - protein, 9 aa, Homo Sapiens
NGAITKGVV

SEQ ID NO: 1216751 - protein, 9 aa, Homo Sapiens
SLLLYEARS

SEQ ID NO: 1216752 - protein, 9 aa, Homo Sapiens
TQGSHDFSF

SEQ ID NO: 1216753 - protein, 9 aa, Homo Sapiens
KMLLERASQ

SEQ ID NO: 1216754 - protein, 9 aa, Homo Sapiens
QGRNQEEHL

SEQ ID NO: 1216755 - protein, 9 aa, Homo Sapiens
VTKIRPVMI

SEQ ID NO: 1216756 - protein, 9 aa, Homo Sapiens
MQLLCEGLL

SEQ ID NO: 1216757 - protein, 9 aa, Homo Sapiens
RIPAGRRSG

SEQ ID NO: 1216758 - protein, 9 aa, Homo Sapiens
FSPDKKKPF

SEQ ID NO: 1216759 - protein, 9 aa, Homo Sapiens
SSVSVTAAA

SEQ ID NO: 1216760 - protein, 9 aa, Homo Sapiens
LDDDDVFLC

SEQ ID NO: 1216761 - protein, 9 aa, Homo Sapiens
RAMRVARSL

SEQ ID NO: 1216762 - protein, 9 aa, Homo Sapiens
FKCKEKMSQ

SEQ ID NO: 1216763 - protein, 9 aa, Homo Sapiens
YQADLKNQL

SEQ ID NO: 1216764 - protein, 9 aa, Homo Sapiens
THYIAPTVL

SEQ ID NO: 1216765 - protein, 9 aa, Homo Sapiens
AWEELGPDG

SEQ ID NO: 1216766 - protein, 9 aa, Homo Sapiens
DDEGLCPAD

SEQ ID NO: 1216767 - protein, 9 aa, Homo Sapiens
HGSSFSVKR

SEQ ID NO: 1216768 - protein, 9 aa, Homo Sapiens
ASYQEAKYK

SEQ ID NO: 1216769 - protein, 9 aa, Homo Sapiens
RWLSSPNTY

SEQ ID NO: 1216770 - protein, 9 aa, Homo Sapiens
QRLEERQRC

SEQ ID NO: 1216771 - protein, 9 aa, Homo Sapiens
AGFEEHRFR

SEQ ID NO: 1216772 - protein, 9 aa, Homo Sapiens
APGPDGATG

SEQ ID NO: 1216773 - protein, 9 aa, Homo Sapiens
MVLTPDFLN

SEQ ID NO: 1216774 - protein, 9 aa, Homo Sapiens
NWTSLYIHV

SEQ ID NO: 1216775 - protein, 9 aa, Homo Sapiens
LVLPHSTKA

SEQ ID NO: 1216776 - protein, 9 aa, Homo Sapiens
FNEFILFIF

SEQ ID NO: 1216777 - protein, 9 aa, Homo Sapiens
KGLQALTRS

SEQ ID NO: 1216778 - protein, 9 aa, Homo Sapiens
QKDYDSHTA

SEQ ID NO: 1216779 - protein, 9 aa, Homo Sapiens
LMLQMNAKY

SEQ ID NO: 1216780 - protein, 9 aa, Homo Sapiens
LHNNGFRNY

SEQ ID NO: 1216781 - protein, 9 aa, Homo Sapiens
VKAVMSKLK

SEQ ID NO: 1216782 - protein, 9 aa, Homo Sapiens
PDVDHQKSE

SEQ ID NO: 1216783 - protein, 9 aa, Homo Sapiens
EPPTQSISA

SEQ ID NO: 1216784 - protein, 9 aa, Homo Sapiens
LPQCFCRIC

SEQ ID NO: 1216785 - protein, 9 aa, Homo Sapiens
FRELLLEDR

SEQ ID NO: 1216786 - protein, 9 aa, Homo Sapiens
RLLENREDI

SEQ ID NO: 1216787 - protein, 9 aa, Homo Sapiens
LETAARSIP

SEQ ID NO: 1216788 - protein, 9 aa, Homo Sapiens
EEMAVRDRN

SEQ ID NO: 1216789 - protein, 9 aa, Homo Sapiens
CFGFWASYH

SEQ ID NO: 1216790 - protein, 9 aa, Homo Sapiens
MPNAIPKRL

SEQ ID NO: 1216791 - protein, 9 aa, Homo Sapiens
WINKTDNNL

SEQ ID NO: 1216792 - protein, 9 aa, Homo Sapiens
VLDKLYKRK

SEQ ID NO: 1216793 - protein, 9 aa, Homo Sapiens
KRLDSPRYT

SEQ ID NO: 1216794 - protein, 9 aa, Homo Sapiens
ENKKTKPVP

SEQ ID NO: 1216795 - protein, 9 aa, Homo Sapiens
CMLCHENMI

SEQ ID NO: 1216796 - protein, 9 aa, Homo Sapiens
MFCHSDEHF

SEQ ID NO: 1216797 - protein, 9 aa, Homo Sapiens
ENDRLFIVM

SEQ ID NO: 1216798 - protein, 9 aa, Homo Sapiens
LWAGSRIVW

SEQ ID NO: 1216799 - protein, 9 aa, Homo Sapiens
NGMMGINSY

SEQ ID NO: 1216800 - protein, 9 aa, Homo Sapiens
SQLSKDWGW

SEQ ID NO: 1216801 - protein, 9 aa, Homo Sapiens
AWVLSAAER

SEQ ID NO: 1216802 - protein, 9 aa, Homo Sapiens
KETVVMKEK

SEQ ID NO: 1216803 - protein, 9 aa, Homo Sapiens
SDLECRCQG

SEQ ID NO: 1216804 - protein, 9 aa, Homo Sapiens
RGRPGRPRW

SEQ ID NO: 1216805 - protein, 9 aa, Homo Sapiens
ILVMLEIVT

SEQ ID NO: 1216806 - protein, 9 aa, Homo Sapiens
TKDNQTRYV

SEQ ID NO: 1216807 - protein, 9 aa, Homo Sapiens
LRLKTPIAF

SEQ ID NO: 1216808 - protein, 9 aa, Homo Sapiens
PTCQKMSPK

SEQ ID NO: 1216809 - protein, 9 aa, Homo Sapiens
HILHGGMVA

SEQ ID NO: 1216810 - protein, 9 aa, Homo Sapiens
ERSQEESPH

SEQ ID NO: 1216811 - protein, 9 aa, Homo Sapiens
EAGRFAVLG

SEQ ID NO: 1216812 - protein, 9 aa, Homo Sapiens
RPIHPVANP

SEQ ID NO: 1216813 - protein, 9 aa, Homo Sapiens
VNNCFSTTV

SEQ ID NO: 1216814 - protein, 9 aa, Homo Sapiens
PPSPLTLYP

SEQ ID NO: 1216815 - protein, 9 aa, Homo Sapiens
FLLSGTVNS

SEQ ID NO: 1216816 - protein, 9 aa, Homo Sapiens
SCDSLNSVT

SEQ ID NO: 1216817 - protein, 9 aa, Homo Sapiens
LGSSDHPIS

SEQ ID NO: 1216818 - protein, 9 aa, Homo Sapiens
PPPGALMWL

SEQ ID NO: 1216819 - protein, 9 aa, Homo Sapiens
HFKLRECGK

SEQ ID NO: 1216820 - protein, 9 aa, Homo Sapiens
LRSLQRSPA

SEQ ID NO: 1216821 - protein, 9 aa, Homo Sapiens
DLDRWRRLK

SEQ ID NO: 1216822 - protein, 9 aa, Homo Sapiens
TLDPHTCWE

SEQ ID NO: 1216823 - protein, 9 aa, Homo Sapiens
GYIIRRGLF

SEQ ID NO: 1216824 - protein, 9 aa, Homo Sapiens
QNCSFPLPG

SEQ ID NO: 1216825 - protein, 9 aa, Homo Sapiens
FKGNFPEQA

SEQ ID NO: 1216826 - protein, 9 aa, Homo Sapiens
VTGTVSGQN

SEQ ID NO: 1216827 - protein, 9 aa, Homo Sapiens
PILVECQEA

SEQ ID NO: 1216828 - protein, 9 aa, Homo Sapiens
QNQECQVLL

SEQ ID NO: 1216829 - protein, 9 aa, Homo Sapiens
DTCWGHYNN

SEQ ID NO: 1216830 - protein, 9 aa, Homo Sapiens
GVQWAILMD

SEQ ID NO: 1216831 - protein, 9 aa, Homo Sapiens
CVHARAALD

SEQ ID NO: 1216832 - protein, 9 aa, Homo Sapiens
GRYQLHVQL

SEQ ID NO: 1216833 - protein, 9 aa, Homo Sapiens
GSTLPKCNG

SEQ ID NO: 1216834 - protein, 9 aa, Homo Sapiens
PKLVHGSLE

SEQ ID NO: 1216835 - protein, 9 aa, Homo Sapiens
CVCKGVSEK

SEQ ID NO: 1216836 - protein, 9 aa, Homo Sapiens
PEAQLLEAH

SEQ ID NO: 1216837 - protein, 9 aa, Homo Sapiens
TGDAIDQMR

SEQ ID NO: 1216838 - protein, 9 aa, Homo Sapiens
HLAIYTVTG

SEQ ID NO: 1216839 - protein, 9 aa, Homo Sapiens
KMVVYPWQL

SEQ ID NO: 1216840 - protein, 9 aa, Homo Sapiens
SEEREMSKG

SEQ ID NO: 1216841 - protein, 9 aa, Homo Sapiens
EEVKRFRGL

SEQ ID NO: 1216842 - protein, 9 aa, Homo Sapiens
VDEVKISSV

SEQ ID NO: 1216843 - protein, 9 aa, Homo Sapiens
ASPPTGTNM

SEQ ID NO: 1216844 - protein, 9 aa, Homo Sapiens
ATDSLGIYN

SEQ ID NO: 1216845 - protein, 9 aa, Homo Sapiens
KIYRAFYNH

SEQ ID NO: 1216846 - protein, 9 aa, Homo Sapiens
VDISPGPTS

SEQ ID NO: 1216847 - protein, 9 aa, Homo Sapiens
ADHFKKGKI

SEQ ID NO: 1216848 - protein, 9 aa, Homo Sapiens
CRQEFGGVA

SEQ ID NO: 1216849 - protein, 9 aa, Homo Sapiens
VGIKYVNKL

SEQ ID NO: 1216850 - protein, 9 aa, Homo Sapiens
RACSVGSVP

SEQ ID NO: 1216851 - protein, 9 aa, Homo Sapiens
LLVFINSFG

SEQ ID NO: 1216852 - protein, 9 aa, Homo Sapiens
EMSGRIVGT

SEQ ID NO: 1216853 - protein, 9 aa, Homo Sapiens
LKEKVKPAD

SEQ ID NO: 1216854 - protein, 9 aa, Homo Sapiens
ETLNSHGTS

SEQ ID NO: 1216855 - protein, 9 aa, Homo Sapiens
TGHYLFGAG

SEQ ID NO: 1216856 - protein, 9 aa, Homo Sapiens
KYTGSLQYV

SEQ ID NO: 1216857 - protein, 9 aa, Homo Sapiens
TPDAFVCRI

SEQ ID NO: 1216858 - protein, 9 aa, Homo Sapiens
PWEKRLTSP

SEQ ID NO: 1216859 - protein, 9 aa, Homo Sapiens
GFKAGDIIE

SEQ ID NO: 1216860 - protein, 9 aa, Homo Sapiens
TGVWLLEPP

SEQ ID NO: 1216861 - protein, 9 aa, Homo Sapiens
NVKYTPKLE

SEQ ID NO: 1216862 - protein, 9 aa, Homo Sapiens
EWILETDSV

SEQ ID NO: 1216863 - protein, 9 aa, Homo Sapiens
GEALVPLSK

SEQ ID NO: 1216864 - protein, 9 aa, Homo Sapiens
IVHDLISRE

SEQ ID NO: 1216865 - protein, 9 aa, Homo Sapiens
NQHRDSYYS

SEQ ID NO: 1216866 - protein, 9 aa, Homo Sapiens
KCKVSLVVN

SEQ ID NO: 1216867 - protein, 9 aa, Homo Sapiens
IVGSGPQLF

SEQ ID NO: 1216868 - protein, 9 aa, Homo Sapiens
HECAWGCCG

SEQ ID NO: 1216869 - protein, 9 aa, Homo Sapiens
LLRVFVERG

SEQ ID NO: 1216870 - protein, 9 aa, Homo Sapiens
HSSLLNQQD

SEQ ID NO: 1216871 - protein, 9 aa, Homo Sapiens
PVTSPSSPR

SEQ ID NO: 1216872 - protein, 9 aa, Homo Sapiens
LKIQMGKKC

SEQ ID NO: 1216873 - protein, 9 aa, Homo Sapiens
GTRKMERTE

SEQ ID NO: 1216874 - protein, 9 aa, Homo Sapiens
LWEQEHSNA

SEQ ID NO: 1216875 - protein, 9 aa, Homo Sapiens
FHLQNPKAR

SEQ ID NO: 1216876 - protein, 9 aa, Homo Sapiens
IPSMGVVSL

SEQ ID NO: 1216877 - protein, 9 aa, Homo Sapiens
NSATCSSAV

SEQ ID NO: 1216878 - protein, 9 aa, Homo Sapiens
CEEYGKAFR

SEQ ID NO: 1216879 - protein, 9 aa, Homo Sapiens
CVSRGTFSR

SEQ ID NO: 1216880 - protein, 9 aa, Homo Sapiens
TDSSHYWSK

SEQ ID NO: 1216881 - protein, 9 aa, Homo Sapiens
NEDHCECQQ

SEQ ID NO: 1216882 - protein, 9 aa, Homo Sapiens
SVGVQSAPS

SEQ ID NO: 1216883 - protein, 9 aa, Homo Sapiens
NEQHFGVKH

SEQ ID NO: 1216884 - protein, 9 aa, Homo Sapiens
QLDVASIIS

SEQ ID NO: 1216885 - protein, 9 aa, Homo Sapiens
KLTVLQVQK

SEQ ID NO: 1216886 - protein, 9 aa, Homo Sapiens
NLERMLTQA

SEQ ID NO: 1216887 - protein, 9 aa, Homo Sapiens
AEKMVIVLD

SEQ ID NO: 1216888 - protein, 9 aa, Homo Sapiens
GLDILTKLK

SEQ ID NO: 1216889 - protein, 9 aa, Homo Sapiens
MAILCNHQR

SEQ ID NO: 1216890 - protein, 9 aa, Homo Sapiens
LAGLTTHLL

SEQ ID NO: 1216891 - protein, 9 aa, Homo Sapiens
GVNIRDDER

SEQ ID NO: 1216892 - protein, 9 aa, Homo Sapiens
CLLHTYVLH

SEQ ID NO: 1216893 - protein, 9 aa, Homo Sapiens
RRAQKEVAG

SEQ ID NO: 1216894 - protein, 9 aa, Homo Sapiens
AQADLEILV

SEQ ID NO: 1216895 - protein, 9 aa, Homo Sapiens
KNTKLLSTS

SEQ ID NO: 1216896 - protein, 9 aa, Homo Sapiens
ISLASTQAQ

SEQ ID NO: 1216897 - protein, 9 aa, Homo Sapiens
RMQARAAGH

SEQ ID NO: 1216898 - protein, 9 aa, Homo Sapiens
IIQGAKRIG

SEQ ID NO: 1216899 - protein, 9 aa, Homo Sapiens
IGHMDSGKS

SEQ ID NO: 1216900 - protein, 9 aa, Homo Sapiens
GRNPPKQEV

SEQ ID NO: 1216901 - protein, 9 aa, Homo Sapiens
PSMEVYESP

SEQ ID NO: 1216902 - protein, 9 aa, Homo Sapiens
SKHWPAVTS

SEQ ID NO: 1216903 - protein, 9 aa, Homo Sapiens
LASPGPEPA

SEQ ID NO: 1216904 - protein, 9 aa, Homo Sapiens
KAHEIPVPG

SEQ ID NO: 1216905 - protein, 9 aa, Homo Sapiens
KPTPILIKV

SEQ ID NO: 1216906 - protein, 9 aa, Homo Sapiens
APGIEEADG

SEQ ID NO: 1216907 - protein, 9 aa, Homo Sapiens
KNLVNALRD

SEQ ID NO: 1216908 - protein, 9 aa, Homo Sapiens
FHTTVRCMH

SEQ ID NO: 1216909 - protein, 9 aa, Homo Sapiens
FSIHLPQPN

SEQ ID NO: 1216910 - protein, 9 aa, Homo Sapiens
VMNPHPKKI

SEQ ID NO: 1216911 - protein, 9 aa, Homo Sapiens
ELQADISLN

SEQ ID NO: 1216912 - protein, 9 aa, Homo Sapiens
ATSSPRPME

SEQ ID NO: 1216913 - protein, 9 aa, Homo Sapiens
DAGRQTMHN

SEQ ID NO: 1216914 - protein, 9 aa, Homo Sapiens
EVRIMHWFG

SEQ ID NO: 1216915 - protein, 9 aa, Homo Sapiens
LGQEYGKNL

SEQ ID NO: 1216916 - protein, 9 aa, Homo Sapiens
HSNSSVLAD

SEQ ID NO: 1216917 - protein, 9 aa, Homo Sapiens
NEKGVLKRR

SEQ ID NO: 1216918 - protein, 9 aa, Homo Sapiens
LRDAIKGMQ

SEQ ID NO: 1216919 - protein, 9 aa, Homo Sapiens
QGFEFWYPV

SEQ ID NO: 1216920 - protein, 9 aa, Homo Sapiens
HPVTMETTK

SEQ ID NO: 1216921 - protein, 9 aa, Homo Sapiens
DSIMGLQTR

SEQ ID NO: 1216922 - protein, 9 aa, Homo Sapiens
TSVCETLVS

SEQ ID NO: 1216923 - protein, 9 aa, Homo Sapiens
LLKMRSFPL

SEQ ID NO: 1216924 - protein, 9 aa, Homo Sapiens
IQAQPLNPR

SEQ ID NO: 1216925 - protein, 9 aa, Homo Sapiens
TLPWGMLSS

SEQ ID NO: 1216926 - protein, 9 aa, Homo Sapiens
ILYHEPRSF

SEQ ID NO: 1216927 - protein, 9 aa, Homo Sapiens
SGYIQKFEF

SEQ ID NO: 1216928 - protein, 9 aa, Homo Sapiens
SALGPLGSR

SEQ ID NO: 1216929 - protein, 9 aa, Homo Sapiens
MAATKLNSG

SEQ ID NO: 1216930 - protein, 9 aa, Homo Sapiens
DGLGDAVGG

SEQ ID NO: 1216931 - protein, 9 aa, Homo Sapiens
ASLQQHFVL

SEQ ID NO: 1216932 - protein, 9 aa, Homo Sapiens
FRRLRENRR

SEQ ID NO: 1216933 - protein, 9 aa, Homo Sapiens
NNNGLSFEE

SEQ ID NO: 1216934 - protein, 9 aa, Homo Sapiens
DKFIYYQVL

SEQ ID NO: 1216935 - protein, 9 aa, Homo Sapiens
IHFVDSEQR

SEQ ID NO: 1216936 - protein, 9 aa, Homo Sapiens
QTLLNGPSS

SEQ ID NO: 1216937 - protein, 9 aa, Homo Sapiens
TLSIVNWYI

SEQ ID NO: 1216938 - protein, 9 aa, Homo Sapiens
KDSIMGLQT

SEQ ID NO: 1216939 - protein, 9 aa, Homo Sapiens
HKYQEASKD

SEQ ID NO: 1216940 - protein, 9 aa, Homo Sapiens
PFVLYLLQN

SEQ ID NO: 1216941 - protein, 9 aa, Homo Sapiens
ACVNDGMFG

SEQ ID NO: 1216942 - protein, 9 aa, Homo Sapiens
RLPTSVPQI

SEQ ID NO: 1216943 - protein, 9 aa, Homo Sapiens
ILDLEKARI

SEQ ID NO: 1216944 - protein, 9 aa, Homo Sapiens
ARTRAGLVE

SEQ ID NO: 1216945 - protein, 9 aa, Homo Sapiens
PGMTSFEPE

SEQ ID NO: 1216946 - protein, 9 aa, Homo Sapiens
MLCHENMIR

SEQ ID NO: 1216947 - protein, 9 aa, Homo Sapiens
KFESMEDDT

SEQ ID NO: 1216948 - protein, 9 aa, Homo Sapiens
VSISSQYWI

SEQ ID NO: 1216949 - protein, 9 aa, Homo Sapiens
FIIMMRTTW

SEQ ID NO: 1216950 - protein, 9 aa, Homo Sapiens
TESDWGKHC

SEQ ID NO: 1216951 - protein, 9 aa, Homo Sapiens
HGLQCSLES

SEQ ID NO: 1216952 - protein, 9 aa, Homo Sapiens
EILDLFDNT

SEQ ID NO: 1216953 - protein, 9 aa, Homo Sapiens
RIANGAITK

SEQ ID NO: 1216954 - protein, 9 aa, Homo Sapiens
AVFLWDFYA

SEQ ID NO: 1216955 - protein, 9 aa, Homo Sapiens
LREDRMTEK

SEQ ID NO: 1216956 - protein, 9 aa, Homo Sapiens
SPASPLHQP

SEQ ID NO: 1216957 - protein, 9 aa, Homo Sapiens
LFSWQGKLR

SEQ ID NO: 1216958 - protein, 9 aa, Homo Sapiens
ATSEGQSKH

SEQ ID NO: 1216959 - protein, 9 aa, Homo Sapiens
RDYANGFGG

SEQ ID NO: 1216960 - protein, 9 aa, Homo Sapiens
ADGSHFILL

SEQ ID NO: 1216961 - protein, 9 aa, Homo Sapiens
EVLEQCYRP

SEQ ID NO: 1216962 - protein, 9 aa, Homo Sapiens
LKWFLGKTR

SEQ ID NO: 1216963 - protein, 9 aa, Homo Sapiens
LDKTQLEQM

SEQ ID NO: 1216964 - protein, 9 aa, Homo Sapiens
KLTSIDNHP

SEQ ID NO: 1216965 - protein, 9 aa, Homo Sapiens
NMKASKPIV

SEQ ID NO: 1216966 - protein, 9 aa, Homo Sapiens
NIRRMCRII

SEQ ID NO: 1216967 - protein, 9 aa, Homo Sapiens
MEESYKDRT

SEQ ID NO: 1216968 - protein, 9 aa, Homo Sapiens
KFTILQVVT

SEQ ID NO: 1216969 - protein, 9 aa, Homo Sapiens
PALSDHLDA

SEQ ID NO: 1216970 - protein, 9 aa, Homo Sapiens
AILSFILLE

SEQ ID NO: 1216971 - protein, 9 aa, Homo Sapiens
SPFRAHSEP

SEQ ID NO: 1216972 - protein, 9 aa, Homo Sapiens
PPRFVMQAK

SEQ ID NO: 1216973 - protein, 9 aa, Homo Sapiens
TRLRGVHYI

SEQ ID NO: 1216974 - protein, 9 aa, Homo Sapiens
ISTRDSVGN

SEQ ID NO: 1216975 - protein, 9 aa, Homo Sapiens
GVDVLLAHC

SEQ ID NO: 1216976 - protein, 9 aa, Homo Sapiens
DLLANEHER

SEQ ID NO: 1216977 - protein, 9 aa, Homo Sapiens
FEKVAAEAR

SEQ ID NO: 1216978 - protein, 9 aa, Homo Sapiens
TPCPREWDS

SEQ ID NO: 1216979 - protein, 9 aa, Homo Sapiens
TFTTQQTTL

SEQ ID NO: 1216980 - protein, 9 aa, Homo Sapiens
SDRFHSFDA

SEQ ID NO: 1216981 - protein, 9 aa, Homo Sapiens
SPLHQPSSP

SEQ ID NO: 1216982 - protein, 9 aa, Homo Sapiens
HMIQAIPFD

SEQ ID NO: 1216983 - protein, 9 aa, Homo Sapiens
PDLEYLMKR

SEQ ID NO: 1216984 - protein, 9 aa, Homo Sapiens
NIQDENDNN

SEQ ID NO: 1216985 - protein, 9 aa, Homo Sapiens
MHLLKSEHQ

SEQ ID NO: 1216986 - protein, 9 aa, Homo Sapiens
VLPPNLNEL

SEQ ID NO: 1216987 - protein, 9 aa, Homo Sapiens
RQLHVELNV

SEQ ID NO: 1216988 - protein, 9 aa, Homo Sapiens
RYNIINALP

SEQ ID NO: 1216989 - protein, 9 aa, Homo Sapiens
TPFLSSLVF

SEQ ID NO: 1216990 - protein, 9 aa, Homo Sapiens
NDNPSIFPE

SEQ ID NO: 1216991 - protein, 9 aa, Homo Sapiens
GCAYIAKEE

SEQ ID NO: 1216992 - protein, 9 aa, Homo Sapiens
RVMLLAWKF

SEQ ID NO: 1216993 - protein, 9 aa, Homo Sapiens
YQTTSPVQK

SEQ ID NO: 1216994 - protein, 9 aa, Homo Sapiens
QIDPNNPAA

SEQ ID NO: 1216995 - protein, 9 aa, Homo Sapiens
KPLSWAPPS

SEQ ID NO: 1216996 - protein, 9 aa, Homo Sapiens
RSWLITAST

SEQ ID NO: 1216997 - protein, 9 aa, Homo Sapiens
GMRAAGRHL

SEQ ID NO: 1216998 - protein, 9 aa, Homo Sapiens
IYKVWFYPV

SEQ ID NO: 1216999 - protein, 9 aa, Homo Sapiens
IFLDADTRR

SEQ ID NO: 1217000 - protein, 9 aa, Homo Sapiens
RPINTTLAV

SEQ ID NO: 1217001 - protein, 9 aa, Homo Sapiens
PVPAMTGMT

SEQ ID NO: 1217002 - protein, 9 aa, Homo Sapiens
LYLDRNLIV

SEQ ID NO: 1217003 - protein, 9 aa, Homo Sapiens
FKDVAINFT

SEQ ID NO: 1217004 - protein, 9 aa, Homo Sapiens
EPLPMFCAM

SEQ ID NO: 1217005 - protein, 9 aa, Homo Sapiens
RSHNDGYDK

SEQ ID NO: 1217006 - protein, 9 aa, Homo Sapiens
LLCTMEKFA

SEQ ID NO: 1217007 - protein, 9 aa, Homo Sapiens
NLTTKSVCH

SEQ ID NO: 1217008 - protein, 9 aa, Homo Sapiens
NLIVYITQV

SEQ ID NO: 1217009 - protein, 9 aa, Homo Sapiens
GAAGDSACQ

SEQ ID NO: 1217010 - protein, 9 aa, Homo Sapiens
DIMDYCKKN

SEQ ID NO: 1217011 - protein, 9 aa, Homo Sapiens
NQGRRGRVV

SEQ ID NO: 1217012 - protein, 9 aa, Homo Sapiens
TQNCMGKAR

SEQ ID NO: 1217013 - protein, 9 aa, Homo Sapiens
IFEHEMEES

SEQ ID NO: 1217014 - protein, 9 aa, Homo Sapiens
GIFPHGIDI

SEQ ID NO: 1217015 - protein, 9 aa, Homo Sapiens
SRAQTFSSY

SEQ ID NO: 1217016 - protein, 9 aa, Homo Sapiens
CDTSFMRED

SEQ ID NO: 1217017 - protein, 9 aa, Homo Sapiens
SWSGTEKLL

SEQ ID NO: 1217018 - protein, 9 aa, Homo Sapiens
AQRKLLPHR

SEQ ID NO: 1217019 - protein, 9 aa, Homo Sapiens
CTWDCGGGL

SEQ ID NO: 1217020 - protein, 9 aa, Homo Sapiens
MLLLWVPGC

SEQ ID NO: 1217021 - protein, 9 aa, Homo Sapiens
SLAILEETQ

SEQ ID NO: 1217022 - protein, 9 aa, Homo Sapiens
DPANAPCRC

SEQ ID NO: 1217023 - protein, 9 aa, Homo Sapiens
TRIKLAFKM

SEQ ID NO: 1217024 - protein, 9 aa, Homo Sapiens
GRSAAALWT

SEQ ID NO: 1217025 - protein, 9 aa, Homo Sapiens
CHALSRLRD

SEQ ID NO: 1217026 - protein, 9 aa, Homo Sapiens
WHWVLGLLS

SEQ ID NO: 1217027 - protein, 9 aa, Homo Sapiens
TVKTAMIGA

SEQ ID NO: 1217028 - protein, 9 aa, Homo Sapiens
TLTHPPASE

SEQ ID NO: 1217029 - protein, 9 aa, Homo Sapiens
GSNHSSARY

SEQ ID NO: 1217030 - protein, 9 aa, Homo Sapiens
AFSQSSPLT

SEQ ID NO: 1217031 - protein, 9 aa, Homo Sapiens
IHSFHGQCQ

SEQ ID NO: 1217032 - protein, 9 aa, Homo Sapiens
YATQNCMGK

SEQ ID NO: 1217033 - protein, 9 aa, Homo Sapiens
AAAVWVVVS

SEQ ID NO: 1217034 - protein, 9 aa, Homo Sapiens
SLNQAADVH

SEQ ID NO: 1217035 - protein, 9 aa, Homo Sapiens
VMLDTAHCL

SEQ ID NO: 1217036 - protein, 9 aa, Homo Sapiens
LMDTFEDLE

SEQ ID NO: 1217037 - protein, 9 aa, Homo Sapiens
ESEEVLQKR

SEQ ID NO: 1217038 - protein, 9 aa, Homo Sapiens
SPSPEQFIS

SEQ ID NO: 1217039 - protein, 9 aa, Homo Sapiens
AARRCKTNI

SEQ ID NO: 1217040 - protein, 9 aa, Homo Sapiens
EVRAPAANL

SEQ ID NO: 1217041 - protein, 9 aa, Homo Sapiens
LLNEHQVEA

SEQ ID NO: 1217042 - protein, 9 aa, Homo Sapiens
SKIEIDAFS

SEQ ID NO: 1217043 - protein, 9 aa, Homo Sapiens
LTHDRVRLL

SEQ ID NO: 1217044 - protein, 9 aa, Homo Sapiens
NRTHSFGHF

SEQ ID NO: 1217045 - protein, 9 aa, Homo Sapiens
KYLSFTEEG

SEQ ID NO: 1217046 - protein, 9 aa, Homo Sapiens
LELRRPMYS

SEQ ID NO: 1217047 - protein, 9 aa, Homo Sapiens
LSGFFNTTW

SEQ ID NO: 1217048 - protein, 9 aa, Homo Sapiens
PEQFISNAG

SEQ ID NO: 1217049 - protein, 9 aa, Homo Sapiens
KEDWEMKED

SEQ ID NO: 1217050 - protein, 9 aa, Homo Sapiens
LWKLMIIVG

SEQ ID NO: 1217051 - protein, 9 aa, Homo Sapiens
ERACFEQAG

SEQ ID NO: 1217052 - protein, 9 aa, Homo Sapiens
VRLLKVGAV

SEQ ID NO: 1217053 - protein, 9 aa, Homo Sapiens
GNWQKECIY

SEQ ID NO: 1217054 - protein, 9 aa, Homo Sapiens
VFLLRHPPQ

SEQ ID NO: 1217055 - protein, 9 aa, Homo Sapiens
EHIEAILDK

SEQ ID NO: 1217056 - protein, 9 aa, Homo Sapiens
SPSTHSIST

SEQ ID NO: 1217057 - protein, 9 aa, Homo Sapiens
DVETLSWIF

SEQ ID NO: 1217058 - protein, 9 aa, Homo Sapiens
DVKPENVLI

SEQ ID NO: 1217059 - protein, 9 aa, Homo Sapiens
HFWRDGRKT

SEQ ID NO: 1217060 - protein, 9 aa, Homo Sapiens
IKKLSNCLA

SEQ ID NO: 1217061 - protein, 9 aa, Homo Sapiens
DWKKEKLRD

SEQ ID NO: 1217062 - protein, 9 aa, Homo Sapiens
GRIMSRMFA

SEQ ID NO: 1217063 - protein, 9 aa, Homo Sapiens
NVMVQNVLQ

SEQ ID NO: 1217064 - protein, 9 aa, Homo Sapiens
ECQSNGEGI

SEQ ID NO: 1217065 - protein, 9 aa, Homo Sapiens
PTLCHLLHA

SEQ ID NO: 1217066 - protein, 9 aa, Homo Sapiens
WLHHAFFSP

SEQ ID NO: 1217067 - protein, 9 aa, Homo Sapiens
LDQQLWGAG

SEQ ID NO: 1217068 - protein, 9 aa, Homo Sapiens
LIVYITQVI

SEQ ID NO: 1217069 - protein, 9 aa, Homo Sapiens
SAQAEANTP

SEQ ID NO: 1217070 - protein, 9 aa, Homo Sapiens
HEYWRFVLQ

SEQ ID NO: 1217071 - protein, 9 aa, Homo Sapiens
SAAAKTGDC

SEQ ID NO: 1217072 - protein, 9 aa, Homo Sapiens
SLNTVFRNL

SEQ ID NO: 1217073 - protein, 9 aa, Homo Sapiens
AAGKCPAED

SEQ ID NO: 1217074 - protein, 9 aa, Homo Sapiens
TCVKEQDLL

SEQ ID NO: 1217075 - protein, 9 aa, Homo Sapiens
HSKDQMKRM

SEQ ID NO: 1217076 - protein, 9 aa, Homo Sapiens
VKAADQDEG

SEQ ID NO: 1217077 - protein, 9 aa, Homo Sapiens
VYGSGEVPM

SEQ ID NO: 1217078 - protein, 9 aa, Homo Sapiens
FVKSMGNLN

SEQ ID NO: 1217079 - protein, 9 aa, Homo Sapiens
THYYQIMPK

SEQ ID NO: 1217080 - protein, 9 aa, Homo Sapiens
VPLMDVGEM

SEQ ID NO: 1217081 - protein, 9 aa, Homo Sapiens
HCALGREGR

SEQ ID NO: 1217082 - protein, 9 aa, Homo Sapiens
MYNEEMNEK

SEQ ID NO: 1217083 - protein, 9 aa, Homo Sapiens
KGTYRLVNV

SEQ ID NO: 1217084 - protein, 9 aa, Homo Sapiens
VAVRNASTS

SEQ ID NO: 1217085 - protein, 9 aa, Homo Sapiens
SRDDLNVCC

SEQ ID NO: 1217086 - protein, 9 aa, Homo Sapiens
VDSDTIIFQ

SEQ ID NO: 1217087 - protein, 9 aa, Homo Sapiens
YLKTFLYNF

SEQ ID NO: 1217088 - protein, 9 aa, Homo Sapiens
GMFIECLDC

SEQ ID NO: 1217089 - protein, 9 aa, Homo Sapiens
FLQYNGMIR

SEQ ID NO: 1217090 - protein, 9 aa, Homo Sapiens
KKCKMSLLF

SEQ ID NO: 1217091 - protein, 9 aa, Homo Sapiens
DYGLAYRYY

SEQ ID NO: 1217092 - protein, 9 aa, Homo Sapiens
VKEELNTIQ

SEQ ID NO: 1217093 - protein, 9 aa, Homo Sapiens
GKLIAAVMN

SEQ ID NO: 1217094 - protein, 9 aa, Homo Sapiens
VCYLGDPNH

SEQ ID NO: 1217095 - protein, 9 aa, Homo Sapiens
VAFIYYKIK

SEQ ID NO: 1217096 - protein, 9 aa, Homo Sapiens
SSVSPSMCS

SEQ ID NO: 1217097 - protein, 9 aa, Homo Sapiens
IHKMEEEHI

SEQ ID NO: 1217098 - protein, 9 aa, Homo Sapiens
QATKDAGPI

SEQ ID NO: 1217099 - protein, 9 aa, Homo Sapiens
ILGDCYHCV

SEQ ID NO: 1217100 - protein, 9 aa, Homo Sapiens
LRQAVKQVP

SEQ ID NO: 1217101 - protein, 9 aa, Homo Sapiens
LWLLGSRMA

SEQ ID NO: 1217102 - protein, 9 aa, Homo Sapiens
CMCNLRGGA

SEQ ID NO: 1217103 - protein, 9 aa, Homo Sapiens
CETLVSMIF

SEQ ID NO: 1217104 - protein, 9 aa, Homo Sapiens
LECDTLGIR

SEQ ID NO: 1217105 - protein, 9 aa, Homo Sapiens
GPPMQSAAK

SEQ ID NO: 1217106 - protein, 9 aa, Homo Sapiens
RFMEPLPMF

SEQ ID NO: 1217107 - protein, 9 aa, Homo Sapiens
PDEPNVLNE

SEQ ID NO: 1217108 - protein, 9 aa, Homo Sapiens
GHEPVLVQL

SEQ ID NO: 1217109 - protein, 9 aa, Homo Sapiens
MQQTEARDD

SEQ ID NO: 1217110 - protein, 9 aa, Homo Sapiens
LQYNGMIRQ

SEQ ID NO: 1217111 - protein, 9 aa, Homo Sapiens
WKDDCLLMI

SEQ ID NO: 1217112 - protein, 9 aa, Homo Sapiens
TSVSVRTPE

SEQ ID NO: 1217113 - protein, 9 aa, Homo Sapiens
VGLTMPIYC

SEQ ID NO: 1217114 - protein, 9 aa, Homo Sapiens
NAVKYVECS

SEQ ID NO: 1217115 - protein, 9 aa, Homo Sapiens
QIHTGRKPY

SEQ ID NO: 1217116 - protein, 9 aa, Homo Sapiens
MPVQVDGEA

SEQ ID NO: 1217117 - protein, 9 aa, Homo Sapiens
PAGVGTWSF

SEQ ID NO: 1217118 - protein, 9 aa, Homo Sapiens
LGDVAHVCN

SEQ ID NO: 1217119 - protein, 9 aa, Homo Sapiens
RHPAAGYRL

SEQ ID NO: 1217120 - protein, 9 aa, Homo Sapiens
VSRTVMELK

SEQ ID NO: 1217121 - protein, 9 aa, Homo Sapiens
RSFVNPLLP

SEQ ID NO: 1217122 - protein, 9 aa, Homo Sapiens
EYPQFQDAL

SEQ ID NO: 1217123 - protein, 9 aa, Homo Sapiens
TVTGTKDSV

SEQ ID NO: 1217124 - protein, 9 aa, Homo Sapiens
SPEPCTIPS

SEQ ID NO: 1217125 - protein, 9 aa, Homo Sapiens
EEMAGLPGL

SEQ ID NO: 1217126 - protein, 9 aa, Homo Sapiens
CIYFLIKIY

SEQ ID NO: 1217127 - protein, 9 aa, Homo Sapiens
MKQEVGEQS

SEQ ID NO: 1217128 - protein, 9 aa, Homo Sapiens
EREECLHGL

SEQ ID NO: 1217129 - protein, 9 aa, Homo Sapiens
KSAQPIEKI

SEQ ID NO: 1217130 - protein, 9 aa, Homo Sapiens
TQNHRTMSL

SEQ ID NO: 1217131 - protein, 9 aa, Homo Sapiens
RPRCRPINT

SEQ ID NO: 1217132 - protein, 9 aa, Homo Sapiens
IFFVSVSFL

SEQ ID NO: 1217133 - protein, 9 aa, Homo Sapiens
AHLELHVLV

SEQ ID NO: 1217134 - protein, 9 aa, Homo Sapiens
KAEKQRSDI

SEQ ID NO: 1217135 - protein, 9 aa, Homo Sapiens
VTEDFYSIF

SEQ ID NO: 1217136 - protein, 9 aa, Homo Sapiens
YEMMGHIKP

SEQ ID NO: 1217137 - protein, 9 aa, Homo Sapiens
LSKLSSDGK

SEQ ID NO: 1217138 - protein, 9 aa, Homo Sapiens
SMNHKTCYN

SEQ ID NO: 1217139 - protein, 9 aa, Homo Sapiens
PLASLALIY

SEQ ID NO: 1217140 - protein, 9 aa, Homo Sapiens
ESNDMHFSS

SEQ ID NO: 1217141 - protein, 9 aa, Homo Sapiens
TLSMSTLRS

SEQ ID NO: 1217142 - protein, 9 aa, Homo Sapiens
KTAELTYTY

SEQ ID NO: 1217143 - protein, 9 aa, Homo Sapiens
LKKRHTEKP

SEQ ID NO: 1217144 - protein, 9 aa, Homo Sapiens
GLHCAFAHC

SEQ ID NO: 1217145 - protein, 9 aa, Homo Sapiens
YAYFVMTCQ

SEQ ID NO: 1217146 - protein, 9 aa, Homo Sapiens
LFLIGLVCV

SEQ ID NO: 1217147 - protein, 9 aa, Homo Sapiens
CPGRYMGRA

SEQ ID NO: 1217148 - protein, 9 aa, Homo Sapiens
FIFFAMEML

SEQ ID NO: 1217149 - protein, 9 aa, Homo Sapiens
GAGGKAFCV

SEQ ID NO: 1217150 - protein, 9 aa, Homo Sapiens
NNDAFMNQE

SEQ ID NO: 1217151 - protein, 9 aa, Homo Sapiens
IEELIHTIK

SEQ ID NO: 1217152 - protein, 9 aa, Homo Sapiens
GPRLPGADV

SEQ ID NO: 1217153 - protein, 9 aa, Homo Sapiens
QRTLSVLAH

SEQ ID NO: 1217154 - protein, 9 aa, Homo Sapiens
FTGSGDPDS

SEQ ID NO: 1217155 - protein, 9 aa, Homo Sapiens
AVGVLCYLE

SEQ ID NO: 1217156 - protein, 9 aa, Homo Sapiens
ITKIEVPKT

SEQ ID NO: 1217157 - protein, 9 aa, Homo Sapiens
NFFCAPPEK

SEQ ID NO: 1217158 - protein, 9 aa, Homo Sapiens
EKPFKCHLY

SEQ ID NO: 1217159 - protein, 9 aa, Homo Sapiens
FRLCSSSGL

SEQ ID NO: 1217160 - protein, 9 aa, Homo Sapiens
VKQGKYQNK

SEQ ID NO: 1217161 - protein, 9 aa, Homo Sapiens
LPFDSMNTF

SEQ ID NO: 1217162 - protein, 9 aa, Homo Sapiens
IPIISEDTS

SEQ ID NO: 1217163 - protein, 9 aa, Homo Sapiens
SLVAAAQRI

SEQ ID NO: 1217164 - protein, 9 aa, Homo Sapiens
SNTPEEHMA

SEQ ID NO: 1217165 - protein, 9 aa, Homo Sapiens
SPTPSPPQP

SEQ ID NO: 1217166 - protein, 9 aa, Homo Sapiens
QYNEETFGY

SEQ ID NO: 1217167 - protein, 9 aa, Homo Sapiens
RGEGRPRNI

SEQ ID NO: 1217168 - protein, 9 aa, Homo Sapiens
IHNVQKDFI

SEQ ID NO: 1217169 - protein, 9 aa, Homo Sapiens
PIAKLIPQT

SEQ ID NO: 1217170 - protein, 9 aa, Homo Sapiens
YDSELGLTS

SEQ ID NO: 1217171 - protein, 9 aa, Homo Sapiens
YNRPPVMTL

SEQ ID NO: 1217172 - protein, 9 aa, Homo Sapiens
GESVLQDNI

SEQ ID NO: 1217173 - protein, 9 aa, Homo Sapiens
DSYYSYMGH

SEQ ID NO: 1217174 - protein, 9 aa, Homo Sapiens
FLLGVLQRM

SEQ ID NO: 1217175 - protein, 9 aa, Homo Sapiens
RTAGIICLE

SEQ ID NO: 1217176 - protein, 9 aa, Homo Sapiens
EVAWLKMLC

SEQ ID NO: 1217177 - protein, 9 aa, Homo Sapiens
TGMCSFVTE

SEQ ID NO: 1217178 - protein, 9 aa, Homo Sapiens
LKPENIILD

SEQ ID NO: 1217179 - protein, 9 aa, Homo Sapiens
QILNLIQAL

SEQ ID NO: 1217180 - protein, 9 aa, Homo Sapiens
VLRTDASGT

SEQ ID NO: 1217181 - protein, 9 aa, Homo Sapiens
YLSENRISS

SEQ ID NO: 1217182 - protein, 9 aa, Homo Sapiens
ISPNINRRN

SEQ ID NO: 1217183 - protein, 9 aa, Homo Sapiens
EHSNAFMVN

SEQ ID NO: 1217184 - protein, 9 aa, Homo Sapiens
VDVGRDGQG

SEQ ID NO: 1217185 - protein, 9 aa, Homo Sapiens
CVLVHFPPG

SEQ ID NO: 1217186 - protein, 9 aa, Homo Sapiens
AHQQQQHLL

SEQ ID NO: 1217187 - protein, 9 aa, Homo Sapiens
SNYQEYLKT

SEQ ID NO: 1217188 - protein, 9 aa, Homo Sapiens
PSTILQQID

SEQ ID NO: 1217189 - protein, 9 aa, Homo Sapiens
MLDTAHCLQ

SEQ ID NO: 1217190 - protein, 9 aa, Homo Sapiens
PGATLTGEQ

SEQ ID NO: 1217191 - protein, 9 aa, Homo Sapiens
VLLDLPSIR

SEQ ID NO: 1217192 - protein, 9 aa, Homo Sapiens
PTSITEMEI

SEQ ID NO: 1217193 - protein, 9 aa, Homo Sapiens
YFLYLETAA

SEQ ID NO: 1217194 - protein, 9 aa, Homo Sapiens
PKHIEVCMY

SEQ ID NO: 1217195 - protein, 9 aa, Homo Sapiens
FVLYLLQNG

SEQ ID NO: 1217196 - protein, 9 aa, Homo Sapiens
VKYTPKLEI

SEQ ID NO: 1217197 - protein, 9 aa, Homo Sapiens
KDHRKSLMI

SEQ ID NO: 1217198 - protein, 9 aa, Homo Sapiens
ATCPFNDRH

SEQ ID NO: 1217199 - protein, 9 aa, Homo Sapiens
RVQGKDIPP

SEQ ID NO: 1217200 - protein, 9 aa, Homo Sapiens
GLRIFTSVL

SEQ ID NO: 1217201 - protein, 9 aa, Homo Sapiens
RGLTHAIRL

SEQ ID NO: 1217202 - protein, 9 aa, Homo Sapiens
SGEQITMLN

SEQ ID NO: 1217203 - protein, 9 aa, Homo Sapiens
ESPARSVME

SEQ ID NO: 1217204 - protein, 9 aa, Homo Sapiens
QCLKDHGSG

SEQ ID NO: 1217205 - protein, 9 aa, Homo Sapiens
SSVRLVPSF

SEQ ID NO: 1217206 - protein, 9 aa, Homo Sapiens
LMIMQNLEF

SEQ ID NO: 1217207 - protein, 9 aa, Homo Sapiens
WHRGYIIRR

SEQ ID NO: 1217208 - protein, 9 aa, Homo Sapiens
TRTSSHLHL

SEQ ID NO: 1217209 - protein, 9 aa, Homo Sapiens
HRCHVDPAN

SEQ ID NO: 1217210 - protein, 9 aa, Homo Sapiens
SGNKHLSRQ

SEQ ID NO: 1217211 - protein, 9 aa, Homo Sapiens
PHPSSPGWT

SEQ ID NO: 1217212 - protein, 9 aa, Homo Sapiens
MALLEAVLF

SEQ ID NO: 1217213 - protein, 9 aa, Homo Sapiens
CCGDPKKTH

SEQ ID NO: 1217214 - protein, 9 aa, Homo Sapiens
QGDTHFDDD

SEQ ID NO: 1217215 - protein, 9 aa, Homo Sapiens
PASSALSTN

SEQ ID NO: 1217216 - protein, 9 aa, Homo Sapiens
FHVLTFLDV

SEQ ID NO: 1217217 - protein, 9 aa, Homo Sapiens
FLAVVGITA

SEQ ID NO: 1217218 - protein, 9 aa, Homo Sapiens
GGLSPGALS

SEQ ID NO: 1217219 - protein, 9 aa, Homo Sapiens
FNSFQENDR

SEQ ID NO: 1217220 - protein, 9 aa, Homo Sapiens
IGLLCYAAL

SEQ ID NO: 1217221 - protein, 9 aa, Homo Sapiens
VKVRQWRAH

SEQ ID NO: 1217222 - protein, 9 aa, Homo Sapiens
RSLAKEMIA

SEQ ID NO: 1217223 - protein, 9 aa, Homo Sapiens
GQAFQKPSK

SEQ ID NO: 1217224 - protein, 9 aa, Homo Sapiens
FGGQQSHHG

SEQ ID NO: 1217225 - protein, 9 aa, Homo Sapiens
FSDTTTMKI

SEQ ID NO: 1217226 - protein, 9 aa, Homo Sapiens
SSMGSKAIS

SEQ ID NO: 1217227 - protein, 9 aa, Homo Sapiens
SMILIGNVY

SEQ ID NO: 1217228 - protein, 9 aa, Homo Sapiens
KVHELQARR

SEQ ID NO: 1217229 - protein, 9 aa, Homo Sapiens
FIRLLSSVS

SEQ ID NO: 1217230 - protein, 9 aa, Homo Sapiens
SLAVISLNI

SEQ ID NO: 1217231 - protein, 9 aa, Homo Sapiens
EGHKCGENS

SEQ ID NO: 1217232 - protein, 9 aa, Homo Sapiens
NNTLSNQSK

SEQ ID NO: 1217233 - protein, 9 aa, Homo Sapiens
GHKNRRKDC

SEQ ID NO: 1217234 - protein, 9 aa, Homo Sapiens
KRKCGYIKN

SEQ ID NO: 1217235 - protein, 9 aa, Homo Sapiens
PSGPHYPPG

SEQ ID NO: 1217236 - protein, 9 aa, Homo Sapiens
IFSVGLHTG

SEQ ID NO: 1217237 - protein, 9 aa, Homo Sapiens
HEVDYYNRL

SEQ ID NO: 1217238 - protein, 9 aa, Homo Sapiens
INALLQVEV

SEQ ID NO: 1217239 - protein, 9 aa, Homo Sapiens
KDMPLQPSI

SEQ ID NO: 1217240 - protein, 9 aa, Homo Sapiens
NAPIGLYHL

SEQ ID NO: 1217241 - protein, 9 aa, Homo Sapiens
RGKSRWRKE

SEQ ID NO: 1217242 - protein, 9 aa, Homo Sapiens
ASKEEATMF

SEQ ID NO: 1217243 - protein, 9 aa, Homo Sapiens
FFLTPKRKL

SEQ ID NO: 1217244 - protein, 9 aa, Homo Sapiens
FGVKTAMYF

SEQ ID NO: 1217245 - protein, 9 aa, Homo Sapiens
IVPLFRENF

SEQ ID NO: 1217246 - protein, 9 aa, Homo Sapiens
AEMEAARDE

SEQ ID NO: 1217247 - protein, 9 aa, Homo Sapiens
RIKVCVWDE

SEQ ID NO: 1217248 - protein, 9 aa, Homo Sapiens
KTGDCFPAG

SEQ ID NO: 1217249 - protein, 9 aa, Homo Sapiens
QRGSPGGPG

SEQ ID NO: 1217250 - protein, 9 aa, Homo Sapiens
EICNLSVFL

SEQ ID NO: 1217251 - protein, 9 aa, Homo Sapiens
GLMASAWPF

SEQ ID NO: 1217252 - protein, 9 aa, Homo Sapiens
HDEYIFIQV

SEQ ID NO: 1217253 - protein, 9 aa, Homo Sapiens
SITDILYTV

SEQ ID NO: 1217254 - protein, 9 aa, Homo Sapiens
NISSCMDNF

SEQ ID NO: 1217255 - protein, 9 aa, Homo Sapiens
PYDHEDCVE

SEQ ID NO: 1217256 - protein, 9 aa, Homo Sapiens
MGSYICHCP

SEQ ID NO: 1217257 - protein, 9 aa, Homo Sapiens
SSWTNRSVA

SEQ ID NO: 1217258 - protein, 9 aa, Homo Sapiens
LAAGDYSPQ

SEQ ID NO: 1217259 - protein, 9 aa, Homo Sapiens
RRGCGGHRG

SEQ ID NO: 1217260 - protein, 9 aa, Homo Sapiens
IASEMADEK

SEQ ID NO: 1217261 - protein, 9 aa, Homo Sapiens
RCYRLCNEC

SEQ ID NO: 1217262 - protein, 9 aa, Homo Sapiens
DGEIWRMYA

SEQ ID NO: 1217263 - protein, 9 aa, Homo Sapiens
FIMNRHPNT

SEQ ID NO: 1217264 - protein, 9 aa, Homo Sapiens
TPSTIFIMN

SEQ ID NO: 1217265 - protein, 9 aa, Homo Sapiens
AELWALLRF

SEQ ID NO: 1217266 - protein, 9 aa, Homo Sapiens
EMPRHGVYV

SEQ ID NO: 1217267 - protein, 9 aa, Homo Sapiens
WIGRLKMRK

SEQ ID NO: 1217268 - protein, 9 aa, Homo Sapiens
MPGATVMPG

SEQ ID NO: 1217269 - protein, 9 aa, Homo Sapiens
QAEMMLKEM

SEQ ID NO: 1217270 - protein, 9 aa, Homo Sapiens
MKFLEDCHI

SEQ ID NO: 1217271 - protein, 9 aa, Homo Sapiens
SYLRRMSQG

SEQ ID NO: 1217272 - protein, 9 aa, Homo Sapiens
TLSQIGRVV

SEQ ID NO: 1217273 - protein, 9 aa, Homo Sapiens
LCTVGLSIK

SEQ ID NO: 1217274 - protein, 9 aa, Homo Sapiens
PYPLLSTPT

SEQ ID NO: 1217275 - protein, 9 aa, Homo Sapiens
YFMYFNLES

SEQ ID NO: 1217276 - protein, 9 aa, Homo Sapiens
PFIKSNKHH

SEQ ID NO: 1217277 - protein, 9 aa, Homo Sapiens
DSITNILKG

SEQ ID NO: 1217278 - protein, 9 aa, Homo Sapiens
AADFKTICG

SEQ ID NO: 1217279 - protein, 9 aa, Homo Sapiens
KQRQRLEED

SEQ ID NO: 1217280 - protein, 9 aa, Homo Sapiens
TSADATINF

SEQ ID NO: 1217281 - protein, 9 aa, Homo Sapiens
LLATRMEVP

SEQ ID NO: 1217282 - protein, 9 aa, Homo Sapiens
GIGPGRRVE

SEQ ID NO: 1217283 - protein, 9 aa, Homo Sapiens
RSIIDDTWW

SEQ ID NO: 1217284 - protein, 9 aa, Homo Sapiens
HLSVIALFY

SEQ ID NO: 1217285 - protein, 9 aa, Homo Sapiens
HRLVGTTNQ

SEQ ID NO: 1217286 - protein, 9 aa, Homo Sapiens
VKMGERVHI

SEQ ID NO: 1217287 - protein, 9 aa, Homo Sapiens
PKEPRPEVA

SEQ ID NO: 1217288 - protein, 9 aa, Homo Sapiens
QPLAEIRLK

SEQ ID NO: 1217289 - protein, 9 aa, Homo Sapiens
DECKTGFCH

SEQ ID NO: 1217290 - protein, 9 aa, Homo Sapiens
EIQEHTKPI

SEQ ID NO: 1217291 - protein, 9 aa, Homo Sapiens
RSGSFLYHV

SEQ ID NO: 1217292 - protein, 9 aa, Homo Sapiens
CGQAPQCVM

SEQ ID NO: 1217293 - protein, 9 aa, Homo Sapiens
YFLILYISM

SEQ ID NO: 1217294 - protein, 9 aa, Homo Sapiens
SEAVLWEVL

SEQ ID NO: 1217295 - protein, 9 aa, Homo Sapiens
SSPMSLHPW

SEQ ID NO: 1217296 - protein, 9 aa, Homo Sapiens
PFTITHRRA

SEQ ID NO: 1217297 - protein, 9 aa, Homo Sapiens
HKVFLSIKG

SEQ ID NO: 1217298 - protein, 9 aa, Homo Sapiens
EICHSNMLC

SEQ ID NO: 1217299 - protein, 9 aa, Homo Sapiens
LREFVLVKL

SEQ ID NO: 1217300 - protein, 9 aa, Homo Sapiens
SDSDSSTYN

SEQ ID NO: 1217301 - protein, 9 aa, Homo Sapiens
AIKMTVSER

SEQ ID NO: 1217302 - protein, 9 aa, Homo Sapiens
GGEASNPES

SEQ ID NO: 1217303 - protein, 9 aa, Homo Sapiens
VLLNHPFIQ

SEQ ID NO: 1217304 - protein, 9 aa, Homo Sapiens
LDHVLYEWF

SEQ ID NO: 1217305 - protein, 9 aa, Homo Sapiens
CMNVVHDKV

SEQ ID NO: 1217306 - protein, 9 aa, Homo Sapiens
ERSMAPDLR

SEQ ID NO: 1217307 - protein, 9 aa, Homo Sapiens
EVVSTITSI

SEQ ID NO: 1217308 - protein, 9 aa, Homo Sapiens
EVLNSAMQA

SEQ ID NO: 1217309 - protein, 9 aa, Homo Sapiens
SIIDDTWWF

SEQ ID NO: 1217310 - protein, 9 aa, Homo Sapiens
LIADGSHFI

SEQ ID NO: 1217311 - protein, 9 aa, Homo Sapiens
YNMIAAKQR

SEQ ID NO: 1217312 - protein, 9 aa, Homo Sapiens
ASIKGVPGF

SEQ ID NO: 1217313 - protein, 9 aa, Homo Sapiens
LLDKHFKML

SEQ ID NO: 1217314 - protein, 9 aa, Homo Sapiens
PMGPRIIAP

SEQ ID NO: 1217315 - protein, 9 aa, Homo Sapiens
FKDAKKQFK

SEQ ID NO: 1217316 - protein, 9 aa, Homo Sapiens
GERGPYGSK

SEQ ID NO: 1217317 - protein, 9 aa, Homo Sapiens
VAVTAKHLS

SEQ ID NO: 1217318 - protein, 9 aa, Homo Sapiens
RITSDDLHN

SEQ ID NO: 1217319 - protein, 9 aa, Homo Sapiens
PPRVILYHE

SEQ ID NO: 1217320 - protein, 9 aa, Homo Sapiens
LLHTIQRQK

SEQ ID NO: 1217321 - protein, 9 aa, Homo Sapiens
KLCRAVSEV

SEQ ID NO: 1217322 - protein, 9 aa, Homo Sapiens
HLATKKYMQ

SEQ ID NO: 1217323 - protein, 9 aa, Homo Sapiens
CYKAKTFQI

SEQ ID NO: 1217324 - protein, 9 aa, Homo Sapiens
VGTGSNIEV

SEQ ID NO: 1217325 - protein, 9 aa, Homo Sapiens
PEHAILKMK

SEQ ID NO: 1217326 - protein, 9 aa, Homo Sapiens
CFEQAGEPR

SEQ ID NO: 1217327 - protein, 9 aa, Homo Sapiens
GKNATLKTI

SEQ ID NO: 1217328 - protein, 9 aa, Homo Sapiens
APQPLLGAL

SEQ ID NO: 1217329 - protein, 9 aa, Homo Sapiens
PEPAPGLAA

SEQ ID NO: 1217330 - protein, 9 aa, Homo Sapiens
FQIYAVPWH

SEQ ID NO: 1217331 - protein, 9 aa, Homo Sapiens
ITLQWLIQQ

SEQ ID NO: 1217332 - protein, 9 aa, Homo Sapiens
STVQEEVQL

SEQ ID NO: 1217333 - protein, 9 aa, Homo Sapiens
YSFSRWCSY

SEQ ID NO: 1217334 - protein, 9 aa, Homo Sapiens
IVENVTDTT

SEQ ID NO: 1217335 - protein, 9 aa, Homo Sapiens
HIDKKDVPE

SEQ ID NO: 1217336 - protein, 9 aa, Homo Sapiens
LAYAMEQYE

SEQ ID NO: 1217337 - protein, 9 aa, Homo Sapiens
WHVRHYRPI

SEQ ID NO: 1217338 - protein, 9 aa, Homo Sapiens
PDPPMPRPV

SEQ ID NO: 1217339 - protein, 9 aa, Homo Sapiens
LGATGIVIW

SEQ ID NO: 1217340 - protein, 9 aa, Homo Sapiens
YQALSEMIQ

SEQ ID NO: 1217341 - protein, 9 aa, Homo Sapiens
VRGDEVMVQ

SEQ ID NO: 1217342 - protein, 9 aa, Homo Sapiens
TLGGSLYEN

SEQ ID NO: 1217343 - protein, 9 aa, Homo Sapiens
QSNLKSNIS

SEQ ID NO: 1217344 - protein, 9 aa, Homo Sapiens
QSQITRIPE

SEQ ID NO: 1217345 - protein, 9 aa, Homo Sapiens
DKNMDNAAE

SEQ ID NO: 1217346 - protein, 9 aa, Homo Sapiens
TPDELEAVC

SEQ ID NO: 1217347 - protein, 9 aa, Homo Sapiens
YETHWWDAP

SEQ ID NO: 1217348 - protein, 9 aa, Homo Sapiens
EYISDTTDL

SEQ ID NO: 1217349 - protein, 9 aa, Homo Sapiens
TDTDTHSHR

SEQ ID NO: 1217350 - protein, 9 aa, Homo Sapiens
KELSTWKES

SEQ ID NO: 1217351 - protein, 9 aa, Homo Sapiens
CQIHIGFPF

SEQ ID NO: 1217352 - protein, 9 aa, Homo Sapiens
IISSTIMDV

SEQ ID NO: 1217353 - protein, 9 aa, Homo Sapiens
GRDHENIKE

SEQ ID NO: 1217354 - protein, 9 aa, Homo Sapiens
WTCRDECKY

SEQ ID NO: 1217355 - protein, 9 aa, Homo Sapiens
NVCAYDPVG

SEQ ID NO: 1217356 - protein, 9 aa, Homo Sapiens
PAQKLILEQ

SEQ ID NO: 1217357 - protein, 9 aa, Homo Sapiens
NRIFKRAFY

SEQ ID NO: 1217358 - protein, 9 aa, Homo Sapiens
CHDGIEKVC

SEQ ID NO: 1217359 - protein, 9 aa, Homo Sapiens
FTTQPFFTT

SEQ ID NO: 1217360 - protein, 9 aa, Homo Sapiens
FLYSEDSTP

SEQ ID NO: 1217361 - protein, 9 aa, Homo Sapiens
ARDEHQLML

SEQ ID NO: 1217362 - protein, 9 aa, Homo Sapiens
YAVFYELKQ

SEQ ID NO: 1217363 - protein, 9 aa, Homo Sapiens
LQEDESCYN

SEQ ID NO: 1217364 - protein, 9 aa, Homo Sapiens
IFYRLHLTS

SEQ ID NO: 1217365 - protein, 9 aa, Homo Sapiens
CHRLRHLLA

SEQ ID NO: 1217366 - protein, 9 aa, Homo Sapiens
VAVAPGAFL

SEQ ID NO: 1217367 - protein, 9 aa, Homo Sapiens
SDLTTKKAV

SEQ ID NO: 1217368 - protein, 9 aa, Homo Sapiens
TCVTDTKNV

SEQ ID NO: 1217369 - protein, 9 aa, Homo Sapiens
FPRAARPIH

SEQ ID NO: 1217370 - protein, 9 aa, Homo Sapiens
QVVLTEYVR

SEQ ID NO: 1217371 - protein, 9 aa, Homo Sapiens
IVALHRAKR

SEQ ID NO: 1217372 - protein, 9 aa, Homo Sapiens
FYYQAMSVA

SEQ ID NO: 1217373 - protein, 9 aa, Homo Sapiens
NVSGELGGG

SEQ ID NO: 1217374 - protein, 9 aa, Homo Sapiens
SPSLQPPTL

SEQ ID NO: 1217375 - protein, 9 aa, Homo Sapiens
DQHWHSILI

SEQ ID NO: 1217376 - protein, 9 aa, Homo Sapiens
GLGVVVVFA

SEQ ID NO: 1217377 - protein, 9 aa, Homo Sapiens
SKKSSRWPT

SEQ ID NO: 1217378 - protein, 9 aa, Homo Sapiens
SKIIVVNYP

SEQ ID NO: 1217379 - protein, 9 aa, Homo Sapiens
EALGISSEI

SEQ ID NO: 1217380 - protein, 9 aa, Homo Sapiens
TRVQTTRTS

SEQ ID NO: 1217381 - protein, 9 aa, Homo Sapiens
VGFGGWGYG

SEQ ID NO: 1217382 - protein, 9 aa, Homo Sapiens
FRMCQVNIV

SEQ ID NO: 1217383 - protein, 9 aa, Homo Sapiens
INIAIVRLI

SEQ ID NO: 1217384 - protein, 9 aa, Homo Sapiens
QERDEVVKK

SEQ ID NO: 1217385 - protein, 9 aa, Homo Sapiens
PYNISIGYS

SEQ ID NO: 1217386 - protein, 9 aa, Homo Sapiens
LSFNSSVNE

SEQ ID NO: 1217387 - protein, 9 aa, Homo Sapiens
TNAWRHVAD

SEQ ID NO: 1217388 - protein, 9 aa, Homo Sapiens
AFWNRATLS

SEQ ID NO: 1217389 - protein, 9 aa, Homo Sapiens
ILPKELLTW

SEQ ID NO: 1217390 - protein, 9 aa, Homo Sapiens
KENTSPSEL

SEQ ID NO: 1217391 - protein, 9 aa, Homo Sapiens
FGVIYYVVF

SEQ ID NO: 1217392 - protein, 9 aa, Homo Sapiens
THGVNADAR

SEQ ID NO: 1217393 - protein, 9 aa, Homo Sapiens
NGFGGQYGI

SEQ ID NO: 1217394 - protein, 9 aa, Homo Sapiens
IMTVVILKL

SEQ ID NO: 1217395 - protein, 9 aa, Homo Sapiens
IHLPQPNSL

SEQ ID NO: 1217396 - protein, 9 aa, Homo Sapiens
EVGFEPFYH

SEQ ID NO: 1217397 - protein, 9 aa, Homo Sapiens
ADLEEWLKN

SEQ ID NO: 1217398 - protein, 9 aa, Homo Sapiens
RLLGDQRRP

SEQ ID NO: 1217399 - protein, 9 aa, Homo Sapiens
DLSLPTIGI

SEQ ID NO: 1217400 - protein, 9 aa, Homo Sapiens
WSAGCWTVR

SEQ ID NO: 1217401 - protein, 9 aa, Homo Sapiens
LLPRSQPLL

SEQ ID NO: 1217402 - protein, 9 aa, Homo Sapiens
YTMKIKPRL

SEQ ID NO: 1217403 - protein, 9 aa, Homo Sapiens
KDLYRNVML

SEQ ID NO: 1217404 - protein, 9 aa, Homo Sapiens
AVLGLLSTG

SEQ ID NO: 1217405 - protein, 9 aa, Homo Sapiens
LEWFSEEAH

SEQ ID NO: 1217406 - protein, 9 aa, Homo Sapiens
YDWYNVSYQ

SEQ ID NO: 1217407 - protein, 9 aa, Homo Sapiens
TDTSRQISG

SEQ ID NO: 1217408 - protein, 9 aa, Homo Sapiens
EERECKHHL

SEQ ID NO: 1217409 - protein, 9 aa, Homo Sapiens
TWKRSRPRP

SEQ ID NO: 1217410 - protein, 9 aa, Homo Sapiens
EMGHLITGA

SEQ ID NO: 1217411 - protein, 9 aa, Homo Sapiens
TGGDWFTSR

SEQ ID NO: 1217412 - protein, 9 aa, Homo Sapiens
PEFLVLTQK

SEQ ID NO: 1217413 - protein, 9 aa, Homo Sapiens
EGFPTLLTF

SEQ ID NO: 1217414 - protein, 9 aa, Homo Sapiens
TTRIEGTQV

SEQ ID NO: 1217415 - protein, 9 aa, Homo Sapiens
NMSFLYILM

SEQ ID NO: 1217416 - protein, 9 aa, Homo Sapiens
RATDFHFNA

SEQ ID NO: 1217417 - protein, 9 aa, Homo Sapiens
DRTICEALQ

SEQ ID NO: 1217418 - protein, 9 aa, Homo Sapiens
TLYRYFVEL

SEQ ID NO: 1217419 - protein, 9 aa, Homo Sapiens
KQRGRPGRP

SEQ ID NO: 1217420 - protein, 9 aa, Homo Sapiens
PQWINVFQE

SEQ ID NO: 1217421 - protein, 8 aa, Homo Sapiens
AESVERLQ

SEQ ID NO: 1217422 - protein, 9 aa, Homo Sapiens
LTRKMVLDW

SEQ ID NO: 1217423 - protein, 9 aa, Homo Sapiens
KRKQDAEDD

SEQ ID NO: 1217424 - protein, 9 aa, Homo Sapiens
STFLTIMHI

SEQ ID NO: 1217425 - protein, 9 aa, Homo Sapiens
SDESAMSFI

SEQ ID NO: 1217426 - protein, 9 aa, Homo Sapiens
LMENGPGKA

SEQ ID NO: 1217427 - protein, 9 aa, Homo Sapiens
KPFMSVFRH

SEQ ID NO: 1217428 - protein, 9 aa, Homo Sapiens
QDVVSVGWL

SEQ ID NO: 1217429 - protein, 9 aa, Homo Sapiens
LKMEASYCV

SEQ ID NO: 1217430 - protein, 9 aa, Homo Sapiens
GWNSKVAAV

SEQ ID NO: 1217431 - protein, 9 aa, Homo Sapiens
YLHRIPTHP

SEQ ID NO: 1217432 - protein, 9 aa, Homo Sapiens
PSWGRRPRY

SEQ ID NO: 1217433 - protein, 9 aa, Homo Sapiens
MHSRVFQIL

SEQ ID NO: 1217434 - protein, 9 aa, Homo Sapiens
QHPRLLIVH

SEQ ID NO: 1217435 - protein, 9 aa, Homo Sapiens
TGLFTLCLY

SEQ ID NO: 1217436 - protein, 9 aa, Homo Sapiens
LADQTSEWD

SEQ ID NO: 1217437 - protein, 9 aa, Homo Sapiens
QVGQSKHLE

SEQ ID NO: 1217438 - protein, 9 aa, Homo Sapiens
VDCMSWLVQ

SEQ ID NO: 1217439 - protein, 9 aa, Homo Sapiens
QLCLQGRLA

SEQ ID NO: 1217440 - protein, 9 aa, Homo Sapiens
PVSSAQDFW

SEQ ID NO: 1217441 - protein, 9 aa, Homo Sapiens
FSSSQTPNP

SEQ ID NO: 1217442 - protein, 9 aa, Homo Sapiens
HVERSTLDQ

SEQ ID NO: 1217443 - protein, 9 aa, Homo Sapiens
CPHPSKGEE

SEQ ID NO: 1217444 - protein, 9 aa, Homo Sapiens
HHVYKTLER

SEQ ID NO: 1217445 - protein, 9 aa, Homo Sapiens
SEVDNGLRN

SEQ ID NO: 1217446 - protein, 9 aa, Homo Sapiens
IVVILSGFF

SEQ ID NO: 1217447 - protein, 9 aa, Homo Sapiens
MQDAQGPRP

SEQ ID NO: 1217448 - protein, 9 aa, Homo Sapiens
RVIRVAAKW

SEQ ID NO: 1217449 - protein, 9 aa, Homo Sapiens
IKPTVIEVE

SEQ ID NO: 1217450 - protein, 9 aa, Homo Sapiens
LPPSWRKIM

SEQ ID NO: 1217451 - protein, 9 aa, Homo Sapiens
HIDDLLRAN

SEQ ID NO: 1217452 - protein, 9 aa, Homo Sapiens
LLLFIYNKD

SEQ ID NO: 1217453 - protein, 9 aa, Homo Sapiens
LVGTHDAIS

SEQ ID NO: 1217454 - protein, 9 aa, Homo Sapiens
CPSRCLVCG

SEQ ID NO: 1217455 - protein, 9 aa, Homo Sapiens
DTGPQGGIT

SEQ ID NO: 1217456 - protein, 9 aa, Homo Sapiens
KCMVEYEEA

SEQ ID NO: 1217457 - protein, 9 aa, Homo Sapiens
KKCDIGPLQ

SEQ ID NO: 1217458 - protein, 9 aa, Homo Sapiens
ELPLSAVCF

SEQ ID NO: 1217459 - protein, 9 aa, Homo Sapiens
TGQQLADTL

SEQ ID NO: 1217460 - protein, 9 aa, Homo Sapiens
HPGNTILHM

SEQ ID NO: 1217461 - protein, 9 aa, Homo Sapiens
LEPGRKCKM

SEQ ID NO: 1217462 - protein, 9 aa, Homo Sapiens
PRGVVVDMI

SEQ ID NO: 1217463 - protein, 9 aa, Homo Sapiens
FNVRLSDQD

SEQ ID NO: 1217464 - protein, 9 aa, Homo Sapiens
VAVTVGGIN

SEQ ID NO: 1217465 - protein, 9 aa, Homo Sapiens
KCYIKNHEG

SEQ ID NO: 1217466 - protein, 9 aa, Homo Sapiens
RYLCLHYPP

SEQ ID NO: 1217467 - protein, 9 aa, Homo Sapiens
DERSKPVNE

SEQ ID NO: 1217468 - protein, 9 aa, Homo Sapiens
VYTGWLFQN

SEQ ID NO: 1217469 - protein, 9 aa, Homo Sapiens
KGDDHKYMD

SEQ ID NO: 1217470 - protein, 9 aa, Homo Sapiens
PPQSQTHPL

SEQ ID NO: 1217471 - protein, 9 aa, Homo Sapiens
FTYLIVVIF

SEQ ID NO: 1217472 - protein, 9 aa, Homo Sapiens
QQLRPQAKA

SEQ ID NO: 1217473 - protein, 9 aa, Homo Sapiens
YHPSHQAHW

SEQ ID NO: 1217474 - protein, 9 aa, Homo Sapiens
LIPRKDLLV

SEQ ID NO: 1217475 - protein, 9 aa, Homo Sapiens
LMDSHKQPV

SEQ ID NO: 1217476 - protein, 9 aa, Homo Sapiens
LSPPLPPAL

SEQ ID NO: 1217477 - protein, 9 aa, Homo Sapiens
AEVNELKKQ

SEQ ID NO: 1217478 - protein, 9 aa, Homo Sapiens
SIGYSGLAT

SEQ ID NO: 1217479 - protein, 9 aa, Homo Sapiens
VHTSGFTGG

SEQ ID NO: 1217480 - protein, 9 aa, Homo Sapiens
LTGLTVIGV

SEQ ID NO: 1217481 - protein, 9 aa, Homo Sapiens
FKDLGMPAR

SEQ ID NO: 1217482 - protein, 9 aa, Homo Sapiens
LKTPRLSRN

SEQ ID NO: 1217483 - protein, 9 aa, Homo Sapiens
SVMDVYDGR

SEQ ID NO: 1217484 - protein, 9 aa, Homo Sapiens
SVLGTDWPK

SEQ ID NO: 1217485 - protein, 9 aa, Homo Sapiens
EHAERRKLW

SEQ ID NO: 1217486 - protein, 9 aa, Homo Sapiens
HPKTGKWQK

SEQ ID NO: 1217487 - protein, 9 aa, Homo Sapiens
VIATLLFCL

SEQ ID NO: 1217488 - protein, 9 aa, Homo Sapiens
AEELKADLL

SEQ ID NO: 1217489 - protein, 9 aa, Homo Sapiens
RLAYALPHW

SEQ ID NO: 1217490 - protein, 9 aa, Homo Sapiens
VSRNIYHSH

SEQ ID NO: 1217491 - protein, 9 aa, Homo Sapiens
LRVRKHGGS

SEQ ID NO: 1217492 - protein, 9 aa, Homo Sapiens
VETYSVRPG

SEQ ID NO: 1217493 - protein, 9 aa, Homo Sapiens
LTKSISLDS

SEQ ID NO: 1217494 - protein, 9 aa, Homo Sapiens
SLSDEQDMP

SEQ ID NO: 1217495 - protein, 9 aa, Homo Sapiens
HTWSLTELI

SEQ ID NO: 1217496 - protein, 9 aa, Homo Sapiens
TWWWGRKTH

SEQ ID NO: 1217497 - protein, 9 aa, Homo Sapiens
SCARSRRSV

SEQ ID NO: 1217498 - protein, 9 aa, Homo Sapiens
GLNRVLEEM

SEQ ID NO: 1217499 - protein, 9 aa, Homo Sapiens
PRFCVSLAG

SEQ ID NO: 1217500 - protein, 9 aa, Homo Sapiens
HGHHWQGPA

SEQ ID NO: 1217501 - protein, 9 aa, Homo Sapiens
TLSVLAHWS

SEQ ID NO: 1217502 - protein, 9 aa, Homo Sapiens
FRHNQQKPL

SEQ ID NO: 1217503 - protein, 9 aa, Homo Sapiens
MSPKWCFLD

SEQ ID NO: 1217504 - protein, 9 aa, Homo Sapiens
GTPFLSSLV

SEQ ID NO: 1217505 - protein, 9 aa, Homo Sapiens
SSSSPASVM

SEQ ID NO: 1217506 - protein, 9 aa, Homo Sapiens
IERMSSGLT

SEQ ID NO: 1217507 - protein, 9 aa, Homo Sapiens
VVALDLVIS

SEQ ID NO: 1217508 - protein, 9 aa, Homo Sapiens
RLGISLLGV

SEQ ID NO: 1217509 - protein, 9 aa, Homo Sapiens
STLGQGLSA

SEQ ID NO: 1217510 - protein, 9 aa, Homo Sapiens
PQGKRPLHS

SEQ ID NO: 1217511 - protein, 9 aa, Homo Sapiens
IKQMLSDLN

SEQ ID NO: 1217512 - protein, 9 aa, Homo Sapiens
SIVLSRPSL

SEQ ID NO: 1217513 - protein, 9 aa, Homo Sapiens
LCTLAWSVH

SEQ ID NO: 1217514 - protein, 9 aa, Homo Sapiens
ECRCQGSTM

SEQ ID NO: 1217515 - protein, 9 aa, Homo Sapiens
TSQIIYRRY

SEQ ID NO: 1217516 - protein, 9 aa, Homo Sapiens
FINHMIQAI

SEQ ID NO: 1217517 - protein, 9 aa, Homo Sapiens
GLVQLWHLW

SEQ ID NO: 1217518 - protein, 9 aa, Homo Sapiens
HIMMLKYFA

SEQ ID NO: 1217519 - protein, 9 aa, Homo Sapiens
NTILHMDTI

SEQ ID NO: 1217520 - protein, 9 aa, Homo Sapiens
FTCYSFRMC

SEQ ID NO: 1217521 - protein, 9 aa, Homo Sapiens
APGLLATRM

SEQ ID NO: 1217522 - protein, 9 aa, Homo Sapiens
IQGHPDGTP

SEQ ID NO: 1217523 - protein, 9 aa, Homo Sapiens
AQHLAQELA

SEQ ID NO: 1217524 - protein, 9 aa, Homo Sapiens
KTTCMFSQG

SEQ ID NO: 1217525 - protein, 9 aa, Homo Sapiens
IKVCVWDED

SEQ ID NO: 1217526 - protein, 9 aa, Homo Sapiens
CLILDISAD

SEQ ID NO: 1217527 - protein, 9 aa, Homo Sapiens
AVLAYSQSA

SEQ ID NO: 1217528 - protein, 9 aa, Homo Sapiens
TPMDLTIRI

SEQ ID NO: 1217529 - protein, 9 aa, Homo Sapiens
LYWYGGESY

SEQ ID NO: 1217530 - protein, 9 aa, Homo Sapiens
KCIHCILLL

SEQ ID NO: 1217531 - protein, 9 aa, Homo Sapiens
FATMITKRP

SEQ ID NO: 1217532 - protein, 9 aa, Homo Sapiens
GQFPRVCIT

SEQ ID NO: 1217533 - protein, 9 aa, Homo Sapiens
NATFNWNTF

SEQ ID NO: 1217534 - protein, 9 aa, Homo Sapiens
MCKQSVDKG

SEQ ID NO: 1217535 - protein, 9 aa, Homo Sapiens
NQEDSVIMF

SEQ ID NO: 1217536 - protein, 9 aa, Homo Sapiens
IAPKQRPKA

SEQ ID NO: 1217537 - protein, 9 aa, Homo Sapiens
PRRGCGGHR

SEQ ID NO: 1217538 - protein, 9 aa, Homo Sapiens
RGRRALWPS

SEQ ID NO: 1217539 - protein, 9 aa, Homo Sapiens
PADQSSDGS

SEQ ID NO: 1217540 - protein, 9 aa, Homo Sapiens
AEKEVTRMA

SEQ ID NO: 1217541 - protein, 9 aa, Homo Sapiens
GRATDIWSL

SEQ ID NO: 1217542 - protein, 9 aa, Homo Sapiens
AISWITIVM

SEQ ID NO: 1217543 - protein, 9 aa, Homo Sapiens
DDGILNTSG

SEQ ID NO: 1217544 - protein, 9 aa, Homo Sapiens
WTLQEALSL

SEQ ID NO: 1217545 - protein, 9 aa, Homo Sapiens
ENTEYTVCL

SEQ ID NO: 1217546 - protein, 9 aa, Homo Sapiens
VRAAFVYAL

SEQ ID NO: 1217547 - protein, 9 aa, Homo Sapiens
DQFVIQFTS

SEQ ID NO: 1217548 - protein, 9 aa, Homo Sapiens
RICTVSYEV

SEQ ID NO: 1217549 - protein, 9 aa, Homo Sapiens
NGVNDVSGP

SEQ ID NO: 1217550 - protein, 9 aa, Homo Sapiens
GLRVQIDCH

SEQ ID NO: 1217551 - protein, 9 aa, Homo Sapiens
DKVSPYEFF

SEQ ID NO: 1217552 - protein, 9 aa, Homo Sapiens
ISIVSLCLV

SEQ ID NO: 1217553 - protein, 9 aa, Homo Sapiens
EVCMAIRNP

SEQ ID NO: 1217554 - protein, 9 aa, Homo Sapiens
DPTEFRVML

SEQ ID NO: 1217555 - protein, 9 aa, Homo Sapiens
TVDIVHVTC

SEQ ID NO: 1217556 - protein, 9 aa, Homo Sapiens
PLLPFYPLR

SEQ ID NO: 1217557 - protein, 9 aa, Homo Sapiens
ERLELYDCR

SEQ ID NO: 1217558 - protein, 9 aa, Homo Sapiens
VWDKSSPVD

SEQ ID NO: 1217559 - protein, 9 aa, Homo Sapiens
QRILLTGLH

SEQ ID NO: 1217560 - protein, 9 aa, Homo Sapiens
TKIFKHTAP

SEQ ID NO: 1217561 - protein, 9 aa, Homo Sapiens
NLDSKGYDI

SEQ ID NO: 1217562 - protein, 9 aa, Homo Sapiens
MGREPWSED

SEQ ID NO: 1217563 - protein, 9 aa, Homo Sapiens
NIKHRGHAR

SEQ ID NO: 1217564 - protein, 9 aa, Homo Sapiens
LQQTRMLLA

SEQ ID NO: 1217565 - protein, 9 aa, Homo Sapiens
PENPEVKEF

SEQ ID NO: 1217566 - protein, 9 aa, Homo Sapiens
QRGARCQDR

SEQ ID NO: 1217567 - protein, 9 aa, Homo Sapiens
HPNALQCLG

SEQ ID NO: 1217568 - protein, 9 aa, Homo Sapiens
YNNLILLNK

SEQ ID NO: 1217569 - protein, 9 aa, Homo Sapiens
MSRAQTFSS

SEQ ID NO: 1217570 - protein, 9 aa, Homo Sapiens
AHGVVSFSL

SEQ ID NO: 1217571 - protein, 9 aa, Homo Sapiens
KTKAVCMIA

SEQ ID NO: 1217572 - protein, 9 aa, Homo Sapiens
IISALNAIH

SEQ ID NO: 1217573 - protein, 9 aa, Homo Sapiens
DINDHYPVF

SEQ ID NO: 1217574 - protein, 9 aa, Homo Sapiens
AGEPLEAEP

SEQ ID NO: 1217575 - protein, 9 aa, Homo Sapiens
LEIAMDQKG

SEQ ID NO: 1217576 - protein, 9 aa, Homo Sapiens
TLVMECVDG

SEQ ID NO: 1217577 - protein, 9 aa, Homo Sapiens
HLKRDHSLI

SEQ ID NO: 1217578 - protein, 9 aa, Homo Sapiens
ATGPRGEPQ

SEQ ID NO: 1217579 - protein, 9 aa, Homo Sapiens
AIQKLFAPV

SEQ ID NO: 1217580 - protein, 9 aa, Homo Sapiens
WVAWMNLYQ

SEQ ID NO: 1217581 - protein, 9 aa, Homo Sapiens
EELHIQGVP

SEQ ID NO: 1217582 - protein, 9 aa, Homo Sapiens
IQALWVGGA

SEQ ID NO: 1217583 - protein, 9 aa, Homo Sapiens
LDEQGSAVE

SEQ ID NO: 1217584 - protein, 9 aa, Homo Sapiens
ALSLKITFI

SEQ ID NO: 1217585 - protein, 9 aa, Homo Sapiens
EEQKMQSRM

SEQ ID NO: 1217586 - protein, 9 aa, Homo Sapiens
VQIHDVVLV

SEQ ID NO: 1217587 - protein, 9 aa, Homo Sapiens
RAAIISRWN

SEQ ID NO: 1217588 - protein, 9 aa, Homo Sapiens
ACETPGRGP

SEQ ID NO: 1217589 - protein, 9 aa, Homo Sapiens
VDFDAFFTS

SEQ ID NO: 1217590 - protein, 9 aa, Homo Sapiens
LILMDMAFD

SEQ ID NO: 1217591 - protein, 9 aa, Homo Sapiens
SWRSDPIQL

SEQ ID NO: 1217592 - protein, 9 aa, Homo Sapiens
VMITYGVSA

SEQ ID NO: 1217593 - protein, 9 aa, Homo Sapiens
DCHIFTRCI

SEQ ID NO: 1217594 - protein, 9 aa, Homo Sapiens
TRCCWCSLT

SEQ ID NO: 1217595 - protein, 9 aa, Homo Sapiens
MLIAFTGDI

SEQ ID NO: 1217596 - protein, 9 aa, Homo Sapiens
DMFYDEARN

SEQ ID NO: 1217597 - protein, 9 aa, Homo Sapiens
FSVAKSMKS

SEQ ID NO: 1217598 - protein, 9 aa, Homo Sapiens
DMLLFLNPD

SEQ ID NO: 1217599 - protein, 9 aa, Homo Sapiens
DEKPASPTP

SEQ ID NO: 1217600 - protein, 9 aa, Homo Sapiens
VAVLLNHPF

SEQ ID NO: 1217601 - protein, 9 aa, Homo Sapiens
RNQEEHLLA

SEQ ID NO: 1217602 - protein, 9 aa, Homo Sapiens
GEGSGSISL

SEQ ID NO: 1217603 - protein, 9 aa, Homo Sapiens
RQWVRMADN

SEQ ID NO: 1217604 - protein, 9 aa, Homo Sapiens
SDAYTVIQA

SEQ ID NO: 1217605 - protein, 9 aa, Homo Sapiens
CDYIPGSGL

SEQ ID NO: 1217606 - protein, 9 aa, Homo Sapiens
NLIVAVAPG

SEQ ID NO: 1217607 - protein, 9 aa, Homo Sapiens
SLVLIWIFS

SEQ ID NO: 1217608 - protein, 9 aa, Homo Sapiens
TGEWPYKCG

SEQ ID NO: 1217609 - protein, 9 aa, Homo Sapiens
SATTGKVVC

SEQ ID NO: 1217610 - protein, 9 aa, Homo Sapiens
VEKTEKIGI

SEQ ID NO: 1217611 - protein, 9 aa, Homo Sapiens
TGHLVIYMP

SEQ ID NO: 1217612 - protein, 9 aa, Homo Sapiens
MVAYHGCRD

SEQ ID NO: 1217613 - protein, 9 aa, Homo Sapiens
RNGVALEEL

SEQ ID NO: 1217614 - protein, 9 aa, Homo Sapiens
GREPWSEDR

SEQ ID NO: 1217615 - protein, 9 aa, Homo Sapiens
VRYKMPSDD

SEQ ID NO: 1217616 - protein, 9 aa, Homo Sapiens
RHIPLTPGS

SEQ ID NO: 1217617 - protein, 9 aa, Homo Sapiens
HMVVIHAEH

SEQ ID NO: 1217618 - protein, 9 aa, Homo Sapiens
QPVLFSMFL

SEQ ID NO: 1217619 - protein, 9 aa, Homo Sapiens
KKSCTYIRS

SEQ ID NO: 1217620 - protein, 9 aa, Homo Sapiens
TCSKDLQMV

SEQ ID NO: 1217621 - protein, 9 aa, Homo Sapiens
DGPSCSSAS

SEQ ID NO: 1217622 - protein, 9 aa, Homo Sapiens
LEHPDCAFM

SEQ ID NO: 1217623 - protein, 9 aa, Homo Sapiens
DNRNTSPSI

SEQ ID NO: 1217624 - protein, 9 aa, Homo Sapiens
RLQLLLLNL

SEQ ID NO: 1217625 - protein, 9 aa, Homo Sapiens
QPPVKVRTK

SEQ ID NO: 1217626 - protein, 9 aa, Homo Sapiens
FGGIGGILW

SEQ ID NO: 1217627 - protein, 9 aa, Homo Sapiens
TCQEYVYPE

SEQ ID NO: 1217628 - protein, 9 aa, Homo Sapiens
GRIRTVGIV

SEQ ID NO: 1217629 - protein, 9 aa, Homo Sapiens
CRDECKYEC

SEQ ID NO: 1217630 - protein, 9 aa, Homo Sapiens
QSFSEIERH

SEQ ID NO: 1217631 - protein, 9 aa, Homo Sapiens
IFLVLVSAC

SEQ ID NO: 1217632 - protein, 9 aa, Homo Sapiens
SLVSENVEP

SEQ ID NO: 1217633 - protein, 9 aa, Homo Sapiens
KKSKEITFQ

SEQ ID NO: 1217634 - protein, 9 aa, Homo Sapiens
PWPPSFSAP

SEQ ID NO: 1217635 - protein, 9 aa, Homo Sapiens
NPTVQFHSK

SEQ ID NO: 1217636 - protein, 9 aa, Homo Sapiens
QLQNNGLRK

SEQ ID NO: 1217637 - protein, 9 aa, Homo Sapiens
LLDLLRSSL

SEQ ID NO: 1217638 - protein, 9 aa, Homo Sapiens
ERVDRLLKQ

SEQ ID NO: 1217639 - protein, 9 aa, Homo Sapiens
RIQREQVLL

SEQ ID NO: 1217640 - protein, 9 aa, Homo Sapiens
VACSCHQCP

SEQ ID NO: 1217641 - protein, 9 aa, Homo Sapiens
GADTFVDLE

SEQ ID NO: 1217642 - protein, 9 aa, Homo Sapiens
EQLVPGSGK

SEQ ID NO: 1217643 - protein, 9 aa, Homo Sapiens
CLNTDGSFH

SEQ ID NO: 1217644 - protein, 9 aa, Homo Sapiens
ILTNFRVMN

SEQ ID NO: 1217645 - protein, 9 aa, Homo Sapiens
SVLMLPVCS

SEQ ID NO: 1217646 - protein, 9 aa, Homo Sapiens
NQKKETQIP

SEQ ID NO: 1217647 - protein, 9 aa, Homo Sapiens
GPWRPLHTA

SEQ ID NO: 1217648 - protein, 9 aa, Homo Sapiens
SDEHRTYGA

SEQ ID NO: 1217649 - protein, 9 aa, Homo Sapiens
HTDADCFVC

SEQ ID NO: 1217650 - protein, 9 aa, Homo Sapiens
QSCGGGGAH

SEQ ID NO: 1217651 - protein, 9 aa, Homo Sapiens
TRSLATKPL

SEQ ID NO: 1217652 - protein, 9 aa, Homo Sapiens
IHHNCAPEF

SEQ ID NO: 1217653 - protein, 9 aa, Homo Sapiens
HTMEEEVPQ

SEQ ID NO: 1217654 - protein, 9 aa, Homo Sapiens
HDLIEDLKL

SEQ ID NO: 1217655 - protein, 9 aa, Homo Sapiens
IDVCKPLHY

SEQ ID NO: 1217656 - protein, 9 aa, Homo Sapiens
IHTSIRPYQ

SEQ ID NO: 1217657 - protein, 9 aa, Homo Sapiens
SRGTFSRIH

SEQ ID NO: 1217658 - protein, 9 aa, Homo Sapiens
EMENLCLES

SEQ ID NO: 1217659 - protein, 9 aa, Homo Sapiens
PKCQASSNG

SEQ ID NO: 1217660 - protein, 9 aa, Homo Sapiens
VMAKESVNA

SEQ ID NO: 1217661 - protein, 9 aa, Homo Sapiens
DEPVFEDQC

SEQ ID NO: 1217662 - protein, 9 aa, Homo Sapiens
QHCARTMPL

SEQ ID NO: 1217663 - protein, 9 aa, Homo Sapiens
GLLGPPRPH

SEQ ID NO: 1217664 - protein, 9 aa, Homo Sapiens
KISVLSFET

SEQ ID NO: 1217665 - protein, 9 aa, Homo Sapiens
GCISPLARA

SEQ ID NO: 1217666 - protein, 9 aa, Homo Sapiens
IENCNKAKA

SEQ ID NO: 1217667 - protein, 9 aa, Homo Sapiens
LTVVFFILW

SEQ ID NO: 1217668 - protein, 9 aa, Homo Sapiens
MTKVQDFLG

SEQ ID NO: 1217669 - protein, 9 aa, Homo Sapiens
FIIQMWSIW

SEQ ID NO: 1217670 - protein, 9 aa, Homo Sapiens
ECTDSTGID

SEQ ID NO: 1217671 - protein, 9 aa, Homo Sapiens
YDAITALVK

SEQ ID NO: 1217672 - protein, 9 aa, Homo Sapiens
NEQPGPMGP

SEQ ID NO: 1217673 - protein, 9 aa, Homo Sapiens
DTGSLNGTN

SEQ ID NO: 1217674 - protein, 9 aa, Homo Sapiens
IVFWVRSKR

SEQ ID NO: 1217675 - protein, 9 aa, Homo Sapiens
GFLYSEDST

SEQ ID NO: 1217676 - protein, 9 aa, Homo Sapiens
LDILTKLKD

SEQ ID NO: 1217677 - protein, 9 aa, Homo Sapiens
NALARYDSI

SEQ ID NO: 1217678 - protein, 9 aa, Homo Sapiens
KLVRFCKLE

SEQ ID NO: 1217679 - protein, 9 aa, Homo Sapiens
SQQQATVMK

SEQ ID NO: 1217680 - protein, 9 aa, Homo Sapiens
KVYNPLYCE

SEQ ID NO: 1217681 - protein, 9 aa, Homo Sapiens
WKQMMKRIK

SEQ ID NO: 1217682 - protein, 9 aa, Homo Sapiens
WVNAAIGSV

SEQ ID NO: 1217683 - protein, 9 aa, Homo Sapiens
VTIDENTGL

SEQ ID NO: 1217684 - protein, 9 aa, Homo Sapiens
FTRYILHPQ

SEQ ID NO: 1217685 - protein, 9 aa, Homo Sapiens
ASKAASQQR

SEQ ID NO: 1217686 - protein, 9 aa, Homo Sapiens
ERIANGAIT

SEQ ID NO: 1217687 - protein, 9 aa, Homo Sapiens
SAQAFPQAD

SEQ ID NO: 1217688 - protein, 9 aa, Homo Sapiens
VTIWMCRHP

SEQ ID NO: 1217689 - protein, 9 aa, Homo Sapiens
LLDFPCINS

SEQ ID NO: 1217690 - protein, 9 aa, Homo Sapiens
DGAIENCNK

SEQ ID NO: 1217691 - protein, 9 aa, Homo Sapiens
VEEHTQAYL

SEQ ID NO: 1217692 - protein, 9 aa, Homo Sapiens
TVPEGSKHG

SEQ ID NO: 1217693 - protein, 9 aa, Homo Sapiens
LGLFSNYIT

SEQ ID NO: 1217694 - protein, 9 aa, Homo Sapiens
QWCGWRRLL

SEQ ID NO: 1217695 - protein, 9 aa, Homo Sapiens
FITLVNVID

SEQ ID NO: 1217696 - protein, 9 aa, Homo Sapiens
LRGPAATTP

SEQ ID NO: 1217697 - protein, 9 aa, Homo Sapiens
QTYLQAAID

SEQ ID NO: 1217698 - protein, 9 aa, Homo Sapiens
FLDADTRRA

SEQ ID NO: 1217699 - protein, 9 aa, Homo Sapiens
WIPLLLVVG

SEQ ID NO: 1217700 - protein, 9 aa, Homo Sapiens
RYEMPRHGV

SEQ ID NO: 1217701 - protein, 9 aa, Homo Sapiens
MQSEEVRKK

SEQ ID NO: 1217702 - protein, 9 aa, Homo Sapiens
KARSFLEFV

SEQ ID NO: 1217703 - protein, 9 aa, Homo Sapiens
YVIFNNTSK

SEQ ID NO: 1217704 - protein, 9 aa, Homo Sapiens
SLSGVCESS

SEQ ID NO: 1217705 - protein, 9 aa, Homo Sapiens
TPGPKLVHG

SEQ ID NO: 1217706 - protein, 9 aa, Homo Sapiens
RDKVVAVFY

SEQ ID NO: 1217707 - protein, 9 aa, Homo Sapiens
TEMPVLPFM

SEQ ID NO: 1217708 - protein, 9 aa, Homo Sapiens
ARSHRRARE

SEQ ID NO: 1217709 - protein, 9 aa, Homo Sapiens
RTTTGSTHE

SEQ ID NO: 1217710 - protein, 9 aa, Homo Sapiens
PQPYASSLE

SEQ ID NO: 1217711 - protein, 9 aa, Homo Sapiens
LDTAHCLQV

SEQ ID NO: 1217712 - protein, 9 aa, Homo Sapiens
DKGSMSLSP

SEQ ID NO: 1217713 - protein, 9 aa, Homo Sapiens
SAKTDEVVP

SEQ ID NO: 1217714 - protein, 9 aa, Homo Sapiens
GWIIFQRRN

SEQ ID NO: 1217715 - protein, 9 aa, Homo Sapiens
YYPTPKVQD

SEQ ID NO: 1217716 - protein, 9 aa, Homo Sapiens
RDADEYYRK

SEQ ID NO: 1217717 - protein, 9 aa, Homo Sapiens
TNILAAQSV

SEQ ID NO: 1217718 - protein, 9 aa, Homo Sapiens
SAGPDCRIN

SEQ ID NO: 1217719 - protein, 9 aa, Homo Sapiens
VRYQGHAQA

SEQ ID NO: 1217720 - protein, 9 aa, Homo Sapiens
HWTTKHVAV

SEQ ID NO: 1217721 - protein, 9 aa, Homo Sapiens
ETMSSETTK

SEQ ID NO: 1217722 - protein, 9 aa, Homo Sapiens
VAASWVICF

SEQ ID NO: 1217723 - protein, 9 aa, Homo Sapiens
GSALLKKAI

SEQ ID NO: 1217724 - protein, 9 aa, Homo Sapiens
HAAQEVLQC

SEQ ID NO: 1217725 - protein, 9 aa, Homo Sapiens
HHPYKMNLA

SEQ ID NO: 1217726 - protein, 9 aa, Homo Sapiens
SRAEGLSLD

SEQ ID NO: 1217727 - protein, 9 aa, Homo Sapiens
KFIPEGENM

SEQ ID NO: 1217728 - protein, 9 aa, Homo Sapiens
SFWLMLTSY

SEQ ID NO: 1217729 - protein, 9 aa, Homo Sapiens
EYCDGCGEN

SEQ ID NO: 1217730 - protein, 9 aa, Homo Sapiens
SVSTDLNGQ

SEQ ID NO: 1217731 - protein, 9 aa, Homo Sapiens
SGLRSVHVP

SEQ ID NO: 1217732 - protein, 9 aa, Homo Sapiens
CLLVETNEK

SEQ ID NO: 1217733 - protein, 9 aa, Homo Sapiens
EPSVFQCVP

SEQ ID NO: 1217734 - protein, 9 aa, Homo Sapiens
DSLSHHSDH

SEQ ID NO: 1217735 - protein, 9 aa, Homo Sapiens
MENNSYPHF

SEQ ID NO: 1217736 - protein, 9 aa, Homo Sapiens
HPPPSTCLD

SEQ ID NO: 1217737 - protein, 9 aa, Homo Sapiens
IKDKNDSVD

SEQ ID NO: 1217738 - protein, 9 aa, Homo Sapiens
ALYVSDFKE

SEQ ID NO: 1217739 - protein, 9 aa, Homo Sapiens
HQETAYEYK

SEQ ID NO: 1217740 - protein, 9 aa, Homo Sapiens
RCNPQKTVP

SEQ ID NO: 1217741 - protein, 9 aa, Homo Sapiens
QEGANLLCG

SEQ ID NO: 1217742 - protein, 9 aa, Homo Sapiens
FEAMIRQNE

SEQ ID NO: 1217743 - protein, 9 aa, Homo Sapiens
PGPKLVHGS

SEQ ID NO: 1217744 - protein, 9 aa, Homo Sapiens
GSSSSNQYT

SEQ ID NO: 1217745 - protein, 9 aa, Homo Sapiens
SRKDSPLIL

SEQ ID NO: 1217746 - protein, 9 aa, Homo Sapiens
GQASAPLSS

SEQ ID NO: 1217747 - protein, 9 aa, Homo Sapiens
IVIIIGAFF

SEQ ID NO: 1217748 - protein, 9 aa, Homo Sapiens
CGFKHFCDG

SEQ ID NO: 1217749 - protein, 9 aa, Homo Sapiens
QLCLPLLEM

SEQ ID NO: 1217750 - protein, 9 aa, Homo Sapiens
KQMGNLEDT

SEQ ID NO: 1217751 - protein, 9 aa, Homo Sapiens
SGQAVLGMD

SEQ ID NO: 1217752 - protein, 9 aa, Homo Sapiens
MAELWALLR

SEQ ID NO: 1217753 - protein, 9 aa, Homo Sapiens
EKVDDDVLL

SEQ ID NO: 1217754 - protein, 9 aa, Homo Sapiens
SPLHLINIR

SEQ ID NO: 1217755 - protein, 9 aa, Homo Sapiens
SCMDNFNLG

SEQ ID NO: 1217756 - protein, 9 aa, Homo Sapiens
HTANPMEYA

SEQ ID NO: 1217757 - protein, 9 aa, Homo Sapiens
RATPAAGSL

SEQ ID NO: 1217758 - protein, 9 aa, Homo Sapiens
LDDFANGTA

SEQ ID NO: 1217759 - protein, 9 aa, Homo Sapiens
LRQQSGIGH

SEQ ID NO: 1217760 - protein, 9 aa, Homo Sapiens
EAGVARGVD

SEQ ID NO: 1217761 - protein, 9 aa, Homo Sapiens
PHPTSDGEG

SEQ ID NO: 1217762 - protein, 9 aa, Homo Sapiens
LKALYTYKS

SEQ ID NO: 1217763 - protein, 9 aa, Homo Sapiens
KQALDFQLK

SEQ ID NO: 1217764 - protein, 9 aa, Homo Sapiens
EFKAELIMY

SEQ ID NO: 1217765 - protein, 9 aa, Homo Sapiens
CLEIPGSRL

SEQ ID NO: 1217766 - protein, 9 aa, Homo Sapiens
ELPSNKTVE

SEQ ID NO: 1217767 - protein, 9 aa, Homo Sapiens
CTIGLRGLT

SEQ ID NO: 1217768 - protein, 9 aa, Homo Sapiens
TYGRSLKVA

SEQ ID NO: 1217769 - protein, 9 aa, Homo Sapiens
PDDQVITIS

SEQ ID NO: 1217770 - protein, 9 aa, Homo Sapiens
GLTGAHLRL

SEQ ID NO: 1217771 - protein, 9 aa, Homo Sapiens
SLIALGSYT

SEQ ID NO: 1217772 - protein, 9 aa, Homo Sapiens
GKVVCVFRP

SEQ ID NO: 1217773 - protein, 9 aa, Homo Sapiens
PYTSVYEYS

SEQ ID NO: 1217774 - protein, 9 aa, Homo Sapiens
GEDQIIEDQ

SEQ ID NO: 1217775 - protein, 9 aa, Homo Sapiens
SVLEIFKQA

SEQ ID NO: 1217776 - protein, 9 aa, Homo Sapiens
TSDMVCKPC

SEQ ID NO: 1217777 - protein, 9 aa, Homo Sapiens
SRPYMAHLQ

SEQ ID NO: 1217778 - protein, 9 aa, Homo Sapiens
DNYDRSMLR

SEQ ID NO: 1217779 - protein, 9 aa, Homo Sapiens
ISHDPKIES

SEQ ID NO: 1217780 - protein, 9 aa, Homo Sapiens
EEYDEEPIP

SEQ ID NO: 1217781 - protein, 9 aa, Homo Sapiens
LGNTGPRGR

SEQ ID NO: 1217782 - protein, 9 aa, Homo Sapiens
MLCQLLQRF

SEQ ID NO: 1217783 - protein, 9 aa, Homo Sapiens
ILMDTFEDL

SEQ ID NO: 1217784 - protein, 9 aa, Homo Sapiens
YDVTKEVPM

SEQ ID NO: 1217785 - protein, 9 aa, Homo Sapiens
DVVVASEVV

SEQ ID NO: 1217786 - protein, 9 aa, Homo Sapiens
YTPGDAPDY

SEQ ID NO: 1217787 - protein, 9 aa, Homo Sapiens
GCHSGEIFA

SEQ ID NO: 1217788 - protein, 9 aa, Homo Sapiens
APRSKWHWQ

SEQ ID NO: 1217789 - protein, 9 aa, Homo Sapiens
ECTWDCGGG

SEQ ID NO: 1217790 - protein, 9 aa, Homo Sapiens
KQNFSKSRH

SEQ ID NO: 1217791 - protein, 9 aa, Homo Sapiens
ILLSASGFS

SEQ ID NO: 1217792 - protein, 9 aa, Homo Sapiens
ANHGYFLIV

SEQ ID NO: 1217793 - protein, 9 aa, Homo Sapiens
TLLQAGLPL

SEQ ID NO: 1217794 - protein, 9 aa, Homo Sapiens
KKHFNSLYI

SEQ ID NO: 1217795 - protein, 9 aa, Homo Sapiens
SKPGTLECG

SEQ ID NO: 1217796 - protein, 9 aa, Homo Sapiens
YLARFEADL

SEQ ID NO: 1217797 - protein, 9 aa, Homo Sapiens
ELGSKHSLH

SEQ ID NO: 1217798 - protein, 9 aa, Homo Sapiens
APANQPRTE

SEQ ID NO: 1217799 - protein, 9 aa, Homo Sapiens
MKQSGEMVI

SEQ ID NO: 1217800 - protein, 9 aa, Homo Sapiens
TCYRPRTSL

SEQ ID NO: 1217801 - protein, 9 aa, Homo Sapiens
DRYHHHFPQ

SEQ ID NO: 1217802 - protein, 9 aa, Homo Sapiens
GPEADVGRA

SEQ ID NO: 1217803 - protein, 9 aa, Homo Sapiens
RRHVSFGGH

SEQ ID NO: 1217804 - protein, 9 aa, Homo Sapiens
RPLDTQQNP

SEQ ID NO: 1217805 - protein, 9 aa, Homo Sapiens
PSTSLTSEE

SEQ ID NO: 1217806 - protein, 9 aa, Homo Sapiens
LCKAPQDSS

SEQ ID NO: 1217807 - protein, 9 aa, Homo Sapiens
PQRGIPPSS

SEQ ID NO: 1217808 - protein, 9 aa, Homo Sapiens
CRDQRCVSS

SEQ ID NO: 1217809 - protein, 9 aa, Homo Sapiens
FLVEFLWSH

SEQ ID NO: 1217810 - protein, 9 aa, Homo Sapiens
EAGHGDPMP

SEQ ID NO: 1217811 - protein, 9 aa, Homo Sapiens
FDYEYTEMG

SEQ ID NO: 1217812 - protein, 9 aa, Homo Sapiens
FKNQPQATG

SEQ ID NO: 1217813 - protein, 9 aa, Homo Sapiens
AVVGITATL

SEQ ID NO: 1217814 - protein, 9 aa, Homo Sapiens
DLLRSSLIL

SEQ ID NO: 1217815 - protein, 9 aa, Homo Sapiens
NCGRSGNSP

SEQ ID NO: 1217816 - protein, 9 aa, Homo Sapiens
RMSAAYLPE

SEQ ID NO: 1217817 - protein, 9 aa, Homo Sapiens
RQKQGIVLK

SEQ ID NO: 1217818 - protein, 9 aa, Homo Sapiens
VFFHPLLIN

SEQ ID NO: 1217819 - protein, 9 aa, Homo Sapiens
LQAKIKAVQ

SEQ ID NO: 1217820 - protein, 9 aa, Homo Sapiens
SAHFLPLIY

SEQ ID NO: 1217821 - protein, 9 aa, Homo Sapiens
SRSTLVMDW

SEQ ID NO: 1217822 - protein, 9 aa, Homo Sapiens
ENSDETKAP

SEQ ID NO: 1217823 - protein, 9 aa, Homo Sapiens
VVASLAEAA

SEQ ID NO: 1217824 - protein, 9 aa, Homo Sapiens
GGSREDHHL

SEQ ID NO: 1217825 - protein, 9 aa, Homo Sapiens
MSRDEKNYY

SEQ ID NO: 1217826 - protein, 9 aa, Homo Sapiens
CPCFFLLTV

SEQ ID NO: 1217827 - protein, 9 aa, Homo Sapiens
SSWLCGPAT

SEQ ID NO: 1217828 - protein, 9 aa, Homo Sapiens
ATQSVLISL

SEQ ID NO: 1217829 - protein, 9 aa, Homo Sapiens
GVKTAMYFA

SEQ ID NO: 1217830 - protein, 9 aa, Homo Sapiens
KAVNMIFAV

SEQ ID NO: 1217831 - protein, 9 aa, Homo Sapiens
TFFYSCFYH

SEQ ID NO: 1217832 - protein, 9 aa, Homo Sapiens
HEDLEIGSH

SEQ ID NO: 1217833 - protein, 9 aa, Homo Sapiens
YKFNFSKII

SEQ ID NO: 1217834 - protein, 9 aa, Homo Sapiens
QKFFFGDVP

SEQ ID NO: 1217835 - protein, 9 aa, Homo Sapiens
ERESTLLKT

SEQ ID NO: 1217836 - protein, 9 aa, Homo Sapiens
HVRKNKMAS

SEQ ID NO: 1217837 - protein, 9 aa, Homo Sapiens
NPEYLRERS

SEQ ID NO: 1217838 - protein, 9 aa, Homo Sapiens
KQRKIAVSS

SEQ ID NO: 1217839 - protein, 9 aa, Homo Sapiens
ALQPQSKNA

SEQ ID NO: 1217840 - protein, 9 aa, Homo Sapiens
KIEGIPETK

SEQ ID NO: 1217841 - protein, 9 aa, Homo Sapiens
PSLSYHQHF

SEQ ID NO: 1217842 - protein, 9 aa, Homo Sapiens
CRADGTMRI

SEQ ID NO: 1217843 - protein, 9 aa, Homo Sapiens
QRRKTINFD

SEQ ID NO: 1217844 - protein, 9 aa, Homo Sapiens
ACKIIIADL

SEQ ID NO: 1217845 - protein, 9 aa, Homo Sapiens
KSIVGSKVM

SEQ ID NO: 1217846 - protein, 9 aa, Homo Sapiens
RLACGAIGI

SEQ ID NO: 1217847 - protein, 9 aa, Homo Sapiens
LGFLLLLLI

SEQ ID NO: 1217848 - protein, 9 aa, Homo Sapiens
DILFCDLAV

SEQ ID NO: 1217849 - protein, 9 aa, Homo Sapiens
PENVLIGRQ

SEQ ID NO: 1217850 - protein, 9 aa, Homo Sapiens
DDLVAVDLQ

SEQ ID NO: 1217851 - protein, 9 aa, Homo Sapiens
AVSTPLLPE

SEQ ID NO: 1217852 - protein, 9 aa, Homo Sapiens
LLGQVLEGN

SEQ ID NO: 1217853 - protein, 9 aa, Homo Sapiens
KNYGKCWEM

SEQ ID NO: 1217854 - protein, 9 aa, Homo Sapiens
HLITGATSP

SEQ ID NO: 1217855 - protein, 9 aa, Homo Sapiens
PDYYGYEEY

SEQ ID NO: 1217856 - protein, 9 aa, Homo Sapiens
GKSFPSTAQ

SEQ ID NO: 1217857 - protein, 9 aa, Homo Sapiens
FAVLKLNEQ

SEQ ID NO: 1217858 - protein, 9 aa, Homo Sapiens
HSSARYAIL

SEQ ID NO: 1217859 - protein, 9 aa, Homo Sapiens
AKDPSATPP

SEQ ID NO: 1217860 - protein, 9 aa, Homo Sapiens
LMDAYLLYT

SEQ ID NO: 1217861 - protein, 9 aa, Homo Sapiens
RVGSVLDKP

SEQ ID NO: 1217862 - protein, 9 aa, Homo Sapiens
CMRPVWTMI

SEQ ID NO: 1217863 - protein, 9 aa, Homo Sapiens
SWDYSMQRF

SEQ ID NO: 1217864 - protein, 9 aa, Homo Sapiens
KNKRRRMQV

SEQ ID NO: 1217865 - protein, 9 aa, Homo Sapiens
LQLLLLNLL

SEQ ID NO: 1217866 - protein, 9 aa, Homo Sapiens
DSGEFAPDS

SEQ ID NO: 1217867 - protein, 9 aa, Homo Sapiens
MFFYQRRHG

SEQ ID NO: 1217868 - protein, 9 aa, Homo Sapiens
DINDNHPTF

SEQ ID NO: 1217869 - protein, 9 aa, Homo Sapiens
PSIFLDADT

SEQ ID NO: 1217870 - protein, 9 aa, Homo Sapiens
QTFLLQDQE

SEQ ID NO: 1217871 - protein, 9 aa, Homo Sapiens
NLKKDDVCV

SEQ ID NO: 1217872 - protein, 9 aa, Homo Sapiens
IWDSPAFNN

SEQ ID NO: 1217873 - protein, 9 aa, Homo Sapiens
PLVQVVDER

SEQ ID NO: 1217874 - protein, 9 aa, Homo Sapiens
KFSGSLPIR

SEQ ID NO: 1217875 - protein, 9 aa, Homo Sapiens
VCENPKSRE

SEQ ID NO: 1217876 - protein, 9 aa, Homo Sapiens
RGILNSPVK

SEQ ID NO: 1217877 - protein, 9 aa, Homo Sapiens
EMICGHAPF

SEQ ID NO: 1217878 - protein, 9 aa, Homo Sapiens
PQPTLARED

SEQ ID NO: 1217879 - protein, 9 aa, Homo Sapiens
VSVSRVFQS

SEQ ID NO: 1217880 - protein, 9 aa, Homo Sapiens
LHFLQNTEG

SEQ ID NO: 1217881 - protein, 9 aa, Homo Sapiens
MCQDSMLHG

SEQ ID NO: 1217882 - protein, 9 aa, Homo Sapiens
LGVWGNLVM

SEQ ID NO: 1217883 - protein, 9 aa, Homo Sapiens
KAYFITKEV

SEQ ID NO: 1217884 - protein, 9 aa, Homo Sapiens
EADMTLIYI

SEQ ID NO: 1217885 - protein, 9 aa, Homo Sapiens
GFTCDCYMT

SEQ ID NO: 1217886 - protein, 9 aa, Homo Sapiens
SLKITFINA

SEQ ID NO: 1217887 - protein, 9 aa, Homo Sapiens
LNLASNWLQ

SEQ ID NO: 1217888 - protein, 9 aa, Homo Sapiens
PLHRACAHH

SEQ ID NO: 1217889 - protein, 9 aa, Homo Sapiens
HLPRLCGPT

SEQ ID NO: 1217890 - protein, 9 aa, Homo Sapiens
GQSCTLPER

SEQ ID NO: 1217891 - protein, 9 aa, Homo Sapiens
CDSEWKSSQ

SEQ ID NO: 1217892 - protein, 9 aa, Homo Sapiens
CVIAEGDLG

SEQ ID NO: 1217893 - protein, 9 aa, Homo Sapiens
TLSINTVKR

SEQ ID NO: 1217894 - protein, 9 aa, Homo Sapiens
AKASEESLH

SEQ ID NO: 1217895 - protein, 9 aa, Homo Sapiens
MRMSTCTIN

SEQ ID NO: 1217896 - protein, 9 aa, Homo Sapiens
SILSQKLGR

SEQ ID NO: 1217897 - protein, 9 aa, Homo Sapiens
SGPHYPPGS

SEQ ID NO: 1217898 - protein, 9 aa, Homo Sapiens
TWLDQYSDD

SEQ ID NO: 1217899 - protein, 9 aa, Homo Sapiens
SMIGQKIAL

SEQ ID NO: 1217900 - protein, 9 aa, Homo Sapiens
LLQNKNKKK

SEQ ID NO: 1217901 - protein, 9 aa, Homo Sapiens
GAYKVDEGD

SEQ ID NO: 1217902 - protein, 9 aa, Homo Sapiens
VMKTTTRNS

SEQ ID NO: 1217903 - protein, 9 aa, Homo Sapiens
RLMNHFMEE

SEQ ID NO: 1217904 - protein, 9 aa, Homo Sapiens
QKNTTVSHE

SEQ ID NO: 1217905 - protein, 9 aa, Homo Sapiens
TRQEWDLTK

SEQ ID NO: 1217906 - protein, 9 aa, Homo Sapiens
MHPCCTIKI

SEQ ID NO: 1217907 - protein, 9 aa, Homo Sapiens
GPGPTATAA

SEQ ID NO: 1217908 - protein, 9 aa, Homo Sapiens
WPLMLLPLP

SEQ ID NO: 1217909 - protein, 9 aa, Homo Sapiens
PFLPSVYLS

SEQ ID NO: 1217910 - protein, 9 aa, Homo Sapiens
DEFLKKFEN

SEQ ID NO: 1217911 - protein, 9 aa, Homo Sapiens
SANKAPGSK

SEQ ID NO: 1217912 - protein, 9 aa, Homo Sapiens
LNITIFFGA

SEQ ID NO: 1217913 - protein, 9 aa, Homo Sapiens
HDSLVIFGP

SEQ ID NO: 1217914 - protein, 9 aa, Homo Sapiens
TVWQLTIQY

SEQ ID NO: 1217915 - protein, 9 aa, Homo Sapiens
PNNPPSSDV

SEQ ID NO: 1217916 - protein, 9 aa, Homo Sapiens
SAVTTLSLR

SEQ ID NO: 1217917 - protein, 9 aa, Homo Sapiens
VVKKVVVSG

SEQ ID NO: 1217918 - protein, 9 aa, Homo Sapiens
FNPLDFEIF

SEQ ID NO: 1217919 - protein, 9 aa, Homo Sapiens
QSSIKQLVS

SEQ ID NO: 1217920 - protein, 9 aa, Homo Sapiens
SFDDVPMSP

SEQ ID NO: 1217921 - protein, 9 aa, Homo Sapiens
NPRGVVHRR

SEQ ID NO: 1217922 - protein, 9 aa, Homo Sapiens
TLLNPMKPV

SEQ ID NO: 1217923 - protein, 9 aa, Homo Sapiens
RCQCLKDIS

SEQ ID NO: 1217924 - protein, 9 aa, Homo Sapiens
DLAVCKKIA

SEQ ID NO: 1217925 - protein, 9 aa, Homo Sapiens
KQYGKAFTW

SEQ ID NO: 1217926 - protein, 9 aa, Homo Sapiens
PGTQLTNPP

SEQ ID NO: 1217927 - protein, 9 aa, Homo Sapiens
VTESENGSP

SEQ ID NO: 1217928 - protein, 9 aa, Homo Sapiens
WWKTNTHLP

SEQ ID NO: 1217929 - protein, 9 aa, Homo Sapiens
GLKSEKEVL

SEQ ID NO: 1217930 - protein, 9 aa, Homo Sapiens
PLVYTIKWH

SEQ ID NO: 1217931 - protein, 9 aa, Homo Sapiens
AYTQTHIQA

SEQ ID NO: 1217932 - protein, 9 aa, Homo Sapiens
LQPQRCSDN

SEQ ID NO: 1217933 - protein, 9 aa, Homo Sapiens
QMDFQREIQ

SEQ ID NO: 1217934 - protein, 9 aa, Homo Sapiens
AVLPEHVPQ

SEQ ID NO: 1217935 - protein, 9 aa, Homo Sapiens
NKNVTVVRN

SEQ ID NO: 1217936 - protein, 9 aa, Homo Sapiens
AVFSSRGQS

SEQ ID NO: 1217937 - protein, 9 aa, Homo Sapiens
LEPVSWSSI

SEQ ID NO: 1217938 - protein, 9 aa, Homo Sapiens
DLEVQVQSL

SEQ ID NO: 1217939 - protein, 9 aa, Homo Sapiens
HCLQVQNVL

SEQ ID NO: 1217940 - protein, 9 aa, Homo Sapiens
ITFTEEETT

SEQ ID NO: 1217941 - protein, 9 aa, Homo Sapiens
VSVSIMGTR

SEQ ID NO: 1217942 - protein, 9 aa, Homo Sapiens
LLCKAPQDS

SEQ ID NO: 1217943 - protein, 9 aa, Homo Sapiens
CTQAEFQTP

SEQ ID NO: 1217944 - protein, 9 aa, Homo Sapiens
PGKPPFLIQ

SEQ ID NO: 1217945 - protein, 9 aa, Homo Sapiens
TSYTSYHFG

SEQ ID NO: 1217946 - protein, 9 aa, Homo Sapiens
TPAVLPEHV

SEQ ID NO: 1217947 - protein, 9 aa, Homo Sapiens
NPTTTKRFE

SEQ ID NO: 1217948 - protein, 9 aa, Homo Sapiens
LVMEDDIPL

SEQ ID NO: 1217949 - protein, 9 aa, Homo Sapiens
TELNRDQVQ

SEQ ID NO: 1217950 - protein, 9 aa, Homo Sapiens
VFRIKHLPY

SEQ ID NO: 1217951 - protein, 9 aa, Homo Sapiens
VKKGEEGGR

SEQ ID NO: 1217952 - protein, 9 aa, Homo Sapiens
DENGSHLPA

SEQ ID NO: 1217953 - protein, 9 aa, Homo Sapiens
AEDELVEAD

SEQ ID NO: 1217954 - protein, 9 aa, Homo Sapiens
DQPHITKDV

SEQ ID NO: 1217955 - protein, 9 aa, Homo Sapiens
EPCIPPVPQ

SEQ ID NO: 1217956 - protein, 9 aa, Homo Sapiens
PYSAPNVPV

SEQ ID NO: 1217957 - protein, 9 aa, Homo Sapiens
PISTQNPDL

SEQ ID NO: 1217958 - protein, 9 aa, Homo Sapiens
GGFCGGNLR

SEQ ID NO: 1217959 - protein, 9 aa, Homo Sapiens
KTVYRDLKL

SEQ ID NO: 1217960 - protein, 9 aa, Homo Sapiens
AMDLYRLVE

SEQ ID NO: 1217961 - protein, 9 aa, Homo Sapiens
QLLTLVLEL

SEQ ID NO: 1217962 - protein, 9 aa, Homo Sapiens
LIPKDHQVL

SEQ ID NO: 1217963 - protein, 9 aa, Homo Sapiens
NETYRDDVR

SEQ ID NO: 1217964 - protein, 9 aa, Homo Sapiens
SAKHGEVLV

SEQ ID NO: 1217965 - protein, 9 aa, Homo Sapiens
RELDPLLCH

SEQ ID NO: 1217966 - protein, 9 aa, Homo Sapiens
PFRKMQEDE

SEQ ID NO: 1217967 - protein, 9 aa, Homo Sapiens
LRKKHRQRK

SEQ ID NO: 1217968 - protein, 9 aa, Homo Sapiens
ANAKALKNK

SEQ ID NO: 1217969 - protein, 9 aa, Homo Sapiens
WLERDTPDY

SEQ ID NO: 1217970 - protein, 9 aa, Homo Sapiens
RETKMLHLE

SEQ ID NO: 1217971 - protein, 9 aa, Homo Sapiens
HLQNLTELS

SEQ ID NO: 1217972 - protein, 9 aa, Homo Sapiens
LQTLCVAYA

SEQ ID NO: 1217973 - protein, 9 aa, Homo Sapiens
EEAVSLPDE

SEQ ID NO: 1217974 - protein, 9 aa, Homo Sapiens
EYVKVISET

SEQ ID NO: 1217975 - protein, 9 aa, Homo Sapiens
KYTVNAFEV

SEQ ID NO: 1217976 - protein, 9 aa, Homo Sapiens
AAERQAVNA

SEQ ID NO: 1217977 - protein, 9 aa, Homo Sapiens
CRHPRPQLS

SEQ ID NO: 1217978 - protein, 9 aa, Homo Sapiens
DPSIKSFHL

SEQ ID NO: 1217979 - protein, 9 aa, Homo Sapiens
TTFINGSAP

SEQ ID NO: 1217980 - protein, 9 aa, Homo Sapiens
PYMDGATPA

SEQ ID NO: 1217981 - protein, 9 aa, Homo Sapiens
FRKDREFIE

SEQ ID NO: 1217982 - protein, 9 aa, Homo Sapiens
CGAIKERRC

SEQ ID NO: 1217983 - protein, 9 aa, Homo Sapiens
QTESDWGKH

SEQ ID NO: 1217984 - protein, 9 aa, Homo Sapiens
ALLLTRGGP

SEQ ID NO: 1217985 - protein, 9 aa, Homo Sapiens
DAFTKTHHA

SEQ ID NO: 1217986 - protein, 9 aa, Homo Sapiens
AFGHEHYEN

SEQ ID NO: 1217987 - protein, 9 aa, Homo Sapiens
NNKIMTING

SEQ ID NO: 1217988 - protein, 9 aa, Homo Sapiens
RKDSEHYAQ

SEQ ID NO: 1217989 - protein, 9 aa, Homo Sapiens
SDVGLEIMT

SEQ ID NO: 1217990 - protein, 9 aa, Homo Sapiens
RQCKEGENC

SEQ ID NO: 1217991 - protein, 9 aa, Homo Sapiens
LKAVDVVLF

SEQ ID NO: 1217992 - protein, 9 aa, Homo Sapiens
GPIFPIIRF

SEQ ID NO: 1217993 - protein, 9 aa, Homo Sapiens
HNFLEGDWK

SEQ ID NO: 1217994 - protein, 9 aa, Homo Sapiens
ANLNEQAAH

SEQ ID NO: 1217995 - protein, 9 aa, Homo Sapiens
LTDDVPLSV

SEQ ID NO: 1217996 - protein, 9 aa, Homo Sapiens
RVAVCFLAV

SEQ ID NO: 1217997 - protein, 9 aa, Homo Sapiens
FDRDKYLKV

SEQ ID NO: 1217998 - protein, 9 aa, Homo Sapiens
LISQIGNDM

SEQ ID NO: 1217999 - protein, 9 aa, Homo Sapiens
KVLNDGGFH

SEQ ID NO: 1218000 - protein, 9 aa, Homo Sapiens
SQCGKATCS

SEQ ID NO: 1218001 - protein, 9 aa, Homo Sapiens
LSRTRQDLW

SEQ ID NO: 1218002 - protein, 9 aa, Homo Sapiens
NTKLLSTSA

SEQ ID NO: 1218003 - protein, 9 aa, Homo Sapiens
DFIFFVMPL

SEQ ID NO: 1218004 - protein, 9 aa, Homo Sapiens
PFIMDTPRD

SEQ ID NO: 1218005 - protein, 9 aa, Homo Sapiens
GYDEQWQPL

SEQ ID NO: 1218006 - protein, 9 aa, Homo Sapiens
ENVKAAIIE

SEQ ID NO: 1218007 - protein, 9 aa, Homo Sapiens
LLSAQKLTT

SEQ ID NO: 1218008 - protein, 9 aa, Homo Sapiens
ADVLARRGE

SEQ ID NO: 1218009 - protein, 9 aa, Homo Sapiens
RKYMDVNEC

SEQ ID NO: 1218010 - protein, 9 aa, Homo Sapiens
ETAKPKDIA

SEQ ID NO: 1218011 - protein, 9 aa, Homo Sapiens
VLSVETDYT

SEQ ID NO: 1218012 - protein, 9 aa, Homo Sapiens
ELIDKSEMP

SEQ ID NO: 1218013 - protein, 9 aa, Homo Sapiens
KKPVLPVSP

SEQ ID NO: 1218014 - protein, 9 aa, Homo Sapiens
MNEFEMEGF

SEQ ID NO: 1218015 - protein, 9 aa, Homo Sapiens
IECNRPQPV

SEQ ID NO: 1218016 - protein, 9 aa, Homo Sapiens
HCTCTLKGK

SEQ ID NO: 1218017 - protein, 9 aa, Homo Sapiens
SKAISHDSI

SEQ ID NO: 1218018 - protein, 9 aa, Homo Sapiens
STSASSLTL

SEQ ID NO: 1218019 - protein, 9 aa, Homo Sapiens
LIISSAIQN

SEQ ID NO: 1218020 - protein, 9 aa, Homo Sapiens
TFPLAVDMT

SEQ ID NO: 1218021 - protein, 9 aa, Homo Sapiens
NILDRNQTH

SEQ ID NO: 1218022 - protein, 9 aa, Homo Sapiens
ATCKGDKKL

SEQ ID NO: 1218023 - protein, 9 aa, Homo Sapiens
DREVHLCCE

SEQ ID NO: 1218024 - protein, 9 aa, Homo Sapiens
RCCRKCHSP

SEQ ID NO: 1218025 - protein, 9 aa, Homo Sapiens
RMLPTRPDL

SEQ ID NO: 1218026 - protein, 9 aa, Homo Sapiens
PAPPATLRF

SEQ ID NO: 1218027 - protein, 9 aa, Homo Sapiens
GMAFALMAS

SEQ ID NO: 1218028 - protein, 9 aa, Homo Sapiens
HKDSKTTAL

SEQ ID NO: 1218029 - protein, 9 aa, Homo Sapiens
LLSASGFSV

SEQ ID NO: 1218030 - protein, 9 aa, Homo Sapiens
GSNIEVWSY

SEQ ID NO: 1218031 - protein, 9 aa, Homo Sapiens
SILDCSIIC

SEQ ID NO: 1218032 - protein, 9 aa, Homo Sapiens
KSVDQYRKQ

SEQ ID NO: 1218033 - protein, 9 aa, Homo Sapiens
CDPCEQLLI

SEQ ID NO: 1218034 - protein, 9 aa, Homo Sapiens
RNIFRKLKV

SEQ ID NO: 1218035 - protein, 9 aa, Homo Sapiens
YIINVHIMS

SEQ ID NO: 1218036 - protein, 9 aa, Homo Sapiens
PGLQVRADV

SEQ ID NO: 1218037 - protein, 9 aa, Homo Sapiens
FRNLASEDI

SEQ ID NO: 1218038 - protein, 9 aa, Homo Sapiens
ETYMSVDDL

SEQ ID NO: 1218039 - protein, 9 aa, Homo Sapiens
RTHITLGCA

SEQ ID NO: 1218040 - protein, 9 aa, Homo Sapiens
YDALPDWLK

SEQ ID NO: 1218041 - protein, 9 aa, Homo Sapiens
LESGSNFTP

SEQ ID NO: 1218042 - protein, 9 aa, Homo Sapiens
HQSQKCKSE

SEQ ID NO: 1218043 - protein, 9 aa, Homo Sapiens
QPLQDSPKC

SEQ ID NO: 1218044 - protein, 9 aa, Homo Sapiens
VWVVPMQLR

SEQ ID NO: 1218045 - protein, 9 aa, Homo Sapiens
RAAEDELVE

SEQ ID NO: 1218046 - protein, 9 aa, Homo Sapiens
IILDSVGHV

SEQ ID NO: 1218047 - protein, 9 aa, Homo Sapiens
SRASQTMVK

SEQ ID NO: 1218048 - protein, 9 aa, Homo Sapiens
SGDQASSDV

SEQ ID NO: 1218049 - protein, 9 aa, Homo Sapiens
DQRPSTGKA

SEQ ID NO: 1218050 - protein, 9 aa, Homo Sapiens
VYAGVDVQS

SEQ ID NO: 1218051 - protein, 9 aa, Homo Sapiens
DHLGCAGSR

SEQ ID NO: 1218052 - protein, 9 aa, Homo Sapiens
LKKGTWRHR

SEQ ID NO: 1218053 - protein, 9 aa, Homo Sapiens
LDLVVFGQV

SEQ ID NO: 1218054 - protein, 9 aa, Homo Sapiens
TAVSSDDKY

SEQ ID NO: 1218055 - protein, 9 aa, Homo Sapiens
SKMTLIQPW

SEQ ID NO: 1218056 - protein, 9 aa, Homo Sapiens
CITSPSRQQ

SEQ ID NO: 1218057 - protein, 9 aa, Homo Sapiens
EWDLTKSLQ

SEQ ID NO: 1218058 - protein, 9 aa, Homo Sapiens
INVSWCFVC

SEQ ID NO: 1218059 - protein, 9 aa, Homo Sapiens
TLLVGKPHF

SEQ ID NO: 1218060 - protein, 9 aa, Homo Sapiens
FRRWNESPG

SEQ ID NO: 1218061 - protein, 9 aa, Homo Sapiens
HFYSKHLRF

SEQ ID NO: 1218062 - protein, 9 aa, Homo Sapiens
DPSGVVSIA

SEQ ID NO: 1218063 - protein, 9 aa, Homo Sapiens
MPDSILSPH

SEQ ID NO: 1218064 - protein, 9 aa, Homo Sapiens
PDQQMDFQR

SEQ ID NO: 1218065 - protein, 9 aa, Homo Sapiens
HKVEEKRRE

SEQ ID NO: 1218066 - protein, 9 aa, Homo Sapiens
ILIVGDTVH

SEQ ID NO: 1218067 - protein, 9 aa, Homo Sapiens
KSRHASIQL

SEQ ID NO: 1218068 - protein, 9 aa, Homo Sapiens
EKMVIVLDD

SEQ ID NO: 1218069 - protein, 9 aa, Homo Sapiens
TGEDIRSLN

SEQ ID NO: 1218070 - protein, 9 aa, Homo Sapiens
SLENASGKL

SEQ ID NO: 1218071 - protein, 9 aa, Homo Sapiens
GPVGPTGGP

SEQ ID NO: 1218072 - protein, 9 aa, Homo Sapiens
KEFGEPWEL

SEQ ID NO: 1218073 - protein, 9 aa, Homo Sapiens
ASGIRAPLC

SEQ ID NO: 1218074 - protein, 9 aa, Homo Sapiens
GVGGLWHWV

SEQ ID NO: 1218075 - protein, 9 aa, Homo Sapiens
QAVAHICRE

SEQ ID NO: 1218076 - protein, 9 aa, Homo Sapiens
ILLFYVTAL

SEQ ID NO: 1218077 - protein, 9 aa, Homo Sapiens
LERHQDLLC

SEQ ID NO: 1218078 - protein, 9 aa, Homo Sapiens
QVPDLKDLD

SEQ ID NO: 1218079 - protein, 9 aa, Homo Sapiens
QEHQGKAKR

SEQ ID NO: 1218080 - protein, 9 aa, Homo Sapiens
EEEHPPPPA

SEQ ID NO: 1218081 - protein, 9 aa, Homo Sapiens
KVPTSITEM

SEQ ID NO: 1218082 - protein, 9 aa, Homo Sapiens
VDGEPWMHP

SEQ ID NO: 1218083 - protein, 9 aa, Homo Sapiens
ETDIRAKKW

SEQ ID NO: 1218084 - protein, 9 aa, Homo Sapiens
TCYRETCPY

SEQ ID NO: 1218085 - protein, 9 aa, Homo Sapiens
QLQFRMEQL

SEQ ID NO: 1218086 - protein, 9 aa, Homo Sapiens
EACGTMECF

SEQ ID NO: 1218087 - protein, 9 aa, Homo Sapiens
KNAPQVSDG

SEQ ID NO: 1218088 - protein, 9 aa, Homo Sapiens
EELTGRLTQ

SEQ ID NO: 1218089 - protein, 9 aa, Homo Sapiens
RRTSQNLHN

SEQ ID NO: 1218090 - protein, 9 aa, Homo Sapiens
AGYYRLSGE

SEQ ID NO: 1218091 - protein, 9 aa, Homo Sapiens
RLNTCGRSW

SEQ ID NO: 1218092 - protein, 9 aa, Homo Sapiens
HWQVSLRVR

SEQ ID NO: 1218093 - protein, 9 aa, Homo Sapiens
LQSGSVAPG

SEQ ID NO: 1218094 - protein, 9 aa, Homo Sapiens
DDDTVLDLK

SEQ ID NO: 1218095 - protein, 9 aa, Homo Sapiens
LEVSLQNCI

SEQ ID NO: 1218096 - protein, 9 aa, Homo Sapiens
AEMCKQSVD

SEQ ID NO: 1218097 - protein, 9 aa, Homo Sapiens
LLCNPFHHS

SEQ ID NO: 1218098 - protein, 9 aa, Homo Sapiens
LSSVSAELL

SEQ ID NO: 1218099 - protein, 9 aa, Homo Sapiens
LLCQQWGCC

SEQ ID NO: 1218100 - protein, 9 aa, Homo Sapiens
IRGAAPTDI

SEQ ID NO: 1218101 - protein, 9 aa, Homo Sapiens
HPLLINGSG

SEQ ID NO: 1218102 - protein, 9 aa, Homo Sapiens
TLPACNGSE

SEQ ID NO: 1218103 - protein, 9 aa, Homo Sapiens
GFCSWSIIS

SEQ ID NO: 1218104 - protein, 9 aa, Homo Sapiens
TRAAGKCPA

SEQ ID NO: 1218105 - protein, 9 aa, Homo Sapiens
IGAYSYPMS

SEQ ID NO: 1218106 - protein, 9 aa, Homo Sapiens
PPRVHAYPE

SEQ ID NO: 1218107 - protein, 9 aa, Homo Sapiens
SGRTIGIVM

SEQ ID NO: 1218108 - protein, 9 aa, Homo Sapiens
HRKSLMIIL

SEQ ID NO: 1218109 - protein, 9 aa, Homo Sapiens
SPLVATGHL

SEQ ID NO: 1218110 - protein, 9 aa, Homo Sapiens
SGVCESSGR

SEQ ID NO: 1218111 - protein, 9 aa, Homo Sapiens
SAKPIPHSD

SEQ ID NO: 1218112 - protein, 9 aa, Homo Sapiens
LASLCSEQS

SEQ ID NO: 1218113 - protein, 9 aa, Homo Sapiens
SHQRQKAAS

SEQ ID NO: 1218114 - protein, 9 aa, Homo Sapiens
QEGTKMAVR

SEQ ID NO: 1218115 - protein, 9 aa, Homo Sapiens
LETTHQTSV

SEQ ID NO: 1218116 - protein, 9 aa, Homo Sapiens
QVCCMVEEV

SEQ ID NO: 1218117 - protein, 9 aa, Homo Sapiens
VVMLIAFTG

SEQ ID NO: 1218118 - protein, 9 aa, Homo Sapiens
SVYEELVNN

SEQ ID NO: 1218119 - protein, 9 aa, Homo Sapiens
WTLKAILQF

SEQ ID NO: 1218120 - protein, 9 aa, Homo Sapiens
SHGEDYAAH

SEQ ID NO: 1218121 - protein, 9 aa, Homo Sapiens
FEWYITKGG

SEQ ID NO: 1218122 - protein, 9 aa, Homo Sapiens
IFRHNQQKP

SEQ ID NO: 1218123 - protein, 9 aa, Homo Sapiens
SVTDTNKTK

SEQ ID NO: 1218124 - protein, 9 aa, Homo Sapiens
LHIKKTIQG

SEQ ID NO: 1218125 - protein, 9 aa, Homo Sapiens
LQIIFVSVL

SEQ ID NO: 1218126 - protein, 9 aa, Homo Sapiens
KPHFETSCL

SEQ ID NO: 1218127 - protein, 9 aa, Homo Sapiens
CSVGSVPGI

SEQ ID NO: 1218128 - protein, 9 aa, Homo Sapiens
EDLTPNPKN

SEQ ID NO: 1218129 - protein, 9 aa, Homo Sapiens
KGNFPEQAH

SEQ ID NO: 1218130 - protein, 9 aa, Homo Sapiens
EPSLVKISE

SEQ ID NO: 1218131 - protein, 9 aa, Homo Sapiens
EHERLNEIV

SEQ ID NO: 1218132 - protein, 9 aa, Homo Sapiens
RPLTSRIVG

SEQ ID NO: 1218133 - protein, 9 aa, Homo Sapiens
LREMWLDRN

SEQ ID NO: 1218134 - protein, 9 aa, Homo Sapiens
EGHGRATDI

SEQ ID NO: 1218135 - protein, 9 aa, Homo Sapiens
LKKHMCLHR

SEQ ID NO: 1218136 - protein, 9 aa, Homo Sapiens
DVKDISFLK

SEQ ID NO: 1218137 - protein, 9 aa, Homo Sapiens
SDGSWAGTG

SEQ ID NO: 1218138 - protein, 9 aa, Homo Sapiens
LYFFPRPTS

SEQ ID NO: 1218139 - protein, 9 aa, Homo Sapiens
IRAPLCPVR

SEQ ID NO: 1218140 - protein, 9 aa, Homo Sapiens
LAQLGVPEL

SEQ ID NO: 1218141 - protein, 9 aa, Homo Sapiens
ALATKDGTF

SEQ ID NO: 1218142 - protein, 9 aa, Homo Sapiens
FVTEGNCSN

SEQ ID NO: 1218143 - protein, 9 aa, Homo Sapiens
RSYETIAKH

SEQ ID NO: 1218144 - protein, 9 aa, Homo Sapiens
YSDIVQNGR

SEQ ID NO: 1218145 - protein, 9 aa, Homo Sapiens
LNRQKIHSL

SEQ ID NO: 1218146 - protein, 9 aa, Homo Sapiens
PQELFEASN

SEQ ID NO: 1218147 - protein, 9 aa, Homo Sapiens
NDVVTLLAE

SEQ ID NO: 1218148 - protein, 9 aa, Homo Sapiens
NVIDLPVEN

SEQ ID NO: 1218149 - protein, 9 aa, Homo Sapiens
TQLQCLLNQ

SEQ ID NO: 1218150 - protein, 9 aa, Homo Sapiens
TWQTATFRQ

SEQ ID NO: 1218151 - protein, 9 aa, Homo Sapiens
CYLWDVQST

SEQ ID NO: 1218152 - protein, 9 aa, Homo Sapiens
VSEGKKQGK

SEQ ID NO: 1218153 - protein, 9 aa, Homo Sapiens
VPTSITEME

SEQ ID NO: 1218154 - protein, 9 aa, Homo Sapiens
EYNPKQFAA

SEQ ID NO: 1218155 - protein, 9 aa, Homo Sapiens
TELFQHHEH

SEQ ID NO: 1218156 - protein, 9 aa, Homo Sapiens
QILHECLKE

SEQ ID NO: 1218157 - protein, 9 aa, Homo Sapiens
YLMKRENQK

SEQ ID NO: 1218158 - protein, 9 aa, Homo Sapiens
TTGKVVCVF

SEQ ID NO: 1218159 - protein, 9 aa, Homo Sapiens
WLQLLNRWD

SEQ ID NO: 1218160 - protein, 9 aa, Homo Sapiens
KKLKKVGDL

SEQ ID NO: 1218161 - protein, 9 aa, Homo Sapiens
EQWLRVVTT

SEQ ID NO: 1218162 - protein, 9 aa, Homo Sapiens
PVTQCPSVI

SEQ ID NO: 1218163 - protein, 9 aa, Homo Sapiens
ISHDSIFML

SEQ ID NO: 1218164 - protein, 9 aa, Homo Sapiens
ELIELFLSF

SEQ ID NO: 1218165 - protein, 9 aa, Homo Sapiens
CPLDLRPPV

SEQ ID NO: 1218166 - protein, 9 aa, Homo Sapiens
HVSLQHLDG

SEQ ID NO: 1218167 - protein, 9 aa, Homo Sapiens
AQAMRMCAA

SEQ ID NO: 1218168 - protein, 9 aa, Homo Sapiens
DEKAGGTNL

SEQ ID NO: 1218169 - protein, 9 aa, Homo Sapiens
ACVEKHLLG

SEQ ID NO: 1218170 - protein, 9 aa, Homo Sapiens
ISKAHDKSP

SEQ ID NO: 1218171 - protein, 9 aa, Homo Sapiens
SQVDSITNI

SEQ ID NO: 1218172 - protein, 9 aa, Homo Sapiens
RLVELLQSI

SEQ ID NO: 1218173 - protein, 9 aa, Homo Sapiens
FISNAGAGD

SEQ ID NO: 1218174 - protein, 9 aa, Homo Sapiens
PDMIVTTHF

SEQ ID NO: 1218175 - protein, 9 aa, Homo Sapiens
ILDWIPYIN

SEQ ID NO: 1218176 - protein, 9 aa, Homo Sapiens
SRAFSRRCP

SEQ ID NO: 1218177 - protein, 9 aa, Homo Sapiens
NLTSWPHWL

SEQ ID NO: 1218178 - protein, 9 aa, Homo Sapiens
WEVRIVAQR

SEQ ID NO: 1218179 - protein, 9 aa, Homo Sapiens
WEFRPRVSC

SEQ ID NO: 1218180 - protein, 9 aa, Homo Sapiens
RPAQVKLLN

SEQ ID NO: 1218181 - protein, 9 aa, Homo Sapiens
PYSTGHLCE

SEQ ID NO: 1218182 - protein, 9 aa, Homo Sapiens
KIKLAMKIG

SEQ ID NO: 1218183 - protein, 9 aa, Homo Sapiens
IFMTDAARR

SEQ ID NO: 1218184 - protein, 9 aa, Homo Sapiens
RELHQHEGF

SEQ ID NO: 1218185 - protein, 9 aa, Homo Sapiens
KPIAHRHSL

SEQ ID NO: 1218186 - protein, 9 aa, Homo Sapiens
QLARHEWAQ

SEQ ID NO: 1218187 - protein, 9 aa, Homo Sapiens
YEELPEQET

SEQ ID NO: 1218188 - protein, 9 aa, Homo Sapiens
TICGTPEFL

SEQ ID NO: 1218189 - protein, 9 aa, Homo Sapiens
EHVLFQSSL

SEQ ID NO: 1218190 - protein, 9 aa, Homo Sapiens
MTLRLRESA

SEQ ID NO: 1218191 - protein, 9 aa, Homo Sapiens
GIIRTLQKR

SEQ ID NO: 1218192 - protein, 9 aa, Homo Sapiens
MSMHVERST

SEQ ID NO: 1218193 - protein, 9 aa, Homo Sapiens
GNGLDQKAG

SEQ ID NO: 1218194 - protein, 9 aa, Homo Sapiens
TIGNSQRMN

SEQ ID NO: 1218195 - protein, 9 aa, Homo Sapiens
KPRSTRCCW

SEQ ID NO: 1218196 - protein, 9 aa, Homo Sapiens
TKAKLIPTC

SEQ ID NO: 1218197 - protein, 9 aa, Homo Sapiens
TVGVTTTQF

SEQ ID NO: 1218198 - protein, 9 aa, Homo Sapiens
ARWSTSFCL

SEQ ID NO: 1218199 - protein, 9 aa, Homo Sapiens
TAEYSRLLD

SEQ ID NO: 1218200 - protein, 9 aa, Homo Sapiens
QMTIQAQPQ

SEQ ID NO: 1218201 - protein, 9 aa, Homo Sapiens
LNADKFSGL

SEQ ID NO: 1218202 - protein, 9 aa, Homo Sapiens
AEYSRLLDV

SEQ ID NO: 1218203 - protein, 9 aa, Homo Sapiens
ARESADQED

SEQ ID NO: 1218204 - protein, 9 aa, Homo Sapiens
VTDTNKTKG

SEQ ID NO: 1218205 - protein, 9 aa, Homo Sapiens
ESSTLLHHR

SEQ ID NO: 1218206 - protein, 9 aa, Homo Sapiens
ITYGVSAFF

SEQ ID NO: 1218207 - protein, 9 aa, Homo Sapiens
EEGTELQVI

SEQ ID NO: 1218208 - protein, 9 aa, Homo Sapiens
ELQAKYKNT

SEQ ID NO: 1218209 - protein, 9 aa, Homo Sapiens
DTRIKLIYN

SEQ ID NO: 1218210 - protein, 9 aa, Homo Sapiens
SPPACPRPS

SEQ ID NO: 1218211 - protein, 9 aa, Homo Sapiens
LLIFTSVTY

SEQ ID NO: 1218212 - protein, 9 aa, Homo Sapiens
IFDMDYASW

SEQ ID NO: 1218213 - protein, 9 aa, Homo Sapiens
RRFIQSCPT

SEQ ID NO: 1218214 - protein, 9 aa, Homo Sapiens
TLKTLMNAI

SEQ ID NO: 1218215 - protein, 9 aa, Homo Sapiens
TMLVGWYPF

SEQ ID NO: 1218216 - protein, 9 aa, Homo Sapiens
IIVGNLKAL

SEQ ID NO: 1218217 - protein, 9 aa, Homo Sapiens
WTVNGHPNE

SEQ ID NO: 1218218 - protein, 9 aa, Homo Sapiens
LNTCGRSWR

SEQ ID NO: 1218219 - protein, 9 aa, Homo Sapiens
CKAGLHAVA

SEQ ID NO: 1218220 - protein, 9 aa, Homo Sapiens
KDWGWVEQL

SEQ ID NO: 1218221 - protein, 9 aa, Homo Sapiens
ASPTLVKRK

SEQ ID NO: 1218222 - protein, 9 aa, Homo Sapiens
FRELKVLCF

SEQ ID NO: 1218223 - protein, 9 aa, Homo Sapiens
EKPYERSEC

SEQ ID NO: 1218224 - protein, 9 aa, Homo Sapiens
CICQKFAVM

SEQ ID NO: 1218225 - protein, 9 aa, Homo Sapiens
TLWNSAAGL

SEQ ID NO: 1218226 - protein, 9 aa, Homo Sapiens
VQCGNRPYK

SEQ ID NO: 1218227 - protein, 9 aa, Homo Sapiens
RDSISKLKT

SEQ ID NO: 1218228 - protein, 9 aa, Homo Sapiens
HARESEMCT

SEQ ID NO: 1218229 - protein, 9 aa, Homo Sapiens
EDTRIKLIY

SEQ ID NO: 1218230 - protein, 9 aa, Homo Sapiens
KIAMTMDQY

SEQ ID NO: 1218231 - protein, 9 aa, Homo Sapiens
IHAEHVHTT

SEQ ID NO: 1218232 - protein, 9 aa, Homo Sapiens
CALSITDIL

SEQ ID NO: 1218233 - protein, 9 aa, Homo Sapiens
SLTMSSAWP

SEQ ID NO: 1218234 - protein, 9 aa, Homo Sapiens
GLEIMTVVI

SEQ ID NO: 1218235 - protein, 9 aa, Homo Sapiens
HTFCVEHNT

SEQ ID NO: 1218236 - protein, 9 aa, Homo Sapiens
LEGMGLSDT

SEQ ID NO: 1218237 - protein, 9 aa, Homo Sapiens
KLRLSFSTK

SEQ ID NO: 1218238 - protein, 9 aa, Homo Sapiens
SFGSSGGSD

SEQ ID NO: 1218239 - protein, 9 aa, Homo Sapiens
CHLVHLFYF

SEQ ID NO: 1218240 - protein, 9 aa, Homo Sapiens
SENGSPEYR

SEQ ID NO: 1218241 - protein, 9 aa, Homo Sapiens
NYLLTAEWM

SEQ ID NO: 1218242 - protein, 9 aa, Homo Sapiens
SRRIPALSP

SEQ ID NO: 1218243 - protein, 9 aa, Homo Sapiens
TQNALRRVI

SEQ ID NO: 1218244 - protein, 9 aa, Homo Sapiens
LRSLTDDVP

SEQ ID NO: 1218245 - protein, 9 aa, Homo Sapiens
VSSWVTWMI

SEQ ID NO: 1218246 - protein, 9 aa, Homo Sapiens
DTETKDLLV

SEQ ID NO: 1218247 - protein, 9 aa, Homo Sapiens
LEETSLVPE

SEQ ID NO: 1218248 - protein, 9 aa, Homo Sapiens
QPQQQQIDP

SEQ ID NO: 1218249 - protein, 9 aa, Homo Sapiens
RLSVTPLCG

SEQ ID NO: 1218250 - protein, 9 aa, Homo Sapiens
RHQRTHEPP

SEQ ID NO: 1218251 - protein, 9 aa, Homo Sapiens
IPIPQSVAS

SEQ ID NO: 1218252 - protein, 9 aa, Homo Sapiens
HSREHKRRR

SEQ ID NO: 1218253 - protein, 9 aa, Homo Sapiens
DQGRHPVRV

SEQ ID NO: 1218254 - protein, 9 aa, Homo Sapiens
FSVSTLHNL

SEQ ID NO: 1218255 - protein, 9 aa, Homo Sapiens
TVSEKTIWQ

SEQ ID NO: 1218256 - protein, 9 aa, Homo Sapiens
DLKPENIIL

SEQ ID NO: 1218257 - protein, 9 aa, Homo Sapiens
AQDMQREWR

SEQ ID NO: 1218258 - protein, 9 aa, Homo Sapiens
EMKIWLSVK

SEQ ID NO: 1218259 - protein, 9 aa, Homo Sapiens
AEAGRKQLA

SEQ ID NO: 1218260 - protein, 9 aa, Homo Sapiens
VDTRESDKM

SEQ ID NO: 1218261 - protein, 9 aa, Homo Sapiens
PCCLYWCCC

SEQ ID NO: 1218262 - protein, 9 aa, Homo Sapiens
EGLMKSVDS

SEQ ID NO: 1218263 - protein, 9 aa, Homo Sapiens
EATLVYSNS

SEQ ID NO: 1218264 - protein, 9 aa, Homo Sapiens
DILTLLGLG

SEQ ID NO: 1218265 - protein, 9 aa, Homo Sapiens
KTHTPCVPN

SEQ ID NO: 1218266 - protein, 9 aa, Homo Sapiens
ILKTHKQRI

SEQ ID NO: 1218267 - protein, 9 aa, Homo Sapiens
EKGISEQTV

SEQ ID NO: 1218268 - protein, 9 aa, Homo Sapiens
SYHFGTGTP

SEQ ID NO: 1218269 - protein, 9 aa, Homo Sapiens
PNPALNEFQ

SEQ ID NO: 1218270 - protein, 9 aa, Homo Sapiens
HVSPELLTE

SEQ ID NO: 1218271 - protein, 9 aa, Homo Sapiens
PENTAESRP

SEQ ID NO: 1218272 - protein, 9 aa, Homo Sapiens
NTSMWLAGH

SEQ ID NO: 1218273 - protein, 9 aa, Homo Sapiens
DPTCSDAYH

SEQ ID NO: 1218274 - protein, 9 aa, Homo Sapiens
LKYTLELQK

SEQ ID NO: 1218275 - protein, 9 aa, Homo Sapiens
GFFIFVLFF

SEQ ID NO: 1218276 - protein, 9 aa, Homo Sapiens
FMVFFFTFM

SEQ ID NO: 1218277 - protein, 9 aa, Homo Sapiens
QASRTMIEN

SEQ ID NO: 1218278 - protein, 9 aa, Homo Sapiens
EEKRHRMRS

SEQ ID NO: 1218279 - protein, 9 aa, Homo Sapiens
NRNIQIDNN

SEQ ID NO: 1218280 - protein, 9 aa, Homo Sapiens
AEDVTNEKQ

SEQ ID NO: 1218281 - protein, 9 aa, Homo Sapiens
TLTQRYRKS

SEQ ID NO: 1218282 - protein, 9 aa, Homo Sapiens
RCGGNLLHF

SEQ ID NO: 1218283 - protein, 9 aa, Homo Sapiens
YVNHSLSIF

SEQ ID NO: 1218284 - protein, 9 aa, Homo Sapiens
AMETFAMGI

SEQ ID NO: 1218285 - protein, 9 aa, Homo Sapiens
ECVILAVMA

SEQ ID NO: 1218286 - protein, 9 aa, Homo Sapiens
MTTERWLVI

SEQ ID NO: 1218287 - protein, 9 aa, Homo Sapiens
NTPSGPVSV

SEQ ID NO: 1218288 - protein, 9 aa, Homo Sapiens
LEDCVEPVV

SEQ ID NO: 1218289 - protein, 9 aa, Homo Sapiens
RCLILDISA

SEQ ID NO: 1218290 - protein, 9 aa, Homo Sapiens
LAEKMVIVL

SEQ ID NO: 1218291 - protein, 9 aa, Homo Sapiens
CLNDDGGRC

SEQ ID NO: 1218292 - protein, 9 aa, Homo Sapiens
RDRGLFYYH

SEQ ID NO: 1218293 - protein, 9 aa, Homo Sapiens
TIPPEIFQE

SEQ ID NO: 1218294 - protein, 9 aa, Homo Sapiens
RLDFKHLDR

SEQ ID NO: 1218295 - protein, 9 aa, Homo Sapiens
PPKLIMLPS

SEQ ID NO: 1218296 - protein, 9 aa, Homo Sapiens
MSGYHRAEV

SEQ ID NO: 1218297 - protein, 9 aa, Homo Sapiens
MFRIHVEFQ

SEQ ID NO: 1218298 - protein, 9 aa, Homo Sapiens
PDYMDKKNC

SEQ ID NO: 1218299 - protein, 9 aa, Homo Sapiens
GKTTLTRKM

SEQ ID NO: 1218300 - protein, 9 aa, Homo Sapiens
KEGHRRPPL

SEQ ID NO: 1218301 - protein, 9 aa, Homo Sapiens
IVAVAPGAF

SEQ ID NO: 1218302 - protein, 9 aa, Homo Sapiens
EAQELLKNK

SEQ ID NO: 1218303 - protein, 9 aa, Homo Sapiens
KCHLYNRCF

SEQ ID NO: 1218304 - protein, 9 aa, Homo Sapiens
EMKEDQGEE

SEQ ID NO: 1218305 - protein, 9 aa, Homo Sapiens
KAWTSQYFG

SEQ ID NO: 1218306 - protein, 9 aa, Homo Sapiens
LQDSPKCFD

SEQ ID NO: 1218307 - protein, 9 aa, Homo Sapiens
FSDDIEHTM

SEQ ID NO: 1218308 - protein, 9 aa, Homo Sapiens
NPVSSGHLE

SEQ ID NO: 1218309 - protein, 9 aa, Homo Sapiens
DNDFIYHDQ

SEQ ID NO: 1218310 - protein, 9 aa, Homo Sapiens
TGTVIMLCK

SEQ ID NO: 1218311 - protein, 9 aa, Homo Sapiens
SHFIGEGMT

SEQ ID NO: 1218312 - protein, 9 aa, Homo Sapiens
IDDEEIERW

SEQ ID NO: 1218313 - protein, 9 aa, Homo Sapiens
LTHLRDLRH

SEQ ID NO: 1218314 - protein, 9 aa, Homo Sapiens
LALRCGTVR

SEQ ID NO: 1218315 - protein, 9 aa, Homo Sapiens
NGLGNTGPR

SEQ ID NO: 1218316 - protein, 9 aa, Homo Sapiens
DLTIRIGAM

SEQ ID NO: 1218317 - protein, 9 aa, Homo Sapiens
LAMKIGGVS

SEQ ID NO: 1218318 - protein, 9 aa, Homo Sapiens
PKLTMEVYF

SEQ ID NO: 1218319 - protein, 9 aa, Homo Sapiens
VVSIACSSC

SEQ ID NO: 1218320 - protein, 9 aa, Homo Sapiens
YEFCDVRCT

SEQ ID NO: 1218321 - protein, 9 aa, Homo Sapiens
SCRLEQGQQ

SEQ ID NO: 1218322 - protein, 9 aa, Homo Sapiens
TIISALNAI

SEQ ID NO: 1218323 - protein, 9 aa, Homo Sapiens
TQAYTQTHI

SEQ ID NO: 1218324 - protein, 9 aa, Homo Sapiens
GMTKLCSAF

SEQ ID NO: 1218325 - protein, 9 aa, Homo Sapiens
FLKTLNEQH

SEQ ID NO: 1218326 - protein, 9 aa, Homo Sapiens
VLECDTLGI

SEQ ID NO: 1218327 - protein, 9 aa, Homo Sapiens
HLSSSTVAI

SEQ ID NO: 1218328 - protein, 9 aa, Homo Sapiens
FLVLLSMTV

SEQ ID NO: 1218329 - protein, 9 aa, Homo Sapiens
SPAPLRHAD

SEQ ID NO: 1218330 - protein, 9 aa, Homo Sapiens
NITLDNRVA

SEQ ID NO: 1218331 - protein, 9 aa, Homo Sapiens
AFQTAYLSM

SEQ ID NO: 1218332 - protein, 9 aa, Homo Sapiens
LTVKFYWIL

SEQ ID NO: 1218333 - protein, 9 aa, Homo Sapiens
PKPLPSPKH

SEQ ID NO: 1218334 - protein, 9 aa, Homo Sapiens
GHPATKLSP

SEQ ID NO: 1218335 - protein, 9 aa, Homo Sapiens
LGYAINKYD

SEQ ID NO: 1218336 - protein, 9 aa, Homo Sapiens
LLDDHNDVV

SEQ ID NO: 1218337 - protein, 9 aa, Homo Sapiens
LLWGWRPYE

SEQ ID NO: 1218338 - protein, 9 aa, Homo Sapiens
VYTPVDSLM

SEQ ID NO: 1218339 - protein, 9 aa, Homo Sapiens
NALNRILLS

SEQ ID NO: 1218340 - protein, 9 aa, Homo Sapiens
CSSISPGTP

SEQ ID NO: 1218341 - protein, 9 aa, Homo Sapiens
KHLDRPVVG

SEQ ID NO: 1218342 - protein, 9 aa, Homo Sapiens
CFILSFFAI

SEQ ID NO: 1218343 - protein, 9 aa, Homo Sapiens
SKAERRSTA

SEQ ID NO: 1218344 - protein, 9 aa, Homo Sapiens
EEKIPDPLD

SEQ ID NO: 1218345 - protein, 9 aa, Homo Sapiens
TDSACLLNT

SEQ ID NO: 1218346 - protein, 9 aa, Homo Sapiens
DAKTYCFMV

SEQ ID NO: 1218347 - protein, 9 aa, Homo Sapiens
IKKRKKIHQ

SEQ ID NO: 1218348 - protein, 9 aa, Homo Sapiens
SATRSTRAE

SEQ ID NO: 1218349 - protein, 9 aa, Homo Sapiens
RHTENRRGA

SEQ ID NO: 1218350 - protein, 9 aa, Homo Sapiens
LFKASEPGI

SEQ ID NO: 1218351 - protein, 9 aa, Homo Sapiens
YFNIVTLQL

SEQ ID NO: 1218352 - protein, 9 aa, Homo Sapiens
SAEYCTDSF

SEQ ID NO: 1218353 - protein, 9 aa, Homo Sapiens
LPLAPQPLL

SEQ ID NO: 1218354 - protein, 9 aa, Homo Sapiens
NRATLSITC

SEQ ID NO: 1218355 - protein, 9 aa, Homo Sapiens
CKGTYLRVL

SEQ ID NO: 1218356 - protein, 9 aa, Homo Sapiens
LDWIPYING

SEQ ID NO: 1218357 - protein, 9 aa, Homo Sapiens
KYRQVAFHV

SEQ ID NO: 1218358 - protein, 9 aa, Homo Sapiens
QEWYKKCLT

SEQ ID NO: 1218359 - protein, 9 aa, Homo Sapiens
SPKLNVDVK

SEQ ID NO: 1218360 - protein, 9 aa, Homo Sapiens
QMKRPLDTQ

SEQ ID NO: 1218361 - protein, 9 aa, Homo Sapiens
SRRLHLEPL

SEQ ID NO: 1218362 - protein, 9 aa, Homo Sapiens
LLAGWRGPR

SEQ ID NO: 1218363 - protein, 9 aa, Homo Sapiens
ECVEFLRPS

SEQ ID NO: 1218364 - protein, 9 aa, Homo Sapiens
KCIEVRVVR

SEQ ID NO: 1218365 - protein, 9 aa, Homo Sapiens
KTDRVKKTA

SEQ ID NO: 1218366 - protein, 9 aa, Homo Sapiens
CAPEDVTSP

SEQ ID NO: 1218367 - protein, 9 aa, Homo Sapiens
LRGTMRRHY

SEQ ID NO: 1218368 - protein, 9 aa, Homo Sapiens
IDVPVGHSL

SEQ ID NO: 1218369 - protein, 9 aa, Homo Sapiens
AFLEYRRQV

SEQ ID NO: 1218370 - protein, 9 aa, Homo Sapiens
NDLHQEECK

SEQ ID NO: 1218371 - protein, 9 aa, Homo Sapiens
KNEADMTLI

SEQ ID NO: 1218372 - protein, 9 aa, Homo Sapiens
PLDKWQVLH

SEQ ID NO: 1218373 - protein, 9 aa, Homo Sapiens
MLVWSQMAV

SEQ ID NO: 1218374 - protein, 9 aa, Homo Sapiens
ESGLKYVAA

SEQ ID NO: 1218375 - protein, 9 aa, Homo Sapiens
CGEQDRQGP

SEQ ID NO: 1218376 - protein, 9 aa, Homo Sapiens
ELVGKPVFV

SEQ ID NO: 1218377 - protein, 9 aa, Homo Sapiens
PKIESSTFQ

SEQ ID NO: 1218378 - protein, 9 aa, Homo Sapiens
MKSPGKERH

SEQ ID NO: 1218379 - protein, 9 aa, Homo Sapiens
ASSEVVSYA

SEQ ID NO: 1218380 - protein, 9 aa, Homo Sapiens
LGDQRRPPV

SEQ ID NO: 1218381 - protein, 9 aa, Homo Sapiens
TGWFTMVIT

SEQ ID NO: 1218382 - protein, 9 aa, Homo Sapiens
RLFENYQMQ

SEQ ID NO: 1218383 - protein, 9 aa, Homo Sapiens
MCDPGMTSF

SEQ ID NO: 1218384 - protein, 9 aa, Homo Sapiens
SGRLAKNLN

SEQ ID NO: 1218385 - protein, 9 aa, Homo Sapiens
VANCLGDQT

SEQ ID NO: 1218386 - protein, 9 aa, Homo Sapiens
HTHFESKTE

SEQ ID NO: 1218387 - protein, 9 aa, Homo Sapiens
HKNRPDLID

SEQ ID NO: 1218388 - protein, 9 aa, Homo Sapiens
SGSQEDARK

SEQ ID NO: 1218389 - protein, 9 aa, Homo Sapiens
LGRSLGLLM

SEQ ID NO: 1218390 - protein, 9 aa, Homo Sapiens
EIFNFLYLH

SEQ ID NO: 1218391 - protein, 9 aa, Homo Sapiens
HVLTFLDVL

SEQ ID NO: 1218392 - protein, 9 aa, Homo Sapiens
VYKVKYPIV

SEQ ID NO: 1218393 - protein, 9 aa, Homo Sapiens
PQVQTQPEN

SEQ ID NO: 1218394 - protein, 9 aa, Homo Sapiens
ESVSDIVPP

SEQ ID NO: 1218395 - protein, 9 aa, Homo Sapiens
QAVPGFIGP

SEQ ID NO: 1218396 - protein, 9 aa, Homo Sapiens
HSCALQERA

SEQ ID NO: 1218397 - protein, 9 aa, Homo Sapiens
IHRRYVAHS

SEQ ID NO: 1218398 - protein, 9 aa, Homo Sapiens
FIPVACLIF

SEQ ID NO: 1218399 - protein, 9 aa, Homo Sapiens
QNIKDAKDF

SEQ ID NO: 1218400 - protein, 9 aa, Homo Sapiens
GYLVSRFAG

SEQ ID NO: 1218401 - protein, 9 aa, Homo Sapiens
KQDAEDDGE

SEQ ID NO: 1218402 - protein, 9 aa, Homo Sapiens
CLPSQHKML

SEQ ID NO: 1218403 - protein, 9 aa, Homo Sapiens
LFTPVPAMT

SEQ ID NO: 1218404 - protein, 9 aa, Homo Sapiens
QRGSPHLLC

SEQ ID NO: 1218405 - protein, 9 aa, Homo Sapiens
ALEVLRCIA

SEQ ID NO: 1218406 - protein, 9 aa, Homo Sapiens
LIDAIKHFL

SEQ ID NO: 1218407 - protein, 9 aa, Homo Sapiens
WLTSTRPLI

SEQ ID NO: 1218408 - protein, 9 aa, Homo Sapiens
KHSREHKRR

SEQ ID NO: 1218409 - protein, 9 aa, Homo Sapiens
LEELRNLRL

SEQ ID NO: 1218410 - protein, 9 aa, Homo Sapiens
PRLPGADVG

SEQ ID NO: 1218411 - protein, 9 aa, Homo Sapiens
LMDMAFDRY

SEQ ID NO: 1218412 - protein, 9 aa, Homo Sapiens
AQCLALRVV

SEQ ID NO: 1218413 - protein, 9 aa, Homo Sapiens
GAEANIKAK

SEQ ID NO: 1218414 - protein, 9 aa, Homo Sapiens
HSHRGAGVL

SEQ ID NO: 1218415 - protein, 9 aa, Homo Sapiens
LTDANQGRR

SEQ ID NO: 1218416 - protein, 9 aa, Homo Sapiens
MPTTQETDS

SEQ ID NO: 1218417 - protein, 9 aa, Homo Sapiens
DAVPVRRWK

SEQ ID NO: 1218418 - protein, 9 aa, Homo Sapiens
SCMHWMKVT

SEQ ID NO: 1218419 - protein, 9 aa, Homo Sapiens
LHRACAHHD

SEQ ID NO: 1218420 - protein, 9 aa, Homo Sapiens
VEDEDEDEQ

SEQ ID NO: 1218421 - protein, 9 aa, Homo Sapiens
VSGLHGSDA

SEQ ID NO: 1218422 - protein, 9 aa, Homo Sapiens
QMGKKCDGQ

SEQ ID NO: 1218423 - protein, 9 aa, Homo Sapiens
QGAADSAPC

SEQ ID NO: 1218424 - protein, 9 aa, Homo Sapiens
VRSRTPQKR

SEQ ID NO: 1218425 - protein, 9 aa, Homo Sapiens
GPNGYGSHL

SEQ ID NO: 1218426 - protein, 9 aa, Homo Sapiens
DDHSFGRDR

SEQ ID NO: 1218427 - protein, 9 aa, Homo Sapiens
LHYFRNRHP

SEQ ID NO: 1218428 - protein, 9 aa, Homo Sapiens
HHMAHRSQK

SEQ ID NO: 1218429 - protein, 9 aa, Homo Sapiens
YKPMEQFIL

SEQ ID NO: 1218430 - protein, 9 aa, Homo Sapiens
RMTKGFTTL

SEQ ID NO: 1218431 - protein, 9 aa, Homo Sapiens
MAIVKAMGT

SEQ ID NO: 1218432 - protein, 9 aa, Homo Sapiens
FPETLLGYP

SEQ ID NO: 1218433 - protein, 9 aa, Homo Sapiens
AMGTLQIDF

SEQ ID NO: 1218434 - protein, 9 aa, Homo Sapiens
QIFIHRDII

SEQ ID NO: 1218435 - protein, 9 aa, Homo Sapiens
WLWEHNRVC

SEQ ID NO: 1218436 - protein, 9 aa, Homo Sapiens
KGQGWWEFP

SEQ ID NO: 1218437 - protein, 9 aa, Homo Sapiens
PLAPAQLCH

SEQ ID NO: 1218438 - protein, 9 aa, Homo Sapiens
NDNNPEVTF

SEQ ID NO: 1218439 - protein, 9 aa, Homo Sapiens
SRTLASMVL

SEQ ID NO: 1218440 - protein, 9 aa, Homo Sapiens
NLSHAFGQT

SEQ ID NO: 1218441 - protein, 9 aa, Homo Sapiens
TTIHVQWQP

SEQ ID NO: 1218442 - protein, 9 aa, Homo Sapiens
ESYKDRTSL

SEQ ID NO: 1218443 - protein, 9 aa, Homo Sapiens
LNAGAFLLG

SEQ ID NO: 1218444 - protein, 9 aa, Homo Sapiens
MENSIFVVC

SEQ ID NO: 1218445 - protein, 9 aa, Homo Sapiens
RAPGQSTCQ

SEQ ID NO: 1218446 - protein, 9 aa, Homo Sapiens
APFLNRLVQ

SEQ ID NO: 1218447 - protein, 9 aa, Homo Sapiens
PCKEAGYLI

SEQ ID NO: 1218448 - protein, 9 aa, Homo Sapiens
MGPAAGRGA

SEQ ID NO: 1218449 - protein, 9 aa, Homo Sapiens
TCNECGNVF

SEQ ID NO: 1218450 - protein, 9 aa, Homo Sapiens
FIYSQINIS

SEQ ID NO: 1218451 - protein, 9 aa, Homo Sapiens
GDVGPNEQP

SEQ ID NO: 1218452 - protein, 9 aa, Homo Sapiens
WEDSRTHTI

SEQ ID NO: 1218453 - protein, 9 aa, Homo Sapiens
AALLRTMGI

SEQ ID NO: 1218454 - protein, 9 aa, Homo Sapiens
ARECDRQKE

SEQ ID NO: 1218455 - protein, 9 aa, Homo Sapiens
ELPLYIPHP

SEQ ID NO: 1218456 - protein, 9 aa, Homo Sapiens
RKKDTHFNF

SEQ ID NO: 1218457 - protein, 9 aa, Homo Sapiens
ITFQLHEDL

SEQ ID NO: 1218458 - protein, 9 aa, Homo Sapiens
QDLVGPLAW

SEQ ID NO: 1218459 - protein, 9 aa, Homo Sapiens
YKFGPIFVR

SEQ ID NO: 1218460 - protein, 9 aa, Homo Sapiens
LVIAHILHG

SEQ ID NO: 1218461 - protein, 9 aa, Homo Sapiens
HASIQLQHP

SEQ ID NO: 1218462 - protein, 9 aa, Homo Sapiens
VGRPDRGCL

SEQ ID NO: 1218463 - protein, 9 aa, Homo Sapiens
VSYRLLPGI

SEQ ID NO: 1218464 - protein, 9 aa, Homo Sapiens
TAECLTVVV

SEQ ID NO: 1218465 - protein, 9 aa, Homo Sapiens
RIVHVRKSR

SEQ ID NO: 1218466 - protein, 9 aa, Homo Sapiens
FEDLEKEHE

SEQ ID NO: 1218467 - protein, 9 aa, Homo Sapiens
KTKGHLDTE

SEQ ID NO: 1218468 - protein, 9 aa, Homo Sapiens
NLGAANGQI

SEQ ID NO: 1218469 - protein, 9 aa, Homo Sapiens
VIFNLYHFL

SEQ ID NO: 1218470 - protein, 9 aa, Homo Sapiens
ADAPHGVVW

SEQ ID NO: 1218471 - protein, 9 aa, Homo Sapiens
HLSVFDFDH

SEQ ID NO: 1218472 - protein, 9 aa, Homo Sapiens
PPCTSTMPP

SEQ ID NO: 1218473 - protein, 9 aa, Homo Sapiens
RAGALRAHM

SEQ ID NO: 1218474 - protein, 9 aa, Homo Sapiens
ACFSLVIPF

SEQ ID NO: 1218475 - protein, 9 aa, Homo Sapiens
CQARKLANR

SEQ ID NO: 1218476 - protein, 9 aa, Homo Sapiens
GGGIEDEIE

SEQ ID NO: 1218477 - protein, 9 aa, Homo Sapiens
VICRGWLTI

SEQ ID NO: 1218478 - protein, 9 aa, Homo Sapiens
LHCLCMCWK

SEQ ID NO: 1218479 - protein, 9 aa, Homo Sapiens
PYDALPDWL

SEQ ID NO: 1218480 - protein, 9 aa, Homo Sapiens
NRHVWELSK

SEQ ID NO: 1218481 - protein, 9 aa, Homo Sapiens
LDCPIKKGP

SEQ ID NO: 1218482 - protein, 9 aa, Homo Sapiens
YGPVHMNSV

SEQ ID NO: 1218483 - protein, 9 aa, Homo Sapiens
EEFVCGCHL

SEQ ID NO: 1218484 - protein, 9 aa, Homo Sapiens
SILTLQPSD

SEQ ID NO: 1218485 - protein, 9 aa, Homo Sapiens
VVYRPCCWA

SEQ ID NO: 1218486 - protein, 9 aa, Homo Sapiens
QKGISFLEC

SEQ ID NO: 1218487 - protein, 9 aa, Homo Sapiens
KGDVETLSW

SEQ ID NO: 1218488 - protein, 9 aa, Homo Sapiens
KHPRNTPSG

SEQ ID NO: 1218489 - protein, 9 aa, Homo Sapiens
SPSWDRRRQ

SEQ ID NO: 1218490 - protein, 9 aa, Homo Sapiens
KTNKWSTPS

SEQ ID NO: 1218491 - protein, 9 aa, Homo Sapiens
TPYISVPPS

SEQ ID NO: 1218492 - protein, 9 aa, Homo Sapiens
HFILLEGSQ

SEQ ID NO: 1218493 - protein, 9 aa, Homo Sapiens
GRLSVTPLC

SEQ ID NO: 1218494 - protein, 9 aa, Homo Sapiens
TSDKMQYFK

SEQ ID NO: 1218495 - protein, 9 aa, Homo Sapiens
RVSTADRSM

SEQ ID NO: 1218496 - protein, 9 aa, Homo Sapiens
KSYKCYQYG

SEQ ID NO: 1218497 - protein, 9 aa, Homo Sapiens
TPIAFRMNV

SEQ ID NO: 1218498 - protein, 9 aa, Homo Sapiens
GIPWFIKTT

SEQ ID NO: 1218499 - protein, 9 aa, Homo Sapiens
TDLIMLRLF

SEQ ID NO: 1218500 - protein, 9 aa, Homo Sapiens
SLFHLTQGE

SEQ ID NO: 1218501 - protein, 9 aa, Homo Sapiens
YTSYHFGTG

SEQ ID NO: 1218502 - protein, 9 aa, Homo Sapiens
RKDIHHMFV

SEQ ID NO: 1218503 - protein, 9 aa, Homo Sapiens
ETLTAFDLT

SEQ ID NO: 1218504 - protein, 9 aa, Homo Sapiens
HARHKGGCD

SEQ ID NO: 1218505 - protein, 9 aa, Homo Sapiens
QTAYLSMGG

SEQ ID NO: 1218506 - protein, 9 aa, Homo Sapiens
SNVLQMFLP

SEQ ID NO: 1218507 - protein, 9 aa, Homo Sapiens
EDEQESMRS

SEQ ID NO: 1218508 - protein, 9 aa, Homo Sapiens
NFNTYKKEM

SEQ ID NO: 1218509 - protein, 9 aa, Homo Sapiens
VTVSIETLC

SEQ ID NO: 1218510 - protein, 9 aa, Homo Sapiens
EAAAKHSKA

SEQ ID NO: 1218511 - protein, 9 aa, Homo Sapiens
FHKGGGYSV

SEQ ID NO: 1218512 - protein, 9 aa, Homo Sapiens
IPQERKDMT

SEQ ID NO: 1218513 - protein, 9 aa, Homo Sapiens
DEEEPVELR

SEQ ID NO: 1218514 - protein, 9 aa, Homo Sapiens
SSSTHNAMV

SEQ ID NO: 1218515 - protein, 9 aa, Homo Sapiens
SLVNVTAGV

SEQ ID NO: 1218516 - protein, 9 aa, Homo Sapiens
NHGALIYKL

SEQ ID NO: 1218517 - protein, 9 aa, Homo Sapiens
EGGIDEHDI

SEQ ID NO: 1218518 - protein, 9 aa, Homo Sapiens
SQDKEGIAS

SEQ ID NO: 1218519 - protein, 9 aa, Homo Sapiens
INGHFELNV

SEQ ID NO: 1218520 - protein, 9 aa, Homo Sapiens
DNDIHITAR

SEQ ID NO: 1218521 - protein, 9 aa, Homo Sapiens
ALVVLAQGS

SEQ ID NO: 1218522 - protein, 9 aa, Homo Sapiens
AASQPLDPN

SEQ ID NO: 1218523 - protein, 9 aa, Homo Sapiens
QDSSLPRVT

SEQ ID NO: 1218524 - protein, 9 aa, Homo Sapiens
SKEELHHLR

SEQ ID NO: 1218525 - protein, 9 aa, Homo Sapiens
KPYEINLMD

SEQ ID NO: 1218526 - protein, 9 aa, Homo Sapiens
VAILQGTLL

SEQ ID NO: 1218527 - protein, 9 aa, Homo Sapiens
LWHLWLDDN

SEQ ID NO: 1218528 - protein, 9 aa, Homo Sapiens
EAKLGVVTP

SEQ ID NO: 1218529 - protein, 9 aa, Homo Sapiens
SLNMVPSIP

SEQ ID NO: 1218530 - protein, 9 aa, Homo Sapiens
RLVRQRQLY

SEQ ID NO: 1218531 - protein, 9 aa, Homo Sapiens
GIQHDQPVK

SEQ ID NO: 1218532 - protein, 9 aa, Homo Sapiens
AKAKRRCSL

SEQ ID NO: 1218533 - protein, 9 aa, Homo Sapiens
LSVYVAHLD

SEQ ID NO: 1218534 - protein, 9 aa, Homo Sapiens
RNSLESKLY

SEQ ID NO: 1218535 - protein, 9 aa, Homo Sapiens
DKPCIIIKL

SEQ ID NO: 1218536 - protein, 9 aa, Homo Sapiens
EKEVLLIGI

SEQ ID NO: 1218537 - protein, 9 aa, Homo Sapiens
LDTELDAYM

SEQ ID NO: 1218538 - protein, 9 aa, Homo Sapiens
QIQVLLAQV

SEQ ID NO: 1218539 - protein, 9 aa, Homo Sapiens
VEALKDVKK

SEQ ID NO: 1218540 - protein, 9 aa, Homo Sapiens
KAEKQVTMA

SEQ ID NO: 1218541 - protein, 9 aa, Homo Sapiens
SPSTTPSIH

SEQ ID NO: 1218542 - protein, 9 aa, Homo Sapiens
CLLPDKGKM

SEQ ID NO: 1218543 - protein, 9 aa, Homo Sapiens
KVQEHQGKA

SEQ ID NO: 1218544 - protein, 9 aa, Homo Sapiens
RQGMQLEVV

SEQ ID NO: 1218545 - protein, 9 aa, Homo Sapiens
EHEEGKIIR

SEQ ID NO: 1218546 - protein, 9 aa, Homo Sapiens
VGSVCYLLP

SEQ ID NO: 1218547 - protein, 9 aa, Homo Sapiens
AVTTTVTGT

SEQ ID NO: 1218548 - protein, 9 aa, Homo Sapiens
GDQVYSVRM

SEQ ID NO: 1218549 - protein, 9 aa, Homo Sapiens
PQSRDAHQQ

SEQ ID NO: 1218550 - protein, 9 aa, Homo Sapiens
TFRVNIFTD

SEQ ID NO: 1218551 - protein, 9 aa, Homo Sapiens
IVVIFGISI

SEQ ID NO: 1218552 - protein, 9 aa, Homo Sapiens
AMSIGLLCY

SEQ ID NO: 1218553 - protein, 9 aa, Homo Sapiens
YTGYRDSAH

SEQ ID NO: 1218554 - protein, 9 aa, Homo Sapiens
ISVCGRSWD

SEQ ID NO: 1218555 - protein, 9 aa, Homo Sapiens
LFVISEVRS

SEQ ID NO: 1218556 - protein, 9 aa, Homo Sapiens
CIVGQYKLN

SEQ ID NO: 1218557 - protein, 9 aa, Homo Sapiens
EVGSEQMGE

SEQ ID NO: 1218558 - protein, 9 aa, Homo Sapiens
PSSSNEHAA

SEQ ID NO: 1218559 - protein, 9 aa, Homo Sapiens
NILNNDAFM

SEQ ID NO: 1218560 - protein, 9 aa, Homo Sapiens
IQAAEPTHT

SEQ ID NO: 1218561 - protein, 9 aa, Homo Sapiens
LDEEHLELH

SEQ ID NO: 1218562 - protein, 9 aa, Homo Sapiens
LTSCVWPDV

SEQ ID NO: 1218563 - protein, 9 aa, Homo Sapiens
EANYLRVQI

SEQ ID NO: 1218564 - protein, 9 aa, Homo Sapiens
IFILAVMAF

SEQ ID NO: 1218565 - protein, 9 aa, Homo Sapiens
QSVVGIGVS

SEQ ID NO: 1218566 - protein, 9 aa, Homo Sapiens
TGATASLGA

SEQ ID NO: 1218567 - protein, 9 aa, Homo Sapiens
NMPLVTTFF

SEQ ID NO: 1218568 - protein, 9 aa, Homo Sapiens
VAASPSAML

SEQ ID NO: 1218569 - protein, 9 aa, Homo Sapiens
RNLQTVDMK

SEQ ID NO: 1218570 - protein, 9 aa, Homo Sapiens
LYMSCGDCL

SEQ ID NO: 1218571 - protein, 9 aa, Homo Sapiens
HKDAIVLTV

SEQ ID NO: 1218572 - protein, 9 aa, Homo Sapiens
AWSWSLDDL

SEQ ID NO: 1218573 - protein, 9 aa, Homo Sapiens
DGTMRFWDA

SEQ ID NO: 1218574 - protein, 9 aa, Homo Sapiens
KDCIGRCSD

SEQ ID NO: 1218575 - protein, 9 aa, Homo Sapiens
RYIMEKTVQ

SEQ ID NO: 1218576 - protein, 9 aa, Homo Sapiens
TVQRVTLEG

SEQ ID NO: 1218577 - protein, 9 aa, Homo Sapiens
DAVGGHSHR

SEQ ID NO: 1218578 - protein, 9 aa, Homo Sapiens
DDVHRLFEA

SEQ ID NO: 1218579 - protein, 9 aa, Homo Sapiens
VFYSFHHID

SEQ ID NO: 1218580 - protein, 9 aa, Homo Sapiens
DTAHCLQVQ

SEQ ID NO: 1218581 - protein, 9 aa, Homo Sapiens
SEKSNTTTL

SEQ ID NO: 1218582 - protein, 9 aa, Homo Sapiens
LQQHFVLRF

SEQ ID NO: 1218583 - protein, 9 aa, Homo Sapiens
IVGTMVFKP

SEQ ID NO: 1218584 - protein, 9 aa, Homo Sapiens
KIATLYLPL

SEQ ID NO: 1218585 - protein, 9 aa, Homo Sapiens
LQFLYVPVK

SEQ ID NO: 1218586 - protein, 9 aa, Homo Sapiens
IVGSMKHPA

SEQ ID NO: 1218587 - protein, 9 aa, Homo Sapiens
NHPDVLVLQ

SEQ ID NO: 1218588 - protein, 9 aa, Homo Sapiens
RPDRGCLGF

SEQ ID NO: 1218589 - protein, 9 aa, Homo Sapiens
RLKHGYLEA

SEQ ID NO: 1218590 - protein, 9 aa, Homo Sapiens
ETTLAGIKT

SEQ ID NO: 1218591 - protein, 9 aa, Homo Sapiens
GVNDGCLYV

SEQ ID NO: 1218592 - protein, 9 aa, Homo Sapiens
SQEYVKVIS

SEQ ID NO: 1218593 - protein, 9 aa, Homo Sapiens
SSANSGARV

SEQ ID NO: 1218594 - protein, 9 aa, Homo Sapiens
VASDEYHRK

SEQ ID NO: 1218595 - protein, 9 aa, Homo Sapiens
RSRACSVGS

SEQ ID NO: 1218596 - protein, 9 aa, Homo Sapiens
LKHPLSLPS

SEQ ID NO: 1218597 - protein, 9 aa, Homo Sapiens
LELSNLDDF

SEQ ID NO: 1218598 - protein, 9 aa, Homo Sapiens
LPNPRHGKC

SEQ ID NO: 1218599 - protein, 9 aa, Homo Sapiens
LRRYTSEDN

SEQ ID NO: 1218600 - protein, 9 aa, Homo Sapiens
LKGDKCSQG

SEQ ID NO: 1218601 - protein, 9 aa, Homo Sapiens
ELRIQREQV

SEQ ID NO: 1218602 - protein, 9 aa, Homo Sapiens
SEYEAKVCM

SEQ ID NO: 1218603 - protein, 9 aa, Homo Sapiens
VLLGITQAS

SEQ ID NO: 1218604 - protein, 9 aa, Homo Sapiens
DEEANNDIF

SEQ ID NO: 1218605 - protein, 9 aa, Homo Sapiens
LTAQQLEMT

SEQ ID NO: 1218606 - protein, 9 aa, Homo Sapiens
PAAGYRLEE

SEQ ID NO: 1218607 - protein, 9 aa, Homo Sapiens
SVMCPGAGL

SEQ ID NO: 1218608 - protein, 9 aa, Homo Sapiens
SPRYTIPPR

SEQ ID NO: 1218609 - protein, 9 aa, Homo Sapiens
VHIMSCNKQ

SEQ ID NO: 1218610 - protein, 9 aa, Homo Sapiens
DRQCEYLLD

SEQ ID NO: 1218611 - protein, 9 aa, Homo Sapiens
HKMHHKRRM

SEQ ID NO: 1218612 - protein, 9 aa, Homo Sapiens
KISFHRNDP

SEQ ID NO: 1218613 - protein, 9 aa, Homo Sapiens
QDGGIGKAK

SEQ ID NO: 1218614 - protein, 9 aa, Homo Sapiens
YTIKVSFSL

SEQ ID NO: 1218615 - protein, 9 aa, Homo Sapiens
PYHDSTQVG

SEQ ID NO: 1218616 - protein, 9 aa, Homo Sapiens
LESDEVAWL

SEQ ID NO: 1218617 - protein, 9 aa, Homo Sapiens
VEGFTIKKH

SEQ ID NO: 1218618 - protein, 9 aa, Homo Sapiens
ILITYIGMI

SEQ ID NO: 1218619 - protein, 9 aa, Homo Sapiens
WSIRHLQDV

SEQ ID NO: 1218620 - protein, 9 aa, Homo Sapiens
QGLQEGQRC

SEQ ID NO: 1218621 - protein, 9 aa, Homo Sapiens
CHLLAQPTL

SEQ ID NO: 1218622 - protein, 9 aa, Homo Sapiens
HLAFNQPSP

SEQ ID NO: 1218623 - protein, 9 aa, Homo Sapiens
MTQDTQNAL

SEQ ID NO: 1218624 - protein, 9 aa, Homo Sapiens
FSVESKWSL

SEQ ID NO: 1218625 - protein, 9 aa, Homo Sapiens
HHISPQRLP

SEQ ID NO: 1218626 - protein, 9 aa, Homo Sapiens
ADAVKKARS

SEQ ID NO: 1218627 - protein, 9 aa, Homo Sapiens
SQLIAMQIN

SEQ ID NO: 1218628 - protein, 9 aa, Homo Sapiens
SIYWVHFYT

SEQ ID NO: 1218629 - protein, 9 aa, Homo Sapiens
RTSTICGTP

SEQ ID NO: 1218630 - protein, 9 aa, Homo Sapiens
KHIKCRRCV

SEQ ID NO: 1218631 - protein, 9 aa, Homo Sapiens
KFTASKDPT

SEQ ID NO: 1218632 - protein, 9 aa, Homo Sapiens
GEDTAALAL

SEQ ID NO: 1218633 - protein, 9 aa, Homo Sapiens
WIPTSLAVG

SEQ ID NO: 1218634 - protein, 9 aa, Homo Sapiens
KHLRFPDND

SEQ ID NO: 1218635 - protein, 9 aa, Homo Sapiens
STDTPSTIF

SEQ ID NO: 1218636 - protein, 9 aa, Homo Sapiens
TLEVLQYLF

SEQ ID NO: 1218637 - protein, 9 aa, Homo Sapiens
PLGSRTLKS

SEQ ID NO: 1218638 - protein, 9 aa, Homo Sapiens
ERNKGFPTL

SEQ ID NO: 1218639 - protein, 9 aa, Homo Sapiens
NLLKGLCHP

SEQ ID NO: 1218640 - protein, 9 aa, Homo Sapiens
QEQMWKILY

SEQ ID NO: 1218641 - protein, 9 aa, Homo Sapiens
GESASPATH

SEQ ID NO: 1218642 - protein, 9 aa, Homo Sapiens
NNVMQLPLC

SEQ ID NO: 1218643 - protein, 9 aa, Homo Sapiens
EQVWFKANR

SEQ ID NO: 1218644 - protein, 9 aa, Homo Sapiens
LFRNGADID

SEQ ID NO: 1218645 - protein, 9 aa, Homo Sapiens
ERLHRLLAE

SEQ ID NO: 1218646 - protein, 9 aa, Homo Sapiens
GMSRGIYST

SEQ ID NO: 1218647 - protein, 9 aa, Homo Sapiens
HIQEAMRVL

SEQ ID NO: 1218648 - protein, 9 aa, Homo Sapiens
KHHMLKIMQ

SEQ ID NO: 1218649 - protein, 9 aa, Homo Sapiens
VYSVRMRQK

SEQ ID NO: 1218650 - protein, 9 aa, Homo Sapiens
NYKSKSAGN

SEQ ID NO: 1218651 - protein, 9 aa, Homo Sapiens
KGLRKGDVM

SEQ ID NO: 1218652 - protein, 9 aa, Homo Sapiens
LVVDTKILI

SEQ ID NO: 1218653 - protein, 9 aa, Homo Sapiens
RPVSGDGAQ

SEQ ID NO: 1218654 - protein, 9 aa, Homo Sapiens
IITDMELPP

SEQ ID NO: 1218655 - protein, 9 aa, Homo Sapiens
KFETVYQIH

SEQ ID NO: 1218656 - protein, 9 aa, Homo Sapiens
QEVLLQGYD

SEQ ID NO: 1218657 - protein, 9 aa, Homo Sapiens
IVGDTVHFI

SEQ ID NO: 1218658 - protein, 9 aa, Homo Sapiens
WDLLTEPDG

SEQ ID NO: 1218659 - protein, 9 aa, Homo Sapiens
LQDASMDAQ

SEQ ID NO: 1218660 - protein, 9 aa, Homo Sapiens
MDTIYNRPS

SEQ ID NO: 1218661 - protein, 9 aa, Homo Sapiens
LWWQARIIS

SEQ ID NO: 1218662 - protein, 9 aa, Homo Sapiens
ATAYIMSVQ

SEQ ID NO: 1218663 - protein, 9 aa, Homo Sapiens
GDDHKYMDI

SEQ ID NO: 1218664 - protein, 9 aa, Homo Sapiens
RIFEMRKKP

SEQ ID NO: 1218665 - protein, 9 aa, Homo Sapiens
LPREGAYLH

SEQ ID NO: 1218666 - protein, 9 aa, Homo Sapiens
HCSMILDEE

SEQ ID NO: 1218667 - protein, 9 aa, Homo Sapiens
CNQHYGWHP

SEQ ID NO: 1218668 - protein, 9 aa, Homo Sapiens
GKGSMGPWG

SEQ ID NO: 1218669 - protein, 9 aa, Homo Sapiens
HPDIHKLGF

SEQ ID NO: 1218670 - protein, 9 aa, Homo Sapiens
EFLKKFENP

SEQ ID NO: 1218671 - protein, 9 aa, Homo Sapiens
LGNWQKECI

SEQ ID NO: 1218672 - protein, 9 aa, Homo Sapiens
NAVQPGTVG

SEQ ID NO: 1218673 - protein, 9 aa, Homo Sapiens
HMVRWVDPT

SEQ ID NO: 1218674 - protein, 9 aa, Homo Sapiens
VVDFVQFEC

SEQ ID NO: 1218675 - protein, 9 aa, Homo Sapiens
MRGLAGRPL

SEQ ID NO: 1218676 - protein, 9 aa, Homo Sapiens
AKYQEKQQK

SEQ ID NO: 1218677 - protein, 9 aa, Homo Sapiens
GALMWLQEP

SEQ ID NO: 1218678 - protein, 9 aa, Homo Sapiens
QKSKKKKEC

SEQ ID NO: 1218679 - protein, 9 aa, Homo Sapiens
DYPDVLPSH

SEQ ID NO: 1218680 - protein, 9 aa, Homo Sapiens
LEEMYWNEG

SEQ ID NO: 1218681 - protein, 9 aa, Homo Sapiens
QAEKDQRLK

SEQ ID NO: 1218682 - protein, 9 aa, Homo Sapiens
KVKYPIVGY

SEQ ID NO: 1218683 - protein, 9 aa, Homo Sapiens
IPEESDECV

SEQ ID NO: 1218684 - protein, 9 aa, Homo Sapiens
WLGTLCPGG

SEQ ID NO: 1218685 - protein, 9 aa, Homo Sapiens
WDMVTPEAK

SEQ ID NO: 1218686 - protein, 9 aa, Homo Sapiens
AATSCMGFF

SEQ ID NO: 1218687 - protein, 9 aa, Homo Sapiens
FQKYGYSPC

SEQ ID NO: 1218688 - protein, 9 aa, Homo Sapiens
MDTWVYECT

SEQ ID NO: 1218689 - protein, 9 aa, Homo Sapiens
GHIDDLLRA

SEQ ID NO: 1218690 - protein, 9 aa, Homo Sapiens
CSSSWTNRS

SEQ ID NO: 1218691 - protein, 9 aa, Homo Sapiens
PRPQLSLTL

SEQ ID NO: 1218692 - protein, 9 aa, Homo Sapiens
CLLMIWSVT

SEQ ID NO: 1218693 - protein, 9 aa, Homo Sapiens
TATQLLHHP

SEQ ID NO: 1218694 - protein, 9 aa, Homo Sapiens
RETQSCPPS

SEQ ID NO: 1218695 - protein, 9 aa, Homo Sapiens
EDVTSPFPT

SEQ ID NO: 1218696 - protein, 9 aa, Homo Sapiens
LTRLRGVHY

SEQ ID NO: 1218697 - protein, 9 aa, Homo Sapiens
KKHSNTSIL

SEQ ID NO: 1218698 - protein, 9 aa, Homo Sapiens
KKDPLTNKV

SEQ ID NO: 1218699 - protein, 9 aa, Homo Sapiens
LCAESLKSN

SEQ ID NO: 1218700 - protein, 9 aa, Homo Sapiens
TSSPSHPSS

SEQ ID NO: 1218701 - protein, 9 aa, Homo Sapiens
PVFLPFLII

SEQ ID NO: 1218702 - protein, 9 aa, Homo Sapiens
KCNTNDTIG

SEQ ID NO: 1218703 - protein, 9 aa, Homo Sapiens
LIVTVWTLG

SEQ ID NO: 1218704 - protein, 9 aa, Homo Sapiens
IKRWQDIYK

SEQ ID NO: 1218705 - protein, 9 aa, Homo Sapiens
EEGKIIRAQ

SEQ ID NO: 1218706 - protein, 9 aa, Homo Sapiens
LYMLNPCNT

SEQ ID NO: 1218707 - protein, 9 aa, Homo Sapiens
LDQLNALRH

SEQ ID NO: 1218708 - protein, 9 aa, Homo Sapiens
KKAIDAMLD

SEQ ID NO: 1218709 - protein, 9 aa, Homo Sapiens
VQSPNCNQH

SEQ ID NO: 1218710 - protein, 9 aa, Homo Sapiens
PGRSAAALW

SEQ ID NO: 1218711 - protein, 9 aa, Homo Sapiens
GDGLKVFMY

SEQ ID NO: 1218712 - protein, 9 aa, Homo Sapiens
NYPAIILFS

SEQ ID NO: 1218713 - protein, 9 aa, Homo Sapiens
STGAEEIYL

SEQ ID NO: 1218714 - protein, 9 aa, Homo Sapiens
TDHHILHVA

SEQ ID NO: 1218715 - protein, 9 aa, Homo Sapiens
CFHPRRERS

SEQ ID NO: 1218716 - protein, 9 aa, Homo Sapiens
PIMNGQGLA

SEQ ID NO: 1218717 - protein, 9 aa, Homo Sapiens
GLTGVTMGS

SEQ ID NO: 1218718 - protein, 9 aa, Homo Sapiens
AYSKKLMDL

SEQ ID NO: 1218719 - protein, 9 aa, Homo Sapiens
EDTLNNFQE

SEQ ID NO: 1218720 - protein, 9 aa, Homo Sapiens
NLTSPDLQI

SEQ ID NO: 1218721 - protein, 9 aa, Homo Sapiens
PELSPPQTP

SEQ ID NO: 1218722 - protein, 9 aa, Homo Sapiens
GLLEGSAEI

SEQ ID NO: 1218723 - protein, 9 aa, Homo Sapiens
RCDRQTQVG

SEQ ID NO: 1218724 - protein, 9 aa, Homo Sapiens
TSHKAARLG

SEQ ID NO: 1218725 - protein, 9 aa, Homo Sapiens
ASGKLIAAV

SEQ ID NO: 1218726 - protein, 9 aa, Homo Sapiens
SNIARKSLP

SEQ ID NO: 1218727 - protein, 9 aa, Homo Sapiens
LSSVSPSMC

SEQ ID NO: 1218728 - protein, 9 aa, Homo Sapiens
SSITVPGRH

SEQ ID NO: 1218729 - protein, 9 aa, Homo Sapiens
ALKKCPLDV

SEQ ID NO: 1218730 - protein, 9 aa, Homo Sapiens
HTGEKPYKR

SEQ ID NO: 1218731 - protein, 9 aa, Homo Sapiens
IVTTHFALT

SEQ ID NO: 1218732 - protein, 9 aa, Homo Sapiens
GKADLEVQV

SEQ ID NO: 1218733 - protein, 9 aa, Homo Sapiens
VTSEAKVQQ

SEQ ID NO: 1218734 - protein, 9 aa, Homo Sapiens
SFCHFWRDG

SEQ ID NO: 1218735 - protein, 9 aa, Homo Sapiens
RHRRSIVFA

SEQ ID NO: 1218736 - protein, 9 aa, Homo Sapiens
MQARAAGHT

SEQ ID NO: 1218737 - protein, 9 aa, Homo Sapiens
EKSYELPDD

SEQ ID NO: 1218738 - protein, 9 aa, Homo Sapiens
RIPPTSRCP

SEQ ID NO: 1218739 - protein, 9 aa, Homo Sapiens
DHATLKLFL

SEQ ID NO: 1218740 - protein, 9 aa, Homo Sapiens
QCKIMQKKI

SEQ ID NO: 1218741 - protein, 9 aa, Homo Sapiens
DPLDNDKNC

SEQ ID NO: 1218742 - protein, 9 aa, Homo Sapiens
LQSKIENFI

SEQ ID NO: 1218743 - protein, 9 aa, Homo Sapiens
GKAFRHATI

SEQ ID NO: 1218744 - protein, 9 aa, Homo Sapiens
YRNEVRHIY

SEQ ID NO: 1218745 - protein, 9 aa, Homo Sapiens
VGTKPLLYS

SEQ ID NO: 1218746 - protein, 9 aa, Homo Sapiens
ITFCNQLWH

SEQ ID NO: 1218747 - protein, 9 aa, Homo Sapiens
SSFYVKHCR

SEQ ID NO: 1218748 - protein, 9 aa, Homo Sapiens
ELDHLLLEL

SEQ ID NO: 1218749 - protein, 9 aa, Homo Sapiens
FMKDAAEGP

SEQ ID NO: 1218750 - protein, 9 aa, Homo Sapiens
GTEHLAPAW

SEQ ID NO: 1218751 - protein, 9 aa, Homo Sapiens
ELHIQGVPK

SEQ ID NO: 1218752 - protein, 9 aa, Homo Sapiens
SLRRSVDPG

SEQ ID NO: 1218753 - protein, 9 aa, Homo Sapiens
APHHMAHRS

SEQ ID NO: 1218754 - protein, 9 aa, Homo Sapiens
FDASDKPLK

SEQ ID NO: 1218755 - protein, 9 aa, Homo Sapiens
GSDSDEPML

SEQ ID NO: 1218756 - protein, 9 aa, Homo Sapiens
ICWMNMNKT

SEQ ID NO: 1218757 - protein, 9 aa, Homo Sapiens
DQCISGHHL

SEQ ID NO: 1218758 - protein, 9 aa, Homo Sapiens
VFLEADVQA

SEQ ID NO: 1218759 - protein, 9 aa, Homo Sapiens
TKKIVYQQS

SEQ ID NO: 1218760 - protein, 9 aa, Homo Sapiens
PSYHLKKYS

SEQ ID NO: 1218761 - protein, 9 aa, Homo Sapiens
FQRKFVGDV

SEQ ID NO: 1218762 - protein, 9 aa, Homo Sapiens
ELHKKYKER

SEQ ID NO: 1218763 - protein, 9 aa, Homo Sapiens
DLLVPAPPP

SEQ ID NO: 1218764 - protein, 9 aa, Homo Sapiens
LNQFKSKIT

SEQ ID NO: 1218765 - protein, 9 aa, Homo Sapiens
TPETLIWQD

SEQ ID NO: 1218766 - protein, 9 aa, Homo Sapiens
LAAGFEEHR

SEQ ID NO: 1218767 - protein, 9 aa, Homo Sapiens
ASWFKDVMT

SEQ ID NO: 1218768 - protein, 9 aa, Homo Sapiens
ELADSVLEI

SEQ ID NO: 1218769 - protein, 9 aa, Homo Sapiens
NAMVPLVRK

SEQ ID NO: 1218770 - protein, 9 aa, Homo Sapiens
YVYYKSMPN

SEQ ID NO: 1218771 - protein, 9 aa, Homo Sapiens
NMTSSWPPI

SEQ ID NO: 1218772 - protein, 9 aa, Homo Sapiens
SNCWTPLTP

SEQ ID NO: 1218773 - protein, 9 aa, Homo Sapiens
SRMSQPLQC

SEQ ID NO: 1218774 - protein, 9 aa, Homo Sapiens
DFVRQIQLL

SEQ ID NO: 1218775 - protein, 9 aa, Homo Sapiens
SDISEDPCH

SEQ ID NO: 1218776 - protein, 9 aa, Homo Sapiens
PAFAANVLR

SEQ ID NO: 1218777 - protein, 9 aa, Homo Sapiens
RKMHFQEGW

SEQ ID NO: 1218778 - protein, 9 aa, Homo Sapiens
GANIASEMA

SEQ ID NO: 1218779 - protein, 9 aa, Homo Sapiens
IPTVGSSLS

SEQ ID NO: 1218780 - protein, 9 aa, Homo Sapiens
KCTLPWGML

SEQ ID NO: 1218781 - protein, 9 aa, Homo Sapiens
NELDTTLYL

SEQ ID NO: 1218782 - protein, 9 aa, Homo Sapiens
YPNTNYEVT

SEQ ID NO: 1218783 - protein, 9 aa, Homo Sapiens
HCEDPSFNM

SEQ ID NO: 1218784 - protein, 9 aa, Homo Sapiens
ARDTRHLGA

SEQ ID NO: 1218785 - protein, 9 aa, Homo Sapiens
TLAKSTGTF

SEQ ID NO: 1218786 - protein, 9 aa, Homo Sapiens
LQWNRIYSD

SEQ ID NO: 1218787 - protein, 9 aa, Homo Sapiens
VSTSSHLIL

SEQ ID NO: 1218788 - protein, 9 aa, Homo Sapiens
RGTSPIRHC

SEQ ID NO: 1218789 - protein, 9 aa, Homo Sapiens
EAASADDGI

SEQ ID NO: 1218790 - protein, 9 aa, Homo Sapiens
RKHQGRIVI

SEQ ID NO: 1218791 - protein, 9 aa, Homo Sapiens
SSDPVGPPC

SEQ ID NO: 1218792 - protein, 9 aa, Homo Sapiens
LGGRDLYRF

SEQ ID NO: 1218793 - protein, 9 aa, Homo Sapiens
LTGDNSLGL

SEQ ID NO: 1218794 - protein, 9 aa, Homo Sapiens
NRGMFLCDE

SEQ ID NO: 1218795 - protein, 9 aa, Homo Sapiens
FLFIHFGVW

SEQ ID NO: 1218796 - protein, 9 aa, Homo Sapiens
NAEQSAASI

SEQ ID NO: 1218797 - protein, 9 aa, Homo Sapiens
EMYWNEGDH

SEQ ID NO: 1218798 - protein, 9 aa, Homo Sapiens
HHCGHSQPQ

SEQ ID NO: 1218799 - protein, 9 aa, Homo Sapiens
TDIPVPLSH

SEQ ID NO: 1218800 - protein, 9 aa, Homo Sapiens
RFAGSIFIG

SEQ ID NO: 1218801 - protein, 9 aa, Homo Sapiens
ARVVEEMAG

SEQ ID NO: 1218802 - protein, 9 aa, Homo Sapiens
DPEWRQTPL

SEQ ID NO: 1218803 - protein, 9 aa, Homo Sapiens
EEGRTIYLR

SEQ ID NO: 1218804 - protein, 9 aa, Homo Sapiens
NEAHVSTNL

SEQ ID NO: 1218805 - protein, 9 aa, Homo Sapiens
AVELELNDF

SEQ ID NO: 1218806 - protein, 9 aa, Homo Sapiens
FKIPATVSE

SEQ ID NO: 1218807 - protein, 9 aa, Homo Sapiens
AFPGRRAPL

SEQ ID NO: 1218808 - protein, 9 aa, Homo Sapiens
KTPDVSFLP

SEQ ID NO: 1218809 - protein, 9 aa, Homo Sapiens
CVEPRLRLY

SEQ ID NO: 1218810 - protein, 9 aa, Homo Sapiens
TTNLEETRI

SEQ ID NO: 1218811 - protein, 9 aa, Homo Sapiens
TYLRVLRDG

SEQ ID NO: 1218812 - protein, 9 aa, Homo Sapiens
GLRTHTGSN

SEQ ID NO: 1218813 - protein, 9 aa, Homo Sapiens
RSRSTQGGH

SEQ ID NO: 1218814 - protein, 9 aa, Homo Sapiens
SDEHFRQLL

SEQ ID NO: 1218815 - protein, 9 aa, Homo Sapiens
FLKYAEKYV

SEQ ID NO: 1218816 - protein, 9 aa, Homo Sapiens
KENPNDLQF

SEQ ID NO: 1218817 - protein, 9 aa, Homo Sapiens
EVHTGLGEL

SEQ ID NO: 1218818 - protein, 9 aa, Homo Sapiens
EFGEPWELN

SEQ ID NO: 1218819 - protein, 9 aa, Homo Sapiens
TSAPQLQVI

SEQ ID NO: 1218820 - protein, 9 aa, Homo Sapiens
AQNQVNISA

SEQ ID NO: 1218821 - protein, 9 aa, Homo Sapiens
PCTQAEFQT

SEQ ID NO: 1218822 - protein, 9 aa, Homo Sapiens
QLLHTGEWP

SEQ ID NO: 1218823 - protein, 9 aa, Homo Sapiens
PAPARSYQG

SEQ ID NO: 1218824 - protein, 9 aa, Homo Sapiens
GQHVSLQHL

SEQ ID NO: 1218825 - protein, 9 aa, Homo Sapiens
LLQSIKDHR

SEQ ID NO: 1218826 - protein, 9 aa, Homo Sapiens
ESQVRELLS

SEQ ID NO: 1218827 - protein, 9 aa, Homo Sapiens
QESKSAVLP

SEQ ID NO: 1218828 - protein, 9 aa, Homo Sapiens
SEGDEDYTG

SEQ ID NO: 1218829 - protein, 9 aa, Homo Sapiens
GSWSRGWGR

SEQ ID NO: 1218830 - protein, 9 aa, Homo Sapiens
LSNVAGIFY

SEQ ID NO: 1218831 - protein, 9 aa, Homo Sapiens
KRFILHAKR

SEQ ID NO: 1218832 - protein, 9 aa, Homo Sapiens
AGHPATKLS

SEQ ID NO: 1218833 - protein, 9 aa, Homo Sapiens
INEKTVLLQ

SEQ ID NO: 1218834 - protein, 9 aa, Homo Sapiens
YMCNACGLY

SEQ ID NO: 1218835 - protein, 9 aa, Homo Sapiens
FLSSHLALA

SEQ ID NO: 1218836 - protein, 9 aa, Homo Sapiens
AVYEELPEQ

SEQ ID NO: 1218837 - protein, 9 aa, Homo Sapiens
ELSPPQTPQ

SEQ ID NO: 1218838 - protein, 9 aa, Homo Sapiens
SISFLTPLH

SEQ ID NO: 1218839 - protein, 9 aa, Homo Sapiens
VCTLSALEC

SEQ ID NO: 1218840 - protein, 9 aa, Homo Sapiens
ALQAQARQL

SEQ ID NO: 1218841 - protein, 9 aa, Homo Sapiens
QMQSEEVRK

SEQ ID NO: 1218842 - protein, 9 aa, Homo Sapiens
FRESQEQSL

SEQ ID NO: 1218843 - protein, 9 aa, Homo Sapiens
RVHAYPEAG

SEQ ID NO: 1218844 - protein, 9 aa, Homo Sapiens
GFTAMNRIR

SEQ ID NO: 1218845 - protein, 9 aa, Homo Sapiens
AFHDPHHCG

SEQ ID NO: 1218846 - protein, 9 aa, Homo Sapiens
SNDEKKMDI

SEQ ID NO: 1218847 - protein, 9 aa, Homo Sapiens
EFRSNVDYQ

SEQ ID NO: 1218848 - protein, 9 aa, Homo Sapiens
PSTTAVRHG

SEQ ID NO: 1218849 - protein, 9 aa, Homo Sapiens
KGHRGFSDL

SEQ ID NO: 1218850 - protein, 9 aa, Homo Sapiens
FQKPIPLEQ

SEQ ID NO: 1218851 - protein, 9 aa, Homo Sapiens
LATPKIRDN

SEQ ID NO: 1218852 - protein, 9 aa, Homo Sapiens
WVWDNIYSI

SEQ ID NO: 1218853 - protein, 9 aa, Homo Sapiens
AQVDVLTQI

SEQ ID NO: 1218854 - protein, 9 aa, Homo Sapiens
YTAFDTYYR

SEQ ID NO: 1218855 - protein, 9 aa, Homo Sapiens
QVSKKIGQW

SEQ ID NO: 1218856 - protein, 9 aa, Homo Sapiens
MNAYLVEQS

SEQ ID NO: 1218857 - protein, 9 aa, Homo Sapiens
SEKIVLPHG

SEQ ID NO: 1218858 - protein, 9 aa, Homo Sapiens
RPRPSSCFH

SEQ ID NO: 1218859 - protein, 9 aa, Homo Sapiens
HHIHVLKEM

SEQ ID NO: 1218860 - protein, 9 aa, Homo Sapiens
FYMTANDPV

SEQ ID NO: 1218861 - protein, 9 aa, Homo Sapiens
YTRRYSIIS

SEQ ID NO: 1218862 - protein, 9 aa, Homo Sapiens
SGTPSSSRN

SEQ ID NO: 1218863 - protein, 9 aa, Homo Sapiens
CKRNEGYFC

SEQ ID NO: 1218864 - protein, 9 aa, Homo Sapiens
DPPRLCTVG

SEQ ID NO: 1218865 - protein, 9 aa, Homo Sapiens
FIHTNWAGH

SEQ ID NO: 1218866 - protein, 9 aa, Homo Sapiens
RNKGRIQRQ

SEQ ID NO: 1218867 - protein, 9 aa, Homo Sapiens
RHAQPVSSA

SEQ ID NO: 1218868 - protein, 9 aa, Homo Sapiens
KEIVEHVFQ

SEQ ID NO: 1218869 - protein, 9 aa, Homo Sapiens
NNAAGNDTF

SEQ ID NO: 1218870 - protein, 9 aa, Homo Sapiens
VSSAPGGGD

SEQ ID NO: 1218871 - protein, 9 aa, Homo Sapiens
SRCLVCGRL

SEQ ID NO: 1218872 - protein, 9 aa, Homo Sapiens
MMVQKERGL

SEQ ID NO: 1218873 - protein, 9 aa, Homo Sapiens
VEEHWTLKA

SEQ ID NO: 1218874 - protein, 9 aa, Homo Sapiens
ALLEQVMIG

SEQ ID NO: 1218875 - protein, 9 aa, Homo Sapiens
RPGRSAAAL

SEQ ID NO: 1218876 - protein, 9 aa, Homo Sapiens
GHLLMTFDV

SEQ ID NO: 1218877 - protein, 9 aa, Homo Sapiens
HSLLLYEAR

SEQ ID NO: 1218878 - protein, 9 aa, Homo Sapiens
ILEKKPVMP

SEQ ID NO: 1218879 - protein, 9 aa, Homo Sapiens
CLALRVVVD

SEQ ID NO: 1218880 - protein, 9 aa, Homo Sapiens
LGLRIGCAF

SEQ ID NO: 1218881 - protein, 9 aa, Homo Sapiens
QGFGSTQIG

SEQ ID NO: 1218882 - protein, 9 aa, Homo Sapiens
HEEIFPQCL

SEQ ID NO: 1218883 - protein, 9 aa, Homo Sapiens
RAPDSRDAR

SEQ ID NO: 1218884 - protein, 9 aa, Homo Sapiens
AGGPCLPRR

SEQ ID NO: 1218885 - protein, 9 aa, Homo Sapiens
TIDNTYYSA

SEQ ID NO: 1218886 - protein, 9 aa, Homo Sapiens
LIFTSVTYL

SEQ ID NO: 1218887 - protein, 9 aa, Homo Sapiens
YIPHPSSPG

SEQ ID NO: 1218888 - protein, 9 aa, Homo Sapiens
NFAVLKLNE

SEQ ID NO: 1218889 - protein, 9 aa, Homo Sapiens
FTITHRRAR

SEQ ID NO: 1218890 - protein, 9 aa, Homo Sapiens
DHIKPTVIE

SEQ ID NO: 1218891 - protein, 9 aa, Homo Sapiens
PLVKRLTGG

SEQ ID NO: 1218892 - protein, 9 aa, Homo Sapiens
SELLSAHKD

SEQ ID NO: 1218893 - protein, 9 aa, Homo Sapiens
GNEQISVMR

SEQ ID NO: 1218894 - protein, 9 aa, Homo Sapiens
SLLNNVCAY

SEQ ID NO: 1218895 - protein, 9 aa, Homo Sapiens
AERERNQES

SEQ ID NO: 1218896 - protein, 9 aa, Homo Sapiens
LVKSALNRI

SEQ ID NO: 1218897 - protein, 9 aa, Homo Sapiens
LLTDMWIGR

SEQ ID NO: 1218898 - protein, 9 aa, Homo Sapiens
PSHMLPEPG

SEQ ID NO: 1218899 - protein, 9 aa, Homo Sapiens
VMCENENGE

SEQ ID NO: 1218900 - protein, 9 aa, Homo Sapiens
TRGPDGDWL

SEQ ID NO: 1218901 - protein, 9 aa, Homo Sapiens
PSWAAASPS

SEQ ID NO: 1218902 - protein, 9 aa, Homo Sapiens
RKHLVKNEK

SEQ ID NO: 1218903 - protein, 9 aa, Homo Sapiens
DGECQFNLN

SEQ ID NO: 1218904 - protein, 9 aa, Homo Sapiens
IDRVTDLIM

SEQ ID NO: 1218905 - protein, 9 aa, Homo Sapiens
YVVFMKFSV

SEQ ID NO: 1218906 - protein, 9 aa, Homo Sapiens
GLICLLRWM

SEQ ID NO: 1218907 - protein, 9 aa, Homo Sapiens
LQHQDWAAI

SEQ ID NO: 1218908 - protein, 9 aa, Homo Sapiens
SLLLALLNE

SEQ ID NO: 1218909 - protein, 9 aa, Homo Sapiens
QDLKESGDD

SEQ ID NO: 1218910 - protein, 9 aa, Homo Sapiens
LLTTAILGA

SEQ ID NO: 1218911 - protein, 9 aa, Homo Sapiens
NTLPGTCTG

SEQ ID NO: 1218912 - protein, 9 aa, Homo Sapiens
SHDPKIESS

SEQ ID NO: 1218913 - protein, 9 aa, Homo Sapiens
FTNLKGLIH

SEQ ID NO: 1218914 - protein, 9 aa, Homo Sapiens
GWITAHVMK

SEQ ID NO: 1218915 - protein, 9 aa, Homo Sapiens
THHLLAAAL

SEQ ID NO: 1218916 - protein, 9 aa, Homo Sapiens
DIIILDNLD

SEQ ID NO: 1218917 - protein, 9 aa, Homo Sapiens
YRDDVRRVM

SEQ ID NO: 1218918 - protein, 9 aa, Homo Sapiens
SPAADAPVT

SEQ ID NO: 1218919 - protein, 9 aa, Homo Sapiens
YVQEVMQPV

SEQ ID NO: 1218920 - protein, 9 aa, Homo Sapiens
LPPLQFLPQ

SEQ ID NO: 1218921 - protein, 9 aa, Homo Sapiens
TIPLDKCLA

SEQ ID NO: 1218922 - protein, 9 aa, Homo Sapiens
KEENTKHFP

SEQ ID NO: 1218923 - protein, 9 aa, Homo Sapiens
VNADARGEH

SEQ ID NO: 1218924 - protein, 9 aa, Homo Sapiens
GARCQDRVH

SEQ ID NO: 1218925 - protein, 9 aa, Homo Sapiens
SVAPGAHFH

SEQ ID NO: 1218926 - protein, 9 aa, Homo Sapiens
FDDIAVYFS

SEQ ID NO: 1218927 - protein, 9 aa, Homo Sapiens
HKMLSPDDA

SEQ ID NO: 1218928 - protein, 9 aa, Homo Sapiens
PVVWVPTEA

SEQ ID NO: 1218929 - protein, 9 aa, Homo Sapiens
LSRTHSEPL

SEQ ID NO: 1218930 - protein, 9 aa, Homo Sapiens
HIDDVDWNK

SEQ ID NO: 1218931 - protein, 9 aa, Homo Sapiens
MFRDKENVL

SEQ ID NO: 1218932 - protein, 9 aa, Homo Sapiens
YNTWPICWG

SEQ ID NO: 1218933 - protein, 9 aa, Homo Sapiens
VCKGVSEKC

SEQ ID NO: 1218934 - protein, 9 aa, Homo Sapiens
TDGYPGEAG

SEQ ID NO: 1218935 - protein, 9 aa, Homo Sapiens
STIPRNLLT

SEQ ID NO: 1218936 - protein, 9 aa, Homo Sapiens
DLHVTNQGM

SEQ ID NO: 1218937 - protein, 9 aa, Homo Sapiens
KGEDQIIED

SEQ ID NO: 1218938 - protein, 9 aa, Homo Sapiens
AGHGGTVSS

SEQ ID NO: 1218939 - protein, 9 aa, Homo Sapiens
AQRKGISRK

SEQ ID NO: 1218940 - protein, 9 aa, Homo Sapiens
QDAVHAVLA

SEQ ID NO: 1218941 - protein, 9 aa, Homo Sapiens
DTCLVYDSR

SEQ ID NO: 1218942 - protein, 9 aa, Homo Sapiens
IGDNTTVNY

SEQ ID NO: 1218943 - protein, 9 aa, Homo Sapiens
EPVLRTDAS

SEQ ID NO: 1218944 - protein, 9 aa, Homo Sapiens
ISSDSHLRT

SEQ ID NO: 1218945 - protein, 9 aa, Homo Sapiens
SPGPPSPLT

SEQ ID NO: 1218946 - protein, 9 aa, Homo Sapiens
DAQDITSKL

SEQ ID NO: 1218947 - protein, 9 aa, Homo Sapiens
DVHCIHAIF

SEQ ID NO: 1218948 - protein, 9 aa, Homo Sapiens
KSRELRVNQ

SEQ ID NO: 1218949 - protein, 9 aa, Homo Sapiens
PASHSDVGL

SEQ ID NO: 1218950 - protein, 9 aa, Homo Sapiens
LNNGLDMET

SEQ ID NO: 1218951 - protein, 9 aa, Homo Sapiens
SRPDLLTPG

SEQ ID NO: 1218952 - protein, 9 aa, Homo Sapiens
ETNQHIWTR

SEQ ID NO: 1218953 - protein, 9 aa, Homo Sapiens
DGRYYNEAG

SEQ ID NO: 1218954 - protein, 9 aa, Homo Sapiens
KDGQGHTTA

SEQ ID NO: 1218955 - protein, 9 aa, Homo Sapiens
YHFLTLPDS

SEQ ID NO: 1218956 - protein, 9 aa, Homo Sapiens
RGGTNKDST

SEQ ID NO: 1218957 - protein, 9 aa, Homo Sapiens
VIHLCCKPY

SEQ ID NO: 1218958 - protein, 9 aa, Homo Sapiens
WLVPDIQGS

SEQ ID NO: 1218959 - protein, 9 aa, Homo Sapiens
LLNIVHSTL

SEQ ID NO: 1218960 - protein, 9 aa, Homo Sapiens
ESALVEHET

SEQ ID NO: 1218961 - protein, 9 aa, Homo Sapiens
RVSENIVCL

SEQ ID NO: 1218962 - protein, 9 aa, Homo Sapiens
FLTHFTVLT

SEQ ID NO: 1218963 - protein, 9 aa, Homo Sapiens
SFVNPLLPP

SEQ ID NO: 1218964 - protein, 9 aa, Homo Sapiens
KNPRKRLRK

SEQ ID NO: 1218965 - protein, 9 aa, Homo Sapiens
GGLGKEAEF

SEQ ID NO: 1218966 - protein, 9 aa, Homo Sapiens
TDVFVELLS

SEQ ID NO: 1218967 - protein, 9 aa, Homo Sapiens
CHGAADELV

SEQ ID NO: 1218968 - protein, 9 aa, Homo Sapiens
NPNGCISPL

SEQ ID NO: 1218969 - protein, 9 aa, Homo Sapiens
QTKKLIGIY

SEQ ID NO: 1218970 - protein, 9 aa, Homo Sapiens
LLPFYPLRG

SEQ ID NO: 1218971 - protein, 9 aa, Homo Sapiens
QSFMTPSCS

SEQ ID NO: 1218972 - protein, 9 aa, Homo Sapiens
DIDRWCSIV

SEQ ID NO: 1218973 - protein, 9 aa, Homo Sapiens
GGGWTVFQW

SEQ ID NO: 1218974 - protein, 9 aa, Homo Sapiens
FGEWSDQPH

SEQ ID NO: 1218975 - protein, 9 aa, Homo Sapiens
TRARSKHWP

SEQ ID NO: 1218976 - protein, 9 aa, Homo Sapiens
TSPPSLCHR

SEQ ID NO: 1218977 - protein, 9 aa, Homo Sapiens
LFKATGPRG

SEQ ID NO: 1218978 - protein, 9 aa, Homo Sapiens
KGTSDDDAP

SEQ ID NO: 1218979 - protein, 9 aa, Homo Sapiens
VPVRSSSIE

SEQ ID NO: 1218980 - protein, 9 aa, Homo Sapiens
DNGLTRTPT

SEQ ID NO: 1218981 - protein, 9 aa, Homo Sapiens
NLFDTTEVY

SEQ ID NO: 1218982 - protein, 9 aa, Homo Sapiens
NDINCLGPQ

SEQ ID NO: 1218983 - protein, 9 aa, Homo Sapiens
LVLQPWMGY

SEQ ID NO: 1218984 - protein, 9 aa, Homo Sapiens
QAMPNALYF

SEQ ID NO: 1218985 - protein, 9 aa, Homo Sapiens
CKYPDIVHQ

SEQ ID NO: 1218986 - protein, 9 aa, Homo Sapiens
HGTSISFSC

SEQ ID NO: 1218987 - protein, 9 aa, Homo Sapiens
VLGLLSTGS

SEQ ID NO: 1218988 - protein, 9 aa, Homo Sapiens
NDLDTQDPP

SEQ ID NO: 1218989 - protein, 9 aa, Homo Sapiens
QFQDALHKV

SEQ ID NO: 1218990 - protein, 9 aa, Homo Sapiens
QYCRKFDIA

SEQ ID NO: 1218991 - protein, 9 aa, Homo Sapiens
CAKQIQVLL

SEQ ID NO: 1218992 - protein, 9 aa, Homo Sapiens
GGTERSPGR

SEQ ID NO: 1218993 - protein, 9 aa, Homo Sapiens
MVVVGTGTS

SEQ ID NO: 1218994 - protein, 9 aa, Homo Sapiens
LISLSINRY

SEQ ID NO: 1218995 - protein, 9 aa, Homo Sapiens
TFSRIHLNH

SEQ ID NO: 1218996 - protein, 9 aa, Homo Sapiens
PCSSVDTRG

SEQ ID NO: 1218997 - protein, 9 aa, Homo Sapiens
RKATQSVLI

SEQ ID NO: 1218998 - protein, 9 aa, Homo Sapiens
SIHDVPSTL

SEQ ID NO: 1218999 - protein, 9 aa, Homo Sapiens
REECLQAKK

SEQ ID NO: 1219000 - protein, 9 aa, Homo Sapiens
TSTMPPRER

SEQ ID NO: 1219001 - protein, 9 aa, Homo Sapiens
FKMSIFSPM

SEQ ID NO: 1219002 - protein, 9 aa, Homo Sapiens
TGMCHQDDA

SEQ ID NO: 1219003 - protein, 9 aa, Homo Sapiens
VPMSPLRTV

SEQ ID NO: 1219004 - protein, 9 aa, Homo Sapiens
SKEKHVMKT

SEQ ID NO: 1219005 - protein, 9 aa, Homo Sapiens
SSQKGLQAL

SEQ ID NO: 1219006 - protein, 9 aa, Homo Sapiens
KLVCADMKA

SEQ ID NO: 1219007 - protein, 9 aa, Homo Sapiens
GRHRKIKRD

SEQ ID NO: 1219008 - protein, 9 aa, Homo Sapiens
HEEAERKAS

SEQ ID NO: 1219009 - protein, 9 aa, Homo Sapiens
GTLVPARAG

SEQ ID NO: 1219010 - protein, 9 aa, Homo Sapiens
AMYTLLCGS

SEQ ID NO: 1219011 - protein, 9 aa, Homo Sapiens
IVCTHNVVS

SEQ ID NO: 1219012 - protein, 9 aa, Homo Sapiens
RRPCQPLTR

SEQ ID NO: 1219013 - protein, 9 aa, Homo Sapiens
NYGKSYLVA

SEQ ID NO: 1219014 - protein, 9 aa, Homo Sapiens
VEYVVRNLA

SEQ ID NO: 1219015 - protein, 9 aa, Homo Sapiens
VINYLPKCI

SEQ ID NO: 1219016 - protein, 9 aa, Homo Sapiens
VHDSTMHSR

SEQ ID NO: 1219017 - protein, 9 aa, Homo Sapiens
TTEVYAAGK

SEQ ID NO: 1219018 - protein, 9 aa, Homo Sapiens
ANSFVGAPY

SEQ ID NO: 1219019 - protein, 9 aa, Homo Sapiens
FVSAVDGLI

SEQ ID NO: 1219020 - protein, 9 aa, Homo Sapiens
VTCSFVQVG

SEQ ID NO: 1219021 - protein, 9 aa, Homo Sapiens
LMAHYLKVR

SEQ ID NO: 1219022 - protein, 9 aa, Homo Sapiens
KYIKAALYV

SEQ ID NO: 1219023 - protein, 9 aa, Homo Sapiens
QCLDTAHQN

SEQ ID NO: 1219024 - protein, 9 aa, Homo Sapiens
NILKNIFKA

SEQ ID NO: 1219025 - protein, 9 aa, Homo Sapiens
TTVNYTLFE

SEQ ID NO: 1219026 - protein, 9 aa, Homo Sapiens
NIHITRPAF

SEQ ID NO: 1219027 - protein, 9 aa, Homo Sapiens
VDFLVSLTV

SEQ ID NO: 1219028 - protein, 9 aa, Homo Sapiens
FVNPLLPPP

SEQ ID NO: 1219029 - protein, 9 aa, Homo Sapiens
GVCWWLPYW

SEQ ID NO: 1219030 - protein, 9 aa, Homo Sapiens
GGIFFRCER

SEQ ID NO: 1219031 - protein, 9 aa, Homo Sapiens
CFPGNQHPL

SEQ ID NO: 1219032 - protein, 9 aa, Homo Sapiens
SRFAGSIFI

SEQ ID NO: 1219033 - protein, 9 aa, Homo Sapiens
SANWDETLL

SEQ ID NO: 1219034 - protein, 9 aa, Homo Sapiens
RLVGFVICV

SEQ ID NO: 1219035 - protein, 9 aa, Homo Sapiens
HVCILHPEL

SEQ ID NO: 1219036 - protein, 9 aa, Homo Sapiens
EEWLKNLRR

SEQ ID NO: 1219037 - protein, 9 aa, Homo Sapiens
DYAVFYELK

SEQ ID NO: 1219038 - protein, 9 aa, Homo Sapiens
RPEYVWIVQ

SEQ ID NO: 1219039 - protein, 9 aa, Homo Sapiens
SHPISICLG

SEQ ID NO: 1219040 - protein, 9 aa, Homo Sapiens
YMTMRQQPM

SEQ ID NO: 1219041 - protein, 9 aa, Homo Sapiens
IPYHPKPAS

SEQ ID NO: 1219042 - protein, 9 aa, Homo Sapiens
LYHAEIDAI

SEQ ID NO: 1219043 - protein, 9 aa, Homo Sapiens
ATWKNSRYL

SEQ ID NO: 1219044 - protein, 9 aa, Homo Sapiens
PASPLHQPS

SEQ ID NO: 1219045 - protein, 9 aa, Homo Sapiens
SSHSRSDLS

SEQ ID NO: 1219046 - protein, 9 aa, Homo Sapiens
TLQGHSHWV

SEQ ID NO: 1219047 - protein, 9 aa, Homo Sapiens
GGPDRIALQ

SEQ ID NO: 1219048 - protein, 9 aa, Homo Sapiens
AYTSGTPSS

SEQ ID NO: 1219049 - protein, 9 aa, Homo Sapiens
ATDFHFNAM

SEQ ID NO: 1219050 - protein, 9 aa, Homo Sapiens
AQVIVVYTD

SEQ ID NO: 1219051 - protein, 9 aa, Homo Sapiens
LLEPCIPPV

SEQ ID NO: 1219052 - protein, 9 aa, Homo Sapiens
KMLKENTSP

SEQ ID NO: 1219053 - protein, 9 aa, Homo Sapiens
APPLAFRGT

SEQ ID NO: 1219054 - protein, 9 aa, Homo Sapiens
FRRFRYQEV

SEQ ID NO: 1219055 - protein, 9 aa, Homo Sapiens
LIYPDRAWL

SEQ ID NO: 1219056 - protein, 9 aa, Homo Sapiens
LRIEGHLGQ

SEQ ID NO: 1219057 - protein, 9 aa, Homo Sapiens
FRNPSMCKR

SEQ ID NO: 1219058 - protein, 9 aa, Homo Sapiens
LAMVLGAFA

SEQ ID NO: 1219059 - protein, 9 aa, Homo Sapiens
GPPCTSTMP

SEQ ID NO: 1219060 - protein, 9 aa, Homo Sapiens
TLTLWNSAA

SEQ ID NO: 1219061 - protein, 9 aa, Homo Sapiens
VNCMSSQTK

SEQ ID NO: 1219062 - protein, 9 aa, Homo Sapiens
TDGGFMSLS

SEQ ID NO: 1219063 - protein, 9 aa, Homo Sapiens
FTELERCIV

SEQ ID NO: 1219064 - protein, 9 aa, Homo Sapiens
PDEEHMDMV

SEQ ID NO: 1219065 - protein, 9 aa, Homo Sapiens
PESSFYSIS

SEQ ID NO: 1219066 - protein, 9 aa, Homo Sapiens
DAKLTKIEN

SEQ ID NO: 1219067 - protein, 9 aa, Homo Sapiens
LHNPKAISV

SEQ ID NO: 1219068 - protein, 9 aa, Homo Sapiens
SLQLQVACM

SEQ ID NO: 1219069 - protein, 9 aa, Homo Sapiens
GIGITLSSS

SEQ ID NO: 1219070 - protein, 9 aa, Homo Sapiens
LTVITIPRP

SEQ ID NO: 1219071 - protein, 9 aa, Homo Sapiens
DYFWWEHLW

SEQ ID NO: 1219072 - protein, 9 aa, Homo Sapiens
LKTNILAAQ

SEQ ID NO: 1219073 - protein, 9 aa, Homo Sapiens
SGAYIFRHN

SEQ ID NO: 1219074 - protein, 9 aa, Homo Sapiens
TCVSLDDVL

SEQ ID NO: 1219075 - protein, 9 aa, Homo Sapiens
SKGLWMEYA

SEQ ID NO: 1219076 - protein, 9 aa, Homo Sapiens
RYPKMYLDG

SEQ ID NO: 1219077 - protein, 9 aa, Homo Sapiens
ATYESHLLH

SEQ ID NO: 1219078 - protein, 9 aa, Homo Sapiens
HDEACFSLV

SEQ ID NO: 1219079 - protein, 9 aa, Homo Sapiens
LMWLQEPQP

SEQ ID NO: 1219080 - protein, 9 aa, Homo Sapiens
NVFPKTNAT

SEQ ID NO: 1219081 - protein, 9 aa, Homo Sapiens
FQEGWRAQQ

SEQ ID NO: 1219082 - protein, 9 aa, Homo Sapiens
LNLANTLQK

SEQ ID NO: 1219083 - protein, 9 aa, Homo Sapiens
TSLETALNA

SEQ ID NO: 1219084 - protein, 9 aa, Homo Sapiens
SKWHWQVSL

SEQ ID NO: 1219085 - protein, 9 aa, Homo Sapiens
TSLVTSSAA

SEQ ID NO: 1219086 - protein, 9 aa, Homo Sapiens
LLYFFPRPT

SEQ ID NO: 1219087 - protein, 9 aa, Homo Sapiens
DLIHEAFSF

SEQ ID NO: 1219088 - protein, 9 aa, Homo Sapiens
HPLLLRNLM

SEQ ID NO: 1219089 - protein, 9 aa, Homo Sapiens
CNTLQPGCT

SEQ ID NO: 1219090 - protein, 9 aa, Homo Sapiens
VMVQNVLQI

SEQ ID NO: 1219091 - protein, 9 aa, Homo Sapiens
NLELIELFL

SEQ ID NO: 1219092 - protein, 9 aa, Homo Sapiens
LSTLPKYIF

SEQ ID NO: 1219093 - protein, 9 aa, Homo Sapiens
YTVMRCSAM

SEQ ID NO: 1219094 - protein, 9 aa, Homo Sapiens
VTFVALLLS

SEQ ID NO: 1219095 - protein, 9 aa, Homo Sapiens
VAKHPALCS

SEQ ID NO: 1219096 - protein, 9 aa, Homo Sapiens
GGHMMNCPK

SEQ ID NO: 1219097 - protein, 9 aa, Homo Sapiens
TCNHDEDTC

SEQ ID NO: 1219098 - protein, 9 aa, Homo Sapiens
GYKLMMVPE

SEQ ID NO: 1219099 - protein, 9 aa, Homo Sapiens
YMLTLHTKL

SEQ ID NO: 1219100 - protein, 9 aa, Homo Sapiens
FLKKFENPE

SEQ ID NO: 1219101 - protein, 9 aa, Homo Sapiens
CEICMAAGS

SEQ ID NO: 1219102 - protein, 9 aa, Homo Sapiens
TASLGTDSS

SEQ ID NO: 1219103 - protein, 9 aa, Homo Sapiens
IKYTISGES

SEQ ID NO: 1219104 - protein, 9 aa, Homo Sapiens
VWDSKKHTG

SEQ ID NO: 1219105 - protein, 9 aa, Homo Sapiens
THPMPTLLA

SEQ ID NO: 1219106 - protein, 9 aa, Homo Sapiens
LGPPRPHVL

SEQ ID NO: 1219107 - protein, 9 aa, Homo Sapiens
EDVHLARDF

SEQ ID NO: 1219108 - protein, 9 aa, Homo Sapiens
HDGGSFLMF

SEQ ID NO: 1219109 - protein, 9 aa, Homo Sapiens
GKVIIQGKN

SEQ ID NO: 1219110 - protein, 9 aa, Homo Sapiens
ESDTDGCRL

SEQ ID NO: 1219111 - protein, 9 aa, Homo Sapiens
TMADDQGCI

SEQ ID NO: 1219112 - protein, 9 aa, Homo Sapiens
MHINVQNGK

SEQ ID NO: 1219113 - protein, 9 aa, Homo Sapiens
VIVHHAMAD

SEQ ID NO: 1219114 - protein, 9 aa, Homo Sapiens
NKNKNVTNR

SEQ ID NO: 1219115 - protein, 9 aa, Homo Sapiens
EKIHSAVGQ

SEQ ID NO: 1219116 - protein, 9 aa, Homo Sapiens
YFLLPTSDM

SEQ ID NO: 1219117 - protein, 9 aa, Homo Sapiens
VCFRPKGSN

SEQ ID NO: 1219118 - protein, 9 aa, Homo Sapiens
FPQHSMAQQ

SEQ ID NO: 1219119 - protein, 9 aa, Homo Sapiens
SAVVGPVAE

SEQ ID NO: 1219120 - protein, 9 aa, Homo Sapiens
SGGVPGAIP

SEQ ID NO: 1219121 - protein, 9 aa, Homo Sapiens
PERTSYPPF

SEQ ID NO: 1219122 - protein, 9 aa, Homo Sapiens
AVAAMDKLM

SEQ ID NO: 1219123 - protein, 9 aa, Homo Sapiens
CLRCGHVYV

SEQ ID NO: 1219124 - protein, 9 aa, Homo Sapiens
GKGVGTPNL

SEQ ID NO: 1219125 - protein, 9 aa, Homo Sapiens
TSIIFCVEL

SEQ ID NO: 1219126 - protein, 9 aa, Homo Sapiens
TRHGWWAGF

SEQ ID NO: 1219127 - protein, 9 aa, Homo Sapiens
SEDDVHRLF

SEQ ID NO: 1219128 - protein, 9 aa, Homo Sapiens
LHQSATQAV

SEQ ID NO: 1219129 - protein, 9 aa, Homo Sapiens
VMLGETMSS

SEQ ID NO: 1219130 - protein, 9 aa, Homo Sapiens
FVMPLHHGL

SEQ ID NO: 1219131 - protein, 9 aa, Homo Sapiens
TPRSTSTTP

SEQ ID NO: 1219132 - protein, 9 aa, Homo Sapiens
FLVACRVEM

SEQ ID NO: 1219133 - protein, 9 aa, Homo Sapiens
KRCQRRGRL

SEQ ID NO: 1219134 - protein, 9 aa, Homo Sapiens
PHPLTVTAA

SEQ ID NO: 1219135 - protein, 9 aa, Homo Sapiens
TKMAVRLAD

SEQ ID NO: 1219136 - protein, 9 aa, Homo Sapiens
FFLELNVEK

SEQ ID NO: 1219137 - protein, 9 aa, Homo Sapiens
SVACNVGYP

SEQ ID NO: 1219138 - protein, 9 aa, Homo Sapiens
ATTRVMTNK

SEQ ID NO: 1219139 - protein, 9 aa, Homo Sapiens
IQAQPQIAT

SEQ ID NO: 1219140 - protein, 9 aa, Homo Sapiens
AYTSLQFSK

SEQ ID NO: 1219141 - protein, 9 aa, Homo Sapiens
LNYSENTPF

SEQ ID NO: 1219142 - protein, 9 aa, Homo Sapiens
LEKKEGHID

SEQ ID NO: 1219143 - protein, 9 aa, Homo Sapiens
KAAQGLQEG

SEQ ID NO: 1219144 - protein, 9 aa, Homo Sapiens
MIIRPSIEE

SEQ ID NO: 1219145 - protein, 9 aa, Homo Sapiens
RERHLKMWE

SEQ ID NO: 1219146 - protein, 9 aa, Homo Sapiens
AEQELDDLV

SEQ ID NO: 1219147 - protein, 9 aa, Homo Sapiens
GRQSKYTVN

SEQ ID NO: 1219148 - protein, 9 aa, Homo Sapiens
AGARRSKAK

SEQ ID NO: 1219149 - protein, 9 aa, Homo Sapiens
VRHAQPVSS

SEQ ID NO: 1219150 - protein, 9 aa, Homo Sapiens
LNPIGVGCV

SEQ ID NO: 1219151 - protein, 9 aa, Homo Sapiens
QASSDVEVE

SEQ ID NO: 1219152 - protein, 9 aa, Homo Sapiens
QMEQKNYNK

SEQ ID NO: 1219153 - protein, 9 aa, Homo Sapiens
AAAAAGILG

SEQ ID NO: 1219154 - protein, 9 aa, Homo Sapiens
GWYPFHDIE

SEQ ID NO: 1219155 - protein, 9 aa, Homo Sapiens
GGLGVVVVF

SEQ ID NO: 1219156 - protein, 9 aa, Homo Sapiens
NPGKSFSTR

SEQ ID NO: 1219157 - protein, 9 aa, Homo Sapiens
EVQMRVMGL

SEQ ID NO: 1219158 - protein, 9 aa, Homo Sapiens
NTGLIKVFR

SEQ ID NO: 1219159 - protein, 9 aa, Homo Sapiens
SQARTRAGL

SEQ ID NO: 1219160 - protein, 9 aa, Homo Sapiens
SRGQSELIL

SEQ ID NO: 1219161 - protein, 9 aa, Homo Sapiens
YSCKGNITH

SEQ ID NO: 1219162 - protein, 9 aa, Homo Sapiens
KKVVTKWKK

SEQ ID NO: 1219163 - protein, 9 aa, Homo Sapiens
EDRAMSQDS

SEQ ID NO: 1219164 - protein, 9 aa, Homo Sapiens
PWSVSAASS

SEQ ID NO: 1219165 - protein, 9 aa, Homo Sapiens
SPLHVKGGV

SEQ ID NO: 1219166 - protein, 9 aa, Homo Sapiens
AKWPNRISS

SEQ ID NO: 1219167 - protein, 9 aa, Homo Sapiens
FIYNKDGPD

SEQ ID NO: 1219168 - protein, 9 aa, Homo Sapiens
PHGHHWQGP

SEQ ID NO: 1219169 - protein, 9 aa, Homo Sapiens
LKVPRGMAY

SEQ ID NO: 1219170 - protein, 9 aa, Homo Sapiens
LRVNQGLDT

SEQ ID NO: 1219171 - protein, 9 aa, Homo Sapiens
KKKYIKAAL

SEQ ID NO: 1219172 - protein, 9 aa, Homo Sapiens
RSGAPASWI

SEQ ID NO: 1219173 - protein, 9 aa, Homo Sapiens
KERPFHCTQ

SEQ ID NO: 1219174 - protein, 9 aa, Homo Sapiens
IMRKVSGHP

SEQ ID NO: 1219175 - protein, 9 aa, Homo Sapiens
QTEIVRSGH

SEQ ID NO: 1219176 - protein, 9 aa, Homo Sapiens
SVGGNAGVR

SEQ ID NO: 1219177 - protein, 9 aa, Homo Sapiens
HAQPYHMLR

SEQ ID NO: 1219178 - protein, 9 aa, Homo Sapiens
RQLTALPSS

SEQ ID NO: 1219179 - protein, 9 aa, Homo Sapiens
CAGCGKNFG

SEQ ID NO: 1219180 - protein, 9 aa, Homo Sapiens
NTSWRVAST

SEQ ID NO: 1219181 - protein, 9 aa, Homo Sapiens
PMLMPPLPS

SEQ ID NO: 1219182 - protein, 9 aa, Homo Sapiens
PGLWLHHAF

SEQ ID NO: 1219183 - protein, 9 aa, Homo Sapiens
LHCHLVHLF

SEQ ID NO: 1219184 - protein, 9 aa, Homo Sapiens
VERVLYSME

SEQ ID NO: 1219185 - protein, 9 aa, Homo Sapiens
EKNKDPSPV

SEQ ID NO: 1219186 - protein, 9 aa, Homo Sapiens
HLARHQQIH

SEQ ID NO: 1219187 - protein, 9 aa, Homo Sapiens
THFALTIPH

SEQ ID NO: 1219188 - protein, 9 aa, Homo Sapiens
EQDLLQELF

SEQ ID NO: 1219189 - protein, 9 aa, Homo Sapiens
PAAPSPAPC

SEQ ID NO: 1219190 - protein, 9 aa, Homo Sapiens
FYVHAYISK

SEQ ID NO: 1219191 - protein, 9 aa, Homo Sapiens
LTSPSEETW

SEQ ID NO: 1219192 - protein, 9 aa, Homo Sapiens
VFRPDIYPY

SEQ ID NO: 1219193 - protein, 9 aa, Homo Sapiens
HPRAQCVVL

SEQ ID NO: 1219194 - protein, 9 aa, Homo Sapiens
PSTSPRSLV

SEQ ID NO: 1219195 - protein, 9 aa, Homo Sapiens
GEPLEAEPQ

SEQ ID NO: 1219196 - protein, 9 aa, Homo Sapiens
GRHQNCSFP

SEQ ID NO: 1219197 - protein, 9 aa, Homo Sapiens
GTLDLVDVS

SEQ ID NO: 1219198 - protein, 9 aa, Homo Sapiens
YWDIRGLTH

SEQ ID NO: 1219199 - protein, 9 aa, Homo Sapiens
CFKGLYVVI

SEQ ID NO: 1219200 - protein, 9 aa, Homo Sapiens
DDEFYQHWQ

SEQ ID NO: 1219201 - protein, 9 aa, Homo Sapiens
HSIVGFVMY

SEQ ID NO: 1219202 - protein, 9 aa, Homo Sapiens
CHRPFHLEE

SEQ ID NO: 1219203 - protein, 9 aa, Homo Sapiens
SGAACPFTI

SEQ ID NO: 1219204 - protein, 9 aa, Homo Sapiens
RASNKNVTV

SEQ ID NO: 1219205 - protein, 9 aa, Homo Sapiens
RISIYWVHF

SEQ ID NO: 1219206 - protein, 9 aa, Homo Sapiens
TYLAQAGLA

SEQ ID NO: 1219207 - protein, 9 aa, Homo Sapiens
PGGIFFRCE

SEQ ID NO: 1219208 - protein, 9 aa, Homo Sapiens
PAENKMNLT

SEQ ID NO: 1219209 - protein, 9 aa, Homo Sapiens
ELDDLVAVD

SEQ ID NO: 1219210 - protein, 9 aa, Homo Sapiens
DHIFAVEWM

SEQ ID NO: 1219211 - protein, 9 aa, Homo Sapiens
LNKWDMLKR

SEQ ID NO: 1219212 - protein, 9 aa, Homo Sapiens
GIGHNGHEL

SEQ ID NO: 1219213 - protein, 9 aa, Homo Sapiens
DLTLTHPPA

SEQ ID NO: 1219214 - protein, 9 aa, Homo Sapiens
FMSDTELFQ

SEQ ID NO: 1219215 - protein, 9 aa, Homo Sapiens
PLLLPCTHS

SEQ ID NO: 1219216 - protein, 9 aa, Homo Sapiens
VIAPLPTIT

SEQ ID NO: 1219217 - protein, 9 aa, Homo Sapiens
REWDSATAY

SEQ ID NO: 1219218 - protein, 9 aa, Homo Sapiens
KGVLKRRAG

SEQ ID NO: 1219219 - protein, 9 aa, Homo Sapiens
RVGHCVIKN

SEQ ID NO: 1219220 - protein, 9 aa, Homo Sapiens
YQGHLSMHH

SEQ ID NO: 1219221 - protein, 9 aa, Homo Sapiens
EDLSGSDSD

SEQ ID NO: 1219222 - protein, 9 aa, Homo Sapiens
LLLALKVNH

SEQ ID NO: 1219223 - protein, 9 aa, Homo Sapiens
PYFLYLETA

SEQ ID NO: 1219224 - protein, 9 aa, Homo Sapiens
ELPQCFCRI

SEQ ID NO: 1219225 - protein, 9 aa, Homo Sapiens
LSTDSHFPY

SEQ ID NO: 1219226 - protein, 9 aa, Homo Sapiens
IDQRYLCVM

SEQ ID NO: 1219227 - protein, 9 aa, Homo Sapiens
MHWFGLVSR

SEQ ID NO: 1219228 - protein, 9 aa, Homo Sapiens
FPGNQHPLG

SEQ ID NO: 1219229 - protein, 9 aa, Homo Sapiens
GAGRIWPDE

SEQ ID NO: 1219230 - protein, 9 aa, Homo Sapiens
PRLSRNKIT

SEQ ID NO: 1219231 - protein, 9 aa, Homo Sapiens
FRKLKVLQK

SEQ ID NO: 1219232 - protein, 9 aa, Homo Sapiens
LLMIWSVTN

SEQ ID NO: 1219233 - protein, 9 aa, Homo Sapiens
PMATGQRPS

SEQ ID NO: 1219234 - protein, 9 aa, Homo Sapiens
PLTCTNIDL

SEQ ID NO: 1219235 - protein, 9 aa, Homo Sapiens
TLSWSPPGP

SEQ ID NO: 1219236 - protein, 9 aa, Homo Sapiens
RVQLMWIRQ

SEQ ID NO: 1219237 - protein, 9 aa, Homo Sapiens
VLIKHEIQR

SEQ ID NO: 1219238 - protein, 9 aa, Homo Sapiens
SGGGATSRG

SEQ ID NO: 1219239 - protein, 9 aa, Homo Sapiens
MKYMYPYEC

SEQ ID NO: 1219240 - protein, 9 aa, Homo Sapiens
KSLALYLLF

SEQ ID NO: 1219241 - protein, 9 aa, Homo Sapiens
SELLWDILQ

SEQ ID NO: 1219242 - protein, 9 aa, Homo Sapiens
HSRKDSPLI

SEQ ID NO: 1219243 - protein, 9 aa, Homo Sapiens
CNQKKENEI

SEQ ID NO: 1219244 - protein, 9 aa, Homo Sapiens
LHVTNQGMT

SEQ ID NO: 1219245 - protein, 9 aa, Homo Sapiens
THPLRSFVN

SEQ ID NO: 1219246 - protein, 9 aa, Homo Sapiens
HILTSILNI

SEQ ID NO: 1219247 - protein, 9 aa, Homo Sapiens
SCPVGTGMD

SEQ ID NO: 1219248 - protein, 9 aa, Homo Sapiens
QAIYPHYPP

SEQ ID NO: 1219249 - protein, 9 aa, Homo Sapiens
NWSTKISLI

SEQ ID NO: 1219250 - protein, 9 aa, Homo Sapiens
HPGHAFFLE

SEQ ID NO: 1219251 - protein, 9 aa, Homo Sapiens
VPEIIGDCC

SEQ ID NO: 1219252 - protein, 9 aa, Homo Sapiens
ETEHFNGVD

SEQ ID NO: 1219253 - protein, 9 aa, Homo Sapiens
LKRTTYVMF

SEQ ID NO: 1219254 - protein, 9 aa, Homo Sapiens
HDTLQIREQ

SEQ ID NO: 1219255 - protein, 9 aa, Homo Sapiens
CPSMEVYES

SEQ ID NO: 1219256 - protein, 9 aa, Homo Sapiens
TTIPPSQVR

SEQ ID NO: 1219257 - protein, 9 aa, Homo Sapiens
HHFSHTIRC

SEQ ID NO: 1219258 - protein, 9 aa, Homo Sapiens
GEEVSLHFL

SEQ ID NO: 1219259 - protein, 9 aa, Homo Sapiens
TVCATVAQF

SEQ ID NO: 1219260 - protein, 9 aa, Homo Sapiens
LLNHPFIQD

SEQ ID NO: 1219261 - protein, 9 aa, Homo Sapiens
QHVKNQGTA

SEQ ID NO: 1219262 - protein, 9 aa, Homo Sapiens
SEGGEVIIT

SEQ ID NO: 1219263 - protein, 9 aa, Homo Sapiens
DYEGHSDGD

SEQ ID NO: 1219264 - protein, 9 aa, Homo Sapiens
VPSPVWDVR

SEQ ID NO: 1219265 - protein, 9 aa, Homo Sapiens
PFPSHMLPE

SEQ ID NO: 1219266 - protein, 9 aa, Homo Sapiens
DLSLTSSPN

SEQ ID NO: 1219267 - protein, 9 aa, Homo Sapiens
IIKLTGVHT

SEQ ID NO: 1219268 - protein, 9 aa, Homo Sapiens
STSSMMSVK

SEQ ID NO: 1219269 - protein, 9 aa, Homo Sapiens
STVCHPLIY

SEQ ID NO: 1219270 - protein, 9 aa, Homo Sapiens
ITSFYNHSW

SEQ ID NO: 1219271 - protein, 9 aa, Homo Sapiens
WGLQSKIEN

SEQ ID NO: 1219272 - protein, 9 aa, Homo Sapiens
PWNEYKSDS

SEQ ID NO: 1219273 - protein, 9 aa, Homo Sapiens
TWPPLFFLQ

SEQ ID NO: 1219274 - protein, 9 aa, Homo Sapiens
RALHQASED

SEQ ID NO: 1219275 - protein, 9 aa, Homo Sapiens
KTQAYHRLK

SEQ ID NO: 1219276 - protein, 9 aa, Homo Sapiens
LTFQDQRYS

SEQ ID NO: 1219277 - protein, 9 aa, Homo Sapiens
GLCRALHSY

SEQ ID NO: 1219278 - protein, 9 aa, Homo Sapiens
PGEAAVFPH

SEQ ID NO: 1219279 - protein, 9 aa, Homo Sapiens
GMTFAGFVS

SEQ ID NO: 1219280 - protein, 9 aa, Homo Sapiens
SRTMIENFN

SEQ ID NO: 1219281 - protein, 9 aa, Homo Sapiens
QVMAKHPRN

SEQ ID NO: 1219282 - protein, 9 aa, Homo Sapiens
LRIQREQVL

SEQ ID NO: 1219283 - protein, 9 aa, Homo Sapiens
TRRGAPRPG

SEQ ID NO: 1219284 - protein, 9 aa, Homo Sapiens
VRMRQKPSD

SEQ ID NO: 1219285 - protein, 9 aa, Homo Sapiens
PKTISGDMR

SEQ ID NO: 1219286 - protein, 9 aa, Homo Sapiens
ANNKIMTIN

SEQ ID NO: 1219287 - protein, 9 aa, Homo Sapiens
EPSCKAKNI

SEQ ID NO: 1219288 - protein, 9 aa, Homo Sapiens
EAQILAFTG

SEQ ID NO: 1219289 - protein, 9 aa, Homo Sapiens
DRIFSYTGD

SEQ ID NO: 1219290 - protein, 9 aa, Homo Sapiens
EYSRLLDVP

SEQ ID NO: 1219291 - protein, 9 aa, Homo Sapiens
HCQEKEIEA

SEQ ID NO: 1219292 - protein, 9 aa, Homo Sapiens
DIQEIISHY

SEQ ID NO: 1219293 - protein, 9 aa, Homo Sapiens
VIATIVTVM

SEQ ID NO: 1219294 - protein, 9 aa, Homo Sapiens
KLHSEIKFV

SEQ ID NO: 1219295 - protein, 9 aa, Homo Sapiens
YTVEYSFSL

SEQ ID NO: 1219296 - protein, 9 aa, Homo Sapiens
EELISELQD

SEQ ID NO: 1219297 - protein, 9 aa, Homo Sapiens
SIDNSQLME

SEQ ID NO: 1219298 - protein, 9 aa, Homo Sapiens
ALHILQQTF

SEQ ID NO: 1219299 - protein, 9 aa, Homo Sapiens
TKKWGDHFV

SEQ ID NO: 1219300 - protein, 9 aa, Homo Sapiens
QYTLDNSLW

SEQ ID NO: 1219301 - protein, 9 aa, Homo Sapiens
RMPAFLDNH

SEQ ID NO: 1219302 - protein, 9 aa, Homo Sapiens
TGSEADGLD

SEQ ID NO: 1219303 - protein, 9 aa, Homo Sapiens
LKGGLSWAL

SEQ ID NO: 1219304 - protein, 9 aa, Homo Sapiens
CVVGTLFKD

SEQ ID NO: 1219305 - protein, 9 aa, Homo Sapiens
GQEMLVRVT

SEQ ID NO: 1219306 - protein, 9 aa, Homo Sapiens
GGATALPLY

SEQ ID NO: 1219307 - protein, 9 aa, Homo Sapiens
HTIALTGSA

SEQ ID NO: 1219308 - protein, 9 aa, Homo Sapiens
ATLPLQPSS

SEQ ID NO: 1219309 - protein, 9 aa, Homo Sapiens
QWHPVSREW

SEQ ID NO: 1219310 - protein, 9 aa, Homo Sapiens
HGAPGPVCY

SEQ ID NO: 1219311 - protein, 9 aa, Homo Sapiens
AAMCVCPFC

SEQ ID NO: 1219312 - protein, 9 aa, Homo Sapiens
SEKASSISP

SEQ ID NO: 1219313 - protein, 9 aa, Homo Sapiens
NRLTTSVDL

SEQ ID NO: 1219314 - protein, 9 aa, Homo Sapiens
SRGGNLYVL

SEQ ID NO: 1219315 - protein, 9 aa, Homo Sapiens
DKPLFHIYL

SEQ ID NO: 1219316 - protein, 9 aa, Homo Sapiens
NQVNISASE

SEQ ID NO: 1219317 - protein, 9 aa, Homo Sapiens
HRVDFDLYK

SEQ ID NO: 1219318 - protein, 9 aa, Homo Sapiens
IQYTQISQP

SEQ ID NO: 1219319 - protein, 9 aa, Homo Sapiens
RGLSWRSDP

SEQ ID NO: 1219320 - protein, 9 aa, Homo Sapiens
GESVQDYDS

SEQ ID NO: 1219321 - protein, 9 aa, Homo Sapiens
RENCDINII

SEQ ID NO: 1219322 - protein, 9 aa, Homo Sapiens
DNMFFYQRR

SEQ ID NO: 1219323 - protein, 9 aa, Homo Sapiens
ISVIQKFVL

SEQ ID NO: 1219324 - protein, 9 aa, Homo Sapiens
NMFFYQRRH

SEQ ID NO: 1219325 - protein, 9 aa, Homo Sapiens
YHAEIDAIY

SEQ ID NO: 1219326 - protein, 9 aa, Homo Sapiens
ERLREKIYR

SEQ ID NO: 1219327 - protein, 9 aa, Homo Sapiens
DDAHAEMHD

SEQ ID NO: 1219328 - protein, 9 aa, Homo Sapiens
TALIVLHTV

SEQ ID NO: 1219329 - protein, 9 aa, Homo Sapiens
SSHRLCILR

SEQ ID NO: 1219330 - protein, 9 aa, Homo Sapiens
FHALIKGGA

SEQ ID NO: 1219331 - protein, 9 aa, Homo Sapiens
SPGHGVSAP

SEQ ID NO: 1219332 - protein, 9 aa, Homo Sapiens
FQSERSRAH

SEQ ID NO: 1219333 - protein, 9 aa, Homo Sapiens
CISIVHMYQ

SEQ ID NO: 1219334 - protein, 9 aa, Homo Sapiens
PTYLVAIVI

SEQ ID NO: 1219335 - protein, 9 aa, Homo Sapiens
IGEPTSNET

SEQ ID NO: 1219336 - protein, 9 aa, Homo Sapiens
AYNSDGLAA

SEQ ID NO: 1219337 - protein, 9 aa, Homo Sapiens
LRIFTSVLK

SEQ ID NO: 1219338 - protein, 9 aa, Homo Sapiens
QELSNDLDT

SEQ ID NO: 1219339 - protein, 9 aa, Homo Sapiens
ASANRFTKA

SEQ ID NO: 1219340 - protein, 9 aa, Homo Sapiens
ILAMKAIRN

SEQ ID NO: 1219341 - protein, 9 aa, Homo Sapiens
SIHRTPRST

SEQ ID NO: 1219342 - protein, 9 aa, Homo Sapiens
FNGNLSSPG

SEQ ID NO: 1219343 - protein, 9 aa, Homo Sapiens
RNGPEFEAM

SEQ ID NO: 1219344 - protein, 9 aa, Homo Sapiens
QTHPLVSQA

SEQ ID NO: 1219345 - protein, 9 aa, Homo Sapiens
QRKLLPHRH

SEQ ID NO: 1219346 - protein, 9 aa, Homo Sapiens
IEHITGFTL

SEQ ID NO: 1219347 - protein, 9 aa, Homo Sapiens
GPMATGQRP

SEQ ID NO: 1219348 - protein, 9 aa, Homo Sapiens
HPGFCCLLP

SEQ ID NO: 1219349 - protein, 9 aa, Homo Sapiens
ILETDSVSL

SEQ ID NO: 1219350 - protein, 9 aa, Homo Sapiens
PRVCHVLAF

SEQ ID NO: 1219351 - protein, 9 aa, Homo Sapiens
PRNLLTTDA

SEQ ID NO: 1219352 - protein, 9 aa, Homo Sapiens
VDIERMSSG

SEQ ID NO: 1219353 - protein, 9 aa, Homo Sapiens
LGERPVQHH

SEQ ID NO: 1219354 - protein, 9 aa, Homo Sapiens
EVGVRVESN

SEQ ID NO: 1219355 - protein, 9 aa, Homo Sapiens
KNNVPMLKL

SEQ ID NO: 1219356 - protein, 9 aa, Homo Sapiens
SDIIVKACQ

SEQ ID NO: 1219357 - protein, 9 aa, Homo Sapiens
HSHGPLQTD

SEQ ID NO: 1219358 - protein, 9 aa, Homo Sapiens
KKKGRKTVE

SEQ ID NO: 1219359 - protein, 9 aa, Homo Sapiens
CSYAKLPSP

SEQ ID NO: 1219360 - protein, 9 aa, Homo Sapiens
ANQGRRGRV

SEQ ID NO: 1219361 - protein, 9 aa, Homo Sapiens
GSAGVKVWY

SEQ ID NO: 1219362 - protein, 9 aa, Homo Sapiens
FPRGFKFDM

SEQ ID NO: 1219363 - protein, 9 aa, Homo Sapiens
MVSGLDYRR

SEQ ID NO: 1219364 - protein, 9 aa, Homo Sapiens
FKANRVYTL

SEQ ID NO: 1219365 - protein, 9 aa, Homo Sapiens
GILPSGMVI

SEQ ID NO: 1219366 - protein, 9 aa, Homo Sapiens
SNVAGIFYI

SEQ ID NO: 1219367 - protein, 9 aa, Homo Sapiens
AWLRQKNDG

SEQ ID NO: 1219368 - protein, 9 aa, Homo Sapiens
IYVFMGNMI

SEQ ID NO: 1219369 - protein, 9 aa, Homo Sapiens
REPVELGKT

SEQ ID NO: 1219370 - protein, 9 aa, Homo Sapiens
SQHFRKVSE

SEQ ID NO: 1219371 - protein, 9 aa, Homo Sapiens
FTFIRLLPS

SEQ ID NO: 1219372 - protein, 9 aa, Homo Sapiens
MVRWVDPTA

SEQ ID NO: 1219373 - protein, 9 aa, Homo Sapiens
LPLPRKAHR

SEQ ID NO: 1219374 - protein, 9 aa, Homo Sapiens
WRYVQRGAT

SEQ ID NO: 1219375 - protein, 9 aa, Homo Sapiens
MQAKTFSEA

SEQ ID NO: 1219376 - protein, 9 aa, Homo Sapiens
GTICSPECS

SEQ ID NO: 1219377 - protein, 9 aa, Homo Sapiens
LRAVVQSSP

SEQ ID NO: 1219378 - protein, 9 aa, Homo Sapiens
MFKLLNTHA

SEQ ID NO: 1219379 - protein, 9 aa, Homo Sapiens
KSGVKLDAA

SEQ ID NO: 1219380 - protein, 9 aa, Homo Sapiens
FLEADVQAI

SEQ ID NO: 1219381 - protein, 9 aa, Homo Sapiens
GIPVVVAMN

SEQ ID NO: 1219382 - protein, 9 aa, Homo Sapiens
RPRVFYIGR

SEQ ID NO: 1219383 - protein, 9 aa, Homo Sapiens
DFKTDLHFQ

SEQ ID NO: 1219384 - protein, 9 aa, Homo Sapiens
LGSMFQNVT

SEQ ID NO: 1219385 - protein, 9 aa, Homo Sapiens
RSREELPYN

SEQ ID NO: 1219386 - protein, 9 aa, Homo Sapiens
VRVNKVMVA

SEQ ID NO: 1219387 - protein, 9 aa, Homo Sapiens
ICGHAPFEA

SEQ ID NO: 1219388 - protein, 9 aa, Homo Sapiens
VGPVAVLDF

SEQ ID NO: 1219389 - protein, 9 aa, Homo Sapiens
HQSTSFWLM

SEQ ID NO: 1219390 - protein, 9 aa, Homo Sapiens
QVPRGRLFT

SEQ ID NO: 1219391 - protein, 9 aa, Homo Sapiens
KASATFNSP

SEQ ID NO: 1219392 - protein, 9 aa, Homo Sapiens
HLEARLNIA

SEQ ID NO: 1219393 - protein, 9 aa, Homo Sapiens
LFRMPGQAS

SEQ ID NO: 1219394 - protein, 9 aa, Homo Sapiens
DLIGLNGIG

SEQ ID NO: 1219395 - protein, 9 aa, Homo Sapiens
TLGYTNSSL

SEQ ID NO: 1219396 - protein, 9 aa, Homo Sapiens
HDEHLQHQD

SEQ ID NO: 1219397 - protein, 9 aa, Homo Sapiens
TLSITSEHH

SEQ ID NO: 1219398 - protein, 9 aa, Homo Sapiens
SARGGRTMG

SEQ ID NO: 1219399 - protein, 9 aa, Homo Sapiens
AVFEWYITK

SEQ ID NO: 1219400 - protein, 9 aa, Homo Sapiens
YHSLILTAL

SEQ ID NO: 1219401 - protein, 9 aa, Homo Sapiens
HQPRINSYV

SEQ ID NO: 1219402 - protein, 9 aa, Homo Sapiens
RLTSPSEET

SEQ ID NO: 1219403 - protein, 9 aa, Homo Sapiens
RLILPQMSK

SEQ ID NO: 1219404 - protein, 9 aa, Homo Sapiens
PLQGEHSGQ

SEQ ID NO: 1219405 - protein, 9 aa, Homo Sapiens
LNTIGKEDN

SEQ ID NO: 1219406 - protein, 9 aa, Homo Sapiens
ILLSPNYSL

SEQ ID NO: 1219407 - protein, 9 aa, Homo Sapiens
IKCEYMPNA

SEQ ID NO: 1219408 - protein, 9 aa, Homo Sapiens
SVLSGANIM

SEQ ID NO: 1219409 - protein, 9 aa, Homo Sapiens
LEEECTNEP

SEQ ID NO: 1219410 - protein, 9 aa, Homo Sapiens
VGAETMHTL

SEQ ID NO: 1219411 - protein, 9 aa, Homo Sapiens
DNGYLLEKK

SEQ ID NO: 1219412 - protein, 9 aa, Homo Sapiens
SLDSKHQKY

SEQ ID NO: 1219413 - protein, 9 aa, Homo Sapiens
HLNSKFGKG

SEQ ID NO: 1219414 - protein, 9 aa, Homo Sapiens
GLSKDTSRC

SEQ ID NO: 1219415 - protein, 9 aa, Homo Sapiens
ERARQGCLR

SEQ ID NO: 1219416 - protein, 9 aa, Homo Sapiens
TLSITCHRS

SEQ ID NO: 1219417 - protein, 9 aa, Homo Sapiens
EIDNSATCS

SEQ ID NO: 1219418 - protein, 9 aa, Homo Sapiens
ILIMSVIIT

SEQ ID NO: 1219419 - protein, 9 aa, Homo Sapiens
GNEEKAVIT

SEQ ID NO: 1219420 - protein, 9 aa, Homo Sapiens
TTAAATGPA

SEQ ID NO: 1219421 - protein, 9 aa, Homo Sapiens
LPEHAILKM

SEQ ID NO: 1219422 - protein, 9 aa, Homo Sapiens
EVGTETVID

SEQ ID NO: 1219423 - protein, 9 aa, Homo Sapiens
EDVCEEEIP

SEQ ID NO: 1219424 - protein, 9 aa, Homo Sapiens
DERKQHALA

SEQ ID NO: 1219425 - protein, 9 aa, Homo Sapiens
LDLVCQCFL

SEQ ID NO: 1219426 - protein, 9 aa, Homo Sapiens
IGELAKGIR

SEQ ID NO: 1219427 - protein, 9 aa, Homo Sapiens
SAHFTLGPL

SEQ ID NO: 1219428 - protein, 9 aa, Homo Sapiens
ELLKHEKIQ

SEQ ID NO: 1219429 - protein, 9 aa, Homo Sapiens
NCICQKFAV

SEQ ID NO: 1219430 - protein, 9 aa, Homo Sapiens
KMDSFTQVF

SEQ ID NO: 1219431 - protein, 9 aa, Homo Sapiens
EQRWQLQKQ

SEQ ID NO: 1219432 - protein, 9 aa, Homo Sapiens
LSAVMMLHH

SEQ ID NO: 1219433 - protein, 9 aa, Homo Sapiens
GKSFLSSYA

SEQ ID NO: 1219434 - protein, 9 aa, Homo Sapiens
IDISSLVVH

SEQ ID NO: 1219435 - protein, 9 aa, Homo Sapiens
PHHSIRCMN

SEQ ID NO: 1219436 - protein, 9 aa, Homo Sapiens
EVASTASRL

SEQ ID NO: 1219437 - protein, 9 aa, Homo Sapiens
TQASAAPTS

SEQ ID NO: 1219438 - protein, 9 aa, Homo Sapiens
TLGHFYECC

SEQ ID NO: 1219439 - protein, 9 aa, Homo Sapiens
SVSAELLLL

SEQ ID NO: 1219440 - protein, 9 aa, Homo Sapiens
RSSGAVSSA

SEQ ID NO: 1219441 - protein, 9 aa, Homo Sapiens
QVVRKPLEA

SEQ ID NO: 1219442 - protein, 9 aa, Homo Sapiens
GDPGGERGL

SEQ ID NO: 1219443 - protein, 9 aa, Homo Sapiens
PQLQSVVGI

SEQ ID NO: 1219444 - protein, 9 aa, Homo Sapiens
KRATPLQFA

SEQ ID NO: 1219445 - protein, 9 aa, Homo Sapiens
RGPKGERGE

SEQ ID NO: 1219446 - protein, 9 aa, Homo Sapiens
QYNGMIRQK

SEQ ID NO: 1219447 - protein, 9 aa, Homo Sapiens
YTISGESAG

SEQ ID NO: 1219448 - protein, 9 aa, Homo Sapiens
AVDQALIGM

SEQ ID NO: 1219449 - protein, 9 aa, Homo Sapiens
SIIMNTALD

SEQ ID NO: 1219450 - protein, 9 aa, Homo Sapiens
DLYARDGLC

SEQ ID NO: 1219451 - protein, 9 aa, Homo Sapiens
YHSRDESAD

SEQ ID NO: 1219452 - protein, 9 aa, Homo Sapiens
GGGWICWRS

SEQ ID NO: 1219453 - protein, 9 aa, Homo Sapiens
MEGASARKT

SEQ ID NO: 1219454 - protein, 9 aa, Homo Sapiens
AEGAVYPFV

SEQ ID NO: 1219455 - protein, 9 aa, Homo Sapiens
DFGVNGHVT

SEQ ID NO: 1219456 - protein, 9 aa, Homo Sapiens
QVLDSQHQR

SEQ ID NO: 1219457 - protein, 9 aa, Homo Sapiens
KEEFLTDTE

SEQ ID NO: 1219458 - protein, 9 aa, Homo Sapiens
SVRKEEETD

SEQ ID NO: 1219459 - protein, 9 aa, Homo Sapiens
VKKRSRKKR

SEQ ID NO: 1219460 - protein, 9 aa, Homo Sapiens
VRNNVLLDL

SEQ ID NO: 1219461 - protein, 9 aa, Homo Sapiens
FRKMQEDEE

SEQ ID NO: 1219462 - protein, 9 aa, Homo Sapiens
WLGCLAGPV

SEQ ID NO: 1219463 - protein, 9 aa, Homo Sapiens
MKKGIHYET

SEQ ID NO: 1219464 - protein, 9 aa, Homo Sapiens
QTPKEGVRV

SEQ ID NO: 1219465 - protein, 9 aa, Homo Sapiens
SLHEKIQPL

SEQ ID NO: 1219466 - protein, 9 aa, Homo Sapiens
LSVIALFYG

SEQ ID NO: 1219467 - protein, 9 aa, Homo Sapiens
EPLREEGIE

SEQ ID NO: 1219468 - protein, 9 aa, Homo Sapiens
EDQKEDRAM

SEQ ID NO: 1219469 - protein, 9 aa, Homo Sapiens
PIMRIIIDH

SEQ ID NO: 1219470 - protein, 9 aa, Homo Sapiens
SNSVGTTSD

SEQ ID NO: 1219471 - protein, 9 aa, Homo Sapiens
FLCLLSTLQ

SEQ ID NO: 1219472 - protein, 9 aa, Homo Sapiens
KKLGQSTRA

SEQ ID NO: 1219473 - protein, 9 aa, Homo Sapiens
RVSTLTKAK

SEQ ID NO: 1219474 - protein, 9 aa, Homo Sapiens
QHLGTPITV

SEQ ID NO: 1219475 - protein, 9 aa, Homo Sapiens
RKEHVFNDE

SEQ ID NO: 1219476 - protein, 9 aa, Homo Sapiens
GGQAKAISG

SEQ ID NO: 1219477 - protein, 9 aa, Homo Sapiens
QLRKRDVRF

SEQ ID NO: 1219478 - protein, 9 aa, Homo Sapiens
DTSRHISVG

SEQ ID NO: 1219479 - protein, 9 aa, Homo Sapiens
QEEEKTLQD

SEQ ID NO: 1219480 - protein, 9 aa, Homo Sapiens
PQNFTSVYE

SEQ ID NO: 1219481 - protein, 9 aa, Homo Sapiens
PSAATFQCF

SEQ ID NO: 1219482 - protein, 9 aa, Homo Sapiens
ETAARSIPP

SEQ ID NO: 1219483 - protein, 9 aa, Homo Sapiens
IMYNEEMNE

SEQ ID NO: 1219484 - protein, 9 aa, Homo Sapiens
LRCIFNWVL

SEQ ID NO: 1219485 - protein, 9 aa, Homo Sapiens
VFIQYNMEA

SEQ ID NO: 1219486 - protein, 9 aa, Homo Sapiens
EQGIPGDRG

SEQ ID NO: 1219487 - protein, 9 aa, Homo Sapiens
DKRNSSDNA

SEQ ID NO: 1219488 - protein, 9 aa, Homo Sapiens
VKKTALCNF

SEQ ID NO: 1219489 - protein, 9 aa, Homo Sapiens
FFPCCLLVQ

SEQ ID NO: 1219490 - protein, 9 aa, Homo Sapiens
LMDGFLSQF

SEQ ID NO: 1219491 - protein, 9 aa, Homo Sapiens
TKVQDFLGL

SEQ ID NO: 1219492 - protein, 9 aa, Homo Sapiens
HLLVLSYID

SEQ ID NO: 1219493 - protein, 9 aa, Homo Sapiens
IMRGLAGRP

SEQ ID NO: 1219494 - protein, 9 aa, Homo Sapiens
SSTNIHKLR

SEQ ID NO: 1219495 - protein, 9 aa, Homo Sapiens
SKLAVSRDK

SEQ ID NO: 1219496 - protein, 9 aa, Homo Sapiens
LSVRLQDNV

SEQ ID NO: 1219497 - protein, 9 aa, Homo Sapiens
EWSDQPHIT

SEQ ID NO: 1219498 - protein, 9 aa, Homo Sapiens
TSNEKEMMQ

SEQ ID NO: 1219499 - protein, 9 aa, Homo Sapiens
QLNVKYTPK

SEQ ID NO: 1219500 - protein, 9 aa, Homo Sapiens
EDAYEYKSV

SEQ ID NO: 1219501 - protein, 9 aa, Homo Sapiens
LCSISGLIT

SEQ ID NO: 1219502 - protein, 9 aa, Homo Sapiens
MRELLYFLD

SEQ ID NO: 1219503 - protein, 9 aa, Homo Sapiens
FHEVGGYDT

SEQ ID NO: 1219504 - protein, 9 aa, Homo Sapiens
FLFVASELG

SEQ ID NO: 1219505 - protein, 9 aa, Homo Sapiens
EVVKHPSAE

SEQ ID NO: 1219506 - protein, 9 aa, Homo Sapiens
TSAKKWKPA

SEQ ID NO: 1219507 - protein, 9 aa, Homo Sapiens
TMIRVNSMS

SEQ ID NO: 1219508 - protein, 9 aa, Homo Sapiens
PDDYYILAE

SEQ ID NO: 1219509 - protein, 9 aa, Homo Sapiens
LEYLMKREN

SEQ ID NO: 1219510 - protein, 9 aa, Homo Sapiens
TMANVFLIL

SEQ ID NO: 1219511 - protein, 9 aa, Homo Sapiens
LTLHTKLSS

SEQ ID NO: 1219512 - protein, 9 aa, Homo Sapiens
KKPALYVSD

SEQ ID NO: 1219513 - protein, 9 aa, Homo Sapiens
RDTPVGDPM

SEQ ID NO: 1219514 - protein, 9 aa, Homo Sapiens
DTVKEALEE

SEQ ID NO: 1219515 - protein, 9 aa, Homo Sapiens
DDVRRVMFA

SEQ ID NO: 1219516 - protein, 9 aa, Homo Sapiens
LALCHLVDL

SEQ ID NO: 1219517 - protein, 9 aa, Homo Sapiens
SDQDVGRGT

SEQ ID NO: 1219518 - protein, 9 aa, Homo Sapiens
DDVPMSPLR

SEQ ID NO: 1219519 - protein, 9 aa, Homo Sapiens
NIKDAKDFG

SEQ ID NO: 1219520 - protein, 9 aa, Homo Sapiens
NLQPRRLKH

SEQ ID NO: 1219521 - protein, 9 aa, Homo Sapiens
EKEHEEKER

SEQ ID NO: 1219522 - protein, 9 aa, Homo Sapiens
ADLLSEKKA

SEQ ID NO: 1219523 - protein, 9 aa, Homo Sapiens
VDEKLSLRQ

SEQ ID NO: 1219524 - protein, 9 aa, Homo Sapiens
VCAAVYQPQ

SEQ ID NO: 1219525 - protein, 9 aa, Homo Sapiens
SDIMRSEDP

SEQ ID NO: 1219526 - protein, 9 aa, Homo Sapiens
QCFLRSGPN

SEQ ID NO: 1219527 - protein, 9 aa, Homo Sapiens
WSKTHRFLF

SEQ ID NO: 1219528 - protein, 9 aa, Homo Sapiens
IADGSHFIL

SEQ ID NO: 1219529 - protein, 9 aa, Homo Sapiens
EETRIAMET

SEQ ID NO: 1219530 - protein, 9 aa, Homo Sapiens
EATDLLHDT

SEQ ID NO: 1219531 - protein, 9 aa, Homo Sapiens
HAYAEYMYT

SEQ ID NO: 1219532 - protein, 9 aa, Homo Sapiens
PYEINLMDE

SEQ ID NO: 1219533 - protein, 9 aa, Homo Sapiens
RGAPRPGRS

SEQ ID NO: 1219534 - protein, 9 aa, Homo Sapiens
GVLCYLERA

SEQ ID NO: 1219535 - protein, 9 aa, Homo Sapiens
LDKDGLGFI

SEQ ID NO: 1219536 - protein, 9 aa, Homo Sapiens
WKVNFRCAM

SEQ ID NO: 1219537 - protein, 9 aa, Homo Sapiens
VDIVLGPIQ

SEQ ID NO: 1219538 - protein, 9 aa, Homo Sapiens
PCMRRYIKN

SEQ ID NO: 1219539 - protein, 9 aa, Homo Sapiens
DVPMSPLRT

SEQ ID NO: 1219540 - protein, 9 aa, Homo Sapiens
FCLAPKRPL

SEQ ID NO: 1219541 - protein, 9 aa, Homo Sapiens
DYASCKCIG

SEQ ID NO: 1219542 - protein, 9 aa, Homo Sapiens
YTDADMKSD

SEQ ID NO: 1219543 - protein, 9 aa, Homo Sapiens
FRQGMQLEV

SEQ ID NO: 1219544 - protein, 9 aa, Homo Sapiens
PELSDLERI

SEQ ID NO: 1219545 - protein, 9 aa, Homo Sapiens
GTLGDRDAI

SEQ ID NO: 1219546 - protein, 9 aa, Homo Sapiens
LTSTRPLIS

SEQ ID NO: 1219547 - protein, 9 aa, Homo Sapiens
GYTQRQAQP

SEQ ID NO: 1219548 - protein, 9 aa, Homo Sapiens
YDVGPTTIH

SEQ ID NO: 1219549 - protein, 9 aa, Homo Sapiens
EAHKWRPDF

SEQ ID NO: 1219550 - protein, 9 aa, Homo Sapiens
LTKGNAKSK

SEQ ID NO: 1219551 - protein, 9 aa, Homo Sapiens
ILGKKKGRK

SEQ ID NO: 1219552 - protein, 9 aa, Homo Sapiens
PMLNYKDIM

SEQ ID NO: 1219553 - protein, 9 aa, Homo Sapiens
SLSFGATRI

SEQ ID NO: 1219554 - protein, 9 aa, Homo Sapiens
AGISLRGQG

SEQ ID NO: 1219555 - protein, 9 aa, Homo Sapiens
HLYDMLHRA

SEQ ID NO: 1219556 - protein, 9 aa, Homo Sapiens
RPGNLVYHF

SEQ ID NO: 1219557 - protein, 9 aa, Homo Sapiens
LTKRSIQTQ

SEQ ID NO: 1219558 - protein, 9 aa, Homo Sapiens
LDLCSVVRL

SEQ ID NO: 1219559 - protein, 9 aa, Homo Sapiens
HTQAYLEEK

SEQ ID NO: 1219560 - protein, 9 aa, Homo Sapiens
QAKRRQKCE

SEQ ID NO: 1219561 - protein, 9 aa, Homo Sapiens
DRLFEIKEG

SEQ ID NO: 1219562 - protein, 9 aa, Homo Sapiens
PPPNMISNR

SEQ ID NO: 1219563 - protein, 9 aa, Homo Sapiens
DRSGIDITY

SEQ ID NO: 1219564 - protein, 9 aa, Homo Sapiens
SPAHNGMMG

SEQ ID NO: 1219565 - protein, 9 aa, Homo Sapiens
ENSSNLWKQ

SEQ ID NO: 1219566 - protein, 9 aa, Homo Sapiens
ALIYKLSGC

SEQ ID NO: 1219567 - protein, 9 aa, Homo Sapiens
ARCLFLGDQ

SEQ ID NO: 1219568 - protein, 9 aa, Homo Sapiens
SSLSTSILL

SEQ ID NO: 1219569 - protein, 9 aa, Homo Sapiens
HTGEKHCKC

SEQ ID NO: 1219570 - protein, 9 aa, Homo Sapiens
SLSRPAHAS

SEQ ID NO: 1219571 - protein, 9 aa, Homo Sapiens
LEHLDHVLY

SEQ ID NO: 1219572 - protein, 9 aa, Homo Sapiens
ECEIAFSQK

SEQ ID NO: 1219573 - protein, 9 aa, Homo Sapiens
KAVCMIAIV

SEQ ID NO: 1219574 - protein, 9 aa, Homo Sapiens
KNWQPLSKS

SEQ ID NO: 1219575 - protein, 9 aa, Homo Sapiens
DSALMPHID

SEQ ID NO: 1219576 - protein, 9 aa, Homo Sapiens
EAAVFPHGS

SEQ ID NO: 1219577 - protein, 9 aa, Homo Sapiens
DPSPVSSEG

SEQ ID NO: 1219578 - protein, 9 aa, Homo Sapiens
KPTRMLNIP

SEQ ID NO: 1219579 - protein, 9 aa, Homo Sapiens
KAPAVEVGA

SEQ ID NO: 1219580 - protein, 9 aa, Homo Sapiens
KRALQDCTQ

SEQ ID NO: 1219581 - protein, 9 aa, Homo Sapiens
VYSGAVNLS

SEQ ID NO: 1219582 - protein, 9 aa, Homo Sapiens
ELGDPRPRG

SEQ ID NO: 1219583 - protein, 9 aa, Homo Sapiens
SRPQSPGAN

SEQ ID NO: 1219584 - protein, 9 aa, Homo Sapiens
GSNALHVVI

SEQ ID NO: 1219585 - protein, 9 aa, Homo Sapiens
LINQDLVGP

SEQ ID NO: 1219586 - protein, 9 aa, Homo Sapiens
CDPAAEEWS

SEQ ID NO: 1219587 - protein, 9 aa, Homo Sapiens
NEKASIMLP

SEQ ID NO: 1219588 - protein, 9 aa, Homo Sapiens
SYKQRLNTC

SEQ ID NO: 1219589 - protein, 9 aa, Homo Sapiens
AAGVNGLSI

SEQ ID NO: 1219590 - protein, 9 aa, Homo Sapiens
WQENDFSKH

SEQ ID NO: 1219591 - protein, 9 aa, Homo Sapiens
PINVNAIKA

SEQ ID NO: 1219592 - protein, 9 aa, Homo Sapiens
DNVPLLHGA

SEQ ID NO: 1219593 - protein, 9 aa, Homo Sapiens
SHKHLSKKS

SEQ ID NO: 1219594 - protein, 9 aa, Homo Sapiens
FSSSTEQSC

SEQ ID NO: 1219595 - protein, 9 aa, Homo Sapiens
TTLAGIKTL

SEQ ID NO: 1219596 - protein, 9 aa, Homo Sapiens
IISQPKRTM

SEQ ID NO: 1219597 - protein, 9 aa, Homo Sapiens
RKDVKDKDT

SEQ ID NO: 1219598 - protein, 9 aa, Homo Sapiens
EETETVSDL

SEQ ID NO: 1219599 - protein, 9 aa, Homo Sapiens
GWVFIPVYI

SEQ ID NO: 1219600 - protein, 9 aa, Homo Sapiens
HERPPLTTS

SEQ ID NO: 1219601 - protein, 9 aa, Homo Sapiens
LSGKLVCRA

SEQ ID NO: 1219602 - protein, 9 aa, Homo Sapiens
KIQLISELA

SEQ ID NO: 1219603 - protein, 9 aa, Homo Sapiens
AVDTDGNDT

SEQ ID NO: 1219604 - protein, 9 aa, Homo Sapiens
ISNAMYKEI

SEQ ID NO: 1219605 - protein, 9 aa, Homo Sapiens
ASAAVLNPR

SEQ ID NO: 1219606 - protein, 9 aa, Homo Sapiens
HKGEHLGEF

SEQ ID NO: 1219607 - protein, 9 aa, Homo Sapiens
LRNVIKGQG

SEQ ID NO: 1219608 - protein, 9 aa, Homo Sapiens
TNKANVVNV

SEQ ID NO: 1219609 - protein, 9 aa, Homo Sapiens
SQEATAPAA

SEQ ID NO: 1219610 - protein, 9 aa, Homo Sapiens
WRMYAHVYG

SEQ ID NO: 1219611 - protein, 9 aa, Homo Sapiens
RHLQDVSGT

SEQ ID NO: 1219612 - protein, 9 aa, Homo Sapiens
AFGQSSVLL

SEQ ID NO: 1219613 - protein, 9 aa, Homo Sapiens
EMWLDRNQL

SEQ ID NO: 1219614 - protein, 9 aa, Homo Sapiens
LSEKKAISF

SEQ ID NO: 1219615 - protein, 9 aa, Homo Sapiens
TKLCSAFAC

SEQ ID NO: 1219616 - protein, 9 aa, Homo Sapiens
PRHIQLIMI

SEQ ID NO: 1219617 - protein, 9 aa, Homo Sapiens
CQHVDLLGA

SEQ ID NO: 1219618 - protein, 9 aa, Homo Sapiens
QVNLSNMQC

SEQ ID NO: 1219619 - protein, 9 aa, Homo Sapiens
HPTVNYFGK

SEQ ID NO: 1219620 - protein, 9 aa, Homo Sapiens
QQMGAFVEI

SEQ ID NO: 1219621 - protein, 9 aa, Homo Sapiens
SAFGVSERS

SEQ ID NO: 1219622 - protein, 9 aa, Homo Sapiens
GVDSLITLT

SEQ ID NO: 1219623 - protein, 9 aa, Homo Sapiens
VDEGDGDIR

SEQ ID NO: 1219624 - protein, 9 aa, Homo Sapiens
ELNRESVRT

SEQ ID NO: 1219625 - protein, 9 aa, Homo Sapiens
SAPPNGSST

SEQ ID NO: 1219626 - protein, 9 aa, Homo Sapiens
QVSDGSEVV

SEQ ID NO: 1219627 - protein, 9 aa, Homo Sapiens
PGWGQWHLG

SEQ ID NO: 1219628 - protein, 9 aa, Homo Sapiens
VNVNASKEG

SEQ ID NO: 1219629 - protein, 9 aa, Homo Sapiens
GTDCWTYRY

SEQ ID NO: 1219630 - protein, 9 aa, Homo Sapiens
VLAKHEAFF

SEQ ID NO: 1219631 - protein, 9 aa, Homo Sapiens
IAGLLSILV

SEQ ID NO: 1219632 - protein, 9 aa, Homo Sapiens
RHAGSSALG

SEQ ID NO: 1219633 - protein, 9 aa, Homo Sapiens
EGSGSTTGS

SEQ ID NO: 1219634 - protein, 9 aa, Homo Sapiens
GLLSHDQLL

SEQ ID NO: 1219635 - protein, 9 aa, Homo Sapiens
QPGRIRTVG

SEQ ID NO: 1219636 - protein, 9 aa, Homo Sapiens
PIGVDHVRC

SEQ ID NO: 1219637 - protein, 9 aa, Homo Sapiens
TFQGLDALK

SEQ ID NO: 1219638 - protein, 9 aa, Homo Sapiens
WELTSNFNF

SEQ ID NO: 1219639 - protein, 9 aa, Homo Sapiens
MAGKFCIIL

SEQ ID NO: 1219640 - protein, 9 aa, Homo Sapiens
LKDQLKHKE

SEQ ID NO: 1219641 - protein, 9 aa, Homo Sapiens
VDVFCLPWE

SEQ ID NO: 1219642 - protein, 9 aa, Homo Sapiens
TVSDLASLT

SEQ ID NO: 1219643 - protein, 9 aa, Homo Sapiens
FSAPDPPMP

SEQ ID NO: 1219644 - protein, 9 aa, Homo Sapiens
VASSSHSRS

SEQ ID NO: 1219645 - protein, 9 aa, Homo Sapiens
GPGHLHQNR

SEQ ID NO: 1219646 - protein, 9 aa, Homo Sapiens
CRIRASFSE

SEQ ID NO: 1219647 - protein, 9 aa, Homo Sapiens
SCLTGSHAY

SEQ ID NO: 1219648 - protein, 9 aa, Homo Sapiens
NSLVAQLML

SEQ ID NO: 1219649 - protein, 9 aa, Homo Sapiens
TVVCWASTL

SEQ ID NO: 1219650 - protein, 9 aa, Homo Sapiens
TGNGLDQKA

SEQ ID NO: 1219651 - protein, 9 aa, Homo Sapiens
VLRNLSMDP

SEQ ID NO: 1219652 - protein, 9 aa, Homo Sapiens
ARERRREGH

SEQ ID NO: 1219653 - protein, 9 aa, Homo Sapiens
RIIFSYIFC

SEQ ID NO: 1219654 - protein, 9 aa, Homo Sapiens
FDVLYPPEC

SEQ ID NO: 1219655 - protein, 9 aa, Homo Sapiens
QVQTQPENT

SEQ ID NO: 1219656 - protein, 9 aa, Homo Sapiens
ESSRTTLGR

SEQ ID NO: 1219657 - protein, 9 aa, Homo Sapiens
QADISLNKF

SEQ ID NO: 1219658 - protein, 9 aa, Homo Sapiens
QSMRITTMP

SEQ ID NO: 1219659 - protein, 9 aa, Homo Sapiens
EQLHQGQNV

SEQ ID NO: 1219660 - protein, 9 aa, Homo Sapiens
RNQVKISCS

SEQ ID NO: 1219661 - protein, 9 aa, Homo Sapiens
KQGYLINSL

SEQ ID NO: 1219662 - protein, 9 aa, Homo Sapiens
DVGVPQVSA

SEQ ID NO: 1219663 - protein, 9 aa, Homo Sapiens
ELSGDNYLW

SEQ ID NO: 1219664 - protein, 9 aa, Homo Sapiens
SRELRVNQG

SEQ ID NO: 1219665 - protein, 9 aa, Homo Sapiens
IVIPGNGAS

SEQ ID NO: 1219666 - protein, 9 aa, Homo Sapiens
HPLGCVKIS

SEQ ID NO: 1219667 - protein, 9 aa, Homo Sapiens
VGFVICVPE

SEQ ID NO: 1219668 - protein, 9 aa, Homo Sapiens
QEQNENIPI

SEQ ID NO: 1219669 - protein, 9 aa, Homo Sapiens
GPGISSYTY

SEQ ID NO: 1219670 - protein, 9 aa, Homo Sapiens
ELIQGWDIT

SEQ ID NO: 1219671 - protein, 9 aa, Homo Sapiens
PMGPYARGP

SEQ ID NO: 1219672 - protein, 9 aa, Homo Sapiens
ISGQHVSLQ

SEQ ID NO: 1219673 - protein, 9 aa, Homo Sapiens
YRDSAHQPE

SEQ ID NO: 1219674 - protein, 9 aa, Homo Sapiens
DIIDCLEQE

SEQ ID NO: 1219675 - protein, 9 aa, Homo Sapiens
LLSLMATEI

SEQ ID NO: 1219676 - protein, 9 aa, Homo Sapiens
RHKTISIDE

SEQ ID NO: 1219677 - protein, 9 aa, Homo Sapiens
RVKQGKYQN

SEQ ID NO: 1219678 - protein, 9 aa, Homo Sapiens
HSLQKQVGT

SEQ ID NO: 1219679 - protein, 9 aa, Homo Sapiens
LKEVQKYPQ

SEQ ID NO: 1219680 - protein, 9 aa, Homo Sapiens
SNMADGDNF

SEQ ID NO: 1219681 - protein, 9 aa, Homo Sapiens
PCQSSVSVT

SEQ ID NO: 1219682 - protein, 9 aa, Homo Sapiens
RGFSDLQGP

SEQ ID NO: 1219683 - protein, 9 aa, Homo Sapiens
KWFLGKTRR

SEQ ID NO: 1219684 - protein, 9 aa, Homo Sapiens
KEVYDTLIK

SEQ ID NO: 1219685 - protein, 9 aa, Homo Sapiens
TWEKTFTWL

SEQ ID NO: 1219686 - protein, 9 aa, Homo Sapiens
GYCRTGSLC

SEQ ID NO: 1219687 - protein, 9 aa, Homo Sapiens
NIRKEKNDI

SEQ ID NO: 1219688 - protein, 9 aa, Homo Sapiens
GIRPHPTSD

SEQ ID NO: 1219689 - protein, 9 aa, Homo Sapiens
RLAIQLLKC

SEQ ID NO: 1219690 - protein, 9 aa, Homo Sapiens
VVLFFIIGV

SEQ ID NO: 1219691 - protein, 9 aa, Homo Sapiens
NKETFNLKG

SEQ ID NO: 1219692 - protein, 9 aa, Homo Sapiens
IEYDSDDEQ

SEQ ID NO: 1219693 - protein, 9 aa, Homo Sapiens
HVPPSVLYE

SEQ ID NO: 1219694 - protein, 9 aa, Homo Sapiens
LQQTTGCSQ

SEQ ID NO: 1219695 - protein, 9 aa, Homo Sapiens
FDTTEVYAA

SEQ ID NO: 1219696 - protein, 9 aa, Homo Sapiens
CPLHCEICM

SEQ ID NO: 1219697 - protein, 9 aa, Homo Sapiens
APLHPQPAP

SEQ ID NO: 1219698 - protein, 9 aa, Homo Sapiens
QKEDRPQAR

SEQ ID NO: 1219699 - protein, 9 aa, Homo Sapiens
ASARRADSP

SEQ ID NO: 1219700 - protein, 9 aa, Homo Sapiens
SYTIKVSFS

SEQ ID NO: 1219701 - protein, 9 aa, Homo Sapiens
EVFSATLAY

SEQ ID NO: 1219702 - protein, 9 aa, Homo Sapiens
TKPSSQSQI

SEQ ID NO: 1219703 - protein, 9 aa, Homo Sapiens
QLDPAEMRD

SEQ ID NO: 1219704 - protein, 9 aa, Homo Sapiens
SGDANDARN

SEQ ID NO: 1219705 - protein, 9 aa, Homo Sapiens
QPKCYRPAM

SEQ ID NO: 1219706 - protein, 9 aa, Homo Sapiens
HMDNIFDFM

SEQ ID NO: 1219707 - protein, 9 aa, Homo Sapiens
AAHSTEAIR

SEQ ID NO: 1219708 - protein, 9 aa, Homo Sapiens
LQELNRTYR

SEQ ID NO: 1219709 - protein, 9 aa, Homo Sapiens
SYMAEMRNE

SEQ ID NO: 1219710 - protein, 9 aa, Homo Sapiens
WSFRNIYKS

SEQ ID NO: 1219711 - protein, 9 aa, Homo Sapiens
VSVSQGFHM

SEQ ID NO: 1219712 - protein, 9 aa, Homo Sapiens
GGRIVRREW

SEQ ID NO: 1219713 - protein, 9 aa, Homo Sapiens
TGSGHYIAY

SEQ ID NO: 1219714 - protein, 9 aa, Homo Sapiens
VVTNKQAVP

SEQ ID NO: 1219715 - protein, 9 aa, Homo Sapiens
GSRKKGMEC

SEQ ID NO: 1219716 - protein, 9 aa, Homo Sapiens
EQWKKVVTK

SEQ ID NO: 1219717 - protein, 9 aa, Homo Sapiens
HNITASDSG

SEQ ID NO: 1219718 - protein, 9 aa, Homo Sapiens
VCKKDKLHL

SEQ ID NO: 1219719 - protein, 9 aa, Homo Sapiens
WNMTSSWPP

SEQ ID NO: 1219720 - protein, 9 aa, Homo Sapiens
SAGRKKFFS

SEQ ID NO: 1219721 - protein, 9 aa, Homo Sapiens
KHERCPWRI

SEQ ID NO: 1219722 - protein, 9 aa, Homo Sapiens
ADVREEVML

SEQ ID NO: 1219723 - protein, 9 aa, Homo Sapiens
PATWKNSRY

SEQ ID NO: 1219724 - protein, 9 aa, Homo Sapiens
FCFSPLWLM

SEQ ID NO: 1219725 - protein, 9 aa, Homo Sapiens
SMQRFRPEE

SEQ ID NO: 1219726 - protein, 9 aa, Homo Sapiens
INSLLNEEN

SEQ ID NO: 1219727 - protein, 9 aa, Homo Sapiens
GATNISKQL

SEQ ID NO: 1219728 - protein, 9 aa, Homo Sapiens
QELLRITLS

SEQ ID NO: 1219729 - protein, 9 aa, Homo Sapiens
LPPAMKCYL

SEQ ID NO: 1219730 - protein, 9 aa, Homo Sapiens
DFPGSFDVM

SEQ ID NO: 1219731 - protein, 9 aa, Homo Sapiens
DTTGMVECL

SEQ ID NO: 1219732 - protein, 9 aa, Homo Sapiens
ECGPKPEHR

SEQ ID NO: 1219733 - protein, 9 aa, Homo Sapiens
LLLSVFGSL

SEQ ID NO: 1219734 - protein, 9 aa, Homo Sapiens
RTSTFSFEC

SEQ ID NO: 1219735 - protein, 9 aa, Homo Sapiens
ILWNILKPL

SEQ ID NO: 1219736 - protein, 9 aa, Homo Sapiens
GPGPSLGYF

SEQ ID NO: 1219737 - protein, 9 aa, Homo Sapiens
AETEVEEPE

SEQ ID NO: 1219738 - protein, 9 aa, Homo Sapiens
LSNLDDFDP

SEQ ID NO: 1219739 - protein, 9 aa, Homo Sapiens
NILKGQAVV

SEQ ID NO: 1219740 - protein, 9 aa, Homo Sapiens
HAFPDTDLV

SEQ ID NO: 1219741 - protein, 9 aa, Homo Sapiens
GADGRQHSY

SEQ ID NO: 1219742 - protein, 9 aa, Homo Sapiens
IHVLKEMVV

SEQ ID NO: 1219743 - protein, 9 aa, Homo Sapiens
GYIQKFEFE

SEQ ID NO: 1219744 - protein, 9 aa, Homo Sapiens
PMSQVYGVP

SEQ ID NO: 1219745 - protein, 9 aa, Homo Sapiens
LYVYDDLKQ

SEQ ID NO: 1219746 - protein, 9 aa, Homo Sapiens
AQCEIQEHT

SEQ ID NO: 1219747 - protein, 9 aa, Homo Sapiens
LLEIYTQQK

SEQ ID NO: 1219748 - protein, 9 aa, Homo Sapiens
AQLPAQGHR

SEQ ID NO: 1219749 - protein, 9 aa, Homo Sapiens
ELWEQEHSN

SEQ ID NO: 1219750 - protein, 9 aa, Homo Sapiens
VKKVMTCPR

SEQ ID NO: 1219751 - protein, 9 aa, Homo Sapiens
SVAARKRSS

SEQ ID NO: 1219752 - protein, 9 aa, Homo Sapiens
RGRSRSRPP

SEQ ID NO: 1219753 - protein, 9 aa, Homo Sapiens
ERESRMELS

SEQ ID NO: 1219754 - protein, 9 aa, Homo Sapiens
DGSWAGTGN

SEQ ID NO: 1219755 - protein, 9 aa, Homo Sapiens
EEMNEKIKL

SEQ ID NO: 1219756 - protein, 9 aa, Homo Sapiens
ILVFGVHYI

SEQ ID NO: 1219757 - protein, 9 aa, Homo Sapiens
TVVVMGGKE

SEQ ID NO: 1219758 - protein, 9 aa, Homo Sapiens
PSPIPTCLA

SEQ ID NO: 1219759 - protein, 9 aa, Homo Sapiens
NGMIRQKVW

SEQ ID NO: 1219760 - protein, 9 aa, Homo Sapiens
VCSLDNREW

SEQ ID NO: 1219761 - protein, 9 aa, Homo Sapiens
GSDLESIIS

SEQ ID NO: 1219762 - protein, 9 aa, Homo Sapiens
GVLHKMDSF

SEQ ID NO: 1219763 - protein, 9 aa, Homo Sapiens
VIDRVTDLI

SEQ ID NO: 1219764 - protein, 9 aa, Homo Sapiens
WLLGSRMAH

SEQ ID NO: 1219765 - protein, 9 aa, Homo Sapiens
YYIYSGGKK

SEQ ID NO: 1219766 - protein, 9 aa, Homo Sapiens
QLVMEKHSS

SEQ ID NO: 1219767 - protein, 9 aa, Homo Sapiens
KCDLPLWTL

SEQ ID NO: 1219768 - protein, 9 aa, Homo Sapiens
KMLAAREDR

SEQ ID NO: 1219769 - protein, 9 aa, Homo Sapiens
PYECNECEI

SEQ ID NO: 1219770 - protein, 9 aa, Homo Sapiens
RNPRSWLER

SEQ ID NO: 1219771 - protein, 9 aa, Homo Sapiens
ADRLILELG

SEQ ID NO: 1219772 - protein, 9 aa, Homo Sapiens
LGLGVHQRV

SEQ ID NO: 1219773 - protein, 9 aa, Homo Sapiens
TQLGSQLIA

SEQ ID NO: 1219774 - protein, 9 aa, Homo Sapiens
PETLIWQDI

SEQ ID NO: 1219775 - protein, 9 aa, Homo Sapiens
SSSWTNRSV

SEQ ID NO: 1219776 - protein, 9 aa, Homo Sapiens
EATDSLYMF

SEQ ID NO: 1219777 - protein, 9 aa, Homo Sapiens
RECLGTHTV

SEQ ID NO: 1219778 - protein, 9 aa, Homo Sapiens
YITKKEELE

SEQ ID NO: 1219779 - protein, 9 aa, Homo Sapiens
QLLEPCPPY

SEQ ID NO: 1219780 - protein, 9 aa, Homo Sapiens
CVIKNATYI

SEQ ID NO: 1219781 - protein, 9 aa, Homo Sapiens
SLSLRRSVD

SEQ ID NO: 1219782 - protein, 9 aa, Homo Sapiens
IRGLTHAIR

SEQ ID NO: 1219783 - protein, 9 aa, Homo Sapiens
QRGLSWRSD

SEQ ID NO: 1219784 - protein, 9 aa, Homo Sapiens
SINRYDKVR

SEQ ID NO: 1219785 - protein, 9 aa, Homo Sapiens
QALFTLHSC

SEQ ID NO: 1219786 - protein, 9 aa, Homo Sapiens
YTSGLLAQF

SEQ ID NO: 1219787 - protein, 9 aa, Homo Sapiens
QVKHITLPK

SEQ ID NO: 1219788 - protein, 9 aa, Homo Sapiens
GSRGAADDR

SEQ ID NO: 1219789 - protein, 9 aa, Homo Sapiens
DHTGENVYK

SEQ ID NO: 1219790 - protein, 9 aa, Homo Sapiens
GDRRGRPSP

SEQ ID NO: 1219791 - protein, 9 aa, Homo Sapiens
VTNKQAVPG

SEQ ID NO: 1219792 - protein, 9 aa, Homo Sapiens
IQMHMGGQI

SEQ ID NO: 1219793 - protein, 9 aa, Homo Sapiens
QAALGGLVF

SEQ ID NO: 1219794 - protein, 9 aa, Homo Sapiens
AQDCELPSC

SEQ ID NO: 1219795 - protein, 9 aa, Homo Sapiens
MSVKFDVQS

SEQ ID NO: 1219796 - protein, 9 aa, Homo Sapiens
LNPCNTKIW

SEQ ID NO: 1219797 - protein, 9 aa, Homo Sapiens
VVMHYGNLK

SEQ ID NO: 1219798 - protein, 9 aa, Homo Sapiens
PEADVGRAG

SEQ ID NO: 1219799 - protein, 9 aa, Homo Sapiens
QDLEKKEGH

SEQ ID NO: 1219800 - protein, 9 aa, Homo Sapiens
SSSHFKVTV

SEQ ID NO: 1219801 - protein, 9 aa, Homo Sapiens
GMQVSQDFP

SEQ ID NO: 1219802 - protein, 9 aa, Homo Sapiens
KWVQYTSGK

SEQ ID NO: 1219803 - protein, 9 aa, Homo Sapiens
AQAEGPLTV

SEQ ID NO: 1219804 - protein, 9 aa, Homo Sapiens
EYITKKEEL

SEQ ID NO: 1219805 - protein, 9 aa, Homo Sapiens
PVSCMHWMK

SEQ ID NO: 1219806 - protein, 9 aa, Homo Sapiens
CGATERDCA

SEQ ID NO: 1219807 - protein, 9 aa, Homo Sapiens
LEGMTFAGF

SEQ ID NO: 1219808 - protein, 9 aa, Homo Sapiens
GPEGYETHW

SEQ ID NO: 1219809 - protein, 9 aa, Homo Sapiens
LKQVTDTVL

SEQ ID NO: 1219810 - protein, 9 aa, Homo Sapiens
GTMITIEGP

SEQ ID NO: 1219811 - protein, 9 aa, Homo Sapiens
CISPLARAG

SEQ ID NO: 1219812 - protein, 9 aa, Homo Sapiens
INRAGMGWY

SEQ ID NO: 1219813 - protein, 9 aa, Homo Sapiens
DECEVCRDR

SEQ ID NO: 1219814 - protein, 9 aa, Homo Sapiens
GKAFCVGGD

SEQ ID NO: 1219815 - protein, 9 aa, Homo Sapiens
GMSHCPGGE

SEQ ID NO: 1219816 - protein, 9 aa, Homo Sapiens
TPSSSFLTM

SEQ ID NO: 1219817 - protein, 9 aa, Homo Sapiens
TGPVAQLCL

SEQ ID NO: 1219818 - protein, 9 aa, Homo Sapiens
VWIVQPVSG

SEQ ID NO: 1219819 - protein, 9 aa, Homo Sapiens
VHTTVLRLI

SEQ ID NO: 1219820 - protein, 9 aa, Homo Sapiens
KASIKGVPG

SEQ ID NO: 1219821 - protein, 9 aa, Homo Sapiens
DDDDVFLCG

SEQ ID NO: 1219822 - protein, 9 aa, Homo Sapiens
FHTGEKPYA

SEQ ID NO: 1219823 - protein, 9 aa, Homo Sapiens
FQPMDHQAT

SEQ ID NO: 1219824 - protein, 9 aa, Homo Sapiens
RIVSGVYDG

SEQ ID NO: 1219825 - protein, 9 aa, Homo Sapiens
KDKLHLLGA

SEQ ID NO: 1219826 - protein, 9 aa, Homo Sapiens
KKGWLPLHE

SEQ ID NO: 1219827 - protein, 9 aa, Homo Sapiens
DICGMVCIG

SEQ ID NO: 1219828 - protein, 9 aa, Homo Sapiens
GPINPDTAA

SEQ ID NO: 1219829 - protein, 9 aa, Homo Sapiens
LSLRQVAVV

SEQ ID NO: 1219830 - protein, 9 aa, Homo Sapiens
NNGSGQSYR

SEQ ID NO: 1219831 - protein, 9 aa, Homo Sapiens
SPNTTVSVH

SEQ ID NO: 1219832 - protein, 9 aa, Homo Sapiens
QKNIYRDVM

SEQ ID NO: 1219833 - protein, 9 aa, Homo Sapiens
SPSLRILTI

SEQ ID NO: 1219834 - protein, 9 aa, Homo Sapiens
LKQKLQEMS

SEQ ID NO: 1219835 - protein, 9 aa, Homo Sapiens
IQHHPSEVT

SEQ ID NO: 1219836 - protein, 9 aa, Homo Sapiens
GEDVHLARD

SEQ ID NO: 1219837 - protein, 9 aa, Homo Sapiens
TTGKVIKCK

SEQ ID NO: 1219838 - protein, 9 aa, Homo Sapiens
SDMEGGGSE

SEQ ID NO: 1219839 - protein, 9 aa, Homo Sapiens
NESPKCQAS

SEQ ID NO: 1219840 - protein, 9 aa, Homo Sapiens
LETGEDGEE

SEQ ID NO: 1219841 - protein, 9 aa, Homo Sapiens
SNILEISLI

SEQ ID NO: 1219842 - protein, 9 aa, Homo Sapiens
ILLPGAPQQ

SEQ ID NO: 1219843 - protein, 9 aa, Homo Sapiens
SYLVALYLV

SEQ ID NO: 1219844 - protein, 9 aa, Homo Sapiens
HTLTMPALE

SEQ ID NO: 1219845 - protein, 9 aa, Homo Sapiens
FYQHWQLKY

SEQ ID NO: 1219846 - protein, 9 aa, Homo Sapiens
ATSPINPAM

SEQ ID NO: 1219847 - protein, 9 aa, Homo Sapiens
PVPGSASLF

SEQ ID NO: 1219848 - protein, 9 aa, Homo Sapiens
YDECAVLCL

SEQ ID NO: 1219849 - protein, 9 aa, Homo Sapiens
CAAVYQPQP

SEQ ID NO: 1219850 - protein, 9 aa, Homo Sapiens
NSLLDMEGA

SEQ ID NO: 1219851 - protein, 9 aa, Homo Sapiens
LMDRGDILS

SEQ ID NO: 1219852 - protein, 9 aa, Homo Sapiens
KAGGSHQDC

SEQ ID NO: 1219853 - protein, 9 aa, Homo Sapiens
VTFCSAGPI

SEQ ID NO: 1219854 - protein, 9 aa, Homo Sapiens
LENAITYEK

SEQ ID NO: 1219855 - protein, 9 aa, Homo Sapiens
LVVLFFIIG

SEQ ID NO: 1219856 - protein, 9 aa, Homo Sapiens
RTMMKALVL

SEQ ID NO: 1219857 - protein, 9 aa, Homo Sapiens
VDVTPYMNH

SEQ ID NO: 1219858 - protein, 9 aa, Homo Sapiens
VRQRQLYKL

SEQ ID NO: 1219859 - protein, 9 aa, Homo Sapiens
QTMVKCVKA

SEQ ID NO: 1219860 - protein, 9 aa, Homo Sapiens
VPDAKKSCT

SEQ ID NO: 1219861 - protein, 9 aa, Homo Sapiens
VAFSEDGHK

SEQ ID NO: 1219862 - protein, 9 aa, Homo Sapiens
QLRFLETTH

SEQ ID NO: 1219863 - protein, 9 aa, Homo Sapiens
MFKKSKEIT

SEQ ID NO: 1219864 - protein, 9 aa, Homo Sapiens
VNLHPQLAS

SEQ ID NO: 1219865 - protein, 9 aa, Homo Sapiens
PTFSGIVGY

SEQ ID NO: 1219866 - protein, 9 aa, Homo Sapiens
MVEDCEHCL

SEQ ID NO: 1219867 - protein, 9 aa, Homo Sapiens
SGQSYRLVL

SEQ ID NO: 1219868 - protein, 9 aa, Homo Sapiens
CVQHQGDLI

SEQ ID NO: 1219869 - protein, 9 aa, Homo Sapiens
MVHLKVAAL

SEQ ID NO: 1219870 - protein, 9 aa, Homo Sapiens
KRREECLQA

SEQ ID NO: 1219871 - protein, 9 aa, Homo Sapiens
STGATASLG

SEQ ID NO: 1219872 - protein, 9 aa, Homo Sapiens
GWKLFYNCA

SEQ ID NO: 1219873 - protein, 9 aa, Homo Sapiens
TLHNLGLGK

SEQ ID NO: 1219874 - protein, 9 aa, Homo Sapiens
PGTVGPSNE

SEQ ID NO: 1219875 - protein, 9 aa, Homo Sapiens
SHCTFAIEA

SEQ ID NO: 1219876 - protein, 9 aa, Homo Sapiens
IQQALRYLH

SEQ ID NO: 1219877 - protein, 9 aa, Homo Sapiens
VTQTDSCSW

SEQ ID NO: 1219878 - protein, 9 aa, Homo Sapiens
EPLINLDVT

SEQ ID NO: 1219879 - protein, 9 aa, Homo Sapiens
SGMSPYAYQ

SEQ ID NO: 1219880 - protein, 9 aa, Homo Sapiens
YNHAKYSAE

SEQ ID NO: 1219881 - protein, 9 aa, Homo Sapiens
AEFLPCHFH

SEQ ID NO: 1219882 - protein, 9 aa, Homo Sapiens
ARLNIAIVW

SEQ ID NO: 1219883 - protein, 9 aa, Homo Sapiens
FFLGTSQDV

SEQ ID NO: 1219884 - protein, 9 aa, Homo Sapiens
ISWHKPKVS

SEQ ID NO: 1219885 - protein, 9 aa, Homo Sapiens
GAHYLMQAA

SEQ ID NO: 1219886 - protein, 9 aa, Homo Sapiens
HAEQSLRSS

SEQ ID NO: 1219887 - protein, 9 aa, Homo Sapiens
PDGATGDRG

SEQ ID NO: 1219888 - protein, 9 aa, Homo Sapiens
WPGKDGKHS

SEQ ID NO: 1219889 - protein, 9 aa, Homo Sapiens
FSVQVEKWV

SEQ ID NO: 1219890 - protein, 9 aa, Homo Sapiens
IPVVIFKYI

SEQ ID NO: 1219891 - protein, 9 aa, Homo Sapiens
SIHFAVDRR

SEQ ID NO: 1219892 - protein, 9 aa, Homo Sapiens
KKGLQRGRL

SEQ ID NO: 1219893 - protein, 9 aa, Homo Sapiens
LPGNVGHQY

SEQ ID NO: 1219894 - protein, 9 aa, Homo Sapiens
HPADGDMRM

SEQ ID NO: 1219895 - protein, 9 aa, Homo Sapiens
KSMYLSEKI

SEQ ID NO: 1219896 - protein, 9 aa, Homo Sapiens
KPNPVTPYW

SEQ ID NO: 1219897 - protein, 9 aa, Homo Sapiens
RDLRDHRYS

SEQ ID NO: 1219898 - protein, 9 aa, Homo Sapiens
LCWNQTHPT

SEQ ID NO: 1219899 - protein, 9 aa, Homo Sapiens
TGRKVALKK

SEQ ID NO: 1219900 - protein, 9 aa, Homo Sapiens
RSIHLFINS

SEQ ID NO: 1219901 - protein, 9 aa, Homo Sapiens
IEMGHLITG

SEQ ID NO: 1219902 - protein, 9 aa, Homo Sapiens
INTPFDRIA

SEQ ID NO: 1219903 - protein, 9 aa, Homo Sapiens
QRCSDNCDV

SEQ ID NO: 1219904 - protein, 9 aa, Homo Sapiens
PTHPLRSFV

SEQ ID NO: 1219905 - protein, 9 aa, Homo Sapiens
APLSSMGGR

SEQ ID NO: 1219906 - protein, 9 aa, Homo Sapiens
RCEGDPSGI

SEQ ID NO: 1219907 - protein, 9 aa, Homo Sapiens
VHLLQFQEE

SEQ ID NO: 1219908 - protein, 9 aa, Homo Sapiens
PRDLRDHRY

SEQ ID NO: 1219909 - protein, 9 aa, Homo Sapiens
CLGMQHRQV

SEQ ID NO: 1219910 - protein, 9 aa, Homo Sapiens
FNAAVMASD

SEQ ID NO: 1219911 - protein, 9 aa, Homo Sapiens
AKSTLVLIL

SEQ ID NO: 1219912 - protein, 9 aa, Homo Sapiens
WCLVQGFGS

SEQ ID NO: 1219913 - protein, 9 aa, Homo Sapiens
TCRVVFDDN

SEQ ID NO: 1219914 - protein, 9 aa, Homo Sapiens
GSNLQCEAT

SEQ ID NO: 1219915 - protein, 9 aa, Homo Sapiens
AMSTLSAHI

SEQ ID NO: 1219916 - protein, 9 aa, Homo Sapiens
LKNFELMMH

SEQ ID NO: 1219917 - protein, 9 aa, Homo Sapiens
EYLKNIIYH

SEQ ID NO: 1219918 - protein, 9 aa, Homo Sapiens
QVISEQLQN

SEQ ID NO: 1219919 - protein, 9 aa, Homo Sapiens
MGLNSANLL

SEQ ID NO: 1219920 - protein, 9 aa, Homo Sapiens
KKSINPWER

SEQ ID NO: 1219921 - protein, 9 aa, Homo Sapiens
SDIYTDVRE

SEQ ID NO: 1219922 - protein, 9 aa, Homo Sapiens
RFLVQQNKM

SEQ ID NO: 1219923 - protein, 9 aa, Homo Sapiens
FRLENLLTD

SEQ ID NO: 1219924 - protein, 9 aa, Homo Sapiens
GIRAPLCPV

SEQ ID NO: 1219925 - protein, 9 aa, Homo Sapiens
YSPCVKKNS

SEQ ID NO: 1219926 - protein, 9 aa, Homo Sapiens
SNEKEMMQF

SEQ ID NO: 1219927 - protein, 9 aa, Homo Sapiens
CRISKYPTL

SEQ ID NO: 1219928 - protein, 9 aa, Homo Sapiens
FPSLAYSTP

SEQ ID NO: 1219929 - protein, 9 aa, Homo Sapiens
LDENALNRI

SEQ ID NO: 1219930 - protein, 9 aa, Homo Sapiens
CKEILHSSL

SEQ ID NO: 1219931 - protein, 9 aa, Homo Sapiens
NVRIVTLVP

SEQ ID NO: 1219932 - protein, 9 aa, Homo Sapiens
TSLENTKPQ

SEQ ID NO: 1219933 - protein, 9 aa, Homo Sapiens
ALVIQVAPS

SEQ ID NO: 1219934 - protein, 9 aa, Homo Sapiens
CCGATERDC

SEQ ID NO: 1219935 - protein, 9 aa, Homo Sapiens
SLEMRTKLY

SEQ ID NO: 1219936 - protein, 9 aa, Homo Sapiens
DVKNIKRCT

SEQ ID NO: 1219937 - protein, 9 aa, Homo Sapiens
YPEKRTQYF

SEQ ID NO: 1219938 - protein, 9 aa, Homo Sapiens
PGWEQNLCQ

SEQ ID NO: 1219939 - protein, 9 aa, Homo Sapiens
MRSRPSRQL

SEQ ID NO: 1219940 - protein, 9 aa, Homo Sapiens
LEGHAVEWL

SEQ ID NO: 1219941 - protein, 9 aa, Homo Sapiens
HYPSKCMVE

SEQ ID NO: 1219942 - protein, 9 aa, Homo Sapiens
CPQHTCPEW

SEQ ID NO: 1219943 - protein, 9 aa, Homo Sapiens
HYEDDGISD

SEQ ID NO: 1219944 - protein, 9 aa, Homo Sapiens
EICQYVITH

SEQ ID NO: 1219945 - protein, 9 aa, Homo Sapiens
PEGKDVLQE

SEQ ID NO: 1219946 - protein, 9 aa, Homo Sapiens
GRQGIFPHG

SEQ ID NO: 1219947 - protein, 9 aa, Homo Sapiens
DLASLTVDV

SEQ ID NO: 1219948 - protein, 9 aa, Homo Sapiens
LQGKFTRVN

SEQ ID NO: 1219949 - protein, 9 aa, Homo Sapiens
FDEPTEQHV

SEQ ID NO: 1219950 - protein, 9 aa, Homo Sapiens
EGVTRMSMD

SEQ ID NO: 1219951 - protein, 9 aa, Homo Sapiens
VKTCDSEES

SEQ ID NO: 1219952 - protein, 9 aa, Homo Sapiens
GCAHVCRET

SEQ ID NO: 1219953 - protein, 9 aa, Homo Sapiens
VAGSLTNLS

SEQ ID NO: 1219954 - protein, 9 aa, Homo Sapiens
DAIVLTVKS

SEQ ID NO: 1219955 - protein, 9 aa, Homo Sapiens
AGRHQNCSF

SEQ ID NO: 1219956 - protein, 9 aa, Homo Sapiens
WNNIKRWQD

SEQ ID NO: 1219957 - protein, 9 aa, Homo Sapiens
TLQLWLIIL

SEQ ID NO: 1219958 - protein, 9 aa, Homo Sapiens
EYATHSTGI

SEQ ID NO: 1219959 - protein, 9 aa, Homo Sapiens
LVMDWDSET

SEQ ID NO: 1219960 - protein, 9 aa, Homo Sapiens
NFQLYMDAI

SEQ ID NO: 1219961 - protein, 9 aa, Homo Sapiens
PLSGRLVKA

SEQ ID NO: 1219962 - protein, 9 aa, Homo Sapiens
PGAGPEEAA

SEQ ID NO: 1219963 - protein, 9 aa, Homo Sapiens
AGGPEMAAS

SEQ ID NO: 1219964 - protein, 9 aa, Homo Sapiens
GLPPISPSR

SEQ ID NO: 1219965 - protein, 9 aa, Homo Sapiens
LEQCYRPLE

SEQ ID NO: 1219966 - protein, 9 aa, Homo Sapiens
IHNDDTKLL

SEQ ID NO: 1219967 - protein, 9 aa, Homo Sapiens
CVWCHLETH

SEQ ID NO: 1219968 - protein, 9 aa, Homo Sapiens
QKNDGIYVR

SEQ ID NO: 1219969 - protein, 9 aa, Homo Sapiens
QQYAGLLSH

SEQ ID NO: 1219970 - protein, 9 aa, Homo Sapiens
LWLCCATPA

SEQ ID NO: 1219971 - protein, 9 aa, Homo Sapiens
SSPTCSKDL

SEQ ID NO: 1219972 - protein, 9 aa, Homo Sapiens
APYYLATVD

SEQ ID NO: 1219973 - protein, 9 aa, Homo Sapiens
SNETYRDDV

SEQ ID NO: 1219974 - protein, 9 aa, Homo Sapiens
RINHSYTGM

SEQ ID NO: 1219975 - protein, 9 aa, Homo Sapiens
VITRNHTQG

SEQ ID NO: 1219976 - protein, 9 aa, Homo Sapiens
QSKIENFIQ

SEQ ID NO: 1219977 - protein, 9 aa, Homo Sapiens
DLYTTEQAF

SEQ ID NO: 1219978 - protein, 9 aa, Homo Sapiens
LWALQSPEH

SEQ ID NO: 1219979 - protein, 9 aa, Homo Sapiens
ATSLWSDGG

SEQ ID NO: 1219980 - protein, 9 aa, Homo Sapiens
GFGSTQIGM

SEQ ID NO: 1219981 - protein, 9 aa, Homo Sapiens
SMICVPLVI

SEQ ID NO: 1219982 - protein, 9 aa, Homo Sapiens
SRPSGSRAP

SEQ ID NO: 1219983 - protein, 9 aa, Homo Sapiens
GVALFNSMH

SEQ ID NO: 1219984 - protein, 9 aa, Homo Sapiens
LRTSLASLC

SEQ ID NO: 1219985 - protein, 9 aa, Homo Sapiens
LRLNQLKFR

SEQ ID NO: 1219986 - protein, 9 aa, Homo Sapiens
IAQTWHFLS

SEQ ID NO: 1219987 - protein, 9 aa, Homo Sapiens
MSHDKHVFT

SEQ ID NO: 1219988 - protein, 9 aa, Homo Sapiens
TESNDMHFS

SEQ ID NO: 1219989 - protein, 9 aa, Homo Sapiens
YQSSSHFYV

SEQ ID NO: 1219990 - protein, 9 aa, Homo Sapiens
KMLVDQVTG

SEQ ID NO: 1219991 - protein, 9 aa, Homo Sapiens
FLYCNTGDV

SEQ ID NO: 1219992 - protein, 9 aa, Homo Sapiens
AQYSSASNP

SEQ ID NO: 1219993 - protein, 9 aa, Homo Sapiens
SAIRKHLVK

SEQ ID NO: 1219994 - protein, 9 aa, Homo Sapiens
IFIMNRHPN

SEQ ID NO: 1219995 - protein, 9 aa, Homo Sapiens
PDVPCLPVK

SEQ ID NO: 1219996 - protein, 9 aa, Homo Sapiens
SSGLALCGI

SEQ ID NO: 1219997 - protein, 9 aa, Homo Sapiens
REAEATALY

SEQ ID NO: 1219998 - protein, 9 aa, Homo Sapiens
SPMSRQEND

SEQ ID NO: 1219999 - protein, 9 aa, Homo Sapiens
VRDPTDVSS

SEQ ID NO: 1220000 - protein, 9 aa, Homo Sapiens
QIIPTARCC

SEQ ID NO: 1220001 - protein, 9 aa, Homo Sapiens
LKQDKKFPP

SEQ ID NO: 1220002 - protein, 9 aa, Homo Sapiens
SLGTDSSHY

SEQ ID NO: 1220003 - protein, 9 aa, Homo Sapiens
GVWAEMVAE

SEQ ID NO: 1220004 - protein, 9 aa, Homo Sapiens
PGGIGITLS

SEQ ID NO: 1220005 - protein, 9 aa, Homo Sapiens
KEQNPNATF

SEQ ID NO: 1220006 - protein, 9 aa, Homo Sapiens
IDINDCPHV

SEQ ID NO: 1220007 - protein, 9 aa, Homo Sapiens
PTLTAFIRL

SEQ ID NO: 1220008 - protein, 9 aa, Homo Sapiens
HLGCTQKTA

SEQ ID NO: 1220009 - protein, 9 aa, Homo Sapiens
FEHPTRDGL

SEQ ID NO: 1220010 - protein, 9 aa, Homo Sapiens
FASTVCHPL

SEQ ID NO: 1220011 - protein, 9 aa, Homo Sapiens
AAAAATMLP

SEQ ID NO: 1220012 - protein, 9 aa, Homo Sapiens
ERGQQYFSD

SEQ ID NO: 1220013 - protein, 9 aa, Homo Sapiens
SIIFCVELS

SEQ ID NO: 1220014 - protein, 9 aa, Homo Sapiens
GFHHVGHAG

SEQ ID NO: 1220015 - protein, 9 aa, Homo Sapiens
PTVLMTSLP

SEQ ID NO: 1220016 - protein, 9 aa, Homo Sapiens
LALNSASAS

SEQ ID NO: 1220017 - protein, 9 aa, Homo Sapiens
KCWVLGRDY

SEQ ID NO: 1220018 - protein, 9 aa, Homo Sapiens
KRSLNVHMR

SEQ ID NO: 1220019 - protein, 9 aa, Homo Sapiens
KSRVPLSVQ

SEQ ID NO: 1220020 - protein, 9 aa, Homo Sapiens
KFSIEGFYQ

SEQ ID NO: 1220021 - protein, 9 aa, Homo Sapiens
LQAQGQIQT

SEQ ID NO: 1220022 - protein, 9 aa, Homo Sapiens
QTPNYNHHT

SEQ ID NO: 1220023 - protein, 9 aa, Homo Sapiens
MIKYQKERN

SEQ ID NO: 1220024 - protein, 9 aa, Homo Sapiens
VEEFLSKDV

SEQ ID NO: 1220025 - protein, 9 aa, Homo Sapiens
DLALQGDMP

SEQ ID NO: 1220026 - protein, 9 aa, Homo Sapiens
AYHTDLEEL

SEQ ID NO: 1220027 - protein, 9 aa, Homo Sapiens
TTFFYSCFY

SEQ ID NO: 1220028 - protein, 9 aa, Homo Sapiens
AFAANVLRE

SEQ ID NO: 1220029 - protein, 9 aa, Homo Sapiens
ETELQGKFT

SEQ ID NO: 1220030 - protein, 9 aa, Homo Sapiens
SLTLSSALT

SEQ ID NO: 1220031 - protein, 9 aa, Homo Sapiens
AKKKAYPSE

SEQ ID NO: 1220032 - protein, 9 aa, Homo Sapiens
KEPSCKAKN

SEQ ID NO: 1220033 - protein, 9 aa, Homo Sapiens
LKNKRYLNS

SEQ ID NO: 1220034 - protein, 9 aa, Homo Sapiens
LSAIKTPQR

SEQ ID NO: 1220035 - protein, 9 aa, Homo Sapiens
LSVTIFSFQ

SEQ ID NO: 1220036 - protein, 9 aa, Homo Sapiens
RDLGSLQHP

SEQ ID NO: 1220037 - protein, 9 aa, Homo Sapiens
ESWPDIESF

SEQ ID NO: 1220038 - protein, 9 aa, Homo Sapiens
SETLRRPAS

SEQ ID NO: 1220039 - protein, 9 aa, Homo Sapiens
CELRHKPQC

SEQ ID NO: 1220040 - protein, 9 aa, Homo Sapiens
PVCSITVNI

SEQ ID NO: 1220041 - protein, 9 aa, Homo Sapiens
PWHGTMTLS

SEQ ID NO: 1220042 - protein, 9 aa, Homo Sapiens
ILAYLRLGK

SEQ ID NO: 1220043 - protein, 9 aa, Homo Sapiens
QKAKPVAIA

SEQ ID NO: 1220044 - protein, 9 aa, Homo Sapiens
IALIIGFVI

SEQ ID NO: 1220045 - protein, 9 aa, Homo Sapiens
CASITGQSI

SEQ ID NO: 1220046 - protein, 9 aa, Homo Sapiens
AAFVYALGD

SEQ ID NO: 1220047 - protein, 9 aa, Homo Sapiens
GLVHMMLAL

SEQ ID NO: 1220048 - protein, 9 aa, Homo Sapiens
PNVLNECLS

SEQ ID NO: 1220049 - protein, 9 aa, Homo Sapiens
ELKMLQDEV

SEQ ID NO: 1220050 - protein, 9 aa, Homo Sapiens
VQSAGQIVL

SEQ ID NO: 1220051 - protein, 9 aa, Homo Sapiens
FSPQGGQMG

SEQ ID NO: 1220052 - protein, 9 aa, Homo Sapiens
ATQNCMGKA

SEQ ID NO: 1220053 - protein, 9 aa, Homo Sapiens
GGHIPIFRT

SEQ ID NO: 1220054 - protein, 9 aa, Homo Sapiens
MMVAYHGCR

SEQ ID NO: 1220055 - protein, 9 aa, Homo Sapiens
VFDYSSHGM

SEQ ID NO: 1220056 - protein, 9 aa, Homo Sapiens
YKRTVACAS

SEQ ID NO: 1220057 - protein, 9 aa, Homo Sapiens
LGESWLRTD

SEQ ID NO: 1220058 - protein, 9 aa, Homo Sapiens
SEDDEWRSD

SEQ ID NO: 1220059 - protein, 9 aa, Homo Sapiens
LVLGDCTRS

SEQ ID NO: 1220060 - protein, 9 aa, Homo Sapiens
GPHYPPGSS

SEQ ID NO: 1220061 - protein, 9 aa, Homo Sapiens
LWGPCPRIC

SEQ ID NO: 1220062 - protein, 9 aa, Homo Sapiens
SKATPQSPS

SEQ ID NO: 1220063 - protein, 9 aa, Homo Sapiens
SQQCHHVYK

SEQ ID NO: 1220064 - protein, 9 aa, Homo Sapiens
WTPRWTTST

SEQ ID NO: 1220065 - protein, 9 aa, Homo Sapiens
LRHNPALPP

SEQ ID NO: 1220066 - protein, 9 aa, Homo Sapiens
GYKLFIPDI

SEQ ID NO: 1220067 - protein, 9 aa, Homo Sapiens
GNPLEDRCV

SEQ ID NO: 1220068 - protein, 9 aa, Homo Sapiens
DVCVNPYHY

SEQ ID NO: 1220069 - protein, 9 aa, Homo Sapiens
QWDDRGAGH

SEQ ID NO: 1220070 - protein, 9 aa, Homo Sapiens
DCVEPVVWV

SEQ ID NO: 1220071 - protein, 9 aa, Homo Sapiens
TDQHLNNLM

SEQ ID NO: 1220072 - protein, 9 aa, Homo Sapiens
GTKMAVRLA

SEQ ID NO: 1220073 - protein, 9 aa, Homo Sapiens
ANMNLEILL

SEQ ID NO: 1220074 - protein, 9 aa, Homo Sapiens
AAVFMSDTE

SEQ ID NO: 1220075 - protein, 9 aa, Homo Sapiens
FVLVGICWY

SEQ ID NO: 1220076 - protein, 9 aa, Homo Sapiens
LKERERHLK

SEQ ID NO: 1220077 - protein, 9 aa, Homo Sapiens
ESGTIMTDL

SEQ ID NO: 1220078 - protein, 9 aa, Homo Sapiens
RETLPSGRT

SEQ ID NO: 1220079 - protein, 9 aa, Homo Sapiens
ENELDTTLY

SEQ ID NO: 1220080 - protein, 9 aa, Homo Sapiens
WDSATAYRM

SEQ ID NO: 1220081 - protein, 9 aa, Homo Sapiens
NVFSRRENL

SEQ ID NO: 1220082 - protein, 9 aa, Homo Sapiens
PRASNHTFC

SEQ ID NO: 1220083 - protein, 9 aa, Homo Sapiens
MTWPPLFFL

SEQ ID NO: 1220084 - protein, 9 aa, Homo Sapiens
IIQLLCFLV

SEQ ID NO: 1220085 - protein, 9 aa, Homo Sapiens
RCSLEGELQ

SEQ ID NO: 1220086 - protein, 9 aa, Homo Sapiens
ITCHRSSSP

SEQ ID NO: 1220087 - protein, 9 aa, Homo Sapiens
QGDLPPSWT

SEQ ID NO: 1220088 - protein, 9 aa, Homo Sapiens
HYSPVCSSD

SEQ ID NO: 1220089 - protein, 9 aa, Homo Sapiens
LHSKDQMKR

SEQ ID NO: 1220090 - protein, 9 aa, Homo Sapiens
SASGFSVFF

SEQ ID NO: 1220091 - protein, 9 aa, Homo Sapiens
WLQSLPASL

SEQ ID NO: 1220092 - protein, 9 aa, Homo Sapiens
YVEVLTDGS

SEQ ID NO: 1220093 - protein, 9 aa, Homo Sapiens
RTRKHSREH

SEQ ID NO: 1220094 - protein, 9 aa, Homo Sapiens
MMFEGGPRP

SEQ ID NO: 1220095 - protein, 9 aa, Homo Sapiens
GTISQPQIL

SEQ ID NO: 1220096 - protein, 9 aa, Homo Sapiens
AQVVLTEYV

SEQ ID NO: 1220097 - protein, 9 aa, Homo Sapiens
ASVSDWWPT

SEQ ID NO: 1220098 - protein, 9 aa, Homo Sapiens
KAEFKEGKN

SEQ ID NO: 1220099 - protein, 9 aa, Homo Sapiens
FVKNVEYVV

SEQ ID NO: 1220100 - protein, 9 aa, Homo Sapiens
TLVNLVCAL

SEQ ID NO: 1220101 - protein, 9 aa, Homo Sapiens
SVMERSKTC

SEQ ID NO: 1220102 - protein, 9 aa, Homo Sapiens
GDPMPEPRP

SEQ ID NO: 1220103 - protein, 9 aa, Homo Sapiens
FVDKTFPQS

SEQ ID NO: 1220104 - protein, 9 aa, Homo Sapiens
LLDKNKCLS

SEQ ID NO: 1220105 - protein, 9 aa, Homo Sapiens
IEEREDEYQ

SEQ ID NO: 1220106 - protein, 9 aa, Homo Sapiens
VIYSIRITL

SEQ ID NO: 1220107 - protein, 9 aa, Homo Sapiens
EIRVVLCEL

SEQ ID NO: 1220108 - protein, 9 aa, Homo Sapiens
REVLGGVND

SEQ ID NO: 1220109 - protein, 9 aa, Homo Sapiens
VAWHEGQGT

SEQ ID NO: 1220110 - protein, 9 aa, Homo Sapiens
GEYKFGPIF

SEQ ID NO: 1220111 - protein, 9 aa, Homo Sapiens
FVYCTFLDF

SEQ ID NO: 1220112 - protein, 9 aa, Homo Sapiens
KLGQSTRAV

SEQ ID NO: 1220113 - protein, 9 aa, Homo Sapiens
GRIFDGREL

SEQ ID NO: 1220114 - protein, 9 aa, Homo Sapiens
MVCMVRAAT

SEQ ID NO: 1220115 - protein, 9 aa, Homo Sapiens
LPCEDQIVL

SEQ ID NO: 1220116 - protein, 9 aa, Homo Sapiens
DFRNDILPC

SEQ ID NO: 1220117 - protein, 9 aa, Homo Sapiens
VNCSKNVMF

SEQ ID NO: 1220118 - protein, 9 aa, Homo Sapiens
HVHFTTLGF

SEQ ID NO: 1220119 - protein, 9 aa, Homo Sapiens
PPDDDFRRP

SEQ ID NO: 1220120 - protein, 9 aa, Homo Sapiens
KKGMSLKSN

SEQ ID NO: 1220121 - protein, 9 aa, Homo Sapiens
SVMVCDVLK

SEQ ID NO: 1220122 - protein, 9 aa, Homo Sapiens
PLLPRAPPE

SEQ ID NO: 1220123 - protein, 9 aa, Homo Sapiens
EMLGRCSMV

SEQ ID NO: 1220124 - protein, 9 aa, Homo Sapiens
GQQFAHQMQ

SEQ ID NO: 1220125 - protein, 9 aa, Homo Sapiens
LHTSERKLR

SEQ ID NO: 1220126 - protein, 9 aa, Homo Sapiens
GRRELGGRA

SEQ ID NO: 1220127 - protein, 9 aa, Homo Sapiens
RESKQREDD

SEQ ID NO: 1220128 - protein, 9 aa, Homo Sapiens
ALATKACAF

SEQ ID NO: 1220129 - protein, 9 aa, Homo Sapiens
FIRTTEALH

SEQ ID NO: 1220130 - protein, 9 aa, Homo Sapiens
LTWAGSRPQ

SEQ ID NO: 1220131 - protein, 9 aa, Homo Sapiens
LGSPPFRLH

SEQ ID NO: 1220132 - protein, 9 aa, Homo Sapiens
SHHIHVLKE

SEQ ID NO: 1220133 - protein, 9 aa, Homo Sapiens
GKAFQHCSS

SEQ ID NO: 1220134 - protein, 9 aa, Homo Sapiens
IVTFKPFDG

SEQ ID NO: 1220135 - protein, 9 aa, Homo Sapiens
EKLSQICLN

SEQ ID NO: 1220136 - protein, 9 aa, Homo Sapiens
VADNAGGIH

SEQ ID NO: 1220137 - protein, 9 aa, Homo Sapiens
VTPSVWEAD

SEQ ID NO: 1220138 - protein, 9 aa, Homo Sapiens
PGMFGTSHG

SEQ ID NO: 1220139 - protein, 9 aa, Homo Sapiens
TFAIEALKS

SEQ ID NO: 1220140 - protein, 9 aa, Homo Sapiens
QKSNCGVDC

SEQ ID NO: 1220141 - protein, 9 aa, Homo Sapiens
GIGVGYCKR

SEQ ID NO: 1220142 - protein, 9 aa, Homo Sapiens
TMMKALVLG

SEQ ID NO: 1220143 - protein, 9 aa, Homo Sapiens
GTMQPFMLY

SEQ ID NO: 1220144 - protein, 9 aa, Homo Sapiens
MEADGILKP

SEQ ID NO: 1220145 - protein, 9 aa, Homo Sapiens
LEEEKHEAA

SEQ ID NO: 1220146 - protein, 9 aa, Homo Sapiens
ENGSMASDP

SEQ ID NO: 1220147 - protein, 9 aa, Homo Sapiens
TSDKRATQG

SEQ ID NO: 1220148 - protein, 9 aa, Homo Sapiens
RNIVSRRPS

SEQ ID NO: 1220149 - protein, 9 aa, Homo Sapiens
LQVTAGHHG

SEQ ID NO: 1220150 - protein, 9 aa, Homo Sapiens
IVRLIMVGY

SEQ ID NO: 1220151 - protein, 9 aa, Homo Sapiens
APPARGTSP

SEQ ID NO: 1220152 - protein, 9 aa, Homo Sapiens
SLTLTVPGI

SEQ ID NO: 1220153 - protein, 9 aa, Homo Sapiens
WTDRGCEWP

SEQ ID NO: 1220154 - protein, 9 aa, Homo Sapiens
GSHHLGFLW

SEQ ID NO: 1220155 - protein, 9 aa, Homo Sapiens
DSTSVDSEG

SEQ ID NO: 1220156 - protein, 9 aa, Homo Sapiens
EYVYYKSMP

SEQ ID NO: 1220157 - protein, 9 aa, Homo Sapiens
HKLFQEIFT

SEQ ID NO: 1220158 - protein, 9 aa, Homo Sapiens
SSVSASRPS

SEQ ID NO: 1220159 - protein, 9 aa, Homo Sapiens
LKPRGVVVD

SEQ ID NO: 1220160 - protein, 9 aa, Homo Sapiens
IQVMTTELA

SEQ ID NO: 1220161 - protein, 9 aa, Homo Sapiens
ECTLRIPCT

SEQ ID NO: 1220162 - protein, 9 aa, Homo Sapiens
TSAVSPSSV

SEQ ID NO: 1220163 - protein, 9 aa, Homo Sapiens
LNIISQPKR

SEQ ID NO: 1220164 - protein, 9 aa, Homo Sapiens
HIHVLKEMV

SEQ ID NO: 1220165 - protein, 9 aa, Homo Sapiens
GLMITCMYT

SEQ ID NO: 1220166 - protein, 9 aa, Homo Sapiens
ADETRNLQT

SEQ ID NO: 1220167 - protein, 9 aa, Homo Sapiens
FMVCLALIG

SEQ ID NO: 1220168 - protein, 9 aa, Homo Sapiens
RNTDHHILH

SEQ ID NO: 1220169 - protein, 9 aa, Homo Sapiens
HILLFNISV

SEQ ID NO: 1220170 - protein, 9 aa, Homo Sapiens
EQKTHLEDM

SEQ ID NO: 1220171 - protein, 9 aa, Homo Sapiens
LNVCFLTLD

SEQ ID NO: 1220172 - protein, 9 aa, Homo Sapiens
VEEKQRQRL

SEQ ID NO: 1220173 - protein, 9 aa, Homo Sapiens
DIYAREMLA

SEQ ID NO: 1220174 - protein, 9 aa, Homo Sapiens
YIVVMVDEA

SEQ ID NO: 1220175 - protein, 9 aa, Homo Sapiens
TCFSHICVI

SEQ ID NO: 1220176 - protein, 9 aa, Homo Sapiens
VLAYAMEQY

SEQ ID NO: 1220177 - protein, 9 aa, Homo Sapiens
AECKEKFTA

SEQ ID NO: 1220178 - protein, 9 aa, Homo Sapiens
EQKLKLHQS

SEQ ID NO: 1220179 - protein, 9 aa, Homo Sapiens
GCLGFQVWL

SEQ ID NO: 1220180 - protein, 9 aa, Homo Sapiens
DINTEDLLL

SEQ ID NO: 1220181 - protein, 9 aa, Homo Sapiens
KCIMKEPVL

SEQ ID NO: 1220182 - protein, 9 aa, Homo Sapiens
YRRESVKSY

SEQ ID NO: 1220183 - protein, 9 aa, Homo Sapiens
SEWARQGAE

SEQ ID NO: 1220184 - protein, 9 aa, Homo Sapiens
EETDVAIQT

SEQ ID NO: 1220185 - protein, 9 aa, Homo Sapiens
SLLFITSVF

SEQ ID NO: 1220186 - protein, 9 aa, Homo Sapiens
ACAAAPQWC

SEQ ID NO: 1220187 - protein, 9 aa, Homo Sapiens
EFDSPVAAI

SEQ ID NO: 1220188 - protein, 9 aa, Homo Sapiens
DICDTSFMR

SEQ ID NO: 1220189 - protein, 9 aa, Homo Sapiens
FCTRINHSY

SEQ ID NO: 1220190 - protein, 9 aa, Homo Sapiens
APEDVTSPF

SEQ ID NO: 1220191 - protein, 9 aa, Homo Sapiens
TVEDWETER

SEQ ID NO: 1220192 - protein, 9 aa, Homo Sapiens
PDRGLDHIA

SEQ ID NO: 1220193 - protein, 9 aa, Homo Sapiens
QCSIDEPVF

SEQ ID NO: 1220194 - protein, 9 aa, Homo Sapiens
GLVHSPEYA

SEQ ID NO: 1220195 - protein, 9 aa, Homo Sapiens
FGYTPVVWG

SEQ ID NO: 1220196 - protein, 9 aa, Homo Sapiens
KDSEHYAQE

SEQ ID NO: 1220197 - protein, 9 aa, Homo Sapiens
EALEWHVIQ

SEQ ID NO: 1220198 - protein, 9 aa, Homo Sapiens
AKDTQGFMG

SEQ ID NO: 1220199 - protein, 9 aa, Homo Sapiens
TKSGTPFLS

SEQ ID NO: 1220200 - protein, 9 aa, Homo Sapiens
HLHVHFTTL

SEQ ID NO: 1220201 - protein, 9 aa, Homo Sapiens
EHPHLAAKY

SEQ ID NO: 1220202 - protein, 9 aa, Homo Sapiens
SRAHCPANG

SEQ ID NO: 1220203 - protein, 9 aa, Homo Sapiens
TRRVNTSWR

SEQ ID NO: 1220204 - protein, 9 aa, Homo Sapiens
LDAMVLLLS

SEQ ID NO: 1220205 - protein, 9 aa, Homo Sapiens
LSLRSRRFS

SEQ ID NO: 1220206 - protein, 9 aa, Homo Sapiens
DAIKHFLDY

SEQ ID NO: 1220207 - protein, 9 aa, Homo Sapiens
EKKRFSSHD

SEQ ID NO: 1220208 - protein, 9 aa, Homo Sapiens
STSSHLILL

SEQ ID NO: 1220209 - protein, 9 aa, Homo Sapiens
VYRPCCWAT

SEQ ID NO: 1220210 - protein, 9 aa, Homo Sapiens
LELGECELP

SEQ ID NO: 1220211 - protein, 9 aa, Homo Sapiens
LLKEKAPAF

SEQ ID NO: 1220212 - protein, 9 aa, Homo Sapiens
HKQITALAT

SEQ ID NO: 1220213 - protein, 9 aa, Homo Sapiens
YERSECRKT

SEQ ID NO: 1220214 - protein, 9 aa, Homo Sapiens
GEFRSNVDY

SEQ ID NO: 1220215 - protein, 9 aa, Homo Sapiens
HIHRLCLSR

SEQ ID NO: 1220216 - protein, 9 aa, Homo Sapiens
KNKISITTI

SEQ ID NO: 1220217 - protein, 9 aa, Homo Sapiens
SQPRRPKPV

SEQ ID NO: 1220218 - protein, 9 aa, Homo Sapiens
VDIMRKVSG

SEQ ID NO: 1220219 - protein, 9 aa, Homo Sapiens
LDALKSLKM

SEQ ID NO: 1220220 - protein, 9 aa, Homo Sapiens
SESSVSEDE

SEQ ID NO: 1220221 - protein, 9 aa, Homo Sapiens
GLKIQMGKK

SEQ ID NO: 1220222 - protein, 9 aa, Homo Sapiens
PVVVAMNAF

SEQ ID NO: 1220223 - protein, 9 aa, Homo Sapiens
EQKGRCKQE

SEQ ID NO: 1220224 - protein, 9 aa, Homo Sapiens
VIDSDNEEE

SEQ ID NO: 1220225 - protein, 9 aa, Homo Sapiens
QELRQWVRM

SEQ ID NO: 1220226 - protein, 9 aa, Homo Sapiens
SAPRRGCGG

SEQ ID NO: 1220227 - protein, 9 aa, Homo Sapiens
MEIDNSATC

SEQ ID NO: 1220228 - protein, 9 aa, Homo Sapiens
DTRLSRRLL

SEQ ID NO: 1220229 - protein, 9 aa, Homo Sapiens
MSVFRHLRL

SEQ ID NO: 1220230 - protein, 9 aa, Homo Sapiens
QKRMNFLHH

SEQ ID NO: 1220231 - protein, 9 aa, Homo Sapiens
DMEPSSTSF

SEQ ID NO: 1220232 - protein, 9 aa, Homo Sapiens
KLVWIPSEC

SEQ ID NO: 1220233 - protein, 9 aa, Homo Sapiens
LTAASPPAS

SEQ ID NO: 1220234 - protein, 9 aa, Homo Sapiens
VDVLTLAIL

SEQ ID NO: 1220235 - protein, 9 aa, Homo Sapiens
QMDHEGEFT

SEQ ID NO: 1220236 - protein, 9 aa, Homo Sapiens
VGVLCYLER

SEQ ID NO: 1220237 - protein, 9 aa, Homo Sapiens
MGLVRRDCL

SEQ ID NO: 1220238 - protein, 9 aa, Homo Sapiens
VAILLEAGV

SEQ ID NO: 1220239 - protein, 9 aa, Homo Sapiens
VQMKLPPCF

SEQ ID NO: 1220240 - protein, 9 aa, Homo Sapiens
CYQDAHGPR

SEQ ID NO: 1220241 - protein, 9 aa, Homo Sapiens
ARHKGGCDS

SEQ ID NO: 1220242 - protein, 9 aa, Homo Sapiens
DHLRECNRE

SEQ ID NO: 1220243 - protein, 9 aa, Homo Sapiens
ATINFAYDT

SEQ ID NO: 1220244 - protein, 9 aa, Homo Sapiens
RVKAADQDE

SEQ ID NO: 1220245 - protein, 9 aa, Homo Sapiens
HLHMIEERR

SEQ ID NO: 1220246 - protein, 9 aa, Homo Sapiens
FLSPYISPK

SEQ ID NO: 1220247 - protein, 9 aa, Homo Sapiens
ADQLLPLAY

SEQ ID NO: 1220248 - protein, 9 aa, Homo Sapiens
FNFKRAHED

SEQ ID NO: 1220249 - protein, 9 aa, Homo Sapiens
VAAMDKLMD

SEQ ID NO: 1220250 - protein, 9 aa, Homo Sapiens
LDVKSKKDS

SEQ ID NO: 1220251 - protein, 9 aa, Homo Sapiens
DLDQFLEGI

SEQ ID NO: 1220252 - protein, 9 aa, Homo Sapiens
KRKNWQPLS

SEQ ID NO: 1220253 - protein, 9 aa, Homo Sapiens
GNLGAEHIC

SEQ ID NO: 1220254 - protein, 9 aa, Homo Sapiens
IHILTSILN

SEQ ID NO: 1220255 - protein, 9 aa, Homo Sapiens
PPLKKMKQE

SEQ ID NO: 1220256 - protein, 9 aa, Homo Sapiens
RPYKGDLQP

SEQ ID NO: 1220257 - protein, 9 aa, Homo Sapiens
SPEEVCMAI

SEQ ID NO: 1220258 - protein, 9 aa, Homo Sapiens
PQGECLNTD

SEQ ID NO: 1220259 - protein, 9 aa, Homo Sapiens
NDPFLHPGF

SEQ ID NO: 1220260 - protein, 9 aa, Homo Sapiens
QVIASVKNK

SEQ ID NO: 1220261 - protein, 9 aa, Homo Sapiens
RHSSNYRAY

SEQ ID NO: 1220262 - protein, 9 aa, Homo Sapiens
NINVFSELS

SEQ ID NO: 1220263 - protein, 9 aa, Homo Sapiens
LRVQIARIS

SEQ ID NO: 1220264 - protein, 9 aa, Homo Sapiens
QPGAAVGSV

SEQ ID NO: 1220265 - protein, 9 aa, Homo Sapiens
IGDWQHTQN

SEQ ID NO: 1220266 - protein, 9 aa, Homo Sapiens
MAIGLLDIF

SEQ ID NO: 1220267 - protein, 9 aa, Homo Sapiens
LACLKESTE

SEQ ID NO: 1220268 - protein, 9 aa, Homo Sapiens
RAIMTQLPQ

SEQ ID NO: 1220269 - protein, 9 aa, Homo Sapiens
PKGNRPTIL

SEQ ID NO: 1220270 - protein, 9 aa, Homo Sapiens
IIEKHPAER

SEQ ID NO: 1220271 - protein, 9 aa, Homo Sapiens
RADSPPSSP

SEQ ID NO: 1220272 - protein, 9 aa, Homo Sapiens
YEMICGHAP

SEQ ID NO: 1220273 - protein, 9 aa, Homo Sapiens
TNHHIIHAG

SEQ ID NO: 1220274 - protein, 9 aa, Homo Sapiens
QIIYRRYSK

SEQ ID NO: 1220275 - protein, 9 aa, Homo Sapiens
GIWAVYERP

SEQ ID NO: 1220276 - protein, 9 aa, Homo Sapiens
KSEKIVLPH

SEQ ID NO: 1220277 - protein, 9 aa, Homo Sapiens
EWIMQKKTY

SEQ ID NO: 1220278 - protein, 9 aa, Homo Sapiens
LHITIAVMG

SEQ ID NO: 1220279 - protein, 9 aa, Homo Sapiens
LTFIGLLSS

SEQ ID NO: 1220280 - protein, 9 aa, Homo Sapiens
MKEKEVKDQ

SEQ ID NO: 1220281 - protein, 9 aa, Homo Sapiens
LPGADVGVP

SEQ ID NO: 1220282 - protein, 9 aa, Homo Sapiens
WRPLEGVLE

SEQ ID NO: 1220283 - protein, 9 aa, Homo Sapiens
SFSDMRRAE

SEQ ID NO: 1220284 - protein, 9 aa, Homo Sapiens
NNIKRWQDI

SEQ ID NO: 1220285 - protein, 9 aa, Homo Sapiens
VCSLERDPS

SEQ ID NO: 1220286 - protein, 9 aa, Homo Sapiens
SHLPAIPRL

SEQ ID NO: 1220287 - protein, 9 aa, Homo Sapiens
LRRVLEMSD

SEQ ID NO: 1220288 - protein, 9 aa, Homo Sapiens
RPDLLTPGE

SEQ ID NO: 1220289 - protein, 9 aa, Homo Sapiens
NALLQVEVL

SEQ ID NO: 1220290 - protein, 9 aa, Homo Sapiens
LFLYNKIRY

SEQ ID NO: 1220291 - protein, 9 aa, Homo Sapiens
QIYSKAERR

SEQ ID NO: 1220292 - protein, 9 aa, Homo Sapiens
HGMTLKSVM

SEQ ID NO: 1220293 - protein, 9 aa, Homo Sapiens
NVRTVVMTV

SEQ ID NO: 1220294 - protein, 9 aa, Homo Sapiens
ASGFSVFFQ

SEQ ID NO: 1220295 - protein, 9 aa, Homo Sapiens
EIKFVLKVD

SEQ ID NO: 1220296 - protein, 9 aa, Homo Sapiens
NWDETLLDK

SEQ ID NO: 1220297 - protein, 9 aa, Homo Sapiens
LDLCHKSGG

SEQ ID NO: 1220298 - protein, 9 aa, Homo Sapiens
NEEEGIQGH

SEQ ID NO: 1220299 - protein, 9 aa, Homo Sapiens
PELEEHYST

SEQ ID NO: 1220300 - protein, 9 aa, Homo Sapiens
QKPIRCGEV

SEQ ID NO: 1220301 - protein, 9 aa, Homo Sapiens
TIQCETLIY

SEQ ID NO: 1220302 - protein, 9 aa, Homo Sapiens
ETSLVPELP

SEQ ID NO: 1220303 - protein, 9 aa, Homo Sapiens
LQGLVDGVT

SEQ ID NO: 1220304 - protein, 9 aa, Homo Sapiens
GESGTRDPH

SEQ ID NO: 1220305 - protein, 9 aa, Homo Sapiens
VVGGLGVVV

SEQ ID NO: 1220306 - protein, 9 aa, Homo Sapiens
LLEKGPSPI

SEQ ID NO: 1220307 - protein, 9 aa, Homo Sapiens
GQTQKVFQL

SEQ ID NO: 1220308 - protein, 9 aa, Homo Sapiens
AASPSSSAT

SEQ ID NO: 1220309 - protein, 9 aa, Homo Sapiens
NQVRMWYLL

SEQ ID NO: 1220310 - protein, 9 aa, Homo Sapiens
SLAQPESIC

SEQ ID NO: 1220311 - protein, 9 aa, Homo Sapiens
APPGSCCPV

SEQ ID NO: 1220312 - protein, 9 aa, Homo Sapiens
TTTAKSICR

SEQ ID NO: 1220313 - protein, 9 aa, Homo Sapiens
EQYYRFHEY

SEQ ID NO: 1220314 - protein, 9 aa, Homo Sapiens
YTPFANSPS

SEQ ID NO: 1220315 - protein, 9 aa, Homo Sapiens
VVAELARKA

SEQ ID NO: 1220316 - protein, 9 aa, Homo Sapiens
LLLNDNRLT

SEQ ID NO: 1220317 - protein, 9 aa, Homo Sapiens
IEHLVITSF

SEQ ID NO: 1220318 - protein, 9 aa, Homo Sapiens
KPRFVHIRQ

SEQ ID NO: 1220319 - protein, 9 aa, Homo Sapiens
EWERCPQEP

SEQ ID NO: 1220320 - protein, 9 aa, Homo Sapiens
HPSAESVVQ

SEQ ID NO: 1220321 - protein, 9 aa, Homo Sapiens
DKLCLMVCY

SEQ ID NO: 1220322 - protein, 9 aa, Homo Sapiens
AMCTAVWSL

SEQ ID NO: 1220323 - protein, 9 aa, Homo Sapiens
PWDALDLGL

SEQ ID NO: 1220324 - protein, 9 aa, Homo Sapiens
LYTMLVGWY

SEQ ID NO: 1220325 - protein, 9 aa, Homo Sapiens
HQEECKYWH

SEQ ID NO: 1220326 - protein, 9 aa, Homo Sapiens
QSQDLSCTL

SEQ ID NO: 1220327 - protein, 9 aa, Homo Sapiens
VDLELLTSN

SEQ ID NO: 1220328 - protein, 9 aa, Homo Sapiens
SGQRPIFCP

SEQ ID NO: 1220329 - protein, 9 aa, Homo Sapiens
LCCKPYLDS

SEQ ID NO: 1220330 - protein, 9 aa, Homo Sapiens
VRFSIHLPQ

SEQ ID NO: 1220331 - protein, 9 aa, Homo Sapiens
ASHLTIVIL

SEQ ID NO: 1220332 - protein, 9 aa, Homo Sapiens
TRTGIIVTT

SEQ ID NO: 1220333 - protein, 9 aa, Homo Sapiens
ADQDDNINT

SEQ ID NO: 1220334 - protein, 9 aa, Homo Sapiens
VLLYEMICG

SEQ ID NO: 1220335 - protein, 9 aa, Homo Sapiens
VSEVSNGMS

SEQ ID NO: 1220336 - protein, 9 aa, Homo Sapiens
RENPFECSE

SEQ ID NO: 1220337 - protein, 9 aa, Homo Sapiens
EGKKDKKYY

SEQ ID NO: 1220338 - protein, 9 aa, Homo Sapiens
EEVEGGVRC

SEQ ID NO: 1220339 - protein, 9 aa, Homo Sapiens
SPDSGVLFE

SEQ ID NO: 1220340 - protein, 9 aa, Homo Sapiens
NSKVAAVVC

SEQ ID NO: 1220341 - protein, 9 aa, Homo Sapiens
QCVVLEARA

SEQ ID NO: 1220342 - protein, 9 aa, Homo Sapiens
KLVIHNDDT

SEQ ID NO: 1220343 - protein, 9 aa, Homo Sapiens
IEYEKTDRV

SEQ ID NO: 1220344 - protein, 9 aa, Homo Sapiens
TARCRQQQQ

SEQ ID NO: 1220345 - protein, 9 aa, Homo Sapiens
AWERVWGLG

SEQ ID NO: 1220346 - protein, 9 aa, Homo Sapiens
ECAALEKLQ

SEQ ID NO: 1220347 - protein, 9 aa, Homo Sapiens
LRMAREKGS

SEQ ID NO: 1220348 - protein, 9 aa, Homo Sapiens
VVAMNAFKT

SEQ ID NO: 1220349 - protein, 9 aa, Homo Sapiens
QHPAAEEAE

SEQ ID NO: 1220350 - protein, 9 aa, Homo Sapiens
RLTGGEAAE

SEQ ID NO: 1220351 - protein, 9 aa, Homo Sapiens
PSLLIGTAW

SEQ ID NO: 1220352 - protein, 9 aa, Homo Sapiens
MEKQMHDSF

SEQ ID NO: 1220353 - protein, 9 aa, Homo Sapiens
KTIAVGLSL

SEQ ID NO: 1220354 - protein, 9 aa, Homo Sapiens
YLRVLRDGL

SEQ ID NO: 1220355 - protein, 9 aa, Homo Sapiens
LEVFAENNN

SEQ ID NO: 1220356 - protein, 9 aa, Homo Sapiens
NGLLLFIYN

SEQ ID NO: 1220357 - protein, 9 aa, Homo Sapiens
HPCMRRYIK

SEQ ID NO: 1220358 - protein, 9 aa, Homo Sapiens
FGMAQKRIH

SEQ ID NO: 1220359 - protein, 9 aa, Homo Sapiens
IQRKNNNGL

SEQ ID NO: 1220360 - protein, 9 aa, Homo Sapiens
MSTYLVDFI

SEQ ID NO: 1220361 - protein, 9 aa, Homo Sapiens
GYLIRNSES

SEQ ID NO: 1220362 - protein, 9 aa, Homo Sapiens
CWASTLWYL

SEQ ID NO: 1220363 - protein, 9 aa, Homo Sapiens
TSPTHDPQW

SEQ ID NO: 1220364 - protein, 9 aa, Homo Sapiens
SPSSSATSS

SEQ ID NO: 1220365 - protein, 9 aa, Homo Sapiens
SWTNRSVAP

SEQ ID NO: 1220366 - protein, 9 aa, Homo Sapiens
IGACTCHTN

SEQ ID NO: 1220367 - protein, 9 aa, Homo Sapiens
TTLFTFIWF

SEQ ID NO: 1220368 - protein, 9 aa, Homo Sapiens
EGCAYIAKE

SEQ ID NO: 1220369 - protein, 9 aa, Homo Sapiens
GFLFVASEL

SEQ ID NO: 1220370 - protein, 9 aa, Homo Sapiens
AREVGWMVA

SEQ ID NO: 1220371 - protein, 9 aa, Homo Sapiens
AHGDRRGRP

SEQ ID NO: 1220372 - protein, 9 aa, Homo Sapiens
ACMIRLFNT

SEQ ID NO: 1220373 - protein, 9 aa, Homo Sapiens
IHLFINSLL

SEQ ID NO: 1220374 - protein, 9 aa, Homo Sapiens
GMIVRCVIA

SEQ ID NO: 1220375 - protein, 9 aa, Homo Sapiens
ECKNVSVSI

SEQ ID NO: 1220376 - protein, 9 aa, Homo Sapiens
VNQGLDTGR

SEQ ID NO: 1220377 - protein, 9 aa, Homo Sapiens
VQLNVKYTP

SEQ ID NO: 1220378 - protein, 9 aa, Homo Sapiens
QVMTHLHMI

SEQ ID NO: 1220379 - protein, 9 aa, Homo Sapiens
AILLKVKDS

SEQ ID NO: 1220380 - protein, 9 aa, Homo Sapiens
QREECAALE

SEQ ID NO: 1220381 - protein, 9 aa, Homo Sapiens
ATLTGEQLL

SEQ ID NO: 1220382 - protein, 9 aa, Homo Sapiens
TVFVQIMRL

SEQ ID NO: 1220383 - protein, 9 aa, Homo Sapiens
WLFLLLPIS

SEQ ID NO: 1220384 - protein, 9 aa, Homo Sapiens
NQPQATGEE

SEQ ID NO: 1220385 - protein, 9 aa, Homo Sapiens
PPQGPAQAP

SEQ ID NO: 1220386 - protein, 9 aa, Homo Sapiens
DAYHHLDSC

SEQ ID NO: 1220387 - protein, 9 aa, Homo Sapiens
YILFYERMN

SEQ ID NO: 1220388 - protein, 9 aa, Homo Sapiens
KPKEPRPEV

SEQ ID NO: 1220389 - protein, 9 aa, Homo Sapiens
TMALQRQRN

SEQ ID NO: 1220390 - protein, 9 aa, Homo Sapiens
GLTTHLLVS

SEQ ID NO: 1220391 - protein, 9 aa, Homo Sapiens
ARICRNWRK

SEQ ID NO: 1220392 - protein, 9 aa, Homo Sapiens
PTILTYHDV

SEQ ID NO: 1220393 - protein, 9 aa, Homo Sapiens
KPSTSLTSE

SEQ ID NO: 1220394 - protein, 9 aa, Homo Sapiens
KTLMNAISP

SEQ ID NO: 1220395 - protein, 9 aa, Homo Sapiens
IYLLCDKIA

SEQ ID NO: 1220396 - protein, 9 aa, Homo Sapiens
STFARCSLE

SEQ ID NO: 1220397 - protein, 9 aa, Homo Sapiens
TSDDDAPCP

SEQ ID NO: 1220398 - protein, 9 aa, Homo Sapiens
AFKKWTHPR

SEQ ID NO: 1220399 - protein, 9 aa, Homo Sapiens
VLIPKDHQV

SEQ ID NO: 1220400 - protein, 9 aa, Homo Sapiens
ASSPRGTVR

SEQ ID NO: 1220401 - protein, 9 aa, Homo Sapiens
GKVILVWEK

SEQ ID NO: 1220402 - protein, 9 aa, Homo Sapiens
VDVTARAGP

SEQ ID NO: 1220403 - protein, 9 aa, Homo Sapiens
ELPEHVSSG

SEQ ID NO: 1220404 - protein, 9 aa, Homo Sapiens
RGQQYFSDL

SEQ ID NO: 1220405 - protein, 9 aa, Homo Sapiens
MLLRFSRMF

SEQ ID NO: 1220406 - protein, 9 aa, Homo Sapiens
KAVAAMDKL

SEQ ID NO: 1220407 - protein, 9 aa, Homo Sapiens
TLEGADAET

SEQ ID NO: 1220408 - protein, 9 aa, Homo Sapiens
ILQTAILLP

SEQ ID NO: 1220409 - protein, 9 aa, Homo Sapiens
RNFEVVLSS

SEQ ID NO: 1220410 - protein, 9 aa, Homo Sapiens
AAHSGTRCH

SEQ ID NO: 1220411 - protein, 9 aa, Homo Sapiens
RCELIQGWD

SEQ ID NO: 1220412 - protein, 9 aa, Homo Sapiens
TKKYMQAGN

SEQ ID NO: 1220413 - protein, 9 aa, Homo Sapiens
NIDVSMDVN

SEQ ID NO: 1220414 - protein, 9 aa, Homo Sapiens
RLESSQNLV

SEQ ID NO: 1220415 - protein, 9 aa, Homo Sapiens
HVKTLEKML

SEQ ID NO: 1220416 - protein, 9 aa, Homo Sapiens
NELSFLSDD

SEQ ID NO: 1220417 - protein, 9 aa, Homo Sapiens
QMSDQQLVE

SEQ ID NO: 1220418 - protein, 9 aa, Homo Sapiens
CSQLMACVR

SEQ ID NO: 1220419 - protein, 9 aa, Homo Sapiens
PMSAMNIKL

SEQ ID NO: 1220420 - protein, 9 aa, Homo Sapiens
GSLQHPPPG

SEQ ID NO: 1220421 - protein, 9 aa, Homo Sapiens
HTHESQAQD

SEQ ID NO: 1220422 - protein, 9 aa, Homo Sapiens
PHPKKIRLQ

SEQ ID NO: 1220423 - protein, 9 aa, Homo Sapiens
GVSHVLNRL

SEQ ID NO: 1220424 - protein, 9 aa, Homo Sapiens
IWFLSSVSS

SEQ ID NO: 1220425 - protein, 9 aa, Homo Sapiens
PKLNVDVKK

SEQ ID NO: 1220426 - protein, 9 aa, Homo Sapiens
GQKCSEWML

SEQ ID NO: 1220427 - protein, 9 aa, Homo Sapiens
VWSKVGPYP

SEQ ID NO: 1220428 - protein, 9 aa, Homo Sapiens
VDRIIKTLS

SEQ ID NO: 1220429 - protein, 9 aa, Homo Sapiens
TLVRLIKES

SEQ ID NO: 1220430 - protein, 9 aa, Homo Sapiens
TPSYTDRIL

SEQ ID NO: 1220431 - protein, 9 aa, Homo Sapiens
NMYGSFWSN

SEQ ID NO: 1220432 - protein, 9 aa, Homo Sapiens
YTLTLWNSA

SEQ ID NO: 1220433 - protein, 9 aa, Homo Sapiens
GTDSSENIL

SEQ ID NO: 1220434 - protein, 9 aa, Homo Sapiens
RTRQDLWEE

SEQ ID NO: 1220435 - protein, 9 aa, Homo Sapiens
DTPSDIIVK

SEQ ID NO: 1220436 - protein, 9 aa, Homo Sapiens
LQQHRFNGS

SEQ ID NO: 1220437 - protein, 9 aa, Homo Sapiens
YVQWHPVSR

SEQ ID NO: 1220438 - protein, 9 aa, Homo Sapiens
PAQSSATLP

SEQ ID NO: 1220439 - protein, 9 aa, Homo Sapiens
ILKSHGKDK

SEQ ID NO: 1220440 - protein, 9 aa, Homo Sapiens
KSAGREKKS

SEQ ID NO: 1220441 - protein, 9 aa, Homo Sapiens
GISSYTYNA

SEQ ID NO: 1220442 - protein, 9 aa, Homo Sapiens
EPERDVMSS

SEQ ID NO: 1220443 - protein, 9 aa, Homo Sapiens
SSMVFPGGG

SEQ ID NO: 1220444 - protein, 9 aa, Homo Sapiens
SGRAGWCVA

SEQ ID NO: 1220445 - protein, 9 aa, Homo Sapiens
QILTSYIFG

SEQ ID NO: 1220446 - protein, 9 aa, Homo Sapiens
ILIAHYIYT

SEQ ID NO: 1220447 - protein, 9 aa, Homo Sapiens
SYCVLRLLC

SEQ ID NO: 1220448 - protein, 9 aa, Homo Sapiens
EDAIACKRA

SEQ ID NO: 1220449 - protein, 9 aa, Homo Sapiens
HLEVVGLEM

SEQ ID NO: 1220450 - protein, 9 aa, Homo Sapiens
LFRGVCVTA

SEQ ID NO: 1220451 - protein, 9 aa, Homo Sapiens
GVALKFVTA

SEQ ID NO: 1220452 - protein, 9 aa, Homo Sapiens
TSAFSKGVH

SEQ ID NO: 1220453 - protein, 9 aa, Homo Sapiens
FFYMTANDP

SEQ ID NO: 1220454 - protein, 9 aa, Homo Sapiens
TASPGRYGR

SEQ ID NO: 1220455 - protein, 9 aa, Homo Sapiens
LPSGMVIFN

SEQ ID NO: 1220456 - protein, 9 aa, Homo Sapiens
PRSTSTTPA

SEQ ID NO: 1220457 - protein, 9 aa, Homo Sapiens
GTAQHVSPE

SEQ ID NO: 1220458 - protein, 9 aa, Homo Sapiens
GRGFPSGMR

SEQ ID NO: 1220459 - protein, 9 aa, Homo Sapiens
QIFCPNHPA

SEQ ID NO: 1220460 - protein, 9 aa, Homo Sapiens
SIQQQEGMQ

SEQ ID NO: 1220461 - protein, 9 aa, Homo Sapiens
PSTPETATR

SEQ ID NO: 1220462 - protein, 9 aa, Homo Sapiens
GNNFTEVTI

SEQ ID NO: 1220463 - protein, 9 aa, Homo Sapiens
HHGTTGSGH

SEQ ID NO: 1220464 - protein, 9 aa, Homo Sapiens
DTGWVNAAI

SEQ ID NO: 1220465 - protein, 9 aa, Homo Sapiens
AWFLLQHTQ

SEQ ID NO: 1220466 - protein, 9 aa, Homo Sapiens
RYNPESESI

SEQ ID NO: 1220467 - protein, 9 aa, Homo Sapiens
GIISFMQSD

SEQ ID NO: 1220468 - protein, 9 aa, Homo Sapiens
WSTSFWVAE

SEQ ID NO: 1220469 - protein, 9 aa, Homo Sapiens
VIHKMHHKR

SEQ ID NO: 1220470 - protein, 9 aa, Homo Sapiens
KVTDINPPQ

SEQ ID NO: 1220471 - protein, 9 aa, Homo Sapiens
YQEGLGGQR

SEQ ID NO: 1220472 - protein, 9 aa, Homo Sapiens
PGRVFGNAS

SEQ ID NO: 1220473 - protein, 9 aa, Homo Sapiens
SDVNDNKSI

SEQ ID NO: 1220474 - protein, 9 aa, Homo Sapiens
SGEGPSSLI

SEQ ID NO: 1220475 - protein, 9 aa, Homo Sapiens
QHDEIKFIC

SEQ ID NO: 1220476 - protein, 9 aa, Homo Sapiens
QPLTSARAK

SEQ ID NO: 1220477 - protein, 9 aa, Homo Sapiens
EVVNRLTTS

SEQ ID NO: 1220478 - protein, 9 aa, Homo Sapiens
WPAPPATLR

SEQ ID NO: 1220479 - protein, 9 aa, Homo Sapiens
KTAEDLEIA

SEQ ID NO: 1220480 - protein, 9 aa, Homo Sapiens
PHVLPVPPM

SEQ ID NO: 1220481 - protein, 9 aa, Homo Sapiens
VSINADNSH

SEQ ID NO: 1220482 - protein, 9 aa, Homo Sapiens
SYFLILYIS

SEQ ID NO: 1220483 - protein, 9 aa, Homo Sapiens
NLVRYNIIN

SEQ ID NO: 1220484 - protein, 9 aa, Homo Sapiens
TILEIKPSF

SEQ ID NO: 1220485 - protein, 9 aa, Homo Sapiens
GAALPPWPV

SEQ ID NO: 1220486 - protein, 9 aa, Homo Sapiens
KNSGTVSSV

SEQ ID NO: 1220487 - protein, 9 aa, Homo Sapiens
ITPWAIFPV

SEQ ID NO: 1220488 - protein, 9 aa, Homo Sapiens
LEWLKYGKR

SEQ ID NO: 1220489 - protein, 9 aa, Homo Sapiens
GTSWEPAQE

SEQ ID NO: 1220490 - protein, 9 aa, Homo Sapiens
GKLVCRAEK

SEQ ID NO: 1220491 - protein, 9 aa, Homo Sapiens
KTRYHIVKK

SEQ ID NO: 1220492 - protein, 9 aa, Homo Sapiens
ILEISLIKK

SEQ ID NO: 1220493 - protein, 9 aa, Homo Sapiens
EAEVGEFLW

SEQ ID NO: 1220494 - protein, 9 aa, Homo Sapiens
PTDSWLRPD

SEQ ID NO: 1220495 - protein, 9 aa, Homo Sapiens
HLVITSFCL

SEQ ID NO: 1220496 - protein, 9 aa, Homo Sapiens
ARCRQQQQL

SEQ ID NO: 1220497 - protein, 9 aa, Homo Sapiens
LVVFVGIKY

SEQ ID NO: 1220498 - protein, 9 aa, Homo Sapiens
DAVPLPPHM

SEQ ID NO: 1220499 - protein, 9 aa, Homo Sapiens
EPWMHPCCT

SEQ ID NO: 1220500 - protein, 9 aa, Homo Sapiens
ADLPKRLPL

SEQ ID NO: 1220501 - protein, 9 aa, Homo Sapiens
EFEGDTHCL

SEQ ID NO: 1220502 - protein, 9 aa, Homo Sapiens
EKYDSDHTE

SEQ ID NO: 1220503 - protein, 9 aa, Homo Sapiens
ESCYNCGRG

SEQ ID NO: 1220504 - protein, 9 aa, Homo Sapiens
ACNGSECRS

SEQ ID NO: 1220505 - protein, 9 aa, Homo Sapiens
PWFIKTTFI

SEQ ID NO: 1220506 - protein, 9 aa, Homo Sapiens
VAGFLDRST

SEQ ID NO: 1220507 - protein, 9 aa, Homo Sapiens
TIGLAAALS

SEQ ID NO: 1220508 - protein, 9 aa, Homo Sapiens
FICIQDAME

SEQ ID NO: 1220509 - protein, 9 aa, Homo Sapiens
EAVLGLLST

SEQ ID NO: 1220510 - protein, 9 aa, Homo Sapiens
SIGLLCYAA

SEQ ID NO: 1220511 - protein, 9 aa, Homo Sapiens
ESYNSHWDP

SEQ ID NO: 1220512 - protein, 9 aa, Homo Sapiens
NVGDVTCGQ

SEQ ID NO: 1220513 - protein, 9 aa, Homo Sapiens
RYTGTTRVA

SEQ ID NO: 1220514 - protein, 9 aa, Homo Sapiens
HGVYTNISV

SEQ ID NO: 1220515 - protein, 9 aa, Homo Sapiens
EVAVLLNHP

SEQ ID NO: 1220516 - protein, 9 aa, Homo Sapiens
NDSSWVQDE

SEQ ID NO: 1220517 - protein, 9 aa, Homo Sapiens
WPNRISSSL

SEQ ID NO: 1220518 - protein, 9 aa, Homo Sapiens
DLSIFFLRK

SEQ ID NO: 1220519 - protein, 9 aa, Homo Sapiens
LYHLQLLVQ

SEQ ID NO: 1220520 - protein, 9 aa, Homo Sapiens
CLPAHSHFF

SEQ ID NO: 1220521 - protein, 9 aa, Homo Sapiens
ECEVCRDRG

SEQ ID NO: 1220522 - protein, 9 aa, Homo Sapiens
VKTLEKMLL

SEQ ID NO: 1220523 - protein, 9 aa, Homo Sapiens
KPKTIAGFQ

SEQ ID NO: 1220524 - protein, 9 aa, Homo Sapiens
PVQRTMMKA

SEQ ID NO: 1220525 - protein, 9 aa, Homo Sapiens
SGQSCTLPE

SEQ ID NO: 1220526 - protein, 9 aa, Homo Sapiens
CKRCKMITE

SEQ ID NO: 1220527 - protein, 9 aa, Homo Sapiens
IPVACLIFL

SEQ ID NO: 1220528 - protein, 9 aa, Homo Sapiens
QVACWTVDE

SEQ ID NO: 1220529 - protein, 9 aa, Homo Sapiens
AGNPLEDRC

SEQ ID NO: 1220530 - protein, 9 aa, Homo Sapiens
HPPEEFGFS

SEQ ID NO: 1220531 - protein, 9 aa, Homo Sapiens
FLQAVNDLC

SEQ ID NO: 1220532 - protein, 9 aa, Homo Sapiens
VETHSSSTP

SEQ ID NO: 1220533 - protein, 9 aa, Homo Sapiens
SEKSDEDGD

SEQ ID NO: 1220534 - protein, 9 aa, Homo Sapiens
WEMPGATVM

SEQ ID NO: 1220535 - protein, 9 aa, Homo Sapiens
NYMLLAKHL

SEQ ID NO: 1220536 - protein, 9 aa, Homo Sapiens
YSGYRWCPK

SEQ ID NO: 1220537 - protein, 9 aa, Homo Sapiens
AKQLEKRHR

SEQ ID NO: 1220538 - protein, 9 aa, Homo Sapiens
LTVPGIFCA

SEQ ID NO: 1220539 - protein, 9 aa, Homo Sapiens
YSNQEVLQS

SEQ ID NO: 1220540 - protein, 9 aa, Homo Sapiens
LVKNEINHS

SEQ ID NO: 1220541 - protein, 9 aa, Homo Sapiens
RQTINSKMF

SEQ ID NO: 1220542 - protein, 9 aa, Homo Sapiens
QAKQDVHCI

SEQ ID NO: 1220543 - protein, 9 aa, Homo Sapiens
AQDPDLQRR

SEQ ID NO: 1220544 - protein, 9 aa, Homo Sapiens
GRTVSLFHL

SEQ ID NO: 1220545 - protein, 9 aa, Homo Sapiens
KSYELPDDQ

SEQ ID NO: 1220546 - protein, 9 aa, Homo Sapiens
RSAACGGRE

SEQ ID NO: 1220547 - protein, 9 aa, Homo Sapiens
GNGRHCNKL

SEQ ID NO: 1220548 - protein, 9 aa, Homo Sapiens
NWYIHLKLG

SEQ ID NO: 1220549 - protein, 9 aa, Homo Sapiens
ERKQHALAA

SEQ ID NO: 1220550 - protein, 9 aa, Homo Sapiens
LYDMLHRAY

SEQ ID NO: 1220551 - protein, 9 aa, Homo Sapiens
SRCGHSWSG

SEQ ID NO: 1220552 - protein, 9 aa, Homo Sapiens
LLHTIDELV

SEQ ID NO: 1220553 - protein, 9 aa, Homo Sapiens
ASIKADSTF

SEQ ID NO: 1220554 - protein, 9 aa, Homo Sapiens
WAAASPSWP

SEQ ID NO: 1220555 - protein, 9 aa, Homo Sapiens
GEELPWDAL

SEQ ID NO: 1220556 - protein, 9 aa, Homo Sapiens
LPSHLFLYN

SEQ ID NO: 1220557 - protein, 9 aa, Homo Sapiens
YPSEKSNKK

SEQ ID NO: 1220558 - protein, 9 aa, Homo Sapiens
HILKMWVIE

SEQ ID NO: 1220559 - protein, 9 aa, Homo Sapiens
EGSYGDHHH

SEQ ID NO: 1220560 - protein, 9 aa, Homo Sapiens
FSVLFLVAW

SEQ ID NO: 1220561 - protein, 9 aa, Homo Sapiens
SFVGAPYWM

SEQ ID NO: 1220562 - protein, 9 aa, Homo Sapiens
QEKVDIVLG

SEQ ID NO: 1220563 - protein, 9 aa, Homo Sapiens
HSKKGRCKV

SEQ ID NO: 1220564 - protein, 9 aa, Homo Sapiens
MKLSGIQHD

SEQ ID NO: 1220565 - protein, 9 aa, Homo Sapiens
WALQSPEHH

SEQ ID NO: 1220566 - protein, 9 aa, Homo Sapiens
LRCGTVRRP

SEQ ID NO: 1220567 - protein, 9 aa, Homo Sapiens
KTKPVPWVE

SEQ ID NO: 1220568 - protein, 9 aa, Homo Sapiens
KMFQKTRNG

SEQ ID NO: 1220569 - protein, 9 aa, Homo Sapiens
YHGLICDQA

SEQ ID NO: 1220570 - protein, 9 aa, Homo Sapiens
QGPRTRPQK

SEQ ID NO: 1220571 - protein, 9 aa, Homo Sapiens
PAQHAPQPY

SEQ ID NO: 1220572 - protein, 9 aa, Homo Sapiens
SLGKLFKLN

SEQ ID NO: 1220573 - protein, 9 aa, Homo Sapiens
RYLADLLLS

SEQ ID NO: 1220574 - protein, 9 aa, Homo Sapiens
IYPMIIHMW

SEQ ID NO: 1220575 - protein, 9 aa, Homo Sapiens
FGMLLGDII

SEQ ID NO: 1220576 - protein, 9 aa, Homo Sapiens
NCVEKHNGY

SEQ ID NO: 1220577 - protein, 9 aa, Homo Sapiens
PQTKAESKP

SEQ ID NO: 1220578 - protein, 9 aa, Homo Sapiens
LCWEDSTGH

SEQ ID NO: 1220579 - protein, 9 aa, Homo Sapiens
GVSTHVLPG

SEQ ID NO: 1220580 - protein, 9 aa, Homo Sapiens
THVAVQMSD

SEQ ID NO: 1220581 - protein, 9 aa, Homo Sapiens
IHTANPMEY

SEQ ID NO: 1220582 - protein, 9 aa, Homo Sapiens
LVHEDYTMK

SEQ ID NO: 1220583 - protein, 9 aa, Homo Sapiens
VEQSQVLLK

SEQ ID NO: 1220584 - protein, 9 aa, Homo Sapiens
VGAGYPVQW

SEQ ID NO: 1220585 - protein, 9 aa, Homo Sapiens
SLEDVAIDI

SEQ ID NO: 1220586 - protein, 9 aa, Homo Sapiens
MKLIYQGHL

SEQ ID NO: 1220587 - protein, 9 aa, Homo Sapiens
SNPPPISKQ

SEQ ID NO: 1220588 - protein, 9 aa, Homo Sapiens
ESSVEGPGG

SEQ ID NO: 1220589 - protein, 9 aa, Homo Sapiens
TSPINPAMA

SEQ ID NO: 1220590 - protein, 9 aa, Homo Sapiens
PKKYMNSVT

SEQ ID NO: 1220591 - protein, 9 aa, Homo Sapiens
GAASRGHRG

SEQ ID NO: 1220592 - protein, 9 aa, Homo Sapiens
QQTTLRLVW

SEQ ID NO: 1220593 - protein, 9 aa, Homo Sapiens
NVTDTTTTL

SEQ ID NO: 1220594 - protein, 9 aa, Homo Sapiens
SYINDNDIT

SEQ ID NO: 1220595 - protein, 9 aa, Homo Sapiens
NHLPQLMLQ

SEQ ID NO: 1220596 - protein, 9 aa, Homo Sapiens
VPSDQKQHP

SEQ ID NO: 1220597 - protein, 9 aa, Homo Sapiens
VISLDLHSQ

SEQ ID NO: 1220598 - protein, 9 aa, Homo Sapiens
SPAPRTKQY

SEQ ID NO: 1220599 - protein, 9 aa, Homo Sapiens
MDNSLKKEK

SEQ ID NO: 1220600 - protein, 9 aa, Homo Sapiens
WGHYNNVSC

SEQ ID NO: 1220601 - protein, 9 aa, Homo Sapiens
NLYVLKLLL

SEQ ID NO: 1220602 - protein, 9 aa, Homo Sapiens
VLHKMDSFT

SEQ ID NO: 1220603 - protein, 9 aa, Homo Sapiens
GWRSPQRSA

SEQ ID NO: 1220604 - protein, 9 aa, Homo Sapiens
ELKANNEGV

SEQ ID NO: 1220605 - protein, 9 aa, Homo Sapiens
QTFLVEFLW

SEQ ID NO: 1220606 - protein, 9 aa, Homo Sapiens
LCVTVSIET

SEQ ID NO: 1220607 - protein, 9 aa, Homo Sapiens
LASTEPFPQ

SEQ ID NO: 1220608 - protein, 9 aa, Homo Sapiens
GGRDLYRFG

SEQ ID NO: 1220609 - protein, 9 aa, Homo Sapiens
NSSREAGAK

SEQ ID NO: 1220610 - protein, 9 aa, Homo Sapiens
WMFICIILT

SEQ ID NO: 1220611 - protein, 9 aa, Homo Sapiens
TDTVYRQTI

SEQ ID NO: 1220612 - protein, 9 aa, Homo Sapiens
LGYQVTAED

SEQ ID NO: 1220613 - protein, 9 aa, Homo Sapiens
FFTELNRDQ

SEQ ID NO: 1220614 - protein, 9 aa, Homo Sapiens
IHPVANPHA

SEQ ID NO: 1220615 - protein, 9 aa, Homo Sapiens
CLCRSSLKA

SEQ ID NO: 1220616 - protein, 9 aa, Homo Sapiens
DRGDTCHRT

SEQ ID NO: 1220617 - protein, 9 aa, Homo Sapiens
SSFLDEDDV

SEQ ID NO: 1220618 - protein, 9 aa, Homo Sapiens
ALPSPDVPC

SEQ ID NO: 1220619 - protein, 9 aa, Homo Sapiens
PHSCALQER

SEQ ID NO: 1220620 - protein, 9 aa, Homo Sapiens
NHQPRINSY

SEQ ID NO: 1220621 - protein, 9 aa, Homo Sapiens
GPIPPAMNA

SEQ ID NO: 1220622 - protein, 9 aa, Homo Sapiens
PGELKSLSK

SEQ ID NO: 1220623 - protein, 9 aa, Homo Sapiens
KDQVVLEGH

SEQ ID NO: 1220624 - protein, 9 aa, Homo Sapiens
NVAFIYYKI

SEQ ID NO: 1220625 - protein, 9 aa, Homo Sapiens
VELGKTQFG

SEQ ID NO: 1220626 - protein, 9 aa, Homo Sapiens
PKDSVIPLT

SEQ ID NO: 1220627 - protein, 9 aa, Homo Sapiens
LQFSKDFSD

SEQ ID NO: 1220628 - protein, 9 aa, Homo Sapiens
EVALDLPQH

SEQ ID NO: 1220629 - protein, 9 aa, Homo Sapiens
DIAVLIPKD

SEQ ID NO: 1220630 - protein, 9 aa, Homo Sapiens
TSRIVGGQS

SEQ ID NO: 1220631 - protein, 9 aa, Homo Sapiens
SNTERMQDL

SEQ ID NO: 1220632 - protein, 9 aa, Homo Sapiens
MVEEREPEL

SEQ ID NO: 1220633 - protein, 9 aa, Homo Sapiens
LEKCGYNKG

SEQ ID NO: 1220634 - protein, 9 aa, Homo Sapiens
EAITNYVKE

SEQ ID NO: 1220635 - protein, 9 aa, Homo Sapiens
RKRALQDCT

SEQ ID NO: 1220636 - protein, 9 aa, Homo Sapiens
IRIIFSYIF

SEQ ID NO: 1220637 - protein, 9 aa, Homo Sapiens
LCTKIQRDT

SEQ ID NO: 1220638 - protein, 9 aa, Homo Sapiens
ECSCAVIED

SEQ ID NO: 1220639 - protein, 9 aa, Homo Sapiens
HCLLVSSRS

SEQ ID NO: 1220640 - protein, 9 aa, Homo Sapiens
HFLLLFCMI

SEQ ID NO: 1220641 - protein, 9 aa, Homo Sapiens
IYLFFDTSR

SEQ ID NO: 1220642 - protein, 9 aa, Homo Sapiens
VDAAGGTTS

SEQ ID NO: 1220643 - protein, 9 aa, Homo Sapiens
REWVLDCHR

SEQ ID NO: 1220644 - protein, 9 aa, Homo Sapiens
APSAPRRGC

SEQ ID NO: 1220645 - protein, 9 aa, Homo Sapiens
GISIVSLCL

SEQ ID NO: 1220646 - protein, 9 aa, Homo Sapiens
DVIHAVWYL

SEQ ID NO: 1220647 - protein, 9 aa, Homo Sapiens
MHAKHIRAE

SEQ ID NO: 1220648 - protein, 9 aa, Homo Sapiens
DIIPDSPIT

SEQ ID NO: 1220649 - protein, 9 aa, Homo Sapiens
QESSQLAEL

SEQ ID NO: 1220650 - protein, 9 aa, Homo Sapiens
GWSSLLRTI

SEQ ID NO: 1220651 - protein, 9 aa, Homo Sapiens
QRPQQASVV

SEQ ID NO: 1220652 - protein, 9 aa, Homo Sapiens
VTTKDGGMV

SEQ ID NO: 1220653 - protein, 9 aa, Homo Sapiens
VVNRLTTSV

SEQ ID NO: 1220654 - protein, 9 aa, Homo Sapiens
SFNMDADYD

SEQ ID NO: 1220655 - protein, 9 aa, Homo Sapiens
TVTKLGCSC

SEQ ID NO: 1220656 - protein, 9 aa, Homo Sapiens
PRREDIVGT

SEQ ID NO: 1220657 - protein, 9 aa, Homo Sapiens
FSNSKKSNW

SEQ ID NO: 1220658 - protein, 9 aa, Homo Sapiens
QICLNTEWV

SEQ ID NO: 1220659 - protein, 9 aa, Homo Sapiens
DWLSQQLVA

SEQ ID NO: 1220660 - protein, 9 aa, Homo Sapiens
QTWKRSRPR

SEQ ID NO: 1220661 - protein, 9 aa, Homo Sapiens
NLKQKVMFH

SEQ ID NO: 1220662 - protein, 9 aa, Homo Sapiens
KGCLSSLQT

SEQ ID NO: 1220663 - protein, 9 aa, Homo Sapiens
LEKQLMKLE

SEQ ID NO: 1220664 - protein, 9 aa, Homo Sapiens
VEWLQGEKQ

SEQ ID NO: 1220665 - protein, 9 aa, Homo Sapiens
EQESMRSSR

SEQ ID NO: 1220666 - protein, 9 aa, Homo Sapiens
LEKVHYLQV

SEQ ID NO: 1220667 - protein, 9 aa, Homo Sapiens
KCKMHLYGL

SEQ ID NO: 1220668 - protein, 9 aa, Homo Sapiens
EGHSKTFDW

SEQ ID NO: 1220669 - protein, 9 aa, Homo Sapiens
WPELRQFLG

SEQ ID NO: 1220670 - protein, 9 aa, Homo Sapiens
GILDLEKAR

SEQ ID NO: 1220671 - protein, 9 aa, Homo Sapiens
LWPLMLLPL

SEQ ID NO: 1220672 - protein, 9 aa, Homo Sapiens
CIFKLTFVK

SEQ ID NO: 1220673 - protein, 9 aa, Homo Sapiens
GPSACPCMC

SEQ ID NO: 1220674 - protein, 9 aa, Homo Sapiens
EGNELQRHV

SEQ ID NO: 1220675 - protein, 9 aa, Homo Sapiens
PRPGGGSKD

SEQ ID NO: 1220676 - protein, 9 aa, Homo Sapiens
CMGLRKGHS

SEQ ID NO: 1220677 - protein, 9 aa, Homo Sapiens
YVHGGEMFS

SEQ ID NO: 1220678 - protein, 9 aa, Homo Sapiens
ARNANMNLE

SEQ ID NO: 1220679 - protein, 9 aa, Homo Sapiens
TRLSRRLLR

SEQ ID NO: 1220680 - protein, 9 aa, Homo Sapiens
FYVELKANN

SEQ ID NO: 1220681 - protein, 9 aa, Homo Sapiens
GNHLNEPLK

SEQ ID NO: 1220682 - protein, 9 aa, Homo Sapiens
EEHEYEEEV

SEQ ID NO: 1220683 - protein, 9 aa, Homo Sapiens
KQVTMALQR

SEQ ID NO: 1220684 - protein, 9 aa, Homo Sapiens
CRSSRTWAS

SEQ ID NO: 1220685 - protein, 9 aa, Homo Sapiens
AYPNHPDVL

SEQ ID NO: 1220686 - protein, 9 aa, Homo Sapiens
CTVPVESDP

SEQ ID NO: 1220687 - protein, 9 aa, Homo Sapiens
CNQDVKYIQ

SEQ ID NO: 1220688 - protein, 9 aa, Homo Sapiens
QWRMLEAVR

SEQ ID NO: 1220689 - protein, 9 aa, Homo Sapiens
TMLNGHYKT

SEQ ID NO: 1220690 - protein, 9 aa, Homo Sapiens
FFIHCRRKN

SEQ ID NO: 1220691 - protein, 9 aa, Homo Sapiens
VCEIGLHCR

SEQ ID NO: 1220692 - protein, 9 aa, Homo Sapiens
YLVETEDTS

SEQ ID NO: 1220693 - protein, 9 aa, Homo Sapiens
LHAEPYPTS

SEQ ID NO: 1220694 - protein, 9 aa, Homo Sapiens
SSDNLTVSS

SEQ ID NO: 1220695 - protein, 9 aa, Homo Sapiens
VRFLVQQNK

SEQ ID NO: 1220696 - protein, 9 aa, Homo Sapiens
PGGLFPAYP

SEQ ID NO: 1220697 - protein, 9 aa, Homo Sapiens
KERNEMQAQ

SEQ ID NO: 1220698 - protein, 9 aa, Homo Sapiens
TSRNQLVTT

SEQ ID NO: 1220699 - protein, 9 aa, Homo Sapiens
LVPARAGLD

SEQ ID NO: 1220700 - protein, 9 aa, Homo Sapiens
HPAAGYRLE

SEQ ID NO: 1220701 - protein, 9 aa, Homo Sapiens
NMPISSHVD

SEQ ID NO: 1220702 - protein, 9 aa, Homo Sapiens
IGYSGLATG

SEQ ID NO: 1220703 - protein, 9 aa, Homo Sapiens
AKMCYHMPV

SEQ ID NO: 1220704 - protein, 9 aa, Homo Sapiens
ASDEYHRKA

SEQ ID NO: 1220705 - protein, 9 aa, Homo Sapiens
ANDARNDSR

SEQ ID NO: 1220706 - protein, 9 aa, Homo Sapiens
DQTLEVLQY

SEQ ID NO: 1220707 - protein, 9 aa, Homo Sapiens
IGHRCEGDP

SEQ ID NO: 1220708 - protein, 9 aa, Homo Sapiens
LTPMAVICV

SEQ ID NO: 1220709 - protein, 9 aa, Homo Sapiens
ARSRRSVPF

SEQ ID NO: 1220710 - protein, 9 aa, Homo Sapiens
MRHRALSID

SEQ ID NO: 1220711 - protein, 9 aa, Homo Sapiens
KRTLIPGSS

SEQ ID NO: 1220712 - protein, 9 aa, Homo Sapiens
LCSNFWGAL

SEQ ID NO: 1220713 - protein, 9 aa, Homo Sapiens
HWMKVTVES

SEQ ID NO: 1220714 - protein, 9 aa, Homo Sapiens
TGKVIKCKA

SEQ ID NO: 1220715 - protein, 9 aa, Homo Sapiens
PAQAHMATH

SEQ ID NO: 1220716 - protein, 9 aa, Homo Sapiens
RGRRPALQA

SEQ ID NO: 1220717 - protein, 9 aa, Homo Sapiens
PSTCLDGAK

SEQ ID NO: 1220718 - protein, 9 aa, Homo Sapiens
DPCCGATER

SEQ ID NO: 1220719 - protein, 9 aa, Homo Sapiens
FPSHMLPEP

SEQ ID NO: 1220720 - protein, 9 aa, Homo Sapiens
YCCLEEYRD

SEQ ID NO: 1220721 - protein, 9 aa, Homo Sapiens
FWLMLTSYI

SEQ ID NO: 1220722 - protein, 9 aa, Homo Sapiens
NFDIKVLNT

SEQ ID NO: 1220723 - protein, 9 aa, Homo Sapiens
YIQKFEFET

SEQ ID NO: 1220724 - protein, 9 aa, Homo Sapiens
GNFADAVFM

SEQ ID NO: 1220725 - protein, 9 aa, Homo Sapiens
SACGWRSPQ

SEQ ID NO: 1220726 - protein, 9 aa, Homo Sapiens
KCLHKHCRP

SEQ ID NO: 1220727 - protein, 9 aa, Homo Sapiens
HVVCREMGY

SEQ ID NO: 1220728 - protein, 9 aa, Homo Sapiens
HENGSNGTI

SEQ ID NO: 1220729 - protein, 9 aa, Homo Sapiens
NHPGTSFPL

SEQ ID NO: 1220730 - protein, 9 aa, Homo Sapiens
LKGVLNSIG

SEQ ID NO: 1220731 - protein, 9 aa, Homo Sapiens
RYRQLRFLE

SEQ ID NO: 1220732 - protein, 9 aa, Homo Sapiens
RCTSDLERS

SEQ ID NO: 1220733 - protein, 9 aa, Homo Sapiens
LSQLSLMDI

SEQ ID NO: 1220734 - protein, 9 aa, Homo Sapiens
MGPIPPAMN

SEQ ID NO: 1220735 - protein, 9 aa, Homo Sapiens
ILSHWENYN

SEQ ID NO: 1220736 - protein, 9 aa, Homo Sapiens
SQINISKVQ

SEQ ID NO: 1220737 - protein, 9 aa, Homo Sapiens
KKKSKEEGT

SEQ ID NO: 1220738 - protein, 9 aa, Homo Sapiens
LDMLLFLNP

SEQ ID NO: 1220739 - protein, 9 aa, Homo Sapiens
VTEEGKHHP

SEQ ID NO: 1220740 - protein, 9 aa, Homo Sapiens
CQAEEEWRQ

SEQ ID NO: 1220741 - protein, 9 aa, Homo Sapiens
DGEPWMHPC

SEQ ID NO: 1220742 - protein, 9 aa, Homo Sapiens
YNKEFLHQG

SEQ ID NO: 1220743 - protein, 9 aa, Homo Sapiens
FNFNTYKKE

SEQ ID NO: 1220744 - protein, 9 aa, Homo Sapiens
IMDTPRDLN

SEQ ID NO: 1220745 - protein, 9 aa, Homo Sapiens
FGFSFSFSP

SEQ ID NO: 1220746 - protein, 9 aa, Homo Sapiens
PGGRPGQCA

SEQ ID NO: 1220747 - protein, 9 aa, Homo Sapiens
GTLTVAVGV

SEQ ID NO: 1220748 - protein, 9 aa, Homo Sapiens
QTTGHLVIY

SEQ ID NO: 1220749 - protein, 9 aa, Homo Sapiens
SGMEYFNMY

SEQ ID NO: 1220750 - protein, 9 aa, Homo Sapiens
TSAGISSAW

SEQ ID NO: 1220751 - protein, 9 aa, Homo Sapiens
KEMIALKMR

SEQ ID NO: 1220752 - protein, 9 aa, Homo Sapiens
GISSEIEQE

SEQ ID NO: 1220753 - protein, 9 aa, Homo Sapiens
AGPPHHRPL

SEQ ID NO: 1220754 - protein, 9 aa, Homo Sapiens
AGNVVSKLH

SEQ ID NO: 1220755 - protein, 9 aa, Homo Sapiens
HKSGGREYL

SEQ ID NO: 1220756 - protein, 9 aa, Homo Sapiens
STGHLCEAP

SEQ ID NO: 1220757 - protein, 9 aa, Homo Sapiens
QQMDFQREI

SEQ ID NO: 1220758 - protein, 9 aa, Homo Sapiens
VLTIIKWKG

SEQ ID NO: 1220759 - protein, 9 aa, Homo Sapiens
AYLIYRLPF

SEQ ID NO: 1220760 - protein, 9 aa, Homo Sapiens
EEYQSSLHL

SEQ ID NO: 1220761 - protein, 9 aa, Homo Sapiens
LLAIYQDKD

SEQ ID NO: 1220762 - protein, 9 aa, Homo Sapiens
HPQHCRLLH

SEQ ID NO: 1220763 - protein, 9 aa, Homo Sapiens
LLVSLEWLM

SEQ ID NO: 1220764 - protein, 9 aa, Homo Sapiens
TGSHAYERF

SEQ ID NO: 1220765 - protein, 9 aa, Homo Sapiens
TILIYHDRT

SEQ ID NO: 1220766 - protein, 9 aa, Homo Sapiens
AMLDKTCIS

SEQ ID NO: 1220767 - protein, 9 aa, Homo Sapiens
GCWTVRGSC

SEQ ID NO: 1220768 - protein, 9 aa, Homo Sapiens
VLEARAPHV

SEQ ID NO: 1220769 - protein, 9 aa, Homo Sapiens
AGKFCIILV

SEQ ID NO: 1220770 - protein, 9 aa, Homo Sapiens
GLPLKGGLS

SEQ ID NO: 1220771 - protein, 9 aa, Homo Sapiens
RIMHWFGLV

SEQ ID NO: 1220772 - protein, 9 aa, Homo Sapiens
HRLCLSRIQ

SEQ ID NO: 1220773 - protein, 9 aa, Homo Sapiens
SDNAIDNPK

SEQ ID NO: 1220774 - protein, 9 aa, Homo Sapiens
KENGRYGRH

SEQ ID NO: 1220775 - protein, 9 aa, Homo Sapiens
WKNSRYLSK

SEQ ID NO: 1220776 - protein, 9 aa, Homo Sapiens
AVMSKLKSR

SEQ ID NO: 1220777 - protein, 9 aa, Homo Sapiens
IKERRCMLL

SEQ ID NO: 1220778 - protein, 9 aa, Homo Sapiens
KIHIDFSLD

SEQ ID NO: 1220779 - protein, 9 aa, Homo Sapiens
VYVQEVMQP

SEQ ID NO: 1220780 - protein, 9 aa, Homo Sapiens
PQWCGWRRL

SEQ ID NO: 1220781 - protein, 9 aa, Homo Sapiens
AQMVERPTV

SEQ ID NO: 1220782 - protein, 9 aa, Homo Sapiens
HHRIQVIAS

SEQ ID NO: 1220783 - protein, 9 aa, Homo Sapiens
DGGCFSFLH

SEQ ID NO: 1220784 - protein, 9 aa, Homo Sapiens
LQTIHLFLA

SEQ ID NO: 1220785 - protein, 9 aa, Homo Sapiens
VKMSTYLVD

SEQ ID NO: 1220786 - protein, 9 aa, Homo Sapiens
HPDQDLFLL

SEQ ID NO: 1220787 - protein, 9 aa, Homo Sapiens
QQDLKGFVW

SEQ ID NO: 1220788 - protein, 9 aa, Homo Sapiens
VPKDSVIPL

SEQ ID NO: 1220789 - protein, 9 aa, Homo Sapiens
TWDDAFTTF

SEQ ID NO: 1220790 - protein, 9 aa, Homo Sapiens
CLNLQVTMA

SEQ ID NO: 1220791 - protein, 9 aa, Homo Sapiens
PLKKRHTEK

SEQ ID NO: 1220792 - protein, 9 aa, Homo Sapiens
SVNHIIYGF

SEQ ID NO: 1220793 - protein, 9 aa, Homo Sapiens
RRGRSRSRP

SEQ ID NO: 1220794 - protein, 9 aa, Homo Sapiens
RKCEMAFQY

SEQ ID NO: 1220795 - protein, 9 aa, Homo Sapiens
LIVLKNVPG

SEQ ID NO: 1220796 - protein, 9 aa, Homo Sapiens
PRKAHRDWA

SEQ ID NO: 1220797 - protein, 9 aa, Homo Sapiens
GLSGHPRIE

SEQ ID NO: 1220798 - protein, 9 aa, Homo Sapiens
VMEMFQPSV

SEQ ID NO: 1220799 - protein, 9 aa, Homo Sapiens
NIIGLEIPD

SEQ ID NO: 1220800 - protein, 9 aa, Homo Sapiens
WSVTLDNRA

SEQ ID NO: 1220801 - protein, 9 aa, Homo Sapiens
YPGFNMSLL

SEQ ID NO: 1220802 - protein, 9 aa, Homo Sapiens
DVGRDGQGH

SEQ ID NO: 1220803 - protein, 9 aa, Homo Sapiens
DLELLGATF

SEQ ID NO: 1220804 - protein, 9 aa, Homo Sapiens
RMPSRVHYY

SEQ ID NO: 1220805 - protein, 9 aa, Homo Sapiens
TIEQNSEAL

SEQ ID NO: 1220806 - protein, 9 aa, Homo Sapiens
HCTFAIEAL

SEQ ID NO: 1220807 - protein, 9 aa, Homo Sapiens
IFISYGSCI

SEQ ID NO: 1220808 - protein, 9 aa, Homo Sapiens
DNPVSSGHL

SEQ ID NO: 1220809 - protein, 9 aa, Homo Sapiens
EDDLFVIAK

SEQ ID NO: 1220810 - protein, 9 aa, Homo Sapiens
SQENVKAAI

SEQ ID NO: 1220811 - protein, 9 aa, Homo Sapiens
QKRIDTYVD

SEQ ID NO: 1220812 - protein, 9 aa, Homo Sapiens
KQAVPGFIG

SEQ ID NO: 1220813 - protein, 9 aa, Homo Sapiens
SKIHSFHGQ

SEQ ID NO: 1220814 - protein, 9 aa, Homo Sapiens
SGITESNDM

SEQ ID NO: 1220815 - protein, 9 aa, Homo Sapiens
AKAISGIAL

SEQ ID NO: 1220816 - protein, 9 aa, Homo Sapiens
ECCLDEVAN

SEQ ID NO: 1220817 - protein, 9 aa, Homo Sapiens
SQSEGESWP

SEQ ID NO: 1220818 - protein, 9 aa, Homo Sapiens
LEVQVQSLK

SEQ ID NO: 1220819 - protein, 9 aa, Homo Sapiens
GTTGSGHYI

SEQ ID NO: 1220820 - protein, 9 aa, Homo Sapiens
YEYKYCDAE

SEQ ID NO: 1220821 - protein, 9 aa, Homo Sapiens
NDLQFWLGD

SEQ ID NO: 1220822 - protein, 9 aa, Homo Sapiens
IMRSLKELD

SEQ ID NO: 1220823 - protein, 9 aa, Homo Sapiens
HVFQSNYFD

SEQ ID NO: 1220824 - protein, 9 aa, Homo Sapiens
GSLDRHMQL

SEQ ID NO: 1220825 - protein, 9 aa, Homo Sapiens
GILQLAFLT

SEQ ID NO: 1220826 - protein, 9 aa, Homo Sapiens
SQWRCQCLK

SEQ ID NO: 1220827 - protein, 9 aa, Homo Sapiens
SDPSAIMSP

SEQ ID NO: 1220828 - protein, 9 aa, Homo Sapiens
WHFLSSRAG

SEQ ID NO: 1220829 - protein, 9 aa, Homo Sapiens
TSWSCQPLP

SEQ ID NO: 1220830 - protein, 9 aa, Homo Sapiens
ATSQDERNI

SEQ ID NO: 1220831 - protein, 9 aa, Homo Sapiens
HSRSLMLGP

SEQ ID NO: 1220832 - protein, 9 aa, Homo Sapiens
FELNAQFSQ

SEQ ID NO: 1220833 - protein, 9 aa, Homo Sapiens
LIGRMMQAF

SEQ ID NO: 1220834 - protein, 9 aa, Homo Sapiens
FYQLECLMQ

SEQ ID NO: 1220835 - protein, 9 aa, Homo Sapiens
YAGLLSHDQ

SEQ ID NO: 1220836 - protein, 9 aa, Homo Sapiens
KSHTEHRSY

SEQ ID NO: 1220837 - protein, 9 aa, Homo Sapiens
HLAPAWMLL

SEQ ID NO: 1220838 - protein, 9 aa, Homo Sapiens
HKPQCGEAS

SEQ ID NO: 1220839 - protein, 9 aa, Homo Sapiens
VMGVYGGMI

SEQ ID NO: 1220840 - protein, 9 aa, Homo Sapiens
TYQRETRHI

SEQ ID NO: 1220841 - protein, 9 aa, Homo Sapiens
LQEEEGGWT

SEQ ID NO: 1220842 - protein, 9 aa, Homo Sapiens
GLVFALRDW

SEQ ID NO: 1220843 - protein, 9 aa, Homo Sapiens
QFLYNNNTM

SEQ ID NO: 1220844 - protein, 9 aa, Homo Sapiens
KRHNLTTKS

SEQ ID NO: 1220845 - protein, 9 aa, Homo Sapiens
DTLKYLIAG

SEQ ID NO: 1220846 - protein, 9 aa, Homo Sapiens
RLRHRAPPR

SEQ ID NO: 1220847 - protein, 9 aa, Homo Sapiens
GNLDSKGYD

SEQ ID NO: 1220848 - protein, 9 aa, Homo Sapiens
GRCKVFSTC

SEQ ID NO: 1220849 - protein, 9 aa, Homo Sapiens
HTHRHTGIH

SEQ ID NO: 1220850 - protein, 9 aa, Homo Sapiens
TAYEYKYCD

SEQ ID NO: 1220851 - protein, 9 aa, Homo Sapiens
CAWETPSHL

SEQ ID NO: 1220852 - protein, 9 aa, Homo Sapiens
AEFWEDNFN

SEQ ID NO: 1220853 - protein, 9 aa, Homo Sapiens
KLVKVLNDG

SEQ ID NO: 1220854 - protein, 9 aa, Homo Sapiens
KRKKIHQKG

SEQ ID NO: 1220855 - protein, 9 aa, Homo Sapiens
GKEQHPAAE

SEQ ID NO: 1220856 - protein, 9 aa, Homo Sapiens
REIKTAVRL

SEQ ID NO: 1220857 - protein, 9 aa, Homo Sapiens
MPTATAETC

SEQ ID NO: 1220858 - protein, 9 aa, Homo Sapiens
LRPGLGECV

SEQ ID NO: 1220859 - protein, 9 aa, Homo Sapiens
MFWYSLTND

SEQ ID NO: 1220860 - protein, 9 aa, Homo Sapiens
KDMFREVGL

SEQ ID NO: 1220861 - protein, 9 aa, Homo Sapiens
EKLYEEDDI

SEQ ID NO: 1220862 - protein, 9 aa, Homo Sapiens
KDQCLPGFS

SEQ ID NO: 1220863 - protein, 9 aa, Homo Sapiens
YATDGGCIL

SEQ ID NO: 1220864 - protein, 9 aa, Homo Sapiens
PPPPPAQSS

SEQ ID NO: 1220865 - protein, 9 aa, Homo Sapiens
NQTRYVGQY

SEQ ID NO: 1220866 - protein, 9 aa, Homo Sapiens
EILVSSYLT

SEQ ID NO: 1220867 - protein, 9 aa, Homo Sapiens
DSKGYDIAT

SEQ ID NO: 1220868 - protein, 9 aa, Homo Sapiens
GRQLRHCLS

SEQ ID NO: 1220869 - protein, 9 aa, Homo Sapiens
GPHRLVGTT

SEQ ID NO: 1220870 - protein, 9 aa, Homo Sapiens
CNECGNVFS

SEQ ID NO: 1220871 - protein, 9 aa, Homo Sapiens
FSLVIPFDP

SEQ ID NO: 1220872 - protein, 9 aa, Homo Sapiens
PSSGAQTAR

SEQ ID NO: 1220873 - protein, 9 aa, Homo Sapiens
ISNPDLITC

SEQ ID NO: 1220874 - protein, 9 aa, Homo Sapiens
EKSEGPCVH

SEQ ID NO: 1220875 - protein, 9 aa, Homo Sapiens
FTCMFAFFR

SEQ ID NO: 1220876 - protein, 9 aa, Homo Sapiens
SFLSDDMKS

SEQ ID NO: 1220877 - protein, 9 aa, Homo Sapiens
DMDYVGGYA

SEQ ID NO: 1220878 - protein, 9 aa, Homo Sapiens
WQQQLNNIH

SEQ ID NO: 1220879 - protein, 9 aa, Homo Sapiens
NYRLRMHLG

SEQ ID NO: 1220880 - protein, 9 aa, Homo Sapiens
YPGDIGYFA

SEQ ID NO: 1220881 - protein, 9 aa, Homo Sapiens
RSRWQGPCR

SEQ ID NO: 1220882 - protein, 9 aa, Homo Sapiens
SPLILQSDR

SEQ ID NO: 1220883 - protein, 9 aa, Homo Sapiens
EGSKATNGS

SEQ ID NO: 1220884 - protein, 9 aa, Homo Sapiens
VTEDYLHLE

SEQ ID NO: 1220885 - protein, 9 aa, Homo Sapiens
TLAIPIAVK

SEQ ID NO: 1220886 - protein, 9 aa, Homo Sapiens
HTQIDQQHP

SEQ ID NO: 1220887 - protein, 9 aa, Homo Sapiens
LCKYPDIVH

SEQ ID NO: 1220888 - protein, 9 aa, Homo Sapiens
SDVAVECDE

SEQ ID NO: 1220889 - protein, 9 aa, Homo Sapiens
PLLVTLLLT

SEQ ID NO: 1220890 - protein, 9 aa, Homo Sapiens
SLLIFPPPL

SEQ ID NO: 1220891 - protein, 9 aa, Homo Sapiens
RHRKSHAGE

SEQ ID NO: 1220892 - protein, 9 aa, Homo Sapiens
EHVPQEDGV

SEQ ID NO: 1220893 - protein, 9 aa, Homo Sapiens
SYQCHSWEE

SEQ ID NO: 1220894 - protein, 9 aa, Homo Sapiens
KGPAKENRC

SEQ ID NO: 1220895 - protein, 9 aa, Homo Sapiens
RMFALERLT

SEQ ID NO: 1220896 - protein, 9 aa, Homo Sapiens
HAKRQPLLW

SEQ ID NO: 1220897 - protein, 9 aa, Homo Sapiens
QKVWFFSAD

SEQ ID NO: 1220898 - protein, 9 aa, Homo Sapiens
FECGRRGSK

SEQ ID NO: 1220899 - protein, 9 aa, Homo Sapiens
AQSSIKQLV

SEQ ID NO: 1220900 - protein, 9 aa, Homo Sapiens
IVLLLLAML

SEQ ID NO: 1220901 - protein, 9 aa, Homo Sapiens
ICHILLIQG

SEQ ID NO: 1220902 - protein, 9 aa, Homo Sapiens
SILVEHLKF

SEQ ID NO: 1220903 - protein, 9 aa, Homo Sapiens
DTPDYLKAQ

SEQ ID NO: 1220904 - protein, 9 aa, Homo Sapiens
KDSATELLL

SEQ ID NO: 1220905 - protein, 9 aa, Homo Sapiens
IHKNRPDLI

SEQ ID NO: 1220906 - protein, 9 aa, Homo Sapiens
VVILSGFFN

SEQ ID NO: 1220907 - protein, 9 aa, Homo Sapiens
DHAVLLGCQ

SEQ ID NO: 1220908 - protein, 9 aa, Homo Sapiens
SMMSVKFDV

SEQ ID NO: 1220909 - protein, 9 aa, Homo Sapiens
HSNQSIKDK

SEQ ID NO: 1220910 - protein, 9 aa, Homo Sapiens
IGSHHLGFL

SEQ ID NO: 1220911 - protein, 9 aa, Homo Sapiens
KWGDHFVYK

SEQ ID NO: 1220912 - protein, 9 aa, Homo Sapiens
MEKNILTCC

SEQ ID NO: 1220913 - protein, 9 aa, Homo Sapiens
NPNVTGHAD

SEQ ID NO: 1220914 - protein, 9 aa, Homo Sapiens
LPPRVHAYP

SEQ ID NO: 1220915 - protein, 9 aa, Homo Sapiens
HLLESKTYH

SEQ ID NO: 1220916 - protein, 9 aa, Homo Sapiens
LLYISLALW

SEQ ID NO: 1220917 - protein, 9 aa, Homo Sapiens
IGDMPLVGD

SEQ ID NO: 1220918 - protein, 9 aa, Homo Sapiens
QCHLNGVTV

SEQ ID NO: 1220919 - protein, 9 aa, Homo Sapiens
LSFGATRIF

SEQ ID NO: 1220920 - protein, 9 aa, Homo Sapiens
MDNAAEAAE

SEQ ID NO: 1220921 - protein, 9 aa, Homo Sapiens
GSQLIAMQI

SEQ ID NO: 1220922 - protein, 9 aa, Homo Sapiens
ELSSTLNLA

SEQ ID NO: 1220923 - protein, 9 aa, Homo Sapiens
ISYIFIDFA

SEQ ID NO: 1220924 - protein, 9 aa, Homo Sapiens
WLYQSTLRH

SEQ ID NO: 1220925 - protein, 9 aa, Homo Sapiens
DLEVQEDLL

SEQ ID NO: 1220926 - protein, 9 aa, Homo Sapiens
LLNLLKEMS

SEQ ID NO: 1220927 - protein, 9 aa, Homo Sapiens
AAFMAKVMS

SEQ ID NO: 1220928 - protein, 9 aa, Homo Sapiens
IEENFPLGN

SEQ ID NO: 1220929 - protein, 9 aa, Homo Sapiens
SDSESDEAI

SEQ ID NO: 1220930 - protein, 9 aa, Homo Sapiens
HPDVLVLQG

SEQ ID NO: 1220931 - protein, 9 aa, Homo Sapiens
VNDVSGPVF

SEQ ID NO: 1220932 - protein, 9 aa, Homo Sapiens
SKRQTLRED

SEQ ID NO: 1220933 - protein, 9 aa, Homo Sapiens
FNISVPRHE

SEQ ID NO: 1220934 - protein, 9 aa, Homo Sapiens
HSGLMIKKE

SEQ ID NO: 1220935 - protein, 9 aa, Homo Sapiens
CIYGKPGGS

SEQ ID NO: 1220936 - protein, 9 aa, Homo Sapiens
SMEVHRAFL

SEQ ID NO: 1220937 - protein, 9 aa, Homo Sapiens
QTACDAATV

SEQ ID NO: 1220938 - protein, 9 aa, Homo Sapiens
SQPVMIITE

SEQ ID NO: 1220939 - protein, 9 aa, Homo Sapiens
ATRHGWWAG

SEQ ID NO: 1220940 - protein, 9 aa, Homo Sapiens
YSNVYYPTP

SEQ ID NO: 1220941 - protein, 9 aa, Homo Sapiens
KVVYCRCWR

SEQ ID NO: 1220942 - protein, 9 aa, Homo Sapiens
NAKSKVHTQ

SEQ ID NO: 1220943 - protein, 9 aa, Homo Sapiens
PCWVSSMRS

SEQ ID NO: 1220944 - protein, 9 aa, Homo Sapiens
VSRILTSKL

SEQ ID NO: 1220945 - protein, 9 aa, Homo Sapiens
SARSSVPWS

SEQ ID NO: 1220946 - protein, 9 aa, Homo Sapiens
LCNGSNCFG

SEQ ID NO: 1220947 - protein, 9 aa, Homo Sapiens
YRQTINSKM

SEQ ID NO: 1220948 - protein, 9 aa, Homo Sapiens
FEKDNEETG

SEQ ID NO: 1220949 - protein, 9 aa, Homo Sapiens
VTINVFDHN

SEQ ID NO: 1220950 - protein, 9 aa, Homo Sapiens
SWLITASTS

SEQ ID NO: 1220951 - protein, 9 aa, Homo Sapiens
AFMAKVMSV

SEQ ID NO: 1220952 - protein, 9 aa, Homo Sapiens
LSLSNISKR

SEQ ID NO: 1220953 - protein, 9 aa, Homo Sapiens
VLSSSWLCG

SEQ ID NO: 1220954 - protein, 9 aa, Homo Sapiens
FYYIQRFQY

SEQ ID NO: 1220955 - protein, 9 aa, Homo Sapiens
APNAQECVC

SEQ ID NO: 1220956 - protein, 9 aa, Homo Sapiens
HIWQKTLTL

SEQ ID NO: 1220957 - protein, 9 aa, Homo Sapiens
ISMNHKTCY

SEQ ID NO: 1220958 - protein, 9 aa, Homo Sapiens
RKRDISLSL

SEQ ID NO: 1220959 - protein, 9 aa, Homo Sapiens
RQLIDEKAG

SEQ ID NO: 1220960 - protein, 9 aa, Homo Sapiens
DKAFNCSST

SEQ ID NO: 1220961 - protein, 9 aa, Homo Sapiens
IPGTSIPGP

SEQ ID NO: 1220962 - protein, 9 aa, Homo Sapiens
NRPPVMTLA

SEQ ID NO: 1220963 - protein, 9 aa, Homo Sapiens
PLSNFVTDF

SEQ ID NO: 1220964 - protein, 9 aa, Homo Sapiens
ILPPQLQPP

SEQ ID NO: 1220965 - protein, 9 aa, Homo Sapiens
GKDTTTSMR

SEQ ID NO: 1220966 - protein, 9 aa, Homo Sapiens
SVSLHFLQN

SEQ ID NO: 1220967 - protein, 9 aa, Homo Sapiens
QTMHNYSGL

SEQ ID NO: 1220968 - protein, 9 aa, Homo Sapiens
RCVIAEGDL

SEQ ID NO: 1220969 - protein, 9 aa, Homo Sapiens
HSPSNCCCR

SEQ ID NO: 1220970 - protein, 9 aa, Homo Sapiens
VVITGQKVG

SEQ ID NO: 1220971 - protein, 9 aa, Homo Sapiens
MEFNILKNI

SEQ ID NO: 1220972 - protein, 9 aa, Homo Sapiens
QPRTESPPP

SEQ ID NO: 1220973 - protein, 9 aa, Homo Sapiens
GVKLSGGLE

SEQ ID NO: 1220974 - protein, 9 aa, Homo Sapiens
TVIMLCKGR

SEQ ID NO: 1220975 - protein, 9 aa, Homo Sapiens
SDYKRTVAC

SEQ ID NO: 1220976 - protein, 9 aa, Homo Sapiens
SWTFAHRPT

SEQ ID NO: 1220977 - protein, 9 aa, Homo Sapiens
VRIPYILSQ

SEQ ID NO: 1220978 - protein, 9 aa, Homo Sapiens
LGMDLVRIG

SEQ ID NO: 1220979 - protein, 9 aa, Homo Sapiens
YPELYPSEH

SEQ ID NO: 1220980 - protein, 9 aa, Homo Sapiens
FGHEHYENG

SEQ ID NO: 1220981 - protein, 9 aa, Homo Sapiens
LTATADHSL

SEQ ID NO: 1220982 - protein, 9 aa, Homo Sapiens
MKIWLSVKE

SEQ ID NO: 1220983 - protein, 9 aa, Homo Sapiens
LSHLRCIFN

SEQ ID NO: 1220984 - protein, 9 aa, Homo Sapiens
SPECSCAVI

SEQ ID NO: 1220985 - protein, 9 aa, Homo Sapiens
PPSPSVAKT

SEQ ID NO: 1220986 - protein, 9 aa, Homo Sapiens
QKEEWRRSL

SEQ ID NO: 1220987 - protein, 9 aa, Homo Sapiens
LEEAIGIGG

SEQ ID NO: 1220988 - protein, 9 aa, Homo Sapiens
APDPPMPRP

SEQ ID NO: 1220989 - protein, 9 aa, Homo Sapiens
LSAAERQAV

SEQ ID NO: 1220990 - protein, 9 aa, Homo Sapiens
TYSVFNPGC

SEQ ID NO: 1220991 - protein, 9 aa, Homo Sapiens
NTGPRGRRA

SEQ ID NO: 1220992 - protein, 9 aa, Homo Sapiens
EFYRNGKYN

SEQ ID NO: 1220993 - protein, 9 aa, Homo Sapiens
ATSAPQLQV

SEQ ID NO: 1220994 - protein, 9 aa, Homo Sapiens
DIDQDNRNT

SEQ ID NO: 1220995 - protein, 9 aa, Homo Sapiens
KEGETYFDG

SEQ ID NO: 1220996 - protein, 9 aa, Homo Sapiens
TLVKNEINH

SEQ ID NO: 1220997 - protein, 9 aa, Homo Sapiens
NLCRMDPTW

SEQ ID NO: 1220998 - protein, 9 aa, Homo Sapiens
NQGTGTKGP

SEQ ID NO: 1220999 - protein, 9 aa, Homo Sapiens
CGGNLLHFS

SEQ ID NO: 1221000 - protein, 9 aa, Homo Sapiens
QLHLTQYHG

SEQ ID NO: 1221001 - protein, 9 aa, Homo Sapiens
LSPCKECGP

SEQ ID NO: 1221002 - protein, 9 aa, Homo Sapiens
NLMPGDVER

SEQ ID NO: 1221003 - protein, 9 aa, Homo Sapiens
KFFSTCASH

SEQ ID NO: 1221004 - protein, 9 aa, Homo Sapiens
SVKDMCTAK

SEQ ID NO: 1221005 - protein, 9 aa, Homo Sapiens
SERRHCSPS

SEQ ID NO: 1221006 - protein, 9 aa, Homo Sapiens
IHGMSQACR

SEQ ID NO: 1221007 - protein, 9 aa, Homo Sapiens
FTEIKNILV

SEQ ID NO: 1221008 - protein, 9 aa, Homo Sapiens
NSCSPAGQS

SEQ ID NO: 1221009 - protein, 9 aa, Homo Sapiens
KYAIYAVQV

SEQ ID NO: 1221010 - protein, 9 aa, Homo Sapiens
EDLAPKLLQ

SEQ ID NO: 1221011 - protein, 9 aa, Homo Sapiens
SLYMFGGFR

SEQ ID NO: 1221012 - protein, 9 aa, Homo Sapiens
SYCVVFPLE

SEQ ID NO: 1221013 - protein, 9 aa, Homo Sapiens
PVDGLGAPR

SEQ ID NO: 1221014 - protein, 9 aa, Homo Sapiens
LGTAICNYC

SEQ ID NO: 1221015 - protein, 9 aa, Homo Sapiens
LVITRNHTQ

SEQ ID NO: 1221016 - protein, 9 aa, Homo Sapiens
SGLVISIIL

SEQ ID NO: 1221017 - protein, 9 aa, Homo Sapiens
ENQKKQPNA

SEQ ID NO: 1221018 - protein, 9 aa, Homo Sapiens
RSSSTAPPM

SEQ ID NO: 1221019 - protein, 9 aa, Homo Sapiens
ATGAASAPA

SEQ ID NO: 1221020 - protein, 9 aa, Homo Sapiens
KGLWMEYAT

SEQ ID NO: 1221021 - protein, 9 aa, Homo Sapiens
RGDTCQSDM

SEQ ID NO: 1221022 - protein, 9 aa, Homo Sapiens
TKLVNTLNT

SEQ ID NO: 1221023 - protein, 9 aa, Homo Sapiens
ERGEGRPRN

SEQ ID NO: 1221024 - protein, 9 aa, Homo Sapiens
ILHGHPGCC

SEQ ID NO: 1221025 - protein, 9 aa, Homo Sapiens
LQRNEIACL

SEQ ID NO: 1221026 - protein, 9 aa, Homo Sapiens
DEVKISSVV

SEQ ID NO: 1221027 - protein, 9 aa, Homo Sapiens
DYNPYQVPK

SEQ ID NO: 1221028 - protein, 9 aa, Homo Sapiens
ALSTNKIAG

SEQ ID NO: 1221029 - protein, 9 aa, Homo Sapiens
QAYHRLKDD

SEQ ID NO: 1221030 - protein, 9 aa, Homo Sapiens
NVLLMAVEI

SEQ ID NO: 1221031 - protein, 9 aa, Homo Sapiens
ELQRYTQNI

SEQ ID NO: 1221032 - protein, 9 aa, Homo Sapiens
PQDPQGPNL

SEQ ID NO: 1221033 - protein, 9 aa, Homo Sapiens
SYICHCPPE

SEQ ID NO: 1221034 - protein, 9 aa, Homo Sapiens
ATLCSTCSR

SEQ ID NO: 1221035 - protein, 9 aa, Homo Sapiens
NLAAAQRDV

SEQ ID NO: 1221036 - protein, 9 aa, Homo Sapiens
PLRGPWRGP

SEQ ID NO: 1221037 - protein, 9 aa, Homo Sapiens
NAGGIHASK

SEQ ID NO: 1221038 - protein, 9 aa, Homo Sapiens
EDAEGSKAT

SEQ ID NO: 1221039 - protein, 9 aa, Homo Sapiens
SIPWTQIPQ

SEQ ID NO: 1221040 - protein, 9 aa, Homo Sapiens
AAMDKLMDR

SEQ ID NO: 1221041 - protein, 9 aa, Homo Sapiens
CTLVMECVD

SEQ ID NO: 1221042 - protein, 9 aa, Homo Sapiens
VCIPCECDP

SEQ ID NO: 1221043 - protein, 9 aa, Homo Sapiens
SRLLADDAL

SEQ ID NO: 1221044 - protein, 9 aa, Homo Sapiens
REQWLRVVT

SEQ ID NO: 1221045 - protein, 9 aa, Homo Sapiens
LDVDTRRTV

SEQ ID NO: 1221046 - protein, 9 aa, Homo Sapiens
PGELRLRET

SEQ ID NO: 1221047 - protein, 9 aa, Homo Sapiens
AGALRAHMA

SEQ ID NO: 1221048 - protein, 9 aa, Homo Sapiens
KACLLPDKG

SEQ ID NO: 1221049 - protein, 9 aa, Homo Sapiens
ERTSYPPFR

SEQ ID NO: 1221050 - protein, 9 aa, Homo Sapiens
VKLAPCISL

SEQ ID NO: 1221051 - protein, 9 aa, Homo Sapiens
YGGESPHLS

SEQ ID NO: 1221052 - protein, 9 aa, Homo Sapiens
KEIVRLCTI

SEQ ID NO: 1221053 - protein, 9 aa, Homo Sapiens
ADKLTLVTR

SEQ ID NO: 1221054 - protein, 9 aa, Homo Sapiens
ALRYLHSNC

SEQ ID NO: 1221055 - protein, 9 aa, Homo Sapiens
KNYTKEYNN

SEQ ID NO: 1221056 - protein, 9 aa, Homo Sapiens
TDSWLRPDQ

SEQ ID NO: 1221057 - protein, 9 aa, Homo Sapiens
ERERLTRQH

SEQ ID NO: 1221058 - protein, 9 aa, Homo Sapiens
FVQIMRLIK

SEQ ID NO: 1221059 - protein, 9 aa, Homo Sapiens
AAEPGYLVI

SEQ ID NO: 1221060 - protein, 9 aa, Homo Sapiens
RKPIVLKMI

SEQ ID NO: 1221061 - protein, 9 aa, Homo Sapiens
CLAPENSDG

SEQ ID NO: 1221062 - protein, 9 aa, Homo Sapiens
GLAYRYYPE

SEQ ID NO: 1221063 - protein, 9 aa, Homo Sapiens
TVKTLRTQC

SEQ ID NO: 1221064 - protein, 9 aa, Homo Sapiens
KALVEAAVR

SEQ ID NO: 1221065 - protein, 9 aa, Homo Sapiens
LPLIYQGHL

SEQ ID NO: 1221066 - protein, 9 aa, Homo Sapiens
VKKRKKEPS

SEQ ID NO: 1221067 - protein, 9 aa, Homo Sapiens
KSPLYVPRS

SEQ ID NO: 1221068 - protein, 9 aa, Homo Sapiens
TLIRTYQVC

SEQ ID NO: 1221069 - protein, 9 aa, Homo Sapiens
QRRRTPQPL

SEQ ID NO: 1221070 - protein, 9 aa, Homo Sapiens
HVFRIKHLP

SEQ ID NO: 1221071 - protein, 9 aa, Homo Sapiens
ILVCFLKRY

SEQ ID NO: 1221072 - protein, 9 aa, Homo Sapiens
GTGTPAPAF

SEQ ID NO: 1221073 - protein, 9 aa, Homo Sapiens
EMNKLMMDK

SEQ ID NO: 1221074 - protein, 9 aa, Homo Sapiens
CESSGRLYR

SEQ ID NO: 1221075 - protein, 9 aa, Homo Sapiens
YYILHGHPG

SEQ ID NO: 1221076 - protein, 9 aa, Homo Sapiens
DARIPLPLN

SEQ ID NO: 1221077 - protein, 9 aa, Homo Sapiens
ERLTRTGII

SEQ ID NO: 1221078 - protein, 9 aa, Homo Sapiens
VPQGKRPLH

SEQ ID NO: 1221079 - protein, 9 aa, Homo Sapiens
INKNKNVTN

SEQ ID NO: 1221080 - protein, 9 aa, Homo Sapiens
PSISILAMP

SEQ ID NO: 1221081 - protein, 9 aa, Homo Sapiens
VHALTLAEH

SEQ ID NO: 1221082 - protein, 9 aa, Homo Sapiens
FLRIVHVRK

SEQ ID NO: 1221083 - protein, 9 aa, Homo Sapiens
EYASLVRET

SEQ ID NO: 1221084 - protein, 9 aa, Homo Sapiens
YVEKKYTPG

SEQ ID NO: 1221085 - protein, 9 aa, Homo Sapiens
DAYTVIQAG

SEQ ID NO: 1221086 - protein, 9 aa, Homo Sapiens
AMKALQKRH

SEQ ID NO: 1221087 - protein, 9 aa, Homo Sapiens
YLSEWRYVQ

SEQ ID NO: 1221088 - protein, 9 aa, Homo Sapiens
AFRHATILI

SEQ ID NO: 1221089 - protein, 9 aa, Homo Sapiens
ISGGDHAPD

SEQ ID NO: 1221090 - protein, 9 aa, Homo Sapiens
LLAQPTLPG

SEQ ID NO: 1221091 - protein, 9 aa, Homo Sapiens
MDAVPVRRW

SEQ ID NO: 1221092 - protein, 9 aa, Homo Sapiens
RNMSGQPNF

SEQ ID NO: 1221093 - protein, 9 aa, Homo Sapiens
GMLNPFGQV

SEQ ID NO: 1221094 - protein, 9 aa, Homo Sapiens
TYETHHMYY

SEQ ID NO: 1221095 - protein, 9 aa, Homo Sapiens
IFKEINTAH

SEQ ID NO: 1221096 - protein, 9 aa, Homo Sapiens
PAAAPGFSF

SEQ ID NO: 1221097 - protein, 9 aa, Homo Sapiens
MRLELQMVE

SEQ ID NO: 1221098 - protein, 9 aa, Homo Sapiens
GSGDDKGSM

SEQ ID NO: 1221099 - protein, 9 aa, Homo Sapiens
YYELWWFCL

SEQ ID NO: 1221100 - protein, 9 aa, Homo Sapiens
PTEQHVRKN

SEQ ID NO: 1221101 - protein, 9 aa, Homo Sapiens
MGKEETKQK

SEQ ID NO: 1221102 - protein, 9 aa, Homo Sapiens
SLTNLSKMP

SEQ ID NO: 1221103 - protein, 9 aa, Homo Sapiens
QMLRQATKC

SEQ ID NO: 1221104 - protein, 9 aa, Homo Sapiens
KTLFLGVTI

SEQ ID NO: 1221105 - protein, 9 aa, Homo Sapiens
RCLREFQNI

SEQ ID NO: 1221106 - protein, 9 aa, Homo Sapiens
REDTRIKLI

SEQ ID NO: 1221107 - protein, 9 aa, Homo Sapiens
CYGHVLSGW

SEQ ID NO: 1221108 - protein, 9 aa, Homo Sapiens
KESPLLTQK

SEQ ID NO: 1221109 - protein, 9 aa, Homo Sapiens
HVAVTVGGI

SEQ ID NO: 1221110 - protein, 9 aa, Homo Sapiens
YYHRCHVDP

SEQ ID NO: 1221111 - protein, 9 aa, Homo Sapiens
NRAFCNYDS

SEQ ID NO: 1221112 - protein, 9 aa, Homo Sapiens
GTPVQNTLL

SEQ ID NO: 1221113 - protein, 9 aa, Homo Sapiens
SWSTSFWVA

SEQ ID NO: 1221114 - protein, 9 aa, Homo Sapiens
DIFEFQVIG

SEQ ID NO: 1221115 - protein, 9 aa, Homo Sapiens
GHTTASCLT

SEQ ID NO: 1221116 - protein, 9 aa, Homo Sapiens
VADLAFTHL

SEQ ID NO: 1221117 - protein, 9 aa, Homo Sapiens
AQKAKPVAI

SEQ ID NO: 1221118 - protein, 9 aa, Homo Sapiens
AVLWLDWFL

SEQ ID NO: 1221119 - protein, 9 aa, Homo Sapiens
VKVTADTVK

SEQ ID NO: 1221120 - protein, 9 aa, Homo Sapiens
QADISISPA

SEQ ID NO: 1221121 - protein, 9 aa, Homo Sapiens
DIPSCRQQW

SEQ ID NO: 1221122 - protein, 9 aa, Homo Sapiens
CKIIIADLN

SEQ ID NO: 1221123 - protein, 9 aa, Homo Sapiens
LKIKLAMKI

SEQ ID NO: 1221124 - protein, 9 aa, Homo Sapiens
PVQSYGPPH

SEQ ID NO: 1221125 - protein, 9 aa, Homo Sapiens
RCQHVDLLG

SEQ ID NO: 1221126 - protein, 9 aa, Homo Sapiens
SSMRRTAFI

SEQ ID NO: 1221127 - protein, 9 aa, Homo Sapiens
KRSQGSSPP

SEQ ID NO: 1221128 - protein, 9 aa, Homo Sapiens
GSSKEMMFE

SEQ ID NO: 1221129 - protein, 9 aa, Homo Sapiens
VSITFNGQV

SEQ ID NO: 1221130 - protein, 9 aa, Homo Sapiens
SPGTQLTNP

SEQ ID NO: 1221131 - protein, 9 aa, Homo Sapiens
CSSHLLMVG

SEQ ID NO: 1221132 - protein, 9 aa, Homo Sapiens
HVLPGGQLR

SEQ ID NO: 1221133 - protein, 9 aa, Homo Sapiens
QMLVENLYR

SEQ ID NO: 1221134 - protein, 9 aa, Homo Sapiens
DFLQLLLPT

SEQ ID NO: 1221135 - protein, 9 aa, Homo Sapiens
DLQEDESCY

SEQ ID NO: 1221136 - protein, 9 aa, Homo Sapiens
PFVEVLATS

SEQ ID NO: 1221137 - protein, 9 aa, Homo Sapiens
AHAAGVSRQ

SEQ ID NO: 1221138 - protein, 9 aa, Homo Sapiens
PSMCSKVRG

SEQ ID NO: 1221139 - protein, 9 aa, Homo Sapiens
PGTLECGDQ

SEQ ID NO: 1221140 - protein, 9 aa, Homo Sapiens
DKLYKRKEI

SEQ ID NO: 1221141 - protein, 9 aa, Homo Sapiens
AHPVSEEHI

SEQ ID NO: 1221142 - protein, 9 aa, Homo Sapiens
VKASLQKCP

SEQ ID NO: 1221143 - protein, 9 aa, Homo Sapiens
EKGETVQEE

SEQ ID NO: 1221144 - protein, 9 aa, Homo Sapiens
FIDSKYDVR

SEQ ID NO: 1221145 - protein, 9 aa, Homo Sapiens
TTSFTDHAI

SEQ ID NO: 1221146 - protein, 9 aa, Homo Sapiens
IQKSPKGRV

SEQ ID NO: 1221147 - protein, 9 aa, Homo Sapiens
IKGEGDMTK

SEQ ID NO: 1221148 - protein, 9 aa, Homo Sapiens
DTTGSPVQN

SEQ ID NO: 1221149 - protein, 9 aa, Homo Sapiens
DLLTEPDGQ

SEQ ID NO: 1221150 - protein, 9 aa, Homo Sapiens
FLLTVKFYW

SEQ ID NO: 1221151 - protein, 9 aa, Homo Sapiens
QHSSELNTI

SEQ ID NO: 1221152 - protein, 9 aa, Homo Sapiens
VTKLVNTLN

SEQ ID NO: 1221153 - protein, 9 aa, Homo Sapiens
NSHEVDYYN

SEQ ID NO: 1221154 - protein, 9 aa, Homo Sapiens
VVSTRVSSI

SEQ ID NO: 1221155 - protein, 9 aa, Homo Sapiens
QHVSVSRVF

SEQ ID NO: 1221156 - protein, 9 aa, Homo Sapiens
HDEEANNDI

SEQ ID NO: 1221157 - protein, 9 aa, Homo Sapiens
ITVFTSRAL

SEQ ID NO: 1221158 - protein, 9 aa, Homo Sapiens
LQSRWHSAP

SEQ ID NO: 1221159 - protein, 9 aa, Homo Sapiens
QGGPNWGHL

SEQ ID NO: 1221160 - protein, 9 aa, Homo Sapiens
EEGRTVAAL

SEQ ID NO: 1221161 - protein, 9 aa, Homo Sapiens
IQKIGECAL

SEQ ID NO: 1221162 - protein, 9 aa, Homo Sapiens
MEAEQEMVC

SEQ ID NO: 1221163 - protein, 9 aa, Homo Sapiens
ALYLALQYS

SEQ ID NO: 1221164 - protein, 9 aa, Homo Sapiens
EMADEEHRI

SEQ ID NO: 1221165 - protein, 9 aa, Homo Sapiens
QYCPVLRPM

SEQ ID NO: 1221166 - protein, 9 aa, Homo Sapiens
ESLQRCYSK

SEQ ID NO: 1221167 - protein, 9 aa, Homo Sapiens
QVDTRESDK

SEQ ID NO: 1221168 - protein, 9 aa, Homo Sapiens
FLLSMKKEV

SEQ ID NO: 1221169 - protein, 9 aa, Homo Sapiens
ASSMTERIR

SEQ ID NO: 1221170 - protein, 9 aa, Homo Sapiens
RMVDIPCGP

SEQ ID NO: 1221171 - protein, 9 aa, Homo Sapiens
DPFKHLSPG

SEQ ID NO: 1221172 - protein, 9 aa, Homo Sapiens
NYPEIRLNM

SEQ ID NO: 1221173 - protein, 9 aa, Homo Sapiens
LASTPRAPD

SEQ ID NO: 1221174 - protein, 9 aa, Homo Sapiens
HIDALYESA

SEQ ID NO: 1221175 - protein, 9 aa, Homo Sapiens
PATFRRKIP

SEQ ID NO: 1221176 - protein, 9 aa, Homo Sapiens
RREGHSKTF

SEQ ID NO: 1221177 - protein, 9 aa, Homo Sapiens
TKLALIKEK

SEQ ID NO: 1221178 - protein, 9 aa, Homo Sapiens
IDTYVDEQM

SEQ ID NO: 1221179 - protein, 9 aa, Homo Sapiens
MVVYPWQLL

SEQ ID NO: 1221180 - protein, 9 aa, Homo Sapiens
LVQRFSTRA

SEQ ID NO: 1221181 - protein, 9 aa, Homo Sapiens
ITYGIQPHL

SEQ ID NO: 1221182 - protein, 9 aa, Homo Sapiens
VLKSIMKVM

SEQ ID NO: 1221183 - protein, 9 aa, Homo Sapiens
EEIIKLEIL

SEQ ID NO: 1221184 - protein, 9 aa, Homo Sapiens
RVLRCTNNQ

SEQ ID NO: 1221185 - protein, 9 aa, Homo Sapiens
HDYNVEAPP

SEQ ID NO: 1221186 - protein, 9 aa, Homo Sapiens
LSMTVTKLG

SEQ ID NO: 1221187 - protein, 9 aa, Homo Sapiens
VDLYHLEKL

SEQ ID NO: 1221188 - protein, 9 aa, Homo Sapiens
GPIGHRCEG

SEQ ID NO: 1221189 - protein, 9 aa, Homo Sapiens
RLNTSAEAP

SEQ ID NO: 1221190 - protein, 9 aa, Homo Sapiens
TFSQAKRNN

SEQ ID NO: 1221191 - protein, 9 aa, Homo Sapiens
VKATDGGFM

SEQ ID NO: 1221192 - protein, 9 aa, Homo Sapiens
AITALVKET

SEQ ID NO: 1221193 - protein, 9 aa, Homo Sapiens
KVHKYSIVI

SEQ ID NO: 1221194 - protein, 9 aa, Homo Sapiens
PHLSPCSSI

SEQ ID NO: 1221195 - protein, 9 aa, Homo Sapiens
EFLYQTIFL

SEQ ID NO: 1221196 - protein, 9 aa, Homo Sapiens
KSQTIEQNS

SEQ ID NO: 1221197 - protein, 9 aa, Homo Sapiens
LSGFSMEQV

SEQ ID NO: 1221198 - protein, 9 aa, Homo Sapiens
YKKHTLQHD

SEQ ID NO: 1221199 - protein, 9 aa, Homo Sapiens
LSSGSITAI

SEQ ID NO: 1221200 - protein, 9 aa, Homo Sapiens
SKTHRFLFN

SEQ ID NO: 1221201 - protein, 9 aa, Homo Sapiens
VTTFFYSCF

SEQ ID NO: 1221202 - protein, 9 aa, Homo Sapiens
DHCECQQCF

SEQ ID NO: 1221203 - protein, 9 aa, Homo Sapiens
PGSNVRSNP

SEQ ID NO: 1221204 - protein, 9 aa, Homo Sapiens
GNNFGYIVT

SEQ ID NO: 1221205 - protein, 9 aa, Homo Sapiens
RHRKTGRKV

SEQ ID NO: 1221206 - protein, 9 aa, Homo Sapiens
LVPLEVTCV

SEQ ID NO: 1221207 - protein, 9 aa, Homo Sapiens
KDREFIEIL

SEQ ID NO: 1221208 - protein, 9 aa, Homo Sapiens
HLGQGGPRF

SEQ ID NO: 1221209 - protein, 9 aa, Homo Sapiens
SPDVLNDHG

SEQ ID NO: 1221210 - protein, 9 aa, Homo Sapiens
TTELLSASV

SEQ ID NO: 1221211 - protein, 9 aa, Homo Sapiens
PSEASVLAA

SEQ ID NO: 1221212 - protein, 9 aa, Homo Sapiens
GGRERRDRR

SEQ ID NO: 1221213 - protein, 9 aa, Homo Sapiens
YLVIKVVAV

SEQ ID NO: 1221214 - protein, 9 aa, Homo Sapiens
GTLQIDFAD

SEQ ID NO: 1221215 - protein, 9 aa, Homo Sapiens
SVKGKHRKP

SEQ ID NO: 1221216 - protein, 9 aa, Homo Sapiens
EQKDYDSHT

SEQ ID NO: 1221217 - protein, 9 aa, Homo Sapiens
RSPGSLQIS

SEQ ID NO: 1221218 - protein, 9 aa, Homo Sapiens
RSVNSRGLS

SEQ ID NO: 1221219 - protein, 9 aa, Homo Sapiens
AEEDRVSTL

SEQ ID NO: 1221220 - protein, 9 aa, Homo Sapiens
MKRQRPDDL

SEQ ID NO: 1221221 - protein, 9 aa, Homo Sapiens
RPLQRRLPK

SEQ ID NO: 1221222 - protein, 9 aa, Homo Sapiens
QGMNIQWMH

SEQ ID NO: 1221223 - protein, 9 aa, Homo Sapiens
APMMLWGLL

SEQ ID NO: 1221224 - protein, 9 aa, Homo Sapiens
LQCTGSGGP

SEQ ID NO: 1221225 - protein, 9 aa, Homo Sapiens
GKSPGMMRH

SEQ ID NO: 1221226 - protein, 9 aa, Homo Sapiens
RCLRCGHVY

SEQ ID NO: 1221227 - protein, 9 aa, Homo Sapiens
VPPHGAIPP

SEQ ID NO: 1221228 - protein, 9 aa, Homo Sapiens
DLTAEDLSG

SEQ ID NO: 1221229 - protein, 9 aa, Homo Sapiens
EDVTNEKQA

SEQ ID NO: 1221230 - protein, 9 aa, Homo Sapiens
PREIRQSAL

SEQ ID NO: 1221231 - protein, 9 aa, Homo Sapiens
NYLSVSKSI

SEQ ID NO: 1221232 - protein, 9 aa, Homo Sapiens
SYRTMEKPP

SEQ ID NO: 1221233 - protein, 9 aa, Homo Sapiens
SQYWISVCV

SEQ ID NO: 1221234 - protein, 9 aa, Homo Sapiens
EDKLEHKTK

SEQ ID NO: 1221235 - protein, 9 aa, Homo Sapiens
YIRPSHIHH

SEQ ID NO: 1221236 - protein, 9 aa, Homo Sapiens
ASCYIKDKD

SEQ ID NO: 1221237 - protein, 9 aa, Homo Sapiens
LLDGRIRLR

SEQ ID NO: 1221238 - protein, 9 aa, Homo Sapiens
MLITCIDSR

SEQ ID NO: 1221239 - protein, 9 aa, Homo Sapiens
TTISPAQLD

SEQ ID NO: 1221240 - protein, 9 aa, Homo Sapiens
KDQLHKYVR

SEQ ID NO: 1221241 - protein, 9 aa, Homo Sapiens
QALSEQLGQ

SEQ ID NO: 1221242 - protein, 9 aa, Homo Sapiens
WCFMFSIWC

SEQ ID NO: 1221243 - protein, 9 aa, Homo Sapiens
YYWGEKLTL

SEQ ID NO: 1221244 - protein, 9 aa, Homo Sapiens
DIFLLEKEK

SEQ ID NO: 1221245 - protein, 9 aa, Homo Sapiens
TPEELKLYD

SEQ ID NO: 1221246 - protein, 9 aa, Homo Sapiens
SAWFLLQHT

SEQ ID NO: 1221247 - protein, 9 aa, Homo Sapiens
PGRSIIVGA

SEQ ID NO: 1221248 - protein, 9 aa, Homo Sapiens
GRPGQCAGA

SEQ ID NO: 1221249 - protein, 9 aa, Homo Sapiens
KIMTINGLN

SEQ ID NO: 1221250 - protein, 9 aa, Homo Sapiens
RATPLQFAF

SEQ ID NO: 1221251 - protein, 9 aa, Homo Sapiens
TPDYLKAQA

SEQ ID NO: 1221252 - protein, 9 aa, Homo Sapiens
LEKCLSSAN

SEQ ID NO: 1221253 - protein, 9 aa, Homo Sapiens
ELQPVLVGL

SEQ ID NO: 1221254 - protein, 9 aa, Homo Sapiens
SVKGLVTVI

SEQ ID NO: 1221255 - protein, 9 aa, Homo Sapiens
STGSAEPPA

SEQ ID NO: 1221256 - protein, 9 aa, Homo Sapiens
TNRSVAPGF

SEQ ID NO: 1221257 - protein, 9 aa, Homo Sapiens
LILEQLESQ

SEQ ID NO: 1221258 - protein, 9 aa, Homo Sapiens
CKLKFRFDA

SEQ ID NO: 1221259 - protein, 9 aa, Homo Sapiens
EKQMILTEF

SEQ ID NO: 1221260 - protein, 9 aa, Homo Sapiens
AQEVAAGAH

SEQ ID NO: 1221261 - protein, 9 aa, Homo Sapiens
PSELVGRSF

SEQ ID NO: 1221262 - protein, 9 aa, Homo Sapiens
EKKQALSDR

SEQ ID NO: 1221263 - protein, 9 aa, Homo Sapiens
DFVGHDAKV

SEQ ID NO: 1221264 - protein, 9 aa, Homo Sapiens
EGHAVEWLC

SEQ ID NO: 1221265 - protein, 9 aa, Homo Sapiens
SMVNVDCMS

SEQ ID NO: 1221266 - protein, 9 aa, Homo Sapiens
SHISRKFTE

SEQ ID NO: 1221267 - protein, 9 aa, Homo Sapiens
DHVLYEWFL

SEQ ID NO: 1221268 - protein, 9 aa, Homo Sapiens
SISKPDVIS

SEQ ID NO: 1221269 - protein, 9 aa, Homo Sapiens
SMDAHSEAA

SEQ ID NO: 1221270 - protein, 9 aa, Homo Sapiens
SMHRELREQ

SEQ ID NO: 1221271 - protein, 9 aa, Homo Sapiens
HEEHCGMLR

SEQ ID NO: 1221272 - protein, 9 aa, Homo Sapiens
QFANVQPIL

SEQ ID NO: 1221273 - protein, 9 aa, Homo Sapiens
RSGTVTCSF

SEQ ID NO: 1221274 - protein, 9 aa, Homo Sapiens
HLSRHRKSH

SEQ ID NO: 1221275 - protein, 9 aa, Homo Sapiens
KKSSVMCEN

SEQ ID NO: 1221276 - protein, 9 aa, Homo Sapiens
RRKLWLQKN

SEQ ID NO: 1221277 - protein, 9 aa, Homo Sapiens
TPRPFVSQT

SEQ ID NO: 1221278 - protein, 9 aa, Homo Sapiens
SESNMDQNC

SEQ ID NO: 1221279 - protein, 9 aa, Homo Sapiens
AYRYYPEGV

SEQ ID NO: 1221280 - protein, 9 aa, Homo Sapiens
VSPSMCSKV

SEQ ID NO: 1221281 - protein, 9 aa, Homo Sapiens
LAVPPHGAI

SEQ ID NO: 1221282 - protein, 9 aa, Homo Sapiens
LEGSSTLNV

SEQ ID NO: 1221283 - protein, 9 aa, Homo Sapiens
EALVDQVLV

SEQ ID NO: 1221284 - protein, 9 aa, Homo Sapiens
AHIFIPIFY

SEQ ID NO: 1221285 - protein, 9 aa, Homo Sapiens
AFIVFWVRS

SEQ ID NO: 1221286 - protein, 9 aa, Homo Sapiens
RVLTAKVST

SEQ ID NO: 1221287 - protein, 9 aa, Homo Sapiens
GGASGNLRS

SEQ ID NO: 1221288 - protein, 9 aa, Homo Sapiens
AQRARDEYQ

SEQ ID NO: 1221289 - protein, 9 aa, Homo Sapiens
DKKFPPSLL

SEQ ID NO: 1221290 - protein, 9 aa, Homo Sapiens
TTLGIIVRA

SEQ ID NO: 1221291 - protein, 9 aa, Homo Sapiens
QLLLPTQDE

SEQ ID NO: 1221292 - protein, 9 aa, Homo Sapiens
KFTVGALLA

SEQ ID NO: 1221293 - protein, 9 aa, Homo Sapiens
LDQMDHEQD

SEQ ID NO: 1221294 - protein, 9 aa, Homo Sapiens
ITLDWMFWY

SEQ ID NO: 1221295 - protein, 9 aa, Homo Sapiens
TIQRQKVWS

SEQ ID NO: 1221296 - protein, 9 aa, Homo Sapiens
NHTDETLAS

SEQ ID NO: 1221297 - protein, 9 aa, Homo Sapiens
AFGVSERSS

SEQ ID NO: 1221298 - protein, 9 aa, Homo Sapiens
MYPSQFNPT

SEQ ID NO: 1221299 - protein, 9 aa, Homo Sapiens
ALFNSMHHE

SEQ ID NO: 1221300 - protein, 9 aa, Homo Sapiens
SYHSDSDIF

SEQ ID NO: 1221301 - protein, 9 aa, Homo Sapiens
VCEAVRSGH

SEQ ID NO: 1221302 - protein, 9 aa, Homo Sapiens
DICFTTSCV

SEQ ID NO: 1221303 - protein, 9 aa, Homo Sapiens
PGHQITSGP

SEQ ID NO: 1221304 - protein, 9 aa, Homo Sapiens
EMSEVTGYA

SEQ ID NO: 1221305 - protein, 9 aa, Homo Sapiens
CGSNKVCRD

SEQ ID NO: 1221306 - protein, 9 aa, Homo Sapiens
RRATVHCMA

SEQ ID NO: 1221307 - protein, 9 aa, Homo Sapiens
ADLEVQVQS

SEQ ID NO: 1221308 - protein, 9 aa, Homo Sapiens
IIRTLQKRL

SEQ ID NO: 1221309 - protein, 9 aa, Homo Sapiens
VQLTSVDAT

SEQ ID NO: 1221310 - protein, 9 aa, Homo Sapiens
KSEKELKVL

SEQ ID NO: 1221311 - protein, 9 aa, Homo Sapiens
AEPAAQPGE

SEQ ID NO: 1221312 - protein, 9 aa, Homo Sapiens
EQQLRPQAK

SEQ ID NO: 1221313 - protein, 9 aa, Homo Sapiens
GGWTVFQWR

SEQ ID NO: 1221314 - protein, 9 aa, Homo Sapiens
FGEQINNDN

SEQ ID NO: 1221315 - protein, 9 aa, Homo Sapiens
RMSQGKVAS

SEQ ID NO: 1221316 - protein, 9 aa, Homo Sapiens
RQLKRPRHV

SEQ ID NO: 1221317 - protein, 9 aa, Homo Sapiens
SPLPDTLLL

SEQ ID NO: 1221318 - protein, 9 aa, Homo Sapiens
TTTLAEFGK

SEQ ID NO: 1221319 - protein, 9 aa, Homo Sapiens
WSPGGRQLR

SEQ ID NO: 1221320 - protein, 9 aa, Homo Sapiens
EECIEFYEL

SEQ ID NO: 1221321 - protein, 9 aa, Homo Sapiens
HWSRSHEDG

SEQ ID NO: 1221322 - protein, 9 aa, Homo Sapiens
ADEGRADLC

SEQ ID NO: 1221323 - protein, 9 aa, Homo Sapiens
TLTLLNPMK

SEQ ID NO: 1221324 - protein, 9 aa, Homo Sapiens
PPACHSFCR

SEQ ID NO: 1221325 - protein, 9 aa, Homo Sapiens
DRKSGRTTL

SEQ ID NO: 1221326 - protein, 9 aa, Homo Sapiens
WEAFATSLW

SEQ ID NO: 1221327 - protein, 9 aa, Homo Sapiens
VEIFILAVM

SEQ ID NO: 1221328 - protein, 9 aa, Homo Sapiens
PLSEYEAKV

SEQ ID NO: 1221329 - protein, 9 aa, Homo Sapiens
NSIWDYGND

SEQ ID NO: 1221330 - protein, 9 aa, Homo Sapiens
TSAWGIPGT

SEQ ID NO: 1221331 - protein, 9 aa, Homo Sapiens
PLMLLPLPP

SEQ ID NO: 1221332 - protein, 9 aa, Homo Sapiens
CLAPKRPLL

SEQ ID NO: 1221333 - protein, 9 aa, Homo Sapiens
SEACVNDGM

SEQ ID NO: 1221334 - protein, 9 aa, Homo Sapiens
LSAGQTDAS

SEQ ID NO: 1221335 - protein, 9 aa, Homo Sapiens
TFVALLLSY

SEQ ID NO: 1221336 - protein, 9 aa, Homo Sapiens
KATLIWCLF

SEQ ID NO: 1221337 - protein, 9 aa, Homo Sapiens
QCMPRKVCI

SEQ ID NO: 1221338 - protein, 9 aa, Homo Sapiens
GRQEDVATA

SEQ ID NO: 1221339 - protein, 9 aa, Homo Sapiens
IFTVLSYMA

SEQ ID NO: 1221340 - protein, 9 aa, Homo Sapiens
WLITASTSQ

SEQ ID NO: 1221341 - protein, 9 aa, Homo Sapiens
LKILKLIHP

SEQ ID NO: 1221342 - protein, 9 aa, Homo Sapiens
KLLEAHTPS

SEQ ID NO: 1221343 - protein, 9 aa, Homo Sapiens
CTKMVVYPW

SEQ ID NO: 1221344 - protein, 9 aa, Homo Sapiens
KVKLHNDSS

SEQ ID NO: 1221345 - protein, 9 aa, Homo Sapiens
DEGRADLCH

SEQ ID NO: 1221346 - protein, 9 aa, Homo Sapiens
LVTTFFYSC

SEQ ID NO: 1221347 - protein, 9 aa, Homo Sapiens
LFFIIGVII

SEQ ID NO: 1221348 - protein, 9 aa, Homo Sapiens
LTREGDTLE

SEQ ID NO: 1221349 - protein, 9 aa, Homo Sapiens
HRDSYYSYM

SEQ ID NO: 1221350 - protein, 9 aa, Homo Sapiens
SLHFLKREA

SEQ ID NO: 1221351 - protein, 9 aa, Homo Sapiens
FASMRILGA

SEQ ID NO: 1221352 - protein, 9 aa, Homo Sapiens
FGSVAVMHL

SEQ ID NO: 1221353 - protein, 9 aa, Homo Sapiens
HLILLWLLG

SEQ ID NO: 1221354 - protein, 9 aa, Homo Sapiens
HSVKGKHRK

SEQ ID NO: 1221355 - protein, 9 aa, Homo Sapiens
ESVSLHFLQ

SEQ ID NO: 1221356 - protein, 9 aa, Homo Sapiens
THRHPSATL

SEQ ID NO: 1221357 - protein, 9 aa, Homo Sapiens
NVLNECLSV

SEQ ID NO: 1221358 - protein, 9 aa, Homo Sapiens
GTDVPEIPG

SEQ ID NO: 1221359 - protein, 9 aa, Homo Sapiens
AGQIVLVDD

SEQ ID NO: 1221360 - protein, 9 aa, Homo Sapiens
AHSVQLFIL

SEQ ID NO: 1221361 - protein, 9 aa, Homo Sapiens
DSSRKPRTF

SEQ ID NO: 1221362 - protein, 9 aa, Homo Sapiens
LGGRCGKCD

SEQ ID NO: 1221363 - protein, 9 aa, Homo Sapiens
LVSAMCTAV

SEQ ID NO: 1221364 - protein, 9 aa, Homo Sapiens
MNSTGSGKN

SEQ ID NO: 1221365 - protein, 9 aa, Homo Sapiens
KHILNVPQE

SEQ ID NO: 1221366 - protein, 9 aa, Homo Sapiens
NNQCYNWTL

SEQ ID NO: 1221367 - protein, 9 aa, Homo Sapiens
QENFFCAPP

SEQ ID NO: 1221368 - protein, 9 aa, Homo Sapiens
QADPTCSDA

SEQ ID NO: 1221369 - protein, 9 aa, Homo Sapiens
GLVIAQSLS

SEQ ID NO: 1221370 - protein, 9 aa, Homo Sapiens
TLQWLIQQS

SEQ ID NO: 1221371 - protein, 9 aa, Homo Sapiens
GLHGSDALN

SEQ ID NO: 1221372 - protein, 9 aa, Homo Sapiens
PSSQSQISR

SEQ ID NO: 1221373 - protein, 9 aa, Homo Sapiens
EQNENIPII

SEQ ID NO: 1221374 - protein, 9 aa, Homo Sapiens
LVREMEEAT

SEQ ID NO: 1221375 - protein, 9 aa, Homo Sapiens
KTSIDSLAN

SEQ ID NO: 1221376 - protein, 9 aa, Homo Sapiens
RWNTQDENM

SEQ ID NO: 1221377 - protein, 9 aa, Homo Sapiens
LQFLPQGSQ

SEQ ID NO: 1221378 - protein, 9 aa, Homo Sapiens
RKCFPGNQH

SEQ ID NO: 1221379 - protein, 9 aa, Homo Sapiens
LKSIMKVMI

SEQ ID NO: 1221380 - protein, 9 aa, Homo Sapiens
INPDTAAAY

SEQ ID NO: 1221381 - protein, 9 aa, Homo Sapiens
PPQEAILVA

SEQ ID NO: 1221382 - protein, 9 aa, Homo Sapiens
CLGFQVWLK

SEQ ID NO: 1221383 - protein, 9 aa, Homo Sapiens
KQGVLTHDR

SEQ ID NO: 1221384 - protein, 9 aa, Homo Sapiens
LSMFIDAPY

SEQ ID NO: 1221385 - protein, 9 aa, Homo Sapiens
DKILQELNA

SEQ ID NO: 1221386 - protein, 9 aa, Homo Sapiens
EVFAENNNL

SEQ ID NO: 1221387 - protein, 9 aa, Homo Sapiens
YHQPSAPTG

SEQ ID NO: 1221388 - protein, 9 aa, Homo Sapiens
MHLPGYAPA

SEQ ID NO: 1221389 - protein, 9 aa, Homo Sapiens
GWAVFGGQV

SEQ ID NO: 1221390 - protein, 9 aa, Homo Sapiens
QILLRDQAL

SEQ ID NO: 1221391 - protein, 9 aa, Homo Sapiens
RNVNSSRFG

SEQ ID NO: 1221392 - protein, 9 aa, Homo Sapiens
VRYYSKGTP

SEQ ID NO: 1221393 - protein, 9 aa, Homo Sapiens
PQGKYSSLT

SEQ ID NO: 1221394 - protein, 9 aa, Homo Sapiens
CLKETMGWV

SEQ ID NO: 1221395 - protein, 9 aa, Homo Sapiens
FVSQTRGIS

SEQ ID NO: 1221396 - protein, 9 aa, Homo Sapiens
ANTDPSVIN

SEQ ID NO: 1221397 - protein, 9 aa, Homo Sapiens
IDEKAGGTN

SEQ ID NO: 1221398 - protein, 9 aa, Homo Sapiens
AAPTFSGIV

SEQ ID NO: 1221399 - protein, 9 aa, Homo Sapiens
DLDSPMQED

SEQ ID NO: 1221400 - protein, 9 aa, Homo Sapiens
MDVYDGREH

SEQ ID NO: 1221401 - protein, 9 aa, Homo Sapiens
KSYQCDVCD

SEQ ID NO: 1221402 - protein, 9 aa, Homo Sapiens
LGPEADVGR

SEQ ID NO: 1221403 - protein, 9 aa, Homo Sapiens
YFHASITNS

SEQ ID NO: 1221404 - protein, 9 aa, Homo Sapiens
DFSLDQPKG

SEQ ID NO: 1221405 - protein, 9 aa, Homo Sapiens
LHDEEANND

SEQ ID NO: 1221406 - protein, 9 aa, Homo Sapiens
AQHAPQPYA

SEQ ID NO: 1221407 - protein, 9 aa, Homo Sapiens
LAGPDMVLT

SEQ ID NO: 1221408 - protein, 9 aa, Homo Sapiens
PVFEDQCSF

SEQ ID NO: 1221409 - protein, 9 aa, Homo Sapiens
FYERMNTID

SEQ ID NO: 1221410 - protein, 9 aa, Homo Sapiens
DPVSRTPTL

SEQ ID NO: 1221411 - protein, 9 aa, Homo Sapiens
KSKEEGTRR

SEQ ID NO: 1221412 - protein, 9 aa, Homo Sapiens
PTVVACPRS

SEQ ID NO: 1221413 - protein, 9 aa, Homo Sapiens
KTYDSFLNY

SEQ ID NO: 1221414 - protein, 9 aa, Homo Sapiens
VKAGHSYDS

SEQ ID NO: 1221415 - protein, 9 aa, Homo Sapiens
DGNDTINAQ

SEQ ID NO: 1221416 - protein, 9 aa, Homo Sapiens
KEILHSSLG

SEQ ID NO: 1221417 - protein, 9 aa, Homo Sapiens
LFSTVCQGH

SEQ ID NO: 1221418 - protein, 9 aa, Homo Sapiens
IFDLNNGSD

SEQ ID NO: 1221419 - protein, 9 aa, Homo Sapiens
ATCFFTFKN

SEQ ID NO: 1221420 - protein, 9 aa, Homo Sapiens
DSPREGLMV

SEQ ID NO: 1221421 - protein, 9 aa, Homo Sapiens
LSAPGKWND

SEQ ID NO: 1221422 - protein, 9 aa, Homo Sapiens
NEDPKDALF

SEQ ID NO: 1221423 - protein, 9 aa, Homo Sapiens
GLQTLCVAY

SEQ ID NO: 1221424 - protein, 9 aa, Homo Sapiens
IRLIVELAD

SEQ ID NO: 1221425 - protein, 9 aa, Homo Sapiens
CLGPLFFPR

SEQ ID NO: 1221426 - protein, 9 aa, Homo Sapiens
LAMLYVVHC

SEQ ID NO: 1221427 - protein, 9 aa, Homo Sapiens
ARQDGEVVC

SEQ ID NO: 1221428 - protein, 9 aa, Homo Sapiens
TVFDGHPIE

SEQ ID NO: 1221429 - protein, 9 aa, Homo Sapiens
GPCITSPSR

SEQ ID NO: 1221430 - protein, 9 aa, Homo Sapiens
GLDAMVLLL

SEQ ID NO: 1221431 - protein, 9 aa, Homo Sapiens
KRAALDECY

SEQ ID NO: 1221432 - protein, 9 aa, Homo Sapiens
MGWVTRLSS

SEQ ID NO: 1221433 - protein, 9 aa, Homo Sapiens
GYLHRIPTH

SEQ ID NO: 1221434 - protein, 9 aa, Homo Sapiens
NLKVRKKMK

SEQ ID NO: 1221435 - protein, 9 aa, Homo Sapiens
RPDSVDIER

SEQ ID NO: 1221436 - protein, 9 aa, Homo Sapiens
QLCIRHWTT

SEQ ID NO: 1221437 - protein, 9 aa, Homo Sapiens
MKGLYTDAD

SEQ ID NO: 1221438 - protein, 9 aa, Homo Sapiens
HGSGAGPFP

SEQ ID NO: 1221439 - protein, 9 aa, Homo Sapiens
GKDDTDGET

SEQ ID NO: 1221440 - protein, 9 aa, Homo Sapiens
SDPYVCIPC

SEQ ID NO: 1221441 - protein, 9 aa, Homo Sapiens
GRGSNALHV

SEQ ID NO: 1221442 - protein, 9 aa, Homo Sapiens
LTPLHNFLE

SEQ ID NO: 1221443 - protein, 9 aa, Homo Sapiens
SSDVRKATQ

SEQ ID NO: 1221444 - protein, 9 aa, Homo Sapiens
VMIAITRLV

SEQ ID NO: 1221445 - protein, 9 aa, Homo Sapiens
SYTYNAAQA

SEQ ID NO: 1221446 - protein, 9 aa, Homo Sapiens
PEEEEEEED

SEQ ID NO: 1221447 - protein, 9 aa, Homo Sapiens
HLFINSLLN

SEQ ID NO: 1221448 - protein, 9 aa, Homo Sapiens
LSRQDAAGK

SEQ ID NO: 1221449 - protein, 9 aa, Homo Sapiens
YLTTYRQLS

SEQ ID NO: 1221450 - protein, 9 aa, Homo Sapiens
LVHVIRRNE

SEQ ID NO: 1221451 - protein, 9 aa, Homo Sapiens
SVSSFVDKI

SEQ ID NO: 1221452 - protein, 9 aa, Homo Sapiens
CEPCPTPGA

SEQ ID NO: 1221453 - protein, 9 aa, Homo Sapiens
AVLSEDARA

SEQ ID NO: 1221454 - protein, 9 aa, Homo Sapiens
LTLWLLDCP

SEQ ID NO: 1221455 - protein, 9 aa, Homo Sapiens
GHVYVRRGP

SEQ ID NO: 1221456 - protein, 9 aa, Homo Sapiens
KSEMPHVSV

SEQ ID NO: 1221457 - protein, 9 aa, Homo Sapiens
GCRKQKSNC

SEQ ID NO: 1221458 - protein, 9 aa, Homo Sapiens
SINPWERKS

SEQ ID NO: 1221459 - protein, 9 aa, Homo Sapiens
RATATQLLH

SEQ ID NO: 1221460 - protein, 9 aa, Homo Sapiens
VFDCKFIEN

SEQ ID NO: 1221461 - protein, 9 aa, Homo Sapiens
YSASYSENR

SEQ ID NO: 1221462 - protein, 9 aa, Homo Sapiens
WPYWAGLPP

SEQ ID NO: 1221463 - protein, 9 aa, Homo Sapiens
NKDPKMYRV

SEQ ID NO: 1221464 - protein, 9 aa, Homo Sapiens
SARKFLDTA

SEQ ID NO: 1221465 - protein, 9 aa, Homo Sapiens
VGSKVMGGL

SEQ ID NO: 1221466 - protein, 9 aa, Homo Sapiens
MGVSGSGKF

SEQ ID NO: 1221467 - protein, 9 aa, Homo Sapiens
PNWGHLVAF

SEQ ID NO: 1221468 - protein, 9 aa, Homo Sapiens
PACNGSECR

SEQ ID NO: 1221469 - protein, 9 aa, Homo Sapiens
GLCFPNHLP

SEQ ID NO: 1221470 - protein, 9 aa, Homo Sapiens
RREWVLDCH

SEQ ID NO: 1221471 - protein, 9 aa, Homo Sapiens
QEPTHTGHL

SEQ ID NO: 1221472 - protein, 9 aa, Homo Sapiens
GIVLDHLKA

SEQ ID NO: 1221473 - protein, 9 aa, Homo Sapiens
KGDVGPNEQ

SEQ ID NO: 1221474 - protein, 9 aa, Homo Sapiens
RPPCPFAPK

SEQ ID NO: 1221475 - protein, 9 aa, Homo Sapiens
SAIAIFLVL

SEQ ID NO: 1221476 - protein, 9 aa, Homo Sapiens
EEFVKSMGN

SEQ ID NO: 1221477 - protein, 9 aa, Homo Sapiens
GSLYIFRGQ

SEQ ID NO: 1221478 - protein, 9 aa, Homo Sapiens
LNEEMLSLK

SEQ ID NO: 1221479 - protein, 9 aa, Homo Sapiens
ERECKHHLK

SEQ ID NO: 1221480 - protein, 9 aa, Homo Sapiens
WMLHCIYET

SEQ ID NO: 1221481 - protein, 9 aa, Homo Sapiens
DDNYDRSML

SEQ ID NO: 1221482 - protein, 9 aa, Homo Sapiens
GIPALVPTP

SEQ ID NO: 1221483 - protein, 9 aa, Homo Sapiens
VVFLYMWSF

SEQ ID NO: 1221484 - protein, 9 aa, Homo Sapiens
TVAMSPLNF

SEQ ID NO: 1221485 - protein, 9 aa, Homo Sapiens
IPAPEEEWT

SEQ ID NO: 1221486 - protein, 9 aa, Homo Sapiens
IIKGVGAET

SEQ ID NO: 1221487 - protein, 9 aa, Homo Sapiens
WEELGPDGA

SEQ ID NO: 1221488 - protein, 9 aa, Homo Sapiens
IIYHFLTLP

SEQ ID NO: 1221489 - protein, 9 aa, Homo Sapiens
GYKRVLVLS

SEQ ID NO: 1221490 - protein, 9 aa, Homo Sapiens
APKDALAHQ

SEQ ID NO: 1221491 - protein, 9 aa, Homo Sapiens
YGAARPVQD

SEQ ID NO: 1221492 - protein, 9 aa, Homo Sapiens
RDKYLKVNR

SEQ ID NO: 1221493 - protein, 9 aa, Homo Sapiens
LGLTGVTMG

SEQ ID NO: 1221494 - protein, 9 aa, Homo Sapiens
LFIHISINK

SEQ ID NO: 1221495 - protein, 9 aa, Homo Sapiens
DVMSPSPDS

SEQ ID NO: 1221496 - protein, 9 aa, Homo Sapiens
KGWSGQMAD

SEQ ID NO: 1221497 - protein, 9 aa, Homo Sapiens
RSCTVVMSA

SEQ ID NO: 1221498 - protein, 9 aa, Homo Sapiens
DHNDVVTLL

SEQ ID NO: 1221499 - protein, 9 aa, Homo Sapiens
LVMEKHSSG

SEQ ID NO: 1221500 - protein, 9 aa, Homo Sapiens
SNLIRHQIT

SEQ ID NO: 1221501 - protein, 9 aa, Homo Sapiens
TKRFEKLMK

SEQ ID NO: 1221502 - protein, 9 aa, Homo Sapiens
GVALEELIR

SEQ ID NO: 1221503 - protein, 9 aa, Homo Sapiens
EERCFMCQA

SEQ ID NO: 1221504 - protein, 9 aa, Homo Sapiens
ICENFQDLM

SEQ ID NO: 1221505 - protein, 9 aa, Homo Sapiens
HAGHVLAPK

SEQ ID NO: 1221506 - protein, 9 aa, Homo Sapiens
IFQAFSYLN

SEQ ID NO: 1221507 - protein, 9 aa, Homo Sapiens
LIKGEMKEL

SEQ ID NO: 1221508 - protein, 9 aa, Homo Sapiens
SNMSFVNNC

SEQ ID NO: 1221509 - protein, 9 aa, Homo Sapiens
CIEALEWHV

SEQ ID NO: 1221510 - protein, 9 aa, Homo Sapiens
THVMSVLHE

SEQ ID NO: 1221511 - protein, 9 aa, Homo Sapiens
PGDPWSVSA

SEQ ID NO: 1221512 - protein, 9 aa, Homo Sapiens
LCAVLAALL

SEQ ID NO: 1221513 - protein, 9 aa, Homo Sapiens
PGALELVWQ

SEQ ID NO: 1221514 - protein, 9 aa, Homo Sapiens
TYTLTLWNS

SEQ ID NO: 1221515 - protein, 9 aa, Homo Sapiens
VMKQEVLPA

SEQ ID NO: 1221516 - protein, 9 aa, Homo Sapiens
TDKAYFITK

SEQ ID NO: 1221517 - protein, 9 aa, Homo Sapiens
FILWYNDGH

SEQ ID NO: 1221518 - protein, 9 aa, Homo Sapiens
EVSTVSHTD

SEQ ID NO: 1221519 - protein, 9 aa, Homo Sapiens
AIAPIPGTP

SEQ ID NO: 1221520 - protein, 9 aa, Homo Sapiens
EGYGMQELK

SEQ ID NO: 1221521 - protein, 9 aa, Homo Sapiens
NQRINKHIN

SEQ ID NO: 1221522 - protein, 9 aa, Homo Sapiens
YAYSGLLSN

SEQ ID NO: 1221523 - protein, 9 aa, Homo Sapiens
DFNEFILFI

SEQ ID NO: 1221524 - protein, 9 aa, Homo Sapiens
ENSSNQGKY

SEQ ID NO: 1221525 - protein, 9 aa, Homo Sapiens
HISSSACED

SEQ ID NO: 1221526 - protein, 9 aa, Homo Sapiens
RLVPTGTWK

SEQ ID NO: 1221527 - protein, 9 aa, Homo Sapiens
SELDLEDKL

SEQ ID NO: 1221528 - protein, 9 aa, Homo Sapiens
EENDILFCD

SEQ ID NO: 1221529 - protein, 9 aa, Homo Sapiens
TSLHPGHAF

SEQ ID NO: 1221530 - protein, 9 aa, Homo Sapiens
FQDALHKVS

SEQ ID NO: 1221531 - protein, 9 aa, Homo Sapiens
LPTDTKKSS

SEQ ID NO: 1221532 - protein, 9 aa, Homo Sapiens
EKLKFSGSL

SEQ ID NO: 1221533 - protein, 9 aa, Homo Sapiens
VARRFLEKD

SEQ ID NO: 1221534 - protein, 9 aa, Homo Sapiens
HVQYGNVPV

SEQ ID NO: 1221535 - protein, 9 aa, Homo Sapiens
RSLLEDILH

SEQ ID NO: 1221536 - protein, 9 aa, Homo Sapiens
NTILGRKYG

SEQ ID NO: 1221537 - protein, 9 aa, Homo Sapiens
YWYGGESYI

SEQ ID NO: 1221538 - protein, 9 aa, Homo Sapiens
QSQKRGLQD

SEQ ID NO: 1221539 - protein, 9 aa, Homo Sapiens
LSTNKIAGP

SEQ ID NO: 1221540 - protein, 9 aa, Homo Sapiens
KKQHLCPSQ

SEQ ID NO: 1221541 - protein, 9 aa, Homo Sapiens
DRNLIVAVA

SEQ ID NO: 1221542 - protein, 9 aa, Homo Sapiens
DNNPAIRDT

SEQ ID NO: 1221543 - protein, 9 aa, Homo Sapiens
YVRRSSSPS

SEQ ID NO: 1221544 - protein, 9 aa, Homo Sapiens
ASPGPEPAP

SEQ ID NO: 1221545 - protein, 9 aa, Homo Sapiens
MTLIQPWDP

SEQ ID NO: 1221546 - protein, 9 aa, Homo Sapiens
QASARRADS

SEQ ID NO: 1221547 - protein, 9 aa, Homo Sapiens
IFSFQTKFD

SEQ ID NO: 1221548 - protein, 9 aa, Homo Sapiens
EGERSQGLH

SEQ ID NO: 1221549 - protein, 9 aa, Homo Sapiens
WLLDCPGVS

SEQ ID NO: 1221550 - protein, 9 aa, Homo Sapiens
GLGYGYVGF

SEQ ID NO: 1221551 - protein, 9 aa, Homo Sapiens
FKTVMGIDT

SEQ ID NO: 1221552 - protein, 9 aa, Homo Sapiens
LIHFVDSEQ

SEQ ID NO: 1221553 - protein, 9 aa, Homo Sapiens
IQAGREKYS

SEQ ID NO: 1221554 - protein, 9 aa, Homo Sapiens
GVTDEVLNS

SEQ ID NO: 1221555 - protein, 9 aa, Homo Sapiens
TLHLKFLEH

SEQ ID NO: 1221556 - protein, 9 aa, Homo Sapiens
ASSDVEVES

SEQ ID NO: 1221557 - protein, 9 aa, Homo Sapiens
TERCTFLTN

SEQ ID NO: 1221558 - protein, 9 aa, Homo Sapiens
DHRKSLMII

SEQ ID NO: 1221559 - protein, 9 aa, Homo Sapiens
FPSMQQLVQ

SEQ ID NO: 1221560 - protein, 9 aa, Homo Sapiens
VCVTAHALG

SEQ ID NO: 1221561 - protein, 9 aa, Homo Sapiens
ECLTVVVVK

SEQ ID NO: 1221562 - protein, 9 aa, Homo Sapiens
SRKEILHFH

SEQ ID NO: 1221563 - protein, 9 aa, Homo Sapiens
YLVYMLAAS

SEQ ID NO: 1221564 - protein, 9 aa, Homo Sapiens
HGHSRRLHL

SEQ ID NO: 1221565 - protein, 9 aa, Homo Sapiens
VGAPYWMAP

SEQ ID NO: 1221566 - protein, 9 aa, Homo Sapiens
RCQRGLSWR

SEQ ID NO: 1221567 - protein, 9 aa, Homo Sapiens
HCLSVLFPI

SEQ ID NO: 1221568 - protein, 9 aa, Homo Sapiens
LHPQPAPAG

SEQ ID NO: 1221569 - protein, 9 aa, Homo Sapiens
IKEWAAHPL

SEQ ID NO: 1221570 - protein, 9 aa, Homo Sapiens
DTLQLWLII

SEQ ID NO: 1221571 - protein, 9 aa, Homo Sapiens
HVEVSCAHT

SEQ ID NO: 1221572 - protein, 9 aa, Homo Sapiens
AFPSKAMFW

SEQ ID NO: 1221573 - protein, 9 aa, Homo Sapiens
LTHPMPTLL

SEQ ID NO: 1221574 - protein, 9 aa, Homo Sapiens
RSKPVNEYA

SEQ ID NO: 1221575 - protein, 9 aa, Homo Sapiens
LEARMLCQL

SEQ ID NO: 1221576 - protein, 9 aa, Homo Sapiens
HRPFHLEEW

SEQ ID NO: 1221577 - protein, 9 aa, Homo Sapiens
RHDYIFKDM

SEQ ID NO: 1221578 - protein, 9 aa, Homo Sapiens
KSYVCEHEG

SEQ ID NO: 1221579 - protein, 9 aa, Homo Sapiens
HSLSAPGNL

SEQ ID NO: 1221580 - protein, 9 aa, Homo Sapiens
TLLQNKVGA

SEQ ID NO: 1221581 - protein, 9 aa, Homo Sapiens
QGRRPRTQA

SEQ ID NO: 1221582 - protein, 9 aa, Homo Sapiens
LTVKPSSPV

SEQ ID NO: 1221583 - protein, 9 aa, Homo Sapiens
FYFTVDIVH

SEQ ID NO: 1221584 - protein, 9 aa, Homo Sapiens
TVNCMSSQT

SEQ ID NO: 1221585 - protein, 9 aa, Homo Sapiens
CWKQMMKRI

SEQ ID NO: 1221586 - protein, 9 aa, Homo Sapiens
RPPLTTSAE

SEQ ID NO: 1221587 - protein, 9 aa, Homo Sapiens
ETESRVPGT

SEQ ID NO: 1221588 - protein, 9 aa, Homo Sapiens
AERRKLWLQ

SEQ ID NO: 1221589 - protein, 9 aa, Homo Sapiens
CAVIKVASL

SEQ ID NO: 1221590 - protein, 9 aa, Homo Sapiens
SSSASSSSM

SEQ ID NO: 1221591 - protein, 9 aa, Homo Sapiens
AIQALWVGG

SEQ ID NO: 1221592 - protein, 9 aa, Homo Sapiens
TRHGFLGQV

SEQ ID NO: 1221593 - protein, 9 aa, Homo Sapiens
IRRMCRIIA

SEQ ID NO: 1221594 - protein, 9 aa, Homo Sapiens
LTKDVAIQV

SEQ ID NO: 1221595 - protein, 9 aa, Homo Sapiens
SSEGGIDEH

SEQ ID NO: 1221596 - protein, 9 aa, Homo Sapiens
ADLQVNNGI

SEQ ID NO: 1221597 - protein, 9 aa, Homo Sapiens
VHISDTCSR

SEQ ID NO: 1221598 - protein, 9 aa, Homo Sapiens
LVAVLRGAV

SEQ ID NO: 1221599 - protein, 9 aa, Homo Sapiens
KASQGRSWN

SEQ ID NO: 1221600 - protein, 9 aa, Homo Sapiens
VLLDEAQKL

SEQ ID NO: 1221601 - protein, 9 aa, Homo Sapiens
QLAFAAVNM

SEQ ID NO: 1221602 - protein, 9 aa, Homo Sapiens
VDTCWGHYN

SEQ ID NO: 1221603 - protein, 9 aa, Homo Sapiens
PVLFSMFLS

SEQ ID NO: 1221604 - protein, 9 aa, Homo Sapiens
LPSIGEDTA

SEQ ID NO: 1221605 - protein, 9 aa, Homo Sapiens
EKPFKYEFC

SEQ ID NO: 1221606 - protein, 9 aa, Homo Sapiens
CKKIKAENP

SEQ ID NO: 1221607 - protein, 9 aa, Homo Sapiens
VIVKRAGSR

SEQ ID NO: 1221608 - protein, 9 aa, Homo Sapiens
SGHLGTVIL

SEQ ID NO: 1221609 - protein, 9 aa, Homo Sapiens
GSHQCSGIL

SEQ ID NO: 1221610 - protein, 9 aa, Homo Sapiens
MRTDTRGKY

SEQ ID NO: 1221611 - protein, 9 aa, Homo Sapiens
FFTIWHIIA

SEQ ID NO: 1221612 - protein, 9 aa, Homo Sapiens
TGENPYKCE

SEQ ID NO: 1221613 - protein, 9 aa, Homo Sapiens
SDLHLILCT

SEQ ID NO: 1221614 - protein, 9 aa, Homo Sapiens
GAGGPEMAA

SEQ ID NO: 1221615 - protein, 9 aa, Homo Sapiens
FCMMKLLNQ

SEQ ID NO: 1221616 - protein, 9 aa, Homo Sapiens
GFVIFTVLS

SEQ ID NO: 1221617 - protein, 9 aa, Homo Sapiens
MGPWRPVVV

SEQ ID NO: 1221618 - protein, 9 aa, Homo Sapiens
MAYDHFIAI

SEQ ID NO: 1221619 - protein, 9 aa, Homo Sapiens
FAKNFSYDK

SEQ ID NO: 1221620 - protein, 9 aa, Homo Sapiens
ALYFCVTSD

SEQ ID NO: 1221621 - protein, 9 aa, Homo Sapiens
NYNKEFLHQ

SEQ ID NO: 1221622 - protein, 9 aa, Homo Sapiens
TVTATTTTT

SEQ ID NO: 1221623 - protein, 9 aa, Homo Sapiens
NDGMFGRCQ

SEQ ID NO: 1221624 - protein, 9 aa, Homo Sapiens
QMSPGTQLT

SEQ ID NO: 1221625 - protein, 9 aa, Homo Sapiens
PDEPQKSSL

SEQ ID NO: 1221626 - protein, 9 aa, Homo Sapiens
VIKKRDQCF

SEQ ID NO: 1221627 - protein, 9 aa, Homo Sapiens
DQQVLYMVT

SEQ ID NO: 1221628 - protein, 9 aa, Homo Sapiens
SYPSDDMAV

SEQ ID NO: 1221629 - protein, 9 aa, Homo Sapiens
TEALHRVAV

SEQ ID NO: 1221630 - protein, 9 aa, Homo Sapiens
NHGYNNDFR

SEQ ID NO: 1221631 - protein, 9 aa, Homo Sapiens
RGVKFVETP

SEQ ID NO: 1221632 - protein, 9 aa, Homo Sapiens
DFPPSLLHP

SEQ ID NO: 1221633 - protein, 9 aa, Homo Sapiens
ECVIDAVRF

SEQ ID NO: 1221634 - protein, 9 aa, Homo Sapiens
RSVLRMALG

SEQ ID NO: 1221635 - protein, 9 aa, Homo Sapiens
SFSETLRRP

SEQ ID NO: 1221636 - protein, 9 aa, Homo Sapiens
LGDLIQDAP

SEQ ID NO: 1221637 - protein, 9 aa, Homo Sapiens
LLAEASILR

SEQ ID NO: 1221638 - protein, 9 aa, Homo Sapiens
LFTFIRLLP

SEQ ID NO: 1221639 - protein, 9 aa, Homo Sapiens
AHVPIIHRD

SEQ ID NO: 1221640 - protein, 9 aa, Homo Sapiens
TFSEEQASV

SEQ ID NO: 1221641 - protein, 9 aa, Homo Sapiens
AFRLCSSSG

SEQ ID NO: 1221642 - protein, 9 aa, Homo Sapiens
HEEVLADVR

SEQ ID NO: 1221643 - protein, 9 aa, Homo Sapiens
ILPEPVIRV

SEQ ID NO: 1221644 - protein, 9 aa, Homo Sapiens
TLDAFGKIN

SEQ ID NO: 1221645 - protein, 9 aa, Homo Sapiens
RKFLDTAKQ

SEQ ID NO: 1221646 - protein, 9 aa, Homo Sapiens
LVPLSKAYQ

SEQ ID NO: 1221647 - protein, 9 aa, Homo Sapiens
LEQVHSSPP

SEQ ID NO: 1221648 - protein, 9 aa, Homo Sapiens
RIPYILSQT

SEQ ID NO: 1221649 - protein, 9 aa, Homo Sapiens
ACHKKYCLK

SEQ ID NO: 1221650 - protein, 9 aa, Homo Sapiens
VATGVSTHV

SEQ ID NO: 1221651 - protein, 9 aa, Homo Sapiens
QALQATIAR

SEQ ID NO: 1221652 - protein, 9 aa, Homo Sapiens
AIKSVLSGA

SEQ ID NO: 1221653 - protein, 9 aa, Homo Sapiens
KTVYGDQSM

SEQ ID NO: 1221654 - protein, 9 aa, Homo Sapiens
AKHLQEEKE

SEQ ID NO: 1221655 - protein, 9 aa, Homo Sapiens
RLLQRMKWD

SEQ ID NO: 1221656 - protein, 9 aa, Homo Sapiens
TQDHSMDIP

SEQ ID NO: 1221657 - protein, 9 aa, Homo Sapiens
ERWRGMMRQ

SEQ ID NO: 1221658 - protein, 9 aa, Homo Sapiens
LLFTTQPFF

SEQ ID NO: 1221659 - protein, 9 aa, Homo Sapiens
APALVPRCL

SEQ ID NO: 1221660 - protein, 9 aa, Homo Sapiens
CGENIGLDQ

SEQ ID NO: 1221661 - protein, 9 aa, Homo Sapiens
RIISDPATC

SEQ ID NO: 1221662 - protein, 9 aa, Homo Sapiens
FPLTMIRVN

SEQ ID NO: 1221663 - protein, 9 aa, Homo Sapiens
TLRLVWILQ

SEQ ID NO: 1221664 - protein, 9 aa, Homo Sapiens
QISHIKYFK

SEQ ID NO: 1221665 - protein, 9 aa, Homo Sapiens
VHSTLSHDT

SEQ ID NO: 1221666 - protein, 9 aa, Homo Sapiens
ASINGSVRL

SEQ ID NO: 1221667 - protein, 9 aa, Homo Sapiens
FGHPLDIQI

SEQ ID NO: 1221668 - protein, 9 aa, Homo Sapiens
LACSRDTLP

SEQ ID NO: 1221669 - protein, 9 aa, Homo Sapiens
FEHFSALRK

SEQ ID NO: 1221670 - protein, 9 aa, Homo Sapiens
PLLFNGCHS

SEQ ID NO: 1221671 - protein, 9 aa, Homo Sapiens
PANFTWKME

SEQ ID NO: 1221672 - protein, 9 aa, Homo Sapiens
EPHLVYCYP

SEQ ID NO: 1221673 - protein, 9 aa, Homo Sapiens
TGEPPTQSI

SEQ ID NO: 1221674 - protein, 9 aa, Homo Sapiens
FEIFDLPEE

SEQ ID NO: 1221675 - protein, 9 aa, Homo Sapiens
LPWKVFTYK

SEQ ID NO: 1221676 - protein, 9 aa, Homo Sapiens
IIRAQLEFN

SEQ ID NO: 1221677 - protein, 9 aa, Homo Sapiens
TEILLSRNS

SEQ ID NO: 1221678 - protein, 9 aa, Homo Sapiens
LTIRIGAMA

SEQ ID NO: 1221679 - protein, 9 aa, Homo Sapiens
MTLSVSEHA

SEQ ID NO: 1221680 - protein, 9 aa, Homo Sapiens
SDGETPPVD

SEQ ID NO: 1221681 - protein, 9 aa, Homo Sapiens
PERNCTLPP

SEQ ID NO: 1221682 - protein, 9 aa, Homo Sapiens
EAATHLSAY

SEQ ID NO: 1221683 - protein, 9 aa, Homo Sapiens
FILMDTFED

SEQ ID NO: 1221684 - protein, 9 aa, Homo Sapiens
SPKREHLSL

SEQ ID NO: 1221685 - protein, 9 aa, Homo Sapiens
RQLAHSKMF

SEQ ID NO: 1221686 - protein, 9 aa, Homo Sapiens
QCGKCGKRF

SEQ ID NO: 1221687 - protein, 9 aa, Homo Sapiens
IYNKDGPDF

SEQ ID NO: 1221688 - protein, 9 aa, Homo Sapiens
TDNMLQSTL

SEQ ID NO: 1221689 - protein, 9 aa, Homo Sapiens
DDGGRCCLV

SEQ ID NO: 1221690 - protein, 9 aa, Homo Sapiens
CYTADIRVI

SEQ ID NO: 1221691 - protein, 9 aa, Homo Sapiens
VARGVDFHH

SEQ ID NO: 1221692 - protein, 9 aa, Homo Sapiens
ALKNPHLIF

SEQ ID NO: 1221693 - protein, 9 aa, Homo Sapiens
LVKSHTNIS

SEQ ID NO: 1221694 - protein, 9 aa, Homo Sapiens
PLRGSAGHW

SEQ ID NO: 1221695 - protein, 9 aa, Homo Sapiens
SRKKSARIC

SEQ ID NO: 1221696 - protein, 9 aa, Homo Sapiens
PLSGVVNVN

SEQ ID NO: 1221697 - protein, 9 aa, Homo Sapiens
TIVSAVTTL

SEQ ID NO: 1221698 - protein, 9 aa, Homo Sapiens
LYTTHSLIK

SEQ ID NO: 1221699 - protein, 9 aa, Homo Sapiens
PLLNNADIV

SEQ ID NO: 1221700 - protein, 9 aa, Homo Sapiens
VGETLRSNH

SEQ ID NO: 1221701 - protein, 9 aa, Homo Sapiens
RQPPERIAN

SEQ ID NO: 1221702 - protein, 9 aa, Homo Sapiens
TMTASEKTR

SEQ ID NO: 1221703 - protein, 9 aa, Homo Sapiens
IRRHSSNYR

SEQ ID NO: 1221704 - protein, 9 aa, Homo Sapiens
SCHGVMGVY

SEQ ID NO: 1221705 - protein, 9 aa, Homo Sapiens
RRCRETAVS

SEQ ID NO: 1221706 - protein, 9 aa, Homo Sapiens
LGCRTTYSN

SEQ ID NO: 1221707 - protein, 9 aa, Homo Sapiens
RQWRMLEAV

SEQ ID NO: 1221708 - protein, 9 aa, Homo Sapiens
LLVKEQGTV

SEQ ID NO: 1221709 - protein, 9 aa, Homo Sapiens
FCGEGSLQE

SEQ ID NO: 1221710 - protein, 9 aa, Homo Sapiens
LEACGMRCK

SEQ ID NO: 1221711 - protein, 9 aa, Homo Sapiens
EAAAGTGCV

SEQ ID NO: 1221712 - protein, 9 aa, Homo Sapiens
YILAEPWRQ

SEQ ID NO: 1221713 - protein, 9 aa, Homo Sapiens
EYETAATRL

SEQ ID NO: 1221714 - protein, 9 aa, Homo Sapiens
IGLIVHEGD

SEQ ID NO: 1221715 - protein, 9 aa, Homo Sapiens
LDMSDTRSS

SEQ ID NO: 1221716 - protein, 9 aa, Homo Sapiens
EVNNATTRV

SEQ ID NO: 1221717 - protein, 9 aa, Homo Sapiens
QAQAVAHIC

SEQ ID NO: 1221718 - protein, 9 aa, Homo Sapiens
TLSRRRVIT

SEQ ID NO: 1221719 - protein, 9 aa, Homo Sapiens
CAHVCRETP

SEQ ID NO: 1221720 - protein, 9 aa, Homo Sapiens
YMTSYSGNQ

SEQ ID NO: 1221721 - protein, 9 aa, Homo Sapiens
CRIIPEACR

SEQ ID NO: 1221722 - protein, 9 aa, Homo Sapiens
HYANKYNVM

SEQ ID NO: 1221723 - protein, 9 aa, Homo Sapiens
NLLKVIPVA

SEQ ID NO: 1221724 - protein, 9 aa, Homo Sapiens
EIIIRNIQE

SEQ ID NO: 1221725 - protein, 9 aa, Homo Sapiens
NSGRRYDLI

SEQ ID NO: 1221726 - protein, 9 aa, Homo Sapiens
LVDLAIMGQ

SEQ ID NO: 1221727 - protein, 9 aa, Homo Sapiens
TTGTPCLCP

SEQ ID NO: 1221728 - protein, 9 aa, Homo Sapiens
QESMRSSRR

SEQ ID NO: 1221729 - protein, 9 aa, Homo Sapiens
VKSMGNLNL

SEQ ID NO: 1221730 - protein, 9 aa, Homo Sapiens
RRDARALHH

SEQ ID NO: 1221731 - protein, 9 aa, Homo Sapiens
HVYIVGNDG

SEQ ID NO: 1221732 - protein, 9 aa, Homo Sapiens
ILKKEHTIY

SEQ ID NO: 1221733 - protein, 9 aa, Homo Sapiens
NHPFIQDLI

SEQ ID NO: 1221734 - protein, 9 aa, Homo Sapiens
ADTGDIVNI

SEQ ID NO: 1221735 - protein, 9 aa, Homo Sapiens
FSLIKKRFV

SEQ ID NO: 1221736 - protein, 9 aa, Homo Sapiens
RWSWDRHRV

SEQ ID NO: 1221737 - protein, 9 aa, Homo Sapiens
STHVLPGGQ

SEQ ID NO: 1221738 - protein, 9 aa, Homo Sapiens
VMKLVCADM

SEQ ID NO: 1221739 - protein, 9 aa, Homo Sapiens
AVVKELAEA

SEQ ID NO: 1221740 - protein, 9 aa, Homo Sapiens
IEGTQVDTR

SEQ ID NO: 1221741 - protein, 9 aa, Homo Sapiens
EPRLRLYYD

SEQ ID NO: 1221742 - protein, 9 aa, Homo Sapiens
KTFPEIINY

SEQ ID NO: 1221743 - protein, 9 aa, Homo Sapiens
DKCLAADGR

SEQ ID NO: 1221744 - protein, 9 aa, Homo Sapiens
HDQVPDLKD

SEQ ID NO: 1221745 - protein, 9 aa, Homo Sapiens
GPGRRVEYV

SEQ ID NO: 1221746 - protein, 9 aa, Homo Sapiens
SDRIKVCVW

SEQ ID NO: 1221747 - protein, 9 aa, Homo Sapiens
EAQEAEAIH

SEQ ID NO: 1221748 - protein, 9 aa, Homo Sapiens
AAMPPHIGD

SEQ ID NO: 1221749 - protein, 9 aa, Homo Sapiens
DLVTMKRLD

SEQ ID NO: 1221750 - protein, 9 aa, Homo Sapiens
DVQPPNFSW

SEQ ID NO: 1221751 - protein, 9 aa, Homo Sapiens
SGQMADGMG

SEQ ID NO: 1221752 - protein, 9 aa, Homo Sapiens
RPVSSASSS

SEQ ID NO: 1221753 - protein, 9 aa, Homo Sapiens
ASSLLHDGG

SEQ ID NO: 1221754 - protein, 9 aa, Homo Sapiens
DLTSQFLKI

SEQ ID NO: 1221755 - protein, 9 aa, Homo Sapiens
KYEWMVSRS

SEQ ID NO: 1221756 - protein, 9 aa, Homo Sapiens
RQNSVTDTN

SEQ ID NO: 1221757 - protein, 9 aa, Homo Sapiens
IIMNTALDK

SEQ ID NO: 1221758 - protein, 9 aa, Homo Sapiens
RAQIPEPLR

SEQ ID NO: 1221759 - protein, 9 aa, Homo Sapiens
PPPQLQAPM

SEQ ID NO: 1221760 - protein, 9 aa, Homo Sapiens
HLQTGCFCN

SEQ ID NO: 1221761 - protein, 9 aa, Homo Sapiens
GERQAALGP

SEQ ID NO: 1221762 - protein, 9 aa, Homo Sapiens
DCQIKNVQL

SEQ ID NO: 1221763 - protein, 9 aa, Homo Sapiens
ICARLRGAA

SEQ ID NO: 1221764 - protein, 9 aa, Homo Sapiens
LDTTGSPVQ

SEQ ID NO: 1221765 - protein, 9 aa, Homo Sapiens
LLRAGPRPG

SEQ ID NO: 1221766 - protein, 9 aa, Homo Sapiens
HHRVTLLAQ

SEQ ID NO: 1221767 - protein, 9 aa, Homo Sapiens
KRTISFLQC

SEQ ID NO: 1221768 - protein, 9 aa, Homo Sapiens
PVKFSSEPP

SEQ ID NO: 1221769 - protein, 9 aa, Homo Sapiens
AQTVSEKTI

SEQ ID NO: 1221770 - protein, 9 aa, Homo Sapiens
YYSNMVFET

SEQ ID NO: 1221771 - protein, 9 aa, Homo Sapiens
LGINVTSVA

SEQ ID NO: 1221772 - protein, 9 aa, Homo Sapiens
EGLMVKRGR

SEQ ID NO: 1221773 - protein, 9 aa, Homo Sapiens
GILSLSNIS

SEQ ID NO: 1221774 - protein, 9 aa, Homo Sapiens
IDVQVEEDK

SEQ ID NO: 1221775 - protein, 9 aa, Homo Sapiens
LHEVLAKHE

SEQ ID NO: 1221776 - protein, 9 aa, Homo Sapiens
PYGSKGDVG

SEQ ID NO: 1221777 - protein, 9 aa, Homo Sapiens
QTNMAKLLS

SEQ ID NO: 1221778 - protein, 9 aa, Homo Sapiens
YFPTVTYTT

SEQ ID NO: 1221779 - protein, 9 aa, Homo Sapiens
TREVKAKLK

SEQ ID NO: 1221780 - protein, 9 aa, Homo Sapiens
WQRGTPSYS

SEQ ID NO: 1221781 - protein, 9 aa, Homo Sapiens
KGNLIKHQQ

SEQ ID NO: 1221782 - protein, 9 aa, Homo Sapiens
HRTQPLSFL

SEQ ID NO: 1221783 - protein, 9 aa, Homo Sapiens
EAPRGYPPI

SEQ ID NO: 1221784 - protein, 9 aa, Homo Sapiens
TQGSHVWGA

SEQ ID NO: 1221785 - protein, 9 aa, Homo Sapiens
SFRMCQVNI

SEQ ID NO: 1221786 - protein, 9 aa, Homo Sapiens
NKETVVMKE

SEQ ID NO: 1221787 - protein, 9 aa, Homo Sapiens
HQKIHTRKH

SEQ ID NO: 1221788 - protein, 9 aa, Homo Sapiens
YIVTFKPFD

SEQ ID NO: 1221789 - protein, 9 aa, Homo Sapiens
LSCEEFVKS

SEQ ID NO: 1221790 - protein, 9 aa, Homo Sapiens
WGAGALRAV

SEQ ID NO: 1221791 - protein, 9 aa, Homo Sapiens
ETIAKHNQV

SEQ ID NO: 1221792 - protein, 9 aa, Homo Sapiens
QGFMGLFLA

SEQ ID NO: 1221793 - protein, 9 aa, Homo Sapiens
NYNHHTRLH

SEQ ID NO: 1221794 - protein, 9 aa, Homo Sapiens
SQDVTLGPT

SEQ ID NO: 1221795 - protein, 9 aa, Homo Sapiens
WFLLQHTQN

SEQ ID NO: 1221796 - protein, 9 aa, Homo Sapiens
ILGTAICNY

SEQ ID NO: 1221797 - protein, 9 aa, Homo Sapiens
YFIHGTRLP

SEQ ID NO: 1221798 - protein, 9 aa, Homo Sapiens
GHTPKTACV

SEQ ID NO: 1221799 - protein, 9 aa, Homo Sapiens
SQGKEHVHL

SEQ ID NO: 1221800 - protein, 9 aa, Homo Sapiens
NIYVQVINY

SEQ ID NO: 1221801 - protein, 9 aa, Homo Sapiens
ENKMNLTLD

SEQ ID NO: 1221802 - protein, 9 aa, Homo Sapiens
DGPKLAPWV

SEQ ID NO: 1221803 - protein, 9 aa, Homo Sapiens
NQEAQNQVN

SEQ ID NO: 1221804 - protein, 9 aa, Homo Sapiens
LVNVTAGVH

SEQ ID NO: 1221805 - protein, 9 aa, Homo Sapiens
PTPWLCRAP

SEQ ID NO: 1221806 - protein, 9 aa, Homo Sapiens
NFRVMNIGL

SEQ ID NO: 1221807 - protein, 9 aa, Homo Sapiens
AKPESRMLK

SEQ ID NO: 1221808 - protein, 9 aa, Homo Sapiens
MIRKVRSWT

SEQ ID NO: 1221809 - protein, 9 aa, Homo Sapiens
NVTAGVHHH

SEQ ID NO: 1221810 - protein, 9 aa, Homo Sapiens
AGCEEDMLD

SEQ ID NO: 1221811 - protein, 9 aa, Homo Sapiens
IVSGHQKNT

SEQ ID NO: 1221812 - protein, 9 aa, Homo Sapiens
PCRMEKNIL

SEQ ID NO: 1221813 - protein, 9 aa, Homo Sapiens
AWGCCGSFI

SEQ ID NO: 1221814 - protein, 9 aa, Homo Sapiens
NLDIGPPVS

SEQ ID NO: 1221815 - protein, 9 aa, Homo Sapiens
DSALEVLRC

SEQ ID NO: 1221816 - protein, 9 aa, Homo Sapiens
NIVCSGKFS

SEQ ID NO: 1221817 - protein, 9 aa, Homo Sapiens
IPLLLVVGC

SEQ ID NO: 1221818 - protein, 9 aa, Homo Sapiens
IMQKKTYVT

SEQ ID NO: 1221819 - protein, 9 aa, Homo Sapiens
LGTLCPGGR

SEQ ID NO: 1221820 - protein, 9 aa, Homo Sapiens
ACAFLEYRR

SEQ ID NO: 1221821 - protein, 9 aa, Homo Sapiens
EVGAGSSSS

SEQ ID NO: 1221822 - protein, 9 aa, Homo Sapiens
MIEERRNQS

SEQ ID NO: 1221823 - protein, 9 aa, Homo Sapiens
SGPFTDVCA

SEQ ID NO: 1221824 - protein, 9 aa, Homo Sapiens
CGYNKGYKG

SEQ ID NO: 1221825 - protein, 9 aa, Homo Sapiens
HTGEKSYNC

SEQ ID NO: 1221826 - protein, 9 aa, Homo Sapiens
PGPPSPLTL

SEQ ID NO: 1221827 - protein, 9 aa, Homo Sapiens
SQPLQCLRR

SEQ ID NO: 1221828 - protein, 9 aa, Homo Sapiens
EPRPEVAAA

SEQ ID NO: 1221829 - protein, 9 aa, Homo Sapiens
ELKVLCFFK

SEQ ID NO: 1221830 - protein, 9 aa, Homo Sapiens
AKKSCTYIR

SEQ ID NO: 1221831 - protein, 9 aa, Homo Sapiens
TLISMVNHM

SEQ ID NO: 1221832 - protein, 9 aa, Homo Sapiens
NGENTDASA

SEQ ID NO: 1221833 - protein, 9 aa, Homo Sapiens
LMRDLEGGH

SEQ ID NO: 1221834 - protein, 9 aa, Homo Sapiens
LHCIYETQS

SEQ ID NO: 1221835 - protein, 9 aa, Homo Sapiens
YEELASAIL

SEQ ID NO: 1221836 - protein, 9 aa, Homo Sapiens
CPPPPLSSV

SEQ ID NO: 1221837 - protein, 9 aa, Homo Sapiens
KKFPPSLLC

SEQ ID NO: 1221838 - protein, 9 aa, Homo Sapiens
SLEDSSMYQ

SEQ ID NO: 1221839 - protein, 9 aa, Homo Sapiens
LLFSWQGKL

SEQ ID NO: 1221840 - protein, 9 aa, Homo Sapiens
GEADASSVP

SEQ ID NO: 1221841 - protein, 9 aa, Homo Sapiens
IGFIHHNCA

SEQ ID NO: 1221842 - protein, 9 aa, Homo Sapiens
LDNVEVVQH

SEQ ID NO: 1221843 - protein, 9 aa, Homo Sapiens
YLELKKALV

SEQ ID NO: 1221844 - protein, 9 aa, Homo Sapiens
EVKEWMQKK

SEQ ID NO: 1221845 - protein, 9 aa, Homo Sapiens
YSSLTSKAQ

SEQ ID NO: 1221846 - protein, 9 aa, Homo Sapiens
QFSLAVISL

SEQ ID NO: 1221847 - protein, 9 aa, Homo Sapiens
SSAHLLYFL

SEQ ID NO: 1221848 - protein, 9 aa, Homo Sapiens
YYDILEDRV

SEQ ID NO: 1221849 - protein, 9 aa, Homo Sapiens
EEMAEYCNG

SEQ ID NO: 1221850 - protein, 9 aa, Homo Sapiens
TSTFARCSL

SEQ ID NO: 1221851 - protein, 9 aa, Homo Sapiens
KFGPIFVRL

SEQ ID NO: 1221852 - protein, 9 aa, Homo Sapiens
VAHVFLACS

SEQ ID NO: 1221853 - protein, 9 aa, Homo Sapiens
LDLFYGMVS

SEQ ID NO: 1221854 - protein, 9 aa, Homo Sapiens
PPPATLIMA

SEQ ID NO: 1221855 - protein, 9 aa, Homo Sapiens
LSYLRESGW

SEQ ID NO: 1221856 - protein, 9 aa, Homo Sapiens
HTIRCTRMV

SEQ ID NO: 1221857 - protein, 9 aa, Homo Sapiens
HFLSRDYLA

SEQ ID NO: 1221858 - protein, 9 aa, Homo Sapiens
LALTQDHSM

SEQ ID NO: 1221859 - protein, 9 aa, Homo Sapiens
DITSKLLHQ

SEQ ID NO: 1221860 - protein, 9 aa, Homo Sapiens
FENEDNSKW

SEQ ID NO: 1221861 - protein, 9 aa, Homo Sapiens
HTVYTLCIP

SEQ ID NO: 1221862 - protein, 9 aa, Homo Sapiens
NSHCTFAIE

SEQ ID NO: 1221863 - protein, 9 aa, Homo Sapiens
ASILRQHKS

SEQ ID NO: 1221864 - protein, 9 aa, Homo Sapiens
ARRADSPPS

SEQ ID NO: 1221865 - protein, 9 aa, Homo Sapiens
TLWTWMTCT

SEQ ID NO: 1221866 - protein, 9 aa, Homo Sapiens
TVPKMLVDQ

SEQ ID NO: 1221867 - protein, 9 aa, Homo Sapiens
APCHDQVLI

SEQ ID NO: 1221868 - protein, 9 aa, Homo Sapiens
VKKSIQSKL

SEQ ID NO: 1221869 - protein, 9 aa, Homo Sapiens
NTSPSIPSP

SEQ ID NO: 1221870 - protein, 9 aa, Homo Sapiens
LPSGTRGPG

SEQ ID NO: 1221871 - protein, 9 aa, Homo Sapiens
YDPQQHKVT

SEQ ID NO: 1221872 - protein, 9 aa, Homo Sapiens
DSWTALECA

SEQ ID NO: 1221873 - protein, 9 aa, Homo Sapiens
SVFYSFHHI

SEQ ID NO: 1221874 - protein, 9 aa, Homo Sapiens
SSSLTPPTS

SEQ ID NO: 1221875 - protein, 9 aa, Homo Sapiens
DSPTSLSEN

SEQ ID NO: 1221876 - protein, 9 aa, Homo Sapiens
NNGFRNYNT

SEQ ID NO: 1221877 - protein, 9 aa, Homo Sapiens
LRSNHPPSL

SEQ ID NO: 1221878 - protein, 9 aa, Homo Sapiens
DPTFALLGF

SEQ ID NO: 1221879 - protein, 9 aa, Homo Sapiens
VCMIAIVLA

SEQ ID NO: 1221880 - protein, 9 aa, Homo Sapiens
FPKPTLWDE

SEQ ID NO: 1221881 - protein, 9 aa, Homo Sapiens
FSESSTLLH

SEQ ID NO: 1221882 - protein, 9 aa, Homo Sapiens
VKLDKPGEG

SEQ ID NO: 1221883 - protein, 9 aa, Homo Sapiens
GHIEMGHLI

SEQ ID NO: 1221884 - protein, 9 aa, Homo Sapiens
VLEGNNLVY

SEQ ID NO: 1221885 - protein, 9 aa, Homo Sapiens
ACLLNTSPK

SEQ ID NO: 1221886 - protein, 9 aa, Homo Sapiens
SDIVQNGRL

SEQ ID NO: 1221887 - protein, 9 aa, Homo Sapiens
LYVPVKRSH

SEQ ID NO: 1221888 - protein, 9 aa, Homo Sapiens
LSDLSFLDI

SEQ ID NO: 1221889 - protein, 9 aa, Homo Sapiens
TLAEHLAGC

SEQ ID NO: 1221890 - protein, 9 aa, Homo Sapiens
NRQEREKQL

SEQ ID NO: 1221891 - protein, 9 aa, Homo Sapiens
MRCKSLLTR

SEQ ID NO: 1221892 - protein, 9 aa, Homo Sapiens
AKDDTIGQV

SEQ ID NO: 1221893 - protein, 9 aa, Homo Sapiens
VRAVLSEDA

SEQ ID NO: 1221894 - protein, 9 aa, Homo Sapiens
HEIQRKSGY

SEQ ID NO: 1221895 - protein, 9 aa, Homo Sapiens
LRHSTTRDR

SEQ ID NO: 1221896 - protein, 9 aa, Homo Sapiens
EKIRNVFQC

SEQ ID NO: 1221897 - protein, 9 aa, Homo Sapiens
IIPLPDIDH

SEQ ID NO: 1221898 - protein, 9 aa, Homo Sapiens
TAHFGSALV

SEQ ID NO: 1221899 - protein, 9 aa, Homo Sapiens
FKNKPFRHV

SEQ ID NO: 1221900 - protein, 9 aa, Homo Sapiens
GGLRIEGHL

SEQ ID NO: 1221901 - protein, 9 aa, Homo Sapiens
QEWDLTKSL

SEQ ID NO: 1221902 - protein, 9 aa, Homo Sapiens
RVIDGKEAK

SEQ ID NO: 1221903 - protein, 9 aa, Homo Sapiens
KLQLCLPLL

SEQ ID NO: 1221904 - protein, 9 aa, Homo Sapiens
KPQKKEKLH

SEQ ID NO: 1221905 - protein, 9 aa, Homo Sapiens
WWGEEVAVK

SEQ ID NO: 1221906 - protein, 9 aa, Homo Sapiens
GMSTDVSRY

SEQ ID NO: 1221907 - protein, 9 aa, Homo Sapiens
AAVEEKQRQ

SEQ ID NO: 1221908 - protein, 9 aa, Homo Sapiens
HVSKVGSRP

SEQ ID NO: 1221909 - protein, 9 aa, Homo Sapiens
QSKEGSLDS

SEQ ID NO: 1221910 - protein, 9 aa, Homo Sapiens
ARSPVFNAI

SEQ ID NO: 1221911 - protein, 9 aa, Homo Sapiens
DTTKCFAKR

SEQ ID NO: 1221912 - protein, 9 aa, Homo Sapiens
IVHEGDAVY

SEQ ID NO: 1221913 - protein, 9 aa, Homo Sapiens
LLEKFGLHT

SEQ ID NO: 1221914 - protein, 9 aa, Homo Sapiens
YTPKVIECF

SEQ ID NO: 1221915 - protein, 9 aa, Homo Sapiens
GFGKLYPHR

SEQ ID NO: 1221916 - protein, 9 aa, Homo Sapiens
YLRERSMAP

SEQ ID NO: 1221917 - protein, 9 aa, Homo Sapiens
HRHTHTQAY

SEQ ID NO: 1221918 - protein, 9 aa, Homo Sapiens
RHTGMHRHT

SEQ ID NO: 1221919 - protein, 9 aa, Homo Sapiens
LRTSPSWAA

SEQ ID NO: 1221920 - protein, 9 aa, Homo Sapiens
GWYQTCSNN

SEQ ID NO: 1221921 - protein, 9 aa, Homo Sapiens
YQHHSLRAI

SEQ ID NO: 1221922 - protein, 9 aa, Homo Sapiens
TGALWHIYA

SEQ ID NO: 1221923 - protein, 9 aa, Homo Sapiens
KMTLIQPWD

SEQ ID NO: 1221924 - protein, 9 aa, Homo Sapiens
HNIYVQVIN

SEQ ID NO: 1221925 - protein, 9 aa, Homo Sapiens
ACAHHDAPA

SEQ ID NO: 1221926 - protein, 9 aa, Homo Sapiens
YNFPKEIPG

SEQ ID NO: 1221927 - protein, 9 aa, Homo Sapiens
NMVFETGQF

SEQ ID NO: 1221928 - protein, 9 aa, Homo Sapiens
RTEPSMATT

SEQ ID NO: 1221929 - protein, 9 aa, Homo Sapiens
SNFSNQTAY

SEQ ID NO: 1221930 - protein, 9 aa, Homo Sapiens
HVLAFLGMA

SEQ ID NO: 1221931 - protein, 9 aa, Homo Sapiens
GFLSSVSPS

SEQ ID NO: 1221932 - protein, 9 aa, Homo Sapiens
TCPRCILTT

SEQ ID NO: 1221933 - protein, 9 aa, Homo Sapiens
IHLCCKPYL

SEQ ID NO: 1221934 - protein, 9 aa, Homo Sapiens
RCLRCFPQP

SEQ ID NO: 1221935 - protein, 9 aa, Homo Sapiens
VLTATADHS

SEQ ID NO: 1221936 - protein, 9 aa, Homo Sapiens
AQTDQHLNN

SEQ ID NO: 1221937 - protein, 9 aa, Homo Sapiens
CEDMGQFIK

SEQ ID NO: 1221938 - protein, 9 aa, Homo Sapiens
GASLCFLAY

SEQ ID NO: 1221939 - protein, 9 aa, Homo Sapiens
YSFHHIDSV

SEQ ID NO: 1221940 - protein, 9 aa, Homo Sapiens
NFMKDAAEG

SEQ ID NO: 1221941 - protein, 9 aa, Homo Sapiens
DNLPRGSRT

SEQ ID NO: 1221942 - protein, 9 aa, Homo Sapiens
ITLIWTAPR

SEQ ID NO: 1221943 - protein, 9 aa, Homo Sapiens
VREIKLFSK

SEQ ID NO: 1221944 - protein, 9 aa, Homo Sapiens
NVDLMNCTW

SEQ ID NO: 1221945 - protein, 9 aa, Homo Sapiens
SDDMKSEEI

SEQ ID NO: 1221946 - protein, 9 aa, Homo Sapiens
TVEEVCSFF

SEQ ID NO: 1221947 - protein, 9 aa, Homo Sapiens
NFRNSFVLN

SEQ ID NO: 1221948 - protein, 9 aa, Homo Sapiens
AVRIGIVFI

SEQ ID NO: 1221949 - protein, 9 aa, Homo Sapiens
KNHTRKNPF

SEQ ID NO: 1221950 - protein, 9 aa, Homo Sapiens
QQNICVIAA

SEQ ID NO: 1221951 - protein, 9 aa, Homo Sapiens
GTQKRFLKY

SEQ ID NO: 1221952 - protein, 9 aa, Homo Sapiens
RIKSFENMA

SEQ ID NO: 1221953 - protein, 9 aa, Homo Sapiens
SGTEGKLHF

SEQ ID NO: 1221954 - protein, 9 aa, Homo Sapiens
HYLSKTSES

SEQ ID NO: 1221955 - protein, 9 aa, Homo Sapiens
NVAGIFYIL

SEQ ID NO: 1221956 - protein, 9 aa, Homo Sapiens
SPEFPFQCD

SEQ ID NO: 1221957 - protein, 9 aa, Homo Sapiens
RKTQCMPRK

SEQ ID NO: 1221958 - protein, 9 aa, Homo Sapiens
TISGDMRGI

SEQ ID NO: 1221959 - protein, 9 aa, Homo Sapiens
VDFDEFVEL

SEQ ID NO: 1221960 - protein, 9 aa, Homo Sapiens
WSCIFFIVY

SEQ ID NO: 1221961 - protein, 9 aa, Homo Sapiens
VWMPRMRQL

SEQ ID NO: 1221962 - protein, 9 aa, Homo Sapiens
LLDKHHTPP

SEQ ID NO: 1221963 - protein, 9 aa, Homo Sapiens
VNLENRLLS

SEQ ID NO: 1221964 - protein, 9 aa, Homo Sapiens
FSIINIYKE

SEQ ID NO: 1221965 - protein, 9 aa, Homo Sapiens
RLVVDGLRV

SEQ ID NO: 1221966 - protein, 9 aa, Homo Sapiens
SLDAELQAK

SEQ ID NO: 1221967 - protein, 9 aa, Homo Sapiens
HLTQYHGGS

SEQ ID NO: 1221968 - protein, 9 aa, Homo Sapiens
NPCNTKIWF

SEQ ID NO: 1221969 - protein, 9 aa, Homo Sapiens
FKLNHKSLT

SEQ ID NO: 1221970 - protein, 9 aa, Homo Sapiens
ELNASLGSW

SEQ ID NO: 1221971 - protein, 9 aa, Homo Sapiens
EADASSVPT

SEQ ID NO: 1221972 - protein, 9 aa, Homo Sapiens
WVAYSFSNC

SEQ ID NO: 1221973 - protein, 9 aa, Homo Sapiens
VLVQLVNYY

SEQ ID NO: 1221974 - protein, 9 aa, Homo Sapiens
KISSVVLKA

SEQ ID NO: 1221975 - protein, 9 aa, Homo Sapiens
NKSILTSAL

SEQ ID NO: 1221976 - protein, 9 aa, Homo Sapiens
SGHLEEFPV

SEQ ID NO: 1221977 - protein, 9 aa, Homo Sapiens
GREKKSHPS

SEQ ID NO: 1221978 - protein, 9 aa, Homo Sapiens
GSLNAGAFL

SEQ ID NO: 1221979 - protein, 9 aa, Homo Sapiens
CSTCSRACS

SEQ ID NO: 1221980 - protein, 9 aa, Homo Sapiens
TDQRISPAS

SEQ ID NO: 1221981 - protein, 9 aa, Homo Sapiens
TLYCVPMST

SEQ ID NO: 1221982 - protein, 9 aa, Homo Sapiens
QNTLLELMS

SEQ ID NO: 1221983 - protein, 9 aa, Homo Sapiens
ELPLKEMGK

SEQ ID NO: 1221984 - protein, 9 aa, Homo Sapiens
EWKLSESGT

SEQ ID NO: 1221985 - protein, 9 aa, Homo Sapiens
VCGRSWDPE

SEQ ID NO: 1221986 - protein, 9 aa, Homo Sapiens
IVNWYIHLK

SEQ ID NO: 1221987 - protein, 9 aa, Homo Sapiens
EPAPEWAII

SEQ ID NO: 1221988 - protein, 9 aa, Homo Sapiens
IPWTQIPQG

SEQ ID NO: 1221989 - protein, 9 aa, Homo Sapiens
ASTLWYLSI

SEQ ID NO: 1221990 - protein, 9 aa, Homo Sapiens
RIPTHPFEE

SEQ ID NO: 1221991 - protein, 9 aa, Homo Sapiens
ILSQLEEER

SEQ ID NO: 1221992 - protein, 9 aa, Homo Sapiens
RKKAENRQE

SEQ ID NO: 1221993 - protein, 9 aa, Homo Sapiens
HHEVISKEI

SEQ ID NO: 1221994 - protein, 9 aa, Homo Sapiens
GNSYDIYIH

SEQ ID NO: 1221995 - protein, 9 aa, Homo Sapiens
QYSNVYYPT

SEQ ID NO: 1221996 - protein, 9 aa, Homo Sapiens
ISVPRHEQI

SEQ ID NO: 1221997 - protein, 9 aa, Homo Sapiens
QVTAEDLDW

SEQ ID NO: 1221998 - protein, 9 aa, Homo Sapiens
QFSKDFSDY

SEQ ID NO: 1221999 - protein, 9 aa, Homo Sapiens
HSSAFHHSV

SEQ ID NO: 1222000 - protein, 9 aa, Homo Sapiens
IPPAMNARL

SEQ ID NO: 1222001 - protein, 9 aa, Homo Sapiens
DHVRCSVMV

SEQ ID NO: 1222002 - protein, 9 aa, Homo Sapiens
PSLGLVAGI

SEQ ID NO: 1222003 - protein, 9 aa, Homo Sapiens
GLAEYMFDK

SEQ ID NO: 1222004 - protein, 9 aa, Homo Sapiens
HRESEEVLQ

SEQ ID NO: 1222005 - protein, 9 aa, Homo Sapiens
VLRDTANHL

SEQ ID NO: 1222006 - protein, 9 aa, Homo Sapiens
IQGAKRIGS

SEQ ID NO: 1222007 - protein, 9 aa, Homo Sapiens
GRREPVELG

SEQ ID NO: 1222008 - protein, 9 aa, Homo Sapiens
TICSPECSC

SEQ ID NO: 1222009 - protein, 9 aa, Homo Sapiens
GASAPCGAA

SEQ ID NO: 1222010 - protein, 9 aa, Homo Sapiens
RAKTVLTII

SEQ ID NO: 1222011 - protein, 9 aa, Homo Sapiens
DKKHKLEIK

SEQ ID NO: 1222012 - protein, 9 aa, Homo Sapiens
RLQNNQCYN

SEQ ID NO: 1222013 - protein, 9 aa, Homo Sapiens
NENPDESTY

SEQ ID NO: 1222014 - protein, 9 aa, Homo Sapiens
HRVIATHSP

SEQ ID NO: 1222015 - protein, 9 aa, Homo Sapiens
MMERRETLA

SEQ ID NO: 1222016 - protein, 9 aa, Homo Sapiens
DEEHPRKRG

SEQ ID NO: 1222017 - protein, 9 aa, Homo Sapiens
VLIRYQSFK

SEQ ID NO: 1222018 - protein, 9 aa, Homo Sapiens
DLALHTAAC

SEQ ID NO: 1222019 - protein, 9 aa, Homo Sapiens
LSQCQRDLH

SEQ ID NO: 1222020 - protein, 9 aa, Homo Sapiens
YLRVIQGDE

SEQ ID NO: 1222021 - protein, 9 aa, Homo Sapiens
CAVCGEIQS

SEQ ID NO: 1222022 - protein, 9 aa, Homo Sapiens
LHLINIRHP

SEQ ID NO: 1222023 - protein, 9 aa, Homo Sapiens
EGRTIYLRP

SEQ ID NO: 1222024 - protein, 9 aa, Homo Sapiens
DIGPLQGEH

SEQ ID NO: 1222025 - protein, 9 aa, Homo Sapiens
STARAKGWA

SEQ ID NO: 1222026 - protein, 9 aa, Homo Sapiens
IYPYFGLFY

SEQ ID NO: 1222027 - protein, 9 aa, Homo Sapiens
FLPKRLQQN

SEQ ID NO: 1222028 - protein, 9 aa, Homo Sapiens
KKNLRTMEQ

SEQ ID NO: 1222029 - protein, 9 aa, Homo Sapiens
NVKAAIIEE

SEQ ID NO: 1222030 - protein, 9 aa, Homo Sapiens
EEHGHQSHS

SEQ ID NO: 1222031 - protein, 9 aa, Homo Sapiens
PLWTLESLL

SEQ ID NO: 1222032 - protein, 9 aa, Homo Sapiens
AQAISCFAY

SEQ ID NO: 1222033 - protein, 9 aa, Homo Sapiens
DFGCPFTMT

SEQ ID NO: 1222034 - protein, 9 aa, Homo Sapiens
VEENEHMRL

SEQ ID NO: 1222035 - protein, 9 aa, Homo Sapiens
YGKAFTWSS

SEQ ID NO: 1222036 - protein, 9 aa, Homo Sapiens
GHSASVPSS

SEQ ID NO: 1222037 - protein, 9 aa, Homo Sapiens
QDLQMKMRR

SEQ ID NO: 1222038 - protein, 9 aa, Homo Sapiens
MKQGVLTHD

SEQ ID NO: 1222039 - protein, 9 aa, Homo Sapiens
DDPSGVILT

SEQ ID NO: 1222040 - protein, 9 aa, Homo Sapiens
EDGSRAIHH

SEQ ID NO: 1222041 - protein, 9 aa, Homo Sapiens
ALIHAHWDA

SEQ ID NO: 1222042 - protein, 9 aa, Homo Sapiens
YVCCLNVGL

SEQ ID NO: 1222043 - protein, 9 aa, Homo Sapiens
DTWWFGTVE

SEQ ID NO: 1222044 - protein, 9 aa, Homo Sapiens
RPQLQSVVG

SEQ ID NO: 1222045 - protein, 9 aa, Homo Sapiens
MAYLIYRLP

SEQ ID NO: 1222046 - protein, 9 aa, Homo Sapiens
DYSELVSID

SEQ ID NO: 1222047 - protein, 9 aa, Homo Sapiens
TLIQPWDPL

SEQ ID NO: 1222048 - protein, 9 aa, Homo Sapiens
EERERLTRQ

SEQ ID NO: 1222049 - protein, 9 aa, Homo Sapiens
SRGAADDRV

SEQ ID NO: 1222050 - protein, 9 aa, Homo Sapiens
EGKIYKYDR

SEQ ID NO: 1222051 - protein, 9 aa, Homo Sapiens
TKPSQVLEG

SEQ ID NO: 1222052 - protein, 9 aa, Homo Sapiens
SQNEGHGGA

SEQ ID NO: 1222053 - protein, 9 aa, Homo Sapiens
GSLPSVNQI

SEQ ID NO: 1222054 - protein, 9 aa, Homo Sapiens
LADLALHTA

SEQ ID NO: 1222055 - protein, 9 aa, Homo Sapiens
GAGKTMISF

SEQ ID NO: 1222056 - protein, 9 aa, Homo Sapiens
PFLVLQILL

SEQ ID NO: 1222057 - protein, 9 aa, Homo Sapiens
WGNMQSLSG

SEQ ID NO: 1222058 - protein, 9 aa, Homo Sapiens
RIKGEGDMT

SEQ ID NO: 1222059 - protein, 9 aa, Homo Sapiens
EWFECKNAD

SEQ ID NO: 1222060 - protein, 9 aa, Homo Sapiens
RAWSMVGRL

SEQ ID NO: 1222061 - protein, 9 aa, Homo Sapiens
MADGDNFNE

SEQ ID NO: 1222062 - protein, 9 aa, Homo Sapiens
RRDTSLETA

SEQ ID NO: 1222063 - protein, 9 aa, Homo Sapiens
ACTNGPPCT

SEQ ID NO: 1222064 - protein, 9 aa, Homo Sapiens
IAKYHKLKY

SEQ ID NO: 1222065 - protein, 9 aa, Homo Sapiens
NHKMCIIAF

SEQ ID NO: 1222066 - protein, 9 aa, Homo Sapiens
LEVWRSRRD

SEQ ID NO: 1222067 - protein, 9 aa, Homo Sapiens
CGIGINAEL

SEQ ID NO: 1222068 - protein, 9 aa, Homo Sapiens
PAIILFSRS

SEQ ID NO: 1222069 - protein, 9 aa, Homo Sapiens
EEATMFSNA

SEQ ID NO: 1222070 - protein, 9 aa, Homo Sapiens
TLAEGLIET

SEQ ID NO: 1222071 - protein, 9 aa, Homo Sapiens
SPHLLCKAP

SEQ ID NO: 1222072 - protein, 9 aa, Homo Sapiens
LRRPMYSRL

SEQ ID NO: 1222073 - protein, 9 aa, Homo Sapiens
HHRRSSGSR

SEQ ID NO: 1222074 - protein, 9 aa, Homo Sapiens
ELKFTPQDA

SEQ ID NO: 1222075 - protein, 9 aa, Homo Sapiens
MREVDFDAF

SEQ ID NO: 1222076 - protein, 9 aa, Homo Sapiens
MSLAKKVII

SEQ ID NO: 1222077 - protein, 9 aa, Homo Sapiens
QPLQCLRRA

SEQ ID NO: 1222078 - protein, 9 aa, Homo Sapiens
DAFVCRIIC

SEQ ID NO: 1222079 - protein, 9 aa, Homo Sapiens
RRLHLQITR

SEQ ID NO: 1222080 - protein, 9 aa, Homo Sapiens
LAGWTCRDE

SEQ ID NO: 1222081 - protein, 9 aa, Homo Sapiens
EKSDEDGDK

SEQ ID NO: 1222082 - protein, 9 aa, Homo Sapiens
AVPEAADMD

SEQ ID NO: 1222083 - protein, 9 aa, Homo Sapiens
KCFAKRLAE

SEQ ID NO: 1222084 - protein, 9 aa, Homo Sapiens
VRDAKNIIP

SEQ ID NO: 1222085 - protein, 9 aa, Homo Sapiens
YCWVIGNQS

SEQ ID NO: 1222086 - protein, 9 aa, Homo Sapiens
GDFYYGWAV

SEQ ID NO: 1222087 - protein, 9 aa, Homo Sapiens
QMVSSNVLQ

SEQ ID NO: 1222088 - protein, 9 aa, Homo Sapiens
KTVEKETVL

SEQ ID NO: 1222089 - protein, 9 aa, Homo Sapiens
KEREEDRCP

SEQ ID NO: 1222090 - protein, 9 aa, Homo Sapiens
VWCHLETHD

SEQ ID NO: 1222091 - protein, 9 aa, Homo Sapiens
PKEEQKMQS

SEQ ID NO: 1222092 - protein, 9 aa, Homo Sapiens
EAWQWGGCR

SEQ ID NO: 1222093 - protein, 9 aa, Homo Sapiens
HMKSHTEHR

SEQ ID NO: 1222094 - protein, 9 aa, Homo Sapiens
LLLPTQDEK

SEQ ID NO: 1222095 - protein, 9 aa, Homo Sapiens
GCGRGHRRR

SEQ ID NO: 1222096 - protein, 9 aa, Homo Sapiens
AAQRAYGQR

SEQ ID NO: 1222097 - protein, 9 aa, Homo Sapiens
IKQTCFSVL

SEQ ID NO: 1222098 - protein, 9 aa, Homo Sapiens
QEDVATARR

SEQ ID NO: 1222099 - protein, 9 aa, Homo Sapiens
PFNPTLPPG

SEQ ID NO: 1222100 - protein, 9 aa, Homo Sapiens
LLVTLLLTL

SEQ ID NO: 1222101 - protein, 9 aa, Homo Sapiens
WTSLVLIWI

SEQ ID NO: 1222102 - protein, 9 aa, Homo Sapiens
ATIPYHPKP

SEQ ID NO: 1222103 - protein, 9 aa, Homo Sapiens
QTALYFCVT

SEQ ID NO: 1222104 - protein, 9 aa, Homo Sapiens
DFASLTFEG

SEQ ID NO: 1222105 - protein, 9 aa, Homo Sapiens
SVVTSDKRA

SEQ ID NO: 1222106 - protein, 9 aa, Homo Sapiens
EVIGKSKPK

SEQ ID NO: 1222107 - protein, 9 aa, Homo Sapiens
EEILNAFRL

SEQ ID NO: 1222108 - protein, 9 aa, Homo Sapiens
IIFVSVLTL

SEQ ID NO: 1222109 - protein, 9 aa, Homo Sapiens
ICGTPEFLA

SEQ ID NO: 1222110 - protein, 9 aa, Homo Sapiens
NTASINIHA

SEQ ID NO: 1222111 - protein, 9 aa, Homo Sapiens
DTDDERSHF

SEQ ID NO: 1222112 - protein, 9 aa, Homo Sapiens
SLLLQGYRF

SEQ ID NO: 1222113 - protein, 9 aa, Homo Sapiens
KVVAVFYTI

SEQ ID NO: 1222114 - protein, 9 aa, Homo Sapiens
TFMERVKKY

SEQ ID NO: 1222115 - protein, 9 aa, Homo Sapiens
IRNSESGNS

SEQ ID NO: 1222116 - protein, 9 aa, Homo Sapiens
NHKALDPAH

SEQ ID NO: 1222117 - protein, 9 aa, Homo Sapiens
AGPTADEEE

SEQ ID NO: 1222118 - protein, 9 aa, Homo Sapiens
VLEDEATYT

SEQ ID NO: 1222119 - protein, 9 aa, Homo Sapiens
CRMDPTWHP

SEQ ID NO: 1222120 - protein, 9 aa, Homo Sapiens
SKKEINIIE

SEQ ID NO: 1222121 - protein, 9 aa, Homo Sapiens
NNGLSFEEL

SEQ ID NO: 1222122 - protein, 9 aa, Homo Sapiens
EVWRGKWWG

SEQ ID NO: 1222123 - protein, 9 aa, Homo Sapiens
DTCYRETCP

SEQ ID NO: 1222124 - protein, 9 aa, Homo Sapiens
GSRPDRQPD

SEQ ID NO: 1222125 - protein, 9 aa, Homo Sapiens
NKETFWCER

SEQ ID NO: 1222126 - protein, 9 aa, Homo Sapiens
TAHCLQVQN

SEQ ID NO: 1222127 - protein, 9 aa, Homo Sapiens
QSMHRELRE

SEQ ID NO: 1222128 - protein, 9 aa, Homo Sapiens
QHSPMWDNP

SEQ ID NO: 1222129 - protein, 9 aa, Homo Sapiens
TNIDLLLEA

SEQ ID NO: 1222130 - protein, 9 aa, Homo Sapiens
PPLLPLPQL

SEQ ID NO: 1222131 - protein, 9 aa, Homo Sapiens
HIQQPLDIL

SEQ ID NO: 1222132 - protein, 9 aa, Homo Sapiens
YLSKTSESS

SEQ ID NO: 1222133 - protein, 9 aa, Homo Sapiens
VVALLLGVV

SEQ ID NO: 1222134 - protein, 9 aa, Homo Sapiens
CILTNFRVM

SEQ ID NO: 1222135 - protein, 9 aa, Homo Sapiens
KNEIQDLQM

SEQ ID NO: 1222136 - protein, 9 aa, Homo Sapiens
KVIRNIVCS

SEQ ID NO: 1222137 - protein, 9 aa, Homo Sapiens
RPSSCFHPR

SEQ ID NO: 1222138 - protein, 9 aa, Homo Sapiens
HQSQIYGCS

SEQ ID NO: 1222139 - protein, 9 aa, Homo Sapiens
KHQHTNVCF

SEQ ID NO: 1222140 - protein, 9 aa, Homo Sapiens
DIPDRPTGI

SEQ ID NO: 1222141 - protein, 9 aa, Homo Sapiens
PEAGLAEYM

SEQ ID NO: 1222142 - protein, 9 aa, Homo Sapiens
GRHLRNLLK

SEQ ID NO: 1222143 - protein, 9 aa, Homo Sapiens
YAVMKNFGT

SEQ ID NO: 1222144 - protein, 9 aa, Homo Sapiens
AEEGRTIYL

SEQ ID NO: 1222145 - protein, 9 aa, Homo Sapiens
ERLNAELVV

SEQ ID NO: 1222146 - protein, 9 aa, Homo Sapiens
RGVCVTAHA

SEQ ID NO: 1222147 - protein, 9 aa, Homo Sapiens
QAHGDPAPP

SEQ ID NO: 1222148 - protein, 9 aa, Homo Sapiens
NERERNHVK

SEQ ID NO: 1222149 - protein, 9 aa, Homo Sapiens
LDKVQIHDV

SEQ ID NO: 1222150 - protein, 9 aa, Homo Sapiens
ALKEYGVMC

SEQ ID NO: 1222151 - protein, 9 aa, Homo Sapiens
NALRRMYTA

SEQ ID NO: 1222152 - protein, 9 aa, Homo Sapiens
DLNVCCESE

SEQ ID NO: 1222153 - protein, 9 aa, Homo Sapiens
SGYLVSRFA

SEQ ID NO: 1222154 - protein, 9 aa, Homo Sapiens
PAGHEWRYY

SEQ ID NO: 1222155 - protein, 9 aa, Homo Sapiens
NQFLCLKRH

SEQ ID NO: 1222156 - protein, 9 aa, Homo Sapiens
VTVKTDVCR

SEQ ID NO: 1222157 - protein, 9 aa, Homo Sapiens
YKAKTFQID

SEQ ID NO: 1222158 - protein, 9 aa, Homo Sapiens
TEIGPKRDH

SEQ ID NO: 1222159 - protein, 9 aa, Homo Sapiens
HDNIYMPRK

SEQ ID NO: 1222160 - protein, 9 aa, Homo Sapiens
GDFAWERVW

SEQ ID NO: 1222161 - protein, 9 aa, Homo Sapiens
ATQLLHHPF

SEQ ID NO: 1222162 - protein, 9 aa, Homo Sapiens
NSGTGFWTG

SEQ ID NO: 1222163 - protein, 9 aa, Homo Sapiens
SWSCPSSPS

SEQ ID NO: 1222164 - protein, 9 aa, Homo Sapiens
KHVPGPGKL

SEQ ID NO: 1222165 - protein, 9 aa, Homo Sapiens
FPVWSPRGR

SEQ ID NO: 1222166 - protein, 9 aa, Homo Sapiens
GHRRRGLSH

SEQ ID NO: 1222167 - protein, 9 aa, Homo Sapiens
RQAVKQVPK

SEQ ID NO: 1222168 - protein, 9 aa, Homo Sapiens
QHVDLLGAQ

SEQ ID NO: 1222169 - protein, 9 aa, Homo Sapiens
NGTNMTLPA

SEQ ID NO: 1222170 - protein, 9 aa, Homo Sapiens
IGASLCFLA

SEQ ID NO: 1222171 - protein, 9 aa, Homo Sapiens
LHYKVLIFT

SEQ ID NO: 1222172 - protein, 9 aa, Homo Sapiens
PEEAAGPTA

SEQ ID NO: 1222173 - protein, 9 aa, Homo Sapiens
TQEHIEAIL

SEQ ID NO: 1222174 - protein, 9 aa, Homo Sapiens
QCGEASWAL

SEQ ID NO: 1222175 - protein, 9 aa, Homo Sapiens
GSPPFRLHL

SEQ ID NO: 1222176 - protein, 9 aa, Homo Sapiens
AAGHTPKTA

SEQ ID NO: 1222177 - protein, 9 aa, Homo Sapiens
FGLDILTKL

SEQ ID NO: 1222178 - protein, 9 aa, Homo Sapiens
PLRPLQEGK

SEQ ID NO: 1222179 - protein, 9 aa, Homo Sapiens
RWHTKKLPH

SEQ ID NO: 1222180 - protein, 9 aa, Homo Sapiens
GPEFIQMSN

SEQ ID NO: 1222181 - protein, 9 aa, Homo Sapiens
NAFMVNGQK

SEQ ID NO: 1222182 - protein, 9 aa, Homo Sapiens
HIKFGDFDI

SEQ ID NO: 1222183 - protein, 9 aa, Homo Sapiens
YMPRKYQVE

SEQ ID NO: 1222184 - protein, 9 aa, Homo Sapiens
SGGKKIPLV

SEQ ID NO: 1222185 - protein, 9 aa, Homo Sapiens
PNLCGVSKP

SEQ ID NO: 1222186 - protein, 9 aa, Homo Sapiens
RTHAYTREC

SEQ ID NO: 1222187 - protein, 9 aa, Homo Sapiens
YKPTPILIK

SEQ ID NO: 1222188 - protein, 9 aa, Homo Sapiens
LPSPGCVLY

SEQ ID NO: 1222189 - protein, 9 aa, Homo Sapiens
LPTIYKHQK

SEQ ID NO: 1222190 - protein, 9 aa, Homo Sapiens
ETMQDIRFH

SEQ ID NO: 1222191 - protein, 9 aa, Homo Sapiens
GRSGNSPMA

SEQ ID NO: 1222192 - protein, 9 aa, Homo Sapiens
LFDLEVNYL

SEQ ID NO: 1222193 - protein, 9 aa, Homo Sapiens
SNLQHVVII

SEQ ID NO: 1222194 - protein, 9 aa, Homo Sapiens
ASAPLSSMG

SEQ ID NO: 1222195 - protein, 9 aa, Homo Sapiens
YLDANIATS

SEQ ID NO: 1222196 - protein, 9 aa, Homo Sapiens
ALPDWLKDN

SEQ ID NO: 1222197 - protein, 9 aa, Homo Sapiens
YHFGTGTPA

SEQ ID NO: 1222198 - protein, 9 aa, Homo Sapiens
RWCSIVRSH

SEQ ID NO: 1222199 - protein, 9 aa, Homo Sapiens
DIGAYSYPM

SEQ ID NO: 1222200 - protein, 9 aa, Homo Sapiens
SLILYETHH

SEQ ID NO: 1222201 - protein, 9 aa, Homo Sapiens
SRAIHHKTF

SEQ ID NO: 1222202 - protein, 9 aa, Homo Sapiens
HRRAREQTV

SEQ ID NO: 1222203 - protein, 9 aa, Homo Sapiens
SGHDSTSVD

SEQ ID NO: 1222204 - protein, 9 aa, Homo Sapiens
NSEIWNASE

SEQ ID NO: 1222205 - protein, 9 aa, Homo Sapiens
LSPAADAPV

SEQ ID NO: 1222206 - protein, 9 aa, Homo Sapiens
TRAQQPYKS

SEQ ID NO: 1222207 - protein, 9 aa, Homo Sapiens
TNYLGYAIT

SEQ ID NO: 1222208 - protein, 9 aa, Homo Sapiens
ETLSWIFSG

SEQ ID NO: 1222209 - protein, 9 aa, Homo Sapiens
NEHGRHRKI

SEQ ID NO: 1222210 - protein, 9 aa, Homo Sapiens
LSLAVGIAF

SEQ ID NO: 1222211 - protein, 9 aa, Homo Sapiens
FIRGVGPDL

SEQ ID NO: 1222212 - protein, 9 aa, Homo Sapiens
SMHVERSTL

SEQ ID NO: 1222213 - protein, 9 aa, Homo Sapiens
GSHVWGADA

SEQ ID NO: 1222214 - protein, 9 aa, Homo Sapiens
SSEDPVLTT

SEQ ID NO: 1222215 - protein, 9 aa, Homo Sapiens
RKCGCRMVH

SEQ ID NO: 1222216 - protein, 9 aa, Homo Sapiens
NPSIFPESK

SEQ ID NO: 1222217 - protein, 9 aa, Homo Sapiens
SVSCGRGNQ

SEQ ID NO: 1222218 - protein, 9 aa, Homo Sapiens
NQHYGWHPA

SEQ ID NO: 1222219 - protein, 9 aa, Homo Sapiens
VGGYDTFME

SEQ ID NO: 1222220 - protein, 9 aa, Homo Sapiens
WMNERGRDQ

SEQ ID NO: 1222221 - protein, 9 aa, Homo Sapiens
RRDGTGHYM

SEQ ID NO: 1222222 - protein, 9 aa, Homo Sapiens
DVLQQYCMV

SEQ ID NO: 1222223 - protein, 9 aa, Homo Sapiens
SYGTGGHMM

SEQ ID NO: 1222224 - protein, 9 aa, Homo Sapiens
KSNWIQEER

SEQ ID NO: 1222225 - protein, 9 aa, Homo Sapiens
VITVHYLDE

SEQ ID NO: 1222226 - protein, 9 aa, Homo Sapiens
PDGRALRDA

SEQ ID NO: 1222227 - protein, 9 aa, Homo Sapiens
VAVFLWDFY

SEQ ID NO: 1222228 - protein, 9 aa, Homo Sapiens
SKATNGSAA

SEQ ID NO: 1222229 - protein, 9 aa, Homo Sapiens
KLDLKKNVM

SEQ ID NO: 1222230 - protein, 9 aa, Homo Sapiens
RRAYLFAHV

SEQ ID NO: 1222231 - protein, 9 aa, Homo Sapiens
GYRPAGHEW

SEQ ID NO: 1222232 - protein, 9 aa, Homo Sapiens
SQAVDQALI

SEQ ID NO: 1222233 - protein, 9 aa, Homo Sapiens
TQTMSCLNK

SEQ ID NO: 1222234 - protein, 9 aa, Homo Sapiens
RETERIIPF

SEQ ID NO: 1222235 - protein, 9 aa, Homo Sapiens
TVEYSFSLI

SEQ ID NO: 1222236 - protein, 9 aa, Homo Sapiens
VNTSWRVAS

SEQ ID NO: 1222237 - protein, 9 aa, Homo Sapiens
LNFETTEES

SEQ ID NO: 1222238 - protein, 9 aa, Homo Sapiens
PEECHLSPS

SEQ ID NO: 1222239 - protein, 9 aa, Homo Sapiens
YKSKSAGNL

SEQ ID NO: 1222240 - protein, 9 aa, Homo Sapiens
LEAMFSMKT

SEQ ID NO: 1222241 - protein, 9 aa, Homo Sapiens
LVGKPVFVM

SEQ ID NO: 1222242 - protein, 9 aa, Homo Sapiens
IWLWKLMII

SEQ ID NO: 1222243 - protein, 9 aa, Homo Sapiens
RPSSTSSSG

SEQ ID NO: 1222244 - protein, 9 aa, Homo Sapiens
SCFIYNVDL

SEQ ID NO: 1222245 - protein, 9 aa, Homo Sapiens
QAEANTPQD

SEQ ID NO: 1222246 - protein, 9 aa, Homo Sapiens
TMSLAKKVI

SEQ ID NO: 1222247 - protein, 9 aa, Homo Sapiens
KNKISKIEI

SEQ ID NO: 1222248 - protein, 9 aa, Homo Sapiens
QRNAMHTSQ

SEQ ID NO: 1222249 - protein, 9 aa, Homo Sapiens
DVVPAFHSL

SEQ ID NO: 1222250 - protein, 9 aa, Homo Sapiens
QLIGTMQPF

SEQ ID NO: 1222251 - protein, 9 aa, Homo Sapiens
GLLLEAGGG

SEQ ID NO: 1222252 - protein, 9 aa, Homo Sapiens
MPTMVSVKL

SEQ ID NO: 1222253 - protein, 9 aa, Homo Sapiens
VAKWITKIE

SEQ ID NO: 1222254 - protein, 9 aa, Homo Sapiens
MSQQKRFLA

SEQ ID NO: 1222255 - protein, 9 aa, Homo Sapiens
PCHDQVLIK

SEQ ID NO: 1222256 - protein, 9 aa, Homo Sapiens
NFSKSRHDM

SEQ ID NO: 1222257 - protein, 9 aa, Homo Sapiens
SDMHFIFTI

SEQ ID NO: 1222258 - protein, 9 aa, Homo Sapiens
DHNQTAGRT

SEQ ID NO: 1222259 - protein, 9 aa, Homo Sapiens
DYKPTRMLN

SEQ ID NO: 1222260 - protein, 9 aa, Homo Sapiens
NDVPTIFLC

SEQ ID NO: 1222261 - protein, 9 aa, Homo Sapiens
AIRKHLVKN

SEQ ID NO: 1222262 - protein, 9 aa, Homo Sapiens
SEHRPSFSG

SEQ ID NO: 1222263 - protein, 9 aa, Homo Sapiens
SKDWGWVEQ

SEQ ID NO: 1222264 - protein, 9 aa, Homo Sapiens
ILQGLVDGV

SEQ ID NO: 1222265 - protein, 9 aa, Homo Sapiens
AASAPAPPG

SEQ ID NO: 1222266 - protein, 9 aa, Homo Sapiens
ANYFGEIMK

SEQ ID NO: 1222267 - protein, 9 aa, Homo Sapiens
SRLKDFSFH

SEQ ID NO: 1222268 - protein, 9 aa, Homo Sapiens
ENPEVKEFF

SEQ ID NO: 1222269 - protein, 9 aa, Homo Sapiens
PSYESRCQN

SEQ ID NO: 1222270 - protein, 9 aa, Homo Sapiens
TVTYTTMIH

SEQ ID NO: 1222271 - protein, 9 aa, Homo Sapiens
GSSLCIIGG

SEQ ID NO: 1222272 - protein, 9 aa, Homo Sapiens
PHPYIKMYI

SEQ ID NO: 1222273 - protein, 9 aa, Homo Sapiens
AGEKPYTCS

SEQ ID NO: 1222274 - protein, 9 aa, Homo Sapiens
MILIGNVYT

SEQ ID NO: 1222275 - protein, 9 aa, Homo Sapiens
NQPLMELLF

SEQ ID NO: 1222276 - protein, 9 aa, Homo Sapiens
SVPLSQGSS

SEQ ID NO: 1222277 - protein, 9 aa, Homo Sapiens
MFMGRVTNP

SEQ ID NO: 1222278 - protein, 9 aa, Homo Sapiens
SEKEVLLIG

SEQ ID NO: 1222279 - protein, 9 aa, Homo Sapiens
DFLVQMQGV

SEQ ID NO: 1222280 - protein, 9 aa, Homo Sapiens
AHDGHPSSF

SEQ ID NO: 1222281 - protein, 9 aa, Homo Sapiens
STPRAPDSR

SEQ ID NO: 1222282 - protein, 9 aa, Homo Sapiens
RPRNIVSRR

SEQ ID NO: 1222283 - protein, 9 aa, Homo Sapiens
KWDADEESI

SEQ ID NO: 1222284 - protein, 9 aa, Homo Sapiens
LRENMTPAN

SEQ ID NO: 1222285 - protein, 9 aa, Homo Sapiens
ANVFLILHF

SEQ ID NO: 1222286 - protein, 9 aa, Homo Sapiens
RQWDDRGAG

SEQ ID NO: 1222287 - protein, 9 aa, Homo Sapiens
APFVYTYLH

SEQ ID NO: 1222288 - protein, 9 aa, Homo Sapiens
DIFTELERC

SEQ ID NO: 1222289 - protein, 9 aa, Homo Sapiens
RPTYSCFSS

SEQ ID NO: 1222290 - protein, 9 aa, Homo Sapiens
PAHNGMMGI

SEQ ID NO: 1222291 - protein, 9 aa, Homo Sapiens
LLKRFRKSE

SEQ ID NO: 1222292 - protein, 9 aa, Homo Sapiens
ENINKAQEV

SEQ ID NO: 1222293 - protein, 9 aa, Homo Sapiens
AQRAYGQRG

SEQ ID NO: 1222294 - protein, 9 aa, Homo Sapiens
SARVHYYQS

SEQ ID NO: 1222295 - protein, 9 aa, Homo Sapiens
PDSFGGPGG

SEQ ID NO: 1222296 - protein, 9 aa, Homo Sapiens
LMITCMYTG

SEQ ID NO: 1222297 - protein, 9 aa, Homo Sapiens
GSSGENKKT

SEQ ID NO: 1222298 - protein, 9 aa, Homo Sapiens
CLSLTMSSA

SEQ ID NO: 1222299 - protein, 9 aa, Homo Sapiens
WDGGSLLGV

SEQ ID NO: 1222300 - protein, 9 aa, Homo Sapiens
EWARQGAEE

SEQ ID NO: 1222301 - protein, 9 aa, Homo Sapiens
QEEKHKVEE

SEQ ID NO: 1222302 - protein, 9 aa, Homo Sapiens
RLKLKHRDL

SEQ ID NO: 1222303 - protein, 9 aa, Homo Sapiens
TTSSTRKVS

SEQ ID NO: 1222304 - protein, 9 aa, Homo Sapiens
AQTGTHRHI

SEQ ID NO: 1222305 - protein, 9 aa, Homo Sapiens
HEKETIYLN

SEQ ID NO: 1222306 - protein, 9 aa, Homo Sapiens
STRSRPSST

SEQ ID NO: 1222307 - protein, 9 aa, Homo Sapiens
DMGMGGFSQ

SEQ ID NO: 1222308 - protein, 9 aa, Homo Sapiens
DSEPETQHR

SEQ ID NO: 1222309 - protein, 9 aa, Homo Sapiens
LVLLSMTVT

SEQ ID NO: 1222310 - protein, 9 aa, Homo Sapiens
PGAWEELGP

SEQ ID NO: 1222311 - protein, 9 aa, Homo Sapiens
CSQEECIEF

SEQ ID NO: 1222312 - protein, 9 aa, Homo Sapiens
AETVGHFSQ

SEQ ID NO: 1222313 - protein, 9 aa, Homo Sapiens
ALLTEREEC

SEQ ID NO: 1222314 - protein, 9 aa, Homo Sapiens
VLPFMLAEF

SEQ ID NO: 1222315 - protein, 9 aa, Homo Sapiens
LGLSGYPMI

SEQ ID NO: 1222316 - protein, 9 aa, Homo Sapiens
YTEVELKHP

SEQ ID NO: 1222317 - protein, 9 aa, Homo Sapiens
PYWSSLWPC

SEQ ID NO: 1222318 - protein, 9 aa, Homo Sapiens
LGTHTVVVM

SEQ ID NO: 1222319 - protein, 9 aa, Homo Sapiens
LSPDSLGSF

SEQ ID NO: 1222320 - protein, 9 aa, Homo Sapiens
IMIFPEGIC

SEQ ID NO: 1222321 - protein, 9 aa, Homo Sapiens
KDTTENENT

SEQ ID NO: 1222322 - protein, 9 aa, Homo Sapiens
KFFFGDVPA

SEQ ID NO: 1222323 - protein, 9 aa, Homo Sapiens
VGSVLDKPL

SEQ ID NO: 1222324 - protein, 8 aa, Homo Sapiens
DSTACLKS

SEQ ID NO: 1222325 - protein, 9 aa, Homo Sapiens
TILGRNMSG

SEQ ID NO: 1222326 - protein, 9 aa, Homo Sapiens
AHLIAIICA

SEQ ID NO: 1222327 - protein, 9 aa, Homo Sapiens
FSHICVIGL

SEQ ID NO: 1222328 - protein, 9 aa, Homo Sapiens
ADLCHQHAT

SEQ ID NO: 1222329 - protein, 9 aa, Homo Sapiens
FRMPSRVHY

SEQ ID NO: 1222330 - protein, 9 aa, Homo Sapiens
PRTESPPPL

SEQ ID NO: 1222331 - protein, 9 aa, Homo Sapiens
YIFRHNQQK

SEQ ID NO: 1222332 - protein, 9 aa, Homo Sapiens
QTLCNGSNC

SEQ ID NO: 1222333 - protein, 9 aa, Homo Sapiens
MHDSFSHSR

SEQ ID NO: 1222334 - protein, 9 aa, Homo Sapiens
RAVLSEDAR

SEQ ID NO: 1222335 - protein, 9 aa, Homo Sapiens
VVYMAVKEL

SEQ ID NO: 1222336 - protein, 9 aa, Homo Sapiens
SWAPPSATR

SEQ ID NO: 1222337 - protein, 9 aa, Homo Sapiens
GVRYTGTTR

SEQ ID NO: 1222338 - protein, 9 aa, Homo Sapiens
NVINMDNFQ

SEQ ID NO: 1222339 - protein, 9 aa, Homo Sapiens
VKIGFFQGD

SEQ ID NO: 1222340 - protein, 9 aa, Homo Sapiens
SGLRTHTGS

SEQ ID NO: 1222341 - protein, 9 aa, Homo Sapiens
SAQIRCPKG

SEQ ID NO: 1222342 - protein, 9 aa, Homo Sapiens
SVLTLLYLA

SEQ ID NO: 1222343 - protein, 9 aa, Homo Sapiens
HTSSNLERM

SEQ ID NO: 1222344 - protein, 9 aa, Homo Sapiens
HIPESEDKY

SEQ ID NO: 1222345 - protein, 9 aa, Homo Sapiens
FSKDFSDYG

SEQ ID NO: 1222346 - protein, 9 aa, Homo Sapiens
AAAIVIIIG

SEQ ID NO: 1222347 - protein, 9 aa, Homo Sapiens
KVMIPLLQI

SEQ ID NO: 1222348 - protein, 9 aa, Homo Sapiens
LPEHVSSGG

SEQ ID NO: 1222349 - protein, 9 aa, Homo Sapiens
QQAGAPPPP

SEQ ID NO: 1222350 - protein, 9 aa, Homo Sapiens
LVSENVEPF

SEQ ID NO: 1222351 - protein, 9 aa, Homo Sapiens
LSLMATEIE

SEQ ID NO: 1222352 - protein, 9 aa, Homo Sapiens
EMRKTAEDL

SEQ ID NO: 1222353 - protein, 9 aa, Homo Sapiens
LYVVHCNSR

SEQ ID NO: 1222354 - protein, 9 aa, Homo Sapiens
LLNLDIGPP

SEQ ID NO: 1222355 - protein, 9 aa, Homo Sapiens
RAQQPYKSL

SEQ ID NO: 1222356 - protein, 9 aa, Homo Sapiens
KSKQKKEEK

SEQ ID NO: 1222357 - protein, 9 aa, Homo Sapiens
VLEGQVTQS

SEQ ID NO: 1222358 - protein, 9 aa, Homo Sapiens
FSKGLWMEY

SEQ ID NO: 1222359 - protein, 9 aa, Homo Sapiens
LGGKTIAVG

SEQ ID NO: 1222360 - protein, 9 aa, Homo Sapiens
QTLVTMVTA

SEQ ID NO: 1222361 - protein, 9 aa, Homo Sapiens
KTNLARHHR

SEQ ID NO: 1222362 - protein, 9 aa, Homo Sapiens
PPATLIMAS

SEQ ID NO: 1222363 - protein, 9 aa, Homo Sapiens
ECKDLINFM

SEQ ID NO: 1222364 - protein, 9 aa, Homo Sapiens
IVNQPLVGE

SEQ ID NO: 1222365 - protein, 9 aa, Homo Sapiens
GYWTDRGCE

SEQ ID NO: 1222366 - protein, 9 aa, Homo Sapiens
NVPIYEGYT

SEQ ID NO: 1222367 - protein, 9 aa, Homo Sapiens
ALSEQLGQE

SEQ ID NO: 1222368 - protein, 9 aa, Homo Sapiens
SPLTIYHAI

SEQ ID NO: 1222369 - protein, 9 aa, Homo Sapiens
TPPSPYHAD

SEQ ID NO: 1222370 - protein, 9 aa, Homo Sapiens
LFNGCHSGE

SEQ ID NO: 1222371 - protein, 9 aa, Homo Sapiens
NQTALYFCV

SEQ ID NO: 1222372 - protein, 9 aa, Homo Sapiens
TNKQAVPGF

SEQ ID NO: 1222373 - protein, 9 aa, Homo Sapiens
SDFIPVACL

SEQ ID NO: 1222374 - protein, 9 aa, Homo Sapiens
QEIRRELEE

SEQ ID NO: 1222375 - protein, 9 aa, Homo Sapiens
PEWDMVTPE

SEQ ID NO: 1222376 - protein, 9 aa, Homo Sapiens
LLEWCGWQS

SEQ ID NO: 1222377 - protein, 9 aa, Homo Sapiens
SEHPDIHKL

SEQ ID NO: 1222378 - protein, 9 aa, Homo Sapiens
ETVKAGHHF

SEQ ID NO: 1222379 - protein, 9 aa, Homo Sapiens
EATNVILME

SEQ ID NO: 1222380 - protein, 9 aa, Homo Sapiens
KGSQLQKTH

SEQ ID NO: 1222381 - protein, 9 aa, Homo Sapiens
KGTPSYDAT

SEQ ID NO: 1222382 - protein, 9 aa, Homo Sapiens
TLDWMFWYS

SEQ ID NO: 1222383 - protein, 9 aa, Homo Sapiens
AYFITKEVS

SEQ ID NO: 1222384 - protein, 9 aa, Homo Sapiens
LQDLEELAV

SEQ ID NO: 1222385 - protein, 9 aa, Homo Sapiens
KAVITETQR

SEQ ID NO: 1222386 - protein, 9 aa, Homo Sapiens
GHVTFDDIA

SEQ ID NO: 1222387 - protein, 9 aa, Homo Sapiens
SAEICQYVI

SEQ ID NO: 1222388 - protein, 9 aa, Homo Sapiens
ILYISMQLL

SEQ ID NO: 1222389 - protein, 9 aa, Homo Sapiens
YMSFSTALH

SEQ ID NO: 1222390 - protein, 9 aa, Homo Sapiens
PVFSTSTLL

SEQ ID NO: 1222391 - protein, 9 aa, Homo Sapiens
TPPRTQEVI

SEQ ID NO: 1222392 - protein, 9 aa, Homo Sapiens
LSPDANVKT

SEQ ID NO: 1222393 - protein, 9 aa, Homo Sapiens
ICLGSFETY

SEQ ID NO: 1222394 - protein, 9 aa, Homo Sapiens
ALLDQNPDI

SEQ ID NO: 1222395 - protein, 9 aa, Homo Sapiens
RDCASPSRP

SEQ ID NO: 1222396 - protein, 9 aa, Homo Sapiens
FEIHIAMCD

SEQ ID NO: 1222397 - protein, 9 aa, Homo Sapiens
SRREFHSID

SEQ ID NO: 1222398 - protein, 9 aa, Homo Sapiens
LAKTFSRGS

SEQ ID NO: 1222399 - protein, 9 aa, Homo Sapiens
EGEPSDPYD

SEQ ID NO: 1222400 - protein, 9 aa, Homo Sapiens
TFMEKYMKA

SEQ ID NO: 1222401 - protein, 9 aa, Homo Sapiens
TVVGAVSAQ

SEQ ID NO: 1222402 - protein, 9 aa, Homo Sapiens
DETEDELDE

SEQ ID NO: 1222403 - protein, 9 aa, Homo Sapiens
ERPSYHLKK

SEQ ID NO: 1222404 - protein, 9 aa, Homo Sapiens
TAHTTMAGL

SEQ ID NO: 1222405 - protein, 9 aa, Homo Sapiens
AGDKIATRK

SEQ ID NO: 1222406 - protein, 9 aa, Homo Sapiens
FRHPAISPK

SEQ ID NO: 1222407 - protein, 9 aa, Homo Sapiens
RCTIHNGHG

SEQ ID NO: 1222408 - protein, 9 aa, Homo Sapiens
AIMCWASDT

SEQ ID NO: 1222409 - protein, 9 aa, Homo Sapiens
GLMMGISHQ

SEQ ID NO: 1222410 - protein, 9 aa, Homo Sapiens
RHLNINGAL

SEQ ID NO: 1222411 - protein, 9 aa, Homo Sapiens
TYRYSEKPM

SEQ ID NO: 1222412 - protein, 9 aa, Homo Sapiens
HGGEMFSHL

SEQ ID NO: 1222413 - protein, 9 aa, Homo Sapiens
RRFLEKDRD

SEQ ID NO: 1222414 - protein, 9 aa, Homo Sapiens
AGYTPFANS

SEQ ID NO: 1222415 - protein, 9 aa, Homo Sapiens
LEVNYLTKI

SEQ ID NO: 1222416 - protein, 9 aa, Homo Sapiens
TPHWRLCGI

SEQ ID NO: 1222417 - protein, 9 aa, Homo Sapiens
SLLLTADLC

SEQ ID NO: 1222418 - protein, 9 aa, Homo Sapiens
SWYPGFNCE

SEQ ID NO: 1222419 - protein, 9 aa, Homo Sapiens
FRGRSAALK

SEQ ID NO: 1222420 - protein, 9 aa, Homo Sapiens
NKLFPQVIS

SEQ ID NO: 1222421 - protein, 9 aa, Homo Sapiens
QMGNLEDTE

SEQ ID NO: 1222422 - protein, 9 aa, Homo Sapiens
SRRCPISRT

SEQ ID NO: 1222423 - protein, 9 aa, Homo Sapiens
GLAKGRGGG

SEQ ID NO: 1222424 - protein, 9 aa, Homo Sapiens
SVGHIPESE

SEQ ID NO: 1222425 - protein, 9 aa, Homo Sapiens
LMRPLCLVT

SEQ ID NO: 1222426 - protein, 9 aa, Homo Sapiens
TATAATSPG

SEQ ID NO: 1222427 - protein, 9 aa, Homo Sapiens
SHAMESATR

SEQ ID NO: 1222428 - protein, 9 aa, Homo Sapiens
GDVPASLDA

SEQ ID NO: 1222429 - protein, 9 aa, Homo Sapiens
CKFSTPTTP

SEQ ID NO: 1222430 - protein, 9 aa, Homo Sapiens
EVKKVMTCP

SEQ ID NO: 1222431 - protein, 9 aa, Homo Sapiens
HGHQSHSSS

SEQ ID NO: 1222432 - protein, 9 aa, Homo Sapiens
PDQTDDIPG

SEQ ID NO: 1222433 - protein, 9 aa, Homo Sapiens
RRFRSVRSR

SEQ ID NO: 1222434 - protein, 9 aa, Homo Sapiens
NVCWLLCGC

SEQ ID NO: 1222435 - protein, 9 aa, Homo Sapiens
SDEVAWLKM

SEQ ID NO: 1222436 - protein, 9 aa, Homo Sapiens
SLLRTIHSV

SEQ ID NO: 1222437 - protein, 9 aa, Homo Sapiens
TLKQHPALE

SEQ ID NO: 1222438 - protein, 9 aa, Homo Sapiens
DMGYVRMIR

SEQ ID NO: 1222439 - protein, 9 aa, Homo Sapiens
LPQGSQYSV

SEQ ID NO: 1222440 - protein, 9 aa, Homo Sapiens
IVRAFTVCW

SEQ ID NO: 1222441 - protein, 9 aa, Homo Sapiens
VLPHPTPPP

SEQ ID NO: 1222442 - protein, 9 aa, Homo Sapiens
LPRPQLQSV

SEQ ID NO: 1222443 - protein, 9 aa, Homo Sapiens
LWENMGQKE

SEQ ID NO: 1222444 - protein, 9 aa, Homo Sapiens
HFDDNQCGN

SEQ ID NO: 1222445 - protein, 9 aa, Homo Sapiens
WQLEEECTN

SEQ ID NO: 1222446 - protein, 9 aa, Homo Sapiens
ICRRSLSED

SEQ ID NO: 1222447 - protein, 9 aa, Homo Sapiens
KHYSWSTSF

SEQ ID NO: 1222448 - protein, 9 aa, Homo Sapiens
PYGTFGMYC

SEQ ID NO: 1222449 - protein, 9 aa, Homo Sapiens
KHRKPRKQN

SEQ ID NO: 1222450 - protein, 9 aa, Homo Sapiens
KHGGSSGDR

SEQ ID NO: 1222451 - protein, 9 aa, Homo Sapiens
PSGTSISSI

SEQ ID NO: 1222452 - protein, 9 aa, Homo Sapiens
KQFKKVSEE

SEQ ID NO: 1222453 - protein, 9 aa, Homo Sapiens
KSLPARQDM

SEQ ID NO: 1222454 - protein, 9 aa, Homo Sapiens
DLGPNMRGF

SEQ ID NO: 1222455 - protein, 9 aa, Homo Sapiens
GYMKALDGF

SEQ ID NO: 1222456 - protein, 9 aa, Homo Sapiens
GKLKKSFDT

SEQ ID NO: 1222457 - protein, 9 aa, Homo Sapiens
EFHTTTTTG

SEQ ID NO: 1222458 - protein, 9 aa, Homo Sapiens
GDDDSGEGP

SEQ ID NO: 1222459 - protein, 9 aa, Homo Sapiens
CITLGYTNS

SEQ ID NO: 1222460 - protein, 9 aa, Homo Sapiens
NTYYSADIN

SEQ ID NO: 1222461 - protein, 9 aa, Homo Sapiens
GADRSYGRD

SEQ ID NO: 1222462 - protein, 9 aa, Homo Sapiens
APYGTRYVG

SEQ ID NO: 1222463 - protein, 9 aa, Homo Sapiens
FCRRRRLPY

SEQ ID NO: 1222464 - protein, 9 aa, Homo Sapiens
KNTTVSHEM

SEQ ID NO: 1222465 - protein, 9 aa, Homo Sapiens
LLFSLHRMP

SEQ ID NO: 1222466 - protein, 9 aa, Homo Sapiens
AKSICRMLS

SEQ ID NO: 1222467 - protein, 9 aa, Homo Sapiens
PSAIMSPFY

SEQ ID NO: 1222468 - protein, 9 aa, Homo Sapiens
IFFVLLGIT

SEQ ID NO: 1222469 - protein, 9 aa, Homo Sapiens
YCNTGDVCY

SEQ ID NO: 1222470 - protein, 9 aa, Homo Sapiens
IDIKNTVYI

SEQ ID NO: 1222471 - protein, 9 aa, Homo Sapiens
QELPEHVSS

SEQ ID NO: 1222472 - protein, 9 aa, Homo Sapiens
IDGYFPTVT

SEQ ID NO: 1222473 - protein, 9 aa, Homo Sapiens
EEMYWNEGD

SEQ ID NO: 1222474 - protein, 9 aa, Homo Sapiens
AGISYSTLP

SEQ ID NO: 1222475 - protein, 9 aa, Homo Sapiens
LQPVLVGLF

SEQ ID NO: 1222476 - protein, 9 aa, Homo Sapiens
LTLNGSNVA

SEQ ID NO: 1222477 - protein, 9 aa, Homo Sapiens
SVNGRRMAD

SEQ ID NO: 1222478 - protein, 9 aa, Homo Sapiens
ALHEDFHAS

SEQ ID NO: 1222479 - protein, 9 aa, Homo Sapiens
SPLAKVNRE

SEQ ID NO: 1222480 - protein, 9 aa, Homo Sapiens
FLYMWSFCF

SEQ ID NO: 1222481 - protein, 9 aa, Homo Sapiens
PYASKSETH

SEQ ID NO: 1222482 - protein, 9 aa, Homo Sapiens
SQGIGPAGE

SEQ ID NO: 1222483 - protein, 9 aa, Homo Sapiens
IQTSDASFL

SEQ ID NO: 1222484 - protein, 9 aa, Homo Sapiens
DVNLNDNTG

SEQ ID NO: 1222485 - protein, 9 aa, Homo Sapiens
LERQNQECQ

SEQ ID NO: 1222486 - protein, 9 aa, Homo Sapiens
DALIVYAKT

SEQ ID NO: 1222487 - protein, 9 aa, Homo Sapiens
SVWDANVPK

SEQ ID NO: 1222488 - protein, 9 aa, Homo Sapiens
MYVEKIDVG

SEQ ID NO: 1222489 - protein, 9 aa, Homo Sapiens
SWHCSMAAN

SEQ ID NO: 1222490 - protein, 9 aa, Homo Sapiens
EINPVHYPG

SEQ ID NO: 1222491 - protein, 9 aa, Homo Sapiens
VMTVTLSTK

SEQ ID NO: 1222492 - protein, 9 aa, Homo Sapiens
TPSGTHSSR

SEQ ID NO: 1222493 - protein, 9 aa, Homo Sapiens
KLTSLPEPR

SEQ ID NO: 1222494 - protein, 9 aa, Homo Sapiens
AVGTMADDQ

SEQ ID NO: 1222495 - protein, 9 aa, Homo Sapiens
YPGPSGDVG

SEQ ID NO: 1222496 - protein, 9 aa, Homo Sapiens
LTFQGLDAL

SEQ ID NO: 1222497 - protein, 9 aa, Homo Sapiens
KCLKQSGHG

SEQ ID NO: 1222498 - protein, 9 aa, Homo Sapiens
AGREKYSTS

SEQ ID NO: 1222499 - protein, 9 aa, Homo Sapiens
REIKLFSKE

SEQ ID NO: 1222500 - protein, 9 aa, Homo Sapiens
EGICTNRTC

SEQ ID NO: 1222501 - protein, 9 aa, Homo Sapiens
LGCVAHVFL

SEQ ID NO: 1222502 - protein, 9 aa, Homo Sapiens
LRDTMTPGE

SEQ ID NO: 1222503 - protein, 9 aa, Homo Sapiens
SKKKTKVAR

SEQ ID NO: 1222504 - protein, 9 aa, Homo Sapiens
SVRPQELVG

SEQ ID NO: 1222505 - protein, 9 aa, Homo Sapiens
EILQYCFEE

SEQ ID NO: 1222506 - protein, 9 aa, Homo Sapiens
IAVSSIQRE

SEQ ID NO: 1222507 - protein, 9 aa, Homo Sapiens
GNAPGFYIS

SEQ ID NO: 1222508 - protein, 9 aa, Homo Sapiens
RCLVCGRLS

SEQ ID NO: 1222509 - protein, 9 aa, Homo Sapiens
PFAPKEASG

SEQ ID NO: 1222510 - protein, 9 aa, Homo Sapiens
EDATTAMDL

SEQ ID NO: 1222511 - protein, 9 aa, Homo Sapiens
AHRSQKSRS

SEQ ID NO: 1222512 - protein, 9 aa, Homo Sapiens
THRHIHSRT

SEQ ID NO: 1222513 - protein, 9 aa, Homo Sapiens
NEADMTLIY

SEQ ID NO: 1222514 - protein, 9 aa, Homo Sapiens
GVDFHHVSA

SEQ ID NO: 1222515 - protein, 9 aa, Homo Sapiens
QLIDEKAGG

SEQ ID NO: 1222516 - protein, 9 aa, Homo Sapiens
GIQTSDASF

SEQ ID NO: 1222517 - protein, 9 aa, Homo Sapiens
ILMVGMDAA

SEQ ID NO: 1222518 - protein, 9 aa, Homo Sapiens
IKLFKCPKG

SEQ ID NO: 1222519 - protein, 9 aa, Homo Sapiens
NEWHYGGLT

SEQ ID NO: 1222520 - protein, 9 aa, Homo Sapiens
ENLLTDDVE

SEQ ID NO: 1222521 - protein, 9 aa, Homo Sapiens
LMKLEQQST

SEQ ID NO: 1222522 - protein, 9 aa, Homo Sapiens
KQATKGKRP

SEQ ID NO: 1222523 - protein, 9 aa, Homo Sapiens
FEAQGNNRL

SEQ ID NO: 1222524 - protein, 9 aa, Homo Sapiens
YRGRCDSIH

SEQ ID NO: 1222525 - protein, 9 aa, Homo Sapiens
WSRRFHLNL

SEQ ID NO: 1222526 - protein, 9 aa, Homo Sapiens
NVYGIPDFL

SEQ ID NO: 1222527 - protein, 9 aa, Homo Sapiens
TRLGRRSKR

SEQ ID NO: 1222528 - protein, 9 aa, Homo Sapiens
AVTTLSLRL

SEQ ID NO: 1222529 - protein, 9 aa, Homo Sapiens
RKAFKKWTH

SEQ ID NO: 1222530 - protein, 9 aa, Homo Sapiens
QCRLRYLLD

SEQ ID NO: 1222531 - protein, 9 aa, Homo Sapiens
CERGFTAMN

SEQ ID NO: 1222532 - protein, 9 aa, Homo Sapiens
LTSVDATSS

SEQ ID NO: 1222533 - protein, 9 aa, Homo Sapiens
VVQVNNGDA

SEQ ID NO: 1222534 - protein, 9 aa, Homo Sapiens
LWGWRPYEI

SEQ ID NO: 1222535 - protein, 9 aa, Homo Sapiens
NEIREDEEH

SEQ ID NO: 1222536 - protein, 9 aa, Homo Sapiens
PDLLTPGED

SEQ ID NO: 1222537 - protein, 9 aa, Homo Sapiens
LQFLHEHKT

SEQ ID NO: 1222538 - protein, 9 aa, Homo Sapiens
CRKEHETWL

SEQ ID NO: 1222539 - protein, 9 aa, Homo Sapiens
PQDLKESGD

SEQ ID NO: 1222540 - protein, 9 aa, Homo Sapiens
SPLTTHKII

SEQ ID NO: 1222541 - protein, 9 aa, Homo Sapiens
SPRRLHLQI

SEQ ID NO: 1222542 - protein, 9 aa, Homo Sapiens
RHRMRSKGV

SEQ ID NO: 1222543 - protein, 9 aa, Homo Sapiens
VAYHGCRDV

SEQ ID NO: 1222544 - protein, 9 aa, Homo Sapiens
TVVACPRSS

SEQ ID NO: 1222545 - protein, 9 aa, Homo Sapiens
FPIQISRLP

SEQ ID NO: 1222546 - protein, 9 aa, Homo Sapiens
RDECKYECM

SEQ ID NO: 1222547 - protein, 9 aa, Homo Sapiens
ATKPGPVLN

SEQ ID NO: 1222548 - protein, 9 aa, Homo Sapiens
KHCGKAFIR

SEQ ID NO: 1222549 - protein, 9 aa, Homo Sapiens
AGELSSTLN

SEQ ID NO: 1222550 - protein, 9 aa, Homo Sapiens
MVVQCGNRP

SEQ ID NO: 1222551 - protein, 9 aa, Homo Sapiens
RLQEWYKKC

SEQ ID NO: 1222552 - protein, 9 aa, Homo Sapiens
QALSGRLWA

SEQ ID NO: 1222553 - protein, 9 aa, Homo Sapiens
DDLCALVFK

SEQ ID NO: 1222554 - protein, 9 aa, Homo Sapiens
HIIYGFFNE

SEQ ID NO: 1222555 - protein, 9 aa, Homo Sapiens
TYFQAKREK

SEQ ID NO: 1222556 - protein, 9 aa, Homo Sapiens
SKITQAIAE

SEQ ID NO: 1222557 - protein, 9 aa, Homo Sapiens
LAFFIHNCT

SEQ ID NO: 1222558 - protein, 9 aa, Homo Sapiens
ELLSEAKAK

SEQ ID NO: 1222559 - protein, 9 aa, Homo Sapiens
SQSQISRIL

SEQ ID NO: 1222560 - protein, 9 aa, Homo Sapiens
TGLEAYSLG

SEQ ID NO: 1222561 - protein, 9 aa, Homo Sapiens
SRCFAFVRD

SEQ ID NO: 1222562 - protein, 9 aa, Homo Sapiens
LLHTYVLHI

SEQ ID NO: 1222563 - protein, 9 aa, Homo Sapiens
NGYKRVLVL

SEQ ID NO: 1222564 - protein, 9 aa, Homo Sapiens
PDKNMDNAA

SEQ ID NO: 1222565 - protein, 9 aa, Homo Sapiens
ISNGIERNK

SEQ ID NO: 1222566 - protein, 9 aa, Homo Sapiens
SACKRRRMS

SEQ ID NO: 1222567 - protein, 9 aa, Homo Sapiens
LRRSVDPGE

SEQ ID NO: 1222568 - protein, 9 aa, Homo Sapiens
DTKFQKLRY

SEQ ID NO: 1222569 - protein, 9 aa, Homo Sapiens
MKMSSGQEY

SEQ ID NO: 1222570 - protein, 9 aa, Homo Sapiens
PTPSWSCPS

SEQ ID NO: 1222571 - protein, 9 aa, Homo Sapiens
PAEAPAAEV

SEQ ID NO: 1222572 - protein, 9 aa, Homo Sapiens
RRAGESGTR

SEQ ID NO: 1222573 - protein, 9 aa, Homo Sapiens
CLSSLQTNW

SEQ ID NO: 1222574 - protein, 9 aa, Homo Sapiens
INDRIQPPR

SEQ ID NO: 1222575 - protein, 9 aa, Homo Sapiens
PGSGRAGWC

SEQ ID NO: 1222576 - protein, 9 aa, Homo Sapiens
VSLEQLCLR

SEQ ID NO: 1222577 - protein, 9 aa, Homo Sapiens
HRRSIVFAS

SEQ ID NO: 1222578 - protein, 9 aa, Homo Sapiens
NPIAKLIPQ

SEQ ID NO: 1222579 - protein, 9 aa, Homo Sapiens
DILPAAEYQ

SEQ ID NO: 1222580 - protein, 9 aa, Homo Sapiens
AGDQTLESG

SEQ ID NO: 1222581 - protein, 9 aa, Homo Sapiens
TIVSHKEWG

SEQ ID NO: 1222582 - protein, 9 aa, Homo Sapiens
CIYSVGYLI

SEQ ID NO: 1222583 - protein, 9 aa, Homo Sapiens
MNRHPNTLP

SEQ ID NO: 1222584 - protein, 9 aa, Homo Sapiens
SRHSNPPPY

SEQ ID NO: 1222585 - protein, 9 aa, Homo Sapiens
WRCMLNTHR

SEQ ID NO: 1222586 - protein, 9 aa, Homo Sapiens
LAPAQLCHR

SEQ ID NO: 1222587 - protein, 9 aa, Homo Sapiens
TGRQEDVAT

SEQ ID NO: 1222588 - protein, 9 aa, Homo Sapiens
IITMLVATT

SEQ ID NO: 1222589 - protein, 9 aa, Homo Sapiens
VAFPVSNIN

SEQ ID NO: 1222590 - protein, 9 aa, Homo Sapiens
STLNDVFLE

SEQ ID NO: 1222591 - protein, 9 aa, Homo Sapiens
LPGPGPRLQ

SEQ ID NO: 1222592 - protein, 9 aa, Homo Sapiens
EYDFECGRR

SEQ ID NO: 1222593 - protein, 9 aa, Homo Sapiens
SPEYDAITA

SEQ ID NO: 1222594 - protein, 9 aa, Homo Sapiens
PLVPQADTS

SEQ ID NO: 1222595 - protein, 9 aa, Homo Sapiens
ARKWPSTLY

SEQ ID NO: 1222596 - protein, 9 aa, Homo Sapiens
YRAMQQRVL

SEQ ID NO: 1222597 - protein, 9 aa, Homo Sapiens
LFNDSVFTM

SEQ ID NO: 1222598 - protein, 9 aa, Homo Sapiens
EAPYYLATV

SEQ ID NO: 1222599 - protein, 9 aa, Homo Sapiens
YVSQVAEHI

SEQ ID NO: 1222600 - protein, 9 aa, Homo Sapiens
FDARQNSVT

SEQ ID NO: 1222601 - protein, 9 aa, Homo Sapiens
FPFQCDPSY

SEQ ID NO: 1222602 - protein, 9 aa, Homo Sapiens
FEEGLRHLQ

SEQ ID NO: 1222603 - protein, 9 aa, Homo Sapiens
IEGFYQLEK

SEQ ID NO: 1222604 - protein, 9 aa, Homo Sapiens
VIGFDMGGM

SEQ ID NO: 1222605 - protein, 9 aa, Homo Sapiens
QRSHHKSKD

SEQ ID NO: 1222606 - protein, 9 aa, Homo Sapiens
QVIVVYTDR

SEQ ID NO: 1222607 - protein, 9 aa, Homo Sapiens
DATINFAYD

SEQ ID NO: 1222608 - protein, 9 aa, Homo Sapiens
PSPKHSASP

SEQ ID NO: 1222609 - protein, 9 aa, Homo Sapiens
KKTLLKAPD

SEQ ID NO: 1222610 - protein, 9 aa, Homo Sapiens
KPVNFQLYM

SEQ ID NO: 1222611 - protein, 9 aa, Homo Sapiens
HCTDWESWC

SEQ ID NO: 1222612 - protein, 9 aa, Homo Sapiens
VFGYQSSSH

SEQ ID NO: 1222613 - protein, 9 aa, Homo Sapiens
YKMTAYDQR

SEQ ID NO: 1222614 - protein, 9 aa, Homo Sapiens
GFEWHRGYI

SEQ ID NO: 1222615 - protein, 9 aa, Homo Sapiens
LGLLSTGSA

SEQ ID NO: 1222616 - protein, 9 aa, Homo Sapiens
RICRNWRKS

SEQ ID NO: 1222617 - protein, 9 aa, Homo Sapiens
KLSLRQVAV

SEQ ID NO: 1222618 - protein, 9 aa, Homo Sapiens
DLDTQDPPE

SEQ ID NO: 1222619 - protein, 9 aa, Homo Sapiens
QFLYVPVKR

SEQ ID NO: 1222620 - protein, 9 aa, Homo Sapiens
HGMFVNVMN

SEQ ID NO: 1222621 - protein, 9 aa, Homo Sapiens
RAREQRWQL

SEQ ID NO: 1222622 - protein, 9 aa, Homo Sapiens
KMISETCSV

SEQ ID NO: 1222623 - protein, 9 aa, Homo Sapiens
RFLCLLSTL

SEQ ID NO: 1222624 - protein, 9 aa, Homo Sapiens
LHYANKYNV

SEQ ID NO: 1222625 - protein, 9 aa, Homo Sapiens
GHFLVFGYT

SEQ ID NO: 1222626 - protein, 9 aa, Homo Sapiens
KDVLGRGTG

SEQ ID NO: 1222627 - protein, 9 aa, Homo Sapiens
GRKCKMHLY

SEQ ID NO: 1222628 - protein, 9 aa, Homo Sapiens
EKPIISAPD

SEQ ID NO: 1222629 - protein, 9 aa, Homo Sapiens
VAGSQEYVK

SEQ ID NO: 1222630 - protein, 9 aa, Homo Sapiens
FGKYKSKEF

SEQ ID NO: 1222631 - protein, 9 aa, Homo Sapiens
HQMVICKKD

SEQ ID NO: 1222632 - protein, 9 aa, Homo Sapiens
AEYCNGAGL

SEQ ID NO: 1222633 - protein, 9 aa, Homo Sapiens
PSWCLCSQP

SEQ ID NO: 1222634 - protein, 9 aa, Homo Sapiens
FLVAWLGLN

SEQ ID NO: 1222635 - protein, 9 aa, Homo Sapiens
YDEEPIPES

SEQ ID NO: 1222636 - protein, 9 aa, Homo Sapiens
TRGKYSDLN

SEQ ID NO: 1222637 - protein, 9 aa, Homo Sapiens
GDALGWLGQ

SEQ ID NO: 1222638 - protein, 9 aa, Homo Sapiens
LYPPECYGH

SEQ ID NO: 1222639 - protein, 9 aa, Homo Sapiens
MQGQQGAEA

SEQ ID NO: 1222640 - protein, 9 aa, Homo Sapiens
RIKFIIGKD

SEQ ID NO: 1222641 - protein, 9 aa, Homo Sapiens
LSSFLIFFI

SEQ ID NO: 1222642 - protein, 9 aa, Homo Sapiens
ETDGGGWII

SEQ ID NO: 1222643 - protein, 9 aa, Homo Sapiens
PVDALKGLV

SEQ ID NO: 1222644 - protein, 9 aa, Homo Sapiens
FVLDIRMPG

SEQ ID NO: 1222645 - protein, 9 aa, Homo Sapiens
FTPTSLLYV

SEQ ID NO: 1222646 - protein, 9 aa, Homo Sapiens
EDGSYEEAM

SEQ ID NO: 1222647 - protein, 9 aa, Homo Sapiens
LHKYYERKA

SEQ ID NO: 1222648 - protein, 9 aa, Homo Sapiens
ECKYECMWV

SEQ ID NO: 1222649 - protein, 9 aa, Homo Sapiens
DLTESEKRY

SEQ ID NO: 1222650 - protein, 9 aa, Homo Sapiens
RFLFNKTFL

SEQ ID NO: 1222651 - protein, 9 aa, Homo Sapiens
TRKNGSNRH

SEQ ID NO: 1222652 - protein, 9 aa, Homo Sapiens
RPYMCNDCG

SEQ ID NO: 1222653 - protein, 9 aa, Homo Sapiens
DVTGQLLSQ

SEQ ID NO: 1222654 - protein, 9 aa, Homo Sapiens
TVLQVQKKS

SEQ ID NO: 1222655 - protein, 9 aa, Homo Sapiens
FLWRRFRSV

SEQ ID NO: 1222656 - protein, 9 aa, Homo Sapiens
YLSSYLPSP

SEQ ID NO: 1222657 - protein, 9 aa, Homo Sapiens
KATVINYLP

SEQ ID NO: 1222658 - protein, 9 aa, Homo Sapiens
EMTIKENIN

SEQ ID NO: 1222659 - protein, 9 aa, Homo Sapiens
HFLPLIYQG

SEQ ID NO: 1222660 - protein, 9 aa, Homo Sapiens
GKHSRCPPK

SEQ ID NO: 1222661 - protein, 9 aa, Homo Sapiens
ASTEPFPQV

SEQ ID NO: 1222662 - protein, 9 aa, Homo Sapiens
VITSTSAPV

SEQ ID NO: 1222663 - protein, 9 aa, Homo Sapiens
RGLWWREGT

SEQ ID NO: 1222664 - protein, 9 aa, Homo Sapiens
VFQTGPQLQ

SEQ ID NO: 1222665 - protein, 9 aa, Homo Sapiens
RLEHSNDPT

SEQ ID NO: 1222666 - protein, 9 aa, Homo Sapiens
CPFAPKEAS

SEQ ID NO: 1222667 - protein, 9 aa, Homo Sapiens
SAEKEATLV

SEQ ID NO: 1222668 - protein, 9 aa, Homo Sapiens
THPPASEGS

SEQ ID NO: 1222669 - protein, 9 aa, Homo Sapiens
CVAFSPSTK

SEQ ID NO: 1222670 - protein, 9 aa, Homo Sapiens
VHPLVGHMD

SEQ ID NO: 1222671 - protein, 9 aa, Homo Sapiens
CMFSQGSDD

SEQ ID NO: 1222672 - protein, 9 aa, Homo Sapiens
GVVGLTMPI

SEQ ID NO: 1222673 - protein, 9 aa, Homo Sapiens
VPAPPPEEV

SEQ ID NO: 1222674 - protein, 9 aa, Homo Sapiens
SEQTVVTLR

SEQ ID NO: 1222675 - protein, 9 aa, Homo Sapiens
SSTSPQPKC

SEQ ID NO: 1222676 - protein, 9 aa, Homo Sapiens
KDWPCKYDW

SEQ ID NO: 1222677 - protein, 9 aa, Homo Sapiens
LRCSAAATT

SEQ ID NO: 1222678 - protein, 9 aa, Homo Sapiens
NAKYKAEEV

SEQ ID NO: 1222679 - protein, 9 aa, Homo Sapiens
VITVELCDH

SEQ ID NO: 1222680 - protein, 9 aa, Homo Sapiens
EAHYIRQQD

SEQ ID NO: 1222681 - protein, 9 aa, Homo Sapiens
ISVEVFLPV

SEQ ID NO: 1222682 - protein, 9 aa, Homo Sapiens
LILTFLALL

SEQ ID NO: 1222683 - protein, 9 aa, Homo Sapiens
YQPDLKYLR

SEQ ID NO: 1222684 - protein, 9 aa, Homo Sapiens
SEHPRLPLA

SEQ ID NO: 1222685 - protein, 9 aa, Homo Sapiens
PSSIEVIPF

SEQ ID NO: 1222686 - protein, 9 aa, Homo Sapiens
IQVAPSRRL

SEQ ID NO: 1222687 - protein, 9 aa, Homo Sapiens
KFLARMFKL

SEQ ID NO: 1222688 - protein, 9 aa, Homo Sapiens
RLALGPMAT

SEQ ID NO: 1222689 - protein, 9 aa, Homo Sapiens
FKLTRRVAD

SEQ ID NO: 1222690 - protein, 9 aa, Homo Sapiens
NTYRTKQEG

SEQ ID NO: 1222691 - protein, 9 aa, Homo Sapiens
ELCRETEKL

SEQ ID NO: 1222692 - protein, 9 aa, Homo Sapiens
TCAPGGILD

SEQ ID NO: 1222693 - protein, 9 aa, Homo Sapiens
SYLPTKIAA

SEQ ID NO: 1222694 - protein, 9 aa, Homo Sapiens
ISPKLNVDV

SEQ ID NO: 1222695 - protein, 9 aa, Homo Sapiens
VNEAGKSTT

SEQ ID NO: 1222696 - protein, 9 aa, Homo Sapiens
RGCGGHRGG

SEQ ID NO: 1222697 - protein, 9 aa, Homo Sapiens
VLRVSDPSP

SEQ ID NO: 1222698 - protein, 9 aa, Homo Sapiens
ETLPSGRTV

SEQ ID NO: 1222699 - protein, 9 aa, Homo Sapiens
PYFHSLEVA

SEQ ID NO: 1222700 - protein, 9 aa, Homo Sapiens
PYLSSYLPS

SEQ ID NO: 1222701 - protein, 9 aa, Homo Sapiens
STRAVYLAS

SEQ ID NO: 1222702 - protein, 9 aa, Homo Sapiens
QRRYPRTTD

SEQ ID NO: 1222703 - protein, 9 aa, Homo Sapiens
TYPGVMHIS

SEQ ID NO: 1222704 - protein, 9 aa, Homo Sapiens
YNVIITWSL

SEQ ID NO: 1222705 - protein, 9 aa, Homo Sapiens
KYLRFTLTK

SEQ ID NO: 1222706 - protein, 9 aa, Homo Sapiens
VIGHMDSGK

SEQ ID NO: 1222707 - protein, 9 aa, Homo Sapiens
THCLLVSSR

SEQ ID NO: 1222708 - protein, 9 aa, Homo Sapiens
TYMEDAVCR

SEQ ID NO: 1222709 - protein, 9 aa, Homo Sapiens
PTSLTLTVP

SEQ ID NO: 1222710 - protein, 9 aa, Homo Sapiens
LAQPPGVGN

SEQ ID NO: 1222711 - protein, 9 aa, Homo Sapiens
IRRLDTYLA

SEQ ID NO: 1222712 - protein, 9 aa, Homo Sapiens
SCLQNYIPA

SEQ ID NO: 1222713 - protein, 9 aa, Homo Sapiens
ASGGSHPLS

SEQ ID NO: 1222714 - protein, 9 aa, Homo Sapiens
EIQRVSLEQ

SEQ ID NO: 1222715 - protein, 9 aa, Homo Sapiens
AHYIRQQDL

SEQ ID NO: 1222716 - protein, 9 aa, Homo Sapiens
RLPESLHYK

SEQ ID NO: 1222717 - protein, 9 aa, Homo Sapiens
FKLQFLYVP

SEQ ID NO: 1222718 - protein, 9 aa, Homo Sapiens
ELPRVQMDH

SEQ ID NO: 1222719 - protein, 9 aa, Homo Sapiens
DFDRLRTTL

SEQ ID NO: 1222720 - protein, 9 aa, Homo Sapiens
NNTCFVDVV

SEQ ID NO: 1222721 - protein, 9 aa, Homo Sapiens
LGSRMAHPR

SEQ ID NO: 1222722 - protein, 9 aa, Homo Sapiens
KAIQWEAEA

SEQ ID NO: 1222723 - protein, 9 aa, Homo Sapiens
MATLPLQPS

SEQ ID NO: 1222724 - protein, 9 aa, Homo Sapiens
IMMLKYFAT

SEQ ID NO: 1222725 - protein, 9 aa, Homo Sapiens
FVSKVYCGY

SEQ ID NO: 1222726 - protein, 9 aa, Homo Sapiens
MSDQQLVEL

SEQ ID NO: 1222727 - protein, 9 aa, Homo Sapiens
SILQTAILL

SEQ ID NO: 1222728 - protein, 9 aa, Homo Sapiens
HSQPQQQQI

SEQ ID NO: 1222729 - protein, 9 aa, Homo Sapiens
VFVYCTFLD

SEQ ID NO: 1222730 - protein, 9 aa, Homo Sapiens
NFSYINDND

SEQ ID NO: 1222731 - protein, 9 aa, Homo Sapiens
SVCIFKLTF

SEQ ID NO: 1222732 - protein, 9 aa, Homo Sapiens
YQTIFLRQL

SEQ ID NO: 1222733 - protein, 9 aa, Homo Sapiens
MLSSVLASL

SEQ ID NO: 1222734 - protein, 9 aa, Homo Sapiens
FETVYQIHK

SEQ ID NO: 1222735 - protein, 9 aa, Homo Sapiens
YQKERNEMQ

SEQ ID NO: 1222736 - protein, 9 aa, Homo Sapiens
PSGPSSSVF

SEQ ID NO: 1222737 - protein, 9 aa, Homo Sapiens
HRGAHRSPS

SEQ ID NO: 1222738 - protein, 9 aa, Homo Sapiens
SILLCNPFH

SEQ ID NO: 1222739 - protein, 9 aa, Homo Sapiens
KKSYEDALL

SEQ ID NO: 1222740 - protein, 9 aa, Homo Sapiens
EASAKPIPH

SEQ ID NO: 1222741 - protein, 9 aa, Homo Sapiens
RHPNTLPGT

SEQ ID NO: 1222742 - protein, 9 aa, Homo Sapiens
SRIVWMPRM

SEQ ID NO: 1222743 - protein, 9 aa, Homo Sapiens
VTMGSLICF

SEQ ID NO: 1222744 - protein, 9 aa, Homo Sapiens
SGLPLIMRG

SEQ ID NO: 1222745 - protein, 9 aa, Homo Sapiens
ALDFQLKKA

SEQ ID NO: 1222746 - protein, 9 aa, Homo Sapiens
VVPAFHSLQ

SEQ ID NO: 1222747 - protein, 9 aa, Homo Sapiens
EDESCYNCG

SEQ ID NO: 1222748 - protein, 9 aa, Homo Sapiens
GASLQQHFV

SEQ ID NO: 1222749 - protein, 9 aa, Homo Sapiens
GIKYVNKLA

SEQ ID NO: 1222750 - protein, 9 aa, Homo Sapiens
CNAGIIRTL

SEQ ID NO: 1222751 - protein, 9 aa, Homo Sapiens
HLSSSGRLA

SEQ ID NO: 1222752 - protein, 9 aa, Homo Sapiens
IHVFFNPWF

SEQ ID NO: 1222753 - protein, 9 aa, Homo Sapiens
VRRVAQVQR

SEQ ID NO: 1222754 - protein, 9 aa, Homo Sapiens
PCRCSAPAN

SEQ ID NO: 1222755 - protein, 9 aa, Homo Sapiens
EDYQVSLQG

SEQ ID NO: 1222756 - protein, 9 aa, Homo Sapiens
GEKDTQTAL

SEQ ID NO: 1222757 - protein, 9 aa, Homo Sapiens
ESIMFMGRV

SEQ ID NO: 1222758 - protein, 9 aa, Homo Sapiens
IFSTEGKRC

SEQ ID NO: 1222759 - protein, 9 aa, Homo Sapiens
SANGSVGDA

SEQ ID NO: 1222760 - protein, 9 aa, Homo Sapiens
ELVAGSQEY

SEQ ID NO: 1222761 - protein, 9 aa, Homo Sapiens
AACRRCMAT

SEQ ID NO: 1222762 - protein, 9 aa, Homo Sapiens
KSEGPCVHV

SEQ ID NO: 1222763 - protein, 9 aa, Homo Sapiens
VCCESEVFH

SEQ ID NO: 1222764 - protein, 9 aa, Homo Sapiens
AREQWLRVV

SEQ ID NO: 1222765 - protein, 9 aa, Homo Sapiens
LKHQPPRVL

SEQ ID NO: 1222766 - protein, 9 aa, Homo Sapiens
LAGWRGPRR

SEQ ID NO: 1222767 - protein, 9 aa, Homo Sapiens
VGKSNTGDA

SEQ ID NO: 1222768 - protein, 9 aa, Homo Sapiens
FSLIPKTWH

SEQ ID NO: 1222769 - protein, 9 aa, Homo Sapiens
MWSIWDPMS

SEQ ID NO: 1222770 - protein, 9 aa, Homo Sapiens
PCCFSWSLS

SEQ ID NO: 1222771 - protein, 9 aa, Homo Sapiens
GCVLRLQFA

SEQ ID NO: 1222772 - protein, 9 aa, Homo Sapiens
KKFRHPAIS

SEQ ID NO: 1222773 - protein, 9 aa, Homo Sapiens
VPLCPSGRR

SEQ ID NO: 1222774 - protein, 9 aa, Homo Sapiens
ALVFKVLHD

SEQ ID NO: 1222775 - protein, 9 aa, Homo Sapiens
HREKEVSIF

SEQ ID NO: 1222776 - protein, 9 aa, Homo Sapiens
TGAKVALVI

SEQ ID NO: 1222777 - protein, 9 aa, Homo Sapiens
RIKLYFMYF

SEQ ID NO: 1222778 - protein, 9 aa, Homo Sapiens
QTLSHLKCT

SEQ ID NO: 1222779 - protein, 9 aa, Homo Sapiens
TSWEPAQEA

SEQ ID NO: 1222780 - protein, 9 aa, Homo Sapiens
HPRRPPHSP

SEQ ID NO: 1222781 - protein, 9 aa, Homo Sapiens
PYCGADPRR

SEQ ID NO: 1222782 - protein, 9 aa, Homo Sapiens
KNVPLRVKI

SEQ ID NO: 1222783 - protein, 9 aa, Homo Sapiens
EMKETKCQQ

SEQ ID NO: 1222784 - protein, 9 aa, Homo Sapiens
DENEQHFGV

SEQ ID NO: 1222785 - protein, 9 aa, Homo Sapiens
ALPILKLAC

SEQ ID NO: 1222786 - protein, 9 aa, Homo Sapiens
MRWNTQDEN

SEQ ID NO: 1222787 - protein, 9 aa, Homo Sapiens
ASASLEVTA

SEQ ID NO: 1222788 - protein, 9 aa, Homo Sapiens
EEMKETKCQ

SEQ ID NO: 1222789 - protein, 9 aa, Homo Sapiens
PQTRCDGKK

SEQ ID NO: 1222790 - protein, 9 aa, Homo Sapiens
MQQALQGMQ

SEQ ID NO: 1222791 - protein, 9 aa, Homo Sapiens
DSRLITLYP

SEQ ID NO: 1222792 - protein, 9 aa, Homo Sapiens
TTTTRSLAT

SEQ ID NO: 1222793 - protein, 9 aa, Homo Sapiens
ARSLKTNIL

SEQ ID NO: 1222794 - protein, 9 aa, Homo Sapiens
TLPGSRHKH

SEQ ID NO: 1222795 - protein, 9 aa, Homo Sapiens
ARTVTVTSR

SEQ ID NO: 1222796 - protein, 9 aa, Homo Sapiens
IFLSMCYCI

SEQ ID NO: 1222797 - protein, 9 aa, Homo Sapiens
ETLGGQDES

SEQ ID NO: 1222798 - protein, 9 aa, Homo Sapiens
AQLGVPELR

SEQ ID NO: 1222799 - protein, 9 aa, Homo Sapiens
NLMVQAAEP

SEQ ID NO: 1222800 - protein, 9 aa, Homo Sapiens
EKLSRFHVK

SEQ ID NO: 1222801 - protein, 9 aa, Homo Sapiens
PAMLTLACM

SEQ ID NO: 1222802 - protein, 9 aa, Homo Sapiens
ILTLQPSDQ

SEQ ID NO: 1222803 - protein, 9 aa, Homo Sapiens
ISMQAILTG

SEQ ID NO: 1222804 - protein, 9 aa, Homo Sapiens
WHWQVSLRV

SEQ ID NO: 1222805 - protein, 9 aa, Homo Sapiens
FPEVSFLET

SEQ ID NO: 1222806 - protein, 9 aa, Homo Sapiens
PGIMGPFGI

SEQ ID NO: 1222807 - protein, 9 aa, Homo Sapiens
EGIVGSMKH

SEQ ID NO: 1222808 - protein, 9 aa, Homo Sapiens
DVLNDHGVF

SEQ ID NO: 1222809 - protein, 9 aa, Homo Sapiens
HAEDLAPKL

SEQ ID NO: 1222810 - protein, 9 aa, Homo Sapiens
YTHVCILHP

SEQ ID NO: 1222811 - protein, 9 aa, Homo Sapiens
PRLSRVPAQ

SEQ ID NO: 1222812 - protein, 9 aa, Homo Sapiens
PMPQMCSPK

SEQ ID NO: 1222813 - protein, 9 aa, Homo Sapiens
SQLGAVKFT

SEQ ID NO: 1222814 - protein, 9 aa, Homo Sapiens
AASAYHAVE

SEQ ID NO: 1222815 - protein, 9 aa, Homo Sapiens
AFSYKHVCV

SEQ ID NO: 1222816 - protein, 9 aa, Homo Sapiens
PGPVLPQEE

SEQ ID NO: 1222817 - protein, 9 aa, Homo Sapiens
SPAHSPSPA

SEQ ID NO: 1222818 - protein, 9 aa, Homo Sapiens
YCVCILGVM

SEQ ID NO: 1222819 - protein, 9 aa, Homo Sapiens
VTDRQILFL

SEQ ID NO: 1222820 - protein, 9 aa, Homo Sapiens
SEADRDSMR

SEQ ID NO: 1222821 - protein, 9 aa, Homo Sapiens
KIRMKEREH

SEQ ID NO: 1222822 - protein, 9 aa, Homo Sapiens
NHSLSADVP

SEQ ID NO: 1222823 - protein, 9 aa, Homo Sapiens
NSANLLKGL

SEQ ID NO: 1222824 - protein, 9 aa, Homo Sapiens
LRALAEHLA

SEQ ID NO: 1222825 - protein, 9 aa, Homo Sapiens
TDVNMFNTI

SEQ ID NO: 1222826 - protein, 9 aa, Homo Sapiens
HASCYIKDK

SEQ ID NO: 1222827 - protein, 9 aa, Homo Sapiens
RRKLNMCLY

SEQ ID NO: 1222828 - protein, 9 aa, Homo Sapiens
SETRGECVI

SEQ ID NO: 1222829 - protein, 9 aa, Homo Sapiens
VLSPAQVIV

SEQ ID NO: 1222830 - protein, 9 aa, Homo Sapiens
PQLPRPHVL

SEQ ID NO: 1222831 - protein, 9 aa, Homo Sapiens
VIIIGAFFI

SEQ ID NO: 1222832 - protein, 9 aa, Homo Sapiens
KTSESSAQP

SEQ ID NO: 1222833 - protein, 9 aa, Homo Sapiens
DDIPDRPTG

SEQ ID NO: 1222834 - protein, 9 aa, Homo Sapiens
SAGVKVWYL

SEQ ID NO: 1222835 - protein, 9 aa, Homo Sapiens
SGLHGSDAL

SEQ ID NO: 1222836 - protein, 9 aa, Homo Sapiens
YIIERPSYH

SEQ ID NO: 1222837 - protein, 9 aa, Homo Sapiens
YSMYSASKV

SEQ ID NO: 1222838 - protein, 9 aa, Homo Sapiens
LLLPISAFH

SEQ ID NO: 1222839 - protein, 9 aa, Homo Sapiens
VGYYIEASI

SEQ ID NO: 1222840 - protein, 9 aa, Homo Sapiens
CYQYGKNFS

SEQ ID NO: 1222841 - protein, 9 aa, Homo Sapiens
DVKCLSEFA

SEQ ID NO: 1222842 - protein, 9 aa, Homo Sapiens
TPGSDWRDL

SEQ ID NO: 1222843 - protein, 9 aa, Homo Sapiens
AGPEGYETH

SEQ ID NO: 1222844 - protein, 9 aa, Homo Sapiens
AAVKFHVLT

SEQ ID NO: 1222845 - protein, 9 aa, Homo Sapiens
LLHILKKEH

SEQ ID NO: 1222846 - protein, 9 aa, Homo Sapiens
PHCMSVIVS

SEQ ID NO: 1222847 - protein, 9 aa, Homo Sapiens
CFGEDLARM

SEQ ID NO: 1222848 - protein, 9 aa, Homo Sapiens
TRCEGLCLL

SEQ ID NO: 1222849 - protein, 9 aa, Homo Sapiens
RCTNNQLGD

SEQ ID NO: 1222850 - protein, 9 aa, Homo Sapiens
KCIYFLIKI

SEQ ID NO: 1222851 - protein, 9 aa, Homo Sapiens
ALWENMGQK

SEQ ID NO: 1222852 - protein, 9 aa, Homo Sapiens
EVEFLQKLL

SEQ ID NO: 1222853 - protein, 9 aa, Homo Sapiens
EAFSEPSVF

SEQ ID NO: 1222854 - protein, 9 aa, Homo Sapiens
ILHECLKET

SEQ ID NO: 1222855 - protein, 9 aa, Homo Sapiens
EYKYCDAES

SEQ ID NO: 1222856 - protein, 9 aa, Homo Sapiens
EANDYSDCK

SEQ ID NO: 1222857 - protein, 9 aa, Homo Sapiens
EPDKPAPME

SEQ ID NO: 1222858 - protein, 9 aa, Homo Sapiens
MDKYSVSQD

SEQ ID NO: 1222859 - protein, 9 aa, Homo Sapiens
QCSQKDLDA

SEQ ID NO: 1222860 - protein, 9 aa, Homo Sapiens
LQEKAQVVL

SEQ ID NO: 1222861 - protein, 9 aa, Homo Sapiens
TGLGLFCEP

SEQ ID NO: 1222862 - protein, 9 aa, Homo Sapiens
IDKVSPYEF

SEQ ID NO: 1222863 - protein, 9 aa, Homo Sapiens
KDDVCVNPY

SEQ ID NO: 1222864 - protein, 9 aa, Homo Sapiens
NEVSMQHLP

SEQ ID NO: 1222865 - protein, 9 aa, Homo Sapiens
HALSRLRDT

SEQ ID NO: 1222866 - protein, 9 aa, Homo Sapiens
REPTSKVTE

SEQ ID NO: 1222867 - protein, 9 aa, Homo Sapiens
MTTELAHSL

SEQ ID NO: 1222868 - protein, 9 aa, Homo Sapiens
TWITSFYNH

SEQ ID NO: 1222869 - protein, 9 aa, Homo Sapiens
KLTLAVLPT

SEQ ID NO: 1222870 - protein, 9 aa, Homo Sapiens
SSVRGSAAA

SEQ ID NO: 1222871 - protein, 9 aa, Homo Sapiens
RKMECHDGI

SEQ ID NO: 1222872 - protein, 9 aa, Homo Sapiens
RRRGLSHGG

SEQ ID NO: 1222873 - protein, 9 aa, Homo Sapiens
NGGAAKQGL

SEQ ID NO: 1222874 - protein, 9 aa, Homo Sapiens
GKGASGAFQ

SEQ ID NO: 1222875 - protein, 9 aa, Homo Sapiens
AMKLLHVLA

SEQ ID NO: 1222876 - protein, 9 aa, Homo Sapiens
AAIKEQNPN

SEQ ID NO: 1222877 - protein, 9 aa, Homo Sapiens
APGPVCYAT

SEQ ID NO: 1222878 - protein, 9 aa, Homo Sapiens
KKTARSHRR

SEQ ID NO: 1222879 - protein, 9 aa, Homo Sapiens
NDEPPLDFP

SEQ ID NO: 1222880 - protein, 9 aa, Homo Sapiens
NKKSQILTS

SEQ ID NO: 1222881 - protein, 9 aa, Homo Sapiens
SYSSSSTSS

SEQ ID NO: 1222882 - protein, 9 aa, Homo Sapiens
LKKATAYIM

SEQ ID NO: 1222883 - protein, 9 aa, Homo Sapiens
RARHLIHNY

SEQ ID NO: 1222884 - protein, 9 aa, Homo Sapiens
LGPARTGLL

SEQ ID NO: 1222885 - protein, 9 aa, Homo Sapiens
SLESGSNFT

SEQ ID NO: 1222886 - protein, 9 aa, Homo Sapiens
HLLYPFNDP

SEQ ID NO: 1222887 - protein, 9 aa, Homo Sapiens
VRLVPSFSF

SEQ ID NO: 1222888 - protein, 9 aa, Homo Sapiens
LSLTQPQPP

SEQ ID NO: 1222889 - protein, 9 aa, Homo Sapiens
SLKELDEGK

SEQ ID NO: 1222890 - protein, 9 aa, Homo Sapiens
TCVVFHYRS

SEQ ID NO: 1222891 - protein, 9 aa, Homo Sapiens
VPSSALKLV

SEQ ID NO: 1222892 - protein, 9 aa, Homo Sapiens
RPGPSRAHC

SEQ ID NO: 1222893 - protein, 9 aa, Homo Sapiens
LWLLDCPGV

SEQ ID NO: 1222894 - protein, 9 aa, Homo Sapiens
IKYVNKLAL

SEQ ID NO: 1222895 - protein, 9 aa, Homo Sapiens
MAFALMASV

SEQ ID NO: 1222896 - protein, 9 aa, Homo Sapiens
LSGSVRPQE

SEQ ID NO: 1222897 - protein, 9 aa, Homo Sapiens
RRNCCYLWD

SEQ ID NO: 1222898 - protein, 9 aa, Homo Sapiens
GIFLLGCVK

SEQ ID NO: 1222899 - protein, 9 aa, Homo Sapiens
YTPSKIRHV

SEQ ID NO: 1222900 - protein, 9 aa, Homo Sapiens
ELAASAYHA

SEQ ID NO: 1222901 - protein, 9 aa, Homo Sapiens
TSFMREDSL

SEQ ID NO: 1222902 - protein, 9 aa, Homo Sapiens
GTDSSHYWS

SEQ ID NO: 1222903 - protein, 9 aa, Homo Sapiens
NCNVPEVVK

SEQ ID NO: 1222904 - protein, 9 aa, Homo Sapiens
EVMHGSSFS

SEQ ID NO: 1222905 - protein, 9 aa, Homo Sapiens
KHEKIQLIS

SEQ ID NO: 1222906 - protein, 9 aa, Homo Sapiens
VEGEVTFKS

SEQ ID NO: 1222907 - protein, 9 aa, Homo Sapiens
QDQEARCRE

SEQ ID NO: 1222908 - protein, 9 aa, Homo Sapiens
LAPLKEELH

SEQ ID NO: 1222909 - protein, 9 aa, Homo Sapiens
ETAGSLSGP

SEQ ID NO: 1222910 - protein, 9 aa, Homo Sapiens
PLEAPRTQP

SEQ ID NO: 1222911 - protein, 9 aa, Homo Sapiens
AEPHLTVGL

SEQ ID NO: 1222912 - protein, 9 aa, Homo Sapiens
KNKFLARMF

SEQ ID NO: 1222913 - protein, 9 aa, Homo Sapiens
RDGTGHYMC

SEQ ID NO: 1222914 - protein, 9 aa, Homo Sapiens
LDSPMQEDP

SEQ ID NO: 1222915 - protein, 9 aa, Homo Sapiens
MDRGDTCHR

SEQ ID NO: 1222916 - protein, 9 aa, Homo Sapiens
EVNYLTKIL

SEQ ID NO: 1222917 - protein, 9 aa, Homo Sapiens
GNKNSQVCP

SEQ ID NO: 1222918 - protein, 9 aa, Homo Sapiens
CTVKLCQTT

SEQ ID NO: 1222919 - protein, 9 aa, Homo Sapiens
GRPVSPRRM

SEQ ID NO: 1222920 - protein, 9 aa, Homo Sapiens
EYCTWNPFR

SEQ ID NO: 1222921 - protein, 9 aa, Homo Sapiens
SAMARGTDV

SEQ ID NO: 1222922 - protein, 9 aa, Homo Sapiens
SVHPLVGHM

SEQ ID NO: 1222923 - protein, 9 aa, Homo Sapiens
CCQCCPGPR

SEQ ID NO: 1222924 - protein, 9 aa, Homo Sapiens
IVSFVCEYA

SEQ ID NO: 1222925 - protein, 9 aa, Homo Sapiens
CTGTLVPAR

SEQ ID NO: 1222926 - protein, 9 aa, Homo Sapiens
SGELGGGWI

SEQ ID NO: 1222927 - protein, 9 aa, Homo Sapiens
WPAVTSSPS

SEQ ID NO: 1222928 - protein, 9 aa, Homo Sapiens
AFNQSSYLI

SEQ ID NO: 1222929 - protein, 9 aa, Homo Sapiens
FLLRHPPQA

SEQ ID NO: 1222930 - protein, 9 aa, Homo Sapiens
SEGSDSAIL

SEQ ID NO: 1222931 - protein, 9 aa, Homo Sapiens
RAHSNYRDG

SEQ ID NO: 1222932 - protein, 9 aa, Homo Sapiens
LMFASVYIY

SEQ ID NO: 1222933 - protein, 9 aa, Homo Sapiens
WYRRSIARC

SEQ ID NO: 1222934 - protein, 9 aa, Homo Sapiens
IHTIKGNPA

SEQ ID NO: 1222935 - protein, 9 aa, Homo Sapiens
PICFIAFQV

SEQ ID NO: 1222936 - protein, 9 aa, Homo Sapiens
KKYTPGDAP

SEQ ID NO: 1222937 - protein, 9 aa, Homo Sapiens
PKMYLDGPF

SEQ ID NO: 1222938 - protein, 9 aa, Homo Sapiens
PTPPSYIGI

SEQ ID NO: 1222939 - protein, 9 aa, Homo Sapiens
TDWPKDLVK

SEQ ID NO: 1222940 - protein, 9 aa, Homo Sapiens
SDPVFISKT

SEQ ID NO: 1222941 - protein, 9 aa, Homo Sapiens
KVMKILRLL

SEQ ID NO: 1222942 - protein, 9 aa, Homo Sapiens
PCGPSCERR

SEQ ID NO: 1222943 - protein, 9 aa, Homo Sapiens
QRFLAWKWD

SEQ ID NO: 1222944 - protein, 9 aa, Homo Sapiens
NLLVSTFVV

SEQ ID NO: 1222945 - protein, 9 aa, Homo Sapiens
PRHVILDPA

SEQ ID NO: 1222946 - protein, 9 aa, Homo Sapiens
FVRDSAKLF

SEQ ID NO: 1222947 - protein, 9 aa, Homo Sapiens
ECVRGLKQQ

SEQ ID NO: 1222948 - protein, 9 aa, Homo Sapiens
GDRTSTICG

SEQ ID NO: 1222949 - protein, 9 aa, Homo Sapiens
AQQLEMTTE

SEQ ID NO: 1222950 - protein, 9 aa, Homo Sapiens
TIYLRPAIC

SEQ ID NO: 1222951 - protein, 9 aa, Homo Sapiens
VLGLAGRGR

SEQ ID NO: 1222952 - protein, 9 aa, Homo Sapiens
FALERLTRT

SEQ ID NO: 1222953 - protein, 9 aa, Homo Sapiens
REGTGRMRV

SEQ ID NO: 1222954 - protein, 9 aa, Homo Sapiens
ELKAGSRGN

SEQ ID NO: 1222955 - protein, 9 aa, Homo Sapiens
GFFLSQCQR

SEQ ID NO: 1222956 - protein, 9 aa, Homo Sapiens
AQTRCHRIG

SEQ ID NO: 1222957 - protein, 9 aa, Homo Sapiens
LVHGSLEEL

SEQ ID NO: 1222958 - protein, 9 aa, Homo Sapiens
NKRRRNRCQ

SEQ ID NO: 1222959 - protein, 9 aa, Homo Sapiens
KEEATMFSN

SEQ ID NO: 1222960 - protein, 9 aa, Homo Sapiens
WGSRDTYAW

SEQ ID NO: 1222961 - protein, 9 aa, Homo Sapiens
ALECAEDKE

SEQ ID NO: 1222962 - protein, 9 aa, Homo Sapiens
ARIEYDAYH

SEQ ID NO: 1222963 - protein, 9 aa, Homo Sapiens
INLREVTDR

SEQ ID NO: 1222964 - protein, 9 aa, Homo Sapiens
LHNDIIFTI

SEQ ID NO: 1222965 - protein, 9 aa, Homo Sapiens
RHFHPVAAA

SEQ ID NO: 1222966 - protein, 9 aa, Homo Sapiens
ASNKNVTVV

SEQ ID NO: 1222967 - protein, 9 aa, Homo Sapiens
QEEATRLPT

SEQ ID NO: 1222968 - protein, 9 aa, Homo Sapiens
PTSRCPMTL

SEQ ID NO: 1222969 - protein, 9 aa, Homo Sapiens
SGGRLQGRG

SEQ ID NO: 1222970 - protein, 9 aa, Homo Sapiens
LPHSTKARD

SEQ ID NO: 1222971 - protein, 9 aa, Homo Sapiens
VRQLLDDHN

SEQ ID NO: 1222972 - protein, 9 aa, Homo Sapiens
ALLNEHQVE

SEQ ID NO: 1222973 - protein, 9 aa, Homo Sapiens
YASGGSHPL

SEQ ID NO: 1222974 - protein, 9 aa, Homo Sapiens
YLVSRFAGS

SEQ ID NO: 1222975 - protein, 9 aa, Homo Sapiens
REAGAKHNT

SEQ ID NO: 1222976 - protein, 9 aa, Homo Sapiens
YPDIVHQFK

SEQ ID NO: 1222977 - protein, 9 aa, Homo Sapiens
PPAQSSATL

SEQ ID NO: 1222978 - protein, 9 aa, Homo Sapiens
GPIVDLLQC

SEQ ID NO: 1222979 - protein, 9 aa, Homo Sapiens
VTRLTRSKG

SEQ ID NO: 1222980 - protein, 9 aa, Homo Sapiens
GENVYKCDD

SEQ ID NO: 1222981 - protein, 9 aa, Homo Sapiens
YVRRGPGPR

SEQ ID NO: 1222982 - protein, 9 aa, Homo Sapiens
KPAPMEGKI

SEQ ID NO: 1222983 - protein, 9 aa, Homo Sapiens
LGWRVSSKS

SEQ ID NO: 1222984 - protein, 9 aa, Homo Sapiens
FKGYECSDM

SEQ ID NO: 1222985 - protein, 9 aa, Homo Sapiens
KKVSEEKEN

SEQ ID NO: 1222986 - protein, 9 aa, Homo Sapiens
LCHRLKPSD

SEQ ID NO: 1222987 - protein, 9 aa, Homo Sapiens
TVIQAGREK

SEQ ID NO: 1222988 - protein, 9 aa, Homo Sapiens
IRCNTQGTW

SEQ ID NO: 1222989 - protein, 9 aa, Homo Sapiens
GRQRQLLRM

SEQ ID NO: 1222990 - protein, 9 aa, Homo Sapiens
WGKPHSTGD

SEQ ID NO: 1222991 - protein, 9 aa, Homo Sapiens
RGIYSTDYY

SEQ ID NO: 1222992 - protein, 9 aa, Homo Sapiens
AVARSWLIT

SEQ ID NO: 1222993 - protein, 9 aa, Homo Sapiens
KDVTKALSD

SEQ ID NO: 1222994 - protein, 9 aa, Homo Sapiens
SFLDEDDVY

SEQ ID NO: 1222995 - protein, 9 aa, Homo Sapiens
GNHITGLCL

SEQ ID NO: 1222996 - protein, 9 aa, Homo Sapiens
TLWYLSITR

SEQ ID NO: 1222997 - protein, 9 aa, Homo Sapiens
LDYECYDVY

SEQ ID NO: 1222998 - protein, 9 aa, Homo Sapiens
VPNQHRSTY

SEQ ID NO: 1222999 - protein, 9 aa, Homo Sapiens
VLLNARSVP

SEQ ID NO: 1223000 - protein, 9 aa, Homo Sapiens
ECLDCDMES

SEQ ID NO: 1223001 - protein, 9 aa, Homo Sapiens
NLRSYQQWV

SEQ ID NO: 1223002 - protein, 9 aa, Homo Sapiens
PPNGSSTEN

SEQ ID NO: 1223003 - protein, 9 aa, Homo Sapiens
FLRRYTSED

SEQ ID NO: 1223004 - protein, 9 aa, Homo Sapiens
NVHRKIHTG

SEQ ID NO: 1223005 - protein, 9 aa, Homo Sapiens
RVPLSVQPT

SEQ ID NO: 1223006 - protein, 9 aa, Homo Sapiens
VLDLCHKSG

SEQ ID NO: 1223007 - protein, 9 aa, Homo Sapiens
MIEKLKKTE

SEQ ID NO: 1223008 - protein, 9 aa, Homo Sapiens
RRPPDDDFR

SEQ ID NO: 1223009 - protein, 9 aa, Homo Sapiens
PSSIVSLLT

SEQ ID NO: 1223010 - protein, 9 aa, Homo Sapiens
MQNLPFEPH

SEQ ID NO: 1223011 - protein, 9 aa, Homo Sapiens
EPCKYTGSL

SEQ ID NO: 1223012 - protein, 9 aa, Homo Sapiens
TAYVQWHPV

SEQ ID NO: 1223013 - protein, 9 aa, Homo Sapiens
TAPTDSWLR

SEQ ID NO: 1223014 - protein, 9 aa, Homo Sapiens
IEHLMGGGR

SEQ ID NO: 1223015 - protein, 9 aa, Homo Sapiens
PHSCIGEIL

SEQ ID NO: 1223016 - protein, 9 aa, Homo Sapiens
VVSNPNRNW

SEQ ID NO: 1223017 - protein, 9 aa, Homo Sapiens
GYLQQEMGP

SEQ ID NO: 1223018 - protein, 9 aa, Homo Sapiens
KYMDAETSL

SEQ ID NO: 1223019 - protein, 9 aa, Homo Sapiens
PSTHSISTA

SEQ ID NO: 1223020 - protein, 9 aa, Homo Sapiens
GPGLFEVGF

SEQ ID NO: 1223021 - protein, 9 aa, Homo Sapiens
EPPPALSPA

SEQ ID NO: 1223022 - protein, 9 aa, Homo Sapiens
DLAKTMSKE

SEQ ID NO: 1223023 - protein, 9 aa, Homo Sapiens
ESKALWENM

SEQ ID NO: 1223024 - protein, 9 aa, Homo Sapiens
IIFPIQISR

SEQ ID NO: 1223025 - protein, 9 aa, Homo Sapiens
PSFITAVLT

SEQ ID NO: 1223026 - protein, 9 aa, Homo Sapiens
VRREWVLDC

SEQ ID NO: 1223027 - protein, 9 aa, Homo Sapiens
PDSARVHYY

SEQ ID NO: 1223028 - protein, 9 aa, Homo Sapiens
AAVLNPRGV

SEQ ID NO: 1223029 - protein, 9 aa, Homo Sapiens
KLPCLKRGA

SEQ ID NO: 1223030 - protein, 9 aa, Homo Sapiens
FGYGVASYF

SEQ ID NO: 1223031 - protein, 9 aa, Homo Sapiens
SMSYNLLEF

SEQ ID NO: 1223032 - protein, 9 aa, Homo Sapiens
QWVRMADNE

SEQ ID NO: 1223033 - protein, 9 aa, Homo Sapiens
RLHRKWEEK

SEQ ID NO: 1223034 - protein, 9 aa, Homo Sapiens
IITSEYIFA

SEQ ID NO: 1223035 - protein, 9 aa, Homo Sapiens
SSEEPPLSP

SEQ ID NO: 1223036 - protein, 9 aa, Homo Sapiens
TRRTVPPLT

SEQ ID NO: 1223037 - protein, 9 aa, Homo Sapiens
KKLSQSPEQ

SEQ ID NO: 1223038 - protein, 9 aa, Homo Sapiens
FLIVTVWTL

SEQ ID NO: 1223039 - protein, 9 aa, Homo Sapiens
LEHEEGKII

SEQ ID NO: 1223040 - protein, 9 aa, Homo Sapiens
GEAMHCPQC

SEQ ID NO: 1223041 - protein, 9 aa, Homo Sapiens
LESALQMES

SEQ ID NO: 1223042 - protein, 9 aa, Homo Sapiens
TPEPGTSQL

SEQ ID NO: 1223043 - protein, 9 aa, Homo Sapiens
TADTVKEAL

SEQ ID NO: 1223044 - protein, 9 aa, Homo Sapiens
SNFTPLKVG

SEQ ID NO: 1223045 - protein, 9 aa, Homo Sapiens
VAWTPPVGM

SEQ ID NO: 1223046 - protein, 9 aa, Homo Sapiens
SYGSVKDMC

SEQ ID NO: 1223047 - protein, 9 aa, Homo Sapiens
VFPLTMIRV

SEQ ID NO: 1223048 - protein, 9 aa, Homo Sapiens
IKTEMAHQI

SEQ ID NO: 1223049 - protein, 9 aa, Homo Sapiens
GGVAPRCPR

SEQ ID NO: 1223050 - protein, 9 aa, Homo Sapiens
WAAHPLLHL

SEQ ID NO: 1223051 - protein, 9 aa, Homo Sapiens
GDYLGLEEW

SEQ ID NO: 1223052 - protein, 9 aa, Homo Sapiens
RCPLNIYYV

SEQ ID NO: 1223053 - protein, 9 aa, Homo Sapiens
AGLPPISPS

SEQ ID NO: 1223054 - protein, 9 aa, Homo Sapiens
RTLSMSTLR

SEQ ID NO: 1223055 - protein, 9 aa, Homo Sapiens
CDGCNGPAV

SEQ ID NO: 1223056 - protein, 9 aa, Homo Sapiens
LAKSTGTFS

SEQ ID NO: 1223057 - protein, 9 aa, Homo Sapiens
STESWELKN

SEQ ID NO: 1223058 - protein, 9 aa, Homo Sapiens
AHILHGGMV

SEQ ID NO: 1223059 - protein, 9 aa, Homo Sapiens
NVFITMANV

SEQ ID NO: 1223060 - protein, 9 aa, Homo Sapiens
AAPPVGLNR

SEQ ID NO: 1223061 - protein, 9 aa, Homo Sapiens
PGTRPPRAR

SEQ ID NO: 1223062 - protein, 9 aa, Homo Sapiens
PGTPQSPHP

SEQ ID NO: 1223063 - protein, 9 aa, Homo Sapiens
HMPPTTTEV

SEQ ID NO: 1223064 - protein, 9 aa, Homo Sapiens
AMYKEIGLL

SEQ ID NO: 1223065 - protein, 9 aa, Homo Sapiens
YETAATRLK

SEQ ID NO: 1223066 - protein, 9 aa, Homo Sapiens
YTQISQPLP

SEQ ID NO: 1223067 - protein, 9 aa, Homo Sapiens
ILVECQEAT

SEQ ID NO: 1223068 - protein, 9 aa, Homo Sapiens
TLLQRANPS

SEQ ID NO: 1223069 - protein, 9 aa, Homo Sapiens
LNDDGGRCC

SEQ ID NO: 1223070 - protein, 9 aa, Homo Sapiens
YQSELLSFI

SEQ ID NO: 1223071 - protein, 9 aa, Homo Sapiens
KPLICWDTT

SEQ ID NO: 1223072 - protein, 9 aa, Homo Sapiens
FGLCLDGDL

SEQ ID NO: 1223073 - protein, 9 aa, Homo Sapiens
AVCHDEPSA

SEQ ID NO: 1223074 - protein, 9 aa, Homo Sapiens
ASGSGPKLP

SEQ ID NO: 1223075 - protein, 9 aa, Homo Sapiens
TMNVASSSH

SEQ ID NO: 1223076 - protein, 9 aa, Homo Sapiens
EHTIYNMIF

SEQ ID NO: 1223077 - protein, 9 aa, Homo Sapiens
VQIARISAA

SEQ ID NO: 1223078 - protein, 9 aa, Homo Sapiens
EGGIWAVYE

SEQ ID NO: 1223079 - protein, 9 aa, Homo Sapiens
GMEYFNMYG

SEQ ID NO: 1223080 - protein, 9 aa, Homo Sapiens
HDSTHVSCK

SEQ ID NO: 1223081 - protein, 9 aa, Homo Sapiens
GEVLFLMLQ

SEQ ID NO: 1223082 - protein, 9 aa, Homo Sapiens
LQKLDLYTT

SEQ ID NO: 1223083 - protein, 9 aa, Homo Sapiens
NTIDTSSYQ

SEQ ID NO: 1223084 - protein, 9 aa, Homo Sapiens
EKNVPLRVK

SEQ ID NO: 1223085 - protein, 9 aa, Homo Sapiens
QPGFLARKV

SEQ ID NO: 1223086 - protein, 9 aa, Homo Sapiens
PSCHGVMGV

SEQ ID NO: 1223087 - protein, 9 aa, Homo Sapiens
GNQARYVSC

SEQ ID NO: 1223088 - protein, 9 aa, Homo Sapiens
PVLPNNKCI

SEQ ID NO: 1223089 - protein, 9 aa, Homo Sapiens
DETRNLQTV

SEQ ID NO: 1223090 - protein, 9 aa, Homo Sapiens
VTHILNAAY

SEQ ID NO: 1223091 - protein, 9 aa, Homo Sapiens
LGNMNNNSI

SEQ ID NO: 1223092 - protein, 9 aa, Homo Sapiens
AQAKHKYQE

SEQ ID NO: 1223093 - protein, 9 aa, Homo Sapiens
FSVLPYHDS

SEQ ID NO: 1223094 - protein, 9 aa, Homo Sapiens
KITDPCLQR

SEQ ID NO: 1223095 - protein, 9 aa, Homo Sapiens
SDPSIKSFH

SEQ ID NO: 1223096 - protein, 9 aa, Homo Sapiens
PHWITSPTH

SEQ ID NO: 1223097 - protein, 9 aa, Homo Sapiens
VVAYAIQKL

SEQ ID NO: 1223098 - protein, 9 aa, Homo Sapiens
EIAFSQKSH

SEQ ID NO: 1223099 - protein, 9 aa, Homo Sapiens
RLLEDAQLQ

SEQ ID NO: 1223100 - protein, 9 aa, Homo Sapiens
GIKVDGLTL

SEQ ID NO: 1223101 - protein, 9 aa, Homo Sapiens
QVRADVNGE

SEQ ID NO: 1223102 - protein, 9 aa, Homo Sapiens
RHGVYTNIS

SEQ ID NO: 1223103 - protein, 9 aa, Homo Sapiens
LVNMSFLYI

SEQ ID NO: 1223104 - protein, 9 aa, Homo Sapiens
FAGLTKLDL

SEQ ID NO: 1223105 - protein, 9 aa, Homo Sapiens
NRIDVDILR

SEQ ID NO: 1223106 - protein, 9 aa, Homo Sapiens
LPPVGPSST

SEQ ID NO: 1223107 - protein, 9 aa, Homo Sapiens
FGDGSLIAL

SEQ ID NO: 1223108 - protein, 9 aa, Homo Sapiens
SNLWKQNSH

SEQ ID NO: 1223109 - protein, 9 aa, Homo Sapiens
ASRLLPDVL

SEQ ID NO: 1223110 - protein, 9 aa, Homo Sapiens
NAIQTMKLR

SEQ ID NO: 1223111 - protein, 9 aa, Homo Sapiens
FEGLITIIV

SEQ ID NO: 1223112 - protein, 9 aa, Homo Sapiens
WSSINPKFL

SEQ ID NO: 1223113 - protein, 9 aa, Homo Sapiens
TTCSSHLLM

SEQ ID NO: 1223114 - protein, 9 aa, Homo Sapiens
TIHQPGYCT

SEQ ID NO: 1223115 - protein, 9 aa, Homo Sapiens
MTPERIDPS

SEQ ID NO: 1223116 - protein, 9 aa, Homo Sapiens
HTRKNPFEC

SEQ ID NO: 1223117 - protein, 9 aa, Homo Sapiens
FGSTLHLDL

SEQ ID NO: 1223118 - protein, 9 aa, Homo Sapiens
IFIMGNHAS

SEQ ID NO: 1223119 - protein, 9 aa, Homo Sapiens
HLMRPLCLV

SEQ ID NO: 1223120 - protein, 9 aa, Homo Sapiens
KSGLDLCSV

SEQ ID NO: 1223121 - protein, 9 aa, Homo Sapiens
RNHTVCYDL

SEQ ID NO: 1223122 - protein, 9 aa, Homo Sapiens
SRTQTSKDD

SEQ ID NO: 1223123 - protein, 9 aa, Homo Sapiens
NYQMQSEEV

SEQ ID NO: 1223124 - protein, 9 aa, Homo Sapiens
DVVPSSFYV

SEQ ID NO: 1223125 - protein, 9 aa, Homo Sapiens
PPPPVKFSS

SEQ ID NO: 1223126 - protein, 9 aa, Homo Sapiens
NKLGIFRRW

SEQ ID NO: 1223127 - protein, 9 aa, Homo Sapiens
KKAENRQER

SEQ ID NO: 1223128 - protein, 9 aa, Homo Sapiens
MRSRGRGGP

SEQ ID NO: 1223129 - protein, 9 aa, Homo Sapiens
VMNVGNQNC

SEQ ID NO: 1223130 - protein, 9 aa, Homo Sapiens
ALGPLGSRT

SEQ ID NO: 1223131 - protein, 9 aa, Homo Sapiens
FKCPKGLGF

SEQ ID NO: 1223132 - protein, 9 aa, Homo Sapiens
GAQGEGQTE

SEQ ID NO: 1223133 - protein, 9 aa, Homo Sapiens
AISNAETFA

SEQ ID NO: 1223134 - protein, 9 aa, Homo Sapiens
CCPGPRHWS

SEQ ID NO: 1223135 - protein, 9 aa, Homo Sapiens
APRCPRSAV

SEQ ID NO: 1223136 - protein, 9 aa, Homo Sapiens
HYAKCIPYM

SEQ ID NO: 1223137 - protein, 9 aa, Homo Sapiens
GNAKTTRNV

SEQ ID NO: 1223138 - protein, 9 aa, Homo Sapiens
HYHLLHRYC

SEQ ID NO: 1223139 - protein, 9 aa, Homo Sapiens
RISSVDLSY

SEQ ID NO: 1223140 - protein, 9 aa, Homo Sapiens
MDECSARRG

SEQ ID NO: 1223141 - protein, 9 aa, Homo Sapiens
GAVYYESQR

SEQ ID NO: 1223142 - protein, 9 aa, Homo Sapiens
QDFLSVRPV

SEQ ID NO: 1223143 - protein, 9 aa, Homo Sapiens
AGYEERCFM

SEQ ID NO: 1223144 - protein, 9 aa, Homo Sapiens
FPQCTFFFL

SEQ ID NO: 1223145 - protein, 9 aa, Homo Sapiens
EELGPDGAT

SEQ ID NO: 1223146 - protein, 9 aa, Homo Sapiens
ILVCCLIFL

SEQ ID NO: 1223147 - protein, 9 aa, Homo Sapiens
EQMYQWAQV

SEQ ID NO: 1223148 - protein, 9 aa, Homo Sapiens
NAIKDVTKA

SEQ ID NO: 1223149 - protein, 9 aa, Homo Sapiens
GGDMGQQTN

SEQ ID NO: 1223150 - protein, 9 aa, Homo Sapiens
YFLGIKYLV

SEQ ID NO: 1223151 - protein, 9 aa, Homo Sapiens
TSVFMLHIW

SEQ ID NO: 1223152 - protein, 9 aa, Homo Sapiens
PEEEWTRQG

SEQ ID NO: 1223153 - protein, 9 aa, Homo Sapiens
SFGERLIFK

SEQ ID NO: 1223154 - protein, 9 aa, Homo Sapiens
KTCCLGMQH

SEQ ID NO: 1223155 - protein, 9 aa, Homo Sapiens
EQKLQVCCM

SEQ ID NO: 1223156 - protein, 9 aa, Homo Sapiens
EISKEGNHL

SEQ ID NO: 1223157 - protein, 9 aa, Homo Sapiens
EVDAHSGRC

SEQ ID NO: 1223158 - protein, 9 aa, Homo Sapiens
LNRFEEDKR

SEQ ID NO: 1223159 - protein, 9 aa, Homo Sapiens
RVCHVLAFL

SEQ ID NO: 1223160 - protein, 9 aa, Homo Sapiens
AICTGPVAQ

SEQ ID NO: 1223161 - protein, 9 aa, Homo Sapiens
FGERLIFKA

SEQ ID NO: 1223162 - protein, 9 aa, Homo Sapiens
EPPPAHPRP

SEQ ID NO: 1223163 - protein, 9 aa, Homo Sapiens
DNFNWGVCR

SEQ ID NO: 1223164 - protein, 9 aa, Homo Sapiens
KSGWADAKC

SEQ ID NO: 1223165 - protein, 9 aa, Homo Sapiens
GLKRTTYVM

SEQ ID NO: 1223166 - protein, 9 aa, Homo Sapiens
NLFTKLTFK

SEQ ID NO: 1223167 - protein, 9 aa, Homo Sapiens
KKGIHYETS

SEQ ID NO: 1223168 - protein, 9 aa, Homo Sapiens
PAANLEARA

SEQ ID NO: 1223169 - protein, 9 aa, Homo Sapiens
FLAELIYII

SEQ ID NO: 1223170 - protein, 9 aa, Homo Sapiens
IISYIFIDF

SEQ ID NO: 1223171 - protein, 9 aa, Homo Sapiens
VTFSDEHRT

SEQ ID NO: 1223172 - protein, 9 aa, Homo Sapiens
VLVKGLREA

SEQ ID NO: 1223173 - protein, 9 aa, Homo Sapiens
ILDCSIICV

SEQ ID NO: 1223174 - protein, 9 aa, Homo Sapiens
LEARAPHVC

SEQ ID NO: 1223175 - protein, 9 aa, Homo Sapiens
EQAPAPARS

SEQ ID NO: 1223176 - protein, 9 aa, Homo Sapiens
KPANILISD

SEQ ID NO: 1223177 - protein, 9 aa, Homo Sapiens
IDKVRFLVQ

SEQ ID NO: 1223178 - protein, 9 aa, Homo Sapiens
LRIHQRTHR

SEQ ID NO: 1223179 - protein, 9 aa, Homo Sapiens
SLFTSAAYT

SEQ ID NO: 1223180 - protein, 9 aa, Homo Sapiens
PEHVSSGGK

SEQ ID NO: 1223181 - protein, 9 aa, Homo Sapiens
MLDKTCISR

SEQ ID NO: 1223182 - protein, 9 aa, Homo Sapiens
LCTLCIAKK

SEQ ID NO: 1223183 - protein, 9 aa, Homo Sapiens
LEEARRCLR

SEQ ID NO: 1223184 - protein, 9 aa, Homo Sapiens
DLFDNTRDP

SEQ ID NO: 1223185 - protein, 9 aa, Homo Sapiens
MKQLQQQHP

SEQ ID NO: 1223186 - protein, 9 aa, Homo Sapiens
RRQKQESLM

SEQ ID NO: 1223187 - protein, 9 aa, Homo Sapiens
EVCFNMGHI

SEQ ID NO: 1223188 - protein, 9 aa, Homo Sapiens
WMCRHPRPQ

SEQ ID NO: 1223189 - protein, 9 aa, Homo Sapiens
NIRKKYPDR

SEQ ID NO: 1223190 - protein, 9 aa, Homo Sapiens
HRSRINTDF

SEQ ID NO: 1223191 - protein, 9 aa, Homo Sapiens
VDSLNNPQD

SEQ ID NO: 1223192 - protein, 9 aa, Homo Sapiens
WETDEAQFI

SEQ ID NO: 1223193 - protein, 9 aa, Homo Sapiens
QKEAKEIAK

SEQ ID NO: 1223194 - protein, 9 aa, Homo Sapiens
QHIRPVRVK

SEQ ID NO: 1223195 - protein, 9 aa, Homo Sapiens
HVLSRTRAC

SEQ ID NO: 1223196 - protein, 9 aa, Homo Sapiens
RKYIHWQEE

SEQ ID NO: 1223197 - protein, 9 aa, Homo Sapiens
TNKDSTSPG

SEQ ID NO: 1223198 - protein, 9 aa, Homo Sapiens
FPGCRMCPW

SEQ ID NO: 1223199 - protein, 9 aa, Homo Sapiens
TATSQGFFQ

SEQ ID NO: 1223200 - protein, 9 aa, Homo Sapiens
VVQRFLCLL

SEQ ID NO: 1223201 - protein, 9 aa, Homo Sapiens
VLLSIPWTQ

SEQ ID NO: 1223202 - protein, 9 aa, Homo Sapiens
MRMCAARLT

SEQ ID NO: 1223203 - protein, 9 aa, Homo Sapiens
GCTVPVESD

SEQ ID NO: 1223204 - protein, 9 aa, Homo Sapiens
LADLPKRLP

SEQ ID NO: 1223205 - protein, 9 aa, Homo Sapiens
CGKVFGVRS

SEQ ID NO: 1223206 - protein, 9 aa, Homo Sapiens
TDVNKAIDQ

SEQ ID NO: 1223207 - protein, 9 aa, Homo Sapiens
EVSEGTTGN

SEQ ID NO: 1223208 - protein, 9 aa, Homo Sapiens
HRKIKRDII

SEQ ID NO: 1223209 - protein, 9 aa, Homo Sapiens
NLQTATSTC

SEQ ID NO: 1223210 - protein, 9 aa, Homo Sapiens
HQSDTEANE

SEQ ID NO: 1223211 - protein, 9 aa, Homo Sapiens
GAVWTNERL

SEQ ID NO: 1223212 - protein, 9 aa, Homo Sapiens
MFPWMRPHT

SEQ ID NO: 1223213 - protein, 9 aa, Homo Sapiens
TFLTLLGNG

SEQ ID NO: 1223214 - protein, 9 aa, Homo Sapiens
ECITMSNSM

SEQ ID NO: 1223215 - protein, 9 aa, Homo Sapiens
TLPSGRTVS

SEQ ID NO: 1223216 - protein, 9 aa, Homo Sapiens
VCRIICTYH

SEQ ID NO: 1223217 - protein, 9 aa, Homo Sapiens
AEWCHAHGM

SEQ ID NO: 1223218 - protein, 9 aa, Homo Sapiens
LPFEPHTAV

SEQ ID NO: 1223219 - protein, 9 aa, Homo Sapiens
GGKWLVSGG

SEQ ID NO: 1223220 - protein, 9 aa, Homo Sapiens
CLDGAKLHC

SEQ ID NO: 1223221 - protein, 9 aa, Homo Sapiens
WYRVDFQGM

SEQ ID NO: 1223222 - protein, 9 aa, Homo Sapiens
GGHTQDLPG

SEQ ID NO: 1223223 - protein, 9 aa, Homo Sapiens
YLAECLQPK

SEQ ID NO: 1223224 - protein, 9 aa, Homo Sapiens
IQLFHKKLS

SEQ ID NO: 1223225 - protein, 9 aa, Homo Sapiens
DLQVNNGIT

SEQ ID NO: 1223226 - protein, 9 aa, Homo Sapiens
CNGSNCFGQ

SEQ ID NO: 1223227 - protein, 9 aa, Homo Sapiens
EILFYDQIL

SEQ ID NO: 1223228 - protein, 9 aa, Homo Sapiens
MWPMARGLN

SEQ ID NO: 1223229 - protein, 9 aa, Homo Sapiens
NRVPFDPLS

SEQ ID NO: 1223230 - protein, 9 aa, Homo Sapiens
IFYILVGGL

SEQ ID NO: 1223231 - protein, 9 aa, Homo Sapiens
LCTIGELLA

SEQ ID NO: 1223232 - protein, 9 aa, Homo Sapiens
DAELQAKIQ

SEQ ID NO: 1223233 - protein, 9 aa, Homo Sapiens
VVEELQSII

SEQ ID NO: 1223234 - protein, 9 aa, Homo Sapiens
NLHPDVTGQ

SEQ ID NO: 1223235 - protein, 9 aa, Homo Sapiens
EACFSLVIP

SEQ ID NO: 1223236 - protein, 9 aa, Homo Sapiens
KEARVWEAT

SEQ ID NO: 1223237 - protein, 9 aa, Homo Sapiens
QKQESLMVL

SEQ ID NO: 1223238 - protein, 9 aa, Homo Sapiens
SRGSGCRGC

SEQ ID NO: 1223239 - protein, 9 aa, Homo Sapiens
GVNLFDTTE

SEQ ID NO: 1223240 - protein, 9 aa, Homo Sapiens
HLGDSENKK

SEQ ID NO: 1223241 - protein, 9 aa, Homo Sapiens
CADLKVKVR

SEQ ID NO: 1223242 - protein, 9 aa, Homo Sapiens
SVPSSPAVL

SEQ ID NO: 1223243 - protein, 9 aa, Homo Sapiens
PESESITFL

SEQ ID NO: 1223244 - protein, 9 aa, Homo Sapiens
VNQHRDSYY

SEQ ID NO: 1223245 - protein, 9 aa, Homo Sapiens
LWLQRNEIA

SEQ ID NO: 1223246 - protein, 9 aa, Homo Sapiens
AGLPLAPQP

SEQ ID NO: 1223247 - protein, 9 aa, Homo Sapiens
ANALARYDS

SEQ ID NO: 1223248 - protein, 9 aa, Homo Sapiens
AIMTQLPQE

SEQ ID NO: 1223249 - protein, 9 aa, Homo Sapiens
IKPLERHVE

SEQ ID NO: 1223250 - protein, 9 aa, Homo Sapiens
FDDKFDDEE

SEQ ID NO: 1223251 - protein, 9 aa, Homo Sapiens
PPSWTMDPQ

SEQ ID NO: 1223252 - protein, 9 aa, Homo Sapiens
YEGYTLPHA

SEQ ID NO: 1223253 - protein, 9 aa, Homo Sapiens
SLSQSKEGS

SEQ ID NO: 1223254 - protein, 9 aa, Homo Sapiens
STAFPEVSF

SEQ ID NO: 1223255 - protein, 9 aa, Homo Sapiens
SPINPAMAL

SEQ ID NO: 1223256 - protein, 9 aa, Homo Sapiens
TRSKGVGPA

SEQ ID NO: 1223257 - protein, 9 aa, Homo Sapiens
LIMYRKSGL

SEQ ID NO: 1223258 - protein, 9 aa, Homo Sapiens
SLVNVFLCM

SEQ ID NO: 1223259 - protein, 9 aa, Homo Sapiens
TDTTENLGA

SEQ ID NO: 1223260 - protein, 9 aa, Homo Sapiens
LTRLAYALP

SEQ ID NO: 1223261 - protein, 9 aa, Homo Sapiens
VHPVAELPR

SEQ ID NO: 1223262 - protein, 9 aa, Homo Sapiens
DIYMLNLAI

SEQ ID NO: 1223263 - protein, 9 aa, Homo Sapiens
YIKAALYVG

SEQ ID NO: 1223264 - protein, 9 aa, Homo Sapiens
KVALVILFI

SEQ ID NO: 1223265 - protein, 9 aa, Homo Sapiens
YRSHNPTLH

SEQ ID NO: 1223266 - protein, 9 aa, Homo Sapiens
GVTVKTDVC

SEQ ID NO: 1223267 - protein, 9 aa, Homo Sapiens
KDHGSGSVA

SEQ ID NO: 1223268 - protein, 9 aa, Homo Sapiens
GINAELSLD

SEQ ID NO: 1223269 - protein, 9 aa, Homo Sapiens
TDSSFSFMV

SEQ ID NO: 1223270 - protein, 9 aa, Homo Sapiens
IEHMPPKSV

SEQ ID NO: 1223271 - protein, 9 aa, Homo Sapiens
TSLKSGKTE

SEQ ID NO: 1223272 - protein, 9 aa, Homo Sapiens
VLYPPECYG

SEQ ID NO: 1223273 - protein, 9 aa, Homo Sapiens
NEDFLKCNA

SEQ ID NO: 1223274 - protein, 9 aa, Homo Sapiens
VSWYDLEHG

SEQ ID NO: 1223275 - protein, 9 aa, Homo Sapiens
PQGPNLEWL

SEQ ID NO: 1223276 - protein, 9 aa, Homo Sapiens
CENENGEEE

SEQ ID NO: 1223277 - protein, 9 aa, Homo Sapiens
PPASQGIGP

SEQ ID NO: 1223278 - protein, 9 aa, Homo Sapiens
ENFSVLDLM

SEQ ID NO: 1223279 - protein, 9 aa, Homo Sapiens
SLVKISEEL

SEQ ID NO: 1223280 - protein, 9 aa, Homo Sapiens
CLKSTPIVG

SEQ ID NO: 1223281 - protein, 9 aa, Homo Sapiens
EHPRLPLAH

SEQ ID NO: 1223282 - protein, 9 aa, Homo Sapiens
WTRLPRRSC

SEQ ID NO: 1223283 - protein, 9 aa, Homo Sapiens
DNKRIVSGV

SEQ ID NO: 1223284 - protein, 9 aa, Homo Sapiens
WLTADMISH

SEQ ID NO: 1223285 - protein, 9 aa, Homo Sapiens
LYVNITKQD

SEQ ID NO: 1223286 - protein, 9 aa, Homo Sapiens
IDIGTFDIY

SEQ ID NO: 1223287 - protein, 9 aa, Homo Sapiens
GLRPTRKVA

SEQ ID NO: 1223288 - protein, 9 aa, Homo Sapiens
YNPNQVRMW

SEQ ID NO: 1223289 - protein, 9 aa, Homo Sapiens
NQTAILVCC

SEQ ID NO: 1223290 - protein, 9 aa, Homo Sapiens
LLLRFLAVM

SEQ ID NO: 1223291 - protein, 9 aa, Homo Sapiens
FSMTDFLLE

SEQ ID NO: 1223292 - protein, 9 aa, Homo Sapiens
ERSYFGSMG

SEQ ID NO: 1223293 - protein, 9 aa, Homo Sapiens
VEYSFSLIS

SEQ ID NO: 1223294 - protein, 9 aa, Homo Sapiens
QCAGGVRTR

SEQ ID NO: 1223295 - protein, 9 aa, Homo Sapiens
SYYFCITLG

SEQ ID NO: 1223296 - protein, 9 aa, Homo Sapiens
HLLRMSAAY

SEQ ID NO: 1223297 - protein, 9 aa, Homo Sapiens
NMGHITLAK

SEQ ID NO: 1223298 - protein, 9 aa, Homo Sapiens
HFRYPERPI

SEQ ID NO: 1223299 - protein, 9 aa, Homo Sapiens
ERIASEDSR

SEQ ID NO: 1223300 - protein, 9 aa, Homo Sapiens
VTNVRRHLK

SEQ ID NO: 1223301 - protein, 9 aa, Homo Sapiens
FGCPDGGDG

SEQ ID NO: 1223302 - protein, 9 aa, Homo Sapiens
GKYGPTLLC

SEQ ID NO: 1223303 - protein, 9 aa, Homo Sapiens
TILGLTGVT

SEQ ID NO: 1223304 - protein, 9 aa, Homo Sapiens
LMGNGRHCN

SEQ ID NO: 1223305 - protein, 9 aa, Homo Sapiens
GLLLSCIDD

SEQ ID NO: 1223306 - protein, 9 aa, Homo Sapiens
YQQFWSSPS

SEQ ID NO: 1223307 - protein, 9 aa, Homo Sapiens
TYGIQPHLD

SEQ ID NO: 1223308 - protein, 9 aa, Homo Sapiens
KVRLVCSVT

SEQ ID NO: 1223309 - protein, 9 aa, Homo Sapiens
SLEYKHRIK

SEQ ID NO: 1223310 - protein, 9 aa, Homo Sapiens
VCRETPKGG

SEQ ID NO: 1223311 - protein, 9 aa, Homo Sapiens
TNLARHHRL

SEQ ID NO: 1223312 - protein, 9 aa, Homo Sapiens
PLKFQETET

SEQ ID NO: 1223313 - protein, 9 aa, Homo Sapiens
KICLKASIK

SEQ ID NO: 1223314 - protein, 9 aa, Homo Sapiens
AQETLKYTL

SEQ ID NO: 1223315 - protein, 9 aa, Homo Sapiens
FPQHVKNQG

SEQ ID NO: 1223316 - protein, 9 aa, Homo Sapiens
QKLLIKMKQ

SEQ ID NO: 1223317 - protein, 9 aa, Homo Sapiens
CKHCFKKRT

SEQ ID NO: 1223318 - protein, 9 aa, Homo Sapiens
SKNTQYENI

SEQ ID NO: 1223319 - protein, 9 aa, Homo Sapiens
KIVTDIDEL

SEQ ID NO: 1223320 - protein, 9 aa, Homo Sapiens
DTGSFAGLP

SEQ ID NO: 1223321 - protein, 9 aa, Homo Sapiens
HGVKKPNKK

SEQ ID NO: 1223322 - protein, 9 aa, Homo Sapiens
ECDKALNNG

SEQ ID NO: 1223323 - protein, 9 aa, Homo Sapiens
SISGLITLC

SEQ ID NO: 1223324 - protein, 9 aa, Homo Sapiens
AAGAEAVRG

SEQ ID NO: 1223325 - protein, 9 aa, Homo Sapiens
MKIKPRLKS

SEQ ID NO: 1223326 - protein, 9 aa, Homo Sapiens
HGVKIGFFQ

SEQ ID NO: 1223327 - protein, 9 aa, Homo Sapiens
ETSVQPILV

SEQ ID NO: 1223328 - protein, 9 aa, Homo Sapiens
YMDVNECRQ

SEQ ID NO: 1223329 - protein, 9 aa, Homo Sapiens
ESRDHNQTA

SEQ ID NO: 1223330 - protein, 9 aa, Homo Sapiens
NECHLCAES

SEQ ID NO: 1223331 - protein, 9 aa, Homo Sapiens
DFILMDTFE

SEQ ID NO: 1223332 - protein, 9 aa, Homo Sapiens
TVLRLIKLL

SEQ ID NO: 1223333 - protein, 9 aa, Homo Sapiens
GPTLLCAGW

SEQ ID NO: 1223334 - protein, 9 aa, Homo Sapiens
NVKYANMWL

SEQ ID NO: 1223335 - protein, 9 aa, Homo Sapiens
DGLTFGHMK

SEQ ID NO: 1223336 - protein, 9 aa, Homo Sapiens
EKIVALMSS

SEQ ID NO: 1223337 - protein, 9 aa, Homo Sapiens
TSVEQYVPS

SEQ ID NO: 1223338 - protein, 9 aa, Homo Sapiens
YRDGMIIDN

SEQ ID NO: 1223339 - protein, 9 aa, Homo Sapiens
QNKQTFLVE

SEQ ID NO: 1223340 - protein, 9 aa, Homo Sapiens
PMSRQENDA

SEQ ID NO: 1223341 - protein, 9 aa, Homo Sapiens
AYYIYSGGK

SEQ ID NO: 1223342 - protein, 9 aa, Homo Sapiens
LVACRVEMS

SEQ ID NO: 1223343 - protein, 9 aa, Homo Sapiens
KTTISPAQL

SEQ ID NO: 1223344 - protein, 9 aa, Homo Sapiens
FFIYSQINI

SEQ ID NO: 1223345 - protein, 9 aa, Homo Sapiens
DEPRKKYMD

SEQ ID NO: 1223346 - protein, 9 aa, Homo Sapiens
WGLYIAVIF

SEQ ID NO: 1223347 - protein, 9 aa, Homo Sapiens
SRCFHHCNP

SEQ ID NO: 1223348 - protein, 9 aa, Homo Sapiens
REDHHLPRL

SEQ ID NO: 1223349 - protein, 9 aa, Homo Sapiens
VGTWSFLTA

SEQ ID NO: 1223350 - protein, 9 aa, Homo Sapiens
EASGFCVEC

SEQ ID NO: 1223351 - protein, 9 aa, Homo Sapiens
VLTRWEMHH

SEQ ID NO: 1223352 - protein, 9 aa, Homo Sapiens
PDIYAREML

SEQ ID NO: 1223353 - protein, 9 aa, Homo Sapiens
FWFLQYNGM

SEQ ID NO: 1223354 - protein, 9 aa, Homo Sapiens
EADLLRRSD

SEQ ID NO: 1223355 - protein, 9 aa, Homo Sapiens
SNYQRVHTG

SEQ ID NO: 1223356 - protein, 9 aa, Homo Sapiens
LKATADEFI

SEQ ID NO: 1223357 - protein, 9 aa, Homo Sapiens
KDFSLKTIS

SEQ ID NO: 1223358 - protein, 9 aa, Homo Sapiens
FPTIVVARL

SEQ ID NO: 1223359 - protein, 9 aa, Homo Sapiens
HILDIFRRL

SEQ ID NO: 1223360 - protein, 9 aa, Homo Sapiens
GKAFLPERK

SEQ ID NO: 1223361 - protein, 9 aa, Homo Sapiens
APGCTGTLV

SEQ ID NO: 1223362 - protein, 9 aa, Homo Sapiens
TSSWDSFLR

SEQ ID NO: 1223363 - protein, 9 aa, Homo Sapiens
KSEGDEDYT

SEQ ID NO: 1223364 - protein, 9 aa, Homo Sapiens
EGLIETKHP

SEQ ID NO: 1223365 - protein, 9 aa, Homo Sapiens
KKAYPSEKS

SEQ ID NO: 1223366 - protein, 9 aa, Homo Sapiens
VFLVVYMIT

SEQ ID NO: 1223367 - protein, 9 aa, Homo Sapiens
LFYFFYDVI

SEQ ID NO: 1223368 - protein, 9 aa, Homo Sapiens
GWSSSEKKT

SEQ ID NO: 1223369 - protein, 9 aa, Homo Sapiens
KKKLRYVFK

SEQ ID NO: 1223370 - protein, 9 aa, Homo Sapiens
FMDMMQIYD

SEQ ID NO: 1223371 - protein, 9 aa, Homo Sapiens
CQEILERSR

SEQ ID NO: 1223372 - protein, 9 aa, Homo Sapiens
FKKPIKFYS

SEQ ID NO: 1223373 - protein, 9 aa, Homo Sapiens
AVPLPCGPT

SEQ ID NO: 1223374 - protein, 9 aa, Homo Sapiens
EPLLPRSQP

SEQ ID NO: 1223375 - protein, 9 aa, Homo Sapiens
TSPSLASCA

SEQ ID NO: 1223376 - protein, 9 aa, Homo Sapiens
LTSLLITAT

SEQ ID NO: 1223377 - protein, 9 aa, Homo Sapiens
LVSLTVLLA

SEQ ID NO: 1223378 - protein, 9 aa, Homo Sapiens
SGVCFGDGS

SEQ ID NO: 1223379 - protein, 9 aa, Homo Sapiens
PPNLNELAS

SEQ ID NO: 1223380 - protein, 9 aa, Homo Sapiens
TVAVQVPQC

SEQ ID NO: 1223381 - protein, 9 aa, Homo Sapiens
VLLAGLLSR

SEQ ID NO: 1223382 - protein, 9 aa, Homo Sapiens
ALSGRLWAI

SEQ ID NO: 1223383 - protein, 9 aa, Homo Sapiens
INGSVRLWH

SEQ ID NO: 1223384 - protein, 9 aa, Homo Sapiens
LAGISLRGQ

SEQ ID NO: 1223385 - protein, 9 aa, Homo Sapiens
RELLSEAKA

SEQ ID NO: 1223386 - protein, 9 aa, Homo Sapiens
GENTDASAS

SEQ ID NO: 1223387 - protein, 9 aa, Homo Sapiens
RSGNSPMAR

SEQ ID NO: 1223388 - protein, 9 aa, Homo Sapiens
FRNTIGNSQ

SEQ ID NO: 1223389 - protein, 9 aa, Homo Sapiens
PPSPYHADP

SEQ ID NO: 1223390 - protein, 9 aa, Homo Sapiens
LTLTVPGIF

SEQ ID NO: 1223391 - protein, 9 aa, Homo Sapiens
PAIQPLDDD

SEQ ID NO: 1223392 - protein, 9 aa, Homo Sapiens
VINCNGFAL

SEQ ID NO: 1223393 - protein, 9 aa, Homo Sapiens
KQVLFLQLQ

SEQ ID NO: 1223394 - protein, 9 aa, Homo Sapiens
FGLYSIFTE

SEQ ID NO: 1223395 - protein, 9 aa, Homo Sapiens
GREPLVGTS

SEQ ID NO: 1223396 - protein, 9 aa, Homo Sapiens
LLQELNRTY

SEQ ID NO: 1223397 - protein, 9 aa, Homo Sapiens
RHASCYIKD

SEQ ID NO: 1223398 - protein, 9 aa, Homo Sapiens
HSDSPRRLC

SEQ ID NO: 1223399 - protein, 9 aa, Homo Sapiens
DAHLLNDAL

SEQ ID NO: 1223400 - protein, 9 aa, Homo Sapiens
FVRKQFANV

SEQ ID NO: 1223401 - protein, 9 aa, Homo Sapiens
HIADGLRYL

SEQ ID NO: 1223402 - protein, 9 aa, Homo Sapiens
ISKATEHLE

SEQ ID NO: 1223403 - protein, 9 aa, Homo Sapiens
LSPGADHMA

SEQ ID NO: 1223404 - protein, 9 aa, Homo Sapiens
VLGLHEKET

SEQ ID NO: 1223405 - protein, 9 aa, Homo Sapiens
ARRFLEKDR

SEQ ID NO: 1223406 - protein, 9 aa, Homo Sapiens
VHVCNECGK

SEQ ID NO: 1223407 - protein, 9 aa, Homo Sapiens
LRNVLWVHS

SEQ ID NO: 1223408 - protein, 9 aa, Homo Sapiens
GAYSYPMSA

SEQ ID NO: 1223409 - protein, 9 aa, Homo Sapiens
FWPLYEAAP

SEQ ID NO: 1223410 - protein, 9 aa, Homo Sapiens
GSNVGECDG

SEQ ID NO: 1223411 - protein, 9 aa, Homo Sapiens
LMPFLQNLC

SEQ ID NO: 1223412 - protein, 9 aa, Homo Sapiens
EGNHPGTSF

SEQ ID NO: 1223413 - protein, 9 aa, Homo Sapiens
FFLEGVRAV

SEQ ID NO: 1223414 - protein, 9 aa, Homo Sapiens
VSVGYGIRK

SEQ ID NO: 1223415 - protein, 9 aa, Homo Sapiens
DPVTLYNQA

SEQ ID NO: 1223416 - protein, 9 aa, Homo Sapiens
QCTSPQLGT

SEQ ID NO: 1223417 - protein, 9 aa, Homo Sapiens
VFLYMWSFC

SEQ ID NO: 1223418 - protein, 9 aa, Homo Sapiens
LRELWQRLE

SEQ ID NO: 1223419 - protein, 9 aa, Homo Sapiens
GPCVHVPPS

SEQ ID NO: 1223420 - protein, 9 aa, Homo Sapiens
EEWTRQGWQ

SEQ ID NO: 1223421 - protein, 9 aa, Homo Sapiens
APPESPQTR

SEQ ID NO: 1223422 - protein, 9 aa, Homo Sapiens
FSEIERHAQ

SEQ ID NO: 1223423 - protein, 9 aa, Homo Sapiens
ETAVSASDI

SEQ ID NO: 1223424 - protein, 9 aa, Homo Sapiens
VSGSDIMRS

SEQ ID NO: 1223425 - protein, 9 aa, Homo Sapiens
CGYIKNKLV

SEQ ID NO: 1223426 - protein, 9 aa, Homo Sapiens
ATTSLENTK

SEQ ID NO: 1223427 - protein, 9 aa, Homo Sapiens
MLTLTRICT

SEQ ID NO: 1223428 - protein, 9 aa, Homo Sapiens
GLTKCVKKS

SEQ ID NO: 1223429 - protein, 9 aa, Homo Sapiens
IEYDAYHTD

SEQ ID NO: 1223430 - protein, 9 aa, Homo Sapiens
DSVIPLTKR

SEQ ID NO: 1223431 - protein, 9 aa, Homo Sapiens
PPPPPPHGP

SEQ ID NO: 1223432 - protein, 9 aa, Homo Sapiens
MTKTESPRT

SEQ ID NO: 1223433 - protein, 9 aa, Homo Sapiens
LNSHGTSSR

SEQ ID NO: 1223434 - protein, 9 aa, Homo Sapiens
IRQSLPNRN

SEQ ID NO: 1223435 - protein, 9 aa, Homo Sapiens
SPVFHVYPL

SEQ ID NO: 1223436 - protein, 9 aa, Homo Sapiens
HNLHSLPGV

SEQ ID NO: 1223437 - protein, 9 aa, Homo Sapiens
LKWFGLWKS

SEQ ID NO: 1223438 - protein, 9 aa, Homo Sapiens
LSLRRSVDP

SEQ ID NO: 1223439 - protein, 9 aa, Homo Sapiens
FQHVVTVEA

SEQ ID NO: 1223440 - protein, 9 aa, Homo Sapiens
VYNWVKARR

SEQ ID NO: 1223441 - protein, 9 aa, Homo Sapiens
LLRTSPSWA

SEQ ID NO: 1223442 - protein, 9 aa, Homo Sapiens
LLKISEGNH

SEQ ID NO: 1223443 - protein, 9 aa, Homo Sapiens
CVRHWHLWK

SEQ ID NO: 1223444 - protein, 9 aa, Homo Sapiens
CAIRNEVTY

SEQ ID NO: 1223445 - protein, 9 aa, Homo Sapiens
TSLRYSPTG

SEQ ID NO: 1223446 - protein, 9 aa, Homo Sapiens
KNQEHEEKI

SEQ ID NO: 1223447 - protein, 9 aa, Homo Sapiens
KCFMVKDLS

SEQ ID NO: 1223448 - protein, 9 aa, Homo Sapiens
NFYVIDIGT

SEQ ID NO: 1223449 - protein, 9 aa, Homo Sapiens
LIRFWLPFG

SEQ ID NO: 1223450 - protein, 9 aa, Homo Sapiens
NPLAQSQDL

SEQ ID NO: 1223451 - protein, 9 aa, Homo Sapiens
SRCQNQDRI

SEQ ID NO: 1223452 - protein, 9 aa, Homo Sapiens
PSFTQEHKT

SEQ ID NO: 1223453 - protein, 9 aa, Homo Sapiens
PREQTWLDP

SEQ ID NO: 1223454 - protein, 9 aa, Homo Sapiens
DRVGHCVIK

SEQ ID NO: 1223455 - protein, 9 aa, Homo Sapiens
KSTPWQPTR

SEQ ID NO: 1223456 - protein, 9 aa, Homo Sapiens
PPTWPTQTW

SEQ ID NO: 1223457 - protein, 9 aa, Homo Sapiens
QQQLRKRDV

SEQ ID NO: 1223458 - protein, 9 aa, Homo Sapiens
PGLPGISGQ

SEQ ID NO: 1223459 - protein, 9 aa, Homo Sapiens
HIVFTDQVL

SEQ ID NO: 1223460 - protein, 9 aa, Homo Sapiens
SKYNHDNEK

SEQ ID NO: 1223461 - protein, 9 aa, Homo Sapiens
PSRGKSRWR

SEQ ID NO: 1223462 - protein, 9 aa, Homo Sapiens
CTNIDLLLE

SEQ ID NO: 1223463 - protein, 9 aa, Homo Sapiens
EASRLLADD

SEQ ID NO: 1223464 - protein, 9 aa, Homo Sapiens
PRHETPPGA

SEQ ID NO: 1223465 - protein, 9 aa, Homo Sapiens
DEKKMDIFE

SEQ ID NO: 1223466 - protein, 9 aa, Homo Sapiens
SSFGMAQKR

SEQ ID NO: 1223467 - protein, 9 aa, Homo Sapiens
DHLTSCVWP

SEQ ID NO: 1223468 - protein, 9 aa, Homo Sapiens
ANCSLYMSC

SEQ ID NO: 1223469 - protein, 9 aa, Homo Sapiens
GWWAPACTR

SEQ ID NO: 1223470 - protein, 9 aa, Homo Sapiens
VRLIKESGA

SEQ ID NO: 1223471 - protein, 9 aa, Homo Sapiens
HSNTSILLT

SEQ ID NO: 1223472 - protein, 9 aa, Homo Sapiens
HPRCGVPDP

SEQ ID NO: 1223473 - protein, 9 aa, Homo Sapiens
TTIQDWSLK

SEQ ID NO: 1223474 - protein, 9 aa, Homo Sapiens
SHAGHVLAP

SEQ ID NO: 1223475 - protein, 9 aa, Homo Sapiens
EEESGQEET

SEQ ID NO: 1223476 - protein, 9 aa, Homo Sapiens
LCTCLPSKP

SEQ ID NO: 1223477 - protein, 9 aa, Homo Sapiens
LIDKCWVLG

SEQ ID NO: 1223478 - protein, 9 aa, Homo Sapiens
QSGIGHAMV

SEQ ID NO: 1223479 - protein, 9 aa, Homo Sapiens
IVAARRCKT

SEQ ID NO: 1223480 - protein, 9 aa, Homo Sapiens
WYPPTPNTV

SEQ ID NO: 1223481 - protein, 9 aa, Homo Sapiens
PLQRRLPKP

SEQ ID NO: 1223482 - protein, 9 aa, Homo Sapiens
NIISQPKRT

SEQ ID NO: 1223483 - protein, 9 aa, Homo Sapiens
LRFPDNDSL

SEQ ID NO: 1223484 - protein, 9 aa, Homo Sapiens
KCIHQNLED

SEQ ID NO: 1223485 - protein, 9 aa, Homo Sapiens
VSGLRSVHV

SEQ ID NO: 1223486 - protein, 9 aa, Homo Sapiens
QDNRNTSPS

SEQ ID NO: 1223487 - protein, 9 aa, Homo Sapiens
GSMFQNVTE

SEQ ID NO: 1223488 - protein, 9 aa, Homo Sapiens
DEPDILDCL

SEQ ID NO: 1223489 - protein, 9 aa, Homo Sapiens
THHRVTLLA

SEQ ID NO: 1223490 - protein, 9 aa, Homo Sapiens
SVLPYHDST

SEQ ID NO: 1223491 - protein, 9 aa, Homo Sapiens
RKGLFPFMH

SEQ ID NO: 1223492 - protein, 9 aa, Homo Sapiens
PVDYEEFVC

SEQ ID NO: 1223493 - protein, 9 aa, Homo Sapiens
LKKKWYLQA

SEQ ID NO: 1223494 - protein, 9 aa, Homo Sapiens
PKQEKDFSL

SEQ ID NO: 1223495 - protein, 9 aa, Homo Sapiens
VVWGVVLNQ

SEQ ID NO: 1223496 - protein, 9 aa, Homo Sapiens
ILKILEGGN

SEQ ID NO: 1223497 - protein, 9 aa, Homo Sapiens
RKEILHFHK

SEQ ID NO: 1223498 - protein, 9 aa, Homo Sapiens
PADQLCLDP

SEQ ID NO: 1223499 - protein, 9 aa, Homo Sapiens
LVIITVFTS

SEQ ID NO: 1223500 - protein, 9 aa, Homo Sapiens
FLEGSSTLN

SEQ ID NO: 1223501 - protein, 9 aa, Homo Sapiens
KVDLEPERD

SEQ ID NO: 1223502 - protein, 9 aa, Homo Sapiens
FKKANWKKI

SEQ ID NO: 1223503 - protein, 9 aa, Homo Sapiens
SHSSSCSGP

SEQ ID NO: 1223504 - protein, 9 aa, Homo Sapiens
PPNMISNRR

SEQ ID NO: 1223505 - protein, 9 aa, Homo Sapiens
MQMVAQPQG

SEQ ID NO: 1223506 - protein, 9 aa, Homo Sapiens
HLCAESLKS

SEQ ID NO: 1223507 - protein, 9 aa, Homo Sapiens
RNFSKHPQH

SEQ ID NO: 1223508 - protein, 9 aa, Homo Sapiens
QPLLQHPQQ

SEQ ID NO: 1223509 - protein, 9 aa, Homo Sapiens
CKDSATELL

SEQ ID NO: 1223510 - protein, 9 aa, Homo Sapiens
GGGRNTDHH

SEQ ID NO: 1223511 - protein, 9 aa, Homo Sapiens
LGSWMATEA

SEQ ID NO: 1223512 - protein, 9 aa, Homo Sapiens
GGRTMGLLV

SEQ ID NO: 1223513 - protein, 9 aa, Homo Sapiens
LIRRKIVTM

SEQ ID NO: 1223514 - protein, 9 aa, Homo Sapiens
CLKEISQDE

SEQ ID NO: 1223515 - protein, 9 aa, Homo Sapiens
ANDRNDRVI

SEQ ID NO: 1223516 - protein, 9 aa, Homo Sapiens
KNRNETELT

SEQ ID NO: 1223517 - protein, 9 aa, Homo Sapiens
FCGGNLRSY

SEQ ID NO: 1223518 - protein, 9 aa, Homo Sapiens
LRDLRHTLH

SEQ ID NO: 1223519 - protein, 9 aa, Homo Sapiens
VQNFIKDKG

SEQ ID NO: 1223520 - protein, 9 aa, Homo Sapiens
HALAAAAKK

SEQ ID NO: 1223521 - protein, 9 aa, Homo Sapiens
ETRSPGLNS

SEQ ID NO: 1223522 - protein, 9 aa, Homo Sapiens
VTMAVLLVQ

SEQ ID NO: 1223523 - protein, 9 aa, Homo Sapiens
YIQAIMMMD

SEQ ID NO: 1223524 - protein, 9 aa, Homo Sapiens
LTPNPKNSS

SEQ ID NO: 1223525 - protein, 9 aa, Homo Sapiens
LIYKLSGCR

SEQ ID NO: 1223526 - protein, 9 aa, Homo Sapiens
WRQTPLPVS

SEQ ID NO: 1223527 - protein, 9 aa, Homo Sapiens
ELQVTAGHH

SEQ ID NO: 1223528 - protein, 9 aa, Homo Sapiens
SHGSTLSKS

SEQ ID NO: 1223529 - protein, 9 aa, Homo Sapiens
RLCNEGTRK

SEQ ID NO: 1223530 - protein, 9 aa, Homo Sapiens
HMAHRSQKS

SEQ ID NO: 1223531 - protein, 9 aa, Homo Sapiens
SQTQENTEY

SEQ ID NO: 1223532 - protein, 9 aa, Homo Sapiens
SVLRMALGE

SEQ ID NO: 1223533 - protein, 9 aa, Homo Sapiens
LNSSMPIFF

SEQ ID NO: 1223534 - protein, 9 aa, Homo Sapiens
CGETLQEFN

SEQ ID NO: 1223535 - protein, 9 aa, Homo Sapiens
GQERCVLVN

SEQ ID NO: 1223536 - protein, 9 aa, Homo Sapiens
FLGGGIDTS

SEQ ID NO: 1223537 - protein, 9 aa, Homo Sapiens
RVGIGHNGH

SEQ ID NO: 1223538 - protein, 9 aa, Homo Sapiens
YPIIGKCLK

SEQ ID NO: 1223539 - protein, 9 aa, Homo Sapiens
QRVTLEGRP

SEQ ID NO: 1223540 - protein, 9 aa, Homo Sapiens
DENFTKDIT

SEQ ID NO: 1223541 - protein, 9 aa, Homo Sapiens
VDTADRLTS

SEQ ID NO: 1223542 - protein, 9 aa, Homo Sapiens
LLSVFGSLR

SEQ ID NO: 1223543 - protein, 9 aa, Homo Sapiens
IHFDDNQCG

SEQ ID NO: 1223544 - protein, 9 aa, Homo Sapiens
RHTLNKCTS

SEQ ID NO: 1223545 - protein, 9 aa, Homo Sapiens
EYYDDYYGY

SEQ ID NO: 1223546 - protein, 9 aa, Homo Sapiens
KDVMTKTES

SEQ ID NO: 1223547 - protein, 9 aa, Homo Sapiens
DADLEEWLK

SEQ ID NO: 1223548 - protein, 9 aa, Homo Sapiens
QTGPQLQAL

SEQ ID NO: 1223549 - protein, 9 aa, Homo Sapiens
GSGGSESQG

SEQ ID NO: 1223550 - protein, 9 aa, Homo Sapiens
HPRPQLSLT

SEQ ID NO: 1223551 - protein, 9 aa, Homo Sapiens
RAVCHDEPS

SEQ ID NO: 1223552 - protein, 9 aa, Homo Sapiens
EGDTLELTC

SEQ ID NO: 1223553 - protein, 9 aa, Homo Sapiens
WDCNTGKYL

SEQ ID NO: 1223554 - protein, 9 aa, Homo Sapiens
KLIHPPLKE

SEQ ID NO: 1223555 - protein, 9 aa, Homo Sapiens
SFKYVTVGF

SEQ ID NO: 1223556 - protein, 9 aa, Homo Sapiens
DRDYRLPRV

SEQ ID NO: 1223557 - protein, 9 aa, Homo Sapiens
YNDGHVFPP

SEQ ID NO: 1223558 - protein, 9 aa, Homo Sapiens
HIANMCAAL

SEQ ID NO: 1223559 - protein, 9 aa, Homo Sapiens
VQCGVQGVQ

SEQ ID NO: 1223560 - protein, 9 aa, Homo Sapiens
MKKMSSDSH

SEQ ID NO: 1223561 - protein, 9 aa, Homo Sapiens
GQDANDLYD

SEQ ID NO: 1223562 - protein, 9 aa, Homo Sapiens
FRYQEVAGP

SEQ ID NO: 1223563 - protein, 9 aa, Homo Sapiens
ITSTSASSL

SEQ ID NO: 1223564 - protein, 9 aa, Homo Sapiens
LEECECELL

SEQ ID NO: 1223565 - protein, 9 aa, Homo Sapiens
EMDWLQICE

SEQ ID NO: 1223566 - protein, 9 aa, Homo Sapiens
GGLLGRQRQ

SEQ ID NO: 1223567 - protein, 9 aa, Homo Sapiens
TLKAILQFQ

SEQ ID NO: 1223568 - protein, 9 aa, Homo Sapiens
DIAIGLLKR

SEQ ID NO: 1223569 - protein, 9 aa, Homo Sapiens
NPFECSECR

SEQ ID NO: 1223570 - protein, 9 aa, Homo Sapiens
FSDEHRTYG

SEQ ID NO: 1223571 - protein, 9 aa, Homo Sapiens
KKNPRKRLR

SEQ ID NO: 1223572 - protein, 9 aa, Homo Sapiens
QGCQVTGRI

SEQ ID NO: 1223573 - protein, 9 aa, Homo Sapiens
LRGQEQRSA

SEQ ID NO: 1223574 - protein, 9 aa, Homo Sapiens
IAKLIPQTP

SEQ ID NO: 1223575 - protein, 9 aa, Homo Sapiens
QRPDDLMAS

SEQ ID NO: 1223576 - protein, 9 aa, Homo Sapiens
YETDGEGGT

SEQ ID NO: 1223577 - protein, 9 aa, Homo Sapiens
SSHNWTEDM

SEQ ID NO: 1223578 - protein, 9 aa, Homo Sapiens
FLAGLTTHL

SEQ ID NO: 1223579 - protein, 9 aa, Homo Sapiens
MLKQAALQG

SEQ ID NO: 1223580 - protein, 9 aa, Homo Sapiens
EHFSTSGFR

SEQ ID NO: 1223581 - protein, 9 aa, Homo Sapiens
RLEGVVTKI

SEQ ID NO: 1223582 - protein, 9 aa, Homo Sapiens
SGLDENYTL

SEQ ID NO: 1223583 - protein, 9 aa, Homo Sapiens
HVQLGGLEA

SEQ ID NO: 1223584 - protein, 9 aa, Homo Sapiens
NMLCWNQTH

SEQ ID NO: 1223585 - protein, 9 aa, Homo Sapiens
RNAVNFAVL

SEQ ID NO: 1223586 - protein, 9 aa, Homo Sapiens
EWLKYGKRL

SEQ ID NO: 1223587 - protein, 9 aa, Homo Sapiens
MVKAGGSHQ

SEQ ID NO: 1223588 - protein, 9 aa, Homo Sapiens
NMLLRFSRM

SEQ ID NO: 1223589 - protein, 9 aa, Homo Sapiens
PEWAIINLG

SEQ ID NO: 1223590 - protein, 9 aa, Homo Sapiens
TFQESVLKM

SEQ ID NO: 1223591 - protein, 9 aa, Homo Sapiens
EVKKVLDKL

SEQ ID NO: 1223592 - protein, 9 aa, Homo Sapiens
RPFTCAGCG

SEQ ID NO: 1223593 - protein, 9 aa, Homo Sapiens
SCERRVNHM

SEQ ID NO: 1223594 - protein, 9 aa, Homo Sapiens
LHQGQNVIG

SEQ ID NO: 1223595 - protein, 9 aa, Homo Sapiens
PWPMAAHSG

SEQ ID NO: 1223596 - protein, 9 aa, Homo Sapiens
PKILLTSDA

SEQ ID NO: 1223597 - protein, 9 aa, Homo Sapiens
LPRGSRTHI

SEQ ID NO: 1223598 - protein, 9 aa, Homo Sapiens
RGALYRLSI

SEQ ID NO: 1223599 - protein, 9 aa, Homo Sapiens
EYTEMGERL

SEQ ID NO: 1223600 - protein, 9 aa, Homo Sapiens
DACKIIIAD

SEQ ID NO: 1223601 - protein, 9 aa, Homo Sapiens
VLRAYNSDG

SEQ ID NO: 1223602 - protein, 9 aa, Homo Sapiens
SPLWLMTAM

SEQ ID NO: 1223603 - protein, 9 aa, Homo Sapiens
RITTASSPS

SEQ ID NO: 1223604 - protein, 9 aa, Homo Sapiens
CEVCRDRGE

SEQ ID NO: 1223605 - protein, 9 aa, Homo Sapiens
ADIENHNDI

SEQ ID NO: 1223606 - protein, 9 aa, Homo Sapiens
ITLVITEFY

SEQ ID NO: 1223607 - protein, 9 aa, Homo Sapiens
KKPNKKQQE

SEQ ID NO: 1223608 - protein, 9 aa, Homo Sapiens
VGSMKHPAR

SEQ ID NO: 1223609 - protein, 9 aa, Homo Sapiens
ARKLELTNA

SEQ ID NO: 1223610 - protein, 9 aa, Homo Sapiens
DSHLRTPMY

SEQ ID NO: 1223611 - protein, 9 aa, Homo Sapiens
PGRHVEVSC

SEQ ID NO: 1223612 - protein, 9 aa, Homo Sapiens
AEANIKAKL

SEQ ID NO: 1223613 - protein, 9 aa, Homo Sapiens
QTDQHLNNL

SEQ ID NO: 1223614 - protein, 9 aa, Homo Sapiens
FLFDHQMVI

SEQ ID NO: 1223615 - protein, 9 aa, Homo Sapiens
TTPGHQITS

SEQ ID NO: 1223616 - protein, 9 aa, Homo Sapiens
FQGTSWEPA

SEQ ID NO: 1223617 - protein, 9 aa, Homo Sapiens
LTKSLQKTI

SEQ ID NO: 1223618 - protein, 9 aa, Homo Sapiens
GRTGRAGRM

SEQ ID NO: 1223619 - protein, 9 aa, Homo Sapiens
VLRLKTPIA

SEQ ID NO: 1223620 - protein, 9 aa, Homo Sapiens
LQSIKDHRK

SEQ ID NO: 1223621 - protein, 9 aa, Homo Sapiens
GRWVMILKL

SEQ ID NO: 1223622 - protein, 9 aa, Homo Sapiens
NISFTSFPI

SEQ ID NO: 1223623 - protein, 9 aa, Homo Sapiens
HKQLERHQD

SEQ ID NO: 1223624 - protein, 9 aa, Homo Sapiens
MYWMASNYQ

SEQ ID NO: 1223625 - protein, 9 aa, Homo Sapiens
PTMDLTVGV

SEQ ID NO: 1223626 - protein, 9 aa, Homo Sapiens
AALGLMITC

SEQ ID NO: 1223627 - protein, 9 aa, Homo Sapiens
CLTGSHAYE

SEQ ID NO: 1223628 - protein, 9 aa, Homo Sapiens
VPDTVHEAC

SEQ ID NO: 1223629 - protein, 9 aa, Homo Sapiens
GADDWIIAM

SEQ ID NO: 1223630 - protein, 9 aa, Homo Sapiens
LDIMPYRLG

SEQ ID NO: 1223631 - protein, 9 aa, Homo Sapiens
PVRHAQPVS

SEQ ID NO: 1223632 - protein, 9 aa, Homo Sapiens
PRAHPAQGL

SEQ ID NO: 1223633 - protein, 9 aa, Homo Sapiens
VCGRLSVTP

SEQ ID NO: 1223634 - protein, 9 aa, Homo Sapiens
TLSVTMLLR

SEQ ID NO: 1223635 - protein, 9 aa, Homo Sapiens
SPESTEEYI

SEQ ID NO: 1223636 - protein, 9 aa, Homo Sapiens
QDADARLTA

SEQ ID NO: 1223637 - protein, 9 aa, Homo Sapiens
HSTAEQDCL

SEQ ID NO: 1223638 - protein, 9 aa, Homo Sapiens
IEDNEFHCQ

SEQ ID NO: 1223639 - protein, 9 aa, Homo Sapiens
MDHEGEFTC

SEQ ID NO: 1223640 - protein, 9 aa, Homo Sapiens
MEASYCVLR

SEQ ID NO: 1223641 - protein, 9 aa, Homo Sapiens
SYMCLALEA

SEQ ID NO: 1223642 - protein, 9 aa, Homo Sapiens
TLKNFELMM

SEQ ID NO: 1223643 - protein, 9 aa, Homo Sapiens
SLSQWMWCL

SEQ ID NO: 1223644 - protein, 9 aa, Homo Sapiens
KHFLSRDYL

SEQ ID NO: 1223645 - protein, 9 aa, Homo Sapiens
YNGISRING

SEQ ID NO: 1223646 - protein, 9 aa, Homo Sapiens
FDHVYSGAV

SEQ ID NO: 1223647 - protein, 9 aa, Homo Sapiens
ADDDTAVVR

SEQ ID NO: 1223648 - protein, 9 aa, Homo Sapiens
QQCVVCLQP

SEQ ID NO: 1223649 - protein, 9 aa, Homo Sapiens
RSSDIFDCL

SEQ ID NO: 1223650 - protein, 9 aa, Homo Sapiens
RRCPISRTY

SEQ ID NO: 1223651 - protein, 9 aa, Homo Sapiens
TNHPGASIV

SEQ ID NO: 1223652 - protein, 9 aa, Homo Sapiens
ATDIWSLGC

SEQ ID NO: 1223653 - protein, 9 aa, Homo Sapiens
TTSIHLMGI

SEQ ID NO: 1223654 - protein, 9 aa, Homo Sapiens
MHGSSFSVK

SEQ ID NO: 1223655 - protein, 9 aa, Homo Sapiens
DDNINTPFD

SEQ ID NO: 1223656 - protein, 9 aa, Homo Sapiens
LQGHSHWVN

SEQ ID NO: 1223657 - protein, 9 aa, Homo Sapiens
LLLLLLFLT

SEQ ID NO: 1223658 - protein, 9 aa, Homo Sapiens
VVSVNGLNA

SEQ ID NO: 1223659 - protein, 9 aa, Homo Sapiens
HTGENVYKC

SEQ ID NO: 1223660 - protein, 9 aa, Homo Sapiens
FSRRFDLLK

SEQ ID NO: 1223661 - protein, 9 aa, Homo Sapiens
CSSFARTIS

SEQ ID NO: 1223662 - protein, 9 aa, Homo Sapiens
HNFFLAPGM

SEQ ID NO: 1223663 - protein, 9 aa, Homo Sapiens
VDCDAIDGG

SEQ ID NO: 1223664 - protein, 9 aa, Homo Sapiens
FCIFSRDGG

SEQ ID NO: 1223665 - protein, 9 aa, Homo Sapiens
VIISYIFID

SEQ ID NO: 1223666 - protein, 9 aa, Homo Sapiens
SVSYFMCME

SEQ ID NO: 1223667 - protein, 9 aa, Homo Sapiens
HPRPTRRGA

SEQ ID NO: 1223668 - protein, 9 aa, Homo Sapiens
YDRIAKDWT

SEQ ID NO: 1223669 - protein, 9 aa, Homo Sapiens
VINQKLIET

SEQ ID NO: 1223670 - protein, 9 aa, Homo Sapiens
HSIDVQVEE

SEQ ID NO: 1223671 - protein, 9 aa, Homo Sapiens
PRRLLHEEL

SEQ ID NO: 1223672 - protein, 9 aa, Homo Sapiens
SAQSSIKQL

SEQ ID NO: 1223673 - protein, 9 aa, Homo Sapiens
EAPRSKWHW

SEQ ID NO: 1223674 - protein, 9 aa, Homo Sapiens
QSISELDLE

SEQ ID NO: 1223675 - protein, 9 aa, Homo Sapiens
ISSNEPYRL

SEQ ID NO: 1223676 - protein, 9 aa, Homo Sapiens
CIHQNLEDN

SEQ ID NO: 1223677 - protein, 9 aa, Homo Sapiens
QINISKVQE

SEQ ID NO: 1223678 - protein, 9 aa, Homo Sapiens
TAISTQHCL

SEQ ID NO: 1223679 - protein, 9 aa, Homo Sapiens
HMKMVLLWA

SEQ ID NO: 1223680 - protein, 9 aa, Homo Sapiens
PRGSPAFPD

SEQ ID NO: 1223681 - protein, 9 aa, Homo Sapiens
VADINDNHP

SEQ ID NO: 1223682 - protein, 9 aa, Homo Sapiens
AEEVEWDYY

SEQ ID NO: 1223683 - protein, 9 aa, Homo Sapiens
FEGLVQLWH

SEQ ID NO: 1223684 - protein, 9 aa, Homo Sapiens
TDSPREGLM

SEQ ID NO: 1223685 - protein, 9 aa, Homo Sapiens
ALNTLSITS

SEQ ID NO: 1223686 - protein, 9 aa, Homo Sapiens
IRFWLPFGF

SEQ ID NO: 1223687 - protein, 9 aa, Homo Sapiens
AGREEEHPP

SEQ ID NO: 1223688 - protein, 9 aa, Homo Sapiens
ATWGSRTSA

SEQ ID NO: 1223689 - protein, 9 aa, Homo Sapiens
RPTAWRVWR

SEQ ID NO: 1223690 - protein, 9 aa, Homo Sapiens
IMGPFGIPG

SEQ ID NO: 1223691 - protein, 9 aa, Homo Sapiens
SDDDTVLDL

SEQ ID NO: 1223692 - protein, 9 aa, Homo Sapiens
FIGKDCIGR

SEQ ID NO: 1223693 - protein, 9 aa, Homo Sapiens
CKIMQKKIE

SEQ ID NO: 1223694 - protein, 9 aa, Homo Sapiens
DEAPPRLQV

SEQ ID NO: 1223695 - protein, 9 aa, Homo Sapiens
QHSEWARQG

SEQ ID NO: 1223696 - protein, 9 aa, Homo Sapiens
SVIHLCCKP

SEQ ID NO: 1223697 - protein, 9 aa, Homo Sapiens
DVNASEKTV

SEQ ID NO: 1223698 - protein, 9 aa, Homo Sapiens
RKLWLQKNQ

SEQ ID NO: 1223699 - protein, 9 aa, Homo Sapiens
ENVPPSNHH

SEQ ID NO: 1223700 - protein, 9 aa, Homo Sapiens
SVYDPSSIV

SEQ ID NO: 1223701 - protein, 9 aa, Homo Sapiens
RRRPGPHRL

SEQ ID NO: 1223702 - protein, 9 aa, Homo Sapiens
DIVNIGDVS

SEQ ID NO: 1223703 - protein, 9 aa, Homo Sapiens
LYTSGLLAQ

SEQ ID NO: 1223704 - protein, 9 aa, Homo Sapiens
GMMVILNVL

SEQ ID NO: 1223705 - protein, 9 aa, Homo Sapiens
GAEEIYLIF

SEQ ID NO: 1223706 - protein, 9 aa, Homo Sapiens
DALLEQVMI

SEQ ID NO: 1223707 - protein, 9 aa, Homo Sapiens
FSLHRMPRN

SEQ ID NO: 1223708 - protein, 9 aa, Homo Sapiens
WRKKCHTAF

SEQ ID NO: 1223709 - protein, 9 aa, Homo Sapiens
LFCMIFNGS

SEQ ID NO: 1223710 - protein, 9 aa, Homo Sapiens
KNASISMRA

SEQ ID NO: 1223711 - protein, 9 aa, Homo Sapiens
IHQRTHRGE

SEQ ID NO: 1223712 - protein, 9 aa, Homo Sapiens
LEDASFEKV

SEQ ID NO: 1223713 - protein, 9 aa, Homo Sapiens
ASAILKRDV

SEQ ID NO: 1223714 - protein, 9 aa, Homo Sapiens
DIVHQFKMQ

SEQ ID NO: 1223715 - protein, 9 aa, Homo Sapiens
LDALPLDML

SEQ ID NO: 1223716 - protein, 9 aa, Homo Sapiens
TPEDVVSDV

SEQ ID NO: 1223717 - protein, 9 aa, Homo Sapiens
KYMDVNECR

SEQ ID NO: 1223718 - protein, 9 aa, Homo Sapiens
SRWVSRATP

SEQ ID NO: 1223719 - protein, 9 aa, Homo Sapiens
RRRKLNMCL

SEQ ID NO: 1223720 - protein, 9 aa, Homo Sapiens
RRCVVCHAP

SEQ ID NO: 1223721 - protein, 9 aa, Homo Sapiens
KGNRTVGPR

SEQ ID NO: 1223722 - protein, 9 aa, Homo Sapiens
HTPPGHHSV

SEQ ID NO: 1223723 - protein, 9 aa, Homo Sapiens
ITSQPMGPR

SEQ ID NO: 1223724 - protein, 9 aa, Homo Sapiens
TKRSIQTQN

SEQ ID NO: 1223725 - protein, 9 aa, Homo Sapiens
VLQDSRVLH

SEQ ID NO: 1223726 - protein, 9 aa, Homo Sapiens
GKNELQVSL

SEQ ID NO: 1223727 - protein, 9 aa, Homo Sapiens
VMSKLKSRY

SEQ ID NO: 1223728 - protein, 9 aa, Homo Sapiens
STIHRTSEP

SEQ ID NO: 1223729 - protein, 9 aa, Homo Sapiens
VLTIPGVKV

SEQ ID NO: 1223730 - protein, 9 aa, Homo Sapiens
QDAIRISQN

SEQ ID NO: 1223731 - protein, 9 aa, Homo Sapiens
TPNSSHWRK

SEQ ID NO: 1223732 - protein, 9 aa, Homo Sapiens
ISLLGVIAG

SEQ ID NO: 1223733 - protein, 9 aa, Homo Sapiens
DCCIKLLSS

SEQ ID NO: 1223734 - protein, 9 aa, Homo Sapiens
TGDILMRML

SEQ ID NO: 1223735 - protein, 9 aa, Homo Sapiens
PPTQSISAC

SEQ ID NO: 1223736 - protein, 9 aa, Homo Sapiens
EMRLKHMDM

SEQ ID NO: 1223737 - protein, 9 aa, Homo Sapiens
LCRTLQGHS

SEQ ID NO: 1223738 - protein, 9 aa, Homo Sapiens
GKDKAPIQD

SEQ ID NO: 1223739 - protein, 9 aa, Homo Sapiens
AFPEVSFLE

SEQ ID NO: 1223740 - protein, 9 aa, Homo Sapiens
EEEKTLQDE

SEQ ID NO: 1223741 - protein, 9 aa, Homo Sapiens
FTSGILTPL

SEQ ID NO: 1223742 - protein, 9 aa, Homo Sapiens
SLTSSPNLD

SEQ ID NO: 1223743 - protein, 9 aa, Homo Sapiens
TACDAATVR

SEQ ID NO: 1223744 - protein, 9 aa, Homo Sapiens
TFQCFGFWA

SEQ ID NO: 1223745 - protein, 9 aa, Homo Sapiens
HIQKGPHGS

SEQ ID NO: 1223746 - protein, 9 aa, Homo Sapiens
PEVSFLETS

SEQ ID NO: 1223747 - protein, 9 aa, Homo Sapiens
MTPLSAEIR

SEQ ID NO: 1223748 - protein, 9 aa, Homo Sapiens
HLALADVVS

SEQ ID NO: 1223749 - protein, 9 aa, Homo Sapiens
VTMKRLDSK

SEQ ID NO: 1223750 - protein, 9 aa, Homo Sapiens
GTILGRNMS

SEQ ID NO: 1223751 - protein, 9 aa, Homo Sapiens
VCHSKIRSN

SEQ ID NO: 1223752 - protein, 9 aa, Homo Sapiens
RSPGLNSMK

SEQ ID NO: 1223753 - protein, 9 aa, Homo Sapiens
MGPGTVPGM

SEQ ID NO: 1223754 - protein, 9 aa, Homo Sapiens
SVAHLPWKV

SEQ ID NO: 1223755 - protein, 9 aa, Homo Sapiens
ILHTHIRQH

SEQ ID NO: 1223756 - protein, 9 aa, Homo Sapiens
ILGDEGMPV

SEQ ID NO: 1223757 - protein, 9 aa, Homo Sapiens
IFFRCERFD

SEQ ID NO: 1223758 - protein, 9 aa, Homo Sapiens
EIWMNQNAG

SEQ ID NO: 1223759 - protein, 9 aa, Homo Sapiens
GPEDLCART

SEQ ID NO: 1223760 - protein, 9 aa, Homo Sapiens
MLGPSLSLG

SEQ ID NO: 1223761 - protein, 9 aa, Homo Sapiens
KQDKKFPPS

SEQ ID NO: 1223762 - protein, 9 aa, Homo Sapiens
LWERVEKPV

SEQ ID NO: 1223763 - protein, 9 aa, Homo Sapiens
FHKYTKGNG

SEQ ID NO: 1223764 - protein, 9 aa, Homo Sapiens
SPAEVDGSV

SEQ ID NO: 1223765 - protein, 9 aa, Homo Sapiens
EQTPKKHGL

SEQ ID NO: 1223766 - protein, 9 aa, Homo Sapiens
KTKGPSRLR

SEQ ID NO: 1223767 - protein, 9 aa, Homo Sapiens
ITKAWKKLS

SEQ ID NO: 1223768 - protein, 9 aa, Homo Sapiens
KMEIHRTYQ

SEQ ID NO: 1223769 - protein, 9 aa, Homo Sapiens
GLPAQCLAL

SEQ ID NO: 1223770 - protein, 9 aa, Homo Sapiens
SSASSSSMV

SEQ ID NO: 1223771 - protein, 9 aa, Homo Sapiens
SLYWYGGES

SEQ ID NO: 1223772 - protein, 9 aa, Homo Sapiens
TGTVSGQNC

SEQ ID NO: 1223773 - protein, 9 aa, Homo Sapiens
PSAASPWSR

SEQ ID NO: 1223774 - protein, 9 aa, Homo Sapiens
THCCRQEMY

SEQ ID NO: 1223775 - protein, 9 aa, Homo Sapiens
LRTTLPTSG

SEQ ID NO: 1223776 - protein, 9 aa, Homo Sapiens
PNRHGVYTN

SEQ ID NO: 1223777 - protein, 9 aa, Homo Sapiens
VASDYMPAL

SEQ ID NO: 1223778 - protein, 9 aa, Homo Sapiens
PWTIDNTYY

SEQ ID NO: 1223779 - protein, 9 aa, Homo Sapiens
CATPAHALQ

SEQ ID NO: 1223780 - protein, 9 aa, Homo Sapiens
TDDEVWAIH

SEQ ID NO: 1223781 - protein, 9 aa, Homo Sapiens
KTQTQLLQQ

SEQ ID NO: 1223782 - protein, 9 aa, Homo Sapiens
KANVVNVRH

SEQ ID NO: 1223783 - protein, 9 aa, Homo Sapiens
NGAGWPCPA

SEQ ID NO: 1223784 - protein, 9 aa, Homo Sapiens
TPNPVDDES

SEQ ID NO: 1223785 - protein, 9 aa, Homo Sapiens
SRDHNQTAG

SEQ ID NO: 1223786 - protein, 9 aa, Homo Sapiens
YYLYEKRNV

SEQ ID NO: 1223787 - protein, 9 aa, Homo Sapiens
GQVLEQVHS

SEQ ID NO: 1223788 - protein, 9 aa, Homo Sapiens
VQLMGINLP

SEQ ID NO: 1223789 - protein, 9 aa, Homo Sapiens
LQLLVQDKF

SEQ ID NO: 1223790 - protein, 9 aa, Homo Sapiens
ATWRWSRKI

SEQ ID NO: 1223791 - protein, 9 aa, Homo Sapiens
SRFFLELNV

SEQ ID NO: 1223792 - protein, 9 aa, Homo Sapiens
EILVICRGW

SEQ ID NO: 1223793 - protein, 9 aa, Homo Sapiens
PTRHGFLGQ

SEQ ID NO: 1223794 - protein, 9 aa, Homo Sapiens
EHRFRNFFN

SEQ ID NO: 1223795 - protein, 9 aa, Homo Sapiens
RPHSFSETL

SEQ ID NO: 1223796 - protein, 9 aa, Homo Sapiens
ESTVQEEVQ

SEQ ID NO: 1223797 - protein, 9 aa, Homo Sapiens
VTPCYYRGH

SEQ ID NO: 1223798 - protein, 9 aa, Homo Sapiens
KHLGCTQKT

SEQ ID NO: 1223799 - protein, 9 aa, Homo Sapiens
IFKLTFVKV

SEQ ID NO: 1223800 - protein, 9 aa, Homo Sapiens
DSESNMDQN

SEQ ID NO: 1223801 - protein, 9 aa, Homo Sapiens
IPDFLGAPG

SEQ ID NO: 1223802 - protein, 9 aa, Homo Sapiens
WFKDVMTKT

SEQ ID NO: 1223803 - protein, 9 aa, Homo Sapiens
VKDMCTAKF

SEQ ID NO: 1223804 - protein, 9 aa, Homo Sapiens
REVFGFEQA

SEQ ID NO: 1223805 - protein, 9 aa, Homo Sapiens
PHLIFDVRV

SEQ ID NO: 1223806 - protein, 9 aa, Homo Sapiens
SKYDVRVQK

SEQ ID NO: 1223807 - protein, 9 aa, Homo Sapiens
LDSYFLLPT

SEQ ID NO: 1223808 - protein, 9 aa, Homo Sapiens
HNPKAISVD

SEQ ID NO: 1223809 - protein, 9 aa, Homo Sapiens
SLEVVYTGW

SEQ ID NO: 1223810 - protein, 9 aa, Homo Sapiens
SLQHPPPGF

SEQ ID NO: 1223811 - protein, 9 aa, Homo Sapiens
SREEKQEHV

SEQ ID NO: 1223812 - protein, 9 aa, Homo Sapiens
TAVHGSSVN

SEQ ID NO: 1223813 - protein, 9 aa, Homo Sapiens
ECGKYYISK

SEQ ID NO: 1223814 - protein, 9 aa, Homo Sapiens
YLPLLLVLM

SEQ ID NO: 1223815 - protein, 9 aa, Homo Sapiens
WDNPGSLHN

SEQ ID NO: 1223816 - protein, 9 aa, Homo Sapiens
WSLWGECTW

SEQ ID NO: 1223817 - protein, 9 aa, Homo Sapiens
KLTFKLTRR

SEQ ID NO: 1223818 - protein, 9 aa, Homo Sapiens
GKLALSKKN

SEQ ID NO: 1223819 - protein, 9 aa, Homo Sapiens
ASCKTGPGT

SEQ ID NO: 1223820 - protein, 9 aa, Homo Sapiens
AYPSEKSNK

SEQ ID NO: 1223821 - protein, 9 aa, Homo Sapiens
ASADDGILN

SEQ ID NO: 1223822 - protein, 9 aa, Homo Sapiens
KVCIDVGKE

SEQ ID NO: 1223823 - protein, 9 aa, Homo Sapiens
MSFHWKRRR

SEQ ID NO: 1223824 - protein, 9 aa, Homo Sapiens
LTGVPEDHI

SEQ ID NO: 1223825 - protein, 9 aa, Homo Sapiens
QSTGATNIS

SEQ ID NO: 1223826 - protein, 9 aa, Homo Sapiens
SKGLKPSSG

SEQ ID NO: 1223827 - protein, 9 aa, Homo Sapiens
TVLAYAMEQ

SEQ ID NO: 1223828 - protein, 9 aa, Homo Sapiens
MVGMDAAGK

SEQ ID NO: 1223829 - protein, 9 aa, Homo Sapiens
WAHLNRDMI

SEQ ID NO: 1223830 - protein, 9 aa, Homo Sapiens
QLSNTASMS

SEQ ID NO: 1223831 - protein, 9 aa, Homo Sapiens
DIDLIPTGT

SEQ ID NO: 1223832 - protein, 9 aa, Homo Sapiens
AKYKGVCYS

SEQ ID NO: 1223833 - protein, 9 aa, Homo Sapiens
HTMAQEFDI

SEQ ID NO: 1223834 - protein, 9 aa, Homo Sapiens
PVGTQASAA

SEQ ID NO: 1223835 - protein, 9 aa, Homo Sapiens
ENFWGEKIV

SEQ ID NO: 1223836 - protein, 9 aa, Homo Sapiens
QNKLPLTRV

SEQ ID NO: 1223837 - protein, 9 aa, Homo Sapiens
DDDTAVVRA

SEQ ID NO: 1223838 - protein, 9 aa, Homo Sapiens
PDPTQNAWS

SEQ ID NO: 1223839 - protein, 9 aa, Homo Sapiens
PVDSDVAVE

SEQ ID NO: 1223840 - protein, 9 aa, Homo Sapiens
IMLPSSSAG

SEQ ID NO: 1223841 - protein, 9 aa, Homo Sapiens
VRGQKKCDI

SEQ ID NO: 1223842 - protein, 9 aa, Homo Sapiens
WFCLLWTVL

SEQ ID NO: 1223843 - protein, 9 aa, Homo Sapiens
PGISSYTYN

SEQ ID NO: 1223844 - protein, 9 aa, Homo Sapiens
VPELVGYCC

SEQ ID NO: 1223845 - protein, 9 aa, Homo Sapiens
AEETERCTF

SEQ ID NO: 1223846 - protein, 9 aa, Homo Sapiens
IKCRRCVQK

SEQ ID NO: 1223847 - protein, 9 aa, Homo Sapiens
AEMMLKEMQ

SEQ ID NO: 1223848 - protein, 9 aa, Homo Sapiens
KWDWMHTGR

SEQ ID NO: 1223849 - protein, 9 aa, Homo Sapiens
RSIRLVGPM

SEQ ID NO: 1223850 - protein, 9 aa, Homo Sapiens
DPHRVRGRR

SEQ ID NO: 1223851 - protein, 9 aa, Homo Sapiens
APEHDANSA

SEQ ID NO: 1223852 - protein, 9 aa, Homo Sapiens
TDLLHDTLQ

SEQ ID NO: 1223853 - protein, 9 aa, Homo Sapiens
DVPSTLWKS

SEQ ID NO: 1223854 - protein, 9 aa, Homo Sapiens
EAYITPRYI

SEQ ID NO: 1223855 - protein, 9 aa, Homo Sapiens
GAGHKSHEY

SEQ ID NO: 1223856 - protein, 9 aa, Homo Sapiens
EFLNRFEED

SEQ ID NO: 1223857 - protein, 9 aa, Homo Sapiens
KVTEVKEGA

SEQ ID NO: 1223858 - protein, 9 aa, Homo Sapiens
QENTINQLE

SEQ ID NO: 1223859 - protein, 9 aa, Homo Sapiens
IAGPVFLPF

SEQ ID NO: 1223860 - protein, 9 aa, Homo Sapiens
PLSVMCPGA

SEQ ID NO: 1223861 - protein, 9 aa, Homo Sapiens
SAEVMDTYI

SEQ ID NO: 1223862 - protein, 9 aa, Homo Sapiens
RKTTMKQLQ

SEQ ID NO: 1223863 - protein, 9 aa, Homo Sapiens
SEQPEQTVL

SEQ ID NO: 1223864 - protein, 9 aa, Homo Sapiens
IRDVRGHDT

SEQ ID NO: 1223865 - protein, 9 aa, Homo Sapiens
SKLSSDGKE

SEQ ID NO: 1223866 - protein, 9 aa, Homo Sapiens
LLHHRRSHQ

SEQ ID NO: 1223867 - protein, 9 aa, Homo Sapiens
AAVNMWRKN

SEQ ID NO: 1223868 - protein, 9 aa, Homo Sapiens
KEEQRPRSA

SEQ ID NO: 1223869 - protein, 9 aa, Homo Sapiens
QNGPIGHRC

SEQ ID NO: 1223870 - protein, 9 aa, Homo Sapiens
TWWLLCQAE

SEQ ID NO: 1223871 - protein, 9 aa, Homo Sapiens
GSTLHLDLE

SEQ ID NO: 1223872 - protein, 9 aa, Homo Sapiens
QEVIPLLLE

SEQ ID NO: 1223873 - protein, 9 aa, Homo Sapiens
EEWETMKVS

SEQ ID NO: 1223874 - protein, 9 aa, Homo Sapiens
QSSFLDEDD

SEQ ID NO: 1223875 - protein, 9 aa, Homo Sapiens
VPLPPHMAI

SEQ ID NO: 1223876 - protein, 9 aa, Homo Sapiens
SAQKNIYRD

SEQ ID NO: 1223877 - protein, 9 aa, Homo Sapiens
SEPESDVFE

SEQ ID NO: 1223878 - protein, 9 aa, Homo Sapiens
SSSTEQSCA

SEQ ID NO: 1223879 - protein, 9 aa, Homo Sapiens
AMFVGHATT

SEQ ID NO: 1223880 - protein, 9 aa, Homo Sapiens
LCLESQQLI

SEQ ID NO: 1223881 - protein, 9 aa, Homo Sapiens
QEAYNTWPI

SEQ ID NO: 1223882 - protein, 9 aa, Homo Sapiens
RGMMKNHSL

SEQ ID NO: 1223883 - protein, 9 aa, Homo Sapiens
SSPWEKRLT

SEQ ID NO: 1223884 - protein, 9 aa, Homo Sapiens
TTDGKEEAK

SEQ ID NO: 1223885 - protein, 9 aa, Homo Sapiens
RLEKAKNDV

SEQ ID NO: 1223886 - protein, 9 aa, Homo Sapiens
QEESPHGST

SEQ ID NO: 1223887 - protein, 9 aa, Homo Sapiens
IHVDDCSLN

SEQ ID NO: 1223888 - protein, 9 aa, Homo Sapiens
FLNKLLKID

SEQ ID NO: 1223889 - protein, 9 aa, Homo Sapiens
TKAWKKLSP

SEQ ID NO: 1223890 - protein, 9 aa, Homo Sapiens
FECNSRQPS

SEQ ID NO: 1223891 - protein, 9 aa, Homo Sapiens
DPRKDSEHY

SEQ ID NO: 1223892 - protein, 9 aa, Homo Sapiens
VTIMDENDN

SEQ ID NO: 1223893 - protein, 9 aa, Homo Sapiens
ATGAHDGKI

SEQ ID NO: 1223894 - protein, 9 aa, Homo Sapiens
DLTSRLSSD

SEQ ID NO: 1223895 - protein, 9 aa, Homo Sapiens
ISEACISIV

SEQ ID NO: 1223896 - protein, 9 aa, Homo Sapiens
GSWYPGFNC

SEQ ID NO: 1223897 - protein, 9 aa, Homo Sapiens
SVAVTTPGL

SEQ ID NO: 1223898 - protein, 9 aa, Homo Sapiens
SSDVLRIQN

SEQ ID NO: 1223899 - protein, 9 aa, Homo Sapiens
APQPYASSL

SEQ ID NO: 1223900 - protein, 9 aa, Homo Sapiens
TLGKADLEV

SEQ ID NO: 1223901 - protein, 9 aa, Homo Sapiens
GKQGHWKAN

SEQ ID NO: 1223902 - protein, 9 aa, Homo Sapiens
VIEEIIKLE

SEQ ID NO: 1223903 - protein, 9 aa, Homo Sapiens
HHLLAAALK

SEQ ID NO: 1223904 - protein, 9 aa, Homo Sapiens
EEHTGMLDV

SEQ ID NO: 1223905 - protein, 9 aa, Homo Sapiens
QKASATFNS

SEQ ID NO: 1223906 - protein, 9 aa, Homo Sapiens
FEVVLSSRT

SEQ ID NO: 1223907 - protein, 9 aa, Homo Sapiens
MHVKIFDPQ

SEQ ID NO: 1223908 - protein, 9 aa, Homo Sapiens
TLGKPDSIL

SEQ ID NO: 1223909 - protein, 9 aa, Homo Sapiens
WARQGAEER

SEQ ID NO: 1223910 - protein, 9 aa, Homo Sapiens
QWALHSYKE

SEQ ID NO: 1223911 - protein, 9 aa, Homo Sapiens
LPLPQLLLL

SEQ ID NO: 1223912 - protein, 9 aa, Homo Sapiens
CQGAKTVFN

SEQ ID NO: 1223913 - protein, 9 aa, Homo Sapiens
VMDWDSETR

SEQ ID NO: 1223914 - protein, 9 aa, Homo Sapiens
GSHNIKAAA

SEQ ID NO: 1223915 - protein, 9 aa, Homo Sapiens
WRMLEAVRH

SEQ ID NO: 1223916 - protein, 9 aa, Homo Sapiens
CFPNHLPQL

SEQ ID NO: 1223917 - protein, 9 aa, Homo Sapiens
LGKEAEFVE

SEQ ID NO: 1223918 - protein, 9 aa, Homo Sapiens
IRLVGPMNH

SEQ ID NO: 1223919 - protein, 9 aa, Homo Sapiens
DVKNLPGVS

SEQ ID NO: 1223920 - protein, 9 aa, Homo Sapiens
AIAIFLVLV

SEQ ID NO: 1223921 - protein, 9 aa, Homo Sapiens
DRQWDDRGA

SEQ ID NO: 1223922 - protein, 9 aa, Homo Sapiens
PSRLRLDAK

SEQ ID NO: 1223923 - protein, 9 aa, Homo Sapiens
RAYLFAHVV

SEQ ID NO: 1223924 - protein, 9 aa, Homo Sapiens
ENAITYEKL

SEQ ID NO: 1223925 - protein, 9 aa, Homo Sapiens
MLPSQDDFS

SEQ ID NO: 1223926 - protein, 9 aa, Homo Sapiens
EHGRHRKIK

SEQ ID NO: 1223927 - protein, 9 aa, Homo Sapiens
DEYQHHSLR

SEQ ID NO: 1223928 - protein, 9 aa, Homo Sapiens
LWQRLEDAQ

SEQ ID NO: 1223929 - protein, 9 aa, Homo Sapiens
DRSYGRDIV

SEQ ID NO: 1223930 - protein, 9 aa, Homo Sapiens
PLLFIISRT

SEQ ID NO: 1223931 - protein, 9 aa, Homo Sapiens
QKAASFQNL

SEQ ID NO: 1223932 - protein, 9 aa, Homo Sapiens
HVFNDELPS

SEQ ID NO: 1223933 - protein, 9 aa, Homo Sapiens
SGGSHPLSY

SEQ ID NO: 1223934 - protein, 9 aa, Homo Sapiens
LQVTKQRGI

SEQ ID NO: 1223935 - protein, 9 aa, Homo Sapiens
RLHSKDQMK

SEQ ID NO: 1223936 - protein, 9 aa, Homo Sapiens
AKYGYALCL

SEQ ID NO: 1223937 - protein, 9 aa, Homo Sapiens
QVHLTASRT

SEQ ID NO: 1223938 - protein, 9 aa, Homo Sapiens
GSGRFGLCL

SEQ ID NO: 1223939 - protein, 9 aa, Homo Sapiens
FTDVKNLPG

SEQ ID NO: 1223940 - protein, 9 aa, Homo Sapiens
TPANYLITS

SEQ ID NO: 1223941 - protein, 9 aa, Homo Sapiens
MEPWASAAV

SEQ ID NO: 1223942 - protein, 9 aa, Homo Sapiens
YSELVSIDS

SEQ ID NO: 1223943 - protein, 9 aa, Homo Sapiens
LVRNNVLLD

SEQ ID NO: 1223944 - protein, 9 aa, Homo Sapiens
TQRNEFTDQ

SEQ ID NO: 1223945 - protein, 9 aa, Homo Sapiens
GPRKYVLTP

SEQ ID NO: 1223946 - protein, 9 aa, Homo Sapiens
EPERSSSED

SEQ ID NO: 1223947 - protein, 9 aa, Homo Sapiens
RSMAPDLRQ

SEQ ID NO: 1223948 - protein, 9 aa, Homo Sapiens
THGGKWTVS

SEQ ID NO: 1223949 - protein, 9 aa, Homo Sapiens
TTPNATFNW

SEQ ID NO: 1223950 - protein, 9 aa, Homo Sapiens
TREIIIRNI

SEQ ID NO: 1223951 - protein, 9 aa, Homo Sapiens
CVRGLKQQK

SEQ ID NO: 1223952 - protein, 9 aa, Homo Sapiens
DADARLTAQ

SEQ ID NO: 1223953 - protein, 9 aa, Homo Sapiens
LAFFRVDHI

SEQ ID NO: 1223954 - protein, 9 aa, Homo Sapiens
RKVCIDVGK

SEQ ID NO: 1223955 - protein, 9 aa, Homo Sapiens
GSPAFPDSP

SEQ ID NO: 1223956 - protein, 9 aa, Homo Sapiens
AEGEGDIFR

SEQ ID NO: 1223957 - protein, 9 aa, Homo Sapiens
LVTMVTATV

SEQ ID NO: 1223958 - protein, 9 aa, Homo Sapiens
FCFLRFAWP

SEQ ID NO: 1223959 - protein, 9 aa, Homo Sapiens
STLSKSKHD

SEQ ID NO: 1223960 - protein, 9 aa, Homo Sapiens
ESSQNLVFH

SEQ ID NO: 1223961 - protein, 9 aa, Homo Sapiens
EILKNPQLH

SEQ ID NO: 1223962 - protein, 9 aa, Homo Sapiens
EPTSKVTEQ

SEQ ID NO: 1223963 - protein, 9 aa, Homo Sapiens
GCWQRLAEL

SEQ ID NO: 1223964 - protein, 9 aa, Homo Sapiens
PAVLLMEKL

SEQ ID NO: 1223965 - protein, 9 aa, Homo Sapiens
ASSISPVEI

SEQ ID NO: 1223966 - protein, 9 aa, Homo Sapiens
EWTRQGWQR

SEQ ID NO: 1223967 - protein, 9 aa, Homo Sapiens
RVVENSDAV

SEQ ID NO: 1223968 - protein, 9 aa, Homo Sapiens
SVLAAEPEA

SEQ ID NO: 1223969 - protein, 9 aa, Homo Sapiens
WREFTASFL

SEQ ID NO: 1223970 - protein, 9 aa, Homo Sapiens
AQEEHVYIE

SEQ ID NO: 1223971 - protein, 9 aa, Homo Sapiens
EGRTSHKAA

SEQ ID NO: 1223972 - protein, 9 aa, Homo Sapiens
PPTEETTYG

SEQ ID NO: 1223973 - protein, 9 aa, Homo Sapiens
NMIRQTNTH

SEQ ID NO: 1223974 - protein, 9 aa, Homo Sapiens
ATLCMGGCS

SEQ ID NO: 1223975 - protein, 9 aa, Homo Sapiens
RIFDGRELL

SEQ ID NO: 1223976 - protein, 9 aa, Homo Sapiens
SPTSLSENN

SEQ ID NO: 1223977 - protein, 9 aa, Homo Sapiens
AHRSPSAPD

SEQ ID NO: 1223978 - protein, 9 aa, Homo Sapiens
NKVGAVFYS

SEQ ID NO: 1223979 - protein, 9 aa, Homo Sapiens
LCQIVNNLS

SEQ ID NO: 1223980 - protein, 9 aa, Homo Sapiens
AGVNGLSIG

SEQ ID NO: 1223981 - protein, 9 aa, Homo Sapiens
KKLLPWQRW

SEQ ID NO: 1223982 - protein, 9 aa, Homo Sapiens
GPGTVPGMP

SEQ ID NO: 1223983 - protein, 9 aa, Homo Sapiens
SGDDKGSMS

SEQ ID NO: 1223984 - protein, 9 aa, Homo Sapiens
WAVTFCSAG

SEQ ID NO: 1223985 - protein, 9 aa, Homo Sapiens
SGIRAPLCP

SEQ ID NO: 1223986 - protein, 9 aa, Homo Sapiens
DQLNALRHE

SEQ ID NO: 1223987 - protein, 9 aa, Homo Sapiens
EGQSHYVPS

SEQ ID NO: 1223988 - protein, 9 aa, Homo Sapiens
RKTNKWSTP

SEQ ID NO: 1223989 - protein, 9 aa, Homo Sapiens
RNNTCFVDV

SEQ ID NO: 1223990 - protein, 9 aa, Homo Sapiens
TMVTATVTA

SEQ ID NO: 1223991 - protein, 9 aa, Homo Sapiens
INVFSELSA

SEQ ID NO: 1223992 - protein, 9 aa, Homo Sapiens
FELNPIGVG

SEQ ID NO: 1223993 - protein, 9 aa, Homo Sapiens
VPERERIWM

SEQ ID NO: 1223994 - protein, 9 aa, Homo Sapiens
TRDAEALVD

SEQ ID NO: 1223995 - protein, 9 aa, Homo Sapiens
PIDSSDFVL

SEQ ID NO: 1223996 - protein, 9 aa, Homo Sapiens
PRNLDSQTF

SEQ ID NO: 1223997 - protein, 9 aa, Homo Sapiens
RSNVDYQYQ

SEQ ID NO: 1223998 - protein, 9 aa, Homo Sapiens
SFLTPMAVI

SEQ ID NO: 1223999 - protein, 9 aa, Homo Sapiens
QFPRVCITV

SEQ ID NO: 1224000 - protein, 9 aa, Homo Sapiens
YFTDIFLDS

SEQ ID NO: 1224001 - protein, 9 aa, Homo Sapiens
GCNGPAVGT

SEQ ID NO: 1224002 - protein, 9 aa, Homo Sapiens
KKDKEKKRK

SEQ ID NO: 1224003 - protein, 9 aa, Homo Sapiens
MASSIIAVI

SEQ ID NO: 1224004 - protein, 9 aa, Homo Sapiens
MAMFKLLNT

SEQ ID NO: 1224005 - protein, 9 aa, Homo Sapiens
PPPPPHGPP

SEQ ID NO: 1224006 - protein, 9 aa, Homo Sapiens
GDRFHHYPH

SEQ ID NO: 1224007 - protein, 9 aa, Homo Sapiens
KLYRTTISQ

SEQ ID NO: 1224008 - protein, 9 aa, Homo Sapiens
WDALYKFMV

SEQ ID NO: 1224009 - protein, 9 aa, Homo Sapiens
MKKDLRLKN

SEQ ID NO: 1224010 - protein, 9 aa, Homo Sapiens
MVQKERGLD

SEQ ID NO: 1224011 - protein, 9 aa, Homo Sapiens
VLKMIVAHA

SEQ ID NO: 1224012 - protein, 9 aa, Homo Sapiens
QLGKRHNLT

SEQ ID NO: 1224013 - protein, 9 aa, Homo Sapiens
SPKASHCSK

SEQ ID NO: 1224014 - protein, 9 aa, Homo Sapiens
GGDLLLPPA

SEQ ID NO: 1224015 - protein, 9 aa, Homo Sapiens
NTFGRILQH

SEQ ID NO: 1224016 - protein, 9 aa, Homo Sapiens
AGLKSAGRR

SEQ ID NO: 1224017 - protein, 9 aa, Homo Sapiens
EECVQPEYQ

SEQ ID NO: 1224018 - protein, 9 aa, Homo Sapiens
SYIGIPITD

SEQ ID NO: 1224019 - protein, 9 aa, Homo Sapiens
SMFGELTVE

SEQ ID NO: 1224020 - protein, 9 aa, Homo Sapiens
FSCFIYNVD

SEQ ID NO: 1224021 - protein, 9 aa, Homo Sapiens
HGAIPPALH

SEQ ID NO: 1224022 - protein, 9 aa, Homo Sapiens
LGPIPQHTI

SEQ ID NO: 1224023 - protein, 9 aa, Homo Sapiens
EAVRSGHEE

SEQ ID NO: 1224024 - protein, 9 aa, Homo Sapiens
SVPPTQELL

SEQ ID NO: 1224025 - protein, 9 aa, Homo Sapiens
SDMGRKCSK

SEQ ID NO: 1224026 - protein, 9 aa, Homo Sapiens
ATFIKKGCL

SEQ ID NO: 1224027 - protein, 9 aa, Homo Sapiens
EGRTGINEK

SEQ ID NO: 1224028 - protein, 9 aa, Homo Sapiens
GCQVTGRIH

SEQ ID NO: 1224029 - protein, 9 aa, Homo Sapiens
VWPDVRVSP

SEQ ID NO: 1224030 - protein, 9 aa, Homo Sapiens
AADLTTGTP

SEQ ID NO: 1224031 - protein, 9 aa, Homo Sapiens
NKGEDQIIE

SEQ ID NO: 1224032 - protein, 9 aa, Homo Sapiens
GLCLDGDLF

SEQ ID NO: 1224033 - protein, 9 aa, Homo Sapiens
SWLCIICAM

SEQ ID NO: 1224034 - protein, 9 aa, Homo Sapiens
SSKPKDSPP

SEQ ID NO: 1224035 - protein, 9 aa, Homo Sapiens
YFNTGTVYR

SEQ ID NO: 1224036 - protein, 9 aa, Homo Sapiens
NKNVKEAIK

SEQ ID NO: 1224037 - protein, 9 aa, Homo Sapiens
EVLRCIASE

SEQ ID NO: 1224038 - protein, 9 aa, Homo Sapiens
IFPVWSPRG

SEQ ID NO: 1224039 - protein, 9 aa, Homo Sapiens
LDSQHQRSP

SEQ ID NO: 1224040 - protein, 9 aa, Homo Sapiens
DRLRRCSDG

SEQ ID NO: 1224041 - protein, 9 aa, Homo Sapiens
WNSMILIGN

SEQ ID NO: 1224042 - protein, 9 aa, Homo Sapiens
QTMSCLNKC

SEQ ID NO: 1224043 - protein, 9 aa, Homo Sapiens
EEPKAQPLR

SEQ ID NO: 1224044 - protein, 9 aa, Homo Sapiens
LGSLPSGTR

SEQ ID NO: 1224045 - protein, 9 aa, Homo Sapiens
CGPDRCDNT

SEQ ID NO: 1224046 - protein, 9 aa, Homo Sapiens
FIDENGSHL

SEQ ID NO: 1224047 - protein, 9 aa, Homo Sapiens
HVSESFPYP

SEQ ID NO: 1224048 - protein, 9 aa, Homo Sapiens
VKVEEVGRL

SEQ ID NO: 1224049 - protein, 9 aa, Homo Sapiens
VDTDDIVEK

SEQ ID NO: 1224050 - protein, 9 aa, Homo Sapiens
RQLHVGGPV

SEQ ID NO: 1224051 - protein, 9 aa, Homo Sapiens
MVERPTVKA

SEQ ID NO: 1224052 - protein, 9 aa, Homo Sapiens
PCMEVLVKG

SEQ ID NO: 1224053 - protein, 9 aa, Homo Sapiens
FVRDLCDEE

SEQ ID NO: 1224054 - protein, 9 aa, Homo Sapiens
PQSFIFLWC

SEQ ID NO: 1224055 - protein, 9 aa, Homo Sapiens
QQLAPAVRS

SEQ ID NO: 1224056 - protein, 9 aa, Homo Sapiens
IFVRLCYEL

SEQ ID NO: 1224057 - protein, 9 aa, Homo Sapiens
RKQDAEDDG

SEQ ID NO: 1224058 - protein, 9 aa, Homo Sapiens
LIHAHWDAH

SEQ ID NO: 1224059 - protein, 9 aa, Homo Sapiens
NVVMFEQHL

SEQ ID NO: 1224060 - protein, 9 aa, Homo Sapiens
PTDANIFVR

SEQ ID NO: 1224061 - protein, 9 aa, Homo Sapiens
VELKFTPQD

SEQ ID NO: 1224062 - protein, 9 aa, Homo Sapiens
TQKRSLNVH

SEQ ID NO: 1224063 - protein, 9 aa, Homo Sapiens
KEDHFLTTL

SEQ ID NO: 1224064 - protein, 9 aa, Homo Sapiens
NNHRASTPI

SEQ ID NO: 1224065 - protein, 9 aa, Homo Sapiens
LLLQVRQDL

SEQ ID NO: 1224066 - protein, 9 aa, Homo Sapiens
SDLASLTVD

SEQ ID NO: 1224067 - protein, 9 aa, Homo Sapiens
RVLHSAMHQ

SEQ ID NO: 1224068 - protein, 9 aa, Homo Sapiens
KREHLSLAV

SEQ ID NO: 1224069 - protein, 9 aa, Homo Sapiens
LIAIICAYG

SEQ ID NO: 1224070 - protein, 9 aa, Homo Sapiens
NDARNDSRN

SEQ ID NO: 1224071 - protein, 9 aa, Homo Sapiens
CGKYYISKG

SEQ ID NO: 1224072 - protein, 9 aa, Homo Sapiens
LHTFCESCL

SEQ ID NO: 1224073 - protein, 9 aa, Homo Sapiens
SWGEVLFLM

SEQ ID NO: 1224074 - protein, 9 aa, Homo Sapiens
FILHAKRQP

SEQ ID NO: 1224075 - protein, 9 aa, Homo Sapiens
DLSEGEEDD

SEQ ID NO: 1224076 - protein, 9 aa, Homo Sapiens
RLPYPLLST

SEQ ID NO: 1224077 - protein, 9 aa, Homo Sapiens
ITMLDTGSF

SEQ ID NO: 1224078 - protein, 9 aa, Homo Sapiens
HDSTMHSRV

SEQ ID NO: 1224079 - protein, 9 aa, Homo Sapiens
VNPSWTTRD

SEQ ID NO: 1224080 - protein, 9 aa, Homo Sapiens
LKVIPVAAF

SEQ ID NO: 1224081 - protein, 9 aa, Homo Sapiens
AVHKCRVHD

SEQ ID NO: 1224082 - protein, 9 aa, Homo Sapiens
QGRRELGGR

SEQ ID NO: 1224083 - protein, 9 aa, Homo Sapiens
CMQMVSSNV

SEQ ID NO: 1224084 - protein, 9 aa, Homo Sapiens
EKKNPGALE

SEQ ID NO: 1224085 - protein, 9 aa, Homo Sapiens
RIGGGRNTD

SEQ ID NO: 1224086 - protein, 9 aa, Homo Sapiens
AVNQRHTEN

SEQ ID NO: 1224087 - protein, 9 aa, Homo Sapiens
DSLYMFGGF

SEQ ID NO: 1224088 - protein, 9 aa, Homo Sapiens
AATAPGAGD

SEQ ID NO: 1224089 - protein, 9 aa, Homo Sapiens
PDVTGQLLS

SEQ ID NO: 1224090 - protein, 9 aa, Homo Sapiens
PLVGTSEFL

SEQ ID NO: 1224091 - protein, 9 aa, Homo Sapiens
KMRSFPLFD

SEQ ID NO: 1224092 - protein, 9 aa, Homo Sapiens
IACGILLAD

SEQ ID NO: 1224093 - protein, 9 aa, Homo Sapiens
LKKVRSLKG

SEQ ID NO: 1224094 - protein, 9 aa, Homo Sapiens
FTWNKRSGM

SEQ ID NO: 1224095 - protein, 9 aa, Homo Sapiens
CEGGVQERG

SEQ ID NO: 1224096 - protein, 9 aa, Homo Sapiens
GDCFPAGAQ

SEQ ID NO: 1224097 - protein, 9 aa, Homo Sapiens
LLAGPDMVL

SEQ ID NO: 1224098 - protein, 9 aa, Homo Sapiens
VLIDFGFLL

SEQ ID NO: 1224099 - protein, 9 aa, Homo Sapiens
EFIVYVQEV

SEQ ID NO: 1224100 - protein, 9 aa, Homo Sapiens
ELEDSVIAY

SEQ ID NO: 1224101 - protein, 9 aa, Homo Sapiens
ITSIVKDSY

SEQ ID NO: 1224102 - protein, 9 aa, Homo Sapiens
LFRWPWHEV

SEQ ID NO: 1224103 - protein, 9 aa, Homo Sapiens
RREECLQAK

SEQ ID NO: 1224104 - protein, 9 aa, Homo Sapiens
CARSRRSVP

SEQ ID NO: 1224105 - protein, 9 aa, Homo Sapiens
LIPLMNIEG

SEQ ID NO: 1224106 - protein, 9 aa, Homo Sapiens
TLFLSLSRH

SEQ ID NO: 1224107 - protein, 9 aa, Homo Sapiens
LVTFVALLL

SEQ ID NO: 1224108 - protein, 9 aa, Homo Sapiens
GERGEQGIP

SEQ ID NO: 1224109 - protein, 9 aa, Homo Sapiens
VLIVLYILC

SEQ ID NO: 1224110 - protein, 9 aa, Homo Sapiens
GCRMVHMPG

SEQ ID NO: 1224111 - protein, 9 aa, Homo Sapiens
LIKHSVMVD

SEQ ID NO: 1224112 - protein, 9 aa, Homo Sapiens
ELKQVMAKH

SEQ ID NO: 1224113 - protein, 9 aa, Homo Sapiens
HYFCDALPI

SEQ ID NO: 1224114 - protein, 9 aa, Homo Sapiens
EKLHCLCMC

SEQ ID NO: 1224115 - protein, 9 aa, Homo Sapiens
CVDPSSPRS

SEQ ID NO: 1224116 - protein, 9 aa, Homo Sapiens
FNGVDELLE

SEQ ID NO: 1224117 - protein, 9 aa, Homo Sapiens
VGPYTFTMD

SEQ ID NO: 1224118 - protein, 9 aa, Homo Sapiens
HDGKSRGTL

SEQ ID NO: 1224119 - protein, 9 aa, Homo Sapiens
GDQTLESGP

SEQ ID NO: 1224120 - protein, 9 aa, Homo Sapiens
GLFLNEEML

SEQ ID NO: 1224121 - protein, 9 aa, Homo Sapiens
QYNMEADGI

SEQ ID NO: 1224122 - protein, 9 aa, Homo Sapiens
VVKASLQKC

SEQ ID NO: 1224123 - protein, 9 aa, Homo Sapiens
MDHEQDREI

SEQ ID NO: 1224124 - protein, 9 aa, Homo Sapiens
MLLANARER

SEQ ID NO: 1224125 - protein, 9 aa, Homo Sapiens
FLGQVWCPS

SEQ ID NO: 1224126 - protein, 9 aa, Homo Sapiens
RSSLSTSIL

SEQ ID NO: 1224127 - protein, 9 aa, Homo Sapiens
MLLKMVALG

SEQ ID NO: 1224128 - protein, 9 aa, Homo Sapiens
SISACAWPQ

SEQ ID NO: 1224129 - protein, 9 aa, Homo Sapiens
QRPAGLIIV

SEQ ID NO: 1224130 - protein, 9 aa, Homo Sapiens
IPLNITLDN

SEQ ID NO: 1224131 - protein, 9 aa, Homo Sapiens
AGCRPYMTP

SEQ ID NO: 1224132 - protein, 9 aa, Homo Sapiens
ERDVMSSEG

SEQ ID NO: 1224133 - protein, 9 aa, Homo Sapiens
WIIFQRRNT

SEQ ID NO: 1224134 - protein, 9 aa, Homo Sapiens
TIARKSVLV

SEQ ID NO: 1224135 - protein, 9 aa, Homo Sapiens
SSHIIVHIR

SEQ ID NO: 1224136 - protein, 9 aa, Homo Sapiens
PCLPSYPPP

SEQ ID NO: 1224137 - protein, 9 aa, Homo Sapiens
SHLILLWLL

SEQ ID NO: 1224138 - protein, 9 aa, Homo Sapiens
VPLEVTCVV

SEQ ID NO: 1224139 - protein, 9 aa, Homo Sapiens
CSQKDLDAV

SEQ ID NO: 1224140 - protein, 9 aa, Homo Sapiens
PLTLTKNSL

SEQ ID NO: 1224141 - protein, 9 aa, Homo Sapiens
VLLLILPVL

SEQ ID NO: 1224142 - protein, 9 aa, Homo Sapiens
TVINYLPKC

SEQ ID NO: 1224143 - protein, 9 aa, Homo Sapiens
PTLQPGTRP

SEQ ID NO: 1224144 - protein, 9 aa, Homo Sapiens
RPQVPKGLE

SEQ ID NO: 1224145 - protein, 9 aa, Homo Sapiens
LLHDLIHEA

SEQ ID NO: 1224146 - protein, 9 aa, Homo Sapiens
TEGGETEEA

SEQ ID NO: 1224147 - protein, 9 aa, Homo Sapiens
REWEAAAEL

SEQ ID NO: 1224148 - protein, 9 aa, Homo Sapiens
EEGKHHPYK

SEQ ID NO: 1224149 - protein, 9 aa, Homo Sapiens
REEVNENFE

SEQ ID NO: 1224150 - protein, 9 aa, Homo Sapiens
SGAPASWIW

SEQ ID NO: 1224151 - protein, 9 aa, Homo Sapiens
RSPGRCAPS

SEQ ID NO: 1224152 - protein, 9 aa, Homo Sapiens
ELSENDKKN

SEQ ID NO: 1224153 - protein, 9 aa, Homo Sapiens
VFHLNTLKE

SEQ ID NO: 1224154 - protein, 9 aa, Homo Sapiens
GDRVVITGQ

SEQ ID NO: 1224155 - protein, 9 aa, Homo Sapiens
VALHRAKRR

SEQ ID NO: 1224156 - protein, 9 aa, Homo Sapiens
RTVQKCQQQ

SEQ ID NO: 1224157 - protein, 9 aa, Homo Sapiens
KNPIVVGGT

SEQ ID NO: 1224158 - protein, 9 aa, Homo Sapiens
ENLRFAHNY

SEQ ID NO: 1224159 - protein, 9 aa, Homo Sapiens
NPLDTFGNM

SEQ ID NO: 1224160 - protein, 9 aa, Homo Sapiens
HAFLPRIPK

SEQ ID NO: 1224161 - protein, 9 aa, Homo Sapiens
RYLHSNCLD

SEQ ID NO: 1224162 - protein, 9 aa, Homo Sapiens
REECAALEK

SEQ ID NO: 1224163 - protein, 9 aa, Homo Sapiens
ENPFECSEC

SEQ ID NO: 1224164 - protein, 9 aa, Homo Sapiens
HGATELVAE

SEQ ID NO: 1224165 - protein, 9 aa, Homo Sapiens
PQPGFLARK

SEQ ID NO: 1224166 - protein, 9 aa, Homo Sapiens
TLTVPGIFC

SEQ ID NO: 1224167 - protein, 9 aa, Homo Sapiens
KNDGIYVRP

SEQ ID NO: 1224168 - protein, 9 aa, Homo Sapiens
EHEEKERIK

SEQ ID NO: 1224169 - protein, 9 aa, Homo Sapiens
RKIAVSSIQ

SEQ ID NO: 1224170 - protein, 9 aa, Homo Sapiens
QRAVLEWDV

SEQ ID NO: 1224171 - protein, 9 aa, Homo Sapiens
QKPLICWDT

SEQ ID NO: 1224172 - protein, 9 aa, Homo Sapiens
TGPLQRGGL

SEQ ID NO: 1224173 - protein, 9 aa, Homo Sapiens
FQLYMDAIR

SEQ ID NO: 1224174 - protein, 9 aa, Homo Sapiens
ALAASVSDW

SEQ ID NO: 1224175 - protein, 9 aa, Homo Sapiens
WQTATFRQQ

SEQ ID NO: 1224176 - protein, 9 aa, Homo Sapiens
KISGSVAGK

SEQ ID NO: 1224177 - protein, 9 aa, Homo Sapiens
EEKKQALSD

SEQ ID NO: 1224178 - protein, 9 aa, Homo Sapiens
SDTIPYLKT

SEQ ID NO: 1224179 - protein, 9 aa, Homo Sapiens
GDEGMPVQV

SEQ ID NO: 1224180 - protein, 9 aa, Homo Sapiens
LPQGQRCNY

SEQ ID NO: 1224181 - protein, 9 aa, Homo Sapiens
PFFYMTAND

SEQ ID NO: 1224182 - protein, 9 aa, Homo Sapiens
VVVGVIATL

SEQ ID NO: 1224183 - protein, 9 aa, Homo Sapiens
EHCTCTLKG

SEQ ID NO: 1224184 - protein, 9 aa, Homo Sapiens
DSAKLFLVD

SEQ ID NO: 1224185 - protein, 9 aa, Homo Sapiens
VAVLLQNWP

SEQ ID NO: 1224186 - protein, 9 aa, Homo Sapiens
WQGSRKKGM

SEQ ID NO: 1224187 - protein, 9 aa, Homo Sapiens
ASPTWRNSM

SEQ ID NO: 1224188 - protein, 9 aa, Homo Sapiens
FNMGSSSSN

SEQ ID NO: 1224189 - protein, 9 aa, Homo Sapiens
LSASGFSVF

SEQ ID NO: 1224190 - protein, 9 aa, Homo Sapiens
CMEVLVKGL

SEQ ID NO: 1224191 - protein, 9 aa, Homo Sapiens
PRPRVPLCP

SEQ ID NO: 1224192 - protein, 9 aa, Homo Sapiens
FDYSSHGMG

SEQ ID NO: 1224193 - protein, 9 aa, Homo Sapiens
APWKPIWLP

SEQ ID NO: 1224194 - protein, 9 aa, Homo Sapiens
IHITRPAFK

SEQ ID NO: 1224195 - protein, 9 aa, Homo Sapiens
RLRRCSDGK

SEQ ID NO: 1224196 - protein, 9 aa, Homo Sapiens
KSYKCLHKH

SEQ ID NO: 1224197 - protein, 9 aa, Homo Sapiens
ALIHFVDSE

SEQ ID NO: 1224198 - protein, 9 aa, Homo Sapiens
QLAGLLQLT

SEQ ID NO: 1224199 - protein, 9 aa, Homo Sapiens
TTAILGAVS

SEQ ID NO: 1224200 - protein, 9 aa, Homo Sapiens
HREADVSLS

SEQ ID NO: 1224201 - protein, 9 aa, Homo Sapiens
LCVYCALLA

SEQ ID NO: 1224202 - protein, 9 aa, Homo Sapiens
PSEKSNKKI

SEQ ID NO: 1224203 - protein, 9 aa, Homo Sapiens
FKGLYVVIT

SEQ ID NO: 1224204 - protein, 9 aa, Homo Sapiens
FLVPTFLRV

SEQ ID NO: 1224205 - protein, 9 aa, Homo Sapiens
EPAKEWNVL

SEQ ID NO: 1224206 - protein, 9 aa, Homo Sapiens
LFQRWYVRR

SEQ ID NO: 1224207 - protein, 9 aa, Homo Sapiens
LNHFMLCIS

SEQ ID NO: 1224208 - protein, 9 aa, Homo Sapiens
RLVPPKTRR

SEQ ID NO: 1224209 - protein, 9 aa, Homo Sapiens
DETMQPWQP

SEQ ID NO: 1224210 - protein, 9 aa, Homo Sapiens
SAEIPTGSE

SEQ ID NO: 1224211 - protein, 9 aa, Homo Sapiens
LLQHPQQKA

SEQ ID NO: 1224212 - protein, 9 aa, Homo Sapiens
QIDQQHPRL

SEQ ID NO: 1224213 - protein, 9 aa, Homo Sapiens
VALLQENQK

SEQ ID NO: 1224214 - protein, 9 aa, Homo Sapiens
AIQVCSLER

SEQ ID NO: 1224215 - protein, 9 aa, Homo Sapiens
HHILPPQLQ

SEQ ID NO: 1224216 - protein, 9 aa, Homo Sapiens
CCAECLDSD

SEQ ID NO: 1224217 - protein, 9 aa, Homo Sapiens
NRDLGPNMR

SEQ ID NO: 1224218 - protein, 9 aa, Homo Sapiens
SYTSFHNNV

SEQ ID NO: 1224219 - protein, 9 aa, Homo Sapiens
SDMRRAEAT

SEQ ID NO: 1224220 - protein, 9 aa, Homo Sapiens
LGSKHSLHR

SEQ ID NO: 1224221 - protein, 9 aa, Homo Sapiens
QEKEIEAQR

SEQ ID NO: 1224222 - protein, 9 aa, Homo Sapiens
NEKKNKAVN

SEQ ID NO: 1224223 - protein, 9 aa, Homo Sapiens
DTANHLRIH

SEQ ID NO: 1224224 - protein, 9 aa, Homo Sapiens
PQPDVDHQK

SEQ ID NO: 1224225 - protein, 9 aa, Homo Sapiens
GSRTHITLG

SEQ ID NO: 1224226 - protein, 9 aa, Homo Sapiens
ERVKKYDLC

SEQ ID NO: 1224227 - protein, 9 aa, Homo Sapiens
AAAIQDETM

SEQ ID NO: 1224228 - protein, 9 aa, Homo Sapiens
ATYINIKPA

SEQ ID NO: 1224229 - protein, 9 aa, Homo Sapiens
GFITPLSLA

SEQ ID NO: 1224230 - protein, 9 aa, Homo Sapiens
RKKPKEPRP

SEQ ID NO: 1224231 - protein, 9 aa, Homo Sapiens
LSLSNVAGI

SEQ ID NO: 1224232 - protein, 9 aa, Homo Sapiens
VYDDLKQKK

SEQ ID NO: 1224233 - protein, 9 aa, Homo Sapiens
FGYLQQEMG

SEQ ID NO: 1224234 - protein, 9 aa, Homo Sapiens
RCEHVQAWL

SEQ ID NO: 1224235 - protein, 9 aa, Homo Sapiens
EVPPHIFSI

SEQ ID NO: 1224236 - protein, 9 aa, Homo Sapiens
KQSLQPFCT

SEQ ID NO: 1224237 - protein, 9 aa, Homo Sapiens
HPDVNNRHK

SEQ ID NO: 1224238 - protein, 9 aa, Homo Sapiens
ASLEVRAPA

SEQ ID NO: 1224239 - protein, 9 aa, Homo Sapiens
KFKRPPQRM

SEQ ID NO: 1224240 - protein, 9 aa, Homo Sapiens
IEMAEMCKQ

SEQ ID NO: 1224241 - protein, 9 aa, Homo Sapiens
ASSSKSHGP

SEQ ID NO: 1224242 - protein, 9 aa, Homo Sapiens
EGRADLCHQ

SEQ ID NO: 1224243 - protein, 9 aa, Homo Sapiens
LLFHTSAWG

SEQ ID NO: 1224244 - protein, 9 aa, Homo Sapiens
DNINTPFDR

SEQ ID NO: 1224245 - protein, 9 aa, Homo Sapiens
MCNACGLYH

SEQ ID NO: 1224246 - protein, 9 aa, Homo Sapiens
PAPAAVPLP

SEQ ID NO: 1224247 - protein, 9 aa, Homo Sapiens
DHDNKELKA

SEQ ID NO: 1224248 - protein, 9 aa, Homo Sapiens
EDLLHTIDE

SEQ ID NO: 1224249 - protein, 9 aa, Homo Sapiens
VDVKPVYKP

SEQ ID NO: 1224250 - protein, 9 aa, Homo Sapiens
AHYFIGFLG

SEQ ID NO: 1224251 - protein, 9 aa, Homo Sapiens
IREGQARER

SEQ ID NO: 1224252 - protein, 9 aa, Homo Sapiens
NGADDWIIA

SEQ ID NO: 1224253 - protein, 9 aa, Homo Sapiens
PGPGPRLQQ

SEQ ID NO: 1224254 - protein, 9 aa, Homo Sapiens
MVTPEAKNL

SEQ ID NO: 1224255 - protein, 9 aa, Homo Sapiens
ENYNTGILF

SEQ ID NO: 1224256 - protein, 9 aa, Homo Sapiens
QVIEEAGKF

SEQ ID NO: 1224257 - protein, 9 aa, Homo Sapiens
YDNAFLLEA

SEQ ID NO: 1224258 - protein, 9 aa, Homo Sapiens
EAGEEENTF

SEQ ID NO: 1224259 - protein, 9 aa, Homo Sapiens
SAGISSAWT

SEQ ID NO: 1224260 - protein, 9 aa, Homo Sapiens
SNSSREAGA

SEQ ID NO: 1224261 - protein, 9 aa, Homo Sapiens
KILHQPKKY

SEQ ID NO: 1224262 - protein, 9 aa, Homo Sapiens
NVTRMCQVT

SEQ ID NO: 1224263 - protein, 9 aa, Homo Sapiens
GCDCVAEGM

SEQ ID NO: 1224264 - protein, 9 aa, Homo Sapiens
IVVYMAVKE

SEQ ID NO: 1224265 - protein, 9 aa, Homo Sapiens
DSSQNKQTF

SEQ ID NO: 1224266 - protein, 9 aa, Homo Sapiens
LKEYGVMCV

SEQ ID NO: 1224267 - protein, 9 aa, Homo Sapiens
IIPEACRGD

SEQ ID NO: 1224268 - protein, 9 aa, Homo Sapiens
TPSVWEADA

SEQ ID NO: 1224269 - protein, 9 aa, Homo Sapiens
EYFATEGLQ

SEQ ID NO: 1224270 - protein, 9 aa, Homo Sapiens
VGAQEEHVY

SEQ ID NO: 1224271 - protein, 9 aa, Homo Sapiens
KERARHLIH

SEQ ID NO: 1224272 - protein, 9 aa, Homo Sapiens
IMMMDESVQ

SEQ ID NO: 1224273 - protein, 9 aa, Homo Sapiens
SKKHSNTSI

SEQ ID NO: 1224274 - protein, 9 aa, Homo Sapiens
AFTSTEHAH

SEQ ID NO: 1224275 - protein, 9 aa, Homo Sapiens
IHIPKNKET

SEQ ID NO: 1224276 - protein, 9 aa, Homo Sapiens
TCSFVQVGG

SEQ ID NO: 1224277 - protein, 9 aa, Homo Sapiens
MYTPPDITS

SEQ ID NO: 1224278 - protein, 9 aa, Homo Sapiens
MDFQREIQI

SEQ ID NO: 1224279 - protein, 9 aa, Homo Sapiens
DAIKGMQRF

SEQ ID NO: 1224280 - protein, 9 aa, Homo Sapiens
RIPALSPKP

SEQ ID NO: 1224281 - protein, 9 aa, Homo Sapiens
NLPFEPHTA

SEQ ID NO: 1224282 - protein, 9 aa, Homo Sapiens
NCNKAKAQD

SEQ ID NO: 1224283 - protein, 9 aa, Homo Sapiens
GKHRKPRKQ

SEQ ID NO: 1224284 - protein, 9 aa, Homo Sapiens
FQPASSHHG

SEQ ID NO: 1224285 - protein, 9 aa, Homo Sapiens
EVLVKGLRE

SEQ ID NO: 1224286 - protein, 9 aa, Homo Sapiens
TEAGPSRWP

SEQ ID NO: 1224287 - protein, 9 aa, Homo Sapiens
CVVCLQPFC

SEQ ID NO: 1224288 - protein, 9 aa, Homo Sapiens
FLYDNATDL

SEQ ID NO: 1224289 - protein, 9 aa, Homo Sapiens
SVSLMRVLS

SEQ ID NO: 1224290 - protein, 9 aa, Homo Sapiens
MRHLNINGA

SEQ ID NO: 1224291 - protein, 9 aa, Homo Sapiens
EGSISALKF

SEQ ID NO: 1224292 - protein, 9 aa, Homo Sapiens
IHPPLKEGA

SEQ ID NO: 1224293 - protein, 9 aa, Homo Sapiens
VLSVCMRHD

SEQ ID NO: 1224294 - protein, 9 aa, Homo Sapiens
PEKEARVWE

SEQ ID NO: 1224295 - protein, 9 aa, Homo Sapiens
GSCSSFART

SEQ ID NO: 1224296 - protein, 9 aa, Homo Sapiens
VLPQTILHK

SEQ ID NO: 1224297 - protein, 9 aa, Homo Sapiens
QAGREKYST

SEQ ID NO: 1224298 - protein, 9 aa, Homo Sapiens
KLAFKMSIF

SEQ ID NO: 1224299 - protein, 9 aa, Homo Sapiens
MKLHYVDVL

SEQ ID NO: 1224300 - protein, 9 aa, Homo Sapiens
SSSKGTIQL

SEQ ID NO: 1224301 - protein, 9 aa, Homo Sapiens
PWKVFTYKA

SEQ ID NO: 1224302 - protein, 9 aa, Homo Sapiens
YRQLRFLET

SEQ ID NO: 1224303 - protein, 9 aa, Homo Sapiens
LTRCLILDI

SEQ ID NO: 1224304 - protein, 9 aa, Homo Sapiens
FKAGDIIEV

SEQ ID NO: 1224305 - protein, 9 aa, Homo Sapiens
HVCDELREV

SEQ ID NO: 1224306 - protein, 9 aa, Homo Sapiens
PWQRWGLLR

SEQ ID NO: 1224307 - protein, 9 aa, Homo Sapiens
MEQVQAYVM

SEQ ID NO: 1224308 - protein, 9 aa, Homo Sapiens
DYFTYITKA

SEQ ID NO: 1224309 - protein, 9 aa, Homo Sapiens
GPRAAEDEL

SEQ ID NO: 1224310 - protein, 9 aa, Homo Sapiens
AIKDVTKAL

SEQ ID NO: 1224311 - protein, 9 aa, Homo Sapiens
RNQEEGKNH

SEQ ID NO: 1224312 - protein, 9 aa, Homo Sapiens
NAISPLKSI

SEQ ID NO: 1224313 - protein, 9 aa, Homo Sapiens
MYAHVYGNG

SEQ ID NO: 1224314 - protein, 9 aa, Homo Sapiens
PLRPQRGPR

SEQ ID NO: 1224315 - protein, 9 aa, Homo Sapiens
FANVQPILN

SEQ ID NO: 1224316 - protein, 9 aa, Homo Sapiens
MEPSSTSFT

SEQ ID NO: 1224317 - protein, 9 aa, Homo Sapiens
IYWVHFYTK

SEQ ID NO: 1224318 - protein, 9 aa, Homo Sapiens
SSRGIVSFV

SEQ ID NO: 1224319 - protein, 9 aa, Homo Sapiens
EALNGIIQG

SEQ ID NO: 1224320 - protein, 9 aa, Homo Sapiens
KKLFTDRKT

SEQ ID NO: 1224321 - protein, 9 aa, Homo Sapiens
HITRPAFKG

SEQ ID NO: 1224322 - protein, 9 aa, Homo Sapiens
RRLQSGSVA

SEQ ID NO: 1224323 - protein, 9 aa, Homo Sapiens
PSMLRDDAI

SEQ ID NO: 1224324 - protein, 9 aa, Homo Sapiens
WERTRKHSR

SEQ ID NO: 1224325 - protein, 9 aa, Homo Sapiens
LPLIPVREQ

SEQ ID NO: 1224326 - protein, 9 aa, Homo Sapiens
QTINFGTVG

SEQ ID NO: 1224327 - protein, 9 aa, Homo Sapiens
ADLDPHRVR

SEQ ID NO: 1224328 - protein, 9 aa, Homo Sapiens
EDCVEPVVW

SEQ ID NO: 1224329 - protein, 9 aa, Homo Sapiens
DPQSGLYNS

SEQ ID NO: 1224330 - protein, 9 aa, Homo Sapiens
AWTSQYFGV

SEQ ID NO: 1224331 - protein, 9 aa, Homo Sapiens
EMVLICGNF

SEQ ID NO: 1224332 - protein, 9 aa, Homo Sapiens
DWFTTETLG

SEQ ID NO: 1224333 - protein, 9 aa, Homo Sapiens
QSAIVLGNL

SEQ ID NO: 1224334 - protein, 9 aa, Homo Sapiens
QELKERERH

SEQ ID NO: 1224335 - protein, 9 aa, Homo Sapiens
ALGGRMDHM

SEQ ID NO: 1224336 - protein, 9 aa, Homo Sapiens
YMDCKGRGV

SEQ ID NO: 1224337 - protein, 9 aa, Homo Sapiens
YSIGRIFDG

SEQ ID NO: 1224338 - protein, 9 aa, Homo Sapiens
TKGNAKSKV

SEQ ID NO: 1224339 - protein, 9 aa, Homo Sapiens
VAVMCLITA

SEQ ID NO: 1224340 - protein, 9 aa, Homo Sapiens
TLPERSDSE

SEQ ID NO: 1224341 - protein, 9 aa, Homo Sapiens
LMLEELRNL

SEQ ID NO: 1224342 - protein, 9 aa, Homo Sapiens
DKDGLGFIT

SEQ ID NO: 1224343 - protein, 9 aa, Homo Sapiens
RRLCLVLSE

SEQ ID NO: 1224344 - protein, 9 aa, Homo Sapiens
CVLYTWDFG

SEQ ID NO: 1224345 - protein, 9 aa, Homo Sapiens
MFWREFTAS

SEQ ID NO: 1224346 - protein, 9 aa, Homo Sapiens
IVQPAAAPG

SEQ ID NO: 1224347 - protein, 9 aa, Homo Sapiens
YFMCMEACG

SEQ ID NO: 1224348 - protein, 9 aa, Homo Sapiens
LGKPDSILV

SEQ ID NO: 1224349 - protein, 9 aa, Homo Sapiens
GRSSGRQQR

SEQ ID NO: 1224350 - protein, 9 aa, Homo Sapiens
RELSESTTL

SEQ ID NO: 1224351 - protein, 9 aa, Homo Sapiens
MYELSWRMC

SEQ ID NO: 1224352 - protein, 9 aa, Homo Sapiens
MQSRMDQWM

SEQ ID NO: 1224353 - protein, 9 aa, Homo Sapiens
RAGRMGVCI

SEQ ID NO: 1224354 - protein, 9 aa, Homo Sapiens
HLILCTVET

SEQ ID NO: 1224355 - protein, 9 aa, Homo Sapiens
VLEKERARH

SEQ ID NO: 1224356 - protein, 9 aa, Homo Sapiens
MYLLKTEDS

SEQ ID NO: 1224357 - protein, 9 aa, Homo Sapiens
GTGKNFVAQ

SEQ ID NO: 1224358 - protein, 9 aa, Homo Sapiens
PVLQKWSLP

SEQ ID NO: 1224359 - protein, 9 aa, Homo Sapiens
YIFIDFASL

SEQ ID NO: 1224360 - protein, 9 aa, Homo Sapiens
LQMESAAFQ

SEQ ID NO: 1224361 - protein, 9 aa, Homo Sapiens
ITQIVANYE

SEQ ID NO: 1224362 - protein, 9 aa, Homo Sapiens
KQFYKGKKK

SEQ ID NO: 1224363 - protein, 9 aa, Homo Sapiens
NYFTNRQRM

SEQ ID NO: 1224364 - protein, 9 aa, Homo Sapiens
VTLGGSLYE

SEQ ID NO: 1224365 - protein, 9 aa, Homo Sapiens
ITTMLNPLI

SEQ ID NO: 1224366 - protein, 9 aa, Homo Sapiens
LEPVLRTDA

SEQ ID NO: 1224367 - protein, 9 aa, Homo Sapiens
VFTLKATVI

SEQ ID NO: 1224368 - protein, 9 aa, Homo Sapiens
KVPRGMAYV

SEQ ID NO: 1224369 - protein, 9 aa, Homo Sapiens
TQLCLRIQT

SEQ ID NO: 1224370 - protein, 9 aa, Homo Sapiens
NALQHWPVL

SEQ ID NO: 1224371 - protein, 9 aa, Homo Sapiens
NDRVIRVAA

SEQ ID NO: 1224372 - protein, 9 aa, Homo Sapiens
MNAKYKAEE

SEQ ID NO: 1224373 - protein, 9 aa, Homo Sapiens
NFIIHISHQ

SEQ ID NO: 1224374 - protein, 9 aa, Homo Sapiens
MSCLNKCDI

SEQ ID NO: 1224375 - protein, 9 aa, Homo Sapiens
TRCDGKKIV

SEQ ID NO: 1224376 - protein, 9 aa, Homo Sapiens
QVARKQDTW

SEQ ID NO: 1224377 - protein, 9 aa, Homo Sapiens
NYNINQSRF

SEQ ID NO: 1224378 - protein, 9 aa, Homo Sapiens
ARKTLFPRE

SEQ ID NO: 1224379 - protein, 9 aa, Homo Sapiens
NKHIRFNVY

SEQ ID NO: 1224380 - protein, 9 aa, Homo Sapiens
LAEAIKCRT

SEQ ID NO: 1224381 - protein, 9 aa, Homo Sapiens
MADDDTAVV

SEQ ID NO: 1224382 - protein, 9 aa, Homo Sapiens
TMDNSLKKE

SEQ ID NO: 1224383 - protein, 9 aa, Homo Sapiens
GNVRNPASP

SEQ ID NO: 1224384 - protein, 9 aa, Homo Sapiens
SKTLPVAQE

SEQ ID NO: 1224385 - protein, 9 aa, Homo Sapiens
GGEVIITSE

SEQ ID NO: 1224386 - protein, 9 aa, Homo Sapiens
CTPPSPYHA

SEQ ID NO: 1224387 - protein, 9 aa, Homo Sapiens
TWTWARPGE

SEQ ID NO: 1224388 - protein, 9 aa, Homo Sapiens
LGSETSKKH

SEQ ID NO: 1224389 - protein, 9 aa, Homo Sapiens
TSCGPLRIF

SEQ ID NO: 1224390 - protein, 9 aa, Homo Sapiens
TSGGITFCN

SEQ ID NO: 1224391 - protein, 9 aa, Homo Sapiens
MPFLYCNTG

SEQ ID NO: 1224392 - protein, 9 aa, Homo Sapiens
NIQGGCSAV

SEQ ID NO: 1224393 - protein, 9 aa, Homo Sapiens
AVDMTALFQ

SEQ ID NO: 1224394 - protein, 9 aa, Homo Sapiens
LMYTVEYSF

SEQ ID NO: 1224395 - protein, 9 aa, Homo Sapiens
GTMECFPTL

SEQ ID NO: 1224396 - protein, 9 aa, Homo Sapiens
DSGTSDFTL

SEQ ID NO: 1224397 - protein, 9 aa, Homo Sapiens
ESALQMESA

SEQ ID NO: 1224398 - protein, 9 aa, Homo Sapiens
PCISLIKEE

SEQ ID NO: 1224399 - protein, 9 aa, Homo Sapiens
VNHSSNKRS

SEQ ID NO: 1224400 - protein, 9 aa, Homo Sapiens
CVDGGELFD

SEQ ID NO: 1224401 - protein, 9 aa, Homo Sapiens
SLPNRNTKV

SEQ ID NO: 1224402 - protein, 9 aa, Homo Sapiens
GWGRGLVGG

SEQ ID NO: 1224403 - protein, 9 aa, Homo Sapiens
PSACPCMCT

SEQ ID NO: 1224404 - protein, 9 aa, Homo Sapiens
APITSLHDA

SEQ ID NO: 1224405 - protein, 9 aa, Homo Sapiens
SVLLYATVL

SEQ ID NO: 1224406 - protein, 9 aa, Homo Sapiens
IYLKQVTDT

SEQ ID NO: 1224407 - protein, 9 aa, Homo Sapiens
QTAILVCCL

SEQ ID NO: 1224408 - protein, 9 aa, Homo Sapiens
SHILVCFLK

SEQ ID NO: 1224409 - protein, 9 aa, Homo Sapiens
DFDAFFTSS

SEQ ID NO: 1224410 - protein, 9 aa, Homo Sapiens
TADEFIHQH

SEQ ID NO: 1224411 - protein, 9 aa, Homo Sapiens
INGQVESAQ

SEQ ID NO: 1224412 - protein, 9 aa, Homo Sapiens
LLLRRQLWA

SEQ ID NO: 1224413 - protein, 9 aa, Homo Sapiens
PSDLIISSA

SEQ ID NO: 1224414 - protein, 9 aa, Homo Sapiens
GVLHYIIIS

SEQ ID NO: 1224415 - protein, 9 aa, Homo Sapiens
IYGYRLHRK

SEQ ID NO: 1224416 - protein, 9 aa, Homo Sapiens
DGRIHKCDR

SEQ ID NO: 1224417 - protein, 9 aa, Homo Sapiens
MNKHLSSST

SEQ ID NO: 1224418 - protein, 9 aa, Homo Sapiens
SLVSQSLVN

SEQ ID NO: 1224419 - protein, 9 aa, Homo Sapiens
LRVLRCTNN

SEQ ID NO: 1224420 - protein, 9 aa, Homo Sapiens
GDAPFCTRI

SEQ ID NO: 1224421 - protein, 9 aa, Homo Sapiens
TMAQEFDIY

SEQ ID NO: 1224422 - protein, 9 aa, Homo Sapiens
ISLSSSESQ

SEQ ID NO: 1224423 - protein, 9 aa, Homo Sapiens
HGSHISMSN

SEQ ID NO: 1224424 - protein, 9 aa, Homo Sapiens
KIGQWPCFD

SEQ ID NO: 1224425 - protein, 9 aa, Homo Sapiens
GEDYAAHLE

SEQ ID NO: 1224426 - protein, 9 aa, Homo Sapiens
ANLSHAAVQ

SEQ ID NO: 1224427 - protein, 9 aa, Homo Sapiens
LESEARIIL

SEQ ID NO: 1224428 - protein, 9 aa, Homo Sapiens
SLGSWMATE

SEQ ID NO: 1224429 - protein, 9 aa, Homo Sapiens
FSEFYVELK

SEQ ID NO: 1224430 - protein, 9 aa, Homo Sapiens
RLSSLKWFL

SEQ ID NO: 1224431 - protein, 9 aa, Homo Sapiens
GQEETRGPD

SEQ ID NO: 1224432 - protein, 9 aa, Homo Sapiens
ARHQQIHTG

SEQ ID NO: 1224433 - protein, 9 aa, Homo Sapiens
LCCELSPGY

SEQ ID NO: 1224434 - protein, 9 aa, Homo Sapiens
SSSSNQYTF

SEQ ID NO: 1224435 - protein, 9 aa, Homo Sapiens
IGNVYTAQN

SEQ ID NO: 1224436 - protein, 9 aa, Homo Sapiens
HLQLLVQDK

SEQ ID NO: 1224437 - protein, 9 aa, Homo Sapiens
VSITPGTIL

SEQ ID NO: 1224438 - protein, 9 aa, Homo Sapiens
RRIVDALQT

SEQ ID NO: 1224439 - protein, 9 aa, Homo Sapiens
DKSEMPHVS

SEQ ID NO: 1224440 - protein, 9 aa, Homo Sapiens
DHEGEFTCH

SEQ ID NO: 1224441 - protein, 9 aa, Homo Sapiens
YSMRQKTQA

SEQ ID NO: 1224442 - protein, 9 aa, Homo Sapiens
LPQLLLLCH

SEQ ID NO: 1224443 - protein, 9 aa, Homo Sapiens
TFITTMLNP

SEQ ID NO: 1224444 - protein, 9 aa, Homo Sapiens
GNIKKLSNC

SEQ ID NO: 1224445 - protein, 9 aa, Homo Sapiens
DLKVPRGMA

SEQ ID NO: 1224446 - protein, 9 aa, Homo Sapiens
FGMYCRETC

SEQ ID NO: 1224447 - protein, 9 aa, Homo Sapiens
SVTTLSDDD

SEQ ID NO: 1224448 - protein, 9 aa, Homo Sapiens
LATLEGGSR

SEQ ID NO: 1224449 - protein, 9 aa, Homo Sapiens
RVNTSWRVA

SEQ ID NO: 1224450 - protein, 9 aa, Homo Sapiens
SGIQTSDAS

SEQ ID NO: 1224451 - protein, 9 aa, Homo Sapiens
PLSLAKKKS

SEQ ID NO: 1224452 - protein, 9 aa, Homo Sapiens
EEVNENFEI

SEQ ID NO: 1224453 - protein, 9 aa, Homo Sapiens
GHELRIIQL

SEQ ID NO: 1224454 - protein, 9 aa, Homo Sapiens
GGAGSGFGC

SEQ ID NO: 1224455 - protein, 9 aa, Homo Sapiens
YVCIPCECD

SEQ ID NO: 1224456 - protein, 9 aa, Homo Sapiens
ANGAITKGV

SEQ ID NO: 1224457 - protein, 9 aa, Homo Sapiens
LVEWLQGEK

SEQ ID NO: 1224458 - protein, 9 aa, Homo Sapiens
CFHDYNVEA

SEQ ID NO: 1224459 - protein, 9 aa, Homo Sapiens
SKSIEERED

SEQ ID NO: 1224460 - protein, 9 aa, Homo Sapiens
TFAISAITV

SEQ ID NO: 1224461 - protein, 9 aa, Homo Sapiens
VDLEPERDV

SEQ ID NO: 1224462 - protein, 9 aa, Homo Sapiens
DHSLLLYEA

SEQ ID NO: 1224463 - protein, 9 aa, Homo Sapiens
PSSVRLVPS

SEQ ID NO: 1224464 - protein, 9 aa, Homo Sapiens
HLLGATAFM

SEQ ID NO: 1224465 - protein, 9 aa, Homo Sapiens
EVLHILHSL

SEQ ID NO: 1224466 - protein, 9 aa, Homo Sapiens
CTGPVAQLC

SEQ ID NO: 1224467 - protein, 9 aa, Homo Sapiens
DNFMSHDKH

SEQ ID NO: 1224468 - protein, 9 aa, Homo Sapiens
KEEQKMQSR

SEQ ID NO: 1224469 - protein, 9 aa, Homo Sapiens
TFIRLLPSV

SEQ ID NO: 1224470 - protein, 9 aa, Homo Sapiens
FDTFNVPVF

SEQ ID NO: 1224471 - protein, 9 aa, Homo Sapiens
QRNEFTDQL

SEQ ID NO: 1224472 - protein, 9 aa, Homo Sapiens
AMFRLSTDS

SEQ ID NO: 1224473 - protein, 9 aa, Homo Sapiens
YSCKLQDIQ

SEQ ID NO: 1224474 - protein, 9 aa, Homo Sapiens
LPPCCRWEA

SEQ ID NO: 1224475 - protein, 9 aa, Homo Sapiens
EDSYSCCQH

SEQ ID NO: 1224476 - protein, 9 aa, Homo Sapiens
AVEEKQRQR

SEQ ID NO: 1224477 - protein, 9 aa, Homo Sapiens
SAGHSQISH

SEQ ID NO: 1224478 - protein, 9 aa, Homo Sapiens
KLKLMAHYG

SEQ ID NO: 1224479 - protein, 9 aa, Homo Sapiens
MEQFFSMFG

SEQ ID NO: 1224480 - protein, 9 aa, Homo Sapiens
GWYPPTPNT

SEQ ID NO: 1224481 - protein, 9 aa, Homo Sapiens
QGCTVPVES

SEQ ID NO: 1224482 - protein, 9 aa, Homo Sapiens
IQGMSDLLS

SEQ ID NO: 1224483 - protein, 9 aa, Homo Sapiens
FTHHLLAAA

SEQ ID NO: 1224484 - protein, 9 aa, Homo Sapiens
ERVEKPVPR

SEQ ID NO: 1224485 - protein, 9 aa, Homo Sapiens
SSPSTTPSI

SEQ ID NO: 1224486 - protein, 9 aa, Homo Sapiens
VRPATTLYR

SEQ ID NO: 1224487 - protein, 9 aa, Homo Sapiens
TPKRKLNSL

SEQ ID NO: 1224488 - protein, 9 aa, Homo Sapiens
LTICGHNYL

SEQ ID NO: 1224489 - protein, 9 aa, Homo Sapiens
NEKTVLLQK

SEQ ID NO: 1224490 - protein, 9 aa, Homo Sapiens
ILPSHVARR

SEQ ID NO: 1224491 - protein, 9 aa, Homo Sapiens
ALQQTRMLL

SEQ ID NO: 1224492 - protein, 9 aa, Homo Sapiens
NIYAAVKHT

SEQ ID NO: 1224493 - protein, 9 aa, Homo Sapiens
PEHRELCLE

SEQ ID NO: 1224494 - protein, 9 aa, Homo Sapiens
TSESIFDMD

SEQ ID NO: 1224495 - protein, 9 aa, Homo Sapiens
TMCIKECIR

SEQ ID NO: 1224496 - protein, 9 aa, Homo Sapiens
NKEEGSSGN

SEQ ID NO: 1224497 - protein, 9 aa, Homo Sapiens
ADPEMATLP

SEQ ID NO: 1224498 - protein, 9 aa, Homo Sapiens
QLVEWLQGE

SEQ ID NO: 1224499 - protein, 9 aa, Homo Sapiens
MAVNQRHTE

SEQ ID NO: 1224500 - protein, 9 aa, Homo Sapiens
SLAMCIVGH

SEQ ID NO: 1224501 - protein, 9 aa, Homo Sapiens
RTTYSNQEV

SEQ ID NO: 1224502 - protein, 9 aa, Homo Sapiens
LTEKTGRLQ

SEQ ID NO: 1224503 - protein, 9 aa, Homo Sapiens
TRLESSQNL

SEQ ID NO: 1224504 - protein, 9 aa, Homo Sapiens
VSVFKCPNC

SEQ ID NO: 1224505 - protein, 9 aa, Homo Sapiens
AEEEAVSLP

SEQ ID NO: 1224506 - protein, 9 aa, Homo Sapiens
QCEIQEHTK

SEQ ID NO: 1224507 - protein, 9 aa, Homo Sapiens
LAHGVVSFS

SEQ ID NO: 1224508 - protein, 9 aa, Homo Sapiens
GINVTSVAV

SEQ ID NO: 1224509 - protein, 9 aa, Homo Sapiens
NKHLSRQDA

SEQ ID NO: 1224510 - protein, 9 aa, Homo Sapiens
AVTGNRIGG

SEQ ID NO: 1224511 - protein, 9 aa, Homo Sapiens
LNSLMSQLT

SEQ ID NO: 1224512 - protein, 9 aa, Homo Sapiens
GVSVNPEPL

SEQ ID NO: 1224513 - protein, 9 aa, Homo Sapiens
SPTFAALTS

SEQ ID NO: 1224514 - protein, 9 aa, Homo Sapiens
ENMTPANSE

SEQ ID NO: 1224515 - protein, 9 aa, Homo Sapiens
RLEERQRCR

SEQ ID NO: 1224516 - protein, 9 aa, Homo Sapiens
AESDTMKRL

SEQ ID NO: 1224517 - protein, 9 aa, Homo Sapiens
VKKVVVSGN

SEQ ID NO: 1224518 - protein, 9 aa, Homo Sapiens
LQHDEIKFI

SEQ ID NO: 1224519 - protein, 9 aa, Homo Sapiens
VKSLEHLHS

SEQ ID NO: 1224520 - protein, 9 aa, Homo Sapiens
PTKIAAVVC

SEQ ID NO: 1224521 - protein, 9 aa, Homo Sapiens
VTLLDFGAT

SEQ ID NO: 1224522 - protein, 9 aa, Homo Sapiens
MQAKYREYI

SEQ ID NO: 1224523 - protein, 9 aa, Homo Sapiens
NGSNGTIKV

SEQ ID NO: 1224524 - protein, 9 aa, Homo Sapiens
LWARSTGNT

SEQ ID NO: 1224525 - protein, 9 aa, Homo Sapiens
FQEDSVTLT

SEQ ID NO: 1224526 - protein, 9 aa, Homo Sapiens
RAEPCQSSV

SEQ ID NO: 1224527 - protein, 9 aa, Homo Sapiens
LGGGIDTSY

SEQ ID NO: 1224528 - protein, 9 aa, Homo Sapiens
CMLLKRMVV

SEQ ID NO: 1224529 - protein, 9 aa, Homo Sapiens
YLKCKLGMK

SEQ ID NO: 1224530 - protein, 9 aa, Homo Sapiens
RHWSSLSLR

SEQ ID NO: 1224531 - protein, 9 aa, Homo Sapiens
EHPNPPSWL

SEQ ID NO: 1224532 - protein, 9 aa, Homo Sapiens
DLVVFGQVC

SEQ ID NO: 1224533 - protein, 9 aa, Homo Sapiens
YLSVSKSIS

SEQ ID NO: 1224534 - protein, 9 aa, Homo Sapiens
QCPESMEVH

SEQ ID NO: 1224535 - protein, 9 aa, Homo Sapiens
QDAHGPREA

SEQ ID NO: 1224536 - protein, 9 aa, Homo Sapiens
CLRPTAWRV

SEQ ID NO: 1224537 - protein, 9 aa, Homo Sapiens
LERLTRTGI

SEQ ID NO: 1224538 - protein, 9 aa, Homo Sapiens
AFQGAKDLH

SEQ ID NO: 1224539 - protein, 9 aa, Homo Sapiens
WLIPSTIGC

SEQ ID NO: 1224540 - protein, 9 aa, Homo Sapiens
RQSLPNRNT

SEQ ID NO: 1224541 - protein, 9 aa, Homo Sapiens
RNYYNFPLA

SEQ ID NO: 1224542 - protein, 9 aa, Homo Sapiens
PSKGKDGVE

SEQ ID NO: 1224543 - protein, 9 aa, Homo Sapiens
ADMTLIYIT

SEQ ID NO: 1224544 - protein, 9 aa, Homo Sapiens
TILPEASTS

SEQ ID NO: 1224545 - protein, 9 aa, Homo Sapiens
TGIVIWGDM

SEQ ID NO: 1224546 - protein, 9 aa, Homo Sapiens
VKQEYCTWN

SEQ ID NO: 1224547 - protein, 9 aa, Homo Sapiens
EYNVIDLPV

SEQ ID NO: 1224548 - protein, 9 aa, Homo Sapiens
EIVRSGHLT

SEQ ID NO: 1224549 - protein, 9 aa, Homo Sapiens
QRKNNNGLS

SEQ ID NO: 1224550 - protein, 9 aa, Homo Sapiens
HMATHRAGG

SEQ ID NO: 1224551 - protein, 9 aa, Homo Sapiens
DIPKMNQEQ

SEQ ID NO: 1224552 - protein, 9 aa, Homo Sapiens
TQTHVNDIM

SEQ ID NO: 1224553 - protein, 9 aa, Homo Sapiens
HPRASNHTF

SEQ ID NO: 1224554 - protein, 9 aa, Homo Sapiens
PVHGAPGPV

SEQ ID NO: 1224555 - protein, 9 aa, Homo Sapiens
VVADHFKKG

SEQ ID NO: 1224556 - protein, 9 aa, Homo Sapiens
FKRPPQRMF

SEQ ID NO: 1224557 - protein, 9 aa, Homo Sapiens
SSSTRSRPS

SEQ ID NO: 1224558 - protein, 9 aa, Homo Sapiens
EVELKHPLS

SEQ ID NO: 1224559 - protein, 9 aa, Homo Sapiens
EHISLTVAY

SEQ ID NO: 1224560 - protein, 9 aa, Homo Sapiens
HIQGVPKVT

SEQ ID NO: 1224561 - protein, 9 aa, Homo Sapiens
KLAPLQVTT

SEQ ID NO: 1224562 - protein, 9 aa, Homo Sapiens
HTQFSIIQP

SEQ ID NO: 1224563 - protein, 9 aa, Homo Sapiens
HISLPQISW

SEQ ID NO: 1224564 - protein, 9 aa, Homo Sapiens
TPVSPTFPD

SEQ ID NO: 1224565 - protein, 9 aa, Homo Sapiens
AAKTGDCFP

SEQ ID NO: 1224566 - protein, 9 aa, Homo Sapiens
YLKREWEML

SEQ ID NO: 1224567 - protein, 9 aa, Homo Sapiens
RVSSIPSNS

SEQ ID NO: 1224568 - protein, 9 aa, Homo Sapiens
LNGTNMTLP

SEQ ID NO: 1224569 - protein, 9 aa, Homo Sapiens
PSYLPTKIA

SEQ ID NO: 1224570 - protein, 9 aa, Homo Sapiens
DPGMTSFEP

SEQ ID NO: 1224571 - protein, 9 aa, Homo Sapiens
ELDTTLYLK

SEQ ID NO: 1224572 - protein, 9 aa, Homo Sapiens
MGFFMPYWL

SEQ ID NO: 1224573 - protein, 9 aa, Homo Sapiens
FETNFFVNG

SEQ ID NO: 1224574 - protein, 9 aa, Homo Sapiens
RHHIRGPPT

SEQ ID NO: 1224575 - protein, 9 aa, Homo Sapiens
KKSITKNVQ

SEQ ID NO: 1224576 - protein, 9 aa, Homo Sapiens
QQMWLTQCR

SEQ ID NO: 1224577 - protein, 9 aa, Homo Sapiens
HKHAPTKSA

SEQ ID NO: 1224578 - protein, 9 aa, Homo Sapiens
LEDKLEHKT

SEQ ID NO: 1224579 - protein, 9 aa, Homo Sapiens
CICLLTFIK

SEQ ID NO: 1224580 - protein, 9 aa, Homo Sapiens
LDTAKQTED

SEQ ID NO: 1224581 - protein, 9 aa, Homo Sapiens
LETLVCKAG

SEQ ID NO: 1224582 - protein, 9 aa, Homo Sapiens
RSPQPGFLA

SEQ ID NO: 1224583 - protein, 9 aa, Homo Sapiens
IPVVVAMNA

SEQ ID NO: 1224584 - protein, 9 aa, Homo Sapiens
ETEVEEPES

SEQ ID NO: 1224585 - protein, 9 aa, Homo Sapiens
HKLITVSKD

SEQ ID NO: 1224586 - protein, 9 aa, Homo Sapiens
CSAHLIAII

SEQ ID NO: 1224587 - protein, 9 aa, Homo Sapiens
QCYSCKGNI

SEQ ID NO: 1224588 - protein, 9 aa, Homo Sapiens
PTPVLTIVP

SEQ ID NO: 1224589 - protein, 9 aa, Homo Sapiens
EGLITIIVG

SEQ ID NO: 1224590 - protein, 9 aa, Homo Sapiens
NETKHLSIG

SEQ ID NO: 1224591 - protein, 9 aa, Homo Sapiens
FSYFHASIT

SEQ ID NO: 1224592 - protein, 9 aa, Homo Sapiens
HQNLEDNNR

SEQ ID NO: 1224593 - protein, 9 aa, Homo Sapiens
ASLIVLKNV

SEQ ID NO: 1224594 - protein, 9 aa, Homo Sapiens
PFRLHLLPQ

SEQ ID NO: 1224595 - protein, 9 aa, Homo Sapiens
PPLTTSAET

SEQ ID NO: 1224596 - protein, 9 aa, Homo Sapiens
LVMSLLFIT

SEQ ID NO: 1224597 - protein, 9 aa, Homo Sapiens
VQFHPLLPD

SEQ ID NO: 1224598 - protein, 9 aa, Homo Sapiens
KKCLDVYQP

SEQ ID NO: 1224599 - protein, 9 aa, Homo Sapiens
VVKELAEAI

SEQ ID NO: 1224600 - protein, 9 aa, Homo Sapiens
QNRNIQIDN

SEQ ID NO: 1224601 - protein, 9 aa, Homo Sapiens
MLLPLPPPA

SEQ ID NO: 1224602 - protein, 9 aa, Homo Sapiens
PHRVRGRRP

SEQ ID NO: 1224603 - protein, 9 aa, Homo Sapiens
QYANARDRN

SEQ ID NO: 1224604 - protein, 9 aa, Homo Sapiens
PVDSDESLG

SEQ ID NO: 1224605 - protein, 9 aa, Homo Sapiens
CPESMEVHR

SEQ ID NO: 1224606 - protein, 9 aa, Homo Sapiens
SSICLLHGK

SEQ ID NO: 1224607 - protein, 9 aa, Homo Sapiens
NKEDTWKFM

SEQ ID NO: 1224608 - protein, 9 aa, Homo Sapiens
IIAMTYERI

SEQ ID NO: 1224609 - protein, 9 aa, Homo Sapiens
QVVLEGHAV

SEQ ID NO: 1224610 - protein, 9 aa, Homo Sapiens
KNRNNDVTG

SEQ ID NO: 1224611 - protein, 9 aa, Homo Sapiens
HANFSPLSE

SEQ ID NO: 1224612 - protein, 9 aa, Homo Sapiens
SVDPIAGKL

SEQ ID NO: 1224613 - protein, 9 aa, Homo Sapiens
VLYKMTAYD

SEQ ID NO: 1224614 - protein, 9 aa, Homo Sapiens
PNPGKSFST

SEQ ID NO: 1224615 - protein, 9 aa, Homo Sapiens
KITYWPKLD

SEQ ID NO: 1224616 - protein, 9 aa, Homo Sapiens
IPWFIKTTF

SEQ ID NO: 1224617 - protein, 9 aa, Homo Sapiens
GEILVICRG

SEQ ID NO: 1224618 - protein, 9 aa, Homo Sapiens
TFPDHLGCA

SEQ ID NO: 1224619 - protein, 9 aa, Homo Sapiens
ELAFFGLVP

SEQ ID NO: 1224620 - protein, 9 aa, Homo Sapiens
KRGRPMTKT

SEQ ID NO: 1224621 - protein, 9 aa, Homo Sapiens
SVVALDLVI

SEQ ID NO: 1224622 - protein, 9 aa, Homo Sapiens
ELISELQDC

SEQ ID NO: 1224623 - protein, 9 aa, Homo Sapiens
IMGKLRGVL

SEQ ID NO: 1224624 - protein, 9 aa, Homo Sapiens
GVEEEGYDG

SEQ ID NO: 1224625 - protein, 9 aa, Homo Sapiens
TRKEEDCKE

SEQ ID NO: 1224626 - protein, 9 aa, Homo Sapiens
KRYHRSRCG

SEQ ID NO: 1224627 - protein, 9 aa, Homo Sapiens
TDMWIGRLK

SEQ ID NO: 1224628 - protein, 9 aa, Homo Sapiens
YGVPHLLRL

SEQ ID NO: 1224629 - protein, 9 aa, Homo Sapiens
RYSGYRWCP

SEQ ID NO: 1224630 - protein, 9 aa, Homo Sapiens
LSRHRKSHA

SEQ ID NO: 1224631 - protein, 9 aa, Homo Sapiens
SESQAMCYI

SEQ ID NO: 1224632 - protein, 9 aa, Homo Sapiens
HLINIRHPI

SEQ ID NO: 1224633 - protein, 9 aa, Homo Sapiens
KFQETETDA

SEQ ID NO: 1224634 - protein, 9 aa, Homo Sapiens
GREVALDLP

SEQ ID NO: 1224635 - protein, 9 aa, Homo Sapiens
RTMPLCAVL

SEQ ID NO: 1224636 - protein, 9 aa, Homo Sapiens
ITKQDIMLS

SEQ ID NO: 1224637 - protein, 9 aa, Homo Sapiens
RHKRHALQD

SEQ ID NO: 1224638 - protein, 9 aa, Homo Sapiens
VSFCHFWRD

SEQ ID NO: 1224639 - protein, 9 aa, Homo Sapiens
ECDLKVEMM

SEQ ID NO: 1224640 - protein, 9 aa, Homo Sapiens
KRHHAHINV

SEQ ID NO: 1224641 - protein, 9 aa, Homo Sapiens
KAVTEMSGR

SEQ ID NO: 1224642 - protein, 9 aa, Homo Sapiens
RADVIGIQH

SEQ ID NO: 1224643 - protein, 9 aa, Homo Sapiens
LFGDDDSGE

SEQ ID NO: 1224644 - protein, 9 aa, Homo Sapiens
VRRWKEFVR

SEQ ID NO: 1224645 - protein, 9 aa, Homo Sapiens
HQKCKPDIM

SEQ ID NO: 1224646 - protein, 9 aa, Homo Sapiens
QFGSVGQDT

SEQ ID NO: 1224647 - protein, 9 aa, Homo Sapiens
LTTLELSNE

SEQ ID NO: 1224648 - protein, 9 aa, Homo Sapiens
DGADGRQHS

SEQ ID NO: 1224649 - protein, 9 aa, Homo Sapiens
DPNNPPAHE

SEQ ID NO: 1224650 - protein, 9 aa, Homo Sapiens
SLTLWLLDC

SEQ ID NO: 1224651 - protein, 9 aa, Homo Sapiens
NHVKLVNLG

SEQ ID NO: 1224652 - protein, 9 aa, Homo Sapiens
RGGCLPLLP

SEQ ID NO: 1224653 - protein, 9 aa, Homo Sapiens
IQLCDMRAS

SEQ ID NO: 1224654 - protein, 9 aa, Homo Sapiens
SINTVKRED

SEQ ID NO: 1224655 - protein, 9 aa, Homo Sapiens
SEGGIDEHD

SEQ ID NO: 1224656 - protein, 9 aa, Homo Sapiens
SNFTEIKNI

SEQ ID NO: 1224657 - protein, 9 aa, Homo Sapiens
TYSFMPTSP

SEQ ID NO: 1224658 - protein, 9 aa, Homo Sapiens
HISINKAVK

SEQ ID NO: 1224659 - protein, 9 aa, Homo Sapiens
GSDEEDEDF

SEQ ID NO: 1224660 - protein, 9 aa, Homo Sapiens
PRVETHSSS

SEQ ID NO: 1224661 - protein, 9 aa, Homo Sapiens
CIQEAEVSA

SEQ ID NO: 1224662 - protein, 9 aa, Homo Sapiens
AVHQRMMSQ

SEQ ID NO: 1224663 - protein, 9 aa, Homo Sapiens
IRYQSFKER

SEQ ID NO: 1224664 - protein, 9 aa, Homo Sapiens
KVAWHEGQG

SEQ ID NO: 1224665 - protein, 9 aa, Homo Sapiens
MPGMTENET

SEQ ID NO: 1224666 - protein, 9 aa, Homo Sapiens
LDQCHRDGQ

SEQ ID NO: 1224667 - protein, 9 aa, Homo Sapiens
YSKCDLPLW

SEQ ID NO: 1224668 - protein, 9 aa, Homo Sapiens
MAEYCNGAG

SEQ ID NO: 1224669 - protein, 9 aa, Homo Sapiens
GETVVNLEN

SEQ ID NO: 1224670 - protein, 9 aa, Homo Sapiens
INNLNPTFS

SEQ ID NO: 1224671 - protein, 9 aa, Homo Sapiens
PLPRSTCTL

SEQ ID NO: 1224672 - protein, 9 aa, Homo Sapiens
APEWAIINL

SEQ ID NO: 1224673 - protein, 9 aa, Homo Sapiens
HGVYSAPCG

SEQ ID NO: 1224674 - protein, 9 aa, Homo Sapiens
NPPSWLSMD

SEQ ID NO: 1224675 - protein, 9 aa, Homo Sapiens
KEDAQVGTI

SEQ ID NO: 1224676 - protein, 9 aa, Homo Sapiens
QHWHSILIE

SEQ ID NO: 1224677 - protein, 9 aa, Homo Sapiens
QLEVVDKSQ

SEQ ID NO: 1224678 - protein, 9 aa, Homo Sapiens
GFLGQVWCP

SEQ ID NO: 1224679 - protein, 9 aa, Homo Sapiens
ITAHVMKQE

SEQ ID NO: 1224680 - protein, 9 aa, Homo Sapiens
AFVHSDAAN

SEQ ID NO: 1224681 - protein, 9 aa, Homo Sapiens
QNWPSMDFD

SEQ ID NO: 1224682 - protein, 9 aa, Homo Sapiens
AARRQWEEQ

SEQ ID NO: 1224683 - protein, 9 aa, Homo Sapiens
QPDYDLDTF

SEQ ID NO: 1224684 - protein, 9 aa, Homo Sapiens
PSPGCVLYT

SEQ ID NO: 1224685 - protein, 9 aa, Homo Sapiens
DNTYYSADI

SEQ ID NO: 1224686 - protein, 9 aa, Homo Sapiens
DTTLYLKCK

SEQ ID NO: 1224687 - protein, 9 aa, Homo Sapiens
HVTATETHL

SEQ ID NO: 1224688 - protein, 9 aa, Homo Sapiens
LATKDGTFV

SEQ ID NO: 1224689 - protein, 9 aa, Homo Sapiens
QPRFPKCEQ

SEQ ID NO: 1224690 - protein, 9 aa, Homo Sapiens
CQLTVSNFS

SEQ ID NO: 1224691 - protein, 9 aa, Homo Sapiens
RKLNSLMSQ

SEQ ID NO: 1224692 - protein, 9 aa, Homo Sapiens
RCMATWRKN

SEQ ID NO: 1224693 - protein, 9 aa, Homo Sapiens
FTFIGFLSS

SEQ ID NO: 1224694 - protein, 9 aa, Homo Sapiens
EYNNLILLN

SEQ ID NO: 1224695 - protein, 9 aa, Homo Sapiens
SSPGKAMPT

SEQ ID NO: 1224696 - protein, 9 aa, Homo Sapiens
TFLDVLAWM

SEQ ID NO: 1224697 - protein, 9 aa, Homo Sapiens
KGQGVEICF

SEQ ID NO: 1224698 - protein, 9 aa, Homo Sapiens
HEKIQPLNF

SEQ ID NO: 1224699 - protein, 9 aa, Homo Sapiens
RVTHLEFFL

SEQ ID NO: 1224700 - protein, 9 aa, Homo Sapiens
AKQSLQPFC

SEQ ID NO: 1224701 - protein, 9 aa, Homo Sapiens
RADECKTGF

SEQ ID NO: 1224702 - protein, 9 aa, Homo Sapiens
MKDAAEGPF

SEQ ID NO: 1224703 - protein, 9 aa, Homo Sapiens
MYWNEGDHS

SEQ ID NO: 1224704 - protein, 9 aa, Homo Sapiens
RRMRITVKK

SEQ ID NO: 1224705 - protein, 9 aa, Homo Sapiens
TALYFCVTS

SEQ ID NO: 1224706 - protein, 9 aa, Homo Sapiens
EKVKPADDG

SEQ ID NO: 1224707 - protein, 9 aa, Homo Sapiens
CTHEELLRA

SEQ ID NO: 1224708 - protein, 9 aa, Homo Sapiens
GQSSTTDAQ

SEQ ID NO: 1224709 - protein, 9 aa, Homo Sapiens
HTHIRQHSG

SEQ ID NO: 1224710 - protein, 9 aa, Homo Sapiens
DPHENGSNG

SEQ ID NO: 1224711 - protein, 9 aa, Homo Sapiens
KHFMSFHWK

SEQ ID NO: 1224712 - protein, 9 aa, Homo Sapiens
LSKKTLIRF

SEQ ID NO: 1224713 - protein, 9 aa, Homo Sapiens
ARAHKQDEE

SEQ ID NO: 1224714 - protein, 9 aa, Homo Sapiens
YHENGTGTN

SEQ ID NO: 1224715 - protein, 9 aa, Homo Sapiens
LRCQTHISL

SEQ ID NO: 1224716 - protein, 9 aa, Homo Sapiens
SDADGECQF

SEQ ID NO: 1224717 - protein, 9 aa, Homo Sapiens
NLDTMTWET

SEQ ID NO: 1224718 - protein, 9 aa, Homo Sapiens
GDPPRLCTV

SEQ ID NO: 1224719 - protein, 9 aa, Homo Sapiens
LMGLMFASV

SEQ ID NO: 1224720 - protein, 9 aa, Homo Sapiens
SACPCMCTE

SEQ ID NO: 1224721 - protein, 9 aa, Homo Sapiens
AYEQKPAVL

SEQ ID NO: 1224722 - protein, 9 aa, Homo Sapiens
HKMDSFTQV

SEQ ID NO: 1224723 - protein, 9 aa, Homo Sapiens
KQLPWVRVA

SEQ ID NO: 1224724 - protein, 9 aa, Homo Sapiens
CLTQCASRR

SEQ ID NO: 1224725 - protein, 9 aa, Homo Sapiens
NPASPNEFA

SEQ ID NO: 1224726 - protein, 9 aa, Homo Sapiens
GTDAFQKPI

SEQ ID NO: 1224727 - protein, 9 aa, Homo Sapiens
SNMQCQPQQ

SEQ ID NO: 1224728 - protein, 9 aa, Homo Sapiens
PIVDLLQCS

SEQ ID NO: 1224729 - protein, 9 aa, Homo Sapiens
QPLYPPILS

SEQ ID NO: 1224730 - protein, 9 aa, Homo Sapiens
KKRSRKKRK

SEQ ID NO: 1224731 - protein, 9 aa, Homo Sapiens
HLPAIPRLK

SEQ ID NO: 1224732 - protein, 9 aa, Homo Sapiens
TRDSQKDYR

SEQ ID NO: 1224733 - protein, 9 aa, Homo Sapiens
QLHMGITPF

SEQ ID NO: 1224734 - protein, 9 aa, Homo Sapiens
MTKGFTTLF

SEQ ID NO: 1224735 - protein, 9 aa, Homo Sapiens
FDVDICPLF

SEQ ID NO: 1224736 - protein, 9 aa, Homo Sapiens
YDPSSIVSL

SEQ ID NO: 1224737 - protein, 9 aa, Homo Sapiens
DWGKHCVDK

SEQ ID NO: 1224738 - protein, 9 aa, Homo Sapiens
DDMLAKTFS

SEQ ID NO: 1224739 - protein, 9 aa, Homo Sapiens
LQFASDGGD

SEQ ID NO: 1224740 - protein, 9 aa, Homo Sapiens
YAISNAETF

SEQ ID NO: 1224741 - protein, 9 aa, Homo Sapiens
GHRRHREEL

SEQ ID NO: 1224742 - protein, 9 aa, Homo Sapiens
GLYKSHRPC

SEQ ID NO: 1224743 - protein, 9 aa, Homo Sapiens
LYMSSNFIG

SEQ ID NO: 1224744 - protein, 9 aa, Homo Sapiens
IPLDLLPDR

SEQ ID NO: 1224745 - protein, 9 aa, Homo Sapiens
REVMLWERL

SEQ ID NO: 1224746 - protein, 9 aa, Homo Sapiens
YIKAKVIRE

SEQ ID NO: 1224747 - protein, 9 aa, Homo Sapiens
PLNSFPVPV

SEQ ID NO: 1224748 - protein, 9 aa, Homo Sapiens
KDNSDYIEQ

SEQ ID NO: 1224749 - protein, 9 aa, Homo Sapiens
PPECYGHVL

SEQ ID NO: 1224750 - protein, 9 aa, Homo Sapiens
FPMFPPNAA

SEQ ID NO: 1224751 - protein, 9 aa, Homo Sapiens
AVMASDSIV

SEQ ID NO: 1224752 - protein, 9 aa, Homo Sapiens
DIFTNIEAA

SEQ ID NO: 1224753 - protein, 9 aa, Homo Sapiens
GQAKAISGI

SEQ ID NO: 1224754 - protein, 9 aa, Homo Sapiens
RQREGQQFG

SEQ ID NO: 1224755 - protein, 9 aa, Homo Sapiens
IGGITITWK

SEQ ID NO: 1224756 - protein, 9 aa, Homo Sapiens
QLLCFLVPT

SEQ ID NO: 1224757 - protein, 9 aa, Homo Sapiens
NIVHSTLSH

SEQ ID NO: 1224758 - protein, 9 aa, Homo Sapiens
VVFGQVCAL

SEQ ID NO: 1224759 - protein, 9 aa, Homo Sapiens
DTINAQELG

SEQ ID NO: 1224760 - protein, 9 aa, Homo Sapiens
CIYKPDFFI

SEQ ID NO: 1224761 - protein, 9 aa, Homo Sapiens
KRNIFRKLK

SEQ ID NO: 1224762 - protein, 9 aa, Homo Sapiens
VEPFKSMYL

SEQ ID NO: 1224763 - protein, 9 aa, Homo Sapiens
VCHDEPSAL

SEQ ID NO: 1224764 - protein, 9 aa, Homo Sapiens
PVWDVRWDA

SEQ ID NO: 1224765 - protein, 9 aa, Homo Sapiens
SRGLVIMAK

SEQ ID NO: 1224766 - protein, 9 aa, Homo Sapiens
SLHPGHAFF

SEQ ID NO: 1224767 - protein, 9 aa, Homo Sapiens
KIRSNPENN

SEQ ID NO: 1224768 - protein, 9 aa, Homo Sapiens
HGVLHYIII

SEQ ID NO: 1224769 - protein, 9 aa, Homo Sapiens
SRGHAPPLA

SEQ ID NO: 1224770 - protein, 9 aa, Homo Sapiens
LRSFVNPLL

SEQ ID NO: 1224771 - protein, 9 aa, Homo Sapiens
SAFVGDKDV

SEQ ID NO: 1224772 - protein, 9 aa, Homo Sapiens
WCLFFLIMF

SEQ ID NO: 1224773 - protein, 9 aa, Homo Sapiens
DLECRCQGS

SEQ ID NO: 1224774 - protein, 9 aa, Homo Sapiens
HENMIRQTN

SEQ ID NO: 1224775 - protein, 9 aa, Homo Sapiens
IERNKGFPT

SEQ ID NO: 1224776 - protein, 9 aa, Homo Sapiens
VQWHYLGSL

SEQ ID NO: 1224777 - protein, 9 aa, Homo Sapiens
ELFLIDNDS

SEQ ID NO: 1224778 - protein, 9 aa, Homo Sapiens
LSIDNSQLM

SEQ ID NO: 1224779 - protein, 9 aa, Homo Sapiens
PNTLIGSLT

SEQ ID NO: 1224780 - protein, 9 aa, Homo Sapiens
EVIPSMGVV

SEQ ID NO: 1224781 - protein, 9 aa, Homo Sapiens
SSIKQLVSG

SEQ ID NO: 1224782 - protein, 9 aa, Homo Sapiens
SPICFIAFQ

SEQ ID NO: 1224783 - protein, 9 aa, Homo Sapiens
FHMVSLHYG

SEQ ID NO: 1224784 - protein, 9 aa, Homo Sapiens
IVSFQNYTP

SEQ ID NO: 1224785 - protein, 9 aa, Homo Sapiens
GRPGAGPEE

SEQ ID NO: 1224786 - protein, 9 aa, Homo Sapiens
YPMEVLKTW

SEQ ID NO: 1224787 - protein, 9 aa, Homo Sapiens
REREAAAKH

SEQ ID NO: 1224788 - protein, 9 aa, Homo Sapiens
FCIAAVIKE

SEQ ID NO: 1224789 - protein, 9 aa, Homo Sapiens
TSTAMIRPD

SEQ ID NO: 1224790 - protein, 9 aa, Homo Sapiens
EEQRYHSLI

SEQ ID NO: 1224791 - protein, 9 aa, Homo Sapiens
ASLGSWMAT

SEQ ID NO: 1224792 - protein, 9 aa, Homo Sapiens
KNEFPVIVH

SEQ ID NO: 1224793 - protein, 9 aa, Homo Sapiens
LCKMVLMAT

SEQ ID NO: 1224794 - protein, 9 aa, Homo Sapiens
QHIQMHMGG

SEQ ID NO: 1224795 - protein, 9 aa, Homo Sapiens
GFDVDICPL

SEQ ID NO: 1224796 - protein, 9 aa, Homo Sapiens
PQGGQMGRP

SEQ ID NO: 1224797 - protein, 9 aa, Homo Sapiens
HSKIRSNPE

SEQ ID NO: 1224798 - protein, 9 aa, Homo Sapiens
QLERHQDLL

SEQ ID NO: 1224799 - protein, 9 aa, Homo Sapiens
STRKRPYEC

SEQ ID NO: 1224800 - protein, 9 aa, Homo Sapiens
GYLFMYNRV

SEQ ID NO: 1224801 - protein, 9 aa, Homo Sapiens
TQTDSCSWA

SEQ ID NO: 1224802 - protein, 9 aa, Homo Sapiens
HRCKDDPGP

SEQ ID NO: 1224803 - protein, 9 aa, Homo Sapiens
GDPAPPSGS

SEQ ID NO: 1224804 - protein, 9 aa, Homo Sapiens
VSGITLMSP

SEQ ID NO: 1224805 - protein, 9 aa, Homo Sapiens
RTIYLRPAI

SEQ ID NO: 1224806 - protein, 9 aa, Homo Sapiens
DNATKPGPV

SEQ ID NO: 1224807 - protein, 9 aa, Homo Sapiens
ACHIRLTYF

SEQ ID NO: 1224808 - protein, 9 aa, Homo Sapiens
SGLFLNEEM

SEQ ID NO: 1224809 - protein, 9 aa, Homo Sapiens
GKLIRTGAW

SEQ ID NO: 1224810 - protein, 9 aa, Homo Sapiens
GFRWKKLSQ

SEQ ID NO: 1224811 - protein, 9 aa, Homo Sapiens
DTRSSDPPR

SEQ ID NO: 1224812 - protein, 9 aa, Homo Sapiens
TGCVMTGRT

SEQ ID NO: 1224813 - protein, 9 aa, Homo Sapiens
VQHPEIVGS

SEQ ID NO: 1224814 - protein, 9 aa, Homo Sapiens
HRQTRPRRL

SEQ ID NO: 1224815 - protein, 9 aa, Homo Sapiens
PHGVVWDSK

SEQ ID NO: 1224816 - protein, 9 aa, Homo Sapiens
TRFHFTHTI

SEQ ID NO: 1224817 - protein, 9 aa, Homo Sapiens
DTFVNKAES

SEQ ID NO: 1224818 - protein, 9 aa, Homo Sapiens
KCPDGHIVS

SEQ ID NO: 1224819 - protein, 9 aa, Homo Sapiens
YVSTYLKMT

SEQ ID NO: 1224820 - protein, 9 aa, Homo Sapiens
IQPLSVPCR

SEQ ID NO: 1224821 - protein, 9 aa, Homo Sapiens
SISKLKTSI

SEQ ID NO: 1224822 - protein, 9 aa, Homo Sapiens
DLTTKKAVD

SEQ ID NO: 1224823 - protein, 9 aa, Homo Sapiens
LYRFGYGFN

SEQ ID NO: 1224824 - protein, 9 aa, Homo Sapiens
GKCFICRRD

SEQ ID NO: 1224825 - protein, 9 aa, Homo Sapiens
DNDSYPIPI

SEQ ID NO: 1224826 - protein, 9 aa, Homo Sapiens
YGRVPHSCA

SEQ ID NO: 1224827 - protein, 9 aa, Homo Sapiens
GSNFTPLKV

SEQ ID NO: 1224828 - protein, 9 aa, Homo Sapiens
AAGASPTVC

SEQ ID NO: 1224829 - protein, 9 aa, Homo Sapiens
KEELYAIKM

SEQ ID NO: 1224830 - protein, 9 aa, Homo Sapiens
APGMCVVDT

SEQ ID NO: 1224831 - protein, 9 aa, Homo Sapiens
HEADDAPSI

SEQ ID NO: 1224832 - protein, 9 aa, Homo Sapiens
AVLGLYVYD

SEQ ID NO: 1224833 - protein, 9 aa, Homo Sapiens
GMCVVDTGI

SEQ ID NO: 1224834 - protein, 9 aa, Homo Sapiens
HVSRRIPAL

SEQ ID NO: 1224835 - protein, 9 aa, Homo Sapiens
VNMFNTILT

SEQ ID NO: 1224836 - protein, 9 aa, Homo Sapiens
GFYDQQVLY

SEQ ID NO: 1224837 - protein, 9 aa, Homo Sapiens
VLTERIANF

SEQ ID NO: 1224838 - protein, 9 aa, Homo Sapiens
SGSRAPAKP

SEQ ID NO: 1224839 - protein, 9 aa, Homo Sapiens
ARSFLEFVE

SEQ ID NO: 1224840 - protein, 9 aa, Homo Sapiens
ESLKRCSFH

SEQ ID NO: 1224841 - protein, 9 aa, Homo Sapiens
KSSDVRKAT

SEQ ID NO: 1224842 - protein, 9 aa, Homo Sapiens
RRLADQTSE

SEQ ID NO: 1224843 - protein, 9 aa, Homo Sapiens
ARPSSIEVI

SEQ ID NO: 1224844 - protein, 9 aa, Homo Sapiens
VFCDRMNEI

SEQ ID NO: 1224845 - protein, 9 aa, Homo Sapiens
VNIAGLLSI

SEQ ID NO: 1224846 - protein, 9 aa, Homo Sapiens
QRLAELEGR

SEQ ID NO: 1224847 - protein, 9 aa, Homo Sapiens
EDQDENPLP

SEQ ID NO: 1224848 - protein, 9 aa, Homo Sapiens
DKLLEKGPS

SEQ ID NO: 1224849 - protein, 9 aa, Homo Sapiens
LTAQLKHDG

SEQ ID NO: 1224850 - protein, 9 aa, Homo Sapiens
TMVITVELC

SEQ ID NO: 1224851 - protein, 9 aa, Homo Sapiens
LFVTVKPYQ

SEQ ID NO: 1224852 - protein, 9 aa, Homo Sapiens
YLRRMSQGK

SEQ ID NO: 1224853 - protein, 9 aa, Homo Sapiens
SPIKKEENT

SEQ ID NO: 1224854 - protein, 9 aa, Homo Sapiens
FKALNDTCL

SEQ ID NO: 1224855 - protein, 9 aa, Homo Sapiens
CPRSMRSLT

SEQ ID NO: 1224856 - protein, 9 aa, Homo Sapiens
PRLLHQQSE

SEQ ID NO: 1224857 - protein, 9 aa, Homo Sapiens
HREKKRGTE

SEQ ID NO: 1224858 - protein, 9 aa, Homo Sapiens
ALENLQPRR

SEQ ID NO: 1224859 - protein, 9 aa, Homo Sapiens
GHVPLTKEQ

SEQ ID NO: 1224860 - protein, 9 aa, Homo Sapiens
EDDNDIHIT

SEQ ID NO: 1224861 - protein, 9 aa, Homo Sapiens
VRIGIVFIG

SEQ ID NO: 1224862 - protein, 9 aa, Homo Sapiens
VSTNLTSSL

SEQ ID NO: 1224863 - protein, 9 aa, Homo Sapiens
YQKHFLSRD

SEQ ID NO: 1224864 - protein, 9 aa, Homo Sapiens
VIEFRTNAI

SEQ ID NO: 1224865 - protein, 9 aa, Homo Sapiens
LPDIDHVPE

SEQ ID NO: 1224866 - protein, 9 aa, Homo Sapiens
SARAIMTQL

SEQ ID NO: 1224867 - protein, 9 aa, Homo Sapiens
LKKPALYVS

SEQ ID NO: 1224868 - protein, 9 aa, Homo Sapiens
RQCSTEAAD

SEQ ID NO: 1224869 - protein, 9 aa, Homo Sapiens
AVDGLIFQA

SEQ ID NO: 1224870 - protein, 9 aa, Homo Sapiens
AETFDVVVA

SEQ ID NO: 1224871 - protein, 9 aa, Homo Sapiens
TLTKNSLDA

SEQ ID NO: 1224872 - protein, 9 aa, Homo Sapiens
PCLHTFCES

SEQ ID NO: 1224873 - protein, 9 aa, Homo Sapiens
MSEETHRKV

SEQ ID NO: 1224874 - protein, 9 aa, Homo Sapiens
QAAIDVPVG

SEQ ID NO: 1224875 - protein, 9 aa, Homo Sapiens
LRSSGASQR

SEQ ID NO: 1224876 - protein, 9 aa, Homo Sapiens
ATRIFEMRK

SEQ ID NO: 1224877 - protein, 9 aa, Homo Sapiens
NIHRKTTSS

SEQ ID NO: 1224878 - protein, 9 aa, Homo Sapiens
HICVIGLFY

SEQ ID NO: 1224879 - protein, 9 aa, Homo Sapiens
GDILSYNML

SEQ ID NO: 1224880 - protein, 9 aa, Homo Sapiens
VLVFAEWLS

SEQ ID NO: 1224881 - protein, 9 aa, Homo Sapiens
YMSKRSSDN

SEQ ID NO: 1224882 - protein, 9 aa, Homo Sapiens
GNRPTILTY

SEQ ID NO: 1224883 - protein, 9 aa, Homo Sapiens
DLVKQKEEW

SEQ ID NO: 1224884 - protein, 9 aa, Homo Sapiens
SHPSSWESC

SEQ ID NO: 1224885 - protein, 9 aa, Homo Sapiens
VACRVEMSE

SEQ ID NO: 1224886 - protein, 9 aa, Homo Sapiens
ETSQPEGEV

SEQ ID NO: 1224887 - protein, 9 aa, Homo Sapiens
GEMAMVTAD

SEQ ID NO: 1224888 - protein, 9 aa, Homo Sapiens
TIVPHPGVQ

SEQ ID NO: 1224889 - protein, 9 aa, Homo Sapiens
SINPKFLSG

SEQ ID NO: 1224890 - protein, 9 aa, Homo Sapiens
LLEGALINS

SEQ ID NO: 1224891 - protein, 9 aa, Homo Sapiens
LDMFSDWDK

SEQ ID NO: 1224892 - protein, 9 aa, Homo Sapiens
SKPREVFGF

SEQ ID NO: 1224893 - protein, 9 aa, Homo Sapiens
SHAPWEEND

SEQ ID NO: 1224894 - protein, 9 aa, Homo Sapiens
ENDKKNKST

SEQ ID NO: 1224895 - protein, 9 aa, Homo Sapiens
MFNFKRAHE

SEQ ID NO: 1224896 - protein, 9 aa, Homo Sapiens
HELQARRFS

SEQ ID NO: 1224897 - protein, 9 aa, Homo Sapiens
KFIYYQVLM

SEQ ID NO: 1224898 - protein, 9 aa, Homo Sapiens
CFHTTVRCM

SEQ ID NO: 1224899 - protein, 9 aa, Homo Sapiens
GPRAHPAQG

SEQ ID NO: 1224900 - protein, 9 aa, Homo Sapiens
GEVIITSEY

SEQ ID NO: 1224901 - protein, 9 aa, Homo Sapiens
CPSRCLCFH

SEQ ID NO: 1224902 - protein, 9 aa, Homo Sapiens
KHPDADSMY

SEQ ID NO: 1224903 - protein, 9 aa, Homo Sapiens
QHLLPAVTF

SEQ ID NO: 1224904 - protein, 9 aa, Homo Sapiens
KMLHLEVVG

SEQ ID NO: 1224905 - protein, 9 aa, Homo Sapiens
SIIDYTLSC

SEQ ID NO: 1224906 - protein, 9 aa, Homo Sapiens
QCVEHYHLL

SEQ ID NO: 1224907 - protein, 9 aa, Homo Sapiens
VIQIFCDTC

SEQ ID NO: 1224908 - protein, 9 aa, Homo Sapiens
ILNLIQALR

SEQ ID NO: 1224909 - protein, 9 aa, Homo Sapiens
VPRGMAYVF

SEQ ID NO: 1224910 - protein, 9 aa, Homo Sapiens
SEALHSLRE

SEQ ID NO: 1224911 - protein, 9 aa, Homo Sapiens
VYKTLERQM

SEQ ID NO: 1224912 - protein, 9 aa, Homo Sapiens
IKRCTYDAL

SEQ ID NO: 1224913 - protein, 9 aa, Homo Sapiens
SVDIERMSS

SEQ ID NO: 1224914 - protein, 9 aa, Homo Sapiens
DTTENLGAA

SEQ ID NO: 1224915 - protein, 9 aa, Homo Sapiens
KSKVPHLHS

SEQ ID NO: 1224916 - protein, 9 aa, Homo Sapiens
LHILQQTFF

SEQ ID NO: 1224917 - protein, 9 aa, Homo Sapiens
HHIRGPPTR

SEQ ID NO: 1224918 - protein, 9 aa, Homo Sapiens
VTQSSVILG

SEQ ID NO: 1224919 - protein, 9 aa, Homo Sapiens
CGLAVGIAL

SEQ ID NO: 1224920 - protein, 9 aa, Homo Sapiens
DFPSPEWDM

SEQ ID NO: 1224921 - protein, 9 aa, Homo Sapiens
PYTCNECGN

SEQ ID NO: 1224922 - protein, 9 aa, Homo Sapiens
RELWQRLED

SEQ ID NO: 1224923 - protein, 9 aa, Homo Sapiens
GGVKQEYCT

SEQ ID NO: 1224924 - protein, 9 aa, Homo Sapiens
GGGVMLVHV

SEQ ID NO: 1224925 - protein, 9 aa, Homo Sapiens
IEAILDKFG

SEQ ID NO: 1224926 - protein, 9 aa, Homo Sapiens
EEEKKGDEN

SEQ ID NO: 1224927 - protein, 9 aa, Homo Sapiens
CVEIYIKSL

SEQ ID NO: 1224928 - protein, 9 aa, Homo Sapiens
VLFLQLQET

SEQ ID NO: 1224929 - protein, 9 aa, Homo Sapiens
SIGHTVMAP

SEQ ID NO: 1224930 - protein, 9 aa, Homo Sapiens
RSRTPQKRC

SEQ ID NO: 1224931 - protein, 9 aa, Homo Sapiens
IADDTFSHL

SEQ ID NO: 1224932 - protein, 9 aa, Homo Sapiens
ELLKEKAPA

SEQ ID NO: 1224933 - protein, 9 aa, Homo Sapiens
ARPVSGDGA

SEQ ID NO: 1224934 - protein, 9 aa, Homo Sapiens
TGRIAQELS

SEQ ID NO: 1224935 - protein, 9 aa, Homo Sapiens
PGQDRHMEF

SEQ ID NO: 1224936 - protein, 9 aa, Homo Sapiens
MVDSFHMVS

SEQ ID NO: 1224937 - protein, 9 aa, Homo Sapiens
KLIGIYRLC

SEQ ID NO: 1224938 - protein, 9 aa, Homo Sapiens
RCTGDNEKA

SEQ ID NO: 1224939 - protein, 9 aa, Homo Sapiens
AKEEFLTDT

SEQ ID NO: 1224940 - protein, 9 aa, Homo Sapiens
CIDSRALGF

SEQ ID NO: 1224941 - protein, 9 aa, Homo Sapiens
ISACAWPQH

SEQ ID NO: 1224942 - protein, 9 aa, Homo Sapiens
VNRGMFLCD

SEQ ID NO: 1224943 - protein, 9 aa, Homo Sapiens
VEGEDVHLA

SEQ ID NO: 1224944 - protein, 9 aa, Homo Sapiens
VAAGIPNIQ

SEQ ID NO: 1224945 - protein, 9 aa, Homo Sapiens
LNGGHRIDY

SEQ ID NO: 1224946 - protein, 9 aa, Homo Sapiens
AWSFQPASS

SEQ ID NO: 1224947 - protein, 9 aa, Homo Sapiens
EAKPESKQD

SEQ ID NO: 1224948 - protein, 9 aa, Homo Sapiens
PRHVFRIKH

SEQ ID NO: 1224949 - protein, 9 aa, Homo Sapiens
LGDEGMPVQ

SEQ ID NO: 1224950 - protein, 9 aa, Homo Sapiens
DNLADYFKK

SEQ ID NO: 1224951 - protein, 9 aa, Homo Sapiens
DPAHWTIQK

SEQ ID NO: 1224952 - protein, 9 aa, Homo Sapiens
VAVCFLAVG

SEQ ID NO: 1224953 - protein, 9 aa, Homo Sapiens
NVKAINQQM

SEQ ID NO: 1224954 - protein, 9 aa, Homo Sapiens
FSGLRDTMT

SEQ ID NO: 1224955 - protein, 9 aa, Homo Sapiens
SHFKVTVSV

SEQ ID NO: 1224956 - protein, 9 aa, Homo Sapiens
EADWLQFWS

SEQ ID NO: 1224957 - protein, 9 aa, Homo Sapiens
DRVHEQGYV

SEQ ID NO: 1224958 - protein, 9 aa, Homo Sapiens
DVPFGHPLD

SEQ ID NO: 1224959 - protein, 9 aa, Homo Sapiens
LEVSNNGSM

SEQ ID NO: 1224960 - protein, 9 aa, Homo Sapiens
LHSLGWTLR

SEQ ID NO: 1224961 - protein, 9 aa, Homo Sapiens
ESYKTAVIP

SEQ ID NO: 1224962 - protein, 9 aa, Homo Sapiens
TIREEHEYE

SEQ ID NO: 1224963 - protein, 9 aa, Homo Sapiens
LKLILVMLE

SEQ ID NO: 1224964 - protein, 9 aa, Homo Sapiens
APSPAPCDG

SEQ ID NO: 1224965 - protein, 9 aa, Homo Sapiens
WLFTHSPSS

SEQ ID NO: 1224966 - protein, 9 aa, Homo Sapiens
LCISELLSA

SEQ ID NO: 1224967 - protein, 9 aa, Homo Sapiens
PTLPATQYN

SEQ ID NO: 1224968 - protein, 9 aa, Homo Sapiens
KLKKVGDLI

SEQ ID NO: 1224969 - protein, 9 aa, Homo Sapiens
LTRQHEDGE

SEQ ID NO: 1224970 - protein, 9 aa, Homo Sapiens
SKPSKGKDG

SEQ ID NO: 1224971 - protein, 9 aa, Homo Sapiens
NIKAKLPVW

SEQ ID NO: 1224972 - protein, 9 aa, Homo Sapiens
AQEPSLVKI

SEQ ID NO: 1224973 - protein, 9 aa, Homo Sapiens
VISGRHSIT

SEQ ID NO: 1224974 - protein, 9 aa, Homo Sapiens
SGQNTWLSY

SEQ ID NO: 1224975 - protein, 9 aa, Homo Sapiens
LIYQGHLSM

SEQ ID NO: 1224976 - protein, 9 aa, Homo Sapiens
LTLAVLPTL

SEQ ID NO: 1224977 - protein, 9 aa, Homo Sapiens
NCTTVSLTS

SEQ ID NO: 1224978 - protein, 9 aa, Homo Sapiens
CDDEPETYM

SEQ ID NO: 1224979 - protein, 9 aa, Homo Sapiens
QQNVTEVFS

SEQ ID NO: 1224980 - protein, 9 aa, Homo Sapiens
LYMFGGFRF

SEQ ID NO: 1224981 - protein, 9 aa, Homo Sapiens
NQGIRTVRY

SEQ ID NO: 1224982 - protein, 9 aa, Homo Sapiens
EAPMTEGTH

SEQ ID NO: 1224983 - protein, 9 aa, Homo Sapiens
VRDINDNPS

SEQ ID NO: 1224984 - protein, 9 aa, Homo Sapiens
TAMIGACFL

SEQ ID NO: 1224985 - protein, 9 aa, Homo Sapiens
HQQRDLHNL

SEQ ID NO: 1224986 - protein, 9 aa, Homo Sapiens
RPLISIAST

SEQ ID NO: 1224987 - protein, 9 aa, Homo Sapiens
MDGFLSQFP

SEQ ID NO: 1224988 - protein, 9 aa, Homo Sapiens
NDIKIDESS

SEQ ID NO: 1224989 - protein, 9 aa, Homo Sapiens
ELYMAHNRK

SEQ ID NO: 1224990 - protein, 9 aa, Homo Sapiens
QENTEYTVC

SEQ ID NO: 1224991 - protein, 9 aa, Homo Sapiens
VTERVIEPS

SEQ ID NO: 1224992 - protein, 9 aa, Homo Sapiens
VYEATREFN

SEQ ID NO: 1224993 - protein, 9 aa, Homo Sapiens
HDLISREYS

SEQ ID NO: 1224994 - protein, 9 aa, Homo Sapiens
FCMIFNGSL

SEQ ID NO: 1224995 - protein, 9 aa, Homo Sapiens
YHLHVHFTT

SEQ ID NO: 1224996 - protein, 9 aa, Homo Sapiens
SSYSSSSTS

SEQ ID NO: 1224997 - protein, 9 aa, Homo Sapiens
AARYSEPLH

SEQ ID NO: 1224998 - protein, 9 aa, Homo Sapiens
LFCDLAVCK

SEQ ID NO: 1224999 - protein, 9 aa, Homo Sapiens
LEVSYIKVV

SEQ ID NO: 1225000 - protein, 9 aa, Homo Sapiens
TVPLGTETS

SEQ ID NO: 1225001 - protein, 9 aa, Homo Sapiens
YMFGGFRFH

SEQ ID NO: 1225002 - protein, 9 aa, Homo Sapiens
IGVGYCKRQ

SEQ ID NO: 1225003 - protein, 9 aa, Homo Sapiens
GHCTDWESW

SEQ ID NO: 1225004 - protein, 9 aa, Homo Sapiens
MAPVGPVQV

SEQ ID NO: 1225005 - protein, 9 aa, Homo Sapiens
CFLVLTNLS

SEQ ID NO: 1225006 - protein, 9 aa, Homo Sapiens
RALHKVFLS

SEQ ID NO: 1225007 - protein, 9 aa, Homo Sapiens
VEIKLFKCP

SEQ ID NO: 1225008 - protein, 9 aa, Homo Sapiens
ATPQSPSVP

SEQ ID NO: 1225009 - protein, 9 aa, Homo Sapiens
MGSPKPATK

SEQ ID NO: 1225010 - protein, 9 aa, Homo Sapiens
GQLMGAGTL

SEQ ID NO: 1225011 - protein, 9 aa, Homo Sapiens
TKILILIMK

SEQ ID NO: 1225012 - protein, 9 aa, Homo Sapiens
MPYGNLLDH

SEQ ID NO: 1225013 - protein, 9 aa, Homo Sapiens
IAMDQKGLT

SEQ ID NO: 1225014 - protein, 9 aa, Homo Sapiens
TSLPEPRDE

SEQ ID NO: 1225015 - protein, 9 aa, Homo Sapiens
VMTCPRCIL

SEQ ID NO: 1225016 - protein, 9 aa, Homo Sapiens
ILNLSSDVR

SEQ ID NO: 1225017 - protein, 9 aa, Homo Sapiens
QLGAVKFTS

SEQ ID NO: 1225018 - protein, 9 aa, Homo Sapiens
LTCSYAKLP

SEQ ID NO: 1225019 - protein, 9 aa, Homo Sapiens
NTIGAAFMA

SEQ ID NO: 1225020 - protein, 9 aa, Homo Sapiens
SQHKMLPSQ

SEQ ID NO: 1225021 - protein, 9 aa, Homo Sapiens
AFSGVVDIV

SEQ ID NO: 1225022 - protein, 9 aa, Homo Sapiens
VVCREMGYV

SEQ ID NO: 1225023 - protein, 9 aa, Homo Sapiens
QLHAAIRVL

SEQ ID NO: 1225024 - protein, 9 aa, Homo Sapiens
RGSRTHITL

SEQ ID NO: 1225025 - protein, 9 aa, Homo Sapiens
SHKKKKTRT

SEQ ID NO: 1225026 - protein, 9 aa, Homo Sapiens
CHGLSRKYI

SEQ ID NO: 1225027 - protein, 9 aa, Homo Sapiens
VTPPQCLSP

SEQ ID NO: 1225028 - protein, 9 aa, Homo Sapiens
MCVVDTGIT

SEQ ID NO: 1225029 - protein, 9 aa, Homo Sapiens
FSSRGQSEL

SEQ ID NO: 1225030 - protein, 9 aa, Homo Sapiens
ATSSKKVVV

SEQ ID NO: 1225031 - protein, 9 aa, Homo Sapiens
QQHLLQHQS

SEQ ID NO: 1225032 - protein, 9 aa, Homo Sapiens
PRHWSSLSL

SEQ ID NO: 1225033 - protein, 9 aa, Homo Sapiens
EIPTGSEAD

SEQ ID NO: 1225034 - protein, 9 aa, Homo Sapiens
WSSLWPCWF

SEQ ID NO: 1225035 - protein, 9 aa, Homo Sapiens
DLLHTIQRQ

SEQ ID NO: 1225036 - protein, 9 aa, Homo Sapiens
LPLASPGAT

SEQ ID NO: 1225037 - protein, 9 aa, Homo Sapiens
VTYIDYEGH

SEQ ID NO: 1225038 - protein, 9 aa, Homo Sapiens
VTCVVFHYR

SEQ ID NO: 1225039 - protein, 9 aa, Homo Sapiens
FTRKEEDCK

SEQ ID NO: 1225040 - protein, 9 aa, Homo Sapiens
IVKDSYAAR

SEQ ID NO: 1225041 - protein, 9 aa, Homo Sapiens
KHTEAKKKA

SEQ ID NO: 1225042 - protein, 9 aa, Homo Sapiens
DVMETVKII

SEQ ID NO: 1225043 - protein, 9 aa, Homo Sapiens
KLGIFRRWN

SEQ ID NO: 1225044 - protein, 9 aa, Homo Sapiens
LKEISQDEC

SEQ ID NO: 1225045 - protein, 9 aa, Homo Sapiens
GAHEQRVAQ

SEQ ID NO: 1225046 - protein, 9 aa, Homo Sapiens
LRADVIGIQ

SEQ ID NO: 1225047 - protein, 9 aa, Homo Sapiens
MIRGIGETP

SEQ ID NO: 1225048 - protein, 9 aa, Homo Sapiens
GRRNENPDE

SEQ ID NO: 1225049 - protein, 9 aa, Homo Sapiens
GPGGDLVIQ

SEQ ID NO: 1225050 - protein, 9 aa, Homo Sapiens
SIQREYLDI

SEQ ID NO: 1225051 - protein, 9 aa, Homo Sapiens
PSSEEPPLS

SEQ ID NO: 1225052 - protein, 9 aa, Homo Sapiens
PSAPTGIGG

SEQ ID NO: 1225053 - protein, 9 aa, Homo Sapiens
LLLDQACHI

SEQ ID NO: 1225054 - protein, 9 aa, Homo Sapiens
SILAEKMVI

SEQ ID NO: 1225055 - protein, 9 aa, Homo Sapiens
GSRMSQPLQ

SEQ ID NO: 1225056 - protein, 9 aa, Homo Sapiens
RCIVGQYKL

SEQ ID NO: 1225057 - protein, 9 aa, Homo Sapiens
PNMREFILW

SEQ ID NO: 1225058 - protein, 9 aa, Homo Sapiens
GGGVRPWLP

SEQ ID NO: 1225059 - protein, 9 aa, Homo Sapiens
NYRDGMIID

SEQ ID NO: 1225060 - protein, 9 aa, Homo Sapiens
THSLCFNCA

SEQ ID NO: 1225061 - protein, 9 aa, Homo Sapiens
LAWKWDYLI

SEQ ID NO: 1225062 - protein, 9 aa, Homo Sapiens
ISDLECRCQ

SEQ ID NO: 1225063 - protein, 9 aa, Homo Sapiens
VYPVHMQLY

SEQ ID NO: 1225064 - protein, 9 aa, Homo Sapiens
RLLADDALY

SEQ ID NO: 1225065 - protein, 9 aa, Homo Sapiens
DHKPYLLSP

SEQ ID NO: 1225066 - protein, 9 aa, Homo Sapiens
HMTTYSTER

SEQ ID NO: 1225067 - protein, 9 aa, Homo Sapiens
TLPQTRCDG

SEQ ID NO: 1225068 - protein, 9 aa, Homo Sapiens
VFVMEPRQE

SEQ ID NO: 1225069 - protein, 9 aa, Homo Sapiens
GPWMLVWSQ

SEQ ID NO: 1225070 - protein, 9 aa, Homo Sapiens
TISKGIFAP

SEQ ID NO: 1225071 - protein, 9 aa, Homo Sapiens
TPNPKNSSR

SEQ ID NO: 1225072 - protein, 9 aa, Homo Sapiens
LWPCWFGAG

SEQ ID NO: 1225073 - protein, 9 aa, Homo Sapiens
GTMYGNDEG

SEQ ID NO: 1225074 - protein, 9 aa, Homo Sapiens
LYVPPTCTY

SEQ ID NO: 1225075 - protein, 9 aa, Homo Sapiens
SALAEQQRH

SEQ ID NO: 1225076 - protein, 9 aa, Homo Sapiens
VICVTGSQN

SEQ ID NO: 1225077 - protein, 9 aa, Homo Sapiens
SGFSVFFQM

SEQ ID NO: 1225078 - protein, 9 aa, Homo Sapiens
KESRVVNLH

SEQ ID NO: 1225079 - protein, 9 aa, Homo Sapiens
AFSPPPGSG

SEQ ID NO: 1225080 - protein, 9 aa, Homo Sapiens
YTKGNGDCA

SEQ ID NO: 1225081 - protein, 9 aa, Homo Sapiens
PTQSISACA

SEQ ID NO: 1225082 - protein, 9 aa, Homo Sapiens
VLDFILMDT

SEQ ID NO: 1225083 - protein, 9 aa, Homo Sapiens
IPATVSEGK

SEQ ID NO: 1225084 - protein, 9 aa, Homo Sapiens
SPVAAIKGP

SEQ ID NO: 1225085 - protein, 9 aa, Homo Sapiens
TKMLHLEVV

SEQ ID NO: 1225086 - protein, 9 aa, Homo Sapiens
PNCSLLYAQ

SEQ ID NO: 1225087 - protein, 9 aa, Homo Sapiens
GILNTSGAG

SEQ ID NO: 1225088 - protein, 9 aa, Homo Sapiens
LSQWSLGND

SEQ ID NO: 1225089 - protein, 9 aa, Homo Sapiens
DIAEPVCRP

SEQ ID NO: 1225090 - protein, 9 aa, Homo Sapiens
RVIPYDALP

SEQ ID NO: 1225091 - protein, 9 aa, Homo Sapiens
RSLGLLMRD

SEQ ID NO: 1225092 - protein, 9 aa, Homo Sapiens
NILPQQKLL

SEQ ID NO: 1225093 - protein, 9 aa, Homo Sapiens
AALPPWPVE

SEQ ID NO: 1225094 - protein, 9 aa, Homo Sapiens
EQDKIVSVF

SEQ ID NO: 1225095 - protein, 9 aa, Homo Sapiens
IIEVMDATN

SEQ ID NO: 1225096 - protein, 9 aa, Homo Sapiens
VANGMPYSA

SEQ ID NO: 1225097 - protein, 9 aa, Homo Sapiens
GPTATAAVE

SEQ ID NO: 1225098 - protein, 9 aa, Homo Sapiens
INDVKRLKH

SEQ ID NO: 1225099 - protein, 9 aa, Homo Sapiens
AIMGCIAYK

SEQ ID NO: 1225100 - protein, 9 aa, Homo Sapiens
QSAGQIVLV

SEQ ID NO: 1225101 - protein, 9 aa, Homo Sapiens
IQGWDITVD

SEQ ID NO: 1225102 - protein, 9 aa, Homo Sapiens
RALQDCTQF

SEQ ID NO: 1225103 - protein, 9 aa, Homo Sapiens
VAGGSTGLV

SEQ ID NO: 1225104 - protein, 9 aa, Homo Sapiens
CYEPGHQAL

SEQ ID NO: 1225105 - protein, 9 aa, Homo Sapiens
FSCNSPQPW

SEQ ID NO: 1225106 - protein, 9 aa, Homo Sapiens
VFDFDHFSR

SEQ ID NO: 1225107 - protein, 9 aa, Homo Sapiens
MHPELVSSW

SEQ ID NO: 1225108 - protein, 9 aa, Homo Sapiens
AVTAKHLSR

SEQ ID NO: 1225109 - protein, 9 aa, Homo Sapiens
EQLTPEICH

SEQ ID NO: 1225110 - protein, 9 aa, Homo Sapiens
TEKSFGERL

SEQ ID NO: 1225111 - protein, 9 aa, Homo Sapiens
ETEQGIRLS

SEQ ID NO: 1225112 - protein, 9 aa, Homo Sapiens
SNHISSMFR

SEQ ID NO: 1225113 - protein, 9 aa, Homo Sapiens
QYHVARAHK

SEQ ID NO: 1225114 - protein, 9 aa, Homo Sapiens
WDLHDAAVA

SEQ ID NO: 1225115 - protein, 9 aa, Homo Sapiens
DSVIAYGQS

SEQ ID NO: 1225116 - protein, 9 aa, Homo Sapiens
GCGLNYHKH

SEQ ID NO: 1225117 - protein, 9 aa, Homo Sapiens
CPMYFMKLH

SEQ ID NO: 1225118 - protein, 9 aa, Homo Sapiens
VCTHNVVSY

SEQ ID NO: 1225119 - protein, 9 aa, Homo Sapiens
GKGIGLSIV

SEQ ID NO: 1225120 - protein, 9 aa, Homo Sapiens
GGSTGLVEI

SEQ ID NO: 1225121 - protein, 9 aa, Homo Sapiens
ESVSVSARV

SEQ ID NO: 1225122 - protein, 9 aa, Homo Sapiens
PLKRRHVSF

SEQ ID NO: 1225123 - protein, 9 aa, Homo Sapiens
IFLEKCLHK

SEQ ID NO: 1225124 - protein, 9 aa, Homo Sapiens
LVKLAPCIS

SEQ ID NO: 1225125 - protein, 9 aa, Homo Sapiens
ALPAPGHFR

SEQ ID NO: 1225126 - protein, 9 aa, Homo Sapiens
LLVGTGSNI

SEQ ID NO: 1225127 - protein, 9 aa, Homo Sapiens
AEGPTPRSG

SEQ ID NO: 1225128 - protein, 9 aa, Homo Sapiens
EGFGIDGTA

SEQ ID NO: 1225129 - protein, 9 aa, Homo Sapiens
ENMIRQTNT

SEQ ID NO: 1225130 - protein, 9 aa, Homo Sapiens
EETFEFVVV

SEQ ID NO: 1225131 - protein, 9 aa, Homo Sapiens
DSQKFFFDR

SEQ ID NO: 1225132 - protein, 9 aa, Homo Sapiens
LHEKIQPLN

SEQ ID NO: 1225133 - protein, 9 aa, Homo Sapiens
EKICLKASI

SEQ ID NO: 1225134 - protein, 9 aa, Homo Sapiens
PSCRQQWTR

SEQ ID NO: 1225135 - protein, 9 aa, Homo Sapiens
SGTFYERKI

SEQ ID NO: 1225136 - protein, 9 aa, Homo Sapiens
QSSETAGSL

SEQ ID NO: 1225137 - protein, 9 aa, Homo Sapiens
DSGRYQLHV

SEQ ID NO: 1225138 - protein, 9 aa, Homo Sapiens
QFCFLRFAW

SEQ ID NO: 1225139 - protein, 9 aa, Homo Sapiens
TPAPAFWNR

SEQ ID NO: 1225140 - protein, 9 aa, Homo Sapiens
SNYQVEQSQ

SEQ ID NO: 1225141 - protein, 9 aa, Homo Sapiens
WEELSVMDV

SEQ ID NO: 1225142 - protein, 9 aa, Homo Sapiens
WVGGAESLQ

SEQ ID NO: 1225143 - protein, 9 aa, Homo Sapiens
APVPLAEPA

SEQ ID NO: 1225144 - protein, 9 aa, Homo Sapiens
LAHQQQQHL

SEQ ID NO: 1225145 - protein, 9 aa, Homo Sapiens
VISVCYILM

SEQ ID NO: 1225146 - protein, 9 aa, Homo Sapiens
ICGNRQDLE

SEQ ID NO: 1225147 - protein, 9 aa, Homo Sapiens
EGFTCDCYM

SEQ ID NO: 1225148 - protein, 9 aa, Homo Sapiens
VEHVFQSNY

SEQ ID NO: 1225149 - protein, 9 aa, Homo Sapiens
KILNRQKIH

SEQ ID NO: 1225150 - protein, 9 aa, Homo Sapiens
LWQVSIQAR

SEQ ID NO: 1225151 - protein, 9 aa, Homo Sapiens
CWCRLQCEI

SEQ ID NO: 1225152 - protein, 9 aa, Homo Sapiens
GPCGPRAHP

SEQ ID NO: 1225153 - protein, 9 aa, Homo Sapiens
NLISVDNFE

SEQ ID NO: 1225154 - protein, 9 aa, Homo Sapiens
KENGSMASD

SEQ ID NO: 1225155 - protein, 9 aa, Homo Sapiens
VDKTFPQSS

SEQ ID NO: 1225156 - protein, 9 aa, Homo Sapiens
SSCVSTYSF

SEQ ID NO: 1225157 - protein, 9 aa, Homo Sapiens
GAVYPFVDD

SEQ ID NO: 1225158 - protein, 9 aa, Homo Sapiens
NRQTKWRKK

SEQ ID NO: 1225159 - protein, 9 aa, Homo Sapiens
ASGVPPPYP

SEQ ID NO: 1225160 - protein, 9 aa, Homo Sapiens
DPANAKALK

SEQ ID NO: 1225161 - protein, 9 aa, Homo Sapiens
FITYGIQPH

SEQ ID NO: 1225162 - protein, 9 aa, Homo Sapiens
QIHIGFPFS

SEQ ID NO: 1225163 - protein, 9 aa, Homo Sapiens
ALLQENQKA

SEQ ID NO: 1225164 - protein, 9 aa, Homo Sapiens
YGMQELKAG

SEQ ID NO: 1225165 - protein, 9 aa, Homo Sapiens
PTSLSENNM

SEQ ID NO: 1225166 - protein, 9 aa, Homo Sapiens
KFQKLRYKD

SEQ ID NO: 1225167 - protein, 9 aa, Homo Sapiens
TLFTFIWFL

SEQ ID NO: 1225168 - protein, 9 aa, Homo Sapiens
EGHSDGDSI

SEQ ID NO: 1225169 - protein, 9 aa, Homo Sapiens
TSSRTSTFS

SEQ ID NO: 1225170 - protein, 9 aa, Homo Sapiens
LRPTAWRVW

SEQ ID NO: 1225171 - protein, 9 aa, Homo Sapiens
FQRSEHISL

SEQ ID NO: 1225172 - protein, 9 aa, Homo Sapiens
NAFFLKVTT

SEQ ID NO: 1225173 - protein, 9 aa, Homo Sapiens
QGNNRLKLL

SEQ ID NO: 1225174 - protein, 9 aa, Homo Sapiens
LGEDRTICE

SEQ ID NO: 1225175 - protein, 9 aa, Homo Sapiens
ANAAGAEAV

SEQ ID NO: 1225176 - protein, 9 aa, Homo Sapiens
AGREKKSHP

SEQ ID NO: 1225177 - protein, 9 aa, Homo Sapiens
RRRSKVFGR

SEQ ID NO: 1225178 - protein, 9 aa, Homo Sapiens
GMLSSLKLQ

SEQ ID NO: 1225179 - protein, 9 aa, Homo Sapiens
YVLTPSEAY

SEQ ID NO: 1225180 - protein, 9 aa, Homo Sapiens
GIMYQSELL

SEQ ID NO: 1225181 - protein, 9 aa, Homo Sapiens
QVIIIVGPG

SEQ ID NO: 1225182 - protein, 9 aa, Homo Sapiens
PPCPFAPKE

SEQ ID NO: 1225183 - protein, 9 aa, Homo Sapiens
NRHGVYTNI

SEQ ID NO: 1225184 - protein, 9 aa, Homo Sapiens
ALEVWRSRR

SEQ ID NO: 1225185 - protein, 9 aa, Homo Sapiens
DAPHGVVWD

SEQ ID NO: 1225186 - protein, 9 aa, Homo Sapiens
RHTHTHRHT

SEQ ID NO: 1225187 - protein, 9 aa, Homo Sapiens
LISREYSLG

SEQ ID NO: 1225188 - protein, 9 aa, Homo Sapiens
HVRKLRVSI

SEQ ID NO: 1225189 - protein, 9 aa, Homo Sapiens
GAVNLSTEN

SEQ ID NO: 1225190 - protein, 9 aa, Homo Sapiens
ATLIMASLP

SEQ ID NO: 1225191 - protein, 9 aa, Homo Sapiens
SSQNLVFHS

SEQ ID NO: 1225192 - protein, 9 aa, Homo Sapiens
ASATFNSPG

SEQ ID NO: 1225193 - protein, 9 aa, Homo Sapiens
STLHLDLEK

SEQ ID NO: 1225194 - protein, 9 aa, Homo Sapiens
QACLISKQL

SEQ ID NO: 1225195 - protein, 9 aa, Homo Sapiens
PSSSTTTCS

SEQ ID NO: 1225196 - protein, 9 aa, Homo Sapiens
LYMAHNRKD

SEQ ID NO: 1225197 - protein, 9 aa, Homo Sapiens
EAIIWDAQD

SEQ ID NO: 1225198 - protein, 9 aa, Homo Sapiens
IFFIVYLSI

SEQ ID NO: 1225199 - protein, 9 aa, Homo Sapiens
TEQPDYDLD

SEQ ID NO: 1225200 - protein, 9 aa, Homo Sapiens
APQSFIFLW

SEQ ID NO: 1225201 - protein, 9 aa, Homo Sapiens
MMKRIKQLI

SEQ ID NO: 1225202 - protein, 9 aa, Homo Sapiens
SNSWCLVQG

SEQ ID NO: 1225203 - protein, 9 aa, Homo Sapiens
ESGQEETRG

SEQ ID NO: 1225204 - protein, 9 aa, Homo Sapiens
KSAPFLILT

SEQ ID NO: 1225205 - protein, 9 aa, Homo Sapiens
NIIFLKCSV

SEQ ID NO: 1225206 - protein, 9 aa, Homo Sapiens
FAPSPTPDV

SEQ ID NO: 1225207 - protein, 9 aa, Homo Sapiens
QPAAAPGFS

SEQ ID NO: 1225208 - protein, 9 aa, Homo Sapiens
FFCLMVAFL

SEQ ID NO: 1225209 - protein, 9 aa, Homo Sapiens
DHNGSSSGG

SEQ ID NO: 1225210 - protein, 9 aa, Homo Sapiens
HRALSIDNS

SEQ ID NO: 1225211 - protein, 9 aa, Homo Sapiens
HNCTITLLK

SEQ ID NO: 1225212 - protein, 9 aa, Homo Sapiens
LSSLVVHLL

SEQ ID NO: 1225213 - protein, 9 aa, Homo Sapiens
DTMLQTAGC

SEQ ID NO: 1225214 - protein, 9 aa, Homo Sapiens
STLNYSQVA

SEQ ID NO: 1225215 - protein, 9 aa, Homo Sapiens
AYHGCRDVE

SEQ ID NO: 1225216 - protein, 9 aa, Homo Sapiens
ELGNHYLYQ

SEQ ID NO: 1225217 - protein, 9 aa, Homo Sapiens
DSFGGPGGF

SEQ ID NO: 1225218 - protein, 9 aa, Homo Sapiens
GHQSHSSSS

SEQ ID NO: 1225219 - protein, 9 aa, Homo Sapiens
KLVAAANCQ

SEQ ID NO: 1225220 - protein, 9 aa, Homo Sapiens
MDNFNLGRA

SEQ ID NO: 1225221 - protein, 9 aa, Homo Sapiens
SIEYDSDDE

SEQ ID NO: 1225222 - protein, 9 aa, Homo Sapiens
SVSRVFQSP

SEQ ID NO: 1225223 - protein, 9 aa, Homo Sapiens
DQTLESGPG

SEQ ID NO: 1225224 - protein, 9 aa, Homo Sapiens
EEDDNDIHI

SEQ ID NO: 1225225 - protein, 9 aa, Homo Sapiens
PLKKMKQEV

SEQ ID NO: 1225226 - protein, 9 aa, Homo Sapiens
ADGMGGIWA

SEQ ID NO: 1225227 - protein, 9 aa, Homo Sapiens
SHQQRDLHN

SEQ ID NO: 1225228 - protein, 9 aa, Homo Sapiens
QRHHIRGPP

SEQ ID NO: 1225229 - protein, 9 aa, Homo Sapiens
KKCLRLADM

SEQ ID NO: 1225230 - protein, 9 aa, Homo Sapiens
HNCAPEFQA

SEQ ID NO: 1225231 - protein, 9 aa, Homo Sapiens
TLELSNELA

SEQ ID NO: 1225232 - protein, 9 aa, Homo Sapiens
LVDEDLLFH

SEQ ID NO: 1225233 - protein, 9 aa, Homo Sapiens
LAYVTIMGK

SEQ ID NO: 1225234 - protein, 9 aa, Homo Sapiens
AEGLIETKH

SEQ ID NO: 1225235 - protein, 9 aa, Homo Sapiens
HFLDYYDLV

SEQ ID NO: 1225236 - protein, 9 aa, Homo Sapiens
QNDLQAQTR

SEQ ID NO: 1225237 - protein, 9 aa, Homo Sapiens
LPDTLLLQV

SEQ ID NO: 1225238 - protein, 9 aa, Homo Sapiens
SFCLAPKRP

SEQ ID NO: 1225239 - protein, 9 aa, Homo Sapiens
SEAYSKKLM

SEQ ID NO: 1225240 - protein, 9 aa, Homo Sapiens
EHMPPKSVD

SEQ ID NO: 1225241 - protein, 9 aa, Homo Sapiens
LPQTRCDGK

SEQ ID NO: 1225242 - protein, 9 aa, Homo Sapiens
SDQTVLFQG

SEQ ID NO: 1225243 - protein, 9 aa, Homo Sapiens
LSSYLPSPG

SEQ ID NO: 1225244 - protein, 9 aa, Homo Sapiens
EEEEVETLL

SEQ ID NO: 1225245 - protein, 9 aa, Homo Sapiens
LATCPFNDR

SEQ ID NO: 1225246 - protein, 9 aa, Homo Sapiens
PGGCSCDYI

SEQ ID NO: 1225247 - protein, 9 aa, Homo Sapiens
EHLARVGPP

SEQ ID NO: 1225248 - protein, 9 aa, Homo Sapiens
SAWPPTVTI

SEQ ID NO: 1225249 - protein, 9 aa, Homo Sapiens
VDLHVYIVG

SEQ ID NO: 1225250 - protein, 9 aa, Homo Sapiens
YANKYNVML

SEQ ID NO: 1225251 - protein, 9 aa, Homo Sapiens
LKSYTSQKT

SEQ ID NO: 1225252 - protein, 9 aa, Homo Sapiens
EIKEAFELF

SEQ ID NO: 1225253 - protein, 9 aa, Homo Sapiens
KQCCMLLKR

SEQ ID NO: 1225254 - protein, 9 aa, Homo Sapiens
INAIKDVTK

SEQ ID NO: 1225255 - protein, 9 aa, Homo Sapiens
KNKPFRHVL

SEQ ID NO: 1225256 - protein, 9 aa, Homo Sapiens
GFFCLMVAF

SEQ ID NO: 1225257 - protein, 9 aa, Homo Sapiens
FGDLLHTIQ

SEQ ID NO: 1225258 - protein, 9 aa, Homo Sapiens
GHLWLGTLC

SEQ ID NO: 1225259 - protein, 9 aa, Homo Sapiens
RVTDSQLVV

SEQ ID NO: 1225260 - protein, 9 aa, Homo Sapiens
RTESPPPLP

SEQ ID NO: 1225261 - protein, 9 aa, Homo Sapiens
HQAILNLHG

SEQ ID NO: 1225262 - protein, 9 aa, Homo Sapiens
HFYVVMWKQ

SEQ ID NO: 1225263 - protein, 9 aa, Homo Sapiens
YLETAARSI

SEQ ID NO: 1225264 - protein, 9 aa, Homo Sapiens
TRTSPTFRR

SEQ ID NO: 1225265 - protein, 9 aa, Homo Sapiens
QNMVKTCDS

SEQ ID NO: 1225266 - protein, 9 aa, Homo Sapiens
TNAQLHAQD

SEQ ID NO: 1225267 - protein, 9 aa, Homo Sapiens
VAGTKVIVQ

SEQ ID NO: 1225268 - protein, 9 aa, Homo Sapiens
AEAAEGEGD

SEQ ID NO: 1225269 - protein, 9 aa, Homo Sapiens
HFKCRHPTG

SEQ ID NO: 1225270 - protein, 9 aa, Homo Sapiens
TRIEGTQVD

SEQ ID NO: 1225271 - protein, 9 aa, Homo Sapiens
ELPDLEYLM

SEQ ID NO: 1225272 - protein, 9 aa, Homo Sapiens
RLTGGDWFT

SEQ ID NO: 1225273 - protein, 9 aa, Homo Sapiens
IVVWTNLTE

SEQ ID NO: 1225274 - protein, 9 aa, Homo Sapiens
KQKEYEENS

SEQ ID NO: 1225275 - protein, 9 aa, Homo Sapiens
PVPKEVNCK

SEQ ID NO: 1225276 - protein, 9 aa, Homo Sapiens
IYVLQVLTF

SEQ ID NO: 1225277 - protein, 9 aa, Homo Sapiens
ITDIIKIQK

SEQ ID NO: 1225278 - protein, 9 aa, Homo Sapiens
SLAFSGVVD

SEQ ID NO: 1225279 - protein, 9 aa, Homo Sapiens
GMTSFEPEA

SEQ ID NO: 1225280 - protein, 9 aa, Homo Sapiens
PKLLQCSPK

SEQ ID NO: 1225281 - protein, 9 aa, Homo Sapiens
PNLTMKEVI

SEQ ID NO: 1225282 - protein, 9 aa, Homo Sapiens
HTSYWESTD

SEQ ID NO: 1225283 - protein, 9 aa, Homo Sapiens
SRPHRTPWP

SEQ ID NO: 1225284 - protein, 9 aa, Homo Sapiens
MEDDTNFFL

SEQ ID NO: 1225285 - protein, 9 aa, Homo Sapiens
AALVELHIM

SEQ ID NO: 1225286 - protein, 9 aa, Homo Sapiens
SHPCANGIT

SEQ ID NO: 1225287 - protein, 9 aa, Homo Sapiens
KAMSTLSAH

SEQ ID NO: 1225288 - protein, 9 aa, Homo Sapiens
HRASTPINN

SEQ ID NO: 1225289 - protein, 9 aa, Homo Sapiens
TQRQAQPHP

SEQ ID NO: 1225290 - protein, 9 aa, Homo Sapiens
MINGQVESA

SEQ ID NO: 1225291 - protein, 9 aa, Homo Sapiens
HRRPPLHVW

SEQ ID NO: 1225292 - protein, 9 aa, Homo Sapiens
GYMSKRSSD

SEQ ID NO: 1225293 - protein, 9 aa, Homo Sapiens
PPEFSRSHI

SEQ ID NO: 1225294 - protein, 9 aa, Homo Sapiens
MVAKWPNRI

SEQ ID NO: 1225295 - protein, 9 aa, Homo Sapiens
PTGGPGFPG

SEQ ID NO: 1225296 - protein, 9 aa, Homo Sapiens
SATELLLLA

SEQ ID NO: 1225297 - protein, 9 aa, Homo Sapiens
QAEDLKAKG

SEQ ID NO: 1225298 - protein, 9 aa, Homo Sapiens
IHRTSEPHG

SEQ ID NO: 1225299 - protein, 9 aa, Homo Sapiens
KETARTVQI

SEQ ID NO: 1225300 - protein, 9 aa, Homo Sapiens
GTGLGLFCE

SEQ ID NO: 1225301 - protein, 9 aa, Homo Sapiens
VEFQLSEPP

SEQ ID NO: 1225302 - protein, 9 aa, Homo Sapiens
TRNQGIRTV

SEQ ID NO: 1225303 - protein, 9 aa, Homo Sapiens
CRELLTQPC

SEQ ID NO: 1225304 - protein, 9 aa, Homo Sapiens
KDTKLALIK

SEQ ID NO: 1225305 - protein, 9 aa, Homo Sapiens
ITCMYTGKE

SEQ ID NO: 1225306 - protein, 9 aa, Homo Sapiens
VYCHKDFGK

SEQ ID NO: 1225307 - protein, 9 aa, Homo Sapiens
KIKFDMEKI

SEQ ID NO: 1225308 - protein, 9 aa, Homo Sapiens
PFHLEEWRT

SEQ ID NO: 1225309 - protein, 9 aa, Homo Sapiens
RCIFNWVLS

SEQ ID NO: 1225310 - protein, 9 aa, Homo Sapiens
RTKQYSNTY

SEQ ID NO: 1225311 - protein, 9 aa, Homo Sapiens
DAYSHLKNI

SEQ ID NO: 1225312 - protein, 9 aa, Homo Sapiens
EPRKKYMDA

SEQ ID NO: 1225313 - protein, 9 aa, Homo Sapiens
VCETLVSMI

SEQ ID NO: 1225314 - protein, 9 aa, Homo Sapiens
PDLEVQEDL

SEQ ID NO: 1225315 - protein, 9 aa, Homo Sapiens
LVKQIISRA

SEQ ID NO: 1225316 - protein, 9 aa, Homo Sapiens
NDAFMNQEI

SEQ ID NO: 1225317 - protein, 9 aa, Homo Sapiens
MISETCSVR

SEQ ID NO: 1225318 - protein, 9 aa, Homo Sapiens
TIGTVLISC

SEQ ID NO: 1225319 - protein, 9 aa, Homo Sapiens
RFSSHDIQP

SEQ ID NO: 1225320 - protein, 9 aa, Homo Sapiens
NFVAQMLVE

SEQ ID NO: 1225321 - protein, 9 aa, Homo Sapiens
TDVLVAPRS

SEQ ID NO: 1225322 - protein, 9 aa, Homo Sapiens
EKEVTRMAV

SEQ ID NO: 1225323 - protein, 9 aa, Homo Sapiens
HIDHIDKKD

SEQ ID NO: 1225324 - protein, 9 aa, Homo Sapiens
PVSPTFPDH

SEQ ID NO: 1225325 - protein, 9 aa, Homo Sapiens
LGYLTSTSE

SEQ ID NO: 1225326 - protein, 9 aa, Homo Sapiens
NSTKNFRPT

SEQ ID NO: 1225327 - protein, 9 aa, Homo Sapiens
PDIDHVPEE

SEQ ID NO: 1225328 - protein, 9 aa, Homo Sapiens
IVLDHLKAT

SEQ ID NO: 1225329 - protein, 9 aa, Homo Sapiens
RMLKQAALQ

SEQ ID NO: 1225330 - protein, 9 aa, Homo Sapiens
PRGGGVRPW

SEQ ID NO: 1225331 - protein, 9 aa, Homo Sapiens
RMRLEATDV

SEQ ID NO: 1225332 - protein, 9 aa, Homo Sapiens
VHRHTNAGH

SEQ ID NO: 1225333 - protein, 9 aa, Homo Sapiens
CRHVSLRVL

SEQ ID NO: 1225334 - protein, 9 aa, Homo Sapiens
GKPHSTGDV

SEQ ID NO: 1225335 - protein, 9 aa, Homo Sapiens
RILTRKNGS

SEQ ID NO: 1225336 - protein, 9 aa, Homo Sapiens
PASPTAIWR

SEQ ID NO: 1225337 - protein, 9 aa, Homo Sapiens
RFYYQAMSV

SEQ ID NO: 1225338 - protein, 9 aa, Homo Sapiens
FGYKLMMVP

SEQ ID NO: 1225339 - protein, 9 aa, Homo Sapiens
SAQPVTEDW

SEQ ID NO: 1225340 - protein, 9 aa, Homo Sapiens
HLFLAKHGD

SEQ ID NO: 1225341 - protein, 9 aa, Homo Sapiens
LDRNLIVAV

SEQ ID NO: 1225342 - protein, 9 aa, Homo Sapiens
TIYMGPWRP

SEQ ID NO: 1225343 - protein, 9 aa, Homo Sapiens
IWDCDYSLA

SEQ ID NO: 1225344 - protein, 9 aa, Homo Sapiens
HLDTELDAY

SEQ ID NO: 1225345 - protein, 9 aa, Homo Sapiens
SSALAIVFM

SEQ ID NO: 1225346 - protein, 9 aa, Homo Sapiens
AGSRPQSPG

SEQ ID NO: 1225347 - protein, 9 aa, Homo Sapiens
GEIDPVTSS

SEQ ID NO: 1225348 - protein, 9 aa, Homo Sapiens
FNSLGLLKV

SEQ ID NO: 1225349 - protein, 9 aa, Homo Sapiens
LNVHRKIHT

SEQ ID NO: 1225350 - protein, 9 aa, Homo Sapiens
QVDLELLTS

SEQ ID NO: 1225351 - protein, 9 aa, Homo Sapiens
FSPLWLMTA

SEQ ID NO: 1225352 - protein, 9 aa, Homo Sapiens
HTRTHMGEK

SEQ ID NO: 1225353 - protein, 9 aa, Homo Sapiens
CLTRLYQSV

SEQ ID NO: 1225354 - protein, 9 aa, Homo Sapiens
EKLHLKEED

SEQ ID NO: 1225355 - protein, 9 aa, Homo Sapiens
VMGGKEDNG

SEQ ID NO: 1225356 - protein, 9 aa, Homo Sapiens
LYKSHRPCV

SEQ ID NO: 1225357 - protein, 9 aa, Homo Sapiens
NLERQQNQQ

SEQ ID NO: 1225358 - protein, 9 aa, Homo Sapiens
LLDPYRSMS

SEQ ID NO: 1225359 - protein, 9 aa, Homo Sapiens
RWDLLTEPD

SEQ ID NO: 1225360 - protein, 9 aa, Homo Sapiens
LRDEYIKWL

SEQ ID NO: 1225361 - protein, 9 aa, Homo Sapiens
WAADRAAII

SEQ ID NO: 1225362 - protein, 9 aa, Homo Sapiens
MHYLDRFLA

SEQ ID NO: 1225363 - protein, 9 aa, Homo Sapiens
SYWDALYKF

SEQ ID NO: 1225364 - protein, 9 aa, Homo Sapiens
SRGSTLPKC

SEQ ID NO: 1225365 - protein, 9 aa, Homo Sapiens
VQQTLVSTN

SEQ ID NO: 1225366 - protein, 9 aa, Homo Sapiens
SFTSFPILL

SEQ ID NO: 1225367 - protein, 9 aa, Homo Sapiens
KMHHKRRMH

SEQ ID NO: 1225368 - protein, 9 aa, Homo Sapiens
KHDGKSRGT

SEQ ID NO: 1225369 - protein, 9 aa, Homo Sapiens
VYVAHLDGR

SEQ ID NO: 1225370 - protein, 9 aa, Homo Sapiens
NGAGEALGI

SEQ ID NO: 1225371 - protein, 9 aa, Homo Sapiens
ELTEKTGRL

SEQ ID NO: 1225372 - protein, 9 aa, Homo Sapiens
LQCLRRAQS

SEQ ID NO: 1225373 - protein, 9 aa, Homo Sapiens
GAPRPGRSA

SEQ ID NO: 1225374 - protein, 9 aa, Homo Sapiens
YPYFGLFYE

SEQ ID NO: 1225375 - protein, 9 aa, Homo Sapiens
PMKSPGKER

SEQ ID NO: 1225376 - protein, 9 aa, Homo Sapiens
RGHGPAETH

SEQ ID NO: 1225377 - protein, 9 aa, Homo Sapiens
MANADRPVA

SEQ ID NO: 1225378 - protein, 9 aa, Homo Sapiens
PTGEDGPSC

SEQ ID NO: 1225379 - protein, 9 aa, Homo Sapiens
ETALDAFLS

SEQ ID NO: 1225380 - protein, 9 aa, Homo Sapiens
QVTMALQRQ

SEQ ID NO: 1225381 - protein, 9 aa, Homo Sapiens
HNGMMGINS

SEQ ID NO: 1225382 - protein, 9 aa, Homo Sapiens
DVTGSEDAH

SEQ ID NO: 1225383 - protein, 9 aa, Homo Sapiens
LWYKPMEQF

SEQ ID NO: 1225384 - protein, 9 aa, Homo Sapiens
SHRTQPLSF

SEQ ID NO: 1225385 - protein, 9 aa, Homo Sapiens
LSGCRFSRP

SEQ ID NO: 1225386 - protein, 9 aa, Homo Sapiens
TTGTDCECC

SEQ ID NO: 1225387 - protein, 9 aa, Homo Sapiens
VAAIKGPEN

SEQ ID NO: 1225388 - protein, 9 aa, Homo Sapiens
KRPIREVHV

SEQ ID NO: 1225389 - protein, 9 aa, Homo Sapiens
VQQCVLLLV

SEQ ID NO: 1225390 - protein, 9 aa, Homo Sapiens
NRIWELTSN

SEQ ID NO: 1225391 - protein, 9 aa, Homo Sapiens
PAGYVSQVA

SEQ ID NO: 1225392 - protein, 9 aa, Homo Sapiens
YLDHLNLSG

SEQ ID NO: 1225393 - protein, 9 aa, Homo Sapiens
PLPPHMAIQ

SEQ ID NO: 1225394 - protein, 9 aa, Homo Sapiens
LAKGRGGGL

SEQ ID NO: 1225395 - protein, 9 aa, Homo Sapiens
IWAALFLGM

SEQ ID NO: 1225396 - protein, 9 aa, Homo Sapiens
LFHRRRAQG

SEQ ID NO: 1225397 - protein, 9 aa, Homo Sapiens
RQQASERDA

SEQ ID NO: 1225398 - protein, 9 aa, Homo Sapiens
VNRIGHSQS

SEQ ID NO: 1225399 - protein, 9 aa, Homo Sapiens
HEQGYVPDH

SEQ ID NO: 1225400 - protein, 9 aa, Homo Sapiens
VEYEEEERK

SEQ ID NO: 1225401 - protein, 9 aa, Homo Sapiens
MNDLVYEIK

SEQ ID NO: 1225402 - protein, 9 aa, Homo Sapiens
TPVVQFHPL

SEQ ID NO: 1225403 - protein, 9 aa, Homo Sapiens
RRQFTSQAN

SEQ ID NO: 1225404 - protein, 9 aa, Homo Sapiens
NGKNNVPML

SEQ ID NO: 1225405 - protein, 9 aa, Homo Sapiens
CPKCKKEYQ

SEQ ID NO: 1225406 - protein, 9 aa, Homo Sapiens
VVGLTMPIY

SEQ ID NO: 1225407 - protein, 9 aa, Homo Sapiens
LARECDRQK

SEQ ID NO: 1225408 - protein, 9 aa, Homo Sapiens
TSSELQNNF

SEQ ID NO: 1225409 - protein, 9 aa, Homo Sapiens
VGNQNCSVG

SEQ ID NO: 1225410 - protein, 9 aa, Homo Sapiens
QCHSWEEMA

SEQ ID NO: 1225411 - protein, 9 aa, Homo Sapiens
VLLSYPSDD

SEQ ID NO: 1225412 - protein, 9 aa, Homo Sapiens
GNLLDHLRE

SEQ ID NO: 1225413 - protein, 9 aa, Homo Sapiens
MGPWGTGKI

SEQ ID NO: 1225414 - protein, 9 aa, Homo Sapiens
HFEPLRGAA

SEQ ID NO: 1225415 - protein, 9 aa, Homo Sapiens
TCIQSQIGG

SEQ ID NO: 1225416 - protein, 9 aa, Homo Sapiens
PLIDAPHDD

SEQ ID NO: 1225417 - protein, 9 aa, Homo Sapiens
VLPGVDPND

SEQ ID NO: 1225418 - protein, 9 aa, Homo Sapiens
TDANQGRRG

SEQ ID NO: 1225419 - protein, 9 aa, Homo Sapiens
FTCDCYMTS

SEQ ID NO: 1225420 - protein, 9 aa, Homo Sapiens
NNTREKSYD

SEQ ID NO: 1225421 - protein, 9 aa, Homo Sapiens
LETLLHSMV

SEQ ID NO: 1225422 - protein, 9 aa, Homo Sapiens
EPLPMPFNP

SEQ ID NO: 1225423 - protein, 9 aa, Homo Sapiens
IGGLNFETT

SEQ ID NO: 1225424 - protein, 9 aa, Homo Sapiens
LMENNSYPH

SEQ ID NO: 1225425 - protein, 9 aa, Homo Sapiens
WLDPDPANA

SEQ ID NO: 1225426 - protein, 9 aa, Homo Sapiens
KDSCSGQWA

SEQ ID NO: 1225427 - protein, 9 aa, Homo Sapiens
YHLQLLVQD

SEQ ID NO: 1225428 - protein, 9 aa, Homo Sapiens
DEFVELIGP

SEQ ID NO: 1225429 - protein, 9 aa, Homo Sapiens
IGGHIPIFR

SEQ ID NO: 1225430 - protein, 9 aa, Homo Sapiens
LFAKNFSYD

SEQ ID NO: 1225431 - protein, 9 aa, Homo Sapiens
DPGWEQNLC

SEQ ID NO: 1225432 - protein, 9 aa, Homo Sapiens
KLGTVEWRG

SEQ ID NO: 1225433 - protein, 9 aa, Homo Sapiens
GLIDAIKHF

SEQ ID NO: 1225434 - protein, 9 aa, Homo Sapiens
PDSESNMDQ

SEQ ID NO: 1225435 - protein, 9 aa, Homo Sapiens
SGGSCLSTS

SEQ ID NO: 1225436 - protein, 9 aa, Homo Sapiens
MWLQEPQPC

SEQ ID NO: 1225437 - protein, 9 aa, Homo Sapiens
VLMANPILF

SEQ ID NO: 1225438 - protein, 9 aa, Homo Sapiens
ANGAGWPCP

SEQ ID NO: 1225439 - protein, 9 aa, Homo Sapiens
LLQLTAAGP

SEQ ID NO: 1225440 - protein, 9 aa, Homo Sapiens
KCATILDII

SEQ ID NO: 1225441 - protein, 9 aa, Homo Sapiens
FEPLRGAAA

SEQ ID NO: 1225442 - protein, 9 aa, Homo Sapiens
IHRAYLDGS

SEQ ID NO: 1225443 - protein, 9 aa, Homo Sapiens
LQPCSSVDT

SEQ ID NO: 1225444 - protein, 9 aa, Homo Sapiens
AMPTTQSFA

SEQ ID NO: 1225445 - protein, 9 aa, Homo Sapiens
TWMILTAGS

SEQ ID NO: 1225446 - protein, 9 aa, Homo Sapiens
PCNTKIWFV

SEQ ID NO: 1225447 - protein, 9 aa, Homo Sapiens
PQVNGEQHH

SEQ ID NO: 1225448 - protein, 9 aa, Homo Sapiens
NRAFICGES

SEQ ID NO: 1225449 - protein, 9 aa, Homo Sapiens
ARIPLPLNS

SEQ ID NO: 1225450 - protein, 9 aa, Homo Sapiens
SHMLPEPGF

SEQ ID NO: 1225451 - protein, 9 aa, Homo Sapiens
PSTRSPLLS

SEQ ID NO: 1225452 - protein, 9 aa, Homo Sapiens
KGLIHHYRT

SEQ ID NO: 1225453 - protein, 9 aa, Homo Sapiens
NWAENGGRP

SEQ ID NO: 1225454 - protein, 9 aa, Homo Sapiens
RVLVLSVET

SEQ ID NO: 1225455 - protein, 9 aa, Homo Sapiens
GGCRDNLKY

SEQ ID NO: 1225456 - protein, 9 aa, Homo Sapiens
RNKGFPTLF

SEQ ID NO: 1225457 - protein, 9 aa, Homo Sapiens
DGQEHFSTS

SEQ ID NO: 1225458 - protein, 9 aa, Homo Sapiens
FFWDQLCSL

SEQ ID NO: 1225459 - protein, 9 aa, Homo Sapiens
GPPHHRPLG

SEQ ID NO: 1225460 - protein, 9 aa, Homo Sapiens
VHFRLTRDI

SEQ ID NO: 1225461 - protein, 9 aa, Homo Sapiens
NDPLRTPDA

SEQ ID NO: 1225462 - protein, 9 aa, Homo Sapiens
SSSCSGPSS

SEQ ID NO: 1225463 - protein, 9 aa, Homo Sapiens
STRPLISIA

SEQ ID NO: 1225464 - protein, 9 aa, Homo Sapiens
QHRFNGSDG

SEQ ID NO: 1225465 - protein, 9 aa, Homo Sapiens
WTHRLHERK

SEQ ID NO: 1225466 - protein, 9 aa, Homo Sapiens
YIGMIFGGD

SEQ ID NO: 1225467 - protein, 9 aa, Homo Sapiens
LIKEWAAHP

SEQ ID NO: 1225468 - protein, 9 aa, Homo Sapiens
PMLLKESYK

SEQ ID NO: 1225469 - protein, 9 aa, Homo Sapiens
ADHCISRDL

SEQ ID NO: 1225470 - protein, 9 aa, Homo Sapiens
DLTGLPEGA

SEQ ID NO: 1225471 - protein, 9 aa, Homo Sapiens
KIKEVPTHF

SEQ ID NO: 1225472 - protein, 9 aa, Homo Sapiens
RSKVFGRGE

SEQ ID NO: 1225473 - protein, 9 aa, Homo Sapiens
LLYEMICGH

SEQ ID NO: 1225474 - protein, 9 aa, Homo Sapiens
PCDGAGSPG

SEQ ID NO: 1225475 - protein, 9 aa, Homo Sapiens
SRLPMSVII

SEQ ID NO: 1225476 - protein, 9 aa, Homo Sapiens
PYAGRFKDM

SEQ ID NO: 1225477 - protein, 9 aa, Homo Sapiens
LGLVAGIPL

SEQ ID NO: 1225478 - protein, 9 aa, Homo Sapiens
VLFVISEVR

SEQ ID NO: 1225479 - protein, 9 aa, Homo Sapiens
SHGQEQAAE

SEQ ID NO: 1225480 - protein, 9 aa, Homo Sapiens
KLVSVGYGI

SEQ ID NO: 1225481 - protein, 9 aa, Homo Sapiens
LCLDMSDTR

SEQ ID NO: 1225482 - protein, 9 aa, Homo Sapiens
QIVLVEGGH

SEQ ID NO: 1225483 - protein, 9 aa, Homo Sapiens
CCLLVQRCG

SEQ ID NO: 1225484 - protein, 9 aa, Homo Sapiens
NMIFAVVVL

SEQ ID NO: 1225485 - protein, 9 aa, Homo Sapiens
RKAASKAAS

SEQ ID NO: 1225486 - protein, 9 aa, Homo Sapiens
RMMSQQKRF

SEQ ID NO: 1225487 - protein, 9 aa, Homo Sapiens
ICVRTVCTH

SEQ ID NO: 1225488 - protein, 9 aa, Homo Sapiens
VGTILGRNM

SEQ ID NO: 1225489 - protein, 9 aa, Homo Sapiens
QYTSGKQTG

SEQ ID NO: 1225490 - protein, 9 aa, Homo Sapiens
KHEIQRKSG

SEQ ID NO: 1225491 - protein, 9 aa, Homo Sapiens
RQCKRNEGY

SEQ ID NO: 1225492 - protein, 9 aa, Homo Sapiens
LPSNKTVEK

SEQ ID NO: 1225493 - protein, 9 aa, Homo Sapiens
KHINNDVNL

SEQ ID NO: 1225494 - protein, 9 aa, Homo Sapiens
MITKRPAQV

SEQ ID NO: 1225495 - protein, 9 aa, Homo Sapiens
CCERGFTAM

SEQ ID NO: 1225496 - protein, 9 aa, Homo Sapiens
IHQFYINVE

SEQ ID NO: 1225497 - protein, 9 aa, Homo Sapiens
KAFRHATIL

SEQ ID NO: 1225498 - protein, 9 aa, Homo Sapiens
VNGHVTCSL

SEQ ID NO: 1225499 - protein, 9 aa, Homo Sapiens
PDGRSHRGG

SEQ ID NO: 1225500 - protein, 9 aa, Homo Sapiens
DQDDNINTP

SEQ ID NO: 1225501 - protein, 9 aa, Homo Sapiens
HSQISHIKY

SEQ ID NO: 1225502 - protein, 9 aa, Homo Sapiens
VLLLVFILL

SEQ ID NO: 1225503 - protein, 9 aa, Homo Sapiens
FLAMSFNSL

SEQ ID NO: 1225504 - protein, 9 aa, Homo Sapiens
PMYGMCPLK

SEQ ID NO: 1225505 - protein, 9 aa, Homo Sapiens
CIWWFFTLI

SEQ ID NO: 1225506 - protein, 9 aa, Homo Sapiens
PVFAMCMTG

SEQ ID NO: 1225507 - protein, 9 aa, Homo Sapiens
EVPPASSVM

SEQ ID NO: 1225508 - protein, 9 aa, Homo Sapiens
TDNNLLDQA

SEQ ID NO: 1225509 - protein, 9 aa, Homo Sapiens
EPQWINVFQ

SEQ ID NO: 1225510 - protein, 9 aa, Homo Sapiens
PSKKKLKLA

SEQ ID NO: 1225511 - protein, 9 aa, Homo Sapiens
RLRTAGIIC

SEQ ID NO: 1225512 - protein, 9 aa, Homo Sapiens
IMEVILNDS

SEQ ID NO: 1225513 - protein, 9 aa, Homo Sapiens
TLITQCTAT

SEQ ID NO: 1225514 - protein, 9 aa, Homo Sapiens
RSVPGTPGF

SEQ ID NO: 1225515 - protein, 9 aa, Homo Sapiens
AANGLMATY

SEQ ID NO: 1225516 - protein, 9 aa, Homo Sapiens
RIAQELSFR

SEQ ID NO: 1225517 - protein, 9 aa, Homo Sapiens
VIHHCLNAC

SEQ ID NO: 1225518 - protein, 9 aa, Homo Sapiens
IWNASEYTS

SEQ ID NO: 1225519 - protein, 9 aa, Homo Sapiens
MDKLKTHVK

SEQ ID NO: 1225520 - protein, 9 aa, Homo Sapiens
KVMVTCLPL

SEQ ID NO: 1225521 - protein, 9 aa, Homo Sapiens
NIRLIRQVE

SEQ ID NO: 1225522 - protein, 9 aa, Homo Sapiens
LVIKVVAVD

SEQ ID NO: 1225523 - protein, 9 aa, Homo Sapiens
RLTSLARDA

SEQ ID NO: 1225524 - protein, 9 aa, Homo Sapiens
LLADLQVNN

SEQ ID NO: 1225525 - protein, 9 aa, Homo Sapiens
KVDDDVLLV

SEQ ID NO: 1225526 - protein, 9 aa, Homo Sapiens
RHVNVSILF

SEQ ID NO: 1225527 - protein, 9 aa, Homo Sapiens
PSNHHQQPP

SEQ ID NO: 1225528 - protein, 9 aa, Homo Sapiens
PLDKDGLGF

SEQ ID NO: 1225529 - protein, 9 aa, Homo Sapiens
LEKTLLVLG

SEQ ID NO: 1225530 - protein, 9 aa, Homo Sapiens
AGTEEMDIE

SEQ ID NO: 1225531 - protein, 9 aa, Homo Sapiens
LHECLKETM

SEQ ID NO: 1225532 - protein, 9 aa, Homo Sapiens
IDCHTDDLT

SEQ ID NO: 1225533 - protein, 9 aa, Homo Sapiens
ASGVKCTKS

SEQ ID NO: 1225534 - protein, 9 aa, Homo Sapiens
VRRYIMEKT

SEQ ID NO: 1225535 - protein, 9 aa, Homo Sapiens
NAKETARTV

SEQ ID NO: 1225536 - protein, 9 aa, Homo Sapiens
KRSRPRPTK

SEQ ID NO: 1225537 - protein, 9 aa, Homo Sapiens
KVTFVGSIS

SEQ ID NO: 1225538 - protein, 9 aa, Homo Sapiens
EGDKFKLIK

SEQ ID NO: 1225539 - protein, 9 aa, Homo Sapiens
HKTKSGLTG

SEQ ID NO: 1225540 - protein, 9 aa, Homo Sapiens
ESHLAAREK

SEQ ID NO: 1225541 - protein, 9 aa, Homo Sapiens
DLKESGDDS

SEQ ID NO: 1225542 - protein, 9 aa, Homo Sapiens
GIIQGFRVI

SEQ ID NO: 1225543 - protein, 9 aa, Homo Sapiens
ENMGQKENL

SEQ ID NO: 1225544 - protein, 9 aa, Homo Sapiens
HGNLTDISQ

SEQ ID NO: 1225545 - protein, 9 aa, Homo Sapiens
ETHWWDAPS

SEQ ID NO: 1225546 - protein, 9 aa, Homo Sapiens
RTTYVMFGG

SEQ ID NO: 1225547 - protein, 9 aa, Homo Sapiens
FSLAVISLN

SEQ ID NO: 1225548 - protein, 9 aa, Homo Sapiens
SYELPDDQV

SEQ ID NO: 1225549 - protein, 9 aa, Homo Sapiens
HVWRLTDQR

SEQ ID NO: 1225550 - protein, 9 aa, Homo Sapiens
LGKVIIQGK

SEQ ID NO: 1225551 - protein, 9 aa, Homo Sapiens
PKEWHHLTM

SEQ ID NO: 1225552 - protein, 9 aa, Homo Sapiens
GGGGPGPAQ

SEQ ID NO: 1225553 - protein, 9 aa, Homo Sapiens
HKRHALQDM

SEQ ID NO: 1225554 - protein, 9 aa, Homo Sapiens
EQLAESTVQ

SEQ ID NO: 1225555 - protein, 9 aa, Homo Sapiens
DICARVRDA

SEQ ID NO: 1225556 - protein, 9 aa, Homo Sapiens
LDEAESTVS

SEQ ID NO: 1225557 - protein, 9 aa, Homo Sapiens
ANFLILMDM

SEQ ID NO: 1225558 - protein, 9 aa, Homo Sapiens
QSKFNFTCL

SEQ ID NO: 1225559 - protein, 9 aa, Homo Sapiens
MLGRCSMVC

SEQ ID NO: 1225560 - protein, 9 aa, Homo Sapiens
KEFQACYRQ

SEQ ID NO: 1225561 - protein, 9 aa, Homo Sapiens
QSVTPPQCL

SEQ ID NO: 1225562 - protein, 9 aa, Homo Sapiens
SQGHCTDWE

SEQ ID NO: 1225563 - protein, 9 aa, Homo Sapiens
QAYTLTYTG

SEQ ID NO: 1225564 - protein, 9 aa, Homo Sapiens
AKSTGTFSD

SEQ ID NO: 1225565 - protein, 9 aa, Homo Sapiens
QLTSVDATS

SEQ ID NO: 1225566 - protein, 9 aa, Homo Sapiens
DNSATCSSA

SEQ ID NO: 1225567 - protein, 9 aa, Homo Sapiens
NCSGQKPLI

SEQ ID NO: 1225568 - protein, 9 aa, Homo Sapiens
RQSSPSPSW

SEQ ID NO: 1225569 - protein, 9 aa, Homo Sapiens
DTRRAMGEQ

SEQ ID NO: 1225570 - protein, 9 aa, Homo Sapiens
PKTCILILI

SEQ ID NO: 1225571 - protein, 9 aa, Homo Sapiens
SYEDALLPL

SEQ ID NO: 1225572 - protein, 9 aa, Homo Sapiens
SRNLLMVNS

SEQ ID NO: 1225573 - protein, 9 aa, Homo Sapiens
ISGSVAGKA

SEQ ID NO: 1225574 - protein, 9 aa, Homo Sapiens
VWSMEHINR

SEQ ID NO: 1225575 - protein, 9 aa, Homo Sapiens
VHMQLYEAW

SEQ ID NO: 1225576 - protein, 9 aa, Homo Sapiens
DGGRCCLVN

SEQ ID NO: 1225577 - protein, 9 aa, Homo Sapiens
NFLTHCLLV

SEQ ID NO: 1225578 - protein, 9 aa, Homo Sapiens
CKGILYVTM

SEQ ID NO: 1225579 - protein, 9 aa, Homo Sapiens
ERASLRRKE

SEQ ID NO: 1225580 - protein, 9 aa, Homo Sapiens
HNYSGLIDS

SEQ ID NO: 1225581 - protein, 9 aa, Homo Sapiens
SFTQEHKTA

SEQ ID NO: 1225582 - protein, 9 aa, Homo Sapiens
RLQTLEIHF

SEQ ID NO: 1225583 - protein, 9 aa, Homo Sapiens
HIHNKILTG

SEQ ID NO: 1225584 - protein, 9 aa, Homo Sapiens
DLGSLQHPP

SEQ ID NO: 1225585 - protein, 9 aa, Homo Sapiens
SFPSLAYST

SEQ ID NO: 1225586 - protein, 9 aa, Homo Sapiens
KQIQVLLAQ

SEQ ID NO: 1225587 - protein, 9 aa, Homo Sapiens
ETSKKHSNT

SEQ ID NO: 1225588 - protein, 9 aa, Homo Sapiens
EVGEFLWQV

SEQ ID NO: 1225589 - protein, 9 aa, Homo Sapiens
NKMEVLKKT

SEQ ID NO: 1225590 - protein, 9 aa, Homo Sapiens
HYEMLGRCS

SEQ ID NO: 1225591 - protein, 9 aa, Homo Sapiens
FIKLWIELL

SEQ ID NO: 1225592 - protein, 9 aa, Homo Sapiens
GLDALNNFL

SEQ ID NO: 1225593 - protein, 9 aa, Homo Sapiens
LSVPCRMEK

SEQ ID NO: 1225594 - protein, 9 aa, Homo Sapiens
GKRKKKGGK

SEQ ID NO: 1225595 - protein, 9 aa, Homo Sapiens
HSTEAIRAS

SEQ ID NO: 1225596 - protein, 9 aa, Homo Sapiens
AFTNYNINQ

SEQ ID NO: 1225597 - protein, 9 aa, Homo Sapiens
EGKDVLQET

SEQ ID NO: 1225598 - protein, 9 aa, Homo Sapiens
KESAIMPFI

SEQ ID NO: 1225599 - protein, 9 aa, Homo Sapiens
STEAVAGSV

SEQ ID NO: 1225600 - protein, 9 aa, Homo Sapiens
TGKCIHCIL

SEQ ID NO: 1225601 - protein, 9 aa, Homo Sapiens
VIFTLSVTM

SEQ ID NO: 1225602 - protein, 9 aa, Homo Sapiens
YTDVRELVS

SEQ ID NO: 1225603 - protein, 9 aa, Homo Sapiens
YSPTGRCWA

SEQ ID NO: 1225604 - protein, 9 aa, Homo Sapiens
RFSTRAVYL

SEQ ID NO: 1225605 - protein, 9 aa, Homo Sapiens
GTGRMRVVG

SEQ ID NO: 1225606 - protein, 9 aa, Homo Sapiens
REYITKKEE

SEQ ID NO: 1225607 - protein, 9 aa, Homo Sapiens
LMIIVGASV

SEQ ID NO: 1225608 - protein, 9 aa, Homo Sapiens
LQLWLIILL

SEQ ID NO: 1225609 - protein, 9 aa, Homo Sapiens
RLNEWHYGG

SEQ ID NO: 1225610 - protein, 9 aa, Homo Sapiens
YNRCFGQQT

SEQ ID NO: 1225611 - protein, 9 aa, Homo Sapiens
WHSAEQFCV

SEQ ID NO: 1225612 - protein, 9 aa, Homo Sapiens
SLEQLCLRI

SEQ ID NO: 1225613 - protein, 9 aa, Homo Sapiens
IINVINMDN

SEQ ID NO: 1225614 - protein, 9 aa, Homo Sapiens
VVFSLGSMF

SEQ ID NO: 1225615 - protein, 9 aa, Homo Sapiens
IIQVMTTEL

SEQ ID NO: 1225616 - protein, 9 aa, Homo Sapiens
RGEQGIPGD

SEQ ID NO: 1225617 - protein, 9 aa, Homo Sapiens
KSELQVTKQ

SEQ ID NO: 1225618 - protein, 9 aa, Homo Sapiens
QPLTLTKNS

SEQ ID NO: 1225619 - protein, 9 aa, Homo Sapiens
GQELLRITL

SEQ ID NO: 1225620 - protein, 9 aa, Homo Sapiens
VMAAVGALE

SEQ ID NO: 1225621 - protein, 9 aa, Homo Sapiens
LVCADMKAN

SEQ ID NO: 1225622 - protein, 9 aa, Homo Sapiens
WLQRNEIAC

SEQ ID NO: 1225623 - protein, 9 aa, Homo Sapiens
GTNYLGYAI

SEQ ID NO: 1225624 - protein, 9 aa, Homo Sapiens
LNRIQVRSI

SEQ ID NO: 1225625 - protein, 9 aa, Homo Sapiens
IRLIGQQLN

SEQ ID NO: 1225626 - protein, 9 aa, Homo Sapiens
NSMVFLHTL

SEQ ID NO: 1225627 - protein, 9 aa, Homo Sapiens
SKSSSFQEL

SEQ ID NO: 1225628 - protein, 9 aa, Homo Sapiens
TGSLNGTNM

SEQ ID NO: 1225629 - protein, 9 aa, Homo Sapiens
LVYHFCDVK

SEQ ID NO: 1225630 - protein, 9 aa, Homo Sapiens
SKIVVVMAK

SEQ ID NO: 1225631 - protein, 9 aa, Homo Sapiens
IPTGSEADG

SEQ ID NO: 1225632 - protein, 9 aa, Homo Sapiens
LSERHAPPG

SEQ ID NO: 1225633 - protein, 9 aa, Homo Sapiens
ESQCKIMQK

SEQ ID NO: 1225634 - protein, 9 aa, Homo Sapiens
IYIIRQKKL

SEQ ID NO: 1225635 - protein, 9 aa, Homo Sapiens
TEPTSRATR

SEQ ID NO: 1225636 - protein, 9 aa, Homo Sapiens
GRLQQAAVL

SEQ ID NO: 1225637 - protein, 9 aa, Homo Sapiens
AIFPVWSPR

SEQ ID NO: 1225638 - protein, 9 aa, Homo Sapiens
LPKRCNKKI

SEQ ID NO: 1225639 - protein, 9 aa, Homo Sapiens
VTNKANVVN

SEQ ID NO: 1225640 - protein, 9 aa, Homo Sapiens
LSQKLGRWC

SEQ ID NO: 1225641 - protein, 9 aa, Homo Sapiens
SKTCCLGMQ

SEQ ID NO: 1225642 - protein, 9 aa, Homo Sapiens
SEPLPKSPA

SEQ ID NO: 1225643 - protein, 9 aa, Homo Sapiens
HVLSQESSE

SEQ ID NO: 1225644 - protein, 9 aa, Homo Sapiens
QLLSQGVIA

SEQ ID NO: 1225645 - protein, 9 aa, Homo Sapiens
FLNRLVQPR

SEQ ID NO: 1225646 - protein, 9 aa, Homo Sapiens
ISLSSLYES

SEQ ID NO: 1225647 - protein, 9 aa, Homo Sapiens
SKFNFTCLE

SEQ ID NO: 1225648 - protein, 9 aa, Homo Sapiens
QIYVLQVLT

SEQ ID NO: 1225649 - protein, 9 aa, Homo Sapiens
TFLYNFDNP

SEQ ID NO: 1225650 - protein, 9 aa, Homo Sapiens
LRRQKQESL

SEQ ID NO: 1225651 - protein, 9 aa, Homo Sapiens
PHHISVKNH

SEQ ID NO: 1225652 - protein, 9 aa, Homo Sapiens
MTKALGTCG

SEQ ID NO: 1225653 - protein, 9 aa, Homo Sapiens
QGCLRALFM

SEQ ID NO: 1225654 - protein, 9 aa, Homo Sapiens
SNAETFAEK

SEQ ID NO: 1225655 - protein, 9 aa, Homo Sapiens
NVDSLNNPQ

SEQ ID NO: 1225656 - protein, 9 aa, Homo Sapiens
MADGMGGIW

SEQ ID NO: 1225657 - protein, 9 aa, Homo Sapiens
PLFQPMDHQ

SEQ ID NO: 1225658 - protein, 9 aa, Homo Sapiens
SEMNKLMMD

SEQ ID NO: 1225659 - protein, 9 aa, Homo Sapiens
KTTKRKCGY

SEQ ID NO: 1225660 - protein, 9 aa, Homo Sapiens
HTPANYLIT

SEQ ID NO: 1225661 - protein, 9 aa, Homo Sapiens
GDLVIQQKL

SEQ ID NO: 1225662 - protein, 9 aa, Homo Sapiens
ILLVALWVA

SEQ ID NO: 1225663 - protein, 9 aa, Homo Sapiens
AGMAPVGPV

SEQ ID NO: 1225664 - protein, 9 aa, Homo Sapiens
WLAAAQADM

SEQ ID NO: 1225665 - protein, 9 aa, Homo Sapiens
AELKDEKWK

SEQ ID NO: 1225666 - protein, 9 aa, Homo Sapiens
RHAPPGSCC

SEQ ID NO: 1225667 - protein, 9 aa, Homo Sapiens
SFDICYLFF

SEQ ID NO: 1225668 - protein, 9 aa, Homo Sapiens
CNSPQPWSL

SEQ ID NO: 1225669 - protein, 9 aa, Homo Sapiens
IPNRVIGLS

SEQ ID NO: 1225670 - protein, 9 aa, Homo Sapiens
MILFFKGIP

SEQ ID NO: 1225671 - protein, 9 aa, Homo Sapiens
PADLPHSSG

SEQ ID NO: 1225672 - protein, 9 aa, Homo Sapiens
LPPHMAIQQ

SEQ ID NO: 1225673 - protein, 9 aa, Homo Sapiens
RDGMIIDNG

SEQ ID NO: 1225674 - protein, 9 aa, Homo Sapiens
RGQEQRSAQ

SEQ ID NO: 1225675 - protein, 9 aa, Homo Sapiens
GSSKGVSAQ

SEQ ID NO: 1225676 - protein, 9 aa, Homo Sapiens
LGKGDDHKY

SEQ ID NO: 1225677 - protein, 9 aa, Homo Sapiens
FDRPTYLWL

SEQ ID NO: 1225678 - protein, 9 aa, Homo Sapiens
RYRKSWRCC

SEQ ID NO: 1225679 - protein, 9 aa, Homo Sapiens
VPVPPPVDI

SEQ ID NO: 1225680 - protein, 9 aa, Homo Sapiens
NPRSWLERD

SEQ ID NO: 1225681 - protein, 9 aa, Homo Sapiens
HVVQKKSRL

SEQ ID NO: 1225682 - protein, 9 aa, Homo Sapiens
MAFNYLSVS

SEQ ID NO: 1225683 - protein, 9 aa, Homo Sapiens
VCILHPELT

SEQ ID NO: 1225684 - protein, 9 aa, Homo Sapiens
ICMEFCGEG

SEQ ID NO: 1225685 - protein, 9 aa, Homo Sapiens
RTYSIGRIF

SEQ ID NO: 1225686 - protein, 9 aa, Homo Sapiens
MKDIYHYIT

SEQ ID NO: 1225687 - protein, 9 aa, Homo Sapiens
LRSPSRDKV

SEQ ID NO: 1225688 - protein, 9 aa, Homo Sapiens
SKQKEYEEN

SEQ ID NO: 1225689 - protein, 9 aa, Homo Sapiens
HMWMVHIDE

SEQ ID NO: 1225690 - protein, 9 aa, Homo Sapiens
TMEKPPKFT

SEQ ID NO: 1225691 - protein, 9 aa, Homo Sapiens
HAIYFVMLL

SEQ ID NO: 1225692 - protein, 9 aa, Homo Sapiens
APTFSGIVG

SEQ ID NO: 1225693 - protein, 9 aa, Homo Sapiens
YMLNLAISD

SEQ ID NO: 1225694 - protein, 9 aa, Homo Sapiens
GQCAGAWGL

SEQ ID NO: 1225695 - protein, 9 aa, Homo Sapiens
KSDHGHRFT

SEQ ID NO: 1225696 - protein, 9 aa, Homo Sapiens
PQTGPQFCQ

SEQ ID NO: 1225697 - protein, 9 aa, Homo Sapiens
ADYLKRYLS

SEQ ID NO: 1225698 - protein, 9 aa, Homo Sapiens
VQVGKEQHP

SEQ ID NO: 1225699 - protein, 9 aa, Homo Sapiens
SHSTTPSWC

SEQ ID NO: 1225700 - protein, 9 aa, Homo Sapiens
MPPLPSEGP

SEQ ID NO: 1225701 - protein, 9 aa, Homo Sapiens
SLVIPFDPK

SEQ ID NO: 1225702 - protein, 9 aa, Homo Sapiens
KVIPVAAFQ

SEQ ID NO: 1225703 - protein, 9 aa, Homo Sapiens
CKKDKLHLL

SEQ ID NO: 1225704 - protein, 9 aa, Homo Sapiens
AEKDQRLKK

SEQ ID NO: 1225705 - protein, 9 aa, Homo Sapiens
LPPSKASKP

SEQ ID NO: 1225706 - protein, 9 aa, Homo Sapiens
GQKPLICWD

SEQ ID NO: 1225707 - protein, 9 aa, Homo Sapiens
GSRLACGAI

SEQ ID NO: 1225708 - protein, 9 aa, Homo Sapiens
DGQERCVLV

SEQ ID NO: 1225709 - protein, 9 aa, Homo Sapiens
EGGFNKWNA

SEQ ID NO: 1225710 - protein, 9 aa, Homo Sapiens
VKTVFFPSA

SEQ ID NO: 1225711 - protein, 9 aa, Homo Sapiens
WSTKISLIK

SEQ ID NO: 1225712 - protein, 9 aa, Homo Sapiens
VRSLYQVIA

SEQ ID NO: 1225713 - protein, 9 aa, Homo Sapiens
QRCNYAHAL

SEQ ID NO: 1225714 - protein, 9 aa, Homo Sapiens
AISVDPIAG

SEQ ID NO: 1225715 - protein, 9 aa, Homo Sapiens
HMCPECKHC

SEQ ID NO: 1225716 - protein, 9 aa, Homo Sapiens
VFTLGNMNN

SEQ ID NO: 1225717 - protein, 9 aa, Homo Sapiens
SQHPDYGQR

SEQ ID NO: 1225718 - protein, 9 aa, Homo Sapiens
FCHSDEHFR

SEQ ID NO: 1225719 - protein, 9 aa, Homo Sapiens
LLPLWPLML

SEQ ID NO: 1225720 - protein, 9 aa, Homo Sapiens
SEDSVTVDV

SEQ ID NO: 1225721 - protein, 9 aa, Homo Sapiens
IGNKGEDQI

SEQ ID NO: 1225722 - protein, 9 aa, Homo Sapiens
KQKWDADEE

SEQ ID NO: 1225723 - protein, 9 aa, Homo Sapiens
LHILHSLGW

SEQ ID NO: 1225724 - protein, 9 aa, Homo Sapiens
NVANGFITL

SEQ ID NO: 1225725 - protein, 9 aa, Homo Sapiens
GIASVVKEL

SEQ ID NO: 1225726 - protein, 9 aa, Homo Sapiens
PASAPAPIS

SEQ ID NO: 1225727 - protein, 9 aa, Homo Sapiens
ICTNRTCLI

SEQ ID NO: 1225728 - protein, 9 aa, Homo Sapiens
MTLPGMHPP

SEQ ID NO: 1225729 - protein, 9 aa, Homo Sapiens
SLRSRRFSS

SEQ ID NO: 1225730 - protein, 9 aa, Homo Sapiens
LKEIVEHVF

SEQ ID NO: 1225731 - protein, 9 aa, Homo Sapiens
LGVHINIAI

SEQ ID NO: 1225732 - protein, 9 aa, Homo Sapiens
KPLPSPKHS

SEQ ID NO: 1225733 - protein, 9 aa, Homo Sapiens
KKYLQASGI

SEQ ID NO: 1225734 - protein, 9 aa, Homo Sapiens
MKKSEADKC

SEQ ID NO: 1225735 - protein, 9 aa, Homo Sapiens
EAGDERMLV

SEQ ID NO: 1225736 - protein, 9 aa, Homo Sapiens
YHKAHLTRC

SEQ ID NO: 1225737 - protein, 9 aa, Homo Sapiens
GGESPHLSP

SEQ ID NO: 1225738 - protein, 9 aa, Homo Sapiens
AEGERQAAL

SEQ ID NO: 1225739 - protein, 9 aa, Homo Sapiens
ATLIYYFVF

SEQ ID NO: 1225740 - protein, 9 aa, Homo Sapiens
SVQGKAGKG

SEQ ID NO: 1225741 - protein, 9 aa, Homo Sapiens
KLMEHERLN

SEQ ID NO: 1225742 - protein, 9 aa, Homo Sapiens
PPASSVMTH

SEQ ID NO: 1225743 - protein, 9 aa, Homo Sapiens
PPQCLSPTV

SEQ ID NO: 1225744 - protein, 9 aa, Homo Sapiens
SSALKNSRK

SEQ ID NO: 1225745 - protein, 9 aa, Homo Sapiens
REDRMTEKL

SEQ ID NO: 1225746 - protein, 9 aa, Homo Sapiens
ELLCLCRSS

SEQ ID NO: 1225747 - protein, 9 aa, Homo Sapiens
TLIWCLFFL

SEQ ID NO: 1225748 - protein, 9 aa, Homo Sapiens
EQVMIGPSP

SEQ ID NO: 1225749 - protein, 9 aa, Homo Sapiens
TCKAHDGDF

SEQ ID NO: 1225750 - protein, 9 aa, Homo Sapiens
HPQDPQGPN

SEQ ID NO: 1225751 - protein, 9 aa, Homo Sapiens
WDFFINMSA

SEQ ID NO: 1225752 - protein, 9 aa, Homo Sapiens
FYDNCRCLR

SEQ ID NO: 1225753 - protein, 9 aa, Homo Sapiens
IAKQSLQPF

SEQ ID NO: 1225754 - protein, 9 aa, Homo Sapiens
WLPQQIRKA

SEQ ID NO: 1225755 - protein, 9 aa, Homo Sapiens
SEGQSKHCK

SEQ ID NO: 1225756 - protein, 9 aa, Homo Sapiens
IMKLSGIQH

SEQ ID NO: 1225757 - protein, 9 aa, Homo Sapiens
FSRDGGSPC

SEQ ID NO: 1225758 - protein, 9 aa, Homo Sapiens
KAFLLRMRR

SEQ ID NO: 1225759 - protein, 9 aa, Homo Sapiens
RHRKVCENP

SEQ ID NO: 1225760 - protein, 9 aa, Homo Sapiens
SRVPGTTRP

SEQ ID NO: 1225761 - protein, 9 aa, Homo Sapiens
TVHHKIHTG

SEQ ID NO: 1225762 - protein, 9 aa, Homo Sapiens
YEAKVCMVY

SEQ ID NO: 1225763 - protein, 9 aa, Homo Sapiens
RRFSSLYSF

SEQ ID NO: 1225764 - protein, 9 aa, Homo Sapiens
LGGVGMHLA

SEQ ID NO: 1225765 - protein, 9 aa, Homo Sapiens
KNLRTMEQQ

SEQ ID NO: 1225766 - protein, 9 aa, Homo Sapiens
QLGLHTQTM

SEQ ID NO: 1225767 - protein, 9 aa, Homo Sapiens
ISLSINRYD

SEQ ID NO: 1225768 - protein, 9 aa, Homo Sapiens
TETHQGFPT

SEQ ID NO: 1225769 - protein, 9 aa, Homo Sapiens
VSKSKVPHL

SEQ ID NO: 1225770 - protein, 9 aa, Homo Sapiens
SVSPESLKP

SEQ ID NO: 1225771 - protein, 9 aa, Homo Sapiens
KNVEYVVRN

SEQ ID NO: 1225772 - protein, 9 aa, Homo Sapiens
GGNCVEKHN

SEQ ID NO: 1225773 - protein, 9 aa, Homo Sapiens
KDQFVIQFT

SEQ ID NO: 1225774 - protein, 9 aa, Homo Sapiens
LHSSGVALS

SEQ ID NO: 1225775 - protein, 9 aa, Homo Sapiens
AEAAPLTLK

SEQ ID NO: 1225776 - protein, 9 aa, Homo Sapiens
DVGPNEQPG

SEQ ID NO: 1225777 - protein, 9 aa, Homo Sapiens
IFGISITGG

SEQ ID NO: 1225778 - protein, 9 aa, Homo Sapiens
TLTNIDSDK

SEQ ID NO: 1225779 - protein, 9 aa, Homo Sapiens
QEIQRKNNN

SEQ ID NO: 1225780 - protein, 9 aa, Homo Sapiens
SMESFPSLA

SEQ ID NO: 1225781 - protein, 9 aa, Homo Sapiens
SSGILVSLT

SEQ ID NO: 1225782 - protein, 9 aa, Homo Sapiens
VVVFAALLL

SEQ ID NO: 1225783 - protein, 9 aa, Homo Sapiens
VHELGHALR

SEQ ID NO: 1225784 - protein, 9 aa, Homo Sapiens
LLRLNQLKF

SEQ ID NO: 1225785 - protein, 9 aa, Homo Sapiens
EKELKVLCI

SEQ ID NO: 1225786 - protein, 9 aa, Homo Sapiens
MRLFPQAAR

SEQ ID NO: 1225787 - protein, 9 aa, Homo Sapiens
EKEPAKEWN

SEQ ID NO: 1225788 - protein, 9 aa, Homo Sapiens
RTSLASLCS

SEQ ID NO: 1225789 - protein, 9 aa, Homo Sapiens
SQEECIEFY

SEQ ID NO: 1225790 - protein, 9 aa, Homo Sapiens
TWMTCTSLS

SEQ ID NO: 1225791 - protein, 9 aa, Homo Sapiens
LTSLVEGED

SEQ ID NO: 1225792 - protein, 9 aa, Homo Sapiens
NQKRELDIQ

SEQ ID NO: 1225793 - protein, 9 aa, Homo Sapiens
GSLDLVCQC

SEQ ID NO: 1225794 - protein, 9 aa, Homo Sapiens
RPQRGPRPL

SEQ ID NO: 1225795 - protein, 9 aa, Homo Sapiens
EVQVQSLKE

SEQ ID NO: 1225796 - protein, 9 aa, Homo Sapiens
KQADVHAAV

SEQ ID NO: 1225797 - protein, 9 aa, Homo Sapiens
YRCLRGGQA

SEQ ID NO: 1225798 - protein, 9 aa, Homo Sapiens
ISLNITSLG

SEQ ID NO: 1225799 - protein, 9 aa, Homo Sapiens
LKEMGKEET

SEQ ID NO: 1225800 - protein, 9 aa, Homo Sapiens
DLPKRLPLE

SEQ ID NO: 1225801 - protein, 9 aa, Homo Sapiens
LKCMVIILL

SEQ ID NO: 1225802 - protein, 9 aa, Homo Sapiens
VFKVLHDKQ

SEQ ID NO: 1225803 - protein, 9 aa, Homo Sapiens
LFFPRRFVL

SEQ ID NO: 1225804 - protein, 9 aa, Homo Sapiens
AKSKLAVSR

SEQ ID NO: 1225805 - protein, 9 aa, Homo Sapiens
TLPPVPLHL

SEQ ID NO: 1225806 - protein, 9 aa, Homo Sapiens
PPRLQVLVS

SEQ ID NO: 1225807 - protein, 9 aa, Homo Sapiens
LREARTIKS

SEQ ID NO: 1225808 - protein, 9 aa, Homo Sapiens
GMAASLAIL

SEQ ID NO: 1225809 - protein, 9 aa, Homo Sapiens
KHEAATCLE

SEQ ID NO: 1225810 - protein, 9 aa, Homo Sapiens
PPLPPALGS

SEQ ID NO: 1225811 - protein, 9 aa, Homo Sapiens
IFTLSVTML

SEQ ID NO: 1225812 - protein, 9 aa, Homo Sapiens
LSYMAEMRN

SEQ ID NO: 1225813 - protein, 9 aa, Homo Sapiens
MKEDQGEEE

SEQ ID NO: 1225814 - protein, 9 aa, Homo Sapiens
LGSQLIAMQ

SEQ ID NO: 1225815 - protein, 9 aa, Homo Sapiens
QISVMRYSP

SEQ ID NO: 1225816 - protein, 9 aa, Homo Sapiens
LDVASIISF

SEQ ID NO: 1225817 - protein, 9 aa, Homo Sapiens
LLSTLPKYI

SEQ ID NO: 1225818 - protein, 9 aa, Homo Sapiens
TFQFCFLRF

SEQ ID NO: 1225819 - protein, 9 aa, Homo Sapiens
GFPTKVTFV

SEQ ID NO: 1225820 - protein, 9 aa, Homo Sapiens
REQASSYSH

SEQ ID NO: 1225821 - protein, 9 aa, Homo Sapiens
SDVRYKMPS

SEQ ID NO: 1225822 - protein, 9 aa, Homo Sapiens
THKKLTACM

SEQ ID NO: 1225823 - protein, 9 aa, Homo Sapiens
LRVVHILFA

SEQ ID NO: 1225824 - protein, 9 aa, Homo Sapiens
FVDVVAELA

SEQ ID NO: 1225825 - protein, 9 aa, Homo Sapiens
KKQALSDRQ

SEQ ID NO: 1225826 - protein, 9 aa, Homo Sapiens
VGIRARLRP

SEQ ID NO: 1225827 - protein, 9 aa, Homo Sapiens
GIHYETSRK

SEQ ID NO: 1225828 - protein, 9 aa, Homo Sapiens
SQIKQMLSD

SEQ ID NO: 1225829 - protein, 9 aa, Homo Sapiens
KNDSVDAQN

SEQ ID NO: 1225830 - protein, 9 aa, Homo Sapiens
VNALRDDPS

SEQ ID NO: 1225831 - protein, 9 aa, Homo Sapiens
AAERERNQE

SEQ ID NO: 1225832 - protein, 9 aa, Homo Sapiens
DRSNSLYWY

SEQ ID NO: 1225833 - protein, 9 aa, Homo Sapiens
GTEAMLVFK

SEQ ID NO: 1225834 - protein, 9 aa, Homo Sapiens
GNISGCKHV

SEQ ID NO: 1225835 - protein, 9 aa, Homo Sapiens
GDQSMHREL

SEQ ID NO: 1225836 - protein, 9 aa, Homo Sapiens
MQLHMGITP

SEQ ID NO: 1225837 - protein, 9 aa, Homo Sapiens
TESPPPLPA

SEQ ID NO: 1225838 - protein, 9 aa, Homo Sapiens
NWLQSLPAS

SEQ ID NO: 1225839 - protein, 9 aa, Homo Sapiens
AQKLLYCDV

SEQ ID NO: 1225840 - protein, 9 aa, Homo Sapiens
IIFPLFMKS

SEQ ID NO: 1225841 - protein, 9 aa, Homo Sapiens
SSFMYSKAT

SEQ ID NO: 1225842 - protein, 9 aa, Homo Sapiens
DMKSEEITA

SEQ ID NO: 1225843 - protein, 9 aa, Homo Sapiens
MRLLKCMVI

SEQ ID NO: 1225844 - protein, 9 aa, Homo Sapiens
NPDLEPILR

SEQ ID NO: 1225845 - protein, 9 aa, Homo Sapiens
KLKTSIDSL

SEQ ID NO: 1225846 - protein, 9 aa, Homo Sapiens
ILEQLESQF

SEQ ID NO: 1225847 - protein, 9 aa, Homo Sapiens
QGLPLYIRL

SEQ ID NO: 1225848 - protein, 9 aa, Homo Sapiens
HPSCGSTCG

SEQ ID NO: 1225849 - protein, 9 aa, Homo Sapiens
GVDGAEKRK

SEQ ID NO: 1225850 - protein, 9 aa, Homo Sapiens
MSAAGRASP

SEQ ID NO: 1225851 - protein, 9 aa, Homo Sapiens
KGLENPPGP

SEQ ID NO: 1225852 - protein, 9 aa, Homo Sapiens
GLGDAVGGH

SEQ ID NO: 1225853 - protein, 9 aa, Homo Sapiens
LAFAAVNMW

SEQ ID NO: 1225854 - protein, 9 aa, Homo Sapiens
CAAAPQWCG

SEQ ID NO: 1225855 - protein, 9 aa, Homo Sapiens
VTTIQDWSL

SEQ ID NO: 1225856 - protein, 9 aa, Homo Sapiens
LIVELADHD

SEQ ID NO: 1225857 - protein, 9 aa, Homo Sapiens
FALTILLVA

SEQ ID NO: 1225858 - protein, 9 aa, Homo Sapiens
QCLLNQELL

SEQ ID NO: 1225859 - protein, 9 aa, Homo Sapiens
QDMQREWRI

SEQ ID NO: 1225860 - protein, 9 aa, Homo Sapiens
GHAQAVLQQ

SEQ ID NO: 1225861 - protein, 9 aa, Homo Sapiens
YSNMVFETG

SEQ ID NO: 1225862 - protein, 9 aa, Homo Sapiens
QCHHVYKTL

SEQ ID NO: 1225863 - protein, 9 aa, Homo Sapiens
QELTETADQ

SEQ ID NO: 1225864 - protein, 9 aa, Homo Sapiens
MRDKVLQLQ

SEQ ID NO: 1225865 - protein, 9 aa, Homo Sapiens
TLTQSPHRQ

SEQ ID NO: 1225866 - protein, 9 aa, Homo Sapiens
VLPNNKCIY

SEQ ID NO: 1225867 - protein, 9 aa, Homo Sapiens
GDPRPRGNQ

SEQ ID NO: 1225868 - protein, 9 aa, Homo Sapiens
KDLGEDRTI

SEQ ID NO: 1225869 - protein, 9 aa, Homo Sapiens
FSTCTTHFC

SEQ ID NO: 1225870 - protein, 9 aa, Homo Sapiens
MRVTGVIIQ

SEQ ID NO: 1225871 - protein, 9 aa, Homo Sapiens
EELIHTIKG

SEQ ID NO: 1225872 - protein, 9 aa, Homo Sapiens
RKSHAGENS

SEQ ID NO: 1225873 - protein, 9 aa, Homo Sapiens
YPVPGYCVP

SEQ ID NO: 1225874 - protein, 9 aa, Homo Sapiens
EEHSLSAPG

SEQ ID NO: 1225875 - protein, 9 aa, Homo Sapiens
SSSINVVAW

SEQ ID NO: 1225876 - protein, 9 aa, Homo Sapiens
FSLRSYLPD

SEQ ID NO: 1225877 - protein, 9 aa, Homo Sapiens
RNSISAFMF

SEQ ID NO: 1225878 - protein, 9 aa, Homo Sapiens
TQNAWSRSD

SEQ ID NO: 1225879 - protein, 9 aa, Homo Sapiens
DLSVSVEES

SEQ ID NO: 1225880 - protein, 9 aa, Homo Sapiens
KVSEVGREG

SEQ ID NO: 1225881 - protein, 9 aa, Homo Sapiens
EEGSSGNSG

SEQ ID NO: 1225882 - protein, 9 aa, Homo Sapiens
PETLTAFDL

SEQ ID NO: 1225883 - protein, 9 aa, Homo Sapiens
RAAGKCPAE

SEQ ID NO: 1225884 - protein, 9 aa, Homo Sapiens
AACETPGRG

SEQ ID NO: 1225885 - protein, 9 aa, Homo Sapiens
AGIVAARRC

SEQ ID NO: 1225886 - protein, 9 aa, Homo Sapiens
PSETNHWRC

SEQ ID NO: 1225887 - protein, 9 aa, Homo Sapiens
NAGVRGKFE

SEQ ID NO: 1225888 - protein, 9 aa, Homo Sapiens
IRVVLCELG

SEQ ID NO: 1225889 - protein, 9 aa, Homo Sapiens
SLVIFGPVL

SEQ ID NO: 1225890 - protein, 9 aa, Homo Sapiens
GPFVHIANM

SEQ ID NO: 1225891 - protein, 9 aa, Homo Sapiens
CECCLPFFQ

SEQ ID NO: 1225892 - protein, 9 aa, Homo Sapiens
AVAVENGTV

SEQ ID NO: 1225893 - protein, 9 aa, Homo Sapiens
GVYDGKIKV

SEQ ID NO: 1225894 - protein, 9 aa, Homo Sapiens
ARSSPAYYT

SEQ ID NO: 1225895 - protein, 9 aa, Homo Sapiens
CRGWLTINN

SEQ ID NO: 1225896 - protein, 9 aa, Homo Sapiens
YMQAGNKLK

SEQ ID NO: 1225897 - protein, 9 aa, Homo Sapiens
VLFLNDLRA

SEQ ID NO: 1225898 - protein, 9 aa, Homo Sapiens
GMFAYIFHD

SEQ ID NO: 1225899 - protein, 9 aa, Homo Sapiens
HLVAFFVFG

SEQ ID NO: 1225900 - protein, 9 aa, Homo Sapiens
LTQKTQTQL

SEQ ID NO: 1225901 - protein, 9 aa, Homo Sapiens
GSAVNLHPQ

SEQ ID NO: 1225902 - protein, 9 aa, Homo Sapiens
PIPLEQHPD

SEQ ID NO: 1225903 - protein, 9 aa, Homo Sapiens
EDKPCIIIK

SEQ ID NO: 1225904 - protein, 9 aa, Homo Sapiens
TVPTFMPLA

SEQ ID NO: 1225905 - protein, 9 aa, Homo Sapiens
PLCPSGRRC

SEQ ID NO: 1225906 - protein, 9 aa, Homo Sapiens
KDSPLILQS

SEQ ID NO: 1225907 - protein, 9 aa, Homo Sapiens
KSSRWPTML

SEQ ID NO: 1225908 - protein, 9 aa, Homo Sapiens
TSNMPISSH

SEQ ID NO: 1225909 - protein, 9 aa, Homo Sapiens
NLAKTHLGD

SEQ ID NO: 1225910 - protein, 9 aa, Homo Sapiens
EEEDAVPEM

SEQ ID NO: 1225911 - protein, 9 aa, Homo Sapiens
RLLHQSIIW

SEQ ID NO: 1225912 - protein, 9 aa, Homo Sapiens
TYLVDFIIS

SEQ ID NO: 1225913 - protein, 9 aa, Homo Sapiens
MLDVDTRRT

SEQ ID NO: 1225914 - protein, 9 aa, Homo Sapiens
EEKMILSFL

SEQ ID NO: 1225915 - protein, 9 aa, Homo Sapiens
DLGHAPMGP

SEQ ID NO: 1225916 - protein, 9 aa, Homo Sapiens
PGFVEQAED

SEQ ID NO: 1225917 - protein, 9 aa, Homo Sapiens
PNTIIHGIK

SEQ ID NO: 1225918 - protein, 9 aa, Homo Sapiens
LQIYKVWFY

SEQ ID NO: 1225919 - protein, 9 aa, Homo Sapiens
CGVGADRSY

SEQ ID NO: 1225920 - protein, 9 aa, Homo Sapiens
SGEITMCEP

SEQ ID NO: 1225921 - protein, 9 aa, Homo Sapiens
LIEPCKYTG

SEQ ID NO: 1225922 - protein, 9 aa, Homo Sapiens
SDPSCWVRQ

SEQ ID NO: 1225923 - protein, 9 aa, Homo Sapiens
EIAKYHKLK

SEQ ID NO: 1225924 - protein, 9 aa, Homo Sapiens
QELGLRIGC

SEQ ID NO: 1225925 - protein, 9 aa, Homo Sapiens
LPTGFDDME

SEQ ID NO: 1225926 - protein, 9 aa, Homo Sapiens
AELIYIIRQ

SEQ ID NO: 1225927 - protein, 9 aa, Homo Sapiens
KHLSRQDAA

SEQ ID NO: 1225928 - protein, 9 aa, Homo Sapiens
DAWVWDNIY

SEQ ID NO: 1225929 - protein, 9 aa, Homo Sapiens
ARDLNAVKY

SEQ ID NO: 1225930 - protein, 9 aa, Homo Sapiens
LPHRHLSEK

SEQ ID NO: 1225931 - protein, 9 aa, Homo Sapiens
CGAAGAREA

SEQ ID NO: 1225932 - protein, 9 aa, Homo Sapiens
CPPEEKDTK

SEQ ID NO: 1225933 - protein, 9 aa, Homo Sapiens
SASSPRGTV

SEQ ID NO: 1225934 - protein, 9 aa, Homo Sapiens
SSQYWISVC

SEQ ID NO: 1225935 - protein, 9 aa, Homo Sapiens
VDSDVAVEC

SEQ ID NO: 1225936 - protein, 9 aa, Homo Sapiens
GVVHRRAAA

SEQ ID NO: 1225937 - protein, 9 aa, Homo Sapiens
SREIKTAVR

SEQ ID NO: 1225938 - protein, 9 aa, Homo Sapiens
EEEGIQGHP

SEQ ID NO: 1225939 - protein, 9 aa, Homo Sapiens
EQTGLEAYS

SEQ ID NO: 1225940 - protein, 9 aa, Homo Sapiens
QSKNALFET

SEQ ID NO: 1225941 - protein, 9 aa, Homo Sapiens
KNLPVNVCW

SEQ ID NO: 1225942 - protein, 9 aa, Homo Sapiens
SFGMAQKRI

SEQ ID NO: 1225943 - protein, 9 aa, Homo Sapiens
VELKHPLSL

SEQ ID NO: 1225944 - protein, 9 aa, Homo Sapiens
TDRVKKTAL

SEQ ID NO: 1225945 - protein, 9 aa, Homo Sapiens
DGHAKKMRQ

SEQ ID NO: 1225946 - protein, 9 aa, Homo Sapiens
DPIPGDKPL

SEQ ID NO: 1225947 - protein, 9 aa, Homo Sapiens
ASGQRPIFC

SEQ ID NO: 1225948 - protein, 9 aa, Homo Sapiens
IAGVVYKDV

SEQ ID NO: 1225949 - protein, 9 aa, Homo Sapiens
KTVFFPSAS

SEQ ID NO: 1225950 - protein, 9 aa, Homo Sapiens
HKRGDDDED

SEQ ID NO: 1225951 - protein, 9 aa, Homo Sapiens
FRWWRRRIC

SEQ ID NO: 1225952 - protein, 9 aa, Homo Sapiens
LGGRMDHMD

SEQ ID NO: 1225953 - protein, 9 aa, Homo Sapiens
APINVNAIK

SEQ ID NO: 1225954 - protein, 9 aa, Homo Sapiens
GRIAQELSF

SEQ ID NO: 1225955 - protein, 9 aa, Homo Sapiens
TTLSDDDTV

SEQ ID NO: 1225956 - protein, 9 aa, Homo Sapiens
TSPSELRDL

SEQ ID NO: 1225957 - protein, 9 aa, Homo Sapiens
LLLSPPLPP

SEQ ID NO: 1225958 - protein, 9 aa, Homo Sapiens
FLVQQNKML

SEQ ID NO: 1225959 - protein, 9 aa, Homo Sapiens
HIQEEIAKR

SEQ ID NO: 1225960 - protein, 9 aa, Homo Sapiens
SGGREYLRQ

SEQ ID NO: 1225961 - protein, 9 aa, Homo Sapiens
QAKAKDAGD

SEQ ID NO: 1225962 - protein, 9 aa, Homo Sapiens
QSPAEVDGS

SEQ ID NO: 1225963 - protein, 9 aa, Homo Sapiens
NGLSYQPNV

SEQ ID NO: 1225964 - protein, 9 aa, Homo Sapiens
SPVPVEALK

SEQ ID NO: 1225965 - protein, 9 aa, Homo Sapiens
SQLQKTHVM

SEQ ID NO: 1225966 - protein, 9 aa, Homo Sapiens
WERVEKPVP

SEQ ID NO: 1225967 - protein, 9 aa, Homo Sapiens
PRRIKYLME

SEQ ID NO: 1225968 - protein, 9 aa, Homo Sapiens
LELHKKYKE

SEQ ID NO: 1225969 - protein, 9 aa, Homo Sapiens
ILLEGYGMQ

SEQ ID NO: 1225970 - protein, 9 aa, Homo Sapiens
CRAEKRLKE

SEQ ID NO: 1225971 - protein, 9 aa, Homo Sapiens
DEYPQFQDA

SEQ ID NO: 1225972 - protein, 9 aa, Homo Sapiens
YSNTYCFRV

SEQ ID NO: 1225973 - protein, 9 aa, Homo Sapiens
APLTPVTQC

SEQ ID NO: 1225974 - protein, 9 aa, Homo Sapiens
LYLKCKLGM

SEQ ID NO: 1225975 - protein, 9 aa, Homo Sapiens
PLQTDVFVE

SEQ ID NO: 1225976 - protein, 9 aa, Homo Sapiens
LCRVAVCFL

SEQ ID NO: 1225977 - protein, 9 aa, Homo Sapiens
LTLACMDTW

SEQ ID NO: 1225978 - protein, 9 aa, Homo Sapiens
TKDLEMRVI

SEQ ID NO: 1225979 - protein, 9 aa, Homo Sapiens
TRGKGVGTP

SEQ ID NO: 1225980 - protein, 9 aa, Homo Sapiens
KSIHSITDF

SEQ ID NO: 1225981 - protein, 9 aa, Homo Sapiens
AEIVIHIHN

SEQ ID NO: 1225982 - protein, 9 aa, Homo Sapiens
VLAIINHVS

SEQ ID NO: 1225983 - protein, 9 aa, Homo Sapiens
THTVVVMGG

SEQ ID NO: 1225984 - protein, 9 aa, Homo Sapiens
CASPSRPTA

SEQ ID NO: 1225985 - protein, 9 aa, Homo Sapiens
ETYGYKEDK

SEQ ID NO: 1225986 - protein, 9 aa, Homo Sapiens
HPTSASVAV

SEQ ID NO: 1225987 - protein, 9 aa, Homo Sapiens
AVQVPQCKL

SEQ ID NO: 1225988 - protein, 9 aa, Homo Sapiens
RGLASGDCS

SEQ ID NO: 1225989 - protein, 9 aa, Homo Sapiens
ESTTLDAQS

SEQ ID NO: 1225990 - protein, 9 aa, Homo Sapiens
AEPNKKGWL

SEQ ID NO: 1225991 - protein, 9 aa, Homo Sapiens
VFKRMDSAP

SEQ ID NO: 1225992 - protein, 9 aa, Homo Sapiens
TIKVSFSLQ

SEQ ID NO: 1225993 - protein, 9 aa, Homo Sapiens
KGCLLHTYV

SEQ ID NO: 1225994 - protein, 9 aa, Homo Sapiens
KVLPQTILH

SEQ ID NO: 1225995 - protein, 9 aa, Homo Sapiens
TKDSSANWD

SEQ ID NO: 1225996 - protein, 9 aa, Homo Sapiens
STSSPYASK

SEQ ID NO: 1225997 - protein, 9 aa, Homo Sapiens
GSNLTLAKL

SEQ ID NO: 1225998 - protein, 9 aa, Homo Sapiens
LLSRVQTQL

SEQ ID NO: 1225999 - protein, 9 aa, Homo Sapiens
GTSDDDAPC

SEQ ID NO: 1226000 - protein, 9 aa, Homo Sapiens
PPYLSSYLP

SEQ ID NO: 1226001 - protein, 9 aa, Homo Sapiens
LLHSMVVAQ

SEQ ID NO: 1226002 - protein, 9 aa, Homo Sapiens
MEMFQPSVV

SEQ ID NO: 1226003 - protein, 9 aa, Homo Sapiens
AANQAKQGY

SEQ ID NO: 1226004 - protein, 9 aa, Homo Sapiens
DDYYILAEP

SEQ ID NO: 1226005 - protein, 9 aa, Homo Sapiens
MHVIQVWFQ

SEQ ID NO: 1226006 - protein, 9 aa, Homo Sapiens
AGVDVQSAI

SEQ ID NO: 1226007 - protein, 9 aa, Homo Sapiens
TDNQEDSVI

SEQ ID NO: 1226008 - protein, 9 aa, Homo Sapiens
GFIVVFCPL

SEQ ID NO: 1226009 - protein, 9 aa, Homo Sapiens
RPTAVGTMA

SEQ ID NO: 1226010 - protein, 9 aa, Homo Sapiens
EADEEVQLH

SEQ ID NO: 1226011 - protein, 9 aa, Homo Sapiens
EKAKNDVVK

SEQ ID NO: 1226012 - protein, 9 aa, Homo Sapiens
HVILDPADP

SEQ ID NO: 1226013 - protein, 9 aa, Homo Sapiens
DVGLEIMTV

SEQ ID NO: 1226014 - protein, 9 aa, Homo Sapiens
QPSAPTGIG

SEQ ID NO: 1226015 - protein, 9 aa, Homo Sapiens
VGLDNGGKT

SEQ ID NO: 1226016 - protein, 9 aa, Homo Sapiens
YHIVRIPYI

SEQ ID NO: 1226017 - protein, 9 aa, Homo Sapiens
RPATYRLMA

SEQ ID NO: 1226018 - protein, 9 aa, Homo Sapiens
PQLLLLCHL

SEQ ID NO: 1226019 - protein, 9 aa, Homo Sapiens
EKISVCGRS

SEQ ID NO: 1226020 - protein, 9 aa, Homo Sapiens
INIRDILIQ

SEQ ID NO: 1226021 - protein, 9 aa, Homo Sapiens
DTQNALRRV

SEQ ID NO: 1226022 - protein, 9 aa, Homo Sapiens
DSCTRRNLG

SEQ ID NO: 1226023 - protein, 9 aa, Homo Sapiens
GKNFRIYKA

SEQ ID NO: 1226024 - protein, 9 aa, Homo Sapiens
HLTFLKRPE

SEQ ID NO: 1226025 - protein, 9 aa, Homo Sapiens
LSFKECNQD

SEQ ID NO: 1226026 - protein, 9 aa, Homo Sapiens
QNSRLARAV

SEQ ID NO: 1226027 - protein, 9 aa, Homo Sapiens
LSVMDVYDG

SEQ ID NO: 1226028 - protein, 9 aa, Homo Sapiens
LCFLVLTNL

SEQ ID NO: 1226029 - protein, 9 aa, Homo Sapiens
TQKMISETC

SEQ ID NO: 1226030 - protein, 9 aa, Homo Sapiens
PDSTSNLAR

SEQ ID NO: 1226031 - protein, 9 aa, Homo Sapiens
AKQGYLINS

SEQ ID NO: 1226032 - protein, 9 aa, Homo Sapiens
TPLPVSATS

SEQ ID NO: 1226033 - protein, 9 aa, Homo Sapiens
RDFHSDTLA

SEQ ID NO: 1226034 - protein, 9 aa, Homo Sapiens
EHLPSISIL

SEQ ID NO: 1226035 - protein, 9 aa, Homo Sapiens
AANLSHAAV

SEQ ID NO: 1226036 - protein, 9 aa, Homo Sapiens
SNQYTFCQP

SEQ ID NO: 1226037 - protein, 9 aa, Homo Sapiens
EHPDCAFMV

SEQ ID NO: 1226038 - protein, 9 aa, Homo Sapiens
EILEIAMDQ

SEQ ID NO: 1226039 - protein, 9 aa, Homo Sapiens
VMEGASARK

SEQ ID NO: 1226040 - protein, 9 aa, Homo Sapiens
PINVVKTCI

SEQ ID NO: 1226041 - protein, 9 aa, Homo Sapiens
MEHQQTGLS

SEQ ID NO: 1226042 - protein, 9 aa, Homo Sapiens
FKCPNCSLL

SEQ ID NO: 1226043 - protein, 9 aa, Homo Sapiens
ASISDQDMN

SEQ ID NO: 1226044 - protein, 9 aa, Homo Sapiens
CLTVVVVKA

SEQ ID NO: 1226045 - protein, 9 aa, Homo Sapiens
RMNKEYSIS

SEQ ID NO: 1226046 - protein, 9 aa, Homo Sapiens
PGNRCPGRY

SEQ ID NO: 1226047 - protein, 9 aa, Homo Sapiens
HTIHPSLLM

SEQ ID NO: 1226048 - protein, 9 aa, Homo Sapiens
RDQNKYKED

SEQ ID NO: 1226049 - protein, 9 aa, Homo Sapiens
QLNNIHITR

SEQ ID NO: 1226050 - protein, 9 aa, Homo Sapiens
LHTQTMSCL

SEQ ID NO: 1226051 - protein, 9 aa, Homo Sapiens
QVTMAVLLV

SEQ ID NO: 1226052 - protein, 9 aa, Homo Sapiens
DEVTKMNLL

SEQ ID NO: 1226053 - protein, 9 aa, Homo Sapiens
CANGITCTT

SEQ ID NO: 1226054 - protein, 9 aa, Homo Sapiens
ILVSSYLTA

SEQ ID NO: 1226055 - protein, 9 aa, Homo Sapiens
ADTRLSRRL

SEQ ID NO: 1226056 - protein, 9 aa, Homo Sapiens
IPNLCGVSK

SEQ ID NO: 1226057 - protein, 9 aa, Homo Sapiens
RAGESGTRD

SEQ ID NO: 1226058 - protein, 9 aa, Homo Sapiens
PQHPEEHGH

SEQ ID NO: 1226059 - protein, 9 aa, Homo Sapiens
HHITCIYDP

SEQ ID NO: 1226060 - protein, 9 aa, Homo Sapiens
IAVICLWNT

SEQ ID NO: 1226061 - protein, 9 aa, Homo Sapiens
PLEKVHYLQ

SEQ ID NO: 1226062 - protein, 9 aa, Homo Sapiens
AISLSSLYE

SEQ ID NO: 1226063 - protein, 9 aa, Homo Sapiens
NALERHVVQ

SEQ ID NO: 1226064 - protein, 9 aa, Homo Sapiens
RIGLERADT

SEQ ID NO: 1226065 - protein, 9 aa, Homo Sapiens
THEELLRAD

SEQ ID NO: 1226066 - protein, 9 aa, Homo Sapiens
GCDETLFGL

SEQ ID NO: 1226067 - protein, 9 aa, Homo Sapiens
GAKHNTSIL

SEQ ID NO: 1226068 - protein, 9 aa, Homo Sapiens
VRIARTFCF

SEQ ID NO: 1226069 - protein, 9 aa, Homo Sapiens
LASMVLSLE

SEQ ID NO: 1226070 - protein, 9 aa, Homo Sapiens
VQEVMQPVE

SEQ ID NO: 1226071 - protein, 9 aa, Homo Sapiens
DEVVPDQTD

SEQ ID NO: 1226072 - protein, 9 aa, Homo Sapiens
CYDELGNHY

SEQ ID NO: 1226073 - protein, 9 aa, Homo Sapiens
LSDMEGGGS

SEQ ID NO: 1226074 - protein, 9 aa, Homo Sapiens
CYKCIHQNL

SEQ ID NO: 1226075 - protein, 9 aa, Homo Sapiens
LLLLFLTQP

SEQ ID NO: 1226076 - protein, 9 aa, Homo Sapiens
GASTLVISL

SEQ ID NO: 1226077 - protein, 9 aa, Homo Sapiens
DLLKGTEAF

SEQ ID NO: 1226078 - protein, 9 aa, Homo Sapiens
NSLGRSPST

SEQ ID NO: 1226079 - protein, 9 aa, Homo Sapiens
SGTHSSREY

SEQ ID NO: 1226080 - protein, 9 aa, Homo Sapiens
HTLGSLPDI

SEQ ID NO: 1226081 - protein, 9 aa, Homo Sapiens
ADLKVKVRQ

SEQ ID NO: 1226082 - protein, 9 aa, Homo Sapiens
LETEAGYYR

SEQ ID NO: 1226083 - protein, 9 aa, Homo Sapiens
LACYTADIR

SEQ ID NO: 1226084 - protein, 9 aa, Homo Sapiens
IEFVADRLI

SEQ ID NO: 1226085 - protein, 9 aa, Homo Sapiens
RMDVGQQAV

SEQ ID NO: 1226086 - protein, 9 aa, Homo Sapiens
SWMLHNNGF

SEQ ID NO: 1226087 - protein, 9 aa, Homo Sapiens
CLPLLPALC

SEQ ID NO: 1226088 - protein, 9 aa, Homo Sapiens
KRGDDDEDT

SEQ ID NO: 1226089 - protein, 9 aa, Homo Sapiens
RFHHYPHLE

SEQ ID NO: 1226090 - protein, 9 aa, Homo Sapiens
NKTMNWAEN

SEQ ID NO: 1226091 - protein, 9 aa, Homo Sapiens
AIDGVNSIA

SEQ ID NO: 1226092 - protein, 9 aa, Homo Sapiens
GPRGGMRSR

SEQ ID NO: 1226093 - protein, 9 aa, Homo Sapiens
VVLTASING

SEQ ID NO: 1226094 - protein, 9 aa, Homo Sapiens
VVCMRRDTS

SEQ ID NO: 1226095 - protein, 9 aa, Homo Sapiens
CPPLLPLPQ

SEQ ID NO: 1226096 - protein, 9 aa, Homo Sapiens
NKPIITPSE

SEQ ID NO: 1226097 - protein, 9 aa, Homo Sapiens
TFPQSSLTM

SEQ ID NO: 1226098 - protein, 9 aa, Homo Sapiens
KNSLLDMEG

SEQ ID NO: 1226099 - protein, 9 aa, Homo Sapiens
CLGRKKTMA

SEQ ID NO: 1226100 - protein, 9 aa, Homo Sapiens
TSFHNNVYR

SEQ ID NO: 1226101 - protein, 9 aa, Homo Sapiens
MSFNSLVNM

SEQ ID NO: 1226102 - protein, 9 aa, Homo Sapiens
LDLYTTEQA

SEQ ID NO: 1226103 - protein, 9 aa, Homo Sapiens
SFFAICGPQ

SEQ ID NO: 1226104 - protein, 9 aa, Homo Sapiens
DVSFLPEEA

SEQ ID NO: 1226105 - protein, 9 aa, Homo Sapiens
SCCRTTPSW

SEQ ID NO: 1226106 - protein, 9 aa, Homo Sapiens
RMLLANARE

SEQ ID NO: 1226107 - protein, 9 aa, Homo Sapiens
YPHRVACKR

SEQ ID NO: 1226108 - protein, 9 aa, Homo Sapiens
HSLDLTLTH

SEQ ID NO: 1226109 - protein, 9 aa, Homo Sapiens
CVILLFYVT

SEQ ID NO: 1226110 - protein, 9 aa, Homo Sapiens
ASSSHSRSD

SEQ ID NO: 1226111 - protein, 9 aa, Homo Sapiens
QTRAIKDQL

SEQ ID NO: 1226112 - protein, 9 aa, Homo Sapiens
CPIKKGPVQ

SEQ ID NO: 1226113 - protein, 9 aa, Homo Sapiens
EVDINTLQE

SEQ ID NO: 1226114 - protein, 9 aa, Homo Sapiens
PKHTEAKKK

SEQ ID NO: 1226115 - protein, 9 aa, Homo Sapiens
RPDVVPAFH

SEQ ID NO: 1226116 - protein, 9 aa, Homo Sapiens
AHLVASFEK

SEQ ID NO: 1226117 - protein, 9 aa, Homo Sapiens
CTHSLCFNC

SEQ ID NO: 1226118 - protein, 9 aa, Homo Sapiens
WDYSMQRFR

SEQ ID NO: 1226119 - protein, 9 aa, Homo Sapiens
YHSPSNCCC

SEQ ID NO: 1226120 - protein, 9 aa, Homo Sapiens
VVCAPEDVT

SEQ ID NO: 1226121 - protein, 9 aa, Homo Sapiens
TVKESAIMP

SEQ ID NO: 1226122 - protein, 9 aa, Homo Sapiens
STTRVQTTR

SEQ ID NO: 1226123 - protein, 9 aa, Homo Sapiens
SFEGLKVHK

SEQ ID NO: 1226124 - protein, 9 aa, Homo Sapiens
DTSASFSTE

SEQ ID NO: 1226125 - protein, 9 aa, Homo Sapiens
NSRSTLVMD

SEQ ID NO: 1226126 - protein, 9 aa, Homo Sapiens
MGPRIIAPP

SEQ ID NO: 1226127 - protein, 9 aa, Homo Sapiens
ERSEALLLQ

SEQ ID NO: 1226128 - protein, 9 aa, Homo Sapiens
TQVGLESAI

SEQ ID NO: 1226129 - protein, 9 aa, Homo Sapiens
RYHIVKKTP

SEQ ID NO: 1226130 - protein, 9 aa, Homo Sapiens
KIHTGEKSN

SEQ ID NO: 1226131 - protein, 9 aa, Homo Sapiens
RSEGFPTLL

SEQ ID NO: 1226132 - protein, 9 aa, Homo Sapiens
CRMAAKLLA

SEQ ID NO: 1226133 - protein, 9 aa, Homo Sapiens
PHGAIPPAL

SEQ ID NO: 1226134 - protein, 9 aa, Homo Sapiens
IIKCVLRAN

SEQ ID NO: 1226135 - protein, 9 aa, Homo Sapiens
ITIITVDRH

SEQ ID NO: 1226136 - protein, 9 aa, Homo Sapiens
KLVHGSLEE

SEQ ID NO: 1226137 - protein, 9 aa, Homo Sapiens
KPNVFPKTN

SEQ ID NO: 1226138 - protein, 9 aa, Homo Sapiens
KGTWRHRRS

SEQ ID NO: 1226139 - protein, 9 aa, Homo Sapiens
VDERKTMIE

SEQ ID NO: 1226140 - protein, 9 aa, Homo Sapiens
MRISRISCL

SEQ ID NO: 1226141 - protein, 9 aa, Homo Sapiens
SNKTYDSFL

SEQ ID NO: 1226142 - protein, 9 aa, Homo Sapiens
HGPVKVREQ

SEQ ID NO: 1226143 - protein, 9 aa, Homo Sapiens
FVTAFFKWL

SEQ ID NO: 1226144 - protein, 9 aa, Homo Sapiens
PWLRMCPWE

SEQ ID NO: 1226145 - protein, 9 aa, Homo Sapiens
GGNGMDSDM

SEQ ID NO: 1226146 - protein, 9 aa, Homo Sapiens
ISDPIPGDK

SEQ ID NO: 1226147 - protein, 9 aa, Homo Sapiens
HMVENSSPR

SEQ ID NO: 1226148 - protein, 9 aa, Homo Sapiens
AERSLPGAV

SEQ ID NO: 1226149 - protein, 9 aa, Homo Sapiens
GKPPFLIQL

SEQ ID NO: 1226150 - protein, 9 aa, Homo Sapiens
IGKEDNKTL

SEQ ID NO: 1226151 - protein, 9 aa, Homo Sapiens
TFINLREVT

SEQ ID NO: 1226152 - protein, 9 aa, Homo Sapiens
GSHDFSFTP

SEQ ID NO: 1226153 - protein, 9 aa, Homo Sapiens
LRANTDPSV

SEQ ID NO: 1226154 - protein, 9 aa, Homo Sapiens
SLLLHAEPY

SEQ ID NO: 1226155 - protein, 9 aa, Homo Sapiens
KVNFDILER

SEQ ID NO: 1226156 - protein, 9 aa, Homo Sapiens
ESMEDDTNF

SEQ ID NO: 1226157 - protein, 9 aa, Homo Sapiens
NYLGYAITF

SEQ ID NO: 1226158 - protein, 9 aa, Homo Sapiens
CMIFNGSLG

SEQ ID NO: 1226159 - protein, 9 aa, Homo Sapiens
THRGEKSYE

SEQ ID NO: 1226160 - protein, 9 aa, Homo Sapiens
STPGTAIFI

SEQ ID NO: 1226161 - protein, 9 aa, Homo Sapiens
KSRHDMQTT

SEQ ID NO: 1226162 - protein, 9 aa, Homo Sapiens
QCCPGPRHW

SEQ ID NO: 1226163 - protein, 9 aa, Homo Sapiens
WYLEEERPF

SEQ ID NO: 1226164 - protein, 9 aa, Homo Sapiens
YKNTTKEVI

SEQ ID NO: 1226165 - protein, 9 aa, Homo Sapiens
GFGAATKVM

SEQ ID NO: 1226166 - protein, 9 aa, Homo Sapiens
KKSAFKKPI

SEQ ID NO: 1226167 - protein, 9 aa, Homo Sapiens
LLEDILHFN

SEQ ID NO: 1226168 - protein, 9 aa, Homo Sapiens
VRNPTVRLL

SEQ ID NO: 1226169 - protein, 9 aa, Homo Sapiens
IELLKHEKI

SEQ ID NO: 1226170 - protein, 9 aa, Homo Sapiens
DFDDKFDDE

SEQ ID NO: 1226171 - protein, 9 aa, Homo Sapiens
EDHCECQQC

SEQ ID NO: 1226172 - protein, 9 aa, Homo Sapiens
IDSFQDDVK

SEQ ID NO: 1226173 - protein, 9 aa, Homo Sapiens
ETHRKVVIL

SEQ ID NO: 1226174 - protein, 9 aa, Homo Sapiens
LGCCIKHYN

SEQ ID NO: 1226175 - protein, 9 aa, Homo Sapiens
SRIQNRRWQ

SEQ ID NO: 1226176 - protein, 9 aa, Homo Sapiens
AKGREEILR

SEQ ID NO: 1226177 - protein, 9 aa, Homo Sapiens
SLELGECEL

SEQ ID NO: 1226178 - protein, 9 aa, Homo Sapiens
TRVQVWFSN

SEQ ID NO: 1226179 - protein, 9 aa, Homo Sapiens
GGLRERPVC

SEQ ID NO: 1226180 - protein, 9 aa, Homo Sapiens
NAIKLQPRQ

SEQ ID NO: 1226181 - protein, 9 aa, Homo Sapiens
LLLSCIDDK

SEQ ID NO: 1226182 - protein, 9 aa, Homo Sapiens
HVSLRVLSE

SEQ ID NO: 1226183 - protein, 9 aa, Homo Sapiens
CKKEYQIFP

SEQ ID NO: 1226184 - protein, 9 aa, Homo Sapiens
PIFCPVHKQ

SEQ ID NO: 1226185 - protein, 9 aa, Homo Sapiens
FLPVLCLAC

SEQ ID NO: 1226186 - protein, 9 aa, Homo Sapiens
VFNEVQKAS

SEQ ID NO: 1226187 - protein, 9 aa, Homo Sapiens
LFLSLSRHD

SEQ ID NO: 1226188 - protein, 9 aa, Homo Sapiens
ATPAAGSLV

SEQ ID NO: 1226189 - protein, 9 aa, Homo Sapiens
VMDVYDGRE

SEQ ID NO: 1226190 - protein, 9 aa, Homo Sapiens
HAEFLPCHF

SEQ ID NO: 1226191 - protein, 9 aa, Homo Sapiens
IYGQFVAGE

SEQ ID NO: 1226192 - protein, 9 aa, Homo Sapiens
DHGRDQGRH

SEQ ID NO: 1226193 - protein, 9 aa, Homo Sapiens
MVSVKLSTL

SEQ ID NO: 1226194 - protein, 9 aa, Homo Sapiens
MCPWTAWSE

SEQ ID NO: 1226195 - protein, 9 aa, Homo Sapiens
LVVYMITLL

SEQ ID NO: 1226196 - protein, 9 aa, Homo Sapiens
KVLDKLYKR

SEQ ID NO: 1226197 - protein, 9 aa, Homo Sapiens
KFRQGYQAG

SEQ ID NO: 1226198 - protein, 9 aa, Homo Sapiens
MSFGVVLGV

SEQ ID NO: 1226199 - protein, 9 aa, Homo Sapiens
EAENQQMTI

SEQ ID NO: 1226200 - protein, 9 aa, Homo Sapiens
EICVLMLLY

SEQ ID NO: 1226201 - protein, 9 aa, Homo Sapiens
AHIQTSSQA

SEQ ID NO: 1226202 - protein, 9 aa, Homo Sapiens
IVIPGLNNS

SEQ ID NO: 1226203 - protein, 9 aa, Homo Sapiens
SKNVLQYRG

SEQ ID NO: 1226204 - protein, 9 aa, Homo Sapiens
DLIMKTCFI

SEQ ID NO: 1226205 - protein, 9 aa, Homo Sapiens
HRPRLFHRC

SEQ ID NO: 1226206 - protein, 9 aa, Homo Sapiens
QYVQEHIKP

SEQ ID NO: 1226207 - protein, 9 aa, Homo Sapiens
TQGTWEPSA

SEQ ID NO: 1226208 - protein, 9 aa, Homo Sapiens
CGMLREDAV

SEQ ID NO: 1226209 - protein, 9 aa, Homo Sapiens
TWVLYHNLH

SEQ ID NO: 1226210 - protein, 9 aa, Homo Sapiens
RSGNTSMWL

SEQ ID NO: 1226211 - protein, 9 aa, Homo Sapiens
TKPLSWAPP

SEQ ID NO: 1226212 - protein, 9 aa, Homo Sapiens
VSVGWLQIR

SEQ ID NO: 1226213 - protein, 9 aa, Homo Sapiens
EADAMTQDT

SEQ ID NO: 1226214 - protein, 9 aa, Homo Sapiens
HVTPGHFFA

SEQ ID NO: 1226215 - protein, 9 aa, Homo Sapiens
SSINVVAWS

SEQ ID NO: 1226216 - protein, 9 aa, Homo Sapiens
LYVLKLLLN

SEQ ID NO: 1226217 - protein, 9 aa, Homo Sapiens
YMYLQYPST

SEQ ID NO: 1226218 - protein, 9 aa, Homo Sapiens
AFMESLTLW

SEQ ID NO: 1226219 - protein, 9 aa, Homo Sapiens
HDAISSANP

SEQ ID NO: 1226220 - protein, 9 aa, Homo Sapiens
DLCALVFKV

SEQ ID NO: 1226221 - protein, 9 aa, Homo Sapiens
PGSQDHQCF

SEQ ID NO: 1226222 - protein, 9 aa, Homo Sapiens
WPVLQKWSL

SEQ ID NO: 1226223 - protein, 9 aa, Homo Sapiens
LLRRQLWAI

SEQ ID NO: 1226224 - protein, 9 aa, Homo Sapiens
CQQLIVSQG

SEQ ID NO: 1226225 - protein, 9 aa, Homo Sapiens
IMAVTLAML

SEQ ID NO: 1226226 - protein, 9 aa, Homo Sapiens
VMGAVNGMQ

SEQ ID NO: 1226227 - protein, 9 aa, Homo Sapiens
AHINVSWCF

SEQ ID NO: 1226228 - protein, 9 aa, Homo Sapiens
TGTLHIMDP

SEQ ID NO: 1226229 - protein, 9 aa, Homo Sapiens
QQHIHVYEN

SEQ ID NO: 1226230 - protein, 9 aa, Homo Sapiens
VPWSAGCWT

SEQ ID NO: 1226231 - protein, 9 aa, Homo Sapiens
SPVWDVRWD

SEQ ID NO: 1226232 - protein, 9 aa, Homo Sapiens
ADDALYRLG

SEQ ID NO: 1226233 - protein, 9 aa, Homo Sapiens
HSHFFEPGL

SEQ ID NO: 1226234 - protein, 9 aa, Homo Sapiens
CIQEIIEQL

SEQ ID NO: 1226235 - protein, 9 aa, Homo Sapiens
TNGPPCTST

SEQ ID NO: 1226236 - protein, 9 aa, Homo Sapiens
LQACEGRTS

SEQ ID NO: 1226237 - protein, 9 aa, Homo Sapiens
LHKKNFLLS

SEQ ID NO: 1226238 - protein, 9 aa, Homo Sapiens
LRLQFASDG

SEQ ID NO: 1226239 - protein, 9 aa, Homo Sapiens
RALRRLQSG

SEQ ID NO: 1226240 - protein, 9 aa, Homo Sapiens
NSLLNEENP

SEQ ID NO: 1226241 - protein, 9 aa, Homo Sapiens
CEIWMNQNA

SEQ ID NO: 1226242 - protein, 9 aa, Homo Sapiens
MGHPEPAPG

SEQ ID NO: 1226243 - protein, 9 aa, Homo Sapiens
PKVGFIPPF

SEQ ID NO: 1226244 - protein, 9 aa, Homo Sapiens
VAKWPNRIS

SEQ ID NO: 1226245 - protein, 9 aa, Homo Sapiens
VHVPTRFLF

SEQ ID NO: 1226246 - protein, 9 aa, Homo Sapiens
RASEMAQAE

SEQ ID NO: 1226247 - protein, 9 aa, Homo Sapiens
ETRHIWDSP

SEQ ID NO: 1226248 - protein, 9 aa, Homo Sapiens
RQSCRLEQG

SEQ ID NO: 1226249 - protein, 9 aa, Homo Sapiens
EAQNQVNIS

SEQ ID NO: 1226250 - protein, 9 aa, Homo Sapiens
TCIVIPGNG

SEQ ID NO: 1226251 - protein, 9 aa, Homo Sapiens
LPWQRWGLL

SEQ ID NO: 1226252 - protein, 9 aa, Homo Sapiens
QHPHTTSCR

SEQ ID NO: 1226253 - protein, 9 aa, Homo Sapiens
LSTSTVAIP

SEQ ID NO: 1226254 - protein, 9 aa, Homo Sapiens
TEISGRVHN

SEQ ID NO: 1226255 - protein, 9 aa, Homo Sapiens
LGGCWQRLA

SEQ ID NO: 1226256 - protein, 9 aa, Homo Sapiens
VQFECGEGE

SEQ ID NO: 1226257 - protein, 9 aa, Homo Sapiens
REQLKMLFL

SEQ ID NO: 1226258 - protein, 9 aa, Homo Sapiens
TRCDRQTQV

SEQ ID NO: 1226259 - protein, 9 aa, Homo Sapiens
LDQLKQGFE

SEQ ID NO: 1226260 - protein, 9 aa, Homo Sapiens
GPAEQRILL

SEQ ID NO: 1226261 - protein, 9 aa, Homo Sapiens
PKCDSGCDE

SEQ ID NO: 1226262 - protein, 9 aa, Homo Sapiens
PQAYTSLQF

SEQ ID NO: 1226263 - protein, 9 aa, Homo Sapiens
QEKEEDIVV

SEQ ID NO: 1226264 - protein, 9 aa, Homo Sapiens
GECTWDCGG

SEQ ID NO: 1226265 - protein, 9 aa, Homo Sapiens
AHVFMPISD

SEQ ID NO: 1226266 - protein, 9 aa, Homo Sapiens
APMAHLSED

SEQ ID NO: 1226267 - protein, 9 aa, Homo Sapiens
NSYRTMEKP

SEQ ID NO: 1226268 - protein, 9 aa, Homo Sapiens
LRRYDEFMV

SEQ ID NO: 1226269 - protein, 9 aa, Homo Sapiens
NMSAADYPI

SEQ ID NO: 1226270 - protein, 9 aa, Homo Sapiens
ACPQEVAST

SEQ ID NO: 1226271 - protein, 9 aa, Homo Sapiens
LQRYTQNIK

SEQ ID NO: 1226272 - protein, 9 aa, Homo Sapiens
EGMTFAGFV

SEQ ID NO: 1226273 - protein, 9 aa, Homo Sapiens
YRGKKRQEV

SEQ ID NO: 1226274 - protein, 9 aa, Homo Sapiens
LFVIAKDSQ

SEQ ID NO: 1226275 - protein, 9 aa, Homo Sapiens
LCVCRIFSL

SEQ ID NO: 1226276 - protein, 9 aa, Homo Sapiens
LLLNLLKEM

SEQ ID NO: 1226277 - protein, 9 aa, Homo Sapiens
KTIVSKNVL

SEQ ID NO: 1226278 - protein, 9 aa, Homo Sapiens
AWSVHPLVG

SEQ ID NO: 1226279 - protein, 9 aa, Homo Sapiens
LSPNYSLNY

SEQ ID NO: 1226280 - protein, 9 aa, Homo Sapiens
RKESSRTTL

SEQ ID NO: 1226281 - protein, 9 aa, Homo Sapiens
QGISLLLHE

SEQ ID NO: 1226282 - protein, 9 aa, Homo Sapiens
HLLHALSDD

SEQ ID NO: 1226283 - protein, 9 aa, Homo Sapiens
DGFDALLTY

SEQ ID NO: 1226284 - protein, 9 aa, Homo Sapiens
ERRQEVLIR

SEQ ID NO: 1226285 - protein, 9 aa, Homo Sapiens
SRHRKSHAG

SEQ ID NO: 1226286 - protein, 9 aa, Homo Sapiens
GIAIHGAER

SEQ ID NO: 1226287 - protein, 9 aa, Homo Sapiens
MFALWELTG

SEQ ID NO: 1226288 - protein, 9 aa, Homo Sapiens
QFLTLWPDQ

SEQ ID NO: 1226289 - protein, 9 aa, Homo Sapiens
DQQDEEKIP

SEQ ID NO: 1226290 - protein, 9 aa, Homo Sapiens
KTFSMSSTL

SEQ ID NO: 1226291 - protein, 9 aa, Homo Sapiens
FKDVMTKTE

SEQ ID NO: 1226292 - protein, 9 aa, Homo Sapiens
VQKKSLLLE

SEQ ID NO: 1226293 - protein, 9 aa, Homo Sapiens
LLMINGQVE

SEQ ID NO: 1226294 - protein, 9 aa, Homo Sapiens
YCIKDCTSA

SEQ ID NO: 1226295 - protein, 9 aa, Homo Sapiens
IDVFHKYTK

SEQ ID NO: 1226296 - protein, 9 aa, Homo Sapiens
HESEIQPAI

SEQ ID NO: 1226297 - protein, 9 aa, Homo Sapiens
VSFLPYTSC

SEQ ID NO: 1226298 - protein, 9 aa, Homo Sapiens
LAIYTVTGQ

SEQ ID NO: 1226299 - protein, 9 aa, Homo Sapiens
ESCLKSTPI

SEQ ID NO: 1226300 - protein, 9 aa, Homo Sapiens
YREPRGGGV

SEQ ID NO: 1226301 - protein, 9 aa, Homo Sapiens
NPDTAAAYP

SEQ ID NO: 1226302 - protein, 9 aa, Homo Sapiens
SYSTTPGHQ

SEQ ID NO: 1226303 - protein, 9 aa, Homo Sapiens
SYPMSAAGR

SEQ ID NO: 1226304 - protein, 9 aa, Homo Sapiens
TEEETTQLA

SEQ ID NO: 1226305 - protein, 9 aa, Homo Sapiens
MYSQGMAPF

SEQ ID NO: 1226306 - protein, 9 aa, Homo Sapiens
PYFTDIFLD

SEQ ID NO: 1226307 - protein, 9 aa, Homo Sapiens
DGDKLSESK

SEQ ID NO: 1226308 - protein, 9 aa, Homo Sapiens
IELNPKDTT

SEQ ID NO: 1226309 - protein, 9 aa, Homo Sapiens
GEQVLSLVS

SEQ ID NO: 1226310 - protein, 9 aa, Homo Sapiens
KSSLSPPHP

SEQ ID NO: 1226311 - protein, 9 aa, Homo Sapiens
GYECSDMSC

SEQ ID NO: 1226312 - protein, 9 aa, Homo Sapiens
TDSFQVKRP

SEQ ID NO: 1226313 - protein, 9 aa, Homo Sapiens
TDDERSHFS

SEQ ID NO: 1226314 - protein, 9 aa, Homo Sapiens
HIFIPIFYR

SEQ ID NO: 1226315 - protein, 9 aa, Homo Sapiens
KDPVLDTNG

SEQ ID NO: 1226316 - protein, 9 aa, Homo Sapiens
NQHRSTYKD

SEQ ID NO: 1226317 - protein, 9 aa, Homo Sapiens
GFGCGYGGG

SEQ ID NO: 1226318 - protein, 9 aa, Homo Sapiens
SSAPHHMAH

SEQ ID NO: 1226319 - protein, 9 aa, Homo Sapiens
LLWIGASLC

SEQ ID NO: 1226320 - protein, 9 aa, Homo Sapiens
QTPEEEHTG

SEQ ID NO: 1226321 - protein, 9 aa, Homo Sapiens
AIDSFQDDV

SEQ ID NO: 1226322 - protein, 9 aa, Homo Sapiens
GGILWYRVD

SEQ ID NO: 1226323 - protein, 9 aa, Homo Sapiens
FAENNNLSK

SEQ ID NO: 1226324 - protein, 9 aa, Homo Sapiens
VVGVIATLL

SEQ ID NO: 1226325 - protein, 9 aa, Homo Sapiens
GSLHATFSI

SEQ ID NO: 1226326 - protein, 9 aa, Homo Sapiens
DHPISAPQS

SEQ ID NO: 1226327 - protein, 9 aa, Homo Sapiens
ERQNQECQV

SEQ ID NO: 1226328 - protein, 9 aa, Homo Sapiens
TILGRKYGV

SEQ ID NO: 1226329 - protein, 9 aa, Homo Sapiens
EVHPRDVMP

SEQ ID NO: 1226330 - protein, 9 aa, Homo Sapiens
PEQQVGQSK

SEQ ID NO: 1226331 - protein, 9 aa, Homo Sapiens
EIPLDKDGL

SEQ ID NO: 1226332 - protein, 9 aa, Homo Sapiens
FGDVPASLD

SEQ ID NO: 1226333 - protein, 9 aa, Homo Sapiens
IEEADGELT

SEQ ID NO: 1226334 - protein, 9 aa, Homo Sapiens
KVAVQPELL

SEQ ID NO: 1226335 - protein, 9 aa, Homo Sapiens
KDGYWTDRG

SEQ ID NO: 1226336 - protein, 9 aa, Homo Sapiens
YHRYYWGEK

SEQ ID NO: 1226337 - protein, 9 aa, Homo Sapiens
ASHAVGVLC

SEQ ID NO: 1226338 - protein, 9 aa, Homo Sapiens
QTEAAINAF

SEQ ID NO: 1226339 - protein, 9 aa, Homo Sapiens
HWSLTRPRV

SEQ ID NO: 1226340 - protein, 9 aa, Homo Sapiens
ETARTVQIL

SEQ ID NO: 1226341 - protein, 9 aa, Homo Sapiens
QLPWVRVAL

SEQ ID NO: 1226342 - protein, 9 aa, Homo Sapiens
LSQVYCHKD

SEQ ID NO: 1226343 - protein, 9 aa, Homo Sapiens
PLNHSLAYQ

SEQ ID NO: 1226344 - protein, 9 aa, Homo Sapiens
TIGNMMSIY

SEQ ID NO: 1226345 - protein, 9 aa, Homo Sapiens
TRGGPSLTP

SEQ ID NO: 1226346 - protein, 9 aa, Homo Sapiens
RGTPSGTHS

SEQ ID NO: 1226347 - protein, 9 aa, Homo Sapiens
EGLKVHKYS

SEQ ID NO: 1226348 - protein, 9 aa, Homo Sapiens
EITRSQPED

SEQ ID NO: 1226349 - protein, 9 aa, Homo Sapiens
TSVSQHWAA

SEQ ID NO: 1226350 - protein, 9 aa, Homo Sapiens
EDQQDEEKI

SEQ ID NO: 1226351 - protein, 9 aa, Homo Sapiens
WLKGDKCSQ

SEQ ID NO: 1226352 - protein, 9 aa, Homo Sapiens
PWGEPEILV

SEQ ID NO: 1226353 - protein, 9 aa, Homo Sapiens
GECALQSPT

SEQ ID NO: 1226354 - protein, 9 aa, Homo Sapiens
QNFTSVYEE

SEQ ID NO: 1226355 - protein, 9 aa, Homo Sapiens
QWEVRIVAQ

SEQ ID NO: 1226356 - protein, 9 aa, Homo Sapiens
VSIGHTVMA

SEQ ID NO: 1226357 - protein, 9 aa, Homo Sapiens
GKPVFVMEP

SEQ ID NO: 1226358 - protein, 9 aa, Homo Sapiens
YMFDKLTLG

SEQ ID NO: 1226359 - protein, 9 aa, Homo Sapiens
RRSALGDLT

SEQ ID NO: 1226360 - protein, 9 aa, Homo Sapiens
EDSRTHTIL

SEQ ID NO: 1226361 - protein, 9 aa, Homo Sapiens
ISRISCLYN

SEQ ID NO: 1226362 - protein, 9 aa, Homo Sapiens
GSNRHEIST

SEQ ID NO: 1226363 - protein, 9 aa, Homo Sapiens
GAADELVLH

SEQ ID NO: 1226364 - protein, 9 aa, Homo Sapiens
GKVFNKKTN

SEQ ID NO: 1226365 - protein, 9 aa, Homo Sapiens
DRAMSQDSN

SEQ ID NO: 1226366 - protein, 9 aa, Homo Sapiens
RKLKYEWMV

SEQ ID NO: 1226367 - protein, 9 aa, Homo Sapiens
DQNKYKEDA

SEQ ID NO: 1226368 - protein, 9 aa, Homo Sapiens
PSQGLLGQT

SEQ ID NO: 1226369 - protein, 9 aa, Homo Sapiens
ENYTLIRTY

SEQ ID NO: 1226370 - protein, 9 aa, Homo Sapiens
KKELKAHTV

SEQ ID NO: 1226371 - protein, 9 aa, Homo Sapiens
ASSALSTNK

SEQ ID NO: 1226372 - protein, 9 aa, Homo Sapiens
RQRQLLRMG

SEQ ID NO: 1226373 - protein, 9 aa, Homo Sapiens
RIYSDTVQG

SEQ ID NO: 1226374 - protein, 9 aa, Homo Sapiens
NVVKTCIQS

SEQ ID NO: 1226375 - protein, 9 aa, Homo Sapiens
PDGSYMCLA

SEQ ID NO: 1226376 - protein, 9 aa, Homo Sapiens
EAYSKKLMD

SEQ ID NO: 1226377 - protein, 9 aa, Homo Sapiens
ETFNAAVMA

SEQ ID NO: 1226378 - protein, 9 aa, Homo Sapiens
NTFECIAPA

SEQ ID NO: 1226379 - protein, 9 aa, Homo Sapiens
DPSLLIFPP

SEQ ID NO: 1226380 - protein, 9 aa, Homo Sapiens
GFYYNVIIT

SEQ ID NO: 1226381 - protein, 9 aa, Homo Sapiens
HHMVRWVDP

SEQ ID NO: 1226382 - protein, 9 aa, Homo Sapiens
SFVSKVYCG

SEQ ID NO: 1226383 - protein, 9 aa, Homo Sapiens
VCMRRDTSL

SEQ ID NO: 1226384 - protein, 9 aa, Homo Sapiens
DSAHQPEMV

SEQ ID NO: 1226385 - protein, 9 aa, Homo Sapiens
KHVEDFIQE

SEQ ID NO: 1226386 - protein, 9 aa, Homo Sapiens
EKHLHASRT

SEQ ID NO: 1226387 - protein, 9 aa, Homo Sapiens
AAAYQSRNY

SEQ ID NO: 1226388 - protein, 9 aa, Homo Sapiens
VRLLLAEAE

SEQ ID NO: 1226389 - protein, 9 aa, Homo Sapiens
ERECEMADE

SEQ ID NO: 1226390 - protein, 9 aa, Homo Sapiens
EAILVALVS

SEQ ID NO: 1226391 - protein, 9 aa, Homo Sapiens
RATLSITCH

SEQ ID NO: 1226392 - protein, 9 aa, Homo Sapiens
FSPQTHTVD

SEQ ID NO: 1226393 - protein, 9 aa, Homo Sapiens
CSLSAPAEA

SEQ ID NO: 1226394 - protein, 9 aa, Homo Sapiens
IYSVGYLIR

SEQ ID NO: 1226395 - protein, 9 aa, Homo Sapiens
MFQYGRTSE

SEQ ID NO: 1226396 - protein, 9 aa, Homo Sapiens
PGWSGHLCD

SEQ ID NO: 1226397 - protein, 9 aa, Homo Sapiens
VTWSVTLDN

SEQ ID NO: 1226398 - protein, 9 aa, Homo Sapiens
PRSREELPY

SEQ ID NO: 1226399 - protein, 9 aa, Homo Sapiens
FMFTVTFAW

SEQ ID NO: 1226400 - protein, 9 aa, Homo Sapiens
TFLALLDGA

SEQ ID NO: 1226401 - protein, 9 aa, Homo Sapiens
GHLARECDR

SEQ ID NO: 1226402 - protein, 9 aa, Homo Sapiens
PLSAVCFME

SEQ ID NO: 1226403 - protein, 9 aa, Homo Sapiens
HAILKMKGN

SEQ ID NO: 1226404 - protein, 9 aa, Homo Sapiens
LQCWSRRFH

SEQ ID NO: 1226405 - protein, 9 aa, Homo Sapiens
FMYPKEWHH

SEQ ID NO: 1226406 - protein, 9 aa, Homo Sapiens
DLINFMLRN

SEQ ID NO: 1226407 - protein, 9 aa, Homo Sapiens
LLGMDLVRI

SEQ ID NO: 1226408 - protein, 9 aa, Homo Sapiens
HGFQARPEL

SEQ ID NO: 1226409 - protein, 9 aa, Homo Sapiens
DQRRPPVSC

SEQ ID NO: 1226410 - protein, 9 aa, Homo Sapiens
SGTGWWRSQ

SEQ ID NO: 1226411 - protein, 9 aa, Homo Sapiens
EFSRSHILE

SEQ ID NO: 1226412 - protein, 9 aa, Homo Sapiens
CIVGHLPWV

SEQ ID NO: 1226413 - protein, 9 aa, Homo Sapiens
LFICNECGK

SEQ ID NO: 1226414 - protein, 9 aa, Homo Sapiens
KDGTRKGYM

SEQ ID NO: 1226415 - protein, 9 aa, Homo Sapiens
LGCDAVLQL

SEQ ID NO: 1226416 - protein, 9 aa, Homo Sapiens
KEKHVMKTT

SEQ ID NO: 1226417 - protein, 9 aa, Homo Sapiens
LQLLLPTQD

SEQ ID NO: 1226418 - protein, 9 aa, Homo Sapiens
NISVPRHEQ

SEQ ID NO: 1226419 - protein, 9 aa, Homo Sapiens
RMAAKLLAK

SEQ ID NO: 1226420 - protein, 9 aa, Homo Sapiens
TGNTCSSGI

SEQ ID NO: 1226421 - protein, 9 aa, Homo Sapiens
RHEKQKLVE

SEQ ID NO: 1226422 - protein, 9 aa, Homo Sapiens
ISFKRKSTS

SEQ ID NO: 1226423 - protein, 9 aa, Homo Sapiens
VPAMTGMTP

SEQ ID NO: 1226424 - protein, 9 aa, Homo Sapiens
LKKEHTIYN

SEQ ID NO: 1226425 - protein, 9 aa, Homo Sapiens
VPQCKLFSM

SEQ ID NO: 1226426 - protein, 9 aa, Homo Sapiens
LKGKLKNQI

SEQ ID NO: 1226427 - protein, 9 aa, Homo Sapiens
RTLASPGPE

SEQ ID NO: 1226428 - protein, 9 aa, Homo Sapiens
TKEDYAVFY

SEQ ID NO: 1226429 - protein, 9 aa, Homo Sapiens
TVSLEKYKC

SEQ ID NO: 1226430 - protein, 9 aa, Homo Sapiens
ESTMDNSLK

SEQ ID NO: 1226431 - protein, 9 aa, Homo Sapiens
LINAIKDVT

SEQ ID NO: 1226432 - protein, 9 aa, Homo Sapiens
NSFVGAPYW

SEQ ID NO: 1226433 - protein, 9 aa, Homo Sapiens
PDVLLERRL

SEQ ID NO: 1226434 - protein, 9 aa, Homo Sapiens
HIRPVRVKR

SEQ ID NO: 1226435 - protein, 9 aa, Homo Sapiens
RDDVRRVMF

SEQ ID NO: 1226436 - protein, 9 aa, Homo Sapiens
HIHTLLWDL

SEQ ID NO: 1226437 - protein, 9 aa, Homo Sapiens
LIGTMQPFM

SEQ ID NO: 1226438 - protein, 9 aa, Homo Sapiens
DLQRRPRHR

SEQ ID NO: 1226439 - protein, 9 aa, Homo Sapiens
PTVITVHYL

SEQ ID NO: 1226440 - protein, 9 aa, Homo Sapiens
KSWRCCRKC

SEQ ID NO: 1226441 - protein, 9 aa, Homo Sapiens
QSQVLLKRE

SEQ ID NO: 1226442 - protein, 9 aa, Homo Sapiens
SPQRSASCK

SEQ ID NO: 1226443 - protein, 9 aa, Homo Sapiens
EDQIVLLKG

SEQ ID NO: 1226444 - protein, 9 aa, Homo Sapiens
RLSGSVRPQ

SEQ ID NO: 1226445 - protein, 9 aa, Homo Sapiens
VKQVFECLV

SEQ ID NO: 1226446 - protein, 9 aa, Homo Sapiens
EAIKCRTLF

SEQ ID NO: 1226447 - protein, 9 aa, Homo Sapiens
NLLCGGGIA

SEQ ID NO: 1226448 - protein, 9 aa, Homo Sapiens
TQCASRRLG

SEQ ID NO: 1226449 - protein, 9 aa, Homo Sapiens
TGFWTGLGT

SEQ ID NO: 1226450 - protein, 9 aa, Homo Sapiens
GRNRRAKKV

SEQ ID NO: 1226451 - protein, 9 aa, Homo Sapiens
TEKVDDDVL

SEQ ID NO: 1226452 - protein, 9 aa, Homo Sapiens
DGGIGKAKL

SEQ ID NO: 1226453 - protein, 9 aa, Homo Sapiens
GCMRPVWTM

SEQ ID NO: 1226454 - protein, 9 aa, Homo Sapiens
PRPAFAGTS

SEQ ID NO: 1226455 - protein, 9 aa, Homo Sapiens
GKENNKMEV

SEQ ID NO: 1226456 - protein, 9 aa, Homo Sapiens
LIGNVYTAQ

SEQ ID NO: 1226457 - protein, 9 aa, Homo Sapiens
LVQLDPAEM

SEQ ID NO: 1226458 - protein, 9 aa, Homo Sapiens
LKLKHRDLE

SEQ ID NO: 1226459 - protein, 9 aa, Homo Sapiens
KGLFSSVSA

SEQ ID NO: 1226460 - protein, 9 aa, Homo Sapiens
TCSRTAPCT

SEQ ID NO: 1226461 - protein, 9 aa, Homo Sapiens
AQETGLNMH

SEQ ID NO: 1226462 - protein, 9 aa, Homo Sapiens
KILKKSYED

SEQ ID NO: 1226463 - protein, 9 aa, Homo Sapiens
HVKNQGTAD

SEQ ID NO: 1226464 - protein, 9 aa, Homo Sapiens
SSPVRLLKV

SEQ ID NO: 1226465 - protein, 9 aa, Homo Sapiens
QPNHCLAPE

SEQ ID NO: 1226466 - protein, 9 aa, Homo Sapiens
LCADTCQCV

SEQ ID NO: 1226467 - protein, 9 aa, Homo Sapiens
RDVLYMPGF

SEQ ID NO: 1226468 - protein, 9 aa, Homo Sapiens
PSTQLLFYD

SEQ ID NO: 1226469 - protein, 9 aa, Homo Sapiens
IMSVQAEEQ

SEQ ID NO: 1226470 - protein, 9 aa, Homo Sapiens
IFTYGMHMI

SEQ ID NO: 1226471 - protein, 9 aa, Homo Sapiens
CDKALNNGS

SEQ ID NO: 1226472 - protein, 9 aa, Homo Sapiens
SEDPVLTTL

SEQ ID NO: 1226473 - protein, 9 aa, Homo Sapiens
DTSIYVCRV

SEQ ID NO: 1226474 - protein, 9 aa, Homo Sapiens
AAIISRWNW

SEQ ID NO: 1226475 - protein, 9 aa, Homo Sapiens
RSYKQRLNT

SEQ ID NO: 1226476 - protein, 9 aa, Homo Sapiens
CMMKLLNQK

SEQ ID NO: 1226477 - protein, 9 aa, Homo Sapiens
RTGRAGRMG

SEQ ID NO: 1226478 - protein, 9 aa, Homo Sapiens
IADLLANEH

SEQ ID NO: 1226479 - protein, 9 aa, Homo Sapiens
ISYMRRDGK

SEQ ID NO: 1226480 - protein, 9 aa, Homo Sapiens
RYTHRHTQA

SEQ ID NO: 1226481 - protein, 9 aa, Homo Sapiens
RKLLQQSVL

SEQ ID NO: 1226482 - protein, 9 aa, Homo Sapiens
QRSQHPHTT

SEQ ID NO: 1226483 - protein, 9 aa, Homo Sapiens
GLFEVGFEP

SEQ ID NO: 1226484 - protein, 9 aa, Homo Sapiens
PSLLHPHPQ

SEQ ID NO: 1226485 - protein, 9 aa, Homo Sapiens
FGQSSVLLQ

SEQ ID NO: 1226486 - protein, 9 aa, Homo Sapiens
SVLVCPPPP

SEQ ID NO: 1226487 - protein, 9 aa, Homo Sapiens
PLQCLRRAQ

SEQ ID NO: 1226488 - protein, 9 aa, Homo Sapiens
MYRKSGLPF

SEQ ID NO: 1226489 - protein, 9 aa, Homo Sapiens
HLPWKVFTY

SEQ ID NO: 1226490 - protein, 9 aa, Homo Sapiens
KMYRVALES

SEQ ID NO: 1226491 - protein, 9 aa, Homo Sapiens
AFLPRIPKV

SEQ ID NO: 1226492 - protein, 9 aa, Homo Sapiens
DLFKLTIDM

SEQ ID NO: 1226493 - protein, 9 aa, Homo Sapiens
AMLSSVLAS

SEQ ID NO: 1226494 - protein, 9 aa, Homo Sapiens
HAMESATRS

SEQ ID NO: 1226495 - protein, 9 aa, Homo Sapiens
FTFDSEGNY

SEQ ID NO: 1226496 - protein, 9 aa, Homo Sapiens
HFFALSEPY

SEQ ID NO: 1226497 - protein, 9 aa, Homo Sapiens
GLDILKGKV

SEQ ID NO: 1226498 - protein, 9 aa, Homo Sapiens
LQVCCMVEE

SEQ ID NO: 1226499 - protein, 9 aa, Homo Sapiens
ARTSLKSGK

SEQ ID NO: 1226500 - protein, 9 aa, Homo Sapiens
DRPTGIGVY

SEQ ID NO: 1226501 - protein, 9 aa, Homo Sapiens
SSGRLYRLC

SEQ ID NO: 1226502 - protein, 9 aa, Homo Sapiens
TALECAEDK

SEQ ID NO: 1226503 - protein, 9 aa, Homo Sapiens
LVKRLTGGD

SEQ ID NO: 1226504 - protein, 9 aa, Homo Sapiens
LNIVHSTLS

SEQ ID NO: 1226505 - protein, 9 aa, Homo Sapiens
EDDVYNLAA

SEQ ID NO: 1226506 - protein, 9 aa, Homo Sapiens
HVPLTKEQL

SEQ ID NO: 1226507 - protein, 9 aa, Homo Sapiens
GLSPGALSS

SEQ ID NO: 1226508 - protein, 9 aa, Homo Sapiens
DFITALPDR

SEQ ID NO: 1226509 - protein, 9 aa, Homo Sapiens
HWHLWKHYS

SEQ ID NO: 1226510 - protein, 9 aa, Homo Sapiens
RMLVDAPPQ

SEQ ID NO: 1226511 - protein, 9 aa, Homo Sapiens
ACYENVIGY

SEQ ID NO: 1226512 - protein, 9 aa, Homo Sapiens
VLLKGCCME

SEQ ID NO: 1226513 - protein, 9 aa, Homo Sapiens
GNYGKSYLV

SEQ ID NO: 1226514 - protein, 9 aa, Homo Sapiens
INTEDLLLS

SEQ ID NO: 1226515 - protein, 9 aa, Homo Sapiens
KYTDVEEGS

SEQ ID NO: 1226516 - protein, 9 aa, Homo Sapiens
LRVVHVAGK

SEQ ID NO: 1226517 - protein, 9 aa, Homo Sapiens
GATVMPGAW

SEQ ID NO: 1226518 - protein, 9 aa, Homo Sapiens
TRHPAAGYR

SEQ ID NO: 1226519 - protein, 9 aa, Homo Sapiens
YGKSYLVAL

SEQ ID NO: 1226520 - protein, 9 aa, Homo Sapiens
HEACDRLIQ

SEQ ID NO: 1226521 - protein, 9 aa, Homo Sapiens
KKALEECEC

SEQ ID NO: 1226522 - protein, 9 aa, Homo Sapiens
HPSATLIAW

SEQ ID NO: 1226523 - protein, 9 aa, Homo Sapiens
GTRLEPLLP

SEQ ID NO: 1226524 - protein, 9 aa, Homo Sapiens
NKIMTINGL

SEQ ID NO: 1226525 - protein, 9 aa, Homo Sapiens
YLRVQIARI

SEQ ID NO: 1226526 - protein, 9 aa, Homo Sapiens
EREKHHMLK

SEQ ID NO: 1226527 - protein, 9 aa, Homo Sapiens
PSAPTGPRP

SEQ ID NO: 1226528 - protein, 9 aa, Homo Sapiens
QTRANVTRM

SEQ ID NO: 1226529 - protein, 9 aa, Homo Sapiens
QELKAGSRG

SEQ ID NO: 1226530 - protein, 9 aa, Homo Sapiens
IPYMDSPQS

SEQ ID NO: 1226531 - protein, 9 aa, Homo Sapiens
ESHRAPGQS

SEQ ID NO: 1226532 - protein, 9 aa, Homo Sapiens
SLNLDFNHI

SEQ ID NO: 1226533 - protein, 9 aa, Homo Sapiens
EDEIEDPAG

SEQ ID NO: 1226534 - protein, 9 aa, Homo Sapiens
AAPSPAPCD

SEQ ID NO: 1226535 - protein, 9 aa, Homo Sapiens
AEGIPALVP

SEQ ID NO: 1226536 - protein, 9 aa, Homo Sapiens
IDKQGRIMS

SEQ ID NO: 1226537 - protein, 9 aa, Homo Sapiens
VQKKSRLRR

SEQ ID NO: 1226538 - protein, 9 aa, Homo Sapiens
HLQEGDLPN

SEQ ID NO: 1226539 - protein, 9 aa, Homo Sapiens
SVHVPLMLN

SEQ ID NO: 1226540 - protein, 9 aa, Homo Sapiens
LKCTVENIK

SEQ ID NO: 1226541 - protein, 9 aa, Homo Sapiens
DGTCLAIDP

SEQ ID NO: 1226542 - protein, 9 aa, Homo Sapiens
FEGQSHYVP

SEQ ID NO: 1226543 - protein, 9 aa, Homo Sapiens
CLEQELLCA

SEQ ID NO: 1226544 - protein, 9 aa, Homo Sapiens
YIKWLEELQ

SEQ ID NO: 1226545 - protein, 9 aa, Homo Sapiens
MSFVNNCFS

SEQ ID NO: 1226546 - protein, 9 aa, Homo Sapiens
ERLAHLYDM

SEQ ID NO: 1226547 - protein, 9 aa, Homo Sapiens
HMFVRDEIQ

SEQ ID NO: 1226548 - protein, 9 aa, Homo Sapiens
NVGYPALKR

SEQ ID NO: 1226549 - protein, 9 aa, Homo Sapiens
PSTTPSIHR

SEQ ID NO: 1226550 - protein, 9 aa, Homo Sapiens
PAVTSSPSH

SEQ ID NO: 1226551 - protein, 9 aa, Homo Sapiens
LSLANNKIM

SEQ ID NO: 1226552 - protein, 9 aa, Homo Sapiens
TNLKTLNQY

SEQ ID NO: 1226553 - protein, 9 aa, Homo Sapiens
IPGNGASWD

SEQ ID NO: 1226554 - protein, 9 aa, Homo Sapiens
CEGLAHGVV

SEQ ID NO: 1226555 - protein, 9 aa, Homo Sapiens
EECGKCFIC

SEQ ID NO: 1226556 - protein, 9 aa, Homo Sapiens
KMEEEHIYA

SEQ ID NO: 1226557 - protein, 9 aa, Homo Sapiens
IWCFAWRKS

SEQ ID NO: 1226558 - protein, 9 aa, Homo Sapiens
TVVMKEKCK

SEQ ID NO: 1226559 - protein, 9 aa, Homo Sapiens
QRHYFYLFP

SEQ ID NO: 1226560 - protein, 9 aa, Homo Sapiens
FARCSLEDI

SEQ ID NO: 1226561 - protein, 9 aa, Homo Sapiens
MSTNQAQAA

SEQ ID NO: 1226562 - protein, 9 aa, Homo Sapiens
THLHMIEER

SEQ ID NO: 1226563 - protein, 9 aa, Homo Sapiens
VVSTITSIF

SEQ ID NO: 1226564 - protein, 9 aa, Homo Sapiens
MYLQYPSTA

SEQ ID NO: 1226565 - protein, 9 aa, Homo Sapiens
HTEDDPVVP

SEQ ID NO: 1226566 - protein, 9 aa, Homo Sapiens
RKQTGHRRH

SEQ ID NO: 1226567 - protein, 9 aa, Homo Sapiens
LNMPLVTTF

SEQ ID NO: 1226568 - protein, 9 aa, Homo Sapiens
VMIERTPSC

SEQ ID NO: 1226569 - protein, 9 aa, Homo Sapiens
LKSTPIVGD

SEQ ID NO: 1226570 - protein, 9 aa, Homo Sapiens
EHPTRDGLG

SEQ ID NO: 1226571 - protein, 9 aa, Homo Sapiens
NQESPNTPA

SEQ ID NO: 1226572 - protein, 9 aa, Homo Sapiens
SGRQQRGTM

SEQ ID NO: 1226573 - protein, 9 aa, Homo Sapiens
KTINFDGRL

SEQ ID NO: 1226574 - protein, 9 aa, Homo Sapiens
ILYQFSRCF

SEQ ID NO: 1226575 - protein, 9 aa, Homo Sapiens
KRQALMPIQ

SEQ ID NO: 1226576 - protein, 9 aa, Homo Sapiens
KHGYLEATV

SEQ ID NO: 1226577 - protein, 9 aa, Homo Sapiens
LPYLDHLNL

SEQ ID NO: 1226578 - protein, 9 aa, Homo Sapiens
SFSFSPGGG

SEQ ID NO: 1226579 - protein, 9 aa, Homo Sapiens
TERMQDLKS

SEQ ID NO: 1226580 - protein, 9 aa, Homo Sapiens
EWIMKAQAL

SEQ ID NO: 1226581 - protein, 9 aa, Homo Sapiens
SRLSFDLSL

SEQ ID NO: 1226582 - protein, 9 aa, Homo Sapiens
VTSFVSSWG

SEQ ID NO: 1226583 - protein, 9 aa, Homo Sapiens
VHKCRVHDL

SEQ ID NO: 1226584 - protein, 9 aa, Homo Sapiens
QRSDISREL

SEQ ID NO: 1226585 - protein, 9 aa, Homo Sapiens
DRQSCRLEQ

SEQ ID NO: 1226586 - protein, 9 aa, Homo Sapiens
TEESLVKWL

SEQ ID NO: 1226587 - protein, 9 aa, Homo Sapiens
RSPPSSSTT

SEQ ID NO: 1226588 - protein, 9 aa, Homo Sapiens
HRALCTCLP

SEQ ID NO: 1226589 - protein, 9 aa, Homo Sapiens
VAHSVQLFI

SEQ ID NO: 1226590 - protein, 9 aa, Homo Sapiens
YMTPERIDP

SEQ ID NO: 1226591 - protein, 9 aa, Homo Sapiens
GTPETRKCK

SEQ ID NO: 1226592 - protein, 9 aa, Homo Sapiens
CMEACGTME

SEQ ID NO: 1226593 - protein, 9 aa, Homo Sapiens
DLLRRSDRV

SEQ ID NO: 1226594 - protein, 9 aa, Homo Sapiens
HTHHYLCLD

SEQ ID NO: 1226595 - protein, 9 aa, Homo Sapiens
FIHFGVWAE

SEQ ID NO: 1226596 - protein, 9 aa, Homo Sapiens
SHHSDHKPY

SEQ ID NO: 1226597 - protein, 9 aa, Homo Sapiens
WHGMFVNVM

SEQ ID NO: 1226598 - protein, 9 aa, Homo Sapiens
NLFPIKIIL

SEQ ID NO: 1226599 - protein, 9 aa, Homo Sapiens
GCNMLDTTG

SEQ ID NO: 1226600 - protein, 9 aa, Homo Sapiens
IQVWHEEHC

SEQ ID NO: 1226601 - protein, 9 aa, Homo Sapiens
YLEAFCLPG

SEQ ID NO: 1226602 - protein, 9 aa, Homo Sapiens
HSGEKPFKY

SEQ ID NO: 1226603 - protein, 9 aa, Homo Sapiens
LIETKHPYT

SEQ ID NO: 1226604 - protein, 9 aa, Homo Sapiens
FHNVCLLEV

SEQ ID NO: 1226605 - protein, 9 aa, Homo Sapiens
ERHVVQKKS

SEQ ID NO: 1226606 - protein, 9 aa, Homo Sapiens
APMSQVYGV

SEQ ID NO: 1226607 - protein, 9 aa, Homo Sapiens
LPEQQVGQS

SEQ ID NO: 1226608 - protein, 9 aa, Homo Sapiens
NKWDMLKRA

SEQ ID NO: 1226609 - protein, 9 aa, Homo Sapiens
DPEGPPWLP

SEQ ID NO: 1226610 - protein, 9 aa, Homo Sapiens
DEKWKLERE

SEQ ID NO: 1226611 - protein, 9 aa, Homo Sapiens
PHPPPACHS

SEQ ID NO: 1226612 - protein, 9 aa, Homo Sapiens
ANPSNFLLD

SEQ ID NO: 1226613 - protein, 9 aa, Homo Sapiens
INIETKNKN

SEQ ID NO: 1226614 - protein, 9 aa, Homo Sapiens
IEPCKYTGS

SEQ ID NO: 1226615 - protein, 9 aa, Homo Sapiens
VASFLSFLG

SEQ ID NO: 1226616 - protein, 9 aa, Homo Sapiens
DAPYEKEVP

SEQ ID NO: 1226617 - protein, 9 aa, Homo Sapiens
FGNMQMASS

SEQ ID NO: 1226618 - protein, 9 aa, Homo Sapiens
SPHLSPCSS

SEQ ID NO: 1226619 - protein, 9 aa, Homo Sapiens
SISDQDMNA

SEQ ID NO: 1226620 - protein, 9 aa, Homo Sapiens
PPLVTINVF

SEQ ID NO: 1226621 - protein, 9 aa, Homo Sapiens
LWLDWFLSC

SEQ ID NO: 1226622 - protein, 9 aa, Homo Sapiens
GSGSISLAL

SEQ ID NO: 1226623 - protein, 9 aa, Homo Sapiens
STCTKMVVY

SEQ ID NO: 1226624 - protein, 9 aa, Homo Sapiens
ITQVILMYI

SEQ ID NO: 1226625 - protein, 9 aa, Homo Sapiens
GPQFCQNPA

SEQ ID NO: 1226626 - protein, 9 aa, Homo Sapiens
SNWCDGMSH

SEQ ID NO: 1226627 - protein, 9 aa, Homo Sapiens
PIEDNCGDY

SEQ ID NO: 1226628 - protein, 9 aa, Homo Sapiens
ELSESTTLD

SEQ ID NO: 1226629 - protein, 9 aa, Homo Sapiens
CIVMRQSKE

SEQ ID NO: 1226630 - protein, 9 aa, Homo Sapiens
CWQQDMSTS

SEQ ID NO: 1226631 - protein, 9 aa, Homo Sapiens
ENIDIKNTV

SEQ ID NO: 1226632 - protein, 9 aa, Homo Sapiens
LVQYLCNEY

SEQ ID NO: 1226633 - protein, 9 aa, Homo Sapiens
ESKWSLLAK

SEQ ID NO: 1226634 - protein, 9 aa, Homo Sapiens
LVFFSLLTT

SEQ ID NO: 1226635 - protein, 9 aa, Homo Sapiens
SQITRIPEA

SEQ ID NO: 1226636 - protein, 9 aa, Homo Sapiens
DKVQIHDVV

SEQ ID NO: 1226637 - protein, 9 aa, Homo Sapiens
LAYSFSRWC

SEQ ID NO: 1226638 - protein, 9 aa, Homo Sapiens
ILVPAVTSD

SEQ ID NO: 1226639 - protein, 9 aa, Homo Sapiens
RQEMTVIVN

SEQ ID NO: 1226640 - protein, 9 aa, Homo Sapiens
ELVSIDSKP

SEQ ID NO: 1226641 - protein, 9 aa, Homo Sapiens
SLVMGACYE

SEQ ID NO: 1226642 - protein, 9 aa, Homo Sapiens
PGAERKKEK

SEQ ID NO: 1226643 - protein, 9 aa, Homo Sapiens
MAVICVVKI

SEQ ID NO: 1226644 - protein, 9 aa, Homo Sapiens
TVQHLNSKF

SEQ ID NO: 1226645 - protein, 9 aa, Homo Sapiens
LIQKIFYML

SEQ ID NO: 1226646 - protein, 9 aa, Homo Sapiens
WDYLILRPH

SEQ ID NO: 1226647 - protein, 9 aa, Homo Sapiens
DAAQTLALT

SEQ ID NO: 1226648 - protein, 9 aa, Homo Sapiens
CYDSELGLT

SEQ ID NO: 1226649 - protein, 9 aa, Homo Sapiens
KMFPIPAGV

SEQ ID NO: 1226650 - protein, 9 aa, Homo Sapiens
CSECGRAFT

SEQ ID NO: 1226651 - protein, 9 aa, Homo Sapiens
IMSFVDICY

SEQ ID NO: 1226652 - protein, 9 aa, Homo Sapiens
WSGCTLQKF

SEQ ID NO: 1226653 - protein, 9 aa, Homo Sapiens
GVGMHLAST

SEQ ID NO: 1226654 - protein, 9 aa, Homo Sapiens
SISCFWETH

SEQ ID NO: 1226655 - protein, 9 aa, Homo Sapiens
QDLWSEQGI

SEQ ID NO: 1226656 - protein, 9 aa, Homo Sapiens
YKLFIPDID

SEQ ID NO: 1226657 - protein, 9 aa, Homo Sapiens
MYLDGPFGE

SEQ ID NO: 1226658 - protein, 9 aa, Homo Sapiens
LVAAVVWKT

SEQ ID NO: 1226659 - protein, 9 aa, Homo Sapiens
TSHSRPGSI

SEQ ID NO: 1226660 - protein, 9 aa, Homo Sapiens
LDIEHITGF

SEQ ID NO: 1226661 - protein, 9 aa, Homo Sapiens
TASMGTCLI

SEQ ID NO: 1226662 - protein, 9 aa, Homo Sapiens
DYQQFWSSP

SEQ ID NO: 1226663 - protein, 9 aa, Homo Sapiens
MKNKFLARM

SEQ ID NO: 1226664 - protein, 9 aa, Homo Sapiens
YTLIRTYQV

SEQ ID NO: 1226665 - protein, 9 aa, Homo Sapiens
DNEKNTASI

SEQ ID NO: 1226666 - protein, 9 aa, Homo Sapiens
NITKQDIML

SEQ ID NO: 1226667 - protein, 9 aa, Homo Sapiens
CILISFSPG

SEQ ID NO: 1226668 - protein, 9 aa, Homo Sapiens
MAEMCKQSV

SEQ ID NO: 1226669 - protein, 9 aa, Homo Sapiens
GNMWDCGRN

SEQ ID NO: 1226670 - protein, 9 aa, Homo Sapiens
GKYKSKEFQ

SEQ ID NO: 1226671 - protein, 9 aa, Homo Sapiens
GRRDARALH

SEQ ID NO: 1226672 - protein, 9 aa, Homo Sapiens
TKLTETRVQ

SEQ ID NO: 1226673 - protein, 9 aa, Homo Sapiens
APGGILDLE

SEQ ID NO: 1226674 - protein, 9 aa, Homo Sapiens
WLLEPPRTD

SEQ ID NO: 1226675 - protein, 9 aa, Homo Sapiens
VWTQNHRTM

SEQ ID NO: 1226676 - protein, 9 aa, Homo Sapiens
SMRITTMPH

SEQ ID NO: 1226677 - protein, 9 aa, Homo Sapiens
DAAGGTTSH

SEQ ID NO: 1226678 - protein, 9 aa, Homo Sapiens
QVNPEGPIQ

SEQ ID NO: 1226679 - protein, 9 aa, Homo Sapiens
NAVKILPIM

SEQ ID NO: 1226680 - protein, 9 aa, Homo Sapiens
CRECGKSFP

SEQ ID NO: 1226681 - protein, 9 aa, Homo Sapiens
SQTIEQNSE

SEQ ID NO: 1226682 - protein, 9 aa, Homo Sapiens
EREAAAKHS

SEQ ID NO: 1226683 - protein, 9 aa, Homo Sapiens
GQLIDKCWV

SEQ ID NO: 1226684 - protein, 9 aa, Homo Sapiens
DSPPSSPPS

SEQ ID NO: 1226685 - protein, 9 aa, Homo Sapiens
DPLSFSPTA

SEQ ID NO: 1226686 - protein, 9 aa, Homo Sapiens
SVAKTEIAL

SEQ ID NO: 1226687 - protein, 9 aa, Homo Sapiens
FKVPTSITE

SEQ ID NO: 1226688 - protein, 9 aa, Homo Sapiens
YENSGTGFW

SEQ ID NO: 1226689 - protein, 9 aa, Homo Sapiens
SQLERESTL

SEQ ID NO: 1226690 - protein, 9 aa, Homo Sapiens
DNTRDPDTR

SEQ ID NO: 1226691 - protein, 9 aa, Homo Sapiens
GMRPLQRRL

SEQ ID NO: 1226692 - protein, 9 aa, Homo Sapiens
SRQELRQWV

SEQ ID NO: 1226693 - protein, 9 aa, Homo Sapiens
NGNVIYSIR

SEQ ID NO: 1226694 - protein, 9 aa, Homo Sapiens
GRDQCPSAW

SEQ ID NO: 1226695 - protein, 9 aa, Homo Sapiens
TEKKKLRYV

SEQ ID NO: 1226696 - protein, 9 aa, Homo Sapiens
PTCLASWLT

SEQ ID NO: 1226697 - protein, 9 aa, Homo Sapiens
PGLSELKVT

SEQ ID NO: 1226698 - protein, 9 aa, Homo Sapiens
DEEKDNSDY

SEQ ID NO: 1226699 - protein, 9 aa, Homo Sapiens
DLLMIHGNE

SEQ ID NO: 1226700 - protein, 9 aa, Homo Sapiens
GDLSYLDQC

SEQ ID NO: 1226701 - protein, 9 aa, Homo Sapiens
TTTMNNTHS

SEQ ID NO: 1226702 - protein, 9 aa, Homo Sapiens
ANGSVGDAT

SEQ ID NO: 1226703 - protein, 9 aa, Homo Sapiens
IVVIGHMDS

SEQ ID NO: 1226704 - protein, 9 aa, Homo Sapiens
CSPECSCAV

SEQ ID NO: 1226705 - protein, 9 aa, Homo Sapiens
ELQPVLFSM

SEQ ID NO: 1226706 - protein, 9 aa, Homo Sapiens
QQQYAGLLS

SEQ ID NO: 1226707 - protein, 9 aa, Homo Sapiens
PFLAGLTTH

SEQ ID NO: 1226708 - protein, 9 aa, Homo Sapiens
GPEPGPGDS

SEQ ID NO: 1226709 - protein, 9 aa, Homo Sapiens
IHNYSAALG

SEQ ID NO: 1226710 - protein, 9 aa, Homo Sapiens
SMRSLTEDK

SEQ ID NO: 1226711 - protein, 9 aa, Homo Sapiens
LNLSSDVRY

SEQ ID NO: 1226712 - protein, 9 aa, Homo Sapiens
GPPLTKGNA

SEQ ID NO: 1226713 - protein, 9 aa, Homo Sapiens
SLPAFIKLW

SEQ ID NO: 1226714 - protein, 9 aa, Homo Sapiens
GTGGTFVFR

SEQ ID NO: 1226715 - protein, 9 aa, Homo Sapiens
LQQFEKLKF

SEQ ID NO: 1226716 - protein, 9 aa, Homo Sapiens
GGERGLWWR

SEQ ID NO: 1226717 - protein, 9 aa, Homo Sapiens
AAQTLALTQ

SEQ ID NO: 1226718 - protein, 9 aa, Homo Sapiens
KAFVTCSSH

SEQ ID NO: 1226719 - protein, 9 aa, Homo Sapiens
HLLVFINSF

SEQ ID NO: 1226720 - protein, 9 aa, Homo Sapiens
LTRTPTMGW

SEQ ID NO: 1226721 - protein, 9 aa, Homo Sapiens
EARAPHVCQ

SEQ ID NO: 1226722 - protein, 9 aa, Homo Sapiens
KNASLGKFL

SEQ ID NO: 1226723 - protein, 9 aa, Homo Sapiens
SLTILDDEP

SEQ ID NO: 1226724 - protein, 9 aa, Homo Sapiens
FDMDELNFP

SEQ ID NO: 1226725 - protein, 9 aa, Homo Sapiens
RWCPKAETT

SEQ ID NO: 1226726 - protein, 9 aa, Homo Sapiens
ERLRVEMDV

SEQ ID NO: 1226727 - protein, 9 aa, Homo Sapiens
EENIQGGCS

SEQ ID NO: 1226728 - protein, 9 aa, Homo Sapiens
PPEGFLIWK

SEQ ID NO: 1226729 - protein, 9 aa, Homo Sapiens
AQPIEKIVT

SEQ ID NO: 1226730 - protein, 9 aa, Homo Sapiens
EDNAEASGF

SEQ ID NO: 1226731 - protein, 9 aa, Homo Sapiens
KAFTTSSHI

SEQ ID NO: 1226732 - protein, 9 aa, Homo Sapiens
TQTVAMSPL

SEQ ID NO: 1226733 - protein, 9 aa, Homo Sapiens
ERRKISRTQ

SEQ ID NO: 1226734 - protein, 9 aa, Homo Sapiens
QRAQKGRYV

SEQ ID NO: 1226735 - protein, 9 aa, Homo Sapiens
DSYFLLPTS

SEQ ID NO: 1226736 - protein, 9 aa, Homo Sapiens
RKYVLTPSE

SEQ ID NO: 1226737 - protein, 9 aa, Homo Sapiens
LTSTQGPHR

SEQ ID NO: 1226738 - protein, 9 aa, Homo Sapiens
NLRLKRCHI

SEQ ID NO: 1226739 - protein, 9 aa, Homo Sapiens
AIKQGDLPP

SEQ ID NO: 1226740 - protein, 9 aa, Homo Sapiens
HSHLIQHQI

SEQ ID NO: 1226741 - protein, 9 aa, Homo Sapiens
SLGLARTSA

SEQ ID NO: 1226742 - protein, 9 aa, Homo Sapiens
CIEFYELDK

SEQ ID NO: 1226743 - protein, 9 aa, Homo Sapiens
CGDCMEKQM

SEQ ID NO: 1226744 - protein, 9 aa, Homo Sapiens
YRYSEKPMN

SEQ ID NO: 1226745 - protein, 9 aa, Homo Sapiens
QDQVNLRTS

SEQ ID NO: 1226746 - protein, 9 aa, Homo Sapiens
LKCSVPPTQ

SEQ ID NO: 1226747 - protein, 9 aa, Homo Sapiens
MWSVWDANV

SEQ ID NO: 1226748 - protein, 9 aa, Homo Sapiens
DFKGNFPEQ

SEQ ID NO: 1226749 - protein, 9 aa, Homo Sapiens
PAGAWSFQP

SEQ ID NO: 1226750 - protein, 9 aa, Homo Sapiens
ATRMTKGFT

SEQ ID NO: 1226751 - protein, 9 aa, Homo Sapiens
SFQRKFVGD

SEQ ID NO: 1226752 - protein, 9 aa, Homo Sapiens
EDELVEADE

SEQ ID NO: 1226753 - protein, 9 aa, Homo Sapiens
CAESLKSNG

SEQ ID NO: 1226754 - protein, 9 aa, Homo Sapiens
LDFNHITGK

SEQ ID NO: 1226755 - protein, 9 aa, Homo Sapiens
KRTVACASY

SEQ ID NO: 1226756 - protein, 9 aa, Homo Sapiens
ILFYERMNT

SEQ ID NO: 1226757 - protein, 9 aa, Homo Sapiens
YEELVNNVE

SEQ ID NO: 1226758 - protein, 9 aa, Homo Sapiens
REFHALIKG

SEQ ID NO: 1226759 - protein, 9 aa, Homo Sapiens
CIQSQIGGE

SEQ ID NO: 1226760 - protein, 9 aa, Homo Sapiens
PAGPPHHRP

SEQ ID NO: 1226761 - protein, 9 aa, Homo Sapiens
EQALSYFTR

SEQ ID NO: 1226762 - protein, 9 aa, Homo Sapiens
HSPWPMAAH

SEQ ID NO: 1226763 - protein, 9 aa, Homo Sapiens
HIKMEEDAL

SEQ ID NO: 1226764 - protein, 9 aa, Homo Sapiens
HPRDVMPQL

SEQ ID NO: 1226765 - protein, 9 aa, Homo Sapiens
DGHQQGVLQ

SEQ ID NO: 1226766 - protein, 9 aa, Homo Sapiens
RSASSPRGT

SEQ ID NO: 1226767 - protein, 9 aa, Homo Sapiens
ACEEFWSRF

SEQ ID NO: 1226768 - protein, 9 aa, Homo Sapiens
SSSFTQHMR

SEQ ID NO: 1226769 - protein, 9 aa, Homo Sapiens
SISSISVAG

SEQ ID NO: 1226770 - protein, 9 aa, Homo Sapiens
ILSYNMLIT

SEQ ID NO: 1226771 - protein, 9 aa, Homo Sapiens
VISIDRYTA

SEQ ID NO: 1226772 - protein, 9 aa, Homo Sapiens
HVHLLSLFK

SEQ ID NO: 1226773 - protein, 9 aa, Homo Sapiens
VTMDSLEDT

SEQ ID NO: 1226774 - protein, 9 aa, Homo Sapiens
MTKNMGGDS

SEQ ID NO: 1226775 - protein, 9 aa, Homo Sapiens
SNCLAQICS

SEQ ID NO: 1226776 - protein, 9 aa, Homo Sapiens
LQTGCFCNT

SEQ ID NO: 1226777 - protein, 9 aa, Homo Sapiens
VVQCGNRPY

SEQ ID NO: 1226778 - protein, 9 aa, Homo Sapiens
ILHKYYERK

SEQ ID NO: 1226779 - protein, 9 aa, Homo Sapiens
TKEDYGHLP

SEQ ID NO: 1226780 - protein, 9 aa, Homo Sapiens
FAHCPLDLR

SEQ ID NO: 1226781 - protein, 9 aa, Homo Sapiens
FPEGSKKED

SEQ ID NO: 1226782 - protein, 9 aa, Homo Sapiens
ISFLGCVAH

SEQ ID NO: 1226783 - protein, 9 aa, Homo Sapiens
ITHRRARWR

SEQ ID NO: 1226784 - protein, 9 aa, Homo Sapiens
HLVSAISQK

SEQ ID NO: 1226785 - protein, 9 aa, Homo Sapiens
LELQRCSLE

SEQ ID NO: 1226786 - protein, 9 aa, Homo Sapiens
LDTGSFAGL

SEQ ID NO: 1226787 - protein, 9 aa, Homo Sapiens
NMLHGATEL

SEQ ID NO: 1226788 - protein, 9 aa, Homo Sapiens
VCVQHQGDL

SEQ ID NO: 1226789 - protein, 9 aa, Homo Sapiens
IYEMMGHIK

SEQ ID NO: 1226790 - protein, 9 aa, Homo Sapiens
RLCVCCAEC

SEQ ID NO: 1226791 - protein, 9 aa, Homo Sapiens
NIYMPRKYQ

SEQ ID NO: 1226792 - protein, 9 aa, Homo Sapiens
ANTYESHIL

SEQ ID NO: 1226793 - protein, 9 aa, Homo Sapiens
KGRYVGAAL

SEQ ID NO: 1226794 - protein, 9 aa, Homo Sapiens
FQLQQFEKL

SEQ ID NO: 1226795 - protein, 9 aa, Homo Sapiens
SHWENYNTG

SEQ ID NO: 1226796 - protein, 9 aa, Homo Sapiens
MDAYLLYTP

SEQ ID NO: 1226797 - protein, 9 aa, Homo Sapiens
SVLGLHEKE

SEQ ID NO: 1226798 - protein, 9 aa, Homo Sapiens
RGGNLYVLK

SEQ ID NO: 1226799 - protein, 9 aa, Homo Sapiens
YAINKYDVV

SEQ ID NO: 1226800 - protein, 9 aa, Homo Sapiens
HFALTIPHC

SEQ ID NO: 1226801 - protein, 9 aa, Homo Sapiens
GISYSTLPM

SEQ ID NO: 1226802 - protein, 9 aa, Homo Sapiens
IENLRFAHN

SEQ ID NO: 1226803 - protein, 9 aa, Homo Sapiens
TIVSKNVLQ

SEQ ID NO: 1226804 - protein, 9 aa, Homo Sapiens
LGLMEKEQK

SEQ ID NO: 1226805 - protein, 9 aa, Homo Sapiens
IIPMDPNGL

SEQ ID NO: 1226806 - protein, 9 aa, Homo Sapiens
VSGTDGKVA

SEQ ID NO: 1226807 - protein, 9 aa, Homo Sapiens
MMNSVLEKF

SEQ ID NO: 1226808 - protein, 9 aa, Homo Sapiens
LIELEKIDD

SEQ ID NO: 1226809 - protein, 9 aa, Homo Sapiens
VHRGFCATL

SEQ ID NO: 1226810 - protein, 9 aa, Homo Sapiens
AAWDGSPDI

SEQ ID NO: 1226811 - protein, 9 aa, Homo Sapiens
CFTISALHS

SEQ ID NO: 1226812 - protein, 9 aa, Homo Sapiens
RHSPHHMVR

SEQ ID NO: 1226813 - protein, 9 aa, Homo Sapiens
FALSDQRGL

SEQ ID NO: 1226814 - protein, 9 aa, Homo Sapiens
HFRSLCTKL

SEQ ID NO: 1226815 - protein, 9 aa, Homo Sapiens
GRKKTFSTY

SEQ ID NO: 1226816 - protein, 9 aa, Homo Sapiens
HREKEREEW

SEQ ID NO: 1226817 - protein, 9 aa, Homo Sapiens
VLGEFERLH

SEQ ID NO: 1226818 - protein, 9 aa, Homo Sapiens
QKKENEIRV

SEQ ID NO: 1226819 - protein, 9 aa, Homo Sapiens
DLTMDTALT

SEQ ID NO: 1226820 - protein, 9 aa, Homo Sapiens
RTLQTNMAK

SEQ ID NO: 1226821 - protein, 9 aa, Homo Sapiens
VHPDQDLFL

SEQ ID NO: 1226822 - protein, 9 aa, Homo Sapiens
FGSAVNLHP

SEQ ID NO: 1226823 - protein, 9 aa, Homo Sapiens
HTMAQVDAW

SEQ ID NO: 1226824 - protein, 9 aa, Homo Sapiens
LAKGIRKKK

SEQ ID NO: 1226825 - protein, 9 aa, Homo Sapiens
VRTTTGSTH

SEQ ID NO: 1226826 - protein, 9 aa, Homo Sapiens
LEKFTILQV

SEQ ID NO: 1226827 - protein, 9 aa, Homo Sapiens
PGLPTGFDD

SEQ ID NO: 1226828 - protein, 9 aa, Homo Sapiens
SLSYHQHFG

SEQ ID NO: 1226829 - protein, 9 aa, Homo Sapiens
CRPYMTPER

SEQ ID NO: 1226830 - protein, 9 aa, Homo Sapiens
LWAILQNQG

SEQ ID NO: 1226831 - protein, 9 aa, Homo Sapiens
IPKIYFGTH

SEQ ID NO: 1226832 - protein, 9 aa, Homo Sapiens
FSNYITMDP

SEQ ID NO: 1226833 - protein, 9 aa, Homo Sapiens
HMVSLHYGI

SEQ ID NO: 1226834 - protein, 9 aa, Homo Sapiens
ESDIIYKKL

SEQ ID NO: 1226835 - protein, 9 aa, Homo Sapiens
AVPCPPPRA

SEQ ID NO: 1226836 - protein, 9 aa, Homo Sapiens
YNVMLVRLN

SEQ ID NO: 1226837 - protein, 9 aa, Homo Sapiens
NTVLAFKRE

SEQ ID NO: 1226838 - protein, 9 aa, Homo Sapiens
TSFFGKYDS

SEQ ID NO: 1226839 - protein, 9 aa, Homo Sapiens
RVTRMVVSV

SEQ ID NO: 1226840 - protein, 9 aa, Homo Sapiens
QVDVLTQIG

SEQ ID NO: 1226841 - protein, 9 aa, Homo Sapiens
PQQCVVCLQ

SEQ ID NO: 1226842 - protein, 9 aa, Homo Sapiens
FEVSFLPYT

SEQ ID NO: 1226843 - protein, 9 aa, Homo Sapiens
ERHMLIHVT

SEQ ID NO: 1226844 - protein, 9 aa, Homo Sapiens
ESWLRTDCF

SEQ ID NO: 1226845 - protein, 9 aa, Homo Sapiens
ETHEKLSQI

SEQ ID NO: 1226846 - protein, 9 aa, Homo Sapiens
TNMHGMKAA

SEQ ID NO: 1226847 - protein, 9 aa, Homo Sapiens
PATYRLMAH

SEQ ID NO: 1226848 - protein, 9 aa, Homo Sapiens
SPPPGSGGD

SEQ ID NO: 1226849 - protein, 9 aa, Homo Sapiens
LWQGSRKKG

SEQ ID NO: 1226850 - protein, 9 aa, Homo Sapiens
YTKGVIPSS

SEQ ID NO: 1226851 - protein, 9 aa, Homo Sapiens
VEFEFHTTT

SEQ ID NO: 1226852 - protein, 9 aa, Homo Sapiens
TILLVALWV

SEQ ID NO: 1226853 - protein, 9 aa, Homo Sapiens
REPKHERCP

SEQ ID NO: 1226854 - protein, 9 aa, Homo Sapiens
SGNLRMPPN

SEQ ID NO: 1226855 - protein, 9 aa, Homo Sapiens
VPGSGKVEE

SEQ ID NO: 1226856 - protein, 9 aa, Homo Sapiens
YVPPTCTYE

SEQ ID NO: 1226857 - protein, 9 aa, Homo Sapiens
KHFCDGKEY

SEQ ID NO: 1226858 - protein, 9 aa, Homo Sapiens
RFSVSTLHN

SEQ ID NO: 1226859 - protein, 9 aa, Homo Sapiens
NLKGVLNSI

SEQ ID NO: 1226860 - protein, 9 aa, Homo Sapiens
DLCYQNDDS

SEQ ID NO: 1226861 - protein, 9 aa, Homo Sapiens
AEQLQQSLG

SEQ ID NO: 1226862 - protein, 9 aa, Homo Sapiens
IGIPGLEKV

SEQ ID NO: 1226863 - protein, 9 aa, Homo Sapiens
LQEEIDTLE

SEQ ID NO: 1226864 - protein, 9 aa, Homo Sapiens
NLKKHMCLH

SEQ ID NO: 1226865 - protein, 9 aa, Homo Sapiens
CVNSFQVYM

SEQ ID NO: 1226866 - protein, 9 aa, Homo Sapiens
ITLMSPKHK

SEQ ID NO: 1226867 - protein, 9 aa, Homo Sapiens
HYYETYIRS

SEQ ID NO: 1226868 - protein, 9 aa, Homo Sapiens
SLTKKLHHL

SEQ ID NO: 1226869 - protein, 9 aa, Homo Sapiens
PGGGRGGPD

SEQ ID NO: 1226870 - protein, 9 aa, Homo Sapiens
SRPTAVGTM

SEQ ID NO: 1226871 - protein, 9 aa, Homo Sapiens
DSSLPRVTR

SEQ ID NO: 1226872 - protein, 9 aa, Homo Sapiens
INEKKIADC

SEQ ID NO: 1226873 - protein, 9 aa, Homo Sapiens
LIGCFALLW

SEQ ID NO: 1226874 - protein, 9 aa, Homo Sapiens
LCLPLLEMY

SEQ ID NO: 1226875 - protein, 9 aa, Homo Sapiens
QRHFAEWCH

SEQ ID NO: 1226876 - protein, 9 aa, Homo Sapiens
PESTMDNSL

SEQ ID NO: 1226877 - protein, 9 aa, Homo Sapiens
PAASQEATA

SEQ ID NO: 1226878 - protein, 9 aa, Homo Sapiens
VMTHLSGHS

SEQ ID NO: 1226879 - protein, 9 aa, Homo Sapiens
AHQCTKMYE

SEQ ID NO: 1226880 - protein, 9 aa, Homo Sapiens
KLIEKCQGA

SEQ ID NO: 1226881 - protein, 9 aa, Homo Sapiens
LCWSVPGSF

SEQ ID NO: 1226882 - protein, 9 aa, Homo Sapiens
FHMLFYTMK

SEQ ID NO: 1226883 - protein, 9 aa, Homo Sapiens
HRLLHQSII

SEQ ID NO: 1226884 - protein, 9 aa, Homo Sapiens
LWLQKNQDL

SEQ ID NO: 1226885 - protein, 9 aa, Homo Sapiens
LLLHAEPYP

SEQ ID NO: 1226886 - protein, 9 aa, Homo Sapiens
KPVLSVCMR

SEQ ID NO: 1226887 - protein, 9 aa, Homo Sapiens
NSQVSESLW

SEQ ID NO: 1226888 - protein, 9 aa, Homo Sapiens
VLTQKTYGA

SEQ ID NO: 1226889 - protein, 9 aa, Homo Sapiens
VFLPFLIII

SEQ ID NO: 1226890 - protein, 9 aa, Homo Sapiens
VCAMREMNG

SEQ ID NO: 1226891 - protein, 9 aa, Homo Sapiens
PTIRIPNRF

SEQ ID NO: 1226892 - protein, 9 aa, Homo Sapiens
MLRTRAKSL

SEQ ID NO: 1226893 - protein, 9 aa, Homo Sapiens
CSFMEPWAS

SEQ ID NO: 1226894 - protein, 9 aa, Homo Sapiens
VQRFLCLLS

SEQ ID NO: 1226895 - protein, 9 aa, Homo Sapiens
LKIHIDFSL

SEQ ID NO: 1226896 - protein, 9 aa, Homo Sapiens
VVMAKESVN

SEQ ID NO: 1226897 - protein, 9 aa, Homo Sapiens
LRRQFTSQA

SEQ ID NO: 1226898 - protein, 9 aa, Homo Sapiens
TSRLSSDEG

SEQ ID NO: 1226899 - protein, 9 aa, Homo Sapiens
KDVLQETIK

SEQ ID NO: 1226900 - protein, 9 aa, Homo Sapiens
EEILDLFDN

SEQ ID NO: 1226901 - protein, 9 aa, Homo Sapiens
WKRLVELLQ

SEQ ID NO: 1226902 - protein, 9 aa, Homo Sapiens
ITGQKVGTL

SEQ ID NO: 1226903 - protein, 9 aa, Homo Sapiens
YTYNAAQAG

SEQ ID NO: 1226904 - protein, 9 aa, Homo Sapiens
SVAADSAQK

SEQ ID NO: 1226905 - protein, 9 aa, Homo Sapiens
MAKVMSVGD

SEQ ID NO: 1226906 - protein, 9 aa, Homo Sapiens
TATRRPCQP

SEQ ID NO: 1226907 - protein, 9 aa, Homo Sapiens
GTFYERKIV

SEQ ID NO: 1226908 - protein, 9 aa, Homo Sapiens
VNENQDLNI

SEQ ID NO: 1226909 - protein, 9 aa, Homo Sapiens
TPYELRMID

SEQ ID NO: 1226910 - protein, 9 aa, Homo Sapiens
NSGHLLVLS

SEQ ID NO: 1226911 - protein, 9 aa, Homo Sapiens
PLELYMSSN

SEQ ID NO: 1226912 - protein, 9 aa, Homo Sapiens
VAALGATAA

SEQ ID NO: 1226913 - protein, 9 aa, Homo Sapiens
CHLLHALSD

SEQ ID NO: 1226914 - protein, 9 aa, Homo Sapiens
KMKQMTTIL

SEQ ID NO: 1226915 - protein, 9 aa, Homo Sapiens
LPLSVMCPG

SEQ ID NO: 1226916 - protein, 9 aa, Homo Sapiens
PQDVPVPPP

SEQ ID NO: 1226917 - protein, 9 aa, Homo Sapiens
GVLLYEMIC

SEQ ID NO: 1226918 - protein, 9 aa, Homo Sapiens
HLCDIRSLP

SEQ ID NO: 1226919 - protein, 9 aa, Homo Sapiens
DIDELENDA

SEQ ID NO: 1226920 - protein, 9 aa, Homo Sapiens
PCPAQEEAE

SEQ ID NO: 1226921 - protein, 9 aa, Homo Sapiens
EYDSDDEQE

SEQ ID NO: 1226922 - protein, 9 aa, Homo Sapiens
ASQKSVACN

SEQ ID NO: 1226923 - protein, 9 aa, Homo Sapiens
GFPTLFTFI

SEQ ID NO: 1226924 - protein, 9 aa, Homo Sapiens
KDSEEQQLR

SEQ ID NO: 1226925 - protein, 9 aa, Homo Sapiens
IQVLLAQVQ

SEQ ID NO: 1226926 - protein, 9 aa, Homo Sapiens
IMMRTTWKL

SEQ ID NO: 1226927 - protein, 9 aa, Homo Sapiens
SKVYCGYSV

SEQ ID NO: 1226928 - protein, 9 aa, Homo Sapiens
KILQKAEDI

SEQ ID NO: 1226929 - protein, 9 aa, Homo Sapiens
QTYVDPSDM

SEQ ID NO: 1226930 - protein, 9 aa, Homo Sapiens
EKLQLCLPL

SEQ ID NO: 1226931 - protein, 9 aa, Homo Sapiens
TPCYYRGHM

SEQ ID NO: 1226932 - protein, 9 aa, Homo Sapiens
QGLPSIVCL

SEQ ID NO: 1226933 - protein, 9 aa, Homo Sapiens
HIHTHFESK

SEQ ID NO: 1226934 - protein, 9 aa, Homo Sapiens
GTYGVLCAD

SEQ ID NO: 1226935 - protein, 9 aa, Homo Sapiens
PWSLQSCWH

SEQ ID NO: 1226936 - protein, 9 aa, Homo Sapiens
HTGHLWLGT

SEQ ID NO: 1226937 - protein, 9 aa, Homo Sapiens
LSWVVSMLH

SEQ ID NO: 1226938 - protein, 9 aa, Homo Sapiens
TGTQWWKTN

SEQ ID NO: 1226939 - protein, 9 aa, Homo Sapiens
GVEQAPTQN

SEQ ID NO: 1226940 - protein, 9 aa, Homo Sapiens
GWLTDGSVR

SEQ ID NO: 1226941 - protein, 9 aa, Homo Sapiens
LHKHCRPKL

SEQ ID NO: 1226942 - protein, 9 aa, Homo Sapiens
KYKLKSYLQ

SEQ ID NO: 1226943 - protein, 9 aa, Homo Sapiens
VSRQELRQW

SEQ ID NO: 1226944 - protein, 9 aa, Homo Sapiens
CMHWMKVTV

SEQ ID NO: 1226945 - protein, 9 aa, Homo Sapiens
FLYILMDRG

SEQ ID NO: 1226946 - protein, 9 aa, Homo Sapiens
AFNLKKDDV

SEQ ID NO: 1226947 - protein, 9 aa, Homo Sapiens
YVMFGGKQV

SEQ ID NO: 1226948 - protein, 9 aa, Homo Sapiens
IGTVLISCI

SEQ ID NO: 1226949 - protein, 9 aa, Homo Sapiens
GLLATRMEV

SEQ ID NO: 1226950 - protein, 9 aa, Homo Sapiens
AGRQTMHNY

SEQ ID NO: 1226951 - protein, 9 aa, Homo Sapiens
CPLGHVPLT

SEQ ID NO: 1226952 - protein, 9 aa, Homo Sapiens
LSLKITFIN

SEQ ID NO: 1226953 - protein, 9 aa, Homo Sapiens
NQHREKKRG

SEQ ID NO: 1226954 - protein, 9 aa, Homo Sapiens
HCFKKRTHL

SEQ ID NO: 1226955 - protein, 9 aa, Homo Sapiens
KKDSCSGQW

SEQ ID NO: 1226956 - protein, 9 aa, Homo Sapiens
STKARDSEL

SEQ ID NO: 1226957 - protein, 9 aa, Homo Sapiens
PSPYHADPS

SEQ ID NO: 1226958 - protein, 9 aa, Homo Sapiens
DTKEAITNY

SEQ ID NO: 1226959 - protein, 9 aa, Homo Sapiens
DSCSGQWAH

SEQ ID NO: 1226960 - protein, 9 aa, Homo Sapiens
RCNYAHALD

SEQ ID NO: 1226961 - protein, 9 aa, Homo Sapiens
EARVWEATV

SEQ ID NO: 1226962 - protein, 9 aa, Homo Sapiens
GHMEVLTDK

SEQ ID NO: 1226963 - protein, 9 aa, Homo Sapiens
ASAYHAVEV

SEQ ID NO: 1226964 - protein, 9 aa, Homo Sapiens
LDVINLVQD

SEQ ID NO: 1226965 - protein, 9 aa, Homo Sapiens
LIKMKQMTT

SEQ ID NO: 1226966 - protein, 9 aa, Homo Sapiens
LAHGDRRGR

SEQ ID NO: 1226967 - protein, 9 aa, Homo Sapiens
PRGMAADMG

SEQ ID NO: 1226968 - protein, 9 aa, Homo Sapiens
IACKRAKIP

SEQ ID NO: 1226969 - protein, 9 aa, Homo Sapiens
HSDCCIKLL

SEQ ID NO: 1226970 - protein, 9 aa, Homo Sapiens
SCQDWKKAW

SEQ ID NO: 1226971 - protein, 9 aa, Homo Sapiens
STIGNMMSI

SEQ ID NO: 1226972 - protein, 9 aa, Homo Sapiens
ILHTEDDPV

SEQ ID NO: 1226973 - protein, 9 aa, Homo Sapiens
HTRNQHVSV

SEQ ID NO: 1226974 - protein, 9 aa, Homo Sapiens
DGRIRLRRI

SEQ ID NO: 1226975 - protein, 9 aa, Homo Sapiens
RQGKNHKMC

SEQ ID NO: 1226976 - protein, 9 aa, Homo Sapiens
VVFLVVYMI

SEQ ID NO: 1226977 - protein, 9 aa, Homo Sapiens
LLEGSDLES

SEQ ID NO: 1226978 - protein, 9 aa, Homo Sapiens
SSPLTTHKI

SEQ ID NO: 1226979 - protein, 9 aa, Homo Sapiens
FFLLTVKFY

SEQ ID NO: 1226980 - protein, 9 aa, Homo Sapiens
CLYWCCCCS

SEQ ID NO: 1226981 - protein, 9 aa, Homo Sapiens
WCSIVRSHS

SEQ ID NO: 1226982 - protein, 9 aa, Homo Sapiens
VGTLFKDMP

SEQ ID NO: 1226983 - protein, 9 aa, Homo Sapiens
NILTCCQCC

SEQ ID NO: 1226984 - protein, 9 aa, Homo Sapiens
LHRIPTHPF

SEQ ID NO: 1226985 - protein, 9 aa, Homo Sapiens
AGDSACQDV

SEQ ID NO: 1226986 - protein, 9 aa, Homo Sapiens
HPEIVGSGP

SEQ ID NO: 1226987 - protein, 9 aa, Homo Sapiens
PSIGEDTAA

SEQ ID NO: 1226988 - protein, 9 aa, Homo Sapiens
GNMENSIFV

SEQ ID NO: 1226989 - protein, 9 aa, Homo Sapiens
GTPAPAFWN

SEQ ID NO: 1226990 - protein, 9 aa, Homo Sapiens
ALHKVFLSI

SEQ ID NO: 1226991 - protein, 9 aa, Homo Sapiens
ALILVSDIC

SEQ ID NO: 1226992 - protein, 9 aa, Homo Sapiens
WFMCGPAEP

SEQ ID NO: 1226993 - protein, 9 aa, Homo Sapiens
FHTVPGQSG

SEQ ID NO: 1226994 - protein, 9 aa, Homo Sapiens
DRQDAVHAV

SEQ ID NO: 1226995 - protein, 9 aa, Homo Sapiens
LNKCTSVSQ

SEQ ID NO: 1226996 - protein, 9 aa, Homo Sapiens
EIRRELEEL

SEQ ID NO: 1226997 - protein, 9 aa, Homo Sapiens
RSVKGLVTV

SEQ ID NO: 1226998 - protein, 9 aa, Homo Sapiens
TRVVSPIIN

SEQ ID NO: 1226999 - protein, 9 aa, Homo Sapiens
DPSATPPIS

SEQ ID NO: 1227000 - protein, 9 aa, Homo Sapiens
GDNMFFYQR

SEQ ID NO: 1227001 - protein, 9 aa, Homo Sapiens
APVTGTVSG

SEQ ID NO: 1227002 - protein, 9 aa, Homo Sapiens
KECVLEAEN

SEQ ID NO: 1227003 - protein, 9 aa, Homo Sapiens
YPTNQRATS

SEQ ID NO: 1227004 - protein, 9 aa, Homo Sapiens
KGADLDPHR

SEQ ID NO: 1227005 - protein, 9 aa, Homo Sapiens
YGDHHHPSA

SEQ ID NO: 1227006 - protein, 9 aa, Homo Sapiens
ETQSMIVVP

SEQ ID NO: 1227007 - protein, 9 aa, Homo Sapiens
AADQDEGIN

SEQ ID NO: 1227008 - protein, 9 aa, Homo Sapiens
RKFDIAIRL

SEQ ID NO: 1227009 - protein, 9 aa, Homo Sapiens
FKHTAPSFT

SEQ ID NO: 1227010 - protein, 9 aa, Homo Sapiens
IDKIRMYNV

SEQ ID NO: 1227011 - protein, 9 aa, Homo Sapiens
NLTMKEVID

SEQ ID NO: 1227012 - protein, 9 aa, Homo Sapiens
ALPPDAQDI

SEQ ID NO: 1227013 - protein, 9 aa, Homo Sapiens
QQVHTGERH

SEQ ID NO: 1227014 - protein, 9 aa, Homo Sapiens
MEQLVFCQD

SEQ ID NO: 1227015 - protein, 9 aa, Homo Sapiens
VPESSFYSI

SEQ ID NO: 1227016 - protein, 9 aa, Homo Sapiens
VSLQTEECV

SEQ ID NO: 1227017 - protein, 9 aa, Homo Sapiens
SGLRDTMTP

SEQ ID NO: 1227018 - protein, 9 aa, Homo Sapiens
SPNCNQHYG

SEQ ID NO: 1227019 - protein, 9 aa, Homo Sapiens
GLAVVTQSA

SEQ ID NO: 1227020 - protein, 9 aa, Homo Sapiens
RPWPPSFSA

SEQ ID NO: 1227021 - protein, 9 aa, Homo Sapiens
CFDCMYGDI

SEQ ID NO: 1227022 - protein, 9 aa, Homo Sapiens
RVRKHGGSS

SEQ ID NO: 1227023 - protein, 9 aa, Homo Sapiens
RRVLEMSDI

SEQ ID NO: 1227024 - protein, 9 aa, Homo Sapiens
KPVMVIGAC

SEQ ID NO: 1227025 - protein, 9 aa, Homo Sapiens
RYCTSTLCH

SEQ ID NO: 1227026 - protein, 9 aa, Homo Sapiens
LAMTLRLRE

SEQ ID NO: 1227027 - protein, 9 aa, Homo Sapiens
RINDLELLG

SEQ ID NO: 1227028 - protein, 9 aa, Homo Sapiens
NQLIGTMQP

SEQ ID NO: 1227029 - protein, 9 aa, Homo Sapiens
LMFGGNILH

SEQ ID NO: 1227030 - protein, 9 aa, Homo Sapiens
RYHLFRGVC

SEQ ID NO: 1227031 - protein, 9 aa, Homo Sapiens
DHPLLQDAI

SEQ ID NO: 1227032 - protein, 9 aa, Homo Sapiens
RTLSVLAHW

SEQ ID NO: 1227033 - protein, 9 aa, Homo Sapiens
NIEAALRAD

SEQ ID NO: 1227034 - protein, 9 aa, Homo Sapiens
ALRRQKQES

SEQ ID NO: 1227035 - protein, 9 aa, Homo Sapiens
MLHNNGFRN

SEQ ID NO: 1227036 - protein, 9 aa, Homo Sapiens
KRDISLSLV

SEQ ID NO: 1227037 - protein, 9 aa, Homo Sapiens
RSEGSISAL

SEQ ID NO: 1227038 - protein, 9 aa, Homo Sapiens
AAVPLPCGP

SEQ ID NO: 1227039 - protein, 9 aa, Homo Sapiens
NQAKQGYLI

SEQ ID NO: 1227040 - protein, 9 aa, Homo Sapiens
PTPDATASP

SEQ ID NO: 1227041 - protein, 9 aa, Homo Sapiens
SIVSLLTES

SEQ ID NO: 1227042 - protein, 9 aa, Homo Sapiens
HGLSHLRCI

SEQ ID NO: 1227043 - protein, 9 aa, Homo Sapiens
VSRTPTLVF

SEQ ID NO: 1227044 - protein, 9 aa, Homo Sapiens
FGSMGPQYV

SEQ ID NO: 1227045 - protein, 9 aa, Homo Sapiens
CTDWESWCE

SEQ ID NO: 1227046 - protein, 9 aa, Homo Sapiens
ESLGYLTST

SEQ ID NO: 1227047 - protein, 9 aa, Homo Sapiens
MEVPLLGIV

SEQ ID NO: 1227048 - protein, 9 aa, Homo Sapiens
NGVCISKKK

SEQ ID NO: 1227049 - protein, 9 aa, Homo Sapiens
VLVGLFLSM

SEQ ID NO: 1227050 - protein, 9 aa, Homo Sapiens
EADKLTLVT

SEQ ID NO: 1227051 - protein, 9 aa, Homo Sapiens
YITQVILMY

SEQ ID NO: 1227052 - protein, 9 aa, Homo Sapiens
KQVVRKPLE

SEQ ID NO: 1227053 - protein, 9 aa, Homo Sapiens
TSTICGTPE

SEQ ID NO: 1227054 - protein, 9 aa, Homo Sapiens
IQAIMMMDE

SEQ ID NO: 1227055 - protein, 9 aa, Homo Sapiens
LKQMFQRLD

SEQ ID NO: 1227056 - protein, 9 aa, Homo Sapiens
VSVMERSKT

SEQ ID NO: 1227057 - protein, 9 aa, Homo Sapiens
EDSVIAYGQ

SEQ ID NO: 1227058 - protein, 9 aa, Homo Sapiens
DELDEQGSA

SEQ ID NO: 1227059 - protein, 9 aa, Homo Sapiens
RLHRLLAEE

SEQ ID NO: 1227060 - protein, 9 aa, Homo Sapiens
LLQENQKAQ

SEQ ID NO: 1227061 - protein, 9 aa, Homo Sapiens
FNCGRSGNS

SEQ ID NO: 1227062 - protein, 9 aa, Homo Sapiens
QRRMRITVK

SEQ ID NO: 1227063 - protein, 9 aa, Homo Sapiens
CLDGDLFRG

SEQ ID NO: 1227064 - protein, 9 aa, Homo Sapiens
EEELKMKNM

SEQ ID NO: 1227065 - protein, 9 aa, Homo Sapiens
TAPGAGDKA

SEQ ID NO: 1227066 - protein, 9 aa, Homo Sapiens
INVVAWSPS

SEQ ID NO: 1227067 - protein, 9 aa, Homo Sapiens
HVTCSLTPR

SEQ ID NO: 1227068 - protein, 9 aa, Homo Sapiens
HPQQKAGLL

SEQ ID NO: 1227069 - protein, 9 aa, Homo Sapiens
SISPKLNVD

SEQ ID NO: 1227070 - protein, 9 aa, Homo Sapiens
DQRITSDDL

SEQ ID NO: 1227071 - protein, 9 aa, Homo Sapiens
FSEPSVFQC

SEQ ID NO: 1227072 - protein, 9 aa, Homo Sapiens
VSKSLWFIG

SEQ ID NO: 1227073 - protein, 9 aa, Homo Sapiens
GTKDSVAST

SEQ ID NO: 1227074 - protein, 9 aa, Homo Sapiens
AECCMCNLR

SEQ ID NO: 1227075 - protein, 9 aa, Homo Sapiens
RVWGLGLPK

SEQ ID NO: 1227076 - protein, 9 aa, Homo Sapiens
SNKDQYSIS

SEQ ID NO: 1227077 - protein, 9 aa, Homo Sapiens
DIMPYRLGP

SEQ ID NO: 1227078 - protein, 9 aa, Homo Sapiens
TAPYDGCYL

SEQ ID NO: 1227079 - protein, 9 aa, Homo Sapiens
THMCPECKH

SEQ ID NO: 1227080 - protein, 9 aa, Homo Sapiens
ILYHGLICD

SEQ ID NO: 1227081 - protein, 9 aa, Homo Sapiens
VSDICARVR

SEQ ID NO: 1227082 - protein, 9 aa, Homo Sapiens
RALLLNKRR

SEQ ID NO: 1227083 - protein, 9 aa, Homo Sapiens
EFVIFNQKI

SEQ ID NO: 1227084 - protein, 9 aa, Homo Sapiens
LHSYALCTR

SEQ ID NO: 1227085 - protein, 9 aa, Homo Sapiens
EMSKGLKPS

SEQ ID NO: 1227086 - protein, 9 aa, Homo Sapiens
RHRISGGDH

SEQ ID NO: 1227087 - protein, 9 aa, Homo Sapiens
RSHNPTLHH

SEQ ID NO: 1227088 - protein, 9 aa, Homo Sapiens
TQGCQVTGR

SEQ ID NO: 1227089 - protein, 9 aa, Homo Sapiens
CDELREVNG

SEQ ID NO: 1227090 - protein, 9 aa, Homo Sapiens
YSQNLAKQQ

SEQ ID NO: 1227091 - protein, 9 aa, Homo Sapiens
IVCSGKFSS

SEQ ID NO: 1227092 - protein, 9 aa, Homo Sapiens
AAGYRLEEL

SEQ ID NO: 1227093 - protein, 9 aa, Homo Sapiens
ILNTSGAGP

SEQ ID NO: 1227094 - protein, 9 aa, Homo Sapiens
TCEECDKAF

SEQ ID NO: 1227095 - protein, 9 aa, Homo Sapiens
WTQGSHVWG

SEQ ID NO: 1227096 - protein, 9 aa, Homo Sapiens
QASSMAVVI

SEQ ID NO: 1227097 - protein, 9 aa, Homo Sapiens
PPTFETFTS

SEQ ID NO: 1227098 - protein, 9 aa, Homo Sapiens
ADRSYGRDI

SEQ ID NO: 1227099 - protein, 9 aa, Homo Sapiens
QTGLEAYSL

SEQ ID NO: 1227100 - protein, 9 aa, Homo Sapiens
AHYTTPEDV

SEQ ID NO: 1227101 - protein, 9 aa, Homo Sapiens
GGGRRDHHT

SEQ ID NO: 1227102 - protein, 9 aa, Homo Sapiens
KKNAPQVSD

SEQ ID NO: 1227103 - protein, 9 aa, Homo Sapiens
KHWPAVTSS

SEQ ID NO: 1227104 - protein, 9 aa, Homo Sapiens
NSLMSQLTC

SEQ ID NO: 1227105 - protein, 9 aa, Homo Sapiens
SCNTRFHFT

SEQ ID NO: 1227106 - protein, 9 aa, Homo Sapiens
SENVPPSNH

SEQ ID NO: 1227107 - protein, 9 aa, Homo Sapiens
SLSRTHSPL

SEQ ID NO: 1227108 - protein, 9 aa, Homo Sapiens
NSKKSNWIQ

SEQ ID NO: 1227109 - protein, 9 aa, Homo Sapiens
ICWYQCCPH

SEQ ID NO: 1227110 - protein, 9 aa, Homo Sapiens
DSYSCCQHS

SEQ ID NO: 1227111 - protein, 9 aa, Homo Sapiens
KPGLVHMML

SEQ ID NO: 1227112 - protein, 9 aa, Homo Sapiens
SRSYCIFTI

SEQ ID NO: 1227113 - protein, 9 aa, Homo Sapiens
QCASRRLGP

SEQ ID NO: 1227114 - protein, 9 aa, Homo Sapiens
SRVTHLEFF

SEQ ID NO: 1227115 - protein, 9 aa, Homo Sapiens
GKTMISFAL

SEQ ID NO: 1227116 - protein, 9 aa, Homo Sapiens
NLVRVGLRN

SEQ ID NO: 1227117 - protein, 9 aa, Homo Sapiens
WGVVADHFK

SEQ ID NO: 1227118 - protein, 9 aa, Homo Sapiens
MSQVYGVPH

SEQ ID NO: 1227119 - protein, 9 aa, Homo Sapiens
SHGMKKMSS

SEQ ID NO: 1227120 - protein, 9 aa, Homo Sapiens
IIQGKNQDA

SEQ ID NO: 1227121 - protein, 9 aa, Homo Sapiens
LAKHLQEEK

SEQ ID NO: 1227122 - protein, 9 aa, Homo Sapiens
VGTICSPEC

SEQ ID NO: 1227123 - protein, 9 aa, Homo Sapiens
FVFYSFSEL

SEQ ID NO: 1227124 - protein, 9 aa, Homo Sapiens
NKLSDQTVL

SEQ ID NO: 1227125 - protein, 9 aa, Homo Sapiens
NNIVKKYGD

SEQ ID NO: 1227126 - protein, 9 aa, Homo Sapiens
VRAVIKNRN

SEQ ID NO: 1227127 - protein, 9 aa, Homo Sapiens
KSQILTSYI

SEQ ID NO: 1227128 - protein, 9 aa, Homo Sapiens
NTYRQKQGI

SEQ ID NO: 1227129 - protein, 9 aa, Homo Sapiens
PSPVWDVRW

SEQ ID NO: 1227130 - protein, 9 aa, Homo Sapiens
GEGMGSSGA

SEQ ID NO: 1227131 - protein, 9 aa, Homo Sapiens
DYKAMSRDE

SEQ ID NO: 1227132 - protein, 9 aa, Homo Sapiens
VGTKLGLRD

SEQ ID NO: 1227133 - protein, 9 aa, Homo Sapiens
LLTAVHGSS

SEQ ID NO: 1227134 - protein, 9 aa, Homo Sapiens
TSIFSLAIA

SEQ ID NO: 1227135 - protein, 9 aa, Homo Sapiens
PSLADRQCE

SEQ ID NO: 1227136 - protein, 9 aa, Homo Sapiens
TFPKQCCML

SEQ ID NO: 1227137 - protein, 9 aa, Homo Sapiens
TCVFTNPLE

SEQ ID NO: 1227138 - protein, 9 aa, Homo Sapiens
EVTCVVFHY

SEQ ID NO: 1227139 - protein, 9 aa, Homo Sapiens
CLERDGIVV

SEQ ID NO: 1227140 - protein, 9 aa, Homo Sapiens
PMHPELVSS

SEQ ID NO: 1227141 - protein, 9 aa, Homo Sapiens
EPYQDSSSH

SEQ ID NO: 1227142 - protein, 9 aa, Homo Sapiens
EGHIDDLLR

SEQ ID NO: 1227143 - protein, 9 aa, Homo Sapiens
SPIINVINM

SEQ ID NO: 1227144 - protein, 9 aa, Homo Sapiens
TGRLQQEEV

SEQ ID NO: 1227145 - protein, 9 aa, Homo Sapiens
KNHYFEVLM

SEQ ID NO: 1227146 - protein, 9 aa, Homo Sapiens
VARKQDTWQ

SEQ ID NO: 1227147 - protein, 9 aa, Homo Sapiens
NVTWDGKYL

SEQ ID NO: 1227148 - protein, 9 aa, Homo Sapiens
PPSTILQQI

SEQ ID NO: 1227149 - protein, 9 aa, Homo Sapiens
GGKTIAVGL

SEQ ID NO: 1227150 - protein, 9 aa, Homo Sapiens
LSVYPLNAK

SEQ ID NO: 1227151 - protein, 9 aa, Homo Sapiens
LCRAVSEVA

SEQ ID NO: 1227152 - protein, 9 aa, Homo Sapiens
SCEICVLML

SEQ ID NO: 1227153 - protein, 9 aa, Homo Sapiens
GMTPTVITV

SEQ ID NO: 1227154 - protein, 9 aa, Homo Sapiens
NLDCKAGLH

SEQ ID NO: 1227155 - protein, 9 aa, Homo Sapiens
RHVVQKKSR

SEQ ID NO: 1227156 - protein, 9 aa, Homo Sapiens
ELASLDQTA

SEQ ID NO: 1227157 - protein, 9 aa, Homo Sapiens
DLDLLVPAP

SEQ ID NO: 1227158 - protein, 9 aa, Homo Sapiens
QWLTMTASE

SEQ ID NO: 1227159 - protein, 9 aa, Homo Sapiens
HINNDVNLR

SEQ ID NO: 1227160 - protein, 9 aa, Homo Sapiens
GSVTDSLCH

SEQ ID NO: 1227161 - protein, 9 aa, Homo Sapiens
HTTSCRHFH

SEQ ID NO: 1227162 - protein, 9 aa, Homo Sapiens
GKYLETLKQ

SEQ ID NO: 1227163 - protein, 9 aa, Homo Sapiens
PVFMVTGRQ

SEQ ID NO: 1227164 - protein, 9 aa, Homo Sapiens
SLYQVIASV

SEQ ID NO: 1227165 - protein, 9 aa, Homo Sapiens
HIRGPPTRQ

SEQ ID NO: 1227166 - protein, 9 aa, Homo Sapiens
TLVPARAGL

SEQ ID NO: 1227167 - protein, 9 aa, Homo Sapiens
FLIGLVCVT

SEQ ID NO: 1227168 - protein, 9 aa, Homo Sapiens
PQSKFNFTC

SEQ ID NO: 1227169 - protein, 9 aa, Homo Sapiens
EQLVTVLCD

SEQ ID NO: 1227170 - protein, 9 aa, Homo Sapiens
LGETMSSET

SEQ ID NO: 1227171 - protein, 9 aa, Homo Sapiens
AQLCHRLRH

SEQ ID NO: 1227172 - protein, 9 aa, Homo Sapiens
PSIMAGKFC

SEQ ID NO: 1227173 - protein, 9 aa, Homo Sapiens
VKLELQRCS

SEQ ID NO: 1227174 - protein, 9 aa, Homo Sapiens
PSNWCDGMS

SEQ ID NO: 1227175 - protein, 9 aa, Homo Sapiens
VKTAPQSRK

SEQ ID NO: 1227176 - protein, 9 aa, Homo Sapiens
ASLNQGISL

SEQ ID NO: 1227177 - protein, 9 aa, Homo Sapiens
TQTSKDDLD

SEQ ID NO: 1227178 - protein, 9 aa, Homo Sapiens
HFNSLYIPK

SEQ ID NO: 1227179 - protein, 9 aa, Homo Sapiens
KGEEKGLAV

SEQ ID NO: 1227180 - protein, 9 aa, Homo Sapiens
VVPYLRNRS

SEQ ID NO: 1227181 - protein, 9 aa, Homo Sapiens
PWNCRTIQG

SEQ ID NO: 1227182 - protein, 9 aa, Homo Sapiens
ERRRKLNMC

SEQ ID NO: 1227183 - protein, 9 aa, Homo Sapiens
WLRPDQRLM

SEQ ID NO: 1227184 - protein, 9 aa, Homo Sapiens
AARVVEEMA

SEQ ID NO: 1227185 - protein, 9 aa, Homo Sapiens
MSPLRTVML

SEQ ID NO: 1227186 - protein, 9 aa, Homo Sapiens
INMSAADYP

SEQ ID NO: 1227187 - protein, 9 aa, Homo Sapiens
LMKNDEPPL

SEQ ID NO: 1227188 - protein, 9 aa, Homo Sapiens
KVSAITIVS

SEQ ID NO: 1227189 - protein, 9 aa, Homo Sapiens
RERMMLMKT

SEQ ID NO: 1227190 - protein, 9 aa, Homo Sapiens
TVPGQSGCQ

SEQ ID NO: 1227191 - protein, 9 aa, Homo Sapiens
TMKIIVEDV

SEQ ID NO: 1227192 - protein, 9 aa, Homo Sapiens
LHAQDYPSP

SEQ ID NO: 1227193 - protein, 9 aa, Homo Sapiens
AFVCRIICT

SEQ ID NO: 1227194 - protein, 9 aa, Homo Sapiens
GLHLAYVTI

SEQ ID NO: 1227195 - protein, 9 aa, Homo Sapiens
LCFHTTVRC

SEQ ID NO: 1227196 - protein, 9 aa, Homo Sapiens
RLLSRVQTQ

SEQ ID NO: 1227197 - protein, 9 aa, Homo Sapiens
FGKQTAFLF

SEQ ID NO: 1227198 - protein, 9 aa, Homo Sapiens
TPGDAPDYD

SEQ ID NO: 1227199 - protein, 9 aa, Homo Sapiens
LVFLCLYCN

SEQ ID NO: 1227200 - protein, 9 aa, Homo Sapiens
YIARDTRHL

SEQ ID NO: 1227201 - protein, 9 aa, Homo Sapiens
CTTVSLTSY

SEQ ID NO: 1227202 - protein, 9 aa, Homo Sapiens
ETQCYCTDT

SEQ ID NO: 1227203 - protein, 9 aa, Homo Sapiens
HPVAELPRF

SEQ ID NO: 1227204 - protein, 9 aa, Homo Sapiens
GSAEYCTDS

SEQ ID NO: 1227205 - protein, 9 aa, Homo Sapiens
LKMTPHKSQ

SEQ ID NO: 1227206 - protein, 9 aa, Homo Sapiens
MMLMKTVEE

SEQ ID NO: 1227207 - protein, 9 aa, Homo Sapiens
SAICLICGN

SEQ ID NO: 1227208 - protein, 9 aa, Homo Sapiens
VNSEIWNAS

SEQ ID NO: 1227209 - protein, 9 aa, Homo Sapiens
YNSKGTDFL

SEQ ID NO: 1227210 - protein, 9 aa, Homo Sapiens
LHQPSSPSQ

SEQ ID NO: 1227211 - protein, 9 aa, Homo Sapiens
LGKTRRVNT

SEQ ID NO: 1227212 - protein, 9 aa, Homo Sapiens
SKSRHDMQT

SEQ ID NO: 1227213 - protein, 9 aa, Homo Sapiens
PSAPDDQGP

SEQ ID NO: 1227214 - protein, 9 aa, Homo Sapiens
SLFPGERLM

SEQ ID NO: 1227215 - protein, 9 aa, Homo Sapiens
GTKLEDSPL

SEQ ID NO: 1227216 - protein, 9 aa, Homo Sapiens
KDQYSISYT

SEQ ID NO: 1227217 - protein, 9 aa, Homo Sapiens
CPSVITTTS

SEQ ID NO: 1227218 - protein, 9 aa, Homo Sapiens
KQIRLCILP

SEQ ID NO: 1227219 - protein, 9 aa, Homo Sapiens
LVHQCYDSE

SEQ ID NO: 1227220 - protein, 9 aa, Homo Sapiens
SVTSNLTVL

SEQ ID NO: 1227221 - protein, 9 aa, Homo Sapiens
GPCLHPHFT

SEQ ID NO: 1227222 - protein, 9 aa, Homo Sapiens
RKSWRCCRK

SEQ ID NO: 1227223 - protein, 9 aa, Homo Sapiens
WERVWGLGL

SEQ ID NO: 1227224 - protein, 9 aa, Homo Sapiens
RQRCRKQGA

SEQ ID NO: 1227225 - protein, 9 aa, Homo Sapiens
FSARGGRTM

SEQ ID NO: 1227226 - protein, 9 aa, Homo Sapiens
EEKGLAVVT

SEQ ID NO: 1227227 - protein, 9 aa, Homo Sapiens
MDFVRQIQL

SEQ ID NO: 1227228 - protein, 9 aa, Homo Sapiens
PGASIVLSR

SEQ ID NO: 1227229 - protein, 9 aa, Homo Sapiens
ASFLTQWKD

SEQ ID NO: 1227230 - protein, 9 aa, Homo Sapiens
INHAFPDTD

SEQ ID NO: 1227231 - protein, 9 aa, Homo Sapiens
ELNTIQGAL

SEQ ID NO: 1227232 - protein, 9 aa, Homo Sapiens
KTVIKKRDQ

SEQ ID NO: 1227233 - protein, 9 aa, Homo Sapiens
WHQRQNQTW

SEQ ID NO: 1227234 - protein, 9 aa, Homo Sapiens
CDKKKEAQA

SEQ ID NO: 1227235 - protein, 9 aa, Homo Sapiens
QGQAGMAPV

SEQ ID NO: 1227236 - protein, 9 aa, Homo Sapiens
LSENDKKNK

SEQ ID NO: 1227237 - protein, 9 aa, Homo Sapiens
LDSQTFITI

SEQ ID NO: 1227238 - protein, 9 aa, Homo Sapiens
THSHRHTHT

SEQ ID NO: 1227239 - protein, 9 aa, Homo Sapiens
LRFIMPTLF

SEQ ID NO: 1227240 - protein, 9 aa, Homo Sapiens
SGEVRFSIH

SEQ ID NO: 1227241 - protein, 9 aa, Homo Sapiens
PCFFLLTVK

SEQ ID NO: 1227242 - protein, 9 aa, Homo Sapiens
REAALDTRF

SEQ ID NO: 1227243 - protein, 9 aa, Homo Sapiens
VHRLLVRVS

SEQ ID NO: 1227244 - protein, 9 aa, Homo Sapiens
NSLKKEKSA

SEQ ID NO: 1227245 - protein, 9 aa, Homo Sapiens
GKHHPYKMN

SEQ ID NO: 1227246 - protein, 9 aa, Homo Sapiens
CSCAVIEDD

SEQ ID NO: 1227247 - protein, 9 aa, Homo Sapiens
GTVILGLLK

SEQ ID NO: 1227248 - protein, 9 aa, Homo Sapiens
LNEQHLEGE

SEQ ID NO: 1227249 - protein, 9 aa, Homo Sapiens
FVASELGNH

SEQ ID NO: 1227250 - protein, 9 aa, Homo Sapiens
FNYQSFLTE

SEQ ID NO: 1227251 - protein, 9 aa, Homo Sapiens
GGDAPVFST

SEQ ID NO: 1227252 - protein, 9 aa, Homo Sapiens
GPVFAMCMT

SEQ ID NO: 1227253 - protein, 9 aa, Homo Sapiens
LLCHLLAQP

SEQ ID NO: 1227254 - protein, 9 aa, Homo Sapiens
LMDVGEMAM

SEQ ID NO: 1227255 - protein, 9 aa, Homo Sapiens
IINALPNTA

SEQ ID NO: 1227256 - protein, 9 aa, Homo Sapiens
VVVMGGKED

SEQ ID NO: 1227257 - protein, 9 aa, Homo Sapiens
SESQGEEEP

SEQ ID NO: 1227258 - protein, 9 aa, Homo Sapiens
VKISKSAGT

SEQ ID NO: 1227259 - protein, 9 aa, Homo Sapiens
PAAKDPSAT

SEQ ID NO: 1227260 - protein, 9 aa, Homo Sapiens
LGYNYKSKS

SEQ ID NO: 1227261 - protein, 9 aa, Homo Sapiens
PSRSSSAAD

SEQ ID NO: 1227262 - protein, 9 aa, Homo Sapiens
CDKIFRKNS

SEQ ID NO: 1227263 - protein, 9 aa, Homo Sapiens
YHLLLVGID

SEQ ID NO: 1227264 - protein, 9 aa, Homo Sapiens
PNDTANSSE

SEQ ID NO: 1227265 - protein, 9 aa, Homo Sapiens
QTTVGVDGS

SEQ ID NO: 1227266 - protein, 9 aa, Homo Sapiens
GATASLGAG

SEQ ID NO: 1227267 - protein, 9 aa, Homo Sapiens
VQTTRTSAI

SEQ ID NO: 1227268 - protein, 9 aa, Homo Sapiens
TGSTHEPTS

SEQ ID NO: 1227269 - protein, 9 aa, Homo Sapiens
YRCIYKPDF

SEQ ID NO: 1227270 - protein, 9 aa, Homo Sapiens
RSRGHAPPL

SEQ ID NO: 1227271 - protein, 9 aa, Homo Sapiens
CALQERAEG

SEQ ID NO: 1227272 - protein, 9 aa, Homo Sapiens
DLLRRTPVS

SEQ ID NO: 1227273 - protein, 9 aa, Homo Sapiens
TAATGSLNA

SEQ ID NO: 1227274 - protein, 9 aa, Homo Sapiens
DLQMKMRRR

SEQ ID NO: 1227275 - protein, 9 aa, Homo Sapiens
REGQQFGAA

SEQ ID NO: 1227276 - protein, 9 aa, Homo Sapiens
YPRKPIAHR

SEQ ID NO: 1227277 - protein, 9 aa, Homo Sapiens
VYIVGNDGR

SEQ ID NO: 1227278 - protein, 9 aa, Homo Sapiens
NMLSHLSVV

SEQ ID NO: 1227279 - protein, 9 aa, Homo Sapiens
STYASHLTS

SEQ ID NO: 1227280 - protein, 9 aa, Homo Sapiens
SLEVRAPAA

SEQ ID NO: 1227281 - protein, 9 aa, Homo Sapiens
PGPPPNMIS

SEQ ID NO: 1227282 - protein, 9 aa, Homo Sapiens
IVGNLKALS

SEQ ID NO: 1227283 - protein, 9 aa, Homo Sapiens
LGLRDDKDT

SEQ ID NO: 1227284 - protein, 9 aa, Homo Sapiens
DGPGREPLV

SEQ ID NO: 1227285 - protein, 9 aa, Homo Sapiens
TFPVPPECA

SEQ ID NO: 1227286 - protein, 9 aa, Homo Sapiens
AVRRSVMRR

SEQ ID NO: 1227287 - protein, 9 aa, Homo Sapiens
VRHFTLRHW

SEQ ID NO: 1227288 - protein, 9 aa, Homo Sapiens
HLYNRCFGQ

SEQ ID NO: 1227289 - protein, 9 aa, Homo Sapiens
IADGLRYLH

SEQ ID NO: 1227290 - protein, 9 aa, Homo Sapiens
EPCPAQEEA

SEQ ID NO: 1227291 - protein, 9 aa, Homo Sapiens
WKRTLIPGS

SEQ ID NO: 1227292 - protein, 9 aa, Homo Sapiens
TRLIVGFFI

SEQ ID NO: 1227293 - protein, 9 aa, Homo Sapiens
SRGRQLRHC

SEQ ID NO: 1227294 - protein, 9 aa, Homo Sapiens
ETWRQLRRV

SEQ ID NO: 1227295 - protein, 9 aa, Homo Sapiens
SMEQVQAYV

SEQ ID NO: 1227296 - protein, 9 aa, Homo Sapiens
HRAFLSYVE

SEQ ID NO: 1227297 - protein, 9 aa, Homo Sapiens
PSPSTQLSA

SEQ ID NO: 1227298 - protein, 9 aa, Homo Sapiens
GTHTVVVMG

SEQ ID NO: 1227299 - protein, 9 aa, Homo Sapiens
YDQNTLISF

SEQ ID NO: 1227300 - protein, 9 aa, Homo Sapiens
DTFNVPVFW

SEQ ID NO: 1227301 - protein, 9 aa, Homo Sapiens
WDITVDLVI

SEQ ID NO: 1227302 - protein, 9 aa, Homo Sapiens
NIETKNKNV

SEQ ID NO: 1227303 - protein, 9 aa, Homo Sapiens
TVMGLITCM

SEQ ID NO: 1227304 - protein, 9 aa, Homo Sapiens
DSVASKYAI

SEQ ID NO: 1227305 - protein, 9 aa, Homo Sapiens
TPYWTSPEK

SEQ ID NO: 1227306 - protein, 9 aa, Homo Sapiens
GSMGPWGTG

SEQ ID NO: 1227307 - protein, 9 aa, Homo Sapiens
VPVRRWKEF

SEQ ID NO: 1227308 - protein, 9 aa, Homo Sapiens
YSQVAMMGL

SEQ ID NO: 1227309 - protein, 9 aa, Homo Sapiens
TSRGVAAAL

SEQ ID NO: 1227310 - protein, 9 aa, Homo Sapiens
CLFLGDQTI

SEQ ID NO: 1227311 - protein, 9 aa, Homo Sapiens
RKLELTNAE

SEQ ID NO: 1227312 - protein, 9 aa, Homo Sapiens
KQCQTLRKM

SEQ ID NO: 1227313 - protein, 9 aa, Homo Sapiens
IPGLNNSTD

SEQ ID NO: 1227314 - protein, 9 aa, Homo Sapiens
NELKKQLKL

SEQ ID NO: 1227315 - protein, 9 aa, Homo Sapiens
RSQVVRKAP

SEQ ID NO: 1227316 - protein, 9 aa, Homo Sapiens
NPTESIMFM

SEQ ID NO: 1227317 - protein, 9 aa, Homo Sapiens
ELRMIDVFD

SEQ ID NO: 1227318 - protein, 9 aa, Homo Sapiens
QEFNGNLSS

SEQ ID NO: 1227319 - protein, 9 aa, Homo Sapiens
CCPSCRRED

SEQ ID NO: 1227320 - protein, 9 aa, Homo Sapiens
GKVEEDSED

SEQ ID NO: 1227321 - protein, 9 aa, Homo Sapiens
LRSVHVPLM

SEQ ID NO: 1227322 - protein, 9 aa, Homo Sapiens
LVLFLIGLV

SEQ ID NO: 1227323 - protein, 9 aa, Homo Sapiens
FRGVCVTAH

SEQ ID NO: 1227324 - protein, 9 aa, Homo Sapiens
RESEEVLQK

SEQ ID NO: 1227325 - protein, 9 aa, Homo Sapiens
EARLNIAIV

SEQ ID NO: 1227326 - protein, 9 aa, Homo Sapiens
KERESRMEL

SEQ ID NO: 1227327 - protein, 9 aa, Homo Sapiens
TPENYPNVG

SEQ ID NO: 1227328 - protein, 9 aa, Homo Sapiens
RCKVFSTCS

SEQ ID NO: 1227329 - protein, 9 aa, Homo Sapiens
LYVTEPETW

SEQ ID NO: 1227330 - protein, 9 aa, Homo Sapiens
HGTYVMTVT

SEQ ID NO: 1227331 - protein, 9 aa, Homo Sapiens
LIDKRQWNR

SEQ ID NO: 1227332 - protein, 9 aa, Homo Sapiens
DDSLLDLSE

SEQ ID NO: 1227333 - protein, 9 aa, Homo Sapiens
LITASTSQA

SEQ ID NO: 1227334 - protein, 9 aa, Homo Sapiens
AERSPSPST

SEQ ID NO: 1227335 - protein, 9 aa, Homo Sapiens
PQNKCIMKE

SEQ ID NO: 1227336 - protein, 9 aa, Homo Sapiens
DNSKWDISE

SEQ ID NO: 1227337 - protein, 9 aa, Homo Sapiens
TKNKNVRFI

SEQ ID NO: 1227338 - protein, 9 aa, Homo Sapiens
EVFPLAMHY

SEQ ID NO: 1227339 - protein, 9 aa, Homo Sapiens
LCNTPLASR

SEQ ID NO: 1227340 - protein, 9 aa, Homo Sapiens
LSLNYLAEC

SEQ ID NO: 1227341 - protein, 9 aa, Homo Sapiens
WLRSVLGLH

SEQ ID NO: 1227342 - protein, 9 aa, Homo Sapiens
TGRGKSLIG

SEQ ID NO: 1227343 - protein, 9 aa, Homo Sapiens
IYRNIIGFV

SEQ ID NO: 1227344 - protein, 9 aa, Homo Sapiens
STEEYIEYL

SEQ ID NO: 1227345 - protein, 9 aa, Homo Sapiens
SFRNIYKSM

SEQ ID NO: 1227346 - protein, 9 aa, Homo Sapiens
EQRQGREHP

SEQ ID NO: 1227347 - protein, 9 aa, Homo Sapiens
AYEYKYCDA

SEQ ID NO: 1227348 - protein, 9 aa, Homo Sapiens
HFVLRFRAF

SEQ ID NO: 1227349 - protein, 9 aa, Homo Sapiens
LLKIELVLI

SEQ ID NO: 1227350 - protein, 9 aa, Homo Sapiens
YLKNIIYHF

SEQ ID NO: 1227351 - protein, 9 aa, Homo Sapiens
PRGSKDINK

SEQ ID NO: 1227352 - protein, 9 aa, Homo Sapiens
CSDGKSRGR

SEQ ID NO: 1227353 - protein, 9 aa, Homo Sapiens
YPTPKVQDL

SEQ ID NO: 1227354 - protein, 9 aa, Homo Sapiens
WLMTAMWLS

SEQ ID NO: 1227355 - protein, 9 aa, Homo Sapiens
LIADQGQLM

SEQ ID NO: 1227356 - protein, 9 aa, Homo Sapiens
GECQFNLNG

SEQ ID NO: 1227357 - protein, 9 aa, Homo Sapiens
SSVLASLIG

SEQ ID NO: 1227358 - protein, 9 aa, Homo Sapiens
RVASTQCAG

SEQ ID NO: 1227359 - protein, 9 aa, Homo Sapiens
CFLRSGPNS

SEQ ID NO: 1227360 - protein, 9 aa, Homo Sapiens
TIMDENDNA

SEQ ID NO: 1227361 - protein, 9 aa, Homo Sapiens
VQMSDQQLV

SEQ ID NO: 1227362 - protein, 9 aa, Homo Sapiens
SRSCEGGVQ

SEQ ID NO: 1227363 - protein, 9 aa, Homo Sapiens
NMGHPEPAP

SEQ ID NO: 1227364 - protein, 9 aa, Homo Sapiens
LHVAALVAS

SEQ ID NO: 1227365 - protein, 9 aa, Homo Sapiens
WYSLTNDIV

SEQ ID NO: 1227366 - protein, 9 aa, Homo Sapiens
QDLWEERSW

SEQ ID NO: 1227367 - protein, 9 aa, Homo Sapiens
PTGTKSLDV

SEQ ID NO: 1227368 - protein, 9 aa, Homo Sapiens
RCSDNCDVC

SEQ ID NO: 1227369 - protein, 9 aa, Homo Sapiens
SKGIFAPLQ

SEQ ID NO: 1227370 - protein, 9 aa, Homo Sapiens
KAWKKLSPG

SEQ ID NO: 1227371 - protein, 9 aa, Homo Sapiens
GCTGTLVPA

SEQ ID NO: 1227372 - protein, 9 aa, Homo Sapiens
LRPLQEGKM

SEQ ID NO: 1227373 - protein, 9 aa, Homo Sapiens
LVTQQPMKS

SEQ ID NO: 1227374 - protein, 9 aa, Homo Sapiens
VWGLGLPKL

SEQ ID NO: 1227375 - protein, 9 aa, Homo Sapiens
VEDCEHCLL

SEQ ID NO: 1227376 - protein, 9 aa, Homo Sapiens
AGQQFAHQM

SEQ ID NO: 1227377 - protein, 9 aa, Homo Sapiens
SSLSPPHPV

SEQ ID NO: 1227378 - protein, 9 aa, Homo Sapiens
QKSRVPLSV

SEQ ID NO: 1227379 - protein, 9 aa, Homo Sapiens
LFENYQMQS

SEQ ID NO: 1227380 - protein, 9 aa, Homo Sapiens
HVCQDIPAS

SEQ ID NO: 1227381 - protein, 9 aa, Homo Sapiens
TGAASAPAP

SEQ ID NO: 1227382 - protein, 9 aa, Homo Sapiens
ATKPLSWAP

SEQ ID NO: 1227383 - protein, 9 aa, Homo Sapiens
VALHILQQT

SEQ ID NO: 1227384 - protein, 9 aa, Homo Sapiens
QKGLQALTR

SEQ ID NO: 1227385 - protein, 9 aa, Homo Sapiens
KVGFIPPFA

SEQ ID NO: 1227386 - protein, 9 aa, Homo Sapiens
ISTVTATTT

SEQ ID NO: 1227387 - protein, 9 aa, Homo Sapiens
ADPRRLLHE

SEQ ID NO: 1227388 - protein, 9 aa, Homo Sapiens
RIFKRAFYP

SEQ ID NO: 1227389 - protein, 9 aa, Homo Sapiens
AFTHLNSPQ

SEQ ID NO: 1227390 - protein, 9 aa, Homo Sapiens
SYLPTAECL

SEQ ID NO: 1227391 - protein, 9 aa, Homo Sapiens
WGGEPRAHT

SEQ ID NO: 1227392 - protein, 9 aa, Homo Sapiens
EVKNVKSEE

SEQ ID NO: 1227393 - protein, 9 aa, Homo Sapiens
DISQMKSMY

SEQ ID NO: 1227394 - protein, 9 aa, Homo Sapiens
DLKYLRFTL

SEQ ID NO: 1227395 - protein, 9 aa, Homo Sapiens
PREWDSATA

SEQ ID NO: 1227396 - protein, 9 aa, Homo Sapiens
KHGWNWRSL

SEQ ID NO: 1227397 - protein, 9 aa, Homo Sapiens
ASELGNHYL

SEQ ID NO: 1227398 - protein, 9 aa, Homo Sapiens
GILGYSQNL

SEQ ID NO: 1227399 - protein, 9 aa, Homo Sapiens
LGRCSVSDC

SEQ ID NO: 1227400 - protein, 9 aa, Homo Sapiens
EIHRTYQEY

SEQ ID NO: 1227401 - protein, 9 aa, Homo Sapiens
VLDIIKLTG

SEQ ID NO: 1227402 - protein, 9 aa, Homo Sapiens
ICLNTEWVE

SEQ ID NO: 1227403 - protein, 9 aa, Homo Sapiens
SDEDSLVKR

SEQ ID NO: 1227404 - protein, 9 aa, Homo Sapiens
AWKRMDVGQ

SEQ ID NO: 1227405 - protein, 9 aa, Homo Sapiens
LADDALYRL

SEQ ID NO: 1227406 - protein, 9 aa, Homo Sapiens
LLDQACHIR

SEQ ID NO: 1227407 - protein, 9 aa, Homo Sapiens
LSLRSLQRS

SEQ ID NO: 1227408 - protein, 9 aa, Homo Sapiens
ETYSVRPGG

SEQ ID NO: 1227409 - protein, 9 aa, Homo Sapiens
EHFDIDDHQ

SEQ ID NO: 1227410 - protein, 9 aa, Homo Sapiens
SDPVGPPCR

SEQ ID NO: 1227411 - protein, 9 aa, Homo Sapiens
SLGEVIVKR

SEQ ID NO: 1227412 - protein, 9 aa, Homo Sapiens
NALRDDPSG

SEQ ID NO: 1227413 - protein, 9 aa, Homo Sapiens
LAARNANMN

SEQ ID NO: 1227414 - protein, 9 aa, Homo Sapiens
QLLSKCPWN

SEQ ID NO: 1227415 - protein, 9 aa, Homo Sapiens
AEYMFDKLT

SEQ ID NO: 1227416 - protein, 9 aa, Homo Sapiens
IMERVGLEV

SEQ ID NO: 1227417 - protein, 9 aa, Homo Sapiens
SGADTGDIV

SEQ ID NO: 1227418 - protein, 9 aa, Homo Sapiens
TTHTTLEHP

SEQ ID NO: 1227419 - protein, 9 aa, Homo Sapiens
MEKLTVLQV

SEQ ID NO: 1227420 - protein, 9 aa, Homo Sapiens
SICLLHGKI

SEQ ID NO: 1227421 - protein, 9 aa, Homo Sapiens
LPPVPGSAS

SEQ ID NO: 1227422 - protein, 9 aa, Homo Sapiens
ASTAKCLSI

SEQ ID NO: 1227423 - protein, 9 aa, Homo Sapiens
RCKSLLTRK

SEQ ID NO: 1227424 - protein, 9 aa, Homo Sapiens
TDPRSIGRL

SEQ ID NO: 1227425 - protein, 9 aa, Homo Sapiens
LNALRHEKQ

SEQ ID NO: 1227426 - protein, 9 aa, Homo Sapiens
PGNVLHCKI

SEQ ID NO: 1227427 - protein, 9 aa, Homo Sapiens
FSRAFSRRC

SEQ ID NO: 1227428 - protein, 9 aa, Homo Sapiens
HTRENPFEC

SEQ ID NO: 1227429 - protein, 9 aa, Homo Sapiens
CSSHMIVIF

SEQ ID NO: 1227430 - protein, 9 aa, Homo Sapiens
EEMSDGSQD

SEQ ID NO: 1227431 - protein, 9 aa, Homo Sapiens
QGVLTHDRV

SEQ ID NO: 1227432 - protein, 9 aa, Homo Sapiens
GYNYKSKSA

SEQ ID NO: 1227433 - protein, 9 aa, Homo Sapiens
RLKSFLLSM

SEQ ID NO: 1227434 - protein, 9 aa, Homo Sapiens
SAPFIMDTP

SEQ ID NO: 1227435 - protein, 9 aa, Homo Sapiens
NFLNRLVPT

SEQ ID NO: 1227436 - protein, 9 aa, Homo Sapiens
HRHPSATLI

SEQ ID NO: 1227437 - protein, 9 aa, Homo Sapiens
SNSQSTGAT

SEQ ID NO: 1227438 - protein, 9 aa, Homo Sapiens
EHPPPPAGL

SEQ ID NO: 1227439 - protein, 9 aa, Homo Sapiens
SLKTLKEIS

SEQ ID NO: 1227440 - protein, 9 aa, Homo Sapiens
ERKTNKWST

SEQ ID NO: 1227441 - protein, 9 aa, Homo Sapiens
IAKKVQELQ

SEQ ID NO: 1227442 - protein, 9 aa, Homo Sapiens
LHLTQYHGG

SEQ ID NO: 1227443 - protein, 9 aa, Homo Sapiens
WASTLWYLS

SEQ ID NO: 1227444 - protein, 9 aa, Homo Sapiens
MTICKEFSL

SEQ ID NO: 1227445 - protein, 9 aa, Homo Sapiens
KHIEVCMYR

SEQ ID NO: 1227446 - protein, 9 aa, Homo Sapiens
RLLKQDCLT

SEQ ID NO: 1227447 - protein, 9 aa, Homo Sapiens
PLLPRSQPL

SEQ ID NO: 1227448 - protein, 9 aa, Homo Sapiens
CRAVPEAAD

SEQ ID NO: 1227449 - protein, 9 aa, Homo Sapiens
SGYFQQLED

SEQ ID NO: 1227450 - protein, 9 aa, Homo Sapiens
LVEAAVRIG

SEQ ID NO: 1227451 - protein, 9 aa, Homo Sapiens
LLLAISFCG

SEQ ID NO: 1227452 - protein, 9 aa, Homo Sapiens
LKIGDWQHT

SEQ ID NO: 1227453 - protein, 9 aa, Homo Sapiens
EECLQAKKE

SEQ ID NO: 1227454 - protein, 9 aa, Homo Sapiens
TKLEDSPLV

SEQ ID NO: 1227455 - protein, 9 aa, Homo Sapiens
SVVISDCKN

SEQ ID NO: 1227456 - protein, 9 aa, Homo Sapiens
LMGLNSANL

SEQ ID NO: 1227457 - protein, 9 aa, Homo Sapiens
RQNQECQVL

SEQ ID NO: 1227458 - protein, 9 aa, Homo Sapiens
SKCPWNEYK

SEQ ID NO: 1227459 - protein, 9 aa, Homo Sapiens
VCEEEIPEE

SEQ ID NO: 1227460 - protein, 9 aa, Homo Sapiens
PGPADQSSD

SEQ ID NO: 1227461 - protein, 9 aa, Homo Sapiens
TVKLELQRC

SEQ ID NO: 1227462 - protein, 9 aa, Homo Sapiens
GRTTTAKSI

SEQ ID NO: 1227463 - protein, 9 aa, Homo Sapiens
SSPVDALKG

SEQ ID NO: 1227464 - protein, 9 aa, Homo Sapiens
SRAHYEMAS

SEQ ID NO: 1227465 - protein, 9 aa, Homo Sapiens
LGTETSILS

SEQ ID NO: 1227466 - protein, 9 aa, Homo Sapiens
ARDPPATAT

SEQ ID NO: 1227467 - protein, 9 aa, Homo Sapiens
DAQVGTIIA

SEQ ID NO: 1227468 - protein, 9 aa, Homo Sapiens
PFLSSLVFK

SEQ ID NO: 1227469 - protein, 9 aa, Homo Sapiens
SYNMLITCI

SEQ ID NO: 1227470 - protein, 9 aa, Homo Sapiens
SLPARQDME

SEQ ID NO: 1227471 - protein, 9 aa, Homo Sapiens
TNKSCDALL

SEQ ID NO: 1227472 - protein, 9 aa, Homo Sapiens
NMITPSYFN

SEQ ID NO: 1227473 - protein, 9 aa, Homo Sapiens
EVAAGAHEQ

SEQ ID NO: 1227474 - protein, 9 aa, Homo Sapiens
MGKARERGR

SEQ ID NO: 1227475 - protein, 9 aa, Homo Sapiens
KRNECGKTF

SEQ ID NO: 1227476 - protein, 9 aa, Homo Sapiens
FAPKEASGP

SEQ ID NO: 1227477 - protein, 9 aa, Homo Sapiens
CSHSSSCSG

SEQ ID NO: 1227478 - protein, 9 aa, Homo Sapiens
TAAPPESPQ

SEQ ID NO: 1227479 - protein, 9 aa, Homo Sapiens
CAYIAKEEI

SEQ ID NO: 1227480 - protein, 9 aa, Homo Sapiens
HVIQVWFQN

SEQ ID NO: 1227481 - protein, 9 aa, Homo Sapiens
HSTGDVFVI

SEQ ID NO: 1227482 - protein, 9 aa, Homo Sapiens
ELSNLDDFD

SEQ ID NO: 1227483 - protein, 9 aa, Homo Sapiens
SGSVRPQEL

SEQ ID NO: 1227484 - protein, 9 aa, Homo Sapiens
RSRRFSSLY

SEQ ID NO: 1227485 - protein, 9 aa, Homo Sapiens
NWCDGMSHC

SEQ ID NO: 1227486 - protein, 9 aa, Homo Sapiens
MDTYIKSCA

SEQ ID NO: 1227487 - protein, 9 aa, Homo Sapiens
GSLYENCQE

SEQ ID NO: 1227488 - protein, 9 aa, Homo Sapiens
VLNSAMQAF

SEQ ID NO: 1227489 - protein, 9 aa, Homo Sapiens
EEVPSPVWD

SEQ ID NO: 1227490 - protein, 9 aa, Homo Sapiens
QTCDPAAEE

SEQ ID NO: 1227491 - protein, 9 aa, Homo Sapiens
RPFYKTMLH

SEQ ID NO: 1227492 - protein, 9 aa, Homo Sapiens
IGQWPCFDS

SEQ ID NO: 1227493 - protein, 9 aa, Homo Sapiens
SAALGMFNS

SEQ ID NO: 1227494 - protein, 9 aa, Homo Sapiens
ADRLTSLAR

SEQ ID NO: 1227495 - protein, 9 aa, Homo Sapiens
EKIQPLNFS

SEQ ID NO: 1227496 - protein, 9 aa, Homo Sapiens
IWRMYAHVY

SEQ ID NO: 1227497 - protein, 9 aa, Homo Sapiens
PWGAGALRA

SEQ ID NO: 1227498 - protein, 9 aa, Homo Sapiens
LIRYQSFKE

SEQ ID NO: 1227499 - protein, 9 aa, Homo Sapiens
GECELPAAC

SEQ ID NO: 1227500 - protein, 9 aa, Homo Sapiens
ALMLPPWLL

SEQ ID NO: 1227501 - protein, 9 aa, Homo Sapiens
FTYITKAYE

SEQ ID NO: 1227502 - protein, 9 aa, Homo Sapiens
PRAHTMAQV

SEQ ID NO: 1227503 - protein, 9 aa, Homo Sapiens
TYADSGPFG

SEQ ID NO: 1227504 - protein, 9 aa, Homo Sapiens
GDHHHPSAP

SEQ ID NO: 1227505 - protein, 9 aa, Homo Sapiens
LQRPVTPAA

SEQ ID NO: 1227506 - protein, 9 aa, Homo Sapiens
VSVASMPSS

SEQ ID NO: 1227507 - protein, 9 aa, Homo Sapiens
GPGFLKTPL

SEQ ID NO: 1227508 - protein, 9 aa, Homo Sapiens
AVRCFYVGL

SEQ ID NO: 1227509 - protein, 9 aa, Homo Sapiens
DEYIKWLEE

SEQ ID NO: 1227510 - protein, 9 aa, Homo Sapiens
MGVCICFYQ

SEQ ID NO: 1227511 - protein, 9 aa, Homo Sapiens
RKINKMMDK

SEQ ID NO: 1227512 - protein, 9 aa, Homo Sapiens
KAALRIHNI

SEQ ID NO: 1227513 - protein, 9 aa, Homo Sapiens
WCLARDPAR

SEQ ID NO: 1227514 - protein, 9 aa, Homo Sapiens
RKTMIEKLK

SEQ ID NO: 1227515 - protein, 9 aa, Homo Sapiens
GKWQKEAFP

SEQ ID NO: 1227516 - protein, 9 aa, Homo Sapiens
SFLYHVSTH

SEQ ID NO: 1227517 - protein, 9 aa, Homo Sapiens
DLGFDVDIC

SEQ ID NO: 1227518 - protein, 9 aa, Homo Sapiens
TASSILHTH

SEQ ID NO: 1227519 - protein, 9 aa, Homo Sapiens
RQNNYTINN

SEQ ID NO: 1227520 - protein, 9 aa, Homo Sapiens
ICRGWLTIN

SEQ ID NO: 1227521 - protein, 9 aa, Homo Sapiens
IRIGAMARL

SEQ ID NO: 1227522 - protein, 9 aa, Homo Sapiens
SEEDIDTSE

SEQ ID NO: 1227523 - protein, 9 aa, Homo Sapiens
MVLMATVLN

SEQ ID NO: 1227524 - protein, 9 aa, Homo Sapiens
ERAVRRVAQ

SEQ ID NO: 1227525 - protein, 9 aa, Homo Sapiens
CRALHSYAL

SEQ ID NO: 1227526 - protein, 9 aa, Homo Sapiens
TKDEVASLR

SEQ ID NO: 1227527 - protein, 9 aa, Homo Sapiens
MAAIRLREF

SEQ ID NO: 1227528 - protein, 9 aa, Homo Sapiens
QHHEVQGNE

SEQ ID NO: 1227529 - protein, 9 aa, Homo Sapiens
CKERACFEQ

SEQ ID NO: 1227530 - protein, 9 aa, Homo Sapiens
LEGVVTKSQ

SEQ ID NO: 1227531 - protein, 9 aa, Homo Sapiens
IEVSRKPRN

SEQ ID NO: 1227532 - protein, 9 aa, Homo Sapiens
DMTKALGTC

SEQ ID NO: 1227533 - protein, 9 aa, Homo Sapiens
KVGMLNGGH

SEQ ID NO: 1227534 - protein, 9 aa, Homo Sapiens
MNSVLEKFT

SEQ ID NO: 1227535 - protein, 9 aa, Homo Sapiens
VREMEEATR

SEQ ID NO: 1227536 - protein, 9 aa, Homo Sapiens
GGQTQVRAL

SEQ ID NO: 1227537 - protein, 9 aa, Homo Sapiens
KLYDSNLRI

SEQ ID NO: 1227538 - protein, 9 aa, Homo Sapiens
FCKLELRLP

SEQ ID NO: 1227539 - protein, 9 aa, Homo Sapiens
ENSRLKSFL

SEQ ID NO: 1227540 - protein, 9 aa, Homo Sapiens
YLSKGVEAE

SEQ ID NO: 1227541 - protein, 9 aa, Homo Sapiens
MALLGKCCD

SEQ ID NO: 1227542 - protein, 9 aa, Homo Sapiens
MHHHGQLIF

SEQ ID NO: 1227543 - protein, 9 aa, Homo Sapiens
PLEEMRKTA

SEQ ID NO: 1227544 - protein, 9 aa, Homo Sapiens
HVVDRLFEI

SEQ ID NO: 1227545 - protein, 9 aa, Homo Sapiens
RHCSHSSSC

SEQ ID NO: 1227546 - protein, 9 aa, Homo Sapiens
WLCCATPAH

SEQ ID NO: 1227547 - protein, 9 aa, Homo Sapiens
HSIRCMNVV

SEQ ID NO: 1227548 - protein, 9 aa, Homo Sapiens
WGHQSDTEA

SEQ ID NO: 1227549 - protein, 9 aa, Homo Sapiens
LVQQNKMLE

SEQ ID NO: 1227550 - protein, 9 aa, Homo Sapiens
CISELLSAH

SEQ ID NO: 1227551 - protein, 9 aa, Homo Sapiens
SVQVNSIEF

SEQ ID NO: 1227552 - protein, 9 aa, Homo Sapiens
VHPRDVMPQ

SEQ ID NO: 1227553 - protein, 9 aa, Homo Sapiens
MEAEVGEFL

SEQ ID NO: 1227554 - protein, 9 aa, Homo Sapiens
FSYKHVCVQ

SEQ ID NO: 1227555 - protein, 9 aa, Homo Sapiens
ASSSLTPHF

SEQ ID NO: 1227556 - protein, 9 aa, Homo Sapiens
ATRVTTPTF

SEQ ID NO: 1227557 - protein, 9 aa, Homo Sapiens
QVFLNGETQ

SEQ ID NO: 1227558 - protein, 9 aa, Homo Sapiens
YKESRVVNL

SEQ ID NO: 1227559 - protein, 9 aa, Homo Sapiens
MVNKIGEHM

SEQ ID NO: 1227560 - protein, 9 aa, Homo Sapiens
WLKTRQVCS

SEQ ID NO: 1227561 - protein, 9 aa, Homo Sapiens
RLEPLLPRS

SEQ ID NO: 1227562 - protein, 9 aa, Homo Sapiens
GRGHRRRGL

SEQ ID NO: 1227563 - protein, 9 aa, Homo Sapiens
PIPQSVASA

SEQ ID NO: 1227564 - protein, 9 aa, Homo Sapiens
EVKAKLKRA

SEQ ID NO: 1227565 - protein, 9 aa, Homo Sapiens
LLTLNGSNV

SEQ ID NO: 1227566 - protein, 9 aa, Homo Sapiens
LLAFIITFH

SEQ ID NO: 1227567 - protein, 9 aa, Homo Sapiens
SACQDVNEC

SEQ ID NO: 1227568 - protein, 9 aa, Homo Sapiens
MSYNLLEFL

SEQ ID NO: 1227569 - protein, 9 aa, Homo Sapiens
KVADQLLPL

SEQ ID NO: 1227570 - protein, 9 aa, Homo Sapiens
YPMSVAVLT

SEQ ID NO: 1227571 - protein, 9 aa, Homo Sapiens
SKYDLLAWF

SEQ ID NO: 1227572 - protein, 9 aa, Homo Sapiens
VPSKIQLIV

SEQ ID NO: 1227573 - protein, 9 aa, Homo Sapiens
GYGQTEMVL

SEQ ID NO: 1227574 - protein, 9 aa, Homo Sapiens
FKKPVLPVS

SEQ ID NO: 1227575 - protein, 9 aa, Homo Sapiens
PVGIMAVTL

SEQ ID NO: 1227576 - protein, 9 aa, Homo Sapiens
SPQPKCWQQ

SEQ ID NO: 1227577 - protein, 9 aa, Homo Sapiens
PSGPVSVAS

SEQ ID NO: 1227578 - protein, 9 aa, Homo Sapiens
KGDCHIFTR

SEQ ID NO: 1227579 - protein, 9 aa, Homo Sapiens
FLGKTRRVN

SEQ ID NO: 1227580 - protein, 9 aa, Homo Sapiens
KPPTRDTPH

SEQ ID NO: 1227581 - protein, 9 aa, Homo Sapiens
AEAIKCRTL

SEQ ID NO: 1227582 - protein, 9 aa, Homo Sapiens
SVSVEESAA

SEQ ID NO: 1227583 - protein, 9 aa, Homo Sapiens
LAAAQRDVV

SEQ ID NO: 1227584 - protein, 9 aa, Homo Sapiens
LCAWETPSH

SEQ ID NO: 1227585 - protein, 9 aa, Homo Sapiens
MGLVIAQSL

SEQ ID NO: 1227586 - protein, 9 aa, Homo Sapiens
SVDVLCVTV

SEQ ID NO: 1227587 - protein, 9 aa, Homo Sapiens
HKKNFLLSG

SEQ ID NO: 1227588 - protein, 9 aa, Homo Sapiens
TPSWCLCSQ

SEQ ID NO: 1227589 - protein, 9 aa, Homo Sapiens
CPLDQALWA

SEQ ID NO: 1227590 - protein, 9 aa, Homo Sapiens
PKCWQQDMS

SEQ ID NO: 1227591 - protein, 9 aa, Homo Sapiens
PLQRGGLSP

SEQ ID NO: 1227592 - protein, 9 aa, Homo Sapiens
RYQGHAQAV

SEQ ID NO: 1227593 - protein, 9 aa, Homo Sapiens
EQVLKFCKL

SEQ ID NO: 1227594 - protein, 9 aa, Homo Sapiens
KGYDIATPK

SEQ ID NO: 1227595 - protein, 9 aa, Homo Sapiens
VMLLAWKFQ

SEQ ID NO: 1227596 - protein, 9 aa, Homo Sapiens
ACFAYTGRI

SEQ ID NO: 1227597 - protein, 9 aa, Homo Sapiens
LMTSLPFCG

SEQ ID NO: 1227598 - protein, 9 aa, Homo Sapiens
NIQTLDCPI

SEQ ID NO: 1227599 - protein, 9 aa, Homo Sapiens
LDTQDPPED

SEQ ID NO: 1227600 - protein, 9 aa, Homo Sapiens
CLSLWTAHI

SEQ ID NO: 1227601 - protein, 9 aa, Homo Sapiens
CRSTGWYPP

SEQ ID NO: 1227602 - protein, 9 aa, Homo Sapiens
CAQEVPGRV

SEQ ID NO: 1227603 - protein, 9 aa, Homo Sapiens
VMLVHVIRR

SEQ ID NO: 1227604 - protein, 9 aa, Homo Sapiens
ILIAIDALG

SEQ ID NO: 1227605 - protein, 9 aa, Homo Sapiens
RTQCPAMVQ

SEQ ID NO: 1227606 - protein, 9 aa, Homo Sapiens
SSENNKASN

SEQ ID NO: 1227607 - protein, 9 aa, Homo Sapiens
PETYMAAVK

SEQ ID NO: 1227608 - protein, 9 aa, Homo Sapiens
SREPPGGDL

SEQ ID NO: 1227609 - protein, 9 aa, Homo Sapiens
YENSFNYQS

SEQ ID NO: 1227610 - protein, 9 aa, Homo Sapiens
EGYTLPHAI

SEQ ID NO: 1227611 - protein, 9 aa, Homo Sapiens
EKCHSSPGY

SEQ ID NO: 1227612 - protein, 9 aa, Homo Sapiens
CGKTFSMSS

SEQ ID NO: 1227613 - protein, 9 aa, Homo Sapiens
TLLLYTVMR

SEQ ID NO: 1227614 - protein, 9 aa, Homo Sapiens
YHLKKYSLH

SEQ ID NO: 1227615 - protein, 9 aa, Homo Sapiens
IKDCDLKKE

SEQ ID NO: 1227616 - protein, 9 aa, Homo Sapiens
EPYGPLGGP

SEQ ID NO: 1227617 - protein, 9 aa, Homo Sapiens
AVNCQAEAA

SEQ ID NO: 1227618 - protein, 9 aa, Homo Sapiens
PINTTLAVE

SEQ ID NO: 1227619 - protein, 9 aa, Homo Sapiens
AIACKRAKI

SEQ ID NO: 1227620 - protein, 9 aa, Homo Sapiens
SAASSSQGV

SEQ ID NO: 1227621 - protein, 9 aa, Homo Sapiens
FPSASGSGP

SEQ ID NO: 1227622 - protein, 9 aa, Homo Sapiens
LLLDKSINH

SEQ ID NO: 1227623 - protein, 9 aa, Homo Sapiens
TPSSSRNAI

SEQ ID NO: 1227624 - protein, 9 aa, Homo Sapiens
GNKHLSRQD

SEQ ID NO: 1227625 - protein, 9 aa, Homo Sapiens
SLGLLMRDL

SEQ ID NO: 1227626 - protein, 9 aa, Homo Sapiens
LCLRIQTRS

SEQ ID NO: 1227627 - protein, 9 aa, Homo Sapiens
SSTSFTPTS

SEQ ID NO: 1227628 - protein, 9 aa, Homo Sapiens
KGWAWIRVA

SEQ ID NO: 1227629 - protein, 9 aa, Homo Sapiens
DSSDSELLW

SEQ ID NO: 1227630 - protein, 9 aa, Homo Sapiens
THSEPLPPS

SEQ ID NO: 1227631 - protein, 9 aa, Homo Sapiens
VITSFCLKH

SEQ ID NO: 1227632 - protein, 9 aa, Homo Sapiens
GGFNKWNAT

SEQ ID NO: 1227633 - protein, 9 aa, Homo Sapiens
RLNTILDVV

SEQ ID NO: 1227634 - protein, 9 aa, Homo Sapiens
VWQLQLEAE

SEQ ID NO: 1227635 - protein, 9 aa, Homo Sapiens
VVSKSKVPH

SEQ ID NO: 1227636 - protein, 9 aa, Homo Sapiens
SSRHSNPPP

SEQ ID NO: 1227637 - protein, 9 aa, Homo Sapiens
SDYKVASDE

SEQ ID NO: 1227638 - protein, 9 aa, Homo Sapiens
MGCIAYKHN

SEQ ID NO: 1227639 - protein, 9 aa, Homo Sapiens
IMLFLLKLA

SEQ ID NO: 1227640 - protein, 9 aa, Homo Sapiens
RAQGHPALH

SEQ ID NO: 1227641 - protein, 9 aa, Homo Sapiens
QNTSQIKQM

SEQ ID NO: 1227642 - protein, 9 aa, Homo Sapiens
GDAVGGHSH

SEQ ID NO: 1227643 - protein, 9 aa, Homo Sapiens
SENNKASNS

SEQ ID NO: 1227644 - protein, 9 aa, Homo Sapiens
STSPRSLVK

SEQ ID NO: 1227645 - protein, 9 aa, Homo Sapiens
QETDSFQVK

SEQ ID NO: 1227646 - protein, 9 aa, Homo Sapiens
STFSFECSS

SEQ ID NO: 1227647 - protein, 9 aa, Homo Sapiens
QVCSLERDP

SEQ ID NO: 1227648 - protein, 9 aa, Homo Sapiens
MPVLPFMLA

SEQ ID NO: 1227649 - protein, 9 aa, Homo Sapiens
ATMTLPGMH

SEQ ID NO: 1227650 - protein, 9 aa, Homo Sapiens
GKSFSTRGF

SEQ ID NO: 1227651 - protein, 9 aa, Homo Sapiens
LERLTQGMN

SEQ ID NO: 1227652 - protein, 9 aa, Homo Sapiens
NVEWLVPDI

SEQ ID NO: 1227653 - protein, 9 aa, Homo Sapiens
APKWRRRIP

SEQ ID NO: 1227654 - protein, 9 aa, Homo Sapiens
SMAPDLRQD

SEQ ID NO: 1227655 - protein, 9 aa, Homo Sapiens
DVCDKIFRK

SEQ ID NO: 1227656 - protein, 9 aa, Homo Sapiens
LKELATPKI

SEQ ID NO: 1227657 - protein, 9 aa, Homo Sapiens
VKQVPKCDV

SEQ ID NO: 1227658 - protein, 9 aa, Homo Sapiens
QRVQGKDIP

SEQ ID NO: 1227659 - protein, 9 aa, Homo Sapiens
MQVVVQQPG

SEQ ID NO: 1227660 - protein, 9 aa, Homo Sapiens
AMQAMIRSM

SEQ ID NO: 1227661 - protein, 9 aa, Homo Sapiens
GAGALRAVV

SEQ ID NO: 1227662 - protein, 9 aa, Homo Sapiens
KYDLRQRFM

SEQ ID NO: 1227663 - protein, 9 aa, Homo Sapiens
ELGECELPA

SEQ ID NO: 1227664 - protein, 9 aa, Homo Sapiens
QKEVAGFLD

SEQ ID NO: 1227665 - protein, 9 aa, Homo Sapiens
YSGSEGSMQ

SEQ ID NO: 1227666 - protein, 9 aa, Homo Sapiens
TWGINQFGP

SEQ ID NO: 1227667 - protein, 9 aa, Homo Sapiens
DPVKTEMGP

SEQ ID NO: 1227668 - protein, 9 aa, Homo Sapiens
KQCSKMTLI

SEQ ID NO: 1227669 - protein, 9 aa, Homo Sapiens
CTLRIPCTQ

SEQ ID NO: 1227670 - protein, 9 aa, Homo Sapiens
TQKRFLKYA

SEQ ID NO: 1227671 - protein, 9 aa, Homo Sapiens
CFSWSLSWP

SEQ ID NO: 1227672 - protein, 9 aa, Homo Sapiens
EDCAKQIQV

SEQ ID NO: 1227673 - protein, 9 aa, Homo Sapiens
TAYLSMGGL

SEQ ID NO: 1227674 - protein, 9 aa, Homo Sapiens
AGDNRAIIV

SEQ ID NO: 1227675 - protein, 9 aa, Homo Sapiens
DVINLVQDS

SEQ ID NO: 1227676 - protein, 9 aa, Homo Sapiens
LIYNLYAIS

SEQ ID NO: 1227677 - protein, 9 aa, Homo Sapiens
EDLKDQLKH

SEQ ID NO: 1227678 - protein, 9 aa, Homo Sapiens
KLSPGNEEN

SEQ ID NO: 1227679 - protein, 9 aa, Homo Sapiens
HTHKQIAQI

SEQ ID NO: 1227680 - protein, 9 aa, Homo Sapiens
AKGWAWIRV

SEQ ID NO: 1227681 - protein, 9 aa, Homo Sapiens
VSLTLSPHH

SEQ ID NO: 1227682 - protein, 9 aa, Homo Sapiens
DKLHLLGAT

SEQ ID NO: 1227683 - protein, 9 aa, Homo Sapiens
RDRREYDRI

SEQ ID NO: 1227684 - protein, 9 aa, Homo Sapiens
WEQEGKMRE

SEQ ID NO: 1227685 - protein, 9 aa, Homo Sapiens
SLDNVEVVQ

SEQ ID NO: 1227686 - protein, 9 aa, Homo Sapiens
NALIHKNRP

SEQ ID NO: 1227687 - protein, 9 aa, Homo Sapiens
EDIFARDKN

SEQ ID NO: 1227688 - protein, 9 aa, Homo Sapiens
THSSREYDG

SEQ ID NO: 1227689 - protein, 9 aa, Homo Sapiens
LRERPVCCV

SEQ ID NO: 1227690 - protein, 9 aa, Homo Sapiens
ILQKRMNFL

SEQ ID NO: 1227691 - protein, 9 aa, Homo Sapiens
VHPPPSTCL

SEQ ID NO: 1227692 - protein, 9 aa, Homo Sapiens
NFTPLKVGG

SEQ ID NO: 1227693 - protein, 9 aa, Homo Sapiens
MLGLCYQIS

SEQ ID NO: 1227694 - protein, 9 aa, Homo Sapiens
RRPMYSRLE

SEQ ID NO: 1227695 - protein, 9 aa, Homo Sapiens
TKTHHAYAE

SEQ ID NO: 1227696 - protein, 9 aa, Homo Sapiens
KIATIAEKL

SEQ ID NO: 1227697 - protein, 9 aa, Homo Sapiens
RDVALPALV

SEQ ID NO: 1227698 - protein, 9 aa, Homo Sapiens
GVVHAALGG

SEQ ID NO: 1227699 - protein, 9 aa, Homo Sapiens
SWLPSSPAH

SEQ ID NO: 1227700 - protein, 9 aa, Homo Sapiens
TFSSYAPEQ

SEQ ID NO: 1227701 - protein, 9 aa, Homo Sapiens
KHVFTVGRI

SEQ ID NO: 1227702 - protein, 9 aa, Homo Sapiens
SVFTLGNMN

SEQ ID NO: 1227703 - protein, 9 aa, Homo Sapiens
TPRRRPGPH

SEQ ID NO: 1227704 - protein, 9 aa, Homo Sapiens
FLFNMCLTR

SEQ ID NO: 1227705 - protein, 9 aa, Homo Sapiens
IMKVNFDIL

SEQ ID NO: 1227706 - protein, 9 aa, Homo Sapiens
ERLTQGMNI

SEQ ID NO: 1227707 - protein, 9 aa, Homo Sapiens
PFYPLRGPW

SEQ ID NO: 1227708 - protein, 9 aa, Homo Sapiens
IQLNEMHSL

SEQ ID NO: 1227709 - protein, 9 aa, Homo Sapiens
TRFNQGHSC

SEQ ID NO: 1227710 - protein, 9 aa, Homo Sapiens
VKWLAAAQA

SEQ ID NO: 1227711 - protein, 9 aa, Homo Sapiens
ENTSPSELR

SEQ ID NO: 1227712 - protein, 9 aa, Homo Sapiens
GFVISGRHS

SEQ ID NO: 1227713 - protein, 9 aa, Homo Sapiens
AVGTRYKCS

SEQ ID NO: 1227714 - protein, 9 aa, Homo Sapiens
EDIHKEKKS

SEQ ID NO: 1227715 - protein, 9 aa, Homo Sapiens
WIPDVFSLP

SEQ ID NO: 1227716 - protein, 9 aa, Homo Sapiens
RAEQLKKAS

SEQ ID NO: 1227717 - protein, 9 aa, Homo Sapiens
LTRQSGGAT

SEQ ID NO: 1227718 - protein, 9 aa, Homo Sapiens
KCGLTPLAR

SEQ ID NO: 1227719 - protein, 9 aa, Homo Sapiens
VVARRLGRC

SEQ ID NO: 1227720 - protein, 9 aa, Homo Sapiens
PSPAPLRHA

SEQ ID NO: 1227721 - protein, 9 aa, Homo Sapiens
NAICTGPVA

SEQ ID NO: 1227722 - protein, 9 aa, Homo Sapiens
INNVLFTTQ

SEQ ID NO: 1227723 - protein, 9 aa, Homo Sapiens
ECTGYTLGF

SEQ ID NO: 1227724 - protein, 9 aa, Homo Sapiens
TLTRKILNV

SEQ ID NO: 1227725 - protein, 9 aa, Homo Sapiens
GLQSKIENF

SEQ ID NO: 1227726 - protein, 9 aa, Homo Sapiens
ASLFHRRRA

SEQ ID NO: 1227727 - protein, 9 aa, Homo Sapiens
NPNITDVFG

SEQ ID NO: 1227728 - protein, 9 aa, Homo Sapiens
HVKLVNLGF

SEQ ID NO: 1227729 - protein, 9 aa, Homo Sapiens
ILNVLLMAV

SEQ ID NO: 1227730 - protein, 9 aa, Homo Sapiens
AVNRRLAQQ

SEQ ID NO: 1227731 - protein, 9 aa, Homo Sapiens
TVRGSCGWW

SEQ ID NO: 1227732 - protein, 9 aa, Homo Sapiens
ILLVTHILR

SEQ ID NO: 1227733 - protein, 9 aa, Homo Sapiens
RNLLTTDAI

SEQ ID NO: 1227734 - protein, 9 aa, Homo Sapiens
FHVKFTLEY

SEQ ID NO: 1227735 - protein, 9 aa, Homo Sapiens
ELVLIDFGF

SEQ ID NO: 1227736 - protein, 9 aa, Homo Sapiens
DVTSPFPTA

SEQ ID NO: 1227737 - protein, 9 aa, Homo Sapiens
AFKLYSLHT

SEQ ID NO: 1227738 - protein, 9 aa, Homo Sapiens
SSVSSFVDK

SEQ ID NO: 1227739 - protein, 9 aa, Homo Sapiens
FRPKGSNKV

SEQ ID NO: 1227740 - protein, 9 aa, Homo Sapiens
VSGSGKFTV

SEQ ID NO: 1227741 - protein, 9 aa, Homo Sapiens
SITAITVTV

SEQ ID NO: 1227742 - protein, 9 aa, Homo Sapiens
RTSAYTLIS

SEQ ID NO: 1227743 - protein, 9 aa, Homo Sapiens
YLWSPGGRQ

SEQ ID NO: 1227744 - protein, 9 aa, Homo Sapiens
MSGLAACGT

SEQ ID NO: 1227745 - protein, 9 aa, Homo Sapiens
ALMQDYTAS

SEQ ID NO: 1227746 - protein, 9 aa, Homo Sapiens
FIHNCTITL

SEQ ID NO: 1227747 - protein, 9 aa, Homo Sapiens
MCHQDDATR

SEQ ID NO: 1227748 - protein, 9 aa, Homo Sapiens
LVFKRMDSA

SEQ ID NO: 1227749 - protein, 9 aa, Homo Sapiens
ENLQPRRLK

SEQ ID NO: 1227750 - protein, 9 aa, Homo Sapiens
HCTVKLCQT

SEQ ID NO: 1227751 - protein, 9 aa, Homo Sapiens
HISDTCSRD

SEQ ID NO: 1227752 - protein, 9 aa, Homo Sapiens
SFRKVQEHQ

SEQ ID NO: 1227753 - protein, 9 aa, Homo Sapiens
EKDWKKEKL

SEQ ID NO: 1227754 - protein, 9 aa, Homo Sapiens
SRRVLVWDL

SEQ ID NO: 1227755 - protein, 9 aa, Homo Sapiens
PSSPSQESG

SEQ ID NO: 1227756 - protein, 9 aa, Homo Sapiens
ISRANTIPI

SEQ ID NO: 1227757 - protein, 9 aa, Homo Sapiens
TILQQIDSV

SEQ ID NO: 1227758 - protein, 9 aa, Homo Sapiens
SGMVIFNLY

SEQ ID NO: 1227759 - protein, 9 aa, Homo Sapiens
KMAFNYLSV

SEQ ID NO: 1227760 - protein, 9 aa, Homo Sapiens
SGDCSARQA

SEQ ID NO: 1227761 - protein, 9 aa, Homo Sapiens
ESQLTCDSA

SEQ ID NO: 1227762 - protein, 9 aa, Homo Sapiens
YICLVEITL

SEQ ID NO: 1227763 - protein, 9 aa, Homo Sapiens
VRVPDQEPT

SEQ ID NO: 1227764 - protein, 9 aa, Homo Sapiens
EVAAERSPS

SEQ ID NO: 1227765 - protein, 9 aa, Homo Sapiens
VTVDVTARA

SEQ ID NO: 1227766 - protein, 9 aa, Homo Sapiens
LRLDAKIFR

SEQ ID NO: 1227767 - protein, 9 aa, Homo Sapiens
LLGYPEKRT

SEQ ID NO: 1227768 - protein, 9 aa, Homo Sapiens
LTVKSLPPQ

SEQ ID NO: 1227769 - protein, 9 aa, Homo Sapiens
MALQRQRNL

SEQ ID NO: 1227770 - protein, 9 aa, Homo Sapiens
GRLWAILQN

SEQ ID NO: 1227771 - protein, 9 aa, Homo Sapiens
RFWAKMCYH

SEQ ID NO: 1227772 - protein, 9 aa, Homo Sapiens
GEKYLTCVE

SEQ ID NO: 1227773 - protein, 9 aa, Homo Sapiens
ALCLHLDGP

SEQ ID NO: 1227774 - protein, 9 aa, Homo Sapiens
IIQGFRVIY

SEQ ID NO: 1227775 - protein, 9 aa, Homo Sapiens
SIISLECSE

SEQ ID NO: 1227776 - protein, 9 aa, Homo Sapiens
GLPAFLAMS

SEQ ID NO: 1227777 - protein, 9 aa, Homo Sapiens
LCPCWVSSM

SEQ ID NO: 1227778 - protein, 9 aa, Homo Sapiens
PAESSMPPV

SEQ ID NO: 1227779 - protein, 9 aa, Homo Sapiens
ANHLRIHSI

SEQ ID NO: 1227780 - protein, 9 aa, Homo Sapiens
TIQGALELR

SEQ ID NO: 1227781 - protein, 9 aa, Homo Sapiens
VSPSSVRGS

SEQ ID NO: 1227782 - protein, 9 aa, Homo Sapiens
LIAIDALGF

SEQ ID NO: 1227783 - protein, 9 aa, Homo Sapiens
IRPEYVWIV

SEQ ID NO: 1227784 - protein, 9 aa, Homo Sapiens
FVCGCHLGV

SEQ ID NO: 1227785 - protein, 9 aa, Homo Sapiens
LTRSKGVGP

SEQ ID NO: 1227786 - protein, 9 aa, Homo Sapiens
TDAFQKPIP

SEQ ID NO: 1227787 - protein, 9 aa, Homo Sapiens
DHPKALKGP

SEQ ID NO: 1227788 - protein, 9 aa, Homo Sapiens
SSENSVAER

SEQ ID NO: 1227789 - protein, 9 aa, Homo Sapiens
VMRCSAMPT

SEQ ID NO: 1227790 - protein, 9 aa, Homo Sapiens
GGMSMLDTI

SEQ ID NO: 1227791 - protein, 9 aa, Homo Sapiens
VLLQGYDKG

SEQ ID NO: 1227792 - protein, 9 aa, Homo Sapiens
LSILHPSRS

SEQ ID NO: 1227793 - protein, 9 aa, Homo Sapiens
SDRPPQNFS

SEQ ID NO: 1227794 - protein, 9 aa, Homo Sapiens
DAHQCTKMY

SEQ ID NO: 1227795 - protein, 9 aa, Homo Sapiens
VLVQDKCVN

SEQ ID NO: 1227796 - protein, 9 aa, Homo Sapiens
EKVHFWVGF

SEQ ID NO: 1227797 - protein, 9 aa, Homo Sapiens
EIVEHVFQS

SEQ ID NO: 1227798 - protein, 9 aa, Homo Sapiens
ERMNTIDQD

SEQ ID NO: 1227799 - protein, 9 aa, Homo Sapiens
NLLEQASHS

SEQ ID NO: 1227800 - protein, 9 aa, Homo Sapiens
HAHWDAHRR

SEQ ID NO: 1227801 - protein, 9 aa, Homo Sapiens
IHAHWDAHR

SEQ ID NO: 1227802 - protein, 9 aa, Homo Sapiens
LVMAPGFAR

SEQ ID NO: 1227803 - protein, 9 aa, Homo Sapiens
STLGIMYQS

SEQ ID NO: 1227804 - protein, 9 aa, Homo Sapiens
VRPWWDIPS

SEQ ID NO: 1227805 - protein, 9 aa, Homo Sapiens
MSHPLLMFS

SEQ ID NO: 1227806 - protein, 9 aa, Homo Sapiens
ILAFLSLQC

SEQ ID NO: 1227807 - protein, 9 aa, Homo Sapiens
KDGIQPMWD

SEQ ID NO: 1227808 - protein, 9 aa, Homo Sapiens
GPRGSPAFP

SEQ ID NO: 1227809 - protein, 9 aa, Homo Sapiens
LKIQKFTGC

SEQ ID NO: 1227810 - protein, 9 aa, Homo Sapiens
NKDQYSISY

SEQ ID NO: 1227811 - protein, 9 aa, Homo Sapiens
KAGDKIATR

SEQ ID NO: 1227812 - protein, 9 aa, Homo Sapiens
LLERHMLIH

SEQ ID NO: 1227813 - protein, 9 aa, Homo Sapiens
LKDVAIVVP

SEQ ID NO: 1227814 - protein, 9 aa, Homo Sapiens
CQKMSPKWC

SEQ ID NO: 1227815 - protein, 9 aa, Homo Sapiens
QSHYVPSSG

SEQ ID NO: 1227816 - protein, 9 aa, Homo Sapiens
FSWSLSWPP

SEQ ID NO: 1227817 - protein, 9 aa, Homo Sapiens
PILSYCTLP

SEQ ID NO: 1227818 - protein, 9 aa, Homo Sapiens
GPCKRCKMI

SEQ ID NO: 1227819 - protein, 9 aa, Homo Sapiens
LLYFVASVF

SEQ ID NO: 1227820 - protein, 9 aa, Homo Sapiens
QNPTVQFHS

SEQ ID NO: 1227821 - protein, 9 aa, Homo Sapiens
HALRLLQES

SEQ ID NO: 1227822 - protein, 9 aa, Homo Sapiens
SELEGMGLS

SEQ ID NO: 1227823 - protein, 9 aa, Homo Sapiens
MFAYIFHDE

SEQ ID NO: 1227824 - protein, 9 aa, Homo Sapiens
KKANWKKIS

SEQ ID NO: 1227825 - protein, 9 aa, Homo Sapiens
TYSYSQKVS

SEQ ID NO: 1227826 - protein, 9 aa, Homo Sapiens
DDEVWAIHR

SEQ ID NO: 1227827 - protein, 9 aa, Homo Sapiens
CLAADGRGL

SEQ ID NO: 1227828 - protein, 9 aa, Homo Sapiens
LHTGEWPFR

SEQ ID NO: 1227829 - protein, 9 aa, Homo Sapiens
LQYTLKQHP

SEQ ID NO: 1227830 - protein, 9 aa, Homo Sapiens
LLFITLVIT

SEQ ID NO: 1227831 - protein, 9 aa, Homo Sapiens
YVNSLVLQP

SEQ ID NO: 1227832 - protein, 9 aa, Homo Sapiens
TGTKGPGAA

SEQ ID NO: 1227833 - protein, 9 aa, Homo Sapiens
RSGLICARL

SEQ ID NO: 1227834 - protein, 9 aa, Homo Sapiens
QHPNDKTNI

SEQ ID NO: 1227835 - protein, 9 aa, Homo Sapiens
QTHISLPQI

SEQ ID NO: 1227836 - protein, 9 aa, Homo Sapiens
PLMETVEDW

SEQ ID NO: 1227837 - protein, 9 aa, Homo Sapiens
AQSQDLSCT

SEQ ID NO: 1227838 - protein, 9 aa, Homo Sapiens
PTDSALMPH

SEQ ID NO: 1227839 - protein, 9 aa, Homo Sapiens
VSEKCSCCD

SEQ ID NO: 1227840 - protein, 9 aa, Homo Sapiens
SSFSPHSSS

SEQ ID NO: 1227841 - protein, 9 aa, Homo Sapiens
ALSYINIFM

SEQ ID NO: 1227842 - protein, 9 aa, Homo Sapiens
ADLTTGTPC

SEQ ID NO: 1227843 - protein, 9 aa, Homo Sapiens
LNVDVKKEV

SEQ ID NO: 1227844 - protein, 9 aa, Homo Sapiens
VAEVRRIVD

SEQ ID NO: 1227845 - protein, 9 aa, Homo Sapiens
GYKEDKPCI

SEQ ID NO: 1227846 - protein, 9 aa, Homo Sapiens
EFWEDNFNC

SEQ ID NO: 1227847 - protein, 9 aa, Homo Sapiens
PGTVPGMPN

SEQ ID NO: 1227848 - protein, 9 aa, Homo Sapiens
SRICSSAHL

SEQ ID NO: 1227849 - protein, 9 aa, Homo Sapiens
CRAAIHYRI

SEQ ID NO: 1227850 - protein, 9 aa, Homo Sapiens
TPAHALQCR

SEQ ID NO: 1227851 - protein, 9 aa, Homo Sapiens
EESMYKRIG

SEQ ID NO: 1227852 - protein, 9 aa, Homo Sapiens
RNSSINSHE

SEQ ID NO: 1227853 - protein, 9 aa, Homo Sapiens
KRKIPCESN

SEQ ID NO: 1227854 - protein, 9 aa, Homo Sapiens
CLNLDTMTW

SEQ ID NO: 1227855 - protein, 9 aa, Homo Sapiens
KAFSYKHVC

SEQ ID NO: 1227856 - protein, 9 aa, Homo Sapiens
NCAPEFQAN

SEQ ID NO: 1227857 - protein, 9 aa, Homo Sapiens
LSSLKWFLG

SEQ ID NO: 1227858 - protein, 9 aa, Homo Sapiens
MVVLLMGLM

SEQ ID NO: 1227859 - protein, 9 aa, Homo Sapiens
TNMMIQRLG

SEQ ID NO: 1227860 - protein, 9 aa, Homo Sapiens
NAEHKPYIC

SEQ ID NO: 1227861 - protein, 9 aa, Homo Sapiens
MLKPRLKTE

SEQ ID NO: 1227862 - protein, 9 aa, Homo Sapiens
QKGRCKQES

SEQ ID NO: 1227863 - protein, 9 aa, Homo Sapiens
PWVAYSFSN

SEQ ID NO: 1227864 - protein, 9 aa, Homo Sapiens
INDNHPTFP

SEQ ID NO: 1227865 - protein, 9 aa, Homo Sapiens
VDSITNILK

SEQ ID NO: 1227866 - protein, 9 aa, Homo Sapiens
LKSVMEGAS

SEQ ID NO: 1227867 - protein, 9 aa, Homo Sapiens
HAFFLEGVR

SEQ ID NO: 1227868 - protein, 9 aa, Homo Sapiens
TLKEEVKRF

SEQ ID NO: 1227869 - protein, 9 aa, Homo Sapiens
RLLHQVFPL

SEQ ID NO: 1227870 - protein, 9 aa, Homo Sapiens
MAEEKKQAL

SEQ ID NO: 1227871 - protein, 9 aa, Homo Sapiens
ERCYLDLTR

SEQ ID NO: 1227872 - protein, 9 aa, Homo Sapiens
ELFLSFNVY

SEQ ID NO: 1227873 - protein, 9 aa, Homo Sapiens
WRMPEFGDF

SEQ ID NO: 1227874 - protein, 9 aa, Homo Sapiens
SDSAILLKV

SEQ ID NO: 1227875 - protein, 9 aa, Homo Sapiens
AKLIHVIHH

SEQ ID NO: 1227876 - protein, 9 aa, Homo Sapiens
QDKEMVRVQ

SEQ ID NO: 1227877 - protein, 9 aa, Homo Sapiens
GAWEELGPD

SEQ ID NO: 1227878 - protein, 9 aa, Homo Sapiens
LQPQSKNAL

SEQ ID NO: 1227879 - protein, 9 aa, Homo Sapiens
KCEMAFQYQ

SEQ ID NO: 1227880 - protein, 9 aa, Homo Sapiens
RAGDAPVGT

SEQ ID NO: 1227881 - protein, 9 aa, Homo Sapiens
VREGVNCRY

SEQ ID NO: 1227882 - protein, 9 aa, Homo Sapiens
TPLPPPVTS

SEQ ID NO: 1227883 - protein, 9 aa, Homo Sapiens
KVLPDRKVW

SEQ ID NO: 1227884 - protein, 9 aa, Homo Sapiens
GSRNQEEGK

SEQ ID NO: 1227885 - protein, 9 aa, Homo Sapiens
HNSTRVIQC

SEQ ID NO: 1227886 - protein, 9 aa, Homo Sapiens
SSTAPAPKF

SEQ ID NO: 1227887 - protein, 9 aa, Homo Sapiens
QTVLFQGAG

SEQ ID NO: 1227888 - protein, 9 aa, Homo Sapiens
TPVCTLSAL

SEQ ID NO: 1227889 - protein, 9 aa, Homo Sapiens
KKLKGKLKN

SEQ ID NO: 1227890 - protein, 9 aa, Homo Sapiens
WWDLFYKLA

SEQ ID NO: 1227891 - protein, 9 aa, Homo Sapiens
ISRSAEPPS

SEQ ID NO: 1227892 - protein, 9 aa, Homo Sapiens
NTERMQDLK

SEQ ID NO: 1227893 - protein, 9 aa, Homo Sapiens
NCRTIQGRT

SEQ ID NO: 1227894 - protein, 9 aa, Homo Sapiens
LTRKNGSNR

SEQ ID NO: 1227895 - protein, 9 aa, Homo Sapiens
DSPPFEGME

SEQ ID NO: 1227896 - protein, 9 aa, Homo Sapiens
FLGFLRWLL

SEQ ID NO: 1227897 - protein, 9 aa, Homo Sapiens
EIMTVVILK

SEQ ID NO: 1227898 - protein, 9 aa, Homo Sapiens
RLNMHINVQ

SEQ ID NO: 1227899 - protein, 9 aa, Homo Sapiens
GEGMTCSSC

SEQ ID NO: 1227900 - protein, 9 aa, Homo Sapiens
LCHLVDLFR

SEQ ID NO: 1227901 - protein, 9 aa, Homo Sapiens
HWKRRRSFS

SEQ ID NO: 1227902 - protein, 9 aa, Homo Sapiens
DIVVLAEEK

SEQ ID NO: 1227903 - protein, 9 aa, Homo Sapiens
CMGKARERG

SEQ ID NO: 1227904 - protein, 9 aa, Homo Sapiens
LSKADYLKR

SEQ ID NO: 1227905 - protein, 9 aa, Homo Sapiens
AQEAPLWVN

SEQ ID NO: 1227906 - protein, 9 aa, Homo Sapiens
IVGYMLLLV

SEQ ID NO: 1227907 - protein, 9 aa, Homo Sapiens
VVVVGVIAT

SEQ ID NO: 1227908 - protein, 9 aa, Homo Sapiens
WVSVMERSK

SEQ ID NO: 1227909 - protein, 9 aa, Homo Sapiens
FPSSLGEVI

SEQ ID NO: 1227910 - protein, 9 aa, Homo Sapiens
HVFFLTPKR

SEQ ID NO: 1227911 - protein, 9 aa, Homo Sapiens
SYQPNVLPH

SEQ ID NO: 1227912 - protein, 9 aa, Homo Sapiens
TKLYRTTIS

SEQ ID NO: 1227913 - protein, 9 aa, Homo Sapiens
FQENSMIGQ

SEQ ID NO: 1227914 - protein, 9 aa, Homo Sapiens
VLTAKVSTD

SEQ ID NO: 1227915 - protein, 9 aa, Homo Sapiens
VSLHFLQNT

SEQ ID NO: 1227916 - protein, 9 aa, Homo Sapiens
WPWDFFINM

SEQ ID NO: 1227917 - protein, 9 aa, Homo Sapiens
PNPGVRYTG

SEQ ID NO: 1227918 - protein, 9 aa, Homo Sapiens
LNSLLKEGH

SEQ ID NO: 1227919 - protein, 9 aa, Homo Sapiens
VSEKVLEMD

SEQ ID NO: 1227920 - protein, 9 aa, Homo Sapiens
KEWNVLKKK

SEQ ID NO: 1227921 - protein, 9 aa, Homo Sapiens
WRRSLKEKS

SEQ ID NO: 1227922 - protein, 9 aa, Homo Sapiens
YPLRGPWRG

SEQ ID NO: 1227923 - protein, 9 aa, Homo Sapiens
PLICWDTTS

SEQ ID NO: 1227924 - protein, 9 aa, Homo Sapiens
PPRLPLRPQ

SEQ ID NO: 1227925 - protein, 9 aa, Homo Sapiens
PGDSVEACP

SEQ ID NO: 1227926 - protein, 9 aa, Homo Sapiens
HGQFSLAVI

SEQ ID NO: 1227927 - protein, 9 aa, Homo Sapiens
EALQTIHLF

SEQ ID NO: 1227928 - protein, 9 aa, Homo Sapiens
YCLGTKKYI

SEQ ID NO: 1227929 - protein, 9 aa, Homo Sapiens
SGPAEGERQ

SEQ ID NO: 1227930 - protein, 9 aa, Homo Sapiens
HMELRDNNT

SEQ ID NO: 1227931 - protein, 9 aa, Homo Sapiens
DAPSIEQRL

SEQ ID NO: 1227932 - protein, 9 aa, Homo Sapiens
QEDSVIMFD

SEQ ID NO: 1227933 - protein, 9 aa, Homo Sapiens
SQIYGCSQT

SEQ ID NO: 1227934 - protein, 9 aa, Homo Sapiens
CNTQGTWEP

SEQ ID NO: 1227935 - protein, 9 aa, Homo Sapiens
DITRGYERI

SEQ ID NO: 1227936 - protein, 9 aa, Homo Sapiens
WMQSPVDVI

SEQ ID NO: 1227937 - protein, 9 aa, Homo Sapiens
TSLVPELPT

SEQ ID NO: 1227938 - protein, 9 aa, Homo Sapiens
SYDPTIENN

SEQ ID NO: 1227939 - protein, 9 aa, Homo Sapiens
AQPLNPRPC

SEQ ID NO: 1227940 - protein, 9 aa, Homo Sapiens
NRMIVSPDL

SEQ ID NO: 1227941 - protein, 9 aa, Homo Sapiens
ATSAPPQGC

SEQ ID NO: 1227942 - protein, 9 aa, Homo Sapiens
PLTSRIVGG

SEQ ID NO: 1227943 - protein, 9 aa, Homo Sapiens
LALLRAGPR

SEQ ID NO: 1227944 - protein, 9 aa, Homo Sapiens
QKDLYRNVM

SEQ ID NO: 1227945 - protein, 9 aa, Homo Sapiens
SRMAHPRLP

SEQ ID NO: 1227946 - protein, 9 aa, Homo Sapiens
KGIQIPNLC

SEQ ID NO: 1227947 - protein, 9 aa, Homo Sapiens
IDDTWWFGT

SEQ ID NO: 1227948 - protein, 9 aa, Homo Sapiens
TERDCASPS

SEQ ID NO: 1227949 - protein, 9 aa, Homo Sapiens
AGISSAWTD

SEQ ID NO: 1227950 - protein, 9 aa, Homo Sapiens
SMSTSTWAD

SEQ ID NO: 1227951 - protein, 9 aa, Homo Sapiens
FNEKASIML

SEQ ID NO: 1227952 - protein, 9 aa, Homo Sapiens
NPGLPGISG

SEQ ID NO: 1227953 - protein, 9 aa, Homo Sapiens
ILQGTLLFM

SEQ ID NO: 1227954 - protein, 9 aa, Homo Sapiens
INVKQVFEC

SEQ ID NO: 1227955 - protein, 9 aa, Homo Sapiens
PLRHADNLR

SEQ ID NO: 1227956 - protein, 9 aa, Homo Sapiens
SLGYAINKY

SEQ ID NO: 1227957 - protein, 9 aa, Homo Sapiens
SFLYILMDR

SEQ ID NO: 1227958 - protein, 9 aa, Homo Sapiens
RCEEVDATR

SEQ ID NO: 1227959 - protein, 9 aa, Homo Sapiens
KCLHKTHRL

SEQ ID NO: 1227960 - protein, 9 aa, Homo Sapiens
FLYLHSRGI

SEQ ID NO: 1227961 - protein, 9 aa, Homo Sapiens
KLAVSRDKA

SEQ ID NO: 1227962 - protein, 9 aa, Homo Sapiens
MRQKPSDRA

SEQ ID NO: 1227963 - protein, 9 aa, Homo Sapiens
RVNEILSQL

SEQ ID NO: 1227964 - protein, 9 aa, Homo Sapiens
KNCPVNKRR

SEQ ID NO: 1227965 - protein, 9 aa, Homo Sapiens
TLFSVLVCP

SEQ ID NO: 1227966 - protein, 9 aa, Homo Sapiens
VNNATTRVM

SEQ ID NO: 1227967 - protein, 9 aa, Homo Sapiens
TRCYRLCNE

SEQ ID NO: 1227968 - protein, 9 aa, Homo Sapiens
VGITATLFV

SEQ ID NO: 1227969 - protein, 9 aa, Homo Sapiens
RPQARTLSA

SEQ ID NO: 1227970 - protein, 9 aa, Homo Sapiens
CFATQRALI

SEQ ID NO: 1227971 - protein, 9 aa, Homo Sapiens
RPTNKFQGM

SEQ ID NO: 1227972 - protein, 9 aa, Homo Sapiens
KGKENNKME

SEQ ID NO: 1227973 - protein, 9 aa, Homo Sapiens
QKLQVCCMV

SEQ ID NO: 1227974 - protein, 9 aa, Homo Sapiens
HSSSINVVA

SEQ ID NO: 1227975 - protein, 9 aa, Homo Sapiens
LCLHYPPSY

SEQ ID NO: 1227976 - protein, 9 aa, Homo Sapiens
NCSLYMSCG

SEQ ID NO: 1227977 - protein, 9 aa, Homo Sapiens
AKQIERVYF

SEQ ID NO: 1227978 - protein, 9 aa, Homo Sapiens
AKFAYRGIL

SEQ ID NO: 1227979 - protein, 9 aa, Homo Sapiens
KSKSSSYSS

SEQ ID NO: 1227980 - protein, 9 aa, Homo Sapiens
MMVPELTCE

SEQ ID NO: 1227981 - protein, 9 aa, Homo Sapiens
GLLSSVSSF

SEQ ID NO: 1227982 - protein, 9 aa, Homo Sapiens
ANAPIGLYH

SEQ ID NO: 1227983 - protein, 9 aa, Homo Sapiens
ILGLTGVTM

SEQ ID NO: 1227984 - protein, 9 aa, Homo Sapiens
RDIIHCGKC

SEQ ID NO: 1227985 - protein, 9 aa, Homo Sapiens
LTELIQALV

SEQ ID NO: 1227986 - protein, 9 aa, Homo Sapiens
TEVTIIEKH

SEQ ID NO: 1227987 - protein, 9 aa, Homo Sapiens
KVRTKAAGG

SEQ ID NO: 1227988 - protein, 9 aa, Homo Sapiens
RQKCEWVKF

SEQ ID NO: 1227989 - protein, 9 aa, Homo Sapiens
QREVRPQVS

SEQ ID NO: 1227990 - protein, 9 aa, Homo Sapiens
TSIYVCRVE

SEQ ID NO: 1227991 - protein, 9 aa, Homo Sapiens
VRHAGPCLP

SEQ ID NO: 1227992 - protein, 9 aa, Homo Sapiens
FPQCLSSEE

SEQ ID NO: 1227993 - protein, 9 aa, Homo Sapiens
SLRILTIGT

SEQ ID NO: 1227994 - protein, 9 aa, Homo Sapiens
PPPAHPRPP

SEQ ID NO: 1227995 - protein, 9 aa, Homo Sapiens
LVEHETVAE

SEQ ID NO: 1227996 - protein, 9 aa, Homo Sapiens
VFTMLPGQG

SEQ ID NO: 1227997 - protein, 9 aa, Homo Sapiens
IFDGRELLV

SEQ ID NO: 1227998 - protein, 9 aa, Homo Sapiens
RIQPPRRLV

SEQ ID NO: 1227999 - protein, 9 aa, Homo Sapiens
SEVISWGGP

SEQ ID NO: 1228000 - protein, 9 aa, Homo Sapiens
WGNTVNMAS

SEQ ID NO: 1228001 - protein, 9 aa, Homo Sapiens
IIYLFFDTS

SEQ ID NO: 1228002 - protein, 9 aa, Homo Sapiens
TDEVVPDQT

SEQ ID NO: 1228003 - protein, 9 aa, Homo Sapiens
LWLHHAFFS

SEQ ID NO: 1228004 - protein, 9 aa, Homo Sapiens
FAAAIVIII

SEQ ID NO: 1228005 - protein, 9 aa, Homo Sapiens
LEADVQAIS

SEQ ID NO: 1228006 - protein, 9 aa, Homo Sapiens
EERSGLICA

SEQ ID NO: 1228007 - protein, 9 aa, Homo Sapiens
KTRQVCSLD

SEQ ID NO: 1228008 - protein, 9 aa, Homo Sapiens
LPLPPDFHP

SEQ ID NO: 1228009 - protein, 9 aa, Homo Sapiens
WAGSSLCII

SEQ ID NO: 1228010 - protein, 9 aa, Homo Sapiens
TLYINIISI

SEQ ID NO: 1228011 - protein, 9 aa, Homo Sapiens
LFIFTYGMH

SEQ ID NO: 1228012 - protein, 9 aa, Homo Sapiens
QCWSRRFHL

SEQ ID NO: 1228013 - protein, 9 aa, Homo Sapiens
TYESHLLHI

SEQ ID NO: 1228014 - protein, 9 aa, Homo Sapiens
VSRVFQSPL

SEQ ID NO: 1228015 - protein, 9 aa, Homo Sapiens
SVLDKPLFH

SEQ ID NO: 1228016 - protein, 9 aa, Homo Sapiens
DVAIVVPFP

SEQ ID NO: 1228017 - protein, 9 aa, Homo Sapiens
SSPPSSKRH

SEQ ID NO: 1228018 - protein, 9 aa, Homo Sapiens
AITVFIALK

SEQ ID NO: 1228019 - protein, 9 aa, Homo Sapiens
PDNVKFRKI

SEQ ID NO: 1228020 - protein, 9 aa, Homo Sapiens
QCDPSYRSV

SEQ ID NO: 1228021 - protein, 9 aa, Homo Sapiens
CRRWKRLVE

SEQ ID NO: 1228022 - protein, 9 aa, Homo Sapiens
QMMKRIKQL

SEQ ID NO: 1228023 - protein, 9 aa, Homo Sapiens
RDTRHLGAT

SEQ ID NO: 1228024 - protein, 9 aa, Homo Sapiens
YISMQLLYF

SEQ ID NO: 1228025 - protein, 9 aa, Homo Sapiens
KTEMAHQIY

SEQ ID NO: 1228026 - protein, 9 aa, Homo Sapiens
GGVMLVHVI

SEQ ID NO: 1228027 - protein, 9 aa, Homo Sapiens
QRIEYANLT

SEQ ID NO: 1228028 - protein, 9 aa, Homo Sapiens
SKSLWFIGL

SEQ ID NO: 1228029 - protein, 9 aa, Homo Sapiens
SSHAMESAT

SEQ ID NO: 1228030 - protein, 9 aa, Homo Sapiens
ECLQAKKEE

SEQ ID NO: 1228031 - protein, 9 aa, Homo Sapiens
PANQFLCLK

SEQ ID NO: 1228032 - protein, 9 aa, Homo Sapiens
DTAHHPGKS

SEQ ID NO: 1228033 - protein, 9 aa, Homo Sapiens
SMDPTFALL

SEQ ID NO: 1228034 - protein, 9 aa, Homo Sapiens
NKFQPKRLH

SEQ ID NO: 1228035 - protein, 9 aa, Homo Sapiens
ANLTSWPHW

SEQ ID NO: 1228036 - protein, 9 aa, Homo Sapiens
APQLQVILL

SEQ ID NO: 1228037 - protein, 9 aa, Homo Sapiens
ITFLTKEDY

SEQ ID NO: 1228038 - protein, 9 aa, Homo Sapiens
TASTSQAQV

SEQ ID NO: 1228039 - protein, 9 aa, Homo Sapiens
LGWDPDNLA

SEQ ID NO: 1228040 - protein, 9 aa, Homo Sapiens
AIKTPQRYK

SEQ ID NO: 1228041 - protein, 9 aa, Homo Sapiens
PAPTPDATA

SEQ ID NO: 1228042 - protein, 9 aa, Homo Sapiens
DNIAKYKGV

SEQ ID NO: 1228043 - protein, 9 aa, Homo Sapiens
EDRETERII

SEQ ID NO: 1228044 - protein, 9 aa, Homo Sapiens
SINADNSHL

SEQ ID NO: 1228045 - protein, 9 aa, Homo Sapiens
LHSLPGVVG

SEQ ID NO: 1228046 - protein, 9 aa, Homo Sapiens
VTSCGPLRI

SEQ ID NO: 1228047 - protein, 9 aa, Homo Sapiens
YNHTHGGKW

SEQ ID NO: 1228048 - protein, 9 aa, Homo Sapiens
KYVTVGFTQ

SEQ ID NO: 1228049 - protein, 9 aa, Homo Sapiens
GLIIVHATS

SEQ ID NO: 1228050 - protein, 9 aa, Homo Sapiens
LREDDLDDS

SEQ ID NO: 1228051 - protein, 9 aa, Homo Sapiens
SPGPRGSPA

SEQ ID NO: 1228052 - protein, 9 aa, Homo Sapiens
QRYYHRCHV

SEQ ID NO: 1228053 - protein, 9 aa, Homo Sapiens
IAIRLQLME

SEQ ID NO: 1228054 - protein, 9 aa, Homo Sapiens
QSMISNPDL

SEQ ID NO: 1228055 - protein, 9 aa, Homo Sapiens
YLRNRSAHN

SEQ ID NO: 1228056 - protein, 9 aa, Homo Sapiens
LFGNDINNV

SEQ ID NO: 1228057 - protein, 9 aa, Homo Sapiens
RDCDGVLQT

SEQ ID NO: 1228058 - protein, 9 aa, Homo Sapiens
IFPIQISRL

SEQ ID NO: 1228059 - protein, 9 aa, Homo Sapiens
RCTFLTNLA

SEQ ID NO: 1228060 - protein, 9 aa, Homo Sapiens
YAIYAVQVI

SEQ ID NO: 1228061 - protein, 9 aa, Homo Sapiens
EDSCLLPVL

SEQ ID NO: 1228062 - protein, 9 aa, Homo Sapiens
REKAANDYN

SEQ ID NO: 1228063 - protein, 9 aa, Homo Sapiens
TTSSHIIVH

SEQ ID NO: 1228064 - protein, 9 aa, Homo Sapiens
HETPPGADP

SEQ ID NO: 1228065 - protein, 9 aa, Homo Sapiens
KPSPDYVTT

SEQ ID NO: 1228066 - protein, 9 aa, Homo Sapiens
FFACLVMIT

SEQ ID NO: 1228067 - protein, 9 aa, Homo Sapiens
SFETNFFVN

SEQ ID NO: 1228068 - protein, 9 aa, Homo Sapiens
RQEVPPHIF

SEQ ID NO: 1228069 - protein, 9 aa, Homo Sapiens
RVSQEPWNS

SEQ ID NO: 1228070 - protein, 9 aa, Homo Sapiens
EGQQFGAAH

SEQ ID NO: 1228071 - protein, 9 aa, Homo Sapiens
SMRTINQQA

SEQ ID NO: 1228072 - protein, 9 aa, Homo Sapiens
QKFYLETQD

SEQ ID NO: 1228073 - protein, 9 aa, Homo Sapiens
TNHWRCMLN

SEQ ID NO: 1228074 - protein, 9 aa, Homo Sapiens
LTGVTMGSL

SEQ ID NO: 1228075 - protein, 9 aa, Homo Sapiens
QIGPCKRCK

SEQ ID NO: 1228076 - protein, 9 aa, Homo Sapiens
KAASKAASQ

SEQ ID NO: 1228077 - protein, 9 aa, Homo Sapiens
SVSDIVPPF

SEQ ID NO: 1228078 - protein, 9 aa, Homo Sapiens
WEAAAELEA

SEQ ID NO: 1228079 - protein, 9 aa, Homo Sapiens
CLLEPCIPP

SEQ ID NO: 1228080 - protein, 9 aa, Homo Sapiens
PAPKDALAH

SEQ ID NO: 1228081 - protein, 9 aa, Homo Sapiens
PREPTSKVT

SEQ ID NO: 1228082 - protein, 9 aa, Homo Sapiens
SHQDFANMT

SEQ ID NO: 1228083 - protein, 9 aa, Homo Sapiens
MACVRYIKE

SEQ ID NO: 1228084 - protein, 9 aa, Homo Sapiens
HLDEHLLCH

SEQ ID NO: 1228085 - protein, 9 aa, Homo Sapiens
SCVWPDVRV

SEQ ID NO: 1228086 - protein, 9 aa, Homo Sapiens
AFLCAVCGE

SEQ ID NO: 1228087 - protein, 9 aa, Homo Sapiens
IHTGEWPYK

SEQ ID NO: 1228088 - protein, 9 aa, Homo Sapiens
IGKDIIQNT

SEQ ID NO: 1228089 - protein, 9 aa, Homo Sapiens
KEFLYQTIF

SEQ ID NO: 1228090 - protein, 9 aa, Homo Sapiens
LIAVFQKYV

SEQ ID NO: 1228091 - protein, 9 aa, Homo Sapiens
PGSRHKHAP

SEQ ID NO: 1228092 - protein, 9 aa, Homo Sapiens
LGIMYQSEL

SEQ ID NO: 1228093 - protein, 9 aa, Homo Sapiens
HALEQLKPL

SEQ ID NO: 1228094 - protein, 9 aa, Homo Sapiens
RISSLVKDT

SEQ ID NO: 1228095 - protein, 9 aa, Homo Sapiens
PKRHRKVCE

SEQ ID NO: 1228096 - protein, 9 aa, Homo Sapiens
ETFDVVVAS

SEQ ID NO: 1228097 - protein, 9 aa, Homo Sapiens
NVIITVTDL

SEQ ID NO: 1228098 - protein, 9 aa, Homo Sapiens
FIYYKIKDG

SEQ ID NO: 1228099 - protein, 9 aa, Homo Sapiens
SALSVYPLN

SEQ ID NO: 1228100 - protein, 9 aa, Homo Sapiens
KCQQQKDFI

SEQ ID NO: 1228101 - protein, 9 aa, Homo Sapiens
GQILNLIQA

SEQ ID NO: 1228102 - protein, 9 aa, Homo Sapiens
RNQHVSVSR

SEQ ID NO: 1228103 - protein, 9 aa, Homo Sapiens
NPQLHAAIR

SEQ ID NO: 1228104 - protein, 9 aa, Homo Sapiens
RCDCVICWM

SEQ ID NO: 1228105 - protein, 9 aa, Homo Sapiens
RVTNMKASK

SEQ ID NO: 1228106 - protein, 9 aa, Homo Sapiens
VPTGTWKPG

SEQ ID NO: 1228107 - protein, 9 aa, Homo Sapiens
QKLFAPVRI

SEQ ID NO: 1228108 - protein, 9 aa, Homo Sapiens
AGMGWYQTC

SEQ ID NO: 1228109 - protein, 9 aa, Homo Sapiens
QQKQTIEHL

SEQ ID NO: 1228110 - protein, 9 aa, Homo Sapiens
CNTGKYLET

SEQ ID NO: 1228111 - protein, 9 aa, Homo Sapiens
CKRICILVF

SEQ ID NO: 1228112 - protein, 9 aa, Homo Sapiens
AVAVFLWDF

SEQ ID NO: 1228113 - protein, 9 aa, Homo Sapiens
GRQCVEHYH

SEQ ID NO: 1228114 - protein, 9 aa, Homo Sapiens
LSFEYVRSF

SEQ ID NO: 1228115 - protein, 9 aa, Homo Sapiens
SDKGDCHIF

SEQ ID NO: 1228116 - protein, 9 aa, Homo Sapiens
DIMKEKEVK

SEQ ID NO: 1228117 - protein, 9 aa, Homo Sapiens
ADINDNHPT

SEQ ID NO: 1228118 - protein, 9 aa, Homo Sapiens
TFLKRPELG

SEQ ID NO: 1228119 - protein, 9 aa, Homo Sapiens
PLVTTFFYS

SEQ ID NO: 1228120 - protein, 9 aa, Homo Sapiens
LDEKPASPT

SEQ ID NO: 1228121 - protein, 9 aa, Homo Sapiens
GDLPPSWTM

SEQ ID NO: 1228122 - protein, 9 aa, Homo Sapiens
HGCAHVCRE

SEQ ID NO: 1228123 - protein, 9 aa, Homo Sapiens
AMYQEGLGG

SEQ ID NO: 1228124 - protein, 9 aa, Homo Sapiens
TANHLRIHS

SEQ ID NO: 1228125 - protein, 9 aa, Homo Sapiens
SLFDKDGDE

SEQ ID NO: 1228126 - protein, 9 aa, Homo Sapiens
ADLANKCMV

SEQ ID NO: 1228127 - protein, 9 aa, Homo Sapiens
VETEDTSFF

SEQ ID NO: 1228128 - protein, 9 aa, Homo Sapiens
PLYEAAPGR

SEQ ID NO: 1228129 - protein, 9 aa, Homo Sapiens
TIVILFYSM

SEQ ID NO: 1228130 - protein, 9 aa, Homo Sapiens
GNCRYCIKD

SEQ ID NO: 1228131 - protein, 9 aa, Homo Sapiens
QDHVLSQES

SEQ ID NO: 1228132 - protein, 9 aa, Homo Sapiens
SRTRACEVI

SEQ ID NO: 1228133 - protein, 9 aa, Homo Sapiens
KPLLQIEVG

SEQ ID NO: 1228134 - protein, 9 aa, Homo Sapiens
EVHRHTNAG

SEQ ID NO: 1228135 - protein, 9 aa, Homo Sapiens
PCQRGARCQ

SEQ ID NO: 1228136 - protein, 9 aa, Homo Sapiens
GCLSSLQTN

SEQ ID NO: 1228137 - protein, 9 aa, Homo Sapiens
LGVYRRESV

SEQ ID NO: 1228138 - protein, 9 aa, Homo Sapiens
ISRNGNVIY

SEQ ID NO: 1228139 - protein, 9 aa, Homo Sapiens
DELADSVLE

SEQ ID NO: 1228140 - protein, 9 aa, Homo Sapiens
CFAYQKISN

SEQ ID NO: 1228141 - protein, 9 aa, Homo Sapiens
ETPAVLPEH

SEQ ID NO: 1228142 - protein, 9 aa, Homo Sapiens
TVGGINGHF

SEQ ID NO: 1228143 - protein, 9 aa, Homo Sapiens
LVLDEDLAK

SEQ ID NO: 1228144 - protein, 9 aa, Homo Sapiens
VNSRGLSRI

SEQ ID NO: 1228145 - protein, 9 aa, Homo Sapiens
ANILISDQD

SEQ ID NO: 1228146 - protein, 9 aa, Homo Sapiens
SEYSNMPDS

SEQ ID NO: 1228147 - protein, 9 aa, Homo Sapiens
LLFLWRRFR

SEQ ID NO: 1228148 - protein, 9 aa, Homo Sapiens
EQGPGHACM

SEQ ID NO: 1228149 - protein, 9 aa, Homo Sapiens
YTMLVGWYP

SEQ ID NO: 1228150 - protein, 9 aa, Homo Sapiens
YKHRIKELS

SEQ ID NO: 1228151 - protein, 9 aa, Homo Sapiens
NNVLLDLLR

SEQ ID NO: 1228152 - protein, 9 aa, Homo Sapiens
RRLPKPASS

SEQ ID NO: 1228153 - protein, 9 aa, Homo Sapiens
EKAKAHILL

SEQ ID NO: 1228154 - protein, 9 aa, Homo Sapiens
GKLCSNFWG

SEQ ID NO: 1228155 - protein, 9 aa, Homo Sapiens
NHYFEVLMR

SEQ ID NO: 1228156 - protein, 9 aa, Homo Sapiens
SHEVDYYNR

SEQ ID NO: 1228157 - protein, 9 aa, Homo Sapiens
KLNAENTGP

SEQ ID NO: 1228158 - protein, 9 aa, Homo Sapiens
QCEIRLTQK

SEQ ID NO: 1228159 - protein, 9 aa, Homo Sapiens
HLGAASRGH

SEQ ID NO: 1228160 - protein, 9 aa, Homo Sapiens
CSKDLQMVN

SEQ ID NO: 1228161 - protein, 9 aa, Homo Sapiens
GIGGILWYR

SEQ ID NO: 1228162 - protein, 9 aa, Homo Sapiens
LPLDMLLFL

SEQ ID NO: 1228163 - protein, 9 aa, Homo Sapiens
SRTHAYTRE

SEQ ID NO: 1228164 - protein, 9 aa, Homo Sapiens
FDAKTYCFM

SEQ ID NO: 1228165 - protein, 9 aa, Homo Sapiens
VQKSKNQEH

SEQ ID NO: 1228166 - protein, 9 aa, Homo Sapiens
WLSQQLVAA

SEQ ID NO: 1228167 - protein, 9 aa, Homo Sapiens
VLQKVIVHH

SEQ ID NO: 1228168 - protein, 9 aa, Homo Sapiens
EAFATSLWS

SEQ ID NO: 1228169 - protein, 9 aa, Homo Sapiens
KSALSGHLG

SEQ ID NO: 1228170 - protein, 9 aa, Homo Sapiens
EKPFSCPQC

SEQ ID NO: 1228171 - protein, 9 aa, Homo Sapiens
IRPHPTSDG

SEQ ID NO: 1228172 - protein, 9 aa, Homo Sapiens
LFIPDIDLI

SEQ ID NO: 1228173 - protein, 9 aa, Homo Sapiens
ADGECQFNL

SEQ ID NO: 1228174 - protein, 9 aa, Homo Sapiens
PRIELLFFV

SEQ ID NO: 1228175 - protein, 9 aa, Homo Sapiens
TRWLSSPNT

SEQ ID NO: 1228176 - protein, 9 aa, Homo Sapiens
SFSDDIEHT

SEQ ID NO: 1228177 - protein, 9 aa, Homo Sapiens
ICDTSFMRE

SEQ ID NO: 1228178 - protein, 9 aa, Homo Sapiens
LWYNDGHVF

SEQ ID NO: 1228179 - protein, 9 aa, Homo Sapiens
EGLAHGVVS

SEQ ID NO: 1228180 - protein, 9 aa, Homo Sapiens
NLGGSREDH

SEQ ID NO: 1228181 - protein, 9 aa, Homo Sapiens
QQTTGCSQR

SEQ ID NO: 1228182 - protein, 9 aa, Homo Sapiens
MQPHKYILV

SEQ ID NO: 1228183 - protein, 9 aa, Homo Sapiens
AMFSMKTSS

SEQ ID NO: 1228184 - protein, 9 aa, Homo Sapiens
DIDGIITKS

SEQ ID NO: 1228185 - protein, 9 aa, Homo Sapiens
WGRKTHHIS

SEQ ID NO: 1228186 - protein, 9 aa, Homo Sapiens
RMLTQADEK

SEQ ID NO: 1228187 - protein, 9 aa, Homo Sapiens
VKGTMETMP

SEQ ID NO: 1228188 - protein, 9 aa, Homo Sapiens
RREIQRELL

SEQ ID NO: 1228189 - protein, 9 aa, Homo Sapiens
RKLDRANNL

SEQ ID NO: 1228190 - protein, 9 aa, Homo Sapiens
IDLDELMKN

SEQ ID NO: 1228191 - protein, 9 aa, Homo Sapiens
PAAEYQTTS

SEQ ID NO: 1228192 - protein, 9 aa, Homo Sapiens
NTVRGIFVL

SEQ ID NO: 1228193 - protein, 9 aa, Homo Sapiens
GSHLTEHLI

SEQ ID NO: 1228194 - protein, 9 aa, Homo Sapiens
PEQVWFKAN

SEQ ID NO: 1228195 - protein, 9 aa, Homo Sapiens
KFHMTTYST

SEQ ID NO: 1228196 - protein, 9 aa, Homo Sapiens
DCKEYKKGF

SEQ ID NO: 1228197 - protein, 9 aa, Homo Sapiens
WTPLTPTPT

SEQ ID NO: 1228198 - protein, 9 aa, Homo Sapiens
KNCYSERKK

SEQ ID NO: 1228199 - protein, 9 aa, Homo Sapiens
IRKVRSWTE

SEQ ID NO: 1228200 - protein, 9 aa, Homo Sapiens
VTDINPPQY

SEQ ID NO: 1228201 - protein, 9 aa, Homo Sapiens
NIHLQTGCF

SEQ ID NO: 1228202 - protein, 9 aa, Homo Sapiens
AWTHRLHER

SEQ ID NO: 1228203 - protein, 9 aa, Homo Sapiens
AILDFEHCT

SEQ ID NO: 1228204 - protein, 9 aa, Homo Sapiens
WGLGLPKLY

SEQ ID NO: 1228205 - protein, 9 aa, Homo Sapiens
REYSHFEKE

SEQ ID NO: 1228206 - protein, 9 aa, Homo Sapiens
LSHHSDHKP

SEQ ID NO: 1228207 - protein, 9 aa, Homo Sapiens
AFYDNCRCL

SEQ ID NO: 1228208 - protein, 9 aa, Homo Sapiens
QQENRYWRR

SEQ ID NO: 1228209 - protein, 9 aa, Homo Sapiens
YDTFKNSFV

SEQ ID NO: 1228210 - protein, 9 aa, Homo Sapiens
GTTRPQRSF

SEQ ID NO: 1228211 - protein, 9 aa, Homo Sapiens
KILGKKKGR

SEQ ID NO: 1228212 - protein, 9 aa, Homo Sapiens
KEGHIDDLL

SEQ ID NO: 1228213 - protein, 9 aa, Homo Sapiens
IGLYHLSLE

SEQ ID NO: 1228214 - protein, 9 aa, Homo Sapiens
IVKSLEHLH

SEQ ID NO: 1228215 - protein, 9 aa, Homo Sapiens
FNTGTVYRY

SEQ ID NO: 1228216 - protein, 9 aa, Homo Sapiens
KIGSLKTLK

SEQ ID NO: 1228217 - protein, 9 aa, Homo Sapiens
LVPELPTPW

SEQ ID NO: 1228218 - protein, 9 aa, Homo Sapiens
NPKYGTLLK

SEQ ID NO: 1228219 - protein, 9 aa, Homo Sapiens
DLQITVGAV

SEQ ID NO: 1228220 - protein, 9 aa, Homo Sapiens
WRGKWWGEE

SEQ ID NO: 1228221 - protein, 9 aa, Homo Sapiens
EHREKEREE

SEQ ID NO: 1228222 - protein, 9 aa, Homo Sapiens
IYGVAQHYK

SEQ ID NO: 1228223 - protein, 9 aa, Homo Sapiens
AALKDRHME

SEQ ID NO: 1228224 - protein, 9 aa, Homo Sapiens
CCSILSMVC

SEQ ID NO: 1228225 - protein, 9 aa, Homo Sapiens
CLPGQVHPA

SEQ ID NO: 1228226 - protein, 9 aa, Homo Sapiens
GTRYVGSMV

SEQ ID NO: 1228227 - protein, 9 aa, Homo Sapiens
PTVPPQEAI

SEQ ID NO: 1228228 - protein, 9 aa, Homo Sapiens
PSCGSTCGC

SEQ ID NO: 1228229 - protein, 9 aa, Homo Sapiens
PKLEHLDHV

SEQ ID NO: 1228230 - protein, 9 aa, Homo Sapiens
RRSKRPQAM

SEQ ID NO: 1228231 - protein, 9 aa, Homo Sapiens
VNLAKNASL

SEQ ID NO: 1228232 - protein, 9 aa, Homo Sapiens
LFFLVTTML

SEQ ID NO: 1228233 - protein, 9 aa, Homo Sapiens
NCRLCNTPL

SEQ ID NO: 1228234 - protein, 9 aa, Homo Sapiens
RPNPALNEF

SEQ ID NO: 1228235 - protein, 9 aa, Homo Sapiens
QTPLPVSAT

SEQ ID NO: 1228236 - protein, 9 aa, Homo Sapiens
YSYECVIRA

SEQ ID NO: 1228237 - protein, 9 aa, Homo Sapiens
KTTWYHRYY

SEQ ID NO: 1228238 - protein, 9 aa, Homo Sapiens
TVKSLPPQT

SEQ ID NO: 1228239 - protein, 9 aa, Homo Sapiens
TMYNSKGTD

SEQ ID NO: 1228240 - protein, 9 aa, Homo Sapiens
VLQPWMGYA

SEQ ID NO: 1228241 - protein, 9 aa, Homo Sapiens
LGADPHFGL

SEQ ID NO: 1228242 - protein, 9 aa, Homo Sapiens
DPVTSSGTA

SEQ ID NO: 1228243 - protein, 9 aa, Homo Sapiens
SKQIRCNTQ

SEQ ID NO: 1228244 - protein, 9 aa, Homo Sapiens
SLRYSPTGR

SEQ ID NO: 1228245 - protein, 9 aa, Homo Sapiens
TKSSVCIFK

SEQ ID NO: 1228246 - protein, 9 aa, Homo Sapiens
KLFTDRKTH

SEQ ID NO: 1228247 - protein, 9 aa, Homo Sapiens
DPVGPPCRS

SEQ ID NO: 1228248 - protein, 9 aa, Homo Sapiens
VDGDDNFRY

SEQ ID NO: 1228249 - protein, 9 aa, Homo Sapiens
IKPSFFVLH

SEQ ID NO: 1228250 - protein, 9 aa, Homo Sapiens
HSTTRDRNK

SEQ ID NO: 1228251 - protein, 9 aa, Homo Sapiens
YFHSLEVAR

SEQ ID NO: 1228252 - protein, 9 aa, Homo Sapiens
CRKCHSPHL

SEQ ID NO: 1228253 - protein, 9 aa, Homo Sapiens
EAAAYQSRN

SEQ ID NO: 1228254 - protein, 9 aa, Homo Sapiens
YQVFHLNTL

SEQ ID NO: 1228255 - protein, 9 aa, Homo Sapiens
HGQQGQAGM

SEQ ID NO: 1228256 - protein, 9 aa, Homo Sapiens
AGKKKKYIK

SEQ ID NO: 1228257 - protein, 9 aa, Homo Sapiens
IWDAQDLFS

SEQ ID NO: 1228258 - protein, 9 aa, Homo Sapiens
SRKRALQDC

SEQ ID NO: 1228259 - protein, 9 aa, Homo Sapiens
VFPTRTAHF

SEQ ID NO: 1228260 - protein, 9 aa, Homo Sapiens
PHHCGHSQP

SEQ ID NO: 1228261 - protein, 9 aa, Homo Sapiens
SEKKAISFA

SEQ ID NO: 1228262 - protein, 9 aa, Homo Sapiens
KYYISKGHL

SEQ ID NO: 1228263 - protein, 9 aa, Homo Sapiens
PGNRGTDGY

SEQ ID NO: 1228264 - protein, 9 aa, Homo Sapiens
DSWLRPDQR

SEQ ID NO: 1228265 - protein, 9 aa, Homo Sapiens
VPLVRKIFL

SEQ ID NO: 1228266 - protein, 9 aa, Homo Sapiens
NNVLFTTQN

SEQ ID NO: 1228267 - protein, 9 aa, Homo Sapiens
DFRALHQAS

SEQ ID NO: 1228268 - protein, 9 aa, Homo Sapiens
RSWLERDTP

SEQ ID NO: 1228269 - protein, 9 aa, Homo Sapiens
CIGRCSDLV

SEQ ID NO: 1228270 - protein, 9 aa, Homo Sapiens
VHEGDAVYR

SEQ ID NO: 1228271 - protein, 9 aa, Homo Sapiens
EVNENFEIQ

SEQ ID NO: 1228272 - protein, 9 aa, Homo Sapiens
RTARCRQQQ

SEQ ID NO: 1228273 - protein, 9 aa, Homo Sapiens
FTDTVYRQT

SEQ ID NO: 1228274 - protein, 9 aa, Homo Sapiens
MTALFQEAS

SEQ ID NO: 1228275 - protein, 9 aa, Homo Sapiens
DAEYVYYKS

SEQ ID NO: 1228276 - protein, 9 aa, Homo Sapiens
CKTPPMSLS

SEQ ID NO: 1228277 - protein, 9 aa, Homo Sapiens
IHSAVGQGV

SEQ ID NO: 1228278 - protein, 9 aa, Homo Sapiens
QKRGLQDGS

SEQ ID NO: 1228279 - protein, 9 aa, Homo Sapiens
RGGMRSRGR

SEQ ID NO: 1228280 - protein, 9 aa, Homo Sapiens
VDVLCVTVS

SEQ ID NO: 1228281 - protein, 9 aa, Homo Sapiens
SVSDHCHHP

SEQ ID NO: 1228282 - protein, 9 aa, Homo Sapiens
CDDGWNSKV

SEQ ID NO: 1228283 - protein, 9 aa, Homo Sapiens
YGSFWSNVS

SEQ ID NO: 1228284 - protein, 9 aa, Homo Sapiens
HFCDGKEYD

SEQ ID NO: 1228285 - protein, 9 aa, Homo Sapiens
VTATTTTTT

SEQ ID NO: 1228286 - protein, 9 aa, Homo Sapiens
GPNMRGFLY

SEQ ID NO: 1228287 - protein, 9 aa, Homo Sapiens
RTMEKPPKF

SEQ ID NO: 1228288 - protein, 9 aa, Homo Sapiens
FIMGNHASE

SEQ ID NO: 1228289 - protein, 9 aa, Homo Sapiens
YLDVGSMKT

SEQ ID NO: 1228290 - protein, 9 aa, Homo Sapiens
IFIDFASLR

SEQ ID NO: 1228291 - protein, 9 aa, Homo Sapiens
PNRIPSSRR

SEQ ID NO: 1228292 - protein, 9 aa, Homo Sapiens
DNNLLDQAL

SEQ ID NO: 1228293 - protein, 9 aa, Homo Sapiens
EWFLNKLCL

SEQ ID NO: 1228294 - protein, 9 aa, Homo Sapiens
NKASNSKAT

SEQ ID NO: 1228295 - protein, 9 aa, Homo Sapiens
HVEDFIQEL

SEQ ID NO: 1228296 - protein, 9 aa, Homo Sapiens
RDDPSMSEI

SEQ ID NO: 1228297 - protein, 9 aa, Homo Sapiens
RTENIDIKN

SEQ ID NO: 1228298 - protein, 9 aa, Homo Sapiens
ACGILLADL

SEQ ID NO: 1228299 - protein, 9 aa, Homo Sapiens
EIGGITITW

SEQ ID NO: 1228300 - protein, 9 aa, Homo Sapiens
GFTLMFWRE

SEQ ID NO: 1228301 - protein, 9 aa, Homo Sapiens
KDMTIDFDR

SEQ ID NO: 1228302 - protein, 9 aa, Homo Sapiens
KNTQYENIS

SEQ ID NO: 1228303 - protein, 9 aa, Homo Sapiens
THILNAAYG

SEQ ID NO: 1228304 - protein, 9 aa, Homo Sapiens
EQGSAVEPE

SEQ ID NO: 1228305 - protein, 9 aa, Homo Sapiens
RPHVLPVPP

SEQ ID NO: 1228306 - protein, 9 aa, Homo Sapiens
TIQKTRKRK

SEQ ID NO: 1228307 - protein, 9 aa, Homo Sapiens
DANVPKEAS

SEQ ID NO: 1228308 - protein, 9 aa, Homo Sapiens
ATYTSDSEG

SEQ ID NO: 1228309 - protein, 9 aa, Homo Sapiens
SSDFVLDIR

SEQ ID NO: 1228310 - protein, 9 aa, Homo Sapiens
KTGGLMALL

SEQ ID NO: 1228311 - protein, 9 aa, Homo Sapiens
DDMAVAVAR

SEQ ID NO: 1228312 - protein, 9 aa, Homo Sapiens
KSTGTFSDP

SEQ ID NO: 1228313 - protein, 9 aa, Homo Sapiens
NKDLGEDRT

SEQ ID NO: 1228314 - protein, 9 aa, Homo Sapiens
PVTEDWSAA

SEQ ID NO: 1228315 - protein, 9 aa, Homo Sapiens
EQCCAYYNM

SEQ ID NO: 1228316 - protein, 9 aa, Homo Sapiens
TVVGLTGAH

SEQ ID NO: 1228317 - protein, 9 aa, Homo Sapiens
LSYINIFMT

SEQ ID NO: 1228318 - protein, 9 aa, Homo Sapiens
ANFTWKMEH

SEQ ID NO: 1228319 - protein, 9 aa, Homo Sapiens
WGKHCVDKF

SEQ ID NO: 1228320 - protein, 9 aa, Homo Sapiens
GDAMVMTQY

SEQ ID NO: 1228321 - protein, 9 aa, Homo Sapiens
SPTLVKRKK

SEQ ID NO: 1228322 - protein, 9 aa, Homo Sapiens
LLLGSLPSG

SEQ ID NO: 1228323 - protein, 9 aa, Homo Sapiens
GENEYANVD

SEQ ID NO: 1228324 - protein, 9 aa, Homo Sapiens
SDNLEAPLM

SEQ ID NO: 1228325 - protein, 9 aa, Homo Sapiens
ILVWRPEAV

SEQ ID NO: 1228326 - protein, 9 aa, Homo Sapiens
KKEFLYQTI

SEQ ID NO: 1228327 - protein, 9 aa, Homo Sapiens
TVTLEKCGY

SEQ ID NO: 1228328 - protein, 9 aa, Homo Sapiens
PPHLAVPPH

SEQ ID NO: 1228329 - protein, 9 aa, Homo Sapiens
LPEIQRVSL

SEQ ID NO: 1228330 - protein, 9 aa, Homo Sapiens
RDTSLNHPP

SEQ ID NO: 1228331 - protein, 9 aa, Homo Sapiens
ERYEMPRHG

SEQ ID NO: 1228332 - protein, 9 aa, Homo Sapiens
RRRVQLMWI

SEQ ID NO: 1228333 - protein, 9 aa, Homo Sapiens
CFLRADECK

SEQ ID NO: 1228334 - protein, 9 aa, Homo Sapiens
PDTAAAYPP

SEQ ID NO: 1228335 - protein, 9 aa, Homo Sapiens
EERLQHSEW

SEQ ID NO: 1228336 - protein, 9 aa, Homo Sapiens
PPALGSPPF

SEQ ID NO: 1228337 - protein, 9 aa, Homo Sapiens
FDEFVELIG

SEQ ID NO: 1228338 - protein, 9 aa, Homo Sapiens
QKLQQLHLT

SEQ ID NO: 1228339 - protein, 9 aa, Homo Sapiens
KVSEFLDEA

SEQ ID NO: 1228340 - protein, 9 aa, Homo Sapiens
MGGRVDFDE

SEQ ID NO: 1228341 - protein, 9 aa, Homo Sapiens
SEPETQHRG

SEQ ID NO: 1228342 - protein, 9 aa, Homo Sapiens
FRSLCTKLS

SEQ ID NO: 1228343 - protein, 9 aa, Homo Sapiens
QMHCQEKEI

SEQ ID NO: 1228344 - protein, 9 aa, Homo Sapiens
CEAEQEQMW

SEQ ID NO: 1228345 - protein, 9 aa, Homo Sapiens
NYCKGTYLR

SEQ ID NO: 1228346 - protein, 9 aa, Homo Sapiens
RPRTGKAVS

SEQ ID NO: 1228347 - protein, 9 aa, Homo Sapiens
SCIFVLYTI

SEQ ID NO: 1228348 - protein, 9 aa, Homo Sapiens
HPVCFLPGT

SEQ ID NO: 1228349 - protein, 9 aa, Homo Sapiens
YVKVISETG

SEQ ID NO: 1228350 - protein, 9 aa, Homo Sapiens
EDTWKFMDM

SEQ ID NO: 1228351 - protein, 9 aa, Homo Sapiens
EHKTAVSVL

SEQ ID NO: 1228352 - protein, 9 aa, Homo Sapiens
RLANPGSDQ

SEQ ID NO: 1228353 - protein, 9 aa, Homo Sapiens
QRTHRGEKS

SEQ ID NO: 1228354 - protein, 9 aa, Homo Sapiens
ATVMPGAWE

SEQ ID NO: 1228355 - protein, 9 aa, Homo Sapiens
HYHVNFSHA

SEQ ID NO: 1228356 - protein, 9 aa, Homo Sapiens
ASASGCHVV

SEQ ID NO: 1228357 - protein, 9 aa, Homo Sapiens
TAQDMFYDE

SEQ ID NO: 1228358 - protein, 9 aa, Homo Sapiens
FVDLEETGR

SEQ ID NO: 1228359 - protein, 9 aa, Homo Sapiens
TPPMSLSAG

SEQ ID NO: 1228360 - protein, 9 aa, Homo Sapiens
TYIDYEGHS

SEQ ID NO: 1228361 - protein, 9 aa, Homo Sapiens
KMWRSIMIQ

SEQ ID NO: 1228362 - protein, 9 aa, Homo Sapiens
ISIGYSGLA

SEQ ID NO: 1228363 - protein, 9 aa, Homo Sapiens
DKKLDCGCL

SEQ ID NO: 1228364 - protein, 9 aa, Homo Sapiens
SHAAVQRIV

SEQ ID NO: 1228365 - protein, 9 aa, Homo Sapiens
RGQQMDPNR

SEQ ID NO: 1228366 - protein, 9 aa, Homo Sapiens
KYACHKKYC

SEQ ID NO: 1228367 - protein, 9 aa, Homo Sapiens
EIHFHEIVT

SEQ ID NO: 1228368 - protein, 9 aa, Homo Sapiens
YKLMMVPEL

SEQ ID NO: 1228369 - protein, 9 aa, Homo Sapiens
HRLKNKRYL

SEQ ID NO: 1228370 - protein, 9 aa, Homo Sapiens
GLVTSCKTP

SEQ ID NO: 1228371 - protein, 9 aa, Homo Sapiens
WMPRMRQLQ

SEQ ID NO: 1228372 - protein, 9 aa, Homo Sapiens
KGHLDTELD

SEQ ID NO: 1228373 - protein, 9 aa, Homo Sapiens
PREEMQPMM

SEQ ID NO: 1228374 - protein, 9 aa, Homo Sapiens
TCILILILS

SEQ ID NO: 1228375 - protein, 9 aa, Homo Sapiens
PQIGKKQSS

SEQ ID NO: 1228376 - protein, 9 aa, Homo Sapiens
SSVLDSALH

SEQ ID NO: 1228377 - protein, 9 aa, Homo Sapiens
MKATYINIK

SEQ ID NO: 1228378 - protein, 9 aa, Homo Sapiens
CIRLYAPVV

SEQ ID NO: 1228379 - protein, 9 aa, Homo Sapiens
ELNRTYRAM

SEQ ID NO: 1228380 - protein, 9 aa, Homo Sapiens
SNTASMSGT

SEQ ID NO: 1228381 - protein, 9 aa, Homo Sapiens
VGRSFYQFV

SEQ ID NO: 1228382 - protein, 9 aa, Homo Sapiens
RTSAGEPGT

SEQ ID NO: 1228383 - protein, 9 aa, Homo Sapiens
RCPISRTYT

SEQ ID NO: 1228384 - protein, 9 aa, Homo Sapiens
LGLEGSGGR

SEQ ID NO: 1228385 - protein, 9 aa, Homo Sapiens
SWASVNRGM

SEQ ID NO: 1228386 - protein, 9 aa, Homo Sapiens
KPKDSPPFE

SEQ ID NO: 1228387 - protein, 9 aa, Homo Sapiens
APKRPLLPR

SEQ ID NO: 1228388 - protein, 9 aa, Homo Sapiens
RQLQSSHYG

SEQ ID NO: 1228389 - protein, 9 aa, Homo Sapiens
QKWDADEES

SEQ ID NO: 1228390 - protein, 9 aa, Homo Sapiens
KTEKSFGER

SEQ ID NO: 1228391 - protein, 9 aa, Homo Sapiens
QPHLDTDPS

SEQ ID NO: 1228392 - protein, 9 aa, Homo Sapiens
VPWHGTMTL

SEQ ID NO: 1228393 - protein, 9 aa, Homo Sapiens
LNPAQKLIL

SEQ ID NO: 1228394 - protein, 9 aa, Homo Sapiens
SFPEGSKKE

SEQ ID NO: 1228395 - protein, 9 aa, Homo Sapiens
HLTVVFFIL

SEQ ID NO: 1228396 - protein, 9 aa, Homo Sapiens
VPLGTETSI

SEQ ID NO: 1228397 - protein, 9 aa, Homo Sapiens
HQRQKAASF

SEQ ID NO: 1228398 - protein, 9 aa, Homo Sapiens
GHMDSGKST

SEQ ID NO: 1228399 - protein, 9 aa, Homo Sapiens
VSRLRTLPG

SEQ ID NO: 1228400 - protein, 9 aa, Homo Sapiens
IQMRISRIS

SEQ ID NO: 1228401 - protein, 9 aa, Homo Sapiens
QFECGEGEE

SEQ ID NO: 1228402 - protein, 9 aa, Homo Sapiens
AMVLGAFAA

SEQ ID NO: 1228403 - protein, 9 aa, Homo Sapiens
ESPGRKALL

SEQ ID NO: 1228404 - protein, 9 aa, Homo Sapiens
DHSSSSQAH

SEQ ID NO: 1228405 - protein, 9 aa, Homo Sapiens
VSHTRNDKY

SEQ ID NO: 1228406 - protein, 9 aa, Homo Sapiens
SGGPLLYRH

SEQ ID NO: 1228407 - protein, 9 aa, Homo Sapiens
FIFFVMPLH

SEQ ID NO: 1228408 - protein, 9 aa, Homo Sapiens
HLDGRLARC

SEQ ID NO: 1228409 - protein, 9 aa, Homo Sapiens
MATQAMPNA

SEQ ID NO: 1228410 - protein, 9 aa, Homo Sapiens
GEVRHFTLR

SEQ ID NO: 1228411 - protein, 9 aa, Homo Sapiens
GVQFLEAQI

SEQ ID NO: 1228412 - protein, 9 aa, Homo Sapiens
VIFGPVLDK

SEQ ID NO: 1228413 - protein, 9 aa, Homo Sapiens
KKLPHKTHR

SEQ ID NO: 1228414 - protein, 9 aa, Homo Sapiens
WMFWYSLTN

SEQ ID NO: 1228415 - protein, 9 aa, Homo Sapiens
FASKEEATM

SEQ ID NO: 1228416 - protein, 9 aa, Homo Sapiens
MFVNVMNKM

SEQ ID NO: 1228417 - protein, 9 aa, Homo Sapiens
ESPPPLPAD

SEQ ID NO: 1228418 - protein, 9 aa, Homo Sapiens
WYHRYYWGE

SEQ ID NO: 1228419 - protein, 9 aa, Homo Sapiens
PAAVPLPCG

SEQ ID NO: 1228420 - protein, 9 aa, Homo Sapiens
LANSMILFF

SEQ ID NO: 1228421 - protein, 9 aa, Homo Sapiens
KKHGLRRRQ

SEQ ID NO: 1228422 - protein, 9 aa, Homo Sapiens
TLREDRMTE

SEQ ID NO: 1228423 - protein, 9 aa, Homo Sapiens
PEFEAMIRQ

SEQ ID NO: 1228424 - protein, 9 aa, Homo Sapiens
PAEVDGSVA

SEQ ID NO: 1228425 - protein, 9 aa, Homo Sapiens
KHYECSKCQ

SEQ ID NO: 1228426 - protein, 9 aa, Homo Sapiens
AMTGMTPLE

SEQ ID NO: 1228427 - protein, 9 aa, Homo Sapiens
VFKCPNCSL

SEQ ID NO: 1228428 - protein, 9 aa, Homo Sapiens
CWVSSMRSW

SEQ ID NO: 1228429 - protein, 9 aa, Homo Sapiens
ETMNVASSS

SEQ ID NO: 1228430 - protein, 9 aa, Homo Sapiens
FQIKKKTKK

SEQ ID NO: 1228431 - protein, 9 aa, Homo Sapiens
KASKPSKGK

SEQ ID NO: 1228432 - protein, 9 aa, Homo Sapiens
VSVSFLLLR

SEQ ID NO: 1228433 - protein, 9 aa, Homo Sapiens
RLAARNANM

SEQ ID NO: 1228434 - protein, 9 aa, Homo Sapiens
EARKRREEC

SEQ ID NO: 1228435 - protein, 9 aa, Homo Sapiens
PHTGPTNYR

SEQ ID NO: 1228436 - protein, 9 aa, Homo Sapiens
MHGCHGVVA

SEQ ID NO: 1228437 - protein, 9 aa, Homo Sapiens
GHALRLEHS

SEQ ID NO: 1228438 - protein, 9 aa, Homo Sapiens
HPHCMSVIV

SEQ ID NO: 1228439 - protein, 9 aa, Homo Sapiens
DVLYMPGFL

SEQ ID NO: 1228440 - protein, 9 aa, Homo Sapiens
GQPNRHGVY

SEQ ID NO: 1228441 - protein, 9 aa, Homo Sapiens
FLDSDELEM

SEQ ID NO: 1228442 - protein, 9 aa, Homo Sapiens
QPTLAREDN

SEQ ID NO: 1228443 - protein, 9 aa, Homo Sapiens
IICRYYIHR

SEQ ID NO: 1228444 - protein, 9 aa, Homo Sapiens
WVLRKALEH

SEQ ID NO: 1228445 - protein, 9 aa, Homo Sapiens
PRVWVVPMQ

SEQ ID NO: 1228446 - protein, 9 aa, Homo Sapiens
CLHKHCRPK

SEQ ID NO: 1228447 - protein, 9 aa, Homo Sapiens
NVKSEEEQS

SEQ ID NO: 1228448 - protein, 9 aa, Homo Sapiens
SSKPTSNRC

SEQ ID NO: 1228449 - protein, 9 aa, Homo Sapiens
TALLLLKLS

SEQ ID NO: 1228450 - protein, 9 aa, Homo Sapiens
ISGQDGPPG

SEQ ID NO: 1228451 - protein, 9 aa, Homo Sapiens
TNIEAALRA

SEQ ID NO: 1228452 - protein, 9 aa, Homo Sapiens
PDFFIKTKA

SEQ ID NO: 1228453 - protein, 9 aa, Homo Sapiens
TVSLFHLTQ

SEQ ID NO: 1228454 - protein, 9 aa, Homo Sapiens
SIRLVGPMN

SEQ ID NO: 1228455 - protein, 9 aa, Homo Sapiens
EKEIVRLCT

SEQ ID NO: 1228456 - protein, 9 aa, Homo Sapiens
LAIPDDFGG

SEQ ID NO: 1228457 - protein, 9 aa, Homo Sapiens
TFSGIVGYM

SEQ ID NO: 1228458 - protein, 9 aa, Homo Sapiens
AMGFFCLMV

SEQ ID NO: 1228459 - protein, 9 aa, Homo Sapiens
RLRGTMRRH

SEQ ID NO: 1228460 - protein, 9 aa, Homo Sapiens
SEESDLELD

SEQ ID NO: 1228461 - protein, 9 aa, Homo Sapiens
TGPFWYEMR

SEQ ID NO: 1228462 - protein, 9 aa, Homo Sapiens
LLIPTVGSS

SEQ ID NO: 1228463 - protein, 9 aa, Homo Sapiens
PGHGVSAPS

SEQ ID NO: 1228464 - protein, 9 aa, Homo Sapiens
DQFKDTNKS

SEQ ID NO: 1228465 - protein, 9 aa, Homo Sapiens
RRVITLPQW

SEQ ID NO: 1228466 - protein, 9 aa, Homo Sapiens
DALLPLYME

SEQ ID NO: 1228467 - protein, 9 aa, Homo Sapiens
MQLEVVDKS

SEQ ID NO: 1228468 - protein, 9 aa, Homo Sapiens
EMEAARDEH

SEQ ID NO: 1228469 - protein, 9 aa, Homo Sapiens
DMGQQTNMM

SEQ ID NO: 1228470 - protein, 9 aa, Homo Sapiens
AENKMNLTL

SEQ ID NO: 1228471 - protein, 9 aa, Homo Sapiens
SLTIHNKIN

SEQ ID NO: 1228472 - protein, 9 aa, Homo Sapiens
NYCGKTFSM

SEQ ID NO: 1228473 - protein, 9 aa, Homo Sapiens
WTVFQWRMD

SEQ ID NO: 1228474 - protein, 9 aa, Homo Sapiens
ERYPDSFSM

SEQ ID NO: 1228475 - protein, 9 aa, Homo Sapiens
SGPMRGAKE

SEQ ID NO: 1228476 - protein, 9 aa, Homo Sapiens
KKYCLKTTA

SEQ ID NO: 1228477 - protein, 9 aa, Homo Sapiens
LRDDAIGTT

SEQ ID NO: 1228478 - protein, 9 aa, Homo Sapiens
PRFVMQAKT

SEQ ID NO: 1228479 - protein, 9 aa, Homo Sapiens
SSPAYYTSS

SEQ ID NO: 1228480 - protein, 9 aa, Homo Sapiens
HHYLCLDKS

SEQ ID NO: 1228481 - protein, 9 aa, Homo Sapiens
SRVPAQEPW

SEQ ID NO: 1228482 - protein, 9 aa, Homo Sapiens
SFGATRIFE

SEQ ID NO: 1228483 - protein, 9 aa, Homo Sapiens
DFGKDMALY

SEQ ID NO: 1228484 - protein, 9 aa, Homo Sapiens
WNKRSGMQV

SEQ ID NO: 1228485 - protein, 9 aa, Homo Sapiens
KETMGWVTR

SEQ ID NO: 1228486 - protein, 9 aa, Homo Sapiens
AGDIIEVMD

SEQ ID NO: 1228487 - protein, 9 aa, Homo Sapiens
NQGKYPMIR

SEQ ID NO: 1228488 - protein, 9 aa, Homo Sapiens
YECSDMSCP

SEQ ID NO: 1228489 - protein, 9 aa, Homo Sapiens
IARLRTAGI

SEQ ID NO: 1228490 - protein, 9 aa, Homo Sapiens
LHSAMHQLA

SEQ ID NO: 1228491 - protein, 9 aa, Homo Sapiens
EDLKAKGVQ

SEQ ID NO: 1228492 - protein, 9 aa, Homo Sapiens
LLQRMKWDW

SEQ ID NO: 1228493 - protein, 9 aa, Homo Sapiens
AIDLSLCDH

SEQ ID NO: 1228494 - protein, 9 aa, Homo Sapiens
YVQEHIKPP

SEQ ID NO: 1228495 - protein, 9 aa, Homo Sapiens
IGPGRRVEY

SEQ ID NO: 1228496 - protein, 9 aa, Homo Sapiens
LPPQSQTHP

SEQ ID NO: 1228497 - protein, 9 aa, Homo Sapiens
ELQFSKDFS

SEQ ID NO: 1228498 - protein, 9 aa, Homo Sapiens
VVYTGWLFQ

SEQ ID NO: 1228499 - protein, 9 aa, Homo Sapiens
FHKKLSLRF

SEQ ID NO: 1228500 - protein, 9 aa, Homo Sapiens
AFFRVDHIM

SEQ ID NO: 1228501 - protein, 9 aa, Homo Sapiens
GEEENTFVK

SEQ ID NO: 1228502 - protein, 9 aa, Homo Sapiens
VLTFITTML

SEQ ID NO: 1228503 - protein, 9 aa, Homo Sapiens
ITQCTATEL

SEQ ID NO: 1228504 - protein, 9 aa, Homo Sapiens
LYVQLMGIN

SEQ ID NO: 1228505 - protein, 9 aa, Homo Sapiens
GMHMILSLK

SEQ ID NO: 1228506 - protein, 9 aa, Homo Sapiens
VKCVKAVTE

SEQ ID NO: 1228507 - protein, 9 aa, Homo Sapiens
TRLSSLKWF

SEQ ID NO: 1228508 - protein, 9 aa, Homo Sapiens
AILGITIGL

SEQ ID NO: 1228509 - protein, 9 aa, Homo Sapiens
QGIVLKYQE

SEQ ID NO: 1228510 - protein, 9 aa, Homo Sapiens
RMNLQTATS

SEQ ID NO: 1228511 - protein, 9 aa, Homo Sapiens
DHHLPRLCG

SEQ ID NO: 1228512 - protein, 9 aa, Homo Sapiens
AGLLSRGNL

SEQ ID NO: 1228513 - protein, 9 aa, Homo Sapiens
EWHYGGLTG

SEQ ID NO: 1228514 - protein, 9 aa, Homo Sapiens
ADELVQRHH

SEQ ID NO: 1228515 - protein, 9 aa, Homo Sapiens
SKTERINDL

SEQ ID NO: 1228516 - protein, 9 aa, Homo Sapiens
INVVKTCIQ

SEQ ID NO: 1228517 - protein, 9 aa, Homo Sapiens
SSVFYSFHH

SEQ ID NO: 1228518 - protein, 9 aa, Homo Sapiens
VTLLNGEQT

SEQ ID NO: 1228519 - protein, 9 aa, Homo Sapiens
IYVYTVSLD

SEQ ID NO: 1228520 - protein, 9 aa, Homo Sapiens
RGPYGSKGD

SEQ ID NO: 1228521 - protein, 9 aa, Homo Sapiens
SFLLRAASG

SEQ ID NO: 1228522 - protein, 9 aa, Homo Sapiens
TSPKREHLS

SEQ ID NO: 1228523 - protein, 9 aa, Homo Sapiens
HDAGLHRVR

SEQ ID NO: 1228524 - protein, 9 aa, Homo Sapiens
KHLRGGGSP

SEQ ID NO: 1228525 - protein, 9 aa, Homo Sapiens
HSAQLDVHE

SEQ ID NO: 1228526 - protein, 9 aa, Homo Sapiens
KVVSKSKVP

SEQ ID NO: 1228527 - protein, 9 aa, Homo Sapiens
SCPSLRGPA

SEQ ID NO: 1228528 - protein, 9 aa, Homo Sapiens
HWRLCGIVS

SEQ ID NO: 1228529 - protein, 9 aa, Homo Sapiens
LLSRGNLGA

SEQ ID NO: 1228530 - protein, 9 aa, Homo Sapiens
SARGPLCKR

SEQ ID NO: 1228531 - protein, 9 aa, Homo Sapiens
GMNIQWMHV

SEQ ID NO: 1228532 - protein, 9 aa, Homo Sapiens
VDLLQCSQK

SEQ ID NO: 1228533 - protein, 9 aa, Homo Sapiens
RTECDQFSQ

SEQ ID NO: 1228534 - protein, 9 aa, Homo Sapiens
PMTLLSTLT

SEQ ID NO: 1228535 - protein, 9 aa, Homo Sapiens
DERLQRHRI

SEQ ID NO: 1228536 - protein, 9 aa, Homo Sapiens
FGEPWELNS

SEQ ID NO: 1228537 - protein, 9 aa, Homo Sapiens
MIVVPKGED

SEQ ID NO: 1228538 - protein, 9 aa, Homo Sapiens
SSRKPRTFS

SEQ ID NO: 1228539 - protein, 9 aa, Homo Sapiens
KPDSARVHY

SEQ ID NO: 1228540 - protein, 9 aa, Homo Sapiens
QVALEVWRS

SEQ ID NO: 1228541 - protein, 9 aa, Homo Sapiens
GPSLGLVAG

SEQ ID NO: 1228542 - protein, 9 aa, Homo Sapiens
AESVVQCEI

SEQ ID NO: 1228543 - protein, 9 aa, Homo Sapiens
SKKIGQWPC

SEQ ID NO: 1228544 - protein, 9 aa, Homo Sapiens
LHHQAKLNL

SEQ ID NO: 1228545 - protein, 9 aa, Homo Sapiens
PSSPVRLLK

SEQ ID NO: 1228546 - protein, 9 aa, Homo Sapiens
VPLRVKIPE

SEQ ID NO: 1228547 - protein, 9 aa, Homo Sapiens
GKFTRVNMG

SEQ ID NO: 1228548 - protein, 9 aa, Homo Sapiens
SSRLKELAT

SEQ ID NO: 1228549 - protein, 9 aa, Homo Sapiens
TGDVCYYAS

SEQ ID NO: 1228550 - protein, 9 aa, Homo Sapiens
CLLVSSRSI

SEQ ID NO: 1228551 - protein, 9 aa, Homo Sapiens
SGIVGYMLL

SEQ ID NO: 1228552 - protein, 9 aa, Homo Sapiens
SNQPNDENI

SEQ ID NO: 1228553 - protein, 9 aa, Homo Sapiens
GRTSHKAAR

SEQ ID NO: 1228554 - protein, 9 aa, Homo Sapiens
HPNDKTNIQ

SEQ ID NO: 1228555 - protein, 9 aa, Homo Sapiens
TGSGDPDSI

SEQ ID NO: 1228556 - protein, 9 aa, Homo Sapiens
IMTQLPQEE

SEQ ID NO: 1228557 - protein, 9 aa, Homo Sapiens
YRTMEKPPK

SEQ ID NO: 1228558 - protein, 9 aa, Homo Sapiens
LAFKMSIFS

SEQ ID NO: 1228559 - protein, 9 aa, Homo Sapiens
QLAEKRILD

SEQ ID NO: 1228560 - protein, 9 aa, Homo Sapiens
DHMDRCFDV

SEQ ID NO: 1228561 - protein, 9 aa, Homo Sapiens
TDCECCLPF

SEQ ID NO: 1228562 - protein, 9 aa, Homo Sapiens
GHGVSAPSV

SEQ ID NO: 1228563 - protein, 9 aa, Homo Sapiens
CDINIIVTQ

SEQ ID NO: 1228564 - protein, 9 aa, Homo Sapiens
CVPMSTNQA

SEQ ID NO: 1228565 - protein, 9 aa, Homo Sapiens
PLSVPCRME

SEQ ID NO: 1228566 - protein, 9 aa, Homo Sapiens
PHSCLQCSE

SEQ ID NO: 1228567 - protein, 9 aa, Homo Sapiens
TLVFLCLYC

SEQ ID NO: 1228568 - protein, 9 aa, Homo Sapiens
HSKGTMITI

SEQ ID NO: 1228569 - protein, 9 aa, Homo Sapiens
EYGAARPVQ

SEQ ID NO: 1228570 - protein, 9 aa, Homo Sapiens
LWHGMFVNV

SEQ ID NO: 1228571 - protein, 9 aa, Homo Sapiens
KLKKSFDTG

SEQ ID NO: 1228572 - protein, 9 aa, Homo Sapiens
GLAHGVVSF

SEQ ID NO: 1228573 - protein, 9 aa, Homo Sapiens
ESQAMCYIE

SEQ ID NO: 1228574 - protein, 9 aa, Homo Sapiens
ALLLQCPEA

SEQ ID NO: 1228575 - protein, 9 aa, Homo Sapiens
KGTCLNDVG

SEQ ID NO: 1228576 - protein, 9 aa, Homo Sapiens
DMQREWRIF

SEQ ID NO: 1228577 - protein, 9 aa, Homo Sapiens
QDEEKIPDP

SEQ ID NO: 1228578 - protein, 9 aa, Homo Sapiens
RRPQPATYQ

SEQ ID NO: 1228579 - protein, 9 aa, Homo Sapiens
SVLGPNAWR

SEQ ID NO: 1228580 - protein, 9 aa, Homo Sapiens
TAQHVSPEL

SEQ ID NO: 1228581 - protein, 9 aa, Homo Sapiens
VNRLTTSVD

SEQ ID NO: 1228582 - protein, 9 aa, Homo Sapiens
RSSVPWSAG

SEQ ID NO: 1228583 - protein, 9 aa, Homo Sapiens
CEMAFQYQP

SEQ ID NO: 1228584 - protein, 9 aa, Homo Sapiens
YTPNSSHWR

SEQ ID NO: 1228585 - protein, 9 aa, Homo Sapiens
GFSDLQGPP

SEQ ID NO: 1228586 - protein, 9 aa, Homo Sapiens
AGPVFLPFL

SEQ ID NO: 1228587 - protein, 9 aa, Homo Sapiens
LYKLEEEKH

SEQ ID NO: 1228588 - protein, 9 aa, Homo Sapiens
IKFIIGKDS

SEQ ID NO: 1228589 - protein, 9 aa, Homo Sapiens
QQKREAEER

SEQ ID NO: 1228590 - protein, 9 aa, Homo Sapiens
VPMGEWTAC

SEQ ID NO: 1228591 - protein, 9 aa, Homo Sapiens
ALAQNMWHT

SEQ ID NO: 1228592 - protein, 9 aa, Homo Sapiens
QAETEVEEP

SEQ ID NO: 1228593 - protein, 9 aa, Homo Sapiens
HDVLRVVHI

SEQ ID NO: 1228594 - protein, 9 aa, Homo Sapiens
FQIPDGSYM

SEQ ID NO: 1228595 - protein, 9 aa, Homo Sapiens
STLPKCNGK

SEQ ID NO: 1228596 - protein, 9 aa, Homo Sapiens
VDTTHLKWF

SEQ ID NO: 1228597 - protein, 9 aa, Homo Sapiens
KLPHKTHRG

SEQ ID NO: 1228598 - protein, 9 aa, Homo Sapiens
GVCILISFS

SEQ ID NO: 1228599 - protein, 9 aa, Homo Sapiens
KQEVQNFIK

SEQ ID NO: 1228600 - protein, 9 aa, Homo Sapiens
ECLMQEYIP

SEQ ID NO: 1228601 - protein, 9 aa, Homo Sapiens
VGGINGHFE

SEQ ID NO: 1228602 - protein, 9 aa, Homo Sapiens
CHHGTTGSG

SEQ ID NO: 1228603 - protein, 9 aa, Homo Sapiens
RMCPWELKQ

SEQ ID NO: 1228604 - protein, 9 aa, Homo Sapiens
SQVLLKREK

SEQ ID NO: 1228605 - protein, 9 aa, Homo Sapiens
LIAMQINSY

SEQ ID NO: 1228606 - protein, 9 aa, Homo Sapiens
IAENIHYGR

SEQ ID NO: 1228607 - protein, 9 aa, Homo Sapiens
LDFCIAAVI

SEQ ID NO: 1228608 - protein, 9 aa, Homo Sapiens
RVEKPVPRP

SEQ ID NO: 1228609 - protein, 9 aa, Homo Sapiens
MNLTKKQCQ

SEQ ID NO: 1228610 - protein, 9 aa, Homo Sapiens
QKTLHKKNF

SEQ ID NO: 1228611 - protein, 9 aa, Homo Sapiens
DISQHFRKV

SEQ ID NO: 1228612 - protein, 9 aa, Homo Sapiens
DTYLARFEA

SEQ ID NO: 1228613 - protein, 9 aa, Homo Sapiens
IFTELERCI

SEQ ID NO: 1228614 - protein, 9 aa, Homo Sapiens
NDRHQVPRA

SEQ ID NO: 1228615 - protein, 9 aa, Homo Sapiens
RIGGKMKIV

SEQ ID NO: 1228616 - protein, 9 aa, Homo Sapiens
AIPVPQIKP

SEQ ID NO: 1228617 - protein, 9 aa, Homo Sapiens
EEEAKLGVV

SEQ ID NO: 1228618 - protein, 9 aa, Homo Sapiens
DMSDTRSSD

SEQ ID NO: 1228619 - protein, 9 aa, Homo Sapiens
EQDQRPIHP

SEQ ID NO: 1228620 - protein, 9 aa, Homo Sapiens
VKSALNRIQ

SEQ ID NO: 1228621 - protein, 9 aa, Homo Sapiens
SHDGSEEDI

SEQ ID NO: 1228622 - protein, 9 aa, Homo Sapiens
LIKLKTPRL

SEQ ID NO: 1228623 - protein, 9 aa, Homo Sapiens
AHALEPPSP

SEQ ID NO: 1228624 - protein, 9 aa, Homo Sapiens
NAARLRKKI

SEQ ID NO: 1228625 - protein, 9 aa, Homo Sapiens
DTSFMREDS

SEQ ID NO: 1228626 - protein, 9 aa, Homo Sapiens
VHAYPEAGS

SEQ ID NO: 1228627 - protein, 9 aa, Homo Sapiens
QRVHTRENP

SEQ ID NO: 1228628 - protein, 9 aa, Homo Sapiens
TSFIKILWN

SEQ ID NO: 1228629 - protein, 9 aa, Homo Sapiens
EGPRKYVLT

SEQ ID NO: 1228630 - protein, 9 aa, Homo Sapiens
GEKIVALMS

SEQ ID NO: 1228631 - protein, 9 aa, Homo Sapiens
LREAQILAF

SEQ ID NO: 1228632 - protein, 9 aa, Homo Sapiens
MNTFRSFGS

SEQ ID NO: 1228633 - protein, 9 aa, Homo Sapiens
ESMRDKVLQ

SEQ ID NO: 1228634 - protein, 9 aa, Homo Sapiens
HPRRERSYV

SEQ ID NO: 1228635 - protein, 9 aa, Homo Sapiens
LKILLDHPK

SEQ ID NO: 1228636 - protein, 9 aa, Homo Sapiens
ASLVRETQV

SEQ ID NO: 1228637 - protein, 9 aa, Homo Sapiens
RTKLYPRYP

SEQ ID NO: 1228638 - protein, 9 aa, Homo Sapiens
FKFAAAIVI

SEQ ID NO: 1228639 - protein, 9 aa, Homo Sapiens
SRCPPKGYV

SEQ ID NO: 1228640 - protein, 9 aa, Homo Sapiens
KTVLERRYS

SEQ ID NO: 1228641 - protein, 9 aa, Homo Sapiens
PSGDVGAPG

SEQ ID NO: 1228642 - protein, 9 aa, Homo Sapiens
KKPKEPRPE

SEQ ID NO: 1228643 - protein, 9 aa, Homo Sapiens
NKYKEDAHL

SEQ ID NO: 1228644 - protein, 9 aa, Homo Sapiens
PSDQLQPQR

SEQ ID NO: 1228645 - protein, 9 aa, Homo Sapiens
LVNKLMEHE

SEQ ID NO: 1228646 - protein, 9 aa, Homo Sapiens
PPAKECTAP

SEQ ID NO: 1228647 - protein, 9 aa, Homo Sapiens
HRFTMGERI

SEQ ID NO: 1228648 - protein, 9 aa, Homo Sapiens
PCLHPHFTH

SEQ ID NO: 1228649 - protein, 9 aa, Homo Sapiens
EELPYNFPK

SEQ ID NO: 1228650 - protein, 9 aa, Homo Sapiens
PPSPATRHG

SEQ ID NO: 1228651 - protein, 9 aa, Homo Sapiens
NPAPLWQGS

SEQ ID NO: 1228652 - protein, 9 aa, Homo Sapiens
TVCHPLIYG

SEQ ID NO: 1228653 - protein, 9 aa, Homo Sapiens
DCPDYMDKK

SEQ ID NO: 1228654 - protein, 9 aa, Homo Sapiens
PALSPAADA

SEQ ID NO: 1228655 - protein, 9 aa, Homo Sapiens
CLATVAPMS

SEQ ID NO: 1228656 - protein, 9 aa, Homo Sapiens
DHSFGRDRN

SEQ ID NO: 1228657 - protein, 9 aa, Homo Sapiens
VAIVICDYD

SEQ ID NO: 1228658 - protein, 9 aa, Homo Sapiens
TVASHLTKD

SEQ ID NO: 1228659 - protein, 9 aa, Homo Sapiens
GYCCLEEYR

SEQ ID NO: 1228660 - protein, 9 aa, Homo Sapiens
TLNDVFLEA

SEQ ID NO: 1228661 - protein, 9 aa, Homo Sapiens
IGVSHRTQP

SEQ ID NO: 1228662 - protein, 9 aa, Homo Sapiens
YSAMDCEDD

SEQ ID NO: 1228663 - protein, 9 aa, Homo Sapiens
TEREECLHG

SEQ ID NO: 1228664 - protein, 9 aa, Homo Sapiens
ITMDPVQKA

SEQ ID NO: 1228665 - protein, 9 aa, Homo Sapiens
ICNLSVFLA

SEQ ID NO: 1228666 - protein, 9 aa, Homo Sapiens
VSLTVLLAS

SEQ ID NO: 1228667 - protein, 9 aa, Homo Sapiens
EITKKYTKG

SEQ ID NO: 1228668 - protein, 9 aa, Homo Sapiens
EQLIPNLTM

SEQ ID NO: 1228669 - protein, 9 aa, Homo Sapiens
WGPISYMRR

SEQ ID NO: 1228670 - protein, 9 aa, Homo Sapiens
FFNSFQEND

SEQ ID NO: 1228671 - protein, 9 aa, Homo Sapiens
ENIGLDQGQ

SEQ ID NO: 1228672 - protein, 9 aa, Homo Sapiens
LSWSPPGPA

SEQ ID NO: 1228673 - protein, 9 aa, Homo Sapiens
PCEDQIVLL

SEQ ID NO: 1228674 - protein, 9 aa, Homo Sapiens
MSFLYILMD

SEQ ID NO: 1228675 - protein, 9 aa, Homo Sapiens
PAAEGGSRN

SEQ ID NO: 1228676 - protein, 9 aa, Homo Sapiens
LMITGSLII

SEQ ID NO: 1228677 - protein, 9 aa, Homo Sapiens
THQTSVYLD

SEQ ID NO: 1228678 - protein, 9 aa, Homo Sapiens
FSLEIFEWF

SEQ ID NO: 1228679 - protein, 9 aa, Homo Sapiens
GILLADLQV

SEQ ID NO: 1228680 - protein, 9 aa, Homo Sapiens
RMAVVMVLA

SEQ ID NO: 1228681 - protein, 9 aa, Homo Sapiens
KLTIDMGDL

SEQ ID NO: 1228682 - protein, 9 aa, Homo Sapiens
FDEYFNDNS

SEQ ID NO: 1228683 - protein, 9 aa, Homo Sapiens
VAAFQGVPH

SEQ ID NO: 1228684 - protein, 9 aa, Homo Sapiens
ANCLGDQTV

SEQ ID NO: 1228685 - protein, 9 aa, Homo Sapiens
PSYKAGDKI

SEQ ID NO: 1228686 - protein, 9 aa, Homo Sapiens
LEDVAIDIQ

SEQ ID NO: 1228687 - protein, 9 aa, Homo Sapiens
GLRSVHVPL

SEQ ID NO: 1228688 - protein, 9 aa, Homo Sapiens
LDKPGEGTY

SEQ ID NO: 1228689 - protein, 9 aa, Homo Sapiens
LLLTRGGPS

SEQ ID NO: 1228690 - protein, 9 aa, Homo Sapiens
QASEATQVV

SEQ ID NO: 1228691 - protein, 9 aa, Homo Sapiens
LNAELVVFK

SEQ ID NO: 1228692 - protein, 9 aa, Homo Sapiens
EDSCMVLEE

SEQ ID NO: 1228693 - protein, 9 aa, Homo Sapiens
ELPCEDQIV

SEQ ID NO: 1228694 - protein, 9 aa, Homo Sapiens
LEKIDDYTV

SEQ ID NO: 1228695 - protein, 9 aa, Homo Sapiens
ISLPQISWV

SEQ ID NO: 1228696 - protein, 9 aa, Homo Sapiens
TFCSAGPIF

SEQ ID NO: 1228697 - protein, 9 aa, Homo Sapiens
GCPMYEGKM

SEQ ID NO: 1228698 - protein, 9 aa, Homo Sapiens
FITHLKFLD

SEQ ID NO: 1228699 - protein, 9 aa, Homo Sapiens
FPLTCTNID

SEQ ID NO: 1228700 - protein, 9 aa, Homo Sapiens
SPYASKSET

SEQ ID NO: 1228701 - protein, 9 aa, Homo Sapiens
RMMDILEIR

SEQ ID NO: 1228702 - protein, 9 aa, Homo Sapiens
TETNSLILE

SEQ ID NO: 1228703 - protein, 9 aa, Homo Sapiens
LHPQLASVT

SEQ ID NO: 1228704 - protein, 9 aa, Homo Sapiens
PSEKSDEDG

SEQ ID NO: 1228705 - protein, 9 aa, Homo Sapiens
FQSGVCFGD

SEQ ID NO: 1228706 - protein, 9 aa, Homo Sapiens
DPQVLILDE

SEQ ID NO: 1228707 - protein, 9 aa, Homo Sapiens
CCRGFRITC

SEQ ID NO: 1228708 - protein, 9 aa, Homo Sapiens
LCCATPAHA

SEQ ID NO: 1228709 - protein, 9 aa, Homo Sapiens
DESEKKNPG

SEQ ID NO: 1228710 - protein, 9 aa, Homo Sapiens
DKLTLVTRV

SEQ ID NO: 1228711 - protein, 9 aa, Homo Sapiens
FRSMIPSYI

SEQ ID NO: 1228712 - protein, 9 aa, Homo Sapiens
FATSAPPQG

SEQ ID NO: 1228713 - protein, 9 aa, Homo Sapiens
AGEALGISS

SEQ ID NO: 1228714 - protein, 9 aa, Homo Sapiens
VWEATVLEK

SEQ ID NO: 1228715 - protein, 9 aa, Homo Sapiens
SSMPIFFEL

SEQ ID NO: 1228716 - protein, 9 aa, Homo Sapiens
GTLAGYFNL

SEQ ID NO: 1228717 - protein, 9 aa, Homo Sapiens
DLDWHVRHY

SEQ ID NO: 1228718 - protein, 9 aa, Homo Sapiens
RWISRSAEP

SEQ ID NO: 1228719 - protein, 9 aa, Homo Sapiens
PFFLAELIY

SEQ ID NO: 1228720 - protein, 9 aa, Homo Sapiens
ITCMFKQTA

SEQ ID NO: 1228721 - protein, 9 aa, Homo Sapiens
TNIHKLRVT

SEQ ID NO: 1228722 - protein, 9 aa, Homo Sapiens
YCTFYDECG

SEQ ID NO: 1228723 - protein, 9 aa, Homo Sapiens
QFQVEHFSQ

SEQ ID NO: 1228724 - protein, 9 aa, Homo Sapiens
TGSNIEVWS

SEQ ID NO: 1228725 - protein, 9 aa, Homo Sapiens
ENTKHFPKG

SEQ ID NO: 1228726 - protein, 9 aa, Homo Sapiens
FVNKMAATK

SEQ ID NO: 1228727 - protein, 9 aa, Homo Sapiens
ERRDRRPGP

SEQ ID NO: 1228728 - protein, 9 aa, Homo Sapiens
ICVLMLLYS

SEQ ID NO: 1228729 - protein, 9 aa, Homo Sapiens
SCVNLAKNA

SEQ ID NO: 1228730 - protein, 9 aa, Homo Sapiens
ECKHHLKHG

SEQ ID NO: 1228731 - protein, 9 aa, Homo Sapiens
LETASRAEG

SEQ ID NO: 1228732 - protein, 9 aa, Homo Sapiens
CDGKKIVSY

SEQ ID NO: 1228733 - protein, 9 aa, Homo Sapiens
QLCLSEVDN

SEQ ID NO: 1228734 - protein, 9 aa, Homo Sapiens
GISEQTVVT

SEQ ID NO: 1228735 - protein, 9 aa, Homo Sapiens
HTCWEYCAI

SEQ ID NO: 1228736 - protein, 9 aa, Homo Sapiens
DQGQLMGAG

SEQ ID NO: 1228737 - protein, 9 aa, Homo Sapiens
SNMVFETGQ

SEQ ID NO: 1228738 - protein, 9 aa, Homo Sapiens
RGEHPNPPS

SEQ ID NO: 1228739 - protein, 9 aa, Homo Sapiens
HRVRPPGCH

SEQ ID NO: 1228740 - protein, 9 aa, Homo Sapiens
HGALQKEDR

SEQ ID NO: 1228741 - protein, 9 aa, Homo Sapiens
CLLAMLLDG

SEQ ID NO: 1228742 - protein, 9 aa, Homo Sapiens
TCKDSATEL

SEQ ID NO: 1228743 - protein, 9 aa, Homo Sapiens
VIIHCRGGK

SEQ ID NO: 1228744 - protein, 9 aa, Homo Sapiens
KHAWTHRLH

SEQ ID NO: 1228745 - protein, 9 aa, Homo Sapiens
VVWDSKKHT

SEQ ID NO: 1228746 - protein, 9 aa, Homo Sapiens
FHMSYSMAI

SEQ ID NO: 1228747 - protein, 9 aa, Homo Sapiens
PGIQAVHKA

SEQ ID NO: 1228748 - protein, 9 aa, Homo Sapiens
GEGTHDEEE

SEQ ID NO: 1228749 - protein, 9 aa, Homo Sapiens
SALSLEEIS

SEQ ID NO: 1228750 - protein, 9 aa, Homo Sapiens
LWDVQSTQD

SEQ ID NO: 1228751 - protein, 9 aa, Homo Sapiens
NENIPIISE

SEQ ID NO: 1228752 - protein, 9 aa, Homo Sapiens
AWRVWRFAP

SEQ ID NO: 1228753 - protein, 9 aa, Homo Sapiens
GEINFSVID

SEQ ID NO: 1228754 - protein, 9 aa, Homo Sapiens
EEDIVVLAE

SEQ ID NO: 1228755 - protein, 9 aa, Homo Sapiens
GLLFFYHAR

SEQ ID NO: 1228756 - protein, 9 aa, Homo Sapiens
LHSPGVHPE

SEQ ID NO: 1228757 - protein, 9 aa, Homo Sapiens
VSRAIGNAE

SEQ ID NO: 1228758 - protein, 9 aa, Homo Sapiens
PPGPPASQG

SEQ ID NO: 1228759 - protein, 9 aa, Homo Sapiens
YPGSNVRSN

SEQ ID NO: 1228760 - protein, 9 aa, Homo Sapiens
PQVSGSPFS

SEQ ID NO: 1228761 - protein, 9 aa, Homo Sapiens
PDLTESEKR

SEQ ID NO: 1228762 - protein, 9 aa, Homo Sapiens
CSSSPTPSS

SEQ ID NO: 1228763 - protein, 9 aa, Homo Sapiens
ERSECRKTF

SEQ ID NO: 1228764 - protein, 9 aa, Homo Sapiens
LIQEAASIQ

SEQ ID NO: 1228765 - protein, 9 aa, Homo Sapiens
FQEEVLAKY

SEQ ID NO: 1228766 - protein, 9 aa, Homo Sapiens
AMNAFKTDT

SEQ ID NO: 1228767 - protein, 9 aa, Homo Sapiens
YETHHRVTL

SEQ ID NO: 1228768 - protein, 9 aa, Homo Sapiens
EYRKKEGEN

SEQ ID NO: 1228769 - protein, 9 aa, Homo Sapiens
LAHLHREVP

SEQ ID NO: 1228770 - protein, 9 aa, Homo Sapiens
YKNLVSEGM

SEQ ID NO: 1228771 - protein, 9 aa, Homo Sapiens
QKELPDLEY

SEQ ID NO: 1228772 - protein, 9 aa, Homo Sapiens
TTIKLNAEN

SEQ ID NO: 1228773 - protein, 9 aa, Homo Sapiens
PLIACVEKH

SEQ ID NO: 1228774 - protein, 9 aa, Homo Sapiens
HYGRENVTM

SEQ ID NO: 1228775 - protein, 9 aa, Homo Sapiens
SHSFSKERT

SEQ ID NO: 1228776 - protein, 9 aa, Homo Sapiens
QCFGFWASY

SEQ ID NO: 1228777 - protein, 9 aa, Homo Sapiens
AVQHIRPVR

SEQ ID NO: 1228778 - protein, 9 aa, Homo Sapiens
PSQESGSQE

SEQ ID NO: 1228779 - protein, 9 aa, Homo Sapiens
TMSYHSDSD

SEQ ID NO: 1228780 - protein, 9 aa, Homo Sapiens
DEQWQPLTV

SEQ ID NO: 1228781 - protein, 9 aa, Homo Sapiens
NDHGVFLNV

SEQ ID NO: 1228782 - protein, 9 aa, Homo Sapiens
TTSSMDPGG

SEQ ID NO: 1228783 - protein, 9 aa, Homo Sapiens
KVVVSGNYL

SEQ ID NO: 1228784 - protein, 9 aa, Homo Sapiens
CLHGLEMER

SEQ ID NO: 1228785 - protein, 9 aa, Homo Sapiens
NERGRDQCP

SEQ ID NO: 1228786 - protein, 9 aa, Homo Sapiens
LIGSLTADY

SEQ ID NO: 1228787 - protein, 9 aa, Homo Sapiens
SHHGHPGSH

SEQ ID NO: 1228788 - protein, 9 aa, Homo Sapiens
NNGGKWLVS

SEQ ID NO: 1228789 - protein, 9 aa, Homo Sapiens
WHTKKLPHK

SEQ ID NO: 1228790 - protein, 9 aa, Homo Sapiens
LADGPGAEG

SEQ ID NO: 1228791 - protein, 9 aa, Homo Sapiens
ENKFQPKRL

SEQ ID NO: 1228792 - protein, 9 aa, Homo Sapiens
LHIMIQYLL

SEQ ID NO: 1228793 - protein, 9 aa, Homo Sapiens
HCHLVHLFY

SEQ ID NO: 1228794 - protein, 9 aa, Homo Sapiens
VFQEDSVTL

SEQ ID NO: 1228795 - protein, 9 aa, Homo Sapiens
TTTCSRTAP

SEQ ID NO: 1228796 - protein, 9 aa, Homo Sapiens
SHSDVGLLE

SEQ ID NO: 1228797 - protein, 9 aa, Homo Sapiens
SEGASQSRP

SEQ ID NO: 1228798 - protein, 9 aa, Homo Sapiens
GLHCRTYYV

SEQ ID NO: 1228799 - protein, 9 aa, Homo Sapiens
AGLWHGMFV

SEQ ID NO: 1228800 - protein, 9 aa, Homo Sapiens
KEDKPCIII

SEQ ID NO: 1228801 - protein, 9 aa, Homo Sapiens
KQPKCYRPA

SEQ ID NO: 1228802 - protein, 9 aa, Homo Sapiens
IHKMHHKRR

SEQ ID NO: 1228803 - protein, 9 aa, Homo Sapiens
SAASITIDQ

SEQ ID NO: 1228804 - protein, 9 aa, Homo Sapiens
NLKLRKFVF

SEQ ID NO: 1228805 - protein, 9 aa, Homo Sapiens
YNGMIRQKV

SEQ ID NO: 1228806 - protein, 9 aa, Homo Sapiens
ISTQNPDLE

SEQ ID NO: 1228807 - protein, 9 aa, Homo Sapiens
VVKTCIQSQ

SEQ ID NO: 1228808 - protein, 9 aa, Homo Sapiens
IDQDDRDLY

SEQ ID NO: 1228809 - protein, 9 aa, Homo Sapiens
IEPCRELLT

SEQ ID NO: 1228810 - protein, 9 aa, Homo Sapiens
LVCCLIFLT

SEQ ID NO: 1228811 - protein, 9 aa, Homo Sapiens
HVPKSGVKL

SEQ ID NO: 1228812 - protein, 9 aa, Homo Sapiens
RDGPQGDIE

SEQ ID NO: 1228813 - protein, 9 aa, Homo Sapiens
AVNRRLHAL

SEQ ID NO: 1228814 - protein, 9 aa, Homo Sapiens
TVCCYLLCP

SEQ ID NO: 1228815 - protein, 9 aa, Homo Sapiens
VGAPGGPGH

SEQ ID NO: 1228816 - protein, 9 aa, Homo Sapiens
TLLDFGATR

SEQ ID NO: 1228817 - protein, 9 aa, Homo Sapiens
AQQPYKSLV

SEQ ID NO: 1228818 - protein, 9 aa, Homo Sapiens
EVLIRYQSF

SEQ ID NO: 1228819 - protein, 9 aa, Homo Sapiens
VGEETQKWD

SEQ ID NO: 1228820 - protein, 9 aa, Homo Sapiens
RSKKALANV

SEQ ID NO: 1228821 - protein, 9 aa, Homo Sapiens
MSSVSRQTY

SEQ ID NO: 1228822 - protein, 9 aa, Homo Sapiens
EDFITHLKF

SEQ ID NO: 1228823 - protein, 9 aa, Homo Sapiens
ECLGTHTVV

SEQ ID NO: 1228824 - protein, 9 aa, Homo Sapiens
ASHSDVGLL

SEQ ID NO: 1228825 - protein, 9 aa, Homo Sapiens
EEEEDSCMV

SEQ ID NO: 1228826 - protein, 9 aa, Homo Sapiens
TLPVMSGDA

SEQ ID NO: 1228827 - protein, 9 aa, Homo Sapiens
QPVAFVVTQ

SEQ ID NO: 1228828 - protein, 9 aa, Homo Sapiens
NDTFTPSEQ

SEQ ID NO: 1228829 - protein, 9 aa, Homo Sapiens
CSLDNREWE

SEQ ID NO: 1228830 - protein, 9 aa, Homo Sapiens
DMIVTTHFA

SEQ ID NO: 1228831 - protein, 9 aa, Homo Sapiens
GHEVKGLQS

SEQ ID NO: 1228832 - protein, 9 aa, Homo Sapiens
LLCWSVPGS

SEQ ID NO: 1228833 - protein, 9 aa, Homo Sapiens
IQISRLPLE

SEQ ID NO: 1228834 - protein, 9 aa, Homo Sapiens
ILWGHRFEL

SEQ ID NO: 1228835 - protein, 9 aa, Homo Sapiens
PPLSPPNEE

SEQ ID NO: 1228836 - protein, 9 aa, Homo Sapiens
SKSAGTMLK

SEQ ID NO: 1228837 - protein, 9 aa, Homo Sapiens
IYKSMLEKS

SEQ ID NO: 1228838 - protein, 9 aa, Homo Sapiens
DLLPPRVHA

SEQ ID NO: 1228839 - protein, 9 aa, Homo Sapiens
ETCINICRV

SEQ ID NO: 1228840 - protein, 9 aa, Homo Sapiens
PPHLVPNQH

SEQ ID NO: 1228841 - protein, 9 aa, Homo Sapiens
RAIALLQQP

SEQ ID NO: 1228842 - protein, 9 aa, Homo Sapiens
DTLGDGMME

SEQ ID NO: 1228843 - protein, 9 aa, Homo Sapiens
VRSCRKKST

SEQ ID NO: 1228844 - protein, 9 aa, Homo Sapiens
NTQGCQVTG

SEQ ID NO: 1228845 - protein, 9 aa, Homo Sapiens
TCLDGAKLH

SEQ ID NO: 1228846 - protein, 9 aa, Homo Sapiens
DKRTYEEGL

SEQ ID NO: 1228847 - protein, 9 aa, Homo Sapiens
SWSSINPKF

SEQ ID NO: 1228848 - protein, 9 aa, Homo Sapiens
YSKATRMTK

SEQ ID NO: 1228849 - protein, 9 aa, Homo Sapiens
DIERMSSGL

SEQ ID NO: 1228850 - protein, 9 aa, Homo Sapiens
TTLSINTVK

SEQ ID NO: 1228851 - protein, 9 aa, Homo Sapiens
LPSYKAGDK

SEQ ID NO: 1228852 - protein, 9 aa, Homo Sapiens
MSLGEQDQM

SEQ ID NO: 1228853 - protein, 9 aa, Homo Sapiens
WNVLKKKKE

SEQ ID NO: 1228854 - protein, 9 aa, Homo Sapiens
ERDPSNHQS

SEQ ID NO: 1228855 - protein, 9 aa, Homo Sapiens
HVPTRFLFI

SEQ ID NO: 1228856 - protein, 9 aa, Homo Sapiens
FIRSSSLIH

SEQ ID NO: 1228857 - protein, 9 aa, Homo Sapiens
SGSPFSYPA

SEQ ID NO: 1228858 - protein, 9 aa, Homo Sapiens
NNLSKLQLG

SEQ ID NO: 1228859 - protein, 9 aa, Homo Sapiens
LLVEVHLLE

SEQ ID NO: 1228860 - protein, 9 aa, Homo Sapiens
GIPVTEDFY

SEQ ID NO: 1228861 - protein, 9 aa, Homo Sapiens
RSEALLLQC

SEQ ID NO: 1228862 - protein, 9 aa, Homo Sapiens
SIILVPQAI

SEQ ID NO: 1228863 - protein, 9 aa, Homo Sapiens
HPSSPGWTP

SEQ ID NO: 1228864 - protein, 9 aa, Homo Sapiens
PSVFLLMIN

SEQ ID NO: 1228865 - protein, 9 aa, Homo Sapiens
KKKLKLAPL

SEQ ID NO: 1228866 - protein, 9 aa, Homo Sapiens
RADILKALV

SEQ ID NO: 1228867 - protein, 9 aa, Homo Sapiens
LAHLYDMLH

SEQ ID NO: 1228868 - protein, 9 aa, Homo Sapiens
PSIKQTCFS

SEQ ID NO: 1228869 - protein, 9 aa, Homo Sapiens
VDIVSWKRP

SEQ ID NO: 1228870 - protein, 9 aa, Homo Sapiens
TESGDANDA

SEQ ID NO: 1228871 - protein, 9 aa, Homo Sapiens
QGDMPTATA

SEQ ID NO: 1228872 - protein, 9 aa, Homo Sapiens
SEALQTIHL

SEQ ID NO: 1228873 - protein, 9 aa, Homo Sapiens
EQHQGPVHL

SEQ ID NO: 1228874 - protein, 9 aa, Homo Sapiens
DDLFVIAKD

SEQ ID NO: 1228875 - protein, 9 aa, Homo Sapiens
KDAQMRAVI

SEQ ID NO: 1228876 - protein, 9 aa, Homo Sapiens
YARESADQE

SEQ ID NO: 1228877 - protein, 9 aa, Homo Sapiens
RGAGVLAGE

SEQ ID NO: 1228878 - protein, 9 aa, Homo Sapiens
NDFIYHDQV

SEQ ID NO: 1228879 - protein, 9 aa, Homo Sapiens
AGGGSALPN

SEQ ID NO: 1228880 - protein, 9 aa, Homo Sapiens
WSLTELIQA

SEQ ID NO: 1228881 - protein, 9 aa, Homo Sapiens
ERPYLADQD

SEQ ID NO: 1228882 - protein, 9 aa, Homo Sapiens
LRHRAPPRK

SEQ ID NO: 1228883 - protein, 9 aa, Homo Sapiens
EMLIYFFVE

SEQ ID NO: 1228884 - protein, 9 aa, Homo Sapiens
SSEMTLYQK

SEQ ID NO: 1228885 - protein, 9 aa, Homo Sapiens
GPKLPCSSL

SEQ ID NO: 1228886 - protein, 9 aa, Homo Sapiens
QEKLQLVEW

SEQ ID NO: 1228887 - protein, 9 aa, Homo Sapiens
GLMFASVYI

SEQ ID NO: 1228888 - protein, 9 aa, Homo Sapiens
AELTYTYST

SEQ ID NO: 1228889 - protein, 9 aa, Homo Sapiens
VVARYFPVG

SEQ ID NO: 1228890 - protein, 9 aa, Homo Sapiens
YIKSCAGYC

SEQ ID NO: 1228891 - protein, 9 aa, Homo Sapiens
LHRKWEEKI

SEQ ID NO: 1228892 - protein, 9 aa, Homo Sapiens
FLHQGQLEN

SEQ ID NO: 1228893 - protein, 9 aa, Homo Sapiens
TKIRPVMIL

SEQ ID NO: 1228894 - protein, 9 aa, Homo Sapiens
TAAVEERQR

SEQ ID NO: 1228895 - protein, 9 aa, Homo Sapiens
SPCAACVDR

SEQ ID NO: 1228896 - protein, 9 aa, Homo Sapiens
AFLIPYVIT

SEQ ID NO: 1228897 - protein, 9 aa, Homo Sapiens
IAAPQSFIF

SEQ ID NO: 1228898 - protein, 9 aa, Homo Sapiens
AIASIQSVA

SEQ ID NO: 1228899 - protein, 9 aa, Homo Sapiens
LTKHLLGSS

SEQ ID NO: 1228900 - protein, 9 aa, Homo Sapiens
FFINMSAAD

SEQ ID NO: 1228901 - protein, 9 aa, Homo Sapiens
QLAKSVRDH

SEQ ID NO: 1228902 - protein, 9 aa, Homo Sapiens
KSPKGRVVS

SEQ ID NO: 1228903 - protein, 9 aa, Homo Sapiens
NNLLDQALQ

SEQ ID NO: 1228904 - protein, 9 aa, Homo Sapiens
DFIYHDQVP

SEQ ID NO: 1228905 - protein, 9 aa, Homo Sapiens
PPYQQPLQS

SEQ ID NO: 1228906 - protein, 9 aa, Homo Sapiens
SEAPDPTQN

SEQ ID NO: 1228907 - protein, 9 aa, Homo Sapiens
ETFVFNLMP

SEQ ID NO: 1228908 - protein, 9 aa, Homo Sapiens
LNGSLRKEH

SEQ ID NO: 1228909 - protein, 9 aa, Homo Sapiens
PLVLVGTHD

SEQ ID NO: 1228910 - protein, 9 aa, Homo Sapiens
IYQGHLSMH

SEQ ID NO: 1228911 - protein, 9 aa, Homo Sapiens
PQMSKALFR

SEQ ID NO: 1228912 - protein, 9 aa, Homo Sapiens
QDANDLYDA

SEQ ID NO: 1228913 - protein, 9 aa, Homo Sapiens
FLSMCYCIY

SEQ ID NO: 1228914 - protein, 9 aa, Homo Sapiens
SGHQKNTTV

SEQ ID NO: 1228915 - protein, 9 aa, Homo Sapiens
FLDVLAWMG

SEQ ID NO: 1228916 - protein, 9 aa, Homo Sapiens
CPHVFAKPL

SEQ ID NO: 1228917 - protein, 9 aa, Homo Sapiens
TLDIQAAQS

SEQ ID NO: 1228918 - protein, 9 aa, Homo Sapiens
RRVEHILKM

SEQ ID NO: 1228919 - protein, 9 aa, Homo Sapiens
NIAGLLSIL

SEQ ID NO: 1228920 - protein, 9 aa, Homo Sapiens
DENDNAPTL

SEQ ID NO: 1228921 - protein, 9 aa, Homo Sapiens
AAAWPGWFM

SEQ ID NO: 1228922 - protein, 9 aa, Homo Sapiens
KDMTKNMGG

SEQ ID NO: 1228923 - protein, 9 aa, Homo Sapiens
KLNSLMSQL

SEQ ID NO: 1228924 - protein, 9 aa, Homo Sapiens
EFPFQCDPS

SEQ ID NO: 1228925 - protein, 9 aa, Homo Sapiens
WHSILIELL

SEQ ID NO: 1228926 - protein, 9 aa, Homo Sapiens
LRLIRPEYV

SEQ ID NO: 1228927 - protein, 9 aa, Homo Sapiens
ILHVPNVVV

SEQ ID NO: 1228928 - protein, 9 aa, Homo Sapiens
GLRHLQEGD

SEQ ID NO: 1228929 - protein, 9 aa, Homo Sapiens
EEQRPRSAN

SEQ ID NO: 1228930 - protein, 9 aa, Homo Sapiens
MSRQENDAE

SEQ ID NO: 1228931 - protein, 9 aa, Homo Sapiens
VVKKLEEFQ

SEQ ID NO: 1228932 - protein, 9 aa, Homo Sapiens
HCVWCHLET

SEQ ID NO: 1228933 - protein, 9 aa, Homo Sapiens
NSFLTDANQ

SEQ ID NO: 1228934 - protein, 9 aa, Homo Sapiens
GHLVSAISQ

SEQ ID NO: 1228935 - protein, 9 aa, Homo Sapiens
STKPSFSDM

SEQ ID NO: 1228936 - protein, 9 aa, Homo Sapiens
VFSSRGQSE

SEQ ID NO: 1228937 - protein, 9 aa, Homo Sapiens
TKQEGLSHI

SEQ ID NO: 1228938 - protein, 9 aa, Homo Sapiens
YSQINISKV

SEQ ID NO: 1228939 - protein, 9 aa, Homo Sapiens
GAAGASVAA

SEQ ID NO: 1228940 - protein, 9 aa, Homo Sapiens
SERGCKKIK

SEQ ID NO: 1228941 - protein, 9 aa, Homo Sapiens
MSDDGVSGD

SEQ ID NO: 1228942 - protein, 9 aa, Homo Sapiens
MDAQPWSEP

SEQ ID NO: 1228943 - protein, 9 aa, Homo Sapiens
LGTGVVHAA

SEQ ID NO: 1228944 - protein, 9 aa, Homo Sapiens
LSRTHSPLQ

SEQ ID NO: 1228945 - protein, 9 aa, Homo Sapiens
LSGHPRIEL

SEQ ID NO: 1228946 - protein, 9 aa, Homo Sapiens
RKAIDTATQ

SEQ ID NO: 1228947 - protein, 9 aa, Homo Sapiens
ASDYKVASD

SEQ ID NO: 1228948 - protein, 9 aa, Homo Sapiens
PQVIEFRTN

SEQ ID NO: 1228949 - protein, 9 aa, Homo Sapiens
MRAVINQKL

SEQ ID NO: 1228950 - protein, 9 aa, Homo Sapiens
PTGGAVLHS

SEQ ID NO: 1228951 - protein, 9 aa, Homo Sapiens
VPFGHPLDI

SEQ ID NO: 1228952 - protein, 9 aa, Homo Sapiens
SNYCGIGIN

SEQ ID NO: 1228953 - protein, 9 aa, Homo Sapiens
GQTKKLIGI

SEQ ID NO: 1228954 - protein, 9 aa, Homo Sapiens
TQSRTASPG

SEQ ID NO: 1228955 - protein, 9 aa, Homo Sapiens
EQLENAITY

SEQ ID NO: 1228956 - protein, 9 aa, Homo Sapiens
TTHNYFGLM

SEQ ID NO: 1228957 - protein, 9 aa, Homo Sapiens
VLRRPPRLR

SEQ ID NO: 1228958 - protein, 9 aa, Homo Sapiens
DHMVPGRPA

SEQ ID NO: 1228959 - protein, 9 aa, Homo Sapiens
LPGWGQWHL

SEQ ID NO: 1228960 - protein, 9 aa, Homo Sapiens
PFVHIANMC

SEQ ID NO: 1228961 - protein, 9 aa, Homo Sapiens
DRLLKQDCL

SEQ ID NO: 1228962 - protein, 9 aa, Homo Sapiens
SQGITLIWT

SEQ ID NO: 1228963 - protein, 9 aa, Homo Sapiens
AFAAVNMWR

SEQ ID NO: 1228964 - protein, 9 aa, Homo Sapiens
CYMTSYSGN

SEQ ID NO: 1228965 - protein, 9 aa, Homo Sapiens
VAGSVGGNA

SEQ ID NO: 1228966 - protein, 9 aa, Homo Sapiens
DGTVFDGHP

SEQ ID NO: 1228967 - protein, 9 aa, Homo Sapiens
RHRKIKRDI

SEQ ID NO: 1228968 - protein, 9 aa, Homo Sapiens
TSFRWWRRR

SEQ ID NO: 1228969 - protein, 9 aa, Homo Sapiens
GQSLADIEN

SEQ ID NO: 1228970 - protein, 9 aa, Homo Sapiens
KKQCQTLRK

SEQ ID NO: 1228971 - protein, 9 aa, Homo Sapiens
APQIGVINV

SEQ ID NO: 1228972 - protein, 9 aa, Homo Sapiens
EVSLQNCIL

SEQ ID NO: 1228973 - protein, 9 aa, Homo Sapiens
VARLPYCRK

SEQ ID NO: 1228974 - protein, 9 aa, Homo Sapiens
YHRCHVDPA

SEQ ID NO: 1228975 - protein, 9 aa, Homo Sapiens
FSAKMDHPV

SEQ ID NO: 1228976 - protein, 9 aa, Homo Sapiens
VMCLLLLLA

SEQ ID NO: 1228977 - protein, 9 aa, Homo Sapiens
LDRYHHHFP

SEQ ID NO: 1228978 - protein, 9 aa, Homo Sapiens
VLTMNRTNI

SEQ ID NO: 1228979 - protein, 9 aa, Homo Sapiens
EDHIKPTVI

SEQ ID NO: 1228980 - protein, 9 aa, Homo Sapiens
FYWTGRGKS

SEQ ID NO: 1228981 - protein, 9 aa, Homo Sapiens
EARMLCQLL

SEQ ID NO: 1228982 - protein, 9 aa, Homo Sapiens
KKLYVEEVV

SEQ ID NO: 1228983 - protein, 9 aa, Homo Sapiens
TLFGNDINN

SEQ ID NO: 1228984 - protein, 9 aa, Homo Sapiens
RKQFANVQP

SEQ ID NO: 1228985 - protein, 9 aa, Homo Sapiens
SLGLTWPVV

SEQ ID NO: 1228986 - protein, 9 aa, Homo Sapiens
REISKEGNH

SEQ ID NO: 1228987 - protein, 9 aa, Homo Sapiens
QEVLIRYQS

SEQ ID NO: 1228988 - protein, 9 aa, Homo Sapiens
SKMYSQGMA

SEQ ID NO: 1228989 - protein, 9 aa, Homo Sapiens
NDKNCYSER

SEQ ID NO: 1228990 - protein, 9 aa, Homo Sapiens
TCFVDVVAE

SEQ ID NO: 1228991 - protein, 9 aa, Homo Sapiens
TRLEPLLPR

SEQ ID NO: 1228992 - protein, 9 aa, Homo Sapiens
MHCQEKEIE

SEQ ID NO: 1228993 - protein, 9 aa, Homo Sapiens
EEKQRQRLE

SEQ ID NO: 1228994 - protein, 9 aa, Homo Sapiens
VCGCHLGVF

SEQ ID NO: 1228995 - protein, 9 aa, Homo Sapiens
DSLDNVEVV

SEQ ID NO: 1228996 - protein, 9 aa, Homo Sapiens
RVARSLGER

SEQ ID NO: 1228997 - protein, 9 aa, Homo Sapiens
LMGYGIVCD

SEQ ID NO: 1228998 - protein, 9 aa, Homo Sapiens
FFAERKTNK

SEQ ID NO: 1228999 - protein, 9 aa, Homo Sapiens
SVPVAQMSN

SEQ ID NO: 1229000 - protein, 9 aa, Homo Sapiens
PIEYASNKL

SEQ ID NO: 1229001 - protein, 9 aa, Homo Sapiens
NVVIYYTSF

SEQ ID NO: 1229002 - protein, 9 aa, Homo Sapiens
EPLKNAVVR

SEQ ID NO: 1229003 - protein, 9 aa, Homo Sapiens
TFIKCAYVK

SEQ ID NO: 1229004 - protein, 9 aa, Homo Sapiens
PVNKRRRNR

SEQ ID NO: 1229005 - protein, 9 aa, Homo Sapiens
QNWTSLYIH

SEQ ID NO: 1229006 - protein, 9 aa, Homo Sapiens
YWAGLPPIS

SEQ ID NO: 1229007 - protein, 9 aa, Homo Sapiens
CTSPQLGTI

SEQ ID NO: 1229008 - protein, 9 aa, Homo Sapiens
RWVSRATPA

SEQ ID NO: 1229009 - protein, 9 aa, Homo Sapiens
LIPTCRDVG

SEQ ID NO: 1229010 - protein, 9 aa, Homo Sapiens
TQKTQTQLL

SEQ ID NO: 1229011 - protein, 9 aa, Homo Sapiens
RTHPKTGKW

SEQ ID NO: 1229012 - protein, 9 aa, Homo Sapiens
DMPQNRLLI

SEQ ID NO: 1229013 - protein, 9 aa, Homo Sapiens
LSGAGKTMI

SEQ ID NO: 1229014 - protein, 9 aa, Homo Sapiens
IFFSKDQFP

SEQ ID NO: 1229015 - protein, 9 aa, Homo Sapiens
NTLLELMSL

SEQ ID NO: 1229016 - protein, 9 aa, Homo Sapiens
RRNENPDES

SEQ ID NO: 1229017 - protein, 9 aa, Homo Sapiens
LMALLEAVL

SEQ ID NO: 1229018 - protein, 9 aa, Homo Sapiens
TRNQHVSVS

SEQ ID NO: 1229019 - protein, 9 aa, Homo Sapiens
VGPRLPGAD

SEQ ID NO: 1229020 - protein, 9 aa, Homo Sapiens
PVLLLKEDV

SEQ ID NO: 1229021 - protein, 9 aa, Homo Sapiens
KNEKHLHAS

SEQ ID NO: 1229022 - protein, 9 aa, Homo Sapiens
VKACLLPDK

SEQ ID NO: 1229023 - protein, 9 aa, Homo Sapiens
NKNCPVNKR

SEQ ID NO: 1229024 - protein, 9 aa, Homo Sapiens
CCLDEVANH

SEQ ID NO: 1229025 - protein, 9 aa, Homo Sapiens
PTTTMNNTH

SEQ ID NO: 1229026 - protein, 9 aa, Homo Sapiens
SSTYNNRGN

SEQ ID NO: 1229027 - protein, 9 aa, Homo Sapiens
AGAGRIWPD

SEQ ID NO: 1229028 - protein, 9 aa, Homo Sapiens
PISKQATKG

SEQ ID NO: 1229029 - protein, 9 aa, Homo Sapiens
ESLTLWLLD

SEQ ID NO: 1229030 - protein, 9 aa, Homo Sapiens
TKRKCGYIK

SEQ ID NO: 1229031 - protein, 9 aa, Homo Sapiens
VILMYIFQN

SEQ ID NO: 1229032 - protein, 9 aa, Homo Sapiens
TSRWSSHAM

SEQ ID NO: 1229033 - protein, 9 aa, Homo Sapiens
ATSGYGAPS

SEQ ID NO: 1229034 - protein, 9 aa, Homo Sapiens
IRLLSSVSS

SEQ ID NO: 1229035 - protein, 9 aa, Homo Sapiens
TILHMDTIY

SEQ ID NO: 1229036 - protein, 9 aa, Homo Sapiens
DGTAIAKCL

SEQ ID NO: 1229037 - protein, 9 aa, Homo Sapiens
YIYSGGKKI

SEQ ID NO: 1229038 - protein, 9 aa, Homo Sapiens
VGCIWWFFT

SEQ ID NO: 1229039 - protein, 9 aa, Homo Sapiens
RWGCVSAPG

SEQ ID NO: 1229040 - protein, 9 aa, Homo Sapiens
PTIENNFTK

SEQ ID NO: 1229041 - protein, 9 aa, Homo Sapiens
KVFTYKAFN

SEQ ID NO: 1229042 - protein, 9 aa, Homo Sapiens
HPKALKGPS

SEQ ID NO: 1229043 - protein, 9 aa, Homo Sapiens
QVLRVSDPS

SEQ ID NO: 1229044 - protein, 9 aa, Homo Sapiens
VFEWYITKG

SEQ ID NO: 1229045 - protein, 9 aa, Homo Sapiens
GERPFTCAG

SEQ ID NO: 1229046 - protein, 9 aa, Homo Sapiens
YWRFVLQRL

SEQ ID NO: 1229047 - protein, 9 aa, Homo Sapiens
EVYNWVKAR

SEQ ID NO: 1229048 - protein, 9 aa, Homo Sapiens
IIYVRNLMI

SEQ ID NO: 1229049 - protein, 9 aa, Homo Sapiens
DLTKSLQKT

SEQ ID NO: 1229050 - protein, 9 aa, Homo Sapiens
CSGQKPLIC

SEQ ID NO: 1229051 - protein, 9 aa, Homo Sapiens
ISLIKSHND

SEQ ID NO: 1229052 - protein, 9 aa, Homo Sapiens
DRKDQFVIQ

SEQ ID NO: 1229053 - protein, 9 aa, Homo Sapiens
SSEDEQGDI

SEQ ID NO: 1229054 - protein, 9 aa, Homo Sapiens
VEVKKVMTC

SEQ ID NO: 1229055 - protein, 9 aa, Homo Sapiens
SPMHHWRNS

SEQ ID NO: 1229056 - protein, 9 aa, Homo Sapiens
TEMAHQIYV

SEQ ID NO: 1229057 - protein, 9 aa, Homo Sapiens
HTGEWPFRC

SEQ ID NO: 1229058 - protein, 9 aa, Homo Sapiens
RKEEETDVA

SEQ ID NO: 1229059 - protein, 9 aa, Homo Sapiens
RKLRRKRRR

SEQ ID NO: 1229060 - protein, 9 aa, Homo Sapiens
HHGSRGAAD

SEQ ID NO: 1229061 - protein, 9 aa, Homo Sapiens
EMTLYQKKH

SEQ ID NO: 1229062 - protein, 9 aa, Homo Sapiens
LSIHDVPST

SEQ ID NO: 1229063 - protein, 9 aa, Homo Sapiens
ALQTIHLFL

SEQ ID NO: 1229064 - protein, 9 aa, Homo Sapiens
YRLHRKWEE

SEQ ID NO: 1229065 - protein, 9 aa, Homo Sapiens
KTWLTLRRT

SEQ ID NO: 1229066 - protein, 9 aa, Homo Sapiens
SPSGLKIQM

SEQ ID NO: 1229067 - protein, 9 aa, Homo Sapiens
KSELPLKEM

SEQ ID NO: 1229068 - protein, 9 aa, Homo Sapiens
EGGASGNLR

SEQ ID NO: 1229069 - protein, 9 aa, Homo Sapiens
QVSQLSTLV

SEQ ID NO: 1229070 - protein, 9 aa, Homo Sapiens
ECECELLWK

SEQ ID NO: 1229071 - protein, 9 aa, Homo Sapiens
SLNYENNHE

SEQ ID NO: 1229072 - protein, 9 aa, Homo Sapiens
VWDHRPPHI

SEQ ID NO: 1229073 - protein, 9 aa, Homo Sapiens
YQLHVQLGG

SEQ ID NO: 1229074 - protein, 9 aa, Homo Sapiens
KQFLEEARR

SEQ ID NO: 1229075 - protein, 9 aa, Homo Sapiens
ATVHCMANL

SEQ ID NO: 1229076 - protein, 9 aa, Homo Sapiens
EPRRIKYLM

SEQ ID NO: 1229077 - protein, 9 aa, Homo Sapiens
FLQQDRCLA

SEQ ID NO: 1229078 - protein, 9 aa, Homo Sapiens
VTFKDVAIN

SEQ ID NO: 1229079 - protein, 9 aa, Homo Sapiens
VMRRFDDQN

SEQ ID NO: 1229080 - protein, 9 aa, Homo Sapiens
KAADQDEGI

SEQ ID NO: 1229081 - protein, 9 aa, Homo Sapiens
HEQKDAWVW

SEQ ID NO: 1229082 - protein, 9 aa, Homo Sapiens
KDGQILHVP

SEQ ID NO: 1229083 - protein, 9 aa, Homo Sapiens
AQVQLQHLG

SEQ ID NO: 1229084 - protein, 9 aa, Homo Sapiens
ILVNTLYTV

SEQ ID NO: 1229085 - protein, 9 aa, Homo Sapiens
NKEKKDSIM

SEQ ID NO: 1229086 - protein, 9 aa, Homo Sapiens
DGRALRDAA

SEQ ID NO: 1229087 - protein, 9 aa, Homo Sapiens
DVRYKMPSD

SEQ ID NO: 1229088 - protein, 9 aa, Homo Sapiens
RHTLKHDTL

SEQ ID NO: 1229089 - protein, 9 aa, Homo Sapiens
PQGQRCNYA

SEQ ID NO: 1229090 - protein, 9 aa, Homo Sapiens
IRHWTTKHV

SEQ ID NO: 1229091 - protein, 9 aa, Homo Sapiens
AGRRYLHVA

SEQ ID NO: 1229092 - protein, 9 aa, Homo Sapiens
GHAGWLLSW

SEQ ID NO: 1229093 - protein, 9 aa, Homo Sapiens
VRGVKFVET

SEQ ID NO: 1229094 - protein, 9 aa, Homo Sapiens
NHHHPYGPP

SEQ ID NO: 1229095 - protein, 9 aa, Homo Sapiens
LSLEDSSMY

SEQ ID NO: 1229096 - protein, 9 aa, Homo Sapiens
EHVQAWLRF

SEQ ID NO: 1229097 - protein, 9 aa, Homo Sapiens
HLSIGKDII

SEQ ID NO: 1229098 - protein, 9 aa, Homo Sapiens
AYSFSNCWT

SEQ ID NO: 1229099 - protein, 9 aa, Homo Sapiens
SPWPMAAHS

SEQ ID NO: 1229100 - protein, 9 aa, Homo Sapiens
TVYTLCIPY

SEQ ID NO: 1229101 - protein, 9 aa, Homo Sapiens
VLVTSCGPL

SEQ ID NO: 1229102 - protein, 9 aa, Homo Sapiens
KENVLMPNW

SEQ ID NO: 1229103 - protein, 9 aa, Homo Sapiens
KDALFREYQ

SEQ ID NO: 1229104 - protein, 9 aa, Homo Sapiens
LALAWNRVY

SEQ ID NO: 1229105 - protein, 9 aa, Homo Sapiens
YRYEWGSRD

SEQ ID NO: 1229106 - protein, 9 aa, Homo Sapiens
LGDQTVQAP

SEQ ID NO: 1229107 - protein, 9 aa, Homo Sapiens
ETLIYPNPD

SEQ ID NO: 1229108 - protein, 9 aa, Homo Sapiens
CLISKQLAV

SEQ ID NO: 1229109 - protein, 9 aa, Homo Sapiens
LVTINVFDH

SEQ ID NO: 1229110 - protein, 9 aa, Homo Sapiens
PWSAGCWTV

SEQ ID NO: 1229111 - protein, 9 aa, Homo Sapiens
NLVALNADK

SEQ ID NO: 1229112 - protein, 9 aa, Homo Sapiens
MSKALFRKK

SEQ ID NO: 1229113 - protein, 9 aa, Homo Sapiens
RLQINEFSG

SEQ ID NO: 1229114 - protein, 9 aa, Homo Sapiens
FILIRELDP

SEQ ID NO: 1229115 - protein, 9 aa, Homo Sapiens
FLGVTIGLA

SEQ ID NO: 1229116 - protein, 9 aa, Homo Sapiens
QHAPQPYAS

SEQ ID NO: 1229117 - protein, 9 aa, Homo Sapiens
GGGIDTSYY

SEQ ID NO: 1229118 - protein, 9 aa, Homo Sapiens
MRRDTSLET

SEQ ID NO: 1229119 - protein, 9 aa, Homo Sapiens
TPRAPDSRD

SEQ ID NO: 1229120 - protein, 9 aa, Homo Sapiens
VSCPSLRGP

SEQ ID NO: 1229121 - protein, 9 aa, Homo Sapiens
QQLATLEGG

SEQ ID NO: 1229122 - protein, 9 aa, Homo Sapiens
DIAIRLQLM

SEQ ID NO: 1229123 - protein, 9 aa, Homo Sapiens
PTYLWLKQR

SEQ ID NO: 1229124 - protein, 9 aa, Homo Sapiens
GTSISFSCS

SEQ ID NO: 1229125 - protein, 9 aa, Homo Sapiens
KRYLNSILP

SEQ ID NO: 1229126 - protein, 9 aa, Homo Sapiens
GRVSENIVC

SEQ ID NO: 1229127 - protein, 9 aa, Homo Sapiens
LLAMTLRLR

SEQ ID NO: 1229128 - protein, 9 aa, Homo Sapiens
CEHCLLELQ

SEQ ID NO: 1229129 - protein, 9 aa, Homo Sapiens
VNPSANYHT

SEQ ID NO: 1229130 - protein, 9 aa, Homo Sapiens
QEGWRAQQQ

SEQ ID NO: 1229131 - protein, 9 aa, Homo Sapiens
GEMWGMYEG

SEQ ID NO: 1229132 - protein, 9 aa, Homo Sapiens
GEGSLQEIY

SEQ ID NO: 1229133 - protein, 9 aa, Homo Sapiens
YMPALPRQQ

SEQ ID NO: 1229134 - protein, 9 aa, Homo Sapiens
SMYQCVAEN

SEQ ID NO: 1229135 - protein, 9 aa, Homo Sapiens
VDWINDRIQ

SEQ ID NO: 1229136 - protein, 9 aa, Homo Sapiens
KAFEHFSAL

SEQ ID NO: 1229137 - protein, 9 aa, Homo Sapiens
MITEFLLLG

SEQ ID NO: 1229138 - protein, 9 aa, Homo Sapiens
IDGIITKSD

SEQ ID NO: 1229139 - protein, 9 aa, Homo Sapiens
VFVRDSAKL

SEQ ID NO: 1229140 - protein, 9 aa, Homo Sapiens
KCIGSSYRA

SEQ ID NO: 1229141 - protein, 9 aa, Homo Sapiens
ESGSQEDAR

SEQ ID NO: 1229142 - protein, 9 aa, Homo Sapiens
MKWDWMHTG

SEQ ID NO: 1229143 - protein, 9 aa, Homo Sapiens
PSLRGPAAT

SEQ ID NO: 1229144 - protein, 9 aa, Homo Sapiens
SSSWLCGPA

SEQ ID NO: 1229145 - protein, 9 aa, Homo Sapiens
RVIDLLRVV

SEQ ID NO: 1229146 - protein, 9 aa, Homo Sapiens
SVILIMSVI

SEQ ID NO: 1229147 - protein, 9 aa, Homo Sapiens
LQASGIRAP

SEQ ID NO: 1229148 - protein, 9 aa, Homo Sapiens
QPMKSPGKE

SEQ ID NO: 1229149 - protein, 9 aa, Homo Sapiens
EVSQSEGES

SEQ ID NO: 1229150 - protein, 9 aa, Homo Sapiens
ETAYEYKYC

SEQ ID NO: 1229151 - protein, 9 aa, Homo Sapiens
RPSRQLLRQ

SEQ ID NO: 1229152 - protein, 9 aa, Homo Sapiens
KKLTACMQG

SEQ ID NO: 1229153 - protein, 9 aa, Homo Sapiens
GRAILQNYW

SEQ ID NO: 1229154 - protein, 9 aa, Homo Sapiens
PANEAHVST

SEQ ID NO: 1229155 - protein, 9 aa, Homo Sapiens
RSWRERVDR

SEQ ID NO: 1229156 - protein, 9 aa, Homo Sapiens
LNGLLLFIY

SEQ ID NO: 1229157 - protein, 9 aa, Homo Sapiens
LFIFTTTHN

SEQ ID NO: 1229158 - protein, 9 aa, Homo Sapiens
NRTNINVFS

SEQ ID NO: 1229159 - protein, 9 aa, Homo Sapiens
SLKSGLDLC

SEQ ID NO: 1229160 - protein, 9 aa, Homo Sapiens
TSMRIGLMM

SEQ ID NO: 1229161 - protein, 9 aa, Homo Sapiens
PLPDTLLLQ

SEQ ID NO: 1229162 - protein, 9 aa, Homo Sapiens
DVAHVCNPS

SEQ ID NO: 1229163 - protein, 9 aa, Homo Sapiens
KDVAIQVCS

SEQ ID NO: 1229164 - protein, 9 aa, Homo Sapiens
IHMHLIKDK

SEQ ID NO: 1229165 - protein, 9 aa, Homo Sapiens
NELASLDQT

SEQ ID NO: 1229166 - protein, 9 aa, Homo Sapiens
CSPLSCNED

SEQ ID NO: 1229167 - protein, 9 aa, Homo Sapiens
CRLERAVCH

SEQ ID NO: 1229168 - protein, 9 aa, Homo Sapiens
HIVKKTPAS

SEQ ID NO: 1229169 - protein, 9 aa, Homo Sapiens
RSHILEKKP

SEQ ID NO: 1229170 - protein, 9 aa, Homo Sapiens
WQVLKENGS

SEQ ID NO: 1229171 - protein, 9 aa, Homo Sapiens
SSLTPHFSA

SEQ ID NO: 1229172 - protein, 9 aa, Homo Sapiens
ITVFIALKS

SEQ ID NO: 1229173 - protein, 9 aa, Homo Sapiens
SSPQVSGSP

SEQ ID NO: 1229174 - protein, 9 aa, Homo Sapiens
APMLNPMIY

SEQ ID NO: 1229175 - protein, 9 aa, Homo Sapiens
AKAKDAGDD

SEQ ID NO: 1229176 - protein, 9 aa, Homo Sapiens
EQTWLDPDP

SEQ ID NO: 1229177 - protein, 9 aa, Homo Sapiens
LYAVNRRLH

SEQ ID NO: 1229178 - protein, 9 aa, Homo Sapiens
TEEGRTVAA

SEQ ID NO: 1229179 - protein, 9 aa, Homo Sapiens
PEGFLIWKG

SEQ ID NO: 1229180 - protein, 9 aa, Homo Sapiens
FKVDQDLIM

SEQ ID NO: 1229181 - protein, 9 aa, Homo Sapiens
LPLRPQRGP

SEQ ID NO: 1229182 - protein, 9 aa, Homo Sapiens
RALSIDNSQ

SEQ ID NO: 1229183 - protein, 9 aa, Homo Sapiens
HRNTQAHTG

SEQ ID NO: 1229184 - protein, 9 aa, Homo Sapiens
YKRVLVLSV

SEQ ID NO: 1229185 - protein, 9 aa, Homo Sapiens
LAKNASLGK

SEQ ID NO: 1229186 - protein, 9 aa, Homo Sapiens
RHMKSHTEH

SEQ ID NO: 1229187 - protein, 9 aa, Homo Sapiens
PDESCLKST

SEQ ID NO: 1229188 - protein, 9 aa, Homo Sapiens
IDMGDLEML

SEQ ID NO: 1229189 - protein, 9 aa, Homo Sapiens
ALPDRGLDH

SEQ ID NO: 1229190 - protein, 9 aa, Homo Sapiens
TTSPGSHFN

SEQ ID NO: 1229191 - protein, 9 aa, Homo Sapiens
TELSTQTIN

SEQ ID NO: 1229192 - protein, 9 aa, Homo Sapiens
KDKALNALN

SEQ ID NO: 1229193 - protein, 9 aa, Homo Sapiens
SDGRIHKCD

SEQ ID NO: 1229194 - protein, 9 aa, Homo Sapiens
SKGYDIATP

SEQ ID NO: 1229195 - protein, 9 aa, Homo Sapiens
MPQELFEAS

SEQ ID NO: 1229196 - protein, 9 aa, Homo Sapiens
IFSVLPYHD

SEQ ID NO: 1229197 - protein, 9 aa, Homo Sapiens
CRTSLGRHA

SEQ ID NO: 1229198 - protein, 9 aa, Homo Sapiens
RERYPDSFS

SEQ ID NO: 1229199 - protein, 9 aa, Homo Sapiens
PIPHSDEYS

SEQ ID NO: 1229200 - protein, 9 aa, Homo Sapiens
PTTIHVQWQ

SEQ ID NO: 1229201 - protein, 9 aa, Homo Sapiens
AVMMLHHMG

SEQ ID NO: 1229202 - protein, 9 aa, Homo Sapiens
HSGEIFAID

SEQ ID NO: 1229203 - protein, 9 aa, Homo Sapiens
VNHMVVIHA

SEQ ID NO: 1229204 - protein, 9 aa, Homo Sapiens
SPSPSWDRR

SEQ ID NO: 1229205 - protein, 9 aa, Homo Sapiens
LNNSTDVQA

SEQ ID NO: 1229206 - protein, 9 aa, Homo Sapiens
LEVHQGPRG

SEQ ID NO: 1229207 - protein, 9 aa, Homo Sapiens
VSSDKGDCH

SEQ ID NO: 1229208 - protein, 9 aa, Homo Sapiens
DVLLVFWDA

SEQ ID NO: 1229209 - protein, 9 aa, Homo Sapiens
VMVTCLPLW

SEQ ID NO: 1229210 - protein, 9 aa, Homo Sapiens
KFCMMKLLN

SEQ ID NO: 1229211 - protein, 9 aa, Homo Sapiens
KRLRNMLSH

SEQ ID NO: 1229212 - protein, 9 aa, Homo Sapiens
VEWDYYPDR

SEQ ID NO: 1229213 - protein, 9 aa, Homo Sapiens
SVSPSMCSK

SEQ ID NO: 1229214 - protein, 9 aa, Homo Sapiens
SRWRKEDGE

SEQ ID NO: 1229215 - protein, 9 aa, Homo Sapiens
GICGSFLLR

SEQ ID NO: 1229216 - protein, 9 aa, Homo Sapiens
QMLLSRLHV

SEQ ID NO: 1229217 - protein, 9 aa, Homo Sapiens
LKALSKQPL

SEQ ID NO: 1229218 - protein, 9 aa, Homo Sapiens
KGISRKSPL

SEQ ID NO: 1229219 - protein, 9 aa, Homo Sapiens
DFLVDIAEP

SEQ ID NO: 1229220 - protein, 9 aa, Homo Sapiens
GGWIIFQRR

SEQ ID NO: 1229221 - protein, 9 aa, Homo Sapiens
EQASHSAGT

SEQ ID NO: 1229222 - protein, 9 aa, Homo Sapiens
GNIVPRHVF

SEQ ID NO: 1229223 - protein, 9 aa, Homo Sapiens
ERERHLKMW

SEQ ID NO: 1229224 - protein, 9 aa, Homo Sapiens
LPWGMLSSL

SEQ ID NO: 1229225 - protein, 9 aa, Homo Sapiens
TFKTDMYLK

SEQ ID NO: 1229226 - protein, 9 aa, Homo Sapiens
LLCWEDSTG

SEQ ID NO: 1229227 - protein, 9 aa, Homo Sapiens
SCSSFARTI

SEQ ID NO: 1229228 - protein, 9 aa, Homo Sapiens
IRFHYGRFQ

SEQ ID NO: 1229229 - protein, 9 aa, Homo Sapiens
ADPSGVVSI

SEQ ID NO: 1229230 - protein, 9 aa, Homo Sapiens
YENISILDQ

SEQ ID NO: 1229231 - protein, 9 aa, Homo Sapiens
KRDHATLKL

SEQ ID NO: 1229232 - protein, 9 aa, Homo Sapiens
SGVYDGKIK

SEQ ID NO: 1229233 - protein, 9 aa, Homo Sapiens
LRTPDALPE

SEQ ID NO: 1229234 - protein, 9 aa, Homo Sapiens
AQDPKNVRM

SEQ ID NO: 1229235 - protein, 9 aa, Homo Sapiens
DALLTYYIA

SEQ ID NO: 1229236 - protein, 9 aa, Homo Sapiens
PSGRTVSLF

SEQ ID NO: 1229237 - protein, 9 aa, Homo Sapiens
FQDDVKCLS

SEQ ID NO: 1229238 - protein, 9 aa, Homo Sapiens
YSAPCGGYL

SEQ ID NO: 1229239 - protein, 9 aa, Homo Sapiens
KNIKRCTYD

SEQ ID NO: 1229240 - protein, 9 aa, Homo Sapiens
PNVGLTMNY

SEQ ID NO: 1229241 - protein, 9 aa, Homo Sapiens
VITIEDYKI

SEQ ID NO: 1229242 - protein, 9 aa, Homo Sapiens
YGDVGTGKQ

SEQ ID NO: 1229243 - protein, 9 aa, Homo Sapiens
IYKLSGCRF

SEQ ID NO: 1229244 - protein, 9 aa, Homo Sapiens
QQFLTLWPD

SEQ ID NO: 1229245 - protein, 9 aa, Homo Sapiens
RLVKLAPCI

SEQ ID NO: 1229246 - protein, 9 aa, Homo Sapiens
CDWFGDFSS

SEQ ID NO: 1229247 - protein, 9 aa, Homo Sapiens
DDNFRYFLA

SEQ ID NO: 1229248 - protein, 9 aa, Homo Sapiens
YDREVHLCC

SEQ ID NO: 1229249 - protein, 9 aa, Homo Sapiens
AIALIIGFV

SEQ ID NO: 1229250 - protein, 9 aa, Homo Sapiens
ENRIDVDIL

SEQ ID NO: 1229251 - protein, 9 aa, Homo Sapiens
SGLIHVCDE

SEQ ID NO: 1229252 - protein, 9 aa, Homo Sapiens
LQKTHVMSV

SEQ ID NO: 1229253 - protein, 9 aa, Homo Sapiens
SLSTSILLF

SEQ ID NO: 1229254 - protein, 9 aa, Homo Sapiens
ASRGGNLYV

SEQ ID NO: 1229255 - protein, 9 aa, Homo Sapiens
LPWAMLLLW

SEQ ID NO: 1229256 - protein, 9 aa, Homo Sapiens
QMNDLVYEI

SEQ ID NO: 1229257 - protein, 9 aa, Homo Sapiens
LVFCQDQIY

SEQ ID NO: 1229258 - protein, 9 aa, Homo Sapiens
SYKAGDKIA

SEQ ID NO: 1229259 - protein, 9 aa, Homo Sapiens
KTRCEGLCL

SEQ ID NO: 1229260 - protein, 9 aa, Homo Sapiens
HALIKGGAA

SEQ ID NO: 1229261 - protein, 9 aa, Homo Sapiens
SPLILIAPS

SEQ ID NO: 1229262 - protein, 9 aa, Homo Sapiens
VSCMHWMKV

SEQ ID NO: 1229263 - protein, 9 aa, Homo Sapiens
QISRLPLES

SEQ ID NO: 1229264 - protein, 9 aa, Homo Sapiens
NFWGEKIVA

SEQ ID NO: 1229265 - protein, 9 aa, Homo Sapiens
LAHANFSPL

SEQ ID NO: 1229266 - protein, 9 aa, Homo Sapiens
ASLHWDGGS

SEQ ID NO: 1229267 - protein, 9 aa, Homo Sapiens
SILIFMTLK

SEQ ID NO: 1229268 - protein, 9 aa, Homo Sapiens
YDLEHGQPP

SEQ ID NO: 1229269 - protein, 9 aa, Homo Sapiens
MRRHYEDDG

SEQ ID NO: 1229270 - protein, 9 aa, Homo Sapiens
NGTLFRLRF

SEQ ID NO: 1229271 - protein, 9 aa, Homo Sapiens
MESDIYTDV

SEQ ID NO: 1229272 - protein, 9 aa, Homo Sapiens
VELGYQVTA

SEQ ID NO: 1229273 - protein, 9 aa, Homo Sapiens
QPPRRLVAP

SEQ ID NO: 1229274 - protein, 9 aa, Homo Sapiens
KGTDVNMFN

SEQ ID NO: 1229275 - protein, 9 aa, Homo Sapiens
LQDCTQFSD

SEQ ID NO: 1229276 - protein, 9 aa, Homo Sapiens
TFPNAGPRY

SEQ ID NO: 1229277 - protein, 9 aa, Homo Sapiens
TTTTTTLMM

SEQ ID NO: 1229278 - protein, 9 aa, Homo Sapiens
RFTQKRSLN

SEQ ID NO: 1229279 - protein, 9 aa, Homo Sapiens
PESMGLTLN

SEQ ID NO: 1229280 - protein, 9 aa, Homo Sapiens
NDILFCDLA

SEQ ID NO: 1229281 - protein, 9 aa, Homo Sapiens
YQVIHKMHH

SEQ ID NO: 1229282 - protein, 9 aa, Homo Sapiens
CRTLQGHSH

SEQ ID NO: 1229283 - protein, 9 aa, Homo Sapiens
KDVAIVVPF

SEQ ID NO: 1229284 - protein, 9 aa, Homo Sapiens
DVNLVTQQI

SEQ ID NO: 1229285 - protein, 9 aa, Homo Sapiens
FMSHDKHVF

SEQ ID NO: 1229286 - protein, 9 aa, Homo Sapiens
GIVLKYQEL

SEQ ID NO: 1229287 - protein, 9 aa, Homo Sapiens
SKNYGKCWE

SEQ ID NO: 1229288 - protein, 9 aa, Homo Sapiens
SMLLWIGAS

SEQ ID NO: 1229289 - protein, 9 aa, Homo Sapiens
DQCSPLSCN

SEQ ID NO: 1229290 - protein, 9 aa, Homo Sapiens
DPELQPVLV

SEQ ID NO: 1229291 - protein, 9 aa, Homo Sapiens
RMRHIPLTP

SEQ ID NO: 1229292 - protein, 9 aa, Homo Sapiens
EMADEKFCE

SEQ ID NO: 1229293 - protein, 9 aa, Homo Sapiens
CQIKNVQLL

SEQ ID NO: 1229294 - protein, 9 aa, Homo Sapiens
DIPPPSLKT

SEQ ID NO: 1229295 - protein, 9 aa, Homo Sapiens
ETLFLLYIS

SEQ ID NO: 1229296 - protein, 9 aa, Homo Sapiens
ASACRNILD

SEQ ID NO: 1229297 - protein, 9 aa, Homo Sapiens
ECGRAFTQK

SEQ ID NO: 1229298 - protein, 9 aa, Homo Sapiens
LQQLSLEMP

SEQ ID NO: 1229299 - protein, 9 aa, Homo Sapiens
VQGFGSTQI

SEQ ID NO: 1229300 - protein, 9 aa, Homo Sapiens
RRCMATWRK

SEQ ID NO: 1229301 - protein, 9 aa, Homo Sapiens
GMSLKSNAV

SEQ ID NO: 1229302 - protein, 9 aa, Homo Sapiens
GGLLHDLIH

SEQ ID NO: 1229303 - protein, 9 aa, Homo Sapiens
STMHSRVFQ

SEQ ID NO: 1229304 - protein, 9 aa, Homo Sapiens
GTTLNYLRD

SEQ ID NO: 1229305 - protein, 9 aa, Homo Sapiens
TSLLNNVCA

SEQ ID NO: 1229306 - protein, 9 aa, Homo Sapiens
PGSHGQEQA

SEQ ID NO: 1229307 - protein, 9 aa, Homo Sapiens
ATASLGAGG

SEQ ID NO: 1229308 - protein, 9 aa, Homo Sapiens
LLRFPQHVK

SEQ ID NO: 1229309 - protein, 9 aa, Homo Sapiens
HLIADGSHF

SEQ ID NO: 1229310 - protein, 9 aa, Homo Sapiens
SGQDGPPGP

SEQ ID NO: 1229311 - protein, 9 aa, Homo Sapiens
ASERDAPSI

SEQ ID NO: 1229312 - protein, 9 aa, Homo Sapiens
GQAALGGLV

SEQ ID NO: 1229313 - protein, 9 aa, Homo Sapiens
GPRGRRALW

SEQ ID NO: 1229314 - protein, 9 aa, Homo Sapiens
RELISDLEC

SEQ ID NO: 1229315 - protein, 9 aa, Homo Sapiens
QPLDILSEE

SEQ ID NO: 1229316 - protein, 9 aa, Homo Sapiens
ASDYMPALP

SEQ ID NO: 1229317 - protein, 9 aa, Homo Sapiens
NSLYWYGGE

SEQ ID NO: 1229318 - protein, 9 aa, Homo Sapiens
NDIPIPQSV

SEQ ID NO: 1229319 - protein, 9 aa, Homo Sapiens
AGTLHPYLT

SEQ ID NO: 1229320 - protein, 9 aa, Homo Sapiens
CWTYRYSEK

SEQ ID NO: 1229321 - protein, 9 aa, Homo Sapiens
NIILDSVGH

SEQ ID NO: 1229322 - protein, 9 aa, Homo Sapiens
VATPGRPWP

SEQ ID NO: 1229323 - protein, 9 aa, Homo Sapiens
RKQKSNCGV

SEQ ID NO: 1229324 - protein, 9 aa, Homo Sapiens
NAFKTVMGI

SEQ ID NO: 1229325 - protein, 9 aa, Homo Sapiens
PVGTGMDGK

SEQ ID NO: 1229326 - protein, 9 aa, Homo Sapiens
AHTVYTLCI

SEQ ID NO: 1229327 - protein, 9 aa, Homo Sapiens
QRGGILASL

SEQ ID NO: 1229328 - protein, 9 aa, Homo Sapiens
YSSASNPQY

SEQ ID NO: 1229329 - protein, 9 aa, Homo Sapiens
CCRKCHSPH

SEQ ID NO: 1229330 - protein, 9 aa, Homo Sapiens
IFTDFDKYM

SEQ ID NO: 1229331 - protein, 9 aa, Homo Sapiens
VLLIYDITN

SEQ ID NO: 1229332 - protein, 9 aa, Homo Sapiens
IACTVTTKD

SEQ ID NO: 1229333 - protein, 9 aa, Homo Sapiens
HRQPMPDPG

SEQ ID NO: 1229334 - protein, 9 aa, Homo Sapiens
AALMQDYTA

SEQ ID NO: 1229335 - protein, 9 aa, Homo Sapiens
GCSQTVAMQ

SEQ ID NO: 1229336 - protein, 9 aa, Homo Sapiens
KSRKNEIKF

SEQ ID NO: 1229337 - protein, 9 aa, Homo Sapiens
KEEMELLKE

SEQ ID NO: 1229338 - protein, 9 aa, Homo Sapiens
DIYIHVHIQ

SEQ ID NO: 1229339 - protein, 9 aa, Homo Sapiens
PACHSFCRR

SEQ ID NO: 1229340 - protein, 9 aa, Homo Sapiens
IVLKLMPIK

SEQ ID NO: 1229341 - protein, 9 aa, Homo Sapiens
PYTCEECDK

SEQ ID NO: 1229342 - protein, 9 aa, Homo Sapiens
YVHAYISKI

SEQ ID NO: 1229343 - protein, 9 aa, Homo Sapiens
WLPWAMLLL

SEQ ID NO: 1229344 - protein, 9 aa, Homo Sapiens
DIRSLNPEL

SEQ ID NO: 1229345 - protein, 9 aa, Homo Sapiens
MPQMCSPKL

SEQ ID NO: 1229346 - protein, 9 aa, Homo Sapiens
PAPKSVLQS

SEQ ID NO: 1229347 - protein, 9 aa, Homo Sapiens
GLEQPLTLT

SEQ ID NO: 1229348 - protein, 9 aa, Homo Sapiens
ISLDLHSQF

SEQ ID NO: 1229349 - protein, 9 aa, Homo Sapiens
GAWGPPAPS

SEQ ID NO: 1229350 - protein, 9 aa, Homo Sapiens
EAEETFEFV

SEQ ID NO: 1229351 - protein, 9 aa, Homo Sapiens
DALPEEKKI

SEQ ID NO: 1229352 - protein, 9 aa, Homo Sapiens
TLAEFGKYI

SEQ ID NO: 1229353 - protein, 9 aa, Homo Sapiens
PDAKKSCTY

SEQ ID NO: 1229354 - protein, 9 aa, Homo Sapiens
HYLDRFLAG

SEQ ID NO: 1229355 - protein, 9 aa, Homo Sapiens
EENFPLGNV

SEQ ID NO: 1229356 - protein, 9 aa, Homo Sapiens
LENKPIITP

SEQ ID NO: 1229357 - protein, 9 aa, Homo Sapiens
AVTDVNASE

SEQ ID NO: 1229358 - protein, 9 aa, Homo Sapiens
QAIMMMDES

SEQ ID NO: 1229359 - protein, 9 aa, Homo Sapiens
CAMYTLLCG

SEQ ID NO: 1229360 - protein, 9 aa, Homo Sapiens
LCGPCITSP

SEQ ID NO: 1229361 - protein, 9 aa, Homo Sapiens
ITQASCQPR

SEQ ID NO: 1229362 - protein, 9 aa, Homo Sapiens
TTELAHSLR

SEQ ID NO: 1229363 - protein, 9 aa, Homo Sapiens
LHIDQNMYP

SEQ ID NO: 1229364 - protein, 9 aa, Homo Sapiens
TFKNFFLFI

SEQ ID NO: 1229365 - protein, 9 aa, Homo Sapiens
NFYAWKRMD

SEQ ID NO: 1229366 - protein, 9 aa, Homo Sapiens
IPGDKPLPV

SEQ ID NO: 1229367 - protein, 9 aa, Homo Sapiens
IQSCPTIRI

SEQ ID NO: 1229368 - protein, 9 aa, Homo Sapiens
RRADSPPSS

SEQ ID NO: 1229369 - protein, 9 aa, Homo Sapiens
TIIFQLKEV

SEQ ID NO: 1229370 - protein, 9 aa, Homo Sapiens
LKTWLTLRR

SEQ ID NO: 1229371 - protein, 9 aa, Homo Sapiens
RCSKDWPCK

SEQ ID NO: 1229372 - protein, 9 aa, Homo Sapiens
RDLRHTLHL

SEQ ID NO: 1229373 - protein, 9 aa, Homo Sapiens
EEFGFSFSF

SEQ ID NO: 1229374 - protein, 9 aa, Homo Sapiens
LEIHFHEIV

SEQ ID NO: 1229375 - protein, 9 aa, Homo Sapiens
SFMVFFFTF

SEQ ID NO: 1229376 - protein, 9 aa, Homo Sapiens
PQHCRLLHQ

SEQ ID NO: 1229377 - protein, 9 aa, Homo Sapiens
FYVKHCRNL

SEQ ID NO: 1229378 - protein, 9 aa, Homo Sapiens
SVSFLLLRR

SEQ ID NO: 1229379 - protein, 9 aa, Homo Sapiens
ILLLFTTQP

SEQ ID NO: 1229380 - protein, 9 aa, Homo Sapiens
NEHMRLELQ

SEQ ID NO: 1229381 - protein, 9 aa, Homo Sapiens
CAACVDRII

SEQ ID NO: 1229382 - protein, 9 aa, Homo Sapiens
WHLWKHYSD

SEQ ID NO: 1229383 - protein, 9 aa, Homo Sapiens
HLSAYVSYG

SEQ ID NO: 1229384 - protein, 9 aa, Homo Sapiens
QCEAHRILY

SEQ ID NO: 1229385 - protein, 9 aa, Homo Sapiens
AHTTWWDLF

SEQ ID NO: 1229386 - protein, 9 aa, Homo Sapiens
PLCAVLAAL

SEQ ID NO: 1229387 - protein, 9 aa, Homo Sapiens
GPSLGYFRG

SEQ ID NO: 1229388 - protein, 9 aa, Homo Sapiens
ACSRDTLPA

SEQ ID NO: 1229389 - protein, 9 aa, Homo Sapiens
IKILWNILK

SEQ ID NO: 1229390 - protein, 9 aa, Homo Sapiens
VVGLLAAVV

SEQ ID NO: 1229391 - protein, 9 aa, Homo Sapiens
SPAQVIVVY

SEQ ID NO: 1229392 - protein, 9 aa, Homo Sapiens
DLLWITSAL

SEQ ID NO: 1229393 - protein, 9 aa, Homo Sapiens
AIIRHLRDV

SEQ ID NO: 1229394 - protein, 9 aa, Homo Sapiens
KKIPLVLSR

SEQ ID NO: 1229395 - protein, 9 aa, Homo Sapiens
SQTFITIGD

SEQ ID NO: 1229396 - protein, 9 aa, Homo Sapiens
HDGGRPALL

SEQ ID NO: 1229397 - protein, 9 aa, Homo Sapiens
DWINDRIQP

SEQ ID NO: 1229398 - protein, 9 aa, Homo Sapiens
RIGGHIPIF

SEQ ID NO: 1229399 - protein, 9 aa, Homo Sapiens
SSGGSDGGS

SEQ ID NO: 1229400 - protein, 9 aa, Homo Sapiens
VPAIGFTLA

SEQ ID NO: 1229401 - protein, 9 aa, Homo Sapiens
TGEKPYERS

SEQ ID NO: 1229402 - protein, 9 aa, Homo Sapiens
QVWFKANRV

SEQ ID NO: 1229403 - protein, 9 aa, Homo Sapiens
TEETTYGRS

SEQ ID NO: 1229404 - protein, 9 aa, Homo Sapiens
LAFSGVVDI

SEQ ID NO: 1229405 - protein, 9 aa, Homo Sapiens
KELKAHTVW

SEQ ID NO: 1229406 - protein, 9 aa, Homo Sapiens
FCPLKADSK

SEQ ID NO: 1229407 - protein, 9 aa, Homo Sapiens
LNAVKYVEC

SEQ ID NO: 1229408 - protein, 9 aa, Homo Sapiens
DYEAIVKRS

SEQ ID NO: 1229409 - protein, 9 aa, Homo Sapiens
FIFYYLEVH

SEQ ID NO: 1229410 - protein, 9 aa, Homo Sapiens
KNMDNAAEA

SEQ ID NO: 1229411 - protein, 9 aa, Homo Sapiens
FLLLAGISL

SEQ ID NO: 1229412 - protein, 9 aa, Homo Sapiens
KKDEDMKVM

SEQ ID NO: 1229413 - protein, 9 aa, Homo Sapiens
DQVVLEGHA

SEQ ID NO: 1229414 - protein, 9 aa, Homo Sapiens
RNQLVTTEP

SEQ ID NO: 1229415 - protein, 9 aa, Homo Sapiens
GYRWDIIAQ

SEQ ID NO: 1229416 - protein, 9 aa, Homo Sapiens
LDMEGANSI

SEQ ID NO: 1229417 - protein, 9 aa, Homo Sapiens
KDFLMSHPL

SEQ ID NO: 1229418 - protein, 9 aa, Homo Sapiens
CDTRLRIQA

SEQ ID NO: 1229419 - protein, 9 aa, Homo Sapiens
AKHKYQEAS

SEQ ID NO: 1229420 - protein, 9 aa, Homo Sapiens
SSLSSLVTQ

SEQ ID NO: 1229421 - protein, 9 aa, Homo Sapiens
MKVMEERYK

SEQ ID NO: 1229422 - protein, 9 aa, Homo Sapiens
LERESTLLK

SEQ ID NO: 1229423 - protein, 9 aa, Homo Sapiens
LPEHVPQED

SEQ ID NO: 1229424 - protein, 9 aa, Homo Sapiens
ITLDNRVAD

SEQ ID NO: 1229425 - protein, 9 aa, Homo Sapiens
FVVARYFPV

SEQ ID NO: 1229426 - protein, 9 aa, Homo Sapiens
EELPGRSII

SEQ ID NO: 1229427 - protein, 9 aa, Homo Sapiens
DECKYECMW

SEQ ID NO: 1229428 - protein, 9 aa, Homo Sapiens
QNVMVMILV

SEQ ID NO: 1229429 - protein, 9 aa, Homo Sapiens
HYGGSLPSV

SEQ ID NO: 1229430 - protein, 9 aa, Homo Sapiens
LQCLLNQEL

SEQ ID NO: 1229431 - protein, 9 aa, Homo Sapiens
GFIPLSNFV

SEQ ID NO: 1229432 - protein, 9 aa, Homo Sapiens
ENSFNYQSF

SEQ ID NO: 1229433 - protein, 9 aa, Homo Sapiens
GSRREEHSL

SEQ ID NO: 1229434 - protein, 9 aa, Homo Sapiens
QLLILVSQL

SEQ ID NO: 1229435 - protein, 9 aa, Homo Sapiens
TGIRDPLLG

SEQ ID NO: 1229436 - protein, 9 aa, Homo Sapiens
NKHLSSSTV

SEQ ID NO: 1229437 - protein, 9 aa, Homo Sapiens
SYFKCKEKM

SEQ ID NO: 1229438 - protein, 9 aa, Homo Sapiens
LLKCMVIIL

SEQ ID NO: 1229439 - protein, 9 aa, Homo Sapiens
DADMKSDNV

SEQ ID NO: 1229440 - protein, 9 aa, Homo Sapiens
GYDTFMEKY

SEQ ID NO: 1229441 - protein, 9 aa, Homo Sapiens
MRQTRHYEM

SEQ ID NO: 1229442 - protein, 9 aa, Homo Sapiens
NISHVMQYG

SEQ ID NO: 1229443 - protein, 9 aa, Homo Sapiens
HQCYDSELG

SEQ ID NO: 1229444 - protein, 9 aa, Homo Sapiens
AGEGSGSIS

SEQ ID NO: 1229445 - protein, 9 aa, Homo Sapiens
AVRSGHEEV

SEQ ID NO: 1229446 - protein, 9 aa, Homo Sapiens
VMNSPTTTM

SEQ ID NO: 1229447 - protein, 9 aa, Homo Sapiens
PVVWGVVLN

SEQ ID NO: 1229448 - protein, 9 aa, Homo Sapiens
TTHKRIYTG

SEQ ID NO: 1229449 - protein, 9 aa, Homo Sapiens
IICAMKALQ

SEQ ID NO: 1229450 - protein, 9 aa, Homo Sapiens
FLHLHNDII

SEQ ID NO: 1229451 - protein, 9 aa, Homo Sapiens
LTTECDLKV

SEQ ID NO: 1229452 - protein, 9 aa, Homo Sapiens
GEKEDHFLT

SEQ ID NO: 1229453 - protein, 9 aa, Homo Sapiens
ALLQQPRSL

SEQ ID NO: 1229454 - protein, 9 aa, Homo Sapiens
NVPMLKLSY

SEQ ID NO: 1229455 - protein, 9 aa, Homo Sapiens
SAPAPISPK

SEQ ID NO: 1229456 - protein, 9 aa, Homo Sapiens
FVIFFIGIA

SEQ ID NO: 1229457 - protein, 9 aa, Homo Sapiens
WAILMDGFL

SEQ ID NO: 1229458 - protein, 9 aa, Homo Sapiens
KVPAPKDAL

SEQ ID NO: 1229459 - protein, 9 aa, Homo Sapiens
VVCHDYDIH

SEQ ID NO: 1229460 - protein, 9 aa, Homo Sapiens
SSALSTNKI

SEQ ID NO: 1229461 - protein, 9 aa, Homo Sapiens
SNLTLAKLP

SEQ ID NO: 1229462 - protein, 9 aa, Homo Sapiens
PRPGRSAAA

SEQ ID NO: 1229463 - protein, 9 aa, Homo Sapiens
SSPPTVVAC

SEQ ID NO: 1229464 - protein, 9 aa, Homo Sapiens
DPYRSMSTS

SEQ ID NO: 1229465 - protein, 9 aa, Homo Sapiens
CPTVLMTSL

SEQ ID NO: 1229466 - protein, 9 aa, Homo Sapiens
PGAIPLAHP

SEQ ID NO: 1229467 - protein, 9 aa, Homo Sapiens
DSDIPPPSL

SEQ ID NO: 1229468 - protein, 9 aa, Homo Sapiens
KILQELNAS

SEQ ID NO: 1229469 - protein, 9 aa, Homo Sapiens
SEQVLKFCK

SEQ ID NO: 1229470 - protein, 9 aa, Homo Sapiens
FLVDIAEPV

SEQ ID NO: 1229471 - protein, 9 aa, Homo Sapiens
VEQRQGREH

SEQ ID NO: 1229472 - protein, 9 aa, Homo Sapiens
NCWTPLTPT

SEQ ID NO: 1229473 - protein, 9 aa, Homo Sapiens
PLHVKGGVS

SEQ ID NO: 1229474 - protein, 9 aa, Homo Sapiens
SHRPCVTHI

SEQ ID NO: 1229475 - protein, 9 aa, Homo Sapiens
ILDEVVAQE

SEQ ID NO: 1229476 - protein, 9 aa, Homo Sapiens
RRNLVALNA

SEQ ID NO: 1229477 - protein, 9 aa, Homo Sapiens
AGRFAVLGT

SEQ ID NO: 1229478 - protein, 9 aa, Homo Sapiens
GVARGVDFH

SEQ ID NO: 1229479 - protein, 9 aa, Homo Sapiens
AHESILPTT

SEQ ID NO: 1229480 - protein, 9 aa, Homo Sapiens
CFIPNRVIG

SEQ ID NO: 1229481 - protein, 9 aa, Homo Sapiens
KNTTKEVIM

SEQ ID NO: 1229482 - protein, 9 aa, Homo Sapiens
FMLLFSWQG

SEQ ID NO: 1229483 - protein, 9 aa, Homo Sapiens
LPLELYMSS

SEQ ID NO: 1229484 - protein, 9 aa, Homo Sapiens
VNVYYGRKC

SEQ ID NO: 1229485 - protein, 9 aa, Homo Sapiens
SKELKQMFQ

SEQ ID NO: 1229486 - protein, 9 aa, Homo Sapiens
TKLSYCVVF

SEQ ID NO: 1229487 - protein, 9 aa, Homo Sapiens
MVCKPCAPG

SEQ ID NO: 1229488 - protein, 9 aa, Homo Sapiens
GALINSLIQ

SEQ ID NO: 1229489 - protein, 9 aa, Homo Sapiens
SVSVSARVQ

SEQ ID NO: 1229490 - protein, 9 aa, Homo Sapiens
PFLNRLVQP

SEQ ID NO: 1229491 - protein, 9 aa, Homo Sapiens
PEMLIYFFV

SEQ ID NO: 1229492 - protein, 9 aa, Homo Sapiens
QNQQVEKME

SEQ ID NO: 1229493 - protein, 9 aa, Homo Sapiens
PWQQATMAL

SEQ ID NO: 1229494 - protein, 9 aa, Homo Sapiens
NVLFTTQNQ

SEQ ID NO: 1229495 - protein, 9 aa, Homo Sapiens
KDPLDNDKN

SEQ ID NO: 1229496 - protein, 9 aa, Homo Sapiens
GIYGYRLHR

SEQ ID NO: 1229497 - protein, 9 aa, Homo Sapiens
CQHSSCQPA

SEQ ID NO: 1229498 - protein, 9 aa, Homo Sapiens
MGLITCMFK

SEQ ID NO: 1229499 - protein, 9 aa, Homo Sapiens
PPATATAAT

SEQ ID NO: 1229500 - protein, 9 aa, Homo Sapiens
PDSRDARWE

SEQ ID NO: 1229501 - protein, 9 aa, Homo Sapiens
GHMKMVLLW

SEQ ID NO: 1229502 - protein, 9 aa, Homo Sapiens
ALSGPVRLF

SEQ ID NO: 1229503 - protein, 9 aa, Homo Sapiens
HMAIQQHSL

SEQ ID NO: 1229504 - protein, 9 aa, Homo Sapiens
AGGKAFCVG

SEQ ID NO: 1229505 - protein, 9 aa, Homo Sapiens
DCMEKQMHD

SEQ ID NO: 1229506 - protein, 9 aa, Homo Sapiens
LMKQALDFQ

SEQ ID NO: 1229507 - protein, 9 aa, Homo Sapiens
CDASVSFHH

SEQ ID NO: 1229508 - protein, 9 aa, Homo Sapiens
PPSGELYFW

SEQ ID NO: 1229509 - protein, 9 aa, Homo Sapiens
QKGPHGSIT

SEQ ID NO: 1229510 - protein, 9 aa, Homo Sapiens
SSPNSTGIR

SEQ ID NO: 1229511 - protein, 9 aa, Homo Sapiens
AKPVAIAPI

SEQ ID NO: 1229512 - protein, 9 aa, Homo Sapiens
KLHQSATQA

SEQ ID NO: 1229513 - protein, 9 aa, Homo Sapiens
PLGRSKAGS

SEQ ID NO: 1229514 - protein, 9 aa, Homo Sapiens
VTHPCMRRY

SEQ ID NO: 1229515 - protein, 9 aa, Homo Sapiens
SKAMCIMNS

SEQ ID NO: 1229516 - protein, 9 aa, Homo Sapiens
LKLYPCMEV

SEQ ID NO: 1229517 - protein, 9 aa, Homo Sapiens
HTPSVRKWA

SEQ ID NO: 1229518 - protein, 9 aa, Homo Sapiens
SFFPVFVWT

SEQ ID NO: 1229519 - protein, 9 aa, Homo Sapiens
QTAGCFVGV

SEQ ID NO: 1229520 - protein, 9 aa, Homo Sapiens
WRSDPIQLE

SEQ ID NO: 1229521 - protein, 9 aa, Homo Sapiens
FGPHGHHWQ

SEQ ID NO: 1229522 - protein, 9 aa, Homo Sapiens
PGNVGHQYV

SEQ ID NO: 1229523 - protein, 9 aa, Homo Sapiens
CSISGLITL

SEQ ID NO: 1229524 - protein, 9 aa, Homo Sapiens
LGKCCDVPT

SEQ ID NO: 1229525 - protein, 9 aa, Homo Sapiens
ERLTRQHED

SEQ ID NO: 1229526 - protein, 9 aa, Homo Sapiens
LPFLIIIIV

SEQ ID NO: 1229527 - protein, 9 aa, Homo Sapiens
SFLPIKSGI

SEQ ID NO: 1229528 - protein, 9 aa, Homo Sapiens
EQNLCQLRV

SEQ ID NO: 1229529 - protein, 9 aa, Homo Sapiens
INQDLVGPL

SEQ ID NO: 1229530 - protein, 9 aa, Homo Sapiens
KREAQVDVL

SEQ ID NO: 1229531 - protein, 9 aa, Homo Sapiens
RHNTGYCVC

SEQ ID NO: 1229532 - protein, 9 aa, Homo Sapiens
ETGVWLLEP

SEQ ID NO: 1229533 - protein, 9 aa, Homo Sapiens
STYNNRGNE

SEQ ID NO: 1229534 - protein, 9 aa, Homo Sapiens
VNELKKQLK

SEQ ID NO: 1229535 - protein, 9 aa, Homo Sapiens
ALDLFYGMV

SEQ ID NO: 1229536 - protein, 9 aa, Homo Sapiens
SLAIPDDFG

SEQ ID NO: 1229537 - protein, 9 aa, Homo Sapiens
PKDIATNSK

SEQ ID NO: 1229538 - protein, 9 aa, Homo Sapiens
APPLAANGQ

SEQ ID NO: 1229539 - protein, 9 aa, Homo Sapiens
NDNSIETRT

SEQ ID NO: 1229540 - protein, 9 aa, Homo Sapiens
QKLHPPNRD

SEQ ID NO: 1229541 - protein, 9 aa, Homo Sapiens
RFHEVPLVQ

SEQ ID NO: 1229542 - protein, 9 aa, Homo Sapiens
FLGCVAHVF

SEQ ID NO: 1229543 - protein, 9 aa, Homo Sapiens
NRTLYHLQL

SEQ ID NO: 1229544 - protein, 9 aa, Homo Sapiens
ELDSQRRPL

SEQ ID NO: 1229545 - protein, 9 aa, Homo Sapiens
LGSTPYISV

SEQ ID NO: 1229546 - protein, 9 aa, Homo Sapiens
VTVKTAMIG

SEQ ID NO: 1229547 - protein, 9 aa, Homo Sapiens
QLPTALLHV

SEQ ID NO: 1229548 - protein, 9 aa, Homo Sapiens
EGQSKHCKP

SEQ ID NO: 1229549 - protein, 9 aa, Homo Sapiens
VLCLACTDT

SEQ ID NO: 1229550 - protein, 9 aa, Homo Sapiens
LIKVFRSLD

SEQ ID NO: 1229551 - protein, 9 aa, Homo Sapiens
NDTTPVCTL

SEQ ID NO: 1229552 - protein, 9 aa, Homo Sapiens
ILYPNTNYE

SEQ ID NO: 1229553 - protein, 9 aa, Homo Sapiens
VPMLSIQPK

SEQ ID NO: 1229554 - protein, 9 aa, Homo Sapiens
IRGVGPDLE

SEQ ID NO: 1229555 - protein, 9 aa, Homo Sapiens
VPPMATATR

SEQ ID NO: 1229556 - protein, 9 aa, Homo Sapiens
HPWVAYSFS

SEQ ID NO: 1229557 - protein, 9 aa, Homo Sapiens
MAHGMAASL

SEQ ID NO: 1229558 - protein, 9 aa, Homo Sapiens
HMMNCPKIL

SEQ ID NO: 1229559 - protein, 9 aa, Homo Sapiens
PNNPNAHGI

SEQ ID NO: 1229560 - protein, 9 aa, Homo Sapiens
FTAVSSDDK

SEQ ID NO: 1229561 - protein, 9 aa, Homo Sapiens
NDLQAQTRC

SEQ ID NO: 1229562 - protein, 9 aa, Homo Sapiens
DDLHNDCTE

SEQ ID NO: 1229563 - protein, 9 aa, Homo Sapiens
DTHFDDDEL

SEQ ID NO: 1229564 - protein, 9 aa, Homo Sapiens
MTSISDLEF

SEQ ID NO: 1229565 - protein, 9 aa, Homo Sapiens
ENGSPEYRQ

SEQ ID NO: 1229566 - protein, 9 aa, Homo Sapiens
PKYGTLLKA

SEQ ID NO: 1229567 - protein, 9 aa, Homo Sapiens
LLLQGYRFT

SEQ ID NO: 1229568 - protein, 9 aa, Homo Sapiens
PCIQEAEVS

SEQ ID NO: 1229569 - protein, 9 aa, Homo Sapiens
IDGEDGIFL

SEQ ID NO: 1229570 - protein, 9 aa, Homo Sapiens
ILDLFDNTR

SEQ ID NO: 1229571 - protein, 9 aa, Homo Sapiens
SPSTKYIVS

SEQ ID NO: 1229572 - protein, 9 aa, Homo Sapiens
KTMGRKEYE

SEQ ID NO: 1229573 - protein, 9 aa, Homo Sapiens
IVPRHVFRI

SEQ ID NO: 1229574 - protein, 9 aa, Homo Sapiens
LRFLAVMAA

SEQ ID NO: 1229575 - protein, 9 aa, Homo Sapiens
PGGSLFTSA

SEQ ID NO: 1229576 - protein, 9 aa, Homo Sapiens
QVLFLQLQE

SEQ ID NO: 1229577 - protein, 9 aa, Homo Sapiens
DARQNSVTD

SEQ ID NO: 1229578 - protein, 9 aa, Homo Sapiens
WCIEMAEMC

SEQ ID NO: 1229579 - protein, 9 aa, Homo Sapiens
DEVLNSAMQ

SEQ ID NO: 1229580 - protein, 9 aa, Homo Sapiens
RDQFKDTNK

SEQ ID NO: 1229581 - protein, 9 aa, Homo Sapiens
RAPAKPRST

SEQ ID NO: 1229582 - protein, 9 aa, Homo Sapiens
DTFMEKYMK

SEQ ID NO: 1229583 - protein, 9 aa, Homo Sapiens
VTNEKQALQ

SEQ ID NO: 1229584 - protein, 9 aa, Homo Sapiens
TVVILKLYP

SEQ ID NO: 1229585 - protein, 9 aa, Homo Sapiens
CLLKDKGLL

SEQ ID NO: 1229586 - protein, 9 aa, Homo Sapiens
VSYTGYRDS

SEQ ID NO: 1229587 - protein, 9 aa, Homo Sapiens
VTTLSLRLI

SEQ ID NO: 1229588 - protein, 9 aa, Homo Sapiens
RVQIDCHTD

SEQ ID NO: 1229589 - protein, 9 aa, Homo Sapiens
GFRAIALLQ

SEQ ID NO: 1229590 - protein, 9 aa, Homo Sapiens
SFNEDFLKC

SEQ ID NO: 1229591 - protein, 9 aa, Homo Sapiens
FSYLRRMSQ

SEQ ID NO: 1229592 - protein, 9 aa, Homo Sapiens
PSFLSYTVS

SEQ ID NO: 1229593 - protein, 9 aa, Homo Sapiens
DPALLRPGC

SEQ ID NO: 1229594 - protein, 9 aa, Homo Sapiens
TLWPDQQLH

SEQ ID NO: 1229595 - protein, 9 aa, Homo Sapiens
LGHAHRKAA

SEQ ID NO: 1229596 - protein, 9 aa, Homo Sapiens
KRHYCCALI

SEQ ID NO: 1229597 - protein, 9 aa, Homo Sapiens
SKTAQLKSL

SEQ ID NO: 1229598 - protein, 9 aa, Homo Sapiens
PDILDCLYG

SEQ ID NO: 1229599 - protein, 9 aa, Homo Sapiens
EGTQVDTRE

SEQ ID NO: 1229600 - protein, 9 aa, Homo Sapiens
DSPRYTIPP

SEQ ID NO: 1229601 - protein, 9 aa, Homo Sapiens
EDTCVECED

SEQ ID NO: 1229602 - protein, 9 aa, Homo Sapiens
SSPRLSRVP

SEQ ID NO: 1229603 - protein, 9 aa, Homo Sapiens
KESSRTTLG

SEQ ID NO: 1229604 - protein, 9 aa, Homo Sapiens
SHLTVVFFI

SEQ ID NO: 1229605 - protein, 9 aa, Homo Sapiens
HFCDVKDET

SEQ ID NO: 1229606 - protein, 9 aa, Homo Sapiens
DCVICWMNM

SEQ ID NO: 1229607 - protein, 9 aa, Homo Sapiens
GWRGPRRLV

SEQ ID NO: 1229608 - protein, 9 aa, Homo Sapiens
VNMASRMES

SEQ ID NO: 1229609 - protein, 9 aa, Homo Sapiens
VSWAARVNY

SEQ ID NO: 1229610 - protein, 9 aa, Homo Sapiens
KARIGGHIP

SEQ ID NO: 1229611 - protein, 9 aa, Homo Sapiens
AGRKDHLGC

SEQ ID NO: 1229612 - protein, 9 aa, Homo Sapiens
VHALRTIVF

SEQ ID NO: 1229613 - protein, 9 aa, Homo Sapiens
EINLMDELT

SEQ ID NO: 1229614 - protein, 9 aa, Homo Sapiens
CTDGQLHAR

SEQ ID NO: 1229615 - protein, 9 aa, Homo Sapiens
MGSSGAATS

SEQ ID NO: 1229616 - protein, 9 aa, Homo Sapiens
SQVYCHKDF

SEQ ID NO: 1229617 - protein, 9 aa, Homo Sapiens
KSEEREMSK

SEQ ID NO: 1229618 - protein, 9 aa, Homo Sapiens
GNLVNMSFL

SEQ ID NO: 1229619 - protein, 9 aa, Homo Sapiens
YRQKQGIVL

SEQ ID NO: 1229620 - protein, 9 aa, Homo Sapiens
SYSMAILNG

SEQ ID NO: 1229621 - protein, 9 aa, Homo Sapiens
VHVTCWFGD

SEQ ID NO: 1229622 - protein, 9 aa, Homo Sapiens
GRHVEVSCA

SEQ ID NO: 1229623 - protein, 9 aa, Homo Sapiens
TDLHFQSSA

SEQ ID NO: 1229624 - protein, 9 aa, Homo Sapiens
KSECHRIKM

SEQ ID NO: 1229625 - protein, 9 aa, Homo Sapiens
DILGLRIIF

SEQ ID NO: 1229626 - protein, 9 aa, Homo Sapiens
SKEELISEL

SEQ ID NO: 1229627 - protein, 9 aa, Homo Sapiens
ECSDMSCPN

SEQ ID NO: 1229628 - protein, 9 aa, Homo Sapiens
VFTSNEKEM

SEQ ID NO: 1229629 - protein, 9 aa, Homo Sapiens
EIYTHFTCV

SEQ ID NO: 1229630 - protein, 9 aa, Homo Sapiens
NFLMGNGRH

SEQ ID NO: 1229631 - protein, 9 aa, Homo Sapiens
TPPGHHSVI

SEQ ID NO: 1229632 - protein, 9 aa, Homo Sapiens
ITFPYPYAK

SEQ ID NO: 1229633 - protein, 9 aa, Homo Sapiens
DEQGDIEDD

SEQ ID NO: 1229634 - protein, 9 aa, Homo Sapiens
YTDGPDGSG

SEQ ID NO: 1229635 - protein, 9 aa, Homo Sapiens
WTHGRGMVV

SEQ ID NO: 1229636 - protein, 9 aa, Homo Sapiens
LISSDNLTV

SEQ ID NO: 1229637 - protein, 9 aa, Homo Sapiens
KEPFVFASM

SEQ ID NO: 1229638 - protein, 9 aa, Homo Sapiens
LHRLLAEEE

SEQ ID NO: 1229639 - protein, 9 aa, Homo Sapiens
LELKKALVT

SEQ ID NO: 1229640 - protein, 9 aa, Homo Sapiens
AALRADPSW

SEQ ID NO: 1229641 - protein, 9 aa, Homo Sapiens
RPTGGAVLH

SEQ ID NO: 1229642 - protein, 9 aa, Homo Sapiens
ADRAAIISR

SEQ ID NO: 1229643 - protein, 9 aa, Homo Sapiens
KGFIISNAM

SEQ ID NO: 1229644 - protein, 9 aa, Homo Sapiens
TDTPGFGEQ

SEQ ID NO: 1229645 - protein, 9 aa, Homo Sapiens
GSTHEPTSS

SEQ ID NO: 1229646 - protein, 9 aa, Homo Sapiens
LDLLMIHGN

SEQ ID NO: 1229647 - protein, 9 aa, Homo Sapiens
KTHKQRITA

SEQ ID NO: 1229648 - protein, 9 aa, Homo Sapiens
DDFLMGMDS

SEQ ID NO: 1229649 - protein, 9 aa, Homo Sapiens
SFVTEGGET

SEQ ID NO: 1229650 - protein, 9 aa, Homo Sapiens
CPMTFGPHG

SEQ ID NO: 1229651 - protein, 9 aa, Homo Sapiens
NLCQLRVLW

SEQ ID NO: 1229652 - protein, 9 aa, Homo Sapiens
SIIGSTNLI

SEQ ID NO: 1229653 - protein, 9 aa, Homo Sapiens
HHYRSHNPT

SEQ ID NO: 1229654 - protein, 9 aa, Homo Sapiens
LVCPPPPLS

SEQ ID NO: 1229655 - protein, 9 aa, Homo Sapiens
ESEIQPAIL

SEQ ID NO: 1229656 - protein, 9 aa, Homo Sapiens
SSSVLRSPA

SEQ ID NO: 1229657 - protein, 9 aa, Homo Sapiens
PTLLTFIGL

SEQ ID NO: 1229658 - protein, 9 aa, Homo Sapiens
MGKSEKIVL

SEQ ID NO: 1229659 - protein, 9 aa, Homo Sapiens
AHTILPEAS

SEQ ID NO: 1229660 - protein, 9 aa, Homo Sapiens
MEAPAPHPR

SEQ ID NO: 1229661 - protein, 9 aa, Homo Sapiens
LAVMAAVGA

SEQ ID NO: 1229662 - protein, 9 aa, Homo Sapiens
CRDTSLNHP

SEQ ID NO: 1229663 - protein, 9 aa, Homo Sapiens
DFLPVLCLA

SEQ ID NO: 1229664 - protein, 9 aa, Homo Sapiens
SPATHYALE

SEQ ID NO: 1229665 - protein, 9 aa, Homo Sapiens
GVESVSVSA

SEQ ID NO: 1229666 - protein, 9 aa, Homo Sapiens
KVCENPKSR

SEQ ID NO: 1229667 - protein, 9 aa, Homo Sapiens
NVPKEASAF

SEQ ID NO: 1229668 - protein, 9 aa, Homo Sapiens
YMKPPVKRQ

SEQ ID NO: 1229669 - protein, 9 aa, Homo Sapiens
HIYTAFDTY

SEQ ID NO: 1229670 - protein, 9 aa, Homo Sapiens
GLTAYVQWH

SEQ ID NO: 1229671 - protein, 9 aa, Homo Sapiens
LALRVVVDR

SEQ ID NO: 1229672 - protein, 9 aa, Homo Sapiens
RTTISQTKQ

SEQ ID NO: 1229673 - protein, 9 aa, Homo Sapiens
WAALFLGMG

SEQ ID NO: 1229674 - protein, 9 aa, Homo Sapiens
IIVRAFTVC

SEQ ID NO: 1229675 - protein, 9 aa, Homo Sapiens
LTAAGPRPR

SEQ ID NO: 1229676 - protein, 9 aa, Homo Sapiens
TFDYLASLQ

SEQ ID NO: 1229677 - protein, 9 aa, Homo Sapiens
EIQSAAFSL

SEQ ID NO: 1229678 - protein, 9 aa, Homo Sapiens
VQCPYIMEE

SEQ ID NO: 1229679 - protein, 9 aa, Homo Sapiens
RLRLDAKIF

SEQ ID NO: 1229680 - protein, 9 aa, Homo Sapiens
SHAGENSLR

SEQ ID NO: 1229681 - protein, 9 aa, Homo Sapiens
MDNFNWGVC

SEQ ID NO: 1229682 - protein, 9 aa, Homo Sapiens
GKKDKKYYD

SEQ ID NO: 1229683 - protein, 9 aa, Homo Sapiens
ISAIDGVNS

SEQ ID NO: 1229684 - protein, 9 aa, Homo Sapiens
TLVCKAGEQ

SEQ ID NO: 1229685 - protein, 9 aa, Homo Sapiens
KITTFDRPT

SEQ ID NO: 1229686 - protein, 9 aa, Homo Sapiens
LKGLFSSVS

SEQ ID NO: 1229687 - protein, 9 aa, Homo Sapiens
SNNGGKWLV

SEQ ID NO: 1229688 - protein, 9 aa, Homo Sapiens
VQGKDIPPI

SEQ ID NO: 1229689 - protein, 9 aa, Homo Sapiens
PLTNKVPEK

SEQ ID NO: 1229690 - protein, 9 aa, Homo Sapiens
PEARLNPPT

SEQ ID NO: 1229691 - protein, 9 aa, Homo Sapiens
AGYVSQVAE

SEQ ID NO: 1229692 - protein, 9 aa, Homo Sapiens
ADILKALVR

SEQ ID NO: 1229693 - protein, 9 aa, Homo Sapiens
VVTKSQPVM

SEQ ID NO: 1229694 - protein, 9 aa, Homo Sapiens
QRRTQSLQP

SEQ ID NO: 1229695 - protein, 9 aa, Homo Sapiens
YKIKDGDGQ

SEQ ID NO: 1229696 - protein, 9 aa, Homo Sapiens
SWSPPGPAG

SEQ ID NO: 1229697 - protein, 9 aa, Homo Sapiens
RKSKHKRHT

SEQ ID NO: 1229698 - protein, 9 aa, Homo Sapiens
YTMLYKPSP

SEQ ID NO: 1229699 - protein, 9 aa, Homo Sapiens
PGTPLPPPV

SEQ ID NO: 1229700 - protein, 9 aa, Homo Sapiens
MYSASKVFV

SEQ ID NO: 1229701 - protein, 9 aa, Homo Sapiens
TTTSPDSGV

SEQ ID NO: 1229702 - protein, 9 aa, Homo Sapiens
HTQTKFEDA

SEQ ID NO: 1229703 - protein, 9 aa, Homo Sapiens
TADHCISRD

SEQ ID NO: 1229704 - protein, 9 aa, Homo Sapiens
LIMIFCSTF

SEQ ID NO: 1229705 - protein, 9 aa, Homo Sapiens
KQFANVQPI

SEQ ID NO: 1229706 - protein, 9 aa, Homo Sapiens
VIITSEYIF

SEQ ID NO: 1229707 - protein, 9 aa, Homo Sapiens
APDDQGPWR

SEQ ID NO: 1229708 - protein, 9 aa, Homo Sapiens
FFRKWDDYR

SEQ ID NO: 1229709 - protein, 9 aa, Homo Sapiens
ALPHTHESQ

SEQ ID NO: 1229710 - protein, 9 aa, Homo Sapiens
ERDTKEAIT

SEQ ID NO: 1229711 - protein, 9 aa, Homo Sapiens
KLRDAIKGM

SEQ ID NO: 1229712 - protein, 9 aa, Homo Sapiens
PTSIDSVII

SEQ ID NO: 1229713 - protein, 9 aa, Homo Sapiens
GIYASIKAD

SEQ ID NO: 1229714 - protein, 9 aa, Homo Sapiens
RQQQLEEMC

SEQ ID NO: 1229715 - protein, 9 aa, Homo Sapiens
PFHREKEVS

SEQ ID NO: 1229716 - protein, 9 aa, Homo Sapiens
MAKFAYRGI

SEQ ID NO: 1229717 - protein, 9 aa, Homo Sapiens
GVFLNLVVL

SEQ ID NO: 1229718 - protein, 9 aa, Homo Sapiens
SPSLASCAS

SEQ ID NO: 1229719 - protein, 9 aa, Homo Sapiens
ENSEGPRKY

SEQ ID NO: 1229720 - protein, 9 aa, Homo Sapiens
RELCLEIPG

SEQ ID NO: 1229721 - protein, 9 aa, Homo Sapiens
TENEVIQIF

SEQ ID NO: 1229722 - protein, 9 aa, Homo Sapiens
YIPFYAGMD

SEQ ID NO: 1229723 - protein, 9 aa, Homo Sapiens
RLVEGQVKT

SEQ ID NO: 1229724 - protein, 9 aa, Homo Sapiens
HPFEEGKKI

SEQ ID NO: 1229725 - protein, 9 aa, Homo Sapiens
LHKRCQRRG

SEQ ID NO: 1229726 - protein, 9 aa, Homo Sapiens
NGEIGRDRI

SEQ ID NO: 1229727 - protein, 9 aa, Homo Sapiens
NTEYTVCLF

SEQ ID NO: 1229728 - protein, 9 aa, Homo Sapiens
GTERSPGRC

SEQ ID NO: 1229729 - protein, 9 aa, Homo Sapiens
YSWSTSFWV

SEQ ID NO: 1229730 - protein, 9 aa, Homo Sapiens
PLSRTHSEP

SEQ ID NO: 1229731 - protein, 9 aa, Homo Sapiens
CKAKSCICH

SEQ ID NO: 1229732 - protein, 9 aa, Homo Sapiens
DEAQKLLYC

SEQ ID NO: 1229733 - protein, 9 aa, Homo Sapiens
GNVIYSIRI

SEQ ID NO: 1229734 - protein, 9 aa, Homo Sapiens
PGSSGPGNV

SEQ ID NO: 1229735 - protein, 9 aa, Homo Sapiens
HYLVSWYDL

SEQ ID NO: 1229736 - protein, 9 aa, Homo Sapiens
PLDNDKNCY

SEQ ID NO: 1229737 - protein, 9 aa, Homo Sapiens
KKLCYDQCI

SEQ ID NO: 1229738 - protein, 9 aa, Homo Sapiens
EEDIFRHLC

SEQ ID NO: 1229739 - protein, 9 aa, Homo Sapiens
FHSLEVART

SEQ ID NO: 1229740 - protein, 9 aa, Homo Sapiens
DIVHVTCWF

SEQ ID NO: 1229741 - protein, 9 aa, Homo Sapiens
NMGHESEIQ

SEQ ID NO: 1229742 - protein, 9 aa, Homo Sapiens
LQCEATVIS

SEQ ID NO: 1229743 - protein, 9 aa, Homo Sapiens
RAPSVWEQV

SEQ ID NO: 1229744 - protein, 9 aa, Homo Sapiens
CGRGHRRRG

SEQ ID NO: 1229745 - protein, 9 aa, Homo Sapiens
ADGELTAAP

SEQ ID NO: 1229746 - protein, 9 aa, Homo Sapiens
QTHTVDLYQ

SEQ ID NO: 1229747 - protein, 9 aa, Homo Sapiens
CRETAVSAS

SEQ ID NO: 1229748 - protein, 9 aa, Homo Sapiens
SFQPASSHH

SEQ ID NO: 1229749 - protein, 9 aa, Homo Sapiens
LSPPHPVLL

SEQ ID NO: 1229750 - protein, 9 aa, Homo Sapiens
DHPMSAMNI

SEQ ID NO: 1229751 - protein, 9 aa, Homo Sapiens
VALEVWRSR

SEQ ID NO: 1229752 - protein, 9 aa, Homo Sapiens
TLLKAPDST

SEQ ID NO: 1229753 - protein, 9 aa, Homo Sapiens
LAIQLLKCL

SEQ ID NO: 1229754 - protein, 9 aa, Homo Sapiens
TEEVLQRVN

SEQ ID NO: 1229755 - protein, 9 aa, Homo Sapiens
QMKRMRAFQ

SEQ ID NO: 1229756 - protein, 9 aa, Homo Sapiens
SLNAGAFLL

SEQ ID NO: 1229757 - protein, 9 aa, Homo Sapiens
QQTQFTVIS

SEQ ID NO: 1229758 - protein, 9 aa, Homo Sapiens
ERLKEMLKE

SEQ ID NO: 1229759 - protein, 9 aa, Homo Sapiens
CVDRIIKTL

SEQ ID NO: 1229760 - protein, 9 aa, Homo Sapiens
KPCHPMTNN

SEQ ID NO: 1229761 - protein, 9 aa, Homo Sapiens
SMCSKVRGR

SEQ ID NO: 1229762 - protein, 9 aa, Homo Sapiens
LSCMDTYEM

SEQ ID NO: 1229763 - protein, 9 aa, Homo Sapiens
DRILYRSRH

SEQ ID NO: 1229764 - protein, 9 aa, Homo Sapiens
YELWWFCLL

SEQ ID NO: 1229765 - protein, 9 aa, Homo Sapiens
QGLTEIPSH

SEQ ID NO: 1229766 - protein, 9 aa, Homo Sapiens
IVSGTEGKL

SEQ ID NO: 1229767 - protein, 9 aa, Homo Sapiens
VTRCYRHNR

SEQ ID NO: 1229768 - protein, 9 aa, Homo Sapiens
ILVICRGWL

SEQ ID NO: 1229769 - protein, 9 aa, Homo Sapiens
ALWPSSVLP

SEQ ID NO: 1229770 - protein, 9 aa, Homo Sapiens
LLWERVEKP

SEQ ID NO: 1229771 - protein, 9 aa, Homo Sapiens
VVYCRCWRS

SEQ ID NO: 1229772 - protein, 9 aa, Homo Sapiens
HSAEQFCVS

SEQ ID NO: 1229773 - protein, 9 aa, Homo Sapiens
RNSMSTKKI

SEQ ID NO: 1229774 - protein, 9 aa, Homo Sapiens
FRPNPALNE

SEQ ID NO: 1229775 - protein, 9 aa, Homo Sapiens
ASFTENTDT

SEQ ID NO: 1229776 - protein, 9 aa, Homo Sapiens
GASIVLSRP

SEQ ID NO: 1229777 - protein, 9 aa, Homo Sapiens
FIFVLFFGD

SEQ ID NO: 1229778 - protein, 9 aa, Homo Sapiens
LKESYKTAV

SEQ ID NO: 1229779 - protein, 9 aa, Homo Sapiens
VISDPIPGD

SEQ ID NO: 1229780 - protein, 9 aa, Homo Sapiens
VSTRVSSIP

SEQ ID NO: 1229781 - protein, 9 aa, Homo Sapiens
SPKFHMTTY

SEQ ID NO: 1229782 - protein, 9 aa, Homo Sapiens
TNKIAGPRK

SEQ ID NO: 1229783 - protein, 9 aa, Homo Sapiens
DGLGAPRQV

SEQ ID NO: 1229784 - protein, 9 aa, Homo Sapiens
REQCFTSEV

SEQ ID NO: 1229785 - protein, 9 aa, Homo Sapiens
SDPYDHEDC

SEQ ID NO: 1229786 - protein, 9 aa, Homo Sapiens
GLDWLSQQL

SEQ ID NO: 1229787 - protein, 9 aa, Homo Sapiens
LLTAISTQH

SEQ ID NO: 1229788 - protein, 9 aa, Homo Sapiens
PVVSAAVKG

SEQ ID NO: 1229789 - protein, 9 aa, Homo Sapiens
KSHEYHECG

SEQ ID NO: 1229790 - protein, 9 aa, Homo Sapiens
KPDFFIKTK

SEQ ID NO: 1229791 - protein, 9 aa, Homo Sapiens
QVILDGLSN

SEQ ID NO: 1229792 - protein, 9 aa, Homo Sapiens
SRHGKLCSN

SEQ ID NO: 1229793 - protein, 9 aa, Homo Sapiens
KRLRKKHRQ

SEQ ID NO: 1229794 - protein, 9 aa, Homo Sapiens
GSGSSEDDE

SEQ ID NO: 1229795 - protein, 9 aa, Homo Sapiens
KEGKPTPPV

SEQ ID NO: 1229796 - protein, 9 aa, Homo Sapiens
TTVKYSKIH

SEQ ID NO: 1229797 - protein, 9 aa, Homo Sapiens
VVISVEVFL

SEQ ID NO: 1229798 - protein, 9 aa, Homo Sapiens
ENSVAERLH

SEQ ID NO: 1229799 - protein, 9 aa, Homo Sapiens
VIIVSISSQ

SEQ ID NO: 1229800 - protein, 9 aa, Homo Sapiens
KLGRWCAVH

SEQ ID NO: 1229801 - protein, 9 aa, Homo Sapiens
YVKHCRNLQ

SEQ ID NO: 1229802 - protein, 9 aa, Homo Sapiens
GHHGDDLKL

SEQ ID NO: 1229803 - protein, 9 aa, Homo Sapiens
LLVVGCVSC

SEQ ID NO: 1229804 - protein, 9 aa, Homo Sapiens
MVRVQGPGI

SEQ ID NO: 1229805 - protein, 9 aa, Homo Sapiens
IKKRFVAGK

SEQ ID NO: 1229806 - protein, 9 aa, Homo Sapiens
DPGGERGLW

SEQ ID NO: 1229807 - protein, 9 aa, Homo Sapiens
RGGLSPGAL

SEQ ID NO: 1229808 - protein, 9 aa, Homo Sapiens
LGPQDLKES

SEQ ID NO: 1229809 - protein, 9 aa, Homo Sapiens
MIQAIPFDD

SEQ ID NO: 1229810 - protein, 9 aa, Homo Sapiens
LSHLKCTVE

SEQ ID NO: 1229811 - protein, 9 aa, Homo Sapiens
RKKSITKNV

SEQ ID NO: 1229812 - protein, 9 aa, Homo Sapiens
TDIIDCLEQ

SEQ ID NO: 1229813 - protein, 9 aa, Homo Sapiens
EAKLDHCRH

SEQ ID NO: 1229814 - protein, 9 aa, Homo Sapiens
TPDVSFLPE

SEQ ID NO: 1229815 - protein, 9 aa, Homo Sapiens
NLLEFLQRS

SEQ ID NO: 1229816 - protein, 9 aa, Homo Sapiens
ILIYHDRTH

SEQ ID NO: 1229817 - protein, 9 aa, Homo Sapiens
VQHIQQPLD

SEQ ID NO: 1229818 - protein, 9 aa, Homo Sapiens
GITGMHHHG

SEQ ID NO: 1229819 - protein, 9 aa, Homo Sapiens
MNGQGLAGF

SEQ ID NO: 1229820 - protein, 9 aa, Homo Sapiens
GECVTEVKT

SEQ ID NO: 1229821 - protein, 9 aa, Homo Sapiens
LIMLPSSSA

SEQ ID NO: 1229822 - protein, 9 aa, Homo Sapiens
SWTALECAE

SEQ ID NO: 1229823 - protein, 9 aa, Homo Sapiens
PGPRGSPAF

SEQ ID NO: 1229824 - protein, 9 aa, Homo Sapiens
DEDLLFHGE

SEQ ID NO: 1229825 - protein, 9 aa, Homo Sapiens
DNGSNLQCE

SEQ ID NO: 1229826 - protein, 9 aa, Homo Sapiens
SPAPCDGAG

SEQ ID NO: 1229827 - protein, 9 aa, Homo Sapiens
AERKKEKAS

SEQ ID NO: 1229828 - protein, 9 aa, Homo Sapiens
LPMPFNPTL

SEQ ID NO: 1229829 - protein, 9 aa, Homo Sapiens
KRAHEDISR

SEQ ID NO: 1229830 - protein, 9 aa, Homo Sapiens
CEHVQAWLR

SEQ ID NO: 1229831 - protein, 9 aa, Homo Sapiens
EEVMLSTYF

SEQ ID NO: 1229832 - protein, 9 aa, Homo Sapiens
DEASRLLAD

SEQ ID NO: 1229833 - protein, 9 aa, Homo Sapiens
VSKKIGQWP

SEQ ID NO: 1229834 - protein, 9 aa, Homo Sapiens
PFDPLSFSP

SEQ ID NO: 1229835 - protein, 9 aa, Homo Sapiens
HRCRHQSPD

SEQ ID NO: 1229836 - protein, 9 aa, Homo Sapiens
LAPGMCVVD

SEQ ID NO: 1229837 - protein, 9 aa, Homo Sapiens
TSITEMEIS

SEQ ID NO: 1229838 - protein, 9 aa, Homo Sapiens
DVLYKMTAY

SEQ ID NO: 1229839 - protein, 9 aa, Homo Sapiens
SVNDLHQEE

SEQ ID NO: 1229840 - protein, 9 aa, Homo Sapiens
DVNDNKSIF

SEQ ID NO: 1229841 - protein, 9 aa, Homo Sapiens
ITLLDLINF

SEQ ID NO: 1229842 - protein, 9 aa, Homo Sapiens
MSLLFITSV

SEQ ID NO: 1229843 - protein, 9 aa, Homo Sapiens
CMEEKNQVV

SEQ ID NO: 1229844 - protein, 9 aa, Homo Sapiens
KAKTFQIDD

SEQ ID NO: 1229845 - protein, 9 aa, Homo Sapiens
VGYFVSNDS

SEQ ID NO: 1229846 - protein, 9 aa, Homo Sapiens
EEDSSEVGP

SEQ ID NO: 1229847 - protein, 9 aa, Homo Sapiens
ARLEFFDHN

SEQ ID NO: 1229848 - protein, 9 aa, Homo Sapiens
AINIRDILI

SEQ ID NO: 1229849 - protein, 9 aa, Homo Sapiens
IKTRNQGIR

SEQ ID NO: 1229850 - protein, 9 aa, Homo Sapiens
DPEVRRATV

SEQ ID NO: 1229851 - protein, 9 aa, Homo Sapiens
KLMIIVGAS

SEQ ID NO: 1229852 - protein, 9 aa, Homo Sapiens
TIKLNAENT

SEQ ID NO: 1229853 - protein, 9 aa, Homo Sapiens
YLCVMSERQ

SEQ ID NO: 1229854 - protein, 9 aa, Homo Sapiens
FWREFTASF

SEQ ID NO: 1229855 - protein, 9 aa, Homo Sapiens
TFNVPVFWP

SEQ ID NO: 1229856 - protein, 9 aa, Homo Sapiens
EATHYIAPT

SEQ ID NO: 1229857 - protein, 9 aa, Homo Sapiens
VTPYWTSPE

SEQ ID NO: 1229858 - protein, 9 aa, Homo Sapiens
HVGHAGLEL

SEQ ID NO: 1229859 - protein, 9 aa, Homo Sapiens
VASQHSLPM

SEQ ID NO: 1229860 - protein, 9 aa, Homo Sapiens
TLFLGVTIG

SEQ ID NO: 1229861 - protein, 9 aa, Homo Sapiens
CKLSFEYVR

SEQ ID NO: 1229862 - protein, 9 aa, Homo Sapiens
RTGLYKSHR

SEQ ID NO: 1229863 - protein, 9 aa, Homo Sapiens
INIKPARKY

SEQ ID NO: 1229864 - protein, 9 aa, Homo Sapiens
MRVARSLGE

SEQ ID NO: 1229865 - protein, 9 aa, Homo Sapiens
PSTLWKSKL

SEQ ID NO: 1229866 - protein, 9 aa, Homo Sapiens
VHDEYIFIQ

SEQ ID NO: 1229867 - protein, 9 aa, Homo Sapiens
RCQTHISLP

SEQ ID NO: 1229868 - protein, 9 aa, Homo Sapiens
KKEGENIRK

SEQ ID NO: 1229869 - protein, 9 aa, Homo Sapiens
TDIIDHIFA

SEQ ID NO: 1229870 - protein, 9 aa, Homo Sapiens
LDVHEKTHT

SEQ ID NO: 1229871 - protein, 9 aa, Homo Sapiens
PCHFHRLIL

SEQ ID NO: 1229872 - protein, 9 aa, Homo Sapiens
ILQLGGRGA

SEQ ID NO: 1229873 - protein, 9 aa, Homo Sapiens
DVMDAVPVR

SEQ ID NO: 1229874 - protein, 9 aa, Homo Sapiens
LTSVIYTDT

SEQ ID NO: 1229875 - protein, 9 aa, Homo Sapiens
KVDIVLGPI

SEQ ID NO: 1229876 - protein, 9 aa, Homo Sapiens
LSLSSPQVS

SEQ ID NO: 1229877 - protein, 9 aa, Homo Sapiens
ERSPGRCAP

SEQ ID NO: 1229878 - protein, 9 aa, Homo Sapiens
INSPTKILP

SEQ ID NO: 1229879 - protein, 9 aa, Homo Sapiens
YSAALGMFN

SEQ ID NO: 1229880 - protein, 9 aa, Homo Sapiens
TFSKQPSTG

SEQ ID NO: 1229881 - protein, 9 aa, Homo Sapiens
NKQAVPGFI

SEQ ID NO: 1229882 - protein, 9 aa, Homo Sapiens
SFFVLHHNV

SEQ ID NO: 1229883 - protein, 9 aa, Homo Sapiens
KRFLKYAEK

SEQ ID NO: 1229884 - protein, 9 aa, Homo Sapiens
NSKLRLSFS

SEQ ID NO: 1229885 - protein, 9 aa, Homo Sapiens
IKKGCLSSL

SEQ ID NO: 1229886 - protein, 9 aa, Homo Sapiens
YQHWQLKYP

SEQ ID NO: 1229887 - protein, 9 aa, Homo Sapiens
DLEIEGRDC

SEQ ID NO: 1229888 - protein, 9 aa, Homo Sapiens
FKYFCRHEM

SEQ ID NO: 1229889 - protein, 9 aa, Homo Sapiens
VPVGIMAVT

SEQ ID NO: 1229890 - protein, 9 aa, Homo Sapiens
RILYQFSRC

SEQ ID NO: 1229891 - protein, 9 aa, Homo Sapiens
ATATVSAVI

SEQ ID NO: 1229892 - protein, 9 aa, Homo Sapiens
TLPGTCTGN

SEQ ID NO: 1229893 - protein, 9 aa, Homo Sapiens
RATDIWSLG

SEQ ID NO: 1229894 - protein, 9 aa, Homo Sapiens
RVLAEPNRI

SEQ ID NO: 1229895 - protein, 9 aa, Homo Sapiens
PKKFRHPAI

SEQ ID NO: 1229896 - protein, 9 aa, Homo Sapiens
SYHTLDEIY

SEQ ID NO: 1229897 - protein, 9 aa, Homo Sapiens
AQETLNSHG

SEQ ID NO: 1229898 - protein, 9 aa, Homo Sapiens
SSSIEQASL

SEQ ID NO: 1229899 - protein, 9 aa, Homo Sapiens
APDWVVTAD

SEQ ID NO: 1229900 - protein, 9 aa, Homo Sapiens
QSKHRASNE

SEQ ID NO: 1229901 - protein, 9 aa, Homo Sapiens
DSAPCDWFG

SEQ ID NO: 1229902 - protein, 9 aa, Homo Sapiens
PVSDDTCYR

SEQ ID NO: 1229903 - protein, 9 aa, Homo Sapiens
TQSLQPVVS

SEQ ID NO: 1229904 - protein, 9 aa, Homo Sapiens
FTDAQDPDL

SEQ ID NO: 1229905 - protein, 9 aa, Homo Sapiens
SCKCIGSSY

SEQ ID NO: 1229906 - protein, 9 aa, Homo Sapiens
VLNKNRHPN

SEQ ID NO: 1229907 - protein, 9 aa, Homo Sapiens
QSPAAQPLQ

SEQ ID NO: 1229908 - protein, 9 aa, Homo Sapiens
LSLTMSSAW

SEQ ID NO: 1229909 - protein, 9 aa, Homo Sapiens
VYRRESVKS

SEQ ID NO: 1229910 - protein, 9 aa, Homo Sapiens
GPPGPPGVH

SEQ ID NO: 1229911 - protein, 9 aa, Homo Sapiens
AVRVGCLQV

SEQ ID NO: 1229912 - protein, 9 aa, Homo Sapiens
ASGAYIFRH

SEQ ID NO: 1229913 - protein, 9 aa, Homo Sapiens
RAGNVVSKL

SEQ ID NO: 1229914 - protein, 9 aa, Homo Sapiens
NKCMVEYEE

SEQ ID NO: 1229915 - protein, 9 aa, Homo Sapiens
HILHSLGWT

SEQ ID NO: 1229916 - protein, 9 aa, Homo Sapiens
TPHFICIQD

SEQ ID NO: 1229917 - protein, 9 aa, Homo Sapiens
RPRGMMKNH

SEQ ID NO: 1229918 - protein, 9 aa, Homo Sapiens
SKLEKQLMK

SEQ ID NO: 1229919 - protein, 9 aa, Homo Sapiens
LVTVLCDIK

SEQ ID NO: 1229920 - protein, 9 aa, Homo Sapiens
SFPILLYSL

SEQ ID NO: 1229921 - protein, 9 aa, Homo Sapiens
EQLYLDPGQ

SEQ ID NO: 1229922 - protein, 9 aa, Homo Sapiens
HRKTGRKVA

SEQ ID NO: 1229923 - protein, 9 aa, Homo Sapiens
FEGADIHKM

SEQ ID NO: 1229924 - protein, 9 aa, Homo Sapiens
THSVTWSVT

SEQ ID NO: 1229925 - protein, 9 aa, Homo Sapiens
HLAVPPHGA

SEQ ID NO: 1229926 - protein, 9 aa, Homo Sapiens
EKNQVVCHD

SEQ ID NO: 1229927 - protein, 9 aa, Homo Sapiens
RVGAGHKSH

SEQ ID NO: 1229928 - protein, 9 aa, Homo Sapiens
ISCFWETHP

SEQ ID NO: 1229929 - protein, 9 aa, Homo Sapiens
VQIANGMYY

SEQ ID NO: 1229930 - protein, 9 aa, Homo Sapiens
RPPPPATLI

SEQ ID NO: 1229931 - protein, 9 aa, Homo Sapiens
LTCCQCCPG

SEQ ID NO: 1229932 - protein, 9 aa, Homo Sapiens
DTMKRLPRN

SEQ ID NO: 1229933 - protein, 9 aa, Homo Sapiens
LCDATRLES

SEQ ID NO: 1229934 - protein, 9 aa, Homo Sapiens
LNRLVQPRR

SEQ ID NO: 1229935 - protein, 9 aa, Homo Sapiens
QDEAMTEGN

SEQ ID NO: 1229936 - protein, 9 aa, Homo Sapiens
LEILDESDM

SEQ ID NO: 1229937 - protein, 9 aa, Homo Sapiens
DPCEQLLIL

SEQ ID NO: 1229938 - protein, 9 aa, Homo Sapiens
GIQFEDFVC

SEQ ID NO: 1229939 - protein, 9 aa, Homo Sapiens
LEMRVIRWF

SEQ ID NO: 1229940 - protein, 9 aa, Homo Sapiens
WPPSFSAPC

SEQ ID NO: 1229941 - protein, 9 aa, Homo Sapiens
LSTLVDAQL

SEQ ID NO: 1229942 - protein, 9 aa, Homo Sapiens
ADQTSEWDS

SEQ ID NO: 1229943 - protein, 9 aa, Homo Sapiens
LLNQHAYAV

SEQ ID NO: 1229944 - protein, 9 aa, Homo Sapiens
LFSNYITMD

SEQ ID NO: 1229945 - protein, 9 aa, Homo Sapiens
EVIITSEYI

SEQ ID NO: 1229946 - protein, 9 aa, Homo Sapiens
AIILDFYNP

SEQ ID NO: 1229947 - protein, 9 aa, Homo Sapiens
TTRSLATKP

SEQ ID NO: 1229948 - protein, 9 aa, Homo Sapiens
RVSHTRNDK

SEQ ID NO: 1229949 - protein, 9 aa, Homo Sapiens
DDVPLSVLI

SEQ ID NO: 1229950 - protein, 9 aa, Homo Sapiens
PPYPRPAFA

SEQ ID NO: 1229951 - protein, 9 aa, Homo Sapiens
DVQKVLCAE

SEQ ID NO: 1229952 - protein, 9 aa, Homo Sapiens
CPTPGAADF

SEQ ID NO: 1229953 - protein, 9 aa, Homo Sapiens
QGHCTDWES

SEQ ID NO: 1229954 - protein, 9 aa, Homo Sapiens
KPQAHGDPA

SEQ ID NO: 1229955 - protein, 9 aa, Homo Sapiens
GFDSHQMND

SEQ ID NO: 1229956 - protein, 9 aa, Homo Sapiens
AIQTMKLRN

SEQ ID NO: 1229957 - protein, 9 aa, Homo Sapiens
TVKPSSPVR

SEQ ID NO: 1229958 - protein, 9 aa, Homo Sapiens
FDNNKTVLE

SEQ ID NO: 1229959 - protein, 9 aa, Homo Sapiens
SPVVKNSIM

SEQ ID NO: 1229960 - protein, 9 aa, Homo Sapiens
EDEEPPRVI

SEQ ID NO: 1229961 - protein, 9 aa, Homo Sapiens
CLSVVFKGA

SEQ ID NO: 1229962 - protein, 9 aa, Homo Sapiens
MNKHLRGGG

SEQ ID NO: 1229963 - protein, 9 aa, Homo Sapiens
QGPSPGSHG

SEQ ID NO: 1229964 - protein, 9 aa, Homo Sapiens
EVQTRVKLN

SEQ ID NO: 1229965 - protein, 9 aa, Homo Sapiens
EGGSRNQEE

SEQ ID NO: 1229966 - protein, 9 aa, Homo Sapiens
KDEDAKKNL

SEQ ID NO: 1229967 - protein, 9 aa, Homo Sapiens
KVDQLQDET

SEQ ID NO: 1229968 - protein, 9 aa, Homo Sapiens
SCLKSTPIV

SEQ ID NO: 1229969 - protein, 9 aa, Homo Sapiens
RYSIISSTI

SEQ ID NO: 1229970 - protein, 9 aa, Homo Sapiens
TTAAFVAAI

SEQ ID NO: 1229971 - protein, 9 aa, Homo Sapiens
RRHFKVASL

SEQ ID NO: 1229972 - protein, 9 aa, Homo Sapiens
QEEIDTLES

SEQ ID NO: 1229973 - protein, 9 aa, Homo Sapiens
YQVIASVKN

SEQ ID NO: 1229974 - protein, 9 aa, Homo Sapiens
GSASNQQFA

SEQ ID NO: 1229975 - protein, 9 aa, Homo Sapiens
SSVLPTLSS

SEQ ID NO: 1229976 - protein, 9 aa, Homo Sapiens
FLARMFKLL

SEQ ID NO: 1229977 - protein, 9 aa, Homo Sapiens
TDAMAPDVE

SEQ ID NO: 1229978 - protein, 9 aa, Homo Sapiens
PSSASRYHH

SEQ ID NO: 1229979 - protein, 9 aa, Homo Sapiens
RFTKASQGR

SEQ ID NO: 1229980 - protein, 9 aa, Homo Sapiens
RQKQESLMV

SEQ ID NO: 1229981 - protein, 9 aa, Homo Sapiens
NTKERPATD

SEQ ID NO: 1229982 - protein, 9 aa, Homo Sapiens
RKTLFPREA

SEQ ID NO: 1229983 - protein, 9 aa, Homo Sapiens
SAPAEATSW

SEQ ID NO: 1229984 - protein, 9 aa, Homo Sapiens
VNKRRRNRC

SEQ ID NO: 1229985 - protein, 9 aa, Homo Sapiens
EEETTQLAK

SEQ ID NO: 1229986 - protein, 9 aa, Homo Sapiens
GCTNVCYDV

SEQ ID NO: 1229987 - protein, 9 aa, Homo Sapiens
CNGFALSDQ

SEQ ID NO: 1229988 - protein, 9 aa, Homo Sapiens
NKIYYLLET

SEQ ID NO: 1229989 - protein, 9 aa, Homo Sapiens
YSIISSTIM

SEQ ID NO: 1229990 - protein, 9 aa, Homo Sapiens
VCLKKHTAS

SEQ ID NO: 1229991 - protein, 9 aa, Homo Sapiens
DDYTVMPES

SEQ ID NO: 1229992 - protein, 9 aa, Homo Sapiens
YKPRFVHIR

SEQ ID NO: 1229993 - protein, 9 aa, Homo Sapiens
RRRVITLPQ

SEQ ID NO: 1229994 - protein, 9 aa, Homo Sapiens
WINVFQEDS

SEQ ID NO: 1229995 - protein, 9 aa, Homo Sapiens
IQKFEFETG

SEQ ID NO: 1229996 - protein, 9 aa, Homo Sapiens
EFNILKNIF

SEQ ID NO: 1229997 - protein, 9 aa, Homo Sapiens
MDPTWHPWL

SEQ ID NO: 1229998 - protein, 9 aa, Homo Sapiens
LWLKGDKCS

SEQ ID NO: 1229999 - protein, 9 aa, Homo Sapiens
VAIAPIPGT

SEQ ID NO: 1230000 - protein, 9 aa, Homo Sapiens
VTFDDIAVY

SEQ ID NO: 1230001 - protein, 9 aa, Homo Sapiens
SSVSAELLL

SEQ ID NO: 1230002 - protein, 9 aa, Homo Sapiens
LSHGGSWSR

SEQ ID NO: 1230003 - protein, 9 aa, Homo Sapiens
AFDQNSYFY

SEQ ID NO: 1230004 - protein, 9 aa, Homo Sapiens
YCVVFPLEL

SEQ ID NO: 1230005 - protein, 9 aa, Homo Sapiens
IRTLQKRLR

SEQ ID NO: 1230006 - protein, 9 aa, Homo Sapiens
EDEQGDIED

SEQ ID NO: 1230007 - protein, 9 aa, Homo Sapiens
DKKRQCKRN

SEQ ID NO: 1230008 - protein, 9 aa, Homo Sapiens
LSQPFRLEN

SEQ ID NO: 1230009 - protein, 9 aa, Homo Sapiens
SMSTIGNMM

SEQ ID NO: 1230010 - protein, 9 aa, Homo Sapiens
AQAFPQADI

SEQ ID NO: 1230011 - protein, 9 aa, Homo Sapiens
PAEMRDGPQ

SEQ ID NO: 1230012 - protein, 9 aa, Homo Sapiens
IGRDRIVTG

SEQ ID NO: 1230013 - protein, 9 aa, Homo Sapiens
VFQKYVGKD

SEQ ID NO: 1230014 - protein, 9 aa, Homo Sapiens
MARGTDVPE

SEQ ID NO: 1230015 - protein, 9 aa, Homo Sapiens
MGNMIRGIG

SEQ ID NO: 1230016 - protein, 9 aa, Homo Sapiens
IPGLEKVHF

SEQ ID NO: 1230017 - protein, 9 aa, Homo Sapiens
KVNAVFEWY

SEQ ID NO: 1230018 - protein, 9 aa, Homo Sapiens
IMNAIKLQP

SEQ ID NO: 1230019 - protein, 9 aa, Homo Sapiens
DKQGRIMSR

SEQ ID NO: 1230020 - protein, 9 aa, Homo Sapiens
NLLIPTVGS

SEQ ID NO: 1230021 - protein, 9 aa, Homo Sapiens
CDVEDGTMY

SEQ ID NO: 1230022 - protein, 9 aa, Homo Sapiens
QPAAKDPSA

SEQ ID NO: 1230023 - protein, 9 aa, Homo Sapiens
NIKPARKYR

SEQ ID NO: 1230024 - protein, 9 aa, Homo Sapiens
QELNASLGS

SEQ ID NO: 1230025 - protein, 9 aa, Homo Sapiens
NAGDNRAII

SEQ ID NO: 1230026 - protein, 9 aa, Homo Sapiens
EKRHRMRSK

SEQ ID NO: 1230027 - protein, 9 aa, Homo Sapiens
RQGCLRALF

SEQ ID NO: 1230028 - protein, 9 aa, Homo Sapiens
HISVKNHSL

SEQ ID NO: 1230029 - protein, 9 aa, Homo Sapiens
VGLTGAHLR

SEQ ID NO: 1230030 - protein, 9 aa, Homo Sapiens
RHMLIHVTS

SEQ ID NO: 1230031 - protein, 9 aa, Homo Sapiens
NVKRFQKKL

SEQ ID NO: 1230032 - protein, 9 aa, Homo Sapiens
SQISRILLS

SEQ ID NO: 1230033 - protein, 9 aa, Homo Sapiens
RYKDLCTHV

SEQ ID NO: 1230034 - protein, 9 aa, Homo Sapiens
VNLVTQQIS

SEQ ID NO: 1230035 - protein, 9 aa, Homo Sapiens
QLKSSSKRQ

SEQ ID NO: 1230036 - protein, 9 aa, Homo Sapiens
EDWEMKEDQ

SEQ ID NO: 1230037 - protein, 9 aa, Homo Sapiens
SLDEWRKKC

SEQ ID NO: 1230038 - protein, 9 aa, Homo Sapiens
ITRTINEVE

SEQ ID NO: 1230039 - protein, 9 aa, Homo Sapiens
HLSAVAILQ

SEQ ID NO: 1230040 - protein, 9 aa, Homo Sapiens
METQSMIVV

SEQ ID NO: 1230041 - protein, 9 aa, Homo Sapiens
YQDAHGPRE

SEQ ID NO: 1230042 - protein, 9 aa, Homo Sapiens
RSLATKPLS

SEQ ID NO: 1230043 - protein, 9 aa, Homo Sapiens
PFVFASMRI

SEQ ID NO: 1230044 - protein, 9 aa, Homo Sapiens
IATTPNATF

SEQ ID NO: 1230045 - protein, 9 aa, Homo Sapiens
VSLAAAWDG

SEQ ID NO: 1230046 - protein, 9 aa, Homo Sapiens
GGTVAAAVL

SEQ ID NO: 1230047 - protein, 9 aa, Homo Sapiens
SERHAPPGS

SEQ ID NO: 1230048 - protein, 9 aa, Homo Sapiens
YRPAGHEWR

SEQ ID NO: 1230049 - protein, 9 aa, Homo Sapiens
VTFVLFLND

SEQ ID NO: 1230050 - protein, 9 aa, Homo Sapiens
NAAIGSVFS

SEQ ID NO: 1230051 - protein, 9 aa, Homo Sapiens
CLSSANGNG

SEQ ID NO: 1230052 - protein, 9 aa, Homo Sapiens
KMSGKARVQ

SEQ ID NO: 1230053 - protein, 9 aa, Homo Sapiens
PGLGECVTE

SEQ ID NO: 1230054 - protein, 9 aa, Homo Sapiens
DEEEEELEE

SEQ ID NO: 1230055 - protein, 9 aa, Homo Sapiens
GEEWERCPQ

SEQ ID NO: 1230056 - protein, 9 aa, Homo Sapiens
IVNAVGNHL

SEQ ID NO: 1230057 - protein, 9 aa, Homo Sapiens
MTKSTSVSG

SEQ ID NO: 1230058 - protein, 9 aa, Homo Sapiens
NASLGSWMA

SEQ ID NO: 1230059 - protein, 9 aa, Homo Sapiens
CSSHLSVIA

SEQ ID NO: 1230060 - protein, 9 aa, Homo Sapiens
PLHQPSSPS

SEQ ID NO: 1230061 - protein, 9 aa, Homo Sapiens
PAGEGMGSS

SEQ ID NO: 1230062 - protein, 9 aa, Homo Sapiens
RTPRSTSTT

SEQ ID NO: 1230063 - protein, 9 aa, Homo Sapiens
QLEEIKEAF

SEQ ID NO: 1230064 - protein, 9 aa, Homo Sapiens
GKPNNAHYF

SEQ ID NO: 1230065 - protein, 9 aa, Homo Sapiens
GWVTRLSSL

SEQ ID NO: 1230066 - protein, 9 aa, Homo Sapiens
NLWKQNSHK

SEQ ID NO: 1230067 - protein, 9 aa, Homo Sapiens
TNLIVYITQ

SEQ ID NO: 1230068 - protein, 9 aa, Homo Sapiens
VSPIINVIN

SEQ ID NO: 1230069 - protein, 9 aa, Homo Sapiens
FVHIANMCA

SEQ ID NO: 1230070 - protein, 9 aa, Homo Sapiens
VITIPRPSV

SEQ ID NO: 1230071 - protein, 9 aa, Homo Sapiens
RNLIVAVAP

SEQ ID NO: 1230072 - protein, 9 aa, Homo Sapiens
TMFQYGRTS

SEQ ID NO: 1230073 - protein, 9 aa, Homo Sapiens
EEGPGGDLV

SEQ ID NO: 1230074 - protein, 9 aa, Homo Sapiens
DFLKCNATS

SEQ ID NO: 1230075 - protein, 9 aa, Homo Sapiens
PCQIHIGFP

SEQ ID NO: 1230076 - protein, 9 aa, Homo Sapiens
PGPSACPCM

SEQ ID NO: 1230077 - protein, 9 aa, Homo Sapiens
TSLARDALV

SEQ ID NO: 1230078 - protein, 9 aa, Homo Sapiens
VRTKAAGGP

SEQ ID NO: 1230079 - protein, 9 aa, Homo Sapiens
CRQLAEKRI

SEQ ID NO: 1230080 - protein, 9 aa, Homo Sapiens
KKLDCGCLL

SEQ ID NO: 1230081 - protein, 9 aa, Homo Sapiens
FQKVKTGSK

SEQ ID NO: 1230082 - protein, 9 aa, Homo Sapiens
CQPLTRLST

SEQ ID NO: 1230083 - protein, 9 aa, Homo Sapiens
EPAMRGSPG

SEQ ID NO: 1230084 - protein, 9 aa, Homo Sapiens
SGDGAQGEG

SEQ ID NO: 1230085 - protein, 9 aa, Homo Sapiens
NEHLAIARQ

SEQ ID NO: 1230086 - protein, 9 aa, Homo Sapiens
MDYASWGIR

SEQ ID NO: 1230087 - protein, 9 aa, Homo Sapiens
NERVVNRVS

SEQ ID NO: 1230088 - protein, 9 aa, Homo Sapiens
LNNGSHMTV

SEQ ID NO: 1230089 - protein, 9 aa, Homo Sapiens
RREDIVGTM

SEQ ID NO: 1230090 - protein, 9 aa, Homo Sapiens
VLAAGDYSP

SEQ ID NO: 1230091 - protein, 9 aa, Homo Sapiens
YLFEMDSSM

SEQ ID NO: 1230092 - protein, 9 aa, Homo Sapiens
LPQVPVRSS

SEQ ID NO: 1230093 - protein, 9 aa, Homo Sapiens
LQVEVLSRQ

SEQ ID NO: 1230094 - protein, 9 aa, Homo Sapiens
CPLNIYYVR

SEQ ID NO: 1230095 - protein, 9 aa, Homo Sapiens
SQGFHMLFY

SEQ ID NO: 1230096 - protein, 9 aa, Homo Sapiens
WQRWGLLRA

SEQ ID NO: 1230097 - protein, 9 aa, Homo Sapiens
GLRDTMTPG

SEQ ID NO: 1230098 - protein, 9 aa, Homo Sapiens
PPDYYGYEE

SEQ ID NO: 1230099 - protein, 9 aa, Homo Sapiens
VLTNVFREE

SEQ ID NO: 1230100 - protein, 9 aa, Homo Sapiens
VCRLLENRE

SEQ ID NO: 1230101 - protein, 9 aa, Homo Sapiens
QSCPTIRIP

SEQ ID NO: 1230102 - protein, 9 aa, Homo Sapiens
INPKFLSGK

SEQ ID NO: 1230103 - protein, 9 aa, Homo Sapiens
AWLGLNVFL

SEQ ID NO: 1230104 - protein, 9 aa, Homo Sapiens
EKEHLAVDS

SEQ ID NO: 1230105 - protein, 9 aa, Homo Sapiens
TGSASTHRH

SEQ ID NO: 1230106 - protein, 9 aa, Homo Sapiens
EIANCEKYG

SEQ ID NO: 1230107 - protein, 9 aa, Homo Sapiens
MKLLNQKKG

SEQ ID NO: 1230108 - protein, 9 aa, Homo Sapiens
SVIIGKDQE

SEQ ID NO: 1230109 - protein, 9 aa, Homo Sapiens
HPDCAFMVD

SEQ ID NO: 1230110 - protein, 9 aa, Homo Sapiens
PEVVKDAYD

SEQ ID NO: 1230111 - protein, 9 aa, Homo Sapiens
LIFMTLKNS

SEQ ID NO: 1230112 - protein, 9 aa, Homo Sapiens
KGNITHGCS

SEQ ID NO: 1230113 - protein, 9 aa, Homo Sapiens
MVVEELQSI

SEQ ID NO: 1230114 - protein, 9 aa, Homo Sapiens
YACHKKYCL

SEQ ID NO: 1230115 - protein, 9 aa, Homo Sapiens
ERGLDILKG

SEQ ID NO: 1230116 - protein, 9 aa, Homo Sapiens
VTIFILSGF

SEQ ID NO: 1230117 - protein, 9 aa, Homo Sapiens
PLVYEATRE

SEQ ID NO: 1230118 - protein, 9 aa, Homo Sapiens
AFVYALGDL

SEQ ID NO: 1230119 - protein, 9 aa, Homo Sapiens
ISIASTDTP

SEQ ID NO: 1230120 - protein, 9 aa, Homo Sapiens
NQEHEEKIM

SEQ ID NO: 1230121 - protein, 9 aa, Homo Sapiens
MARLCVCCA

SEQ ID NO: 1230122 - protein, 9 aa, Homo Sapiens
RSGHEEVLA

SEQ ID NO: 1230123 - protein, 9 aa, Homo Sapiens
TSKKHSNTS

SEQ ID NO: 1230124 - protein, 9 aa, Homo Sapiens
PLSVMVSMV

SEQ ID NO: 1230125 - protein, 9 aa, Homo Sapiens
IIPPAGYVS

SEQ ID NO: 1230126 - protein, 9 aa, Homo Sapiens
VHVIRRNES

SEQ ID NO: 1230127 - protein, 9 aa, Homo Sapiens
RDVMSSEGR

SEQ ID NO: 1230128 - protein, 9 aa, Homo Sapiens
THITLGCAA

SEQ ID NO: 1230129 - protein, 9 aa, Homo Sapiens
NLSPEVPSN

SEQ ID NO: 1230130 - protein, 9 aa, Homo Sapiens
EQAEDLKAK

SEQ ID NO: 1230131 - protein, 9 aa, Homo Sapiens
LRNDLSSTS

SEQ ID NO: 1230132 - protein, 9 aa, Homo Sapiens
TWWFGTVES

SEQ ID NO: 1230133 - protein, 9 aa, Homo Sapiens
GNNIRGMMR

SEQ ID NO: 1230134 - protein, 9 aa, Homo Sapiens
HRIHTGEKH

SEQ ID NO: 1230135 - protein, 9 aa, Homo Sapiens
LSEAKAKDS

SEQ ID NO: 1230136 - protein, 9 aa, Homo Sapiens
TMLKPHAPK

SEQ ID NO: 1230137 - protein, 9 aa, Homo Sapiens
SAKMDHPVC

SEQ ID NO: 1230138 - protein, 9 aa, Homo Sapiens
SLGLVAGIP

SEQ ID NO: 1230139 - protein, 9 aa, Homo Sapiens
AENMLETIQ

SEQ ID NO: 1230140 - protein, 9 aa, Homo Sapiens
TGTFSDPCK

SEQ ID NO: 1230141 - protein, 9 aa, Homo Sapiens
EYSVGSDEE

SEQ ID NO: 1230142 - protein, 9 aa, Homo Sapiens
IKVLNTQRA

SEQ ID NO: 1230143 - protein, 9 aa, Homo Sapiens
WMTLSVSEH

SEQ ID NO: 1230144 - protein, 9 aa, Homo Sapiens
LPPYLSSYL

SEQ ID NO: 1230145 - protein, 9 aa, Homo Sapiens
KQLERHQDL

SEQ ID NO: 1230146 - protein, 9 aa, Homo Sapiens
ASGAFQLKK

SEQ ID NO: 1230147 - protein, 9 aa, Homo Sapiens
CRIFSLIGM

SEQ ID NO: 1230148 - protein, 9 aa, Homo Sapiens
MSEAGEEEN

SEQ ID NO: 1230149 - protein, 9 aa, Homo Sapiens
TKDGQILHV

SEQ ID NO: 1230150 - protein, 9 aa, Homo Sapiens
SLSKEDLGL

SEQ ID NO: 1230151 - protein, 9 aa, Homo Sapiens
SPGCVLYTW

SEQ ID NO: 1230152 - protein, 9 aa, Homo Sapiens
SYDKPLNNE

SEQ ID NO: 1230153 - protein, 9 aa, Homo Sapiens
SDTTTMKII

SEQ ID NO: 1230154 - protein, 9 aa, Homo Sapiens
TKIENLRFA

SEQ ID NO: 1230155 - protein, 9 aa, Homo Sapiens
KWPNRISSS

SEQ ID NO: 1230156 - protein, 9 aa, Homo Sapiens
WRKEDGERS

SEQ ID NO: 1230157 - protein, 9 aa, Homo Sapiens
IVSGSDIMR

SEQ ID NO: 1230158 - protein, 9 aa, Homo Sapiens
IKCAYVKWG

SEQ ID NO: 1230159 - protein, 9 aa, Homo Sapiens
GPLRIFVYN

SEQ ID NO: 1230160 - protein, 9 aa, Homo Sapiens
LLKESYKTA

SEQ ID NO: 1230161 - protein, 9 aa, Homo Sapiens
HPGASIVLS

SEQ ID NO: 1230162 - protein, 9 aa, Homo Sapiens
GLTQSNLRS

SEQ ID NO: 1230163 - protein, 9 aa, Homo Sapiens
YKEDKPCII

SEQ ID NO: 1230164 - protein, 9 aa, Homo Sapiens
RHGKCLPDQ

SEQ ID NO: 1230165 - protein, 9 aa, Homo Sapiens
VVTSDKRAT

SEQ ID NO: 1230166 - protein, 9 aa, Homo Sapiens
ECPEYTVWQ

SEQ ID NO: 1230167 - protein, 9 aa, Homo Sapiens
IDSDNEEED

SEQ ID NO: 1230168 - protein, 9 aa, Homo Sapiens
DESYIEKSL

SEQ ID NO: 1230169 - protein, 9 aa, Homo Sapiens
SKTKGHLDT

SEQ ID NO: 1230170 - protein, 9 aa, Homo Sapiens
HGQLIVNDD

SEQ ID NO: 1230171 - protein, 9 aa, Homo Sapiens
EVSSWVTWM

SEQ ID NO: 1230172 - protein, 9 aa, Homo Sapiens
HAEIDAIYK

SEQ ID NO: 1230173 - protein, 9 aa, Homo Sapiens
QFGAAHVWE

SEQ ID NO: 1230174 - protein, 9 aa, Homo Sapiens
QDHQCFFLS

SEQ ID NO: 1230175 - protein, 9 aa, Homo Sapiens
IQQFLTLWP

SEQ ID NO: 1230176 - protein, 9 aa, Homo Sapiens
DATRGQVCQ

SEQ ID NO: 1230177 - protein, 9 aa, Homo Sapiens
TCSYAKLPS

SEQ ID NO: 1230178 - protein, 9 aa, Homo Sapiens
MPLCAVLAA

SEQ ID NO: 1230179 - protein, 9 aa, Homo Sapiens
WSFAFRLCS

SEQ ID NO: 1230180 - protein, 9 aa, Homo Sapiens
SSLVTQTDS

SEQ ID NO: 1230181 - protein, 9 aa, Homo Sapiens
SMRDKVLQL

SEQ ID NO: 1230182 - protein, 9 aa, Homo Sapiens
SISALKFQR

SEQ ID NO: 1230183 - protein, 9 aa, Homo Sapiens
FFSLLTTAI

SEQ ID NO: 1230184 - protein, 9 aa, Homo Sapiens
YLALQYSEH

SEQ ID NO: 1230185 - protein, 9 aa, Homo Sapiens
FICNWLFCG

SEQ ID NO: 1230186 - protein, 9 aa, Homo Sapiens
RSYFGSMGP

SEQ ID NO: 1230187 - protein, 9 aa, Homo Sapiens
GEFLGQSDG

SEQ ID NO: 1230188 - protein, 9 aa, Homo Sapiens
RREEHSLSA

SEQ ID NO: 1230189 - protein, 9 aa, Homo Sapiens
QYCMVSGLD

SEQ ID NO: 1230190 - protein, 9 aa, Homo Sapiens
SRWCSYIAE

SEQ ID NO: 1230191 - protein, 9 aa, Homo Sapiens
GYEERCFMC

SEQ ID NO: 1230192 - protein, 9 aa, Homo Sapiens
TRYVGQYDN

SEQ ID NO: 1230193 - protein, 9 aa, Homo Sapiens
SAKPKVHNH

SEQ ID NO: 1230194 - protein, 9 aa, Homo Sapiens
YRVALESLY

SEQ ID NO: 1230195 - protein, 9 aa, Homo Sapiens
INEFSGKVM

SEQ ID NO: 1230196 - protein, 9 aa, Homo Sapiens
LPSISILAM

SEQ ID NO: 1230197 - protein, 9 aa, Homo Sapiens
NLGMSMHVE

SEQ ID NO: 1230198 - protein, 9 aa, Homo Sapiens
CPADQLCLD

SEQ ID NO: 1230199 - protein, 9 aa, Homo Sapiens
DCIGRCSDL

SEQ ID NO: 1230200 - protein, 9 aa, Homo Sapiens
TGIGVYSAI

SEQ ID NO: 1230201 - protein, 9 aa, Homo Sapiens
KTCKDSATE

SEQ ID NO: 1230202 - protein, 9 aa, Homo Sapiens
SRAAGTEEM

SEQ ID NO: 1230203 - protein, 9 aa, Homo Sapiens
LFHTSAWGI

SEQ ID NO: 1230204 - protein, 9 aa, Homo Sapiens
LTLWNSAAG

SEQ ID NO: 1230205 - protein, 9 aa, Homo Sapiens
SCTVVMSAG

SEQ ID NO: 1230206 - protein, 9 aa, Homo Sapiens
LSVMVCDVL

SEQ ID NO: 1230207 - protein, 9 aa, Homo Sapiens
EEKTLQDEE

SEQ ID NO: 1230208 - protein, 9 aa, Homo Sapiens
SCKGALYKN

SEQ ID NO: 1230209 - protein, 9 aa, Homo Sapiens
MHLELREGV

SEQ ID NO: 1230210 - protein, 9 aa, Homo Sapiens
KYREYITKK

SEQ ID NO: 1230211 - protein, 9 aa, Homo Sapiens
SHNDGYDKY

SEQ ID NO: 1230212 - protein, 9 aa, Homo Sapiens
CGGRERRDR

SEQ ID NO: 1230213 - protein, 9 aa, Homo Sapiens
SRLANPGSD

SEQ ID NO: 1230214 - protein, 9 aa, Homo Sapiens
QTKDEVASL

SEQ ID NO: 1230215 - protein, 9 aa, Homo Sapiens
TGRNFDDIL

SEQ ID NO: 1230216 - protein, 9 aa, Homo Sapiens
KKVLDKLYK

SEQ ID NO: 1230217 - protein, 9 aa, Homo Sapiens
SEIKFVLKV

SEQ ID NO: 1230218 - protein, 9 aa, Homo Sapiens
SAGCWTVRG

SEQ ID NO: 1230219 - protein, 9 aa, Homo Sapiens
VLTVHAGKV

SEQ ID NO: 1230220 - protein, 9 aa, Homo Sapiens
GERGPTGPP

SEQ ID NO: 1230221 - protein, 9 aa, Homo Sapiens
DVMSGLVIS

SEQ ID NO: 1230222 - protein, 9 aa, Homo Sapiens
FLPQGSQYS

SEQ ID NO: 1230223 - protein, 9 aa, Homo Sapiens
APTDSWLRP

SEQ ID NO: 1230224 - protein, 9 aa, Homo Sapiens
KVSPPVLGL

SEQ ID NO: 1230225 - protein, 9 aa, Homo Sapiens
PGSPTFAAL

SEQ ID NO: 1230226 - protein, 9 aa, Homo Sapiens
GTSPIRHCS

SEQ ID NO: 1230227 - protein, 9 aa, Homo Sapiens
HWHWSSGSL

SEQ ID NO: 1230228 - protein, 9 aa, Homo Sapiens
SPAYYTSSS

SEQ ID NO: 1230229 - protein, 9 aa, Homo Sapiens
FVAAISMVV

SEQ ID NO: 1230230 - protein, 9 aa, Homo Sapiens
IVTMDSLED

SEQ ID NO: 1230231 - protein, 9 aa, Homo Sapiens
QETIKFMYT

SEQ ID NO: 1230232 - protein, 9 aa, Homo Sapiens
KVLEGMTFA

SEQ ID NO: 1230233 - protein, 9 aa, Homo Sapiens
SFYSISGGG

SEQ ID NO: 1230234 - protein, 9 aa, Homo Sapiens
VPPTCTYEC

SEQ ID NO: 1230235 - protein, 9 aa, Homo Sapiens
YLDLTRLRG

SEQ ID NO: 1230236 - protein, 9 aa, Homo Sapiens
KSAGTMLKP

SEQ ID NO: 1230237 - protein, 9 aa, Homo Sapiens
PFNPNVTGH

SEQ ID NO: 1230238 - protein, 9 aa, Homo Sapiens
HRQRKSRRK

SEQ ID NO: 1230239 - protein, 9 aa, Homo Sapiens
MGLFLALIQ

SEQ ID NO: 1230240 - protein, 9 aa, Homo Sapiens
VLWDDNHFS

SEQ ID NO: 1230241 - protein, 9 aa, Homo Sapiens
AQAETEVEE

SEQ ID NO: 1230242 - protein, 9 aa, Homo Sapiens
LCLEYLPPE

SEQ ID NO: 1230243 - protein, 9 aa, Homo Sapiens
EAESTVSTV

SEQ ID NO: 1230244 - protein, 9 aa, Homo Sapiens
GSVAVMHLR

SEQ ID NO: 1230245 - protein, 9 aa, Homo Sapiens
RDITRGYER

SEQ ID NO: 1230246 - protein, 9 aa, Homo Sapiens
LDITLDIQA

SEQ ID NO: 1230247 - protein, 9 aa, Homo Sapiens
SCEQIVVQV

SEQ ID NO: 1230248 - protein, 9 aa, Homo Sapiens
EELVGKPVF

SEQ ID NO: 1230249 - protein, 9 aa, Homo Sapiens
IILDFYNPL

SEQ ID NO: 1230250 - protein, 9 aa, Homo Sapiens
TLHIMDPGC

SEQ ID NO: 1230251 - protein, 9 aa, Homo Sapiens
NYSASYSEN

SEQ ID NO: 1230252 - protein, 9 aa, Homo Sapiens
WMTCTSLSK

SEQ ID NO: 1230253 - protein, 9 aa, Homo Sapiens
EQVMLDSLG

SEQ ID NO: 1230254 - protein, 9 aa, Homo Sapiens
IRNNRLGSA

SEQ ID NO: 1230255 - protein, 9 aa, Homo Sapiens
DLLHTIDEL

SEQ ID NO: 1230256 - protein, 9 aa, Homo Sapiens
EKTDIIDCL

SEQ ID NO: 1230257 - protein, 9 aa, Homo Sapiens
SIWDPMSVW

SEQ ID NO: 1230258 - protein, 9 aa, Homo Sapiens
QGLHEEAER

SEQ ID NO: 1230259 - protein, 9 aa, Homo Sapiens
DDAIGTTPF

SEQ ID NO: 1230260 - protein, 9 aa, Homo Sapiens
LNVKYTPKL

SEQ ID NO: 1230261 - protein, 9 aa, Homo Sapiens
AVTLGGSLY

SEQ ID NO: 1230262 - protein, 9 aa, Homo Sapiens
WRIGSVTSR

SEQ ID NO: 1230263 - protein, 9 aa, Homo Sapiens
VVERVLHNV

SEQ ID NO: 1230264 - protein, 9 aa, Homo Sapiens
TEVYAAGKA

SEQ ID NO: 1230265 - protein, 9 aa, Homo Sapiens
EGTGRMRVV

SEQ ID NO: 1230266 - protein, 9 aa, Homo Sapiens
LVGVGSEAY

SEQ ID NO: 1230267 - protein, 9 aa, Homo Sapiens
KYKCKVSLV

SEQ ID NO: 1230268 - protein, 9 aa, Homo Sapiens
GYGPVHMNS

SEQ ID NO: 1230269 - protein, 9 aa, Homo Sapiens
NHRHRSRIN

SEQ ID NO: 1230270 - protein, 9 aa, Homo Sapiens
PERDVMSSE

SEQ ID NO: 1230271 - protein, 9 aa, Homo Sapiens
YLGLLQVGP

SEQ ID NO: 1230272 - protein, 9 aa, Homo Sapiens
SQQLVAAGV

SEQ ID NO: 1230273 - protein, 9 aa, Homo Sapiens
DRDITLLDL

SEQ ID NO: 1230274 - protein, 9 aa, Homo Sapiens
IRLMPEKKV

SEQ ID NO: 1230275 - protein, 9 aa, Homo Sapiens
LTGAYTSGT

SEQ ID NO: 1230276 - protein, 9 aa, Homo Sapiens
LRSGTVTCS

SEQ ID NO: 1230277 - protein, 9 aa, Homo Sapiens
VWIPSECHG

SEQ ID NO: 1230278 - protein, 9 aa, Homo Sapiens
EDLDRWRRL

SEQ ID NO: 1230279 - protein, 9 aa, Homo Sapiens
DRGELFCCD

SEQ ID NO: 1230280 - protein, 9 aa, Homo Sapiens
HLPRQPSTP

SEQ ID NO: 1230281 - protein, 9 aa, Homo Sapiens
KGTYLRVLR

SEQ ID NO: 1230282 - protein, 9 aa, Homo Sapiens
VNFFTKLPI

SEQ ID NO: 1230283 - protein, 9 aa, Homo Sapiens
ILLFLTHFT

SEQ ID NO: 1230284 - protein, 9 aa, Homo Sapiens
FLPSVYLSC

SEQ ID NO: 1230285 - protein, 9 aa, Homo Sapiens
LKAPDSTSN

SEQ ID NO: 1230286 - protein, 9 aa, Homo Sapiens
AEKHVTIHA

SEQ ID NO: 1230287 - protein, 9 aa, Homo Sapiens
EGHLGQGGP

SEQ ID NO: 1230288 - protein, 9 aa, Homo Sapiens
RGRSAALKT

SEQ ID NO: 1230289 - protein, 9 aa, Homo Sapiens
WDNIYSILA

SEQ ID NO: 1230290 - protein, 9 aa, Homo Sapiens
QDIQEIISH

SEQ ID NO: 1230291 - protein, 9 aa, Homo Sapiens
ASLSQTEIV

SEQ ID NO: 1230292 - protein, 9 aa, Homo Sapiens
AGVGFFIHC

SEQ ID NO: 1230293 - protein, 9 aa, Homo Sapiens
LPEQETFYE

SEQ ID NO: 1230294 - protein, 9 aa, Homo Sapiens
CALRELWQR

SEQ ID NO: 1230295 - protein, 9 aa, Homo Sapiens
NQVALEVWR

SEQ ID NO: 1230296 - protein, 9 aa, Homo Sapiens
CMFKQTAIA

SEQ ID NO: 1230297 - protein, 9 aa, Homo Sapiens
QDGKLEAQN

SEQ ID NO: 1230298 - protein, 9 aa, Homo Sapiens
ETIKDIPKM

SEQ ID NO: 1230299 - protein, 9 aa, Homo Sapiens
DCHMTSISD

SEQ ID NO: 1230300 - protein, 9 aa, Homo Sapiens
APTGPRPLL

SEQ ID NO: 1230301 - protein, 9 aa, Homo Sapiens
CPPHMFWIG

SEQ ID NO: 1230302 - protein, 9 aa, Homo Sapiens
HITLAKKLA

SEQ ID NO: 1230303 - protein, 9 aa, Homo Sapiens
PDKPAPMEG

SEQ ID NO: 1230304 - protein, 9 aa, Homo Sapiens
SLNRHMKSH

SEQ ID NO: 1230305 - protein, 9 aa, Homo Sapiens
HRFRNFFNA

SEQ ID NO: 1230306 - protein, 9 aa, Homo Sapiens
LREDAPTEH

SEQ ID NO: 1230307 - protein, 9 aa, Homo Sapiens
FILWCLARD

SEQ ID NO: 1230308 - protein, 9 aa, Homo Sapiens
MYFMKLHSG

SEQ ID NO: 1230309 - protein, 9 aa, Homo Sapiens
DRRGRPSPQ

SEQ ID NO: 1230310 - protein, 9 aa, Homo Sapiens
NKRYLNSIL

SEQ ID NO: 1230311 - protein, 9 aa, Homo Sapiens
QRPVTPAAT

SEQ ID NO: 1230312 - protein, 9 aa, Homo Sapiens
QFSRCFHHC

SEQ ID NO: 1230313 - protein, 9 aa, Homo Sapiens
AISISIIGF

SEQ ID NO: 1230314 - protein, 9 aa, Homo Sapiens
WHYLGSLQP

SEQ ID NO: 1230315 - protein, 9 aa, Homo Sapiens
MKHQSTSFW

SEQ ID NO: 1230316 - protein, 9 aa, Homo Sapiens
YEKGAILKV

SEQ ID NO: 1230317 - protein, 9 aa, Homo Sapiens
RRYLHVANP

SEQ ID NO: 1230318 - protein, 9 aa, Homo Sapiens
VDRVPQHLQ

SEQ ID NO: 1230319 - protein, 9 aa, Homo Sapiens
HTNWAGHGG

SEQ ID NO: 1230320 - protein, 9 aa, Homo Sapiens
DENYTLIRT

SEQ ID NO: 1230321 - protein, 9 aa, Homo Sapiens
HTRKHYECS

SEQ ID NO: 1230322 - protein, 9 aa, Homo Sapiens
FKLYSLHTQ

SEQ ID NO: 1230323 - protein, 9 aa, Homo Sapiens
RELCRETEK

SEQ ID NO: 1230324 - protein, 9 aa, Homo Sapiens
DRYLCLHYP

SEQ ID NO: 1230325 - protein, 9 aa, Homo Sapiens
PLEDRCVSS

SEQ ID NO: 1230326 - protein, 9 aa, Homo Sapiens
TRKGYMSKR

SEQ ID NO: 1230327 - protein, 9 aa, Homo Sapiens
HRHSLVEKR

SEQ ID NO: 1230328 - protein, 9 aa, Homo Sapiens
AHNGMMGIN

SEQ ID NO: 1230329 - protein, 9 aa, Homo Sapiens
FKHDIFLLE

SEQ ID NO: 1230330 - protein, 9 aa, Homo Sapiens
QKAGMIVRC

SEQ ID NO: 1230331 - protein, 9 aa, Homo Sapiens
PRTKQYSNT

SEQ ID NO: 1230332 - protein, 9 aa, Homo Sapiens
MADEEHRIK

SEQ ID NO: 1230333 - protein, 9 aa, Homo Sapiens
LLAGLLSRG

SEQ ID NO: 1230334 - protein, 9 aa, Homo Sapiens
HQMNDSKGG

SEQ ID NO: 1230335 - protein, 9 aa, Homo Sapiens
EPLPKSPAS

SEQ ID NO: 1230336 - protein, 9 aa, Homo Sapiens
GLYMAQTCD

SEQ ID NO: 1230337 - protein, 9 aa, Homo Sapiens
LESEEGQEY

SEQ ID NO: 1230338 - protein, 9 aa, Homo Sapiens
NKCTSVSQH

SEQ ID NO: 1230339 - protein, 9 aa, Homo Sapiens
AQTFSSYAP

SEQ ID NO: 1230340 - protein, 9 aa, Homo Sapiens
AYRHSPVFH

SEQ ID NO: 1230341 - protein, 9 aa, Homo Sapiens
DLHLILCTV

SEQ ID NO: 1230342 - protein, 9 aa, Homo Sapiens
ETVQEELLK

SEQ ID NO: 1230343 - protein, 9 aa, Homo Sapiens
PIINVINMD

SEQ ID NO: 1230344 - protein, 9 aa, Homo Sapiens
YPMIIHMWP

SEQ ID NO: 1230345 - protein, 9 aa, Homo Sapiens
VMFTRYILH

SEQ ID NO: 1230346 - protein, 9 aa, Homo Sapiens
DLTKRSIQT

SEQ ID NO: 1230347 - protein, 9 aa, Homo Sapiens
MGSGIECMG

SEQ ID NO: 1230348 - protein, 9 aa, Homo Sapiens
TANDPVVAD

SEQ ID NO: 1230349 - protein, 9 aa, Homo Sapiens
KWRPDFRES

SEQ ID NO: 1230350 - protein, 9 aa, Homo Sapiens
MKAIRNNRL

SEQ ID NO: 1230351 - protein, 9 aa, Homo Sapiens
SPPNEEVPP

SEQ ID NO: 1230352 - protein, 9 aa, Homo Sapiens
RYRYDGLGW

SEQ ID NO: 1230353 - protein, 9 aa, Homo Sapiens
VYTFSIENF

SEQ ID NO: 1230354 - protein, 9 aa, Homo Sapiens
YTIKWHKWS

SEQ ID NO: 1230355 - protein, 9 aa, Homo Sapiens
IDLIPTGTY

SEQ ID NO: 1230356 - protein, 9 aa, Homo Sapiens
SYLHSHFIG

SEQ ID NO: 1230357 - protein, 9 aa, Homo Sapiens
HVSGITLMS

SEQ ID NO: 1230358 - protein, 9 aa, Homo Sapiens
GPKLVHGSL

SEQ ID NO: 1230359 - protein, 9 aa, Homo Sapiens
VSKVYCGYS

SEQ ID NO: 1230360 - protein, 9 aa, Homo Sapiens
GAPCIQEAE

SEQ ID NO: 1230361 - protein, 9 aa, Homo Sapiens
FRENFSVLD

SEQ ID NO: 1230362 - protein, 9 aa, Homo Sapiens
VGFIVVFCP

SEQ ID NO: 1230363 - protein, 9 aa, Homo Sapiens
RLSANSGCS

SEQ ID NO: 1230364 - protein, 9 aa, Homo Sapiens
RIHATDVIH

SEQ ID NO: 1230365 - protein, 9 aa, Homo Sapiens
CRLLHQRQQ

SEQ ID NO: 1230366 - protein, 9 aa, Homo Sapiens
HNFTHHLLA

SEQ ID NO: 1230367 - protein, 9 aa, Homo Sapiens
QETHRQPMP

SEQ ID NO: 1230368 - protein, 9 aa, Homo Sapiens
REFSGLSHI

SEQ ID NO: 1230369 - protein, 9 aa, Homo Sapiens
PPSATRARS

SEQ ID NO: 1230370 - protein, 9 aa, Homo Sapiens
SGHFPSMQQ

SEQ ID NO: 1230371 - protein, 9 aa, Homo Sapiens
GLNFETTEE

SEQ ID NO: 1230372 - protein, 9 aa, Homo Sapiens
LLTIVVYMA

SEQ ID NO: 1230373 - protein, 9 aa, Homo Sapiens
KQESLMVLE

SEQ ID NO: 1230374 - protein, 9 aa, Homo Sapiens
VTRHPAAGY

SEQ ID NO: 1230375 - protein, 9 aa, Homo Sapiens
RKQLARHEW

SEQ ID NO: 1230376 - protein, 9 aa, Homo Sapiens
LHSMVVAQN

SEQ ID NO: 1230377 - protein, 9 aa, Homo Sapiens
PMIEIVYFA

SEQ ID NO: 1230378 - protein, 9 aa, Homo Sapiens
SSAADLTTG

SEQ ID NO: 1230379 - protein, 9 aa, Homo Sapiens
LNQGISLLL

SEQ ID NO: 1230380 - protein, 9 aa, Homo Sapiens
ESGDDSLPA

SEQ ID NO: 1230381 - protein, 9 aa, Homo Sapiens
NEFILFIFK

SEQ ID NO: 1230382 - protein, 9 aa, Homo Sapiens
GDPWSVSAA

SEQ ID NO: 1230383 - protein, 9 aa, Homo Sapiens
QSGSVAPGN

SEQ ID NO: 1230384 - protein, 9 aa, Homo Sapiens
GPDGATLCM

SEQ ID NO: 1230385 - protein, 9 aa, Homo Sapiens
QVLEQVHSS

SEQ ID NO: 1230386 - protein, 9 aa, Homo Sapiens
LSVLRAYNS

SEQ ID NO: 1230387 - protein, 9 aa, Homo Sapiens
TVKREDAGT

SEQ ID NO: 1230388 - protein, 9 aa, Homo Sapiens
NEFHCQEQT

SEQ ID NO: 1230389 - protein, 9 aa, Homo Sapiens
PEKMLDQSP

SEQ ID NO: 1230390 - protein, 9 aa, Homo Sapiens
PYAPINVNA

SEQ ID NO: 1230391 - protein, 9 aa, Homo Sapiens
LMSHPLLMF

SEQ ID NO: 1230392 - protein, 9 aa, Homo Sapiens
SQSPAEVDG

SEQ ID NO: 1230393 - protein, 9 aa, Homo Sapiens
EKGLAVVTQ

SEQ ID NO: 1230394 - protein, 9 aa, Homo Sapiens
PKCITPRCP

SEQ ID NO: 1230395 - protein, 9 aa, Homo Sapiens
QWQRHYFYL

SEQ ID NO: 1230396 - protein, 9 aa, Homo Sapiens
DINIRLIRQ

SEQ ID NO: 1230397 - protein, 9 aa, Homo Sapiens
AKTFQIDDY

SEQ ID NO: 1230398 - protein, 9 aa, Homo Sapiens
YKTLFIIFS

SEQ ID NO: 1230399 - protein, 9 aa, Homo Sapiens
KKKGGKVMK

SEQ ID NO: 1230400 - protein, 9 aa, Homo Sapiens
FPIEYASNK

SEQ ID NO: 1230401 - protein, 9 aa, Homo Sapiens
QVLLNARSV

SEQ ID NO: 1230402 - protein, 9 aa, Homo Sapiens
SAPAPPGRP

SEQ ID NO: 1230403 - protein, 9 aa, Homo Sapiens
MRPLDRAIS

SEQ ID NO: 1230404 - protein, 9 aa, Homo Sapiens
EMEEATRQV

SEQ ID NO: 1230405 - protein, 9 aa, Homo Sapiens
VKLLQKCIE

SEQ ID NO: 1230406 - protein, 9 aa, Homo Sapiens
WMGYAAMAA

SEQ ID NO: 1230407 - protein, 9 aa, Homo Sapiens
NYPSTSPRS

SEQ ID NO: 1230408 - protein, 9 aa, Homo Sapiens
KHLSRLVVG

SEQ ID NO: 1230409 - protein, 9 aa, Homo Sapiens
DELFKMFCT

SEQ ID NO: 1230410 - protein, 9 aa, Homo Sapiens
RDIALITNH

SEQ ID NO: 1230411 - protein, 9 aa, Homo Sapiens
VLEQCYRPL

SEQ ID NO: 1230412 - protein, 9 aa, Homo Sapiens
GLHGGIAGR

SEQ ID NO: 1230413 - protein, 9 aa, Homo Sapiens
IGFVISGRH

SEQ ID NO: 1230414 - protein, 9 aa, Homo Sapiens
PSVCELVMA

SEQ ID NO: 1230415 - protein, 9 aa, Homo Sapiens
CGQPVHWEH

SEQ ID NO: 1230416 - protein, 9 aa, Homo Sapiens
NGGKWLVSG

SEQ ID NO: 1230417 - protein, 9 aa, Homo Sapiens
YHYRMEKSG

SEQ ID NO: 1230418 - protein, 9 aa, Homo Sapiens
SLLGVLQYR

SEQ ID NO: 1230419 - protein, 9 aa, Homo Sapiens
EGLQTLCVA

SEQ ID NO: 1230420 - protein, 9 aa, Homo Sapiens
NRNNDVTGS

SEQ ID NO: 1230421 - protein, 9 aa, Homo Sapiens
GDQTLEVLQ

SEQ ID NO: 1230422 - protein, 9 aa, Homo Sapiens
NVLVIITVF

SEQ ID NO: 1230423 - protein, 9 aa, Homo Sapiens
TIGCRLRKK

SEQ ID NO: 1230424 - protein, 9 aa, Homo Sapiens
WHHLTMFIL

SEQ ID NO: 1230425 - protein, 9 aa, Homo Sapiens
PWLFTHSPS

SEQ ID NO: 1230426 - protein, 9 aa, Homo Sapiens
ASQEATAPA

SEQ ID NO: 1230427 - protein, 9 aa, Homo Sapiens
KHHTPPMIG

SEQ ID NO: 1230428 - protein, 9 aa, Homo Sapiens
NICVIAAFT

SEQ ID NO: 1230429 - protein, 9 aa, Homo Sapiens
VASELGNHY

SEQ ID NO: 1230430 - protein, 9 aa, Homo Sapiens
HLIAIICAY

SEQ ID NO: 1230431 - protein, 9 aa, Homo Sapiens
FIQGNDIKI

SEQ ID NO: 1230432 - protein, 9 aa, Homo Sapiens
HLIKDKKAA

SEQ ID NO: 1230433 - protein, 9 aa, Homo Sapiens
IIANATTRQ

SEQ ID NO: 1230434 - protein, 9 aa, Homo Sapiens
ASLKLKLTA

SEQ ID NO: 1230435 - protein, 9 aa, Homo Sapiens
GSTECVILA

SEQ ID NO: 1230436 - protein, 9 aa, Homo Sapiens
ITTASGQFT

SEQ ID NO: 1230437 - protein, 9 aa, Homo Sapiens
KHHMIMFLD

SEQ ID NO: 1230438 - protein, 9 aa, Homo Sapiens
EAPDPTQNA

SEQ ID NO: 1230439 - protein, 9 aa, Homo Sapiens
LVCLSVTIF

SEQ ID NO: 1230440 - protein, 9 aa, Homo Sapiens
GPICLVLVS

SEQ ID NO: 1230441 - protein, 9 aa, Homo Sapiens
EQSQVLLKR

SEQ ID NO: 1230442 - protein, 9 aa, Homo Sapiens
LYIHVDDCS

SEQ ID NO: 1230443 - protein, 9 aa, Homo Sapiens
LTNLSHAFG

SEQ ID NO: 1230444 - protein, 9 aa, Homo Sapiens
MKKQDKKNG

SEQ ID NO: 1230445 - protein, 9 aa, Homo Sapiens
TTMCIKECI

SEQ ID NO: 1230446 - protein, 9 aa, Homo Sapiens
RMSTCTINY

SEQ ID NO: 1230447 - protein, 9 aa, Homo Sapiens
LVSYVSKIK

SEQ ID NO: 1230448 - protein, 9 aa, Homo Sapiens
IECDKALNN

SEQ ID NO: 1230449 - protein, 9 aa, Homo Sapiens
VIPFDPKDS

SEQ ID NO: 1230450 - protein, 9 aa, Homo Sapiens
KLLYCDVML

SEQ ID NO: 1230451 - protein, 9 aa, Homo Sapiens
RTSLMDCQA

SEQ ID NO: 1230452 - protein, 9 aa, Homo Sapiens
WIPYINGKF

SEQ ID NO: 1230453 - protein, 9 aa, Homo Sapiens
CPSNPDPDG

SEQ ID NO: 1230454 - protein, 9 aa, Homo Sapiens
EEMELLKED

SEQ ID NO: 1230455 - protein, 9 aa, Homo Sapiens
RADKKKRLK

SEQ ID NO: 1230456 - protein, 9 aa, Homo Sapiens
QPRKTTISP

SEQ ID NO: 1230457 - protein, 9 aa, Homo Sapiens
DVSMDVNPS

SEQ ID NO: 1230458 - protein, 9 aa, Homo Sapiens
CHIYNKPTD

SEQ ID NO: 1230459 - protein, 9 aa, Homo Sapiens
RKEEESKKG

SEQ ID NO: 1230460 - protein, 9 aa, Homo Sapiens
PANYLITSL

SEQ ID NO: 1230461 - protein, 9 aa, Homo Sapiens
TLGQMATYF

SEQ ID NO: 1230462 - protein, 9 aa, Homo Sapiens
FMAKVMSVG

SEQ ID NO: 1230463 - protein, 9 aa, Homo Sapiens
DTQAAIKEQ

SEQ ID NO: 1230464 - protein, 9 aa, Homo Sapiens
ITMANVFLI

SEQ ID NO: 1230465 - protein, 9 aa, Homo Sapiens
LQAAQRAYG

SEQ ID NO: 1230466 - protein, 9 aa, Homo Sapiens
RVLMKHKKS

SEQ ID NO: 1230467 - protein, 9 aa, Homo Sapiens
MTLLSTLTR

SEQ ID NO: 1230468 - protein, 9 aa, Homo Sapiens
TGVSIIMNT

SEQ ID NO: 1230469 - protein, 9 aa, Homo Sapiens
PNKSPMHHW

SEQ ID NO: 1230470 - protein, 9 aa, Homo Sapiens
MSPICFIAF

SEQ ID NO: 1230471 - protein, 9 aa, Homo Sapiens
SIVCLKKHT

SEQ ID NO: 1230472 - protein, 9 aa, Homo Sapiens
DILHFNIFD

SEQ ID NO: 1230473 - protein, 9 aa, Homo Sapiens
NPTSIDSVI

SEQ ID NO: 1230474 - protein, 9 aa, Homo Sapiens
KMEASYCVL

SEQ ID NO: 1230475 - protein, 9 aa, Homo Sapiens
LDHPKIATW

SEQ ID NO: 1230476 - protein, 9 aa, Homo Sapiens
MDKLMDRHQ

SEQ ID NO: 1230477 - protein, 9 aa, Homo Sapiens
AYSMRQKTQ

SEQ ID NO: 1230478 - protein, 9 aa, Homo Sapiens
KRHREYNSK

SEQ ID NO: 1230479 - protein, 9 aa, Homo Sapiens
YDFHDSWEK

SEQ ID NO: 1230480 - protein, 9 aa, Homo Sapiens
PTDSACLLN

SEQ ID NO: 1230481 - protein, 9 aa, Homo Sapiens
LNSISNQPN

SEQ ID NO: 1230482 - protein, 9 aa, Homo Sapiens
KDLGCCIKH

SEQ ID NO: 1230483 - protein, 9 aa, Homo Sapiens
YTVMFRIHV

SEQ ID NO: 1230484 - protein, 9 aa, Homo Sapiens
NNELREVRE

SEQ ID NO: 1230485 - protein, 9 aa, Homo Sapiens
LHPWLFTHS

SEQ ID NO: 1230486 - protein, 9 aa, Homo Sapiens
TARTHPKTG

SEQ ID NO: 1230487 - protein, 9 aa, Homo Sapiens
SEIFNFLYL

SEQ ID NO: 1230488 - protein, 9 aa, Homo Sapiens
GNLKALSKQ

SEQ ID NO: 1230489 - protein, 9 aa, Homo Sapiens
TLPKCNGKG

SEQ ID NO: 1230490 - protein, 9 aa, Homo Sapiens
GRPGSGRAG

SEQ ID NO: 1230491 - protein, 9 aa, Homo Sapiens
GLCKVKLHN

SEQ ID NO: 1230492 - protein, 9 aa, Homo Sapiens
YTCPRWISR

SEQ ID NO: 1230493 - protein, 9 aa, Homo Sapiens
RLLHQQSEN

SEQ ID NO: 1230494 - protein, 9 aa, Homo Sapiens
EAMTEGNMG

SEQ ID NO: 1230495 - protein, 9 aa, Homo Sapiens
CQVTGRIHA

SEQ ID NO: 1230496 - protein, 9 aa, Homo Sapiens
YEMPRHGVY

SEQ ID NO: 1230497 - protein, 9 aa, Homo Sapiens
NSVILIMSV

SEQ ID NO: 1230498 - protein, 9 aa, Homo Sapiens
LLFIYNKDG

SEQ ID NO: 1230499 - protein, 9 aa, Homo Sapiens
SRWSSHAME

SEQ ID NO: 1230500 - protein, 9 aa, Homo Sapiens
NTDPSVINC

SEQ ID NO: 1230501 - protein, 9 aa, Homo Sapiens
RTFAEVTEL

SEQ ID NO: 1230502 - protein, 9 aa, Homo Sapiens
VSTNLKTLN

SEQ ID NO: 1230503 - protein, 9 aa, Homo Sapiens
VRLCNEGTR

SEQ ID NO: 1230504 - protein, 9 aa, Homo Sapiens
VLSTLYISL

SEQ ID NO: 1230505 - protein, 9 aa, Homo Sapiens
KTCILILIL

SEQ ID NO: 1230506 - protein, 9 aa, Homo Sapiens
MVITVELCD

SEQ ID NO: 1230507 - protein, 9 aa, Homo Sapiens
NHINSYFKC

SEQ ID NO: 1230508 - protein, 9 aa, Homo Sapiens
SLDVFLRRY

SEQ ID NO: 1230509 - protein, 9 aa, Homo Sapiens
REKNPNTFE

SEQ ID NO: 1230510 - protein, 9 aa, Homo Sapiens
LLLIMSYCY

SEQ ID NO: 1230511 - protein, 9 aa, Homo Sapiens
LGRCSMVCD

SEQ ID NO: 1230512 - protein, 9 aa, Homo Sapiens
QHYGWHPAT

SEQ ID NO: 1230513 - protein, 9 aa, Homo Sapiens
LERDPSNHQ

SEQ ID NO: 1230514 - protein, 9 aa, Homo Sapiens
IKALQQTRM

SEQ ID NO: 1230515 - protein, 9 aa, Homo Sapiens
DYSMQRFRP

SEQ ID NO: 1230516 - protein, 9 aa, Homo Sapiens
PHTCWEYCA

SEQ ID NO: 1230517 - protein, 9 aa, Homo Sapiens
YGRHKQYPI

SEQ ID NO: 1230518 - protein, 9 aa, Homo Sapiens
LLLFTTQPF

SEQ ID NO: 1230519 - protein, 9 aa, Homo Sapiens
ELLVFLTHA

SEQ ID NO: 1230520 - protein, 9 aa, Homo Sapiens
RETEATNVI

SEQ ID NO: 1230521 - protein, 9 aa, Homo Sapiens
HASESAVWA

SEQ ID NO: 1230522 - protein, 9 aa, Homo Sapiens
DPPMPRPVS

SEQ ID NO: 1230523 - protein, 9 aa, Homo Sapiens
PTMLDKSSQ

SEQ ID NO: 1230524 - protein, 9 aa, Homo Sapiens
AVFMSDTEL

SEQ ID NO: 1230525 - protein, 9 aa, Homo Sapiens
ARTQRQWRM

SEQ ID NO: 1230526 - protein, 9 aa, Homo Sapiens
SSWGPLACS

SEQ ID NO: 1230527 - protein, 9 aa, Homo Sapiens
TDASGTTAV

SEQ ID NO: 1230528 - protein, 9 aa, Homo Sapiens
IQGNDIKID

SEQ ID NO: 1230529 - protein, 9 aa, Homo Sapiens
KTFLYNFDN

SEQ ID NO: 1230530 - protein, 9 aa, Homo Sapiens
HCKGILYVT

SEQ ID NO: 1230531 - protein, 9 aa, Homo Sapiens
EKKEGHIDD

SEQ ID NO: 1230532 - protein, 9 aa, Homo Sapiens
VRDHYARSP

SEQ ID NO: 1230533 - protein, 9 aa, Homo Sapiens
IANMCAALL

SEQ ID NO: 1230534 - protein, 9 aa, Homo Sapiens
GARPLTSRI

SEQ ID NO: 1230535 - protein, 9 aa, Homo Sapiens
SAIMSPFYQ

SEQ ID NO: 1230536 - protein, 9 aa, Homo Sapiens
TGAHDGKIK

SEQ ID NO: 1230537 - protein, 9 aa, Homo Sapiens
NDQRRAALD

SEQ ID NO: 1230538 - protein, 9 aa, Homo Sapiens
IVKACQVCS

SEQ ID NO: 1230539 - protein, 9 aa, Homo Sapiens
ILDIFRRLR

SEQ ID NO: 1230540 - protein, 9 aa, Homo Sapiens
NIYHSHHPT

SEQ ID NO: 1230541 - protein, 9 aa, Homo Sapiens
AYSLGLDTK

SEQ ID NO: 1230542 - protein, 9 aa, Homo Sapiens
LRDTPVGDP

SEQ ID NO: 1230543 - protein, 9 aa, Homo Sapiens
YLDQCHRDG

SEQ ID NO: 1230544 - protein, 9 aa, Homo Sapiens
ESKQKEYEE

SEQ ID NO: 1230545 - protein, 9 aa, Homo Sapiens
ESCCRTTPS

SEQ ID NO: 1230546 - protein, 9 aa, Homo Sapiens
VAFIFHCKR

SEQ ID NO: 1230547 - protein, 9 aa, Homo Sapiens
TGIHTDTDT

SEQ ID NO: 1230548 - protein, 9 aa, Homo Sapiens
ETQDGKLEA

SEQ ID NO: 1230549 - protein, 9 aa, Homo Sapiens
EQRILLTGL

SEQ ID NO: 1230550 - protein, 9 aa, Homo Sapiens
ICNMLHGAT

SEQ ID NO: 1230551 - protein, 9 aa, Homo Sapiens
HVWELSKAN

SEQ ID NO: 1230552 - protein, 9 aa, Homo Sapiens
CITPRCPPK

SEQ ID NO: 1230553 - protein, 9 aa, Homo Sapiens
FQACYRQLV

SEQ ID NO: 1230554 - protein, 9 aa, Homo Sapiens
FEVGFEPFY

SEQ ID NO: 1230555 - protein, 9 aa, Homo Sapiens
SSHLARHQQ

SEQ ID NO: 1230556 - protein, 9 aa, Homo Sapiens
VLQQYCMVS

SEQ ID NO: 1230557 - protein, 9 aa, Homo Sapiens
LALIGCFAL

SEQ ID NO: 1230558 - protein, 9 aa, Homo Sapiens
QRMFDAEKI

SEQ ID NO: 1230559 - protein, 9 aa, Homo Sapiens
QDKIVSVFY

SEQ ID NO: 1230560 - protein, 9 aa, Homo Sapiens
MKSHTEHRS

SEQ ID NO: 1230561 - protein, 9 aa, Homo Sapiens
KKFFSTCAS

SEQ ID NO: 1230562 - protein, 9 aa, Homo Sapiens
RRLDTYLAR

SEQ ID NO: 1230563 - protein, 9 aa, Homo Sapiens
SRSAACGGR

SEQ ID NO: 1230564 - protein, 9 aa, Homo Sapiens
SEPRKEFGC

SEQ ID NO: 1230565 - protein, 9 aa, Homo Sapiens
YESAESDTM

SEQ ID NO: 1230566 - protein, 9 aa, Homo Sapiens
WSCQPLPQP

SEQ ID NO: 1230567 - protein, 9 aa, Homo Sapiens
IQGDTHFDD

SEQ ID NO: 1230568 - protein, 9 aa, Homo Sapiens
ISISIIGFA

SEQ ID NO: 1230569 - protein, 9 aa, Homo Sapiens
IALMDAYLL

SEQ ID NO: 1230570 - protein, 9 aa, Homo Sapiens
SLRTLRALH

SEQ ID NO: 1230571 - protein, 9 aa, Homo Sapiens
AIWRIGSVT

SEQ ID NO: 1230572 - protein, 9 aa, Homo Sapiens
PVSPRRMTP

SEQ ID NO: 1230573 - protein, 9 aa, Homo Sapiens
GYQLKGRKY

SEQ ID NO: 1230574 - protein, 9 aa, Homo Sapiens
DWFLSCLGP

SEQ ID NO: 1230575 - protein, 9 aa, Homo Sapiens
PVEYEEEER

SEQ ID NO: 1230576 - protein, 9 aa, Homo Sapiens
QLLLNDNRL

SEQ ID NO: 1230577 - protein, 9 aa, Homo Sapiens
LDLTDNMLQ

SEQ ID NO: 1230578 - protein, 9 aa, Homo Sapiens
LESHRAPGQ

SEQ ID NO: 1230579 - protein, 9 aa, Homo Sapiens
LDAFGKINF

SEQ ID NO: 1230580 - protein, 9 aa, Homo Sapiens
LKLLNTCML

SEQ ID NO: 1230581 - protein, 9 aa, Homo Sapiens
IFTKPLKFQ

SEQ ID NO: 1230582 - protein, 9 aa, Homo Sapiens
RETAVSASD

SEQ ID NO: 1230583 - protein, 9 aa, Homo Sapiens
DGMFIECLD

SEQ ID NO: 1230584 - protein, 9 aa, Homo Sapiens
PPSGMGYCR

SEQ ID NO: 1230585 - protein, 9 aa, Homo Sapiens
KIQVHLTAS

SEQ ID NO: 1230586 - protein, 9 aa, Homo Sapiens
IHYRILDDK

SEQ ID NO: 1230587 - protein, 9 aa, Homo Sapiens
HPLSLPSWE

SEQ ID NO: 1230588 - protein, 9 aa, Homo Sapiens
SSKVTLQNL

SEQ ID NO: 1230589 - protein, 9 aa, Homo Sapiens
PHTHESQAQ

SEQ ID NO: 1230590 - protein, 9 aa, Homo Sapiens
LATKACAFL

SEQ ID NO: 1230591 - protein, 9 aa, Homo Sapiens
SFHRNDPME

SEQ ID NO: 1230592 - protein, 9 aa, Homo Sapiens
RSSSLIHHY

SEQ ID NO: 1230593 - protein, 9 aa, Homo Sapiens
PAQKDLYRN

SEQ ID NO: 1230594 - protein, 9 aa, Homo Sapiens
HTDHPRAQC

SEQ ID NO: 1230595 - protein, 9 aa, Homo Sapiens
QPRRPKPVT

SEQ ID NO: 1230596 - protein, 9 aa, Homo Sapiens
LYTVMRCSA

SEQ ID NO: 1230597 - protein, 9 aa, Homo Sapiens
GEQITMLNG

SEQ ID NO: 1230598 - protein, 9 aa, Homo Sapiens
TCLVTLMQK

SEQ ID NO: 1230599 - protein, 9 aa, Homo Sapiens
KTDVNKAID

SEQ ID NO: 1230600 - protein, 9 aa, Homo Sapiens
DHQMVICKK

SEQ ID NO: 1230601 - protein, 9 aa, Homo Sapiens
LSLVSENVE

SEQ ID NO: 1230602 - protein, 9 aa, Homo Sapiens
WDKVSVSIM

SEQ ID NO: 1230603 - protein, 9 aa, Homo Sapiens
KMGKSEKIV

SEQ ID NO: 1230604 - protein, 9 aa, Homo Sapiens
LDGMFIECL

SEQ ID NO: 1230605 - protein, 9 aa, Homo Sapiens
KGIFAPLQS

SEQ ID NO: 1230606 - protein, 9 aa, Homo Sapiens
LLIEPCKYT

SEQ ID NO: 1230607 - protein, 9 aa, Homo Sapiens
GTLECGDQT

SEQ ID NO: 1230608 - protein, 9 aa, Homo Sapiens
KELLTWVRD

SEQ ID NO: 1230609 - protein, 9 aa, Homo Sapiens
EEIPLDKDG

SEQ ID NO: 1230610 - protein, 9 aa, Homo Sapiens
QKYVGKDGY

SEQ ID NO: 1230611 - protein, 9 aa, Homo Sapiens
LSDDDTVLD

SEQ ID NO: 1230612 - protein, 9 aa, Homo Sapiens
GLELFRWPW

SEQ ID NO: 1230613 - protein, 9 aa, Homo Sapiens
VGLSLWVCE

SEQ ID NO: 1230614 - protein, 9 aa, Homo Sapiens
ENVRTVVMT

SEQ ID NO: 1230615 - protein, 9 aa, Homo Sapiens
QQVSRPAAP

SEQ ID NO: 1230616 - protein, 9 aa, Homo Sapiens
RSTQGGHMN

SEQ ID NO: 1230617 - protein, 9 aa, Homo Sapiens
RVVNLHFPN

SEQ ID NO: 1230618 - protein, 9 aa, Homo Sapiens
EFILFIFKV

SEQ ID NO: 1230619 - protein, 9 aa, Homo Sapiens
RVLQRTLSV

SEQ ID NO: 1230620 - protein, 9 aa, Homo Sapiens
KSQDTEETV

SEQ ID NO: 1230621 - protein, 9 aa, Homo Sapiens
VLAPYRECV

SEQ ID NO: 1230622 - protein, 9 aa, Homo Sapiens
PVVKSEGDE

SEQ ID NO: 1230623 - protein, 9 aa, Homo Sapiens
AMTQDTQNA

SEQ ID NO: 1230624 - protein, 9 aa, Homo Sapiens
YFNLPEDDK

SEQ ID NO: 1230625 - protein, 9 aa, Homo Sapiens
DIYHYITSY

SEQ ID NO: 1230626 - protein, 9 aa, Homo Sapiens
KQQQYAGLL

SEQ ID NO: 1230627 - protein, 9 aa, Homo Sapiens
SSFFCCFHD

SEQ ID NO: 1230628 - protein, 9 aa, Homo Sapiens
EGTHCCRQE

SEQ ID NO: 1230629 - protein, 9 aa, Homo Sapiens
KALLFHTSA

SEQ ID NO: 1230630 - protein, 9 aa, Homo Sapiens
QHGCCPYCH

SEQ ID NO: 1230631 - protein, 9 aa, Homo Sapiens
EMATLPLQP

SEQ ID NO: 1230632 - protein, 9 aa, Homo Sapiens
LFEAQGNNR

SEQ ID NO: 1230633 - protein, 9 aa, Homo Sapiens
ATRPTDAQD

SEQ ID NO: 1230634 - protein, 9 aa, Homo Sapiens
LFLTDPKLT

SEQ ID NO: 1230635 - protein, 9 aa, Homo Sapiens
EDEEKDNSD

SEQ ID NO: 1230636 - protein, 9 aa, Homo Sapiens
QRVHHTDHP

SEQ ID NO: 1230637 - protein, 9 aa, Homo Sapiens
WIFLGLMEK

SEQ ID NO: 1230638 - protein, 9 aa, Homo Sapiens
HKRIYTGEK

SEQ ID NO: 1230639 - protein, 9 aa, Homo Sapiens
KEVKAVMSK

SEQ ID NO: 1230640 - protein, 9 aa, Homo Sapiens
SQECTDSTG

SEQ ID NO: 1230641 - protein, 9 aa, Homo Sapiens
SVRTPPNRT

SEQ ID NO: 1230642 - protein, 9 aa, Homo Sapiens
KWCGYALAS

SEQ ID NO: 1230643 - protein, 9 aa, Homo Sapiens
KVVHVTVFD

SEQ ID NO: 1230644 - protein, 9 aa, Homo Sapiens
SMSKNTKLL

SEQ ID NO: 1230645 - protein, 9 aa, Homo Sapiens
AICYDAFGE

SEQ ID NO: 1230646 - protein, 9 aa, Homo Sapiens
FVLHHNVWK

SEQ ID NO: 1230647 - protein, 9 aa, Homo Sapiens
TKLYPRYPL

SEQ ID NO: 1230648 - protein, 9 aa, Homo Sapiens
PHLYMYLQY

SEQ ID NO: 1230649 - protein, 9 aa, Homo Sapiens
ELCADLKVK

SEQ ID NO: 1230650 - protein, 9 aa, Homo Sapiens
FWEGLDGSC

SEQ ID NO: 1230651 - protein, 9 aa, Homo Sapiens
DELAASAYH

SEQ ID NO: 1230652 - protein, 9 aa, Homo Sapiens
MTRGNVKYA

SEQ ID NO: 1230653 - protein, 9 aa, Homo Sapiens
STLRHLNLE

SEQ ID NO: 1230654 - protein, 9 aa, Homo Sapiens
CVEYSLMVY

SEQ ID NO: 1230655 - protein, 9 aa, Homo Sapiens
QLQPQRCSD

SEQ ID NO: 1230656 - protein, 9 aa, Homo Sapiens
FQLEGMSPI

SEQ ID NO: 1230657 - protein, 9 aa, Homo Sapiens
LLTSVCETL

SEQ ID NO: 1230658 - protein, 9 aa, Homo Sapiens
LPGYAPAMA

SEQ ID NO: 1230659 - protein, 9 aa, Homo Sapiens
AASSMTERI

SEQ ID NO: 1230660 - protein, 9 aa, Homo Sapiens
AWGLLPGWG

SEQ ID NO: 1230661 - protein, 9 aa, Homo Sapiens
GPLGVPGED

SEQ ID NO: 1230662 - protein, 9 aa, Homo Sapiens
SKLVSVGYG

SEQ ID NO: 1230663 - protein, 9 aa, Homo Sapiens
GIDITYFQA

SEQ ID NO: 1230664 - protein, 9 aa, Homo Sapiens
LQTFLDDDS

SEQ ID NO: 1230665 - protein, 9 aa, Homo Sapiens
VSPTFPDHL

SEQ ID NO: 1230666 - protein, 9 aa, Homo Sapiens
AKVALVILF

SEQ ID NO: 1230667 - protein, 9 aa, Homo Sapiens
DHLGCKEDY

SEQ ID NO: 1230668 - protein, 9 aa, Homo Sapiens
PTGIGGPYM

SEQ ID NO: 1230669 - protein, 9 aa, Homo Sapiens
HQRQNQTWN

SEQ ID NO: 1230670 - protein, 9 aa, Homo Sapiens
GRTTLHLAA

SEQ ID NO: 1230671 - protein, 9 aa, Homo Sapiens
SHTDADCFV

SEQ ID NO: 1230672 - protein, 9 aa, Homo Sapiens
PINPDTAAA

SEQ ID NO: 1230673 - protein, 9 aa, Homo Sapiens
KAKRRCSLH

SEQ ID NO: 1230674 - protein, 9 aa, Homo Sapiens
ASGCHVVNI

SEQ ID NO: 1230675 - protein, 9 aa, Homo Sapiens
RGQILNLIQ

SEQ ID NO: 1230676 - protein, 9 aa, Homo Sapiens
TEQAFVRCK

SEQ ID NO: 1230677 - protein, 9 aa, Homo Sapiens
KILLDHPKA

SEQ ID NO: 1230678 - protein, 9 aa, Homo Sapiens
NAHLVASFE

SEQ ID NO: 1230679 - protein, 9 aa, Homo Sapiens
EGMGSSGAA

SEQ ID NO: 1230680 - protein, 9 aa, Homo Sapiens
SIVKDSYAA

SEQ ID NO: 1230681 - protein, 9 aa, Homo Sapiens
MSLSRQCST

SEQ ID NO: 1230682 - protein, 9 aa, Homo Sapiens
PIPLMETVE

SEQ ID NO: 1230683 - protein, 9 aa, Homo Sapiens
MITGSLIIG

SEQ ID NO: 1230684 - protein, 9 aa, Homo Sapiens
ALEEEAKLG

SEQ ID NO: 1230685 - protein, 9 aa, Homo Sapiens
VKTLKWGLY

SEQ ID NO: 1230686 - protein, 9 aa, Homo Sapiens
QMRISRISC

SEQ ID NO: 1230687 - protein, 9 aa, Homo Sapiens
DVGRAGRDV

SEQ ID NO: 1230688 - protein, 9 aa, Homo Sapiens
SGSNFTPLK

SEQ ID NO: 1230689 - protein, 9 aa, Homo Sapiens
SAHDCHEFG

SEQ ID NO: 1230690 - protein, 9 aa, Homo Sapiens
SGQKPLICW

SEQ ID NO: 1230691 - protein, 9 aa, Homo Sapiens
TSRCSEQPS

SEQ ID NO: 1230692 - protein, 9 aa, Homo Sapiens
SICRMLSDL

SEQ ID NO: 1230693 - protein, 9 aa, Homo Sapiens
SFMDLKIKL

SEQ ID NO: 1230694 - protein, 9 aa, Homo Sapiens
GTNMHGMKA

SEQ ID NO: 1230695 - protein, 9 aa, Homo Sapiens
VCVKTCSCV

SEQ ID NO: 1230696 - protein, 9 aa, Homo Sapiens
GKWLVSGGD

SEQ ID NO: 1230697 - protein, 9 aa, Homo Sapiens
AYLAVRRHS

SEQ ID NO: 1230698 - protein, 9 aa, Homo Sapiens
KQGIVLKYQ

SEQ ID NO: 1230699 - protein, 9 aa, Homo Sapiens
TQCPSVITT

SEQ ID NO: 1230700 - protein, 9 aa, Homo Sapiens
VGFGNVCVN

SEQ ID NO: 1230701 - protein, 9 aa, Homo Sapiens
GHQSFMTPS

SEQ ID NO: 1230702 - protein, 9 aa, Homo Sapiens
YECCIRGAT

SEQ ID NO: 1230703 - protein, 9 aa, Homo Sapiens
ARKVNSLTA

SEQ ID NO: 1230704 - protein, 9 aa, Homo Sapiens
QLQQSLGLT

SEQ ID NO: 1230705 - protein, 9 aa, Homo Sapiens
KKKQHLCPS

SEQ ID NO: 1230706 - protein, 9 aa, Homo Sapiens
ATSFGILNG

SEQ ID NO: 1230707 - protein, 9 aa, Homo Sapiens
LLHIDQNMY

SEQ ID NO: 1230708 - protein, 9 aa, Homo Sapiens
ANVTVASHL

SEQ ID NO: 1230709 - protein, 9 aa, Homo Sapiens
RPVEEHWTL

SEQ ID NO: 1230710 - protein, 9 aa, Homo Sapiens
NCSEGGEVI

SEQ ID NO: 1230711 - protein, 9 aa, Homo Sapiens
YRFHEYWRF

SEQ ID NO: 1230712 - protein, 9 aa, Homo Sapiens
KENEIRVVL

SEQ ID NO: 1230713 - protein, 9 aa, Homo Sapiens
LLPRAPPEA

SEQ ID NO: 1230714 - protein, 9 aa, Homo Sapiens
VIHIHNKIL

SEQ ID NO: 1230715 - protein, 9 aa, Homo Sapiens
MLMPPLPSE

SEQ ID NO: 1230716 - protein, 9 aa, Homo Sapiens
DGWDLHDAA

SEQ ID NO: 1230717 - protein, 9 aa, Homo Sapiens
ASQLTLVNL

SEQ ID NO: 1230718 - protein, 9 aa, Homo Sapiens
LKQHPALEP

SEQ ID NO: 1230719 - protein, 9 aa, Homo Sapiens
VCQEILERS

SEQ ID NO: 1230720 - protein, 9 aa, Homo Sapiens
FVQMKLPPC

SEQ ID NO: 1230721 - protein, 9 aa, Homo Sapiens
LRYVFKKGD

SEQ ID NO: 1230722 - protein, 9 aa, Homo Sapiens
APHPRPTRR

SEQ ID NO: 1230723 - protein, 9 aa, Homo Sapiens
NTTGTDCEC

SEQ ID NO: 1230724 - protein, 9 aa, Homo Sapiens
SAPTGPRPL

SEQ ID NO: 1230725 - protein, 9 aa, Homo Sapiens
LRADECKTG

SEQ ID NO: 1230726 - protein, 9 aa, Homo Sapiens
SGARRTVTS

SEQ ID NO: 1230727 - protein, 9 aa, Homo Sapiens
IQIFCDTCE

SEQ ID NO: 1230728 - protein, 9 aa, Homo Sapiens
LNLKVRKKM

SEQ ID NO: 1230729 - protein, 9 aa, Homo Sapiens
HVLWDDNHF

SEQ ID NO: 1230730 - protein, 9 aa, Homo Sapiens
SHFKLRECG

SEQ ID NO: 1230731 - protein, 9 aa, Homo Sapiens
QVWLRQKLL

SEQ ID NO: 1230732 - protein, 9 aa, Homo Sapiens
HLHQNRLAP

SEQ ID NO: 1230733 - protein, 9 aa, Homo Sapiens
ENHNDIVDS

SEQ ID NO: 1230734 - protein, 9 aa, Homo Sapiens
LPRCAPPPP

SEQ ID NO: 1230735 - protein, 9 aa, Homo Sapiens
QAAVPAETV

SEQ ID NO: 1230736 - protein, 9 aa, Homo Sapiens
HARAALDKA

SEQ ID NO: 1230737 - protein, 9 aa, Homo Sapiens
VVYMITLLG

SEQ ID NO: 1230738 - protein, 9 aa, Homo Sapiens
YVQVINYPT

SEQ ID NO: 1230739 - protein, 9 aa, Homo Sapiens
SHLSAVAIL

SEQ ID NO: 1230740 - protein, 9 aa, Homo Sapiens
NQSIKDKAL

SEQ ID NO: 1230741 - protein, 9 aa, Homo Sapiens
FMERVKKYD

SEQ ID NO: 1230742 - protein, 9 aa, Homo Sapiens
DGSSDMGRK

SEQ ID NO: 1230743 - protein, 9 aa, Homo Sapiens
CGGTVAAAV

SEQ ID NO: 1230744 - protein, 9 aa, Homo Sapiens
GPNEQPGPM

SEQ ID NO: 1230745 - protein, 9 aa, Homo Sapiens
YLSSQQQAT

SEQ ID NO: 1230746 - protein, 9 aa, Homo Sapiens
LPEECHLSP

SEQ ID NO: 1230747 - protein, 9 aa, Homo Sapiens
SSMNIIGLE

SEQ ID NO: 1230748 - protein, 9 aa, Homo Sapiens
LEVGTETVI

SEQ ID NO: 1230749 - protein, 9 aa, Homo Sapiens
ERRCMLLLF

SEQ ID NO: 1230750 - protein, 9 aa, Homo Sapiens
EDYKAMSRD

SEQ ID NO: 1230751 - protein, 9 aa, Homo Sapiens
GHADLKHFD

SEQ ID NO: 1230752 - protein, 9 aa, Homo Sapiens
CGPAEQRIL

SEQ ID NO: 1230753 - protein, 9 aa, Homo Sapiens
GCFDRQIFI

SEQ ID NO: 1230754 - protein, 9 aa, Homo Sapiens
DDDFRRPPE

SEQ ID NO: 1230755 - protein, 9 aa, Homo Sapiens
QCRQEFGGV

SEQ ID NO: 1230756 - protein, 9 aa, Homo Sapiens
ASTQCAGGV

SEQ ID NO: 1230757 - protein, 9 aa, Homo Sapiens
QTVAMSPLN

SEQ ID NO: 1230758 - protein, 9 aa, Homo Sapiens
SIVKSLEHL

SEQ ID NO: 1230759 - protein, 9 aa, Homo Sapiens
ETRCDDTAA

SEQ ID NO: 1230760 - protein, 9 aa, Homo Sapiens
QKQPKCYRP

SEQ ID NO: 1230761 - protein, 9 aa, Homo Sapiens
ARRTVTSTR

SEQ ID NO: 1230762 - protein, 9 aa, Homo Sapiens
THVYVTIMD

SEQ ID NO: 1230763 - protein, 9 aa, Homo Sapiens
CGVQGVQVQ

SEQ ID NO: 1230764 - protein, 9 aa, Homo Sapiens
KGDPGNRGT

SEQ ID NO: 1230765 - protein, 9 aa, Homo Sapiens
SMQAILTGR

SEQ ID NO: 1230766 - protein, 9 aa, Homo Sapiens
IYGKPGGSL

SEQ ID NO: 1230767 - protein, 9 aa, Homo Sapiens
VKKESINDG

SEQ ID NO: 1230768 - protein, 9 aa, Homo Sapiens
IWTAPRGPG

SEQ ID NO: 1230769 - protein, 9 aa, Homo Sapiens
RHETPPGAD

SEQ ID NO: 1230770 - protein, 9 aa, Homo Sapiens
GKAVSTPLL

SEQ ID NO: 1230771 - protein, 9 aa, Homo Sapiens
AMVQALEEV

SEQ ID NO: 1230772 - protein, 9 aa, Homo Sapiens
RERLTRQHE

SEQ ID NO: 1230773 - protein, 9 aa, Homo Sapiens
VRVGLRNPV

SEQ ID NO: 1230774 - protein, 9 aa, Homo Sapiens
FWRDGRKTC

SEQ ID NO: 1230775 - protein, 9 aa, Homo Sapiens
LHNFLEGDW

SEQ ID NO: 1230776 - protein, 9 aa, Homo Sapiens
LHRWLQQTT

SEQ ID NO: 1230777 - protein, 9 aa, Homo Sapiens
QLLNRWDKL

SEQ ID NO: 1230778 - protein, 9 aa, Homo Sapiens
RSRPRPTKT

SEQ ID NO: 1230779 - protein, 9 aa, Homo Sapiens
GLICARLRG

SEQ ID NO: 1230780 - protein, 9 aa, Homo Sapiens
IEIMGGAKQ

SEQ ID NO: 1230781 - protein, 9 aa, Homo Sapiens
LEPERDVMS

SEQ ID NO: 1230782 - protein, 9 aa, Homo Sapiens
TPTVITVHY

SEQ ID NO: 1230783 - protein, 9 aa, Homo Sapiens
FYQLEKVLP

SEQ ID NO: 1230784 - protein, 9 aa, Homo Sapiens
IIPFLPSVY

SEQ ID NO: 1230785 - protein, 9 aa, Homo Sapiens
ITHLKFLDK

SEQ ID NO: 1230786 - protein, 9 aa, Homo Sapiens
EDGHKLITV

SEQ ID NO: 1230787 - protein, 9 aa, Homo Sapiens
PCSSCPTLI

SEQ ID NO: 1230788 - protein, 9 aa, Homo Sapiens
TWSDSTSQI

SEQ ID NO: 1230789 - protein, 9 aa, Homo Sapiens
ISNPDLMRQ

SEQ ID NO: 1230790 - protein, 9 aa, Homo Sapiens
SVNQIGSGL

SEQ ID NO: 1230791 - protein, 9 aa, Homo Sapiens
EPDILDCLY

SEQ ID NO: 1230792 - protein, 9 aa, Homo Sapiens
TQTHIQAQT

SEQ ID NO: 1230793 - protein, 9 aa, Homo Sapiens
LIEYISYCW

SEQ ID NO: 1230794 - protein, 9 aa, Homo Sapiens
PEEHMAYIW

SEQ ID NO: 1230795 - protein, 9 aa, Homo Sapiens
GKEDNKTLK

SEQ ID NO: 1230796 - protein, 9 aa, Homo Sapiens
ERPVCCVEA

SEQ ID NO: 1230797 - protein, 9 aa, Homo Sapiens
YKAEEVEDE

SEQ ID NO: 1230798 - protein, 9 aa, Homo Sapiens
RMKWDWMHT

SEQ ID NO: 1230799 - protein, 9 aa, Homo Sapiens
HQSAMYEIC

SEQ ID NO: 1230800 - protein, 9 aa, Homo Sapiens
RRHAMPCSR

SEQ ID NO: 1230801 - protein, 9 aa, Homo Sapiens
DENALNRIL

SEQ ID NO: 1230802 - protein, 9 aa, Homo Sapiens
STLTNHHII

SEQ ID NO: 1230803 - protein, 9 aa, Homo Sapiens
DDVFLCGKC

SEQ ID NO: 1230804 - protein, 9 aa, Homo Sapiens
GVLKRRAGD

SEQ ID NO: 1230805 - protein, 9 aa, Homo Sapiens
NVKTAPQSR

SEQ ID NO: 1230806 - protein, 9 aa, Homo Sapiens
EKRANPCPS

SEQ ID NO: 1230807 - protein, 9 aa, Homo Sapiens
QQLEDKTNV

SEQ ID NO: 1230808 - protein, 9 aa, Homo Sapiens
RCDSIHFAV

SEQ ID NO: 1230809 - protein, 9 aa, Homo Sapiens
TLMLFSRVI

SEQ ID NO: 1230810 - protein, 9 aa, Homo Sapiens
EGDEFDDWE

SEQ ID NO: 1230811 - protein, 9 aa, Homo Sapiens
LERGTGLGL

SEQ ID NO: 1230812 - protein, 9 aa, Homo Sapiens
RVKLDDSRL

SEQ ID NO: 1230813 - protein, 9 aa, Homo Sapiens
PGTCTGNRK

SEQ ID NO: 1230814 - protein, 9 aa, Homo Sapiens
RMDHMDRCF

SEQ ID NO: 1230815 - protein, 9 aa, Homo Sapiens
HSLGWTLRD

SEQ ID NO: 1230816 - protein, 9 aa, Homo Sapiens
QLPPQSQTH

SEQ ID NO: 1230817 - protein, 9 aa, Homo Sapiens
WGCNVSRKP

SEQ ID NO: 1230818 - protein, 9 aa, Homo Sapiens
DLCHKSGGR

SEQ ID NO: 1230819 - protein, 9 aa, Homo Sapiens
FQQLEDKTN

SEQ ID NO: 1230820 - protein, 9 aa, Homo Sapiens
KKSSRWPTM

SEQ ID NO: 1230821 - protein, 9 aa, Homo Sapiens
SNDLDTQDP

SEQ ID NO: 1230822 - protein, 9 aa, Homo Sapiens
TEMVLICGN

SEQ ID NO: 1230823 - protein, 9 aa, Homo Sapiens
PLASPGTSS

SEQ ID NO: 1230824 - protein, 9 aa, Homo Sapiens
PKNVRMAIG

SEQ ID NO: 1230825 - protein, 9 aa, Homo Sapiens
VIIQGKNQD

SEQ ID NO: 1230826 - protein, 9 aa, Homo Sapiens
VCCMVEEVW

SEQ ID NO: 1230827 - protein, 9 aa, Homo Sapiens
HIVKVDLKF

SEQ ID NO: 1230828 - protein, 9 aa, Homo Sapiens
IAIPSHPTE

SEQ ID NO: 1230829 - protein, 9 aa, Homo Sapiens
LLHVLASAG

SEQ ID NO: 1230830 - protein, 9 aa, Homo Sapiens
RHFTLRHWL

SEQ ID NO: 1230831 - protein, 9 aa, Homo Sapiens
SQFFITYGI

SEQ ID NO: 1230832 - protein, 9 aa, Homo Sapiens
AHRVYGDII

SEQ ID NO: 1230833 - protein, 9 aa, Homo Sapiens
PTSPSLASC

SEQ ID NO: 1230834 - protein, 9 aa, Homo Sapiens
LEEWLKNLR

SEQ ID NO: 1230835 - protein, 9 aa, Homo Sapiens
SQVYGVPHL

SEQ ID NO: 1230836 - protein, 9 aa, Homo Sapiens
WQDVIMKGA

SEQ ID NO: 1230837 - protein, 9 aa, Homo Sapiens
EEEQVMLDS

SEQ ID NO: 1230838 - protein, 9 aa, Homo Sapiens
RKCKAKSCI

SEQ ID NO: 1230839 - protein, 9 aa, Homo Sapiens
DIRAEADAF

SEQ ID NO: 1230840 - protein, 9 aa, Homo Sapiens
RVPAASPST

SEQ ID NO: 1230841 - protein, 9 aa, Homo Sapiens
WDPPEEEIP

SEQ ID NO: 1230842 - protein, 9 aa, Homo Sapiens
KRSGECQSN

SEQ ID NO: 1230843 - protein, 9 aa, Homo Sapiens
CQYNAVVGA

SEQ ID NO: 1230844 - protein, 9 aa, Homo Sapiens
EGVASFETN

SEQ ID NO: 1230845 - protein, 9 aa, Homo Sapiens
AMCVCPFCQ

SEQ ID NO: 1230846 - protein, 9 aa, Homo Sapiens
FDDVPMSPL

SEQ ID NO: 1230847 - protein, 9 aa, Homo Sapiens
DKLKNIFMF

SEQ ID NO: 1230848 - protein, 9 aa, Homo Sapiens
LQWSPTRPV

SEQ ID NO: 1230849 - protein, 9 aa, Homo Sapiens
GQSDGVIEP

SEQ ID NO: 1230850 - protein, 9 aa, Homo Sapiens
EIDYASCKC

SEQ ID NO: 1230851 - protein, 9 aa, Homo Sapiens
TVTFNPKYG

SEQ ID NO: 1230852 - protein, 9 aa, Homo Sapiens
RSGGQVGIR

SEQ ID NO: 1230853 - protein, 9 aa, Homo Sapiens
HLARECDRQ

SEQ ID NO: 1230854 - protein, 9 aa, Homo Sapiens
SAPVPLAEP

SEQ ID NO: 1230855 - protein, 9 aa, Homo Sapiens
AQGHPALHQ

SEQ ID NO: 1230856 - protein, 9 aa, Homo Sapiens
STSWHCSMA

SEQ ID NO: 1230857 - protein, 9 aa, Homo Sapiens
PATKLSPDS

SEQ ID NO: 1230858 - protein, 9 aa, Homo Sapiens
VRKSRPDEG

SEQ ID NO: 1230859 - protein, 9 aa, Homo Sapiens
QAYTSLQFS

SEQ ID NO: 1230860 - protein, 9 aa, Homo Sapiens
LRLEEAIGI

SEQ ID NO: 1230861 - protein, 9 aa, Homo Sapiens
TPVEGSKIG

SEQ ID NO: 1230862 - protein, 9 aa, Homo Sapiens
LEGMLNPFG

SEQ ID NO: 1230863 - protein, 9 aa, Homo Sapiens
HFNGVDELL

SEQ ID NO: 1230864 - protein, 9 aa, Homo Sapiens
RLQLDINTE

SEQ ID NO: 1230865 - protein, 9 aa, Homo Sapiens
RVTEGIKEY

SEQ ID NO: 1230866 - protein, 9 aa, Homo Sapiens
MASRMESTG

SEQ ID NO: 1230867 - protein, 9 aa, Homo Sapiens
FLHEHKTVY

SEQ ID NO: 1230868 - protein, 9 aa, Homo Sapiens
ILIMKVNFD

SEQ ID NO: 1230869 - protein, 9 aa, Homo Sapiens
GGPWLRMCP

SEQ ID NO: 1230870 - protein, 9 aa, Homo Sapiens
QPESICSDL

SEQ ID NO: 1230871 - protein, 9 aa, Homo Sapiens
DSKGGEKEE

SEQ ID NO: 1230872 - protein, 9 aa, Homo Sapiens
RRVAQVQRL

SEQ ID NO: 1230873 - protein, 9 aa, Homo Sapiens
KNVQQARSP

SEQ ID NO: 1230874 - protein, 9 aa, Homo Sapiens
NLNPAQKLI

SEQ ID NO: 1230875 - protein, 9 aa, Homo Sapiens
VMLWERLSS

SEQ ID NO: 1230876 - protein, 9 aa, Homo Sapiens
KKSEEREMS

SEQ ID NO: 1230877 - protein, 9 aa, Homo Sapiens
GPEVETNVK

SEQ ID NO: 1230878 - protein, 9 aa, Homo Sapiens
TKVMCIGLR

SEQ ID NO: 1230879 - protein, 9 aa, Homo Sapiens
PPLTKGNAK

SEQ ID NO: 1230880 - protein, 9 aa, Homo Sapiens
FGAGGPEMA

SEQ ID NO: 1230881 - protein, 9 aa, Homo Sapiens
TKPSFSDMR

SEQ ID NO: 1230882 - protein, 9 aa, Homo Sapiens
VNQSKATPQ

SEQ ID NO: 1230883 - protein, 9 aa, Homo Sapiens
ILRLLHQVF

SEQ ID NO: 1230884 - protein, 9 aa, Homo Sapiens
RMGGRVDFD

SEQ ID NO: 1230885 - protein, 9 aa, Homo Sapiens
THEMTHTGE

SEQ ID NO: 1230886 - protein, 9 aa, Homo Sapiens
RPPARRSGR

SEQ ID NO: 1230887 - protein, 9 aa, Homo Sapiens
ESAGTIFLI

SEQ ID NO: 1230888 - protein, 9 aa, Homo Sapiens
RTAVWVLNN

SEQ ID NO: 1230889 - protein, 9 aa, Homo Sapiens
VNSIARGQK

SEQ ID NO: 1230890 - protein, 9 aa, Homo Sapiens
SVEALVMAM

SEQ ID NO: 1230891 - protein, 9 aa, Homo Sapiens
KKIEGIPET

SEQ ID NO: 1230892 - protein, 9 aa, Homo Sapiens
HRYTHRHTQ

SEQ ID NO: 1230893 - protein, 9 aa, Homo Sapiens
HSDHKPYLL

SEQ ID NO: 1230894 - protein, 9 aa, Homo Sapiens
LIGTAWGRL

SEQ ID NO: 1230895 - protein, 9 aa, Homo Sapiens
LIPKTWHSA

SEQ ID NO: 1230896 - protein, 9 aa, Homo Sapiens
LHVTATETH

SEQ ID NO: 1230897 - protein, 9 aa, Homo Sapiens
EKQNENIRK

SEQ ID NO: 1230898 - protein, 9 aa, Homo Sapiens
KRQRPDDLM

SEQ ID NO: 1230899 - protein, 9 aa, Homo Sapiens
PEQCCAYYN

SEQ ID NO: 1230900 - protein, 9 aa, Homo Sapiens
ATVYPGLEL

SEQ ID NO: 1230901 - protein, 9 aa, Homo Sapiens
VLQPLYPPI

SEQ ID NO: 1230902 - protein, 9 aa, Homo Sapiens
EWPELRQFL

SEQ ID NO: 1230903 - protein, 9 aa, Homo Sapiens
VWEEGPGGD

SEQ ID NO: 1230904 - protein, 9 aa, Homo Sapiens
MPIYCLFGD

SEQ ID NO: 1230905 - protein, 9 aa, Homo Sapiens
DLPSECQML

SEQ ID NO: 1230906 - protein, 9 aa, Homo Sapiens
IQIPNLCGV

SEQ ID NO: 1230907 - protein, 9 aa, Homo Sapiens
PDGSGQYTH

SEQ ID NO: 1230908 - protein, 9 aa, Homo Sapiens
LTCTNIDLL

SEQ ID NO: 1230909 - protein, 9 aa, Homo Sapiens
LLQQPRSLT

SEQ ID NO: 1230910 - protein, 9 aa, Homo Sapiens
AEKGEEKGL

SEQ ID NO: 1230911 - protein, 9 aa, Homo Sapiens
LARNLIYFV

SEQ ID NO: 1230912 - protein, 9 aa, Homo Sapiens
KFTSLACGN

SEQ ID NO: 1230913 - protein, 9 aa, Homo Sapiens
LVERVLYSM

SEQ ID NO: 1230914 - protein, 8 aa, Homo Sapiens
CRLKRQEF

SEQ ID NO: 1230915 - protein, 9 aa, Homo Sapiens
SEDSTPAFA

SEQ ID NO: 1230916 - protein, 9 aa, Homo Sapiens
GTHRHTHTH

SEQ ID NO: 1230917 - protein, 9 aa, Homo Sapiens
VDTNHNEEY

SEQ ID NO: 1230918 - protein, 9 aa, Homo Sapiens
AGSLSLRRS

SEQ ID NO: 1230919 - protein, 9 aa, Homo Sapiens
TPDHPKALK

SEQ ID NO: 1230920 - protein, 9 aa, Homo Sapiens
PIPGDKPLP

SEQ ID NO: 1230921 - protein, 9 aa, Homo Sapiens
VKNVKSEEE

SEQ ID NO: 1230922 - protein, 9 aa, Homo Sapiens
ITVNIAGLL

SEQ ID NO: 1230923 - protein, 9 aa, Homo Sapiens
NNRTYHIDD

SEQ ID NO: 1230924 - protein, 9 aa, Homo Sapiens
NNDTLGSVH

SEQ ID NO: 1230925 - protein, 9 aa, Homo Sapiens
CGTVRRPDS

SEQ ID NO: 1230926 - protein, 9 aa, Homo Sapiens
VLFSMFLSM

SEQ ID NO: 1230927 - protein, 9 aa, Homo Sapiens
KTMSKEELH

SEQ ID NO: 1230928 - protein, 9 aa, Homo Sapiens
EKSYNCKVC

SEQ ID NO: 1230929 - protein, 9 aa, Homo Sapiens
APDPTQNAW

SEQ ID NO: 1230930 - protein, 9 aa, Homo Sapiens
LVPEIIGDC

SEQ ID NO: 1230931 - protein, 9 aa, Homo Sapiens
MAVAVFLWD

SEQ ID NO: 1230932 - protein, 9 aa, Homo Sapiens
NINTPFDRI

SEQ ID NO: 1230933 - protein, 9 aa, Homo Sapiens
IGVIIGKIA

SEQ ID NO: 1230934 - protein, 9 aa, Homo Sapiens
RQHEDGEFW

SEQ ID NO: 1230935 - protein, 9 aa, Homo Sapiens
CHFHRLILT

SEQ ID NO: 1230936 - protein, 9 aa, Homo Sapiens
TVLVLWPLY

SEQ ID NO: 1230937 - protein, 9 aa, Homo Sapiens
DTIIFQLKE

SEQ ID NO: 1230938 - protein, 9 aa, Homo Sapiens
VRGPEAPDG

SEQ ID NO: 1230939 - protein, 9 aa, Homo Sapiens
IRQKVWFFS

SEQ ID NO: 1230940 - protein, 9 aa, Homo Sapiens
NLASEDIPD

SEQ ID NO: 1230941 - protein, 9 aa, Homo Sapiens
ESTYVDITY

SEQ ID NO: 1230942 - protein, 9 aa, Homo Sapiens
QVDGEPWMH

SEQ ID NO: 1230943 - protein, 9 aa, Homo Sapiens
AVGIPLSEY

SEQ ID NO: 1230944 - protein, 9 aa, Homo Sapiens
LQLTAAGPR

SEQ ID NO: 1230945 - protein, 9 aa, Homo Sapiens
PDPKTWKVN

SEQ ID NO: 1230946 - protein, 9 aa, Homo Sapiens
ECRMAAKLL

SEQ ID NO: 1230947 - protein, 9 aa, Homo Sapiens
KAFRALLLN

SEQ ID NO: 1230948 - protein, 9 aa, Homo Sapiens
VSEKAVAFS

SEQ ID NO: 1230949 - protein, 9 aa, Homo Sapiens
AKITHVDFP

SEQ ID NO: 1230950 - protein, 9 aa, Homo Sapiens
GDSGPHTFP

SEQ ID NO: 1230951 - protein, 9 aa, Homo Sapiens
SGMRAAGRH

SEQ ID NO: 1230952 - protein, 9 aa, Homo Sapiens
SLQTNWTTP

SEQ ID NO: 1230953 - protein, 9 aa, Homo Sapiens
GNNRLKLLV

SEQ ID NO: 1230954 - protein, 9 aa, Homo Sapiens
VFFPCCLLV

SEQ ID NO: 1230955 - protein, 9 aa, Homo Sapiens
PKRERMMLM

SEQ ID NO: 1230956 - protein, 9 aa, Homo Sapiens
KKYSYMTIC

SEQ ID NO: 1230957 - protein, 9 aa, Homo Sapiens
LPYPLLSTP

SEQ ID NO: 1230958 - protein, 9 aa, Homo Sapiens
YLPSPGELY

SEQ ID NO: 1230959 - protein, 9 aa, Homo Sapiens
IRAEADAFM

SEQ ID NO: 1230960 - protein, 9 aa, Homo Sapiens
KILRLLHQV

SEQ ID NO: 1230961 - protein, 9 aa, Homo Sapiens
MNKLMMDKY

SEQ ID NO: 1230962 - protein, 9 aa, Homo Sapiens
DVKDKDTTE

SEQ ID NO: 1230963 - protein, 9 aa, Homo Sapiens
WQLKTKEQE

SEQ ID NO: 1230964 - protein, 9 aa, Homo Sapiens
RSANKAPGS

SEQ ID NO: 1230965 - protein, 9 aa, Homo Sapiens
MVKCNNQTI

SEQ ID NO: 1230966 - protein, 9 aa, Homo Sapiens
AALGMFNSS

SEQ ID NO: 1230967 - protein, 9 aa, Homo Sapiens
PFLIQLHSC

SEQ ID NO: 1230968 - protein, 9 aa, Homo Sapiens
TSSNLERML

SEQ ID NO: 1230969 - protein, 9 aa, Homo Sapiens
VLNYSASYS

SEQ ID NO: 1230970 - protein, 9 aa, Homo Sapiens
GCEEDMLDG

SEQ ID NO: 1230971 - protein, 9 aa, Homo Sapiens
LVPELVGYC

SEQ ID NO: 1230972 - protein, 9 aa, Homo Sapiens
ILRSLTDDV

SEQ ID NO: 1230973 - protein, 9 aa, Homo Sapiens
REIQSAAFS

SEQ ID NO: 1230974 - protein, 9 aa, Homo Sapiens
VERTAVWVL

SEQ ID NO: 1230975 - protein, 9 aa, Homo Sapiens
QQQATVMKQ

SEQ ID NO: 1230976 - protein, 9 aa, Homo Sapiens
MDANHCSLG

SEQ ID NO: 1230977 - protein, 9 aa, Homo Sapiens
LAHRRFHST

SEQ ID NO: 1230978 - protein, 9 aa, Homo Sapiens
MAKHPRNTP

SEQ ID NO: 1230979 - protein, 9 aa, Homo Sapiens
EHIPDVSLI

SEQ ID NO: 1230980 - protein, 9 aa, Homo Sapiens
LVPTFLRVA

SEQ ID NO: 1230981 - protein, 9 aa, Homo Sapiens
TPSCSVLHC

SEQ ID NO: 1230982 - protein, 9 aa, Homo Sapiens
QETAYEYKY

SEQ ID NO: 1230983 - protein, 9 aa, Homo Sapiens
HSTAFPEVS

SEQ ID NO: 1230984 - protein, 9 aa, Homo Sapiens
LLMKQALDF

SEQ ID NO: 1230985 - protein, 9 aa, Homo Sapiens
RILEKLAER

SEQ ID NO: 1230986 - protein, 9 aa, Homo Sapiens
LQKFMDCPY

SEQ ID NO: 1230987 - protein, 9 aa, Homo Sapiens
LPLLLVLMA

SEQ ID NO: 1230988 - protein, 9 aa, Homo Sapiens
AQGVLLIYD

SEQ ID NO: 1230989 - protein, 9 aa, Homo Sapiens
LYKRKEIQK

SEQ ID NO: 1230990 - protein, 9 aa, Homo Sapiens
KMIMVDDSK

SEQ ID NO: 1230991 - protein, 9 aa, Homo Sapiens
LQYSNVYYP

SEQ ID NO: 1230992 - protein, 9 aa, Homo Sapiens
EIVVWTNLT

SEQ ID NO: 1230993 - protein, 9 aa, Homo Sapiens
SHKAARLGI

SEQ ID NO: 1230994 - protein, 9 aa, Homo Sapiens
VDVSSVKQN

SEQ ID NO: 1230995 - protein, 9 aa, Homo Sapiens
SSHLSVIAL

SEQ ID NO: 1230996 - protein, 9 aa, Homo Sapiens
VARKLELTN

SEQ ID NO: 1230997 - protein, 9 aa, Homo Sapiens
LGRSAPPST

SEQ ID NO: 1230998 - protein, 9 aa, Homo Sapiens
MNPHPKKIR

SEQ ID NO: 1230999 - protein, 9 aa, Homo Sapiens
VPTTTTTTE

SEQ ID NO: 1231000 - protein, 9 aa, Homo Sapiens
AIYYVMSGP

SEQ ID NO: 1231001 - protein, 9 aa, Homo Sapiens
ASHCSKQRH

SEQ ID NO: 1231002 - protein, 9 aa, Homo Sapiens
DHSVKGKHR

SEQ ID NO: 1231003 - protein, 9 aa, Homo Sapiens
CGPLRIFVY

SEQ ID NO: 1231004 - protein, 9 aa, Homo Sapiens
ALSSMICVP

SEQ ID NO: 1231005 - protein, 9 aa, Homo Sapiens
ASIYGQFVA

SEQ ID NO: 1231006 - protein, 9 aa, Homo Sapiens
CLANVSWAA

SEQ ID NO: 1231007 - protein, 9 aa, Homo Sapiens
PPQTPQHWG

SEQ ID NO: 1231008 - protein, 9 aa, Homo Sapiens
EADRDSMRC

SEQ ID NO: 1231009 - protein, 9 aa, Homo Sapiens
QKRSGECQS

SEQ ID NO: 1231010 - protein, 9 aa, Homo Sapiens
IINLGVTLC

SEQ ID NO: 1231011 - protein, 9 aa, Homo Sapiens
CLVQGFGST

SEQ ID NO: 1231012 - protein, 9 aa, Homo Sapiens
TPAAGSLVQ

SEQ ID NO: 1231013 - protein, 9 aa, Homo Sapiens
MHVERSTLD

SEQ ID NO: 1231014 - protein, 9 aa, Homo Sapiens
ENFTKDITE

SEQ ID NO: 1231015 - protein, 9 aa, Homo Sapiens
QVIVVLKDA

SEQ ID NO: 1231016 - protein, 9 aa, Homo Sapiens
NGHHRIQVI

SEQ ID NO: 1231017 - protein, 9 aa, Homo Sapiens
RSRLTATST

SEQ ID NO: 1231018 - protein, 9 aa, Homo Sapiens
ELHIMEVIL

SEQ ID NO: 1231019 - protein, 9 aa, Homo Sapiens
VLPSPGPVL

SEQ ID NO: 1231020 - protein, 9 aa, Homo Sapiens
FIRPFYKTM

SEQ ID NO: 1231021 - protein, 9 aa, Homo Sapiens
MCTEEGPLC

SEQ ID NO: 1231022 - protein, 9 aa, Homo Sapiens
FKECNQDVK

SEQ ID NO: 1231023 - protein, 9 aa, Homo Sapiens
HTALHVAAA

SEQ ID NO: 1231024 - protein, 9 aa, Homo Sapiens
ASRATKSGT

SEQ ID NO: 1231025 - protein, 9 aa, Homo Sapiens
QILYQTEQY

SEQ ID NO: 1231026 - protein, 9 aa, Homo Sapiens
VMLCHGVKI

SEQ ID NO: 1231027 - protein, 9 aa, Homo Sapiens
SRSYKQRLN

SEQ ID NO: 1231028 - protein, 9 aa, Homo Sapiens
TLCLYVLMQ

SEQ ID NO: 1231029 - protein, 9 aa, Homo Sapiens
DRFHSFDAL

SEQ ID NO: 1231030 - protein, 9 aa, Homo Sapiens
TRSFLKWTL

SEQ ID NO: 1231031 - protein, 9 aa, Homo Sapiens
TKLGLRDDK

SEQ ID NO: 1231032 - protein, 9 aa, Homo Sapiens
HQRVHTREN

SEQ ID NO: 1231033 - protein, 9 aa, Homo Sapiens
LGTSQDVTL

SEQ ID NO: 1231034 - protein, 9 aa, Homo Sapiens
DADSMYVEK

SEQ ID NO: 1231035 - protein, 9 aa, Homo Sapiens
AAQRDVVDF

SEQ ID NO: 1231036 - protein, 9 aa, Homo Sapiens
SQLQVHMAL

SEQ ID NO: 1231037 - protein, 9 aa, Homo Sapiens
NANALARYD

SEQ ID NO: 1231038 - protein, 9 aa, Homo Sapiens
SVRLVPSFS

SEQ ID NO: 1231039 - protein, 9 aa, Homo Sapiens
VEAVTRLTR

SEQ ID NO: 1231040 - protein, 9 aa, Homo Sapiens
IDCLEQELL

SEQ ID NO: 1231041 - protein, 9 aa, Homo Sapiens
ATGVSTHVL

SEQ ID NO: 1231042 - protein, 9 aa, Homo Sapiens
TVITGGASG

SEQ ID NO: 1231043 - protein, 9 aa, Homo Sapiens
KRRRMSPSN

SEQ ID NO: 1231044 - protein, 9 aa, Homo Sapiens
HDSITSVVV

SEQ ID NO: 1231045 - protein, 9 aa, Homo Sapiens
LKKGLQRGR

SEQ ID NO: 1231046 - protein, 9 aa, Homo Sapiens
TTFFIDCMT

SEQ ID NO: 1231047 - protein, 9 aa, Homo Sapiens
NEHMKLHSD

SEQ ID NO: 1231048 - protein, 9 aa, Homo Sapiens
TFIWFLSSV

SEQ ID NO: 1231049 - protein, 9 aa, Homo Sapiens
GVGFFIHCR

SEQ ID NO: 1231050 - protein, 9 aa, Homo Sapiens
PDHLGCAGS

SEQ ID NO: 1231051 - protein, 9 aa, Homo Sapiens
QQQHLLQHQ

SEQ ID NO: 1231052 - protein, 9 aa, Homo Sapiens
LCLKRHVNL

SEQ ID NO: 1231053 - protein, 9 aa, Homo Sapiens
VKEFFTLIE

SEQ ID NO: 1231054 - protein, 9 aa, Homo Sapiens
VPKCDVTQS

SEQ ID NO: 1231055 - protein, 9 aa, Homo Sapiens
MPPTTTEVI

SEQ ID NO: 1231056 - protein, 9 aa, Homo Sapiens
TIFFGALFG

SEQ ID NO: 1231057 - protein, 9 aa, Homo Sapiens
IIFYCDFFY

SEQ ID NO: 1231058 - protein, 9 aa, Homo Sapiens
DSFHMVSLH

SEQ ID NO: 1231059 - protein, 9 aa, Homo Sapiens
TEMLATGAH

SEQ ID NO: 1231060 - protein, 9 aa, Homo Sapiens
STLPKYIFD

SEQ ID NO: 1231061 - protein, 9 aa, Homo Sapiens
TATYADSGP

SEQ ID NO: 1231062 - protein, 9 aa, Homo Sapiens
TQSEGSDSA

SEQ ID NO: 1231063 - protein, 9 aa, Homo Sapiens
EVNELKKQL

SEQ ID NO: 1231064 - protein, 9 aa, Homo Sapiens
IRSNPENNV

SEQ ID NO: 1231065 - protein, 9 aa, Homo Sapiens
QWSLGNDTP

SEQ ID NO: 1231066 - protein, 9 aa, Homo Sapiens
LDPHRVRGR

SEQ ID NO: 1231067 - protein, 9 aa, Homo Sapiens
DTSYYKLPL

SEQ ID NO: 1231068 - protein, 9 aa, Homo Sapiens
RKNWQPLSK

SEQ ID NO: 1231069 - protein, 9 aa, Homo Sapiens
SHSRSDLSV

SEQ ID NO: 1231070 - protein, 9 aa, Homo Sapiens
VFGGPDSFG

SEQ ID NO: 1231071 - protein, 9 aa, Homo Sapiens
AQTCDPAAE

SEQ ID NO: 1231072 - protein, 9 aa, Homo Sapiens
MTFMERVKK

SEQ ID NO: 1231073 - protein, 9 aa, Homo Sapiens
DNYLWSPGG

SEQ ID NO: 1231074 - protein, 9 aa, Homo Sapiens
MGIVSNSLM

SEQ ID NO: 1231075 - protein, 9 aa, Homo Sapiens
IFKIPATVS

SEQ ID NO: 1231076 - protein, 9 aa, Homo Sapiens
SVKVWLAAV

SEQ ID NO: 1231077 - protein, 9 aa, Homo Sapiens
TINNKRNGV

SEQ ID NO: 1231078 - protein, 9 aa, Homo Sapiens
MGLSDTATY

SEQ ID NO: 1231079 - protein, 9 aa, Homo Sapiens
MGPWGEPEI

SEQ ID NO: 1231080 - protein, 9 aa, Homo Sapiens
EKQRQRLEE

SEQ ID NO: 1231081 - protein, 9 aa, Homo Sapiens
GFLLGGIGV

SEQ ID NO: 1231082 - protein, 9 aa, Homo Sapiens
TQSKAIMGC

SEQ ID NO: 1231083 - protein, 9 aa, Homo Sapiens
STRLEAMFS

SEQ ID NO: 1231084 - protein, 9 aa, Homo Sapiens
QPMGPRIIA

SEQ ID NO: 1231085 - protein, 9 aa, Homo Sapiens
AKQADVVQV

SEQ ID NO: 1231086 - protein, 9 aa, Homo Sapiens
QTSSQAKVL

SEQ ID NO: 1231087 - protein, 9 aa, Homo Sapiens
YKYHENGTG

SEQ ID NO: 1231088 - protein, 9 aa, Homo Sapiens
SICSDLESS

SEQ ID NO: 1231089 - protein, 9 aa, Homo Sapiens
EKLPPKKKC

SEQ ID NO: 1231090 - protein, 9 aa, Homo Sapiens
QCSKMTLIQ

SEQ ID NO: 1231091 - protein, 9 aa, Homo Sapiens
IPGSSNQIF

SEQ ID NO: 1231092 - protein, 9 aa, Homo Sapiens
KVWYLEEER

SEQ ID NO: 1231093 - protein, 9 aa, Homo Sapiens
NCVTNKANV

SEQ ID NO: 1231094 - protein, 9 aa, Homo Sapiens
IFYQLLLLG

SEQ ID NO: 1231095 - protein, 9 aa, Homo Sapiens
TIAFAHNST

SEQ ID NO: 1231096 - protein, 9 aa, Homo Sapiens
DCYNPAAVV

SEQ ID NO: 1231097 - protein, 9 aa, Homo Sapiens
ETPPVDGLG

SEQ ID NO: 1231098 - protein, 9 aa, Homo Sapiens
SEWKSSQIG

SEQ ID NO: 1231099 - protein, 9 aa, Homo Sapiens
SFASTVCHP

SEQ ID NO: 1231100 - protein, 9 aa, Homo Sapiens
SATAEYSRL

SEQ ID NO: 1231101 - protein, 9 aa, Homo Sapiens
SLLGCRHYV

SEQ ID NO: 1231102 - protein, 9 aa, Homo Sapiens
EASLEYAKV

SEQ ID NO: 1231103 - protein, 9 aa, Homo Sapiens
YFRNRHPGA

SEQ ID NO: 1231104 - protein, 9 aa, Homo Sapiens
DMFSDWDKW

SEQ ID NO: 1231105 - protein, 9 aa, Homo Sapiens
KEKQKWDAD

SEQ ID NO: 1231106 - protein, 9 aa, Homo Sapiens
FSVIDQYVD

SEQ ID NO: 1231107 - protein, 9 aa, Homo Sapiens
LQCSQKDLD

SEQ ID NO: 1231108 - protein, 9 aa, Homo Sapiens
VLCQIVNNL

SEQ ID NO: 1231109 - protein, 9 aa, Homo Sapiens
DLTHLRDLR

SEQ ID NO: 1231110 - protein, 9 aa, Homo Sapiens
SDENEQHFG

SEQ ID NO: 1231111 - protein, 9 aa, Homo Sapiens
TVYRDLKLD

SEQ ID NO: 1231112 - protein, 9 aa, Homo Sapiens
QLDLSHGFV

SEQ ID NO: 1231113 - protein, 9 aa, Homo Sapiens
LWPSSVLPT

SEQ ID NO: 1231114 - protein, 9 aa, Homo Sapiens
SKSAGNLDE

SEQ ID NO: 1231115 - protein, 9 aa, Homo Sapiens
PSMSEITSE

SEQ ID NO: 1231116 - protein, 9 aa, Homo Sapiens
AMLLLWVPG

SEQ ID NO: 1231117 - protein, 9 aa, Homo Sapiens
GTVKMIMVD

SEQ ID NO: 1231118 - protein, 9 aa, Homo Sapiens
ELKADLLKR

SEQ ID NO: 1231119 - protein, 9 aa, Homo Sapiens
SLSVNHSSN

SEQ ID NO: 1231120 - protein, 9 aa, Homo Sapiens
SISLALHLQ

SEQ ID NO: 1231121 - protein, 9 aa, Homo Sapiens
SFPYPGFNM

SEQ ID NO: 1231122 - protein, 9 aa, Homo Sapiens
RHAGPCLPR

SEQ ID NO: 1231123 - protein, 9 aa, Homo Sapiens
SSSAGRKKF

SEQ ID NO: 1231124 - protein, 9 aa, Homo Sapiens
LYETHHRVT

SEQ ID NO: 1231125 - protein, 9 aa, Homo Sapiens
SCEIYGRRY

SEQ ID NO: 1231126 - protein, 9 aa, Homo Sapiens
KWTHPRSPF

SEQ ID NO: 1231127 - protein, 9 aa, Homo Sapiens
ILAAQSVIK

SEQ ID NO: 1231128 - protein, 9 aa, Homo Sapiens
MKIIVEDVD

SEQ ID NO: 1231129 - protein, 9 aa, Homo Sapiens
QKCPDGHIV

SEQ ID NO: 1231130 - protein, 9 aa, Homo Sapiens
CGKCFICRR

SEQ ID NO: 1231131 - protein, 9 aa, Homo Sapiens
HHNCAPEFQ

SEQ ID NO: 1231132 - protein, 9 aa, Homo Sapiens
ANGFITLVN

SEQ ID NO: 1231133 - protein, 9 aa, Homo Sapiens
RTLYTIMNS

SEQ ID NO: 1231134 - protein, 9 aa, Homo Sapiens
PLNPRPCQI

SEQ ID NO: 1231135 - protein, 9 aa, Homo Sapiens
TFYDECGKN

SEQ ID NO: 1231136 - protein, 9 aa, Homo Sapiens
QAAIKEQNP

SEQ ID NO: 1231137 - protein, 9 aa, Homo Sapiens
SHPLLMFSF

SEQ ID NO: 1231138 - protein, 9 aa, Homo Sapiens
RIICTYHPN

SEQ ID NO: 1231139 - protein, 9 aa, Homo Sapiens
FVEITKKYT

SEQ ID NO: 1231140 - protein, 9 aa, Homo Sapiens
YEVQAEKNQ

SEQ ID NO: 1231141 - protein, 9 aa, Homo Sapiens
VTADTVKEA

SEQ ID NO: 1231142 - protein, 9 aa, Homo Sapiens
LHPYLTEEA

SEQ ID NO: 1231143 - protein, 9 aa, Homo Sapiens
LPAPGHFRH

SEQ ID NO: 1231144 - protein, 9 aa, Homo Sapiens
LMATYLAQA

SEQ ID NO: 1231145 - protein, 9 aa, Homo Sapiens
SDSERSESS

SEQ ID NO: 1231146 - protein, 9 aa, Homo Sapiens
VVVASEVVE

SEQ ID NO: 1231147 - protein, 9 aa, Homo Sapiens
LYIPKALQK

SEQ ID NO: 1231148 - protein, 9 aa, Homo Sapiens
NALHVDYRT

SEQ ID NO: 1231149 - protein, 9 aa, Homo Sapiens
SSHSTTPSW

SEQ ID NO: 1231150 - protein, 9 aa, Homo Sapiens
HAEMHDDAK

SEQ ID NO: 1231151 - protein, 9 aa, Homo Sapiens
TVITIPRPS

SEQ ID NO: 1231152 - protein, 9 aa, Homo Sapiens
EIVSVAMVQ

SEQ ID NO: 1231153 - protein, 9 aa, Homo Sapiens
QIYKVWFYP

SEQ ID NO: 1231154 - protein, 9 aa, Homo Sapiens
YRKKEGENI

SEQ ID NO: 1231155 - protein, 9 aa, Homo Sapiens
PVAFVVTQH

SEQ ID NO: 1231156 - protein, 9 aa, Homo Sapiens
IRASFSEAK

SEQ ID NO: 1231157 - protein, 9 aa, Homo Sapiens
LGMGVLFSL

SEQ ID NO: 1231158 - protein, 9 aa, Homo Sapiens
GQERFRSMI

SEQ ID NO: 1231159 - protein, 9 aa, Homo Sapiens
CDAATVRGG

SEQ ID NO: 1231160 - protein, 9 aa, Homo Sapiens
DPMPEPRPT

SEQ ID NO: 1231161 - protein, 9 aa, Homo Sapiens
GMGLVIAQS

SEQ ID NO: 1231162 - protein, 9 aa, Homo Sapiens
FKDPSDYVC

SEQ ID NO: 1231163 - protein, 9 aa, Homo Sapiens
RRHLKVIQA

SEQ ID NO: 1231164 - protein, 9 aa, Homo Sapiens
LVPTPHGLA

SEQ ID NO: 1231165 - protein, 9 aa, Homo Sapiens
WTTFLKVRL

SEQ ID NO: 1231166 - protein, 9 aa, Homo Sapiens
LLADDALYR

SEQ ID NO: 1231167 - protein, 9 aa, Homo Sapiens
GLEEWPELR

SEQ ID NO: 1231168 - protein, 9 aa, Homo Sapiens
QADGGCFSF

SEQ ID NO: 1231169 - protein, 9 aa, Homo Sapiens
VVIFKYIEG

SEQ ID NO: 1231170 - protein, 9 aa, Homo Sapiens
FINSFGGKG

SEQ ID NO: 1231171 - protein, 9 aa, Homo Sapiens
VKFHVLTER

SEQ ID NO: 1231172 - protein, 9 aa, Homo Sapiens
GDTVHFIQQ

SEQ ID NO: 1231173 - protein, 9 aa, Homo Sapiens
HFVPKHIEV

SEQ ID NO: 1231174 - protein, 9 aa, Homo Sapiens
TVTDRQILF

SEQ ID NO: 1231175 - protein, 9 aa, Homo Sapiens
YFGTHTHKQ

SEQ ID NO: 1231176 - protein, 9 aa, Homo Sapiens
VTKSQPVMI

SEQ ID NO: 1231177 - protein, 9 aa, Homo Sapiens
KQHGKAFSY

SEQ ID NO: 1231178 - protein, 9 aa, Homo Sapiens
RVKMGERVH

SEQ ID NO: 1231179 - protein, 9 aa, Homo Sapiens
TEGKRCPAK

SEQ ID NO: 1231180 - protein, 9 aa, Homo Sapiens
TNVFSPMCT

SEQ ID NO: 1231181 - protein, 9 aa, Homo Sapiens
WAPACTRWK

SEQ ID NO: 1231182 - protein, 9 aa, Homo Sapiens
VASTTSVIT

SEQ ID NO: 1231183 - protein, 9 aa, Homo Sapiens
ERNCTLPPP

SEQ ID NO: 1231184 - protein, 9 aa, Homo Sapiens
VRTVCTHEE

SEQ ID NO: 1231185 - protein, 9 aa, Homo Sapiens
RFGYGFNEP

SEQ ID NO: 1231186 - protein, 9 aa, Homo Sapiens
VTKDNQTRY

SEQ ID NO: 1231187 - protein, 9 aa, Homo Sapiens
LEQQACLIS

SEQ ID NO: 1231188 - protein, 9 aa, Homo Sapiens
NLSSDVRYK

SEQ ID NO: 1231189 - protein, 9 aa, Homo Sapiens
LSYRLGIWV

SEQ ID NO: 1231190 - protein, 9 aa, Homo Sapiens
TAVYEAKLL

SEQ ID NO: 1231191 - protein, 9 aa, Homo Sapiens
LSGIQHDQP

SEQ ID NO: 1231192 - protein, 9 aa, Homo Sapiens
SNYPAIILF

SEQ ID NO: 1231193 - protein, 9 aa, Homo Sapiens
HTGSYQCHS

SEQ ID NO: 1231194 - protein, 9 aa, Homo Sapiens
TYGMHMILS

SEQ ID NO: 1231195 - protein, 9 aa, Homo Sapiens
LKLSPESTE

SEQ ID NO: 1231196 - protein, 9 aa, Homo Sapiens
QHLCPSQQS

SEQ ID NO: 1231197 - protein, 9 aa, Homo Sapiens
TPYMNHSPF

SEQ ID NO: 1231198 - protein, 9 aa, Homo Sapiens
QGLKSEKEV

SEQ ID NO: 1231199 - protein, 9 aa, Homo Sapiens
DMSNLNKHQ

SEQ ID NO: 1231200 - protein, 9 aa, Homo Sapiens
FTDMSNLNK

SEQ ID NO: 1231201 - protein, 9 aa, Homo Sapiens
EHNTFGRIL

SEQ ID NO: 1231202 - protein, 9 aa, Homo Sapiens
MRIFSTEIL

SEQ ID NO: 1231203 - protein, 9 aa, Homo Sapiens
SVFQTGPQL

SEQ ID NO: 1231204 - protein, 9 aa, Homo Sapiens
LRSVAVHRL

SEQ ID NO: 1231205 - protein, 9 aa, Homo Sapiens
HHEHLPSIS

SEQ ID NO: 1231206 - protein, 9 aa, Homo Sapiens
KCLSIWALI

SEQ ID NO: 1231207 - protein, 9 aa, Homo Sapiens
KYQKERNEM

SEQ ID NO: 1231208 - protein, 9 aa, Homo Sapiens
QAGMAPVGP

SEQ ID NO: 1231209 - protein, 9 aa, Homo Sapiens
PNNPPAHES

SEQ ID NO: 1231210 - protein, 9 aa, Homo Sapiens
DPLLCHSDN

SEQ ID NO: 1231211 - protein, 9 aa, Homo Sapiens
PIYLQNSSV

SEQ ID NO: 1231212 - protein, 9 aa, Homo Sapiens
VTYSCIVSN

SEQ ID NO: 1231213 - protein, 9 aa, Homo Sapiens
ENMLETIQG

SEQ ID NO: 1231214 - protein, 9 aa, Homo Sapiens
IDCMTALGL

SEQ ID NO: 1231215 - protein, 9 aa, Homo Sapiens
AEPTHTQVY

SEQ ID NO: 1231216 - protein, 9 aa, Homo Sapiens
PLGDFEAVW

SEQ ID NO: 1231217 - protein, 9 aa, Homo Sapiens
NLRKRIIFH

SEQ ID NO: 1231218 - protein, 9 aa, Homo Sapiens
THTGSNHSS

SEQ ID NO: 1231219 - protein, 9 aa, Homo Sapiens
RTSLGRHAS

SEQ ID NO: 1231220 - protein, 9 aa, Homo Sapiens
LGQTKKLIG

SEQ ID NO: 1231221 - protein, 9 aa, Homo Sapiens
WAIINLGVT

SEQ ID NO: 1231222 - protein, 9 aa, Homo Sapiens
KLAPCISLI

SEQ ID NO: 1231223 - protein, 9 aa, Homo Sapiens
FLEKCLHKT

SEQ ID NO: 1231224 - protein, 9 aa, Homo Sapiens
KIHTGEWPY

SEQ ID NO: 1231225 - protein, 9 aa, Homo Sapiens
GEGGRRPYK

SEQ ID NO: 1231226 - protein, 9 aa, Homo Sapiens
ENIYAAVKH

SEQ ID NO: 1231227 - protein, 9 aa, Homo Sapiens
QRTCEDLKD

SEQ ID NO: 1231228 - protein, 9 aa, Homo Sapiens
TFWCERVMG

SEQ ID NO: 1231229 - protein, 9 aa, Homo Sapiens
ELMMHTVYD

SEQ ID NO: 1231230 - protein, 9 aa, Homo Sapiens
RVDFDEFVE

SEQ ID NO: 1231231 - protein, 9 aa, Homo Sapiens
IVTRDSQKD

SEQ ID NO: 1231232 - protein, 9 aa, Homo Sapiens
SQMKSMYMS

SEQ ID NO: 1231233 - protein, 9 aa, Homo Sapiens
RYLRVGLKG

SEQ ID NO: 1231234 - protein, 9 aa, Homo Sapiens
VACNVGYPA

SEQ ID NO: 1231235 - protein, 9 aa, Homo Sapiens
ATAAVEERQ

SEQ ID NO: 1231236 - protein, 9 aa, Homo Sapiens
ELREPGPSP

SEQ ID NO: 1231237 - protein, 9 aa, Homo Sapiens
DPSFNMDAD

SEQ ID NO: 1231238 - protein, 9 aa, Homo Sapiens
CPFSNPNGC

SEQ ID NO: 1231239 - protein, 9 aa, Homo Sapiens
MAASLAILE

SEQ ID NO: 1231240 - protein, 9 aa, Homo Sapiens
LSMSYNLLE

SEQ ID NO: 1231241 - protein, 9 aa, Homo Sapiens
EKEIYNQVI

SEQ ID NO: 1231242 - protein, 9 aa, Homo Sapiens
MTLAIPIAV

SEQ ID NO: 1231243 - protein, 9 aa, Homo Sapiens
CTKLSLIMR

SEQ ID NO: 1231244 - protein, 9 aa, Homo Sapiens
VDGTLFLSL

SEQ ID NO: 1231245 - protein, 9 aa, Homo Sapiens
VTDAEIKNG

SEQ ID NO: 1231246 - protein, 9 aa, Homo Sapiens
AEVDGSVAF

SEQ ID NO: 1231247 - protein, 9 aa, Homo Sapiens
PGSASLFHR

SEQ ID NO: 1231248 - protein, 9 aa, Homo Sapiens
DESEEETEK

SEQ ID NO: 1231249 - protein, 9 aa, Homo Sapiens
WPCFDSQRT

SEQ ID NO: 1231250 - protein, 9 aa, Homo Sapiens
LKADLLKRY

SEQ ID NO: 1231251 - protein, 9 aa, Homo Sapiens
GSQLQKTHV

SEQ ID NO: 1231252 - protein, 9 aa, Homo Sapiens
EKRLHSPAL

SEQ ID NO: 1231253 - protein, 9 aa, Homo Sapiens
ASKYAIYAV

SEQ ID NO: 1231254 - protein, 9 aa, Homo Sapiens
GQIIPTARC

SEQ ID NO: 1231255 - protein, 9 aa, Homo Sapiens
HLETHDDCL

SEQ ID NO: 1231256 - protein, 9 aa, Homo Sapiens
LHTIQRQKV

SEQ ID NO: 1231257 - protein, 9 aa, Homo Sapiens
YFWWEHLWL

SEQ ID NO: 1231258 - protein, 9 aa, Homo Sapiens
HLVKNEKGT

SEQ ID NO: 1231259 - protein, 9 aa, Homo Sapiens
PTLRNLHCY

SEQ ID NO: 1231260 - protein, 9 aa, Homo Sapiens
QWLTTMLLH

SEQ ID NO: 1231261 - protein, 9 aa, Homo Sapiens
VKQKEEWRR

SEQ ID NO: 1231262 - protein, 9 aa, Homo Sapiens
SRVVNLHFP

SEQ ID NO: 1231263 - protein, 9 aa, Homo Sapiens
FQNVMVMIL

SEQ ID NO: 1231264 - protein, 9 aa, Homo Sapiens
TCTNIDLLL

SEQ ID NO: 1231265 - protein, 9 aa, Homo Sapiens
GENIRKKYP

SEQ ID NO: 1231266 - protein, 9 aa, Homo Sapiens
ACYFRVQFL

SEQ ID NO: 1231267 - protein, 9 aa, Homo Sapiens
IPPSSVLDS

SEQ ID NO: 1231268 - protein, 9 aa, Homo Sapiens
RENMTPANS

SEQ ID NO: 1231269 - protein, 9 aa, Homo Sapiens
EYAKVEAHQ

SEQ ID NO: 1231270 - protein, 9 aa, Homo Sapiens
WETMKVSEK

SEQ ID NO: 1231271 - protein, 9 aa, Homo Sapiens
AQKNIYRDV

SEQ ID NO: 1231272 - protein, 9 aa, Homo Sapiens
SPGLNSMKP

SEQ ID NO: 1231273 - protein, 9 aa, Homo Sapiens
LHRVRPPGC

SEQ ID NO: 1231274 - protein, 9 aa, Homo Sapiens
SLNHGMSLT

SEQ ID NO: 1231275 - protein, 9 aa, Homo Sapiens
HYMCNACGL

SEQ ID NO: 1231276 - protein, 9 aa, Homo Sapiens
KYDSHGSTL

SEQ ID NO: 1231277 - protein, 9 aa, Homo Sapiens
QDVIVSGTE

SEQ ID NO: 1231278 - protein, 9 aa, Homo Sapiens
PRLLAPCLP

SEQ ID NO: 1231279 - protein, 9 aa, Homo Sapiens
LDTQQNPAR

SEQ ID NO: 1231280 - protein, 9 aa, Homo Sapiens
SGITLMSPK

SEQ ID NO: 1231281 - protein, 9 aa, Homo Sapiens
LYTTEQAFV

SEQ ID NO: 1231282 - protein, 9 aa, Homo Sapiens
KTFTWLALE

SEQ ID NO: 1231283 - protein, 9 aa, Homo Sapiens
RLEVGTETV

SEQ ID NO: 1231284 - protein, 9 aa, Homo Sapiens
LKEKAPAFG

SEQ ID NO: 1231285 - protein, 9 aa, Homo Sapiens
VRKKMKLTL

SEQ ID NO: 1231286 - protein, 9 aa, Homo Sapiens
LSRQCSTEA

SEQ ID NO: 1231287 - protein, 9 aa, Homo Sapiens
LLNKRRTES

SEQ ID NO: 1231288 - protein, 9 aa, Homo Sapiens
SDHGHRFTM

SEQ ID NO: 1231289 - protein, 9 aa, Homo Sapiens
LTFKLTRRV

SEQ ID NO: 1231290 - protein, 9 aa, Homo Sapiens
LAIMGQAYA

SEQ ID NO: 1231291 - protein, 9 aa, Homo Sapiens
GYVNHSLSI

SEQ ID NO: 1231292 - protein, 9 aa, Homo Sapiens
NGRHCNKLF

SEQ ID NO: 1231293 - protein, 9 aa, Homo Sapiens
RPFVSQTRG

SEQ ID NO: 1231294 - protein, 9 aa, Homo Sapiens
ANLLKGLCH

SEQ ID NO: 1231295 - protein, 9 aa, Homo Sapiens
SWVTWMILT

SEQ ID NO: 1231296 - protein, 9 aa, Homo Sapiens
IKGQGVEIC

SEQ ID NO: 1231297 - protein, 9 aa, Homo Sapiens
RQWKMKAEV

SEQ ID NO: 1231298 - protein, 9 aa, Homo Sapiens
RHVWELSKA

SEQ ID NO: 1231299 - protein, 9 aa, Homo Sapiens
SVQDYDSDK

SEQ ID NO: 1231300 - protein, 9 aa, Homo Sapiens
DESTYVDIT

SEQ ID NO: 1231301 - protein, 9 aa, Homo Sapiens
VSRAFNSLG

SEQ ID NO: 1231302 - protein, 9 aa, Homo Sapiens
VVDRVPQHL

SEQ ID NO: 1231303 - protein, 9 aa, Homo Sapiens
SECGRAFTQ

SEQ ID NO: 1231304 - protein, 9 aa, Homo Sapiens
CFCRICAVF

SEQ ID NO: 1231305 - protein, 9 aa, Homo Sapiens
AGITGMHHH

SEQ ID NO: 1231306 - protein, 9 aa, Homo Sapiens
TEETVTYTQ

SEQ ID NO: 1231307 - protein, 9 aa, Homo Sapiens
YTTTGGLTS

SEQ ID NO: 1231308 - protein, 9 aa, Homo Sapiens
GQVGRLHGS

SEQ ID NO: 1231309 - protein, 9 aa, Homo Sapiens
LHSGAGTLH

SEQ ID NO: 1231310 - protein, 9 aa, Homo Sapiens
ATQYRIIVC

SEQ ID NO: 1231311 - protein, 9 aa, Homo Sapiens
HASRTQIVH

SEQ ID NO: 1231312 - protein, 9 aa, Homo Sapiens
GGLSHHIHV

SEQ ID NO: 1231313 - protein, 9 aa, Homo Sapiens
SSGMTWPPL

SEQ ID NO: 1231314 - protein, 9 aa, Homo Sapiens
IRTVGIVGI

SEQ ID NO: 1231315 - protein, 9 aa, Homo Sapiens
STYLVDFII

SEQ ID NO: 1231316 - protein, 9 aa, Homo Sapiens
SESDEAIVA

SEQ ID NO: 1231317 - protein, 9 aa, Homo Sapiens
FFFGDVPAS

SEQ ID NO: 1231318 - protein, 9 aa, Homo Sapiens
PSHVARRFL

SEQ ID NO: 1231319 - protein, 9 aa, Homo Sapiens
VKICNICHI

SEQ ID NO: 1231320 - protein, 9 aa, Homo Sapiens
QCLRKNYKC

SEQ ID NO: 1231321 - protein, 9 aa, Homo Sapiens
PAPGHFRHG

SEQ ID NO: 1231322 - protein, 9 aa, Homo Sapiens
LPGFTSLMG

SEQ ID NO: 1231323 - protein, 9 aa, Homo Sapiens
QLISQIGND

SEQ ID NO: 1231324 - protein, 9 aa, Homo Sapiens
GPISYMRRD

SEQ ID NO: 1231325 - protein, 9 aa, Homo Sapiens
REMENLCLE

SEQ ID NO: 1231326 - protein, 9 aa, Homo Sapiens
APPEKSYAK

SEQ ID NO: 1231327 - protein, 9 aa, Homo Sapiens
RRKISRTQA

SEQ ID NO: 1231328 - protein, 9 aa, Homo Sapiens
SSCMDNFNL

SEQ ID NO: 1231329 - protein, 9 aa, Homo Sapiens
LPQLSLTQP

SEQ ID NO: 1231330 - protein, 9 aa, Homo Sapiens
HYARSPKEK

SEQ ID NO: 1231331 - protein, 9 aa, Homo Sapiens
CFICRKKVG

SEQ ID NO: 1231332 - protein, 9 aa, Homo Sapiens
LVHMMLALS

SEQ ID NO: 1231333 - protein, 9 aa, Homo Sapiens
KLKLAPLQV

SEQ ID NO: 1231334 - protein, 9 aa, Homo Sapiens
HLGTVILGL

SEQ ID NO: 1231335 - protein, 9 aa, Homo Sapiens
GHFEPLRGA

SEQ ID NO: 1231336 - protein, 9 aa, Homo Sapiens
RIIFHKISD

SEQ ID NO: 1231337 - protein, 9 aa, Homo Sapiens
KVLCAEFKM

SEQ ID NO: 1231338 - protein, 9 aa, Homo Sapiens
EEEKHEAAT

SEQ ID NO: 1231339 - protein, 9 aa, Homo Sapiens
AKNINLWLF

SEQ ID NO: 1231340 - protein, 9 aa, Homo Sapiens
WLTDGSVRF

SEQ ID NO: 1231341 - protein, 9 aa, Homo Sapiens
PTCRDVGPV

SEQ ID NO: 1231342 - protein, 9 aa, Homo Sapiens
KISSPTCSK

SEQ ID NO: 1231343 - protein, 9 aa, Homo Sapiens
FGVWAEMVA

SEQ ID NO: 1231344 - protein, 9 aa, Homo Sapiens
AVPATCFLR

SEQ ID NO: 1231345 - protein, 9 aa, Homo Sapiens
PYMCNDCGK

SEQ ID NO: 1231346 - protein, 9 aa, Homo Sapiens
GMVVVGTGT

SEQ ID NO: 1231347 - protein, 9 aa, Homo Sapiens
NMENSIFVV

SEQ ID NO: 1231348 - protein, 9 aa, Homo Sapiens
CGNVFSRRE

SEQ ID NO: 1231349 - protein, 9 aa, Homo Sapiens
KQKVMFHVI

SEQ ID NO: 1231350 - protein, 9 aa, Homo Sapiens
KEVNCKKND

SEQ ID NO: 1231351 - protein, 9 aa, Homo Sapiens
APPNGSSTE

SEQ ID NO: 1231352 - protein, 9 aa, Homo Sapiens
LNTIKRVGY

SEQ ID NO: 1231353 - protein, 9 aa, Homo Sapiens
QHLDGHQQG

SEQ ID NO: 1231354 - protein, 9 aa, Homo Sapiens
CVCCAECLD

SEQ ID NO: 1231355 - protein, 9 aa, Homo Sapiens
LPWDALDLG

SEQ ID NO: 1231356 - protein, 9 aa, Homo Sapiens
METVEDWET

SEQ ID NO: 1231357 - protein, 9 aa, Homo Sapiens
ILVWEKATG

SEQ ID NO: 1231358 - protein, 9 aa, Homo Sapiens
QTWHFLSSR

SEQ ID NO: 1231359 - protein, 9 aa, Homo Sapiens
QRTMMKALV

SEQ ID NO: 1231360 - protein, 9 aa, Homo Sapiens
ADAVPLPPH

SEQ ID NO: 1231361 - protein, 9 aa, Homo Sapiens
FDCKFIENS

SEQ ID NO: 1231362 - protein, 9 aa, Homo Sapiens
SAAVLSSAT

SEQ ID NO: 1231363 - protein, 9 aa, Homo Sapiens
FDPRLSRVT

SEQ ID NO: 1231364 - protein, 9 aa, Homo Sapiens
MPLESQTHP

SEQ ID NO: 1231365 - protein, 9 aa, Homo Sapiens
SRPRPTKTS

SEQ ID NO: 1231366 - protein, 9 aa, Homo Sapiens
NALTQTVAM

SEQ ID NO: 1231367 - protein, 9 aa, Homo Sapiens
RCALGRWGY

SEQ ID NO: 1231368 - protein, 9 aa, Homo Sapiens
KPIPLEQHP

SEQ ID NO: 1231369 - protein, 9 aa, Homo Sapiens
SPRRLCLVL

SEQ ID NO: 1231370 - protein, 9 aa, Homo Sapiens
NGHGSASTD

SEQ ID NO: 1231371 - protein, 9 aa, Homo Sapiens
DSESDEAIV

SEQ ID NO: 1231372 - protein, 9 aa, Homo Sapiens
MLAIDLSLC

SEQ ID NO: 1231373 - protein, 9 aa, Homo Sapiens
DGSCVLVHF

SEQ ID NO: 1231374 - protein, 9 aa, Homo Sapiens
CDYNGHHRI

SEQ ID NO: 1231375 - protein, 9 aa, Homo Sapiens
GTMETMPLE

SEQ ID NO: 1231376 - protein, 9 aa, Homo Sapiens
EEVCMAIRN

SEQ ID NO: 1231377 - protein, 9 aa, Homo Sapiens
LLHALSDDG

SEQ ID NO: 1231378 - protein, 9 aa, Homo Sapiens
HYMTRDADE

SEQ ID NO: 1231379 - protein, 9 aa, Homo Sapiens
GNPGLPGIS

SEQ ID NO: 1231380 - protein, 9 aa, Homo Sapiens
VCGRLQQAA

SEQ ID NO: 1231381 - protein, 9 aa, Homo Sapiens
QYWISVCVF

SEQ ID NO: 1231382 - protein, 9 aa, Homo Sapiens
LAVLPTLRN

SEQ ID NO: 1231383 - protein, 9 aa, Homo Sapiens
QQLHLTQYH

SEQ ID NO: 1231384 - protein, 9 aa, Homo Sapiens
QNLRLKRCH

SEQ ID NO: 1231385 - protein, 9 aa, Homo Sapiens
SPFHREKEV

SEQ ID NO: 1231386 - protein, 9 aa, Homo Sapiens
NISWDVAVV

SEQ ID NO: 1231387 - protein, 9 aa, Homo Sapiens
YCRETCNCQ

SEQ ID NO: 1231388 - protein, 9 aa, Homo Sapiens
LLFGDDDSG

SEQ ID NO: 1231389 - protein, 9 aa, Homo Sapiens
ALERLTRTG

SEQ ID NO: 1231390 - protein, 9 aa, Homo Sapiens
STSVSGDMC

SEQ ID NO: 1231391 - protein, 9 aa, Homo Sapiens
GVNVDSLNN

SEQ ID NO: 1231392 - protein, 9 aa, Homo Sapiens
TQPLSFLIW

SEQ ID NO: 1231393 - protein, 9 aa, Homo Sapiens
LTAVHGSSV

SEQ ID NO: 1231394 - protein, 9 aa, Homo Sapiens
TMITIEGPR

SEQ ID NO: 1231395 - protein, 9 aa, Homo Sapiens
QQRHILQQD

SEQ ID NO: 1231396 - protein, 9 aa, Homo Sapiens
AKAHILLTA

SEQ ID NO: 1231397 - protein, 9 aa, Homo Sapiens
SDLQGPPGP

SEQ ID NO: 1231398 - protein, 9 aa, Homo Sapiens
LLNGSSLEN

SEQ ID NO: 1231399 - protein, 9 aa, Homo Sapiens
DPGRLSANS

SEQ ID NO: 1231400 - protein, 9 aa, Homo Sapiens
HRRYVAHSV

SEQ ID NO: 1231401 - protein, 9 aa, Homo Sapiens
DVVSVGWLQ

SEQ ID NO: 1231402 - protein, 9 aa, Homo Sapiens
GEKPFSCPQ

SEQ ID NO: 1231403 - protein, 9 aa, Homo Sapiens
TNCHIYNKP

SEQ ID NO: 1231404 - protein, 9 aa, Homo Sapiens
THAILFKKI

SEQ ID NO: 1231405 - protein, 9 aa, Homo Sapiens
ELMKNDEPP

SEQ ID NO: 1231406 - protein, 9 aa, Homo Sapiens
EQLQQSLGL

SEQ ID NO: 1231407 - protein, 9 aa, Homo Sapiens
ECGDQTRSG

SEQ ID NO: 1231408 - protein, 9 aa, Homo Sapiens
EDGRHLRNL

SEQ ID NO: 1231409 - protein, 9 aa, Homo Sapiens
AKWITKIEV

SEQ ID NO: 1231410 - protein, 9 aa, Homo Sapiens
LWGHRFELV

SEQ ID NO: 1231411 - protein, 9 aa, Homo Sapiens
MPEKKVSEV

SEQ ID NO: 1231412 - protein, 9 aa, Homo Sapiens
LEDILHFNI

SEQ ID NO: 1231413 - protein, 9 aa, Homo Sapiens
EWAAHPLLH

SEQ ID NO: 1231414 - protein, 9 aa, Homo Sapiens
ASLEVTAMG

SEQ ID NO: 1231415 - protein, 9 aa, Homo Sapiens
PLPLNSFPV

SEQ ID NO: 1231416 - protein, 9 aa, Homo Sapiens
SQLTCKQPR

SEQ ID NO: 1231417 - protein, 9 aa, Homo Sapiens
YNNDFRSME

SEQ ID NO: 1231418 - protein, 9 aa, Homo Sapiens
NTTFEAGEE

SEQ ID NO: 1231419 - protein, 9 aa, Homo Sapiens
GISFLECGV

SEQ ID NO: 1231420 - protein, 9 aa, Homo Sapiens
KFLEHFDID

SEQ ID NO: 1231421 - protein, 9 aa, Homo Sapiens
QRANPSNFL

SEQ ID NO: 1231422 - protein, 9 aa, Homo Sapiens
CVAQADLEI

SEQ ID NO: 1231423 - protein, 9 aa, Homo Sapiens
TVKHREFHA

SEQ ID NO: 1231424 - protein, 9 aa, Homo Sapiens
AVPLFSTVC

SEQ ID NO: 1231425 - protein, 9 aa, Homo Sapiens
KDQKAKERN

SEQ ID NO: 1231426 - protein, 9 aa, Homo Sapiens
DDSDIPPPS

SEQ ID NO: 1231427 - protein, 9 aa, Homo Sapiens
TVTIWMCRH

SEQ ID NO: 1231428 - protein, 9 aa, Homo Sapiens
EHQGKAKRH

SEQ ID NO: 1231429 - protein, 9 aa, Homo Sapiens
LTILRNVLW

SEQ ID NO: 1231430 - protein, 9 aa, Homo Sapiens
KHFGTTLNY

SEQ ID NO: 1231431 - protein, 9 aa, Homo Sapiens
LLLLKEDHP

SEQ ID NO: 1231432 - protein, 9 aa, Homo Sapiens
AEGNISGCK

SEQ ID NO: 1231433 - protein, 9 aa, Homo Sapiens
KATADEFIH

SEQ ID NO: 1231434 - protein, 9 aa, Homo Sapiens
GGPGPAQAS

SEQ ID NO: 1231435 - protein, 9 aa, Homo Sapiens
MRPHTPGRR

SEQ ID NO: 1231436 - protein, 9 aa, Homo Sapiens
QHCRLLHQR

SEQ ID NO: 1231437 - protein, 9 aa, Homo Sapiens
VLAMISVTQ

SEQ ID NO: 1231438 - protein, 9 aa, Homo Sapiens
SDLESIIST

SEQ ID NO: 1231439 - protein, 9 aa, Homo Sapiens
ISDQDVCKI

SEQ ID NO: 1231440 - protein, 9 aa, Homo Sapiens
TAMKLLHVL

SEQ ID NO: 1231441 - protein, 9 aa, Homo Sapiens
PATCFLRQS

SEQ ID NO: 1231442 - protein, 9 aa, Homo Sapiens
DTLLTLMPC

SEQ ID NO: 1231443 - protein, 9 aa, Homo Sapiens
CSSDGLMYF

SEQ ID NO: 1231444 - protein, 9 aa, Homo Sapiens
SELQQHRFN

SEQ ID NO: 1231445 - protein, 9 aa, Homo Sapiens
GQSSVLLQH

SEQ ID NO: 1231446 - protein, 9 aa, Homo Sapiens
GWPCPAVPL

SEQ ID NO: 1231447 - protein, 9 aa, Homo Sapiens
SASSLDNVV

SEQ ID NO: 1231448 - protein, 9 aa, Homo Sapiens
MMKTHLLRM

SEQ ID NO: 1231449 - protein, 9 aa, Homo Sapiens
NHSLAYQKQ

SEQ ID NO: 1231450 - protein, 9 aa, Homo Sapiens
WKILYQKES

SEQ ID NO: 1231451 - protein, 9 aa, Homo Sapiens
YPLLSTPTR

SEQ ID NO: 1231452 - protein, 9 aa, Homo Sapiens
LKVIQASLD

SEQ ID NO: 1231453 - protein, 9 aa, Homo Sapiens
RKIPESVGG

SEQ ID NO: 1231454 - protein, 9 aa, Homo Sapiens
KNYVALHIL

SEQ ID NO: 1231455 - protein, 9 aa, Homo Sapiens
DDLREGAHY

SEQ ID NO: 1231456 - protein, 9 aa, Homo Sapiens
TTASMGTCL

SEQ ID NO: 1231457 - protein, 9 aa, Homo Sapiens
AAIVIIIGA

SEQ ID NO: 1231458 - protein, 9 aa, Homo Sapiens
LDLTRLRGV

SEQ ID NO: 1231459 - protein, 9 aa, Homo Sapiens
RLQDPGRLS

SEQ ID NO: 1231460 - protein, 9 aa, Homo Sapiens
VDTKILILI

SEQ ID NO: 1231461 - protein, 9 aa, Homo Sapiens
TATSTCFDA

SEQ ID NO: 1231462 - protein, 9 aa, Homo Sapiens
LPNCDCKGF

SEQ ID NO: 1231463 - protein, 9 aa, Homo Sapiens
DWLQFWSKY

SEQ ID NO: 1231464 - protein, 9 aa, Homo Sapiens
LSTWKESPA

SEQ ID NO: 1231465 - protein, 9 aa, Homo Sapiens
EASILRQHK

SEQ ID NO: 1231466 - protein, 9 aa, Homo Sapiens
KARDSELSD

SEQ ID NO: 1231467 - protein, 9 aa, Homo Sapiens
QIYGCSQTV

SEQ ID NO: 1231468 - protein, 9 aa, Homo Sapiens
DNFNEMNSR

SEQ ID NO: 1231469 - protein, 9 aa, Homo Sapiens
DHPVCFLPG

SEQ ID NO: 1231470 - protein, 9 aa, Homo Sapiens
PLLAVFSSR

SEQ ID NO: 1231471 - protein, 9 aa, Homo Sapiens
AQVTDLHVT

SEQ ID NO: 1231472 - protein, 9 aa, Homo Sapiens
MEGFFALHQ

SEQ ID NO: 1231473 - protein, 9 aa, Homo Sapiens
RQEDVATAR

SEQ ID NO: 1231474 - protein, 9 aa, Homo Sapiens
SKCDLPLWT

SEQ ID NO: 1231475 - protein, 9 aa, Homo Sapiens
TQRALISKF

SEQ ID NO: 1231476 - protein, 9 aa, Homo Sapiens
IMLVKLNSQ

SEQ ID NO: 1231477 - protein, 9 aa, Homo Sapiens
SAESDTMKR

SEQ ID NO: 1231478 - protein, 9 aa, Homo Sapiens
RVFVERGQQ

SEQ ID NO: 1231479 - protein, 9 aa, Homo Sapiens
EGKLGPLGV

SEQ ID NO: 1231480 - protein, 9 aa, Homo Sapiens
SSKSHGPVK

SEQ ID NO: 1231481 - protein, 9 aa, Homo Sapiens
GGAKQIERV

SEQ ID NO: 1231482 - protein, 9 aa, Homo Sapiens
SHRRAREQT

SEQ ID NO: 1231483 - protein, 9 aa, Homo Sapiens
VATSVEQYV

SEQ ID NO: 1231484 - protein, 9 aa, Homo Sapiens
HQSIIWSWD

SEQ ID NO: 1231485 - protein, 9 aa, Homo Sapiens
AHTPPGHHS

SEQ ID NO: 1231486 - protein, 9 aa, Homo Sapiens
PDYDLDTFV

SEQ ID NO: 1231487 - protein, 9 aa, Homo Sapiens
GYSQNLAKQ

SEQ ID NO: 1231488 - protein, 9 aa, Homo Sapiens
GSIWLGPNT

SEQ ID NO: 1231489 - protein, 9 aa, Homo Sapiens
SVLYVWAHL

SEQ ID NO: 1231490 - protein, 9 aa, Homo Sapiens
DQSMHRELR

SEQ ID NO: 1231491 - protein, 9 aa, Homo Sapiens
KLCYQDAHG

SEQ ID NO: 1231492 - protein, 9 aa, Homo Sapiens
DCNQGNQVE

SEQ ID NO: 1231493 - protein, 9 aa, Homo Sapiens
DRVRLLLSK

SEQ ID NO: 1231494 - protein, 9 aa, Homo Sapiens
QDLAEAGRG

SEQ ID NO: 1231495 - protein, 9 aa, Homo Sapiens
QNNGLRKNG

SEQ ID NO: 1231496 - protein, 9 aa, Homo Sapiens
FDSSVFGVI

SEQ ID NO: 1231497 - protein, 9 aa, Homo Sapiens
HSGTRCHTL

SEQ ID NO: 1231498 - protein, 9 aa, Homo Sapiens
RPATTLYRH

SEQ ID NO: 1231499 - protein, 9 aa, Homo Sapiens
PVTNSLKDG

SEQ ID NO: 1231500 - protein, 9 aa, Homo Sapiens
GNMQMASST

SEQ ID NO: 1231501 - protein, 9 aa, Homo Sapiens
IECRKFQGD

SEQ ID NO: 1231502 - protein, 9 aa, Homo Sapiens
KTRRVNTSW

SEQ ID NO: 1231503 - protein, 9 aa, Homo Sapiens
QFIDNLKQF

SEQ ID NO: 1231504 - protein, 9 aa, Homo Sapiens
DHSFELDEN

SEQ ID NO: 1231505 - protein, 9 aa, Homo Sapiens
WNRCQYCRY

SEQ ID NO: 1231506 - protein, 9 aa, Homo Sapiens
VISPYNISI

SEQ ID NO: 1231507 - protein, 9 aa, Homo Sapiens
TNVFREELL

SEQ ID NO: 1231508 - protein, 9 aa, Homo Sapiens
LLGSLPSGT

SEQ ID NO: 1231509 - protein, 9 aa, Homo Sapiens
IKNRNETEL

SEQ ID NO: 1231510 - protein, 9 aa, Homo Sapiens
EATPLFNAC

SEQ ID NO: 1231511 - protein, 9 aa, Homo Sapiens
GFHGADHHE

SEQ ID NO: 1231512 - protein, 9 aa, Homo Sapiens
HFDIDDHQQ

SEQ ID NO: 1231513 - protein, 9 aa, Homo Sapiens
ELPYNFPKE

SEQ ID NO: 1231514 - protein, 9 aa, Homo Sapiens
WVGRKGDLL

SEQ ID NO: 1231515 - protein, 9 aa, Homo Sapiens
NFEVVLSSR

SEQ ID NO: 1231516 - protein, 9 aa, Homo Sapiens
GDGSLIALS

SEQ ID NO: 1231517 - protein, 9 aa, Homo Sapiens
HKMCIIAFV

SEQ ID NO: 1231518 - protein, 9 aa, Homo Sapiens
GGRVDFDEF

SEQ ID NO: 1231519 - protein, 9 aa, Homo Sapiens
YVISRTEPS

SEQ ID NO: 1231520 - protein, 9 aa, Homo Sapiens
VCCLNVGLI

SEQ ID NO: 1231521 - protein, 9 aa, Homo Sapiens
DLVIQQKLL

SEQ ID NO: 1231522 - protein, 9 aa, Homo Sapiens
VNEMHVSFS

SEQ ID NO: 1231523 - protein, 9 aa, Homo Sapiens
VVKRSHSFS

SEQ ID NO: 1231524 - protein, 9 aa, Homo Sapiens
AQDITSKLL

SEQ ID NO: 1231525 - protein, 9 aa, Homo Sapiens
YYISKGHLR

SEQ ID NO: 1231526 - protein, 9 aa, Homo Sapiens
VSLWKHLLP

SEQ ID NO: 1231527 - protein, 9 aa, Homo Sapiens
RWKKLSQSP

SEQ ID NO: 1231528 - protein, 9 aa, Homo Sapiens
LTMVKCNNQ

SEQ ID NO: 1231529 - protein, 9 aa, Homo Sapiens
RNGENTDAS

SEQ ID NO: 1231530 - protein, 9 aa, Homo Sapiens
HWQLKYPKL

SEQ ID NO: 1231531 - protein, 9 aa, Homo Sapiens
THLHPQHCR

SEQ ID NO: 1231532 - protein, 9 aa, Homo Sapiens
LFDSVIHLC

SEQ ID NO: 1231533 - protein, 9 aa, Homo Sapiens
TGKVEIVLL

SEQ ID NO: 1231534 - protein, 9 aa, Homo Sapiens
DHILPSNYG

SEQ ID NO: 1231535 - protein, 9 aa, Homo Sapiens
LKWISHDPK

SEQ ID NO: 1231536 - protein, 9 aa, Homo Sapiens
EVIPFVIEK

SEQ ID NO: 1231537 - protein, 9 aa, Homo Sapiens
SNKNEKAAL

SEQ ID NO: 1231538 - protein, 9 aa, Homo Sapiens
AWNRVYIAR

SEQ ID NO: 1231539 - protein, 9 aa, Homo Sapiens
HCRPKLPPS

SEQ ID NO: 1231540 - protein, 9 aa, Homo Sapiens
GSEAYSKKL

SEQ ID NO: 1231541 - protein, 9 aa, Homo Sapiens
VVDVMVIGW

SEQ ID NO: 1231542 - protein, 9 aa, Homo Sapiens
HESQRDYAN

SEQ ID NO: 1231543 - protein, 9 aa, Homo Sapiens
DDTRVDTDD

SEQ ID NO: 1231544 - protein, 9 aa, Homo Sapiens
PYPGFNMSL

SEQ ID NO: 1231545 - protein, 9 aa, Homo Sapiens
AHEQRVAQA

SEQ ID NO: 1231546 - protein, 9 aa, Homo Sapiens
EKERARHLI

SEQ ID NO: 1231547 - protein, 9 aa, Homo Sapiens
NGRRMADVP

SEQ ID NO: 1231548 - protein, 9 aa, Homo Sapiens
FVPLVKRLT

SEQ ID NO: 1231549 - protein, 9 aa, Homo Sapiens
DLIACTVTT

SEQ ID NO: 1231550 - protein, 9 aa, Homo Sapiens
HKYYERKAE

SEQ ID NO: 1231551 - protein, 9 aa, Homo Sapiens
GESYWLQFD

SEQ ID NO: 1231552 - protein, 9 aa, Homo Sapiens
LHFLKREAK

SEQ ID NO: 1231553 - protein, 9 aa, Homo Sapiens
ATGKLCKLE

SEQ ID NO: 1231554 - protein, 9 aa, Homo Sapiens
EGASQSRPH

SEQ ID NO: 1231555 - protein, 9 aa, Homo Sapiens
KETKCQQIC

SEQ ID NO: 1231556 - protein, 9 aa, Homo Sapiens
KEEETDVAI

SEQ ID NO: 1231557 - protein, 9 aa, Homo Sapiens
KGDMGGTRT

SEQ ID NO: 1231558 - protein, 9 aa, Homo Sapiens
FAYRGILNS

SEQ ID NO: 1231559 - protein, 9 aa, Homo Sapiens
IPGGNLFGL

SEQ ID NO: 1231560 - protein, 9 aa, Homo Sapiens
WITSPTHDP

SEQ ID NO: 1231561 - protein, 9 aa, Homo Sapiens
MSLSPPLNK

SEQ ID NO: 1231562 - protein, 9 aa, Homo Sapiens
DLAFLSPVA

SEQ ID NO: 1231563 - protein, 9 aa, Homo Sapiens
FGIGPGRRV

SEQ ID NO: 1231564 - protein, 9 aa, Homo Sapiens
TGSQNEGHG

SEQ ID NO: 1231565 - protein, 9 aa, Homo Sapiens
GMYEGQQPM

SEQ ID NO: 1231566 - protein, 9 aa, Homo Sapiens
EGDFYYGWA

SEQ ID NO: 1231567 - protein, 9 aa, Homo Sapiens
GTVALLQEN

SEQ ID NO: 1231568 - protein, 9 aa, Homo Sapiens
GKVDLSLPT

SEQ ID NO: 1231569 - protein, 9 aa, Homo Sapiens
CDRQTQVGL

SEQ ID NO: 1231570 - protein, 9 aa, Homo Sapiens
TPPGDQQLH

SEQ ID NO: 1231571 - protein, 9 aa, Homo Sapiens
KDYQQFWSS

SEQ ID NO: 1231572 - protein, 9 aa, Homo Sapiens
YKKCLTRLY

SEQ ID NO: 1231573 - protein, 9 aa, Homo Sapiens
VGPNEQPGP

SEQ ID NO: 1231574 - protein, 9 aa, Homo Sapiens
LPASSALST

SEQ ID NO: 1231575 - protein, 9 aa, Homo Sapiens
TARCCLYAS

SEQ ID NO: 1231576 - protein, 9 aa, Homo Sapiens
DGLGFITSS

SEQ ID NO: 1231577 - protein, 9 aa, Homo Sapiens
DRVIRVAAK

SEQ ID NO: 1231578 - protein, 9 aa, Homo Sapiens
GAVQDLRMA

SEQ ID NO: 1231579 - protein, 9 aa, Homo Sapiens
QLKHDGKSR

SEQ ID NO: 1231580 - protein, 9 aa, Homo Sapiens
KAMGTLQID

SEQ ID NO: 1231581 - protein, 9 aa, Homo Sapiens
KNQPPILNH

SEQ ID NO: 1231582 - protein, 9 aa, Homo Sapiens
SLQTEECVQ

SEQ ID NO: 1231583 - protein, 9 aa, Homo Sapiens
DNLCRMDPT

SEQ ID NO: 1231584 - protein, 9 aa, Homo Sapiens
GNSGHLLVL

SEQ ID NO: 1231585 - protein, 9 aa, Homo Sapiens
QASGIRAPL

SEQ ID NO: 1231586 - protein, 9 aa, Homo Sapiens
SDEDGDKLS

SEQ ID NO: 1231587 - protein, 9 aa, Homo Sapiens
DADDSVGHI

SEQ ID NO: 1231588 - protein, 9 aa, Homo Sapiens
YGPVFTIYM

SEQ ID NO: 1231589 - protein, 9 aa, Homo Sapiens
PEVVNRIGH

SEQ ID NO: 1231590 - protein, 9 aa, Homo Sapiens
PGVGNTPAQ

SEQ ID NO: 1231591 - protein, 9 aa, Homo Sapiens
LVPGALELV

SEQ ID NO: 1231592 - protein, 9 aa, Homo Sapiens
FIGGLNFET

SEQ ID NO: 1231593 - protein, 9 aa, Homo Sapiens
GYFVSNDSP

SEQ ID NO: 1231594 - protein, 9 aa, Homo Sapiens
DVSVSQGFH

SEQ ID NO: 1231595 - protein, 9 aa, Homo Sapiens
TLTKAKLRL

SEQ ID NO: 1231596 - protein, 9 aa, Homo Sapiens
IFHDEFVAS

SEQ ID NO: 1231597 - protein, 9 aa, Homo Sapiens
EPFYTDQYV

SEQ ID NO: 1231598 - protein, 9 aa, Homo Sapiens
ILHMDTIYN

SEQ ID NO: 1231599 - protein, 9 aa, Homo Sapiens
QEHFSTSGF

SEQ ID NO: 1231600 - protein, 9 aa, Homo Sapiens
SEADPSGVV

SEQ ID NO: 1231601 - protein, 9 aa, Homo Sapiens
ICNYCKKTP

SEQ ID NO: 1231602 - protein, 9 aa, Homo Sapiens
AIKRYFSIV

SEQ ID NO: 1231603 - protein, 9 aa, Homo Sapiens
SIARRAGDP

SEQ ID NO: 1231604 - protein, 9 aa, Homo Sapiens
DFDEFVELI

SEQ ID NO: 1231605 - protein, 9 aa, Homo Sapiens
DDVNEILRN

SEQ ID NO: 1231606 - protein, 9 aa, Homo Sapiens
IRGCTLSSW

SEQ ID NO: 1231607 - protein, 9 aa, Homo Sapiens
REAGRFAVL

SEQ ID NO: 1231608 - protein, 9 aa, Homo Sapiens
GLLSRGNLG

SEQ ID NO: 1231609 - protein, 9 aa, Homo Sapiens
ACSCSTSTH

SEQ ID NO: 1231610 - protein, 9 aa, Homo Sapiens
CHCPPLLPL

SEQ ID NO: 1231611 - protein, 9 aa, Homo Sapiens
EQINNDNCW

SEQ ID NO: 1231612 - protein, 9 aa, Homo Sapiens
GHPEPAPGL

SEQ ID NO: 1231613 - protein, 9 aa, Homo Sapiens
EEVNTELNA

SEQ ID NO: 1231614 - protein, 9 aa, Homo Sapiens
LHIADGLRY

SEQ ID NO: 1231615 - protein, 9 aa, Homo Sapiens
PVSFEGLKV

SEQ ID NO: 1231616 - protein, 9 aa, Homo Sapiens
QISGQHVSL

SEQ ID NO: 1231617 - protein, 9 aa, Homo Sapiens
CVGAKQADV

SEQ ID NO: 1231618 - protein, 9 aa, Homo Sapiens
SNGYRTLQW

SEQ ID NO: 1231619 - protein, 9 aa, Homo Sapiens
AMARGTDVP

SEQ ID NO: 1231620 - protein, 9 aa, Homo Sapiens
AAALDVLTN

SEQ ID NO: 1231621 - protein, 9 aa, Homo Sapiens
EDLAKADEG

SEQ ID NO: 1231622 - protein, 9 aa, Homo Sapiens
SEADKLTLV

SEQ ID NO: 1231623 - protein, 9 aa, Homo Sapiens
EDGDKLSES

SEQ ID NO: 1231624 - protein, 9 aa, Homo Sapiens
SLTQPQPPV

SEQ ID NO: 1231625 - protein, 9 aa, Homo Sapiens
LDWFLSCLG

SEQ ID NO: 1231626 - protein, 9 aa, Homo Sapiens
CVYCALLAG

SEQ ID NO: 1231627 - protein, 9 aa, Homo Sapiens
ATLVSAMCT

SEQ ID NO: 1231628 - protein, 9 aa, Homo Sapiens
MYGSFWSNV

SEQ ID NO: 1231629 - protein, 9 aa, Homo Sapiens
MWIRQQEDR

SEQ ID NO: 1231630 - protein, 9 aa, Homo Sapiens
KIRNVFQCE

SEQ ID NO: 1231631 - protein, 9 aa, Homo Sapiens
ARKSLAQPP

SEQ ID NO: 1231632 - protein, 9 aa, Homo Sapiens
AFNALIHKN

SEQ ID NO: 1231633 - protein, 9 aa, Homo Sapiens
IYSIRITLT

SEQ ID NO: 1231634 - protein, 9 aa, Homo Sapiens
TQVYLKAFL

SEQ ID NO: 1231635 - protein, 9 aa, Homo Sapiens
AWPAPPATL

SEQ ID NO: 1231636 - protein, 9 aa, Homo Sapiens
KDSVIPLTK

SEQ ID NO: 1231637 - protein, 9 aa, Homo Sapiens
VHLVQQCVL

SEQ ID NO: 1231638 - protein, 9 aa, Homo Sapiens
HNTLKLIPR

SEQ ID NO: 1231639 - protein, 9 aa, Homo Sapiens
NRESVRTPP

SEQ ID NO: 1231640 - protein, 9 aa, Homo Sapiens
NILAAQSVI

SEQ ID NO: 1231641 - protein, 9 aa, Homo Sapiens
GDLSPGHGV

SEQ ID NO: 1231642 - protein, 9 aa, Homo Sapiens
SVIPLTKRD

SEQ ID NO: 1231643 - protein, 9 aa, Homo Sapiens
LARHQQIHT

SEQ ID NO: 1231644 - protein, 9 aa, Homo Sapiens
FQEEDFPTL

SEQ ID NO: 1231645 - protein, 9 aa, Homo Sapiens
SLFQRWYVR

SEQ ID NO: 1231646 - protein, 9 aa, Homo Sapiens
FSLRVCASI

SEQ ID NO: 1231647 - protein, 9 aa, Homo Sapiens
KYLMEDISQ

SEQ ID NO: 1231648 - protein, 9 aa, Homo Sapiens
CSRPRSRIP

SEQ ID NO: 1231649 - protein, 9 aa, Homo Sapiens
EADGLDSGA

SEQ ID NO: 1231650 - protein, 9 aa, Homo Sapiens
KRRHVSFGG

SEQ ID NO: 1231651 - protein, 9 aa, Homo Sapiens
IPSLLIGTA

SEQ ID NO: 1231652 - protein, 9 aa, Homo Sapiens
SSISPGTPQ

SEQ ID NO: 1231653 - protein, 9 aa, Homo Sapiens
HRIPTHPFE

SEQ ID NO: 1231654 - protein, 9 aa, Homo Sapiens
ASHLTKDVA

SEQ ID NO: 1231655 - protein, 9 aa, Homo Sapiens
HMGFDMQMV

SEQ ID NO: 1231656 - protein, 9 aa, Homo Sapiens
NCQAEAAPL

SEQ ID NO: 1231657 - protein, 9 aa, Homo Sapiens
ANVSWAARV

SEQ ID NO: 1231658 - protein, 9 aa, Homo Sapiens
TIDKVSPYE

SEQ ID NO: 1231659 - protein, 9 aa, Homo Sapiens
HTSERKLRE

SEQ ID NO: 1231660 - protein, 9 aa, Homo Sapiens
LQFRMEQLV

SEQ ID NO: 1231661 - protein, 9 aa, Homo Sapiens
ELFRWPWHE

SEQ ID NO: 1231662 - protein, 9 aa, Homo Sapiens
GISLHEKIQ

SEQ ID NO: 1231663 - protein, 9 aa, Homo Sapiens
TMTPGELLK

SEQ ID NO: 1231664 - protein, 9 aa, Homo Sapiens
QPLSVPCRM

SEQ ID NO: 1231665 - protein, 9 aa, Homo Sapiens
LELDKEGVI

SEQ ID NO: 1231666 - protein, 9 aa, Homo Sapiens
LQQELLIGM

SEQ ID NO: 1231667 - protein, 9 aa, Homo Sapiens
RVVHVAGKE

SEQ ID NO: 1231668 - protein, 9 aa, Homo Sapiens
WKPIWLPVF

SEQ ID NO: 1231669 - protein, 9 aa, Homo Sapiens
TSRCPMTLL

SEQ ID NO: 1231670 - protein, 9 aa, Homo Sapiens
LQKDFSVYH

SEQ ID NO: 1231671 - protein, 9 aa, Homo Sapiens
RLPLRPQRG

SEQ ID NO: 1231672 - protein, 9 aa, Homo Sapiens
ELQQHRFNG

SEQ ID NO: 1231673 - protein, 9 aa, Homo Sapiens
KIHQKGRKK

SEQ ID NO: 1231674 - protein, 9 aa, Homo Sapiens
GPYPWWPCM

SEQ ID NO: 1231675 - protein, 9 aa, Homo Sapiens
MGPFGIPGT

SEQ ID NO: 1231676 - protein, 9 aa, Homo Sapiens
ENFPLGNVQ

SEQ ID NO: 1231677 - protein, 9 aa, Homo Sapiens
APAPIRRHS

SEQ ID NO: 1231678 - protein, 9 aa, Homo Sapiens
NNAEQSAAS

SEQ ID NO: 1231679 - protein, 9 aa, Homo Sapiens
QRVSGLHGS

SEQ ID NO: 1231680 - protein, 9 aa, Homo Sapiens
KNLCYTQAD

SEQ ID NO: 1231681 - protein, 9 aa, Homo Sapiens
RRDAMYQEG

SEQ ID NO: 1231682 - protein, 9 aa, Homo Sapiens
PRQPSTPET

SEQ ID NO: 1231683 - protein, 9 aa, Homo Sapiens
GWTCRDECK

SEQ ID NO: 1231684 - protein, 9 aa, Homo Sapiens
TYASHLTSV

SEQ ID NO: 1231685 - protein, 9 aa, Homo Sapiens
EYANLTGIS

SEQ ID NO: 1231686 - protein, 9 aa, Homo Sapiens
MNYPSTSPR

SEQ ID NO: 1231687 - protein, 9 aa, Homo Sapiens
FSFEMSLTP

SEQ ID NO: 1231688 - protein, 9 aa, Homo Sapiens
TQDHVLSQE

SEQ ID NO: 1231689 - protein, 9 aa, Homo Sapiens
SSEESDLEL

SEQ ID NO: 1231690 - protein, 9 aa, Homo Sapiens
MFDKLTLGG

SEQ ID NO: 1231691 - protein, 9 aa, Homo Sapiens
LVVHDEYIF

SEQ ID NO: 1231692 - protein, 9 aa, Homo Sapiens
LLCLCRSSL

SEQ ID NO: 1231693 - protein, 9 aa, Homo Sapiens
GLARSSVRQ

SEQ ID NO: 1231694 - protein, 9 aa, Homo Sapiens
SHYVPSSGM

SEQ ID NO: 1231695 - protein, 9 aa, Homo Sapiens
QTRCHRIGQ

SEQ ID NO: 1231696 - protein, 9 aa, Homo Sapiens
LNYMLLAKH

SEQ ID NO: 1231697 - protein, 9 aa, Homo Sapiens
YAVNRRLHA

SEQ ID NO: 1231698 - protein, 9 aa, Homo Sapiens
PMHKGEHLG

SEQ ID NO: 1231699 - protein, 9 aa, Homo Sapiens
PRVQMDHEG

SEQ ID NO: 1231700 - protein, 9 aa, Homo Sapiens
WISHDPKIE

SEQ ID NO: 1231701 - protein, 9 aa, Homo Sapiens
DCVGAKQAD

SEQ ID NO: 1231702 - protein, 9 aa, Homo Sapiens
SGTSSTMRL

SEQ ID NO: 1231703 - protein, 9 aa, Homo Sapiens
TIAEKLDLK

SEQ ID NO: 1231704 - protein, 9 aa, Homo Sapiens
NLVYHFCDV

SEQ ID NO: 1231705 - protein, 9 aa, Homo Sapiens
QFKSKITQA

SEQ ID NO: 1231706 - protein, 9 aa, Homo Sapiens
EYWRFVLQR

SEQ ID NO: 1231707 - protein, 9 aa, Homo Sapiens
LEVDPMHPE

SEQ ID NO: 1231708 - protein, 9 aa, Homo Sapiens
EICMAAGSR

SEQ ID NO: 1231709 - protein, 9 aa, Homo Sapiens
TDIIKIQKE

SEQ ID NO: 1231710 - protein, 9 aa, Homo Sapiens
NVCVNTDAE

SEQ ID NO: 1231711 - protein, 9 aa, Homo Sapiens
DADVELERQ

SEQ ID NO: 1231712 - protein, 9 aa, Homo Sapiens
SGAVNLSTE

SEQ ID NO: 1231713 - protein, 9 aa, Homo Sapiens
LLSTGSAEP

SEQ ID NO: 1231714 - protein, 9 aa, Homo Sapiens
LETLHQLAT

SEQ ID NO: 1231715 - protein, 9 aa, Homo Sapiens
KELGSKHSL

SEQ ID NO: 1231716 - protein, 9 aa, Homo Sapiens
EGRTVAALS

SEQ ID NO: 1231717 - protein, 9 aa, Homo Sapiens
KLRYVFKKG

SEQ ID NO: 1231718 - protein, 9 aa, Homo Sapiens
VSSSQGKRW

SEQ ID NO: 1231719 - protein, 9 aa, Homo Sapiens
SGLLTPPQI

SEQ ID NO: 1231720 - protein, 9 aa, Homo Sapiens
LTAFIRLLS

SEQ ID NO: 1231721 - protein, 9 aa, Homo Sapiens
GMYVCIANN

SEQ ID NO: 1231722 - protein, 9 aa, Homo Sapiens
ASNPQYPTA

SEQ ID NO: 1231723 - protein, 9 aa, Homo Sapiens
SCFWETHPL

SEQ ID NO: 1231724 - protein, 9 aa, Homo Sapiens
TEPSMATTK

SEQ ID NO: 1231725 - protein, 9 aa, Homo Sapiens
IGHIEMGHL

SEQ ID NO: 1231726 - protein, 9 aa, Homo Sapiens
IVNTPEVIQ

SEQ ID NO: 1231727 - protein, 9 aa, Homo Sapiens
GRYGRHKQY

SEQ ID NO: 1231728 - protein, 9 aa, Homo Sapiens
QIVVILSGF

SEQ ID NO: 1231729 - protein, 9 aa, Homo Sapiens
LKCTLPWGM

SEQ ID NO: 1231730 - protein, 9 aa, Homo Sapiens
IIVTQNGEV

SEQ ID NO: 1231731 - protein, 9 aa, Homo Sapiens
STPEELKLY

SEQ ID NO: 1231732 - protein, 9 aa, Homo Sapiens
RMCAARLTD

SEQ ID NO: 1231733 - protein, 9 aa, Homo Sapiens
EARKKDTHF

SEQ ID NO: 1231734 - protein, 9 aa, Homo Sapiens
TEKTAGARR

SEQ ID NO: 1231735 - protein, 9 aa, Homo Sapiens
FPFMHVKIF

SEQ ID NO: 1231736 - protein, 9 aa, Homo Sapiens
DSTLLAIIR

SEQ ID NO: 1231737 - protein, 9 aa, Homo Sapiens
LKLLLEIYT

SEQ ID NO: 1231738 - protein, 9 aa, Homo Sapiens
HSPVFHVYP

SEQ ID NO: 1231739 - protein, 9 aa, Homo Sapiens
KEKEKEEKN

SEQ ID NO: 1231740 - protein, 9 aa, Homo Sapiens
TCSSHLSVI

SEQ ID NO: 1231741 - protein, 9 aa, Homo Sapiens
VEPVVWVPT

SEQ ID NO: 1231742 - protein, 9 aa, Homo Sapiens
TRLTRSKGV

SEQ ID NO: 1231743 - protein, 9 aa, Homo Sapiens
SLQERGGVA

SEQ ID NO: 1231744 - protein, 9 aa, Homo Sapiens
IVDGQEEKY

SEQ ID NO: 1231745 - protein, 9 aa, Homo Sapiens
FVSFFPVFV

SEQ ID NO: 1231746 - protein, 9 aa, Homo Sapiens
KHPSAESVV

SEQ ID NO: 1231747 - protein, 9 aa, Homo Sapiens
IKVDGLTLL

SEQ ID NO: 1231748 - protein, 9 aa, Homo Sapiens
SALCPGPGE

SEQ ID NO: 1231749 - protein, 9 aa, Homo Sapiens
TVQVRVPYH

SEQ ID NO: 1231750 - protein, 9 aa, Homo Sapiens
LCGRNGVAL

SEQ ID NO: 1231751 - protein, 9 aa, Homo Sapiens
EYISYCWVI

SEQ ID NO: 1231752 - protein, 9 aa, Homo Sapiens
CEEFWSRFR

SEQ ID NO: 1231753 - protein, 9 aa, Homo Sapiens
ELLPPCCRW

SEQ ID NO: 1231754 - protein, 9 aa, Homo Sapiens
RCSFHIENK

SEQ ID NO: 1231755 - protein, 9 aa, Homo Sapiens
GMAKITHVD

SEQ ID NO: 1231756 - protein, 9 aa, Homo Sapiens
SNFVTDFCG

SEQ ID NO: 1231757 - protein, 9 aa, Homo Sapiens
LEDRYNVYQ

SEQ ID NO: 1231758 - protein, 9 aa, Homo Sapiens
KKMRQGEAT

SEQ ID NO: 1231759 - protein, 9 aa, Homo Sapiens
DYYPDRSWE

SEQ ID NO: 1231760 - protein, 9 aa, Homo Sapiens
NGPPCTSTM

SEQ ID NO: 1231761 - protein, 9 aa, Homo Sapiens
TLVMDWDSE

SEQ ID NO: 1231762 - protein, 9 aa, Homo Sapiens
TMISFALEE

SEQ ID NO: 1231763 - protein, 9 aa, Homo Sapiens
WSWSLDDLR

SEQ ID NO: 1231764 - protein, 9 aa, Homo Sapiens
LIENGVAEW

SEQ ID NO: 1231765 - protein, 9 aa, Homo Sapiens
VNVSILFAD

SEQ ID NO: 1231766 - protein, 9 aa, Homo Sapiens
RHPRRPPHS

SEQ ID NO: 1231767 - protein, 9 aa, Homo Sapiens
RCEEYGKAF

SEQ ID NO: 1231768 - protein, 9 aa, Homo Sapiens
FHWKRRRSF

SEQ ID NO: 1231769 - protein, 9 aa, Homo Sapiens
KLAMKIGGV

SEQ ID NO: 1231770 - protein, 9 aa, Homo Sapiens
CLDVYQPEA

SEQ ID NO: 1231771 - protein, 9 aa, Homo Sapiens
SQPCTPSPL

SEQ ID NO: 1231772 - protein, 9 aa, Homo Sapiens
VWGASKLVS

SEQ ID NO: 1231773 - protein, 9 aa, Homo Sapiens
SKTCGDHPI

SEQ ID NO: 1231774 - protein, 9 aa, Homo Sapiens
ILTSYIFGK

SEQ ID NO: 1231775 - protein, 9 aa, Homo Sapiens
YEDALLPLY

SEQ ID NO: 1231776 - protein, 9 aa, Homo Sapiens
AAVLEKRNY

SEQ ID NO: 1231777 - protein, 9 aa, Homo Sapiens
SAMYEICQG

SEQ ID NO: 1231778 - protein, 9 aa, Homo Sapiens
LRTQYMKYM

SEQ ID NO: 1231779 - protein, 9 aa, Homo Sapiens
KMFQSWSGT

SEQ ID NO: 1231780 - protein, 9 aa, Homo Sapiens
HEKILCGLA

SEQ ID NO: 1231781 - protein, 9 aa, Homo Sapiens
GIDTSYYKL

SEQ ID NO: 1231782 - protein, 9 aa, Homo Sapiens
PDLKYLRFT

SEQ ID NO: 1231783 - protein, 9 aa, Homo Sapiens
HLKVIQASL

SEQ ID NO: 1231784 - protein, 9 aa, Homo Sapiens
GCTSKGLIL

SEQ ID NO: 1231785 - protein, 9 aa, Homo Sapiens
CIGHIEMGH

SEQ ID NO: 1231786 - protein, 9 aa, Homo Sapiens
TADIRVIEE

SEQ ID NO: 1231787 - protein, 9 aa, Homo Sapiens
KCSTCSRLY

SEQ ID NO: 1231788 - protein, 9 aa, Homo Sapiens
YNVAVMCLI

SEQ ID NO: 1231789 - protein, 9 aa, Homo Sapiens
CRIIAEDPE

SEQ ID NO: 1231790 - protein, 9 aa, Homo Sapiens
KAERRSTAA

SEQ ID NO: 1231791 - protein, 9 aa, Homo Sapiens
FSTVCQGHW

SEQ ID NO: 1231792 - protein, 9 aa, Homo Sapiens
YTPVVWGVV

SEQ ID NO: 1231793 - protein, 9 aa, Homo Sapiens
LSFADEKFL

SEQ ID NO: 1231794 - protein, 9 aa, Homo Sapiens
RLGIWVLVT

SEQ ID NO: 1231795 - protein, 9 aa, Homo Sapiens
PKIQYTQIS

SEQ ID NO: 1231796 - protein, 9 aa, Homo Sapiens
QAQTGTHRH

SEQ ID NO: 1231797 - protein, 9 aa, Homo Sapiens
NVLKKKKEP

SEQ ID NO: 1231798 - protein, 9 aa, Homo Sapiens
KKHMAMCHR

SEQ ID NO: 1231799 - protein, 9 aa, Homo Sapiens
KMTAYDQRY

SEQ ID NO: 1231800 - protein, 9 aa, Homo Sapiens
EPACPPRQS

SEQ ID NO: 1231801 - protein, 9 aa, Homo Sapiens
RVAQVQRLE

SEQ ID NO: 1231802 - protein, 9 aa, Homo Sapiens
WDWMHTGRR

SEQ ID NO: 1231803 - protein, 9 aa, Homo Sapiens
ATFTYIPLL

SEQ ID NO: 1231804 - protein, 9 aa, Homo Sapiens
GKYPMIRNQ

SEQ ID NO: 1231805 - protein, 9 aa, Homo Sapiens
QQQQHLLQH

SEQ ID NO: 1231806 - protein, 9 aa, Homo Sapiens
SEKLYKSEE

SEQ ID NO: 1231807 - protein, 9 aa, Homo Sapiens
LAAVVALLL

SEQ ID NO: 1231808 - protein, 9 aa, Homo Sapiens
VWAHLNRDM

SEQ ID NO: 1231809 - protein, 9 aa, Homo Sapiens
DIQRRYLRV

SEQ ID NO: 1231810 - protein, 9 aa, Homo Sapiens
ISKIEIDAF

SEQ ID NO: 1231811 - protein, 9 aa, Homo Sapiens
GLDGSCVLV

SEQ ID NO: 1231812 - protein, 9 aa, Homo Sapiens
VPAGGQTQV

SEQ ID NO: 1231813 - protein, 9 aa, Homo Sapiens
KCQGAKTVF

SEQ ID NO: 1231814 - protein, 9 aa, Homo Sapiens
RRPGPSRAH

SEQ ID NO: 1231815 - protein, 9 aa, Homo Sapiens
SCASVAIGK

SEQ ID NO: 1231816 - protein, 9 aa, Homo Sapiens
LDPAEMRDG

SEQ ID NO: 1231817 - protein, 9 aa, Homo Sapiens
FTSLACGNQ

SEQ ID NO: 1231818 - protein, 9 aa, Homo Sapiens
LEAEEWFEC

SEQ ID NO: 1231819 - protein, 9 aa, Homo Sapiens
AVCMIAIVL

SEQ ID NO: 1231820 - protein, 9 aa, Homo Sapiens
HGPRAAEDE

SEQ ID NO: 1231821 - protein, 9 aa, Homo Sapiens
VNRHRHMFV

SEQ ID NO: 1231822 - protein, 9 aa, Homo Sapiens
YMTICKEFS

SEQ ID NO: 1231823 - protein, 9 aa, Homo Sapiens
TMHSRVFQI

SEQ ID NO: 1231824 - protein, 9 aa, Homo Sapiens
YDSIPMSTS

SEQ ID NO: 1231825 - protein, 9 aa, Homo Sapiens
RPHPTSDGE

SEQ ID NO: 1231826 - protein, 9 aa, Homo Sapiens
FPMPKVGFI

SEQ ID NO: 1231827 - protein, 9 aa, Homo Sapiens
KVGPYPWWP

SEQ ID NO: 1231828 - protein, 9 aa, Homo Sapiens
RFRKLNWKR

SEQ ID NO: 1231829 - protein, 9 aa, Homo Sapiens
HICQAIEAY

SEQ ID NO: 1231830 - protein, 9 aa, Homo Sapiens
ESHILIVEG

SEQ ID NO: 1231831 - protein, 9 aa, Homo Sapiens
TLSNIARKS

SEQ ID NO: 1231832 - protein, 9 aa, Homo Sapiens
PQFQDALHK

SEQ ID NO: 1231833 - protein, 9 aa, Homo Sapiens
LMASAWPFI

SEQ ID NO: 1231834 - protein, 9 aa, Homo Sapiens
LEDSCLLPV

SEQ ID NO: 1231835 - protein, 9 aa, Homo Sapiens
KNLVSEGML

SEQ ID NO: 1231836 - protein, 9 aa, Homo Sapiens
IACLPQTIS

SEQ ID NO: 1231837 - protein, 9 aa, Homo Sapiens
QRHVIAWGH

SEQ ID NO: 1231838 - protein, 9 aa, Homo Sapiens
FTMLPGQGA

SEQ ID NO: 1231839 - protein, 9 aa, Homo Sapiens
KNILTCCQC

SEQ ID NO: 1231840 - protein, 9 aa, Homo Sapiens
VWLRQKLLV

SEQ ID NO: 1231841 - protein, 9 aa, Homo Sapiens
NGITCTTVA

SEQ ID NO: 1231842 - protein, 9 aa, Homo Sapiens
DVDICPLFQ

SEQ ID NO: 1231843 - protein, 9 aa, Homo Sapiens
AALDFCIAA

SEQ ID NO: 1231844 - protein, 9 aa, Homo Sapiens
VAGKYLADN

SEQ ID NO: 1231845 - protein, 9 aa, Homo Sapiens
FLTFPKQCC

SEQ ID NO: 1231846 - protein, 9 aa, Homo Sapiens
GWFSMANTL

SEQ ID NO: 1231847 - protein, 9 aa, Homo Sapiens
PEPDGRSHR

SEQ ID NO: 1231848 - protein, 9 aa, Homo Sapiens
TLLFAFFVW

SEQ ID NO: 1231849 - protein, 9 aa, Homo Sapiens
RQELQEIRR

SEQ ID NO: 1231850 - protein, 9 aa, Homo Sapiens
VKAGGSHQD

SEQ ID NO: 1231851 - protein, 9 aa, Homo Sapiens
ASPLHQPSS

SEQ ID NO: 1231852 - protein, 9 aa, Homo Sapiens
HFKVASLEL

SEQ ID NO: 1231853 - protein, 9 aa, Homo Sapiens
KDIMKEKEV

SEQ ID NO: 1231854 - protein, 9 aa, Homo Sapiens
TEQGIRLST

SEQ ID NO: 1231855 - protein, 9 aa, Homo Sapiens
EGEFQTVKN

SEQ ID NO: 1231856 - protein, 9 aa, Homo Sapiens
ISTARAKGW

SEQ ID NO: 1231857 - protein, 9 aa, Homo Sapiens
EDEEHPRKR

SEQ ID NO: 1231858 - protein, 9 aa, Homo Sapiens
CCTPASSQC

SEQ ID NO: 1231859 - protein, 9 aa, Homo Sapiens
NGLEQLENA

SEQ ID NO: 1231860 - protein, 9 aa, Homo Sapiens
LVNFMKDAA

SEQ ID NO: 1231861 - protein, 9 aa, Homo Sapiens
EAKLLAYNQ

SEQ ID NO: 1231862 - protein, 9 aa, Homo Sapiens
NMIVSGSDI

SEQ ID NO: 1231863 - protein, 9 aa, Homo Sapiens
GRVDFNEFI

SEQ ID NO: 1231864 - protein, 9 aa, Homo Sapiens
ISVQVNSIE

SEQ ID NO: 1231865 - protein, 9 aa, Homo Sapiens
ADQSSDGSW

SEQ ID NO: 1231866 - protein, 9 aa, Homo Sapiens
WKKLSPGNE

SEQ ID NO: 1231867 - protein, 9 aa, Homo Sapiens
EFHKQITAL

SEQ ID NO: 1231868 - protein, 9 aa, Homo Sapiens
IRGMMRELL

SEQ ID NO: 1231869 - protein, 9 aa, Homo Sapiens
SASRPSEQL

SEQ ID NO: 1231870 - protein, 9 aa, Homo Sapiens
PIAHRHSLV

SEQ ID NO: 1231871 - protein, 9 aa, Homo Sapiens
NLLKPTAAN

SEQ ID NO: 1231872 - protein, 9 aa, Homo Sapiens
FWVGRKGDL

SEQ ID NO: 1231873 - protein, 9 aa, Homo Sapiens
DVEYNNGPD

SEQ ID NO: 1231874 - protein, 9 aa, Homo Sapiens
GVPHLLRLF

SEQ ID NO: 1231875 - protein, 9 aa, Homo Sapiens
LYILMDRGD

SEQ ID NO: 1231876 - protein, 9 aa, Homo Sapiens
NDPVVADLM

SEQ ID NO: 1231877 - protein, 9 aa, Homo Sapiens
RTPRSLIPP

SEQ ID NO: 1231878 - protein, 9 aa, Homo Sapiens
LRHRVIATH

SEQ ID NO: 1231879 - protein, 9 aa, Homo Sapiens
RMLNIPFPY

SEQ ID NO: 1231880 - protein, 9 aa, Homo Sapiens
ALALKDVAI

SEQ ID NO: 1231881 - protein, 9 aa, Homo Sapiens
IVTVMCLLL

SEQ ID NO: 1231882 - protein, 9 aa, Homo Sapiens
THPTSASVA

SEQ ID NO: 1231883 - protein, 9 aa, Homo Sapiens
DSISKLKTS

SEQ ID NO: 1231884 - protein, 9 aa, Homo Sapiens
HQRRTQSLQ

SEQ ID NO: 1231885 - protein, 9 aa, Homo Sapiens
TQAMPNALY

SEQ ID NO: 1231886 - protein, 9 aa, Homo Sapiens
LIVLYILCK

SEQ ID NO: 1231887 - protein, 9 aa, Homo Sapiens
LLQEIKECF

SEQ ID NO: 1231888 - protein, 9 aa, Homo Sapiens
QITVGAVIV

SEQ ID NO: 1231889 - protein, 9 aa, Homo Sapiens
VKYANMWLE

SEQ ID NO: 1231890 - protein, 9 aa, Homo Sapiens
MHFQEGWRA

SEQ ID NO: 1231891 - protein, 9 aa, Homo Sapiens
KVIREGQAR

SEQ ID NO: 1231892 - protein, 9 aa, Homo Sapiens
FYEVDCDAI

SEQ ID NO: 1231893 - protein, 9 aa, Homo Sapiens
LPMFCAMPP

SEQ ID NO: 1231894 - protein, 9 aa, Homo Sapiens
SHNIKAAAK

SEQ ID NO: 1231895 - protein, 9 aa, Homo Sapiens
RRSVMRRFD

SEQ ID NO: 1231896 - protein, 9 aa, Homo Sapiens
QASVVIRSP

SEQ ID NO: 1231897 - protein, 9 aa, Homo Sapiens
PFVEECLVD

SEQ ID NO: 1231898 - protein, 9 aa, Homo Sapiens
YEEFVCGCH

SEQ ID NO: 1231899 - protein, 9 aa, Homo Sapiens
KLGMAKITH

SEQ ID NO: 1231900 - protein, 9 aa, Homo Sapiens
TGAEEIYLI

SEQ ID NO: 1231901 - protein, 9 aa, Homo Sapiens
ATIVTVMCL

SEQ ID NO: 1231902 - protein, 9 aa, Homo Sapiens
SEQMGEQVT

SEQ ID NO: 1231903 - protein, 9 aa, Homo Sapiens
WQGKLRLQK

SEQ ID NO: 1231904 - protein, 9 aa, Homo Sapiens
AMIALVIQV

SEQ ID NO: 1231905 - protein, 9 aa, Homo Sapiens
GSKIGSETL

SEQ ID NO: 1231906 - protein, 9 aa, Homo Sapiens
QGDQEYSPE

SEQ ID NO: 1231907 - protein, 9 aa, Homo Sapiens
CKGFYKRKQ

SEQ ID NO: 1231908 - protein, 9 aa, Homo Sapiens
LKYAEKYVS

SEQ ID NO: 1231909 - protein, 9 aa, Homo Sapiens
MGQQTNMMI

SEQ ID NO: 1231910 - protein, 9 aa, Homo Sapiens
CVEPVVWVP

SEQ ID NO: 1231911 - protein, 9 aa, Homo Sapiens
EKIYRAFYN

SEQ ID NO: 1231912 - protein, 9 aa, Homo Sapiens
VYNPLYCES

SEQ ID NO: 1231913 - protein, 9 aa, Homo Sapiens
ENDILFCDL

SEQ ID NO: 1231914 - protein, 9 aa, Homo Sapiens
CPYGTFGMY

SEQ ID NO: 1231915 - protein, 9 aa, Homo Sapiens
KHCAFSIPN

SEQ ID NO: 1231916 - protein, 9 aa, Homo Sapiens
SEPDLASYI

SEQ ID NO: 1231917 - protein, 9 aa, Homo Sapiens
LKAIQWEAE

SEQ ID NO: 1231918 - protein, 9 aa, Homo Sapiens
KTCFIPNRV

SEQ ID NO: 1231919 - protein, 9 aa, Homo Sapiens
HQKGRKKKG

SEQ ID NO: 1231920 - protein, 9 aa, Homo Sapiens
NGGKTTILY

SEQ ID NO: 1231921 - protein, 9 aa, Homo Sapiens
IQKFTGCGG

SEQ ID NO: 1231922 - protein, 9 aa, Homo Sapiens
KVRKKMKLT

SEQ ID NO: 1231923 - protein, 9 aa, Homo Sapiens
LRNSSLGYA

SEQ ID NO: 1231924 - protein, 9 aa, Homo Sapiens
VFVGIKYVN

SEQ ID NO: 1231925 - protein, 9 aa, Homo Sapiens
IDNLYVQLM

SEQ ID NO: 1231926 - protein, 9 aa, Homo Sapiens
LAMSFNSLV

SEQ ID NO: 1231927 - protein, 9 aa, Homo Sapiens
FVISGRHSI

SEQ ID NO: 1231928 - protein, 9 aa, Homo Sapiens
HHGDDLKLT

SEQ ID NO: 1231929 - protein, 9 aa, Homo Sapiens
RLLCRVAVC

SEQ ID NO: 1231930 - protein, 9 aa, Homo Sapiens
VETLSWIFS

SEQ ID NO: 1231931 - protein, 9 aa, Homo Sapiens
GTLGLELAV

SEQ ID NO: 1231932 - protein, 9 aa, Homo Sapiens
VGYCCLEEY

SEQ ID NO: 1231933 - protein, 9 aa, Homo Sapiens
PPGKRGHPG

SEQ ID NO: 1231934 - protein, 9 aa, Homo Sapiens
GQMSLSRQC

SEQ ID NO: 1231935 - protein, 9 aa, Homo Sapiens
AAREDRLQE

SEQ ID NO: 1231936 - protein, 9 aa, Homo Sapiens
INICRVDFS

SEQ ID NO: 1231937 - protein, 9 aa, Homo Sapiens
GHSFHMSYS

SEQ ID NO: 1231938 - protein, 9 aa, Homo Sapiens
LEGIHQFYI

SEQ ID NO: 1231939 - protein, 9 aa, Homo Sapiens
SSPQVLNYS

SEQ ID NO: 1231940 - protein, 9 aa, Homo Sapiens
HDAAVACRQ

SEQ ID NO: 1231941 - protein, 9 aa, Homo Sapiens
ESGLRTHTG

SEQ ID NO: 1231942 - protein, 9 aa, Homo Sapiens
PNAIPKRLC

SEQ ID NO: 1231943 - protein, 9 aa, Homo Sapiens
DSDDEQEAG

SEQ ID NO: 1231944 - protein, 9 aa, Homo Sapiens
PKELLTWVR

SEQ ID NO: 1231945 - protein, 9 aa, Homo Sapiens
IPSGAVKLE

SEQ ID NO: 1231946 - protein, 9 aa, Homo Sapiens
MYATIWLWE

SEQ ID NO: 1231947 - protein, 9 aa, Homo Sapiens
VGFIPPFAK

SEQ ID NO: 1231948 - protein, 9 aa, Homo Sapiens
RRQLHVELN

SEQ ID NO: 1231949 - protein, 9 aa, Homo Sapiens
VISNPDLIT

SEQ ID NO: 1231950 - protein, 9 aa, Homo Sapiens
ECKQYGKAF

SEQ ID NO: 1231951 - protein, 9 aa, Homo Sapiens
VVQFHPLLP

SEQ ID NO: 1231952 - protein, 9 aa, Homo Sapiens
GRMGVCICF

SEQ ID NO: 1231953 - protein, 9 aa, Homo Sapiens
MYGDIFGNS

SEQ ID NO: 1231954 - protein, 9 aa, Homo Sapiens
FDIAIRLQL

SEQ ID NO: 1231955 - protein, 9 aa, Homo Sapiens
LAVVKRSHS

SEQ ID NO: 1231956 - protein, 9 aa, Homo Sapiens
PSPLPDTLL

SEQ ID NO: 1231957 - protein, 9 aa, Homo Sapiens
PCELREPGP

SEQ ID NO: 1231958 - protein, 9 aa, Homo Sapiens
WFECKNADP

SEQ ID NO: 1231959 - protein, 9 aa, Homo Sapiens
RFTASSILH

SEQ ID NO: 1231960 - protein, 9 aa, Homo Sapiens
QELLCLCRS

SEQ ID NO: 1231961 - protein, 9 aa, Homo Sapiens
VAWLKMLCV

SEQ ID NO: 1231962 - protein, 9 aa, Homo Sapiens
AAAGTGCVM

SEQ ID NO: 1231963 - protein, 9 aa, Homo Sapiens
PSLLMENGP

SEQ ID NO: 1231964 - protein, 9 aa, Homo Sapiens
MISFALEEY

SEQ ID NO: 1231965 - protein, 9 aa, Homo Sapiens
HQGFPTKVT

SEQ ID NO: 1231966 - protein, 9 aa, Homo Sapiens
CRDRGELFC

SEQ ID NO: 1231967 - protein, 9 aa, Homo Sapiens
GAHRSPSAP

SEQ ID NO: 1231968 - protein, 9 aa, Homo Sapiens
ATLGHFYEC

SEQ ID NO: 1231969 - protein, 9 aa, Homo Sapiens
KNPNTFECI

SEQ ID NO: 1231970 - protein, 9 aa, Homo Sapiens
FAPLNQTEC

SEQ ID NO: 1231971 - protein, 9 aa, Homo Sapiens
IRVKLDDSR

SEQ ID NO: 1231972 - protein, 9 aa, Homo Sapiens
YTLCIPYCK

SEQ ID NO: 1231973 - protein, 9 aa, Homo Sapiens
SPTLEDQEC

SEQ ID NO: 1231974 - protein, 9 aa, Homo Sapiens
NFMSHDKHV

SEQ ID NO: 1231975 - protein, 9 aa, Homo Sapiens
STFVVFLVF

SEQ ID NO: 1231976 - protein, 9 aa, Homo Sapiens
EESFPEGSK

SEQ ID NO: 1231977 - protein, 9 aa, Homo Sapiens
SFECSSNCT

SEQ ID NO: 1231978 - protein, 9 aa, Homo Sapiens
NLFIYPSNM

SEQ ID NO: 1231979 - protein, 9 aa, Homo Sapiens
LRVALRSVA

SEQ ID NO: 1231980 - protein, 9 aa, Homo Sapiens
APGGPGHLH

SEQ ID NO: 1231981 - protein, 9 aa, Homo Sapiens
HGKKEVYDT

SEQ ID NO: 1231982 - protein, 9 aa, Homo Sapiens
VYYGRKCIA

SEQ ID NO: 1231983 - protein, 9 aa, Homo Sapiens
TAFIRLLSS

SEQ ID NO: 1231984 - protein, 9 aa, Homo Sapiens
TAETFDVVV

SEQ ID NO: 1231985 - protein, 9 aa, Homo Sapiens
GGKAFCVGG

SEQ ID NO: 1231986 - protein, 9 aa, Homo Sapiens
VMPLHHGLT

SEQ ID NO: 1231987 - protein, 9 aa, Homo Sapiens
ARRCKTNIV

SEQ ID NO: 1231988 - protein, 9 aa, Homo Sapiens
GYLLVGTGS

SEQ ID NO: 1231989 - protein, 9 aa, Homo Sapiens
EREEDRCPL

SEQ ID NO: 1231990 - protein, 9 aa, Homo Sapiens
GWEQNLCQL

SEQ ID NO: 1231991 - protein, 9 aa, Homo Sapiens
SQKFFFGDV

SEQ ID NO: 1231992 - protein, 9 aa, Homo Sapiens
HRFNGSDGG

SEQ ID NO: 1231993 - protein, 9 aa, Homo Sapiens
IRISQNFLS

SEQ ID NO: 1231994 - protein, 9 aa, Homo Sapiens
ARMLCQLLQ

SEQ ID NO: 1231995 - protein, 9 aa, Homo Sapiens
AMCMTGAHD

SEQ ID NO: 1231996 - protein, 9 aa, Homo Sapiens
TPSTTAVRH

SEQ ID NO: 1231997 - protein, 9 aa, Homo Sapiens
LSPPNEEVP

SEQ ID NO: 1231998 - protein, 9 aa, Homo Sapiens
LRQLYTSGL

SEQ ID NO: 1231999 - protein, 9 aa, Homo Sapiens
QCTGSGGPG

SEQ ID NO: 1232000 - protein, 9 aa, Homo Sapiens
IKPIKFEDV

SEQ ID NO: 1232001 - protein, 9 aa, Homo Sapiens
NQDEWAWND

SEQ ID NO: 1232002 - protein, 9 aa, Homo Sapiens
LTLPMAYLI

SEQ ID NO: 1232003 - protein, 9 aa, Homo Sapiens
IGLNAPVKY

SEQ ID NO: 1232004 - protein, 9 aa, Homo Sapiens
ECAPGSAGP

SEQ ID NO: 1232005 - protein, 9 aa, Homo Sapiens
QLQVHMALQ

SEQ ID NO: 1232006 - protein, 9 aa, Homo Sapiens
YISPKESPF

SEQ ID NO: 1232007 - protein, 9 aa, Homo Sapiens
TVITVHYLD

SEQ ID NO: 1232008 - protein, 9 aa, Homo Sapiens
NKTDIIDHI

SEQ ID NO: 1232009 - protein, 9 aa, Homo Sapiens
MRVPDSLDN

SEQ ID NO: 1232010 - protein, 9 aa, Homo Sapiens
CIMKEPVLN

SEQ ID NO: 1232011 - protein, 9 aa, Homo Sapiens
IKSNKHHMI

SEQ ID NO: 1232012 - protein, 9 aa, Homo Sapiens
GATEDKSAE

SEQ ID NO: 1232013 - protein, 9 aa, Homo Sapiens
NEYANVDAI

SEQ ID NO: 1232014 - protein, 9 aa, Homo Sapiens
DVGEMAMVT

SEQ ID NO: 1232015 - protein, 9 aa, Homo Sapiens
LTVAVGVCW

SEQ ID NO: 1232016 - protein, 9 aa, Homo Sapiens
VIGVFLNLV

SEQ ID NO: 1232017 - protein, 9 aa, Homo Sapiens
CLIFLCVVL

SEQ ID NO: 1232018 - protein, 9 aa, Homo Sapiens
MLVHVIRRN

SEQ ID NO: 1232019 - protein, 9 aa, Homo Sapiens
RCITSLLPQ

SEQ ID NO: 1232020 - protein, 9 aa, Homo Sapiens
HVFFNPWFQ

SEQ ID NO: 1232021 - protein, 9 aa, Homo Sapiens
ANVYGIPDF

SEQ ID NO: 1232022 - protein, 9 aa, Homo Sapiens
YHQHFGRPR

SEQ ID NO: 1232023 - protein, 9 aa, Homo Sapiens
HSDTDQQTQ

SEQ ID NO: 1232024 - protein, 9 aa, Homo Sapiens
RGGTERSPG

SEQ ID NO: 1232025 - protein, 9 aa, Homo Sapiens
MAAHAAGVS

SEQ ID NO: 1232026 - protein, 9 aa, Homo Sapiens
VQKCQQQKD

SEQ ID NO: 1232027 - protein, 9 aa, Homo Sapiens
PLTEPEKLH

SEQ ID NO: 1232028 - protein, 9 aa, Homo Sapiens
ALTAANGKK

SEQ ID NO: 1232029 - protein, 9 aa, Homo Sapiens
IQKGPHGSI

SEQ ID NO: 1232030 - protein, 9 aa, Homo Sapiens
NQFKSKITQ

SEQ ID NO: 1232031 - protein, 9 aa, Homo Sapiens
WNIFLEKNV

SEQ ID NO: 1232032 - protein, 9 aa, Homo Sapiens
LIGELAKGI

SEQ ID NO: 1232033 - protein, 9 aa, Homo Sapiens
IEEIIKLEI

SEQ ID NO: 1232034 - protein, 9 aa, Homo Sapiens
PFSQIVAIC

SEQ ID NO: 1232035 - protein, 9 aa, Homo Sapiens
WHLWLDDNS

SEQ ID NO: 1232036 - protein, 9 aa, Homo Sapiens
EKQYTIYIT

SEQ ID NO: 1232037 - protein, 9 aa, Homo Sapiens
IVVFCPLKA

SEQ ID NO: 1232038 - protein, 9 aa, Homo Sapiens
NTVEQRQGR

SEQ ID NO: 1232039 - protein, 9 aa, Homo Sapiens
YQQPLQSGS

SEQ ID NO: 1232040 - protein, 9 aa, Homo Sapiens
QDVHCIHAI

SEQ ID NO: 1232041 - protein, 9 aa, Homo Sapiens
PHHRPLGPE

SEQ ID NO: 1232042 - protein, 9 aa, Homo Sapiens
NYIKGTVKV

SEQ ID NO: 1232043 - protein, 9 aa, Homo Sapiens
TPITPWAIF

SEQ ID NO: 1232044 - protein, 9 aa, Homo Sapiens
EEIHRKQRV

SEQ ID NO: 1232045 - protein, 9 aa, Homo Sapiens
WIMKAQALR

SEQ ID NO: 1232046 - protein, 9 aa, Homo Sapiens
KQYMRMSTC

SEQ ID NO: 1232047 - protein, 9 aa, Homo Sapiens
IKAVQHQAN

SEQ ID NO: 1232048 - protein, 9 aa, Homo Sapiens
LFSSAVLIY

SEQ ID NO: 1232049 - protein, 9 aa, Homo Sapiens
HSMVVAQNG

SEQ ID NO: 1232050 - protein, 9 aa, Homo Sapiens
DCSQQGLTE

SEQ ID NO: 1232051 - protein, 9 aa, Homo Sapiens
DKNCYSERK

SEQ ID NO: 1232052 - protein, 9 aa, Homo Sapiens
KKPVMVIGA

SEQ ID NO: 1232053 - protein, 9 aa, Homo Sapiens
RRAALDGFL

SEQ ID NO: 1232054 - protein, 9 aa, Homo Sapiens
FRWPWHEVE

SEQ ID NO: 1232055 - protein, 9 aa, Homo Sapiens
VDEDLLFHG

SEQ ID NO: 1232056 - protein, 9 aa, Homo Sapiens
VKTKGPSRL

SEQ ID NO: 1232057 - protein, 9 aa, Homo Sapiens
TGVTDSTDT

SEQ ID NO: 1232058 - protein, 9 aa, Homo Sapiens
QREDTRIKL

SEQ ID NO: 1232059 - protein, 9 aa, Homo Sapiens
PGYCVPHTD

SEQ ID NO: 1232060 - protein, 9 aa, Homo Sapiens
PASSTAPAP

SEQ ID NO: 1232061 - protein, 9 aa, Homo Sapiens
RGMVVVGTG

SEQ ID NO: 1232062 - protein, 9 aa, Homo Sapiens
QGFHMLFYT

SEQ ID NO: 1232063 - protein, 9 aa, Homo Sapiens
YVVARLLKE

SEQ ID NO: 1232064 - protein, 9 aa, Homo Sapiens
GVDVQSAIC

SEQ ID NO: 1232065 - protein, 9 aa, Homo Sapiens
SSSGRLAKN

SEQ ID NO: 1232066 - protein, 9 aa, Homo Sapiens
NKRRTESRP

SEQ ID NO: 1232067 - protein, 9 aa, Homo Sapiens
METMPLESQ

SEQ ID NO: 1232068 - protein, 9 aa, Homo Sapiens
VVMTVTLST

SEQ ID NO: 1232069 - protein, 9 aa, Homo Sapiens
DLGYIQGMS

SEQ ID NO: 1232070 - protein, 9 aa, Homo Sapiens
SASLVNVTA

SEQ ID NO: 1232071 - protein, 9 aa, Homo Sapiens
FHEYWRFVL

SEQ ID NO: 1232072 - protein, 9 aa, Homo Sapiens
ILAEKMVIV

SEQ ID NO: 1232073 - protein, 9 aa, Homo Sapiens
LHEEAERKA

SEQ ID NO: 1232074 - protein, 9 aa, Homo Sapiens
TDEATHYIA

SEQ ID NO: 1232075 - protein, 9 aa, Homo Sapiens
NTGKYLETL

SEQ ID NO: 1232076 - protein, 9 aa, Homo Sapiens
RHPAISPKS

SEQ ID NO: 1232077 - protein, 9 aa, Homo Sapiens
VGDLILATS

SEQ ID NO: 1232078 - protein, 9 aa, Homo Sapiens
CLGTHTVVV

SEQ ID NO: 1232079 - protein, 9 aa, Homo Sapiens
PIGLYHLSL

SEQ ID NO: 1232080 - protein, 9 aa, Homo Sapiens
KKKLGQSTR

SEQ ID NO: 1232081 - protein, 9 aa, Homo Sapiens
SMYSASKVF

SEQ ID NO: 1232082 - protein, 9 aa, Homo Sapiens
YHNLNLEQW

SEQ ID NO: 1232083 - protein, 9 aa, Homo Sapiens
LLMVGMYYG

SEQ ID NO: 1232084 - protein, 9 aa, Homo Sapiens
SSIPSNSNV

SEQ ID NO: 1232085 - protein, 9 aa, Homo Sapiens
PHWLYSLYD

SEQ ID NO: 1232086 - protein, 9 aa, Homo Sapiens
TNLSHAFGQ

SEQ ID NO: 1232087 - protein, 9 aa, Homo Sapiens
FLYNKIRYL

SEQ ID NO: 1232088 - protein, 9 aa, Homo Sapiens
FVDERKTMI

SEQ ID NO: 1232089 - protein, 9 aa, Homo Sapiens
PGEGTYATV

SEQ ID NO: 1232090 - protein, 9 aa, Homo Sapiens
VDEVMCLAF

SEQ ID NO: 1232091 - protein, 9 aa, Homo Sapiens
STCGCRWSG

SEQ ID NO: 1232092 - protein, 9 aa, Homo Sapiens
IGSLKTLKE

SEQ ID NO: 1232093 - protein, 9 aa, Homo Sapiens
IYKDLTAKG

SEQ ID NO: 1232094 - protein, 9 aa, Homo Sapiens
DVTKALSDL

SEQ ID NO: 1232095 - protein, 9 aa, Homo Sapiens
DSDSSTYNN

SEQ ID NO: 1232096 - protein, 9 aa, Homo Sapiens
DNQPIVKKG

SEQ ID NO: 1232097 - protein, 9 aa, Homo Sapiens
HRPLGPELS

SEQ ID NO: 1232098 - protein, 9 aa, Homo Sapiens
LWRGKKLVV

SEQ ID NO: 1232099 - protein, 9 aa, Homo Sapiens
LGAEHICQA

SEQ ID NO: 1232100 - protein, 9 aa, Homo Sapiens
TGKWQKEAF

SEQ ID NO: 1232101 - protein, 9 aa, Homo Sapiens
VLRVVHILF

SEQ ID NO: 1232102 - protein, 9 aa, Homo Sapiens
GHRVSQEPW

SEQ ID NO: 1232103 - protein, 9 aa, Homo Sapiens
DLEILVSSY

SEQ ID NO: 1232104 - protein, 9 aa, Homo Sapiens
SATLCSTCS

SEQ ID NO: 1232105 - protein, 9 aa, Homo Sapiens
TIKDIPKMN

SEQ ID NO: 1232106 - protein, 9 aa, Homo Sapiens
VVPSSFYVK

SEQ ID NO: 1232107 - protein, 9 aa, Homo Sapiens
LLVRVSLTA

SEQ ID NO: 1232108 - protein, 9 aa, Homo Sapiens
NWIQEERHL

SEQ ID NO: 1232109 - protein, 9 aa, Homo Sapiens
GFFNTTWQE

SEQ ID NO: 1232110 - protein, 9 aa, Homo Sapiens
LKLYDSNLR

SEQ ID NO: 1232111 - protein, 9 aa, Homo Sapiens
EDTETKDLL

SEQ ID NO: 1232112 - protein, 9 aa, Homo Sapiens
KQQYSKGGE

SEQ ID NO: 1232113 - protein, 9 aa, Homo Sapiens
RNLSMDPTF

SEQ ID NO: 1232114 - protein, 9 aa, Homo Sapiens
IQALRDGKS

SEQ ID NO: 1232115 - protein, 9 aa, Homo Sapiens
CSVQDGEPW

SEQ ID NO: 1232116 - protein, 9 aa, Homo Sapiens
DLGMPARAV

SEQ ID NO: 1232117 - protein, 9 aa, Homo Sapiens
GYDLRADVI

SEQ ID NO: 1232118 - protein, 9 aa, Homo Sapiens
TYECCLDEV

SEQ ID NO: 1232119 - protein, 9 aa, Homo Sapiens
MTPPGDQQL

SEQ ID NO: 1232120 - protein, 9 aa, Homo Sapiens
VVKNSIMKN

SEQ ID NO: 1232121 - protein, 9 aa, Homo Sapiens
AKIMGVAGS

SEQ ID NO: 1232122 - protein, 9 aa, Homo Sapiens
EMCQLFTTE

SEQ ID NO: 1232123 - protein, 9 aa, Homo Sapiens
WSFQPASSH

SEQ ID NO: 1232124 - protein, 9 aa, Homo Sapiens
LAQDADVEL

SEQ ID NO: 1232125 - protein, 9 aa, Homo Sapiens
TPTPSWSCP

SEQ ID NO: 1232126 - protein, 9 aa, Homo Sapiens
QDSRVLHVL

SEQ ID NO: 1232127 - protein, 9 aa, Homo Sapiens
ITPRCPPKC

SEQ ID NO: 1232128 - protein, 9 aa, Homo Sapiens
AASPPASSC

SEQ ID NO: 1232129 - protein, 9 aa, Homo Sapiens
ELLLTTITR

SEQ ID NO: 1232130 - protein, 9 aa, Homo Sapiens
PVAEAKSPR

SEQ ID NO: 1232131 - protein, 9 aa, Homo Sapiens
HRKVVILGD

SEQ ID NO: 1232132 - protein, 9 aa, Homo Sapiens
QSTSIRLTE

SEQ ID NO: 1232133 - protein, 9 aa, Homo Sapiens
EGENMNVTN

SEQ ID NO: 1232134 - protein, 9 aa, Homo Sapiens
EMVVAKHPA

SEQ ID NO: 1232135 - protein, 9 aa, Homo Sapiens
GKYDSHGST

SEQ ID NO: 1232136 - protein, 9 aa, Homo Sapiens
LATTSLENT

SEQ ID NO: 1232137 - protein, 9 aa, Homo Sapiens
PLLLVLMAN

SEQ ID NO: 1232138 - protein, 9 aa, Homo Sapiens
RGQQVTLRY

SEQ ID NO: 1232139 - protein, 9 aa, Homo Sapiens
KDEGSDPRH

SEQ ID NO: 1232140 - protein, 9 aa, Homo Sapiens
NPSWTTRDV

SEQ ID NO: 1232141 - protein, 9 aa, Homo Sapiens
ILNRQKIHS

SEQ ID NO: 1232142 - protein, 9 aa, Homo Sapiens
SCVLMTKSA

SEQ ID NO: 1232143 - protein, 9 aa, Homo Sapiens
VIHTMAQEF

SEQ ID NO: 1232144 - protein, 9 aa, Homo Sapiens
LRVREGSLP

SEQ ID NO: 1232145 - protein, 9 aa, Homo Sapiens
GHLDTELDA

SEQ ID NO: 1232146 - protein, 9 aa, Homo Sapiens
IWMQSPVDV

SEQ ID NO: 1232147 - protein, 9 aa, Homo Sapiens
LKHDGKSRG

SEQ ID NO: 1232148 - protein, 9 aa, Homo Sapiens
GKQTAFLFA

SEQ ID NO: 1232149 - protein, 9 aa, Homo Sapiens
QIRCPKGSK

SEQ ID NO: 1232150 - protein, 9 aa, Homo Sapiens
PWPCCLALV

SEQ ID NO: 1232151 - protein, 9 aa, Homo Sapiens
MPSLPSYKA

SEQ ID NO: 1232152 - protein, 9 aa, Homo Sapiens
VLQYRGNSQ

SEQ ID NO: 1232153 - protein, 9 aa, Homo Sapiens
YSLEHAIDL

SEQ ID NO: 1232154 - protein, 9 aa, Homo Sapiens
ILSFFAICG

SEQ ID NO: 1232155 - protein, 9 aa, Homo Sapiens
CGDRATDFH

SEQ ID NO: 1232156 - protein, 9 aa, Homo Sapiens
HLRCIFNWV

SEQ ID NO: 1232157 - protein, 9 aa, Homo Sapiens
PKSGVKLDA

SEQ ID NO: 1232158 - protein, 9 aa, Homo Sapiens
MFVGVTRHS

SEQ ID NO: 1232159 - protein, 9 aa, Homo Sapiens
SEWMLLFRN

SEQ ID NO: 1232160 - protein, 9 aa, Homo Sapiens
YCHRCKDDP

SEQ ID NO: 1232161 - protein, 9 aa, Homo Sapiens
VAWMNLYQV

SEQ ID NO: 1232162 - protein, 9 aa, Homo Sapiens
KSDEDGDKL

SEQ ID NO: 1232163 - protein, 9 aa, Homo Sapiens
GVVADHFKK

SEQ ID NO: 1232164 - protein, 9 aa, Homo Sapiens
KTLIRFWLP

SEQ ID NO: 1232165 - protein, 9 aa, Homo Sapiens
GLPYLDHLN

SEQ ID NO: 1232166 - protein, 9 aa, Homo Sapiens
LLITKKWGD

SEQ ID NO: 1232167 - protein, 9 aa, Homo Sapiens
TLPQLSLTQ

SEQ ID NO: 1232168 - protein, 9 aa, Homo Sapiens
CSWSIISLE

SEQ ID NO: 1232169 - protein, 9 aa, Homo Sapiens
VLGSVKYVK

SEQ ID NO: 1232170 - protein, 9 aa, Homo Sapiens
NRFEEDKRT

SEQ ID NO: 1232171 - protein, 9 aa, Homo Sapiens
QNLCQLRVL

SEQ ID NO: 1232172 - protein, 9 aa, Homo Sapiens
LVTVAFIVF

SEQ ID NO: 1232173 - protein, 9 aa, Homo Sapiens
LVDRGEVRH

SEQ ID NO: 1232174 - protein, 9 aa, Homo Sapiens
RCLCFHTTV

SEQ ID NO: 1232175 - protein, 9 aa, Homo Sapiens
TLYTTGAGI

SEQ ID NO: 1232176 - protein, 9 aa, Homo Sapiens
TLGGQDESS

SEQ ID NO: 1232177 - protein, 9 aa, Homo Sapiens
CSAVIDMEN

SEQ ID NO: 1232178 - protein, 9 aa, Homo Sapiens
SAPNVPVVG

SEQ ID NO: 1232179 - protein, 9 aa, Homo Sapiens
FKNFFLFIL

SEQ ID NO: 1232180 - protein, 9 aa, Homo Sapiens
PPQVLDSQH

SEQ ID NO: 1232181 - protein, 9 aa, Homo Sapiens
EPVELRGQE

SEQ ID NO: 1232182 - protein, 9 aa, Homo Sapiens
HFSLNLLCC

SEQ ID NO: 1232183 - protein, 9 aa, Homo Sapiens
GIGIISFMQ

SEQ ID NO: 1232184 - protein, 9 aa, Homo Sapiens
SRWQGPCRH

SEQ ID NO: 1232185 - protein, 9 aa, Homo Sapiens
MPKVGFIPP

SEQ ID NO: 1232186 - protein, 9 aa, Homo Sapiens
ALRRKNETL

SEQ ID NO: 1232187 - protein, 9 aa, Homo Sapiens
QKKQPNAFG

SEQ ID NO: 1232188 - protein, 9 aa, Homo Sapiens
ADTVKEALE

SEQ ID NO: 1232189 - protein, 9 aa, Homo Sapiens
MYKEIGLLT

SEQ ID NO: 1232190 - protein, 9 aa, Homo Sapiens
GDLIQDAPN

SEQ ID NO: 1232191 - protein, 9 aa, Homo Sapiens
SHKEWGARP

SEQ ID NO: 1232192 - protein, 9 aa, Homo Sapiens
MDAHSEAAP

SEQ ID NO: 1232193 - protein, 9 aa, Homo Sapiens
DEQDKEMVR

SEQ ID NO: 1232194 - protein, 9 aa, Homo Sapiens
LNGHYKTVD

SEQ ID NO: 1232195 - protein, 9 aa, Homo Sapiens
EADKKRQCK

SEQ ID NO: 1232196 - protein, 9 aa, Homo Sapiens
MRFWDASGV

SEQ ID NO: 1232197 - protein, 9 aa, Homo Sapiens
GCAMYTLLC

SEQ ID NO: 1232198 - protein, 9 aa, Homo Sapiens
SGFEGQSHY

SEQ ID NO: 1232199 - protein, 9 aa, Homo Sapiens
ETDSFQVKR

SEQ ID NO: 1232200 - protein, 9 aa, Homo Sapiens
LLQRANPSN

SEQ ID NO: 1232201 - protein, 9 aa, Homo Sapiens
ALLLSYVFI

SEQ ID NO: 1232202 - protein, 9 aa, Homo Sapiens
QKPIPRPTN

SEQ ID NO: 1232203 - protein, 9 aa, Homo Sapiens
RVNQGLDTG

SEQ ID NO: 1232204 - protein, 9 aa, Homo Sapiens
FCGWASLST

SEQ ID NO: 1232205 - protein, 9 aa, Homo Sapiens
YFGKHFMSF

SEQ ID NO: 1232206 - protein, 9 aa, Homo Sapiens
PFMHVKIFD

SEQ ID NO: 1232207 - protein, 9 aa, Homo Sapiens
AGEMTKVQD

SEQ ID NO: 1232208 - protein, 9 aa, Homo Sapiens
FVGTAQHVS

SEQ ID NO: 1232209 - protein, 9 aa, Homo Sapiens
PQRCSDNCD

SEQ ID NO: 1232210 - protein, 9 aa, Homo Sapiens
PPHPVLLSI

SEQ ID NO: 1232211 - protein, 9 aa, Homo Sapiens
FINLREVTD

SEQ ID NO: 1232212 - protein, 9 aa, Homo Sapiens
PGMMRHLNI

SEQ ID NO: 1232213 - protein, 9 aa, Homo Sapiens
RYYWGEKLT

SEQ ID NO: 1232214 - protein, 9 aa, Homo Sapiens
CESVSDHCH

SEQ ID NO: 1232215 - protein, 9 aa, Homo Sapiens
CHFCDDILS

SEQ ID NO: 1232216 - protein, 9 aa, Homo Sapiens
QPEGEVGVR

SEQ ID NO: 1232217 - protein, 9 aa, Homo Sapiens
GDDCSSDCA

SEQ ID NO: 1232218 - protein, 9 aa, Homo Sapiens
EVSYIKVVH

SEQ ID NO: 1232219 - protein, 9 aa, Homo Sapiens
GKRTLSMST

SEQ ID NO: 1232220 - protein, 9 aa, Homo Sapiens
EGKCLQAKG

SEQ ID NO: 1232221 - protein, 9 aa, Homo Sapiens
KIYIQRHVN

SEQ ID NO: 1232222 - protein, 9 aa, Homo Sapiens
RKPIAHRHS

SEQ ID NO: 1232223 - protein, 9 aa, Homo Sapiens
GQFIHTNWA

SEQ ID NO: 1232224 - protein, 9 aa, Homo Sapiens
LASPESLGY

SEQ ID NO: 1232225 - protein, 9 aa, Homo Sapiens
GSVLDKPLF

SEQ ID NO: 1232226 - protein, 9 aa, Homo Sapiens
TLEDQECHL

SEQ ID NO: 1232227 - protein, 9 aa, Homo Sapiens
AWSMVGRLP

SEQ ID NO: 1232228 - protein, 9 aa, Homo Sapiens
CSCHQCPSG

SEQ ID NO: 1232229 - protein, 9 aa, Homo Sapiens
VTFLEGSST

SEQ ID NO: 1232230 - protein, 9 aa, Homo Sapiens
EGTRCYRLC

SEQ ID NO: 1232231 - protein, 9 aa, Homo Sapiens
KVIVHHAMA

SEQ ID NO: 1232232 - protein, 9 aa, Homo Sapiens
FLEVDPMHP

SEQ ID NO: 1232233 - protein, 9 aa, Homo Sapiens
YMSSNFIGL

SEQ ID NO: 1232234 - protein, 9 aa, Homo Sapiens
QPPERIANG

SEQ ID NO: 1232235 - protein, 9 aa, Homo Sapiens
VCSITVNIA

SEQ ID NO: 1232236 - protein, 9 aa, Homo Sapiens
SLDLVTMKR

SEQ ID NO: 1232237 - protein, 9 aa, Homo Sapiens
PGALMWLQE

SEQ ID NO: 1232238 - protein, 9 aa, Homo Sapiens
ASESEEDHS

SEQ ID NO: 1232239 - protein, 9 aa, Homo Sapiens
TIIALISVS

SEQ ID NO: 1232240 - protein, 9 aa, Homo Sapiens
FLLLLLIMS

SEQ ID NO: 1232241 - protein, 9 aa, Homo Sapiens
QVTTIQDWS

SEQ ID NO: 1232242 - protein, 9 aa, Homo Sapiens
KYPTRNSIV

SEQ ID NO: 1232243 - protein, 9 aa, Homo Sapiens
DETELQGKF

SEQ ID NO: 1232244 - protein, 9 aa, Homo Sapiens
SKLEVYLTL

SEQ ID NO: 1232245 - protein, 9 aa, Homo Sapiens
QEQKAKMEK

SEQ ID NO: 1232246 - protein, 9 aa, Homo Sapiens
AWGHAFVLV

SEQ ID NO: 1232247 - protein, 9 aa, Homo Sapiens
TIRVRCNPQ

SEQ ID NO: 1232248 - protein, 9 aa, Homo Sapiens
DVEVESSMG

SEQ ID NO: 1232249 - protein, 9 aa, Homo Sapiens
KCDFFKRTH

SEQ ID NO: 1232250 - protein, 9 aa, Homo Sapiens
RRHCSPSER

SEQ ID NO: 1232251 - protein, 9 aa, Homo Sapiens
AHYHVNFSH

SEQ ID NO: 1232252 - protein, 9 aa, Homo Sapiens
KEVDIMRKV

SEQ ID NO: 1232253 - protein, 9 aa, Homo Sapiens
FIRLLPSVS

SEQ ID NO: 1232254 - protein, 9 aa, Homo Sapiens
CPLDVTDSA

SEQ ID NO: 1232255 - protein, 9 aa, Homo Sapiens
GGLMVGAVS

SEQ ID NO: 1232256 - protein, 9 aa, Homo Sapiens
GIRTVRYHD

SEQ ID NO: 1232257 - protein, 9 aa, Homo Sapiens
QHCLSVLFP

SEQ ID NO: 1232258 - protein, 9 aa, Homo Sapiens
ACLRNHQGT

SEQ ID NO: 1232259 - protein, 9 aa, Homo Sapiens
EEQASVLVE

SEQ ID NO: 1232260 - protein, 9 aa, Homo Sapiens
RRQQASERD

SEQ ID NO: 1232261 - protein, 9 aa, Homo Sapiens
SSTFQFCFL

SEQ ID NO: 1232262 - protein, 9 aa, Homo Sapiens
MSQLTCKQP

SEQ ID NO: 1232263 - protein, 9 aa, Homo Sapiens
GITLIWTAP

SEQ ID NO: 1232264 - protein, 9 aa, Homo Sapiens
LDGTCLAID

SEQ ID NO: 1232265 - protein, 9 aa, Homo Sapiens
LLRMSAAYL

SEQ ID NO: 1232266 - protein, 9 aa, Homo Sapiens
ASEMADEKF

SEQ ID NO: 1232267 - protein, 9 aa, Homo Sapiens
NKEEPKAQP

SEQ ID NO: 1232268 - protein, 9 aa, Homo Sapiens
KERRRKLNM

SEQ ID NO: 1232269 - protein, 9 aa, Homo Sapiens
IFSRDGGSP

SEQ ID NO: 1232270 - protein, 9 aa, Homo Sapiens
ALNRIQVRS

SEQ ID NO: 1232271 - protein, 9 aa, Homo Sapiens
EGNNLVYSA

SEQ ID NO: 1232272 - protein, 9 aa, Homo Sapiens
TMHGTSISF

SEQ ID NO: 1232273 - protein, 9 aa, Homo Sapiens
PRKISSPTC

SEQ ID NO: 1232274 - protein, 9 aa, Homo Sapiens
SIFDMDYAS

SEQ ID NO: 1232275 - protein, 9 aa, Homo Sapiens
LDALNNFLT

SEQ ID NO: 1232276 - protein, 9 aa, Homo Sapiens
MRFMLLFSW

SEQ ID NO: 1232277 - protein, 9 aa, Homo Sapiens
TGRAPGCTG

SEQ ID NO: 1232278 - protein, 9 aa, Homo Sapiens
SKTTAAHYL

SEQ ID NO: 1232279 - protein, 9 aa, Homo Sapiens
HVKFTLEYS

SEQ ID NO: 1232280 - protein, 9 aa, Homo Sapiens
PPVTSPSSP

SEQ ID NO: 1232281 - protein, 9 aa, Homo Sapiens
GNVQFLMDF

SEQ ID NO: 1232282 - protein, 9 aa, Homo Sapiens
AFFGLVPEI

SEQ ID NO: 1232283 - protein, 9 aa, Homo Sapiens
LFPPLEKVH

SEQ ID NO: 1232284 - protein, 9 aa, Homo Sapiens
SGVKLDAAG

SEQ ID NO: 1232285 - protein, 9 aa, Homo Sapiens
PAGSPLTSG

SEQ ID NO: 1232286 - protein, 9 aa, Homo Sapiens
GRAGRMGVC

SEQ ID NO: 1232287 - protein, 9 aa, Homo Sapiens
QAKQGYLIN

SEQ ID NO: 1232288 - protein, 9 aa, Homo Sapiens
AVTSSPSHP

SEQ ID NO: 1232289 - protein, 9 aa, Homo Sapiens
KGVALKFVT

SEQ ID NO: 1232290 - protein, 9 aa, Homo Sapiens
IDHIFAVEW

SEQ ID NO: 1232291 - protein, 9 aa, Homo Sapiens
DKKLCYDQC

SEQ ID NO: 1232292 - protein, 9 aa, Homo Sapiens
LHQRRTQSL

SEQ ID NO: 1232293 - protein, 9 aa, Homo Sapiens
LNVCCESEV

SEQ ID NO: 1232294 - protein, 9 aa, Homo Sapiens
RTLQGHSHW

SEQ ID NO: 1232295 - protein, 9 aa, Homo Sapiens
VPPLIHVQC

SEQ ID NO: 1232296 - protein, 9 aa, Homo Sapiens
YMNHSPFTV

SEQ ID NO: 1232297 - protein, 9 aa, Homo Sapiens
QDIRFHYGR

SEQ ID NO: 1232298 - protein, 9 aa, Homo Sapiens
QPKCWQQDM

SEQ ID NO: 1232299 - protein, 9 aa, Homo Sapiens
GHLEEFPVL

SEQ ID NO: 1232300 - protein, 9 aa, Homo Sapiens
YGYALCLQK

SEQ ID NO: 1232301 - protein, 9 aa, Homo Sapiens
VQQTQFTVI

SEQ ID NO: 1232302 - protein, 9 aa, Homo Sapiens
DEQESMRSS

SEQ ID NO: 1232303 - protein, 9 aa, Homo Sapiens
LIDVDTKFL

SEQ ID NO: 1232304 - protein, 9 aa, Homo Sapiens
EENTKHFPK

SEQ ID NO: 1232305 - protein, 9 aa, Homo Sapiens
ANVTRMCQV

SEQ ID NO: 1232306 - protein, 9 aa, Homo Sapiens
TVTCSFVQV

SEQ ID NO: 1232307 - protein, 9 aa, Homo Sapiens
PKEGVRVNK

SEQ ID NO: 1232308 - protein, 9 aa, Homo Sapiens
RLLKEFQAC

SEQ ID NO: 1232309 - protein, 9 aa, Homo Sapiens
LPQQKLLIK

SEQ ID NO: 1232310 - protein, 9 aa, Homo Sapiens
NLVMLGLCS

SEQ ID NO: 1232311 - protein, 9 aa, Homo Sapiens
RVVSPIINV

SEQ ID NO: 1232312 - protein, 9 aa, Homo Sapiens
LWIPLLLVV

SEQ ID NO: 1232313 - protein, 9 aa, Homo Sapiens
ESCEQIVVQ

SEQ ID NO: 1232314 - protein, 9 aa, Homo Sapiens
ICHHGTTGS

SEQ ID NO: 1232315 - protein, 9 aa, Homo Sapiens
ERPPLTTSA

SEQ ID NO: 1232316 - protein, 9 aa, Homo Sapiens
HFGKYKSKE

SEQ ID NO: 1232317 - protein, 9 aa, Homo Sapiens
IFGNNLVVI

SEQ ID NO: 1232318 - protein, 9 aa, Homo Sapiens
KVTDAEIKN

SEQ ID NO: 1232319 - protein, 9 aa, Homo Sapiens
SSLVVHDEY

SEQ ID NO: 1232320 - protein, 9 aa, Homo Sapiens
CSDNYEVQA

SEQ ID NO: 1232321 - protein, 9 aa, Homo Sapiens
ENGITMLDT

SEQ ID NO: 1232322 - protein, 9 aa, Homo Sapiens
KRTVPWNCR

SEQ ID NO: 1232323 - protein, 9 aa, Homo Sapiens
LETCKAHDG

SEQ ID NO: 1232324 - protein, 9 aa, Homo Sapiens
LCIAKTLSY

SEQ ID NO: 1232325 - protein, 9 aa, Homo Sapiens
PEELKLYDS

SEQ ID NO: 1232326 - protein, 9 aa, Homo Sapiens
PKDQVVLEG

SEQ ID NO: 1232327 - protein, 9 aa, Homo Sapiens
RSLKELDEG

SEQ ID NO: 1232328 - protein, 9 aa, Homo Sapiens
CCLVLFLIG

SEQ ID NO: 1232329 - protein, 9 aa, Homo Sapiens
EGTNHEEIF

SEQ ID NO: 1232330 - protein, 9 aa, Homo Sapiens
NNQFQVEHF

SEQ ID NO: 1232331 - protein, 9 aa, Homo Sapiens
AVQHQANQA

SEQ ID NO: 1232332 - protein, 9 aa, Homo Sapiens
ENNKASNSK

SEQ ID NO: 1232333 - protein, 9 aa, Homo Sapiens
SQHSLPMDC

SEQ ID NO: 1232334 - protein, 9 aa, Homo Sapiens
WLPYWSSLW

SEQ ID NO: 1232335 - protein, 9 aa, Homo Sapiens
LLLTTITRT

SEQ ID NO: 1232336 - protein, 9 aa, Homo Sapiens
CDTLGIREV

SEQ ID NO: 1232337 - protein, 9 aa, Homo Sapiens
TSTEHAHIV

SEQ ID NO: 1232338 - protein, 9 aa, Homo Sapiens
DVFHKYTKG

SEQ ID NO: 1232339 - protein, 9 aa, Homo Sapiens
TSFDGVQES

SEQ ID NO: 1232340 - protein, 9 aa, Homo Sapiens
WLFLFQIQK

SEQ ID NO: 1232341 - protein, 9 aa, Homo Sapiens
NHPPSLAIT

SEQ ID NO: 1232342 - protein, 9 aa, Homo Sapiens
GTTGNGLDQ

SEQ ID NO: 1232343 - protein, 9 aa, Homo Sapiens
FTLVNCSKN

SEQ ID NO: 1232344 - protein, 9 aa, Homo Sapiens
KVHNHQPRI

SEQ ID NO: 1232345 - protein, 9 aa, Homo Sapiens
LSNFVTDFC

SEQ ID NO: 1232346 - protein, 9 aa, Homo Sapiens
NRQRMNKEY

SEQ ID NO: 1232347 - protein, 9 aa, Homo Sapiens
LSDQDVGRG

SEQ ID NO: 1232348 - protein, 9 aa, Homo Sapiens
KAKDTQGFM

SEQ ID NO: 1232349 - protein, 9 aa, Homo Sapiens
GHGDPMPEP

SEQ ID NO: 1232350 - protein, 9 aa, Homo Sapiens
QLEDKTNVI

SEQ ID NO: 1232351 - protein, 9 aa, Homo Sapiens
QQCVLLLVL

SEQ ID NO: 1232352 - protein, 9 aa, Homo Sapiens
SNKKISVLS

SEQ ID NO: 1232353 - protein, 9 aa, Homo Sapiens
SAKGREEIL

SEQ ID NO: 1232354 - protein, 9 aa, Homo Sapiens
NYLWSPGGR

SEQ ID NO: 1232355 - protein, 9 aa, Homo Sapiens
CRQDDDQRS

SEQ ID NO: 1232356 - protein, 9 aa, Homo Sapiens
QRCRKQGAG

SEQ ID NO: 1232357 - protein, 9 aa, Homo Sapiens
GSVPGITKF

SEQ ID NO: 1232358 - protein, 9 aa, Homo Sapiens
GGEKRWGCV

SEQ ID NO: 1232359 - protein, 9 aa, Homo Sapiens
NETFVFNLM

SEQ ID NO: 1232360 - protein, 9 aa, Homo Sapiens
GVQSAPSSL

SEQ ID NO: 1232361 - protein, 9 aa, Homo Sapiens
MFLESQELM

SEQ ID NO: 1232362 - protein, 9 aa, Homo Sapiens
TLPLKKRHT

SEQ ID NO: 1232363 - protein, 9 aa, Homo Sapiens
VARPFSGNL

SEQ ID NO: 1232364 - protein, 9 aa, Homo Sapiens
SHYGGSLPS

SEQ ID NO: 1232365 - protein, 9 aa, Homo Sapiens
GYFAIYFLN

SEQ ID NO: 1232366 - protein, 9 aa, Homo Sapiens
ALSWVVSML

SEQ ID NO: 1232367 - protein, 9 aa, Homo Sapiens
GWVEQLVLY

SEQ ID NO: 1232368 - protein, 9 aa, Homo Sapiens
PAQGAIGCL

SEQ ID NO: 1232369 - protein, 9 aa, Homo Sapiens
MDFSQALKK

SEQ ID NO: 1232370 - protein, 9 aa, Homo Sapiens
LESHLNSDL

SEQ ID NO: 1232371 - protein, 9 aa, Homo Sapiens
SWYDLEHGQ

SEQ ID NO: 1232372 - protein, 9 aa, Homo Sapiens
TEPFPQVKL

SEQ ID NO: 1232373 - protein, 9 aa, Homo Sapiens
RRHGFTSFR

SEQ ID NO: 1232374 - protein, 9 aa, Homo Sapiens
VTLVPELGR

SEQ ID NO: 1232375 - protein, 9 aa, Homo Sapiens
ADSMYVEKI

SEQ ID NO: 1232376 - protein, 9 aa, Homo Sapiens
GEWPYKCGE

SEQ ID NO: 1232377 - protein, 9 aa, Homo Sapiens
LSLQESGMA

SEQ ID NO: 1232378 - protein, 9 aa, Homo Sapiens
WVVSMLHTM

SEQ ID NO: 1232379 - protein, 9 aa, Homo Sapiens
FVIFNQKIS

SEQ ID NO: 1232380 - protein, 9 aa, Homo Sapiens
LFKDLGMPA

SEQ ID NO: 1232381 - protein, 9 aa, Homo Sapiens
TLISPNINR

SEQ ID NO: 1232382 - protein, 9 aa, Homo Sapiens
TADRSMRKG

SEQ ID NO: 1232383 - protein, 9 aa, Homo Sapiens
KYYASLKKD

SEQ ID NO: 1232384 - protein, 9 aa, Homo Sapiens
TGEKSYVCE

SEQ ID NO: 1232385 - protein, 9 aa, Homo Sapiens
SSHLHLKRA

SEQ ID NO: 1232386 - protein, 9 aa, Homo Sapiens
GNTGPRGRR

SEQ ID NO: 1232387 - protein, 9 aa, Homo Sapiens
AVHGSSVNR

SEQ ID NO: 1232388 - protein, 9 aa, Homo Sapiens
AAVVVVTEL

SEQ ID NO: 1232389 - protein, 9 aa, Homo Sapiens
TIITDMELP

SEQ ID NO: 1232390 - protein, 9 aa, Homo Sapiens
TPDSVTILA

SEQ ID NO: 1232391 - protein, 9 aa, Homo Sapiens
ADQLCLDPM

SEQ ID NO: 1232392 - protein, 9 aa, Homo Sapiens
MELVMQEEI

SEQ ID NO: 1232393 - protein, 9 aa, Homo Sapiens
MAHQIYVLQ

SEQ ID NO: 1232394 - protein, 9 aa, Homo Sapiens
MTEGNMGVT

SEQ ID NO: 1232395 - protein, 9 aa, Homo Sapiens
FMKFSVQVE

SEQ ID NO: 1232396 - protein, 9 aa, Homo Sapiens
ERAVCHDEP

SEQ ID NO: 1232397 - protein, 9 aa, Homo Sapiens
NGVIHFDDN

SEQ ID NO: 1232398 - protein, 9 aa, Homo Sapiens
KTKQTCWAS

SEQ ID NO: 1232399 - protein, 9 aa, Homo Sapiens
PTVQFHSKE

SEQ ID NO: 1232400 - protein, 9 aa, Homo Sapiens
KLSDQTVLF

SEQ ID NO: 1232401 - protein, 9 aa, Homo Sapiens
HDGHPSSFS

SEQ ID NO: 1232402 - protein, 9 aa, Homo Sapiens
PPVKRQELT

SEQ ID NO: 1232403 - protein, 9 aa, Homo Sapiens
RTCVSLDDV

SEQ ID NO: 1232404 - protein, 9 aa, Homo Sapiens
DGFCKMSGY

SEQ ID NO: 1232405 - protein, 9 aa, Homo Sapiens
KTMIEKLKK

SEQ ID NO: 1232406 - protein, 9 aa, Homo Sapiens
ICGMVCIGP

SEQ ID NO: 1232407 - protein, 9 aa, Homo Sapiens
MQDLKSTVD

SEQ ID NO: 1232408 - protein, 9 aa, Homo Sapiens
VSGGPLLYR

SEQ ID NO: 1232409 - protein, 9 aa, Homo Sapiens
TSWRVASTQ

SEQ ID NO: 1232410 - protein, 9 aa, Homo Sapiens
SMPKTCILI

SEQ ID NO: 1232411 - protein, 9 aa, Homo Sapiens
VVGLTGAHL

SEQ ID NO: 1232412 - protein, 9 aa, Homo Sapiens
ESKKEINII

SEQ ID NO: 1232413 - protein, 9 aa, Homo Sapiens
AEKRILDPS

SEQ ID NO: 1232414 - protein, 9 aa, Homo Sapiens
EDPVLTTLE

SEQ ID NO: 1232415 - protein, 9 aa, Homo Sapiens
PPEIFQESS

SEQ ID NO: 1232416 - protein, 9 aa, Homo Sapiens
EETSTESWE

SEQ ID NO: 1232417 - protein, 9 aa, Homo Sapiens
KTKKIVYQQ

SEQ ID NO: 1232418 - protein, 9 aa, Homo Sapiens
TGEKSYNCK

SEQ ID NO: 1232419 - protein, 9 aa, Homo Sapiens
GDCHIFTRC

SEQ ID NO: 1232420 - protein, 9 aa, Homo Sapiens
QCQKEAKEI

SEQ ID NO: 1232421 - protein, 9 aa, Homo Sapiens
NVNSSRFGK

SEQ ID NO: 1232422 - protein, 9 aa, Homo Sapiens
PRHGKCLPD

SEQ ID NO: 1232423 - protein, 9 aa, Homo Sapiens
EHTMEEEVP

SEQ ID NO: 1232424 - protein, 9 aa, Homo Sapiens
EHMRLELQM

SEQ ID NO: 1232425 - protein, 9 aa, Homo Sapiens
KIGETVVNL

SEQ ID NO: 1232426 - protein, 9 aa, Homo Sapiens
ECSKPREVF

SEQ ID NO: 1232427 - protein, 9 aa, Homo Sapiens
KALKPKKTK

SEQ ID NO: 1232428 - protein, 9 aa, Homo Sapiens
HKQRITASE

SEQ ID NO: 1232429 - protein, 9 aa, Homo Sapiens
PITSTSASS

SEQ ID NO: 1232430 - protein, 9 aa, Homo Sapiens
ERREIQREL

SEQ ID NO: 1232431 - protein, 9 aa, Homo Sapiens
PPPTDSACL

SEQ ID NO: 1232432 - protein, 9 aa, Homo Sapiens
TLSVLVTPE

SEQ ID NO: 1232433 - protein, 9 aa, Homo Sapiens
HNVQKDFII

SEQ ID NO: 1232434 - protein, 9 aa, Homo Sapiens
QIGSAEYCT

SEQ ID NO: 1232435 - protein, 9 aa, Homo Sapiens
SVIALFYGT

SEQ ID NO: 1232436 - protein, 9 aa, Homo Sapiens
VMTTELAHS

SEQ ID NO: 1232437 - protein, 9 aa, Homo Sapiens
LCIRHWTTK

SEQ ID NO: 1232438 - protein, 9 aa, Homo Sapiens
ASLYNIHLQ

SEQ ID NO: 1232439 - protein, 9 aa, Homo Sapiens
EENSSNLWK

SEQ ID NO: 1232440 - protein, 9 aa, Homo Sapiens
AGPRPRAPA

SEQ ID NO: 1232441 - protein, 9 aa, Homo Sapiens
ERTRKHSRE

SEQ ID NO: 1232442 - protein, 9 aa, Homo Sapiens
VTATVTANN

SEQ ID NO: 1232443 - protein, 9 aa, Homo Sapiens
QVDWLPQQI

SEQ ID NO: 1232444 - protein, 9 aa, Homo Sapiens
SVTDSLCHM

SEQ ID NO: 1232445 - protein, 9 aa, Homo Sapiens
QCYDSELGL

SEQ ID NO: 1232446 - protein, 9 aa, Homo Sapiens
FAWERVWGL

SEQ ID NO: 1232447 - protein, 9 aa, Homo Sapiens
RFRSMIPSY

SEQ ID NO: 1232448 - protein, 9 aa, Homo Sapiens
TVKIIYVRN

SEQ ID NO: 1232449 - protein, 9 aa, Homo Sapiens
DFSFSRYAS

SEQ ID NO: 1232450 - protein, 9 aa, Homo Sapiens
KILEGGNGM

SEQ ID NO: 1232451 - protein, 9 aa, Homo Sapiens
AMDFSQALK

SEQ ID NO: 1232452 - protein, 9 aa, Homo Sapiens
AGRIWPDEL

SEQ ID NO: 1232453 - protein, 9 aa, Homo Sapiens
YHDISMNHK

SEQ ID NO: 1232454 - protein, 9 aa, Homo Sapiens
LHGGIAGRS

SEQ ID NO: 1232455 - protein, 9 aa, Homo Sapiens
KLFKCPKGL

SEQ ID NO: 1232456 - protein, 9 aa, Homo Sapiens
LILVMLEIV

SEQ ID NO: 1232457 - protein, 9 aa, Homo Sapiens
VRLCTIGEL

SEQ ID NO: 1232458 - protein, 9 aa, Homo Sapiens
YYDDRFIVK

SEQ ID NO: 1232459 - protein, 9 aa, Homo Sapiens
MIYLLCDKI

SEQ ID NO: 1232460 - protein, 9 aa, Homo Sapiens
SRAFNSLGL

SEQ ID NO: 1232461 - protein, 9 aa, Homo Sapiens
EYSNMPDSI

SEQ ID NO: 1232462 - protein, 9 aa, Homo Sapiens
DIFRHYDTD

SEQ ID NO: 1232463 - protein, 9 aa, Homo Sapiens
ANIEAFNSC

SEQ ID NO: 1232464 - protein, 9 aa, Homo Sapiens
KAVDVVLFG

SEQ ID NO: 1232465 - protein, 9 aa, Homo Sapiens
VAEIVIHIH

SEQ ID NO: 1232466 - protein, 9 aa, Homo Sapiens
VEDAIACKR

SEQ ID NO: 1232467 - protein, 9 aa, Homo Sapiens
MYTCPRWIS

SEQ ID NO: 1232468 - protein, 9 aa, Homo Sapiens
NFELMMHTV

SEQ ID NO: 1232469 - protein, 9 aa, Homo Sapiens
AGVVYKDVI

SEQ ID NO: 1232470 - protein, 9 aa, Homo Sapiens
VMQAKTFSE

SEQ ID NO: 1232471 - protein, 9 aa, Homo Sapiens
ETLVCKAGE

SEQ ID NO: 1232472 - protein, 9 aa, Homo Sapiens
TLWDEPGSV

SEQ ID NO: 1232473 - protein, 9 aa, Homo Sapiens
KPFRKMQED

SEQ ID NO: 1232474 - protein, 9 aa, Homo Sapiens
AFILYIILH

SEQ ID NO: 1232475 - protein, 9 aa, Homo Sapiens
MDMMQIYDG

SEQ ID NO: 1232476 - protein, 9 aa, Homo Sapiens
SGCQDINEC

SEQ ID NO: 1232477 - protein, 9 aa, Homo Sapiens
TTIIAPMML

SEQ ID NO: 1232478 - protein, 9 aa, Homo Sapiens
TVSIETLCA

SEQ ID NO: 1232479 - protein, 9 aa, Homo Sapiens
DCLAEEGRT

SEQ ID NO: 1232480 - protein, 9 aa, Homo Sapiens
LDDSDIPPP

SEQ ID NO: 1232481 - protein, 9 aa, Homo Sapiens
EDRAREQRW

SEQ ID NO: 1232482 - protein, 9 aa, Homo Sapiens
GYSPCVKKN

SEQ ID NO: 1232483 - protein, 9 aa, Homo Sapiens
QNNLTDAKY

SEQ ID NO: 1232484 - protein, 9 aa, Homo Sapiens
RHDSSFKKY

SEQ ID NO: 1232485 - protein, 9 aa, Homo Sapiens
GPNLEWLKK

SEQ ID NO: 1232486 - protein, 9 aa, Homo Sapiens
SQAMCYIET

SEQ ID NO: 1232487 - protein, 9 aa, Homo Sapiens
RVAPQQCVV

SEQ ID NO: 1232488 - protein, 9 aa, Homo Sapiens
VSPSHQRQK

SEQ ID NO: 1232489 - protein, 9 aa, Homo Sapiens
IFLEVDPMH

SEQ ID NO: 1232490 - protein, 9 aa, Homo Sapiens
RNEDLDRWR

SEQ ID NO: 1232491 - protein, 9 aa, Homo Sapiens
RPWWDIPSC

SEQ ID NO: 1232492 - protein, 9 aa, Homo Sapiens
LIVLNNLIV

SEQ ID NO: 1232493 - protein, 9 aa, Homo Sapiens
LGDCYHCVS

SEQ ID NO: 1232494 - protein, 9 aa, Homo Sapiens
KKVVVSGNY

SEQ ID NO: 1232495 - protein, 9 aa, Homo Sapiens
TRSPGLNSM

SEQ ID NO: 1232496 - protein, 9 aa, Homo Sapiens
FIWMLHCIY

SEQ ID NO: 1232497 - protein, 9 aa, Homo Sapiens
GHDSTSVDS

SEQ ID NO: 1232498 - protein, 9 aa, Homo Sapiens
KSSKPQIKC

SEQ ID NO: 1232499 - protein, 9 aa, Homo Sapiens
ITVELCDHV

SEQ ID NO: 1232500 - protein, 9 aa, Homo Sapiens
VQIPWDKNH

SEQ ID NO: 1232501 - protein, 9 aa, Homo Sapiens
EPYQASQHD

SEQ ID NO: 1232502 - protein, 9 aa, Homo Sapiens
KKGDENFTK

SEQ ID NO: 1232503 - protein, 9 aa, Homo Sapiens
VAMNAFKTD

SEQ ID NO: 1232504 - protein, 9 aa, Homo Sapiens
QPLLFIISR

SEQ ID NO: 1232505 - protein, 9 aa, Homo Sapiens
GRTTITTIV

SEQ ID NO: 1232506 - protein, 9 aa, Homo Sapiens
AVLPTLRNL

SEQ ID NO: 1232507 - protein, 9 aa, Homo Sapiens
KSICRMLSD

SEQ ID NO: 1232508 - protein, 9 aa, Homo Sapiens
PAKCGDAEY

SEQ ID NO: 1232509 - protein, 9 aa, Homo Sapiens
NLDSQTFIT

SEQ ID NO: 1232510 - protein, 9 aa, Homo Sapiens
KNVVLDCLL

SEQ ID NO: 1232511 - protein, 9 aa, Homo Sapiens
ALRDEYIKW

SEQ ID NO: 1232512 - protein, 9 aa, Homo Sapiens
NTGTEAPYY

SEQ ID NO: 1232513 - protein, 9 aa, Homo Sapiens
DANHCSLGV

SEQ ID NO: 1232514 - protein, 9 aa, Homo Sapiens
DGGFMSLSS

SEQ ID NO: 1232515 - protein, 9 aa, Homo Sapiens
VQKPQVKLC

SEQ ID NO: 1232516 - protein, 9 aa, Homo Sapiens
RKGIATLAM

SEQ ID NO: 1232517 - protein, 9 aa, Homo Sapiens
VLAYSQSAE

SEQ ID NO: 1232518 - protein, 9 aa, Homo Sapiens
SRACSVGSV

SEQ ID NO: 1232519 - protein, 9 aa, Homo Sapiens
IICLETFKD

SEQ ID NO: 1232520 - protein, 9 aa, Homo Sapiens
FRSALSVYP

SEQ ID NO: 1232521 - protein, 9 aa, Homo Sapiens
LGAALPPWP

SEQ ID NO: 1232522 - protein, 9 aa, Homo Sapiens
VPCLPVKRG

SEQ ID NO: 1232523 - protein, 9 aa, Homo Sapiens
GNGTLPACN

SEQ ID NO: 1232524 - protein, 9 aa, Homo Sapiens
SVMEGASAR

SEQ ID NO: 1232525 - protein, 9 aa, Homo Sapiens
GSGQAVLGM

SEQ ID NO: 1232526 - protein, 9 aa, Homo Sapiens
GYPPILYWF

SEQ ID NO: 1232527 - protein, 9 aa, Homo Sapiens
ANMCAALLS

SEQ ID NO: 1232528 - protein, 9 aa, Homo Sapiens
LKKGADSGI

SEQ ID NO: 1232529 - protein, 9 aa, Homo Sapiens
VILFDFAAD

SEQ ID NO: 1232530 - protein, 9 aa, Homo Sapiens
ELEMTIKEN

SEQ ID NO: 1232531 - protein, 9 aa, Homo Sapiens
QVQKKSLLL

SEQ ID NO: 1232532 - protein, 9 aa, Homo Sapiens
SSEKIATIA

SEQ ID NO: 1232533 - protein, 9 aa, Homo Sapiens
LDFYNPLVA

SEQ ID NO: 1232534 - protein, 9 aa, Homo Sapiens
SVEQYVPSE

SEQ ID NO: 1232535 - protein, 9 aa, Homo Sapiens
KYSVSQDPF

SEQ ID NO: 1232536 - protein, 9 aa, Homo Sapiens
PVGPTGGPG

SEQ ID NO: 1232537 - protein, 9 aa, Homo Sapiens
LAFAKRHRL

SEQ ID NO: 1232538 - protein, 9 aa, Homo Sapiens
RAGDPEGPP

SEQ ID NO: 1232539 - protein, 9 aa, Homo Sapiens
HRSSSPAPR

SEQ ID NO: 1232540 - protein, 9 aa, Homo Sapiens
PHPSSPRLS

SEQ ID NO: 1232541 - protein, 9 aa, Homo Sapiens
DLRQRFMAS

SEQ ID NO: 1232542 - protein, 9 aa, Homo Sapiens
GQVLRVSDP

SEQ ID NO: 1232543 - protein, 9 aa, Homo Sapiens
AHSDCCIKL

SEQ ID NO: 1232544 - protein, 9 aa, Homo Sapiens
AHDGDFEVP

SEQ ID NO: 1232545 - protein, 9 aa, Homo Sapiens
HNTLGRSAP

SEQ ID NO: 1232546 - protein, 9 aa, Homo Sapiens
KEYGVMCVR

SEQ ID NO: 1232547 - protein, 9 aa, Homo Sapiens
AVNLSTENI

SEQ ID NO: 1232548 - protein, 9 aa, Homo Sapiens
YISLLLHAE

SEQ ID NO: 1232549 - protein, 9 aa, Homo Sapiens
PDMVLTPDF

SEQ ID NO: 1232550 - protein, 9 aa, Homo Sapiens
AVNFSSISM

SEQ ID NO: 1232551 - protein, 9 aa, Homo Sapiens
EYEIAQTWH

SEQ ID NO: 1232552 - protein, 9 aa, Homo Sapiens
RSEHISLTV

SEQ ID NO: 1232553 - protein, 9 aa, Homo Sapiens
YLPFGAGPH

SEQ ID NO: 1232554 - protein, 9 aa, Homo Sapiens
GKRCPAKAW

SEQ ID NO: 1232555 - protein, 9 aa, Homo Sapiens
NAIDNPKPN

SEQ ID NO: 1232556 - protein, 9 aa, Homo Sapiens
CVSSLSIQF

SEQ ID NO: 1232557 - protein, 9 aa, Homo Sapiens
YIPSGICSL

SEQ ID NO: 1232558 - protein, 9 aa, Homo Sapiens
SMATQAMPN

SEQ ID NO: 1232559 - protein, 9 aa, Homo Sapiens
MITPSYFNR

SEQ ID NO: 1232560 - protein, 9 aa, Homo Sapiens
HLEHLCCDL

SEQ ID NO: 1232561 - protein, 9 aa, Homo Sapiens
GARAQPQTK

SEQ ID NO: 1232562 - protein, 9 aa, Homo Sapiens
SLTELIQAL

SEQ ID NO: 1232563 - protein, 9 aa, Homo Sapiens
DCWTYRYSE

SEQ ID NO: 1232564 - protein, 9 aa, Homo Sapiens
SLPSGTRGP

SEQ ID NO: 1232565 - protein, 9 aa, Homo Sapiens
IEDDQAGSG

SEQ ID NO: 1232566 - protein, 9 aa, Homo Sapiens
DEHLQHQDW

SEQ ID NO: 1232567 - protein, 9 aa, Homo Sapiens
EQIKTNLFI

SEQ ID NO: 1232568 - protein, 9 aa, Homo Sapiens
NDAEPRSLF

SEQ ID NO: 1232569 - protein, 9 aa, Homo Sapiens
FANGTAQSG

SEQ ID NO: 1232570 - protein, 9 aa, Homo Sapiens
VAQADLEIL

SEQ ID NO: 1232571 - protein, 9 aa, Homo Sapiens
TCRDECKYE

SEQ ID NO: 1232572 - protein, 9 aa, Homo Sapiens
ICAVFGGIY

SEQ ID NO: 1232573 - protein, 9 aa, Homo Sapiens
VVTPRPFVS

SEQ ID NO: 1232574 - protein, 9 aa, Homo Sapiens
IFIPIFYRL

SEQ ID NO: 1232575 - protein, 9 aa, Homo Sapiens
VVTVEAYTR

SEQ ID NO: 1232576 - protein, 9 aa, Homo Sapiens
YDQCISGHH

SEQ ID NO: 1232577 - protein, 9 aa, Homo Sapiens
GLDALKSLK

SEQ ID NO: 1232578 - protein, 9 aa, Homo Sapiens
VRTPEENTA

SEQ ID NO: 1232579 - protein, 9 aa, Homo Sapiens
IEFSNNGGK

SEQ ID NO: 1232580 - protein, 9 aa, Homo Sapiens
DYANGFGGQ

SEQ ID NO: 1232581 - protein, 9 aa, Homo Sapiens
KNALFETLI

SEQ ID NO: 1232582 - protein, 9 aa, Homo Sapiens
GPDQQMDFQ

SEQ ID NO: 1232583 - protein, 9 aa, Homo Sapiens
ANIATSQRD

SEQ ID NO: 1232584 - protein, 9 aa, Homo Sapiens
RNLLMVNSN

SEQ ID NO: 1232585 - protein, 9 aa, Homo Sapiens
AHNYENNYH

SEQ ID NO: 1232586 - protein, 9 aa, Homo Sapiens
STICGTPEF

SEQ ID NO: 1232587 - protein, 9 aa, Homo Sapiens
CLLPPVGPS

SEQ ID NO: 1232588 - protein, 9 aa, Homo Sapiens
HFILIRELD

SEQ ID NO: 1232589 - protein, 9 aa, Homo Sapiens
DVQVEEDKR

SEQ ID NO: 1232590 - protein, 9 aa, Homo Sapiens
ALSDQRGLQ

SEQ ID NO: 1232591 - protein, 9 aa, Homo Sapiens
NPLEDRCVS

SEQ ID NO: 1232592 - protein, 9 aa, Homo Sapiens
CATVAQFNT

SEQ ID NO: 1232593 - protein, 9 aa, Homo Sapiens
LAVDMTALF

SEQ ID NO: 1232594 - protein, 9 aa, Homo Sapiens
CHLNGVTVK

SEQ ID NO: 1232595 - protein, 9 aa, Homo Sapiens
EGTKMAVRL

SEQ ID NO: 1232596 - protein, 9 aa, Homo Sapiens
QVMLDTAHC

SEQ ID NO: 1232597 - protein, 9 aa, Homo Sapiens
SFSRWCSYI

SEQ ID NO: 1232598 - protein, 9 aa, Homo Sapiens
IKYLVYMLA

SEQ ID NO: 1232599 - protein, 9 aa, Homo Sapiens
EAVVHMNQE

SEQ ID NO: 1232600 - protein, 9 aa, Homo Sapiens
TNWAGHGGT

SEQ ID NO: 1232601 - protein, 9 aa, Homo Sapiens
EEHMDMVVE

SEQ ID NO: 1232602 - protein, 9 aa, Homo Sapiens
DFDNRLMNH

SEQ ID NO: 1232603 - protein, 9 aa, Homo Sapiens
FPINVVKTC

SEQ ID NO: 1232604 - protein, 9 aa, Homo Sapiens
CASRLMRRH

SEQ ID NO: 1232605 - protein, 9 aa, Homo Sapiens
HRFELVLFE

SEQ ID NO: 1232606 - protein, 9 aa, Homo Sapiens
ERDACKIII

SEQ ID NO: 1232607 - protein, 9 aa, Homo Sapiens
PSHPSSWES

SEQ ID NO: 1232608 - protein, 9 aa, Homo Sapiens
EKAANDYNQ

SEQ ID NO: 1232609 - protein, 9 aa, Homo Sapiens
AHLQSSVVI

SEQ ID NO: 1232610 - protein, 9 aa, Homo Sapiens
GTETSILSK

SEQ ID NO: 1232611 - protein, 9 aa, Homo Sapiens
IPVVKSSMP

SEQ ID NO: 1232612 - protein, 9 aa, Homo Sapiens
QASPSSHST

SEQ ID NO: 1232613 - protein, 9 aa, Homo Sapiens
WCRLQCEIR

SEQ ID NO: 1232614 - protein, 9 aa, Homo Sapiens
GVPQVNGEQ

SEQ ID NO: 1232615 - protein, 9 aa, Homo Sapiens
TLALTQDHS

SEQ ID NO: 1232616 - protein, 9 aa, Homo Sapiens
HGPAETHTL

SEQ ID NO: 1232617 - protein, 9 aa, Homo Sapiens
EADASRSLE

SEQ ID NO: 1232618 - protein, 9 aa, Homo Sapiens
EENNQFQVE

SEQ ID NO: 1232619 - protein, 9 aa, Homo Sapiens
SPSTSAYLT

SEQ ID NO: 1232620 - protein, 9 aa, Homo Sapiens
ISWDVAVVL

SEQ ID NO: 1232621 - protein, 9 aa, Homo Sapiens
RNDILPCLP

SEQ ID NO: 1232622 - protein, 9 aa, Homo Sapiens
GIPLSEYEA

SEQ ID NO: 1232623 - protein, 9 aa, Homo Sapiens
IHVQWQPVG

SEQ ID NO: 1232624 - protein, 9 aa, Homo Sapiens
SRQNNYTIN

SEQ ID NO: 1232625 - protein, 9 aa, Homo Sapiens
QSFIFLWCG

SEQ ID NO: 1232626 - protein, 9 aa, Homo Sapiens
KNKETFWCE

SEQ ID NO: 1232627 - protein, 9 aa, Homo Sapiens
LVLAAGDYS

SEQ ID NO: 1232628 - protein, 9 aa, Homo Sapiens
ALQDDLQCY

SEQ ID NO: 1232629 - protein, 9 aa, Homo Sapiens
LPSDVGLEI

SEQ ID NO: 1232630 - protein, 9 aa, Homo Sapiens
TPANSEATK

SEQ ID NO: 1232631 - protein, 9 aa, Homo Sapiens
AEGKKDKKY

SEQ ID NO: 1232632 - protein, 9 aa, Homo Sapiens
PPACPRPSP

SEQ ID NO: 1232633 - protein, 9 aa, Homo Sapiens
MMSVKFDVQ

SEQ ID NO: 1232634 - protein, 9 aa, Homo Sapiens
REYIRSLNM

SEQ ID NO: 1232635 - protein, 9 aa, Homo Sapiens
DGQEEKYTD

SEQ ID NO: 1232636 - protein, 9 aa, Homo Sapiens
TPPQVLDSQ

SEQ ID NO: 1232637 - protein, 9 aa, Homo Sapiens
PSSDVLRIQ

SEQ ID NO: 1232638 - protein, 9 aa, Homo Sapiens
ETVSDLASL

SEQ ID NO: 1232639 - protein, 9 aa, Homo Sapiens
KTCMHTVPD

SEQ ID NO: 1232640 - protein, 9 aa, Homo Sapiens
AVVMVLAFC

SEQ ID NO: 1232641 - protein, 9 aa, Homo Sapiens
ENHTDETLA

SEQ ID NO: 1232642 - protein, 9 aa, Homo Sapiens
LDLLWITSA

SEQ ID NO: 1232643 - protein, 9 aa, Homo Sapiens
MDSFTQVFA

SEQ ID NO: 1232644 - protein, 9 aa, Homo Sapiens
KLGDRVVIT

SEQ ID NO: 1232645 - protein, 9 aa, Homo Sapiens
AHNSTRVIQ

SEQ ID NO: 1232646 - protein, 9 aa, Homo Sapiens
ATKTTCMFS

SEQ ID NO: 1232647 - protein, 9 aa, Homo Sapiens
LHLLEGALI

SEQ ID NO: 1232648 - protein, 9 aa, Homo Sapiens
GVKLDAAGL

SEQ ID NO: 1232649 - protein, 9 aa, Homo Sapiens
DHGAEANIK

SEQ ID NO: 1232650 - protein, 9 aa, Homo Sapiens
KAYEQKPAV

SEQ ID NO: 1232651 - protein, 9 aa, Homo Sapiens
GTFSRIHLN

SEQ ID NO: 1232652 - protein, 9 aa, Homo Sapiens
LVLLAFIIT

SEQ ID NO: 1232653 - protein, 9 aa, Homo Sapiens
VRTSFFGKY

SEQ ID NO: 1232654 - protein, 9 aa, Homo Sapiens
LQLQETRCA

SEQ ID NO: 1232655 - protein, 9 aa, Homo Sapiens
IHRTPRSTS

SEQ ID NO: 1232656 - protein, 9 aa, Homo Sapiens
SMRSWSSWG

SEQ ID NO: 1232657 - protein, 9 aa, Homo Sapiens
PVELRGQEQ

SEQ ID NO: 1232658 - protein, 9 aa, Homo Sapiens
RVDRSREPP

SEQ ID NO: 1232659 - protein, 9 aa, Homo Sapiens
PEIQELHQW

SEQ ID NO: 1232660 - protein, 9 aa, Homo Sapiens
TPGHFFALS

SEQ ID NO: 1232661 - protein, 9 aa, Homo Sapiens
DSSFKKYQR

SEQ ID NO: 1232662 - protein, 9 aa, Homo Sapiens
LEQPLTLTK

SEQ ID NO: 1232663 - protein, 9 aa, Homo Sapiens
CRYCIKDCT

SEQ ID NO: 1232664 - protein, 9 aa, Homo Sapiens
LRASEMAQA

SEQ ID NO: 1232665 - protein, 9 aa, Homo Sapiens
FSCDSLNSV

SEQ ID NO: 1232666 - protein, 9 aa, Homo Sapiens
CRHYVVARL

SEQ ID NO: 1232667 - protein, 9 aa, Homo Sapiens
MVKCVKAVT

SEQ ID NO: 1232668 - protein, 9 aa, Homo Sapiens
PSPSPAPLR

SEQ ID NO: 1232669 - protein, 9 aa, Homo Sapiens
LEVARTTAG

SEQ ID NO: 1232670 - protein, 9 aa, Homo Sapiens
VAQLCLGEL

SEQ ID NO: 1232671 - protein, 9 aa, Homo Sapiens
MSLISDNAV

SEQ ID NO: 1232672 - protein, 9 aa, Homo Sapiens
CCESEVFHA

SEQ ID NO: 1232673 - protein, 9 aa, Homo Sapiens
ISFGVTLLF

SEQ ID NO: 1232674 - protein, 9 aa, Homo Sapiens
TADEEEPVE

SEQ ID NO: 1232675 - protein, 9 aa, Homo Sapiens
KPVLMALAD

SEQ ID NO: 1232676 - protein, 9 aa, Homo Sapiens
LTASINGSV

SEQ ID NO: 1232677 - protein, 9 aa, Homo Sapiens
EKEEDIVVL

SEQ ID NO: 1232678 - protein, 9 aa, Homo Sapiens
GCCPYCHRC

SEQ ID NO: 1232679 - protein, 9 aa, Homo Sapiens
DKVRFLVQQ

SEQ ID NO: 1232680 - protein, 9 aa, Homo Sapiens
ARSYQGVRV

SEQ ID NO: 1232681 - protein, 9 aa, Homo Sapiens
CTTVHDSLV

SEQ ID NO: 1232682 - protein, 9 aa, Homo Sapiens
VGHLLMTFD

SEQ ID NO: 1232683 - protein, 9 aa, Homo Sapiens
VIRVAAKWY

SEQ ID NO: 1232684 - protein, 9 aa, Homo Sapiens
GVLAGEPLE

SEQ ID NO: 1232685 - protein, 9 aa, Homo Sapiens
TQCYCTDTG

SEQ ID NO: 1232686 - protein, 9 aa, Homo Sapiens
PGMHPPTLN

SEQ ID NO: 1232687 - protein, 9 aa, Homo Sapiens
LYMVMEYVH

SEQ ID NO: 1232688 - protein, 9 aa, Homo Sapiens
TKCFAKRLA

SEQ ID NO: 1232689 - protein, 9 aa, Homo Sapiens
SSCFHPRRE

SEQ ID NO: 1232690 - protein, 9 aa, Homo Sapiens
LELRLPSVS

SEQ ID NO: 1232691 - protein, 9 aa, Homo Sapiens
REDEEHPRK

SEQ ID NO: 1232692 - protein, 9 aa, Homo Sapiens
VEVLTDGSL

SEQ ID NO: 1232693 - protein, 9 aa, Homo Sapiens
KVSGKWIPT

SEQ ID NO: 1232694 - protein, 9 aa, Homo Sapiens
PLHNFLEGD

SEQ ID NO: 1232695 - protein, 9 aa, Homo Sapiens
NNFFVTEGN

SEQ ID NO: 1232696 - protein, 9 aa, Homo Sapiens
PSVSYFMCM

SEQ ID NO: 1232697 - protein, 9 aa, Homo Sapiens
CTRWKQRGR

SEQ ID NO: 1232698 - protein, 9 aa, Homo Sapiens
PKPATKSIS

SEQ ID NO: 1232699 - protein, 9 aa, Homo Sapiens
PAPLWQGSR

SEQ ID NO: 1232700 - protein, 9 aa, Homo Sapiens
GIFCARSSW

SEQ ID NO: 1232701 - protein, 9 aa, Homo Sapiens
SSRIGLRVY

SEQ ID NO: 1232702 - protein, 9 aa, Homo Sapiens
DSYYCRCHR

SEQ ID NO: 1232703 - protein, 9 aa, Homo Sapiens
EHKLSHGSV

SEQ ID NO: 1232704 - protein, 9 aa, Homo Sapiens
VATERRERI

SEQ ID NO: 1232705 - protein, 9 aa, Homo Sapiens
CDRVLAVNG

SEQ ID NO: 1232706 - protein, 9 aa, Homo Sapiens
NKANVVNVR

SEQ ID NO: 1232707 - protein, 9 aa, Homo Sapiens
LFHLTQGEP

SEQ ID NO: 1232708 - protein, 9 aa, Homo Sapiens
DVDYKSGPP

SEQ ID NO: 1232709 - protein, 9 aa, Homo Sapiens
LVRYNIINA

SEQ ID NO: 1232710 - protein, 9 aa, Homo Sapiens
GNVLAARYM

SEQ ID NO: 1232711 - protein, 9 aa, Homo Sapiens
SHIHHRKFD

SEQ ID NO: 1232712 - protein, 9 aa, Homo Sapiens
MYFFLSIMS

SEQ ID NO: 1232713 - protein, 9 aa, Homo Sapiens
PVHMNSVER

SEQ ID NO: 1232714 - protein, 9 aa, Homo Sapiens
IFVIWAVTF

SEQ ID NO: 1232715 - protein, 9 aa, Homo Sapiens
KEGIASVVK

SEQ ID NO: 1232716 - protein, 9 aa, Homo Sapiens
SPGNEENSG

SEQ ID NO: 1232717 - protein, 9 aa, Homo Sapiens
VLFAMSTLG

SEQ ID NO: 1232718 - protein, 9 aa, Homo Sapiens
DTMTWETIL

SEQ ID NO: 1232719 - protein, 9 aa, Homo Sapiens
LSWRSDPIQ

SEQ ID NO: 1232720 - protein, 9 aa, Homo Sapiens
EIRVTSLRY

SEQ ID NO: 1232721 - protein, 9 aa, Homo Sapiens
RVSLEQLCL

SEQ ID NO: 1232722 - protein, 9 aa, Homo Sapiens
EKEMMQFLN

SEQ ID NO: 1232723 - protein, 9 aa, Homo Sapiens
LKSSSKRQA

SEQ ID NO: 1232724 - protein, 9 aa, Homo Sapiens
ISFMQVGCE

SEQ ID NO: 1232725 - protein, 9 aa, Homo Sapiens
ECHLSPSRE

SEQ ID NO: 1232726 - protein, 9 aa, Homo Sapiens
RPRAPAQAH

SEQ ID NO: 1232727 - protein, 9 aa, Homo Sapiens
HQCPSGSRT

SEQ ID NO: 1232728 - protein, 9 aa, Homo Sapiens
FLKKISFKR

SEQ ID NO: 1232729 - protein, 9 aa, Homo Sapiens
IVAICSAEG

SEQ ID NO: 1232730 - protein, 9 aa, Homo Sapiens
NKQTFLVEF

SEQ ID NO: 1232731 - protein, 9 aa, Homo Sapiens
IYIINVHIM

SEQ ID NO: 1232732 - protein, 9 aa, Homo Sapiens
THKHYMTRD

SEQ ID NO: 1232733 - protein, 9 aa, Homo Sapiens
TKRPAQVKL

SEQ ID NO: 1232734 - protein, 9 aa, Homo Sapiens
ESNMDQNCL

SEQ ID NO: 1232735 - protein, 9 aa, Homo Sapiens
IYNHTIHGM

SEQ ID NO: 1232736 - protein, 9 aa, Homo Sapiens
LNEQAAHST

SEQ ID NO: 1232737 - protein, 9 aa, Homo Sapiens
APCGGYLAP

SEQ ID NO: 1232738 - protein, 9 aa, Homo Sapiens
VQMDHEGEF

SEQ ID NO: 1232739 - protein, 9 aa, Homo Sapiens
SRNPWSCIF

SEQ ID NO: 1232740 - protein, 9 aa, Homo Sapiens
WEEGPGGDL

SEQ ID NO: 1232741 - protein, 9 aa, Homo Sapiens
IKHEIQRKS

SEQ ID NO: 1232742 - protein, 9 aa, Homo Sapiens
PGGDLVIQQ

SEQ ID NO: 1232743 - protein, 9 aa, Homo Sapiens
IGLAAALSF

SEQ ID NO: 1232744 - protein, 9 aa, Homo Sapiens
SFQDDVKCL

SEQ ID NO: 1232745 - protein, 9 aa, Homo Sapiens
QLVTVLCDI

SEQ ID NO: 1232746 - protein, 9 aa, Homo Sapiens
QALLLTRGG

SEQ ID NO: 1232747 - protein, 9 aa, Homo Sapiens
QRRPATYRL

SEQ ID NO: 1232748 - protein, 9 aa, Homo Sapiens
LDTTLYLKC

SEQ ID NO: 1232749 - protein, 9 aa, Homo Sapiens
GGTNKDSTS

SEQ ID NO: 1232750 - protein, 9 aa, Homo Sapiens
ELDKEGVIE

SEQ ID NO: 1232751 - protein, 9 aa, Homo Sapiens
SECSKTCCL

SEQ ID NO: 1232752 - protein, 9 aa, Homo Sapiens
IKESNILEI

SEQ ID NO: 1232753 - protein, 9 aa, Homo Sapiens
WERYTAAVS

SEQ ID NO: 1232754 - protein, 9 aa, Homo Sapiens
DVSSVKQNI

SEQ ID NO: 1232755 - protein, 9 aa, Homo Sapiens
VKAKLKRAA

SEQ ID NO: 1232756 - protein, 9 aa, Homo Sapiens
SQKRGLQDG

SEQ ID NO: 1232757 - protein, 9 aa, Homo Sapiens
TFCNQLWHK

SEQ ID NO: 1232758 - protein, 9 aa, Homo Sapiens
GAGTLHPYL

SEQ ID NO: 1232759 - protein, 9 aa, Homo Sapiens
MMMSLYNVS

SEQ ID NO: 1232760 - protein, 9 aa, Homo Sapiens
CYITSTFAR

SEQ ID NO: 1232761 - protein, 9 aa, Homo Sapiens
GEDYNHTHG

SEQ ID NO: 1232762 - protein, 9 aa, Homo Sapiens
RGTGGTFVF

SEQ ID NO: 1232763 - protein, 9 aa, Homo Sapiens
EVITPDNMC

SEQ ID NO: 1232764 - protein, 9 aa, Homo Sapiens
LIYPNPDCP

SEQ ID NO: 1232765 - protein, 9 aa, Homo Sapiens
KKTTKRKCG

SEQ ID NO: 1232766 - protein, 9 aa, Homo Sapiens
LSFLQQDRC

SEQ ID NO: 1232767 - protein, 9 aa, Homo Sapiens
ILPQQKLLI

SEQ ID NO: 1232768 - protein, 9 aa, Homo Sapiens
KSKSAGNLD

SEQ ID NO: 1232769 - protein, 9 aa, Homo Sapiens
QAALVELHI

SEQ ID NO: 1232770 - protein, 9 aa, Homo Sapiens
ISAFVGDKD

SEQ ID NO: 1232771 - protein, 9 aa, Homo Sapiens
IVLKNVPGL

SEQ ID NO: 1232772 - protein, 9 aa, Homo Sapiens
LYWCCCCSC

SEQ ID NO: 1232773 - protein, 9 aa, Homo Sapiens
SLWFIGLSE

SEQ ID NO: 1232774 - protein, 9 aa, Homo Sapiens
SSMSTIGNM

SEQ ID NO: 1232775 - protein, 9 aa, Homo Sapiens
ILRNDLSST

SEQ ID NO: 1232776 - protein, 9 aa, Homo Sapiens
YHPADGDMR

SEQ ID NO: 1232777 - protein, 9 aa, Homo Sapiens
MKALDGFVK

SEQ ID NO: 1232778 - protein, 9 aa, Homo Sapiens
PPTPPSYIG

SEQ ID NO: 1232779 - protein, 9 aa, Homo Sapiens
FGIDGTAIA

SEQ ID NO: 1232780 - protein, 9 aa, Homo Sapiens
HSSNYRAYA

SEQ ID NO: 1232781 - protein, 9 aa, Homo Sapiens
QVHSSPPPP

SEQ ID NO: 1232782 - protein, 9 aa, Homo Sapiens
EENSRLKSF

SEQ ID NO: 1232783 - protein, 9 aa, Homo Sapiens
MSKGLKPSS

SEQ ID NO: 1232784 - protein, 9 aa, Homo Sapiens
GPHHITCIY

SEQ ID NO: 1232785 - protein, 9 aa, Homo Sapiens
LHTKLSSQE

SEQ ID NO: 1232786 - protein, 9 aa, Homo Sapiens
YRTLQWNAG

SEQ ID NO: 1232787 - protein, 9 aa, Homo Sapiens
FGYQSSSHF

SEQ ID NO: 1232788 - protein, 9 aa, Homo Sapiens
TLKYLIAGI

SEQ ID NO: 1232789 - protein, 9 aa, Homo Sapiens
PDANVKTAP

SEQ ID NO: 1232790 - protein, 9 aa, Homo Sapiens
ERRALRHST

SEQ ID NO: 1232791 - protein, 9 aa, Homo Sapiens
YAGVDVQSA

SEQ ID NO: 1232792 - protein, 9 aa, Homo Sapiens
WSCPSSPST

SEQ ID NO: 1232793 - protein, 9 aa, Homo Sapiens
VMELKMHPH

SEQ ID NO: 1232794 - protein, 9 aa, Homo Sapiens
LSSSPGKAM

SEQ ID NO: 1232795 - protein, 9 aa, Homo Sapiens
ELQRCSLEG

SEQ ID NO: 1232796 - protein, 9 aa, Homo Sapiens
YLQNSSVKI

SEQ ID NO: 1232797 - protein, 9 aa, Homo Sapiens
VSNFSNQTA

SEQ ID NO: 1232798 - protein, 9 aa, Homo Sapiens
YVKLREFVL

SEQ ID NO: 1232799 - protein, 9 aa, Homo Sapiens
WTNERLKVA

SEQ ID NO: 1232800 - protein, 9 aa, Homo Sapiens
LDSQRRPLV

SEQ ID NO: 1232801 - protein, 9 aa, Homo Sapiens
GIPGGIFFR

SEQ ID NO: 1232802 - protein, 9 aa, Homo Sapiens
FTASSILHT

SEQ ID NO: 1232803 - protein, 9 aa, Homo Sapiens
KEKAPAFGC

SEQ ID NO: 1232804 - protein, 9 aa, Homo Sapiens
GITITWKFD

SEQ ID NO: 1232805 - protein, 9 aa, Homo Sapiens
AKADEGRAD

SEQ ID NO: 1232806 - protein, 9 aa, Homo Sapiens
RIKMQRAGL

SEQ ID NO: 1232807 - protein, 9 aa, Homo Sapiens
LQMNDLVYE

SEQ ID NO: 1232808 - protein, 9 aa, Homo Sapiens
PITPWAIFP

SEQ ID NO: 1232809 - protein, 9 aa, Homo Sapiens
SRILEKLAE

SEQ ID NO: 1232810 - protein, 9 aa, Homo Sapiens
YRFGHDVLR

SEQ ID NO: 1232811 - protein, 9 aa, Homo Sapiens
HALEPPSPE

SEQ ID NO: 1232812 - protein, 9 aa, Homo Sapiens
WYLGLLQVG

SEQ ID NO: 1232813 - protein, 9 aa, Homo Sapiens
CYVVFMKFS

SEQ ID NO: 1232814 - protein, 9 aa, Homo Sapiens
DQACHIRLT

SEQ ID NO: 1232815 - protein, 9 aa, Homo Sapiens
KLPPCFPVK

SEQ ID NO: 1232816 - protein, 9 aa, Homo Sapiens
DLTSQDKEG

SEQ ID NO: 1232817 - protein, 9 aa, Homo Sapiens
LQFWSKYKL

SEQ ID NO: 1232818 - protein, 9 aa, Homo Sapiens
EDGLGDAVG

SEQ ID NO: 1232819 - protein, 9 aa, Homo Sapiens
SIRLTESLA

SEQ ID NO: 1232820 - protein, 9 aa, Homo Sapiens
HNPEMCQLF

SEQ ID NO: 1232821 - protein, 9 aa, Homo Sapiens
LKSNAVLSK

SEQ ID NO: 1232822 - protein, 9 aa, Homo Sapiens
EVENLVRVG

SEQ ID NO: 1232823 - protein, 9 aa, Homo Sapiens
EKHVTIHAT

SEQ ID NO: 1232824 - protein, 9 aa, Homo Sapiens
EELKADLLK

SEQ ID NO: 1232825 - protein, 9 aa, Homo Sapiens
FEMSLTPMI

SEQ ID NO: 1232826 - protein, 9 aa, Homo Sapiens
YQAMSVAPQ

SEQ ID NO: 1232827 - protein, 9 aa, Homo Sapiens
EACVNDGMF

SEQ ID NO: 1232828 - protein, 9 aa, Homo Sapiens
FMGLFLALI

SEQ ID NO: 1232829 - protein, 9 aa, Homo Sapiens
FLAMLYVVH

SEQ ID NO: 1232830 - protein, 9 aa, Homo Sapiens
VITETQRKP

SEQ ID NO: 1232831 - protein, 9 aa, Homo Sapiens
SWNRITTAS

SEQ ID NO: 1232832 - protein, 9 aa, Homo Sapiens
EDISQMKSM

SEQ ID NO: 1232833 - protein, 9 aa, Homo Sapiens
MCTAVWSLS

SEQ ID NO: 1232834 - protein, 9 aa, Homo Sapiens
LLDIMPYRL

SEQ ID NO: 1232835 - protein, 9 aa, Homo Sapiens
GDCIGWLDD

SEQ ID NO: 1232836 - protein, 9 aa, Homo Sapiens
WNFSTLCVC

SEQ ID NO: 1232837 - protein, 9 aa, Homo Sapiens
PKTWHSAEQ

SEQ ID NO: 1232838 - protein, 9 aa, Homo Sapiens
NICHILLIQ

SEQ ID NO: 1232839 - protein, 9 aa, Homo Sapiens
VLADLALHT

SEQ ID NO: 1232840 - protein, 9 aa, Homo Sapiens
NNSYPHFLE

SEQ ID NO: 1232841 - protein, 9 aa, Homo Sapiens
HSDAANKSI

SEQ ID NO: 1232842 - protein, 9 aa, Homo Sapiens
EERKEDKEE

SEQ ID NO: 1232843 - protein, 9 aa, Homo Sapiens
LIYFVFYSF

SEQ ID NO: 1232844 - protein, 9 aa, Homo Sapiens
SKGRDHENI

SEQ ID NO: 1232845 - protein, 9 aa, Homo Sapiens
IRPSIEEVS

SEQ ID NO: 1232846 - protein, 9 aa, Homo Sapiens
EKIVTDIDE

SEQ ID NO: 1232847 - protein, 9 aa, Homo Sapiens
LITLCGILV

SEQ ID NO: 1232848 - protein, 9 aa, Homo Sapiens
KAKAHILLT

SEQ ID NO: 1232849 - protein, 9 aa, Homo Sapiens
CYHSDFNRQ

SEQ ID NO: 1232850 - protein, 9 aa, Homo Sapiens
DAHSEAAPT

SEQ ID NO: 1232851 - protein, 9 aa, Homo Sapiens
ANILNNDAF

SEQ ID NO: 1232852 - protein, 9 aa, Homo Sapiens
NQGEILVIC

SEQ ID NO: 1232853 - protein, 9 aa, Homo Sapiens
TAEQDCLAL

SEQ ID NO: 1232854 - protein, 9 aa, Homo Sapiens
ATDKNSLLD

SEQ ID NO: 1232855 - protein, 9 aa, Homo Sapiens
TDPPLVRVN

SEQ ID NO: 1232856 - protein, 9 aa, Homo Sapiens
GEPEILVWR

SEQ ID NO: 1232857 - protein, 9 aa, Homo Sapiens
NTLIGSLTA

SEQ ID NO: 1232858 - protein, 9 aa, Homo Sapiens
VEHLKFIPE

SEQ ID NO: 1232859 - protein, 9 aa, Homo Sapiens
EEEAVYEEL

SEQ ID NO: 1232860 - protein, 9 aa, Homo Sapiens
CAEDKEALL

SEQ ID NO: 1232861 - protein, 9 aa, Homo Sapiens
QERSFLDLM

SEQ ID NO: 1232862 - protein, 9 aa, Homo Sapiens
PVPGYCVPH

SEQ ID NO: 1232863 - protein, 9 aa, Homo Sapiens
SWTMDPQEM

SEQ ID NO: 1232864 - protein, 9 aa, Homo Sapiens
RMIDVFDGN

SEQ ID NO: 1232865 - protein, 9 aa, Homo Sapiens
TLLEGSDLE

SEQ ID NO: 1232866 - protein, 9 aa, Homo Sapiens
TIHRTSEPH

SEQ ID NO: 1232867 - protein, 9 aa, Homo Sapiens
PNHPAILNG

SEQ ID NO: 1232868 - protein, 9 aa, Homo Sapiens
LELFLIDND

SEQ ID NO: 1232869 - protein, 9 aa, Homo Sapiens
VRPQELVGT

SEQ ID NO: 1232870 - protein, 9 aa, Homo Sapiens
DTLGYTVHD

SEQ ID NO: 1232871 - protein, 9 aa, Homo Sapiens
RMCQVNIVG

SEQ ID NO: 1232872 - protein, 9 aa, Homo Sapiens
EAVAGSVPL

SEQ ID NO: 1232873 - protein, 9 aa, Homo Sapiens
LCRLDQQLW

SEQ ID NO: 1232874 - protein, 9 aa, Homo Sapiens
GPNQPVDSD

SEQ ID NO: 1232875 - protein, 9 aa, Homo Sapiens
GNVVSKLHG

SEQ ID NO: 1232876 - protein, 9 aa, Homo Sapiens
EAKVAWHEG

SEQ ID NO: 1232877 - protein, 9 aa, Homo Sapiens
NRITTASSP

SEQ ID NO: 1232878 - protein, 9 aa, Homo Sapiens
WTDSNSQST

SEQ ID NO: 1232879 - protein, 9 aa, Homo Sapiens
GLFDLEVNY

SEQ ID NO: 1232880 - protein, 9 aa, Homo Sapiens
PDSVTILAS

SEQ ID NO: 1232881 - protein, 9 aa, Homo Sapiens
YMTRDADEY

SEQ ID NO: 1232882 - protein, 9 aa, Homo Sapiens
ALEPLLAHA

SEQ ID NO: 1232883 - protein, 9 aa, Homo Sapiens
ALKDRHMEN

SEQ ID NO: 1232884 - protein, 9 aa, Homo Sapiens
KDVAINFTQ

SEQ ID NO: 1232885 - protein, 9 aa, Homo Sapiens
LDTMTWETI

SEQ ID NO: 1232886 - protein, 9 aa, Homo Sapiens
SVICHHGTT

SEQ ID NO: 1232887 - protein, 9 aa, Homo Sapiens
KKCSSASVD

SEQ ID NO: 1232888 - protein, 9 aa, Homo Sapiens
YPPECYGHV

SEQ ID NO: 1232889 - protein, 9 aa, Homo Sapiens
ATEEAEETF

SEQ ID NO: 1232890 - protein, 9 aa, Homo Sapiens
KRFSSHDIQ

SEQ ID NO: 1232891 - protein, 9 aa, Homo Sapiens
VMDVKDISF

SEQ ID NO: 1232892 - protein, 9 aa, Homo Sapiens
HDFFIYSQI

SEQ ID NO: 1232893 - protein, 9 aa, Homo Sapiens
RCHVDPAND

SEQ ID NO: 1232894 - protein, 9 aa, Homo Sapiens
TQNPDLEPI

SEQ ID NO: 1232895 - protein, 9 aa, Homo Sapiens
AFQEEDFPT

SEQ ID NO: 1232896 - protein, 9 aa, Homo Sapiens
LGIKYLVYM

SEQ ID NO: 1232897 - protein, 9 aa, Homo Sapiens
AAVMASDSI

SEQ ID NO: 1232898 - protein, 9 aa, Homo Sapiens
VGAGSSSSQ

SEQ ID NO: 1232899 - protein, 9 aa, Homo Sapiens
LTFLDVLAW

SEQ ID NO: 1232900 - protein, 9 aa, Homo Sapiens
MVGPGPTAT

SEQ ID NO: 1232901 - protein, 9 aa, Homo Sapiens
NHTFCWEQW

SEQ ID NO: 1232902 - protein, 9 aa, Homo Sapiens
QDLNIISQP

SEQ ID NO: 1232903 - protein, 9 aa, Homo Sapiens
THRAGGLPA

SEQ ID NO: 1232904 - protein, 9 aa, Homo Sapiens
QKKCDIGPL

SEQ ID NO: 1232905 - protein, 9 aa, Homo Sapiens
DGTFVFVDQ

SEQ ID NO: 1232906 - protein, 9 aa, Homo Sapiens
IAHYIYTPL

SEQ ID NO: 1232907 - protein, 9 aa, Homo Sapiens
TTTGSTHEP

SEQ ID NO: 1232908 - protein, 9 aa, Homo Sapiens
HDNEKVQLL

SEQ ID NO: 1232909 - protein, 9 aa, Homo Sapiens
YMSCGDCLL

SEQ ID NO: 1232910 - protein, 9 aa, Homo Sapiens
DSVIIGKDQ

SEQ ID NO: 1232911 - protein, 9 aa, Homo Sapiens
PEIRLNMLL

SEQ ID NO: 1232912 - protein, 9 aa, Homo Sapiens
LSRAAGTEE

SEQ ID NO: 1232913 - protein, 9 aa, Homo Sapiens
AGKTMISFA

SEQ ID NO: 1232914 - protein, 9 aa, Homo Sapiens
DMDECSARR

SEQ ID NO: 1232915 - protein, 9 aa, Homo Sapiens
NPGTQKSRV

SEQ ID NO: 1232916 - protein, 9 aa, Homo Sapiens
HPQPAPAGA

SEQ ID NO: 1232917 - protein, 9 aa, Homo Sapiens
NLGTGVVHA

SEQ ID NO: 1232918 - protein, 9 aa, Homo Sapiens
DSGEAMGLV

SEQ ID NO: 1232919 - protein, 9 aa, Homo Sapiens
CHIRLTYFG

SEQ ID NO: 1232920 - protein, 9 aa, Homo Sapiens
LKYFVLGLP

SEQ ID NO: 1232921 - protein, 9 aa, Homo Sapiens
HSFGRDRNR

SEQ ID NO: 1232922 - protein, 9 aa, Homo Sapiens
MKLGTVEWR

SEQ ID NO: 1232923 - protein, 9 aa, Homo Sapiens
PIKFYSVPS

SEQ ID NO: 1232924 - protein, 9 aa, Homo Sapiens
LQVRADVNG

SEQ ID NO: 1232925 - protein, 9 aa, Homo Sapiens
PFVFSMVNV

SEQ ID NO: 1232926 - protein, 9 aa, Homo Sapiens
QQWGCCGEQ

SEQ ID NO: 1232927 - protein, 9 aa, Homo Sapiens
VVEEMAGLP

SEQ ID NO: 1232928 - protein, 9 aa, Homo Sapiens
TIQLCDMRA

SEQ ID NO: 1232929 - protein, 9 aa, Homo Sapiens
QPRWVALPC

SEQ ID NO: 1232930 - protein, 9 aa, Homo Sapiens
EISGRVHNM

SEQ ID NO: 1232931 - protein, 9 aa, Homo Sapiens
PPTPNTVEQ

SEQ ID NO: 1232932 - protein, 9 aa, Homo Sapiens
ILKMKGNFT

SEQ ID NO: 1232933 - protein, 9 aa, Homo Sapiens
NSRLARAVR

SEQ ID NO: 1232934 - protein, 9 aa, Homo Sapiens
PMTFGPHGH

SEQ ID NO: 1232935 - protein, 9 aa, Homo Sapiens
AEEELKMKN

SEQ ID NO: 1232936 - protein, 9 aa, Homo Sapiens
GALIVDPLK

SEQ ID NO: 1232937 - protein, 9 aa, Homo Sapiens
PPLAPSPHS

SEQ ID NO: 1232938 - protein, 9 aa, Homo Sapiens
SYSQKVSQA

SEQ ID NO: 1232939 - protein, 9 aa, Homo Sapiens
KRWLENKPI

SEQ ID NO: 1232940 - protein, 9 aa, Homo Sapiens
IENHNDIVD

SEQ ID NO: 1232941 - protein, 9 aa, Homo Sapiens
INIFMTDAA

SEQ ID NO: 1232942 - protein, 9 aa, Homo Sapiens
GSLKTLKEI

SEQ ID NO: 1232943 - protein, 9 aa, Homo Sapiens
KAENMLETI

SEQ ID NO: 1232944 - protein, 9 aa, Homo Sapiens
RAPSGPHYP

SEQ ID NO: 1232945 - protein, 9 aa, Homo Sapiens
DDSPGDKRL

SEQ ID NO: 1232946 - protein, 9 aa, Homo Sapiens
YSEPLHVSI

SEQ ID NO: 1232947 - protein, 9 aa, Homo Sapiens
KLEVYLTLT

SEQ ID NO: 1232948 - protein, 9 aa, Homo Sapiens
LDLHSQFPR

SEQ ID NO: 1232949 - protein, 9 aa, Homo Sapiens
DIQISKDGL

SEQ ID NO: 1232950 - protein, 9 aa, Homo Sapiens
CDGMSHCPG

SEQ ID NO: 1232951 - protein, 9 aa, Homo Sapiens
KHMAMCHRR

SEQ ID NO: 1232952 - protein, 9 aa, Homo Sapiens
ANGMPYSAP

SEQ ID NO: 1232953 - protein, 9 aa, Homo Sapiens
EAKEIAKKV

SEQ ID NO: 1232954 - protein, 9 aa, Homo Sapiens
LIVVIFGIS

SEQ ID NO: 1232955 - protein, 9 aa, Homo Sapiens
LHYVDVLTL

SEQ ID NO: 1232956 - protein, 9 aa, Homo Sapiens
VLYLLQNGS

SEQ ID NO: 1232957 - protein, 9 aa, Homo Sapiens
IPAHIFIPI

SEQ ID NO: 1232958 - protein, 9 aa, Homo Sapiens
GENQTMITE

SEQ ID NO: 1232959 - protein, 9 aa, Homo Sapiens
AITFPYPYA

SEQ ID NO: 1232960 - protein, 9 aa, Homo Sapiens
DESCLKSTP

SEQ ID NO: 1232961 - protein, 9 aa, Homo Sapiens
AENTTVVWK

SEQ ID NO: 1232962 - protein, 9 aa, Homo Sapiens
NEGGPPTET

SEQ ID NO: 1232963 - protein, 9 aa, Homo Sapiens
QNAWSRSDS

SEQ ID NO: 1232964 - protein, 9 aa, Homo Sapiens
FIHISINKA

SEQ ID NO: 1232965 - protein, 9 aa, Homo Sapiens
LLDEAQKLL

SEQ ID NO: 1232966 - protein, 9 aa, Homo Sapiens
IVGFVMYYF

SEQ ID NO: 1232967 - protein, 9 aa, Homo Sapiens
QVMTTELAH

SEQ ID NO: 1232968 - protein, 9 aa, Homo Sapiens
VHFIQQLLR

SEQ ID NO: 1232969 - protein, 9 aa, Homo Sapiens
EGMLHHFQK

SEQ ID NO: 1232970 - protein, 9 aa, Homo Sapiens
EVSMQHLPA

SEQ ID NO: 1232971 - protein, 9 aa, Homo Sapiens
RETYECCLD

SEQ ID NO: 1232972 - protein, 9 aa, Homo Sapiens
IKLAMKIGG

SEQ ID NO: 1232973 - protein, 9 aa, Homo Sapiens
TGEDGEELD

SEQ ID NO: 1232974 - protein, 9 aa, Homo Sapiens
IRVLTAKVS

SEQ ID NO: 1232975 - protein, 9 aa, Homo Sapiens
FALWELTGS

SEQ ID NO: 1232976 - protein, 9 aa, Homo Sapiens
LKRRHVSFG

SEQ ID NO: 1232977 - protein, 9 aa, Homo Sapiens
EYTVCLFLV

SEQ ID NO: 1232978 - protein, 9 aa, Homo Sapiens
ITQAIAETP

SEQ ID NO: 1232979 - protein, 9 aa, Homo Sapiens
HQASEDMKL

SEQ ID NO: 1232980 - protein, 9 aa, Homo Sapiens
YERMNTIDQ

SEQ ID NO: 1232981 - protein, 9 aa, Homo Sapiens
PFLYCNTGD

SEQ ID NO: 1232982 - protein, 9 aa, Homo Sapiens
RRSKVFGRG

SEQ ID NO: 1232983 - protein, 9 aa, Homo Sapiens
FYSIFTKEK

SEQ ID NO: 1232984 - protein, 9 aa, Homo Sapiens
TNIFTKRDI

SEQ ID NO: 1232985 - protein, 9 aa, Homo Sapiens
THTVDLYQE

SEQ ID NO: 1232986 - protein, 9 aa, Homo Sapiens
VAQDMQREW

SEQ ID NO: 1232987 - protein, 9 aa, Homo Sapiens
SAVDISPGP

SEQ ID NO: 1232988 - protein, 9 aa, Homo Sapiens
QDALHKVSQ

SEQ ID NO: 1232989 - protein, 9 aa, Homo Sapiens
SKVIKTRYH

SEQ ID NO: 1232990 - protein, 9 aa, Homo Sapiens
KDFGKDMAL

SEQ ID NO: 1232991 - protein, 9 aa, Homo Sapiens
WLPVFSSLS

SEQ ID NO: 1232992 - protein, 9 aa, Homo Sapiens
LSVFDFDHF

SEQ ID NO: 1232993 - protein, 9 aa, Homo Sapiens
LRRMSQGKV

SEQ ID NO: 1232994 - protein, 9 aa, Homo Sapiens
NDCNDNQWE

SEQ ID NO: 1232995 - protein, 9 aa, Homo Sapiens
IPDSESNMD

SEQ ID NO: 1232996 - protein, 9 aa, Homo Sapiens
KPLPFDSMN

SEQ ID NO: 1232997 - protein, 9 aa, Homo Sapiens
LEETAAMCV

SEQ ID NO: 1232998 - protein, 9 aa, Homo Sapiens
PYDGCYLIT

SEQ ID NO: 1232999 - protein, 9 aa, Homo Sapiens
YTLELQKLN

SEQ ID NO: 1233000 - protein, 9 aa, Homo Sapiens
FCLLWTVLI

SEQ ID NO: 1233001 - protein, 9 aa, Homo Sapiens
VPLVYTIKW

SEQ ID NO: 1233002 - protein, 9 aa, Homo Sapiens
KIVLPHGQL

SEQ ID NO: 1233003 - protein, 9 aa, Homo Sapiens
GCTQKTAVP

SEQ ID NO: 1233004 - protein, 9 aa, Homo Sapiens
TSALFNTAS

SEQ ID NO: 1233005 - protein, 9 aa, Homo Sapiens
TIPPSQVRI

SEQ ID NO: 1233006 - protein, 9 aa, Homo Sapiens
ANVKTAPQS

SEQ ID NO: 1233007 - protein, 9 aa, Homo Sapiens
NILLSASGF

SEQ ID NO: 1233008 - protein, 9 aa, Homo Sapiens
KAEVDVIAK

SEQ ID NO: 1233009 - protein, 9 aa, Homo Sapiens
PLAMHYLDR

SEQ ID NO: 1233010 - protein, 9 aa, Homo Sapiens
GDIEVLGHA

SEQ ID NO: 1233011 - protein, 9 aa, Homo Sapiens
LLIFLEKCL

SEQ ID NO: 1233012 - protein, 9 aa, Homo Sapiens
VHFWVGFPL

SEQ ID NO: 1233013 - protein, 9 aa, Homo Sapiens
YVVHCNSRK

SEQ ID NO: 1233014 - protein, 9 aa, Homo Sapiens
REKSYDCKE

SEQ ID NO: 1233015 - protein, 9 aa, Homo Sapiens
KGIHYETSR

SEQ ID NO: 1233016 - protein, 9 aa, Homo Sapiens
QGHPALHQC

SEQ ID NO: 1233017 - protein, 9 aa, Homo Sapiens
GHDVLRVVH

SEQ ID NO: 1233018 - protein, 9 aa, Homo Sapiens
EAGGGSALP

SEQ ID NO: 1233019 - protein, 9 aa, Homo Sapiens
IKLLFPVGY

SEQ ID NO: 1233020 - protein, 9 aa, Homo Sapiens
GLTRTPTMG

SEQ ID NO: 1233021 - protein, 9 aa, Homo Sapiens
LHTYVLHIL

SEQ ID NO: 1233022 - protein, 9 aa, Homo Sapiens
CKAPQDSSL

SEQ ID NO: 1233023 - protein, 9 aa, Homo Sapiens
CNATSLQHL

SEQ ID NO: 1233024 - protein, 9 aa, Homo Sapiens
SDTIIFQLK

SEQ ID NO: 1233025 - protein, 9 aa, Homo Sapiens
MWHTYLSPF

SEQ ID NO: 1233026 - protein, 9 aa, Homo Sapiens
MSVAVLTEC

SEQ ID NO: 1233027 - protein, 9 aa, Homo Sapiens
KSVTKSTTT

SEQ ID NO: 1233028 - protein, 9 aa, Homo Sapiens
NEILRNDLS

SEQ ID NO: 1233029 - protein, 9 aa, Homo Sapiens
LISQNDIPI

SEQ ID NO: 1233030 - protein, 9 aa, Homo Sapiens
FMVTGRQED

SEQ ID NO: 1233031 - protein, 9 aa, Homo Sapiens
LEEKSEDQG

SEQ ID NO: 1233032 - protein, 9 aa, Homo Sapiens
RVPYHVVGL

SEQ ID NO: 1233033 - protein, 9 aa, Homo Sapiens
GQEPAQHCS

SEQ ID NO: 1233034 - protein, 9 aa, Homo Sapiens
MVPRMRQTR

SEQ ID NO: 1233035 - protein, 9 aa, Homo Sapiens
PQLCLQGRL

SEQ ID NO: 1233036 - protein, 9 aa, Homo Sapiens
STEAATHLS

SEQ ID NO: 1233037 - protein, 9 aa, Homo Sapiens
RRFPLEAPR

SEQ ID NO: 1233038 - protein, 9 aa, Homo Sapiens
NIQWMHVPG

SEQ ID NO: 1233039 - protein, 9 aa, Homo Sapiens
PSRNPCCLY

SEQ ID NO: 1233040 - protein, 9 aa, Homo Sapiens
KKLSPGNEE

SEQ ID NO: 1233041 - protein, 9 aa, Homo Sapiens
DKNKCLSRK

SEQ ID NO: 1233042 - protein, 9 aa, Homo Sapiens
EQNPNATFG

SEQ ID NO: 1233043 - protein, 9 aa, Homo Sapiens
DIIVKACQV

SEQ ID NO: 1233044 - protein, 9 aa, Homo Sapiens
PQRVLSTLS

SEQ ID NO: 1233045 - protein, 9 aa, Homo Sapiens
EMGQIYAGL

SEQ ID NO: 1233046 - protein, 9 aa, Homo Sapiens
FFLAPGMCV

SEQ ID NO: 1233047 - protein, 9 aa, Homo Sapiens
FMSLSSQVT

SEQ ID NO: 1233048 - protein, 9 aa, Homo Sapiens
AIYKDLTAK

SEQ ID NO: 1233049 - protein, 9 aa, Homo Sapiens
WKESPARSV

SEQ ID NO: 1233050 - protein, 9 aa, Homo Sapiens
ISILGDEGM

SEQ ID NO: 1233051 - protein, 9 aa, Homo Sapiens
TQTYLQAAI

SEQ ID NO: 1233052 - protein, 9 aa, Homo Sapiens
SEIWNASEY

SEQ ID NO: 1233053 - protein, 9 aa, Homo Sapiens
THALEEHQK

SEQ ID NO: 1233054 - protein, 9 aa, Homo Sapiens
CFAYTGRIA

SEQ ID NO: 1233055 - protein, 9 aa, Homo Sapiens
FLESQELMR

SEQ ID NO: 1233056 - protein, 9 aa, Homo Sapiens
VVENSDAVT

SEQ ID NO: 1233057 - protein, 9 aa, Homo Sapiens
VGPRHVQNG

SEQ ID NO: 1233058 - protein, 9 aa, Homo Sapiens
SGHEEVLAD

SEQ ID NO: 1233059 - protein, 9 aa, Homo Sapiens
VEEPESLRV

SEQ ID NO: 1233060 - protein, 9 aa, Homo Sapiens
SSSDGQEHF

SEQ ID NO: 1233061 - protein, 9 aa, Homo Sapiens
ALHPLRALS

SEQ ID NO: 1233062 - protein, 9 aa, Homo Sapiens
IHAVWYLTT

SEQ ID NO: 1233063 - protein, 9 aa, Homo Sapiens
RGGQAFQKP

SEQ ID NO: 1233064 - protein, 9 aa, Homo Sapiens
GVAQHYKKV

SEQ ID NO: 1233065 - protein, 9 aa, Homo Sapiens
MTQLPQEEK

SEQ ID NO: 1233066 - protein, 9 aa, Homo Sapiens
NFSPKGMTK

SEQ ID NO: 1233067 - protein, 9 aa, Homo Sapiens
GLEKVHFWV

SEQ ID NO: 1233068 - protein, 9 aa, Homo Sapiens
DHLLAINGV

SEQ ID NO: 1233069 - protein, 9 aa, Homo Sapiens
RKCKMHLYG

SEQ ID NO: 1233070 - protein, 9 aa, Homo Sapiens
DEMLIKPKE

SEQ ID NO: 1233071 - protein, 9 aa, Homo Sapiens
EQVLSLVSE

SEQ ID NO: 1233072 - protein, 9 aa, Homo Sapiens
LIYYFVFDH

SEQ ID NO: 1233073 - protein, 9 aa, Homo Sapiens
AFTVHNPEM

SEQ ID NO: 1233074 - protein, 9 aa, Homo Sapiens
GPLQRGGLS

SEQ ID NO: 1233075 - protein, 9 aa, Homo Sapiens
PEKGPPLAP

SEQ ID NO: 1233076 - protein, 9 aa, Homo Sapiens
IRQERDEVV

SEQ ID NO: 1233077 - protein, 9 aa, Homo Sapiens
YWQLEEECT

SEQ ID NO: 1233078 - protein, 9 aa, Homo Sapiens
SNQGKYPMI

SEQ ID NO: 1233079 - protein, 9 aa, Homo Sapiens
HAQAVLQQY

SEQ ID NO: 1233080 - protein, 9 aa, Homo Sapiens
KERIQNASG

SEQ ID NO: 1233081 - protein, 9 aa, Homo Sapiens
IFLYVRTGK

SEQ ID NO: 1233082 - protein, 9 aa, Homo Sapiens
SKIQLIVMQ

SEQ ID NO: 1233083 - protein, 9 aa, Homo Sapiens
KSEADKCGL

SEQ ID NO: 1233084 - protein, 9 aa, Homo Sapiens
PATATAATS

SEQ ID NO: 1233085 - protein, 9 aa, Homo Sapiens
NEDFLPGAI

SEQ ID NO: 1233086 - protein, 9 aa, Homo Sapiens
SAAFQALYS

SEQ ID NO: 1233087 - protein, 9 aa, Homo Sapiens
TSIDSVIIG

SEQ ID NO: 1233088 - protein, 9 aa, Homo Sapiens
NRTYHIDDV

SEQ ID NO: 1233089 - protein, 9 aa, Homo Sapiens
HNTFGRILQ

SEQ ID NO: 1233090 - protein, 9 aa, Homo Sapiens
RRNERERNH

SEQ ID NO: 1233091 - protein, 9 aa, Homo Sapiens
MEVHRAFLS

SEQ ID NO: 1233092 - protein, 9 aa, Homo Sapiens
SGMEHQQTG

SEQ ID NO: 1233093 - protein, 9 aa, Homo Sapiens
RYKEDGSSK

SEQ ID NO: 1233094 - protein, 9 aa, Homo Sapiens
THRHTQAYT

SEQ ID NO: 1233095 - protein, 9 aa, Homo Sapiens
MPSDLIISS

SEQ ID NO: 1233096 - protein, 9 aa, Homo Sapiens
CGKHVEDFI

SEQ ID NO: 1233097 - protein, 9 aa, Homo Sapiens
DWIPYINGK

SEQ ID NO: 1233098 - protein, 9 aa, Homo Sapiens
ESFPEGSKK

SEQ ID NO: 1233099 - protein, 9 aa, Homo Sapiens
VCEIWMNQN

SEQ ID NO: 1233100 - protein, 9 aa, Homo Sapiens
ATSPKELGR

SEQ ID NO: 1233101 - protein, 9 aa, Homo Sapiens
CIFFIVYLS

SEQ ID NO: 1233102 - protein, 9 aa, Homo Sapiens
VNDNKSIFK

SEQ ID NO: 1233103 - protein, 9 aa, Homo Sapiens
ISALKFQRT

SEQ ID NO: 1233104 - protein, 9 aa, Homo Sapiens
AFATSLWSD

SEQ ID NO: 1233105 - protein, 9 aa, Homo Sapiens
SLPEQISPG

SEQ ID NO: 1233106 - protein, 9 aa, Homo Sapiens
QQGEAMHCP

SEQ ID NO: 1233107 - protein, 9 aa, Homo Sapiens
STTPACCKF

SEQ ID NO: 1233108 - protein, 9 aa, Homo Sapiens
GITATLFVV

SEQ ID NO: 1233109 - protein, 9 aa, Homo Sapiens
KKVIRNIVC

SEQ ID NO: 1233110 - protein, 9 aa, Homo Sapiens
LCKVKLHND

SEQ ID NO: 1233111 - protein, 9 aa, Homo Sapiens
LSSLQTNWT

SEQ ID NO: 1233112 - protein, 9 aa, Homo Sapiens
FTGCGGRRL

SEQ ID NO: 1233113 - protein, 9 aa, Homo Sapiens
KVNSLLYAY

SEQ ID NO: 1233114 - protein, 9 aa, Homo Sapiens
PLPMPFNPT

SEQ ID NO: 1233115 - protein, 9 aa, Homo Sapiens
SVREVMLWE

SEQ ID NO: 1233116 - protein, 9 aa, Homo Sapiens
LLLRNLMVQ

SEQ ID NO: 1233117 - protein, 9 aa, Homo Sapiens
MHCQKIACI

SEQ ID NO: 1233118 - protein, 9 aa, Homo Sapiens
STSTWADGL

SEQ ID NO: 1233119 - protein, 9 aa, Homo Sapiens
LDLVRQYDV

SEQ ID NO: 1233120 - protein, 9 aa, Homo Sapiens
LNTIQGALE

SEQ ID NO: 1233121 - protein, 9 aa, Homo Sapiens
NLKGLIHHY

SEQ ID NO: 1233122 - protein, 9 aa, Homo Sapiens
HMLPEPGFP

SEQ ID NO: 1233123 - protein, 9 aa, Homo Sapiens
RLHLEPLVL

SEQ ID NO: 1233124 - protein, 9 aa, Homo Sapiens
TTGSGHYIA

SEQ ID NO: 1233125 - protein, 9 aa, Homo Sapiens
VIKSLTCSY

SEQ ID NO: 1233126 - protein, 9 aa, Homo Sapiens
CTRMVDIPC

SEQ ID NO: 1233127 - protein, 9 aa, Homo Sapiens
PCRHAGSSA

SEQ ID NO: 1233128 - protein, 9 aa, Homo Sapiens
GPVHMNSVE

SEQ ID NO: 1233129 - protein, 9 aa, Homo Sapiens
CGKAFQHCS

SEQ ID NO: 1233130 - protein, 9 aa, Homo Sapiens
APHVCQDIP

SEQ ID NO: 1233131 - protein, 9 aa, Homo Sapiens
TIIKWKGEK

SEQ ID NO: 1233132 - protein, 9 aa, Homo Sapiens
YFFVVVISV

SEQ ID NO: 1233133 - protein, 9 aa, Homo Sapiens
VSRKPRNLK

SEQ ID NO: 1233134 - protein, 9 aa, Homo Sapiens
QNCILFVNS

SEQ ID NO: 1233135 - protein, 9 aa, Homo Sapiens
RVHTRENPF

SEQ ID NO: 1233136 - protein, 9 aa, Homo Sapiens
FLSSYALHV

SEQ ID NO: 1233137 - protein, 9 aa, Homo Sapiens
TYLIVVIFG

SEQ ID NO: 1233138 - protein, 9 aa, Homo Sapiens
ICHCPPETY

SEQ ID NO: 1233139 - protein, 9 aa, Homo Sapiens
CDICGMVCI

SEQ ID NO: 1233140 - protein, 9 aa, Homo Sapiens
VSEGTTGNG

SEQ ID NO: 1233141 - protein, 9 aa, Homo Sapiens
TLVSMIFPL

SEQ ID NO: 1233142 - protein, 9 aa, Homo Sapiens
YYSYLLKES

SEQ ID NO: 1233143 - protein, 9 aa, Homo Sapiens
HFLGFLRWL

SEQ ID NO: 1233144 - protein, 9 aa, Homo Sapiens
EIKECFTSS

SEQ ID NO: 1233145 - protein, 9 aa, Homo Sapiens
DTTEVYAAG

SEQ ID NO: 1233146 - protein, 9 aa, Homo Sapiens
WSVWDANVP

SEQ ID NO: 1233147 - protein, 9 aa, Homo Sapiens
EEEHTGMLD

SEQ ID NO: 1233148 - protein, 9 aa, Homo Sapiens
LTSYIFGKQ

SEQ ID NO: 1233149 - protein, 9 aa, Homo Sapiens
EFVCGCHLG

SEQ ID NO: 1233150 - protein, 9 aa, Homo Sapiens
GKYQNKARR

SEQ ID NO: 1233151 - protein, 9 aa, Homo Sapiens
FYMETQSMI

SEQ ID NO: 1233152 - protein, 9 aa, Homo Sapiens
IMKTCFIPN

SEQ ID NO: 1233153 - protein, 9 aa, Homo Sapiens
NGYRTLQWN

SEQ ID NO: 1233154 - protein, 9 aa, Homo Sapiens
LKMLFLAVL

SEQ ID NO: 1233155 - protein, 9 aa, Homo Sapiens
LTLTKNSLD

SEQ ID NO: 1233156 - protein, 9 aa, Homo Sapiens
RIIPFLPSV

SEQ ID NO: 1233157 - protein, 9 aa, Homo Sapiens
CHYFDGPKL

SEQ ID NO: 1233158 - protein, 9 aa, Homo Sapiens
AQDMFYDEA

SEQ ID NO: 1233159 - protein, 9 aa, Homo Sapiens
EVLSRLGDV

SEQ ID NO: 1233160 - protein, 9 aa, Homo Sapiens
TGQLLSQGV

SEQ ID NO: 1233161 - protein, 9 aa, Homo Sapiens
SPSRPTAVG

SEQ ID NO: 1233162 - protein, 9 aa, Homo Sapiens
RYDEFMVQA

SEQ ID NO: 1233163 - protein, 9 aa, Homo Sapiens
KYCLKTTAK

SEQ ID NO: 1233164 - protein, 9 aa, Homo Sapiens
LKGTEAFTK

SEQ ID NO: 1233165 - protein, 9 aa, Homo Sapiens
PLPPALGSP

SEQ ID NO: 1233166 - protein, 9 aa, Homo Sapiens
PSSTVWLSR

SEQ ID NO: 1233167 - protein, 9 aa, Homo Sapiens
FCSWSIISL

SEQ ID NO: 1233168 - protein, 9 aa, Homo Sapiens
NLANTLQKL

SEQ ID NO: 1233169 - protein, 9 aa, Homo Sapiens
IDFEESLVM

SEQ ID NO: 1233170 - protein, 9 aa, Homo Sapiens
VMAFDVVSF

SEQ ID NO: 1233171 - protein, 9 aa, Homo Sapiens
YFSSLHIHT

SEQ ID NO: 1233172 - protein, 9 aa, Homo Sapiens
PLPPPVTSP

SEQ ID NO: 1233173 - protein, 9 aa, Homo Sapiens
WWSSHVLEW

SEQ ID NO: 1233174 - protein, 9 aa, Homo Sapiens
LHTHIRQHS

SEQ ID NO: 1233175 - protein, 9 aa, Homo Sapiens
NYCGIGINA

SEQ ID NO: 1233176 - protein, 9 aa, Homo Sapiens
GCTQDLVLP

SEQ ID NO: 1233177 - protein, 9 aa, Homo Sapiens
RQKAASFQN

SEQ ID NO: 1233178 - protein, 9 aa, Homo Sapiens
ETDSVSLMR

SEQ ID NO: 1233179 - protein, 9 aa, Homo Sapiens
SYNRANRVM

SEQ ID NO: 1233180 - protein, 9 aa, Homo Sapiens
AYLGGEKRW

SEQ ID NO: 1233181 - protein, 9 aa, Homo Sapiens
VKWHQRQNQ

SEQ ID NO: 1233182 - protein, 9 aa, Homo Sapiens
LASGIGIIS

SEQ ID NO: 1233183 - protein, 9 aa, Homo Sapiens
HRGGGRSFW

SEQ ID NO: 1233184 - protein, 9 aa, Homo Sapiens
TVYDDRGQL

SEQ ID NO: 1233185 - protein, 9 aa, Homo Sapiens
KRSHSFSKE

SEQ ID NO: 1233186 - protein, 9 aa, Homo Sapiens
VIPVAAFQG

SEQ ID NO: 1233187 - protein, 9 aa, Homo Sapiens
HKISDVKKE

SEQ ID NO: 1233188 - protein, 9 aa, Homo Sapiens
SDEQDMPQN

SEQ ID NO: 1233189 - protein, 9 aa, Homo Sapiens
PQEEATRLP

SEQ ID NO: 1233190 - protein, 9 aa, Homo Sapiens
VPYKGDVET

SEQ ID NO: 1233191 - protein, 9 aa, Homo Sapiens
SDYIINEKT

SEQ ID NO: 1233192 - protein, 9 aa, Homo Sapiens
GTSESIFDM

SEQ ID NO: 1233193 - protein, 9 aa, Homo Sapiens
VFSPQTHTV

SEQ ID NO: 1233194 - protein, 9 aa, Homo Sapiens
CKECGPKPE

SEQ ID NO: 1233195 - protein, 9 aa, Homo Sapiens
LCLMVCYRT

SEQ ID NO: 1233196 - protein, 9 aa, Homo Sapiens
EISIEYDSD

SEQ ID NO: 1233197 - protein, 9 aa, Homo Sapiens
KVIKTRYHI

SEQ ID NO: 1233198 - protein, 9 aa, Homo Sapiens
LTNHKRIYT

SEQ ID NO: 1233199 - protein, 9 aa, Homo Sapiens
ASPTVCATV

SEQ ID NO: 1233200 - protein, 9 aa, Homo Sapiens
DHIKTRKVR

SEQ ID NO: 1233201 - protein, 9 aa, Homo Sapiens
DEYGDKTTR

SEQ ID NO: 1233202 - protein, 9 aa, Homo Sapiens
HNKILTGAD

SEQ ID NO: 1233203 - protein, 9 aa, Homo Sapiens
SFNYQSFLT

SEQ ID NO: 1233204 - protein, 9 aa, Homo Sapiens
KDICENFQD

SEQ ID NO: 1233205 - protein, 9 aa, Homo Sapiens
VFNKKTNLA

SEQ ID NO: 1233206 - protein, 9 aa, Homo Sapiens
VKNATVYPG

SEQ ID NO: 1233207 - protein, 9 aa, Homo Sapiens
QELEETAAM

SEQ ID NO: 1233208 - protein, 9 aa, Homo Sapiens
CPAQEEAEL

SEQ ID NO: 1233209 - protein, 9 aa, Homo Sapiens
EVQKASATF

SEQ ID NO: 1233210 - protein, 9 aa, Homo Sapiens
CITVDSLVN

SEQ ID NO: 1233211 - protein, 9 aa, Homo Sapiens
ISQMKSMYM

SEQ ID NO: 1233212 - protein, 9 aa, Homo Sapiens
HSHFIGEGM

SEQ ID NO: 1233213 - protein, 9 aa, Homo Sapiens
KGLFQNPTV

SEQ ID NO: 1233214 - protein, 9 aa, Homo Sapiens
ELEETAAMC

SEQ ID NO: 1233215 - protein, 9 aa, Homo Sapiens
SSTREIIIR

SEQ ID NO: 1233216 - protein, 9 aa, Homo Sapiens
ELAKGIRKK

SEQ ID NO: 1233217 - protein, 9 aa, Homo Sapiens
RLYYDILED

SEQ ID NO: 1233218 - protein, 9 aa, Homo Sapiens
VMAPMLNPM

SEQ ID NO: 1233219 - protein, 9 aa, Homo Sapiens
ARVKQGKYQ

SEQ ID NO: 1233220 - protein, 9 aa, Homo Sapiens
ILVSLTSRM

SEQ ID NO: 1233221 - protein, 9 aa, Homo Sapiens
KCNGKGTEP

SEQ ID NO: 1233222 - protein, 9 aa, Homo Sapiens
LYQEGTKMA

SEQ ID NO: 1233223 - protein, 9 aa, Homo Sapiens
RSKTCGDHP

SEQ ID NO: 1233224 - protein, 9 aa, Homo Sapiens
ISDPSCWVR

SEQ ID NO: 1233225 - protein, 9 aa, Homo Sapiens
SSMTERIRE

SEQ ID NO: 1233226 - protein, 9 aa, Homo Sapiens
NVEVVQHRF

SEQ ID NO: 1233227 - protein, 9 aa, Homo Sapiens
DRLFIVMEY

SEQ ID NO: 1233228 - protein, 9 aa, Homo Sapiens
RKNNNGLSF

SEQ ID NO: 1233229 - protein, 9 aa, Homo Sapiens
VQEMELVMQ

SEQ ID NO: 1233230 - protein, 9 aa, Homo Sapiens
SRGRGGPGN

SEQ ID NO: 1233231 - protein, 9 aa, Homo Sapiens
HMSSPGEEV

SEQ ID NO: 1233232 - protein, 9 aa, Homo Sapiens
PDSILVPAV

SEQ ID NO: 1233233 - protein, 9 aa, Homo Sapiens
EDMLDGHSR

SEQ ID NO: 1233234 - protein, 9 aa, Homo Sapiens
SWAQAIYPH

SEQ ID NO: 1233235 - protein, 9 aa, Homo Sapiens
VRSFMDLKI

SEQ ID NO: 1233236 - protein, 9 aa, Homo Sapiens
ALSTRIVGC

SEQ ID NO: 1233237 - protein, 9 aa, Homo Sapiens
DDTIGQVGR

SEQ ID NO: 1233238 - protein, 9 aa, Homo Sapiens
HTIHGMSQA

SEQ ID NO: 1233239 - protein, 9 aa, Homo Sapiens
NMDNAAEAA

SEQ ID NO: 1233240 - protein, 9 aa, Homo Sapiens
DSARVHYYQ

SEQ ID NO: 1233241 - protein, 9 aa, Homo Sapiens
RPTGIGVYS

SEQ ID NO: 1233242 - protein, 9 aa, Homo Sapiens
RLCTVGLSI

SEQ ID NO: 1233243 - protein, 9 aa, Homo Sapiens
QCIMQTYLH

SEQ ID NO: 1233244 - protein, 9 aa, Homo Sapiens
KDTQGFMGL

SEQ ID NO: 1233245 - protein, 9 aa, Homo Sapiens
MTMRQQPMH

SEQ ID NO: 1233246 - protein, 9 aa, Homo Sapiens
IIFSYIFCL

SEQ ID NO: 1233247 - protein, 9 aa, Homo Sapiens
AASITIDQL

SEQ ID NO: 1233248 - protein, 9 aa, Homo Sapiens
PFEEGLRHL

SEQ ID NO: 1233249 - protein, 9 aa, Homo Sapiens
LLFLFSSFS

SEQ ID NO: 1233250 - protein, 9 aa, Homo Sapiens
MPRKVCIDV

SEQ ID NO: 1233251 - protein, 9 aa, Homo Sapiens
QSRMDQWMD

SEQ ID NO: 1233252 - protein, 9 aa, Homo Sapiens
GLLLLLLLF

SEQ ID NO: 1233253 - protein, 9 aa, Homo Sapiens
PDESTYVDI

SEQ ID NO: 1233254 - protein, 9 aa, Homo Sapiens
SIFVVCANK

SEQ ID NO: 1233255 - protein, 9 aa, Homo Sapiens
EEFLTDTEK

SEQ ID NO: 1233256 - protein, 9 aa, Homo Sapiens
AEDDEQCLS

SEQ ID NO: 1233257 - protein, 9 aa, Homo Sapiens
ATEDDMLAK

SEQ ID NO: 1233258 - protein, 9 aa, Homo Sapiens
YEEELEAQI

SEQ ID NO: 1233259 - protein, 9 aa, Homo Sapiens
RNSFVLNIQ

SEQ ID NO: 1233260 - protein, 9 aa, Homo Sapiens
MWDNPGSLH

SEQ ID NO: 1233261 - protein, 9 aa, Homo Sapiens
LPRTPRSLI

SEQ ID NO: 1233262 - protein, 9 aa, Homo Sapiens
TKLKVLMMM

SEQ ID NO: 1233263 - protein, 9 aa, Homo Sapiens
TGVIIQGAK

SEQ ID NO: 1233264 - protein, 9 aa, Homo Sapiens
MSCGDCLLA

SEQ ID NO: 1233265 - protein, 9 aa, Homo Sapiens
DMEGANSIF

SEQ ID NO: 1233266 - protein, 9 aa, Homo Sapiens
DTIPYLKTF

SEQ ID NO: 1233267 - protein, 9 aa, Homo Sapiens
HHWRNSALL

SEQ ID NO: 1233268 - protein, 9 aa, Homo Sapiens
RYVNMTLPV

SEQ ID NO: 1233269 - protein, 9 aa, Homo Sapiens
SKYRQVAFH

SEQ ID NO: 1233270 - protein, 9 aa, Homo Sapiens
HSRRLHLEP

SEQ ID NO: 1233271 - protein, 9 aa, Homo Sapiens
CYRPLEPTL

SEQ ID NO: 1233272 - protein, 9 aa, Homo Sapiens
IQTETHQGF

SEQ ID NO: 1233273 - protein, 9 aa, Homo Sapiens
RIKLIYNLY

SEQ ID NO: 1233274 - protein, 9 aa, Homo Sapiens
RKKEGENIR

SEQ ID NO: 1233275 - protein, 9 aa, Homo Sapiens
LLSILGLPH

SEQ ID NO: 1233276 - protein, 9 aa, Homo Sapiens
VDPTEFRVM

SEQ ID NO: 1233277 - protein, 9 aa, Homo Sapiens
WEDSGLYQD

SEQ ID NO: 1233278 - protein, 9 aa, Homo Sapiens
SPQLGTITP

SEQ ID NO: 1233279 - protein, 9 aa, Homo Sapiens
RPVCLPAHS

SEQ ID NO: 1233280 - protein, 9 aa, Homo Sapiens
RPSFEDLLH

SEQ ID NO: 1233281 - protein, 9 aa, Homo Sapiens
LATRMEVPL

SEQ ID NO: 1233282 - protein, 9 aa, Homo Sapiens
VSVSARVQM

SEQ ID NO: 1233283 - protein, 9 aa, Homo Sapiens
PLDTQQNPA

SEQ ID NO: 1233284 - protein, 9 aa, Homo Sapiens
GIATTPNAT

SEQ ID NO: 1233285 - protein, 9 aa, Homo Sapiens
EISRSLRFI

SEQ ID NO: 1233286 - protein, 9 aa, Homo Sapiens
TSVDATSSL

SEQ ID NO: 1233287 - protein, 9 aa, Homo Sapiens
VEWLVPDIQ

SEQ ID NO: 1233288 - protein, 9 aa, Homo Sapiens
RTMGIRQPP

SEQ ID NO: 1233289 - protein, 9 aa, Homo Sapiens
STSFCLAPK

SEQ ID NO: 1233290 - protein, 9 aa, Homo Sapiens
MWLPWAMLL

SEQ ID NO: 1233291 - protein, 9 aa, Homo Sapiens
QLLDDHNDV

SEQ ID NO: 1233292 - protein, 9 aa, Homo Sapiens
GSDIMRSED

SEQ ID NO: 1233293 - protein, 9 aa, Homo Sapiens
VAVQVPQCK

SEQ ID NO: 1233294 - protein, 9 aa, Homo Sapiens
SHMIVIFIS

SEQ ID NO: 1233295 - protein, 9 aa, Homo Sapiens
LAELKDEKW

SEQ ID NO: 1233296 - protein, 9 aa, Homo Sapiens
KALYTYKSK

SEQ ID NO: 1233297 - protein, 9 aa, Homo Sapiens
TGVVHAALG

SEQ ID NO: 1233298 - protein, 9 aa, Homo Sapiens
ELCIEALEW

SEQ ID NO: 1233299 - protein, 9 aa, Homo Sapiens
CRIPITPEN

SEQ ID NO: 1233300 - protein, 9 aa, Homo Sapiens
FEETALDAF

SEQ ID NO: 1233301 - protein, 9 aa, Homo Sapiens
AAVSYRLLP

SEQ ID NO: 1233302 - protein, 9 aa, Homo Sapiens
HDSMCPGYR

SEQ ID NO: 1233303 - protein, 9 aa, Homo Sapiens
DLLAWFEIS

SEQ ID NO: 1233304 - protein, 9 aa, Homo Sapiens
SLRHPRCGV

SEQ ID NO: 1233305 - protein, 9 aa, Homo Sapiens
DILIQQGYA

SEQ ID NO: 1233306 - protein, 9 aa, Homo Sapiens
LCTKLSLIM

SEQ ID NO: 1233307 - protein, 9 aa, Homo Sapiens
NDYNQKLKE

SEQ ID NO: 1233308 - protein, 9 aa, Homo Sapiens
PAPAWCPCS

SEQ ID NO: 1233309 - protein, 9 aa, Homo Sapiens
ALVPRCLVP

SEQ ID NO: 1233310 - protein, 9 aa, Homo Sapiens
YRDVKPENV

SEQ ID NO: 1233311 - protein, 9 aa, Homo Sapiens
PALHQCLSL

SEQ ID NO: 1233312 - protein, 9 aa, Homo Sapiens
LAELIYIIR

SEQ ID NO: 1233313 - protein, 9 aa, Homo Sapiens
GRYMHSWLE

SEQ ID NO: 1233314 - protein, 9 aa, Homo Sapiens
NLQEEIDTL

SEQ ID NO: 1233315 - protein, 9 aa, Homo Sapiens
WHIYVSLES

SEQ ID NO: 1233316 - protein, 9 aa, Homo Sapiens
RDRRNQDQR

SEQ ID NO: 1233317 - protein, 9 aa, Homo Sapiens
TEDSARTLL

SEQ ID NO: 1233318 - protein, 9 aa, Homo Sapiens
IYRSTCLVN

SEQ ID NO: 1233319 - protein, 9 aa, Homo Sapiens
TYHNPLCSS

SEQ ID NO: 1233320 - protein, 9 aa, Homo Sapiens
RGPEAPDGR

SEQ ID NO: 1233321 - protein, 9 aa, Homo Sapiens
YNPLYCESV

SEQ ID NO: 1233322 - protein, 9 aa, Homo Sapiens
EVVGLKSTQ

SEQ ID NO: 1233323 - protein, 9 aa, Homo Sapiens
QLHQRRTQS

SEQ ID NO: 1233324 - protein, 9 aa, Homo Sapiens
PSTGKATTI

SEQ ID NO: 1233325 - protein, 9 aa, Homo Sapiens
QKSLFYLLL

SEQ ID NO: 1233326 - protein, 9 aa, Homo Sapiens
EKSTYSVFN

SEQ ID NO: 1233327 - protein, 9 aa, Homo Sapiens
SRRFHLNLK

SEQ ID NO: 1233328 - protein, 9 aa, Homo Sapiens
KIFKHTAPS

SEQ ID NO: 1233329 - protein, 9 aa, Homo Sapiens
ERVMGNLVN

SEQ ID NO: 1233330 - protein, 9 aa, Homo Sapiens
APAWCPCSS

SEQ ID NO: 1233331 - protein, 9 aa, Homo Sapiens
KDPSATPPI

SEQ ID NO: 1233332 - protein, 9 aa, Homo Sapiens
SDSSTYNNR

SEQ ID NO: 1233333 - protein, 9 aa, Homo Sapiens
ESKLYQAYT

SEQ ID NO: 1233334 - protein, 9 aa, Homo Sapiens
ESMYKRIGV

SEQ ID NO: 1233335 - protein, 9 aa, Homo Sapiens
MVALKKYVW

SEQ ID NO: 1233336 - protein, 9 aa, Homo Sapiens
LAPYRECVE

SEQ ID NO: 1233337 - protein, 9 aa, Homo Sapiens
ISLRGQGNF

SEQ ID NO: 1233338 - protein, 9 aa, Homo Sapiens
GFMSLSSQV

SEQ ID NO: 1233339 - protein, 9 aa, Homo Sapiens
LYMWSFCFS

SEQ ID NO: 1233340 - protein, 9 aa, Homo Sapiens
SSTSPVIKV

SEQ ID NO: 1233341 - protein, 9 aa, Homo Sapiens
CTLPERSDS

SEQ ID NO: 1233342 - protein, 9 aa, Homo Sapiens
FTFKNFFLF

SEQ ID NO: 1233343 - protein, 9 aa, Homo Sapiens
VAEKNKDPS

SEQ ID NO: 1233344 - protein, 9 aa, Homo Sapiens
WNEYKSDSG

SEQ ID NO: 1233345 - protein, 9 aa, Homo Sapiens
KKVSEVGRE

SEQ ID NO: 1233346 - protein, 9 aa, Homo Sapiens
AIHRAYLDG

SEQ ID NO: 1233347 - protein, 9 aa, Homo Sapiens
EENTFVKNV

SEQ ID NO: 1233348 - protein, 9 aa, Homo Sapiens
FTSASGTSS

SEQ ID NO: 1233349 - protein, 9 aa, Homo Sapiens
DSPRRLHLQ

SEQ ID NO: 1233350 - protein, 9 aa, Homo Sapiens
LVLDIIKLT

SEQ ID NO: 1233351 - protein, 9 aa, Homo Sapiens
ISDCKNSHI

SEQ ID NO: 1233352 - protein, 9 aa, Homo Sapiens
QSSTTDAQP

SEQ ID NO: 1233353 - protein, 9 aa, Homo Sapiens
RGLTNLGNT

SEQ ID NO: 1233354 - protein, 9 aa, Homo Sapiens
MALLDQNPD

SEQ ID NO: 1233355 - protein, 9 aa, Homo Sapiens
HTVMAPMLN

SEQ ID NO: 1233356 - protein, 9 aa, Homo Sapiens
FLDTAKQTE

SEQ ID NO: 1233357 - protein, 9 aa, Homo Sapiens
RFYWNDGLD

SEQ ID NO: 1233358 - protein, 9 aa, Homo Sapiens
DNMLQSTLK

SEQ ID NO: 1233359 - protein, 9 aa, Homo Sapiens
QSGEKYLTC

SEQ ID NO: 1233360 - protein, 9 aa, Homo Sapiens
LDQMPSRQP

SEQ ID NO: 1233361 - protein, 9 aa, Homo Sapiens
RASRLPMSV

SEQ ID NO: 1233362 - protein, 9 aa, Homo Sapiens
HTCPEWVRN

SEQ ID NO: 1233363 - protein, 9 aa, Homo Sapiens
DTSRCSEQP

SEQ ID NO: 1233364 - protein, 9 aa, Homo Sapiens
PIHPVANPH

SEQ ID NO: 1233365 - protein, 9 aa, Homo Sapiens
ALETASRAE

SEQ ID NO: 1233366 - protein, 9 aa, Homo Sapiens
GLPLIMRGL

SEQ ID NO: 1233367 - protein, 9 aa, Homo Sapiens
LQNKNKKKL

SEQ ID NO: 1233368 - protein, 9 aa, Homo Sapiens
KIQSAHIKM

SEQ ID NO: 1233369 - protein, 9 aa, Homo Sapiens
CGRLSVTPL

SEQ ID NO: 1233370 - protein, 9 aa, Homo Sapiens
YGVASQHSL

SEQ ID NO: 1233371 - protein, 9 aa, Homo Sapiens
DDKFDDEEP

SEQ ID NO: 1233372 - protein, 9 aa, Homo Sapiens
LWELTGSLL

SEQ ID NO: 1233373 - protein, 9 aa, Homo Sapiens
DELCFLRAD

SEQ ID NO: 1233374 - protein, 9 aa, Homo Sapiens
KLDHILPSN

SEQ ID NO: 1233375 - protein, 9 aa, Homo Sapiens
THDRVRLLL

SEQ ID NO: 1233376 - protein, 9 aa, Homo Sapiens
MEDAVCRLL

SEQ ID NO: 1233377 - protein, 9 aa, Homo Sapiens
YNISFTSFP

SEQ ID NO: 1233378 - protein, 9 aa, Homo Sapiens
HSLPGVVGG

SEQ ID NO: 1233379 - protein, 9 aa, Homo Sapiens
GMQELKAGS

SEQ ID NO: 1233380 - protein, 9 aa, Homo Sapiens
SAITVFIAL

SEQ ID NO: 1233381 - protein, 9 aa, Homo Sapiens
ETMGWVTRL

SEQ ID NO: 1233382 - protein, 9 aa, Homo Sapiens
IERESGGHR

SEQ ID NO: 1233383 - protein, 9 aa, Homo Sapiens
THRFLFNKT

SEQ ID NO: 1233384 - protein, 9 aa, Homo Sapiens
WAKRRDVLY

SEQ ID NO: 1233385 - protein, 9 aa, Homo Sapiens
FILSFFAIC

SEQ ID NO: 1233386 - protein, 9 aa, Homo Sapiens
QQELDEKPA

SEQ ID NO: 1233387 - protein, 9 aa, Homo Sapiens
REELPYNFP

SEQ ID NO: 1233388 - protein, 9 aa, Homo Sapiens
HPWLHACMI

SEQ ID NO: 1233389 - protein, 9 aa, Homo Sapiens
ILVEHLKFI

SEQ ID NO: 1233390 - protein, 9 aa, Homo Sapiens
VTEVHVPTR

SEQ ID NO: 1233391 - protein, 9 aa, Homo Sapiens
PEGICTNRT

SEQ ID NO: 1233392 - protein, 9 aa, Homo Sapiens
LPSGMEHIM

SEQ ID NO: 1233393 - protein, 9 aa, Homo Sapiens
EESGQEETR

SEQ ID NO: 1233394 - protein, 9 aa, Homo Sapiens
FCAPPEKSY

SEQ ID NO: 1233395 - protein, 9 aa, Homo Sapiens
EEVQLHVTA

SEQ ID NO: 1233396 - protein, 9 aa, Homo Sapiens
QCSRSCEGG

SEQ ID NO: 1233397 - protein, 9 aa, Homo Sapiens
AASIQEAAS

SEQ ID NO: 1233398 - protein, 9 aa, Homo Sapiens
KCYASGGSH

SEQ ID NO: 1233399 - protein, 9 aa, Homo Sapiens
WNRVYIARS

SEQ ID NO: 1233400 - protein, 9 aa, Homo Sapiens
GTRTLQRKW

SEQ ID NO: 1233401 - protein, 9 aa, Homo Sapiens
CFMFSIWCF

SEQ ID NO: 1233402 - protein, 9 aa, Homo Sapiens
VRGRSEGFP

SEQ ID NO: 1233403 - protein, 9 aa, Homo Sapiens
DMVLTPDFL

SEQ ID NO: 1233404 - protein, 9 aa, Homo Sapiens
YKDDLCALV

SEQ ID NO: 1233405 - protein, 9 aa, Homo Sapiens
VPSAPTGPR

SEQ ID NO: 1233406 - protein, 9 aa, Homo Sapiens
RITCSFPRR

SEQ ID NO: 1233407 - protein, 9 aa, Homo Sapiens
SNMLCWNQT

SEQ ID NO: 1233408 - protein, 9 aa, Homo Sapiens
KKCPLDVTD

SEQ ID NO: 1233409 - protein, 9 aa, Homo Sapiens
HRDIIHCGK

SEQ ID NO: 1233410 - protein, 9 aa, Homo Sapiens
TEDYLHLET

SEQ ID NO: 1233411 - protein, 9 aa, Homo Sapiens
KLQPRQVLC

SEQ ID NO: 1233412 - protein, 9 aa, Homo Sapiens
DQKASGVKC

SEQ ID NO: 1233413 - protein, 9 aa, Homo Sapiens
SAAFSLMPN

SEQ ID NO: 1233414 - protein, 9 aa, Homo Sapiens
IQVHLTASR

SEQ ID NO: 1233415 - protein, 9 aa, Homo Sapiens
YTYLCPRSM

SEQ ID NO: 1233416 - protein, 9 aa, Homo Sapiens
ALGDLTGDN

SEQ ID NO: 1233417 - protein, 9 aa, Homo Sapiens
PAKMYPANF

SEQ ID NO: 1233418 - protein, 9 aa, Homo Sapiens
ENLLKMRSF

SEQ ID NO: 1233419 - protein, 9 aa, Homo Sapiens
RPYAPINVN

SEQ ID NO: 1233420 - protein, 9 aa, Homo Sapiens
FQNYTPKVI

SEQ ID NO: 1233421 - protein, 9 aa, Homo Sapiens
FDRLRTTLP

SEQ ID NO: 1233422 - protein, 9 aa, Homo Sapiens
DERMLVDAP

SEQ ID NO: 1233423 - protein, 9 aa, Homo Sapiens
EGANLLCGG

SEQ ID NO: 1233424 - protein, 9 aa, Homo Sapiens
TQNIMDQMP

SEQ ID NO: 1233425 - protein, 9 aa, Homo Sapiens
ERGFTAMNR

SEQ ID NO: 1233426 - protein, 9 aa, Homo Sapiens
ALPSLPARS

SEQ ID NO: 1233427 - protein, 9 aa, Homo Sapiens
RQELRQWVR

SEQ ID NO: 1233428 - protein, 9 aa, Homo Sapiens
HMPPKSVDQ

SEQ ID NO: 1233429 - protein, 9 aa, Homo Sapiens
LLGDQRRPP

SEQ ID NO: 1233430 - protein, 9 aa, Homo Sapiens
GKDGYWTDR

SEQ ID NO: 1233431 - protein, 9 aa, Homo Sapiens
FVIAKDSQK

SEQ ID NO: 1233432 - protein, 9 aa, Homo Sapiens
IVHHAMADD

SEQ ID NO: 1233433 - protein, 9 aa, Homo Sapiens
EAYNHAKYS

SEQ ID NO: 1233434 - protein, 9 aa, Homo Sapiens
CEEDIIPDS

SEQ ID NO: 1233435 - protein, 9 aa, Homo Sapiens
TLARTVTVT

SEQ ID NO: 1233436 - protein, 9 aa, Homo Sapiens
FKQQVWLRQ

SEQ ID NO: 1233437 - protein, 9 aa, Homo Sapiens
LGTITPSAS

SEQ ID NO: 1233438 - protein, 9 aa, Homo Sapiens
CFKSDHGHR

SEQ ID NO: 1233439 - protein, 9 aa, Homo Sapiens
ALNNGSHMT

SEQ ID NO: 1233440 - protein, 9 aa, Homo Sapiens
KCNTVRGIF

SEQ ID NO: 1233441 - protein, 9 aa, Homo Sapiens
LTMTTLSNI

SEQ ID NO: 1233442 - protein, 9 aa, Homo Sapiens
KGYLGYQAL

SEQ ID NO: 1233443 - protein, 9 aa, Homo Sapiens
APAVRSSGF

SEQ ID NO: 1233444 - protein, 9 aa, Homo Sapiens
SSASSQKGL

SEQ ID NO: 1233445 - protein, 9 aa, Homo Sapiens
NTKPQVKPG

SEQ ID NO: 1233446 - protein, 9 aa, Homo Sapiens
WTAATGSLN

SEQ ID NO: 1233447 - protein, 9 aa, Homo Sapiens
NSEGPRKYV

SEQ ID NO: 1233448 - protein, 9 aa, Homo Sapiens
RESVRTPPN

SEQ ID NO: 1233449 - protein, 9 aa, Homo Sapiens
GTVQHLNSK

SEQ ID NO: 1233450 - protein, 9 aa, Homo Sapiens
GTVMHRMIG

SEQ ID NO: 1233451 - protein, 9 aa, Homo Sapiens
MYEICQGMH

SEQ ID NO: 1233452 - protein, 9 aa, Homo Sapiens
CTRRNLGSI

SEQ ID NO: 1233453 - protein, 9 aa, Homo Sapiens
RPQLSLTLP

SEQ ID NO: 1233454 - protein, 9 aa, Homo Sapiens
RRTPQPLTS

SEQ ID NO: 1233455 - protein, 9 aa, Homo Sapiens
LSPESTEEY

SEQ ID NO: 1233456 - protein, 9 aa, Homo Sapiens
SRQCSTEAA

SEQ ID NO: 1233457 - protein, 9 aa, Homo Sapiens
QVLKFCKLN

SEQ ID NO: 1233458 - protein, 9 aa, Homo Sapiens
HGDPMPEPR

SEQ ID NO: 1233459 - protein, 9 aa, Homo Sapiens
GAALDFCIA

SEQ ID NO: 1233460 - protein, 9 aa, Homo Sapiens
VISEQLQNN

SEQ ID NO: 1233461 - protein, 9 aa, Homo Sapiens
EEMQPMMQA

SEQ ID NO: 1233462 - protein, 9 aa, Homo Sapiens
EQEMVCMVR

SEQ ID NO: 1233463 - protein, 9 aa, Homo Sapiens
ERIWMQSPV

SEQ ID NO: 1233464 - protein, 9 aa, Homo Sapiens
QELQVTAGH

SEQ ID NO: 1233465 - protein, 9 aa, Homo Sapiens
RPRSANKAP

SEQ ID NO: 1233466 - protein, 9 aa, Homo Sapiens
TNPPDHGDK

SEQ ID NO: 1233467 - protein, 9 aa, Homo Sapiens
MIFPEGICT

SEQ ID NO: 1233468 - protein, 9 aa, Homo Sapiens
SESKQKEYE

SEQ ID NO: 1233469 - protein, 9 aa, Homo Sapiens
MHDERSKPV

SEQ ID NO: 1233470 - protein, 9 aa, Homo Sapiens
VRDCDGVLQ

SEQ ID NO: 1233471 - protein, 9 aa, Homo Sapiens
AKYKNTTKE

SEQ ID NO: 1233472 - protein, 9 aa, Homo Sapiens
HRVRGRRPA

SEQ ID NO: 1233473 - protein, 9 aa, Homo Sapiens
IHDNIYMPR

SEQ ID NO: 1233474 - protein, 9 aa, Homo Sapiens
PKAISVDPI

SEQ ID NO: 1233475 - protein, 9 aa, Homo Sapiens
EGIHQFYIN

SEQ ID NO: 1233476 - protein, 9 aa, Homo Sapiens
SSRHEGVQT

SEQ ID NO: 1233477 - protein, 9 aa, Homo Sapiens
FLMDAQPWS

SEQ ID NO: 1233478 - protein, 9 aa, Homo Sapiens
TSAGEPGTE

SEQ ID NO: 1233479 - protein, 9 aa, Homo Sapiens
FSIRTEICN

SEQ ID NO: 1233480 - protein, 9 aa, Homo Sapiens
RTVGIVGIE

SEQ ID NO: 1233481 - protein, 9 aa, Homo Sapiens
KDAGDDEAM

SEQ ID NO: 1233482 - protein, 9 aa, Homo Sapiens
SMPSSSCVS

SEQ ID NO: 1233483 - protein, 9 aa, Homo Sapiens
VPEVVKDAY

SEQ ID NO: 1233484 - protein, 9 aa, Homo Sapiens
KKSQILTSY

SEQ ID NO: 1233485 - protein, 9 aa, Homo Sapiens
RHKHAPTKS

SEQ ID NO: 1233486 - protein, 9 aa, Homo Sapiens
FNFSKIIVV

SEQ ID NO: 1233487 - protein, 9 aa, Homo Sapiens
YKCKVSLVV

SEQ ID NO: 1233488 - protein, 9 aa, Homo Sapiens
WWDIPSCRQ

SEQ ID NO: 1233489 - protein, 9 aa, Homo Sapiens
IMYQSELLS

SEQ ID NO: 1233490 - protein, 9 aa, Homo Sapiens
FFLHKEFLL

SEQ ID NO: 1233491 - protein, 9 aa, Homo Sapiens
DSGSQPHLD

SEQ ID NO: 1233492 - protein, 9 aa, Homo Sapiens
CDLKVEMMA

SEQ ID NO: 1233493 - protein, 9 aa, Homo Sapiens
GMFLCDECC

SEQ ID NO: 1233494 - protein, 9 aa, Homo Sapiens
ILIGNVYTA

SEQ ID NO: 1233495 - protein, 9 aa, Homo Sapiens
IGMIFGGDY

SEQ ID NO: 1233496 - protein, 9 aa, Homo Sapiens
PSYTDRILY

SEQ ID NO: 1233497 - protein, 9 aa, Homo Sapiens
QGQSLAVNF

SEQ ID NO: 1233498 - protein, 9 aa, Homo Sapiens
FKSKITQAI

SEQ ID NO: 1233499 - protein, 9 aa, Homo Sapiens
HESILPTTA

SEQ ID NO: 1233500 - protein, 9 aa, Homo Sapiens
VPIDSSDFV

SEQ ID NO: 1233501 - protein, 9 aa, Homo Sapiens
EPLHAEIMR

SEQ ID NO: 1233502 - protein, 9 aa, Homo Sapiens
APAANLEAR

SEQ ID NO: 1233503 - protein, 9 aa, Homo Sapiens
VSIIMNTAL

SEQ ID NO: 1233504 - protein, 9 aa, Homo Sapiens
ITLAEGLIE

SEQ ID NO: 1233505 - protein, 9 aa, Homo Sapiens
GSPLTSGIS

SEQ ID NO: 1233506 - protein, 9 aa, Homo Sapiens
LLILHTEDD

SEQ ID NO: 1233507 - protein, 9 aa, Homo Sapiens
LNRLVPTGT

SEQ ID NO: 1233508 - protein, 9 aa, Homo Sapiens
SVWEADASR

SEQ ID NO: 1233509 - protein, 9 aa, Homo Sapiens
REEVMLSTY

SEQ ID NO: 1233510 - protein, 9 aa, Homo Sapiens
VLVIITVFT

SEQ ID NO: 1233511 - protein, 9 aa, Homo Sapiens
PAQGHRLGN

SEQ ID NO: 1233512 - protein, 9 aa, Homo Sapiens
VEHNTFGRI

SEQ ID NO: 1233513 - protein, 9 aa, Homo Sapiens
PPARGTSPI

SEQ ID NO: 1233514 - protein, 9 aa, Homo Sapiens
HRLELQADI

SEQ ID NO: 1233515 - protein, 9 aa, Homo Sapiens
RYVQRGATW

SEQ ID NO: 1233516 - protein, 9 aa, Homo Sapiens
CGDQTRSGQ

SEQ ID NO: 1233517 - protein, 9 aa, Homo Sapiens
APRTKQYSN

SEQ ID NO: 1233518 - protein, 9 aa, Homo Sapiens
GMSQACRWQ

SEQ ID NO: 1233519 - protein, 9 aa, Homo Sapiens
SCATDSLGI

SEQ ID NO: 1233520 - protein, 9 aa, Homo Sapiens
VVGTLFKDM

SEQ ID NO: 1233521 - protein, 9 aa, Homo Sapiens
SAGRRYLHV

SEQ ID NO: 1233522 - protein, 9 aa, Homo Sapiens
PEAGVARGV

SEQ ID NO: 1233523 - protein, 9 aa, Homo Sapiens
KGISFLECG

SEQ ID NO: 1233524 - protein, 9 aa, Homo Sapiens
YMLQNLFWQ

SEQ ID NO: 1233525 - protein, 9 aa, Homo Sapiens
NALSLKITF

SEQ ID NO: 1233526 - protein, 9 aa, Homo Sapiens
TSCMGFFMP

SEQ ID NO: 1233527 - protein, 9 aa, Homo Sapiens
INDNDITAV

SEQ ID NO: 1233528 - protein, 9 aa, Homo Sapiens
VLATSSNSA

SEQ ID NO: 1233529 - protein, 9 aa, Homo Sapiens
LIVGDTVHF

SEQ ID NO: 1233530 - protein, 9 aa, Homo Sapiens
PTPSPPQPT

SEQ ID NO: 1233531 - protein, 9 aa, Homo Sapiens
VTRMAVVMV

SEQ ID NO: 1233532 - protein, 9 aa, Homo Sapiens
TIAVMGWLA

SEQ ID NO: 1233533 - protein, 9 aa, Homo Sapiens
RHSHGPLQT

SEQ ID NO: 1233534 - protein, 9 aa, Homo Sapiens
GSLLLEWCG

SEQ ID NO: 1233535 - protein, 9 aa, Homo Sapiens
EDKEDDLFV

SEQ ID NO: 1233536 - protein, 9 aa, Homo Sapiens
CSLYYTDTK

SEQ ID NO: 1233537 - protein, 9 aa, Homo Sapiens
ITPSTYVCC

SEQ ID NO: 1233538 - protein, 9 aa, Homo Sapiens
FTTLGFEAP

SEQ ID NO: 1233539 - protein, 9 aa, Homo Sapiens
RKDDLVDTN

SEQ ID NO: 1233540 - protein, 9 aa, Homo Sapiens
TEGNMGVTL

SEQ ID NO: 1233541 - protein, 9 aa, Homo Sapiens
ANQAKQGYL

SEQ ID NO: 1233542 - protein, 9 aa, Homo Sapiens
SKGLILPAV

SEQ ID NO: 1233543 - protein, 9 aa, Homo Sapiens
AYLSMGGLG

SEQ ID NO: 1233544 - protein, 9 aa, Homo Sapiens
RTKAAGGPC

SEQ ID NO: 1233545 - protein, 9 aa, Homo Sapiens
EKGQVKNEV

SEQ ID NO: 1233546 - protein, 9 aa, Homo Sapiens
QEIAKYHKL

SEQ ID NO: 1233547 - protein, 9 aa, Homo Sapiens
DIEKSRHAS

SEQ ID NO: 1233548 - protein, 9 aa, Homo Sapiens
TWKESPARS

SEQ ID NO: 1233549 - protein, 9 aa, Homo Sapiens
GMMREIRKV

SEQ ID NO: 1233550 - protein, 9 aa, Homo Sapiens
HSYDSKKQQ

SEQ ID NO: 1233551 - protein, 9 aa, Homo Sapiens
RSQEESPHG

SEQ ID NO: 1233552 - protein, 9 aa, Homo Sapiens
RGDDDEDTE

SEQ ID NO: 1233553 - protein, 9 aa, Homo Sapiens
IEVAVLLNH

SEQ ID NO: 1233554 - protein, 9 aa, Homo Sapiens
GEHSGQPRE

SEQ ID NO: 1233555 - protein, 9 aa, Homo Sapiens
DDGWNSKVA

SEQ ID NO: 1233556 - protein, 9 aa, Homo Sapiens
HLQEEKEKV

SEQ ID NO: 1233557 - protein, 9 aa, Homo Sapiens
TVVLTFITT

SEQ ID NO: 1233558 - protein, 9 aa, Homo Sapiens
TQSSVILGG

SEQ ID NO: 1233559 - protein, 9 aa, Homo Sapiens
ASYGTGGHM

SEQ ID NO: 1233560 - protein, 9 aa, Homo Sapiens
NRGTDGYPG

SEQ ID NO: 1233561 - protein, 9 aa, Homo Sapiens
NEDCAKQIQ

SEQ ID NO: 1233562 - protein, 9 aa, Homo Sapiens
LRDDPSGVI

SEQ ID NO: 1233563 - protein, 9 aa, Homo Sapiens
SNKTVEKET

SEQ ID NO: 1233564 - protein, 9 aa, Homo Sapiens
PLLPLPQLL

SEQ ID NO: 1233565 - protein, 9 aa, Homo Sapiens
HGVMGVYGG

SEQ ID NO: 1233566 - protein, 9 aa, Homo Sapiens
LTVHHKIHT

SEQ ID NO: 1233567 - protein, 9 aa, Homo Sapiens
GSEQPEQTV

SEQ ID NO: 1233568 - protein, 9 aa, Homo Sapiens
LEVYNWVKA

SEQ ID NO: 1233569 - protein, 9 aa, Homo Sapiens
RKVLIYQKK

SEQ ID NO: 1233570 - protein, 9 aa, Homo Sapiens
KNIFMFITR

SEQ ID NO: 1233571 - protein, 9 aa, Homo Sapiens
GETVHVCNE

SEQ ID NO: 1233572 - protein, 9 aa, Homo Sapiens
HPLSYKWAK

SEQ ID NO: 1233573 - protein, 9 aa, Homo Sapiens
IQRKLKYEW

SEQ ID NO: 1233574 - protein, 9 aa, Homo Sapiens
THFLDRDEE

SEQ ID NO: 1233575 - protein, 9 aa, Homo Sapiens
HSSGLALCG

SEQ ID NO: 1233576 - protein, 9 aa, Homo Sapiens
ELDLEDKLE

SEQ ID NO: 1233577 - protein, 9 aa, Homo Sapiens
DFFIYSQIN

SEQ ID NO: 1233578 - protein, 9 aa, Homo Sapiens
LFHKKLSLR

SEQ ID NO: 1233579 - protein, 9 aa, Homo Sapiens
YVPPMATAT

SEQ ID NO: 1233580 - protein, 9 aa, Homo Sapiens
QENSMIGQK

SEQ ID NO: 1233581 - protein, 9 aa, Homo Sapiens
ECCLPFFQD

SEQ ID NO: 1233582 - protein, 9 aa, Homo Sapiens
RGPGICGSF

SEQ ID NO: 1233583 - protein, 9 aa, Homo Sapiens
ENLELIELF

SEQ ID NO: 1233584 - protein, 9 aa, Homo Sapiens
LEIIMLNTA

SEQ ID NO: 1233585 - protein, 9 aa, Homo Sapiens
LMPGDVERR

SEQ ID NO: 1233586 - protein, 9 aa, Homo Sapiens
RSLMLGPSL

SEQ ID NO: 1233587 - protein, 9 aa, Homo Sapiens
EKPYRCEEY

SEQ ID NO: 1233588 - protein, 9 aa, Homo Sapiens
YSRNPWSCI

SEQ ID NO: 1233589 - protein, 9 aa, Homo Sapiens
PEQKMSDDG

SEQ ID NO: 1233590 - protein, 9 aa, Homo Sapiens
LQEFNGNLS

SEQ ID NO: 1233591 - protein, 9 aa, Homo Sapiens
SMHSRSLML

SEQ ID NO: 1233592 - protein, 9 aa, Homo Sapiens
ALEKLDITG

SEQ ID NO: 1233593 - protein, 9 aa, Homo Sapiens
WPDELGCQG

SEQ ID NO: 1233594 - protein, 9 aa, Homo Sapiens
IFSYTGDSQ

SEQ ID NO: 1233595 - protein, 9 aa, Homo Sapiens
IHQPGYCTF

SEQ ID NO: 1233596 - protein, 9 aa, Homo Sapiens
CSFPLPGVQ

SEQ ID NO: 1233597 - protein, 9 aa, Homo Sapiens
SLPWRPNTY

SEQ ID NO: 1233598 - protein, 9 aa, Homo Sapiens
ISLIKEEQP

SEQ ID NO: 1233599 - protein, 9 aa, Homo Sapiens
SSVSEDEFV

SEQ ID NO: 1233600 - protein, 9 aa, Homo Sapiens
ETPGRGPPL

SEQ ID NO: 1233601 - protein, 9 aa, Homo Sapiens
QVILMYIFQ

SEQ ID NO: 1233602 - protein, 9 aa, Homo Sapiens
PPTPSPDSV

SEQ ID NO: 1233603 - protein, 9 aa, Homo Sapiens
FHLEEWRTL

SEQ ID NO: 1233604 - protein, 9 aa, Homo Sapiens
HAYISKIWN

SEQ ID NO: 1233605 - protein, 9 aa, Homo Sapiens
LRGEKRKQD

SEQ ID NO: 1233606 - protein, 9 aa, Homo Sapiens
PGERGPYGS

SEQ ID NO: 1233607 - protein, 9 aa, Homo Sapiens
MYTRRYSII

SEQ ID NO: 1233608 - protein, 9 aa, Homo Sapiens
LDGLKRTTY

SEQ ID NO: 1233609 - protein, 9 aa, Homo Sapiens
ELMRLFGIP

SEQ ID NO: 1233610 - protein, 9 aa, Homo Sapiens
SEEEQVMLD

SEQ ID NO: 1233611 - protein, 9 aa, Homo Sapiens
SMQTLTKGE

SEQ ID NO: 1233612 - protein, 9 aa, Homo Sapiens
RKCGYIKNK

SEQ ID NO: 1233613 - protein, 9 aa, Homo Sapiens
RTINQQAMD

SEQ ID NO: 1233614 - protein, 9 aa, Homo Sapiens
VTADHCISR

SEQ ID NO: 1233615 - protein, 9 aa, Homo Sapiens
NSSRSYCIF

SEQ ID NO: 1233616 - protein, 9 aa, Homo Sapiens
SAPDPPMPR

SEQ ID NO: 1233617 - protein, 9 aa, Homo Sapiens
NGLNALHVD

SEQ ID NO: 1233618 - protein, 9 aa, Homo Sapiens
TNGHSSHRL

SEQ ID NO: 1233619 - protein, 9 aa, Homo Sapiens
GEPKGLHQL

SEQ ID NO: 1233620 - protein, 9 aa, Homo Sapiens
EDFDNRLMN

SEQ ID NO: 1233621 - protein, 9 aa, Homo Sapiens
LRIIQLLCF

SEQ ID NO: 1233622 - protein, 9 aa, Homo Sapiens
SPYTSVYEY

SEQ ID NO: 1233623 - protein, 9 aa, Homo Sapiens
RSMDTLRIQ

SEQ ID NO: 1233624 - protein, 9 aa, Homo Sapiens
NSAPWKPIW

SEQ ID NO: 1233625 - protein, 9 aa, Homo Sapiens
SHTNISHVM

SEQ ID NO: 1233626 - protein, 9 aa, Homo Sapiens
PPHGPPPPP

SEQ ID NO: 1233627 - protein, 9 aa, Homo Sapiens
FLPTDTKKS

SEQ ID NO: 1233628 - protein, 9 aa, Homo Sapiens
EMPVLPFML

SEQ ID NO: 1233629 - protein, 9 aa, Homo Sapiens
YFVSNDSPD

SEQ ID NO: 1233630 - protein, 9 aa, Homo Sapiens
LFLPTDTKK

SEQ ID NO: 1233631 - protein, 9 aa, Homo Sapiens
LGSVHTEFM

SEQ ID NO: 1233632 - protein, 9 aa, Homo Sapiens
MATEAGPSR

SEQ ID NO: 1233633 - protein, 9 aa, Homo Sapiens
HTVVVMGGK

SEQ ID NO: 1233634 - protein, 9 aa, Homo Sapiens
FIVCTHNVV

SEQ ID NO: 1233635 - protein, 9 aa, Homo Sapiens
ELCLEIPGS

SEQ ID NO: 1233636 - protein, 9 aa, Homo Sapiens
LAQPESICS

SEQ ID NO: 1233637 - protein, 9 aa, Homo Sapiens
CVNKKKDKK

SEQ ID NO: 1233638 - protein, 9 aa, Homo Sapiens
SGEKPFKYE

SEQ ID NO: 1233639 - protein, 9 aa, Homo Sapiens
TLDYECYDV

SEQ ID NO: 1233640 - protein, 9 aa, Homo Sapiens
LGGGWICWR

SEQ ID NO: 1233641 - protein, 9 aa, Homo Sapiens
TSGYGAPST

SEQ ID NO: 1233642 - protein, 9 aa, Homo Sapiens
TLKSVMEGA

SEQ ID NO: 1233643 - protein, 9 aa, Homo Sapiens
LGLNCESVS

SEQ ID NO: 1233644 - protein, 9 aa, Homo Sapiens
RLCGPTLHL

SEQ ID NO: 1233645 - protein, 9 aa, Homo Sapiens
FLHTSTPLV

SEQ ID NO: 1233646 - protein, 9 aa, Homo Sapiens
VVDFVPSEE

SEQ ID NO: 1233647 - protein, 9 aa, Homo Sapiens
RSTWTMLLS

SEQ ID NO: 1233648 - protein, 9 aa, Homo Sapiens
EKLRDRDYD

SEQ ID NO: 1233649 - protein, 9 aa, Homo Sapiens
ISPGGAGSG

SEQ ID NO: 1233650 - protein, 9 aa, Homo Sapiens
VDLMNCTWA

SEQ ID NO: 1233651 - protein, 9 aa, Homo Sapiens
STLYCVPMS

SEQ ID NO: 1233652 - protein, 9 aa, Homo Sapiens
ETGMCSFVT

SEQ ID NO: 1233653 - protein, 9 aa, Homo Sapiens
ESNKNEKAA

SEQ ID NO: 1233654 - protein, 9 aa, Homo Sapiens
SIFMTLLYF

SEQ ID NO: 1233655 - protein, 9 aa, Homo Sapiens
ILGLVCFRP

SEQ ID NO: 1233656 - protein, 9 aa, Homo Sapiens
CCLPGQVHP

SEQ ID NO: 1233657 - protein, 9 aa, Homo Sapiens
MQVGCELKK

SEQ ID NO: 1233658 - protein, 9 aa, Homo Sapiens
ISALNAIHA

SEQ ID NO: 1233659 - protein, 9 aa, Homo Sapiens
GPPLAHGDR

SEQ ID NO: 1233660 - protein, 9 aa, Homo Sapiens
IKGHRGFSD

SEQ ID NO: 1233661 - protein, 9 aa, Homo Sapiens
PLGNVQFLM

SEQ ID NO: 1233662 - protein, 9 aa, Homo Sapiens
PEVKEFFTL

SEQ ID NO: 1233663 - protein, 9 aa, Homo Sapiens
VNDLHQEEC

SEQ ID NO: 1233664 - protein, 9 aa, Homo Sapiens
INFMLRNER

SEQ ID NO: 1233665 - protein, 9 aa, Homo Sapiens
QRELLSILG

SEQ ID NO: 1233666 - protein, 9 aa, Homo Sapiens
VANYELICV

SEQ ID NO: 1233667 - protein, 9 aa, Homo Sapiens
TRGFPRHCY

SEQ ID NO: 1233668 - protein, 9 aa, Homo Sapiens
RGFKFDMDE

SEQ ID NO: 1233669 - protein, 9 aa, Homo Sapiens
VFIFWGPIS

SEQ ID NO: 1233670 - protein, 9 aa, Homo Sapiens
MLIYFFVER

SEQ ID NO: 1233671 - protein, 9 aa, Homo Sapiens
AQLRFLSSH

SEQ ID NO: 1233672 - protein, 9 aa, Homo Sapiens
IFEWFLNKL

SEQ ID NO: 1233673 - protein, 9 aa, Homo Sapiens
EDSVIMFDQ

SEQ ID NO: 1233674 - protein, 9 aa, Homo Sapiens
PGSQVIIIV

SEQ ID NO: 1233675 - protein, 9 aa, Homo Sapiens
CQQWGCCGE

SEQ ID NO: 1233676 - protein, 9 aa, Homo Sapiens
SSSDLHLIL

SEQ ID NO: 1233677 - protein, 9 aa, Homo Sapiens
AESDTDGCR

SEQ ID NO: 1233678 - protein, 9 aa, Homo Sapiens
QFPGCRMCP

SEQ ID NO: 1233679 - protein, 9 aa, Homo Sapiens
QSTSSPYAS

SEQ ID NO: 1233680 - protein, 9 aa, Homo Sapiens
PLTPVTQCP

SEQ ID NO: 1233681 - protein, 9 aa, Homo Sapiens
LAISAIAIF

SEQ ID NO: 1233682 - protein, 9 aa, Homo Sapiens
YPLNAKVHY

SEQ ID NO: 1233683 - protein, 9 aa, Homo Sapiens
HFIAICNPL

SEQ ID NO: 1233684 - protein, 9 aa, Homo Sapiens
VGAGHKSHE

SEQ ID NO: 1233685 - protein, 9 aa, Homo Sapiens
LHEKETIYL

SEQ ID NO: 1233686 - protein, 9 aa, Homo Sapiens
QGLDALKSL

SEQ ID NO: 1233687 - protein, 9 aa, Homo Sapiens
SRMDQWMDK

SEQ ID NO: 1233688 - protein, 9 aa, Homo Sapiens
ILEPLKNAV

SEQ ID NO: 1233689 - protein, 9 aa, Homo Sapiens
VVSPIINVI

SEQ ID NO: 1233690 - protein, 9 aa, Homo Sapiens
TLPLPEEFQ

SEQ ID NO: 1233691 - protein, 9 aa, Homo Sapiens
HKKLTACMQ

SEQ ID NO: 1233692 - protein, 9 aa, Homo Sapiens
RKVTKDLEM

SEQ ID NO: 1233693 - protein, 9 aa, Homo Sapiens
LLTRGGPSL

SEQ ID NO: 1233694 - protein, 9 aa, Homo Sapiens
HMVRCITSL

SEQ ID NO: 1233695 - protein, 9 aa, Homo Sapiens
APPVHPVAE

SEQ ID NO: 1233696 - protein, 9 aa, Homo Sapiens
RCHSKGTMI

SEQ ID NO: 1233697 - protein, 9 aa, Homo Sapiens
RALEPLLAH

SEQ ID NO: 1233698 - protein, 9 aa, Homo Sapiens
LGVVTKPSQ

SEQ ID NO: 1233699 - protein, 9 aa, Homo Sapiens
NDSSILDFN

SEQ ID NO: 1233700 - protein, 9 aa, Homo Sapiens
PGKGIGLSI

SEQ ID NO: 1233701 - protein, 9 aa, Homo Sapiens
LAKADEGRA

SEQ ID NO: 1233702 - protein, 9 aa, Homo Sapiens
EQYNEETFG

SEQ ID NO: 1233703 - protein, 9 aa, Homo Sapiens
LWIIDCLGR

SEQ ID NO: 1233704 - protein, 9 aa, Homo Sapiens
ALVRYGADV

SEQ ID NO: 1233705 - protein, 9 aa, Homo Sapiens
LGSYTSFHN

SEQ ID NO: 1233706 - protein, 9 aa, Homo Sapiens
QLRFLSSHL

SEQ ID NO: 1233707 - protein, 9 aa, Homo Sapiens
CLSRKNEDL

SEQ ID NO: 1233708 - protein, 9 aa, Homo Sapiens
SVAVRNAST

SEQ ID NO: 1233709 - protein, 9 aa, Homo Sapiens
SDNTLHLAS

SEQ ID NO: 1233710 - protein, 9 aa, Homo Sapiens
VHLCCELSP

SEQ ID NO: 1233711 - protein, 9 aa, Homo Sapiens
RTLQWNAGS

SEQ ID NO: 1233712 - protein, 9 aa, Homo Sapiens
LGCRHYVVA

SEQ ID NO: 1233713 - protein, 9 aa, Homo Sapiens
GLAGRGRPG

SEQ ID NO: 1233714 - protein, 9 aa, Homo Sapiens
PPGLHGPSG

SEQ ID NO: 1233715 - protein, 9 aa, Homo Sapiens
LHIQEEIAK

SEQ ID NO: 1233716 - protein, 9 aa, Homo Sapiens
LIALGSYTS

SEQ ID NO: 1233717 - protein, 9 aa, Homo Sapiens
RVVNRVSAI

SEQ ID NO: 1233718 - protein, 9 aa, Homo Sapiens
FNGCHSGEI

SEQ ID NO: 1233719 - protein, 9 aa, Homo Sapiens
APNYKTLFI

SEQ ID NO: 1233720 - protein, 9 aa, Homo Sapiens
EEAEETFEF

SEQ ID NO: 1233721 - protein, 9 aa, Homo Sapiens
DRPPQNFSA

SEQ ID NO: 1233722 - protein, 9 aa, Homo Sapiens
ALTRLAYAL

SEQ ID NO: 1233723 - protein, 9 aa, Homo Sapiens
VIFTVLSYM

SEQ ID NO: 1233724 - protein, 9 aa, Homo Sapiens
AVVGAGYPV

SEQ ID NO: 1233725 - protein, 9 aa, Homo Sapiens
PTQYHISLQ

SEQ ID NO: 1233726 - protein, 9 aa, Homo Sapiens
KGKDGYWTD

SEQ ID NO: 1233727 - protein, 9 aa, Homo Sapiens
TDVKVTADT

SEQ ID NO: 1233728 - protein, 9 aa, Homo Sapiens
DTHPAIHDI

SEQ ID NO: 1233729 - protein, 9 aa, Homo Sapiens
LHFQSSAVM

SEQ ID NO: 1233730 - protein, 9 aa, Homo Sapiens
WHVIQAVNT

SEQ ID NO: 1233731 - protein, 9 aa, Homo Sapiens
IVMPLLTFE

SEQ ID NO: 1233732 - protein, 9 aa, Homo Sapiens
SQSTGATNI

SEQ ID NO: 1233733 - protein, 9 aa, Homo Sapiens
ENDNNPEVT

SEQ ID NO: 1233734 - protein, 9 aa, Homo Sapiens
QKLILEQLE

SEQ ID NO: 1233735 - protein, 9 aa, Homo Sapiens
KEELNTIQG

SEQ ID NO: 1233736 - protein, 9 aa, Homo Sapiens
YTSQHPDYG

SEQ ID NO: 1233737 - protein, 9 aa, Homo Sapiens
DNLEAPLML

SEQ ID NO: 1233738 - protein, 9 aa, Homo Sapiens
CCRSPPSSS

SEQ ID NO: 1233739 - protein, 9 aa, Homo Sapiens
LGKLFKLNH

SEQ ID NO: 1233740 - protein, 9 aa, Homo Sapiens
IRFMEPLPM

SEQ ID NO: 1233741 - protein, 9 aa, Homo Sapiens
ARAHAGLPC

SEQ ID NO: 1233742 - protein, 9 aa, Homo Sapiens
HKTVYRDLK

SEQ ID NO: 1233743 - protein, 9 aa, Homo Sapiens
QSQISRILL

SEQ ID NO: 1233744 - protein, 9 aa, Homo Sapiens
IPALVPTPH

SEQ ID NO: 1233745 - protein, 9 aa, Homo Sapiens
ILWYNDGHV

SEQ ID NO: 1233746 - protein, 9 aa, Homo Sapiens
RLALRCGTV

SEQ ID NO: 1233747 - protein, 9 aa, Homo Sapiens
LCYTQADGG

SEQ ID NO: 1233748 - protein, 9 aa, Homo Sapiens
SVVIHTMAQ

SEQ ID NO: 1233749 - protein, 9 aa, Homo Sapiens
ANSPSDTPE

SEQ ID NO: 1233750 - protein, 9 aa, Homo Sapiens
KAAKVHLEL

SEQ ID NO: 1233751 - protein, 9 aa, Homo Sapiens
YDLDSPMQE

SEQ ID NO: 1233752 - protein, 9 aa, Homo Sapiens
PGPDGATGD

SEQ ID NO: 1233753 - protein, 9 aa, Homo Sapiens
PGYAPAMAD

SEQ ID NO: 1233754 - protein, 9 aa, Homo Sapiens
HLLPQRPAF

SEQ ID NO: 1233755 - protein, 9 aa, Homo Sapiens
LDKHFKMLT

SEQ ID NO: 1233756 - protein, 9 aa, Homo Sapiens
HRMRSKGVR

SEQ ID NO: 1233757 - protein, 9 aa, Homo Sapiens
RVVVDRVPQ

SEQ ID NO: 1233758 - protein, 9 aa, Homo Sapiens
YIQRFQYAN

SEQ ID NO: 1233759 - protein, 9 aa, Homo Sapiens
RTPDALPEE

SEQ ID NO: 1233760 - protein, 9 aa, Homo Sapiens
KEHLAVDSW

SEQ ID NO: 1233761 - protein, 9 aa, Homo Sapiens
AFFLEGVRA

SEQ ID NO: 1233762 - protein, 9 aa, Homo Sapiens
VAGITGMHH

SEQ ID NO: 1233763 - protein, 9 aa, Homo Sapiens
YTHRHTQAY

SEQ ID NO: 1233764 - protein, 9 aa, Homo Sapiens
LAPLQVTTT

SEQ ID NO: 1233765 - protein, 9 aa, Homo Sapiens
REPDKPAPM

SEQ ID NO: 1233766 - protein, 9 aa, Homo Sapiens
RKRIIFHKI

SEQ ID NO: 1233767 - protein, 9 aa, Homo Sapiens
INNTLSNQS

SEQ ID NO: 1233768 - protein, 9 aa, Homo Sapiens
PFTDVCAAV

SEQ ID NO: 1233769 - protein, 9 aa, Homo Sapiens
FLSSLVFKR

SEQ ID NO: 1233770 - protein, 9 aa, Homo Sapiens
WGVPVGIMA

SEQ ID NO: 1233771 - protein, 9 aa, Homo Sapiens
VAGPREALQ

SEQ ID NO: 1233772 - protein, 9 aa, Homo Sapiens
WADSQEKGQ

SEQ ID NO: 1233773 - protein, 9 aa, Homo Sapiens
GDCYHCVSG

SEQ ID NO: 1233774 - protein, 9 aa, Homo Sapiens
HFQEGWRAQ

SEQ ID NO: 1233775 - protein, 9 aa, Homo Sapiens
EKELELSNL

SEQ ID NO: 1233776 - protein, 9 aa, Homo Sapiens
TLPVAQEIF

SEQ ID NO: 1233777 - protein, 9 aa, Homo Sapiens
AILLEAGVF

SEQ ID NO: 1233778 - protein, 9 aa, Homo Sapiens
TRFFKLQFL

SEQ ID NO: 1233779 - protein, 9 aa, Homo Sapiens
GHQSSSVLR

SEQ ID NO: 1233780 - protein, 9 aa, Homo Sapiens
PVVTALKKC

SEQ ID NO: 1233781 - protein, 9 aa, Homo Sapiens
LQGAVWTNE

SEQ ID NO: 1233782 - protein, 9 aa, Homo Sapiens
NGYLLEKKI

SEQ ID NO: 1233783 - protein, 9 aa, Homo Sapiens
GPIQHHPSE

SEQ ID NO: 1233784 - protein, 9 aa, Homo Sapiens
QDKEGIASV

SEQ ID NO: 1233785 - protein, 9 aa, Homo Sapiens
NTINQLEQL

SEQ ID NO: 1233786 - protein, 9 aa, Homo Sapiens
SLRLTGGEA

SEQ ID NO: 1233787 - protein, 9 aa, Homo Sapiens
SMDAQPAET

SEQ ID NO: 1233788 - protein, 9 aa, Homo Sapiens
LTVLLASSM

SEQ ID NO: 1233789 - protein, 9 aa, Homo Sapiens
RTPPSEEHV

SEQ ID NO: 1233790 - protein, 9 aa, Homo Sapiens
AVITETQRK

SEQ ID NO: 1233791 - protein, 9 aa, Homo Sapiens
DWLPQQIRK

SEQ ID NO: 1233792 - protein, 9 aa, Homo Sapiens
SSSNQYTFC

SEQ ID NO: 1233793 - protein, 9 aa, Homo Sapiens
FVLRFRAFQ

SEQ ID NO: 1233794 - protein, 9 aa, Homo Sapiens
FLYQTIFLR

SEQ ID NO: 1233795 - protein, 9 aa, Homo Sapiens
IFSVSRTVM

SEQ ID NO: 1233796 - protein, 9 aa, Homo Sapiens
SYALINFSY

SEQ ID NO: 1233797 - protein, 9 aa, Homo Sapiens
DNIFDFMIC

SEQ ID NO: 1233798 - protein, 9 aa, Homo Sapiens
SKQDPVKTE

SEQ ID NO: 1233799 - protein, 9 aa, Homo Sapiens
VAAGAHEQR

SEQ ID NO: 1233800 - protein, 9 aa, Homo Sapiens
GSTLNYSQV

SEQ ID NO: 1233801 - protein, 9 aa, Homo Sapiens
LQDNVPLLH

SEQ ID NO: 1233802 - protein, 9 aa, Homo Sapiens
LIDQDDRDL

SEQ ID NO: 1233803 - protein, 9 aa, Homo Sapiens
RFVAGKYLA

SEQ ID NO: 1233804 - protein, 9 aa, Homo Sapiens
GWRVSSKSS

SEQ ID NO: 1233805 - protein, 9 aa, Homo Sapiens
LPRKAHRDW

SEQ ID NO: 1233806 - protein, 9 aa, Homo Sapiens
WDINTHITC

SEQ ID NO: 1233807 - protein, 9 aa, Homo Sapiens
GAIKERRCM

SEQ ID NO: 1233808 - protein, 9 aa, Homo Sapiens
QYTIYITTA

SEQ ID NO: 1233809 - protein, 9 aa, Homo Sapiens
DTRHLGATI

SEQ ID NO: 1233810 - protein, 9 aa, Homo Sapiens
LKVTTLTKK

SEQ ID NO: 1233811 - protein, 9 aa, Homo Sapiens
PFVYTYLHP

SEQ ID NO: 1233812 - protein, 9 aa, Homo Sapiens
YMMNSVLEK

SEQ ID NO: 1233813 - protein, 9 aa, Homo Sapiens
DGSQRGGIL

SEQ ID NO: 1233814 - protein, 9 aa, Homo Sapiens
PSLDVFLRR

SEQ ID NO: 1233815 - protein, 9 aa, Homo Sapiens
QTDYSCNTR

SEQ ID NO: 1233816 - protein, 9 aa, Homo Sapiens
AAPADPEMA

SEQ ID NO: 1233817 - protein, 9 aa, Homo Sapiens
RTSAGISSA

SEQ ID NO: 1233818 - protein, 9 aa, Homo Sapiens
MSLTIHNKI

SEQ ID NO: 1233819 - protein, 9 aa, Homo Sapiens
VSVNGLNAL

SEQ ID NO: 1233820 - protein, 9 aa, Homo Sapiens
RDILIQQGY

SEQ ID NO: 1233821 - protein, 9 aa, Homo Sapiens
REARTIKSI

SEQ ID NO: 1233822 - protein, 9 aa, Homo Sapiens
EMCKQSVDK

SEQ ID NO: 1233823 - protein, 9 aa, Homo Sapiens
MKRKAFQLQ

SEQ ID NO: 1233824 - protein, 9 aa, Homo Sapiens
TLVFEHVNN

SEQ ID NO: 1233825 - protein, 9 aa, Homo Sapiens
EKRILDPSI

SEQ ID NO: 1233826 - protein, 9 aa, Homo Sapiens
YIFDLPLKV

SEQ ID NO: 1233827 - protein, 9 aa, Homo Sapiens
GVPSHHILP

SEQ ID NO: 1233828 - protein, 9 aa, Homo Sapiens
EIVTAMRRI

SEQ ID NO: 1233829 - protein, 9 aa, Homo Sapiens
RLQTTVGVD

SEQ ID NO: 1233830 - protein, 9 aa, Homo Sapiens
VIQIIHIPK

SEQ ID NO: 1233831 - protein, 9 aa, Homo Sapiens
NDDSIRIIF

SEQ ID NO: 1233832 - protein, 9 aa, Homo Sapiens
GSGLPLIMR

SEQ ID NO: 1233833 - protein, 9 aa, Homo Sapiens
HGLVCDLCN

SEQ ID NO: 1233834 - protein, 9 aa, Homo Sapiens
VQYGNVPVV

SEQ ID NO: 1233835 - protein, 9 aa, Homo Sapiens
IMRIIIDHF

SEQ ID NO: 1233836 - protein, 9 aa, Homo Sapiens
YIPGSGLKM

SEQ ID NO: 1233837 - protein, 9 aa, Homo Sapiens
EKGFAPLNQ

SEQ ID NO: 1233838 - protein, 9 aa, Homo Sapiens
EVVNRIGHS

SEQ ID NO: 1233839 - protein, 9 aa, Homo Sapiens
ITLVNVIDW

SEQ ID NO: 1233840 - protein, 9 aa, Homo Sapiens
SVCYILMIR

SEQ ID NO: 1233841 - protein, 9 aa, Homo Sapiens
NAWSRSDSD

SEQ ID NO: 1233842 - protein, 9 aa, Homo Sapiens
HAAVQRIVR

SEQ ID NO: 1233843 - protein, 9 aa, Homo Sapiens
TPLSLAKKK

SEQ ID NO: 1233844 - protein, 9 aa, Homo Sapiens
RSVQQTLVS

SEQ ID NO: 1233845 - protein, 9 aa, Homo Sapiens
TSTGDQTLE

SEQ ID NO: 1233846 - protein, 9 aa, Homo Sapiens
LSQALSAHT

SEQ ID NO: 1233847 - protein, 9 aa, Homo Sapiens
AETFAEKLS

SEQ ID NO: 1233848 - protein, 9 aa, Homo Sapiens
LEKAKNDVV

SEQ ID NO: 1233849 - protein, 9 aa, Homo Sapiens
WWLLCQAEE

SEQ ID NO: 1233850 - protein, 9 aa, Homo Sapiens
KDLPEHAIL

SEQ ID NO: 1233851 - protein, 9 aa, Homo Sapiens
LCLPDEDAF

SEQ ID NO: 1233852 - protein, 9 aa, Homo Sapiens
CPRWISRSA

SEQ ID NO: 1233853 - protein, 9 aa, Homo Sapiens
FTLGPLVPR

SEQ ID NO: 1233854 - protein, 9 aa, Homo Sapiens
GYPGIQAVH

SEQ ID NO: 1233855 - protein, 9 aa, Homo Sapiens
KGTMKDICE

SEQ ID NO: 1233856 - protein, 9 aa, Homo Sapiens
SKDVSYLIS

SEQ ID NO: 1233857 - protein, 9 aa, Homo Sapiens
PSSVLPTLS

SEQ ID NO: 1233858 - protein, 9 aa, Homo Sapiens
KNIFKADKE

SEQ ID NO: 1233859 - protein, 9 aa, Homo Sapiens
ALTTECDLK

SEQ ID NO: 1233860 - protein, 9 aa, Homo Sapiens
LKLEKTLLV

SEQ ID NO: 1233861 - protein, 9 aa, Homo Sapiens
IGTVQHLNS

SEQ ID NO: 1233862 - protein, 9 aa, Homo Sapiens
ARTHPKTGK

SEQ ID NO: 1233863 - protein, 9 aa, Homo Sapiens
SKRHKTISI

SEQ ID NO: 1233864 - protein, 9 aa, Homo Sapiens
TCLKLLTAV

SEQ ID NO: 1233865 - protein, 9 aa, Homo Sapiens
LLAKHLQEE

SEQ ID NO: 1233866 - protein, 9 aa, Homo Sapiens
SLGVCPLGH

SEQ ID NO: 1233867 - protein, 9 aa, Homo Sapiens
EDQIIEDQY

SEQ ID NO: 1233868 - protein, 9 aa, Homo Sapiens
LTFPKQCCM

SEQ ID NO: 1233869 - protein, 9 aa, Homo Sapiens
LLKYVNMDA

SEQ ID NO: 1233870 - protein, 9 aa, Homo Sapiens
LQQQHPNDK

SEQ ID NO: 1233871 - protein, 9 aa, Homo Sapiens
ATFRRKIPE

SEQ ID NO: 1233872 - protein, 9 aa, Homo Sapiens
RCKTNIVTA

SEQ ID NO: 1233873 - protein, 9 aa, Homo Sapiens
WSDLITFLY

SEQ ID NO: 1233874 - protein, 9 aa, Homo Sapiens
YGIRPHPTS

SEQ ID NO: 1233875 - protein, 9 aa, Homo Sapiens
TAGRKDHLG

SEQ ID NO: 1233876 - protein, 9 aa, Homo Sapiens
TRLAYALPH

SEQ ID NO: 1233877 - protein, 9 aa, Homo Sapiens
HPMPTLLAQ

SEQ ID NO: 1233878 - protein, 9 aa, Homo Sapiens
ADKKRQCKR

SEQ ID NO: 1233879 - protein, 9 aa, Homo Sapiens
GPLSGVVNV

SEQ ID NO: 1233880 - protein, 9 aa, Homo Sapiens
QLKQKLQEM

SEQ ID NO: 1233881 - protein, 9 aa, Homo Sapiens
GSHLTVVFF

SEQ ID NO: 1233882 - protein, 9 aa, Homo Sapiens
SPPLPPALG

SEQ ID NO: 1233883 - protein, 9 aa, Homo Sapiens
EHIIEATSD

SEQ ID NO: 1233884 - protein, 9 aa, Homo Sapiens
NCSCSADIW

SEQ ID NO: 1233885 - protein, 9 aa, Homo Sapiens
DINPPQYFA

SEQ ID NO: 1233886 - protein, 9 aa, Homo Sapiens
PALYRVIME

SEQ ID NO: 1233887 - protein, 9 aa, Homo Sapiens
QRHVDEFLL

SEQ ID NO: 1233888 - protein, 9 aa, Homo Sapiens
EAYSLGLDT

SEQ ID NO: 1233889 - protein, 9 aa, Homo Sapiens
CRYDRPQDS

SEQ ID NO: 1233890 - protein, 9 aa, Homo Sapiens
TLVYNSMRT

SEQ ID NO: 1233891 - protein, 9 aa, Homo Sapiens
VKKNAPQVS

SEQ ID NO: 1233892 - protein, 9 aa, Homo Sapiens
AEMRDGPQG

SEQ ID NO: 1233893 - protein, 9 aa, Homo Sapiens
RDRRPGPSR

SEQ ID NO: 1233894 - protein, 9 aa, Homo Sapiens
TKDELFKMF

SEQ ID NO: 1233895 - protein, 9 aa, Homo Sapiens
HGYFLIVTV

SEQ ID NO: 1233896 - protein, 9 aa, Homo Sapiens
DMEKIHSAV

SEQ ID NO: 1233897 - protein, 9 aa, Homo Sapiens
GYAINKYDV

SEQ ID NO: 1233898 - protein, 9 aa, Homo Sapiens
LSLMDIMLI

SEQ ID NO: 1233899 - protein, 9 aa, Homo Sapiens
WTYRYSEKP

SEQ ID NO: 1233900 - protein, 9 aa, Homo Sapiens
DDDVLLVFW

SEQ ID NO: 1233901 - protein, 9 aa, Homo Sapiens
GTVGPSNEL

SEQ ID NO: 1233902 - protein, 9 aa, Homo Sapiens
IYYFLGIKY

SEQ ID NO: 1233903 - protein, 9 aa, Homo Sapiens
LARSSPAYY

SEQ ID NO: 1233904 - protein, 9 aa, Homo Sapiens
SQTRAIKDQ

SEQ ID NO: 1233905 - protein, 9 aa, Homo Sapiens
RDDHSFGRD

SEQ ID NO: 1233906 - protein, 9 aa, Homo Sapiens
LPSIVCLKK

SEQ ID NO: 1233907 - protein, 9 aa, Homo Sapiens
AAEDELVEA

SEQ ID NO: 1233908 - protein, 9 aa, Homo Sapiens
GLQVRADVN

SEQ ID NO: 1233909 - protein, 9 aa, Homo Sapiens
CVKKNSVHE

SEQ ID NO: 1233910 - protein, 9 aa, Homo Sapiens
AILPKELLT

SEQ ID NO: 1233911 - protein, 9 aa, Homo Sapiens
QKASGVKCT

SEQ ID NO: 1233912 - protein, 9 aa, Homo Sapiens
LHPAKPKYF

SEQ ID NO: 1233913 - protein, 9 aa, Homo Sapiens
ARQGCLRAL

SEQ ID NO: 1233914 - protein, 9 aa, Homo Sapiens
RFFAPTILT

SEQ ID NO: 1233915 - protein, 9 aa, Homo Sapiens
SWVVSMLHT

SEQ ID NO: 1233916 - protein, 9 aa, Homo Sapiens
QRVLSTLSV

SEQ ID NO: 1233917 - protein, 9 aa, Homo Sapiens
LPPVGGDLT

SEQ ID NO: 1233918 - protein, 9 aa, Homo Sapiens
CRDVGPVPP

SEQ ID NO: 1233919 - protein, 9 aa, Homo Sapiens
DYDSHTALH

SEQ ID NO: 1233920 - protein, 9 aa, Homo Sapiens
RGFDQDMVN

SEQ ID NO: 1233921 - protein, 9 aa, Homo Sapiens
ACVAFSPST

SEQ ID NO: 1233922 - protein, 9 aa, Homo Sapiens
NMWRKNLQD

SEQ ID NO: 1233923 - protein, 9 aa, Homo Sapiens
ETVAEAAVV

SEQ ID NO: 1233924 - protein, 9 aa, Homo Sapiens
QHIVLKLMP

SEQ ID NO: 1233925 - protein, 9 aa, Homo Sapiens
VQDISLPLS

SEQ ID NO: 1233926 - protein, 9 aa, Homo Sapiens
LSVSVEESA

SEQ ID NO: 1233927 - protein, 9 aa, Homo Sapiens
IRTGAWGPP

SEQ ID NO: 1233928 - protein, 9 aa, Homo Sapiens
KSYWDALYK

SEQ ID NO: 1233929 - protein, 9 aa, Homo Sapiens
ADGNSNTAL

SEQ ID NO: 1233930 - protein, 9 aa, Homo Sapiens
SSVMTHLSG

SEQ ID NO: 1233931 - protein, 9 aa, Homo Sapiens
DFLQLMPAA

SEQ ID NO: 1233932 - protein, 9 aa, Homo Sapiens
STSFWLMLT

SEQ ID NO: 1233933 - protein, 9 aa, Homo Sapiens
LPNGLGNTG

SEQ ID NO: 1233934 - protein, 9 aa, Homo Sapiens
NPTFSKKFV

SEQ ID NO: 1233935 - protein, 9 aa, Homo Sapiens
FDCMYGDIF

SEQ ID NO: 1233936 - protein, 9 aa, Homo Sapiens
LQTLEIHFH

SEQ ID NO: 1233937 - protein, 9 aa, Homo Sapiens
SIHSITDFW

SEQ ID NO: 1233938 - protein, 9 aa, Homo Sapiens
CVKKSKQPL

SEQ ID NO: 1233939 - protein, 9 aa, Homo Sapiens
LETLMLFSR

SEQ ID NO: 1233940 - protein, 9 aa, Homo Sapiens
RVSDPSPNT

SEQ ID NO: 1233941 - protein, 9 aa, Homo Sapiens
YYPDRSWER

SEQ ID NO: 1233942 - protein, 9 aa, Homo Sapiens
LDHLKATHA

SEQ ID NO: 1233943 - protein, 9 aa, Homo Sapiens
PGEPAASLI

SEQ ID NO: 1233944 - protein, 9 aa, Homo Sapiens
TASFGIGPG

SEQ ID NO: 1233945 - protein, 9 aa, Homo Sapiens
RYCFGEDLA

SEQ ID NO: 1233946 - protein, 9 aa, Homo Sapiens
ERQRCRKQG

SEQ ID NO: 1233947 - protein, 9 aa, Homo Sapiens
TVAIQALWV

SEQ ID NO: 1233948 - protein, 9 aa, Homo Sapiens
TLNEQHLEG

SEQ ID NO: 1233949 - protein, 9 aa, Homo Sapiens
LICARLRGA

SEQ ID NO: 1233950 - protein, 9 aa, Homo Sapiens
IRLAQDADV

SEQ ID NO: 1233951 - protein, 9 aa, Homo Sapiens
TTVTGTKDS

SEQ ID NO: 1233952 - protein, 9 aa, Homo Sapiens
APCDGAGSP

SEQ ID NO: 1233953 - protein, 9 aa, Homo Sapiens
IFEFQVIGE

SEQ ID NO: 1233954 - protein, 9 aa, Homo Sapiens
GVIHFDDNQ

SEQ ID NO: 1233955 - protein, 9 aa, Homo Sapiens
TNHDLDQFL

SEQ ID NO: 1233956 - protein, 9 aa, Homo Sapiens
LLRITLSFQ

SEQ ID NO: 1233957 - protein, 9 aa, Homo Sapiens
KYMNSVTRN

SEQ ID NO: 1233958 - protein, 9 aa, Homo Sapiens
CTIGELLAP

SEQ ID NO: 1233959 - protein, 9 aa, Homo Sapiens
RRQLWAILS

SEQ ID NO: 1233960 - protein, 9 aa, Homo Sapiens
DDDDCQIKN

SEQ ID NO: 1233961 - protein, 9 aa, Homo Sapiens
FRNGADIDV

SEQ ID NO: 1233962 - protein, 9 aa, Homo Sapiens
EEPPLVTIN

SEQ ID NO: 1233963 - protein, 9 aa, Homo Sapiens
HTDLEELNL

SEQ ID NO: 1233964 - protein, 9 aa, Homo Sapiens
SWGTLGLEL

SEQ ID NO: 1233965 - protein, 9 aa, Homo Sapiens
DGIYVRPRL

SEQ ID NO: 1233966 - protein, 9 aa, Homo Sapiens
TPTERTALA

SEQ ID NO: 1233967 - protein, 9 aa, Homo Sapiens
HALSSGSIT

SEQ ID NO: 1233968 - protein, 9 aa, Homo Sapiens
IDNNKSIGC

SEQ ID NO: 1233969 - protein, 9 aa, Homo Sapiens
NGRYGRHKQ

SEQ ID NO: 1233970 - protein, 9 aa, Homo Sapiens
LGDRDAILQ

SEQ ID NO: 1233971 - protein, 9 aa, Homo Sapiens
RIALMDAYL

SEQ ID NO: 1233972 - protein, 9 aa, Homo Sapiens
MSQGKVASL

SEQ ID NO: 1233973 - protein, 9 aa, Homo Sapiens
HKYILVSCG

SEQ ID NO: 1233974 - protein, 9 aa, Homo Sapiens
FPQDVPVPP

SEQ ID NO: 1233975 - protein, 9 aa, Homo Sapiens
VTIFSFQTK

SEQ ID NO: 1233976 - protein, 9 aa, Homo Sapiens
MRAATFTYI

SEQ ID NO: 1233977 - protein, 9 aa, Homo Sapiens
RTHSPLQST

SEQ ID NO: 1233978 - protein, 9 aa, Homo Sapiens
EGGVQERGV

SEQ ID NO: 1233979 - protein, 9 aa, Homo Sapiens
GLCPADQLC

SEQ ID NO: 1233980 - protein, 9 aa, Homo Sapiens
SSEDDEWRS

SEQ ID NO: 1233981 - protein, 9 aa, Homo Sapiens
LVELHIMEV

SEQ ID NO: 1233982 - protein, 9 aa, Homo Sapiens
LDHGAEANI

SEQ ID NO: 1233983 - protein, 9 aa, Homo Sapiens
PYRLGPGSP

SEQ ID NO: 1233984 - protein, 9 aa, Homo Sapiens
TTHSLIKGP

SEQ ID NO: 1233985 - protein, 9 aa, Homo Sapiens
DVLQETIKF

SEQ ID NO: 1233986 - protein, 9 aa, Homo Sapiens
AMSRDEKNY

SEQ ID NO: 1233987 - protein, 9 aa, Homo Sapiens
HVHTTVLRL

SEQ ID NO: 1233988 - protein, 9 aa, Homo Sapiens
LETHDDCLQ

SEQ ID NO: 1233989 - protein, 9 aa, Homo Sapiens
QVITSNMPI

SEQ ID NO: 1233990 - protein, 9 aa, Homo Sapiens
LTEPEKLHL

SEQ ID NO: 1233991 - protein, 9 aa, Homo Sapiens
FLTPMAVIC

SEQ ID NO: 1233992 - protein, 9 aa, Homo Sapiens
LFDTTEVYA

SEQ ID NO: 1233993 - protein, 9 aa, Homo Sapiens
DRSREPPGG

SEQ ID NO: 1233994 - protein, 9 aa, Homo Sapiens
EEFWSRFRK

SEQ ID NO: 1233995 - protein, 9 aa, Homo Sapiens
NGSPEYRQQ

SEQ ID NO: 1233996 - protein, 9 aa, Homo Sapiens
LEKERARHL

SEQ ID NO: 1233997 - protein, 9 aa, Homo Sapiens
INSLIQLNN

SEQ ID NO: 1233998 - protein, 9 aa, Homo Sapiens
FLYNNNTMQ

SEQ ID NO: 1233999 - protein, 9 aa, Homo Sapiens
AVMGWLASG

SEQ ID NO: 1234000 - protein, 9 aa, Homo Sapiens
VCREMGYVE

SEQ ID NO: 1234001 - protein, 9 aa, Homo Sapiens
YMSEAGEEE

SEQ ID NO: 1234002 - protein, 9 aa, Homo Sapiens
GGITITWKF

SEQ ID NO: 1234003 - protein, 9 aa, Homo Sapiens
AKHLSRLVV

SEQ ID NO: 1234004 - protein, 9 aa, Homo Sapiens
LGIFRRWNE

SEQ ID NO: 1234005 - protein, 9 aa, Homo Sapiens
TASTSWHCS

SEQ ID NO: 1234006 - protein, 9 aa, Homo Sapiens
IGVLFNNGA

SEQ ID NO: 1234007 - protein, 9 aa, Homo Sapiens
PRSVCGRLQ

SEQ ID NO: 1234008 - protein, 9 aa, Homo Sapiens
AEKLARDLN

SEQ ID NO: 1234009 - protein, 9 aa, Homo Sapiens
PQRPAFAAN

SEQ ID NO: 1234010 - protein, 9 aa, Homo Sapiens
RRMSPSNSS

SEQ ID NO: 1234011 - protein, 9 aa, Homo Sapiens
TSVSGDMCS

SEQ ID NO: 1234012 - protein, 9 aa, Homo Sapiens
MEYANHMAA

SEQ ID NO: 1234013 - protein, 9 aa, Homo Sapiens
YISKIWNEA

SEQ ID NO: 1234014 - protein, 9 aa, Homo Sapiens
PVHLVQQCV

SEQ ID NO: 1234015 - protein, 9 aa, Homo Sapiens
LHHLRLPTY

SEQ ID NO: 1234016 - protein, 9 aa, Homo Sapiens
VNLQEEEGG

SEQ ID NO: 1234017 - protein, 9 aa, Homo Sapiens
EQWQPLTVE

SEQ ID NO: 1234018 - protein, 9 aa, Homo Sapiens
MIPSYIRDS

SEQ ID NO: 1234019 - protein, 9 aa, Homo Sapiens
VAPTQYHIS

SEQ ID NO: 1234020 - protein, 9 aa, Homo Sapiens
ALYTYKSKM

SEQ ID NO: 1234021 - protein, 9 aa, Homo Sapiens
APQVSDGSE

SEQ ID NO: 1234022 - protein, 9 aa, Homo Sapiens
AALGATAAP

SEQ ID NO: 1234023 - protein, 9 aa, Homo Sapiens
AVVWKTKQT

SEQ ID NO: 1234024 - protein, 9 aa, Homo Sapiens
LHPGFCCLL

SEQ ID NO: 1234025 - protein, 9 aa, Homo Sapiens
ENEGVEQAP

SEQ ID NO: 1234026 - protein, 9 aa, Homo Sapiens
AHEIPVPGN

SEQ ID NO: 1234027 - protein, 9 aa, Homo Sapiens
LSDQREQVL

SEQ ID NO: 1234028 - protein, 9 aa, Homo Sapiens
LFILGCTWY

SEQ ID NO: 1234029 - protein, 9 aa, Homo Sapiens
TLCGILVLL

SEQ ID NO: 1234030 - protein, 9 aa, Homo Sapiens
AANLLIPTV

SEQ ID NO: 1234031 - protein, 9 aa, Homo Sapiens
HDLLPPRVH

SEQ ID NO: 1234032 - protein, 9 aa, Homo Sapiens
SEDDSRDEI

SEQ ID NO: 1234033 - protein, 9 aa, Homo Sapiens
LAQRASNKN

SEQ ID NO: 1234034 - protein, 9 aa, Homo Sapiens
EDHFLTTLS

SEQ ID NO: 1234035 - protein, 9 aa, Homo Sapiens
LGVCPLGHV

SEQ ID NO: 1234036 - protein, 9 aa, Homo Sapiens
SLGNDTPVT

SEQ ID NO: 1234037 - protein, 9 aa, Homo Sapiens
PLSDQREQV

SEQ ID NO: 1234038 - protein, 9 aa, Homo Sapiens
TSCLYIMKF

SEQ ID NO: 1234039 - protein, 9 aa, Homo Sapiens
VMCIGLRYW

SEQ ID NO: 1234040 - protein, 9 aa, Homo Sapiens
HIGEIPYEC

SEQ ID NO: 1234041 - protein, 9 aa, Homo Sapiens
IHISHQDFA

SEQ ID NO: 1234042 - protein, 9 aa, Homo Sapiens
QGWDITVDL

SEQ ID NO: 1234043 - protein, 9 aa, Homo Sapiens
YFWGKPHST

SEQ ID NO: 1234044 - protein, 9 aa, Homo Sapiens
ISCFAYQKI

SEQ ID NO: 1234045 - protein, 9 aa, Homo Sapiens
RQRPDDLMA

SEQ ID NO: 1234046 - protein, 9 aa, Homo Sapiens
LHPQHCRLL

SEQ ID NO: 1234047 - protein, 9 aa, Homo Sapiens
RCMLNTHRT

SEQ ID NO: 1234048 - protein, 9 aa, Homo Sapiens
RATSFGILN

SEQ ID NO: 1234049 - protein, 9 aa, Homo Sapiens
LHHFQKVIP

SEQ ID NO: 1234050 - protein, 9 aa, Homo Sapiens
LHVLDQFQV

SEQ ID NO: 1234051 - protein, 9 aa, Homo Sapiens
RPGCFDRQI

SEQ ID NO: 1234052 - protein, 9 aa, Homo Sapiens
HILEKKPVM

SEQ ID NO: 1234053 - protein, 9 aa, Homo Sapiens
MGLQTRTQP

SEQ ID NO: 1234054 - protein, 9 aa, Homo Sapiens
YADSGPFGL

SEQ ID NO: 1234055 - protein, 9 aa, Homo Sapiens
ACGAIGIAQ

SEQ ID NO: 1234056 - protein, 9 aa, Homo Sapiens
RYSRDLRDH

SEQ ID NO: 1234057 - protein, 9 aa, Homo Sapiens
RAPPRKPEP

SEQ ID NO: 1234058 - protein, 9 aa, Homo Sapiens
SIHLPQPNS

SEQ ID NO: 1234059 - protein, 9 aa, Homo Sapiens
IARKSVLVV

SEQ ID NO: 1234060 - protein, 9 aa, Homo Sapiens
LHIQGVPKV

SEQ ID NO: 1234061 - protein, 9 aa, Homo Sapiens
SQPEGEVGV

SEQ ID NO: 1234062 - protein, 9 aa, Homo Sapiens
EQACPQHTC

SEQ ID NO: 1234063 - protein, 9 aa, Homo Sapiens
LGQALFTLH

SEQ ID NO: 1234064 - protein, 9 aa, Homo Sapiens
IKSLSAPGK

SEQ ID NO: 1234065 - protein, 9 aa, Homo Sapiens
SNCCCRSPP

SEQ ID NO: 1234066 - protein, 9 aa, Homo Sapiens
PNYSLNYEN

SEQ ID NO: 1234067 - protein, 9 aa, Homo Sapiens
PLFRENFSV

SEQ ID NO: 1234068 - protein, 9 aa, Homo Sapiens
QTLDCPIKK

SEQ ID NO: 1234069 - protein, 9 aa, Homo Sapiens
NEEMNEKIK

SEQ ID NO: 1234070 - protein, 9 aa, Homo Sapiens
YPQFQDALH

SEQ ID NO: 1234071 - protein, 9 aa, Homo Sapiens
ATEGGQSST

SEQ ID NO: 1234072 - protein, 9 aa, Homo Sapiens
DSEHYAQEN

SEQ ID NO: 1234073 - protein, 9 aa, Homo Sapiens
KYRCPRCMQ

SEQ ID NO: 1234074 - protein, 9 aa, Homo Sapiens
DELMKNDEP

SEQ ID NO: 1234075 - protein, 9 aa, Homo Sapiens
STFQFCFLR

SEQ ID NO: 1234076 - protein, 9 aa, Homo Sapiens
KDLQAQAVA

SEQ ID NO: 1234077 - protein, 9 aa, Homo Sapiens
SHLRCIFNW

SEQ ID NO: 1234078 - protein, 9 aa, Homo Sapiens
RPAIYYVMS

SEQ ID NO: 1234079 - protein, 9 aa, Homo Sapiens
VKEWMQKKR

SEQ ID NO: 1234080 - protein, 9 aa, Homo Sapiens
SGPDQQMDF

SEQ ID NO: 1234081 - protein, 9 aa, Homo Sapiens
AHHPGKSNL

SEQ ID NO: 1234082 - protein, 9 aa, Homo Sapiens
DPKSKQKKE

SEQ ID NO: 1234083 - protein, 9 aa, Homo Sapiens
SVPGTPGFM

SEQ ID NO: 1234084 - protein, 9 aa, Homo Sapiens
MLTLAEYHE

SEQ ID NO: 1234085 - protein, 9 aa, Homo Sapiens
ILGRNMSGQ

SEQ ID NO: 1234086 - protein, 9 aa, Homo Sapiens
RIQNASGSV

SEQ ID NO: 1234087 - protein, 9 aa, Homo Sapiens
TETSDMVCK

SEQ ID NO: 1234088 - protein, 9 aa, Homo Sapiens
FLVCHLLVM

SEQ ID NO: 1234089 - protein, 9 aa, Homo Sapiens
KSRLSFDLS

SEQ ID NO: 1234090 - protein, 9 aa, Homo Sapiens
DYDIIKCVL

SEQ ID NO: 1234091 - protein, 9 aa, Homo Sapiens
MDSSMACSP

SEQ ID NO: 1234092 - protein, 9 aa, Homo Sapiens
KSYMSEETH

SEQ ID NO: 1234093 - protein, 9 aa, Homo Sapiens
DELTLKGVT

SEQ ID NO: 1234094 - protein, 9 aa, Homo Sapiens
FSMSSTLIR

SEQ ID NO: 1234095 - protein, 9 aa, Homo Sapiens
EHTWSLTEL

SEQ ID NO: 1234096 - protein, 9 aa, Homo Sapiens
KSFLLSMKK

SEQ ID NO: 1234097 - protein, 9 aa, Homo Sapiens
SVEQTPKKH

SEQ ID NO: 1234098 - protein, 9 aa, Homo Sapiens
VLDEDLAKA

SEQ ID NO: 1234099 - protein, 9 aa, Homo Sapiens
ADSTLLAII

SEQ ID NO: 1234100 - protein, 9 aa, Homo Sapiens
DCKAGLHAV

SEQ ID NO: 1234101 - protein, 9 aa, Homo Sapiens
GSLTNLSKM

SEQ ID NO: 1234102 - protein, 9 aa, Homo Sapiens
PRGMAYVFG

SEQ ID NO: 1234103 - protein, 9 aa, Homo Sapiens
DLRCQTHIS

SEQ ID NO: 1234104 - protein, 9 aa, Homo Sapiens
PPALSLRSL

SEQ ID NO: 1234105 - protein, 9 aa, Homo Sapiens
PGERLMGYG

SEQ ID NO: 1234106 - protein, 9 aa, Homo Sapiens
TYLDIEHIT

SEQ ID NO: 1234107 - protein, 9 aa, Homo Sapiens
ERHAQVAEK

SEQ ID NO: 1234108 - protein, 9 aa, Homo Sapiens
ALRRMYTAI

SEQ ID NO: 1234109 - protein, 9 aa, Homo Sapiens
KVCYPERIT

SEQ ID NO: 1234110 - protein, 9 aa, Homo Sapiens
FMVDSKEEY

SEQ ID NO: 1234111 - protein, 9 aa, Homo Sapiens
EMMFEGGPR

SEQ ID NO: 1234112 - protein, 9 aa, Homo Sapiens
LKAAMRRYK

SEQ ID NO: 1234113 - protein, 9 aa, Homo Sapiens
LFAHVVDFV

SEQ ID NO: 1234114 - protein, 9 aa, Homo Sapiens
EYDAITALV

SEQ ID NO: 1234115 - protein, 9 aa, Homo Sapiens
AGRSADFVV

SEQ ID NO: 1234116 - protein, 9 aa, Homo Sapiens
LTIGTRSGA

SEQ ID NO: 1234117 - protein, 9 aa, Homo Sapiens
HLKFLEHFD

SEQ ID NO: 1234118 - protein, 9 aa, Homo Sapiens
ECGLIQWKA

SEQ ID NO: 1234119 - protein, 9 aa, Homo Sapiens
LAQPTLPGP

SEQ ID NO: 1234120 - protein, 9 aa, Homo Sapiens
HFYTKIHIY

SEQ ID NO: 1234121 - protein, 9 aa, Homo Sapiens
ITAITVTVI

SEQ ID NO: 1234122 - protein, 9 aa, Homo Sapiens
ENEYANVDA

SEQ ID NO: 1234123 - protein, 9 aa, Homo Sapiens
HTIQKTRKR

SEQ ID NO: 1234124 - protein, 9 aa, Homo Sapiens
EKQLMKLEQ

SEQ ID NO: 1234125 - protein, 9 aa, Homo Sapiens
VWLGTMFQN

SEQ ID NO: 1234126 - protein, 9 aa, Homo Sapiens
GPVQVGKEQ

SEQ ID NO: 1234127 - protein, 9 aa, Homo Sapiens
HQPGYCTFY

SEQ ID NO: 1234128 - protein, 9 aa, Homo Sapiens
TAGHHGDDL

SEQ ID NO: 1234129 - protein, 9 aa, Homo Sapiens
CNSRQPSCK

SEQ ID NO: 1234130 - protein, 9 aa, Homo Sapiens
PSDMHFIFT

SEQ ID NO: 1234131 - protein, 9 aa, Homo Sapiens
KWLVSGGDD

SEQ ID NO: 1234132 - protein, 9 aa, Homo Sapiens
VIEEFWQQE

SEQ ID NO: 1234133 - protein, 9 aa, Homo Sapiens
LTCIVIPGN

SEQ ID NO: 1234134 - protein, 9 aa, Homo Sapiens
GASPTVCAT

SEQ ID NO: 1234135 - protein, 9 aa, Homo Sapiens
IPDYPGFFL

SEQ ID NO: 1234136 - protein, 9 aa, Homo Sapiens
TTTVGVTTT

SEQ ID NO: 1234137 - protein, 9 aa, Homo Sapiens
ETYFDGVAV

SEQ ID NO: 1234138 - protein, 9 aa, Homo Sapiens
KHQPPRVLM

SEQ ID NO: 1234139 - protein, 9 aa, Homo Sapiens
RDEHQLMLM

SEQ ID NO: 1234140 - protein, 9 aa, Homo Sapiens
SCLERDGIV

SEQ ID NO: 1234141 - protein, 9 aa, Homo Sapiens
KHCFKKRTH

SEQ ID NO: 1234142 - protein, 9 aa, Homo Sapiens
DREEQRYHS

SEQ ID NO: 1234143 - protein, 9 aa, Homo Sapiens
NFRIYKAPS

SEQ ID NO: 1234144 - protein, 9 aa, Homo Sapiens
KILNVKRSQ

SEQ ID NO: 1234145 - protein, 9 aa, Homo Sapiens
QEVPPHIFS

SEQ ID NO: 1234146 - protein, 9 aa, Homo Sapiens
CRLQCEIRL

SEQ ID NO: 1234147 - protein, 9 aa, Homo Sapiens
FLNSSMPIF

SEQ ID NO: 1234148 - protein, 9 aa, Homo Sapiens
RTDTRGKYS

SEQ ID NO: 1234149 - protein, 9 aa, Homo Sapiens
FTIWHIIAF

SEQ ID NO: 1234150 - protein, 9 aa, Homo Sapiens
LDEDLAKAD

SEQ ID NO: 1234151 - protein, 9 aa, Homo Sapiens
QGYLINSLK

SEQ ID NO: 1234152 - protein, 9 aa, Homo Sapiens
NQQVEKMEQ

SEQ ID NO: 1234153 - protein, 9 aa, Homo Sapiens
TLPTSGSSA

SEQ ID NO: 1234154 - protein, 9 aa, Homo Sapiens
KPGELKSLS

SEQ ID NO: 1234155 - protein, 9 aa, Homo Sapiens
NGPIGHRCE

SEQ ID NO: 1234156 - protein, 9 aa, Homo Sapiens
DLKGPKTDA

SEQ ID NO: 1234157 - protein, 9 aa, Homo Sapiens
QRARDEYQH

SEQ ID NO: 1234158 - protein, 9 aa, Homo Sapiens
PAPAGAWSF

SEQ ID NO: 1234159 - protein, 9 aa, Homo Sapiens
SLLNQHAYA

SEQ ID NO: 1234160 - protein, 9 aa, Homo Sapiens
QVAMMGLTG

SEQ ID NO: 1234161 - protein, 9 aa, Homo Sapiens
KCHSSPGYP

SEQ ID NO: 1234162 - protein, 9 aa, Homo Sapiens
ASLSIIVLL

SEQ ID NO: 1234163 - protein, 9 aa, Homo Sapiens
AARYMCDVE

SEQ ID NO: 1234164 - protein, 9 aa, Homo Sapiens
KLTMEVYFG

SEQ ID NO: 1234165 - protein, 9 aa, Homo Sapiens
EKYGEMWGM

SEQ ID NO: 1234166 - protein, 9 aa, Homo Sapiens
LTHGVNADA

SEQ ID NO: 1234167 - protein, 9 aa, Homo Sapiens
GFGEQINND

SEQ ID NO: 1234168 - protein, 9 aa, Homo Sapiens
LELNDFMNV

SEQ ID NO: 1234169 - protein, 9 aa, Homo Sapiens
RKKRKKNPR

SEQ ID NO: 1234170 - protein, 9 aa, Homo Sapiens
FAGMNISLT

SEQ ID NO: 1234171 - protein, 9 aa, Homo Sapiens
PGGMMREIR

SEQ ID NO: 1234172 - protein, 9 aa, Homo Sapiens
LDICFTTSC

SEQ ID NO: 1234173 - protein, 9 aa, Homo Sapiens
CWTVDEVAE

SEQ ID NO: 1234174 - protein, 9 aa, Homo Sapiens
GSVSFKYVT

SEQ ID NO: 1234175 - protein, 9 aa, Homo Sapiens
RLKNKRYLN

SEQ ID NO: 1234176 - protein, 9 aa, Homo Sapiens
NEEYDEEPI

SEQ ID NO: 1234177 - protein, 9 aa, Homo Sapiens
KTLLITKKW

SEQ ID NO: 1234178 - protein, 9 aa, Homo Sapiens
EDCGVCTNR

SEQ ID NO: 1234179 - protein, 9 aa, Homo Sapiens
EDNGYLLEK

SEQ ID NO: 1234180 - protein, 9 aa, Homo Sapiens
VTSDKRATQ

SEQ ID NO: 1234181 - protein, 9 aa, Homo Sapiens
PTAAAAAGI

SEQ ID NO: 1234182 - protein, 9 aa, Homo Sapiens
KKYMNSVTR

SEQ ID NO: 1234183 - protein, 9 aa, Homo Sapiens
LHDAAVACR

SEQ ID NO: 1234184 - protein, 9 aa, Homo Sapiens
NRCLYRAMG

SEQ ID NO: 1234185 - protein, 9 aa, Homo Sapiens
DGTSQGCTV

SEQ ID NO: 1234186 - protein, 9 aa, Homo Sapiens
NVVKGHRVS

SEQ ID NO: 1234187 - protein, 9 aa, Homo Sapiens
DSACLLNTS

SEQ ID NO: 1234188 - protein, 9 aa, Homo Sapiens
GMMLGLCYQ

SEQ ID NO: 1234189 - protein, 9 aa, Homo Sapiens
LEVVGLEMV

SEQ ID NO: 1234190 - protein, 9 aa, Homo Sapiens
LQEYLAFAK

SEQ ID NO: 1234191 - protein, 9 aa, Homo Sapiens
SILYHGLIC

SEQ ID NO: 1234192 - protein, 9 aa, Homo Sapiens
SALEVLRCI

SEQ ID NO: 1234193 - protein, 9 aa, Homo Sapiens
PKAEVDVIA

SEQ ID NO: 1234194 - protein, 9 aa, Homo Sapiens
VRPPGCHVP

SEQ ID NO: 1234195 - protein, 9 aa, Homo Sapiens
QKPAVLLME

SEQ ID NO: 1234196 - protein, 9 aa, Homo Sapiens
LARSLKTNI

SEQ ID NO: 1234197 - protein, 9 aa, Homo Sapiens
SSGAQTART

SEQ ID NO: 1234198 - protein, 9 aa, Homo Sapiens
TYRLVNVFL

SEQ ID NO: 1234199 - protein, 9 aa, Homo Sapiens
FQHCSSLAQ

SEQ ID NO: 1234200 - protein, 9 aa, Homo Sapiens
VFDSEMNKL

SEQ ID NO: 1234201 - protein, 9 aa, Homo Sapiens
LVSAISQKI

SEQ ID NO: 1234202 - protein, 9 aa, Homo Sapiens
TGVHTVANC

SEQ ID NO: 1234203 - protein, 9 aa, Homo Sapiens
FLDTTGSPV

SEQ ID NO: 1234204 - protein, 9 aa, Homo Sapiens
SIMFMGRVT

SEQ ID NO: 1234205 - protein, 9 aa, Homo Sapiens
LDFSSSWQD

SEQ ID NO: 1234206 - protein, 9 aa, Homo Sapiens
STYSVFNPG

SEQ ID NO: 1234207 - protein, 9 aa, Homo Sapiens
AQVDLELLT

SEQ ID NO: 1234208 - protein, 9 aa, Homo Sapiens
KEEVKRFRG

SEQ ID NO: 1234209 - protein, 9 aa, Homo Sapiens
CFICRRDLY

SEQ ID NO: 1234210 - protein, 9 aa, Homo Sapiens
DSDESLGGL

SEQ ID NO: 1234211 - protein, 9 aa, Homo Sapiens
HVKGGVSMM

SEQ ID NO: 1234212 - protein, 9 aa, Homo Sapiens
FILVGPICL

SEQ ID NO: 1234213 - protein, 9 aa, Homo Sapiens
KPDFFSSMQ

SEQ ID NO: 1234214 - protein, 9 aa, Homo Sapiens
QKECIYYAD

SEQ ID NO: 1234215 - protein, 9 aa, Homo Sapiens
PSQMDLMCA

SEQ ID NO: 1234216 - protein, 9 aa, Homo Sapiens
ALSLRSLQR

SEQ ID NO: 1234217 - protein, 9 aa, Homo Sapiens
QRHVNVSIL

SEQ ID NO: 1234218 - protein, 9 aa, Homo Sapiens
FCKHLGCTQ

SEQ ID NO: 1234219 - protein, 9 aa, Homo Sapiens
YGGSLPSVN

SEQ ID NO: 1234220 - protein, 9 aa, Homo Sapiens
CTSRLDVHK

SEQ ID NO: 1234221 - protein, 9 aa, Homo Sapiens
SFSRYASIK

SEQ ID NO: 1234222 - protein, 9 aa, Homo Sapiens
FFFFFVSCH

SEQ ID NO: 1234223 - protein, 9 aa, Homo Sapiens
GPGGLFPAY

SEQ ID NO: 1234224 - protein, 9 aa, Homo Sapiens
CQAEAAPLT

SEQ ID NO: 1234225 - protein, 9 aa, Homo Sapiens
RSQCTSPQL

SEQ ID NO: 1234226 - protein, 9 aa, Homo Sapiens
LCFPNHLPQ

SEQ ID NO: 1234227 - protein, 9 aa, Homo Sapiens
IVLKYQELP

SEQ ID NO: 1234228 - protein, 9 aa, Homo Sapiens
QGITSSDFA

SEQ ID NO: 1234229 - protein, 9 aa, Homo Sapiens
PIYDIDELE

SEQ ID NO: 1234230 - protein, 9 aa, Homo Sapiens
LQILLVTHI

SEQ ID NO: 1234231 - protein, 9 aa, Homo Sapiens
QRSAQVDVG

SEQ ID NO: 1234232 - protein, 9 aa, Homo Sapiens
VTWDGKYLS

SEQ ID NO: 1234233 - protein, 9 aa, Homo Sapiens
MSPKHKYKS

SEQ ID NO: 1234234 - protein, 9 aa, Homo Sapiens
DVIVSGTEG

SEQ ID NO: 1234235 - protein, 9 aa, Homo Sapiens
VSMQHLPAT

SEQ ID NO: 1234236 - protein, 9 aa, Homo Sapiens
SFALTILLV

SEQ ID NO: 1234237 - protein, 9 aa, Homo Sapiens
FNEAHYPDI

SEQ ID NO: 1234238 - protein, 9 aa, Homo Sapiens
NLEQLAEST

SEQ ID NO: 1234239 - protein, 9 aa, Homo Sapiens
DEYFNDNSI

SEQ ID NO: 1234240 - protein, 9 aa, Homo Sapiens
AVKFHVLTE

SEQ ID NO: 1234241 - protein, 9 aa, Homo Sapiens
SPPQPTLAR

SEQ ID NO: 1234242 - protein, 9 aa, Homo Sapiens
VQQHQQMMH

SEQ ID NO: 1234243 - protein, 9 aa, Homo Sapiens
ALLRTMGIR

SEQ ID NO: 1234244 - protein, 9 aa, Homo Sapiens
NNNTMQQTE

SEQ ID NO: 1234245 - protein, 9 aa, Homo Sapiens
GACTCHTNC

SEQ ID NO: 1234246 - protein, 9 aa, Homo Sapiens
ALDGFLAAL

SEQ ID NO: 1234247 - protein, 9 aa, Homo Sapiens
DGMFAYIFH

SEQ ID NO: 1234248 - protein, 9 aa, Homo Sapiens
VSGTEGKLH

SEQ ID NO: 1234249 - protein, 9 aa, Homo Sapiens
NPCPSSSNE

SEQ ID NO: 1234250 - protein, 9 aa, Homo Sapiens
QAFPQADIS

SEQ ID NO: 1234251 - protein, 9 aa, Homo Sapiens
TQAEKDQRL

SEQ ID NO: 1234252 - protein, 9 aa, Homo Sapiens
AISSDSHLR

SEQ ID NO: 1234253 - protein, 9 aa, Homo Sapiens
IKHFLDYYD

SEQ ID NO: 1234254 - protein, 9 aa, Homo Sapiens
VDHIMMLKY

SEQ ID NO: 1234255 - protein, 9 aa, Homo Sapiens
ELMVWDIAY

SEQ ID NO: 1234256 - protein, 9 aa, Homo Sapiens
HKQDEEERE

SEQ ID NO: 1234257 - protein, 9 aa, Homo Sapiens
APAPGLTKC

SEQ ID NO: 1234258 - protein, 9 aa, Homo Sapiens
HMDSGKSTT

SEQ ID NO: 1234259 - protein, 9 aa, Homo Sapiens
VAAILGITI

SEQ ID NO: 1234260 - protein, 9 aa, Homo Sapiens
GGLCRALHS

SEQ ID NO: 1234261 - protein, 9 aa, Homo Sapiens
SMGLTLNSQ

SEQ ID NO: 1234262 - protein, 9 aa, Homo Sapiens
IQSAHIKME

SEQ ID NO: 1234263 - protein, 9 aa, Homo Sapiens
VQVDVKPVY

SEQ ID NO: 1234264 - protein, 9 aa, Homo Sapiens
DEDDVYNLA

SEQ ID NO: 1234265 - protein, 9 aa, Homo Sapiens
LWKRTLIPG

SEQ ID NO: 1234266 - protein, 9 aa, Homo Sapiens
PKTLLLDKS

SEQ ID NO: 1234267 - protein, 9 aa, Homo Sapiens
GAKQIERVY

SEQ ID NO: 1234268 - protein, 9 aa, Homo Sapiens
GLIFQAFSY

SEQ ID NO: 1234269 - protein, 9 aa, Homo Sapiens
RLTQLLLND

SEQ ID NO: 1234270 - protein, 9 aa, Homo Sapiens
ICLVEITLP

SEQ ID NO: 1234271 - protein, 9 aa, Homo Sapiens
DQMDHEQDR

SEQ ID NO: 1234272 - protein, 9 aa, Homo Sapiens
HIHTRTHMG

SEQ ID NO: 1234273 - protein, 9 aa, Homo Sapiens
LQHQRIHAG

SEQ ID NO: 1234274 - protein, 9 aa, Homo Sapiens
KSMYMSEAG

SEQ ID NO: 1234275 - protein, 9 aa, Homo Sapiens
ASIISFDIC

SEQ ID NO: 1234276 - protein, 9 aa, Homo Sapiens
IILFSRSLS

SEQ ID NO: 1234277 - protein, 9 aa, Homo Sapiens
YVQRGATWK

SEQ ID NO: 1234278 - protein, 9 aa, Homo Sapiens
CQGARCGGN

SEQ ID NO: 1234279 - protein, 9 aa, Homo Sapiens
ERTNFKSIH

SEQ ID NO: 1234280 - protein, 9 aa, Homo Sapiens
LRFFAPTIL

SEQ ID NO: 1234281 - protein, 9 aa, Homo Sapiens
FAPSYESRC

SEQ ID NO: 1234282 - protein, 9 aa, Homo Sapiens
SIDEPVFED

SEQ ID NO: 1234283 - protein, 9 aa, Homo Sapiens
NRVFVYCTF

SEQ ID NO: 1234284 - protein, 9 aa, Homo Sapiens
TVPVESDPR

SEQ ID NO: 1234285 - protein, 9 aa, Homo Sapiens
CSQQGLTEI

SEQ ID NO: 1234286 - protein, 9 aa, Homo Sapiens
YGAQGVLLI

SEQ ID NO: 1234287 - protein, 9 aa, Homo Sapiens
GHLLYPFND

SEQ ID NO: 1234288 - protein, 9 aa, Homo Sapiens
GGSNVGECD

SEQ ID NO: 1234289 - protein, 9 aa, Homo Sapiens
LKEFGEPWE

SEQ ID NO: 1234290 - protein, 9 aa, Homo Sapiens
RANPCPSSS

SEQ ID NO: 1234291 - protein, 9 aa, Homo Sapiens
HFEGLITII

SEQ ID NO: 1234292 - protein, 9 aa, Homo Sapiens
DVTHPCMRR

SEQ ID NO: 1234293 - protein, 9 aa, Homo Sapiens
VFMFNANIS

SEQ ID NO: 1234294 - protein, 9 aa, Homo Sapiens
LSYCSLEHL

SEQ ID NO: 1234295 - protein, 9 aa, Homo Sapiens
GMGSSGAAT

SEQ ID NO: 1234296 - protein, 9 aa, Homo Sapiens
QQATMALLD

SEQ ID NO: 1234297 - protein, 9 aa, Homo Sapiens
FRVFHLQNP

SEQ ID NO: 1234298 - protein, 9 aa, Homo Sapiens
FSDLQGPPG

SEQ ID NO: 1234299 - protein, 9 aa, Homo Sapiens
RERVDRLLK

SEQ ID NO: 1234300 - protein, 9 aa, Homo Sapiens
RLCPHPSKG

SEQ ID NO: 1234301 - protein, 9 aa, Homo Sapiens
LPAGVGTWS

SEQ ID NO: 1234302 - protein, 9 aa, Homo Sapiens
YIRGAAPTD

SEQ ID NO: 1234303 - protein, 9 aa, Homo Sapiens
LTGGDWFTS

SEQ ID NO: 1234304 - protein, 9 aa, Homo Sapiens
SGTSISSIS

SEQ ID NO: 1234305 - protein, 9 aa, Homo Sapiens
TKVFQPKRK

SEQ ID NO: 1234306 - protein, 9 aa, Homo Sapiens
CEIGLHCRT

SEQ ID NO: 1234307 - protein, 9 aa, Homo Sapiens
YSNDGFCKM

SEQ ID NO: 1234308 - protein, 9 aa, Homo Sapiens
TTPSIHRTP

SEQ ID NO: 1234309 - protein, 9 aa, Homo Sapiens
LVKASTPAL

SEQ ID NO: 1234310 - protein, 9 aa, Homo Sapiens
AGIKTLTQR

SEQ ID NO: 1234311 - protein, 9 aa, Homo Sapiens
GVAWTPPVG

SEQ ID NO: 1234312 - protein, 9 aa, Homo Sapiens
TAQSGVLTL

SEQ ID NO: 1234313 - protein, 9 aa, Homo Sapiens
QAMRMCAAR

SEQ ID NO: 1234314 - protein, 9 aa, Homo Sapiens
ESMGLTLNS

SEQ ID NO: 1234315 - protein, 9 aa, Homo Sapiens
LLPNHHHPY

SEQ ID NO: 1234316 - protein, 9 aa, Homo Sapiens
TDRGCEWPL

SEQ ID NO: 1234317 - protein, 9 aa, Homo Sapiens
TRPKQEKDF

SEQ ID NO: 1234318 - protein, 9 aa, Homo Sapiens
IAIQYKEAI

SEQ ID NO: 1234319 - protein, 9 aa, Homo Sapiens
PGSGITESN

SEQ ID NO: 1234320 - protein, 9 aa, Homo Sapiens
IGTAWGRLF

SEQ ID NO: 1234321 - protein, 9 aa, Homo Sapiens
SDNCDVCGS

SEQ ID NO: 1234322 - protein, 9 aa, Homo Sapiens
SMVFPGGGA

SEQ ID NO: 1234323 - protein, 9 aa, Homo Sapiens
RGLAGRPLP

SEQ ID NO: 1234324 - protein, 9 aa, Homo Sapiens
TPPQCLSPT

SEQ ID NO: 1234325 - protein, 9 aa, Homo Sapiens
CHVDPANDT

SEQ ID NO: 1234326 - protein, 9 aa, Homo Sapiens
IFYMLNTLT

SEQ ID NO: 1234327 - protein, 9 aa, Homo Sapiens
TCDPAAEEW

SEQ ID NO: 1234328 - protein, 9 aa, Homo Sapiens
YASTAKCLS

SEQ ID NO: 1234329 - protein, 9 aa, Homo Sapiens
RVGHMELRD

SEQ ID NO: 1234330 - protein, 9 aa, Homo Sapiens
QDIPASHSD

SEQ ID NO: 1234331 - protein, 9 aa, Homo Sapiens
TQLAKIRPQ

SEQ ID NO: 1234332 - protein, 9 aa, Homo Sapiens
QDFELNPIG

SEQ ID NO: 1234333 - protein, 9 aa, Homo Sapiens
CTLAWSVHP

SEQ ID NO: 1234334 - protein, 9 aa, Homo Sapiens
RGRWVMILK

SEQ ID NO: 1234335 - protein, 9 aa, Homo Sapiens
TTKEVIMLY

SEQ ID NO: 1234336 - protein, 9 aa, Homo Sapiens
TPDATASPP

SEQ ID NO: 1234337 - protein, 9 aa, Homo Sapiens
DFHDSWEKV

SEQ ID NO: 1234338 - protein, 9 aa, Homo Sapiens
WPCWFGAGG

SEQ ID NO: 1234339 - protein, 9 aa, Homo Sapiens
EECTNEPSQ

SEQ ID NO: 1234340 - protein, 9 aa, Homo Sapiens
WIRETLPSG

SEQ ID NO: 1234341 - protein, 9 aa, Homo Sapiens
IIQTVPTFM

SEQ ID NO: 1234342 - protein, 9 aa, Homo Sapiens
PSTMKIEII

SEQ ID NO: 1234343 - protein, 9 aa, Homo Sapiens
ANYLRVQIA

SEQ ID NO: 1234344 - protein, 9 aa, Homo Sapiens
QCRPPCPFA

SEQ ID NO: 1234345 - protein, 9 aa, Homo Sapiens
IFVSVLTLL

SEQ ID NO: 1234346 - protein, 9 aa, Homo Sapiens
SLQSCWHLL

SEQ ID NO: 1234347 - protein, 9 aa, Homo Sapiens
QSLSEYNRQ

SEQ ID NO: 1234348 - protein, 9 aa, Homo Sapiens
LGSRTQTSK

SEQ ID NO: 1234349 - protein, 9 aa, Homo Sapiens
WGWRPYEIH

SEQ ID NO: 1234350 - protein, 9 aa, Homo Sapiens
AQVFLVVFL

SEQ ID NO: 1234351 - protein, 9 aa, Homo Sapiens
DTRIDKIRM

SEQ ID NO: 1234352 - protein, 9 aa, Homo Sapiens
CQKLNFTGS

SEQ ID NO: 1234353 - protein, 9 aa, Homo Sapiens
HLPGYAPAM

SEQ ID NO: 1234354 - protein, 9 aa, Homo Sapiens
MDDPMYGMC

SEQ ID NO: 1234355 - protein, 9 aa, Homo Sapiens
HLNVNIKSS

SEQ ID NO: 1234356 - protein, 9 aa, Homo Sapiens
KKKCSSASV

SEQ ID NO: 1234357 - protein, 9 aa, Homo Sapiens
EPLRGAAAV

SEQ ID NO: 1234358 - protein, 9 aa, Homo Sapiens
ENQKKTLIG

SEQ ID NO: 1234359 - protein, 9 aa, Homo Sapiens
ETLVSMIFP

SEQ ID NO: 1234360 - protein, 9 aa, Homo Sapiens
TWQRLGKCN

SEQ ID NO: 1234361 - protein, 9 aa, Homo Sapiens
VRTRELESS

SEQ ID NO: 1234362 - protein, 9 aa, Homo Sapiens
TINMITPSY

SEQ ID NO: 1234363 - protein, 9 aa, Homo Sapiens
KTGRKVALK

SEQ ID NO: 1234364 - protein, 9 aa, Homo Sapiens
QAPQCVMAF

SEQ ID NO: 1234365 - protein, 9 aa, Homo Sapiens
EEYERWTGH

SEQ ID NO: 1234366 - protein, 9 aa, Homo Sapiens
SKSSSYSSS

SEQ ID NO: 1234367 - protein, 9 aa, Homo Sapiens
LEVLVQDKC

SEQ ID NO: 1234368 - protein, 9 aa, Homo Sapiens
VTSLRYSPT

SEQ ID NO: 1234369 - protein, 9 aa, Homo Sapiens
HVNFSHAIS

SEQ ID NO: 1234370 - protein, 9 aa, Homo Sapiens
FDIKVLNTQ

SEQ ID NO: 1234371 - protein, 9 aa, Homo Sapiens
EEDHAEVQS

SEQ ID NO: 1234372 - protein, 9 aa, Homo Sapiens
QRIVIARAL

SEQ ID NO: 1234373 - protein, 9 aa, Homo Sapiens
CLAQLGVPE

SEQ ID NO: 1234374 - protein, 9 aa, Homo Sapiens
SQDPKKPNR

SEQ ID NO: 1234375 - protein, 9 aa, Homo Sapiens
PCTIPSGAV

SEQ ID NO: 1234376 - protein, 9 aa, Homo Sapiens
LDEAQKLLY

SEQ ID NO: 1234377 - protein, 9 aa, Homo Sapiens
PRTTDGKEE

SEQ ID NO: 1234378 - protein, 9 aa, Homo Sapiens
GERTKIFKH

SEQ ID NO: 1234379 - protein, 9 aa, Homo Sapiens
GISSKAMCI

SEQ ID NO: 1234380 - protein, 9 aa, Homo Sapiens
INSLTILDD

SEQ ID NO: 1234381 - protein, 9 aa, Homo Sapiens
PWQPTRPFQ

SEQ ID NO: 1234382 - protein, 9 aa, Homo Sapiens
HAIDLRVEV

SEQ ID NO: 1234383 - protein, 9 aa, Homo Sapiens
HRIKELSSI

SEQ ID NO: 1234384 - protein, 9 aa, Homo Sapiens
HPAPTPRWK

SEQ ID NO: 1234385 - protein, 9 aa, Homo Sapiens
VWDNIYSIL

SEQ ID NO: 1234386 - protein, 9 aa, Homo Sapiens
SKSKVPHLH

SEQ ID NO: 1234387 - protein, 9 aa, Homo Sapiens
KNFYAVLKG

SEQ ID NO: 1234388 - protein, 9 aa, Homo Sapiens
HSDRPPQNF

SEQ ID NO: 1234389 - protein, 9 aa, Homo Sapiens
IAFTGDILM

SEQ ID NO: 1234390 - protein, 9 aa, Homo Sapiens
MMRELLYFL

SEQ ID NO: 1234391 - protein, 9 aa, Homo Sapiens
GSRSVLGTD

SEQ ID NO: 1234392 - protein, 9 aa, Homo Sapiens
LIGESTIHR

SEQ ID NO: 1234393 - protein, 9 aa, Homo Sapiens
EVTVYTFSI

SEQ ID NO: 1234394 - protein, 9 aa, Homo Sapiens
MFQKTRNGS

SEQ ID NO: 1234395 - protein, 9 aa, Homo Sapiens
LDCSIICVE

SEQ ID NO: 1234396 - protein, 9 aa, Homo Sapiens
PNHPDVLVL

SEQ ID NO: 1234397 - protein, 9 aa, Homo Sapiens
THDAISSAN

SEQ ID NO: 1234398 - protein, 9 aa, Homo Sapiens
KRCEEVDAT

SEQ ID NO: 1234399 - protein, 9 aa, Homo Sapiens
PRRLKHQPP

SEQ ID NO: 1234400 - protein, 9 aa, Homo Sapiens
LRWMRRKGQ

SEQ ID NO: 1234401 - protein, 9 aa, Homo Sapiens
CYAALSLLW

SEQ ID NO: 1234402 - protein, 9 aa, Homo Sapiens
RTVTSTRKR

SEQ ID NO: 1234403 - protein, 9 aa, Homo Sapiens
DVLAWMGVI

SEQ ID NO: 1234404 - protein, 9 aa, Homo Sapiens
PLPTIYKHQ

SEQ ID NO: 1234405 - protein, 9 aa, Homo Sapiens
QLLFYDTSA

SEQ ID NO: 1234406 - protein, 9 aa, Homo Sapiens
ITGQSIANT

SEQ ID NO: 1234407 - protein, 9 aa, Homo Sapiens
NYPNVGLTM

SEQ ID NO: 1234408 - protein, 9 aa, Homo Sapiens
PMVKNATVY

SEQ ID NO: 1234409 - protein, 9 aa, Homo Sapiens
HQWQKKLRE

SEQ ID NO: 1234410 - protein, 9 aa, Homo Sapiens
VIVNQPLVG

SEQ ID NO: 1234411 - protein, 9 aa, Homo Sapiens
ILPSNYGQG

SEQ ID NO: 1234412 - protein, 9 aa, Homo Sapiens
YGIRYEFVI

SEQ ID NO: 1234413 - protein, 9 aa, Homo Sapiens
KHSNTSILL

SEQ ID NO: 1234414 - protein, 9 aa, Homo Sapiens
EGLGGQRDL

SEQ ID NO: 1234415 - protein, 9 aa, Homo Sapiens
SAPFLILTF

SEQ ID NO: 1234416 - protein, 9 aa, Homo Sapiens
CSSNCTTVS

SEQ ID NO: 1234417 - protein, 9 aa, Homo Sapiens
DMDYASWGI

SEQ ID NO: 1234418 - protein, 9 aa, Homo Sapiens
AVRSSGFPN

SEQ ID NO: 1234419 - protein, 9 aa, Homo Sapiens
LKKSFDTGP

SEQ ID NO: 1234420 - protein, 9 aa, Homo Sapiens
VCLALIGCF

SEQ ID NO: 1234421 - protein, 9 aa, Homo Sapiens
KRWDLLTEP

SEQ ID NO: 1234422 - protein, 9 aa, Homo Sapiens
HMDTIYNRP

SEQ ID NO: 1234423 - protein, 9 aa, Homo Sapiens
IYGAVAKWI

SEQ ID NO: 1234424 - protein, 9 aa, Homo Sapiens
GPPGLHGPS

SEQ ID NO: 1234425 - protein, 9 aa, Homo Sapiens
FLSVYVAHL

SEQ ID NO: 1234426 - protein, 9 aa, Homo Sapiens
FGYGFNEPE

SEQ ID NO: 1234427 - protein, 9 aa, Homo Sapiens
MTPTVITVH

SEQ ID NO: 1234428 - protein, 9 aa, Homo Sapiens
EPGPSPFSS

SEQ ID NO: 1234429 - protein, 9 aa, Homo Sapiens
AVWVVVSYV

SEQ ID NO: 1234430 - protein, 9 aa, Homo Sapiens
YGAVAKWIT

SEQ ID NO: 1234431 - protein, 9 aa, Homo Sapiens
TLPQWKANP

SEQ ID NO: 1234432 - protein, 9 aa, Homo Sapiens
DGRSRGCGR

SEQ ID NO: 1234433 - protein, 9 aa, Homo Sapiens
GQIYAGLKS

SEQ ID NO: 1234434 - protein, 9 aa, Homo Sapiens
KDDLVDTNL

SEQ ID NO: 1234435 - protein, 9 aa, Homo Sapiens
FSQYFNIVT

SEQ ID NO: 1234436 - protein, 9 aa, Homo Sapiens
FIISNAMYK

SEQ ID NO: 1234437 - protein, 9 aa, Homo Sapiens
CGWRSPQRS

SEQ ID NO: 1234438 - protein, 9 aa, Homo Sapiens
MLLDGRIRL

SEQ ID NO: 1234439 - protein, 9 aa, Homo Sapiens
GKSRWRKED

SEQ ID NO: 1234440 - protein, 9 aa, Homo Sapiens
ENQQMTIQA

SEQ ID NO: 1234441 - protein, 9 aa, Homo Sapiens
VIRNIVCSG

SEQ ID NO: 1234442 - protein, 9 aa, Homo Sapiens
YALHVHKRV

SEQ ID NO: 1234443 - protein, 9 aa, Homo Sapiens
GLLTPPQIG

SEQ ID NO: 1234444 - protein, 9 aa, Homo Sapiens
TPAFAIFKF

SEQ ID NO: 1234445 - protein, 9 aa, Homo Sapiens
SCGGGGAHG

SEQ ID NO: 1234446 - protein, 9 aa, Homo Sapiens
TTVSVHPLN

SEQ ID NO: 1234447 - protein, 9 aa, Homo Sapiens
AIVNAVGNH

SEQ ID NO: 1234448 - protein, 9 aa, Homo Sapiens
RCGLDSEGA

SEQ ID NO: 1234449 - protein, 9 aa, Homo Sapiens
PSSCTAVVY

SEQ ID NO: 1234450 - protein, 9 aa, Homo Sapiens
RAPPARGTS

SEQ ID NO: 1234451 - protein, 9 aa, Homo Sapiens
YLESDEVAW

SEQ ID NO: 1234452 - protein, 9 aa, Homo Sapiens
PMEVLKTWL

SEQ ID NO: 1234453 - protein, 9 aa, Homo Sapiens
IFLLVGIII

SEQ ID NO: 1234454 - protein, 9 aa, Homo Sapiens
MDSGKSTTT

SEQ ID NO: 1234455 - protein, 9 aa, Homo Sapiens
APGLAALAK

SEQ ID NO: 1234456 - protein, 9 aa, Homo Sapiens
LTLDHYPMS

SEQ ID NO: 1234457 - protein, 9 aa, Homo Sapiens
GNVGHQYVK

SEQ ID NO: 1234458 - protein, 9 aa, Homo Sapiens
PEMATLPLQ

SEQ ID NO: 1234459 - protein, 9 aa, Homo Sapiens
AHKDAIVLT

SEQ ID NO: 1234460 - protein, 9 aa, Homo Sapiens
EKRKQDAED

SEQ ID NO: 1234461 - protein, 9 aa, Homo Sapiens
PRANIRRMC

SEQ ID NO: 1234462 - protein, 9 aa, Homo Sapiens
TGYRPAGHE

SEQ ID NO: 1234463 - protein, 9 aa, Homo Sapiens
ERQAALGPS

SEQ ID NO: 1234464 - protein, 9 aa, Homo Sapiens
SKRKRELHQ

SEQ ID NO: 1234465 - protein, 9 aa, Homo Sapiens
MVMEYVHGG

SEQ ID NO: 1234466 - protein, 9 aa, Homo Sapiens
HLLQDPART

SEQ ID NO: 1234467 - protein, 9 aa, Homo Sapiens
REFTASFLL

SEQ ID NO: 1234468 - protein, 9 aa, Homo Sapiens
DGREVLGGV

SEQ ID NO: 1234469 - protein, 9 aa, Homo Sapiens
PCGSMSFTT

SEQ ID NO: 1234470 - protein, 9 aa, Homo Sapiens
KNSRKALKA

SEQ ID NO: 1234471 - protein, 9 aa, Homo Sapiens
TLRFLALAN

SEQ ID NO: 1234472 - protein, 9 aa, Homo Sapiens
YYSYMGHFD

SEQ ID NO: 1234473 - protein, 9 aa, Homo Sapiens
FQTAQLLTL

SEQ ID NO: 1234474 - protein, 9 aa, Homo Sapiens
NCDRDNLEY

SEQ ID NO: 1234475 - protein, 9 aa, Homo Sapiens
TGSNHSSAR

SEQ ID NO: 1234476 - protein, 9 aa, Homo Sapiens
PVQVGKEQH

SEQ ID NO: 1234477 - protein, 9 aa, Homo Sapiens
ELVMQEEIF

SEQ ID NO: 1234478 - protein, 9 aa, Homo Sapiens
MWCLFIGIG

SEQ ID NO: 1234479 - protein, 9 aa, Homo Sapiens
QELQEIRRE

SEQ ID NO: 1234480 - protein, 9 aa, Homo Sapiens
AKKERESRM

SEQ ID NO: 1234481 - protein, 9 aa, Homo Sapiens
TPNTVEQRQ

SEQ ID NO: 1234482 - protein, 9 aa, Homo Sapiens
LNEHQVEAD

SEQ ID NO: 1234483 - protein, 9 aa, Homo Sapiens
NKISKIEID

SEQ ID NO: 1234484 - protein, 9 aa, Homo Sapiens
PCCRWEALA

SEQ ID NO: 1234485 - protein, 9 aa, Homo Sapiens
YVNITKQDI

SEQ ID NO: 1234486 - protein, 9 aa, Homo Sapiens
ENTDTSRQI

SEQ ID NO: 1234487 - protein, 9 aa, Homo Sapiens
LLYPFNDPY

SEQ ID NO: 1234488 - protein, 9 aa, Homo Sapiens
QLTSTQGPH

SEQ ID NO: 1234489 - protein, 9 aa, Homo Sapiens
FCPKCVNKK

SEQ ID NO: 1234490 - protein, 9 aa, Homo Sapiens
RYTIPPRMT

SEQ ID NO: 1234491 - protein, 9 aa, Homo Sapiens
SRTHSEPLP

SEQ ID NO: 1234492 - protein, 9 aa, Homo Sapiens
YIEIEKGET

SEQ ID NO: 1234493 - protein, 9 aa, Homo Sapiens
SGGSDGGSM

SEQ ID NO: 1234494 - protein, 9 aa, Homo Sapiens
HTVWLGCPE

SEQ ID NO: 1234495 - protein, 9 aa, Homo Sapiens
FQELRLEEA

SEQ ID NO: 1234496 - protein, 9 aa, Homo Sapiens
QVSGLARAH

SEQ ID NO: 1234497 - protein, 9 aa, Homo Sapiens
SQHPHTTSC

SEQ ID NO: 1234498 - protein, 9 aa, Homo Sapiens
KPNNAHYFI

SEQ ID NO: 1234499 - protein, 9 aa, Homo Sapiens
IPESEDKYR

SEQ ID NO: 1234500 - protein, 9 aa, Homo Sapiens
QQALRYLHS

SEQ ID NO: 1234501 - protein, 9 aa, Homo Sapiens
TKIQVHLTA

SEQ ID NO: 1234502 - protein, 9 aa, Homo Sapiens
IQDENDNNP

SEQ ID NO: 1234503 - protein, 9 aa, Homo Sapiens
ALYLLFTGA

SEQ ID NO: 1234504 - protein, 9 aa, Homo Sapiens
LPSQHKMLP

SEQ ID NO: 1234505 - protein, 9 aa, Homo Sapiens
NLSKEELIS

SEQ ID NO: 1234506 - protein, 9 aa, Homo Sapiens
VPEGSKHGT

SEQ ID NO: 1234507 - protein, 9 aa, Homo Sapiens
MHQSAMYEI

SEQ ID NO: 1234508 - protein, 9 aa, Homo Sapiens
SKGDVGPAG

SEQ ID NO: 1234509 - protein, 9 aa, Homo Sapiens
ISHQDFANM

SEQ ID NO: 1234510 - protein, 9 aa, Homo Sapiens
ILHFNIFDS

SEQ ID NO: 1234511 - protein, 9 aa, Homo Sapiens
EHLKFIPEG

SEQ ID NO: 1234512 - protein, 9 aa, Homo Sapiens
IQAIPFDDP

SEQ ID NO: 1234513 - protein, 9 aa, Homo Sapiens
INDCPHVFA

SEQ ID NO: 1234514 - protein, 9 aa, Homo Sapiens
VIKGQGVEI

SEQ ID NO: 1234515 - protein, 9 aa, Homo Sapiens
LMYLLKTED

SEQ ID NO: 1234516 - protein, 9 aa, Homo Sapiens
KPQCGEASW

SEQ ID NO: 1234517 - protein, 9 aa, Homo Sapiens
LGLMITCMY

SEQ ID NO: 1234518 - protein, 9 aa, Homo Sapiens
VGSPFARTS

SEQ ID NO: 1234519 - protein, 9 aa, Homo Sapiens
NEEEDAVPE

SEQ ID NO: 1234520 - protein, 9 aa, Homo Sapiens
IDITYFQAK

SEQ ID NO: 1234521 - protein, 9 aa, Homo Sapiens
HKSMENTAP

SEQ ID NO: 1234522 - protein, 9 aa, Homo Sapiens
GLEAYSLGL

SEQ ID NO: 1234523 - protein, 9 aa, Homo Sapiens
YANLFIHIS

SEQ ID NO: 1234524 - protein, 9 aa, Homo Sapiens
RNIYKSMLE

SEQ ID NO: 1234525 - protein, 9 aa, Homo Sapiens
SAAAAATAA

SEQ ID NO: 1234526 - protein, 9 aa, Homo Sapiens
MSSETTKFY

SEQ ID NO: 1234527 - protein, 9 aa, Homo Sapiens
VLVLSVETD

SEQ ID NO: 1234528 - protein, 9 aa, Homo Sapiens
KHQQVHTGE

SEQ ID NO: 1234529 - protein, 9 aa, Homo Sapiens
SEEGQEYED

SEQ ID NO: 1234530 - protein, 9 aa, Homo Sapiens
GLFYYHLLL

SEQ ID NO: 1234531 - protein, 9 aa, Homo Sapiens
SYQEAKYKL

SEQ ID NO: 1234532 - protein, 9 aa, Homo Sapiens
TLECGDQTR

SEQ ID NO: 1234533 - protein, 9 aa, Homo Sapiens
GSYQEKVDI

SEQ ID NO: 1234534 - protein, 9 aa, Homo Sapiens
TSQDERNIP

SEQ ID NO: 1234535 - protein, 9 aa, Homo Sapiens
VITGQKVGT

SEQ ID NO: 1234536 - protein, 9 aa, Homo Sapiens
PDATASPPT

SEQ ID NO: 1234537 - protein, 9 aa, Homo Sapiens
EGKAHEIPV

SEQ ID NO: 1234538 - protein, 9 aa, Homo Sapiens
KTMNWAENG

SEQ ID NO: 1234539 - protein, 9 aa, Homo Sapiens
TGTEHLAPA

SEQ ID NO: 1234540 - protein, 9 aa, Homo Sapiens
TMPIYCLFG

SEQ ID NO: 1234541 - protein, 9 aa, Homo Sapiens
LSHHIHVLK

SEQ ID NO: 1234542 - protein, 9 aa, Homo Sapiens
CKMVLMATV

SEQ ID NO: 1234543 - protein, 9 aa, Homo Sapiens
YVTIMGKLR

SEQ ID NO: 1234544 - protein, 9 aa, Homo Sapiens
LRERVTQDL

SEQ ID NO: 1234545 - protein, 9 aa, Homo Sapiens
CLVPEGLPL

SEQ ID NO: 1234546 - protein, 9 aa, Homo Sapiens
GKNNVPMLK

SEQ ID NO: 1234547 - protein, 9 aa, Homo Sapiens
NQPVKMAPN

SEQ ID NO: 1234548 - protein, 9 aa, Homo Sapiens
ALHFFREHA

SEQ ID NO: 1234549 - protein, 9 aa, Homo Sapiens
IKVKRKNLN

SEQ ID NO: 1234550 - protein, 9 aa, Homo Sapiens
HGNVLVRYS

SEQ ID NO: 1234551 - protein, 9 aa, Homo Sapiens
DAEPRSLFP

SEQ ID NO: 1234552 - protein, 9 aa, Homo Sapiens
FNLHLDQMP

SEQ ID NO: 1234553 - protein, 9 aa, Homo Sapiens
KKMDIFEFQ

SEQ ID NO: 1234554 - protein, 9 aa, Homo Sapiens
HCRSLGLLF

SEQ ID NO: 1234555 - protein, 9 aa, Homo Sapiens
LIRTYQVCQ

SEQ ID NO: 1234556 - protein, 9 aa, Homo Sapiens
EGVATALLL

SEQ ID NO: 1234557 - protein, 9 aa, Homo Sapiens
VLPEHVPQE

SEQ ID NO: 1234558 - protein, 9 aa, Homo Sapiens
ILFYDQILC

SEQ ID NO: 1234559 - protein, 9 aa, Homo Sapiens
RQQSGIGHA

SEQ ID NO: 1234560 - protein, 9 aa, Homo Sapiens
NSSMPIFFE

SEQ ID NO: 1234561 - protein, 9 aa, Homo Sapiens
KAKVIREGQ

SEQ ID NO: 1234562 - protein, 9 aa, Homo Sapiens
PPAKKPEPN

SEQ ID NO: 1234563 - protein, 9 aa, Homo Sapiens
ASLQSLEFQ

SEQ ID NO: 1234564 - protein, 9 aa, Homo Sapiens
EIIAPPERK

SEQ ID NO: 1234565 - protein, 9 aa, Homo Sapiens
VCLPAHSHF

SEQ ID NO: 1234566 - protein, 9 aa, Homo Sapiens
ELVNKLMEH

SEQ ID NO: 1234567 - protein, 9 aa, Homo Sapiens
QQLIVSQGP

SEQ ID NO: 1234568 - protein, 9 aa, Homo Sapiens
SNMYGSFWS

SEQ ID NO: 1234569 - protein, 9 aa, Homo Sapiens
ETATRRPCQ

SEQ ID NO: 1234570 - protein, 9 aa, Homo Sapiens
RPSCHGVMG

SEQ ID NO: 1234571 - protein, 9 aa, Homo Sapiens
RRVNTSWRV

SEQ ID NO: 1234572 - protein, 9 aa, Homo Sapiens
VDICPLFQT

SEQ ID NO: 1234573 - protein, 9 aa, Homo Sapiens
AAGDSACQD

SEQ ID NO: 1234574 - protein, 9 aa, Homo Sapiens
LTRVVYASA

SEQ ID NO: 1234575 - protein, 9 aa, Homo Sapiens
DQILYQTEQ

SEQ ID NO: 1234576 - protein, 9 aa, Homo Sapiens
SVNEMHVSF

SEQ ID NO: 1234577 - protein, 9 aa, Homo Sapiens
VTEEQVQST

SEQ ID NO: 1234578 - protein, 9 aa, Homo Sapiens
GYPGPSGDV

SEQ ID NO: 1234579 - protein, 9 aa, Homo Sapiens
AFIFHCKRD

SEQ ID NO: 1234580 - protein, 9 aa, Homo Sapiens
LQHPPPGFT

SEQ ID NO: 1234581 - protein, 9 aa, Homo Sapiens
VDWVKSQTI

SEQ ID NO: 1234582 - protein, 9 aa, Homo Sapiens
PRPTYSCFS

SEQ ID NO: 1234583 - protein, 9 aa, Homo Sapiens
MPRPVSLSL

SEQ ID NO: 1234584 - protein, 9 aa, Homo Sapiens
CLTHPMPTL

SEQ ID NO: 1234585 - protein, 9 aa, Homo Sapiens
REAAAKHSK

SEQ ID NO: 1234586 - protein, 9 aa, Homo Sapiens
EGDAVYRVF

SEQ ID NO: 1234587 - protein, 9 aa, Homo Sapiens
GPRHVQNGL

SEQ ID NO: 1234588 - protein, 9 aa, Homo Sapiens
FGAATKVMC

SEQ ID NO: 1234589 - protein, 9 aa, Homo Sapiens
NLVSEGMLT

SEQ ID NO: 1234590 - protein, 9 aa, Homo Sapiens
DQLKQGFEF

SEQ ID NO: 1234591 - protein, 9 aa, Homo Sapiens
IVANYELIC

SEQ ID NO: 1234592 - protein, 9 aa, Homo Sapiens
VQVRVPYHV

SEQ ID NO: 1234593 - protein, 9 aa, Homo Sapiens
FLGLMEKEQ

SEQ ID NO: 1234594 - protein, 9 aa, Homo Sapiens
HVARRFLEK

SEQ ID NO: 1234595 - protein, 9 aa, Homo Sapiens
LKTKAVCMI

SEQ ID NO: 1234596 - protein, 9 aa, Homo Sapiens
DFELNPIGV

SEQ ID NO: 1234597 - protein, 9 aa, Homo Sapiens
VSLLTESNL

SEQ ID NO: 1234598 - protein, 9 aa, Homo Sapiens
VNMDAWSRE

SEQ ID NO: 1234599 - protein, 9 aa, Homo Sapiens
AIVFMGAKG

SEQ ID NO: 1234600 - protein, 9 aa, Homo Sapiens
YRANLKKHM

SEQ ID NO: 1234601 - protein, 9 aa, Homo Sapiens
KDISFLKSC

SEQ ID NO: 1234602 - protein, 9 aa, Homo Sapiens
GLMEKEQKT

SEQ ID NO: 1234603 - protein, 9 aa, Homo Sapiens
NALFETLIQ

SEQ ID NO: 1234604 - protein, 9 aa, Homo Sapiens
SGVVQIIFY

SEQ ID NO: 1234605 - protein, 9 aa, Homo Sapiens
QVLDRFYWN

SEQ ID NO: 1234606 - protein, 9 aa, Homo Sapiens
AFSEDGHKL

SEQ ID NO: 1234607 - protein, 9 aa, Homo Sapiens
QSMKSERAD

SEQ ID NO: 1234608 - protein, 9 aa, Homo Sapiens
ATKLSPDSL

SEQ ID NO: 1234609 - protein, 9 aa, Homo Sapiens
TMLNPLIYT

SEQ ID NO: 1234610 - protein, 9 aa, Homo Sapiens
ECLVDVICE

SEQ ID NO: 1234611 - protein, 9 aa, Homo Sapiens
RHLHSPMYY

SEQ ID NO: 1234612 - protein, 9 aa, Homo Sapiens
HEDISRLRR

SEQ ID NO: 1234613 - protein, 9 aa, Homo Sapiens
YTGSLQYVH

SEQ ID NO: 1234614 - protein, 9 aa, Homo Sapiens
YLQHAAQEV

SEQ ID NO: 1234615 - protein, 9 aa, Homo Sapiens
EPGYLVIKV

SEQ ID NO: 1234616 - protein, 9 aa, Homo Sapiens
GVKSVTKST

SEQ ID NO: 1234617 - protein, 9 aa, Homo Sapiens
TTETLGVSG

SEQ ID NO: 1234618 - protein, 9 aa, Homo Sapiens
ELNKIYYLL

SEQ ID NO: 1234619 - protein, 9 aa, Homo Sapiens
LPKYIFDLP

SEQ ID NO: 1234620 - protein, 9 aa, Homo Sapiens
FGLHTIALT

SEQ ID NO: 1234621 - protein, 9 aa, Homo Sapiens
WLGTPTERT

SEQ ID NO: 1234622 - protein, 9 aa, Homo Sapiens
VGTTSDILT

SEQ ID NO: 1234623 - protein, 9 aa, Homo Sapiens
GSGADTGDI

SEQ ID NO: 1234624 - protein, 9 aa, Homo Sapiens
LNHGMSLTI

SEQ ID NO: 1234625 - protein, 9 aa, Homo Sapiens
SLGSMFQNV

SEQ ID NO: 1234626 - protein, 9 aa, Homo Sapiens
KTAQLKSLS

SEQ ID NO: 1234627 - protein, 9 aa, Homo Sapiens
QIGKKQSSG

SEQ ID NO: 1234628 - protein, 9 aa, Homo Sapiens
LSDEQDMPQ

SEQ ID NO: 1234629 - protein, 9 aa, Homo Sapiens
ITVHELNLE

SEQ ID NO: 1234630 - protein, 9 aa, Homo Sapiens
ANDQQHIHV

SEQ ID NO: 1234631 - protein, 9 aa, Homo Sapiens
EARIILEPD

SEQ ID NO: 1234632 - protein, 9 aa, Homo Sapiens
IKRNTTIPA

SEQ ID NO: 1234633 - protein, 9 aa, Homo Sapiens
NSNTALHYS

SEQ ID NO: 1234634 - protein, 9 aa, Homo Sapiens
SEANFLGSG

SEQ ID NO: 1234635 - protein, 9 aa, Homo Sapiens
RQTMWWAFE

SEQ ID NO: 1234636 - protein, 9 aa, Homo Sapiens
QADVVQVLK

SEQ ID NO: 1234637 - protein, 9 aa, Homo Sapiens
GSTPYISVP

SEQ ID NO: 1234638 - protein, 9 aa, Homo Sapiens
VVPMQLRRD

SEQ ID NO: 1234639 - protein, 9 aa, Homo Sapiens
EKCLSSANG

SEQ ID NO: 1234640 - protein, 9 aa, Homo Sapiens
LVGRSFYQF

SEQ ID NO: 1234641 - protein, 9 aa, Homo Sapiens
ARRRQAEDD

SEQ ID NO: 1234642 - protein, 9 aa, Homo Sapiens
PPSPPKPPT

SEQ ID NO: 1234643 - protein, 9 aa, Homo Sapiens
RTVVMTVTL

SEQ ID NO: 1234644 - protein, 9 aa, Homo Sapiens
QYTQISQPL

SEQ ID NO: 1234645 - protein, 9 aa, Homo Sapiens
FGATRIFEM

SEQ ID NO: 1234646 - protein, 9 aa, Homo Sapiens
KKEKLHCLC

SEQ ID NO: 1234647 - protein, 9 aa, Homo Sapiens
ELRVRKHGG

SEQ ID NO: 1234648 - protein, 9 aa, Homo Sapiens
FLEFEGDTH

SEQ ID NO: 1234649 - protein, 9 aa, Homo Sapiens
THRYTHRHT

SEQ ID NO: 1234650 - protein, 9 aa, Homo Sapiens
KSNKHHMIM

SEQ ID NO: 1234651 - protein, 9 aa, Homo Sapiens
IYTIDGFKK

SEQ ID NO: 1234652 - protein, 9 aa, Homo Sapiens
GVKLGVHIS

SEQ ID NO: 1234653 - protein, 9 aa, Homo Sapiens
WFKANRVYT

SEQ ID NO: 1234654 - protein, 9 aa, Homo Sapiens
CGRGNQARY

SEQ ID NO: 1234655 - protein, 9 aa, Homo Sapiens
TKAVTEMSG

SEQ ID NO: 1234656 - protein, 9 aa, Homo Sapiens
VVNRIGHSQ

SEQ ID NO: 1234657 - protein, 9 aa, Homo Sapiens
YQSTLRHLN

SEQ ID NO: 1234658 - protein, 9 aa, Homo Sapiens
FALRANTDP

SEQ ID NO: 1234659 - protein, 9 aa, Homo Sapiens
RCVLVNASL

SEQ ID NO: 1234660 - protein, 9 aa, Homo Sapiens
NFNEMNSRR

SEQ ID NO: 1234661 - protein, 9 aa, Homo Sapiens
RIVGCIWWF

SEQ ID NO: 1234662 - protein, 9 aa, Homo Sapiens
PKDALFREY

SEQ ID NO: 1234663 - protein, 9 aa, Homo Sapiens
SEKKNPGAL

SEQ ID NO: 1234664 - protein, 9 aa, Homo Sapiens
SVAERLHRN

SEQ ID NO: 1234665 - protein, 9 aa, Homo Sapiens
VIIVGNLKA

SEQ ID NO: 1234666 - protein, 9 aa, Homo Sapiens
AGMIVRCVI

SEQ ID NO: 1234667 - protein, 9 aa, Homo Sapiens
LSNMQCQPQ

SEQ ID NO: 1234668 - protein, 9 aa, Homo Sapiens
QTNWTTPSP

SEQ ID NO: 1234669 - protein, 9 aa, Homo Sapiens
VSRTRCGGH

SEQ ID NO: 1234670 - protein, 9 aa, Homo Sapiens
APTEHVERF

SEQ ID NO: 1234671 - protein, 9 aa, Homo Sapiens
IKWLEELQL

SEQ ID NO: 1234672 - protein, 9 aa, Homo Sapiens
ICAYGPIIT

SEQ ID NO: 1234673 - protein, 9 aa, Homo Sapiens
TTSCRHFHL

SEQ ID NO: 1234674 - protein, 9 aa, Homo Sapiens
PAATTPSTT

SEQ ID NO: 1234675 - protein, 9 aa, Homo Sapiens
SQSSPLTTH

SEQ ID NO: 1234676 - protein, 9 aa, Homo Sapiens
ILFDFAADF

SEQ ID NO: 1234677 - protein, 9 aa, Homo Sapiens
QELPLYIPH

SEQ ID NO: 1234678 - protein, 9 aa, Homo Sapiens
LTYTGTHRH

SEQ ID NO: 1234679 - protein, 9 aa, Homo Sapiens
NYSLNYENN

SEQ ID NO: 1234680 - protein, 9 aa, Homo Sapiens
EKTAGARRS

SEQ ID NO: 1234681 - protein, 9 aa, Homo Sapiens
RGTPYAGRF

SEQ ID NO: 1234682 - protein, 9 aa, Homo Sapiens
YTFSITSFD

SEQ ID NO: 1234683 - protein, 9 aa, Homo Sapiens
SNLQCEATV

SEQ ID NO: 1234684 - protein, 9 aa, Homo Sapiens
ADHSLLLYE

SEQ ID NO: 1234685 - protein, 9 aa, Homo Sapiens
LTNKVPEKP

SEQ ID NO: 1234686 - protein, 9 aa, Homo Sapiens
RPRWRDYKR

SEQ ID NO: 1234687 - protein, 9 aa, Homo Sapiens
TPRLQTTVG

SEQ ID NO: 1234688 - protein, 9 aa, Homo Sapiens
LTFAISAIT

SEQ ID NO: 1234689 - protein, 9 aa, Homo Sapiens
LHQQSENQA

SEQ ID NO: 1234690 - protein, 9 aa, Homo Sapiens
TTTKRFEKL

SEQ ID NO: 1234691 - protein, 9 aa, Homo Sapiens
SSNVLQMFL

SEQ ID NO: 1234692 - protein, 9 aa, Homo Sapiens
EVLLQGYDK

SEQ ID NO: 1234693 - protein, 9 aa, Homo Sapiens
LYFFCATLI

SEQ ID NO: 1234694 - protein, 9 aa, Homo Sapiens
VSHGAIPVS

SEQ ID NO: 1234695 - protein, 9 aa, Homo Sapiens
PNNAHYFIG

SEQ ID NO: 1234696 - protein, 9 aa, Homo Sapiens
SCHFRGRSA

SEQ ID NO: 1234697 - protein, 9 aa, Homo Sapiens
GAHDGHPSS

SEQ ID NO: 1234698 - protein, 9 aa, Homo Sapiens
SLVLYGTSM

SEQ ID NO: 1234699 - protein, 9 aa, Homo Sapiens
VVTEEQVQS

SEQ ID NO: 1234700 - protein, 9 aa, Homo Sapiens
LRGGQAFQK

SEQ ID NO: 1234701 - protein, 9 aa, Homo Sapiens
LQFPLTCTN

SEQ ID NO: 1234702 - protein, 9 aa, Homo Sapiens
VNTPEVIQV

SEQ ID NO: 1234703 - protein, 9 aa, Homo Sapiens
KPEYISDTT

SEQ ID NO: 1234704 - protein, 9 aa, Homo Sapiens
PNKHIRFNV

SEQ ID NO: 1234705 - protein, 9 aa, Homo Sapiens
GIGLSIVGK

SEQ ID NO: 1234706 - protein, 9 aa, Homo Sapiens
EKTFTWLAL

SEQ ID NO: 1234707 - protein, 9 aa, Homo Sapiens
DDGMAVATS

SEQ ID NO: 1234708 - protein, 9 aa, Homo Sapiens
PDTMLQTAG

SEQ ID NO: 1234709 - protein, 9 aa, Homo Sapiens
TKKLPHKTH

SEQ ID NO: 1234710 - protein, 9 aa, Homo Sapiens
DNPGSLHNF

SEQ ID NO: 1234711 - protein, 9 aa, Homo Sapiens
AHRDWAVFH

SEQ ID NO: 1234712 - protein, 9 aa, Homo Sapiens
SSLWNLMGD

SEQ ID NO: 1234713 - protein, 9 aa, Homo Sapiens
DGRSHRGGG

SEQ ID NO: 1234714 - protein, 9 aa, Homo Sapiens
SGVYPVHMQ

SEQ ID NO: 1234715 - protein, 9 aa, Homo Sapiens
AGRKKFFST

SEQ ID NO: 1234716 - protein, 9 aa, Homo Sapiens
TPPSGNGSQ

SEQ ID NO: 1234717 - protein, 9 aa, Homo Sapiens
PCHPMTNNA

SEQ ID NO: 1234718 - protein, 9 aa, Homo Sapiens
ICARVRDAD

SEQ ID NO: 1234719 - protein, 9 aa, Homo Sapiens
ACPFTITHR

SEQ ID NO: 1234720 - protein, 9 aa, Homo Sapiens
ARSGLKRSS

SEQ ID NO: 1234721 - protein, 9 aa, Homo Sapiens
QRKFVGDVK

SEQ ID NO: 1234722 - protein, 9 aa, Homo Sapiens
EEQVMLDSL

SEQ ID NO: 1234723 - protein, 9 aa, Homo Sapiens
SDSILAEKM

SEQ ID NO: 1234724 - protein, 9 aa, Homo Sapiens
SLDDLRDCI

SEQ ID NO: 1234725 - protein, 9 aa, Homo Sapiens
ALLGDLIQD

SEQ ID NO: 1234726 - protein, 9 aa, Homo Sapiens
LRRSGAPAS

SEQ ID NO: 1234727 - protein, 9 aa, Homo Sapiens
NFVTDFCGQ

SEQ ID NO: 1234728 - protein, 9 aa, Homo Sapiens
GVVMHYGNL

SEQ ID NO: 1234729 - protein, 9 aa, Homo Sapiens
NEVQKASAT

SEQ ID NO: 1234730 - protein, 9 aa, Homo Sapiens
FVKSWIPDV

SEQ ID NO: 1234731 - protein, 9 aa, Homo Sapiens
GMRCKSLLT

SEQ ID NO: 1234732 - protein, 9 aa, Homo Sapiens
PNHRHRSRI

SEQ ID NO: 1234733 - protein, 9 aa, Homo Sapiens
SGMYVCIAN

SEQ ID NO: 1234734 - protein, 9 aa, Homo Sapiens
SQALSGRLW

SEQ ID NO: 1234735 - protein, 9 aa, Homo Sapiens
QYMSVNQAA

SEQ ID NO: 1234736 - protein, 9 aa, Homo Sapiens
SAHLIAIIC

SEQ ID NO: 1234737 - protein, 9 aa, Homo Sapiens
HAAVTAAAA

SEQ ID NO: 1234738 - protein, 9 aa, Homo Sapiens
VAPRCPRSA

SEQ ID NO: 1234739 - protein, 9 aa, Homo Sapiens
YELIDQDDR

SEQ ID NO: 1234740 - protein, 9 aa, Homo Sapiens
HYKKVGECL

SEQ ID NO: 1234741 - protein, 9 aa, Homo Sapiens
ERKTMIEKL

SEQ ID NO: 1234742 - protein, 9 aa, Homo Sapiens
GSRTSAGIS

SEQ ID NO: 1234743 - protein, 9 aa, Homo Sapiens
FEFHTTTTT

SEQ ID NO: 1234744 - protein, 9 aa, Homo Sapiens
SPQNFTSVY

SEQ ID NO: 1234745 - protein, 9 aa, Homo Sapiens
RSDPYVKAC

SEQ ID NO: 1234746 - protein, 9 aa, Homo Sapiens
APAFWNRAT

SEQ ID NO: 1234747 - protein, 9 aa, Homo Sapiens
RKTVLFLPT

SEQ ID NO: 1234748 - protein, 9 aa, Homo Sapiens
HTYVLHILT

SEQ ID NO: 1234749 - protein, 9 aa, Homo Sapiens
ALGTVEEVC

SEQ ID NO: 1234750 - protein, 9 aa, Homo Sapiens
LKILEGGNG

SEQ ID NO: 1234751 - protein, 9 aa, Homo Sapiens
ICSLEELPS

SEQ ID NO: 1234752 - protein, 9 aa, Homo Sapiens
ALLHVLRGR

SEQ ID NO: 1234753 - protein, 9 aa, Homo Sapiens
TVNIAGLLS

SEQ ID NO: 1234754 - protein, 9 aa, Homo Sapiens
TAGCFVGVV

SEQ ID NO: 1234755 - protein, 9 aa, Homo Sapiens
KANRVYTLV

SEQ ID NO: 1234756 - protein, 9 aa, Homo Sapiens
FSVTYIEHP

SEQ ID NO: 1234757 - protein, 9 aa, Homo Sapiens
THTGEKLFI

SEQ ID NO: 1234758 - protein, 9 aa, Homo Sapiens
LVKRRFATS

SEQ ID NO: 1234759 - protein, 9 aa, Homo Sapiens
CLFFLIMFL

SEQ ID NO: 1234760 - protein, 9 aa, Homo Sapiens
YDLIGLNGI

SEQ ID NO: 1234761 - protein, 9 aa, Homo Sapiens
PSNKTVEKE

SEQ ID NO: 1234762 - protein, 9 aa, Homo Sapiens
CRSPPSSST

SEQ ID NO: 1234763 - protein, 9 aa, Homo Sapiens
IQKIFYMLN

SEQ ID NO: 1234764 - protein, 9 aa, Homo Sapiens
YHFCDVKDE

SEQ ID NO: 1234765 - protein, 9 aa, Homo Sapiens
LQHAAQEVL

SEQ ID NO: 1234766 - protein, 9 aa, Homo Sapiens
EGKAFLPER

SEQ ID NO: 1234767 - protein, 9 aa, Homo Sapiens
NYHTLYRYF

SEQ ID NO: 1234768 - protein, 9 aa, Homo Sapiens
LGPNTVLAF

SEQ ID NO: 1234769 - protein, 9 aa, Homo Sapiens
LYTVLAMIS

SEQ ID NO: 1234770 - protein, 9 aa, Homo Sapiens
LIHVIHHCL

SEQ ID NO: 1234771 - protein, 9 aa, Homo Sapiens
KFSVQVEKW

SEQ ID NO: 1234772 - protein, 9 aa, Homo Sapiens
VPMPQMCSP

SEQ ID NO: 1234773 - protein, 9 aa, Homo Sapiens
DHIMMLKYF

SEQ ID NO: 1234774 - protein, 9 aa, Homo Sapiens
VFYYIQRFQ

SEQ ID NO: 1234775 - protein, 9 aa, Homo Sapiens
VAGIPLLVA

SEQ ID NO: 1234776 - protein, 9 aa, Homo Sapiens
TLSITGKAG

SEQ ID NO: 1234777 - protein, 9 aa, Homo Sapiens
PTGELGDPR

SEQ ID NO: 1234778 - protein, 9 aa, Homo Sapiens
EHIHTHFES

SEQ ID NO: 1234779 - protein, 9 aa, Homo Sapiens
LPATIVSAV

SEQ ID NO: 1234780 - protein, 9 aa, Homo Sapiens
AVLLNHPFI

SEQ ID NO: 1234781 - protein, 9 aa, Homo Sapiens
CRRCVVCHA

SEQ ID NO: 1234782 - protein, 9 aa, Homo Sapiens
VGLNRVLEE

SEQ ID NO: 1234783 - protein, 9 aa, Homo Sapiens
HRKWEEKIP

SEQ ID NO: 1234784 - protein, 9 aa, Homo Sapiens
VTDLHVTNQ

SEQ ID NO: 1234785 - protein, 9 aa, Homo Sapiens
LWDEPGSVI

SEQ ID NO: 1234786 - protein, 9 aa, Homo Sapiens
MVFFFTFMA

SEQ ID NO: 1234787 - protein, 9 aa, Homo Sapiens
LIHTSIRPY

SEQ ID NO: 1234788 - protein, 9 aa, Homo Sapiens
REEKQEHVV

SEQ ID NO: 1234789 - protein, 9 aa, Homo Sapiens
VERLFKATG

SEQ ID NO: 1234790 - protein, 9 aa, Homo Sapiens
LSQLGAVKF

SEQ ID NO: 1234791 - protein, 9 aa, Homo Sapiens
TVAVGVCWW

SEQ ID NO: 1234792 - protein, 9 aa, Homo Sapiens
PNKKQQEPA

SEQ ID NO: 1234793 - protein, 9 aa, Homo Sapiens
GETVQEELL

SEQ ID NO: 1234794 - protein, 9 aa, Homo Sapiens
KYLSLSVNH

SEQ ID NO: 1234795 - protein, 9 aa, Homo Sapiens
HHAYAEYMY

SEQ ID NO: 1234796 - protein, 9 aa, Homo Sapiens
PGGPWLRMC

SEQ ID NO: 1234797 - protein, 9 aa, Homo Sapiens
QQTNMMIQR

SEQ ID NO: 1234798 - protein, 9 aa, Homo Sapiens
ADRQCEYLL

SEQ ID NO: 1234799 - protein, 9 aa, Homo Sapiens
TDASVYQQA

SEQ ID NO: 1234800 - protein, 9 aa, Homo Sapiens
ISFDICYLF

SEQ ID NO: 1234801 - protein, 9 aa, Homo Sapiens
YTSADATIN

SEQ ID NO: 1234802 - protein, 9 aa, Homo Sapiens
GSPGGPGFL

SEQ ID NO: 1234803 - protein, 9 aa, Homo Sapiens
SQKSLFYLL

SEQ ID NO: 1234804 - protein, 9 aa, Homo Sapiens
RQLLAVGQE

SEQ ID NO: 1234805 - protein, 9 aa, Homo Sapiens
SCSTSTHGS

SEQ ID NO: 1234806 - protein, 9 aa, Homo Sapiens
SNLRSIYTP

SEQ ID NO: 1234807 - protein, 9 aa, Homo Sapiens
KMSQGHCTD

SEQ ID NO: 1234808 - protein, 9 aa, Homo Sapiens
FPEPGAEPH

SEQ ID NO: 1234809 - protein, 9 aa, Homo Sapiens
MIVFEPYQA

SEQ ID NO: 1234810 - protein, 9 aa, Homo Sapiens
YNSMRTINQ

SEQ ID NO: 1234811 - protein, 9 aa, Homo Sapiens
RNIPNGLHD

SEQ ID NO: 1234812 - protein, 9 aa, Homo Sapiens
TYTYSTSVG

SEQ ID NO: 1234813 - protein, 9 aa, Homo Sapiens
ARQLIDEKA

SEQ ID NO: 1234814 - protein, 9 aa, Homo Sapiens
YPNPDCPLK

SEQ ID NO: 1234815 - protein, 9 aa, Homo Sapiens
AQPWSEPTP

SEQ ID NO: 1234816 - protein, 9 aa, Homo Sapiens
CHRSSSPAP

SEQ ID NO: 1234817 - protein, 9 aa, Homo Sapiens
VHQAAPLID

SEQ ID NO: 1234818 - protein, 9 aa, Homo Sapiens
GSRPQSPGA

SEQ ID NO: 1234819 - protein, 9 aa, Homo Sapiens
PRPTRRGAP

SEQ ID NO: 1234820 - protein, 9 aa, Homo Sapiens
AEGGSRNQE

SEQ ID NO: 1234821 - protein, 9 aa, Homo Sapiens
RHILQQDWS

SEQ ID NO: 1234822 - protein, 9 aa, Homo Sapiens
CSVPPTQEL

SEQ ID NO: 1234823 - protein, 9 aa, Homo Sapiens
RRVNHMVVI

SEQ ID NO: 1234824 - protein, 9 aa, Homo Sapiens
GALIYKLSG

SEQ ID NO: 1234825 - protein, 9 aa, Homo Sapiens
IYFVMLLAG

SEQ ID NO: 1234826 - protein, 9 aa, Homo Sapiens
IKDAKDFGI

SEQ ID NO: 1234827 - protein, 9 aa, Homo Sapiens
RHPSATLIA

SEQ ID NO: 1234828 - protein, 9 aa, Homo Sapiens
VSFFPVFVW

SEQ ID NO: 1234829 - protein, 9 aa, Homo Sapiens
GREKCHSSP

SEQ ID NO: 1234830 - protein, 9 aa, Homo Sapiens
NAELSLDFH

SEQ ID NO: 1234831 - protein, 9 aa, Homo Sapiens
GSESKKEIN

SEQ ID NO: 1234832 - protein, 9 aa, Homo Sapiens
CVRYIKERE

SEQ ID NO: 1234833 - protein, 9 aa, Homo Sapiens
RNNVITLSI

SEQ ID NO: 1234834 - protein, 9 aa, Homo Sapiens
VDIVHVTCW

SEQ ID NO: 1234835 - protein, 9 aa, Homo Sapiens
VSGKWIPTS

SEQ ID NO: 1234836 - protein, 9 aa, Homo Sapiens
WAGSRIVWM

SEQ ID NO: 1234837 - protein, 9 aa, Homo Sapiens
SNCGVDCSC

SEQ ID NO: 1234838 - protein, 9 aa, Homo Sapiens
IYHAIDHNS

SEQ ID NO: 1234839 - protein, 9 aa, Homo Sapiens
DTVHFIQQL

SEQ ID NO: 1234840 - protein, 9 aa, Homo Sapiens
SLDDVLYEC

SEQ ID NO: 1234841 - protein, 9 aa, Homo Sapiens
SSPCAACVD

SEQ ID NO: 1234842 - protein, 9 aa, Homo Sapiens
TSISSISVA

SEQ ID NO: 1234843 - protein, 9 aa, Homo Sapiens
QSCWHLLRT

SEQ ID NO: 1234844 - protein, 9 aa, Homo Sapiens
LEEEAKLGV

SEQ ID NO: 1234845 - protein, 9 aa, Homo Sapiens
SGSGPKLPC

SEQ ID NO: 1234846 - protein, 9 aa, Homo Sapiens
DFFIKTKAE

SEQ ID NO: 1234847 - protein, 9 aa, Homo Sapiens
DAPCPGYLF

SEQ ID NO: 1234848 - protein, 9 aa, Homo Sapiens
ATTTSLVTS

SEQ ID NO: 1234849 - protein, 9 aa, Homo Sapiens
CGPTLHLHD

SEQ ID NO: 1234850 - protein, 9 aa, Homo Sapiens
SFWVAEVIC

SEQ ID NO: 1234851 - protein, 9 aa, Homo Sapiens
IEDNCGDYL

SEQ ID NO: 1234852 - protein, 9 aa, Homo Sapiens
ARIGGHIPI

SEQ ID NO: 1234853 - protein, 9 aa, Homo Sapiens
SATINMITP

SEQ ID NO: 1234854 - protein, 9 aa, Homo Sapiens
EWYITKGGN

SEQ ID NO: 1234855 - protein, 9 aa, Homo Sapiens
GEVGVRVES

SEQ ID NO: 1234856 - protein, 9 aa, Homo Sapiens
DGTLFLSLS

SEQ ID NO: 1234857 - protein, 9 aa, Homo Sapiens
PDLALQGDM

SEQ ID NO: 1234858 - protein, 9 aa, Homo Sapiens
GEVIPSMGV

SEQ ID NO: 1234859 - protein, 9 aa, Homo Sapiens
WFLFIHFGV

SEQ ID NO: 1234860 - protein, 9 aa, Homo Sapiens
HRYYWGEKL

SEQ ID NO: 1234861 - protein, 9 aa, Homo Sapiens
VFALRDWRT

SEQ ID NO: 1234862 - protein, 9 aa, Homo Sapiens
LFVNKMAAT

SEQ ID NO: 1234863 - protein, 9 aa, Homo Sapiens
EKDFLMSHP

SEQ ID NO: 1234864 - protein, 9 aa, Homo Sapiens
WLGTMFQNP

SEQ ID NO: 1234865 - protein, 9 aa, Homo Sapiens
WKLMIIVGA

SEQ ID NO: 1234866 - protein, 9 aa, Homo Sapiens
VHPEVENRP

SEQ ID NO: 1234867 - protein, 9 aa, Homo Sapiens
PLINLDVTN

SEQ ID NO: 1234868 - protein, 9 aa, Homo Sapiens
SPRGTVRVC

SEQ ID NO: 1234869 - protein, 9 aa, Homo Sapiens
SQPQQQQID

SEQ ID NO: 1234870 - protein, 9 aa, Homo Sapiens
AMAPDVEVS

SEQ ID NO: 1234871 - protein, 9 aa, Homo Sapiens
LLTYYIAFV

SEQ ID NO: 1234872 - protein, 9 aa, Homo Sapiens
SLGYFRGDE

SEQ ID NO: 1234873 - protein, 9 aa, Homo Sapiens
QVLLFGTCA

SEQ ID NO: 1234874 - protein, 9 aa, Homo Sapiens
IGGSEEMDW

SEQ ID NO: 1234875 - protein, 9 aa, Homo Sapiens
LAKTMSKEE

SEQ ID NO: 1234876 - protein, 9 aa, Homo Sapiens
KTVEEPRTT

SEQ ID NO: 1234877 - protein, 9 aa, Homo Sapiens
LIKLLFPVG

SEQ ID NO: 1234878 - protein, 9 aa, Homo Sapiens
ANGMYYLEE

SEQ ID NO: 1234879 - protein, 9 aa, Homo Sapiens
SKDQMKRMR

SEQ ID NO: 1234880 - protein, 9 aa, Homo Sapiens
KTLITQCTA

SEQ ID NO: 1234881 - protein, 9 aa, Homo Sapiens
ITESNDMHF

SEQ ID NO: 1234882 - protein, 9 aa, Homo Sapiens
SFHCDICDT

SEQ ID NO: 1234883 - protein, 9 aa, Homo Sapiens
PTNYRLRMH

SEQ ID NO: 1234884 - protein, 9 aa, Homo Sapiens
KNFLLSGTV

SEQ ID NO: 1234885 - protein, 9 aa, Homo Sapiens
PLDRKDQFV

SEQ ID NO: 1234886 - protein, 9 aa, Homo Sapiens
KKATAYIMS

SEQ ID NO: 1234887 - protein, 9 aa, Homo Sapiens
PGMTTTLSS

SEQ ID NO: 1234888 - protein, 9 aa, Homo Sapiens
MSKSLPARQ

SEQ ID NO: 1234889 - protein, 9 aa, Homo Sapiens
NSTGSGKNS

SEQ ID NO: 1234890 - protein, 9 aa, Homo Sapiens
VMETVKIIY

SEQ ID NO: 1234891 - protein, 9 aa, Homo Sapiens
DLPEHAILK

SEQ ID NO: 1234892 - protein, 9 aa, Homo Sapiens
SVVGFCLLI

SEQ ID NO: 1234893 - protein, 9 aa, Homo Sapiens
GVATPGRPW

SEQ ID NO: 1234894 - protein, 9 aa, Homo Sapiens
VRPQVSLTF

SEQ ID NO: 1234895 - protein, 9 aa, Homo Sapiens
DSMNTFRSF

SEQ ID NO: 1234896 - protein, 9 aa, Homo Sapiens
QKKLYVEEV

SEQ ID NO: 1234897 - protein, 9 aa, Homo Sapiens
HALQDMARP

SEQ ID NO: 1234898 - protein, 9 aa, Homo Sapiens
MDVHDSTHV

SEQ ID NO: 1234899 - protein, 9 aa, Homo Sapiens
FQEDPQTKD

SEQ ID NO: 1234900 - protein, 9 aa, Homo Sapiens
AIHDNIYMP

SEQ ID NO: 1234901 - protein, 9 aa, Homo Sapiens
DKKNCSFCQ

SEQ ID NO: 1234902 - protein, 9 aa, Homo Sapiens
CDGCGENIG

SEQ ID NO: 1234903 - protein, 9 aa, Homo Sapiens
PSPSWDRRR

SEQ ID NO: 1234904 - protein, 9 aa, Homo Sapiens
NIRFMEPLP

SEQ ID NO: 1234905 - protein, 9 aa, Homo Sapiens
RLRALDLFY

SEQ ID NO: 1234906 - protein, 9 aa, Homo Sapiens
LQTISKGIF

SEQ ID NO: 1234907 - protein, 9 aa, Homo Sapiens
LSRPAHASR

SEQ ID NO: 1234908 - protein, 9 aa, Homo Sapiens
NSVFTLGNM

SEQ ID NO: 1234909 - protein, 9 aa, Homo Sapiens
NMEDSYYCR

SEQ ID NO: 1234910 - protein, 9 aa, Homo Sapiens
AACVDRIIK

SEQ ID NO: 1234911 - protein, 9 aa, Homo Sapiens
VMPGAWEEL

SEQ ID NO: 1234912 - protein, 9 aa, Homo Sapiens
GGHRIDYVL

SEQ ID NO: 1234913 - protein, 9 aa, Homo Sapiens
KSLYTVGTK

SEQ ID NO: 1234914 - protein, 9 aa, Homo Sapiens
ISLHEKIQP

SEQ ID NO: 1234915 - protein, 9 aa, Homo Sapiens
KAMFWWVSG

SEQ ID NO: 1234916 - protein, 9 aa, Homo Sapiens
VYDTLIKDL

SEQ ID NO: 1234917 - protein, 9 aa, Homo Sapiens
DKKLLHFIQ

SEQ ID NO: 1234918 - protein, 9 aa, Homo Sapiens
VRCVIAEGD

SEQ ID NO: 1234919 - protein, 9 aa, Homo Sapiens
GDLILATSA

SEQ ID NO: 1234920 - protein, 9 aa, Homo Sapiens
ILAEPWRQE

SEQ ID NO: 1234921 - protein, 9 aa, Homo Sapiens
DISLNKFKQ

SEQ ID NO: 1234922 - protein, 9 aa, Homo Sapiens
MGVLFSLVS

SEQ ID NO: 1234923 - protein, 9 aa, Homo Sapiens
FAMEMLLKM

SEQ ID NO: 1234924 - protein, 9 aa, Homo Sapiens
QLIDKCWVL

SEQ ID NO: 1234925 - protein, 9 aa, Homo Sapiens
DMGGTRTLQ

SEQ ID NO: 1234926 - protein, 9 aa, Homo Sapiens
AWMNLYQVF

SEQ ID NO: 1234927 - protein, 9 aa, Homo Sapiens
GRCSMVCDP

SEQ ID NO: 1234928 - protein, 9 aa, Homo Sapiens
GFNVRLSDQ

SEQ ID NO: 1234929 - protein, 9 aa, Homo Sapiens
KVEENEHMR

SEQ ID NO: 1234930 - protein, 9 aa, Homo Sapiens
DGIFLLGCV

SEQ ID NO: 1234931 - protein, 9 aa, Homo Sapiens
DHLLLELNA

SEQ ID NO: 1234932 - protein, 9 aa, Homo Sapiens
EQAAHSTEA

SEQ ID NO: 1234933 - protein, 9 aa, Homo Sapiens
PTLSVTSNL

SEQ ID NO: 1234934 - protein, 9 aa, Homo Sapiens
TGELGDPRP

SEQ ID NO: 1234935 - protein, 9 aa, Homo Sapiens
STCLVNWSC

SEQ ID NO: 1234936 - protein, 9 aa, Homo Sapiens
VCILISFSP

SEQ ID NO: 1234937 - protein, 9 aa, Homo Sapiens
EKEDHFLTT

SEQ ID NO: 1234938 - protein, 9 aa, Homo Sapiens
EDSPLVATG

SEQ ID NO: 1234939 - protein, 9 aa, Homo Sapiens
KYGEMWGMY

SEQ ID NO: 1234940 - protein, 9 aa, Homo Sapiens
QVVQVILDG

SEQ ID NO: 1234941 - protein, 9 aa, Homo Sapiens
VPPPYPRPA

SEQ ID NO: 1234942 - protein, 9 aa, Homo Sapiens
TVLAICYDA

SEQ ID NO: 1234943 - protein, 9 aa, Homo Sapiens
WGCCGSFIP

SEQ ID NO: 1234944 - protein, 9 aa, Homo Sapiens
EADVGRAGR

SEQ ID NO: 1234945 - protein, 9 aa, Homo Sapiens
QSSVLLQHL

SEQ ID NO: 1234946 - protein, 9 aa, Homo Sapiens
DVLGRGTGG

SEQ ID NO: 1234947 - protein, 9 aa, Homo Sapiens
DAATVRGGA

SEQ ID NO: 1234948 - protein, 9 aa, Homo Sapiens
RCQDRVHDF

SEQ ID NO: 1234949 - protein, 9 aa, Homo Sapiens
EFYQHWQLK

SEQ ID NO: 1234950 - protein, 9 aa, Homo Sapiens
MGFDMQMVA

SEQ ID NO: 1234951 - protein, 9 aa, Homo Sapiens
PNYCKGTYL

SEQ ID NO: 1234952 - protein, 9 aa, Homo Sapiens
STEQSCASR

SEQ ID NO: 1234953 - protein, 9 aa, Homo Sapiens
LGAAACPLD

SEQ ID NO: 1234954 - protein, 9 aa, Homo Sapiens
QAQGQIQTQ

SEQ ID NO: 1234955 - protein, 9 aa, Homo Sapiens
RAPPEAPLT

SEQ ID NO: 1234956 - protein, 9 aa, Homo Sapiens
TGEKPYKRN

SEQ ID NO: 1234957 - protein, 9 aa, Homo Sapiens
QLAHSKMFP

SEQ ID NO: 1234958 - protein, 9 aa, Homo Sapiens
IRSGMGQRR

SEQ ID NO: 1234959 - protein, 9 aa, Homo Sapiens
VFDGKHQHT

SEQ ID NO: 1234960 - protein, 9 aa, Homo Sapiens
LTTALIVLH

SEQ ID NO: 1234961 - protein, 9 aa, Homo Sapiens
SEDQTWKRS

SEQ ID NO: 1234962 - protein, 9 aa, Homo Sapiens
NFETTEESL

SEQ ID NO: 1234963 - protein, 9 aa, Homo Sapiens
LHSLREACE

SEQ ID NO: 1234964 - protein, 9 aa, Homo Sapiens
SIRSQVVRK

SEQ ID NO: 1234965 - protein, 9 aa, Homo Sapiens
VHNLHSLPG

SEQ ID NO: 1234966 - protein, 9 aa, Homo Sapiens
AVKQVPKCD

SEQ ID NO: 1234967 - protein, 9 aa, Homo Sapiens
GMAPVGPVQ

SEQ ID NO: 1234968 - protein, 9 aa, Homo Sapiens
PRSSSTAPP

SEQ ID NO: 1234969 - protein, 9 aa, Homo Sapiens
GDRATDFHF

SEQ ID NO: 1234970 - protein, 9 aa, Homo Sapiens
QAMSVAPQI

SEQ ID NO: 1234971 - protein, 9 aa, Homo Sapiens
PTMVSVKLS

SEQ ID NO: 1234972 - protein, 9 aa, Homo Sapiens
YTLDPHTCW

SEQ ID NO: 1234973 - protein, 9 aa, Homo Sapiens
EAMIRQNEI

SEQ ID NO: 1234974 - protein, 9 aa, Homo Sapiens
LAMKAIRNN

SEQ ID NO: 1234975 - protein, 9 aa, Homo Sapiens
MTTILEIKP

SEQ ID NO: 1234976 - protein, 9 aa, Homo Sapiens
PFSVAKSMK

SEQ ID NO: 1234977 - protein, 9 aa, Homo Sapiens
DAQLQDLEK

SEQ ID NO: 1234978 - protein, 9 aa, Homo Sapiens
ETLISMVNH

SEQ ID NO: 1234979 - protein, 9 aa, Homo Sapiens
VTPLCGPCI

SEQ ID NO: 1234980 - protein, 9 aa, Homo Sapiens
PPPGSGGDG

SEQ ID NO: 1234981 - protein, 9 aa, Homo Sapiens
FALSEAMGF

SEQ ID NO: 1234982 - protein, 9 aa, Homo Sapiens
FRSNVDYQY

SEQ ID NO: 1234983 - protein, 9 aa, Homo Sapiens
KGKKKQHLC

SEQ ID NO: 1234984 - protein, 9 aa, Homo Sapiens
AATGIQRNH

SEQ ID NO: 1234985 - protein, 9 aa, Homo Sapiens
QLQQQHPND

SEQ ID NO: 1234986 - protein, 9 aa, Homo Sapiens
AFGNTIDTS

SEQ ID NO: 1234987 - protein, 9 aa, Homo Sapiens
LHCEDPSFN

SEQ ID NO: 1234988 - protein, 9 aa, Homo Sapiens
DEEHRIKME

SEQ ID NO: 1234989 - protein, 9 aa, Homo Sapiens
SSLDNVVTQ

SEQ ID NO: 1234990 - protein, 9 aa, Homo Sapiens
QFAHQMQQQ

SEQ ID NO: 1234991 - protein, 9 aa, Homo Sapiens
LCVWMFICI

SEQ ID NO: 1234992 - protein, 9 aa, Homo Sapiens
LSRRDTREV

SEQ ID NO: 1234993 - protein, 9 aa, Homo Sapiens
YTGYAETYH

SEQ ID NO: 1234994 - protein, 9 aa, Homo Sapiens
MCPGYRGPG

SEQ ID NO: 1234995 - protein, 9 aa, Homo Sapiens
LNTILDVVE

SEQ ID NO: 1234996 - protein, 9 aa, Homo Sapiens
NSDGWLHTG

SEQ ID NO: 1234997 - protein, 9 aa, Homo Sapiens
TYNAAQAGE

SEQ ID NO: 1234998 - protein, 9 aa, Homo Sapiens
QTLALTQDH

SEQ ID NO: 1234999 - protein, 8 aa, Homo Sapiens
PLLTQQIQ

SEQ ID NO: 1235000 - protein, 9 aa, Homo Sapiens
GQLHARQIL

SEQ ID NO: 1235001 - protein, 9 aa, Homo Sapiens
CLQAKKEEI

SEQ ID NO: 1235002 - protein, 9 aa, Homo Sapiens
IRCMNVVHD

SEQ ID NO: 1235003 - protein, 9 aa, Homo Sapiens
GLWHWVLGL

SEQ ID NO: 1235004 - protein, 9 aa, Homo Sapiens
ECNSRQPSC

SEQ ID NO: 1235005 - protein, 9 aa, Homo Sapiens
TGGAVLHSP

SEQ ID NO: 1235006 - protein, 9 aa, Homo Sapiens
VKELAEAIK

SEQ ID NO: 1235007 - protein, 9 aa, Homo Sapiens
PETATRRPC

SEQ ID NO: 1235008 - protein, 9 aa, Homo Sapiens
IKLLSSGFE

SEQ ID NO: 1235009 - protein, 9 aa, Homo Sapiens
PLNITLDNR

SEQ ID NO: 1235010 - protein, 9 aa, Homo Sapiens
GKHARHKGG

SEQ ID NO: 1235011 - protein, 9 aa, Homo Sapiens
IPSTIGCRL

SEQ ID NO: 1235012 - protein, 9 aa, Homo Sapiens
DMIIRPSIE

SEQ ID NO: 1235013 - protein, 9 aa, Homo Sapiens
DSCMVLEEE

SEQ ID NO: 1235014 - protein, 9 aa, Homo Sapiens
YKAGDKIAT

SEQ ID NO: 1235015 - protein, 9 aa, Homo Sapiens
LIVPRKTRL

SEQ ID NO: 1235016 - protein, 9 aa, Homo Sapiens
IDALYESAK

SEQ ID NO: 1235017 - protein, 9 aa, Homo Sapiens
HPQVIMVVV

SEQ ID NO: 1235018 - protein, 9 aa, Homo Sapiens
YCVPMSTNQ

SEQ ID NO: 1235019 - protein, 9 aa, Homo Sapiens
TMQDIRFHY

SEQ ID NO: 1235020 - protein, 9 aa, Homo Sapiens
MAPEVVNRI

SEQ ID NO: 1235021 - protein, 9 aa, Homo Sapiens
SKEALNGII

SEQ ID NO: 1235022 - protein, 9 aa, Homo Sapiens
SMDVNPSWT

SEQ ID NO: 1235023 - protein, 9 aa, Homo Sapiens
GFLLLLLIM

SEQ ID NO: 1235024 - protein, 9 aa, Homo Sapiens
RDEERIKNL

SEQ ID NO: 1235025 - protein, 9 aa, Homo Sapiens
LNDGSSDMG

SEQ ID NO: 1235026 - protein, 9 aa, Homo Sapiens
AIVIIIGAF

SEQ ID NO: 1235027 - protein, 9 aa, Homo Sapiens
QQKREAQVD

SEQ ID NO: 1235028 - protein, 9 aa, Homo Sapiens
RNLGMSMHV

SEQ ID NO: 1235029 - protein, 9 aa, Homo Sapiens
LSFSDDIEH

SEQ ID NO: 1235030 - protein, 9 aa, Homo Sapiens
LRLVDEDLL

SEQ ID NO: 1235031 - protein, 9 aa, Homo Sapiens
GRNFDDILR

SEQ ID NO: 1235032 - protein, 9 aa, Homo Sapiens
FHDPHHCGH

SEQ ID NO: 1235033 - protein, 9 aa, Homo Sapiens
RLVKQIISR

SEQ ID NO: 1235034 - protein, 9 aa, Homo Sapiens
RASKELKQM

SEQ ID NO: 1235035 - protein, 9 aa, Homo Sapiens
PWVNPYMDG

SEQ ID NO: 1235036 - protein, 9 aa, Homo Sapiens
SCKTPDVSF

SEQ ID NO: 1235037 - protein, 9 aa, Homo Sapiens
IVIFISYGS

SEQ ID NO: 1235038 - protein, 9 aa, Homo Sapiens
HELGHALRL

SEQ ID NO: 1235039 - protein, 9 aa, Homo Sapiens
CPWELKQVM

SEQ ID NO: 1235040 - protein, 9 aa, Homo Sapiens
STREEIVVW

SEQ ID NO: 1235041 - protein, 9 aa, Homo Sapiens
SKVMGGLKN

SEQ ID NO: 1235042 - protein, 9 aa, Homo Sapiens
QERAEGIPA

SEQ ID NO: 1235043 - protein, 9 aa, Homo Sapiens
EEHCGMLRE

SEQ ID NO: 1235044 - protein, 9 aa, Homo Sapiens
LFKVIPLDH

SEQ ID NO: 1235045 - protein, 9 aa, Homo Sapiens
GGVMGAVNG

SEQ ID NO: 1235046 - protein, 9 aa, Homo Sapiens
SSQAHASAL

SEQ ID NO: 1235047 - protein, 9 aa, Homo Sapiens
GSYEEAMVH

SEQ ID NO: 1235048 - protein, 9 aa, Homo Sapiens
EGGELVIAH

SEQ ID NO: 1235049 - protein, 9 aa, Homo Sapiens
YKRSIDAEN

SEQ ID NO: 1235050 - protein, 9 aa, Homo Sapiens
ENALNRILL

SEQ ID NO: 1235051 - protein, 9 aa, Homo Sapiens
PGSGKVEED

SEQ ID NO: 1235052 - protein, 9 aa, Homo Sapiens
SKAMFWWVS

SEQ ID NO: 1235053 - protein, 9 aa, Homo Sapiens
TSYPPFRFV

SEQ ID NO: 1235054 - protein, 9 aa, Homo Sapiens
ANPMEYANH

SEQ ID NO: 1235055 - protein, 9 aa, Homo Sapiens
GDIEKSRHA

SEQ ID NO: 1235056 - protein, 9 aa, Homo Sapiens
KSQSKHRAS

SEQ ID NO: 1235057 - protein, 9 aa, Homo Sapiens
RSQGSSPPT

SEQ ID NO: 1235058 - protein, 9 aa, Homo Sapiens
FIWFLSSVS

SEQ ID NO: 1235059 - protein, 9 aa, Homo Sapiens
LYQVIASVK

SEQ ID NO: 1235060 - protein, 9 aa, Homo Sapiens
QVYCHKDFG

SEQ ID NO: 1235061 - protein, 9 aa, Homo Sapiens
GTDGYPGEA

SEQ ID NO: 1235062 - protein, 9 aa, Homo Sapiens
RGMAADMGM

SEQ ID NO: 1235063 - protein, 9 aa, Homo Sapiens
ANKYNVMLV

SEQ ID NO: 1235064 - protein, 9 aa, Homo Sapiens
VKISCSNSE

SEQ ID NO: 1235065 - protein, 9 aa, Homo Sapiens
STNLKTLNQ

SEQ ID NO: 1235066 - protein, 9 aa, Homo Sapiens
KEDYAVFYE

SEQ ID NO: 1235067 - protein, 9 aa, Homo Sapiens
AEEGEHMTP

SEQ ID NO: 1235068 - protein, 9 aa, Homo Sapiens
TEDWSAQPV

SEQ ID NO: 1235069 - protein, 9 aa, Homo Sapiens
REEEHPPPP

SEQ ID NO: 1235070 - protein, 9 aa, Homo Sapiens
QASAAVLNP

SEQ ID NO: 1235071 - protein, 9 aa, Homo Sapiens
YELLWGWRP

SEQ ID NO: 1235072 - protein, 9 aa, Homo Sapiens
YSIFTEHKK

SEQ ID NO: 1235073 - protein, 9 aa, Homo Sapiens
VWEWKEQGS

SEQ ID NO: 1235074 - protein, 9 aa, Homo Sapiens
VIYVILRKC

SEQ ID NO: 1235075 - protein, 9 aa, Homo Sapiens
PASPTWRNS

SEQ ID NO: 1235076 - protein, 9 aa, Homo Sapiens
KRHTEKPPE

SEQ ID NO: 1235077 - protein, 9 aa, Homo Sapiens
ERERYPDSF

SEQ ID NO: 1235078 - protein, 9 aa, Homo Sapiens
KAGLHAVAP

SEQ ID NO: 1235079 - protein, 9 aa, Homo Sapiens
ALDDFANGT

SEQ ID NO: 1235080 - protein, 9 aa, Homo Sapiens
YQLLLLGGC

SEQ ID NO: 1235081 - protein, 9 aa, Homo Sapiens
LLVKDIQWA

SEQ ID NO: 1235082 - protein, 9 aa, Homo Sapiens
SMENTAPSQ

SEQ ID NO: 1235083 - protein, 9 aa, Homo Sapiens
AKKWVLRKA

SEQ ID NO: 1235084 - protein, 9 aa, Homo Sapiens
LTQSNLRSI

SEQ ID NO: 1235085 - protein, 9 aa, Homo Sapiens
RRALRHSTT

SEQ ID NO: 1235086 - protein, 9 aa, Homo Sapiens
WWEHLWLPV

SEQ ID NO: 1235087 - protein, 9 aa, Homo Sapiens
ASKACQTLC

SEQ ID NO: 1235088 - protein, 9 aa, Homo Sapiens
TATGYSGYI

SEQ ID NO: 1235089 - protein, 9 aa, Homo Sapiens
DICRRSLSE

SEQ ID NO: 1235090 - protein, 9 aa, Homo Sapiens
KGTDFLQLM

SEQ ID NO: 1235091 - protein, 9 aa, Homo Sapiens
CTNYPMSVA

SEQ ID NO: 1235092 - protein, 9 aa, Homo Sapiens
RDAKLDKVQ

SEQ ID NO: 1235093 - protein, 9 aa, Homo Sapiens
HDAALMQDY

SEQ ID NO: 1235094 - protein, 9 aa, Homo Sapiens
LPLIMRGLA

SEQ ID NO: 1235095 - protein, 9 aa, Homo Sapiens
HVYVRRGPG

SEQ ID NO: 1235096 - protein, 9 aa, Homo Sapiens
AASCVLMTK

SEQ ID NO: 1235097 - protein, 9 aa, Homo Sapiens
ATSWSCQPL

SEQ ID NO: 1235098 - protein, 9 aa, Homo Sapiens
DRLRTTLPT

SEQ ID NO: 1235099 - protein, 9 aa, Homo Sapiens
HLTTHKRIY

SEQ ID NO: 1235100 - protein, 9 aa, Homo Sapiens
CFLRQSGIG

SEQ ID NO: 1235101 - protein, 9 aa, Homo Sapiens
PLADKFIYY

SEQ ID NO: 1235102 - protein, 9 aa, Homo Sapiens
NRYCTSTLC

SEQ ID NO: 1235103 - protein, 9 aa, Homo Sapiens
IAHSNSSVL

SEQ ID NO: 1235104 - protein, 9 aa, Homo Sapiens
TLLLDKSIN

SEQ ID NO: 1235105 - protein, 9 aa, Homo Sapiens
PMYSRLEHV

SEQ ID NO: 1235106 - protein, 9 aa, Homo Sapiens
AQTPEEEHT

SEQ ID NO: 1235107 - protein, 9 aa, Homo Sapiens
EHLLADLMQ

SEQ ID NO: 1235108 - protein, 9 aa, Homo Sapiens
NIDSSTREI

SEQ ID NO: 1235109 - protein, 9 aa, Homo Sapiens
LASGDCSAR

SEQ ID NO: 1235110 - protein, 9 aa, Homo Sapiens
DGILNTSGA

SEQ ID NO: 1235111 - protein, 9 aa, Homo Sapiens
NMEADGILK

SEQ ID NO: 1235112 - protein, 9 aa, Homo Sapiens
FWGEKIVAL

SEQ ID NO: 1235113 - protein, 9 aa, Homo Sapiens
QCPSVITTT

SEQ ID NO: 1235114 - protein, 9 aa, Homo Sapiens
RVKKNAPQV

SEQ ID NO: 1235115 - protein, 9 aa, Homo Sapiens
QTHIQAQTG

SEQ ID NO: 1235116 - protein, 9 aa, Homo Sapiens
GKYSDLNEY

SEQ ID NO: 1235117 - protein, 9 aa, Homo Sapiens
LKPQTPNYN

SEQ ID NO: 1235118 - protein, 9 aa, Homo Sapiens
VGHIPESED

SEQ ID NO: 1235119 - protein, 9 aa, Homo Sapiens
EGMLNPFGQ

SEQ ID NO: 1235120 - protein, 9 aa, Homo Sapiens
PRVHAYPEA

SEQ ID NO: 1235121 - protein, 9 aa, Homo Sapiens
TINFDGRLP

SEQ ID NO: 1235122 - protein, 9 aa, Homo Sapiens
WTNRSVAPG

SEQ ID NO: 1235123 - protein, 9 aa, Homo Sapiens
FALEKLDIT

SEQ ID NO: 1235124 - protein, 9 aa, Homo Sapiens
RQALMPIQE

SEQ ID NO: 1235125 - protein, 9 aa, Homo Sapiens
AILLLCLPD

SEQ ID NO: 1235126 - protein, 9 aa, Homo Sapiens
FSGVVDIVS

SEQ ID NO: 1235127 - protein, 9 aa, Homo Sapiens
MIFCSTFLS

SEQ ID NO: 1235128 - protein, 9 aa, Homo Sapiens
VFGVIYYVV

SEQ ID NO: 1235129 - protein, 9 aa, Homo Sapiens
LGGRQSKYT

SEQ ID NO: 1235130 - protein, 9 aa, Homo Sapiens
LQNNQCYNW

SEQ ID NO: 1235131 - protein, 9 aa, Homo Sapiens
VWTNERLKV

SEQ ID NO: 1235132 - protein, 9 aa, Homo Sapiens
DVTVQYPIM

SEQ ID NO: 1235133 - protein, 9 aa, Homo Sapiens
IRTTEALHR

SEQ ID NO: 1235134 - protein, 9 aa, Homo Sapiens
TVEWRGAMG

SEQ ID NO: 1235135 - protein, 9 aa, Homo Sapiens
RSPASPLHQ

SEQ ID NO: 1235136 - protein, 9 aa, Homo Sapiens
RCHISSSAC

SEQ ID NO: 1235137 - protein, 9 aa, Homo Sapiens
LADEQDKEM

SEQ ID NO: 1235138 - protein, 9 aa, Homo Sapiens
RNLSSHVVD

SEQ ID NO: 1235139 - protein, 9 aa, Homo Sapiens
TCSRLYVPH

SEQ ID NO: 1235140 - protein, 9 aa, Homo Sapiens
TDPSVINCL

SEQ ID NO: 1235141 - protein, 9 aa, Homo Sapiens
RALPVEELC

SEQ ID NO: 1235142 - protein, 9 aa, Homo Sapiens
ALVPLSKAY

SEQ ID NO: 1235143 - protein, 9 aa, Homo Sapiens
IQIDNNKSI

SEQ ID NO: 1235144 - protein, 9 aa, Homo Sapiens
LASWLTSTR

SEQ ID NO: 1235145 - protein, 9 aa, Homo Sapiens
PCINSLVAQ

SEQ ID NO: 1235146 - protein, 9 aa, Homo Sapiens
HMLIHVTSS

SEQ ID NO: 1235147 - protein, 9 aa, Homo Sapiens
ITKRPAQVK

SEQ ID NO: 1235148 - protein, 9 aa, Homo Sapiens
VTGGQAFFG

SEQ ID NO: 1235149 - protein, 9 aa, Homo Sapiens
TKASQGRSW

SEQ ID NO: 1235150 - protein, 9 aa, Homo Sapiens
PDVSFLPEE

SEQ ID NO: 1235151 - protein, 9 aa, Homo Sapiens
VTVASHLTK

SEQ ID NO: 1235152 - protein, 9 aa, Homo Sapiens
IAALKEQLS

SEQ ID NO: 1235153 - protein, 9 aa, Homo Sapiens
SAQRESASI

SEQ ID NO: 1235154 - protein, 9 aa, Homo Sapiens
GNPVIMQES

SEQ ID NO: 1235155 - protein, 9 aa, Homo Sapiens
AHYPDIYAR

SEQ ID NO: 1235156 - protein, 9 aa, Homo Sapiens
ARCCLYASV

SEQ ID NO: 1235157 - protein, 9 aa, Homo Sapiens
LNDFMNVLP

SEQ ID NO: 1235158 - protein, 9 aa, Homo Sapiens
NNKCIYFLI

SEQ ID NO: 1235159 - protein, 9 aa, Homo Sapiens
ETVMGLITC

SEQ ID NO: 1235160 - protein, 9 aa, Homo Sapiens
GQTEMVLIC

SEQ ID NO: 1235161 - protein, 9 aa, Homo Sapiens
KIENFIQKQ

SEQ ID NO: 1235162 - protein, 9 aa, Homo Sapiens
NLADYFKKL

SEQ ID NO: 1235163 - protein, 9 aa, Homo Sapiens
IKTRYHIVK

SEQ ID NO: 1235164 - protein, 9 aa, Homo Sapiens
GDERMLVDA

SEQ ID NO: 1235165 - protein, 9 aa, Homo Sapiens
TFDSEGNYM

SEQ ID NO: 1235166 - protein, 9 aa, Homo Sapiens
SQTPNPVDD

SEQ ID NO: 1235167 - protein, 9 aa, Homo Sapiens
GQQFGAAHV

SEQ ID NO: 1235168 - protein, 9 aa, Homo Sapiens
TNGAENEML

SEQ ID NO: 1235169 - protein, 9 aa, Homo Sapiens
PRLFHRCRH

SEQ ID NO: 1235170 - protein, 9 aa, Homo Sapiens
QLYMDAIRF

SEQ ID NO: 1235171 - protein, 9 aa, Homo Sapiens
KNVKEAIKR

SEQ ID NO: 1235172 - protein, 9 aa, Homo Sapiens
SLCFLAYSI

SEQ ID NO: 1235173 - protein, 9 aa, Homo Sapiens
WPFITTFFT

SEQ ID NO: 1235174 - protein, 9 aa, Homo Sapiens
DKPLPVPPE

SEQ ID NO: 1235175 - protein, 9 aa, Homo Sapiens
HQRTHEPPR

SEQ ID NO: 1235176 - protein, 9 aa, Homo Sapiens
RVGLRNPVR

SEQ ID NO: 1235177 - protein, 9 aa, Homo Sapiens
CQRGLSWRS

SEQ ID NO: 1235178 - protein, 9 aa, Homo Sapiens
RKMQEDEEE

SEQ ID NO: 1235179 - protein, 9 aa, Homo Sapiens
LVDVATDGD

SEQ ID NO: 1235180 - protein, 9 aa, Homo Sapiens
SMGGLGERV

SEQ ID NO: 1235181 - protein, 9 aa, Homo Sapiens
ATRSTRAEM

SEQ ID NO: 1235182 - protein, 9 aa, Homo Sapiens
DWRLILDWI

SEQ ID NO: 1235183 - protein, 9 aa, Homo Sapiens
QVGVKGTYR

SEQ ID NO: 1235184 - protein, 9 aa, Homo Sapiens
ATVPFKYES

SEQ ID NO: 1235185 - protein, 9 aa, Homo Sapiens
YIHLTFLKR

SEQ ID NO: 1235186 - protein, 9 aa, Homo Sapiens
ETDEAQFIY

SEQ ID NO: 1235187 - protein, 9 aa, Homo Sapiens
KEDQGEEEE

SEQ ID NO: 1235188 - protein, 9 aa, Homo Sapiens
EDELDEQGS

SEQ ID NO: 1235189 - protein, 9 aa, Homo Sapiens
CEGRTSHKA

SEQ ID NO: 1235190 - protein, 9 aa, Homo Sapiens
RTSQNLHNS

SEQ ID NO: 1235191 - protein, 9 aa, Homo Sapiens
GFHTVPGQS

SEQ ID NO: 1235192 - protein, 9 aa, Homo Sapiens
VIHAVWYLT

SEQ ID NO: 1235193 - protein, 9 aa, Homo Sapiens
QRGPNQPVD

SEQ ID NO: 1235194 - protein, 9 aa, Homo Sapiens
YTAPIMNGQ

SEQ ID NO: 1235195 - protein, 9 aa, Homo Sapiens
EKTVQANKL

SEQ ID NO: 1235196 - protein, 9 aa, Homo Sapiens
SGVVDIVSW

SEQ ID NO: 1235197 - protein, 9 aa, Homo Sapiens
SGSLPIRVL

SEQ ID NO: 1235198 - protein, 9 aa, Homo Sapiens
VIGESYWLQ

SEQ ID NO: 1235199 - protein, 9 aa, Homo Sapiens
WWRRRICAL

SEQ ID NO: 1235200 - protein, 9 aa, Homo Sapiens
HDIFLLEKE

SEQ ID NO: 1235201 - protein, 9 aa, Homo Sapiens
SGLITLCGI

SEQ ID NO: 1235202 - protein, 9 aa, Homo Sapiens
ILQQIDSVA

SEQ ID NO: 1235203 - protein, 9 aa, Homo Sapiens
SFLEFVEDF

SEQ ID NO: 1235204 - protein, 9 aa, Homo Sapiens
IQALHQYCP

SEQ ID NO: 1235205 - protein, 9 aa, Homo Sapiens
GKMQYLQVP

SEQ ID NO: 1235206 - protein, 9 aa, Homo Sapiens
GHALGFLGQ

SEQ ID NO: 1235207 - protein, 9 aa, Homo Sapiens
SAHFNRTMR

SEQ ID NO: 1235208 - protein, 9 aa, Homo Sapiens
PSIRKMECH

SEQ ID NO: 1235209 - protein, 9 aa, Homo Sapiens
KYSMDHGVD

SEQ ID NO: 1235210 - protein, 9 aa, Homo Sapiens
PKQRPKANS

SEQ ID NO: 1235211 - protein, 9 aa, Homo Sapiens
CSRYDSIPM

SEQ ID NO: 1235212 - protein, 9 aa, Homo Sapiens
CLLFITLVI

SEQ ID NO: 1235213 - protein, 9 aa, Homo Sapiens
PLPMCCTPA

SEQ ID NO: 1235214 - protein, 9 aa, Homo Sapiens
ILEVMNPHP

SEQ ID NO: 1235215 - protein, 9 aa, Homo Sapiens
SGFRWKKLS

SEQ ID NO: 1235216 - protein, 9 aa, Homo Sapiens
YPVHMQLYE

SEQ ID NO: 1235217 - protein, 9 aa, Homo Sapiens
PIREVHVTK

SEQ ID NO: 1235218 - protein, 9 aa, Homo Sapiens
RGCHRYLCY

SEQ ID NO: 1235219 - protein, 9 aa, Homo Sapiens
LGITIGLLV

SEQ ID NO: 1235220 - protein, 9 aa, Homo Sapiens
GAETRRISE

SEQ ID NO: 1235221 - protein, 9 aa, Homo Sapiens
SGDNYLWSP

SEQ ID NO: 1235222 - protein, 9 aa, Homo Sapiens
IVKAMGTLQ

SEQ ID NO: 1235223 - protein, 9 aa, Homo Sapiens
CRESGLRTH

SEQ ID NO: 1235224 - protein, 9 aa, Homo Sapiens
CSNTRIIHT

SEQ ID NO: 1235225 - protein, 9 aa, Homo Sapiens
MSGLVISII

SEQ ID NO: 1235226 - protein, 9 aa, Homo Sapiens
CMARLCVCC

SEQ ID NO: 1235227 - protein, 9 aa, Homo Sapiens
APKAEVDVI

SEQ ID NO: 1235228 - protein, 9 aa, Homo Sapiens
EKLIEKCQG

SEQ ID NO: 1235229 - protein, 9 aa, Homo Sapiens
ADVNLNDNT

SEQ ID NO: 1235230 - protein, 9 aa, Homo Sapiens
LLHDTLQIR

SEQ ID NO: 1235231 - protein, 9 aa, Homo Sapiens
GLTFGHMKM

SEQ ID NO: 1235232 - protein, 9 aa, Homo Sapiens
LMKVLEGMT

SEQ ID NO: 1235233 - protein, 9 aa, Homo Sapiens
HVLYEWFLG

SEQ ID NO: 1235234 - protein, 9 aa, Homo Sapiens
ANKNCPVNK

SEQ ID NO: 1235235 - protein, 9 aa, Homo Sapiens
FWCERVMGN

SEQ ID NO: 1235236 - protein, 9 aa, Homo Sapiens
QVNSIEFDS

SEQ ID NO: 1235237 - protein, 9 aa, Homo Sapiens
YLMEDISQM

SEQ ID NO: 1235238 - protein, 9 aa, Homo Sapiens
FFHPLLING

SEQ ID NO: 1235239 - protein, 9 aa, Homo Sapiens
NAMYKEIGL

SEQ ID NO: 1235240 - protein, 9 aa, Homo Sapiens
YVYTVSLDK

SEQ ID NO: 1235241 - protein, 9 aa, Homo Sapiens
DVMIAITRL

SEQ ID NO: 1235242 - protein, 9 aa, Homo Sapiens
QEAILVALV

SEQ ID NO: 1235243 - protein, 9 aa, Homo Sapiens
AKCYEEKTQ

SEQ ID NO: 1235244 - protein, 9 aa, Homo Sapiens
GGSLYENCQ

SEQ ID NO: 1235245 - protein, 9 aa, Homo Sapiens
STNKIAGPR

SEQ ID NO: 1235246 - protein, 9 aa, Homo Sapiens
DIRAKKWVL

SEQ ID NO: 1235247 - protein, 9 aa, Homo Sapiens
SQLSLMDIM

SEQ ID NO: 1235248 - protein, 9 aa, Homo Sapiens
QPGTVGPSN

SEQ ID NO: 1235249 - protein, 9 aa, Homo Sapiens
LGMWVQEGM

SEQ ID NO: 1235250 - protein, 9 aa, Homo Sapiens
GIWSKVYNP

SEQ ID NO: 1235251 - protein, 9 aa, Homo Sapiens
EDKRTYEEG

SEQ ID NO: 1235252 - protein, 9 aa, Homo Sapiens
VALDLPQHK

SEQ ID NO: 1235253 - protein, 9 aa, Homo Sapiens
TVWLSRPSG

SEQ ID NO: 1235254 - protein, 9 aa, Homo Sapiens
CGRRGSKKG

SEQ ID NO: 1235255 - protein, 9 aa, Homo Sapiens
VAINFTQEE

SEQ ID NO: 1235256 - protein, 9 aa, Homo Sapiens
ILRVKAADQ

SEQ ID NO: 1235257 - protein, 9 aa, Homo Sapiens
SPEPPPAHP

SEQ ID NO: 1235258 - protein, 9 aa, Homo Sapiens
CYQISCVLF

SEQ ID NO: 1235259 - protein, 9 aa, Homo Sapiens
TFAHRPTEQ

SEQ ID NO: 1235260 - protein, 9 aa, Homo Sapiens
SVDGDDNFR

SEQ ID NO: 1235261 - protein, 9 aa, Homo Sapiens
EWRRSLKEK

SEQ ID NO: 1235262 - protein, 9 aa, Homo Sapiens
PKYHMVRCI

SEQ ID NO: 1235263 - protein, 9 aa, Homo Sapiens
TPLGRSKAG

SEQ ID NO: 1235264 - protein, 9 aa, Homo Sapiens
GQNTWLSYR

SEQ ID NO: 1235265 - protein, 9 aa, Homo Sapiens
QYMTMRQQP

SEQ ID NO: 1235266 - protein, 9 aa, Homo Sapiens
PVMVIGACT

SEQ ID NO: 1235267 - protein, 9 aa, Homo Sapiens
SMVVAQNGM

SEQ ID NO: 1235268 - protein, 9 aa, Homo Sapiens
RGVDFHHVS

SEQ ID NO: 1235269 - protein, 9 aa, Homo Sapiens
SLLAKCYEE

SEQ ID NO: 1235270 - protein, 9 aa, Homo Sapiens
ELHRTVQKC

SEQ ID NO: 1235271 - protein, 9 aa, Homo Sapiens
HYRPIYEFH

SEQ ID NO: 1235272 - protein, 9 aa, Homo Sapiens
MIALKMRSV

SEQ ID NO: 1235273 - protein, 9 aa, Homo Sapiens
MYNRVQFLG

SEQ ID NO: 1235274 - protein, 9 aa, Homo Sapiens
DGLRVREGS

SEQ ID NO: 1235275 - protein, 9 aa, Homo Sapiens
RCVVCHAPE

SEQ ID NO: 1235276 - protein, 9 aa, Homo Sapiens
EMRTKLYPR

SEQ ID NO: 1235277 - protein, 9 aa, Homo Sapiens
LCAATSCMG

SEQ ID NO: 1235278 - protein, 9 aa, Homo Sapiens
NIVKKYGDM

SEQ ID NO: 1235279 - protein, 9 aa, Homo Sapiens
GSTTGSVSS

SEQ ID NO: 1235280 - protein, 9 aa, Homo Sapiens
ILGPIPQHT

SEQ ID NO: 1235281 - protein, 9 aa, Homo Sapiens
GRKKAFVTC

SEQ ID NO: 1235282 - protein, 9 aa, Homo Sapiens
VFGYTQRQA

SEQ ID NO: 1235283 - protein, 9 aa, Homo Sapiens
AAIQDETMQ

SEQ ID NO: 1235284 - protein, 9 aa, Homo Sapiens
LIVGFFIFV

SEQ ID NO: 1235285 - protein, 9 aa, Homo Sapiens
NQESLQLQV

SEQ ID NO: 1235286 - protein, 9 aa, Homo Sapiens
DLLHDTLQI

SEQ ID NO: 1235287 - protein, 9 aa, Homo Sapiens
DSLIVPVTF

SEQ ID NO: 1235288 - protein, 9 aa, Homo Sapiens
FSQSSPLTT

SEQ ID NO: 1235289 - protein, 9 aa, Homo Sapiens
SGSEGSMQT

SEQ ID NO: 1235290 - protein, 9 aa, Homo Sapiens
STHSPFRAH

SEQ ID NO: 1235291 - protein, 9 aa, Homo Sapiens
GATERDCAS

SEQ ID NO: 1235292 - protein, 9 aa, Homo Sapiens
VVKKRKKEP

SEQ ID NO: 1235293 - protein, 9 aa, Homo Sapiens
DTNHNEEYD

SEQ ID NO: 1235294 - protein, 9 aa, Homo Sapiens
GLSFNSSVN

SEQ ID NO: 1235295 - protein, 9 aa, Homo Sapiens
LSTGRASPA

SEQ ID NO: 1235296 - protein, 9 aa, Homo Sapiens
KDELFKMFC

SEQ ID NO: 1235297 - protein, 9 aa, Homo Sapiens
LPVLMNADC

SEQ ID NO: 1235298 - protein, 9 aa, Homo Sapiens
PTPNTVEQR

SEQ ID NO: 1235299 - protein, 9 aa, Homo Sapiens
QGFKGYECS

SEQ ID NO: 1235300 - protein, 9 aa, Homo Sapiens
IFQRSEHIS

SEQ ID NO: 1235301 - protein, 9 aa, Homo Sapiens
ISVPPSPTF

SEQ ID NO: 1235302 - protein, 9 aa, Homo Sapiens
GTAQSGVLT

SEQ ID NO: 1235303 - protein, 9 aa, Homo Sapiens
DSELGLTSE

SEQ ID NO: 1235304 - protein, 9 aa, Homo Sapiens
AGVEMQLMA

SEQ ID NO: 1235305 - protein, 9 aa, Homo Sapiens
DLVDVSSVK

SEQ ID NO: 1235306 - protein, 9 aa, Homo Sapiens
FSKEEWETM

SEQ ID NO: 1235307 - protein, 9 aa, Homo Sapiens
HRGRGRRPV

SEQ ID NO: 1235308 - protein, 9 aa, Homo Sapiens
FGGLGKEAE

SEQ ID NO: 1235309 - protein, 9 aa, Homo Sapiens
EAGPSRWPY

SEQ ID NO: 1235310 - protein, 9 aa, Homo Sapiens
TRPQKPIRC

SEQ ID NO: 1235311 - protein, 9 aa, Homo Sapiens
TQPQPLLQH

SEQ ID NO: 1235312 - protein, 9 aa, Homo Sapiens
APPTEETTY

SEQ ID NO: 1235313 - protein, 9 aa, Homo Sapiens
TSSPYASKS

SEQ ID NO: 1235314 - protein, 9 aa, Homo Sapiens
MYEGKMKGC

SEQ ID NO: 1235315 - protein, 9 aa, Homo Sapiens
LALIHAHWD

SEQ ID NO: 1235316 - protein, 9 aa, Homo Sapiens
EMTGIDLGT

SEQ ID NO: 1235317 - protein, 9 aa, Homo Sapiens
YLCYLAELM

SEQ ID NO: 1235318 - protein, 9 aa, Homo Sapiens
NDKYSSYNN

SEQ ID NO: 1235319 - protein, 9 aa, Homo Sapiens
VVDFDVRVD

SEQ ID NO: 1235320 - protein, 9 aa, Homo Sapiens
WLALENMTK

SEQ ID NO: 1235321 - protein, 9 aa, Homo Sapiens
PDIDLIPTG

SEQ ID NO: 1235322 - protein, 9 aa, Homo Sapiens
SKIRSNPEN

SEQ ID NO: 1235323 - protein, 9 aa, Homo Sapiens
KYGTLLKAV

SEQ ID NO: 1235324 - protein, 9 aa, Homo Sapiens
FIDAPYEKE

SEQ ID NO: 1235325 - protein, 9 aa, Homo Sapiens
GGGSALPNG

SEQ ID NO: 1235326 - protein, 9 aa, Homo Sapiens
PTLRCSAAA

SEQ ID NO: 1235327 - protein, 9 aa, Homo Sapiens
TTQPFFTTS

SEQ ID NO: 1235328 - protein, 9 aa, Homo Sapiens
EIDEIAAPQ

SEQ ID NO: 1235329 - protein, 9 aa, Homo Sapiens
MCRHPRPQL

SEQ ID NO: 1235330 - protein, 9 aa, Homo Sapiens
QLIVSQGPS

SEQ ID NO: 1235331 - protein, 9 aa, Homo Sapiens
AHSKMFPIP

SEQ ID NO: 1235332 - protein, 9 aa, Homo Sapiens
IKGMQRFAG

SEQ ID NO: 1235333 - protein, 9 aa, Homo Sapiens
DSDEYGDKT

SEQ ID NO: 1235334 - protein, 9 aa, Homo Sapiens
AAVLSSATA

SEQ ID NO: 1235335 - protein, 9 aa, Homo Sapiens
GYYRLSGEA

SEQ ID NO: 1235336 - protein, 9 aa, Homo Sapiens
QEDEEESWS

SEQ ID NO: 1235337 - protein, 9 aa, Homo Sapiens
GRELLIFLV

SEQ ID NO: 1235338 - protein, 9 aa, Homo Sapiens
EVKKEVKKR

SEQ ID NO: 1235339 - protein, 9 aa, Homo Sapiens
AKTDEVVPD

SEQ ID NO: 1235340 - protein, 9 aa, Homo Sapiens
SPDANVKTA

SEQ ID NO: 1235341 - protein, 9 aa, Homo Sapiens
SLAYQKQWE

SEQ ID NO: 1235342 - protein, 9 aa, Homo Sapiens
VLDLLWITS

SEQ ID NO: 1235343 - protein, 9 aa, Homo Sapiens
QIVAICSAE

SEQ ID NO: 1235344 - protein, 9 aa, Homo Sapiens
NTSAEAPQS

SEQ ID NO: 1235345 - protein, 9 aa, Homo Sapiens
ECQKRIDTY

SEQ ID NO: 1235346 - protein, 9 aa, Homo Sapiens
AGRKQLARH

SEQ ID NO: 1235347 - protein, 9 aa, Homo Sapiens
FGVTLLFAF

SEQ ID NO: 1235348 - protein, 9 aa, Homo Sapiens
PPGPEKGPP

SEQ ID NO: 1235349 - protein, 9 aa, Homo Sapiens
RKCIAKKKT

SEQ ID NO: 1235350 - protein, 9 aa, Homo Sapiens
WSRFRKLNW

SEQ ID NO: 1235351 - protein, 9 aa, Homo Sapiens
LSRHGKLCS

SEQ ID NO: 1235352 - protein, 9 aa, Homo Sapiens
GVYRRESVK

SEQ ID NO: 1235353 - protein, 9 aa, Homo Sapiens
HDNNPAIRD

SEQ ID NO: 1235354 - protein, 9 aa, Homo Sapiens
DNNSTSALE

SEQ ID NO: 1235355 - protein, 9 aa, Homo Sapiens
ILIELEKID

SEQ ID NO: 1235356 - protein, 9 aa, Homo Sapiens
GPPGPGLPT

SEQ ID NO: 1235357 - protein, 9 aa, Homo Sapiens
KLDDSDIPP

SEQ ID NO: 1235358 - protein, 9 aa, Homo Sapiens
AAVPAETVG

SEQ ID NO: 1235359 - protein, 9 aa, Homo Sapiens
TLEKCGYNK

SEQ ID NO: 1235360 - protein, 9 aa, Homo Sapiens
FAKDDTIGQ

SEQ ID NO: 1235361 - protein, 9 aa, Homo Sapiens
SDLIKLKTP

SEQ ID NO: 1235362 - protein, 9 aa, Homo Sapiens
GCSCDYIPG

SEQ ID NO: 1235363 - protein, 9 aa, Homo Sapiens
ENEDNSKWD

SEQ ID NO: 1235364 - protein, 9 aa, Homo Sapiens
SALQMESAA

SEQ ID NO: 1235365 - protein, 9 aa, Homo Sapiens
EPPQYMSVN

SEQ ID NO: 1235366 - protein, 9 aa, Homo Sapiens
VMTHLHMIE

SEQ ID NO: 1235367 - protein, 9 aa, Homo Sapiens
TLCSTCSRA

SEQ ID NO: 1235368 - protein, 9 aa, Homo Sapiens
ELRLRETLL

SEQ ID NO: 1235369 - protein, 9 aa, Homo Sapiens
KSTVKKVLP

SEQ ID NO: 1235370 - protein, 9 aa, Homo Sapiens
MAMVTADSK

SEQ ID NO: 1235371 - protein, 9 aa, Homo Sapiens
CRKKSTRPA

SEQ ID NO: 1235372 - protein, 9 aa, Homo Sapiens
RDAHQQRFA

SEQ ID NO: 1235373 - protein, 9 aa, Homo Sapiens
DEQGSAVEP

SEQ ID NO: 1235374 - protein, 9 aa, Homo Sapiens
ASSQKGLQA

SEQ ID NO: 1235375 - protein, 9 aa, Homo Sapiens
EPKAQPLRV

SEQ ID NO: 1235376 - protein, 9 aa, Homo Sapiens
VGLEIMTVV

SEQ ID NO: 1235377 - protein, 9 aa, Homo Sapiens
GFLGMLQMN

SEQ ID NO: 1235378 - protein, 9 aa, Homo Sapiens
HLHGMSSKN

SEQ ID NO: 1235379 - protein, 9 aa, Homo Sapiens
QEVEVKNVK

SEQ ID NO: 1235380 - protein, 9 aa, Homo Sapiens
DLVRIGLER

SEQ ID NO: 1235381 - protein, 9 aa, Homo Sapiens
GSGPKLPCS

SEQ ID NO: 1235382 - protein, 9 aa, Homo Sapiens
EELADLPKR

SEQ ID NO: 1235383 - protein, 9 aa, Homo Sapiens
ISSRDDPSM

SEQ ID NO: 1235384 - protein, 9 aa, Homo Sapiens
FFVTEGNCS

SEQ ID NO: 1235385 - protein, 9 aa, Homo Sapiens
THWWDAPSI

SEQ ID NO: 1235386 - protein, 9 aa, Homo Sapiens
WENMGQKEN

SEQ ID NO: 1235387 - protein, 9 aa, Homo Sapiens
CQKEAKEIA

SEQ ID NO: 1235388 - protein, 9 aa, Homo Sapiens
STSPKFHMT

SEQ ID NO: 1235389 - protein, 9 aa, Homo Sapiens
LARTVTVTS

SEQ ID NO: 1235390 - protein, 9 aa, Homo Sapiens
RAGHFEPLR

SEQ ID NO: 1235391 - protein, 9 aa, Homo Sapiens
LKFCKLNFN

SEQ ID NO: 1235392 - protein, 9 aa, Homo Sapiens
ATKCATILD

SEQ ID NO: 1235393 - protein, 9 aa, Homo Sapiens
NRLMNHFME

SEQ ID NO: 1235394 - protein, 9 aa, Homo Sapiens
NAIHALMEN

SEQ ID NO: 1235395 - protein, 9 aa, Homo Sapiens
AHLPWKVFT

SEQ ID NO: 1235396 - protein, 9 aa, Homo Sapiens
DVHDSTHVS

SEQ ID NO: 1235397 - protein, 9 aa, Homo Sapiens
IDMVPRMRQ

SEQ ID NO: 1235398 - protein, 9 aa, Homo Sapiens
HRGAGVLAG

SEQ ID NO: 1235399 - protein, 9 aa, Homo Sapiens
VKRTHYYET

SEQ ID NO: 1235400 - protein, 9 aa, Homo Sapiens
IGWGPWERC

SEQ ID NO: 1235401 - protein, 9 aa, Homo Sapiens
RSGLIHVCD

SEQ ID NO: 1235402 - protein, 9 aa, Homo Sapiens
DLPHSSGLA

SEQ ID NO: 1235403 - protein, 9 aa, Homo Sapiens
TEEPSTSSA

SEQ ID NO: 1235404 - protein, 9 aa, Homo Sapiens
HPVLLSIPW

SEQ ID NO: 1235405 - protein, 9 aa, Homo Sapiens
AEGPLTVIT

SEQ ID NO: 1235406 - protein, 9 aa, Homo Sapiens
IFRHYDTDQ

SEQ ID NO: 1235407 - protein, 9 aa, Homo Sapiens
PRLCGPTLH

SEQ ID NO: 1235408 - protein, 9 aa, Homo Sapiens
CPTIRIPNR

SEQ ID NO: 1235409 - protein, 9 aa, Homo Sapiens
MELLKEDVQ

SEQ ID NO: 1235410 - protein, 9 aa, Homo Sapiens
FCDALPILK

SEQ ID NO: 1235411 - protein, 9 aa, Homo Sapiens
FVGVTRHSG

SEQ ID NO: 1235412 - protein, 9 aa, Homo Sapiens
PALGVSITF

SEQ ID NO: 1235413 - protein, 9 aa, Homo Sapiens
ECFPTLTAF

SEQ ID NO: 1235414 - protein, 9 aa, Homo Sapiens
AFNSCRYDR

SEQ ID NO: 1235415 - protein, 9 aa, Homo Sapiens
MLSIQPKGK

SEQ ID NO: 1235416 - protein, 9 aa, Homo Sapiens
LNEWHYGGL

SEQ ID NO: 1235417 - protein, 9 aa, Homo Sapiens
FCARSSWLP

SEQ ID NO: 1235418 - protein, 9 aa, Homo Sapiens
CASVAIGKL

SEQ ID NO: 1235419 - protein, 9 aa, Homo Sapiens
TSGTPSSSR

SEQ ID NO: 1235420 - protein, 9 aa, Homo Sapiens
FDLLKTGSS

SEQ ID NO: 1235421 - protein, 9 aa, Homo Sapiens
RRLAQQSLN

SEQ ID NO: 1235422 - protein, 9 aa, Homo Sapiens
LSESGTIMT

SEQ ID NO: 1235423 - protein, 9 aa, Homo Sapiens
FDALLTHRV

SEQ ID NO: 1235424 - protein, 9 aa, Homo Sapiens
SLTRPRVFY

SEQ ID NO: 1235425 - protein, 9 aa, Homo Sapiens
EHLSSSGRL

SEQ ID NO: 1235426 - protein, 9 aa, Homo Sapiens
VFHVYPLLN

SEQ ID NO: 1235427 - protein, 9 aa, Homo Sapiens
LAKKWGSKG

SEQ ID NO: 1235428 - protein, 9 aa, Homo Sapiens
QIPNLCGVS

SEQ ID NO: 1235429 - protein, 9 aa, Homo Sapiens
IMLRLFETY

SEQ ID NO: 1235430 - protein, 9 aa, Homo Sapiens
PVLPSEANF

SEQ ID NO: 1235431 - protein, 9 aa, Homo Sapiens
SLENANYKY

SEQ ID NO: 1235432 - protein, 9 aa, Homo Sapiens
QLIVNDDIN

SEQ ID NO: 1235433 - protein, 9 aa, Homo Sapiens
NMTLPATTL

SEQ ID NO: 1235434 - protein, 9 aa, Homo Sapiens
RLEATDVKS

SEQ ID NO: 1235435 - protein, 9 aa, Homo Sapiens
WDDYRVGFG

SEQ ID NO: 1235436 - protein, 9 aa, Homo Sapiens
LNSASASGC

SEQ ID NO: 1235437 - protein, 9 aa, Homo Sapiens
TVKMIMVDD

SEQ ID NO: 1235438 - protein, 9 aa, Homo Sapiens
FFCAPPEKS

SEQ ID NO: 1235439 - protein, 9 aa, Homo Sapiens
NFPLGNVQF

SEQ ID NO: 1235440 - protein, 9 aa, Homo Sapiens
EMAMVTADS

SEQ ID NO: 1235441 - protein, 9 aa, Homo Sapiens
VSVVLCCLR

SEQ ID NO: 1235442 - protein, 9 aa, Homo Sapiens
WFLGKTRRV

SEQ ID NO: 1235443 - protein, 9 aa, Homo Sapiens
HIFTRCIQV

SEQ ID NO: 1235444 - protein, 9 aa, Homo Sapiens
ILREDAPTE

SEQ ID NO: 1235445 - protein, 9 aa, Homo Sapiens
IPDRPTGIG

SEQ ID NO: 1235446 - protein, 9 aa, Homo Sapiens
TDGLTFGHM

SEQ ID NO: 1235447 - protein, 9 aa, Homo Sapiens
QQLEQFEKD

SEQ ID NO: 1235448 - protein, 9 aa, Homo Sapiens
PQVLDSQHQ

SEQ ID NO: 1235449 - protein, 9 aa, Homo Sapiens
EQISHAQML

SEQ ID NO: 1235450 - protein, 9 aa, Homo Sapiens
QCFQMMEGK

SEQ ID NO: 1235451 - protein, 9 aa, Homo Sapiens
SIMKVMIPL

SEQ ID NO: 1235452 - protein, 9 aa, Homo Sapiens
GQILLRDQA

SEQ ID NO: 1235453 - protein, 9 aa, Homo Sapiens
DSRHIFNQN

SEQ ID NO: 1235454 - protein, 9 aa, Homo Sapiens
FTCLEAREH

SEQ ID NO: 1235455 - protein, 9 aa, Homo Sapiens
QSSVVISDC

SEQ ID NO: 1235456 - protein, 9 aa, Homo Sapiens
QWTLQEALS

SEQ ID NO: 1235457 - protein, 9 aa, Homo Sapiens
CGNGTLPAC

SEQ ID NO: 1235458 - protein, 9 aa, Homo Sapiens
SDVGLLEGS

SEQ ID NO: 1235459 - protein, 9 aa, Homo Sapiens
HTKLSSQEI

SEQ ID NO: 1235460 - protein, 9 aa, Homo Sapiens
SSINPKFLS

SEQ ID NO: 1235461 - protein, 9 aa, Homo Sapiens
SPESLKPST

SEQ ID NO: 1235462 - protein, 9 aa, Homo Sapiens
GAEGPTPRS

SEQ ID NO: 1235463 - protein, 9 aa, Homo Sapiens
GRKKFFSTC

SEQ ID NO: 1235464 - protein, 9 aa, Homo Sapiens
LHPGHAFFL

SEQ ID NO: 1235465 - protein, 9 aa, Homo Sapiens
LGLRPTRKV

SEQ ID NO: 1235466 - protein, 9 aa, Homo Sapiens
QYSISYTLS

SEQ ID NO: 1235467 - protein, 9 aa, Homo Sapiens
TYDSFLNYP

SEQ ID NO: 1235468 - protein, 9 aa, Homo Sapiens
RRDFHSDTL

SEQ ID NO: 1235469 - protein, 9 aa, Homo Sapiens
RLNVPKDSV

SEQ ID NO: 1235470 - protein, 9 aa, Homo Sapiens
DKGDCHIFT

SEQ ID NO: 1235471 - protein, 9 aa, Homo Sapiens
VSRLRLVPP

SEQ ID NO: 1235472 - protein, 9 aa, Homo Sapiens
YTFTMDFCF

SEQ ID NO: 1235473 - protein, 9 aa, Homo Sapiens
GREKPVYYA

SEQ ID NO: 1235474 - protein, 9 aa, Homo Sapiens
QHMSSPGEE

SEQ ID NO: 1235475 - protein, 9 aa, Homo Sapiens
LKLMQQALQ

SEQ ID NO: 1235476 - protein, 9 aa, Homo Sapiens
LVFLTHALL

SEQ ID NO: 1235477 - protein, 9 aa, Homo Sapiens
AMEQYECSL

SEQ ID NO: 1235478 - protein, 9 aa, Homo Sapiens
CEEVDATRG

SEQ ID NO: 1235479 - protein, 9 aa, Homo Sapiens
LYMYLQYPS

SEQ ID NO: 1235480 - protein, 9 aa, Homo Sapiens
QPHVDFVGE

SEQ ID NO: 1235481 - protein, 9 aa, Homo Sapiens
SLQALQATI

SEQ ID NO: 1235482 - protein, 9 aa, Homo Sapiens
PLRSFVNPL

SEQ ID NO: 1235483 - protein, 9 aa, Homo Sapiens
QAVLDGFDA

SEQ ID NO: 1235484 - protein, 9 aa, Homo Sapiens
FRFDASDKP

SEQ ID NO: 1235485 - protein, 9 aa, Homo Sapiens
NSPTTTMNN

SEQ ID NO: 1235486 - protein, 9 aa, Homo Sapiens
EKLRDAIKG

SEQ ID NO: 1235487 - protein, 9 aa, Homo Sapiens
KTLEKMLLE

SEQ ID NO: 1235488 - protein, 9 aa, Homo Sapiens
LRMALGEGA

SEQ ID NO: 1235489 - protein, 9 aa, Homo Sapiens
LVCGRLSVT

SEQ ID NO: 1235490 - protein, 9 aa, Homo Sapiens
TTRNVNSSR

SEQ ID NO: 1235491 - protein, 9 aa, Homo Sapiens
HGTRLPPPT

SEQ ID NO: 1235492 - protein, 9 aa, Homo Sapiens
VEQSQKRGL

SEQ ID NO: 1235493 - protein, 9 aa, Homo Sapiens
DKTCMHTVP

SEQ ID NO: 1235494 - protein, 9 aa, Homo Sapiens
ATSQGFFQS

SEQ ID NO: 1235495 - protein, 9 aa, Homo Sapiens
MPPSTILQQ

SEQ ID NO: 1235496 - protein, 9 aa, Homo Sapiens
WEDNFNCKL

SEQ ID NO: 1235497 - protein, 9 aa, Homo Sapiens
RQTKWRKKH

SEQ ID NO: 1235498 - protein, 9 aa, Homo Sapiens
NIFTDFDKY

SEQ ID NO: 1235499 - protein, 9 aa, Homo Sapiens
LKQFYKGKK

SEQ ID NO: 1235500 - protein, 9 aa, Homo Sapiens
QLIPNLTMK

SEQ ID NO: 1235501 - protein, 9 aa, Homo Sapiens
EGSDLESII

SEQ ID NO: 1235502 - protein, 9 aa, Homo Sapiens
SYVEVLTDG

SEQ ID NO: 1235503 - protein, 9 aa, Homo Sapiens
PGPGKLALS

SEQ ID NO: 1235504 - protein, 9 aa, Homo Sapiens
TRTHQGHHV

SEQ ID NO: 1235505 - protein, 9 aa, Homo Sapiens
RNSSDNAID

SEQ ID NO: 1235506 - protein, 9 aa, Homo Sapiens
LNQHREKKR

SEQ ID NO: 1235507 - protein, 9 aa, Homo Sapiens
STQGGHMNS

SEQ ID NO: 1235508 - protein, 9 aa, Homo Sapiens
CGGHRGGRG

SEQ ID NO: 1235509 - protein, 9 aa, Homo Sapiens
SSSEDTLNN

SEQ ID NO: 1235510 - protein, 9 aa, Homo Sapiens
KVRHKRHAL

SEQ ID NO: 1235511 - protein, 9 aa, Homo Sapiens
CARTMPLCA

SEQ ID NO: 1235512 - protein, 9 aa, Homo Sapiens
DYKVASDEY

SEQ ID NO: 1235513 - protein, 9 aa, Homo Sapiens
AGILGHANL

SEQ ID NO: 1235514 - protein, 9 aa, Homo Sapiens
GSGQSYRLV

SEQ ID NO: 1235515 - protein, 9 aa, Homo Sapiens
CPGPGELRL

SEQ ID NO: 1235516 - protein, 9 aa, Homo Sapiens
YHNWGHQSD

SEQ ID NO: 1235517 - protein, 9 aa, Homo Sapiens
SEIGGITIT

SEQ ID NO: 1235518 - protein, 9 aa, Homo Sapiens
DPDGRYYNE

SEQ ID NO: 1235519 - protein, 9 aa, Homo Sapiens
YKITYWPKL

SEQ ID NO: 1235520 - protein, 9 aa, Homo Sapiens
TEHVERFFE

SEQ ID NO: 1235521 - protein, 9 aa, Homo Sapiens
LSKTSESSA

SEQ ID NO: 1235522 - protein, 9 aa, Homo Sapiens
CLPGEAPVI

SEQ ID NO: 1235523 - protein, 9 aa, Homo Sapiens
YHCIEKGFA

SEQ ID NO: 1235524 - protein, 9 aa, Homo Sapiens
QPVMIITEF

SEQ ID NO: 1235525 - protein, 9 aa, Homo Sapiens
RILLTGLHS

SEQ ID NO: 1235526 - protein, 9 aa, Homo Sapiens
STNGEKRKI

SEQ ID NO: 1235527 - protein, 9 aa, Homo Sapiens
FQEALDPVP

SEQ ID NO: 1235528 - protein, 9 aa, Homo Sapiens
LARDLNAVK

SEQ ID NO: 1235529 - protein, 9 aa, Homo Sapiens
MCIVGHLPW

SEQ ID NO: 1235530 - protein, 9 aa, Homo Sapiens
CEMADEEHR

SEQ ID NO: 1235531 - protein, 9 aa, Homo Sapiens
DTQTALNNA

SEQ ID NO: 1235532 - protein, 9 aa, Homo Sapiens
QCTFFFLHK

SEQ ID NO: 1235533 - protein, 9 aa, Homo Sapiens
GMFGRCQKV

SEQ ID NO: 1235534 - protein, 9 aa, Homo Sapiens
GEHDLIEDL

SEQ ID NO: 1235535 - protein, 9 aa, Homo Sapiens
MDPGGMMRE

SEQ ID NO: 1235536 - protein, 9 aa, Homo Sapiens
NLNELASLD

SEQ ID NO: 1235537 - protein, 9 aa, Homo Sapiens
ILGVVHMSF

SEQ ID NO: 1235538 - protein, 9 aa, Homo Sapiens
LELAGQILL

SEQ ID NO: 1235539 - protein, 9 aa, Homo Sapiens
GGSFLMFKV

SEQ ID NO: 1235540 - protein, 9 aa, Homo Sapiens
DSRDEIQES

SEQ ID NO: 1235541 - protein, 9 aa, Homo Sapiens
HIMHLDEHL

SEQ ID NO: 1235542 - protein, 9 aa, Homo Sapiens
LVGTGSNIE

SEQ ID NO: 1235543 - protein, 9 aa, Homo Sapiens
TDVKNLPGV

SEQ ID NO: 1235544 - protein, 9 aa, Homo Sapiens
RCPKASCLL

SEQ ID NO: 1235545 - protein, 9 aa, Homo Sapiens
ICHRGTRPP

SEQ ID NO: 1235546 - protein, 9 aa, Homo Sapiens
KLSSDGKEV

SEQ ID NO: 1235547 - protein, 9 aa, Homo Sapiens
EASIAGSGK

SEQ ID NO: 1235548 - protein, 9 aa, Homo Sapiens
QNLPFEPHT

SEQ ID NO: 1235549 - protein, 9 aa, Homo Sapiens
LLFLTQPGA

SEQ ID NO: 1235550 - protein, 9 aa, Homo Sapiens
IIRPSIEEV

SEQ ID NO: 1235551 - protein, 9 aa, Homo Sapiens
GVGPDLEVQ

SEQ ID NO: 1235552 - protein, 9 aa, Homo Sapiens
LYVRTGKAH

SEQ ID NO: 1235553 - protein, 9 aa, Homo Sapiens
RDTHGGEAF

SEQ ID NO: 1235554 - protein, 9 aa, Homo Sapiens
DSFQDDVKC

SEQ ID NO: 1235555 - protein, 9 aa, Homo Sapiens
TDCWTYRYS

SEQ ID NO: 1235556 - protein, 9 aa, Homo Sapiens
TEGLQTLCV

SEQ ID NO: 1235557 - protein, 9 aa, Homo Sapiens
LDMEGMLHH

SEQ ID NO: 1235558 - protein, 9 aa, Homo Sapiens
CPSSPSTTP

SEQ ID NO: 1235559 - protein, 9 aa, Homo Sapiens
TFGRILQHE

SEQ ID NO: 1235560 - protein, 9 aa, Homo Sapiens
DLQAQAVAH

SEQ ID NO: 1235561 - protein, 9 aa, Homo Sapiens
DQCHRDGQR

SEQ ID NO: 1235562 - protein, 9 aa, Homo Sapiens
QDIYKQFDT

SEQ ID NO: 1235563 - protein, 9 aa, Homo Sapiens
LALLLFSLH

SEQ ID NO: 1235564 - protein, 9 aa, Homo Sapiens
IHIDFSLDQ

SEQ ID NO: 1235565 - protein, 9 aa, Homo Sapiens
RPRGNQGDR

SEQ ID NO: 1235566 - protein, 9 aa, Homo Sapiens
SRTPHWRLC

SEQ ID NO: 1235567 - protein, 9 aa, Homo Sapiens
AGLLSHDQL

SEQ ID NO: 1235568 - protein, 9 aa, Homo Sapiens
AVFPHGSGA

SEQ ID NO: 1235569 - protein, 9 aa, Homo Sapiens
RVDHIMMLK

SEQ ID NO: 1235570 - protein, 9 aa, Homo Sapiens
SGKLIAAVM

SEQ ID NO: 1235571 - protein, 9 aa, Homo Sapiens
QKCQQQKDF

SEQ ID NO: 1235572 - protein, 9 aa, Homo Sapiens
SVATFPDPN

SEQ ID NO: 1235573 - protein, 9 aa, Homo Sapiens
GPMNHDELK

SEQ ID NO: 1235574 - protein, 9 aa, Homo Sapiens
ELDIQISKD

SEQ ID NO: 1235575 - protein, 9 aa, Homo Sapiens
KAELIMYRK

SEQ ID NO: 1235576 - protein, 9 aa, Homo Sapiens
IIGVIIGKI

SEQ ID NO: 1235577 - protein, 9 aa, Homo Sapiens
PNATFNWNT

SEQ ID NO: 1235578 - protein, 9 aa, Homo Sapiens
RTHTGSNID

SEQ ID NO: 1235579 - protein, 9 aa, Homo Sapiens
LSLSRHDEI

SEQ ID NO: 1235580 - protein, 9 aa, Homo Sapiens
SVMRRFDDQ

SEQ ID NO: 1235581 - protein, 9 aa, Homo Sapiens
PQTILHKYY

SEQ ID NO: 1235582 - protein, 9 aa, Homo Sapiens
WLSFASTVC

SEQ ID NO: 1235583 - protein, 9 aa, Homo Sapiens
AQEAEAIHI

SEQ ID NO: 1235584 - protein, 9 aa, Homo Sapiens
SMTDIYMLN

SEQ ID NO: 1235585 - protein, 9 aa, Homo Sapiens
NSPSDTPEE

SEQ ID NO: 1235586 - protein, 9 aa, Homo Sapiens
AKLGVVTPE

SEQ ID NO: 1235587 - protein, 9 aa, Homo Sapiens
HLHSPMYYF

SEQ ID NO: 1235588 - protein, 9 aa, Homo Sapiens
EGYDGKEPQ

SEQ ID NO: 1235589 - protein, 9 aa, Homo Sapiens
KGLLLSCID

SEQ ID NO: 1235590 - protein, 9 aa, Homo Sapiens
PHLTVGLLK

SEQ ID NO: 1235591 - protein, 9 aa, Homo Sapiens
IIILDNLDA

SEQ ID NO: 1235592 - protein, 9 aa, Homo Sapiens
SLRQFPPGM

SEQ ID NO: 1235593 - protein, 9 aa, Homo Sapiens
LGMFNSSLH

SEQ ID NO: 1235594 - protein, 9 aa, Homo Sapiens
LCPGPGELR

SEQ ID NO: 1235595 - protein, 9 aa, Homo Sapiens
TILTYHDVG

SEQ ID NO: 1235596 - protein, 9 aa, Homo Sapiens
GLRIGCAFT

SEQ ID NO: 1235597 - protein, 9 aa, Homo Sapiens
LTQEHIEAI

SEQ ID NO: 1235598 - protein, 9 aa, Homo Sapiens
SQVAMMGLT

SEQ ID NO: 1235599 - protein, 9 aa, Homo Sapiens
HILVCFLKR

SEQ ID NO: 1235600 - protein, 9 aa, Homo Sapiens
LNSFPVPVS

SEQ ID NO: 1235601 - protein, 9 aa, Homo Sapiens
DAEIKNGLL

SEQ ID NO: 1235602 - protein, 9 aa, Homo Sapiens
EHYHLLHRY

SEQ ID NO: 1235603 - protein, 9 aa, Homo Sapiens
FGNNLVVIV

SEQ ID NO: 1235604 - protein, 9 aa, Homo Sapiens
LNIAIVWLA

SEQ ID NO: 1235605 - protein, 9 aa, Homo Sapiens
ATSDKMQYF

SEQ ID NO: 1235606 - protein, 9 aa, Homo Sapiens
KQKLQDEDY

SEQ ID NO: 1235607 - protein, 9 aa, Homo Sapiens
ILMLKGKSQ

SEQ ID NO: 1235608 - protein, 9 aa, Homo Sapiens
LNCESVSDH

SEQ ID NO: 1235609 - protein, 9 aa, Homo Sapiens
KTLKWGLYI

SEQ ID NO: 1235610 - protein, 9 aa, Homo Sapiens
REWEMLHNF

SEQ ID NO: 1235611 - protein, 9 aa, Homo Sapiens
VHPAPTPRW

SEQ ID NO: 1235612 - protein, 9 aa, Homo Sapiens
QSLGLTWPV

SEQ ID NO: 1235613 - protein, 9 aa, Homo Sapiens
VEPHLVYCY

SEQ ID NO: 1235614 - protein, 9 aa, Homo Sapiens
LTMDACYGI

SEQ ID NO: 1235615 - protein, 9 aa, Homo Sapiens
FVFNLMPGD

SEQ ID NO: 1235616 - protein, 9 aa, Homo Sapiens
GFCKMSGYH

SEQ ID NO: 1235617 - protein, 9 aa, Homo Sapiens
YKKMIVFEP

SEQ ID NO: 1235618 - protein, 9 aa, Homo Sapiens
NVTEVFSKT

SEQ ID NO: 1235619 - protein, 9 aa, Homo Sapiens
EFLTDTEKR

SEQ ID NO: 1235620 - protein, 9 aa, Homo Sapiens
VTLLFAFFV

SEQ ID NO: 1235621 - protein, 9 aa, Homo Sapiens
GHNFCAEGH

SEQ ID NO: 1235622 - protein, 9 aa, Homo Sapiens
DGEDGIFLL

SEQ ID NO: 1235623 - protein, 9 aa, Homo Sapiens
EKTGRLQQE

SEQ ID NO: 1235624 - protein, 9 aa, Homo Sapiens
CGRNGVALE

SEQ ID NO: 1235625 - protein, 9 aa, Homo Sapiens
KWLDMFSDW

SEQ ID NO: 1235626 - protein, 9 aa, Homo Sapiens
HALRLEHSN

SEQ ID NO: 1235627 - protein, 9 aa, Homo Sapiens
VYILTLILR

SEQ ID NO: 1235628 - protein, 9 aa, Homo Sapiens
SSVNRHRHM

SEQ ID NO: 1235629 - protein, 9 aa, Homo Sapiens
NSDYIEQEV

SEQ ID NO: 1235630 - protein, 9 aa, Homo Sapiens
RSVNDLHQE

SEQ ID NO: 1235631 - protein, 9 aa, Homo Sapiens
DEPETYMAA

SEQ ID NO: 1235632 - protein, 9 aa, Homo Sapiens
LSVLLYATV

SEQ ID NO: 1235633 - protein, 9 aa, Homo Sapiens
QCPMTFGPH

SEQ ID NO: 1235634 - protein, 9 aa, Homo Sapiens
NVRIARTFC

SEQ ID NO: 1235635 - protein, 9 aa, Homo Sapiens
PHENGSNGT

SEQ ID NO: 1235636 - protein, 9 aa, Homo Sapiens
EMIALKMRS

SEQ ID NO: 1235637 - protein, 9 aa, Homo Sapiens
QKLQDEDYQ

SEQ ID NO: 1235638 - protein, 9 aa, Homo Sapiens
WRVRNPTVR

SEQ ID NO: 1235639 - protein, 9 aa, Homo Sapiens
EGSEHKLSH

SEQ ID NO: 1235640 - protein, 9 aa, Homo Sapiens
PMPEPRPTQ

SEQ ID NO: 1235641 - protein, 9 aa, Homo Sapiens
MNQEDLARI

SEQ ID NO: 1235642 - protein, 9 aa, Homo Sapiens
YDQRYSGST

SEQ ID NO: 1235643 - protein, 9 aa, Homo Sapiens
HLSLEASTG

SEQ ID NO: 1235644 - protein, 9 aa, Homo Sapiens
GKNHKMCII

SEQ ID NO: 1235645 - protein, 9 aa, Homo Sapiens
HGVFLNVSS

SEQ ID NO: 1235646 - protein, 9 aa, Homo Sapiens
LRSRNLLMV

SEQ ID NO: 1235647 - protein, 9 aa, Homo Sapiens
AHVVCREMG

SEQ ID NO: 1235648 - protein, 9 aa, Homo Sapiens
WKTNTHLPR

SEQ ID NO: 1235649 - protein, 9 aa, Homo Sapiens
VLYVWAHLN

SEQ ID NO: 1235650 - protein, 9 aa, Homo Sapiens
FQNPTVQFH

SEQ ID NO: 1235651 - protein, 9 aa, Homo Sapiens
QRQKAASFQ

SEQ ID NO: 1235652 - protein, 9 aa, Homo Sapiens
EMQKEEKKT

SEQ ID NO: 1235653 - protein, 9 aa, Homo Sapiens
VTKWKKMNF

SEQ ID NO: 1235654 - protein, 9 aa, Homo Sapiens
TSSHLHLKR

SEQ ID NO: 1235655 - protein, 9 aa, Homo Sapiens
ERVTQDLAE

SEQ ID NO: 1235656 - protein, 9 aa, Homo Sapiens
FDKDGDETI

SEQ ID NO: 1235657 - protein, 9 aa, Homo Sapiens
KKEAQAAVP

SEQ ID NO: 1235658 - protein, 9 aa, Homo Sapiens
NHASESAVW

SEQ ID NO: 1235659 - protein, 9 aa, Homo Sapiens
NSAPYGTRY

SEQ ID NO: 1235660 - protein, 9 aa, Homo Sapiens
DQLKRSEAD

SEQ ID NO: 1235661 - protein, 9 aa, Homo Sapiens
NLLKYVNMD

SEQ ID NO: 1235662 - protein, 9 aa, Homo Sapiens
SLISSDNLT

SEQ ID NO: 1235663 - protein, 9 aa, Homo Sapiens
EEPVELRGQ

SEQ ID NO: 1235664 - protein, 9 aa, Homo Sapiens
FIFTYGMHM

SEQ ID NO: 1235665 - protein, 9 aa, Homo Sapiens
AMRMCAARL

SEQ ID NO: 1235666 - protein, 9 aa, Homo Sapiens
TREVAIEVS

SEQ ID NO: 1235667 - protein, 9 aa, Homo Sapiens
AKPIPHSDE

SEQ ID NO: 1235668 - protein, 9 aa, Homo Sapiens
QFPLTCTNI

SEQ ID NO: 1235669 - protein, 9 aa, Homo Sapiens
PLFSTVCQG

SEQ ID NO: 1235670 - protein, 9 aa, Homo Sapiens
VIVLGADTR

SEQ ID NO: 1235671 - protein, 9 aa, Homo Sapiens
HTSTPLVYE

SEQ ID NO: 1235672 - protein, 9 aa, Homo Sapiens
PISPKKPKI

SEQ ID NO: 1235673 - protein, 9 aa, Homo Sapiens
MKRPIREVH

SEQ ID NO: 1235674 - protein, 9 aa, Homo Sapiens
AELGLGVHQ

SEQ ID NO: 1235675 - protein, 9 aa, Homo Sapiens
LHFSVLMLP

SEQ ID NO: 1235676 - protein, 9 aa, Homo Sapiens
PPPYPRPAF

SEQ ID NO: 1235677 - protein, 9 aa, Homo Sapiens
WKKEKLRDR

SEQ ID NO: 1235678 - protein, 9 aa, Homo Sapiens
AQSLSEYNR

SEQ ID NO: 1235679 - protein, 9 aa, Homo Sapiens
ALGATAAPP

SEQ ID NO: 1235680 - protein, 9 aa, Homo Sapiens
HPQLASVTF

SEQ ID NO: 1235681 - protein, 9 aa, Homo Sapiens
THTPCVPNR

SEQ ID NO: 1235682 - protein, 9 aa, Homo Sapiens
TVPGMPNSG

SEQ ID NO: 1235683 - protein, 9 aa, Homo Sapiens
TTPACCKFS

SEQ ID NO: 1235684 - protein, 9 aa, Homo Sapiens
RDYRLPRVE

SEQ ID NO: 1235685 - protein, 9 aa, Homo Sapiens
KALEECECE

SEQ ID NO: 1235686 - protein, 9 aa, Homo Sapiens
ELAGQILLR

SEQ ID NO: 1235687 - protein, 9 aa, Homo Sapiens
ILKRDVDII

SEQ ID NO: 1235688 - protein, 9 aa, Homo Sapiens
DFSLKTIST

SEQ ID NO: 1235689 - protein, 9 aa, Homo Sapiens
KTDEVVPDQ

SEQ ID NO: 1235690 - protein, 9 aa, Homo Sapiens
HELNLEEKQ

SEQ ID NO: 1235691 - protein, 9 aa, Homo Sapiens
DHFLTTLSS

SEQ ID NO: 1235692 - protein, 9 aa, Homo Sapiens
EPPRVILYH

SEQ ID NO: 1235693 - protein, 9 aa, Homo Sapiens
NGKILKACV

SEQ ID NO: 1235694 - protein, 9 aa, Homo Sapiens
RQLYTSGLL

SEQ ID NO: 1235695 - protein, 9 aa, Homo Sapiens
SEKSRVNEI

SEQ ID NO: 1235696 - protein, 9 aa, Homo Sapiens
KKKTKKIVY

SEQ ID NO: 1235697 - protein, 9 aa, Homo Sapiens
RFRGLGDRP

SEQ ID NO: 1235698 - protein, 9 aa, Homo Sapiens
QEPAQHCSM

SEQ ID NO: 1235699 - protein, 9 aa, Homo Sapiens
AVDAISISI

SEQ ID NO: 1235700 - protein, 9 aa, Homo Sapiens
AFIKLWIEL

SEQ ID NO: 1235701 - protein, 9 aa, Homo Sapiens
PKVSSISTE

SEQ ID NO: 1235702 - protein, 9 aa, Homo Sapiens
VSGDMCSLE

SEQ ID NO: 1235703 - protein, 9 aa, Homo Sapiens
DMVPRMRQT

SEQ ID NO: 1235704 - protein, 9 aa, Homo Sapiens
FNIVTLQLF

SEQ ID NO: 1235705 - protein, 9 aa, Homo Sapiens
RTMGLLVKR

SEQ ID NO: 1235706 - protein, 9 aa, Homo Sapiens
NVAVMCLIT

SEQ ID NO: 1235707 - protein, 9 aa, Homo Sapiens
EIVPLFREN

SEQ ID NO: 1235708 - protein, 9 aa, Homo Sapiens
GHPHCMSVI

SEQ ID NO: 1235709 - protein, 9 aa, Homo Sapiens
LKVKVRQWR

SEQ ID NO: 1235710 - protein, 9 aa, Homo Sapiens
GITLSSSLS

SEQ ID NO: 1235711 - protein, 9 aa, Homo Sapiens
MVLGAFAAC

SEQ ID NO: 1235712 - protein, 9 aa, Homo Sapiens
ASMVLSLEV

SEQ ID NO: 1235713 - protein, 9 aa, Homo Sapiens
TAINNLNPT

SEQ ID NO: 1235714 - protein, 9 aa, Homo Sapiens
SRKPRNLKT

SEQ ID NO: 1235715 - protein, 9 aa, Homo Sapiens
QTDASVYQQ

SEQ ID NO: 1235716 - protein, 9 aa, Homo Sapiens
PPAPAPAAV

SEQ ID NO: 1235717 - protein, 9 aa, Homo Sapiens
KATGPRGEP

SEQ ID NO: 1235718 - protein, 9 aa, Homo Sapiens
QSKMYSQGM

SEQ ID NO: 1235719 - protein, 9 aa, Homo Sapiens
GRYVGAALG

SEQ ID NO: 1235720 - protein, 9 aa, Homo Sapiens
IVYQQSQYL

SEQ ID NO: 1235721 - protein, 9 aa, Homo Sapiens
EGESWPDIE

SEQ ID NO: 1235722 - protein, 9 aa, Homo Sapiens
LEMTTERWL

SEQ ID NO: 1235723 - protein, 9 aa, Homo Sapiens
ITFLTLLGN

SEQ ID NO: 1235724 - protein, 9 aa, Homo Sapiens
MGGMSTDVS

SEQ ID NO: 1235725 - protein, 9 aa, Homo Sapiens
KKESINDGH

SEQ ID NO: 1235726 - protein, 9 aa, Homo Sapiens
PSPSVAKTE

SEQ ID NO: 1235727 - protein, 9 aa, Homo Sapiens
KLCSNFWGA

SEQ ID NO: 1235728 - protein, 9 aa, Homo Sapiens
ASSLDNVVT

SEQ ID NO: 1235729 - protein, 9 aa, Homo Sapiens
EGLDWLSQQ

SEQ ID NO: 1235730 - protein, 9 aa, Homo Sapiens
RIPITPENP

SEQ ID NO: 1235731 - protein, 9 aa, Homo Sapiens
SAVFYLLWT

SEQ ID NO: 1235732 - protein, 9 aa, Homo Sapiens
VGLLAAVVA

SEQ ID NO: 1235733 - protein, 9 aa, Homo Sapiens
TLLNGEQTE

SEQ ID NO: 1235734 - protein, 9 aa, Homo Sapiens
LINLDVTNP

SEQ ID NO: 1235735 - protein, 9 aa, Homo Sapiens
LFRSALSVY

SEQ ID NO: 1235736 - protein, 9 aa, Homo Sapiens
MPCSRPRSR

SEQ ID NO: 1235737 - protein, 9 aa, Homo Sapiens
FVLFLNDLR

SEQ ID NO: 1235738 - protein, 9 aa, Homo Sapiens
AIINHVSKV

SEQ ID NO: 1235739 - protein, 9 aa, Homo Sapiens
QNDIPIPQS

SEQ ID NO: 1235740 - protein, 9 aa, Homo Sapiens
FPGSFDVMS

SEQ ID NO: 1235741 - protein, 9 aa, Homo Sapiens
YGGLGYGYV

SEQ ID NO: 1235742 - protein, 9 aa, Homo Sapiens
VIPSMGVVS

SEQ ID NO: 1235743 - protein, 9 aa, Homo Sapiens
DHAEVQSPL

SEQ ID NO: 1235744 - protein, 9 aa, Homo Sapiens
QSTAGRKDH

SEQ ID NO: 1235745 - protein, 9 aa, Homo Sapiens
VICVPESTG

SEQ ID NO: 1235746 - protein, 9 aa, Homo Sapiens
SLTAQPTKV

SEQ ID NO: 1235747 - protein, 9 aa, Homo Sapiens
KAINQQMGA

SEQ ID NO: 1235748 - protein, 9 aa, Homo Sapiens
SGSDSDEPM

SEQ ID NO: 1235749 - protein, 9 aa, Homo Sapiens
RHGFTSFRW

SEQ ID NO: 1235750 - protein, 9 aa, Homo Sapiens
LARMFKLLE

SEQ ID NO: 1235751 - protein, 9 aa, Homo Sapiens
SKREMDELK

SEQ ID NO: 1235752 - protein, 9 aa, Homo Sapiens
SSVCEIWMN

SEQ ID NO: 1235753 - protein, 9 aa, Homo Sapiens
CSDSSGVID

SEQ ID NO: 1235754 - protein, 9 aa, Homo Sapiens
YLADLLLSV

SEQ ID NO: 1235755 - protein, 9 aa, Homo Sapiens
LNSANLLKG

SEQ ID NO: 1235756 - protein, 9 aa, Homo Sapiens
NVLWVHSNQ

SEQ ID NO: 1235757 - protein, 9 aa, Homo Sapiens
YTINNKRNG

SEQ ID NO: 1235758 - protein, 9 aa, Homo Sapiens
QIIPPAGYV

SEQ ID NO: 1235759 - protein, 9 aa, Homo Sapiens
AAGIPNIQS

SEQ ID NO: 1235760 - protein, 9 aa, Homo Sapiens
HSVMVDATT

SEQ ID NO: 1235761 - protein, 9 aa, Homo Sapiens
LTRTLQTNM

SEQ ID NO: 1235762 - protein, 9 aa, Homo Sapiens
SGRLVKAST

SEQ ID NO: 1235763 - protein, 9 aa, Homo Sapiens
STCFDAAQG

SEQ ID NO: 1235764 - protein, 9 aa, Homo Sapiens
KRIVSGVYD

SEQ ID NO: 1235765 - protein, 9 aa, Homo Sapiens
VLMDRGDTC

SEQ ID NO: 1235766 - protein, 9 aa, Homo Sapiens
EMAQKKMNY

SEQ ID NO: 1235767 - protein, 9 aa, Homo Sapiens
NLTDISQPT

SEQ ID NO: 1235768 - protein, 9 aa, Homo Sapiens
NPQKTVPGS

SEQ ID NO: 1235769 - protein, 9 aa, Homo Sapiens
LFLWRRFRS

SEQ ID NO: 1235770 - protein, 9 aa, Homo Sapiens
ERFEEAKTL

SEQ ID NO: 1235771 - protein, 9 aa, Homo Sapiens
WGWVEQLVL

SEQ ID NO: 1235772 - protein, 9 aa, Homo Sapiens
LLVTPPQGP

SEQ ID NO: 1235773 - protein, 9 aa, Homo Sapiens
KLGREKPVY

SEQ ID NO: 1235774 - protein, 9 aa, Homo Sapiens
NGHPHCMSV

SEQ ID NO: 1235775 - protein, 9 aa, Homo Sapiens
LPAHSHFFE

SEQ ID NO: 1235776 - protein, 9 aa, Homo Sapiens
KSKHKRHTS

SEQ ID NO: 1235777 - protein, 9 aa, Homo Sapiens
SDDLAHKHV

SEQ ID NO: 1235778 - protein, 9 aa, Homo Sapiens
ACRFTDVKN

SEQ ID NO: 1235779 - protein, 9 aa, Homo Sapiens
QTIISALNA

SEQ ID NO: 1235780 - protein, 9 aa, Homo Sapiens
SELVGRSFY

SEQ ID NO: 1235781 - protein, 9 aa, Homo Sapiens
ILFSRSLSS

SEQ ID NO: 1235782 - protein, 9 aa, Homo Sapiens
MDSLEDTKL

SEQ ID NO: 1235783 - protein, 9 aa, Homo Sapiens
DWEMKEDQG

SEQ ID NO: 1235784 - protein, 9 aa, Homo Sapiens
RAVPIKVMV

SEQ ID NO: 1235785 - protein, 9 aa, Homo Sapiens
LSRPDLLTP

SEQ ID NO: 1235786 - protein, 9 aa, Homo Sapiens
VSAASSLHA

SEQ ID NO: 1235787 - protein, 9 aa, Homo Sapiens
NLMDELTLK

SEQ ID NO: 1235788 - protein, 9 aa, Homo Sapiens
TPSGPVSVA

SEQ ID NO: 1235789 - protein, 9 aa, Homo Sapiens
YCVLRLLCC

SEQ ID NO: 1235790 - protein, 9 aa, Homo Sapiens
ARLNTILDV

SEQ ID NO: 1235791 - protein, 9 aa, Homo Sapiens
MLNGGHRID

SEQ ID NO: 1235792 - protein, 9 aa, Homo Sapiens
KSGPPMQSA

SEQ ID NO: 1235793 - protein, 9 aa, Homo Sapiens
DGGDPPRLC

SEQ ID NO: 1235794 - protein, 9 aa, Homo Sapiens
KFVGDVKRC

SEQ ID NO: 1235795 - protein, 9 aa, Homo Sapiens
EIRQSALCP

SEQ ID NO: 1235796 - protein, 9 aa, Homo Sapiens
GKSKPKAQN

SEQ ID NO: 1235797 - protein, 9 aa, Homo Sapiens
HVDFPPREI

SEQ ID NO: 1235798 - protein, 9 aa, Homo Sapiens
KEAEFVEVE

SEQ ID NO: 1235799 - protein, 9 aa, Homo Sapiens
CAECGKAFQ

SEQ ID NO: 1235800 - protein, 9 aa, Homo Sapiens
RNQLVREME

SEQ ID NO: 1235801 - protein, 9 aa, Homo Sapiens
QWKMKAEVT

SEQ ID NO: 1235802 - protein, 9 aa, Homo Sapiens
VQKLHPPNR

SEQ ID NO: 1235803 - protein, 9 aa, Homo Sapiens
LSSPQVSGS

SEQ ID NO: 1235804 - protein, 9 aa, Homo Sapiens
CWVQGNACI

SEQ ID NO: 1235805 - protein, 9 aa, Homo Sapiens
ITIIANATT

SEQ ID NO: 1235806 - protein, 9 aa, Homo Sapiens
QHLAQELAW

SEQ ID NO: 1235807 - protein, 9 aa, Homo Sapiens
DEIVNTTFE

SEQ ID NO: 1235808 - protein, 9 aa, Homo Sapiens
GWWRSQEVL

SEQ ID NO: 1235809 - protein, 9 aa, Homo Sapiens
DDQGPWRPL

SEQ ID NO: 1235810 - protein, 9 aa, Homo Sapiens
TMECFPTLT

SEQ ID NO: 1235811 - protein, 9 aa, Homo Sapiens
SIKVEGGIW

SEQ ID NO: 1235812 - protein, 9 aa, Homo Sapiens
PYILSQTEV

SEQ ID NO: 1235813 - protein, 9 aa, Homo Sapiens
SRFRKLNWK

SEQ ID NO: 1235814 - protein, 9 aa, Homo Sapiens
IERTPSCQD

SEQ ID NO: 1235815 - protein, 9 aa, Homo Sapiens
DFKGYLGYQ

SEQ ID NO: 1235816 - protein, 9 aa, Homo Sapiens
EVLLIGIIS

SEQ ID NO: 1235817 - protein, 9 aa, Homo Sapiens
SIHIGEIPY

SEQ ID NO: 1235818 - protein, 9 aa, Homo Sapiens
RNMLSHLSV

SEQ ID NO: 1235819 - protein, 9 aa, Homo Sapiens
HACMIRLFN

SEQ ID NO: 1235820 - protein, 9 aa, Homo Sapiens
IVTSVVGLA

SEQ ID NO: 1235821 - protein, 9 aa, Homo Sapiens
DRHTLNKCT

SEQ ID NO: 1235822 - protein, 9 aa, Homo Sapiens
RERNKGRIQ

SEQ ID NO: 1235823 - protein, 9 aa, Homo Sapiens
IQSAAFSLM

SEQ ID NO: 1235824 - protein, 9 aa, Homo Sapiens
AFVAAISMV

SEQ ID NO: 1235825 - protein, 9 aa, Homo Sapiens
AKLVWEETM

SEQ ID NO: 1235826 - protein, 9 aa, Homo Sapiens
TCLLIFFSK

SEQ ID NO: 1235827 - protein, 9 aa, Homo Sapiens
ASTDTPSTI

SEQ ID NO: 1235828 - protein, 9 aa, Homo Sapiens
LHLEVVGLE

SEQ ID NO: 1235829 - protein, 9 aa, Homo Sapiens
EIKNYTKEY

SEQ ID NO: 1235830 - protein, 9 aa, Homo Sapiens
IKNKISITT

SEQ ID NO: 1235831 - protein, 9 aa, Homo Sapiens
RVPDSLDNV

SEQ ID NO: 1235832 - protein, 9 aa, Homo Sapiens
PTGTNMHGM

SEQ ID NO: 1235833 - protein, 9 aa, Homo Sapiens
LSVSKSISM

SEQ ID NO: 1235834 - protein, 9 aa, Homo Sapiens
SYLPSPGEL

SEQ ID NO: 1235835 - protein, 9 aa, Homo Sapiens
SHDIQPLSV

SEQ ID NO: 1235836 - protein, 9 aa, Homo Sapiens
TLPTPVVQF

SEQ ID NO: 1235837 - protein, 9 aa, Homo Sapiens
CTFFDTFNV

SEQ ID NO: 1235838 - protein, 9 aa, Homo Sapiens
IHRLCLSRI

SEQ ID NO: 1235839 - protein, 9 aa, Homo Sapiens
IHHYQIHTE

SEQ ID NO: 1235840 - protein, 9 aa, Homo Sapiens
RSRDSDEYG

SEQ ID NO: 1235841 - protein, 9 aa, Homo Sapiens
ADAKCVLEA

SEQ ID NO: 1235842 - protein, 9 aa, Homo Sapiens
GREHPSCGS

SEQ ID NO: 1235843 - protein, 9 aa, Homo Sapiens
WSLSWPPGC

SEQ ID NO: 1235844 - protein, 9 aa, Homo Sapiens
ECEEDIIPD

SEQ ID NO: 1235845 - protein, 9 aa, Homo Sapiens
PSERRHCSP

SEQ ID NO: 1235846 - protein, 9 aa, Homo Sapiens
ISRDDLNVC

SEQ ID NO: 1235847 - protein, 9 aa, Homo Sapiens
PASSHHGSR

SEQ ID NO: 1235848 - protein, 9 aa, Homo Sapiens
QAENKKSQI

SEQ ID NO: 1235849 - protein, 9 aa, Homo Sapiens
FEAIIWDAQ

SEQ ID NO: 1235850 - protein, 9 aa, Homo Sapiens
ACGQPVHWE

SEQ ID NO: 1235851 - protein, 9 aa, Homo Sapiens
SPPTVVACP

SEQ ID NO: 1235852 - protein, 9 aa, Homo Sapiens
KRQWNRCQY

SEQ ID NO: 1235853 - protein, 9 aa, Homo Sapiens
SMRCGLDSE

SEQ ID NO: 1235854 - protein, 9 aa, Homo Sapiens
HWITSPTHD

SEQ ID NO: 1235855 - protein, 9 aa, Homo Sapiens
CWNQTHPTI

SEQ ID NO: 1235856 - protein, 9 aa, Homo Sapiens
CHRDGQRKS

SEQ ID NO: 1235857 - protein, 9 aa, Homo Sapiens
ASYTAPIMN

SEQ ID NO: 1235858 - protein, 9 aa, Homo Sapiens
KLKLLLEIY

SEQ ID NO: 1235859 - protein, 9 aa, Homo Sapiens
RSRPPARRS

SEQ ID NO: 1235860 - protein, 9 aa, Homo Sapiens
AIAAVGKPD

SEQ ID NO: 1235861 - protein, 9 aa, Homo Sapiens
LADIENHND

SEQ ID NO: 1235862 - protein, 9 aa, Homo Sapiens
IVLGSGQAV

SEQ ID NO: 1235863 - protein, 9 aa, Homo Sapiens
PVGNVVNEG

SEQ ID NO: 1235864 - protein, 9 aa, Homo Sapiens
AQAEANTPQ

SEQ ID NO: 1235865 - protein, 9 aa, Homo Sapiens
MVLDLCHKS

SEQ ID NO: 1235866 - protein, 9 aa, Homo Sapiens
PEWRQTPLP

SEQ ID NO: 1235867 - protein, 9 aa, Homo Sapiens
QCKLFSMVS

SEQ ID NO: 1235868 - protein, 9 aa, Homo Sapiens
DEFYQHWQL

SEQ ID NO: 1235869 - protein, 9 aa, Homo Sapiens
VAQHYKKVG

SEQ ID NO: 1235870 - protein, 9 aa, Homo Sapiens
GILEVTVYT

SEQ ID NO: 1235871 - protein, 9 aa, Homo Sapiens
SWSCQPLPQ

SEQ ID NO: 1235872 - protein, 9 aa, Homo Sapiens
MLPGQGAFV

SEQ ID NO: 1235873 - protein, 9 aa, Homo Sapiens
VAICSAEGE

SEQ ID NO: 1235874 - protein, 9 aa, Homo Sapiens
RCLLCICAL

SEQ ID NO: 1235875 - protein, 9 aa, Homo Sapiens
PTPSPDSVS

SEQ ID NO: 1235876 - protein, 9 aa, Homo Sapiens
LLMALLEAV

SEQ ID NO: 1235877 - protein, 9 aa, Homo Sapiens
RCCWCSLTV

SEQ ID NO: 1235878 - protein, 9 aa, Homo Sapiens
CFAKRLAER

SEQ ID NO: 1235879 - protein, 9 aa, Homo Sapiens
CKRSVPMAK

SEQ ID NO: 1235880 - protein, 9 aa, Homo Sapiens
YRLCPHPSK

SEQ ID NO: 1235881 - protein, 9 aa, Homo Sapiens
FDNDCNQGN

SEQ ID NO: 1235882 - protein, 9 aa, Homo Sapiens
GAWGLLPGW

SEQ ID NO: 1235883 - protein, 9 aa, Homo Sapiens
YPDRAWLIE

SEQ ID NO: 1235884 - protein, 9 aa, Homo Sapiens
DKIVSVFYT

SEQ ID NO: 1235885 - protein, 9 aa, Homo Sapiens
RALDNGLTR

SEQ ID NO: 1235886 - protein, 9 aa, Homo Sapiens
TRAIKDQLH

SEQ ID NO: 1235887 - protein, 9 aa, Homo Sapiens
LSSVSSFVD

SEQ ID NO: 1235888 - protein, 9 aa, Homo Sapiens
EQGYVPDHG

SEQ ID NO: 1235889 - protein, 9 aa, Homo Sapiens
ICVPESTGE

SEQ ID NO: 1235890 - protein, 9 aa, Homo Sapiens
AKQIQVLLA

SEQ ID NO: 1235891 - protein, 9 aa, Homo Sapiens
FTIYMGPWR

SEQ ID NO: 1235892 - protein, 9 aa, Homo Sapiens
PEPGTSQLM

SEQ ID NO: 1235893 - protein, 9 aa, Homo Sapiens
TKDMNEFEM

SEQ ID NO: 1235894 - protein, 9 aa, Homo Sapiens
RNTQAHTGI

SEQ ID NO: 1235895 - protein, 9 aa, Homo Sapiens
EAVLWEVLR

SEQ ID NO: 1235896 - protein, 9 aa, Homo Sapiens
ILMGLDAMV

SEQ ID NO: 1235897 - protein, 9 aa, Homo Sapiens
LIRNSESGN

SEQ ID NO: 1235898 - protein, 9 aa, Homo Sapiens
PTTNAWRHV

SEQ ID NO: 1235899 - protein, 9 aa, Homo Sapiens
FVTEGGETE

SEQ ID NO: 1235900 - protein, 9 aa, Homo Sapiens
YATHSTGIT

SEQ ID NO: 1235901 - protein, 9 aa, Homo Sapiens
LKLIPRKDL

SEQ ID NO: 1235902 - protein, 9 aa, Homo Sapiens
VKKPNKKQQ

SEQ ID NO: 1235903 - protein, 9 aa, Homo Sapiens
DVDILRMKV

SEQ ID NO: 1235904 - protein, 9 aa, Homo Sapiens
ALHVDYRTV

SEQ ID NO: 1235905 - protein, 9 aa, Homo Sapiens
PFHCTQCGR

SEQ ID NO: 1235906 - protein, 9 aa, Homo Sapiens
RPGAGPEEA

SEQ ID NO: 1235907 - protein, 9 aa, Homo Sapiens
GTQLTNPPD

SEQ ID NO: 1235908 - protein, 9 aa, Homo Sapiens
SILKTHKQR

SEQ ID NO: 1235909 - protein, 9 aa, Homo Sapiens
TYLCPRSMR

SEQ ID NO: 1235910 - protein, 9 aa, Homo Sapiens
AFRGTPGAP

SEQ ID NO: 1235911 - protein, 9 aa, Homo Sapiens
QTEQYNEET

SEQ ID NO: 1235912 - protein, 9 aa, Homo Sapiens
DNGADDWII

SEQ ID NO: 1235913 - protein, 9 aa, Homo Sapiens
KSLSAPGKW

SEQ ID NO: 1235914 - protein, 9 aa, Homo Sapiens
ALDNATKPG

SEQ ID NO: 1235915 - protein, 9 aa, Homo Sapiens
HIMEVILND

SEQ ID NO: 1235916 - protein, 9 aa, Homo Sapiens
LWALTTECD

SEQ ID NO: 1235917 - protein, 9 aa, Homo Sapiens
KIELVLIDF

SEQ ID NO: 1235918 - protein, 9 aa, Homo Sapiens
IVQHPEIVG

SEQ ID NO: 1235919 - protein, 9 aa, Homo Sapiens
DWAAIMANL

SEQ ID NO: 1235920 - protein, 9 aa, Homo Sapiens
TYLVDMQHF

SEQ ID NO: 1235921 - protein, 9 aa, Homo Sapiens
IHDGKEKTG

SEQ ID NO: 1235922 - protein, 9 aa, Homo Sapiens
VVLGTSAFS

SEQ ID NO: 1235923 - protein, 9 aa, Homo Sapiens
PPPLPADLP

SEQ ID NO: 1235924 - protein, 9 aa, Homo Sapiens
AQHCSMILD

SEQ ID NO: 1235925 - protein, 9 aa, Homo Sapiens
LFIAQSIVC

SEQ ID NO: 1235926 - protein, 9 aa, Homo Sapiens
LLINQDLVG

SEQ ID NO: 1235927 - protein, 9 aa, Homo Sapiens
CASRRLGPG

SEQ ID NO: 1235928 - protein, 9 aa, Homo Sapiens
ENDNAPTLL

SEQ ID NO: 1235929 - protein, 9 aa, Homo Sapiens
CVMLCHGVK

SEQ ID NO: 1235930 - protein, 9 aa, Homo Sapiens
TVNGHPNEN

SEQ ID NO: 1235931 - protein, 9 aa, Homo Sapiens
ARLRKKILR

SEQ ID NO: 1235932 - protein, 9 aa, Homo Sapiens
TLHLASERE

SEQ ID NO: 1235933 - protein, 9 aa, Homo Sapiens
SETERQSMK

SEQ ID NO: 1235934 - protein, 9 aa, Homo Sapiens
PQSGSESKK

SEQ ID NO: 1235935 - protein, 9 aa, Homo Sapiens
RVIVQHPEI

SEQ ID NO: 1235936 - protein, 9 aa, Homo Sapiens
RFTDVKNLP

SEQ ID NO: 1235937 - protein, 9 aa, Homo Sapiens
KSKSELQVT

SEQ ID NO: 1235938 - protein, 9 aa, Homo Sapiens
QVSGSPFSY

SEQ ID NO: 1235939 - protein, 9 aa, Homo Sapiens
CGRLQQAAV

SEQ ID NO: 1235940 - protein, 9 aa, Homo Sapiens
ETVGHFSQA

SEQ ID NO: 1235941 - protein, 9 aa, Homo Sapiens
KWLEELQLA

SEQ ID NO: 1235942 - protein, 9 aa, Homo Sapiens
ENFFCAPPE

SEQ ID NO: 1235943 - protein, 9 aa, Homo Sapiens
TTVLRLIKL

SEQ ID NO: 1235944 - protein, 9 aa, Homo Sapiens
GPGIQGDTH

SEQ ID NO: 1235945 - protein, 9 aa, Homo Sapiens
TFLDDDSPG

SEQ ID NO: 1235946 - protein, 9 aa, Homo Sapiens
TPSYSPYVS

SEQ ID NO: 1235947 - protein, 9 aa, Homo Sapiens
RGDELADSV

SEQ ID NO: 1235948 - protein, 9 aa, Homo Sapiens
EKYLSLSVN

SEQ ID NO: 1235949 - protein, 9 aa, Homo Sapiens
GMLHHFQKV

SEQ ID NO: 1235950 - protein, 9 aa, Homo Sapiens
QPHWITSPT

SEQ ID NO: 1235951 - protein, 9 aa, Homo Sapiens
VHITLHDEE

SEQ ID NO: 1235952 - protein, 9 aa, Homo Sapiens
SQTEIVRSG

SEQ ID NO: 1235953 - protein, 9 aa, Homo Sapiens
LPCHFHRLI

SEQ ID NO: 1235954 - protein, 9 aa, Homo Sapiens
ITFRMPSRV

SEQ ID NO: 1235955 - protein, 9 aa, Homo Sapiens
SDDTCYRET

SEQ ID NO: 1235956 - protein, 9 aa, Homo Sapiens
KAHDKSPCR

SEQ ID NO: 1235957 - protein, 9 aa, Homo Sapiens
IYGCSQTVA

SEQ ID NO: 1235958 - protein, 9 aa, Homo Sapiens
TMVSVKLST

SEQ ID NO: 1235959 - protein, 9 aa, Homo Sapiens
TTGSTHEPT

SEQ ID NO: 1235960 - protein, 9 aa, Homo Sapiens
PGFSFSKEQ

SEQ ID NO: 1235961 - protein, 9 aa, Homo Sapiens
GEKRKIPCE

SEQ ID NO: 1235962 - protein, 9 aa, Homo Sapiens
RQCVEHYHL

SEQ ID NO: 1235963 - protein, 9 aa, Homo Sapiens
KKEVYDTLI

SEQ ID NO: 1235964 - protein, 9 aa, Homo Sapiens
SWRKIMSDP

SEQ ID NO: 1235965 - protein, 9 aa, Homo Sapiens
TSGVLHKMD

SEQ ID NO: 1235966 - protein, 9 aa, Homo Sapiens
LGVHISDTC

SEQ ID NO: 1235967 - protein, 9 aa, Homo Sapiens
ILPQMSKAL

SEQ ID NO: 1235968 - protein, 9 aa, Homo Sapiens
KLSQICLNT

SEQ ID NO: 1235969 - protein, 9 aa, Homo Sapiens
GTHDEEEGG

SEQ ID NO: 1235970 - protein, 9 aa, Homo Sapiens
QVTATYADS

SEQ ID NO: 1235971 - protein, 9 aa, Homo Sapiens
MPTYLVAIV

SEQ ID NO: 1235972 - protein, 9 aa, Homo Sapiens
DHKYMDIIT

SEQ ID NO: 1235973 - protein, 9 aa, Homo Sapiens
THGGEAFQS

SEQ ID NO: 1235974 - protein, 9 aa, Homo Sapiens
DTRVDTDDI

SEQ ID NO: 1235975 - protein, 9 aa, Homo Sapiens
RGFPSGMRA

SEQ ID NO: 1235976 - protein, 9 aa, Homo Sapiens
QHLQCLSVV

SEQ ID NO: 1235977 - protein, 9 aa, Homo Sapiens
PKKNRCFIC

SEQ ID NO: 1235978 - protein, 9 aa, Homo Sapiens
PFGDLLHTI

SEQ ID NO: 1235979 - protein, 9 aa, Homo Sapiens
IAPSGPSSS

SEQ ID NO: 1235980 - protein, 9 aa, Homo Sapiens
SAIVLGNLK

SEQ ID NO: 1235981 - protein, 9 aa, Homo Sapiens
SRTSTFSFE

SEQ ID NO: 1235982 - protein, 9 aa, Homo Sapiens
LHHPFIKNA

SEQ ID NO: 1235983 - protein, 9 aa, Homo Sapiens
RQLRFLETT

SEQ ID NO: 1235984 - protein, 9 aa, Homo Sapiens
EIFPPSGMG

SEQ ID NO: 1235985 - protein, 9 aa, Homo Sapiens
SPPSLCHRL

SEQ ID NO: 1235986 - protein, 9 aa, Homo Sapiens
PDRQPDFTQ

SEQ ID NO: 1235987 - protein, 9 aa, Homo Sapiens
KCGYIKNKL

SEQ ID NO: 1235988 - protein, 9 aa, Homo Sapiens
KSSSFQELY

SEQ ID NO: 1235989 - protein, 9 aa, Homo Sapiens
MGQIYAGLK

SEQ ID NO: 1235990 - protein, 9 aa, Homo Sapiens
LLSCHFRGR

SEQ ID NO: 1235991 - protein, 9 aa, Homo Sapiens
YVAAMPPHI

SEQ ID NO: 1235992 - protein, 9 aa, Homo Sapiens
TWDGKYLSF

SEQ ID NO: 1235993 - protein, 9 aa, Homo Sapiens
SSKGTIQLC

SEQ ID NO: 1235994 - protein, 9 aa, Homo Sapiens
TTEQAFVRC

SEQ ID NO: 1235995 - protein, 9 aa, Homo Sapiens
DCLYGPIAF

SEQ ID NO: 1235996 - protein, 9 aa, Homo Sapiens
YDEDSQKFF

SEQ ID NO: 1235997 - protein, 9 aa, Homo Sapiens
QVFLVVFLY

SEQ ID NO: 1235998 - protein, 9 aa, Homo Sapiens
FSFSRYASI

SEQ ID NO: 1235999 - protein, 9 aa, Homo Sapiens
VFFPSASGS

SEQ ID NO: 1236000 - protein, 9 aa, Homo Sapiens
RSFLDLMFG

SEQ ID NO: 1236001 - protein, 9 aa, Homo Sapiens
TPFDRIAEI

SEQ ID NO: 1236002 - protein, 9 aa, Homo Sapiens
IIAGPVFLP

SEQ ID NO: 1236003 - protein, 9 aa, Homo Sapiens
STTTCSRTA

SEQ ID NO: 1236004 - protein, 9 aa, Homo Sapiens
MSKYDLLAW

SEQ ID NO: 1236005 - protein, 9 aa, Homo Sapiens
RSEDHAVLL

SEQ ID NO: 1236006 - protein, 9 aa, Homo Sapiens
YGTRYVGSM

SEQ ID NO: 1236007 - protein, 9 aa, Homo Sapiens
QEEMAVRDR

SEQ ID NO: 1236008 - protein, 9 aa, Homo Sapiens
ATTQRTLAS

SEQ ID NO: 1236009 - protein, 9 aa, Homo Sapiens
LTVLSQPNA

SEQ ID NO: 1236010 - protein, 9 aa, Homo Sapiens
VTLRYSPIS

SEQ ID NO: 1236011 - protein, 8 aa, Homo Sapiens
EAPGPRAL

SEQ ID NO: 1236012 - protein, 9 aa, Homo Sapiens
RHSTTRDRN

SEQ ID NO: 1236013 - protein, 9 aa, Homo Sapiens
WRRRICALA

SEQ ID NO: 1236014 - protein, 9 aa, Homo Sapiens
WLDMFSDWD

SEQ ID NO: 1236015 - protein, 9 aa, Homo Sapiens
ARDSELSDT

SEQ ID NO: 1236016 - protein, 9 aa, Homo Sapiens
LFLLLAGIS

SEQ ID NO: 1236017 - protein, 9 aa, Homo Sapiens
TFAGFVSER

SEQ ID NO: 1236018 - protein, 9 aa, Homo Sapiens
MKSMYMSEA

SEQ ID NO: 1236019 - protein, 9 aa, Homo Sapiens
KGRCKQESS

SEQ ID NO: 1236020 - protein, 9 aa, Homo Sapiens
SQKKSVDRS

SEQ ID NO: 1236021 - protein, 9 aa, Homo Sapiens
KWLAAAQAD

SEQ ID NO: 1236022 - protein, 9 aa, Homo Sapiens
HYQLPIYCL

SEQ ID NO: 1236023 - protein, 9 aa, Homo Sapiens
ILTKLKDVK

SEQ ID NO: 1236024 - protein, 9 aa, Homo Sapiens
KLVWEETMS

SEQ ID NO: 1236025 - protein, 9 aa, Homo Sapiens
PNLWPDMTL

SEQ ID NO: 1236026 - protein, 9 aa, Homo Sapiens
ICLNDDGGR

SEQ ID NO: 1236027 - protein, 9 aa, Homo Sapiens
YKVASDEYH

SEQ ID NO: 1236028 - protein, 9 aa, Homo Sapiens
NQTAGRTLT

SEQ ID NO: 1236029 - protein, 9 aa, Homo Sapiens
KLDLLMIHG

SEQ ID NO: 1236030 - protein, 9 aa, Homo Sapiens
YHNPLCSSI

SEQ ID NO: 1236031 - protein, 9 aa, Homo Sapiens
GHPALHQCL

SEQ ID NO: 1236032 - protein, 9 aa, Homo Sapiens
HTLKHDTLK

SEQ ID NO: 1236033 - protein, 9 aa, Homo Sapiens
LHLVSRNIY

SEQ ID NO: 1236034 - protein, 9 aa, Homo Sapiens
ESICSDLES

SEQ ID NO: 1236035 - protein, 9 aa, Homo Sapiens
RLRTTLPTS

SEQ ID NO: 1236036 - protein, 9 aa, Homo Sapiens
CPCWVSSMR

SEQ ID NO: 1236037 - protein, 9 aa, Homo Sapiens
DVELERQRG

SEQ ID NO: 1236038 - protein, 9 aa, Homo Sapiens
SMKSLYLGR

SEQ ID NO: 1236039 - protein, 9 aa, Homo Sapiens
CVTDHFSQT

SEQ ID NO: 1236040 - protein, 9 aa, Homo Sapiens
GDCGSCGCS

SEQ ID NO: 1236041 - protein, 9 aa, Homo Sapiens
HVADINDNH

SEQ ID NO: 1236042 - protein, 9 aa, Homo Sapiens
MATEIERLI

SEQ ID NO: 1236043 - protein, 9 aa, Homo Sapiens
DENPLPAAL

SEQ ID NO: 1236044 - protein, 9 aa, Homo Sapiens
LCTDGQLHA

SEQ ID NO: 1236045 - protein, 9 aa, Homo Sapiens
SNGCLGHGN

SEQ ID NO: 1236046 - protein, 9 aa, Homo Sapiens
LEPDMIIRP

SEQ ID NO: 1236047 - protein, 9 aa, Homo Sapiens
CTLQKFMDC

SEQ ID NO: 1236048 - protein, 9 aa, Homo Sapiens
LLFCMIFNG

SEQ ID NO: 1236049 - protein, 9 aa, Homo Sapiens
KQLLHMCLQ

SEQ ID NO: 1236050 - protein, 9 aa, Homo Sapiens
SVTPPQCLS

SEQ ID NO: 1236051 - protein, 9 aa, Homo Sapiens
VYKDVIVLG

SEQ ID NO: 1236052 - protein, 9 aa, Homo Sapiens
EGIASVVKE

SEQ ID NO: 1236053 - protein, 9 aa, Homo Sapiens
VLVVLDVIN

SEQ ID NO: 1236054 - protein, 9 aa, Homo Sapiens
GVTLLFAFF

SEQ ID NO: 1236055 - protein, 9 aa, Homo Sapiens
RFGHDVLRV

SEQ ID NO: 1236056 - protein, 9 aa, Homo Sapiens
NVSVSISHN

SEQ ID NO: 1236057 - protein, 9 aa, Homo Sapiens
FFIGIAIHG

SEQ ID NO: 1236058 - protein, 9 aa, Homo Sapiens
SQRSSDIFD

SEQ ID NO: 1236059 - protein, 9 aa, Homo Sapiens
VTIIEKHPA

SEQ ID NO: 1236060 - protein, 9 aa, Homo Sapiens
KVWSCSSGN

SEQ ID NO: 1236061 - protein, 9 aa, Homo Sapiens
QEYGKNLAH

SEQ ID NO: 1236062 - protein, 9 aa, Homo Sapiens
NTPLVPQAD

SEQ ID NO: 1236063 - protein, 9 aa, Homo Sapiens
QKCSEWMLL

SEQ ID NO: 1236064 - protein, 9 aa, Homo Sapiens
VGTQASAAP

SEQ ID NO: 1236065 - protein, 9 aa, Homo Sapiens
HGRDQGRHP

SEQ ID NO: 1236066 - protein, 9 aa, Homo Sapiens
RYDSICQQN

SEQ ID NO: 1236067 - protein, 9 aa, Homo Sapiens
RWGWNDINC

SEQ ID NO: 1236068 - protein, 9 aa, Homo Sapiens
HELRIIQLL

SEQ ID NO: 1236069 - protein, 9 aa, Homo Sapiens
VNSVILIMS

SEQ ID NO: 1236070 - protein, 9 aa, Homo Sapiens
VVAYYQQAY

SEQ ID NO: 1236071 - protein, 9 aa, Homo Sapiens
SPQVSGSPF

SEQ ID NO: 1236072 - protein, 9 aa, Homo Sapiens
HYFDGPKLA

SEQ ID NO: 1236073 - protein, 9 aa, Homo Sapiens
NWQPLSKST

SEQ ID NO: 1236074 - protein, 9 aa, Homo Sapiens
PCRELLTQP

SEQ ID NO: 1236075 - protein, 9 aa, Homo Sapiens
LLEQASHSA

SEQ ID NO: 1236076 - protein, 9 aa, Homo Sapiens
RSSGRQQRG

SEQ ID NO: 1236077 - protein, 9 aa, Homo Sapiens
NSAMQAFLL

SEQ ID NO: 1236078 - protein, 9 aa, Homo Sapiens
IHHYRTVHQ

SEQ ID NO: 1236079 - protein, 9 aa, Homo Sapiens
SPAAQPLQI

SEQ ID NO: 1236080 - protein, 9 aa, Homo Sapiens
SYYEYDFEC

SEQ ID NO: 1236081 - protein, 9 aa, Homo Sapiens
HDIQPLSVP

SEQ ID NO: 1236082 - protein, 9 aa, Homo Sapiens
MLQDEVTKM

SEQ ID NO: 1236083 - protein, 9 aa, Homo Sapiens
DYIFKDMFR

SEQ ID NO: 1236084 - protein, 9 aa, Homo Sapiens
SGLKYVAAM

SEQ ID NO: 1236085 - protein, 9 aa, Homo Sapiens
LQLDINTED

SEQ ID NO: 1236086 - protein, 9 aa, Homo Sapiens
TSAEAPQSL

SEQ ID NO: 1236087 - protein, 9 aa, Homo Sapiens
ILLWLLGSR

SEQ ID NO: 1236088 - protein, 9 aa, Homo Sapiens
KLARDLNAV

SEQ ID NO: 1236089 - protein, 9 aa, Homo Sapiens
VKYPIVGYT

SEQ ID NO: 1236090 - protein, 9 aa, Homo Sapiens
VKFVETPRT

SEQ ID NO: 1236091 - protein, 9 aa, Homo Sapiens
WSPCLDVEY

SEQ ID NO: 1236092 - protein, 9 aa, Homo Sapiens
PQLSLTQPQ

SEQ ID NO: 1236093 - protein, 9 aa, Homo Sapiens
HTFVQSESH

SEQ ID NO: 1236094 - protein, 9 aa, Homo Sapiens
TDQRPSTGK

SEQ ID NO: 1236095 - protein, 9 aa, Homo Sapiens
ECNKQRSHH

SEQ ID NO: 1236096 - protein, 9 aa, Homo Sapiens
KNVNFFTKL

SEQ ID NO: 1236097 - protein, 9 aa, Homo Sapiens
RSVCGRLQQ

SEQ ID NO: 1236098 - protein, 9 aa, Homo Sapiens
AMPNALYFS

SEQ ID NO: 1236099 - protein, 9 aa, Homo Sapiens
VNGVTVHEA

SEQ ID NO: 1236100 - protein, 9 aa, Homo Sapiens
TIYKHQKKQ

SEQ ID NO: 1236101 - protein, 9 aa, Homo Sapiens
ISHTGTEHL

SEQ ID NO: 1236102 - protein, 9 aa, Homo Sapiens
LGADTFVDL

SEQ ID NO: 1236103 - protein, 9 aa, Homo Sapiens
VIQAGREKY

SEQ ID NO: 1236104 - protein, 9 aa, Homo Sapiens
CKPSSVRLV

SEQ ID NO: 1236105 - protein, 9 aa, Homo Sapiens
GYVPDHGRD

SEQ ID NO: 1236106 - protein, 9 aa, Homo Sapiens
IGGILWYRV

SEQ ID NO: 1236107 - protein, 9 aa, Homo Sapiens
EYVRSFVTH

SEQ ID NO: 1236108 - protein, 9 aa, Homo Sapiens
QSPGANLTY

SEQ ID NO: 1236109 - protein, 9 aa, Homo Sapiens
GFENVTQAL

SEQ ID NO: 1236110 - protein, 9 aa, Homo Sapiens
HLAPKAEVD

SEQ ID NO: 1236111 - protein, 9 aa, Homo Sapiens
DGYWTDRGC

SEQ ID NO: 1236112 - protein, 9 aa, Homo Sapiens
DTQEDQINL

SEQ ID NO: 1236113 - protein, 9 aa, Homo Sapiens
NVCFLTLDH

SEQ ID NO: 1236114 - protein, 9 aa, Homo Sapiens
LFYNCALVI

SEQ ID NO: 1236115 - protein, 9 aa, Homo Sapiens
STSPVIKVE

SEQ ID NO: 1236116 - protein, 9 aa, Homo Sapiens
PPISPSRSS

SEQ ID NO: 1236117 - protein, 9 aa, Homo Sapiens
NSGRNPQAS

SEQ ID NO: 1236118 - protein, 9 aa, Homo Sapiens
SAPYGTRYV

SEQ ID NO: 1236119 - protein, 9 aa, Homo Sapiens
HGRLSGSVR

SEQ ID NO: 1236120 - protein, 9 aa, Homo Sapiens
LAGEPLEAE

SEQ ID NO: 1236121 - protein, 9 aa, Homo Sapiens
AANVLRERQ

SEQ ID NO: 1236122 - protein, 9 aa, Homo Sapiens
PLLLRNLMV

SEQ ID NO: 1236123 - protein, 9 aa, Homo Sapiens
APCLPSYPP

SEQ ID NO: 1236124 - protein, 9 aa, Homo Sapiens
HSAMHQLAG

SEQ ID NO: 1236125 - protein, 9 aa, Homo Sapiens
ELISDLECR

SEQ ID NO: 1236126 - protein, 9 aa, Homo Sapiens
LNSIAAVVL

SEQ ID NO: 1236127 - protein, 9 aa, Homo Sapiens
QQRRMSLGE

SEQ ID NO: 1236128 - protein, 9 aa, Homo Sapiens
CKEAGYLIR

SEQ ID NO: 1236129 - protein, 9 aa, Homo Sapiens
PPVHPVAEL

SEQ ID NO: 1236130 - protein, 9 aa, Homo Sapiens
GKVFGVRSS

SEQ ID NO: 1236131 - protein, 9 aa, Homo Sapiens
IVNSMDKSY

SEQ ID NO: 1236132 - protein, 9 aa, Homo Sapiens
GDKASGEGM

SEQ ID NO: 1236133 - protein, 9 aa, Homo Sapiens
GSVGGNAGV

SEQ ID NO: 1236134 - protein, 9 aa, Homo Sapiens
ILGPLKRKC

SEQ ID NO: 1236135 - protein, 9 aa, Homo Sapiens
ILTFLALLD

SEQ ID NO: 1236136 - protein, 9 aa, Homo Sapiens
LRLAAEDVT

SEQ ID NO: 1236137 - protein, 9 aa, Homo Sapiens
STSAYLTVQ

SEQ ID NO: 1236138 - protein, 9 aa, Homo Sapiens
DNSIETRTI

SEQ ID NO: 1236139 - protein, 9 aa, Homo Sapiens
LHTIALTGS

SEQ ID NO: 1236140 - protein, 9 aa, Homo Sapiens
RNENPDEST

SEQ ID NO: 1236141 - protein, 9 aa, Homo Sapiens
AGHLLYPFN

SEQ ID NO: 1236142 - protein, 9 aa, Homo Sapiens
NRPQPVHRF

SEQ ID NO: 1236143 - protein, 9 aa, Homo Sapiens
RYHRSRCGH

SEQ ID NO: 1236144 - protein, 9 aa, Homo Sapiens
AQEENIYAA

SEQ ID NO: 1236145 - protein, 9 aa, Homo Sapiens
TYSLEHAID

SEQ ID NO: 1236146 - protein, 9 aa, Homo Sapiens
VSFVCEYAS

SEQ ID NO: 1236147 - protein, 9 aa, Homo Sapiens
HILQQDWSD

SEQ ID NO: 1236148 - protein, 9 aa, Homo Sapiens
GCRMCPWTA

SEQ ID NO: 1236149 - protein, 9 aa, Homo Sapiens
QQCHHVYKT

SEQ ID NO: 1236150 - protein, 9 aa, Homo Sapiens
KQQVWLRQK

SEQ ID NO: 1236151 - protein, 9 aa, Homo Sapiens
KMAHTPPGH

SEQ ID NO: 1236152 - protein, 9 aa, Homo Sapiens
PMATATRVT

SEQ ID NO: 1236153 - protein, 9 aa, Homo Sapiens
VPKHIEVCM

SEQ ID NO: 1236154 - protein, 9 aa, Homo Sapiens
FQESVLKMC

SEQ ID NO: 1236155 - protein, 9 aa, Homo Sapiens
VRIVTLVPE

SEQ ID NO: 1236156 - protein, 9 aa, Homo Sapiens
FLWQVSIQA

SEQ ID NO: 1236157 - protein, 9 aa, Homo Sapiens
GGIGITLSS

SEQ ID NO: 1236158 - protein, 9 aa, Homo Sapiens
LLAWFEISE

SEQ ID NO: 1236159 - protein, 9 aa, Homo Sapiens
PCKRCKMIT

SEQ ID NO: 1236160 - protein, 9 aa, Homo Sapiens
SLVVHDEYI

SEQ ID NO: 1236161 - protein, 9 aa, Homo Sapiens
PPRVLMKHK

SEQ ID NO: 1236162 - protein, 9 aa, Homo Sapiens
CYCIYSVGY

SEQ ID NO: 1236163 - protein, 9 aa, Homo Sapiens
MRVWFCNQR

SEQ ID NO: 1236164 - protein, 9 aa, Homo Sapiens
LEIGSHHLG

SEQ ID NO: 1236165 - protein, 9 aa, Homo Sapiens
QTQPENTAE

SEQ ID NO: 1236166 - protein, 9 aa, Homo Sapiens
GRSEGFPTL

SEQ ID NO: 1236167 - protein, 9 aa, Homo Sapiens
QGYDKGVEI

SEQ ID NO: 1236168 - protein, 9 aa, Homo Sapiens
RVMAILCNH

SEQ ID NO: 1236169 - protein, 9 aa, Homo Sapiens
EEAMVHLKV

SEQ ID NO: 1236170 - protein, 9 aa, Homo Sapiens
IDTSYYKLP

SEQ ID NO: 1236171 - protein, 9 aa, Homo Sapiens
QCKRNEGYF

SEQ ID NO: 1236172 - protein, 9 aa, Homo Sapiens
LDVTVKTAM

SEQ ID NO: 1236173 - protein, 9 aa, Homo Sapiens
MWIGRLKMR

SEQ ID NO: 1236174 - protein, 9 aa, Homo Sapiens
ETKNKNVRF

SEQ ID NO: 1236175 - protein, 9 aa, Homo Sapiens
QGPCRHAGS

SEQ ID NO: 1236176 - protein, 9 aa, Homo Sapiens
ENEVIQIFC

SEQ ID NO: 1236177 - protein, 9 aa, Homo Sapiens
APGQSTCQK

SEQ ID NO: 1236178 - protein, 9 aa, Homo Sapiens
RGPAATTPS

SEQ ID NO: 1236179 - protein, 9 aa, Homo Sapiens
RVLSSSWLC

SEQ ID NO: 1236180 - protein, 9 aa, Homo Sapiens
VGHFSQART

SEQ ID NO: 1236181 - protein, 9 aa, Homo Sapiens
WHRLKNKRY

SEQ ID NO: 1236182 - protein, 9 aa, Homo Sapiens
ALETCKAHD

SEQ ID NO: 1236183 - protein, 9 aa, Homo Sapiens
YRECLANVS

SEQ ID NO: 1236184 - protein, 9 aa, Homo Sapiens
VGCELKKVR

SEQ ID NO: 1236185 - protein, 9 aa, Homo Sapiens
PGMTENETP

SEQ ID NO: 1236186 - protein, 9 aa, Homo Sapiens
TNGEKRKIP

SEQ ID NO: 1236187 - protein, 9 aa, Homo Sapiens
GTYTDGEGY

SEQ ID NO: 1236188 - protein, 9 aa, Homo Sapiens
ALFREYQEE

SEQ ID NO: 1236189 - protein, 9 aa, Homo Sapiens
LHVLRGRLR

SEQ ID NO: 1236190 - protein, 9 aa, Homo Sapiens
QEKTDIIDC

SEQ ID NO: 1236191 - protein, 9 aa, Homo Sapiens
KHSRCPPKG

SEQ ID NO: 1236192 - protein, 9 aa, Homo Sapiens
PADVREEVM

SEQ ID NO: 1236193 - protein, 9 aa, Homo Sapiens
WTRFLTTPG

SEQ ID NO: 1236194 - protein, 9 aa, Homo Sapiens
YDTSASFST

SEQ ID NO: 1236195 - protein, 9 aa, Homo Sapiens
QPPTLGAAL

SEQ ID NO: 1236196 - protein, 9 aa, Homo Sapiens
SVPGITKFM

SEQ ID NO: 1236197 - protein, 9 aa, Homo Sapiens
LTQGEPKGL

SEQ ID NO: 1236198 - protein, 9 aa, Homo Sapiens
VSEVGREGR

SEQ ID NO: 1236199 - protein, 9 aa, Homo Sapiens
NHLLGGSGD

SEQ ID NO: 1236200 - protein, 9 aa, Homo Sapiens
IPRNLLTTD

SEQ ID NO: 1236201 - protein, 9 aa, Homo Sapiens
NALLRPPVT

SEQ ID NO: 1236202 - protein, 9 aa, Homo Sapiens
HCLIWLLEE

SEQ ID NO: 1236203 - protein, 9 aa, Homo Sapiens
CMLNTHRTA

SEQ ID NO: 1236204 - protein, 9 aa, Homo Sapiens
YFAIYFLNL

SEQ ID NO: 1236205 - protein, 9 aa, Homo Sapiens
LSELRVRKH

SEQ ID NO: 1236206 - protein, 9 aa, Homo Sapiens
GTCLNDVGG

SEQ ID NO: 1236207 - protein, 9 aa, Homo Sapiens
KELATPKIR

SEQ ID NO: 1236208 - protein, 9 aa, Homo Sapiens
GIKNRNETE

SEQ ID NO: 1236209 - protein, 9 aa, Homo Sapiens
NPEARLNPP

SEQ ID NO: 1236210 - protein, 9 aa, Homo Sapiens
GSISALKFQ

SEQ ID NO: 1236211 - protein, 9 aa, Homo Sapiens
YPSKCMVEK

SEQ ID NO: 1236212 - protein, 9 aa, Homo Sapiens
NLFEKNHCD

SEQ ID NO: 1236213 - protein, 9 aa, Homo Sapiens
SHAISQDVN

SEQ ID NO: 1236214 - protein, 9 aa, Homo Sapiens
YLLKTEDSA

SEQ ID NO: 1236215 - protein, 9 aa, Homo Sapiens
FIKTTFING

SEQ ID NO: 1236216 - protein, 9 aa, Homo Sapiens
RSAAALWTW

SEQ ID NO: 1236217 - protein, 9 aa, Homo Sapiens
KARTLYTIM

SEQ ID NO: 1236218 - protein, 9 aa, Homo Sapiens
RGGRTMGLL

SEQ ID NO: 1236219 - protein, 9 aa, Homo Sapiens
FGDDDSGEG

SEQ ID NO: 1236220 - protein, 9 aa, Homo Sapiens
TAICNYCKK

SEQ ID NO: 1236221 - protein, 9 aa, Homo Sapiens
ALDECYHSD

SEQ ID NO: 1236222 - protein, 9 aa, Homo Sapiens
RCSLHHKQQ

SEQ ID NO: 1236223 - protein, 9 aa, Homo Sapiens
YLRASEMAQ

SEQ ID NO: 1236224 - protein, 9 aa, Homo Sapiens
VFCIWKSHP

SEQ ID NO: 1236225 - protein, 9 aa, Homo Sapiens
GMSPICFIA

SEQ ID NO: 1236226 - protein, 9 aa, Homo Sapiens
CDIGPLQGE

SEQ ID NO: 1236227 - protein, 9 aa, Homo Sapiens
TSFTPTSLL

SEQ ID NO: 1236228 - protein, 9 aa, Homo Sapiens
TVPGRHVEV

SEQ ID NO: 1236229 - protein, 9 aa, Homo Sapiens
SVASMPSSS

SEQ ID NO: 1236230 - protein, 9 aa, Homo Sapiens
FEDLSDMEG

SEQ ID NO: 1236231 - protein, 9 aa, Homo Sapiens
REKGPNDTA

SEQ ID NO: 1236232 - protein, 9 aa, Homo Sapiens
HGMKKMSSD

SEQ ID NO: 1236233 - protein, 9 aa, Homo Sapiens
LIMRGLAGR

SEQ ID NO: 1236234 - protein, 9 aa, Homo Sapiens
LSAVAILQG

SEQ ID NO: 1236235 - protein, 9 aa, Homo Sapiens
DEIDIWGKH

SEQ ID NO: 1236236 - protein, 9 aa, Homo Sapiens
PPTSRCPMT

SEQ ID NO: 1236237 - protein, 9 aa, Homo Sapiens
DQVEHEKQM

SEQ ID NO: 1236238 - protein, 9 aa, Homo Sapiens
TPETLTAFD

SEQ ID NO: 1236239 - protein, 9 aa, Homo Sapiens
HQGPRGSLG

SEQ ID NO: 1236240 - protein, 9 aa, Homo Sapiens
ADALLEQVM

SEQ ID NO: 1236241 - protein, 9 aa, Homo Sapiens
PGRPWPPSF

SEQ ID NO: 1236242 - protein, 9 aa, Homo Sapiens
HVFMPISDP

SEQ ID NO: 1236243 - protein, 9 aa, Homo Sapiens
LSKDVSYLI

SEQ ID NO: 1236244 - protein, 9 aa, Homo Sapiens
SRQILTTTD

SEQ ID NO: 1236245 - protein, 9 aa, Homo Sapiens
SDVEVESSM

SEQ ID NO: 1236246 - protein, 9 aa, Homo Sapiens
QYAGLLSHD

SEQ ID NO: 1236247 - protein, 9 aa, Homo Sapiens
EDTAALALA

SEQ ID NO: 1236248 - protein, 9 aa, Homo Sapiens
DMWIGRLKM

SEQ ID NO: 1236249 - protein, 9 aa, Homo Sapiens
NSHLFALRS

SEQ ID NO: 1236250 - protein, 9 aa, Homo Sapiens
PLYIRLHKW

SEQ ID NO: 1236251 - protein, 9 aa, Homo Sapiens
CNHDEDTCV

SEQ ID NO: 1236252 - protein, 9 aa, Homo Sapiens
ITASTSQAQ

SEQ ID NO: 1236253 - protein, 9 aa, Homo Sapiens
GAGGEASNP

SEQ ID NO: 1236254 - protein, 9 aa, Homo Sapiens
IYCLFGDTV

SEQ ID NO: 1236255 - protein, 9 aa, Homo Sapiens
AVLFGINEF

SEQ ID NO: 1236256 - protein, 9 aa, Homo Sapiens
PGREPLVGT

SEQ ID NO: 1236257 - protein, 9 aa, Homo Sapiens
TGRASPAPR

SEQ ID NO: 1236258 - protein, 9 aa, Homo Sapiens
VKEQGTVPG

SEQ ID NO: 1236259 - protein, 9 aa, Homo Sapiens
KKSIQSKLS

SEQ ID NO: 1236260 - protein, 9 aa, Homo Sapiens
GPQPLTKSI

SEQ ID NO: 1236261 - protein, 9 aa, Homo Sapiens
FSEDGHKLI

SEQ ID NO: 1236262 - protein, 9 aa, Homo Sapiens
CDACMCQDS

SEQ ID NO: 1236263 - protein, 9 aa, Homo Sapiens
RVGGKRVVY

SEQ ID NO: 1236264 - protein, 9 aa, Homo Sapiens
YNLLEFLQR

SEQ ID NO: 1236265 - protein, 9 aa, Homo Sapiens
ALVEAAVRI

SEQ ID NO: 1236266 - protein, 9 aa, Homo Sapiens
IMNRHPNTL

SEQ ID NO: 1236267 - protein, 9 aa, Homo Sapiens
VARFSVIFL

SEQ ID NO: 1236268 - protein, 9 aa, Homo Sapiens
SNAVLSKSK

SEQ ID NO: 1236269 - protein, 9 aa, Homo Sapiens
LQQSLGLTW

SEQ ID NO: 1236270 - protein, 9 aa, Homo Sapiens
AVPIKVMVT

SEQ ID NO: 1236271 - protein, 9 aa, Homo Sapiens
VKVLNDGGF

SEQ ID NO: 1236272 - protein, 9 aa, Homo Sapiens
DTVYRQTIN

SEQ ID NO: 1236273 - protein, 9 aa, Homo Sapiens
GLITIIVGY

SEQ ID NO: 1236274 - protein, 9 aa, Homo Sapiens
RNQDQRSAS

SEQ ID NO: 1236275 - protein, 9 aa, Homo Sapiens
GKKKQHLCP

SEQ ID NO: 1236276 - protein, 9 aa, Homo Sapiens
MDHPVCFLP

SEQ ID NO: 1236277 - protein, 9 aa, Homo Sapiens
FHMTTYSTE

SEQ ID NO: 1236278 - protein, 9 aa, Homo Sapiens
LNNDAFMNQ

SEQ ID NO: 1236279 - protein, 9 aa, Homo Sapiens
DIRGLTHAI

SEQ ID NO: 1236280 - protein, 9 aa, Homo Sapiens
WAGSTWADS

SEQ ID NO: 1236281 - protein, 9 aa, Homo Sapiens
MLNTACAVG

SEQ ID NO: 1236282 - protein, 9 aa, Homo Sapiens
GGRQSKYTV

SEQ ID NO: 1236283 - protein, 9 aa, Homo Sapiens
CQRYYHRCH

SEQ ID NO: 1236284 - protein, 9 aa, Homo Sapiens
QTQGSHDFS

SEQ ID NO: 1236285 - protein, 9 aa, Homo Sapiens
QPQATGEEC

SEQ ID NO: 1236286 - protein, 9 aa, Homo Sapiens
YVVMTGLFT

SEQ ID NO: 1236287 - protein, 9 aa, Homo Sapiens
YCFMVDSKE

SEQ ID NO: 1236288 - protein, 9 aa, Homo Sapiens
VDPAGEMTK

SEQ ID NO: 1236289 - protein, 9 aa, Homo Sapiens
SSISTETEE

SEQ ID NO: 1236290 - protein, 9 aa, Homo Sapiens
DMQHFRYPE

SEQ ID NO: 1236291 - protein, 9 aa, Homo Sapiens
VMCVRNVKE

SEQ ID NO: 1236292 - protein, 9 aa, Homo Sapiens
HSPHHMVRW

SEQ ID NO: 1236293 - protein, 9 aa, Homo Sapiens
DEVLTIPGV

SEQ ID NO: 1236294 - protein, 9 aa, Homo Sapiens
KDDTIGQVG

SEQ ID NO: 1236295 - protein, 9 aa, Homo Sapiens
DIAQRCRIS

SEQ ID NO: 1236296 - protein, 9 aa, Homo Sapiens
MKRMRAFQQ

SEQ ID NO: 1236297 - protein, 9 aa, Homo Sapiens
WLLEKFGLH

SEQ ID NO: 1236298 - protein, 9 aa, Homo Sapiens
RDLKPENII

SEQ ID NO: 1236299 - protein, 9 aa, Homo Sapiens
SAEEDHAEV

SEQ ID NO: 1236300 - protein, 9 aa, Homo Sapiens
GLKYVAAMP

SEQ ID NO: 1236301 - protein, 9 aa, Homo Sapiens
CRCQGSTME

SEQ ID NO: 1236302 - protein, 9 aa, Homo Sapiens
NPRPCQIHI

SEQ ID NO: 1236303 - protein, 9 aa, Homo Sapiens
CWQRLAELE

SEQ ID NO: 1236304 - protein, 9 aa, Homo Sapiens
AKNFSYDKP

SEQ ID NO: 1236305 - protein, 9 aa, Homo Sapiens
IMLNTACAV

SEQ ID NO: 1236306 - protein, 9 aa, Homo Sapiens
HQSTSSPYA

SEQ ID NO: 1236307 - protein, 9 aa, Homo Sapiens
NGEKRKIPC

SEQ ID NO: 1236308 - protein, 9 aa, Homo Sapiens
RLYQSVLSM

SEQ ID NO: 1236309 - protein, 9 aa, Homo Sapiens
LHERKQLVI

SEQ ID NO: 1236310 - protein, 9 aa, Homo Sapiens
DWMFWYSLT

SEQ ID NO: 1236311 - protein, 9 aa, Homo Sapiens
SFNSSVNEM

SEQ ID NO: 1236312 - protein, 9 aa, Homo Sapiens
AGVICKDQC

SEQ ID NO: 1236313 - protein, 9 aa, Homo Sapiens
FDISEACIS

SEQ ID NO: 1236314 - protein, 9 aa, Homo Sapiens
LPQHKGVAV

SEQ ID NO: 1236315 - protein, 9 aa, Homo Sapiens
GLRIIFPLF

SEQ ID NO: 1236316 - protein, 9 aa, Homo Sapiens
VHGAPGPVC

SEQ ID NO: 1236317 - protein, 9 aa, Homo Sapiens
SSMDPGGMM

SEQ ID NO: 1236318 - protein, 9 aa, Homo Sapiens
DVKSKKDSC

SEQ ID NO: 1236319 - protein, 9 aa, Homo Sapiens
LDVDYKSGP

SEQ ID NO: 1236320 - protein, 9 aa, Homo Sapiens
HSYSSKPPL

SEQ ID NO: 1236321 - protein, 9 aa, Homo Sapiens
TLGFMSLDS

SEQ ID NO: 1236322 - protein, 9 aa, Homo Sapiens
AISNKDQYS

SEQ ID NO: 1236323 - protein, 9 aa, Homo Sapiens
CDSGCDETL

SEQ ID NO: 1236324 - protein, 9 aa, Homo Sapiens
LVDTTHLKW

SEQ ID NO: 1236325 - protein, 9 aa, Homo Sapiens
LYPTMLVTF

SEQ ID NO: 1236326 - protein, 9 aa, Homo Sapiens
VRVKCNTND

SEQ ID NO: 1236327 - protein, 9 aa, Homo Sapiens
WGTLGLELA

SEQ ID NO: 1236328 - protein, 9 aa, Homo Sapiens
APIMNGQGL

SEQ ID NO: 1236329 - protein, 9 aa, Homo Sapiens
HNLHIMIQY

SEQ ID NO: 1236330 - protein, 9 aa, Homo Sapiens
NTDTSRQIS

SEQ ID NO: 1236331 - protein, 9 aa, Homo Sapiens
TMLDKSSQT

SEQ ID NO: 1236332 - protein, 9 aa, Homo Sapiens
GTIMTDLEE

SEQ ID NO: 1236333 - protein, 9 aa, Homo Sapiens
IKADSTFSG

SEQ ID NO: 1236334 - protein, 9 aa, Homo Sapiens
ANAKETART

SEQ ID NO: 1236335 - protein, 9 aa, Homo Sapiens
YQFGSVGQD

SEQ ID NO: 1236336 - protein, 9 aa, Homo Sapiens
VEHYHLLHR

SEQ ID NO: 1236337 - protein, 9 aa, Homo Sapiens
RSDGFNGAD

SEQ ID NO: 1236338 - protein, 9 aa, Homo Sapiens
SQLMPPSMG

SEQ ID NO: 1236339 - protein, 9 aa, Homo Sapiens
QEIKLDDSD

SEQ ID NO: 1236340 - protein, 9 aa, Homo Sapiens
ATGIVIWGD

SEQ ID NO: 1236341 - protein, 9 aa, Homo Sapiens
DKALNNGSH

SEQ ID NO: 1236342 - protein, 9 aa, Homo Sapiens
AINFTQEEW

SEQ ID NO: 1236343 - protein, 9 aa, Homo Sapiens
GCRTTYSNQ

SEQ ID NO: 1236344 - protein, 9 aa, Homo Sapiens
RGCGRGHRR

SEQ ID NO: 1236345 - protein, 9 aa, Homo Sapiens
WSQMAVPCP

SEQ ID NO: 1236346 - protein, 9 aa, Homo Sapiens
SKATRMTKG

SEQ ID NO: 1236347 - protein, 9 aa, Homo Sapiens
DLAHKHVFL

SEQ ID NO: 1236348 - protein, 9 aa, Homo Sapiens
RGMAYVFGG

SEQ ID NO: 1236349 - protein, 9 aa, Homo Sapiens
LRLIKLLFP

SEQ ID NO: 1236350 - protein, 9 aa, Homo Sapiens
LTESEKRYV

SEQ ID NO: 1236351 - protein, 9 aa, Homo Sapiens
HRLHERKQL

SEQ ID NO: 1236352 - protein, 9 aa, Homo Sapiens
DRPGNLVYH

SEQ ID NO: 1236353 - protein, 9 aa, Homo Sapiens
NFSTLCVCR

SEQ ID NO: 1236354 - protein, 9 aa, Homo Sapiens
WASYHISSS

SEQ ID NO: 1236355 - protein, 9 aa, Homo Sapiens
LSESTTLDA

SEQ ID NO: 1236356 - protein, 9 aa, Homo Sapiens
SYIKVVHVT

SEQ ID NO: 1236357 - protein, 9 aa, Homo Sapiens
TMRRHYEDD

SEQ ID NO: 1236358 - protein, 9 aa, Homo Sapiens
LDCGCLLLY

SEQ ID NO: 1236359 - protein, 9 aa, Homo Sapiens
IMSPFYQWM

SEQ ID NO: 1236360 - protein, 9 aa, Homo Sapiens
GEGTVQLTS

SEQ ID NO: 1236361 - protein, 9 aa, Homo Sapiens
MPPVTSIGI

SEQ ID NO: 1236362 - protein, 9 aa, Homo Sapiens
ALFNTASGW

SEQ ID NO: 1236363 - protein, 9 aa, Homo Sapiens
AIGKLALLG

SEQ ID NO: 1236364 - protein, 9 aa, Homo Sapiens
ALQGDMPTA

SEQ ID NO: 1236365 - protein, 9 aa, Homo Sapiens
PVEVDSDTI

SEQ ID NO: 1236366 - protein, 9 aa, Homo Sapiens
GNAEHKPYI

SEQ ID NO: 1236367 - protein, 9 aa, Homo Sapiens
EKWKLERER

SEQ ID NO: 1236368 - protein, 9 aa, Homo Sapiens
DIIKCVLRA

SEQ ID NO: 1236369 - protein, 9 aa, Homo Sapiens
DYEGSGSTT

SEQ ID NO: 1236370 - protein, 9 aa, Homo Sapiens
QPRRLKHQP

SEQ ID NO: 1236371 - protein, 9 aa, Homo Sapiens
LIPTVGSSL

SEQ ID NO: 1236372 - protein, 9 aa, Homo Sapiens
LSCLTGSHA

SEQ ID NO: 1236373 - protein, 9 aa, Homo Sapiens
GAGPEEAAG

SEQ ID NO: 1236374 - protein, 9 aa, Homo Sapiens
TRNGSFHIR

SEQ ID NO: 1236375 - protein, 9 aa, Homo Sapiens
REVKAKLKR

SEQ ID NO: 1236376 - protein, 9 aa, Homo Sapiens
FPKCEQELE

SEQ ID NO: 1236377 - protein, 9 aa, Homo Sapiens
HLWLGTLCP

SEQ ID NO: 1236378 - protein, 9 aa, Homo Sapiens
NKTLKINEV

SEQ ID NO: 1236379 - protein, 9 aa, Homo Sapiens
ALSRLRDTP

SEQ ID NO: 1236380 - protein, 9 aa, Homo Sapiens
ELRVNQGLD

SEQ ID NO: 1236381 - protein, 9 aa, Homo Sapiens
ECLHGLEME

SEQ ID NO: 1236382 - protein, 9 aa, Homo Sapiens
IMHIQIKQE

SEQ ID NO: 1236383 - protein, 9 aa, Homo Sapiens
ELRRPMYSR

SEQ ID NO: 1236384 - protein, 9 aa, Homo Sapiens
NRCTSDLER

SEQ ID NO: 1236385 - protein, 9 aa, Homo Sapiens
QLLEAHALE

SEQ ID NO: 1236386 - protein, 9 aa, Homo Sapiens
LQHRIALHI

SEQ ID NO: 1236387 - protein, 9 aa, Homo Sapiens
PLIHVQCTG

SEQ ID NO: 1236388 - protein, 9 aa, Homo Sapiens
DPLALCHLV

SEQ ID NO: 1236389 - protein, 9 aa, Homo Sapiens
PCPRICRGI

SEQ ID NO: 1236390 - protein, 9 aa, Homo Sapiens
LVVSNPNRN

SEQ ID NO: 1236391 - protein, 9 aa, Homo Sapiens
FFMVKGAVL

SEQ ID NO: 1236392 - protein, 9 aa, Homo Sapiens
PETRAWSMV

SEQ ID NO: 1236393 - protein, 9 aa, Homo Sapiens
LVIAPLPTI

SEQ ID NO: 1236394 - protein, 9 aa, Homo Sapiens
VPAPKDALA

SEQ ID NO: 1236395 - protein, 9 aa, Homo Sapiens
KGDKCSQGS

SEQ ID NO: 1236396 - protein, 9 aa, Homo Sapiens
VSGPDGQTQ

SEQ ID NO: 1236397 - protein, 9 aa, Homo Sapiens
SKISGSVAG

SEQ ID NO: 1236398 - protein, 9 aa, Homo Sapiens
KPHISNKPK

SEQ ID NO: 1236399 - protein, 9 aa, Homo Sapiens
AIKEQNPNA

SEQ ID NO: 1236400 - protein, 9 aa, Homo Sapiens
ASMRILGAW

SEQ ID NO: 1236401 - protein, 9 aa, Homo Sapiens
ERTALAGAG

SEQ ID NO: 1236402 - protein, 9 aa, Homo Sapiens
TSTLCHFLP

SEQ ID NO: 1236403 - protein, 9 aa, Homo Sapiens
CLVCVNFSH

SEQ ID NO: 1236404 - protein, 9 aa, Homo Sapiens
NHGCAHVCR

SEQ ID NO: 1236405 - protein, 9 aa, Homo Sapiens
GNGLTPDAA

SEQ ID NO: 1236406 - protein, 9 aa, Homo Sapiens
LCEHCPTCY

SEQ ID NO: 1236407 - protein, 9 aa, Homo Sapiens
VMHISCPQE

SEQ ID NO: 1236408 - protein, 9 aa, Homo Sapiens
LYKMTAYDQ

SEQ ID NO: 1236409 - protein, 9 aa, Homo Sapiens
IKSSICLLH

SEQ ID NO: 1236410 - protein, 9 aa, Homo Sapiens
PGTSQLMPP

SEQ ID NO: 1236411 - protein, 9 aa, Homo Sapiens
VVTKWKKMN

SEQ ID NO: 1236412 - protein, 9 aa, Homo Sapiens
QALGLRPTR

SEQ ID NO: 1236413 - protein, 9 aa, Homo Sapiens
HDSSFKKYQ

SEQ ID NO: 1236414 - protein, 9 aa, Homo Sapiens
SMCPGYRGP

SEQ ID NO: 1236415 - protein, 9 aa, Homo Sapiens
CLRGKHARH

SEQ ID NO: 1236416 - protein, 9 aa, Homo Sapiens
YECVIRAMK

SEQ ID NO: 1236417 - protein, 9 aa, Homo Sapiens
RILTIGTRS

SEQ ID NO: 1236418 - protein, 9 aa, Homo Sapiens
RASGVARFS

SEQ ID NO: 1236419 - protein, 9 aa, Homo Sapiens
IVLSRPSLN

SEQ ID NO: 1236420 - protein, 9 aa, Homo Sapiens
TIDENTGLI

SEQ ID NO: 1236421 - protein, 9 aa, Homo Sapiens
YFLVLLSMT

SEQ ID NO: 1236422 - protein, 9 aa, Homo Sapiens
GCVLYTWDF

SEQ ID NO: 1236423 - protein, 9 aa, Homo Sapiens
SFGGKGQGK

SEQ ID NO: 1236424 - protein, 9 aa, Homo Sapiens
RGEKSYECN

SEQ ID NO: 1236425 - protein, 9 aa, Homo Sapiens
KHPARNVEA

SEQ ID NO: 1236426 - protein, 9 aa, Homo Sapiens
LVQYIPFYA

SEQ ID NO: 1236427 - protein, 9 aa, Homo Sapiens
TKPVLSVCM

SEQ ID NO: 1236428 - protein, 9 aa, Homo Sapiens
LSGRLWAIL

SEQ ID NO: 1236429 - protein, 9 aa, Homo Sapiens
GDKFKLIKG

SEQ ID NO: 1236430 - protein, 9 aa, Homo Sapiens
GALELVWQH

SEQ ID NO: 1236431 - protein, 9 aa, Homo Sapiens
VISLNITSL

SEQ ID NO: 1236432 - protein, 9 aa, Homo Sapiens
VRAGGGIED

SEQ ID NO: 1236433 - protein, 9 aa, Homo Sapiens
QMNAKYKAE

SEQ ID NO: 1236434 - protein, 9 aa, Homo Sapiens
LYQSVLSMT

SEQ ID NO: 1236435 - protein, 9 aa, Homo Sapiens
PAQHCSMIL

SEQ ID NO: 1236436 - protein, 9 aa, Homo Sapiens
DHHEVISKE

SEQ ID NO: 1236437 - protein, 9 aa, Homo Sapiens
PANSFVGAP

SEQ ID NO: 1236438 - protein, 9 aa, Homo Sapiens
LEVFAHALH

SEQ ID NO: 1236439 - protein, 9 aa, Homo Sapiens
FTPVPAMTG

SEQ ID NO: 1236440 - protein, 9 aa, Homo Sapiens
TEQHVRKNK

SEQ ID NO: 1236441 - protein, 9 aa, Homo Sapiens
PAFHSLQKQ

SEQ ID NO: 1236442 - protein, 9 aa, Homo Sapiens
VYITQVILM

SEQ ID NO: 1236443 - protein, 9 aa, Homo Sapiens
GDEVDINTL

SEQ ID NO: 1236444 - protein, 9 aa, Homo Sapiens
NDNGSNLQC

SEQ ID NO: 1236445 - protein, 9 aa, Homo Sapiens
SSLVFKRMD

SEQ ID NO: 1236446 - protein, 9 aa, Homo Sapiens
ANVVNVRHD

SEQ ID NO: 1236447 - protein, 9 aa, Homo Sapiens
GQQSHHGHP

SEQ ID NO: 1236448 - protein, 9 aa, Homo Sapiens
DPSMSEITS

SEQ ID NO: 1236449 - protein, 9 aa, Homo Sapiens
DIFARDKNP

SEQ ID NO: 1236450 - protein, 9 aa, Homo Sapiens
SYKTAVIPI

SEQ ID NO: 1236451 - protein, 9 aa, Homo Sapiens
LLNQFKSKI

SEQ ID NO: 1236452 - protein, 9 aa, Homo Sapiens
FAEWCHAHG

SEQ ID NO: 1236453 - protein, 9 aa, Homo Sapiens
MFPDTMLQT

SEQ ID NO: 1236454 - protein, 9 aa, Homo Sapiens
LNYSQVAMM

SEQ ID NO: 1236455 - protein, 9 aa, Homo Sapiens
YGPPGGLFE

SEQ ID NO: 1236456 - protein, 9 aa, Homo Sapiens
VAECKEKFT

SEQ ID NO: 1236457 - protein, 9 aa, Homo Sapiens
LKGAPDPCC

SEQ ID NO: 1236458 - protein, 9 aa, Homo Sapiens
LITLYPTML

SEQ ID NO: 1236459 - protein, 9 aa, Homo Sapiens
FTHLNSPQL

SEQ ID NO: 1236460 - protein, 9 aa, Homo Sapiens
VPIKVMVTC

SEQ ID NO: 1236461 - protein, 9 aa, Homo Sapiens
YLVGTPYYM

SEQ ID NO: 1236462 - protein, 9 aa, Homo Sapiens
MEKYLSLSV

SEQ ID NO: 1236463 - protein, 9 aa, Homo Sapiens
SRLLLLAIS

SEQ ID NO: 1236464 - protein, 9 aa, Homo Sapiens
VALGTVEEV

SEQ ID NO: 1236465 - protein, 9 aa, Homo Sapiens
GGEPRAHTM

SEQ ID NO: 1236466 - protein, 9 aa, Homo Sapiens
YQEGTKMAV

SEQ ID NO: 1236467 - protein, 9 aa, Homo Sapiens
FSVLFVISE

SEQ ID NO: 1236468 - protein, 9 aa, Homo Sapiens
ATYLAQAGL

SEQ ID NO: 1236469 - protein, 9 aa, Homo Sapiens
RSRKKRKKN

SEQ ID NO: 1236470 - protein, 9 aa, Homo Sapiens
LHTEDDPVV

SEQ ID NO: 1236471 - protein, 9 aa, Homo Sapiens
DPHFGLIKA

SEQ ID NO: 1236472 - protein, 9 aa, Homo Sapiens
LRVSITPGT

SEQ ID NO: 1236473 - protein, 9 aa, Homo Sapiens
TGSKNYGKC

SEQ ID NO: 1236474 - protein, 9 aa, Homo Sapiens
AILKRDVDI

SEQ ID NO: 1236475 - protein, 9 aa, Homo Sapiens
WKRRRSFSC

SEQ ID NO: 1236476 - protein, 9 aa, Homo Sapiens
MSIFSPMKK

SEQ ID NO: 1236477 - protein, 9 aa, Homo Sapiens
KVIVQVFEG

SEQ ID NO: 1236478 - protein, 9 aa, Homo Sapiens
LGTVEWRGA

SEQ ID NO: 1236479 - protein, 9 aa, Homo Sapiens
ASIQEAASV

SEQ ID NO: 1236480 - protein, 9 aa, Homo Sapiens
RGVTEDYLH

SEQ ID NO: 1236481 - protein, 9 aa, Homo Sapiens
TGSFAGLPG

SEQ ID NO: 1236482 - protein, 9 aa, Homo Sapiens
HGPLDKWQV

SEQ ID NO: 1236483 - protein, 9 aa, Homo Sapiens
KNHKMCIIA

SEQ ID NO: 1236484 - protein, 9 aa, Homo Sapiens
SISPGTPQS

SEQ ID NO: 1236485 - protein, 9 aa, Homo Sapiens
FDQDMVNKI

SEQ ID NO: 1236486 - protein, 9 aa, Homo Sapiens
ISNKDQYSI

SEQ ID NO: 1236487 - protein, 9 aa, Homo Sapiens
YGNVPVVSA

SEQ ID NO: 1236488 - protein, 9 aa, Homo Sapiens
EFLATGKLC

SEQ ID NO: 1236489 - protein, 9 aa, Homo Sapiens
TCIDSRALG

SEQ ID NO: 1236490 - protein, 9 aa, Homo Sapiens
ENYQMQSEE

SEQ ID NO: 1236491 - protein, 9 aa, Homo Sapiens
PDMIIRPSI

SEQ ID NO: 1236492 - protein, 9 aa, Homo Sapiens
TKTESPRTS

SEQ ID NO: 1236493 - protein, 9 aa, Homo Sapiens
HRAPGQSTC

SEQ ID NO: 1236494 - protein, 9 aa, Homo Sapiens
HSYALCTRR

SEQ ID NO: 1236495 - protein, 9 aa, Homo Sapiens
NSLKDGIVF

SEQ ID NO: 1236496 - protein, 9 aa, Homo Sapiens
YAWKRMDVG

SEQ ID NO: 1236497 - protein, 9 aa, Homo Sapiens
AAVRAVIKN

SEQ ID NO: 1236498 - protein, 9 aa, Homo Sapiens
TVHELNLEE

SEQ ID NO: 1236499 - protein, 9 aa, Homo Sapiens
LALQLAYYI

SEQ ID NO: 1236500 - protein, 9 aa, Homo Sapiens
EDSYYCRCH

SEQ ID NO: 1236501 - protein, 9 aa, Homo Sapiens
EDCHIQPLI

SEQ ID NO: 1236502 - protein, 9 aa, Homo Sapiens
CVKEQDLLQ

SEQ ID NO: 1236503 - protein, 9 aa, Homo Sapiens
RSPSPSTQL

SEQ ID NO: 1236504 - protein, 9 aa, Homo Sapiens
VFPLAMHYL

SEQ ID NO: 1236505 - protein, 9 aa, Homo Sapiens
LTMSSAWPP

SEQ ID NO: 1236506 - protein, 9 aa, Homo Sapiens
GIYNCWEFP

SEQ ID NO: 1236507 - protein, 9 aa, Homo Sapiens
VSNNGSMRN

SEQ ID NO: 1236508 - protein, 9 aa, Homo Sapiens
TGKAHSVQV

SEQ ID NO: 1236509 - protein, 9 aa, Homo Sapiens
GFFGGQQSH

SEQ ID NO: 1236510 - protein, 9 aa, Homo Sapiens
GIQPMWDDS

SEQ ID NO: 1236511 - protein, 9 aa, Homo Sapiens
EETMQDIRF

SEQ ID NO: 1236512 - protein, 9 aa, Homo Sapiens
THKQHGKAF

SEQ ID NO: 1236513 - protein, 9 aa, Homo Sapiens
MALQLCPVL

SEQ ID NO: 1236514 - protein, 9 aa, Homo Sapiens
ARCALGRWG

SEQ ID NO: 1236515 - protein, 9 aa, Homo Sapiens
SAPANQPRT

SEQ ID NO: 1236516 - protein, 9 aa, Homo Sapiens
VRYGADVDV

SEQ ID NO: 1236517 - protein, 9 aa, Homo Sapiens
GLRIEGHLG

SEQ ID NO: 1236518 - protein, 9 aa, Homo Sapiens
AQEHFGKYK

SEQ ID NO: 1236519 - protein, 9 aa, Homo Sapiens
AQAEGIPKI

SEQ ID NO: 1236520 - protein, 9 aa, Homo Sapiens
ADTFVDLEE

SEQ ID NO: 1236521 - protein, 9 aa, Homo Sapiens
STAQQELDE

SEQ ID NO: 1236522 - protein, 9 aa, Homo Sapiens
IIISVIQKF

SEQ ID NO: 1236523 - protein, 9 aa, Homo Sapiens
RLNITIFFG

SEQ ID NO: 1236524 - protein, 9 aa, Homo Sapiens
ETSIAPKQR

SEQ ID NO: 1236525 - protein, 9 aa, Homo Sapiens
PGTGKVEIV

SEQ ID NO: 1236526 - protein, 9 aa, Homo Sapiens
LLLIFTSVT

SEQ ID NO: 1236527 - protein, 9 aa, Homo Sapiens
GEFQTVKNV

SEQ ID NO: 1236528 - protein, 9 aa, Homo Sapiens
CNIKHRGHA

SEQ ID NO: 1236529 - protein, 9 aa, Homo Sapiens
DDFIAKVSP

SEQ ID NO: 1236530 - protein, 9 aa, Homo Sapiens
NRIGGKMKI

SEQ ID NO: 1236531 - protein, 9 aa, Homo Sapiens
RCEGLCLLS

SEQ ID NO: 1236532 - protein, 9 aa, Homo Sapiens
ITCIDSRAL

SEQ ID NO: 1236533 - protein, 9 aa, Homo Sapiens
EASYCVLRL

SEQ ID NO: 1236534 - protein, 9 aa, Homo Sapiens
HTEKPPESD

SEQ ID NO: 1236535 - protein, 9 aa, Homo Sapiens
RHIHSRTHA

SEQ ID NO: 1236536 - protein, 9 aa, Homo Sapiens
HTHTQAYTL

SEQ ID NO: 1236537 - protein, 9 aa, Homo Sapiens
RLSQHQPRS

SEQ ID NO: 1236538 - protein, 9 aa, Homo Sapiens
TIPVVIFKY

SEQ ID NO: 1236539 - protein, 9 aa, Homo Sapiens
FTENEVIQI

SEQ ID NO: 1236540 - protein, 9 aa, Homo Sapiens
TTAAHYLVG

SEQ ID NO: 1236541 - protein, 9 aa, Homo Sapiens
LSAEAQAQH

SEQ ID NO: 1236542 - protein, 9 aa, Homo Sapiens
MLCHGVKIG

SEQ ID NO: 1236543 - protein, 9 aa, Homo Sapiens
HAKYSAENE

SEQ ID NO: 1236544 - protein, 9 aa, Homo Sapiens
LSRLRDTPV

SEQ ID NO: 1236545 - protein, 9 aa, Homo Sapiens
TMTTLSNIA

SEQ ID NO: 1236546 - protein, 9 aa, Homo Sapiens
DEAQMVERP

SEQ ID NO: 1236547 - protein, 9 aa, Homo Sapiens
FRVDHIMML

SEQ ID NO: 1236548 - protein, 9 aa, Homo Sapiens
AIEALKSLP

SEQ ID NO: 1236549 - protein, 9 aa, Homo Sapiens
CAAVRAVIK

SEQ ID NO: 1236550 - protein, 9 aa, Homo Sapiens
VMGLITCMF

SEQ ID NO: 1236551 - protein, 9 aa, Homo Sapiens
TSKYNHDNE

SEQ ID NO: 1236552 - protein, 9 aa, Homo Sapiens
CSVSCGRGN

SEQ ID NO: 1236553 - protein, 9 aa, Homo Sapiens
LGREKPVYY

SEQ ID NO: 1236554 - protein, 9 aa, Homo Sapiens
GKDGQGHTT

SEQ ID NO: 1236555 - protein, 9 aa, Homo Sapiens
SRALGFQTF

SEQ ID NO: 1236556 - protein, 9 aa, Homo Sapiens
QASEDMKLF

SEQ ID NO: 1236557 - protein, 9 aa, Homo Sapiens
TVGQCMETT

SEQ ID NO: 1236558 - protein, 9 aa, Homo Sapiens
NQLEQLRQR

SEQ ID NO: 1236559 - protein, 9 aa, Homo Sapiens
PGKPFMSVF

SEQ ID NO: 1236560 - protein, 9 aa, Homo Sapiens
ECELPAACL

SEQ ID NO: 1236561 - protein, 9 aa, Homo Sapiens
SVMVSMVTK

SEQ ID NO: 1236562 - protein, 9 aa, Homo Sapiens
SSISEYSNM

SEQ ID NO: 1236563 - protein, 9 aa, Homo Sapiens
VNIFTDFDK

SEQ ID NO: 1236564 - protein, 9 aa, Homo Sapiens
KTGSKNYGK

SEQ ID NO: 1236565 - protein, 9 aa, Homo Sapiens
GVCRRSLDS

SEQ ID NO: 1236566 - protein, 9 aa, Homo Sapiens
SVLEDEATY

SEQ ID NO: 1236567 - protein, 9 aa, Homo Sapiens
FCITLGYTN

SEQ ID NO: 1236568 - protein, 9 aa, Homo Sapiens
CSSLPKTDC

SEQ ID NO: 1236569 - protein, 9 aa, Homo Sapiens
NKKQQEPAA

SEQ ID NO: 1236570 - protein, 9 aa, Homo Sapiens
VTVHEATPL

SEQ ID NO: 1236571 - protein, 9 aa, Homo Sapiens
PYIMEEADV

SEQ ID NO: 1236572 - protein, 9 aa, Homo Sapiens
ARKKAENRQ

SEQ ID NO: 1236573 - protein, 9 aa, Homo Sapiens
RRTASTSWH

SEQ ID NO: 1236574 - protein, 9 aa, Homo Sapiens
LMDELTLKG

SEQ ID NO: 1236575 - protein, 9 aa, Homo Sapiens
DMLKRAETA

SEQ ID NO: 1236576 - protein, 9 aa, Homo Sapiens
THSPLQSTP

SEQ ID NO: 1236577 - protein, 9 aa, Homo Sapiens
QVDVGRDGQ

SEQ ID NO: 1236578 - protein, 9 aa, Homo Sapiens
ATSVEQYVP

SEQ ID NO: 1236579 - protein, 9 aa, Homo Sapiens
QRWGLLRAQ

SEQ ID NO: 1236580 - protein, 9 aa, Homo Sapiens
PCGPDRCDN

SEQ ID NO: 1236581 - protein, 9 aa, Homo Sapiens
AKSYWDALY

SEQ ID NO: 1236582 - protein, 9 aa, Homo Sapiens
LAHKHVFLT

SEQ ID NO: 1236583 - protein, 9 aa, Homo Sapiens
NKDVTHPCM

SEQ ID NO: 1236584 - protein, 9 aa, Homo Sapiens
LAPKAEVDV

SEQ ID NO: 1236585 - protein, 9 aa, Homo Sapiens
CIKHYNTGK

SEQ ID NO: 1236586 - protein, 9 aa, Homo Sapiens
LLKEFQACY

SEQ ID NO: 1236587 - protein, 9 aa, Homo Sapiens
LMSPKHKYK

SEQ ID NO: 1236588 - protein, 9 aa, Homo Sapiens
YLGYQALSE

SEQ ID NO: 1236589 - protein, 9 aa, Homo Sapiens
YISLALWSY

SEQ ID NO: 1236590 - protein, 9 aa, Homo Sapiens
CTVSYEVRS

SEQ ID NO: 1236591 - protein, 9 aa, Homo Sapiens
LFYDTSASF

SEQ ID NO: 1236592 - protein, 9 aa, Homo Sapiens
LWWFCLLWT

SEQ ID NO: 1236593 - protein, 9 aa, Homo Sapiens
MLEELRNLR

SEQ ID NO: 1236594 - protein, 9 aa, Homo Sapiens
KPKMWRSIM

SEQ ID NO: 1236595 - protein, 9 aa, Homo Sapiens
SEAKAKDSE

SEQ ID NO: 1236596 - protein, 9 aa, Homo Sapiens
KNEILEIAM

SEQ ID NO: 1236597 - protein, 9 aa, Homo Sapiens
AGRGRPGAG

SEQ ID NO: 1236598 - protein, 9 aa, Homo Sapiens
LLAHANFSP

SEQ ID NO: 1236599 - protein, 9 aa, Homo Sapiens
RYLCVMSER

SEQ ID NO: 1236600 - protein, 9 aa, Homo Sapiens
ILNTIKRVG

SEQ ID NO: 1236601 - protein, 9 aa, Homo Sapiens
SVHTEFMNP

SEQ ID NO: 1236602 - protein, 9 aa, Homo Sapiens
FLSALTLVR

SEQ ID NO: 1236603 - protein, 9 aa, Homo Sapiens
ILQNYWTEV

SEQ ID NO: 1236604 - protein, 9 aa, Homo Sapiens
PEPCTIPSG

SEQ ID NO: 1236605 - protein, 9 aa, Homo Sapiens
TTLGFEAPG

SEQ ID NO: 1236606 - protein, 9 aa, Homo Sapiens
SMRIGLMME

SEQ ID NO: 1236607 - protein, 9 aa, Homo Sapiens
WLTTMLLHI

SEQ ID NO: 1236608 - protein, 9 aa, Homo Sapiens
HKKYCLKTT

SEQ ID NO: 1236609 - protein, 9 aa, Homo Sapiens
KGSLDRHMQ

SEQ ID NO: 1236610 - protein, 9 aa, Homo Sapiens
KTGVRDPTD

SEQ ID NO: 1236611 - protein, 9 aa, Homo Sapiens
LYFVASVFR

SEQ ID NO: 1236612 - protein, 9 aa, Homo Sapiens
YFTYITKAY

SEQ ID NO: 1236613 - protein, 9 aa, Homo Sapiens
RILTSKLLH

SEQ ID NO: 1236614 - protein, 9 aa, Homo Sapiens
RSHSFSKER

SEQ ID NO: 1236615 - protein, 9 aa, Homo Sapiens
VFEEDGCVT

SEQ ID NO: 1236616 - protein, 9 aa, Homo Sapiens
EDCEHCLLE

SEQ ID NO: 1236617 - protein, 9 aa, Homo Sapiens
YYIAFVEKS

SEQ ID NO: 1236618 - protein, 9 aa, Homo Sapiens
ASSVMTHLS

SEQ ID NO: 1236619 - protein, 9 aa, Homo Sapiens
FYYLEVHQG

SEQ ID NO: 1236620 - protein, 9 aa, Homo Sapiens
NATVYPGLE

SEQ ID NO: 1236621 - protein, 9 aa, Homo Sapiens
TGISAIDGV

SEQ ID NO: 1236622 - protein, 9 aa, Homo Sapiens
TWYHRYYWG

SEQ ID NO: 1236623 - protein, 9 aa, Homo Sapiens
NGHLVSAIS

SEQ ID NO: 1236624 - protein, 9 aa, Homo Sapiens
GPWNTSSLV

SEQ ID NO: 1236625 - protein, 9 aa, Homo Sapiens
ADQGQLMGA

SEQ ID NO: 1236626 - protein, 9 aa, Homo Sapiens
KQDTWQTAT

SEQ ID NO: 1236627 - protein, 9 aa, Homo Sapiens
LLRPPVTAF

SEQ ID NO: 1236628 - protein, 9 aa, Homo Sapiens
MTEEVLQRV

SEQ ID NO: 1236629 - protein, 9 aa, Homo Sapiens
IYEGYTLPH

SEQ ID NO: 1236630 - protein, 9 aa, Homo Sapiens
CVMAFDVVS

SEQ ID NO: 1236631 - protein, 9 aa, Homo Sapiens
MLGETMSSE

SEQ ID NO: 1236632 - protein, 9 aa, Homo Sapiens
EIHVKTLEK

SEQ ID NO: 1236633 - protein, 9 aa, Homo Sapiens
VKEQDLLQE

SEQ ID NO: 1236634 - protein, 9 aa, Homo Sapiens
ITIFFGALF

SEQ ID NO: 1236635 - protein, 9 aa, Homo Sapiens
DTSSYQQST

SEQ ID NO: 1236636 - protein, 9 aa, Homo Sapiens
LHATFSIIN

SEQ ID NO: 1236637 - protein, 9 aa, Homo Sapiens
YRMHQAIMC

SEQ ID NO: 1236638 - protein, 9 aa, Homo Sapiens
KGNEEKAVI

SEQ ID NO: 1236639 - protein, 9 aa, Homo Sapiens
AHCPANGAG

SEQ ID NO: 1236640 - protein, 9 aa, Homo Sapiens
PGMAFALMA

SEQ ID NO: 1236641 - protein, 9 aa, Homo Sapiens
PRSLVKHIC

SEQ ID NO: 1236642 - protein, 9 aa, Homo Sapiens
LLSSEGGID

SEQ ID NO: 1236643 - protein, 9 aa, Homo Sapiens
SFDTGPQGG

SEQ ID NO: 1236644 - protein, 9 aa, Homo Sapiens
DPLTNKVPE

SEQ ID NO: 1236645 - protein, 9 aa, Homo Sapiens
RHLNLEEEN

SEQ ID NO: 1236646 - protein, 9 aa, Homo Sapiens
PMNKHLSSS

SEQ ID NO: 1236647 - protein, 9 aa, Homo Sapiens
NFMLRNERQ

SEQ ID NO: 1236648 - protein, 9 aa, Homo Sapiens
RDHYARSPK

SEQ ID NO: 1236649 - protein, 9 aa, Homo Sapiens
VISRTEPSM

SEQ ID NO: 1236650 - protein, 9 aa, Homo Sapiens
EGKIIRAQL

SEQ ID NO: 1236651 - protein, 9 aa, Homo Sapiens
FEMDSSMAC

SEQ ID NO: 1236652 - protein, 9 aa, Homo Sapiens
APLPLELYM

SEQ ID NO: 1236653 - protein, 9 aa, Homo Sapiens
EKAGGTNLG

SEQ ID NO: 1236654 - protein, 9 aa, Homo Sapiens
ECQFNLNGN

SEQ ID NO: 1236655 - protein, 9 aa, Homo Sapiens
LSAIADLLA

SEQ ID NO: 1236656 - protein, 9 aa, Homo Sapiens
LLSGTVNSE

SEQ ID NO: 1236657 - protein, 9 aa, Homo Sapiens
TTGVSIIMN

SEQ ID NO: 1236658 - protein, 9 aa, Homo Sapiens
QFFSMFGEL

SEQ ID NO: 1236659 - protein, 9 aa, Homo Sapiens
QVTLRYSPI

SEQ ID NO: 1236660 - protein, 9 aa, Homo Sapiens
VPQVNGEQH

SEQ ID NO: 1236661 - protein, 9 aa, Homo Sapiens
SELRVRKHG

SEQ ID NO: 1236662 - protein, 9 aa, Homo Sapiens
NQHIWTRFL

SEQ ID NO: 1236663 - protein, 9 aa, Homo Sapiens
SNGIERNKG

SEQ ID NO: 1236664 - protein, 9 aa, Homo Sapiens
HLNLKVRKK

SEQ ID NO: 1236665 - protein, 9 aa, Homo Sapiens
ETVHVCNEC

SEQ ID NO: 1236666 - protein, 9 aa, Homo Sapiens
RYAILQQLS

SEQ ID NO: 1236667 - protein, 9 aa, Homo Sapiens
GGQSSTTDA

SEQ ID NO: 1236668 - protein, 9 aa, Homo Sapiens
RESGGHRYV

SEQ ID NO: 1236669 - protein, 9 aa, Homo Sapiens
GAIENCNKA

SEQ ID NO: 1236670 - protein, 9 aa, Homo Sapiens
NQRRYPRTT

SEQ ID NO: 1236671 - protein, 9 aa, Homo Sapiens
VTLARQDGE

SEQ ID NO: 1236672 - protein, 9 aa, Homo Sapiens
RAATFTYIP

SEQ ID NO: 1236673 - protein, 9 aa, Homo Sapiens
LGTWDDAFT

SEQ ID NO: 1236674 - protein, 9 aa, Homo Sapiens
QIQTQAPQP

SEQ ID NO: 1236675 - protein, 9 aa, Homo Sapiens
LPLRGSAGH

SEQ ID NO: 1236676 - protein, 9 aa, Homo Sapiens
SQNRTHSFG

SEQ ID NO: 1236677 - protein, 9 aa, Homo Sapiens
GYAPAMADG

SEQ ID NO: 1236678 - protein, 9 aa, Homo Sapiens
AQHYLSKTS

SEQ ID NO: 1236679 - protein, 9 aa, Homo Sapiens
YAYVPPMAT

SEQ ID NO: 1236680 - protein, 9 aa, Homo Sapiens
LLNQQDEID

SEQ ID NO: 1236681 - protein, 9 aa, Homo Sapiens
WLIGRMMQA

SEQ ID NO: 1236682 - protein, 9 aa, Homo Sapiens
NFKSIHSIT

SEQ ID NO: 1236683 - protein, 9 aa, Homo Sapiens
FVGHDAKVP

SEQ ID NO: 1236684 - protein, 9 aa, Homo Sapiens
PGCIFVHTS

SEQ ID NO: 1236685 - protein, 9 aa, Homo Sapiens
WSCVQNNIP

SEQ ID NO: 1236686 - protein, 9 aa, Homo Sapiens
EEPKQADVH

SEQ ID NO: 1236687 - protein, 9 aa, Homo Sapiens
RTHTGEKHC

SEQ ID NO: 1236688 - protein, 9 aa, Homo Sapiens
SGGSESQGE

SEQ ID NO: 1236689 - protein, 9 aa, Homo Sapiens
CPQDFLSVR

SEQ ID NO: 1236690 - protein, 9 aa, Homo Sapiens
SPSRDKVVA

SEQ ID NO: 1236691 - protein, 9 aa, Homo Sapiens
ERPFTCAGC

SEQ ID NO: 1236692 - protein, 9 aa, Homo Sapiens
DIPIPQSVA

SEQ ID NO: 1236693 - protein, 9 aa, Homo Sapiens
EVGPPESAE

SEQ ID NO: 1236694 - protein, 9 aa, Homo Sapiens
LLKTEDSAR

SEQ ID NO: 1236695 - protein, 9 aa, Homo Sapiens
SEGPRKYVL

SEQ ID NO: 1236696 - protein, 9 aa, Homo Sapiens
IIFTIDVTY

SEQ ID NO: 1236697 - protein, 9 aa, Homo Sapiens
LSKREMDEL

SEQ ID NO: 1236698 - protein, 9 aa, Homo Sapiens
EGGVKQEYC

SEQ ID NO: 1236699 - protein, 9 aa, Homo Sapiens
NPVIMQESH

SEQ ID NO: 1236700 - protein, 9 aa, Homo Sapiens
KLIVPRKTR

SEQ ID NO: 1236701 - protein, 9 aa, Homo Sapiens
QTEECVQPE

SEQ ID NO: 1236702 - protein, 9 aa, Homo Sapiens
LQNTSQIKQ

SEQ ID NO: 1236703 - protein, 9 aa, Homo Sapiens
LAIINHVSK

SEQ ID NO: 1236704 - protein, 9 aa, Homo Sapiens
DQNTLISFF

SEQ ID NO: 1236705 - protein, 9 aa, Homo Sapiens
RPLHTAGGG

SEQ ID NO: 1236706 - protein, 9 aa, Homo Sapiens
PDWVVTADH

SEQ ID NO: 1236707 - protein, 9 aa, Homo Sapiens
DEYFWGKPH

SEQ ID NO: 1236708 - protein, 9 aa, Homo Sapiens
TASMSGTKG

SEQ ID NO: 1236709 - protein, 9 aa, Homo Sapiens
DSSTYNNRG

SEQ ID NO: 1236710 - protein, 9 aa, Homo Sapiens
VAVVLKATQ

SEQ ID NO: 1236711 - protein, 9 aa, Homo Sapiens
LLKEGHRRP

SEQ ID NO: 1236712 - protein, 9 aa, Homo Sapiens
LDIIKLTGV

SEQ ID NO: 1236713 - protein, 9 aa, Homo Sapiens
QSTKPSFSD

SEQ ID NO: 1236714 - protein, 9 aa, Homo Sapiens
RGLSRIIIC

SEQ ID NO: 1236715 - protein, 9 aa, Homo Sapiens
KATDGGFMS

SEQ ID NO: 1236716 - protein, 9 aa, Homo Sapiens
ILSPCKECG

SEQ ID NO: 1236717 - protein, 9 aa, Homo Sapiens
QAVHQRMMS

SEQ ID NO: 1236718 - protein, 9 aa, Homo Sapiens
DELVEADEA

SEQ ID NO: 1236719 - protein, 9 aa, Homo Sapiens
CIFSRDGGS

SEQ ID NO: 1236720 - protein, 9 aa, Homo Sapiens
VQNLGMWVQ

SEQ ID NO: 1236721 - protein, 9 aa, Homo Sapiens
HEALAKWAE

SEQ ID NO: 1236722 - protein, 9 aa, Homo Sapiens
GEIWRMYAH

SEQ ID NO: 1236723 - protein, 9 aa, Homo Sapiens
ELQAELGLG

SEQ ID NO: 1236724 - protein, 9 aa, Homo Sapiens
LIAAVFMSD

SEQ ID NO: 1236725 - protein, 9 aa, Homo Sapiens
RLTQARGAA

SEQ ID NO: 1236726 - protein, 9 aa, Homo Sapiens
FQCFGFWAS

SEQ ID NO: 1236727 - protein, 9 aa, Homo Sapiens
SHHILPPQL

SEQ ID NO: 1236728 - protein, 9 aa, Homo Sapiens
CSGHQSFMT

SEQ ID NO: 1236729 - protein, 9 aa, Homo Sapiens
RPFSGNLRM

SEQ ID NO: 1236730 - protein, 9 aa, Homo Sapiens
PEGVRQQVF

SEQ ID NO: 1236731 - protein, 9 aa, Homo Sapiens
VENVTDTTT

SEQ ID NO: 1236732 - protein, 9 aa, Homo Sapiens
ALIIGFVIS

SEQ ID NO: 1236733 - protein, 9 aa, Homo Sapiens
SSLSLRVRG

SEQ ID NO: 1236734 - protein, 9 aa, Homo Sapiens
GRDQGRHPV

SEQ ID NO: 1236735 - protein, 9 aa, Homo Sapiens
PRLRLYYDI

SEQ ID NO: 1236736 - protein, 9 aa, Homo Sapiens
HPEVENRPP

SEQ ID NO: 1236737 - protein, 9 aa, Homo Sapiens
SMMTRRRTK

SEQ ID NO: 1236738 - protein, 9 aa, Homo Sapiens
VWYLEEERP

SEQ ID NO: 1236739 - protein, 9 aa, Homo Sapiens
RHGKLCSNF

SEQ ID NO: 1236740 - protein, 9 aa, Homo Sapiens
RRPRGMMKN

SEQ ID NO: 1236741 - protein, 9 aa, Homo Sapiens
VVISDIDGI

SEQ ID NO: 1236742 - protein, 9 aa, Homo Sapiens
IDENTGLIK

SEQ ID NO: 1236743 - protein, 9 aa, Homo Sapiens
NKMNLTLDF

SEQ ID NO: 1236744 - protein, 9 aa, Homo Sapiens
NSMILIGNV

SEQ ID NO: 1236745 - protein, 9 aa, Homo Sapiens
KVAEVRRIV

SEQ ID NO: 1236746 - protein, 9 aa, Homo Sapiens
ELQTQGSHD

SEQ ID NO: 1236747 - protein, 9 aa, Homo Sapiens
SFLMFKVDQ

SEQ ID NO: 1236748 - protein, 9 aa, Homo Sapiens
GTSSELQNN

SEQ ID NO: 1236749 - protein, 9 aa, Homo Sapiens
SGALPSPDV

SEQ ID NO: 1236750 - protein, 9 aa, Homo Sapiens
AVKFTSLAC

SEQ ID NO: 1236751 - protein, 9 aa, Homo Sapiens
ETWEKTFTW

SEQ ID NO: 1236752 - protein, 9 aa, Homo Sapiens
HQQKPIEPC

SEQ ID NO: 1236753 - protein, 9 aa, Homo Sapiens
SADDGILNT

SEQ ID NO: 1236754 - protein, 9 aa, Homo Sapiens
NLLSSEGGI

SEQ ID NO: 1236755 - protein, 9 aa, Homo Sapiens
TLDLVDVSS

SEQ ID NO: 1236756 - protein, 9 aa, Homo Sapiens
GAMFRLSTD

SEQ ID NO: 1236757 - protein, 9 aa, Homo Sapiens
RVCITVDSL

SEQ ID NO: 1236758 - protein, 9 aa, Homo Sapiens
YIIISVIQK

SEQ ID NO: 1236759 - protein, 9 aa, Homo Sapiens
SARAENTTV

SEQ ID NO: 1236760 - protein, 9 aa, Homo Sapiens
GLLAAVVAL

SEQ ID NO: 1236761 - protein, 9 aa, Homo Sapiens
LENQYTLDN

SEQ ID NO: 1236762 - protein, 9 aa, Homo Sapiens
DMYLKSLNP

SEQ ID NO: 1236763 - protein, 9 aa, Homo Sapiens
HSLEYKHRI

SEQ ID NO: 1236764 - protein, 9 aa, Homo Sapiens
SSPPTLRCS

SEQ ID NO: 1236765 - protein, 9 aa, Homo Sapiens
LGDPRPRGN

SEQ ID NO: 1236766 - protein, 9 aa, Homo Sapiens
HINVQNGKW

SEQ ID NO: 1236767 - protein, 9 aa, Homo Sapiens
VLRSTWTML

SEQ ID NO: 1236768 - protein, 9 aa, Homo Sapiens
SQEESPHGS

SEQ ID NO: 1236769 - protein, 9 aa, Homo Sapiens
PNRAFICGE

SEQ ID NO: 1236770 - protein, 9 aa, Homo Sapiens
KRFTQKRSL

SEQ ID NO: 1236771 - protein, 9 aa, Homo Sapiens
IVYITQVIL

SEQ ID NO: 1236772 - protein, 9 aa, Homo Sapiens
HRVSRLRTL

SEQ ID NO: 1236773 - protein, 9 aa, Homo Sapiens
HTSAWGIPG

SEQ ID NO: 1236774 - protein, 9 aa, Homo Sapiens
TFEDTVVAY

SEQ ID NO: 1236775 - protein, 9 aa, Homo Sapiens
TTQQTTLRL

SEQ ID NO: 1236776 - protein, 9 aa, Homo Sapiens
SYHISSSLT

SEQ ID NO: 1236777 - protein, 9 aa, Homo Sapiens
VDGLTLLKC

SEQ ID NO: 1236778 - protein, 9 aa, Homo Sapiens
LNTLSITSE

SEQ ID NO: 1236779 - protein, 9 aa, Homo Sapiens
ACCSILSMV

SEQ ID NO: 1236780 - protein, 9 aa, Homo Sapiens
TLQPGTRPP

SEQ ID NO: 1236781 - protein, 9 aa, Homo Sapiens
KHQKKQDLT

SEQ ID NO: 1236782 - protein, 9 aa, Homo Sapiens
DIEDDQAGS

SEQ ID NO: 1236783 - protein, 9 aa, Homo Sapiens
PVRLLKVGA

SEQ ID NO: 1236784 - protein, 9 aa, Homo Sapiens
DYLKAQAIK

SEQ ID NO: 1236785 - protein, 9 aa, Homo Sapiens
FIYNVDLMN

SEQ ID NO: 1236786 - protein, 9 aa, Homo Sapiens
YMAAVKKAI

SEQ ID NO: 1236787 - protein, 9 aa, Homo Sapiens
TLCPGGRPG

SEQ ID NO: 1236788 - protein, 9 aa, Homo Sapiens
DSAIRKHLV

SEQ ID NO: 1236789 - protein, 9 aa, Homo Sapiens
NAELVVFKG

SEQ ID NO: 1236790 - protein, 9 aa, Homo Sapiens
NQYAYVPPM

SEQ ID NO: 1236791 - protein, 9 aa, Homo Sapiens
RRSVDPGEN

SEQ ID NO: 1236792 - protein, 9 aa, Homo Sapiens
ADDGILNTS

SEQ ID NO: 1236793 - protein, 9 aa, Homo Sapiens
NPAQKLILE

SEQ ID NO: 1236794 - protein, 9 aa, Homo Sapiens
LTDTEKRVI

SEQ ID NO: 1236795 - protein, 9 aa, Homo Sapiens
DIIAQRASQ

SEQ ID NO: 1236796 - protein, 9 aa, Homo Sapiens
TSQFLKIKP

SEQ ID NO: 1236797 - protein, 9 aa, Homo Sapiens
VGMDAAGKT

SEQ ID NO: 1236798 - protein, 9 aa, Homo Sapiens
RSAFGVSER

SEQ ID NO: 1236799 - protein, 9 aa, Homo Sapiens
FAMETFAMG

SEQ ID NO: 1236800 - protein, 9 aa, Homo Sapiens
VFINSFGGK

SEQ ID NO: 1236801 - protein, 9 aa, Homo Sapiens
MVIFNLYHF

SEQ ID NO: 1236802 - protein, 9 aa, Homo Sapiens
VKVKIATLY

SEQ ID NO: 1236803 - protein, 9 aa, Homo Sapiens
DAMLDKTCI

SEQ ID NO: 1236804 - protein, 9 aa, Homo Sapiens
WDDRGAGHV

SEQ ID NO: 1236805 - protein, 9 aa, Homo Sapiens
ITLGYTNSS

SEQ ID NO: 1236806 - protein, 9 aa, Homo Sapiens
CVTVSIETL

SEQ ID NO: 1236807 - protein, 9 aa, Homo Sapiens
TGLTQSNLR

SEQ ID NO: 1236808 - protein, 9 aa, Homo Sapiens
ISRLSACGW

SEQ ID NO: 1236809 - protein, 9 aa, Homo Sapiens
GHPNENNSS

SEQ ID NO: 1236810 - protein, 9 aa, Homo Sapiens
PLHYPSIMA

SEQ ID NO: 1236811 - protein, 9 aa, Homo Sapiens
KRGHPGFKG

SEQ ID NO: 1236812 - protein, 9 aa, Homo Sapiens
PLGPARTGL

SEQ ID NO: 1236813 - protein, 9 aa, Homo Sapiens
ERNKGRIQR

SEQ ID NO: 1236814 - protein, 9 aa, Homo Sapiens
HLVQQCVLL

SEQ ID NO: 1236815 - protein, 9 aa, Homo Sapiens
NWQKECIYY

SEQ ID NO: 1236816 - protein, 9 aa, Homo Sapiens
VDIPCGPSC

SEQ ID NO: 1236817 - protein, 9 aa, Homo Sapiens
LDLVTMKRL

SEQ ID NO: 1236818 - protein, 9 aa, Homo Sapiens
SCPSSPSTT

SEQ ID NO: 1236819 - protein, 9 aa, Homo Sapiens
EEIFPQCLS

SEQ ID NO: 1236820 - protein, 9 aa, Homo Sapiens
DSCLLPVLA

SEQ ID NO: 1236821 - protein, 9 aa, Homo Sapiens
TLTETVYDD

SEQ ID NO: 1236822 - protein, 9 aa, Homo Sapiens
ENANYKYHE

SEQ ID NO: 1236823 - protein, 9 aa, Homo Sapiens
LHIMEVILN

SEQ ID NO: 1236824 - protein, 9 aa, Homo Sapiens
RRFRYQEVA

SEQ ID NO: 1236825 - protein, 9 aa, Homo Sapiens
KDSPPFEGM

SEQ ID NO: 1236826 - protein, 9 aa, Homo Sapiens
PIRHCSHSS

SEQ ID NO: 1236827 - protein, 9 aa, Homo Sapiens
ERAITFRMP

SEQ ID NO: 1236828 - protein, 9 aa, Homo Sapiens
GVRQQVFTA

SEQ ID NO: 1236829 - protein, 9 aa, Homo Sapiens
VGTHDAISS

SEQ ID NO: 1236830 - protein, 9 aa, Homo Sapiens
MVVVVPAKM

SEQ ID NO: 1236831 - protein, 9 aa, Homo Sapiens
EDFVCYLGD

SEQ ID NO: 1236832 - protein, 9 aa, Homo Sapiens
RETRHIWDS

SEQ ID NO: 1236833 - protein, 9 aa, Homo Sapiens
ERSKPVNEY

SEQ ID NO: 1236834 - protein, 9 aa, Homo Sapiens
ERVGLEVSN

SEQ ID NO: 1236835 - protein, 9 aa, Homo Sapiens
PGEEVEGGV

SEQ ID NO: 1236836 - protein, 9 aa, Homo Sapiens
GGLFPAYPI

SEQ ID NO: 1236837 - protein, 9 aa, Homo Sapiens
NDGHVFPPS

SEQ ID NO: 1236838 - protein, 9 aa, Homo Sapiens
KLQLVEWLQ

SEQ ID NO: 1236839 - protein, 9 aa, Homo Sapiens
GVSIIMNTA

SEQ ID NO: 1236840 - protein, 9 aa, Homo Sapiens
LLELAGQIL

SEQ ID NO: 1236841 - protein, 9 aa, Homo Sapiens
RLLEPDMII

SEQ ID NO: 1236842 - protein, 9 aa, Homo Sapiens
MQPYSPTNE

SEQ ID NO: 1236843 - protein, 9 aa, Homo Sapiens
IIKIQKEKY

SEQ ID NO: 1236844 - protein, 9 aa, Homo Sapiens
CFVDVVAEL

SEQ ID NO: 1236845 - protein, 9 aa, Homo Sapiens
SQVRELLSE

SEQ ID NO: 1236846 - protein, 9 aa, Homo Sapiens
PNPRHGKCL

SEQ ID NO: 1236847 - protein, 9 aa, Homo Sapiens
LHTSTPLVY

SEQ ID NO: 1236848 - protein, 9 aa, Homo Sapiens
RRSQHLTRY

SEQ ID NO: 1236849 - protein, 9 aa, Homo Sapiens
RFQVFLNGE

SEQ ID NO: 1236850 - protein, 9 aa, Homo Sapiens
NSLLEEYQS

SEQ ID NO: 1236851 - protein, 9 aa, Homo Sapiens
ISFLQCIMQ

SEQ ID NO: 1236852 - protein, 9 aa, Homo Sapiens
VCTHEELLR

SEQ ID NO: 1236853 - protein, 9 aa, Homo Sapiens
GPCLPRPVS

SEQ ID NO: 1236854 - protein, 9 aa, Homo Sapiens
IFLLGCVKN

SEQ ID NO: 1236855 - protein, 9 aa, Homo Sapiens
VVMFEQHLL

SEQ ID NO: 1236856 - protein, 9 aa, Homo Sapiens
EISQDECLR

SEQ ID NO: 1236857 - protein, 9 aa, Homo Sapiens
VDDIPDRPT

SEQ ID NO: 1236858 - protein, 9 aa, Homo Sapiens
VEATKNEIS

SEQ ID NO: 1236859 - protein, 9 aa, Homo Sapiens
KCLATVAPM

SEQ ID NO: 1236860 - protein, 9 aa, Homo Sapiens
LGAVKFTSL

SEQ ID NO: 1236861 - protein, 9 aa, Homo Sapiens
WYNDGHVFP

SEQ ID NO: 1236862 - protein, 9 aa, Homo Sapiens
TVLFQGAGE

SEQ ID NO: 1236863 - protein, 9 aa, Homo Sapiens
HAVEVDRQF

SEQ ID NO: 1236864 - protein, 9 aa, Homo Sapiens
VLYMVTNSQ

SEQ ID NO: 1236865 - protein, 9 aa, Homo Sapiens
MSRGIYSTD

SEQ ID NO: 1236866 - protein, 9 aa, Homo Sapiens
QMKMRRRKA

SEQ ID NO: 1236867 - protein, 9 aa, Homo Sapiens
QQACLISKQ

SEQ ID NO: 1236868 - protein, 9 aa, Homo Sapiens
RALWPSSVL

SEQ ID NO: 1236869 - protein, 9 aa, Homo Sapiens
IWRIGSVTS

SEQ ID NO: 1236870 - protein, 9 aa, Homo Sapiens
IPCTQAEFQ

SEQ ID NO: 1236871 - protein, 9 aa, Homo Sapiens
YIQNRNIQI

SEQ ID NO: 1236872 - protein, 9 aa, Homo Sapiens
FKTIVSKNV

SEQ ID NO: 1236873 - protein, 9 aa, Homo Sapiens
WRDHTGENV

SEQ ID NO: 1236874 - protein, 9 aa, Homo Sapiens
EVDPMHPEL

SEQ ID NO: 1236875 - protein, 9 aa, Homo Sapiens
KNDEPPLDF

SEQ ID NO: 1236876 - protein, 9 aa, Homo Sapiens
MEQFILPES

SEQ ID NO: 1236877 - protein, 9 aa, Homo Sapiens
VSYVSKIKQ

SEQ ID NO: 1236878 - protein, 9 aa, Homo Sapiens
CQRDSKIDS

SEQ ID NO: 1236879 - protein, 9 aa, Homo Sapiens
SIVGFVMYY

SEQ ID NO: 1236880 - protein, 9 aa, Homo Sapiens
EGMWLPQLH

SEQ ID NO: 1236881 - protein, 9 aa, Homo Sapiens
ELGHALRLE

SEQ ID NO: 1236882 - protein, 9 aa, Homo Sapiens
ETERCTFLT

SEQ ID NO: 1236883 - protein, 9 aa, Homo Sapiens
GHQKCKPDI

SEQ ID NO: 1236884 - protein, 9 aa, Homo Sapiens
SCHQCPSGS

SEQ ID NO: 1236885 - protein, 9 aa, Homo Sapiens
MSTSLLGDT

SEQ ID NO: 1236886 - protein, 9 aa, Homo Sapiens
GDIIEVMDA

SEQ ID NO: 1236887 - protein, 9 aa, Homo Sapiens
VCRIFSLIG

SEQ ID NO: 1236888 - protein, 9 aa, Homo Sapiens
DVLLERRLT

SEQ ID NO: 1236889 - protein, 9 aa, Homo Sapiens
LLAPCLPSY

SEQ ID NO: 1236890 - protein, 9 aa, Homo Sapiens
ANLFIHISI

SEQ ID NO: 1236891 - protein, 9 aa, Homo Sapiens
KETTQAPRL

SEQ ID NO: 1236892 - protein, 9 aa, Homo Sapiens
FVPKHIEVC

SEQ ID NO: 1236893 - protein, 9 aa, Homo Sapiens
WLPSSPAHS

SEQ ID NO: 1236894 - protein, 9 aa, Homo Sapiens
ERIIPFLPS

SEQ ID NO: 1236895 - protein, 9 aa, Homo Sapiens
ETNSLILEE

SEQ ID NO: 1236896 - protein, 9 aa, Homo Sapiens
ASNSKIVVV

SEQ ID NO: 1236897 - protein, 9 aa, Homo Sapiens
CGDPKKTHT

SEQ ID NO: 1236898 - protein, 9 aa, Homo Sapiens
IPFLPSVYL

SEQ ID NO: 1236899 - protein, 9 aa, Homo Sapiens
NFDTTKCFA

SEQ ID NO: 1236900 - protein, 9 aa, Homo Sapiens
DASFEKVAA

SEQ ID NO: 1236901 - protein, 9 aa, Homo Sapiens
PIVLKMIVA

SEQ ID NO: 1236902 - protein, 9 aa, Homo Sapiens
QELFEASNW

SEQ ID NO: 1236903 - protein, 9 aa, Homo Sapiens
KASCLLPPV

SEQ ID NO: 1236904 - protein, 9 aa, Homo Sapiens
CGSFLLRAA

SEQ ID NO: 1236905 - protein, 9 aa, Homo Sapiens
HLGLNCESV

SEQ ID NO: 1236906 - protein, 9 aa, Homo Sapiens
SLVKWLAAA

SEQ ID NO: 1236907 - protein, 9 aa, Homo Sapiens
ERGPTGPPG

SEQ ID NO: 1236908 - protein, 9 aa, Homo Sapiens
SDFTLSNRY

SEQ ID NO: 1236909 - protein, 9 aa, Homo Sapiens
VNYTLFESL

SEQ ID NO: 1236910 - protein, 9 aa, Homo Sapiens
LDVLAWMGV

SEQ ID NO: 1236911 - protein, 9 aa, Homo Sapiens
LQELNASLG

SEQ ID NO: 1236912 - protein, 9 aa, Homo Sapiens
TRACEVIEA

SEQ ID NO: 1236913 - protein, 9 aa, Homo Sapiens
VLYILCKSF

SEQ ID NO: 1236914 - protein, 9 aa, Homo Sapiens
LMAHYGRLA

SEQ ID NO: 1236915 - protein, 9 aa, Homo Sapiens
HSHKKKKTR

SEQ ID NO: 1236916 - protein, 9 aa, Homo Sapiens
ERGTGLGLF

SEQ ID NO: 1236917 - protein, 9 aa, Homo Sapiens
LLIKMKQMT

SEQ ID NO: 1236918 - protein, 9 aa, Homo Sapiens
VVLAEEKIE

SEQ ID NO: 1236919 - protein, 9 aa, Homo Sapiens
FTMTRNKVA

SEQ ID NO: 1236920 - protein, 9 aa, Homo Sapiens
ENSNEVTKL

SEQ ID NO: 1236921 - protein, 9 aa, Homo Sapiens
GLIVHEGDA

SEQ ID NO: 1236922 - protein, 9 aa, Homo Sapiens
EIHIDPGTI

SEQ ID NO: 1236923 - protein, 9 aa, Homo Sapiens
FPNAGPRYL

SEQ ID NO: 1236924 - protein, 9 aa, Homo Sapiens
AGTATSQGF

SEQ ID NO: 1236925 - protein, 9 aa, Homo Sapiens
IFCPNHPAI

SEQ ID NO: 1236926 - protein, 9 aa, Homo Sapiens
RWYVRRSSS

SEQ ID NO: 1236927 - protein, 9 aa, Homo Sapiens
EEELTGRLT

SEQ ID NO: 1236928 - protein, 9 aa, Homo Sapiens
KRAKTVLTI

SEQ ID NO: 1236929 - protein, 9 aa, Homo Sapiens
ALLFHTSAW

SEQ ID NO: 1236930 - protein, 9 aa, Homo Sapiens
KTLTLLNPM

SEQ ID NO: 1236931 - protein, 9 aa, Homo Sapiens
GTWDDAFTT

SEQ ID NO: 1236932 - protein, 9 aa, Homo Sapiens
ARTYSIGRI

SEQ ID NO: 1236933 - protein, 9 aa, Homo Sapiens
HYPDIYARE

SEQ ID NO: 1236934 - protein, 9 aa, Homo Sapiens
GKGVALKFV

SEQ ID NO: 1236935 - protein, 9 aa, Homo Sapiens
KKWYLQAAS

SEQ ID NO: 1236936 - protein, 9 aa, Homo Sapiens
MPLVTTFFY

SEQ ID NO: 1236937 - protein, 9 aa, Homo Sapiens
GHGSASTDF

SEQ ID NO: 1236938 - protein, 9 aa, Homo Sapiens
GTCVFTNPL

SEQ ID NO: 1236939 - protein, 9 aa, Homo Sapiens
EVLYTSTAM

SEQ ID NO: 1236940 - protein, 9 aa, Homo Sapiens
VSNYQRVHT

SEQ ID NO: 1236941 - protein, 9 aa, Homo Sapiens
LRQATKCAT

SEQ ID NO: 1236942 - protein, 9 aa, Homo Sapiens
DGHSRESME

SEQ ID NO: 1236943 - protein, 9 aa, Homo Sapiens
IYITTASGQ

SEQ ID NO: 1236944 - protein, 9 aa, Homo Sapiens
DNKGTPRLQ

SEQ ID NO: 1236945 - protein, 9 aa, Homo Sapiens
DRTSTICGT

SEQ ID NO: 1236946 - protein, 9 aa, Homo Sapiens
KAMSRDEKN

SEQ ID NO: 1236947 - protein, 9 aa, Homo Sapiens
YMEDAVCRL

SEQ ID NO: 1236948 - protein, 9 aa, Homo Sapiens
EFEAMIRQN

SEQ ID NO: 1236949 - protein, 9 aa, Homo Sapiens
SRKALKALL

SEQ ID NO: 1236950 - protein, 9 aa, Homo Sapiens
IDENGSHLP

SEQ ID NO: 1236951 - protein, 9 aa, Homo Sapiens
AYDHFIAIC

SEQ ID NO: 1236952 - protein, 9 aa, Homo Sapiens
QKIHSLDVV

SEQ ID NO: 1236953 - protein, 9 aa, Homo Sapiens
KSHGPVKVR

SEQ ID NO: 1236954 - protein, 9 aa, Homo Sapiens
VWAEMVAEQ

SEQ ID NO: 1236955 - protein, 9 aa, Homo Sapiens
LTLYPLASP

SEQ ID NO: 1236956 - protein, 9 aa, Homo Sapiens
NSQCPACRI

SEQ ID NO: 1236957 - protein, 9 aa, Homo Sapiens
NGKQQYSKG

SEQ ID NO: 1236958 - protein, 9 aa, Homo Sapiens
VTALKKCPL

SEQ ID NO: 1236959 - protein, 9 aa, Homo Sapiens
DESMRDKVL

SEQ ID NO: 1236960 - protein, 9 aa, Homo Sapiens
IQQSKSRRS

SEQ ID NO: 1236961 - protein, 9 aa, Homo Sapiens
TIKWHKWSV

SEQ ID NO: 1236962 - protein, 9 aa, Homo Sapiens
PVLVQLVNY

SEQ ID NO: 1236963 - protein, 9 aa, Homo Sapiens
NTYKKEMAS

SEQ ID NO: 1236964 - protein, 9 aa, Homo Sapiens
KNTDVLVAP

SEQ ID NO: 1236965 - protein, 9 aa, Homo Sapiens
GDTLELTCE

SEQ ID NO: 1236966 - protein, 9 aa, Homo Sapiens
FEKLRTARC

SEQ ID NO: 1236967 - protein, 9 aa, Homo Sapiens
YPGFNCEFF

SEQ ID NO: 1236968 - protein, 9 aa, Homo Sapiens
GLFTLCLYV

SEQ ID NO: 1236969 - protein, 9 aa, Homo Sapiens
QIMRLIKPM

SEQ ID NO: 1236970 - protein, 9 aa, Homo Sapiens
AAHAAGVSR

SEQ ID NO: 1236971 - protein, 9 aa, Homo Sapiens
KCVKKSKQP

SEQ ID NO: 1236972 - protein, 9 aa, Homo Sapiens
LAPPVHPVA

SEQ ID NO: 1236973 - protein, 9 aa, Homo Sapiens
MASWALLPD

SEQ ID NO: 1236974 - protein, 9 aa, Homo Sapiens
LRKEHVFND

SEQ ID NO: 1236975 - protein, 9 aa, Homo Sapiens
HPPPLHYRE

SEQ ID NO: 1236976 - protein, 9 aa, Homo Sapiens
ERRKLWLQK

SEQ ID NO: 1236977 - protein, 9 aa, Homo Sapiens
PCLPRPVSL

SEQ ID NO: 1236978 - protein, 9 aa, Homo Sapiens
RQRMNKEYS

SEQ ID NO: 1236979 - protein, 9 aa, Homo Sapiens
AIVRLIMVG

SEQ ID NO: 1236980 - protein, 9 aa, Homo Sapiens
YVASFLSFL

SEQ ID NO: 1236981 - protein, 9 aa, Homo Sapiens
AASLEVRAP

SEQ ID NO: 1236982 - protein, 9 aa, Homo Sapiens
ASHSFFSVN

SEQ ID NO: 1236983 - protein, 9 aa, Homo Sapiens
SAPQLQVIL

SEQ ID NO: 1236984 - protein, 9 aa, Homo Sapiens
KQDLAKTMS

SEQ ID NO: 1236985 - protein, 9 aa, Homo Sapiens
DVAVECDEQ

SEQ ID NO: 1236986 - protein, 9 aa, Homo Sapiens
IPKCFKGLY

SEQ ID NO: 1236987 - protein, 9 aa, Homo Sapiens
NIYRNIIGF

SEQ ID NO: 1236988 - protein, 9 aa, Homo Sapiens
AGWRGPRRL

SEQ ID NO: 1236989 - protein, 9 aa, Homo Sapiens
LNGGNLVVS

SEQ ID NO: 1236990 - protein, 9 aa, Homo Sapiens
HRTPWPLPM

SEQ ID NO: 1236991 - protein, 9 aa, Homo Sapiens
KLCLMVCYR

SEQ ID NO: 1236992 - protein, 9 aa, Homo Sapiens
MTPANSEAT

SEQ ID NO: 1236993 - protein, 9 aa, Homo Sapiens
LQEQQRTVQ

SEQ ID NO: 1236994 - protein, 9 aa, Homo Sapiens
TSSMMSVKF

SEQ ID NO: 1236995 - protein, 9 aa, Homo Sapiens
VECNDTTPV

SEQ ID NO: 1236996 - protein, 9 aa, Homo Sapiens
PSIVCLKKH

SEQ ID NO: 1236997 - protein, 9 aa, Homo Sapiens
STPDAMLDK

SEQ ID NO: 1236998 - protein, 9 aa, Homo Sapiens
NIVCLIRKL

SEQ ID NO: 1236999 - protein, 9 aa, Homo Sapiens
DNLYVQLMG

SEQ ID NO: 1237000 - protein, 9 aa, Homo Sapiens
HPSRSGGVP

SEQ ID NO: 1237001 - protein, 9 aa, Homo Sapiens
FNRTMRALA

SEQ ID NO: 1237002 - protein, 9 aa, Homo Sapiens
AIRNNRLGS

SEQ ID NO: 1237003 - protein, 9 aa, Homo Sapiens
GEGDMTKAL

SEQ ID NO: 1237004 - protein, 9 aa, Homo Sapiens
YCTFLDFSS

SEQ ID NO: 1237005 - protein, 9 aa, Homo Sapiens
EVVKKLEEF

SEQ ID NO: 1237006 - protein, 9 aa, Homo Sapiens
LGLHTQTMS

SEQ ID NO: 1237007 - protein, 9 aa, Homo Sapiens
MEKEQKTPR

SEQ ID NO: 1237008 - protein, 9 aa, Homo Sapiens
AMLLDGRIR

SEQ ID NO: 1237009 - protein, 9 aa, Homo Sapiens
KVSNKTYDS

SEQ ID NO: 1237010 - protein, 9 aa, Homo Sapiens
ILFFKGIPQ

SEQ ID NO: 1237011 - protein, 9 aa, Homo Sapiens
TATTTTTTL

SEQ ID NO: 1237012 - protein, 9 aa, Homo Sapiens
AGAAFHLAI

SEQ ID NO: 1237013 - protein, 9 aa, Homo Sapiens
FGYIVTFKP

SEQ ID NO: 1237014 - protein, 9 aa, Homo Sapiens
DNRLMNHFM

SEQ ID NO: 1237015 - protein, 9 aa, Homo Sapiens
ALKAVGESV

SEQ ID NO: 1237016 - protein, 9 aa, Homo Sapiens
EAEEGEHMT

SEQ ID NO: 1237017 - protein, 9 aa, Homo Sapiens
QAADVHALR

SEQ ID NO: 1237018 - protein, 9 aa, Homo Sapiens
QIPDGSYMC

SEQ ID NO: 1237019 - protein, 9 aa, Homo Sapiens
KKMKLTLAV

SEQ ID NO: 1237020 - protein, 9 aa, Homo Sapiens
RLHALEEQG

SEQ ID NO: 1237021 - protein, 9 aa, Homo Sapiens
MHQAIMCWA

SEQ ID NO: 1237022 - protein, 9 aa, Homo Sapiens
FVCRIICTY

SEQ ID NO: 1237023 - protein, 9 aa, Homo Sapiens
SYATVYNGI

SEQ ID NO: 1237024 - protein, 9 aa, Homo Sapiens
QHSPRHKPH

SEQ ID NO: 1237025 - protein, 9 aa, Homo Sapiens
AHRQRAVLE

SEQ ID NO: 1237026 - protein, 9 aa, Homo Sapiens
VMEDDIPLR

SEQ ID NO: 1237027 - protein, 9 aa, Homo Sapiens
IVNIGDVSY

SEQ ID NO: 1237028 - protein, 9 aa, Homo Sapiens
AIHILTSIL

SEQ ID NO: 1237029 - protein, 9 aa, Homo Sapiens
PTTSPGSHF

SEQ ID NO: 1237030 - protein, 9 aa, Homo Sapiens
PAFIKLWIE

SEQ ID NO: 1237031 - protein, 9 aa, Homo Sapiens
LHCEICMAA

SEQ ID NO: 1237032 - protein, 9 aa, Homo Sapiens
ALQDCTQFS

SEQ ID NO: 1237033 - protein, 9 aa, Homo Sapiens
RCECAPGSA

SEQ ID NO: 1237034 - protein, 9 aa, Homo Sapiens
MGANIASEM

SEQ ID NO: 1237035 - protein, 9 aa, Homo Sapiens
YHQIGSAEY

SEQ ID NO: 1237036 - protein, 9 aa, Homo Sapiens
GLTPDAARD

SEQ ID NO: 1237037 - protein, 9 aa, Homo Sapiens
LSWDYSMQR

SEQ ID NO: 1237038 - protein, 9 aa, Homo Sapiens
LSALVNRMI

SEQ ID NO: 1237039 - protein, 9 aa, Homo Sapiens
WGPLACSCS

SEQ ID NO: 1237040 - protein, 9 aa, Homo Sapiens
YLMGLNSAN

SEQ ID NO: 1237041 - protein, 9 aa, Homo Sapiens
RPPQRMFDA

SEQ ID NO: 1237042 - protein, 9 aa, Homo Sapiens
PKVHNHQPR

SEQ ID NO: 1237043 - protein, 9 aa, Homo Sapiens
TALGLAYDR

SEQ ID NO: 1237044 - protein, 9 aa, Homo Sapiens
FPSPEWDMV

SEQ ID NO: 1237045 - protein, 9 aa, Homo Sapiens
VPGFIGPQL

SEQ ID NO: 1237046 - protein, 9 aa, Homo Sapiens
IFRRWNESP

SEQ ID NO: 1237047 - protein, 9 aa, Homo Sapiens
PVAAFQGVP

SEQ ID NO: 1237048 - protein, 9 aa, Homo Sapiens
TAMQAMIRS

SEQ ID NO: 1237049 - protein, 9 aa, Homo Sapiens
MPYRLGPGS

SEQ ID NO: 1237050 - protein, 9 aa, Homo Sapiens
LPRSTCTLW

SEQ ID NO: 1237051 - protein, 9 aa, Homo Sapiens
LEAVVHMNQ

SEQ ID NO: 1237052 - protein, 9 aa, Homo Sapiens
NIKRCTYDA

SEQ ID NO: 1237053 - protein, 9 aa, Homo Sapiens
LQEEPPLVT

SEQ ID NO: 1237054 - protein, 9 aa, Homo Sapiens
ISSSLQLPG

SEQ ID NO: 1237055 - protein, 9 aa, Homo Sapiens
IHKEKKSRK

SEQ ID NO: 1237056 - protein, 9 aa, Homo Sapiens
AAEEGPVSA

SEQ ID NO: 1237057 - protein, 9 aa, Homo Sapiens
GNLLHFSVL

SEQ ID NO: 1237058 - protein, 9 aa, Homo Sapiens
WTPGPKLVH

SEQ ID NO: 1237059 - protein, 9 aa, Homo Sapiens
VGGLGVVVV

SEQ ID NO: 1237060 - protein, 9 aa, Homo Sapiens
MAPMLNPMI

SEQ ID NO: 1237061 - protein, 9 aa, Homo Sapiens
SLSSLVTQT

SEQ ID NO: 1237062 - protein, 9 aa, Homo Sapiens
HGMSLTIHN

SEQ ID NO: 1237063 - protein, 9 aa, Homo Sapiens
LFPQVISYL

SEQ ID NO: 1237064 - protein, 9 aa, Homo Sapiens
VKILPIMFP

SEQ ID NO: 1237065 - protein, 9 aa, Homo Sapiens
KALKNKRRR

SEQ ID NO: 1237066 - protein, 9 aa, Homo Sapiens
MTHSEEKSY

SEQ ID NO: 1237067 - protein, 9 aa, Homo Sapiens
WEKTFTWLA

SEQ ID NO: 1237068 - protein, 9 aa, Homo Sapiens
KGALYKNLV

SEQ ID NO: 1237069 - protein, 9 aa, Homo Sapiens
SLAQPPGPP

SEQ ID NO: 1237070 - protein, 9 aa, Homo Sapiens
LKEVRDNKN

SEQ ID NO: 1237071 - protein, 9 aa, Homo Sapiens
QMILTEFEL

SEQ ID NO: 1237072 - protein, 9 aa, Homo Sapiens
YHIVKKTPA

SEQ ID NO: 1237073 - protein, 9 aa, Homo Sapiens
PDFGGLGKE

SEQ ID NO: 1237074 - protein, 9 aa, Homo Sapiens
VQHFHKHQL

SEQ ID NO: 1237075 - protein, 9 aa, Homo Sapiens
VILYHEPRS

SEQ ID NO: 1237076 - protein, 9 aa, Homo Sapiens
LLEGYGMQE

SEQ ID NO: 1237077 - protein, 9 aa, Homo Sapiens
MKETALIYL

SEQ ID NO: 1237078 - protein, 9 aa, Homo Sapiens
NNLVVIVIY

SEQ ID NO: 1237079 - protein, 9 aa, Homo Sapiens
HAIDHNSPF

SEQ ID NO: 1237080 - protein, 9 aa, Homo Sapiens
SRYDSIPMS

SEQ ID NO: 1237081 - protein, 9 aa, Homo Sapiens
PYYSNMVFE

SEQ ID NO: 1237082 - protein, 9 aa, Homo Sapiens
PMREALKLH

SEQ ID NO: 1237083 - protein, 9 aa, Homo Sapiens
PACCKFSTP

SEQ ID NO: 1237084 - protein, 9 aa, Homo Sapiens
AMFSGHMEV

SEQ ID NO: 1237085 - protein, 9 aa, Homo Sapiens
SIARCLFLG

SEQ ID NO: 1237086 - protein, 9 aa, Homo Sapiens
SRYASIKDY

SEQ ID NO: 1237087 - protein, 9 aa, Homo Sapiens
DNFNCKLTS

SEQ ID NO: 1237088 - protein, 9 aa, Homo Sapiens
GVFCDRMNE

SEQ ID NO: 1237089 - protein, 9 aa, Homo Sapiens
DLLSEKKAI

SEQ ID NO: 1237090 - protein, 9 aa, Homo Sapiens
IGVFLNLVV

SEQ ID NO: 1237091 - protein, 9 aa, Homo Sapiens
TAARSIPPI

SEQ ID NO: 1237092 - protein, 9 aa, Homo Sapiens
SSFQELYCM

SEQ ID NO: 1237093 - protein, 9 aa, Homo Sapiens
KHQQVRAKS

SEQ ID NO: 1237094 - protein, 9 aa, Homo Sapiens
YAADINIRL

SEQ ID NO: 1237095 - protein, 9 aa, Homo Sapiens
VSIETLCAL

SEQ ID NO: 1237096 - protein, 9 aa, Homo Sapiens
FLMFKVDQD

SEQ ID NO: 1237097 - protein, 9 aa, Homo Sapiens
GYCVCILGV

SEQ ID NO: 1237098 - protein, 9 aa, Homo Sapiens
EEVHTGLGE

SEQ ID NO: 1237099 - protein, 9 aa, Homo Sapiens
AQKKMNYEN

SEQ ID NO: 1237100 - protein, 9 aa, Homo Sapiens
HYPPSYKAL

SEQ ID NO: 1237101 - protein, 9 aa, Homo Sapiens
AIRLQLMEQ

SEQ ID NO: 1237102 - protein, 9 aa, Homo Sapiens
MVFKNQPQA

SEQ ID NO: 1237103 - protein, 9 aa, Homo Sapiens
DQGNGKILK

SEQ ID NO: 1237104 - protein, 9 aa, Homo Sapiens
LLEAGVFVN

SEQ ID NO: 1237105 - protein, 9 aa, Homo Sapiens
VEDATTAMD

SEQ ID NO: 1237106 - protein, 9 aa, Homo Sapiens
AIYQDKDNT

SEQ ID NO: 1237107 - protein, 9 aa, Homo Sapiens
VQHKEVEFL

SEQ ID NO: 1237108 - protein, 9 aa, Homo Sapiens
NLQVTMAVL

SEQ ID NO: 1237109 - protein, 9 aa, Homo Sapiens
MQVSQDFPF

SEQ ID NO: 1237110 - protein, 9 aa, Homo Sapiens
AHKWRPDFR

SEQ ID NO: 1237111 - protein, 9 aa, Homo Sapiens
LFQNPTVQF

SEQ ID NO: 1237112 - protein, 9 aa, Homo Sapiens
DDTDGETEV

SEQ ID NO: 1237113 - protein, 9 aa, Homo Sapiens
WLRQKNDGI

SEQ ID NO: 1237114 - protein, 9 aa, Homo Sapiens
LRPTTGTLH

SEQ ID NO: 1237115 - protein, 9 aa, Homo Sapiens
CLLTFIKCA

SEQ ID NO: 1237116 - protein, 9 aa, Homo Sapiens
ELPSAQIRC

SEQ ID NO: 1237117 - protein, 9 aa, Homo Sapiens
SQYFGVLQR

SEQ ID NO: 1237118 - protein, 9 aa, Homo Sapiens
KVTTLTKKP

SEQ ID NO: 1237119 - protein, 9 aa, Homo Sapiens
VKLPQGQRC

SEQ ID NO: 1237120 - protein, 9 aa, Homo Sapiens
WFGAGGPEM

SEQ ID NO: 1237121 - protein, 9 aa, Homo Sapiens
GWDITVDLV

SEQ ID NO: 1237122 - protein, 9 aa, Homo Sapiens
LGTDSSHYW

SEQ ID NO: 1237123 - protein, 9 aa, Homo Sapiens
TIFSFQTKF

SEQ ID NO: 1237124 - protein, 9 aa, Homo Sapiens
DKASGEGMA

SEQ ID NO: 1237125 - protein, 9 aa, Homo Sapiens
KRPLLPRAP

SEQ ID NO: 1237126 - protein, 9 aa, Homo Sapiens
STTIRVRCN

SEQ ID NO: 1237127 - protein, 9 aa, Homo Sapiens
PSTKYIVSV

SEQ ID NO: 1237128 - protein, 9 aa, Homo Sapiens
NNDFRSMEA

SEQ ID NO: 1237129 - protein, 9 aa, Homo Sapiens
VLMGIVSNS

SEQ ID NO: 1237130 - protein, 9 aa, Homo Sapiens
QTRSFLKWT

SEQ ID NO: 1237131 - protein, 9 aa, Homo Sapiens
GNTIDTSSY

SEQ ID NO: 1237132 - protein, 9 aa, Homo Sapiens
LTSKLLHEE

SEQ ID NO: 1237133 - protein, 9 aa, Homo Sapiens
KCKAKSCIC

SEQ ID NO: 1237134 - protein, 9 aa, Homo Sapiens
LYPIIGKCL

SEQ ID NO: 1237135 - protein, 9 aa, Homo Sapiens
LHLHDAGLH

SEQ ID NO: 1237136 - protein, 9 aa, Homo Sapiens
HQEEKHKVE

SEQ ID NO: 1237137 - protein, 9 aa, Homo Sapiens
TRPPPPATL

SEQ ID NO: 1237138 - protein, 9 aa, Homo Sapiens
PLLPALCLH

SEQ ID NO: 1237139 - protein, 9 aa, Homo Sapiens
MSHCPGGED

SEQ ID NO: 1237140 - protein, 9 aa, Homo Sapiens
NAGAFLLGG

SEQ ID NO: 1237141 - protein, 9 aa, Homo Sapiens
DPVFISKTN

SEQ ID NO: 1237142 - protein, 9 aa, Homo Sapiens
GETLQEFNG

SEQ ID NO: 1237143 - protein, 9 aa, Homo Sapiens
LVASFEKSL

SEQ ID NO: 1237144 - protein, 9 aa, Homo Sapiens
DHFKKGKIV

SEQ ID NO: 1237145 - protein, 9 aa, Homo Sapiens
LKYLRFTLT

SEQ ID NO: 1237146 - protein, 9 aa, Homo Sapiens
TFFIDCMTA

SEQ ID NO: 1237147 - protein, 9 aa, Homo Sapiens
TLELTCEAI

SEQ ID NO: 1237148 - protein, 9 aa, Homo Sapiens
LMDQASRTM

SEQ ID NO: 1237149 - protein, 9 aa, Homo Sapiens
LKDQPKSHY

SEQ ID NO: 1237150 - protein, 9 aa, Homo Sapiens
IEQISHAQM

SEQ ID NO: 1237151 - protein, 9 aa, Homo Sapiens
EKDSGHDST

SEQ ID NO: 1237152 - protein, 9 aa, Homo Sapiens
EYVVRNLAC

SEQ ID NO: 1237153 - protein, 9 aa, Homo Sapiens
MLIAAVFMS

SEQ ID NO: 1237154 - protein, 9 aa, Homo Sapiens
QSMPKTCIL

SEQ ID NO: 1237155 - protein, 9 aa, Homo Sapiens
NDCISFMQV

SEQ ID NO: 1237156 - protein, 9 aa, Homo Sapiens
VLHSAMHQL

SEQ ID NO: 1237157 - protein, 9 aa, Homo Sapiens
IGIVMDSGD

SEQ ID NO: 1237158 - protein, 9 aa, Homo Sapiens
FVHIRQTRS

SEQ ID NO: 1237159 - protein, 9 aa, Homo Sapiens
VFMYPAVGT

SEQ ID NO: 1237160 - protein, 9 aa, Homo Sapiens
LSIVNWYIH

SEQ ID NO: 1237161 - protein, 9 aa, Homo Sapiens
LTRICTVSY

SEQ ID NO: 1237162 - protein, 9 aa, Homo Sapiens
TSKLLHEEL

SEQ ID NO: 1237163 - protein, 9 aa, Homo Sapiens
FFKFAAAIV

SEQ ID NO: 1237164 - protein, 9 aa, Homo Sapiens
CWRSRWQGP

SEQ ID NO: 1237165 - protein, 9 aa, Homo Sapiens
DSRLIKVHL

SEQ ID NO: 1237166 - protein, 9 aa, Homo Sapiens
CTSTLCHFL

SEQ ID NO: 1237167 - protein, 9 aa, Homo Sapiens
IVGCIWWFF

SEQ ID NO: 1237168 - protein, 9 aa, Homo Sapiens
FRHYDTDQD

SEQ ID NO: 1237169 - protein, 9 aa, Homo Sapiens
RIWPDELGC

SEQ ID NO: 1237170 - protein, 9 aa, Homo Sapiens
LNLDIGPPV

SEQ ID NO: 1237171 - protein, 9 aa, Homo Sapiens
CGKVFNKKT

SEQ ID NO: 1237172 - protein, 9 aa, Homo Sapiens
PHRHLSEKS

SEQ ID NO: 1237173 - protein, 9 aa, Homo Sapiens
VLLQHLHVH

SEQ ID NO: 1237174 - protein, 9 aa, Homo Sapiens
DEIYSWIDN

SEQ ID NO: 1237175 - protein, 9 aa, Homo Sapiens
AALDVLTNV

SEQ ID NO: 1237176 - protein, 9 aa, Homo Sapiens
FQRPAIYYV

SEQ ID NO: 1237177 - protein, 9 aa, Homo Sapiens
VELNVKQGA

SEQ ID NO: 1237178 - protein, 9 aa, Homo Sapiens
RVQMDHEGE

SEQ ID NO: 1237179 - protein, 9 aa, Homo Sapiens
YIDYEGHSD

SEQ ID NO: 1237180 - protein, 9 aa, Homo Sapiens
GNGSQKKSV

SEQ ID NO: 1237181 - protein, 9 aa, Homo Sapiens
CGWWAPACT

SEQ ID NO: 1237182 - protein, 9 aa, Homo Sapiens
NISASEKGY

SEQ ID NO: 1237183 - protein, 9 aa, Homo Sapiens
IYLIFLKGI

SEQ ID NO: 1237184 - protein, 9 aa, Homo Sapiens
LLPPRVHAY

SEQ ID NO: 1237185 - protein, 9 aa, Homo Sapiens
VEEMAGLPG

SEQ ID NO: 1237186 - protein, 9 aa, Homo Sapiens
CQNQDRINK

SEQ ID NO: 1237187 - protein, 9 aa, Homo Sapiens
RGAADDRVH

SEQ ID NO: 1237188 - protein, 9 aa, Homo Sapiens
QRYTQNIKD

SEQ ID NO: 1237189 - protein, 9 aa, Homo Sapiens
TVSHTDADC

SEQ ID NO: 1237190 - protein, 9 aa, Homo Sapiens
QSCASRLMR

SEQ ID NO: 1237191 - protein, 9 aa, Homo Sapiens
VGLFLSMYL

SEQ ID NO: 1237192 - protein, 9 aa, Homo Sapiens
QEQRSAQVD

SEQ ID NO: 1237193 - protein, 9 aa, Homo Sapiens
PSGMGYCRT

SEQ ID NO: 1237194 - protein, 9 aa, Homo Sapiens
KKKKYIKAA

SEQ ID NO: 1237195 - protein, 9 aa, Homo Sapiens
WKWDYLILR

SEQ ID NO: 1237196 - protein, 9 aa, Homo Sapiens
LEEVKQASI

SEQ ID NO: 1237197 - protein, 9 aa, Homo Sapiens
TKDVAIQVC

SEQ ID NO: 1237198 - protein, 9 aa, Homo Sapiens
ITRGYERIP

SEQ ID NO: 1237199 - protein, 9 aa, Homo Sapiens
HCIYETQSQ

SEQ ID NO: 1237200 - protein, 9 aa, Homo Sapiens
KPFKCHLYN

SEQ ID NO: 1237201 - protein, 9 aa, Homo Sapiens
GPLACSCST

SEQ ID NO: 1237202 - protein, 9 aa, Homo Sapiens
GCVTDHFSQ

SEQ ID NO: 1237203 - protein, 9 aa, Homo Sapiens
VRDQDREGT

SEQ ID NO: 1237204 - protein, 9 aa, Homo Sapiens
EINHAFPDT

SEQ ID NO: 1237205 - protein, 9 aa, Homo Sapiens
HQAKQDVHC

SEQ ID NO: 1237206 - protein, 9 aa, Homo Sapiens
IVELADHDA

SEQ ID NO: 1237207 - protein, 9 aa, Homo Sapiens
MLGLCSWTG

SEQ ID NO: 1237208 - protein, 9 aa, Homo Sapiens
NMQMASSTD

SEQ ID NO: 1237209 - protein, 9 aa, Homo Sapiens
IQTMKLRNY

SEQ ID NO: 1237210 - protein, 9 aa, Homo Sapiens
HMAYIWDYF

SEQ ID NO: 1237211 - protein, 9 aa, Homo Sapiens
ILQSDRNVT

SEQ ID NO: 1237212 - protein, 9 aa, Homo Sapiens
VAESDTDGC

SEQ ID NO: 1237213 - protein, 9 aa, Homo Sapiens
CHKKYCLKT

SEQ ID NO: 1237214 - protein, 9 aa, Homo Sapiens
LQPRRLKHQ

SEQ ID NO: 1237215 - protein, 9 aa, Homo Sapiens
FTSHIDALY

SEQ ID NO: 1237216 - protein, 9 aa, Homo Sapiens
ALLKILKLI

SEQ ID NO: 1237217 - protein, 9 aa, Homo Sapiens
LESSQNLVF

SEQ ID NO: 1237218 - protein, 9 aa, Homo Sapiens
ATGIQRNHT

SEQ ID NO: 1237219 - protein, 9 aa, Homo Sapiens
DGRVSENIV

SEQ ID NO: 1237220 - protein, 9 aa, Homo Sapiens
VGPVAEAKS

SEQ ID NO: 1237221 - protein, 9 aa, Homo Sapiens
SDYPHLQKV

SEQ ID NO: 1237222 - protein, 9 aa, Homo Sapiens
VKESAIMPF

SEQ ID NO: 1237223 - protein, 9 aa, Homo Sapiens
EECLHGLEM

SEQ ID NO: 1237224 - protein, 9 aa, Homo Sapiens
NTMGSYICH

SEQ ID NO: 1237225 - protein, 9 aa, Homo Sapiens
NQDLVGPLA

SEQ ID NO: 1237226 - protein, 9 aa, Homo Sapiens
FGYTQRQAQ

SEQ ID NO: 1237227 - protein, 9 aa, Homo Sapiens
PNAWRPLEG

SEQ ID NO: 1237228 - protein, 9 aa, Homo Sapiens
VPLVQLDPA

SEQ ID NO: 1237229 - protein, 9 aa, Homo Sapiens
QLTICNMLH

SEQ ID NO: 1237230 - protein, 9 aa, Homo Sapiens
NGVTVHEAT

SEQ ID NO: 1237231 - protein, 9 aa, Homo Sapiens
IGTFDIYVK

SEQ ID NO: 1237232 - protein, 9 aa, Homo Sapiens
DDTNFFLSL

SEQ ID NO: 1237233 - protein, 9 aa, Homo Sapiens
VTSVVGLAE

SEQ ID NO: 1237234 - protein, 9 aa, Homo Sapiens
HLARVGPPE

SEQ ID NO: 1237235 - protein, 9 aa, Homo Sapiens
DLRADVIGI

SEQ ID NO: 1237236 - protein, 9 aa, Homo Sapiens
ISIYWVHFY

SEQ ID NO: 1237237 - protein, 9 aa, Homo Sapiens
HLQNPKARV

SEQ ID NO: 1237238 - protein, 9 aa, Homo Sapiens
GPSSAAVLP

SEQ ID NO: 1237239 - protein, 9 aa, Homo Sapiens
NAKKVTHIL

SEQ ID NO: 1237240 - protein, 9 aa, Homo Sapiens
CSPLHLINI

SEQ ID NO: 1237241 - protein, 9 aa, Homo Sapiens
FFKRTHYYQ

SEQ ID NO: 1237242 - protein, 9 aa, Homo Sapiens
SSNMADGDN

SEQ ID NO: 1237243 - protein, 9 aa, Homo Sapiens
RQAKLNQHR

SEQ ID NO: 1237244 - protein, 9 aa, Homo Sapiens
ETELTEELT

SEQ ID NO: 1237245 - protein, 9 aa, Homo Sapiens
LQLMYTVEY

SEQ ID NO: 1237246 - protein, 9 aa, Homo Sapiens
QTQKVFQLQ

SEQ ID NO: 1237247 - protein, 9 aa, Homo Sapiens
EIKNILVNT

SEQ ID NO: 1237248 - protein, 9 aa, Homo Sapiens
RKHYECSKC

SEQ ID NO: 1237249 - protein, 9 aa, Homo Sapiens
PETSVQPIL

SEQ ID NO: 1237250 - protein, 9 aa, Homo Sapiens
NSQVCPLTT

SEQ ID NO: 1237251 - protein, 9 aa, Homo Sapiens
SPPVLGLEF

SEQ ID NO: 1237252 - protein, 9 aa, Homo Sapiens
LDCLLDIMP

SEQ ID NO: 1237253 - protein, 9 aa, Homo Sapiens
SLQESGMAL

SEQ ID NO: 1237254 - protein, 9 aa, Homo Sapiens
LSRGNLGAK

SEQ ID NO: 1237255 - protein, 9 aa, Homo Sapiens
LKEEVKRFR

SEQ ID NO: 1237256 - protein, 9 aa, Homo Sapiens
PGVDLYHLE

SEQ ID NO: 1237257 - protein, 9 aa, Homo Sapiens
PQGPAQAPL

SEQ ID NO: 1237258 - protein, 9 aa, Homo Sapiens
PFLVIAPLP

SEQ ID NO: 1237259 - protein, 9 aa, Homo Sapiens
LSFFAICGP

SEQ ID NO: 1237260 - protein, 9 aa, Homo Sapiens
RSGIDITYF

SEQ ID NO: 1237261 - protein, 9 aa, Homo Sapiens
GIGPAGEPM

SEQ ID NO: 1237262 - protein, 9 aa, Homo Sapiens
MVWDIAYLQ

SEQ ID NO: 1237263 - protein, 9 aa, Homo Sapiens
EGVRVNKVM

SEQ ID NO: 1237264 - protein, 9 aa, Homo Sapiens
TTTSMRIGL

SEQ ID NO: 1237265 - protein, 9 aa, Homo Sapiens
GQFKSLALY

SEQ ID NO: 1237266 - protein, 9 aa, Homo Sapiens
HAMADDDTA

SEQ ID NO: 1237267 - protein, 9 aa, Homo Sapiens
WFLNKLCLR

SEQ ID NO: 1237268 - protein, 9 aa, Homo Sapiens
KVLKEIVEH

SEQ ID NO: 1237269 - protein, 9 aa, Homo Sapiens
KMSDDGVSG

SEQ ID NO: 1237270 - protein, 9 aa, Homo Sapiens
ARLPYCRKE

SEQ ID NO: 1237271 - protein, 9 aa, Homo Sapiens
QLWAILSFI

SEQ ID NO: 1237272 - protein, 9 aa, Homo Sapiens
VGWMVAGLM

SEQ ID NO: 1237273 - protein, 9 aa, Homo Sapiens
WSWDRHRVD

SEQ ID NO: 1237274 - protein, 9 aa, Homo Sapiens
YQRRHGFTS

SEQ ID NO: 1237275 - protein, 9 aa, Homo Sapiens
WNDSGPEFI

SEQ ID NO: 1237276 - protein, 9 aa, Homo Sapiens
KNPGTQKSR

SEQ ID NO: 1237277 - protein, 9 aa, Homo Sapiens
LLLLLFLTQ

SEQ ID NO: 1237278 - protein, 9 aa, Homo Sapiens
NVMQLPLCE

SEQ ID NO: 1237279 - protein, 9 aa, Homo Sapiens
GWSGQMADG

SEQ ID NO: 1237280 - protein, 9 aa, Homo Sapiens
KGKGKKKQH

SEQ ID NO: 1237281 - protein, 9 aa, Homo Sapiens
TTWYHRYYW

SEQ ID NO: 1237282 - protein, 9 aa, Homo Sapiens
PIPPAMNAR

SEQ ID NO: 1237283 - protein, 9 aa, Homo Sapiens
RESVKSYKS

SEQ ID NO: 1237284 - protein, 9 aa, Homo Sapiens
PRPSPAQVL

SEQ ID NO: 1237285 - protein, 9 aa, Homo Sapiens
NLFIHISIN

SEQ ID NO: 1237286 - protein, 9 aa, Homo Sapiens
NTTVSHEMS

SEQ ID NO: 1237287 - protein, 9 aa, Homo Sapiens
PPHHRNIPN

SEQ ID NO: 1237288 - protein, 9 aa, Homo Sapiens
KERLVRQRQ

SEQ ID NO: 1237289 - protein, 9 aa, Homo Sapiens
PACRIPITP

SEQ ID NO: 1237290 - protein, 9 aa, Homo Sapiens
PVRVPDQEP

SEQ ID NO: 1237291 - protein, 9 aa, Homo Sapiens
RRETKMLHL

SEQ ID NO: 1237292 - protein, 9 aa, Homo Sapiens
PHYPPGSSQ

SEQ ID NO: 1237293 - protein, 9 aa, Homo Sapiens
ASIVLSRPS

SEQ ID NO: 1237294 - protein, 9 aa, Homo Sapiens
QTILHKYYE

SEQ ID NO: 1237295 - protein, 9 aa, Homo Sapiens
TQDLVLPDS

SEQ ID NO: 1237296 - protein, 9 aa, Homo Sapiens
IQGSGKTAT

SEQ ID NO: 1237297 - protein, 9 aa, Homo Sapiens
AASLMATAP

SEQ ID NO: 1237298 - protein, 9 aa, Homo Sapiens
VNPEGPIQH

SEQ ID NO: 1237299 - protein, 9 aa, Homo Sapiens
ASKRKNWQP

SEQ ID NO: 1237300 - protein, 9 aa, Homo Sapiens
SLHPWLFTH

SEQ ID NO: 1237301 - protein, 9 aa, Homo Sapiens
TRPLISIAS

SEQ ID NO: 1237302 - protein, 9 aa, Homo Sapiens
LPLSAVCFM

SEQ ID NO: 1237303 - protein, 9 aa, Homo Sapiens
KRIYTGEKP

SEQ ID NO: 1237304 - protein, 9 aa, Homo Sapiens
IECHSLDFQ

SEQ ID NO: 1237305 - protein, 9 aa, Homo Sapiens
ISMRAQDRY

SEQ ID NO: 1237306 - protein, 9 aa, Homo Sapiens
CRDNLKYSS

SEQ ID NO: 1237307 - protein, 9 aa, Homo Sapiens
KGILYVTMT

SEQ ID NO: 1237308 - protein, 9 aa, Homo Sapiens
RLHSPALPC

SEQ ID NO: 1237309 - protein, 9 aa, Homo Sapiens
GPSRLRLDA

SEQ ID NO: 1237310 - protein, 9 aa, Homo Sapiens
GVVNVNASK

SEQ ID NO: 1237311 - protein, 9 aa, Homo Sapiens
VMLIAAVFM

SEQ ID NO: 1237312 - protein, 9 aa, Homo Sapiens
VSMSKNTKL

SEQ ID NO: 1237313 - protein, 9 aa, Homo Sapiens
NVPAGGQTQ

SEQ ID NO: 1237314 - protein, 9 aa, Homo Sapiens
STRDSVGNT

SEQ ID NO: 1237315 - protein, 9 aa, Homo Sapiens
KHSASPKPS

SEQ ID NO: 1237316 - protein, 9 aa, Homo Sapiens
ASDSELMVW

SEQ ID NO: 1237317 - protein, 9 aa, Homo Sapiens
NDLRAEAGG

SEQ ID NO: 1237318 - protein, 9 aa, Homo Sapiens
SLAVGIAFF

SEQ ID NO: 1237319 - protein, 9 aa, Homo Sapiens
PDDDFRRPP

SEQ ID NO: 1237320 - protein, 9 aa, Homo Sapiens
AHQQRFAHF

SEQ ID NO: 1237321 - protein, 9 aa, Homo Sapiens
AGIIRTLQK

SEQ ID NO: 1237322 - protein, 9 aa, Homo Sapiens
NLHPAKPKY

SEQ ID NO: 1237323 - protein, 9 aa, Homo Sapiens
RIDKIRMYN

SEQ ID NO: 1237324 - protein, 9 aa, Homo Sapiens
PKTKGEIAN

SEQ ID NO: 1237325 - protein, 9 aa, Homo Sapiens
CCLRSKEEP

SEQ ID NO: 1237326 - protein, 9 aa, Homo Sapiens
LENASGKLI

SEQ ID NO: 1237327 - protein, 9 aa, Homo Sapiens
LVPDIQGSG

SEQ ID NO: 1237328 - protein, 9 aa, Homo Sapiens
IHFTVEGEV

SEQ ID NO: 1237329 - protein, 9 aa, Homo Sapiens
YQSFLTEHQ

SEQ ID NO: 1237330 - protein, 9 aa, Homo Sapiens
LTICNMLHG

SEQ ID NO: 1237331 - protein, 9 aa, Homo Sapiens
VMMLHHMGL

SEQ ID NO: 1237332 - protein, 9 aa, Homo Sapiens
AEDLSGSDS

SEQ ID NO: 1237333 - protein, 9 aa, Homo Sapiens
SEADKCGLT

SEQ ID NO: 1237334 - protein, 9 aa, Homo Sapiens
FLVTTMLAS

SEQ ID NO: 1237335 - protein, 9 aa, Homo Sapiens
YPEIRLNML

SEQ ID NO: 1237336 - protein, 9 aa, Homo Sapiens
RTPQPLTSA

SEQ ID NO: 1237337 - protein, 9 aa, Homo Sapiens
YVFMGNMIR

SEQ ID NO: 1237338 - protein, 9 aa, Homo Sapiens
TGYAETYHW

SEQ ID NO: 1237339 - protein, 9 aa, Homo Sapiens
LIHTIKGNP

SEQ ID NO: 1237340 - protein, 9 aa, Homo Sapiens
LDFRNDILP

SEQ ID NO: 1237341 - protein, 9 aa, Homo Sapiens
RTTLHLAAE

SEQ ID NO: 1237342 - protein, 9 aa, Homo Sapiens
KLFIFTTTH

SEQ ID NO: 1237343 - protein, 9 aa, Homo Sapiens
LLGSRMAHP

SEQ ID NO: 1237344 - protein, 9 aa, Homo Sapiens
YDLWHILLV

SEQ ID NO: 1237345 - protein, 9 aa, Homo Sapiens
MEEATRQVA

SEQ ID NO: 1237346 - protein, 9 aa, Homo Sapiens
NCVNIPMIR

SEQ ID NO: 1237347 - protein, 9 aa, Homo Sapiens
LYIPHPSSP

SEQ ID NO: 1237348 - protein, 9 aa, Homo Sapiens
LAAQAISCF

SEQ ID NO: 1237349 - protein, 9 aa, Homo Sapiens
ITWKFDSPE

SEQ ID NO: 1237350 - protein, 9 aa, Homo Sapiens
EYTSYQRDS

SEQ ID NO: 1237351 - protein, 9 aa, Homo Sapiens
MSRGEHDLI

SEQ ID NO: 1237352 - protein, 9 aa, Homo Sapiens
ELQQLEQFE

SEQ ID NO: 1237353 - protein, 9 aa, Homo Sapiens
HTLYRYFVE

SEQ ID NO: 1237354 - protein, 9 aa, Homo Sapiens
DILEREKHH

SEQ ID NO: 1237355 - protein, 9 aa, Homo Sapiens
CAGGVRTRE

SEQ ID NO: 1237356 - protein, 9 aa, Homo Sapiens
VGTMADDQG

SEQ ID NO: 1237357 - protein, 9 aa, Homo Sapiens
NIFKADKEA

SEQ ID NO: 1237358 - protein, 9 aa, Homo Sapiens
DISRELEEI

SEQ ID NO: 1237359 - protein, 9 aa, Homo Sapiens
TTYSNQEVL

SEQ ID NO: 1237360 - protein, 9 aa, Homo Sapiens
VSGTLARTV

SEQ ID NO: 1237361 - protein, 9 aa, Homo Sapiens
VSHKEWGAR

SEQ ID NO: 1237362 - protein, 9 aa, Homo Sapiens
SRILTSKLL

SEQ ID NO: 1237363 - protein, 9 aa, Homo Sapiens
CGQMTSYPL

SEQ ID NO: 1237364 - protein, 9 aa, Homo Sapiens
FYSKHLRFP

SEQ ID NO: 1237365 - protein, 9 aa, Homo Sapiens
LLATVFCIW

SEQ ID NO: 1237366 - protein, 9 aa, Homo Sapiens
FKSDHGHRF

SEQ ID NO: 1237367 - protein, 9 aa, Homo Sapiens
IKPCHPMTN

SEQ ID NO: 1237368 - protein, 9 aa, Homo Sapiens
MFHVILSVL

SEQ ID NO: 1237369 - protein, 9 aa, Homo Sapiens
KIPEATNRH

SEQ ID NO: 1237370 - protein, 9 aa, Homo Sapiens
GHLVAFFVF

SEQ ID NO: 1237371 - protein, 9 aa, Homo Sapiens
LQESGMALD

SEQ ID NO: 1237372 - protein, 9 aa, Homo Sapiens
MQKKTYVTL

SEQ ID NO: 1237373 - protein, 9 aa, Homo Sapiens
LQQHIQMHM

SEQ ID NO: 1237374 - protein, 9 aa, Homo Sapiens
GLNCESVSD

SEQ ID NO: 1237375 - protein, 9 aa, Homo Sapiens
RIHNITASD

SEQ ID NO: 1237376 - protein, 9 aa, Homo Sapiens
QLMGINLPA

SEQ ID NO: 1237377 - protein, 9 aa, Homo Sapiens
GLFLALIQV

SEQ ID NO: 1237378 - protein, 9 aa, Homo Sapiens
TAAVAAGIP

SEQ ID NO: 1237379 - protein, 9 aa, Homo Sapiens
RLPLESVLH

SEQ ID NO: 1237380 - protein, 9 aa, Homo Sapiens
QSSVSVTAA

SEQ ID NO: 1237381 - protein, 9 aa, Homo Sapiens
ISSISVAGM

SEQ ID NO: 1237382 - protein, 9 aa, Homo Sapiens
LSINRYDKV

SEQ ID NO: 1237383 - protein, 9 aa, Homo Sapiens
AVLGTMVMK

SEQ ID NO: 1237384 - protein, 9 aa, Homo Sapiens
GSHVSKMAL

SEQ ID NO: 1237385 - protein, 9 aa, Homo Sapiens
KCEYMPNAI

SEQ ID NO: 1237386 - protein, 9 aa, Homo Sapiens
VGICWYQCC

SEQ ID NO: 1237387 - protein, 9 aa, Homo Sapiens
FVGAPYWMA

SEQ ID NO: 1237388 - protein, 9 aa, Homo Sapiens
RIYKAPSFT

SEQ ID NO: 1237389 - protein, 9 aa, Homo Sapiens
VVFMKFSVQ

SEQ ID NO: 1237390 - protein, 9 aa, Homo Sapiens
GHHRIQVIA

SEQ ID NO: 1237391 - protein, 9 aa, Homo Sapiens
EYMFDKLTL

SEQ ID NO: 1237392 - protein, 9 aa, Homo Sapiens
AHSNSSVLA

SEQ ID NO: 1237393 - protein, 9 aa, Homo Sapiens
HHTDHPRAQ

SEQ ID NO: 1237394 - protein, 9 aa, Homo Sapiens
VITLSITGK

SEQ ID NO: 1237395 - protein, 9 aa, Homo Sapiens
IYEVIGKSK

SEQ ID NO: 1237396 - protein, 9 aa, Homo Sapiens
PGTTRPQRS

SEQ ID NO: 1237397 - protein, 9 aa, Homo Sapiens
CDDGWDLHD

SEQ ID NO: 1237398 - protein, 9 aa, Homo Sapiens
GAKQADVVQ

SEQ ID NO: 1237399 - protein, 9 aa, Homo Sapiens
NVLVRYSSK

SEQ ID NO: 1237400 - protein, 9 aa, Homo Sapiens
KAAGGPCLP

SEQ ID NO: 1237401 - protein, 9 aa, Homo Sapiens
EDFLKCNAT

SEQ ID NO: 1237402 - protein, 9 aa, Homo Sapiens
KLDLNQWLT

SEQ ID NO: 1237403 - protein, 9 aa, Homo Sapiens
TRLPRRSCC

SEQ ID NO: 1237404 - protein, 9 aa, Homo Sapiens
HSPSPAVPL

SEQ ID NO: 1237405 - protein, 9 aa, Homo Sapiens
LEAVCKYFQ

SEQ ID NO: 1237406 - protein, 9 aa, Homo Sapiens
SFFGKYDSH

SEQ ID NO: 1237407 - protein, 9 aa, Homo Sapiens
YDLRQRFMA

SEQ ID NO: 1237408 - protein, 9 aa, Homo Sapiens
HHTQTKFED

SEQ ID NO: 1237409 - protein, 9 aa, Homo Sapiens
QGLTREGDT

SEQ ID NO: 1237410 - protein, 9 aa, Homo Sapiens
LSTLSVLVT

SEQ ID NO: 1237411 - protein, 9 aa, Homo Sapiens
QKIHTGEWP

SEQ ID NO: 1237412 - protein, 9 aa, Homo Sapiens
PTGSEADGL

SEQ ID NO: 1237413 - protein, 9 aa, Homo Sapiens
ETITTKELG

SEQ ID NO: 1237414 - protein, 9 aa, Homo Sapiens
GVLLIYDIT

SEQ ID NO: 1237415 - protein, 9 aa, Homo Sapiens
TVPPQEAIL

SEQ ID NO: 1237416 - protein, 9 aa, Homo Sapiens
MIKQCLKDH

SEQ ID NO: 1237417 - protein, 9 aa, Homo Sapiens
PPQYFAIIE

SEQ ID NO: 1237418 - protein, 9 aa, Homo Sapiens
LGHAPMGPY

SEQ ID NO: 1237419 - protein, 9 aa, Homo Sapiens
LFINSLLNE

SEQ ID NO: 1237420 - protein, 9 aa, Homo Sapiens
LQKKPGKGI

SEQ ID NO: 1237421 - protein, 9 aa, Homo Sapiens
WGPPAPSSS

SEQ ID NO: 1237422 - protein, 9 aa, Homo Sapiens
LMDIMLICT

SEQ ID NO: 1237423 - protein, 9 aa, Homo Sapiens
YLINSLKPS

SEQ ID NO: 1237424 - protein, 9 aa, Homo Sapiens
EDEDEMEDE

SEQ ID NO: 1237425 - protein, 9 aa, Homo Sapiens
YYRLSGEAY

SEQ ID NO: 1237426 - protein, 9 aa, Homo Sapiens
VQAEKNQGQ

SEQ ID NO: 1237427 - protein, 9 aa, Homo Sapiens
DVFCLPWEI

SEQ ID NO: 1237428 - protein, 9 aa, Homo Sapiens
AWGPPAPSS

SEQ ID NO: 1237429 - protein, 9 aa, Homo Sapiens
VNIPMIRQQ

SEQ ID NO: 1237430 - protein, 9 aa, Homo Sapiens
SQLSTLVDA

SEQ ID NO: 1237431 - protein, 9 aa, Homo Sapiens
NFTKDITEL

SEQ ID NO: 1237432 - protein, 9 aa, Homo Sapiens
QKVEENEHM

SEQ ID NO: 1237433 - protein, 9 aa, Homo Sapiens
VLPVSPAAR

SEQ ID NO: 1237434 - protein, 9 aa, Homo Sapiens
AKTVLTIIK

SEQ ID NO: 1237435 - protein, 9 aa, Homo Sapiens
NSRVEIVTA

SEQ ID NO: 1237436 - protein, 9 aa, Homo Sapiens
YNHTIHGMS

SEQ ID NO: 1237437 - protein, 9 aa, Homo Sapiens
HQHTNVCFW

SEQ ID NO: 1237438 - protein, 9 aa, Homo Sapiens
AFYQVFHLN

SEQ ID NO: 1237439 - protein, 9 aa, Homo Sapiens
LPSSGTESW

SEQ ID NO: 1237440 - protein, 9 aa, Homo Sapiens
VSTTAAFVA

SEQ ID NO: 1237441 - protein, 9 aa, Homo Sapiens
WTGHEVKGL

SEQ ID NO: 1237442 - protein, 9 aa, Homo Sapiens
RSCRKKSTR

SEQ ID NO: 1237443 - protein, 9 aa, Homo Sapiens
HQCLSLTMS

SEQ ID NO: 1237444 - protein, 9 aa, Homo Sapiens
NFEDLEKEH

SEQ ID NO: 1237445 - protein, 9 aa, Homo Sapiens
LSISKPDVI

SEQ ID NO: 1237446 - protein, 9 aa, Homo Sapiens
EESDLELDK

SEQ ID NO: 1237447 - protein, 9 aa, Homo Sapiens
WLHACMIRL

SEQ ID NO: 1237448 - protein, 9 aa, Homo Sapiens
EKMILSFLP

SEQ ID NO: 1237449 - protein, 9 aa, Homo Sapiens
WFTFLLTMD

SEQ ID NO: 1237450 - protein, 9 aa, Homo Sapiens
ALDGFVKLG

SEQ ID NO: 1237451 - protein, 9 aa, Homo Sapiens
WSEDRDLGF

SEQ ID NO: 1237452 - protein, 9 aa, Homo Sapiens
CQCCPGPRH

SEQ ID NO: 1237453 - protein, 9 aa, Homo Sapiens
SAVAILQGT

SEQ ID NO: 1237454 - protein, 9 aa, Homo Sapiens
TVDCVHARA

SEQ ID NO: 1237455 - protein, 9 aa, Homo Sapiens
RVITLPQWK

SEQ ID NO: 1237456 - protein, 9 aa, Homo Sapiens
PPLKEGADH

SEQ ID NO: 1237457 - protein, 9 aa, Homo Sapiens
VDPSSPRSP

SEQ ID NO: 1237458 - protein, 9 aa, Homo Sapiens
YSMQRFRPE

SEQ ID NO: 1237459 - protein, 9 aa, Homo Sapiens
FNHVSNLVQ

SEQ ID NO: 1237460 - protein, 9 aa, Homo Sapiens
SRTTTTVGV

SEQ ID NO: 1237461 - protein, 9 aa, Homo Sapiens
PALVPTPHG

SEQ ID NO: 1237462 - protein, 9 aa, Homo Sapiens
EWLQGEKQQ

SEQ ID NO: 1237463 - protein, 9 aa, Homo Sapiens
DQVPDLKDL

SEQ ID NO: 1237464 - protein, 9 aa, Homo Sapiens
TGFGILGYS

SEQ ID NO: 1237465 - protein, 9 aa, Homo Sapiens
VMAILCNHQ

SEQ ID NO: 1237466 - protein, 9 aa, Homo Sapiens
TSTPLVYEA

SEQ ID NO: 1237467 - protein, 9 aa, Homo Sapiens
GPGEEWERC

SEQ ID NO: 1237468 - protein, 9 aa, Homo Sapiens
VRQYDVVAD

SEQ ID NO: 1237469 - protein, 9 aa, Homo Sapiens
ASPSSSATS

SEQ ID NO: 1237470 - protein, 9 aa, Homo Sapiens
VRRIVDALQ

SEQ ID NO: 1237471 - protein, 9 aa, Homo Sapiens
SLLCLDMSD

SEQ ID NO: 1237472 - protein, 9 aa, Homo Sapiens
LFLQLQETR

SEQ ID NO: 1237473 - protein, 9 aa, Homo Sapiens
TFSTYASHL

SEQ ID NO: 1237474 - protein, 9 aa, Homo Sapiens
DIFRHLCLE

SEQ ID NO: 1237475 - protein, 9 aa, Homo Sapiens
SFLGCVAHV

SEQ ID NO: 1237476 - protein, 9 aa, Homo Sapiens
KGYMSKRSS

SEQ ID NO: 1237477 - protein, 9 aa, Homo Sapiens
KRKLNSLMS

SEQ ID NO: 1237478 - protein, 9 aa, Homo Sapiens
KLSDSFGTR

SEQ ID NO: 1237479 - protein, 9 aa, Homo Sapiens
ETLLGYPEK

SEQ ID NO: 1237480 - protein, 9 aa, Homo Sapiens
VTPSEASVL

SEQ ID NO: 1237481 - protein, 9 aa, Homo Sapiens
KVCVWDEDD

SEQ ID NO: 1237482 - protein, 9 aa, Homo Sapiens
DGFYDQQVL

SEQ ID NO: 1237483 - protein, 9 aa, Homo Sapiens
NMANADRPV

SEQ ID NO: 1237484 - protein, 9 aa, Homo Sapiens
PRPTSLTLT

SEQ ID NO: 1237485 - protein, 9 aa, Homo Sapiens
ISREYSLGP

SEQ ID NO: 1237486 - protein, 9 aa, Homo Sapiens
GRKGDLLRR

SEQ ID NO: 1237487 - protein, 9 aa, Homo Sapiens
DLREDDLDD

SEQ ID NO: 1237488 - protein, 9 aa, Homo Sapiens
AAAKHSKAS

SEQ ID NO: 1237489 - protein, 9 aa, Homo Sapiens
IHTMAQEFD

SEQ ID NO: 1237490 - protein, 9 aa, Homo Sapiens
GPGNVLHCK

SEQ ID NO: 1237491 - protein, 9 aa, Homo Sapiens
RRWNESPGA

SEQ ID NO: 1237492 - protein, 9 aa, Homo Sapiens
QTLVSTNLT

SEQ ID NO: 1237493 - protein, 9 aa, Homo Sapiens
EDPFEKPII

SEQ ID NO: 1237494 - protein, 9 aa, Homo Sapiens
GKGNRTVGP

SEQ ID NO: 1237495 - protein, 9 aa, Homo Sapiens
NYFGEIMKW

SEQ ID NO: 1237496 - protein, 9 aa, Homo Sapiens
EQQLKLMQQ

SEQ ID NO: 1237497 - protein, 9 aa, Homo Sapiens
MEIHRTYQE

SEQ ID NO: 1237498 - protein, 9 aa, Homo Sapiens
NSSDRIKVC

SEQ ID NO: 1237499 - protein, 9 aa, Homo Sapiens
FTVDIVHVT

SEQ ID NO: 1237500 - protein, 9 aa, Homo Sapiens
VSRHTLKHD

SEQ ID NO: 1237501 - protein, 9 aa, Homo Sapiens
YECKQYGKA

SEQ ID NO: 1237502 - protein, 9 aa, Homo Sapiens
AVMKFRNTI

SEQ ID NO: 1237503 - protein, 9 aa, Homo Sapiens
PLVKVTYHV

SEQ ID NO: 1237504 - protein, 9 aa, Homo Sapiens
MGGLKNSKH

SEQ ID NO: 1237505 - protein, 9 aa, Homo Sapiens
TRPAAGVGD

SEQ ID NO: 1237506 - protein, 9 aa, Homo Sapiens
KCMVIILLH

SEQ ID NO: 1237507 - protein, 9 aa, Homo Sapiens
HYLCLDKSV

SEQ ID NO: 1237508 - protein, 9 aa, Homo Sapiens
LTRWEMHHT

SEQ ID NO: 1237509 - protein, 9 aa, Homo Sapiens
KQIISRANT

SEQ ID NO: 1237510 - protein, 9 aa, Homo Sapiens
LLKRNPRSW

SEQ ID NO: 1237511 - protein, 9 aa, Homo Sapiens
VDRLFEIKE

SEQ ID NO: 1237512 - protein, 9 aa, Homo Sapiens
ALRADPSWL

SEQ ID NO: 1237513 - protein, 9 aa, Homo Sapiens
HLEQECLTF

SEQ ID NO: 1237514 - protein, 9 aa, Homo Sapiens
VGLMMGISH

SEQ ID NO: 1237515 - protein, 9 aa, Homo Sapiens
ELKAHTVWL

SEQ ID NO: 1237516 - protein, 9 aa, Homo Sapiens
TGMHHHGQL

SEQ ID NO: 1237517 - protein, 9 aa, Homo Sapiens
LDNGLTRTP

SEQ ID NO: 1237518 - protein, 9 aa, Homo Sapiens
GVRVNKVMV

SEQ ID NO: 1237519 - protein, 9 aa, Homo Sapiens
LFLRFFAPT

SEQ ID NO: 1237520 - protein, 9 aa, Homo Sapiens
IRKLLQQSV

SEQ ID NO: 1237521 - protein, 9 aa, Homo Sapiens
TKMAFLCAV

SEQ ID NO: 1237522 - protein, 9 aa, Homo Sapiens
LEFLQRSSN

SEQ ID NO: 1237523 - protein, 9 aa, Homo Sapiens
KLQDIQEII

SEQ ID NO: 1237524 - protein, 9 aa, Homo Sapiens
LWLFLLLPI

SEQ ID NO: 1237525 - protein, 9 aa, Homo Sapiens
PSASGSGPK

SEQ ID NO: 1237526 - protein, 9 aa, Homo Sapiens
RKLCYQDAH

SEQ ID NO: 1237527 - protein, 9 aa, Homo Sapiens
NLLMVNSNY

SEQ ID NO: 1237528 - protein, 9 aa, Homo Sapiens
FKHLDRPVV

SEQ ID NO: 1237529 - protein, 9 aa, Homo Sapiens
MIWSVTNKS

SEQ ID NO: 1237530 - protein, 9 aa, Homo Sapiens
LLNEYNVID

SEQ ID NO: 1237531 - protein, 9 aa, Homo Sapiens
STECVILAV

SEQ ID NO: 1237532 - protein, 9 aa, Homo Sapiens
GGSSQNHHV

SEQ ID NO: 1237533 - protein, 9 aa, Homo Sapiens
NLNEQAAHS

SEQ ID NO: 1237534 - protein, 9 aa, Homo Sapiens
HEMTHSEEK

SEQ ID NO: 1237535 - protein, 9 aa, Homo Sapiens
CRSVKGLVT

SEQ ID NO: 1237536 - protein, 9 aa, Homo Sapiens
VSRGTFSRI

SEQ ID NO: 1237537 - protein, 9 aa, Homo Sapiens
NLETWRQLR

SEQ ID NO: 1237538 - protein, 9 aa, Homo Sapiens
LLGDIIILD

SEQ ID NO: 1237539 - protein, 9 aa, Homo Sapiens
KWHPDKNMD

SEQ ID NO: 1237540 - protein, 9 aa, Homo Sapiens
EDEEESWST

SEQ ID NO: 1237541 - protein, 9 aa, Homo Sapiens
PSLCHRLKP

SEQ ID NO: 1237542 - protein, 9 aa, Homo Sapiens
HKLLVTPPQ

SEQ ID NO: 1237543 - protein, 9 aa, Homo Sapiens
HPVAAAAAA

SEQ ID NO: 1237544 - protein, 9 aa, Homo Sapiens
GRCSVSDCS

SEQ ID NO: 1237545 - protein, 9 aa, Homo Sapiens
HPSLLMENG

SEQ ID NO: 1237546 - protein, 9 aa, Homo Sapiens
LSSSSLAIP

SEQ ID NO: 1237547 - protein, 9 aa, Homo Sapiens
SGAHDGHPS

SEQ ID NO: 1237548 - protein, 9 aa, Homo Sapiens
PSQKSLFYL

SEQ ID NO: 1237549 - protein, 9 aa, Homo Sapiens
QFLEEARRC

SEQ ID NO: 1237550 - protein, 9 aa, Homo Sapiens
SVLKMCQPE

SEQ ID NO: 1237551 - protein, 9 aa, Homo Sapiens
LCSQPRRPK

SEQ ID NO: 1237552 - protein, 9 aa, Homo Sapiens
THFCAIVLT

SEQ ID NO: 1237553 - protein, 9 aa, Homo Sapiens
RCPWRIWFL

SEQ ID NO: 1237554 - protein, 9 aa, Homo Sapiens
CVCRIFSLI

SEQ ID NO: 1237555 - protein, 9 aa, Homo Sapiens
HGTMTLSKS

SEQ ID NO: 1237556 - protein, 9 aa, Homo Sapiens
LASVSTPDS

SEQ ID NO: 1237557 - protein, 9 aa, Homo Sapiens
VFLNSSMPI

SEQ ID NO: 1237558 - protein, 9 aa, Homo Sapiens
EDGEELDLR

SEQ ID NO: 1237559 - protein, 9 aa, Homo Sapiens
WSMVGRLPE

SEQ ID NO: 1237560 - protein, 9 aa, Homo Sapiens
FFDTFNVPV

SEQ ID NO: 1237561 - protein, 9 aa, Homo Sapiens
MEHIMHMIS

SEQ ID NO: 1237562 - protein, 9 aa, Homo Sapiens
TMHNYSGLI

SEQ ID NO: 1237563 - protein, 9 aa, Homo Sapiens
VGLESAIDA

SEQ ID NO: 1237564 - protein, 9 aa, Homo Sapiens
DVPASLDAF

SEQ ID NO: 1237565 - protein, 9 aa, Homo Sapiens
GKAFNQSSY

SEQ ID NO: 1237566 - protein, 9 aa, Homo Sapiens
NPYMDGATP

SEQ ID NO: 1237567 - protein, 9 aa, Homo Sapiens
TCPSMEVYE

SEQ ID NO: 1237568 - protein, 9 aa, Homo Sapiens
LQSISELDL

SEQ ID NO: 1237569 - protein, 9 aa, Homo Sapiens
STPTTPSAA

SEQ ID NO: 1237570 - protein, 9 aa, Homo Sapiens
GTKSTPWQP

SEQ ID NO: 1237571 - protein, 9 aa, Homo Sapiens
TLIWRHLMR

SEQ ID NO: 1237572 - protein, 9 aa, Homo Sapiens
MDLTIRIGA

SEQ ID NO: 1237573 - protein, 9 aa, Homo Sapiens
PVFCMTEEV

SEQ ID NO: 1237574 - protein, 9 aa, Homo Sapiens
FTFLLTMDA

SEQ ID NO: 1237575 - protein, 9 aa, Homo Sapiens
KHKRHTSSS

SEQ ID NO: 1237576 - protein, 9 aa, Homo Sapiens
RAGMGWYQT

SEQ ID NO: 1237577 - protein, 9 aa, Homo Sapiens
VCMRHDKIV

SEQ ID NO: 1237578 - protein, 9 aa, Homo Sapiens
LRLLHQVFP

SEQ ID NO: 1237579 - protein, 9 aa, Homo Sapiens
NMNLEILLG

SEQ ID NO: 1237580 - protein, 9 aa, Homo Sapiens
MGGGRRDHH

SEQ ID NO: 1237581 - protein, 9 aa, Homo Sapiens
QFRMEQLVF

SEQ ID NO: 1237582 - protein, 9 aa, Homo Sapiens
LKHEKIQLI

SEQ ID NO: 1237583 - protein, 9 aa, Homo Sapiens
RIGLRVYFN

SEQ ID NO: 1237584 - protein, 9 aa, Homo Sapiens
SHGRLSGSV

SEQ ID NO: 1237585 - protein, 9 aa, Homo Sapiens
WYNVSYQAD

SEQ ID NO: 1237586 - protein, 9 aa, Homo Sapiens
GVPPPYPRP

SEQ ID NO: 1237587 - protein, 9 aa, Homo Sapiens
AHVYFPEEL

SEQ ID NO: 1237588 - protein, 9 aa, Homo Sapiens
IKLYCDLPL

SEQ ID NO: 1237589 - protein, 9 aa, Homo Sapiens
HRGHARESE

SEQ ID NO: 1237590 - protein, 9 aa, Homo Sapiens
RSSVKRTHY

SEQ ID NO: 1237591 - protein, 9 aa, Homo Sapiens
LGKRHNLTT

SEQ ID NO: 1237592 - protein, 9 aa, Homo Sapiens
MGNGRHCNK

SEQ ID NO: 1237593 - protein, 9 aa, Homo Sapiens
LFKLNHKSL

SEQ ID NO: 1237594 - protein, 9 aa, Homo Sapiens
DGSLHATFS

SEQ ID NO: 1237595 - protein, 9 aa, Homo Sapiens
SSDLHLILC

SEQ ID NO: 1237596 - protein, 9 aa, Homo Sapiens
CDICDTSFM

SEQ ID NO: 1237597 - protein, 9 aa, Homo Sapiens
VSYAFILYI

SEQ ID NO: 1237598 - protein, 9 aa, Homo Sapiens
QASLQVDWL

SEQ ID NO: 1237599 - protein, 9 aa, Homo Sapiens
PSLPEQISP

SEQ ID NO: 1237600 - protein, 9 aa, Homo Sapiens
DLLRLNQLK

SEQ ID NO: 1237601 - protein, 9 aa, Homo Sapiens
SISILAMPL

SEQ ID NO: 1237602 - protein, 9 aa, Homo Sapiens
EAEATALYL

SEQ ID NO: 1237603 - protein, 9 aa, Homo Sapiens
QLGCDAVLQ

SEQ ID NO: 1237604 - protein, 9 aa, Homo Sapiens
ALSKREMDE

SEQ ID NO: 1237605 - protein, 9 aa, Homo Sapiens
FSGLSHISR

SEQ ID NO: 1237606 - protein, 9 aa, Homo Sapiens
DAISESQHV

SEQ ID NO: 1237607 - protein, 9 aa, Homo Sapiens
YNFMNNGFF

SEQ ID NO: 1237608 - protein, 9 aa, Homo Sapiens
CTSKGLILP

SEQ ID NO: 1237609 - protein, 9 aa, Homo Sapiens
IFLKCSVPP

SEQ ID NO: 1237610 - protein, 9 aa, Homo Sapiens
PHRDTHGGE

SEQ ID NO: 1237611 - protein, 9 aa, Homo Sapiens
ISSVQKKMK

SEQ ID NO: 1237612 - protein, 9 aa, Homo Sapiens
ITRSQPEDT

SEQ ID NO: 1237613 - protein, 9 aa, Homo Sapiens
FVQSESHLA

SEQ ID NO: 1237614 - protein, 9 aa, Homo Sapiens
KAISVDPIA

SEQ ID NO: 1237615 - protein, 9 aa, Homo Sapiens
SNVDYQYQL

SEQ ID NO: 1237616 - protein, 9 aa, Homo Sapiens
LVHSPEYAS

SEQ ID NO: 1237617 - protein, 9 aa, Homo Sapiens
KFAAAIVII

SEQ ID NO: 1237618 - protein, 9 aa, Homo Sapiens
SYTSADATI

SEQ ID NO: 1237619 - protein, 9 aa, Homo Sapiens
QAFQKPSKP

SEQ ID NO: 1237620 - protein, 9 aa, Homo Sapiens
VKLCRAVSE

SEQ ID NO: 1237621 - protein, 9 aa, Homo Sapiens
ALGISSEIE

SEQ ID NO: 1237622 - protein, 9 aa, Homo Sapiens
NEGHGGAQL

SEQ ID NO: 1237623 - protein, 9 aa, Homo Sapiens
TCLNDVGGN

SEQ ID NO: 1237624 - protein, 9 aa, Homo Sapiens
REGVPMHKG

SEQ ID NO: 1237625 - protein, 9 aa, Homo Sapiens
HHLGNDEVH

SEQ ID NO: 1237626 - protein, 9 aa, Homo Sapiens
PVTEDFYSI

SEQ ID NO: 1237627 - protein, 9 aa, Homo Sapiens
KLIPQTPES

SEQ ID NO: 1237628 - protein, 9 aa, Homo Sapiens
THTHRHTGI

SEQ ID NO: 1237629 - protein, 9 aa, Homo Sapiens
NSCPEGVRQ

SEQ ID NO: 1237630 - protein, 9 aa, Homo Sapiens
IKKRDQCFQ

SEQ ID NO: 1237631 - protein, 9 aa, Homo Sapiens
WLSASHFTT

SEQ ID NO: 1237632 - protein, 9 aa, Homo Sapiens
HRLFEAFGN

SEQ ID NO: 1237633 - protein, 9 aa, Homo Sapiens
FQFCFLRFA

SEQ ID NO: 1237634 - protein, 9 aa, Homo Sapiens
SSSWQDVIM

SEQ ID NO: 1237635 - protein, 9 aa, Homo Sapiens
LKKMKQEVG

SEQ ID NO: 1237636 - protein, 9 aa, Homo Sapiens
VLYMVRFKG

SEQ ID NO: 1237637 - protein, 9 aa, Homo Sapiens
TQNTHGLRI

SEQ ID NO: 1237638 - protein, 9 aa, Homo Sapiens
GGGSPSRSA

SEQ ID NO: 1237639 - protein, 9 aa, Homo Sapiens
WFGLWKSKD

SEQ ID NO: 1237640 - protein, 9 aa, Homo Sapiens
ASTVCHPLI

SEQ ID NO: 1237641 - protein, 9 aa, Homo Sapiens
CYYRGHMSS

SEQ ID NO: 1237642 - protein, 9 aa, Homo Sapiens
CNEGTRKME

SEQ ID NO: 1237643 - protein, 9 aa, Homo Sapiens
GRCSDLVSL

SEQ ID NO: 1237644 - protein, 9 aa, Homo Sapiens
HMPTYLVAI

SEQ ID NO: 1237645 - protein, 9 aa, Homo Sapiens
SNPDLITCL

SEQ ID NO: 1237646 - protein, 9 aa, Homo Sapiens
LLCICALDV

SEQ ID NO: 1237647 - protein, 9 aa, Homo Sapiens
YNPKQFAAV

SEQ ID NO: 1237648 - protein, 9 aa, Homo Sapiens
FAMCMTGAH

SEQ ID NO: 1237649 - protein, 9 aa, Homo Sapiens
DDGWDLHDA

SEQ ID NO: 1237650 - protein, 9 aa, Homo Sapiens
SSPRPMEAP

SEQ ID NO: 1237651 - protein, 9 aa, Homo Sapiens
KLGEEVSLH

SEQ ID NO: 1237652 - protein, 9 aa, Homo Sapiens
SEQPLFQPM

SEQ ID NO: 1237653 - protein, 9 aa, Homo Sapiens
VHINIAIVR

SEQ ID NO: 1237654 - protein, 9 aa, Homo Sapiens
CIAKTLSYL

SEQ ID NO: 1237655 - protein, 9 aa, Homo Sapiens
AEGVNIRDD

SEQ ID NO: 1237656 - protein, 9 aa, Homo Sapiens
GPLGSRTLK

SEQ ID NO: 1237657 - protein, 9 aa, Homo Sapiens
ATKACAFLE

SEQ ID NO: 1237658 - protein, 9 aa, Homo Sapiens
AQYHVARAH

SEQ ID NO: 1237659 - protein, 9 aa, Homo Sapiens
NLRSRKLVS

SEQ ID NO: 1237660 - protein, 9 aa, Homo Sapiens
GTVTCSFVQ

SEQ ID NO: 1237661 - protein, 9 aa, Homo Sapiens
LENTKPQVK

SEQ ID NO: 1237662 - protein, 9 aa, Homo Sapiens
HILNVPQEL

SEQ ID NO: 1237663 - protein, 9 aa, Homo Sapiens
NPTLHHSHH

SEQ ID NO: 1237664 - protein, 9 aa, Homo Sapiens
TEVEPFKSM

SEQ ID NO: 1237665 - protein, 9 aa, Homo Sapiens
CVSMQPHKY

SEQ ID NO: 1237666 - protein, 9 aa, Homo Sapiens
KPHGVKKPN

SEQ ID NO: 1237667 - protein, 9 aa, Homo Sapiens
IKLWIELLI

SEQ ID NO: 1237668 - protein, 9 aa, Homo Sapiens
GQQLADTLG

SEQ ID NO: 1237669 - protein, 9 aa, Homo Sapiens
RTGLLPGEA

SEQ ID NO: 1237670 - protein, 9 aa, Homo Sapiens
SEEQQLRPQ

SEQ ID NO: 1237671 - protein, 9 aa, Homo Sapiens
SQAKVLLHM

SEQ ID NO: 1237672 - protein, 9 aa, Homo Sapiens
HLNRDMIVS

SEQ ID NO: 1237673 - protein, 9 aa, Homo Sapiens
YGDQNSRLA

SEQ ID NO: 1237674 - protein, 9 aa, Homo Sapiens
VISDCKNSH

SEQ ID NO: 1237675 - protein, 9 aa, Homo Sapiens
PCIPPVPQC

SEQ ID NO: 1237676 - protein, 9 aa, Homo Sapiens
PTRVCPRPL

SEQ ID NO: 1237677 - protein, 9 aa, Homo Sapiens
GVEMQLMAA

SEQ ID NO: 1237678 - protein, 9 aa, Homo Sapiens
SHVLNRLTF

SEQ ID NO: 1237679 - protein, 9 aa, Homo Sapiens
VIDQYVDYL

SEQ ID NO: 1237680 - protein, 9 aa, Homo Sapiens
PPLEDKLEH

SEQ ID NO: 1237681 - protein, 9 aa, Homo Sapiens
ILTGRAPGC

SEQ ID NO: 1237682 - protein, 9 aa, Homo Sapiens
CIFVLYTIL

SEQ ID NO: 1237683 - protein, 9 aa, Homo Sapiens
DNHPTFPHA

SEQ ID NO: 1237684 - protein, 9 aa, Homo Sapiens
WPDVRVSPS

SEQ ID NO: 1237685 - protein, 9 aa, Homo Sapiens
NGLLHCTQK

SEQ ID NO: 1237686 - protein, 9 aa, Homo Sapiens
RAHKQDEEE

SEQ ID NO: 1237687 - protein, 9 aa, Homo Sapiens
PSDDMAVAV

SEQ ID NO: 1237688 - protein, 9 aa, Homo Sapiens
TAVSASDIL

SEQ ID NO: 1237689 - protein, 9 aa, Homo Sapiens
QNSGNVRNP

SEQ ID NO: 1237690 - protein, 9 aa, Homo Sapiens
HLQKVLFVL

SEQ ID NO: 1237691 - protein, 9 aa, Homo Sapiens
LSAPAEATS

SEQ ID NO: 1237692 - protein, 9 aa, Homo Sapiens
QGQFPRVCI

SEQ ID NO: 1237693 - protein, 9 aa, Homo Sapiens
EADEGVESV

SEQ ID NO: 1237694 - protein, 9 aa, Homo Sapiens
WVQYTSGKQ

SEQ ID NO: 1237695 - protein, 9 aa, Homo Sapiens
RIIIKGVGA

SEQ ID NO: 1237696 - protein, 9 aa, Homo Sapiens
SGTESWPPA

SEQ ID NO: 1237697 - protein, 9 aa, Homo Sapiens
RHFAEWCHA

SEQ ID NO: 1237698 - protein, 9 aa, Homo Sapiens
HSHGMKKMS

SEQ ID NO: 1237699 - protein, 9 aa, Homo Sapiens
LRLVPPKTR

SEQ ID NO: 1237700 - protein, 9 aa, Homo Sapiens
ASVLAAEPE

SEQ ID NO: 1237701 - protein, 9 aa, Homo Sapiens
QRETRHIWD

SEQ ID NO: 1237702 - protein, 9 aa, Homo Sapiens
SSPVQRTMM

SEQ ID NO: 1237703 - protein, 9 aa, Homo Sapiens
HPAAEEAEQ

SEQ ID NO: 1237704 - protein, 9 aa, Homo Sapiens
NKQSKMYSQ

SEQ ID NO: 1237705 - protein, 9 aa, Homo Sapiens
LVLQVYILT

SEQ ID NO: 1237706 - protein, 9 aa, Homo Sapiens
NMPDSILSP

SEQ ID NO: 1237707 - protein, 9 aa, Homo Sapiens
TTHLLVSQL

SEQ ID NO: 1237708 - protein, 9 aa, Homo Sapiens
SDWDKWLSR

SEQ ID NO: 1237709 - protein, 9 aa, Homo Sapiens
DFGGLGKEA

SEQ ID NO: 1237710 - protein, 9 aa, Homo Sapiens
VMFEQHLLP

SEQ ID NO: 1237711 - protein, 9 aa, Homo Sapiens
PGLLATRME

SEQ ID NO: 1237712 - protein, 9 aa, Homo Sapiens
GRMDHMDRC

SEQ ID NO: 1237713 - protein, 9 aa, Homo Sapiens
EVLKTWLTL

SEQ ID NO: 1237714 - protein, 9 aa, Homo Sapiens
AAAAAATML

SEQ ID NO: 1237715 - protein, 9 aa, Homo Sapiens
MVHMPGDVP

SEQ ID NO: 1237716 - protein, 9 aa, Homo Sapiens
TKKLIGIYR

SEQ ID NO: 1237717 - protein, 9 aa, Homo Sapiens
RQLLDDHND

SEQ ID NO: 1237718 - protein, 9 aa, Homo Sapiens
AGGGGGPGP

SEQ ID NO: 1237719 - protein, 9 aa, Homo Sapiens
QRLNTGQRP

SEQ ID NO: 1237720 - protein, 9 aa, Homo Sapiens
CPAVPLGPA

SEQ ID NO: 1237721 - protein, 9 aa, Homo Sapiens
RRIKTDFLV

SEQ ID NO: 1237722 - protein, 9 aa, Homo Sapiens
SVAMVQALE

SEQ ID NO: 1237723 - protein, 9 aa, Homo Sapiens
PVANGMPYS

SEQ ID NO: 1237724 - protein, 9 aa, Homo Sapiens
TTKQLLHMC

SEQ ID NO: 1237725 - protein, 9 aa, Homo Sapiens
LMIYLLCDK

SEQ ID NO: 1237726 - protein, 9 aa, Homo Sapiens
SSINSHEVD

SEQ ID NO: 1237727 - protein, 9 aa, Homo Sapiens
LTPPQIGKK

SEQ ID NO: 1237728 - protein, 9 aa, Homo Sapiens
DTLQIREQT

SEQ ID NO: 1237729 - protein, 9 aa, Homo Sapiens
ITYIGMIFG

SEQ ID NO: 1237730 - protein, 9 aa, Homo Sapiens
RERMTFTRA

SEQ ID NO: 1237731 - protein, 9 aa, Homo Sapiens
KRHALQDMA

SEQ ID NO: 1237732 - protein, 9 aa, Homo Sapiens
AEQEMVCMV

SEQ ID NO: 1237733 - protein, 9 aa, Homo Sapiens
VVMKEKCKF

SEQ ID NO: 1237734 - protein, 9 aa, Homo Sapiens
NDIIFTIDV

SEQ ID NO: 1237735 - protein, 9 aa, Homo Sapiens
CADTCQCVN

SEQ ID NO: 1237736 - protein, 9 aa, Homo Sapiens
DRGDILSYN

SEQ ID NO: 1237737 - protein, 9 aa, Homo Sapiens
LNGIIQGFR

SEQ ID NO: 1237738 - protein, 9 aa, Homo Sapiens
HLAAKYGYA

SEQ ID NO: 1237739 - protein, 9 aa, Homo Sapiens
HEDGTMRFW

SEQ ID NO: 1237740 - protein, 9 aa, Homo Sapiens
MTGLFTLCL

SEQ ID NO: 1237741 - protein, 9 aa, Homo Sapiens
QRQNQTWNR

SEQ ID NO: 1237742 - protein, 9 aa, Homo Sapiens
AERLHRNRE

SEQ ID NO: 1237743 - protein, 9 aa, Homo Sapiens
RESLQRCYS

SEQ ID NO: 1237744 - protein, 9 aa, Homo Sapiens
SRLKSFLLS

SEQ ID NO: 1237745 - protein, 9 aa, Homo Sapiens
SIMGLQTRT

SEQ ID NO: 1237746 - protein, 9 aa, Homo Sapiens
VVLKATVPF

SEQ ID NO: 1237747 - protein, 9 aa, Homo Sapiens
AKYREYITK

SEQ ID NO: 1237748 - protein, 9 aa, Homo Sapiens
DSTSQIIYR

SEQ ID NO: 1237749 - protein, 9 aa, Homo Sapiens
RREYDRIAK

SEQ ID NO: 1237750 - protein, 9 aa, Homo Sapiens
ISNQPNDEN

SEQ ID NO: 1237751 - protein, 9 aa, Homo Sapiens
LMMGISHQE

SEQ ID NO: 1237752 - protein, 9 aa, Homo Sapiens
VLRELRVEL

SEQ ID NO: 1237753 - protein, 9 aa, Homo Sapiens
FKTDMYLKS

SEQ ID NO: 1237754 - protein, 9 aa, Homo Sapiens
KSNTTTLAE

SEQ ID NO: 1237755 - protein, 9 aa, Homo Sapiens
FLSLSRHDE

SEQ ID NO: 1237756 - protein, 9 aa, Homo Sapiens
PVCTLSALE

SEQ ID NO: 1237757 - protein, 9 aa, Homo Sapiens
VEMQLMAAM

SEQ ID NO: 1237758 - protein, 9 aa, Homo Sapiens
IYQGHLLQD

SEQ ID NO: 1237759 - protein, 9 aa, Homo Sapiens
WTAECCMCN

SEQ ID NO: 1237760 - protein, 9 aa, Homo Sapiens
ILQESKSAV

SEQ ID NO: 1237761 - protein, 9 aa, Homo Sapiens
NLKMKETAL

SEQ ID NO: 1237762 - protein, 9 aa, Homo Sapiens
DSEPESDVF

SEQ ID NO: 1237763 - protein, 9 aa, Homo Sapiens
EWKSSQIGS

SEQ ID NO: 1237764 - protein, 9 aa, Homo Sapiens
TKCNGRRDA

SEQ ID NO: 1237765 - protein, 9 aa, Homo Sapiens
LVTTEPTSR

SEQ ID NO: 1237766 - protein, 9 aa, Homo Sapiens
EKVHYLQVP

SEQ ID NO: 1237767 - protein, 9 aa, Homo Sapiens
GVFGGPDSF

SEQ ID NO: 1237768 - protein, 9 aa, Homo Sapiens
PPGYESVSD

SEQ ID NO: 1237769 - protein, 9 aa, Homo Sapiens
EFSMTDFLL

SEQ ID NO: 1237770 - protein, 9 aa, Homo Sapiens
HLSQDHMVP

SEQ ID NO: 1237771 - protein, 9 aa, Homo Sapiens
GYGIGVGYC

SEQ ID NO: 1237772 - protein, 9 aa, Homo Sapiens
TNSLILEEN

SEQ ID NO: 1237773 - protein, 9 aa, Homo Sapiens
AEGRKKAFV

SEQ ID NO: 1237774 - protein, 9 aa, Homo Sapiens
MTLLYFVAS

SEQ ID NO: 1237775 - protein, 9 aa, Homo Sapiens
DMVCKPCAP

SEQ ID NO: 1237776 - protein, 9 aa, Homo Sapiens
VEYNNGPDG

SEQ ID NO: 1237777 - protein, 9 aa, Homo Sapiens
PDNLADYFK

SEQ ID NO: 1237778 - protein, 9 aa, Homo Sapiens
SIRPYQCHI

SEQ ID NO: 1237779 - protein, 9 aa, Homo Sapiens
VTTLTKKPD

SEQ ID NO: 1237780 - protein, 9 aa, Homo Sapiens
FLVVYMITL

SEQ ID NO: 1237781 - protein, 9 aa, Homo Sapiens
SGVKCTKSD

SEQ ID NO: 1237782 - protein, 9 aa, Homo Sapiens
DVKPKTLLL

SEQ ID NO: 1237783 - protein, 9 aa, Homo Sapiens
FYQFVHGQD

SEQ ID NO: 1237784 - protein, 9 aa, Homo Sapiens
VEDGTMYGN

SEQ ID NO: 1237785 - protein, 9 aa, Homo Sapiens
ESWPPAPLP

SEQ ID NO: 1237786 - protein, 9 aa, Homo Sapiens
IDICLKEIS

SEQ ID NO: 1237787 - protein, 9 aa, Homo Sapiens
GSCLSTSTV

SEQ ID NO: 1237788 - protein, 9 aa, Homo Sapiens
FVTDFCGQI

SEQ ID NO: 1237789 - protein, 9 aa, Homo Sapiens
QAKAISGIA

SEQ ID NO: 1237790 - protein, 9 aa, Homo Sapiens
RGFRITCSF

SEQ ID NO: 1237791 - protein, 9 aa, Homo Sapiens
TWTMLLSAY

SEQ ID NO: 1237792 - protein, 9 aa, Homo Sapiens
TDGPDGSGQ

SEQ ID NO: 1237793 - protein, 9 aa, Homo Sapiens
ILIRELDPL

SEQ ID NO: 1237794 - protein, 9 aa, Homo Sapiens
FKEGKNELQ

SEQ ID NO: 1237795 - protein, 9 aa, Homo Sapiens
ELEYSRILE

SEQ ID NO: 1237796 - protein, 9 aa, Homo Sapiens
EACYFRVQF

SEQ ID NO: 1237797 - protein, 9 aa, Homo Sapiens
QACHIRLTY

SEQ ID NO: 1237798 - protein, 9 aa, Homo Sapiens
RQREWEAAA

SEQ ID NO: 1237799 - protein, 9 aa, Homo Sapiens
LTFLALLDG

SEQ ID NO: 1237800 - protein, 9 aa, Homo Sapiens
NIFDFMICI

SEQ ID NO: 1237801 - protein, 9 aa, Homo Sapiens
HHEVQGNES

SEQ ID NO: 1237802 - protein, 9 aa, Homo Sapiens
NHIMHLDEH

SEQ ID NO: 1237803 - protein, 9 aa, Homo Sapiens
ILTSALENL

SEQ ID NO: 1237804 - protein, 9 aa, Homo Sapiens
SAYTLISPN

SEQ ID NO: 1237805 - protein, 9 aa, Homo Sapiens
HLSLAVGIA

SEQ ID NO: 1237806 - protein, 9 aa, Homo Sapiens
LLGGRCGKC

SEQ ID NO: 1237807 - protein, 9 aa, Homo Sapiens
KLHYVDVLT

SEQ ID NO: 1237808 - protein, 9 aa, Homo Sapiens
SILSMVCAD

SEQ ID NO: 1237809 - protein, 9 aa, Homo Sapiens
SNPESAASS

SEQ ID NO: 1237810 - protein, 9 aa, Homo Sapiens
APENSDGPN

SEQ ID NO: 1237811 - protein, 9 aa, Homo Sapiens
REEQRYHSL

SEQ ID NO: 1237812 - protein, 9 aa, Homo Sapiens
GIHIQKGPH

SEQ ID NO: 1237813 - protein, 9 aa, Homo Sapiens
KSKLAVSRD

SEQ ID NO: 1237814 - protein, 9 aa, Homo Sapiens
LERTRYSPI

SEQ ID NO: 1237815 - protein, 9 aa, Homo Sapiens
SGLVTSCKT

SEQ ID NO: 1237816 - protein, 9 aa, Homo Sapiens
TQLLHHPFI

SEQ ID NO: 1237817 - protein, 9 aa, Homo Sapiens
RHVSFGGHL

SEQ ID NO: 1237818 - protein, 9 aa, Homo Sapiens
VSVRTPEEN

SEQ ID NO: 1237819 - protein, 9 aa, Homo Sapiens
ETNHWRCML

SEQ ID NO: 1237820 - protein, 9 aa, Homo Sapiens
EDLEIGSHH

SEQ ID NO: 1237821 - protein, 9 aa, Homo Sapiens
ISDTCSRDT

SEQ ID NO: 1237822 - protein, 9 aa, Homo Sapiens
WRCCRKCHS

SEQ ID NO: 1237823 - protein, 9 aa, Homo Sapiens
KKPEPNARE

SEQ ID NO: 1237824 - protein, 9 aa, Homo Sapiens
QWRCQCLKD

SEQ ID NO: 1237825 - protein, 9 aa, Homo Sapiens
VDMQHFRYP

SEQ ID NO: 1237826 - protein, 9 aa, Homo Sapiens
IECLDCDME

SEQ ID NO: 1237827 - protein, 9 aa, Homo Sapiens
HPDLYLESD

SEQ ID NO: 1237828 - protein, 9 aa, Homo Sapiens
LMATEIERL

SEQ ID NO: 1237829 - protein, 9 aa, Homo Sapiens
RYMGRAVRM

SEQ ID NO: 1237830 - protein, 9 aa, Homo Sapiens
THLEFFLDG

SEQ ID NO: 1237831 - protein, 9 aa, Homo Sapiens
QWAILMDGF

SEQ ID NO: 1237832 - protein, 9 aa, Homo Sapiens
EPLHLIVEN

SEQ ID NO: 1237833 - protein, 9 aa, Homo Sapiens
TENLLKMRS

SEQ ID NO: 1237834 - protein, 9 aa, Homo Sapiens
CTNVCYDVF

SEQ ID NO: 1237835 - protein, 9 aa, Homo Sapiens
VKLHNDSSI

SEQ ID NO: 1237836 - protein, 9 aa, Homo Sapiens
TKSLQKTIQ

SEQ ID NO: 1237837 - protein, 9 aa, Homo Sapiens
PGKLALSKK

SEQ ID NO: 1237838 - protein, 9 aa, Homo Sapiens
VILAVMAYD

SEQ ID NO: 1237839 - protein, 9 aa, Homo Sapiens
HRYVNMTLP

SEQ ID NO: 1237840 - protein, 9 aa, Homo Sapiens
RASQTMVKC

SEQ ID NO: 1237841 - protein, 9 aa, Homo Sapiens
ELLTSNDPP

SEQ ID NO: 1237842 - protein, 9 aa, Homo Sapiens
PENVLLAST

SEQ ID NO: 1237843 - protein, 9 aa, Homo Sapiens
PGEVTSMSE

SEQ ID NO: 1237844 - protein, 9 aa, Homo Sapiens
LYQSTLRHL

SEQ ID NO: 1237845 - protein, 9 aa, Homo Sapiens
SVFLLMING

SEQ ID NO: 1237846 - protein, 9 aa, Homo Sapiens
SVPSYTIKV

SEQ ID NO: 1237847 - protein, 9 aa, Homo Sapiens
QEQLIPNLT

SEQ ID NO: 1237848 - protein, 9 aa, Homo Sapiens
AQDADVELE

SEQ ID NO: 1237849 - protein, 9 aa, Homo Sapiens
SVFAVTDVN

SEQ ID NO: 1237850 - protein, 9 aa, Homo Sapiens
PKLIMLPSS

SEQ ID NO: 1237851 - protein, 9 aa, Homo Sapiens
MECVDGGEL

SEQ ID NO: 1237852 - protein, 9 aa, Homo Sapiens
TYRTKQEGL

SEQ ID NO: 1237853 - protein, 9 aa, Homo Sapiens
PALQAQARQ

SEQ ID NO: 1237854 - protein, 9 aa, Homo Sapiens
SRDSDEYGD

SEQ ID NO: 1237855 - protein, 9 aa, Homo Sapiens
TPASQPCTP

SEQ ID NO: 1237856 - protein, 9 aa, Homo Sapiens
EGTVQLTSV

SEQ ID NO: 1237857 - protein, 9 aa, Homo Sapiens
VGPGPTATA

SEQ ID NO: 1237858 - protein, 9 aa, Homo Sapiens
LLGSSDHPI

SEQ ID NO: 1237859 - protein, 9 aa, Homo Sapiens
DVCAAVYQP

SEQ ID NO: 1237860 - protein, 9 aa, Homo Sapiens
LANQRYSIS

SEQ ID NO: 1237861 - protein, 9 aa, Homo Sapiens
HKMEEEHIY

SEQ ID NO: 1237862 - protein, 9 aa, Homo Sapiens
ILHSLGWTL

SEQ ID NO: 1237863 - protein, 9 aa, Homo Sapiens
SLYICLVEI

SEQ ID NO: 1237864 - protein, 9 aa, Homo Sapiens
SGMGYCRTG

SEQ ID NO: 1237865 - protein, 9 aa, Homo Sapiens
HATLKLFLS

SEQ ID NO: 1237866 - protein, 9 aa, Homo Sapiens
QHSGPDQQM

SEQ ID NO: 1237867 - protein, 9 aa, Homo Sapiens
MMDESVQHV

SEQ ID NO: 1237868 - protein, 9 aa, Homo Sapiens
AKLTSIDNH

SEQ ID NO: 1237869 - protein, 9 aa, Homo Sapiens
RPCQIHIGF

SEQ ID NO: 1237870 - protein, 9 aa, Homo Sapiens
TKPNPVTPY

SEQ ID NO: 1237871 - protein, 9 aa, Homo Sapiens
HFRGRSAAL

SEQ ID NO: 1237872 - protein, 9 aa, Homo Sapiens
LVYEATREF

SEQ ID NO: 1237873 - protein, 9 aa, Homo Sapiens
ESGDANDAR

SEQ ID NO: 1237874 - protein, 9 aa, Homo Sapiens
VLVISVCYI

SEQ ID NO: 1237875 - protein, 9 aa, Homo Sapiens
KYMEIHGAV

SEQ ID NO: 1237876 - protein, 9 aa, Homo Sapiens
DDIEKKLTS

SEQ ID NO: 1237877 - protein, 9 aa, Homo Sapiens
DANQGRRGR

SEQ ID NO: 1237878 - protein, 9 aa, Homo Sapiens
RAPLQLPLR

SEQ ID NO: 1237879 - protein, 9 aa, Homo Sapiens
VSSMRSWSS

SEQ ID NO: 1237880 - protein, 9 aa, Homo Sapiens
AVDISPGPT

SEQ ID NO: 1237881 - protein, 9 aa, Homo Sapiens
HKAHLTRCL

SEQ ID NO: 1237882 - protein, 9 aa, Homo Sapiens
MVVDIQRRY

SEQ ID NO: 1237883 - protein, 9 aa, Homo Sapiens
SYSPYVSPR

SEQ ID NO: 1237884 - protein, 9 aa, Homo Sapiens
HNYFGLMSE

SEQ ID NO: 1237885 - protein, 9 aa, Homo Sapiens
EDYLLSKLS

SEQ ID NO: 1237886 - protein, 9 aa, Homo Sapiens
EEISRSLRF

SEQ ID NO: 1237887 - protein, 9 aa, Homo Sapiens
KVSSISTET

SEQ ID NO: 1237888 - protein, 9 aa, Homo Sapiens
GETEKERLV

SEQ ID NO: 1237889 - protein, 9 aa, Homo Sapiens
RNRRAKKVA

SEQ ID NO: 1237890 - protein, 9 aa, Homo Sapiens
FVISNPDLI

SEQ ID NO: 1237891 - protein, 9 aa, Homo Sapiens
CGKAFEHFS

SEQ ID NO: 1237892 - protein, 9 aa, Homo Sapiens
KFFFWDYDN

SEQ ID NO: 1237893 - protein, 9 aa, Homo Sapiens
LRDHRYSRD

SEQ ID NO: 1237894 - protein, 9 aa, Homo Sapiens
IATHSPEEI

SEQ ID NO: 1237895 - protein, 9 aa, Homo Sapiens
YGDIFGNSF

SEQ ID NO: 1237896 - protein, 9 aa, Homo Sapiens
TLTRKMVLD

SEQ ID NO: 1237897 - protein, 9 aa, Homo Sapiens
CGYGGGLGG

SEQ ID NO: 1237898 - protein, 9 aa, Homo Sapiens
GHIKPIKFE

SEQ ID NO: 1237899 - protein, 9 aa, Homo Sapiens
SCNEDGYMS

SEQ ID NO: 1237900 - protein, 9 aa, Homo Sapiens
LILPQMSKA

SEQ ID NO: 1237901 - protein, 9 aa, Homo Sapiens
AQVDVGRDG

SEQ ID NO: 1237902 - protein, 9 aa, Homo Sapiens
DEEESWSTS

SEQ ID NO: 1237903 - protein, 9 aa, Homo Sapiens
KSRWRKEDG

SEQ ID NO: 1237904 - protein, 9 aa, Homo Sapiens
EKKAISFAG

SEQ ID NO: 1237905 - protein, 9 aa, Homo Sapiens
CDVCGSDPS

SEQ ID NO: 1237906 - protein, 9 aa, Homo Sapiens
EKTYGCNEC

SEQ ID NO: 1237907 - protein, 9 aa, Homo Sapiens
RSEMRLKHM

SEQ ID NO: 1237908 - protein, 9 aa, Homo Sapiens
IAPIPGTPW

SEQ ID NO: 1237909 - protein, 9 aa, Homo Sapiens
NLCHFCDDI

SEQ ID NO: 1237910 - protein, 9 aa, Homo Sapiens
KVVTKWKKM

SEQ ID NO: 1237911 - protein, 9 aa, Homo Sapiens
VNMIFAVVV

SEQ ID NO: 1237912 - protein, 9 aa, Homo Sapiens
LRVVVDRVP

SEQ ID NO: 1237913 - protein, 9 aa, Homo Sapiens
AIMPFINGD

SEQ ID NO: 1237914 - protein, 9 aa, Homo Sapiens
TPMAVICVV

SEQ ID NO: 1237915 - protein, 9 aa, Homo Sapiens
SNEVTKLVN

SEQ ID NO: 1237916 - protein, 9 aa, Homo Sapiens
AVTEMSGRI

SEQ ID NO: 1237917 - protein, 9 aa, Homo Sapiens
PPMATATRV

SEQ ID NO: 1237918 - protein, 9 aa, Homo Sapiens
CSVGATNMN

SEQ ID NO: 1237919 - protein, 9 aa, Homo Sapiens
EGYGQTEMV

SEQ ID NO: 1237920 - protein, 9 aa, Homo Sapiens
VHARAALDK

SEQ ID NO: 1237921 - protein, 9 aa, Homo Sapiens
DLSYCSLEH

SEQ ID NO: 1237922 - protein, 9 aa, Homo Sapiens
NGVTVKTDV

SEQ ID NO: 1237923 - protein, 9 aa, Homo Sapiens
VSNPNRNWD

SEQ ID NO: 1237924 - protein, 9 aa, Homo Sapiens
NKACRFTDV

SEQ ID NO: 1237925 - protein, 9 aa, Homo Sapiens
DELENDAAF

SEQ ID NO: 1237926 - protein, 9 aa, Homo Sapiens
GEKPYERSE

SEQ ID NO: 1237927 - protein, 9 aa, Homo Sapiens
KMSSDSHKD

SEQ ID NO: 1237928 - protein, 9 aa, Homo Sapiens
GPSGDVGAP

SEQ ID NO: 1237929 - protein, 9 aa, Homo Sapiens
LPPNLNELA

SEQ ID NO: 1237930 - protein, 9 aa, Homo Sapiens
SFAGLTKLD

SEQ ID NO: 1237931 - protein, 9 aa, Homo Sapiens
THIQAQTGT

SEQ ID NO: 1237932 - protein, 9 aa, Homo Sapiens
GSPFHREKE

SEQ ID NO: 1237933 - protein, 9 aa, Homo Sapiens
ARRIKTDFL

SEQ ID NO: 1237934 - protein, 9 aa, Homo Sapiens
YLHVANPVV

SEQ ID NO: 1237935 - protein, 9 aa, Homo Sapiens
MKLEQQSTG

SEQ ID NO: 1237936 - protein, 9 aa, Homo Sapiens
LVPTGTWKP

SEQ ID NO: 1237937 - protein, 9 aa, Homo Sapiens
HAHIVASFR

SEQ ID NO: 1237938 - protein, 9 aa, Homo Sapiens
KGDENFTKD

SEQ ID NO: 1237939 - protein, 9 aa, Homo Sapiens
SFYTVFTPP

SEQ ID NO: 1237940 - protein, 9 aa, Homo Sapiens
QSQIYGCSQ

SEQ ID NO: 1237941 - protein, 9 aa, Homo Sapiens
EPEDNNSTS

SEQ ID NO: 1237942 - protein, 9 aa, Homo Sapiens
QGKYQNKAR

SEQ ID NO: 1237943 - protein, 9 aa, Homo Sapiens
ASYCVLRLL

SEQ ID NO: 1237944 - protein, 9 aa, Homo Sapiens
QLHVELNVK

SEQ ID NO: 1237945 - protein, 9 aa, Homo Sapiens
KGAIKSVLS

SEQ ID NO: 1237946 - protein, 9 aa, Homo Sapiens
GTKSSRKSM

SEQ ID NO: 1237947 - protein, 9 aa, Homo Sapiens
PGQSTCQKE

SEQ ID NO: 1237948 - protein, 9 aa, Homo Sapiens
SRNIYHSHH

SEQ ID NO: 1237949 - protein, 9 aa, Homo Sapiens
TNILKGQAV

SEQ ID NO: 1237950 - protein, 9 aa, Homo Sapiens
KSSMGSKAI

SEQ ID NO: 1237951 - protein, 9 aa, Homo Sapiens
LQHPQQKAG

SEQ ID NO: 1237952 - protein, 9 aa, Homo Sapiens
PLAQSQDLS

SEQ ID NO: 1237953 - protein, 9 aa, Homo Sapiens
CKGALYKNL

SEQ ID NO: 1237954 - protein, 9 aa, Homo Sapiens
TGAWGPPAP

SEQ ID NO: 1237955 - protein, 9 aa, Homo Sapiens
SDNAVKILP

SEQ ID NO: 1237956 - protein, 9 aa, Homo Sapiens
YPITTTFIS

SEQ ID NO: 1237957 - protein, 9 aa, Homo Sapiens
HSGRCANGV

SEQ ID NO: 1237958 - protein, 9 aa, Homo Sapiens
ILHAKRQPL

SEQ ID NO: 1237959 - protein, 9 aa, Homo Sapiens
TGVPEDHIK

SEQ ID NO: 1237960 - protein, 9 aa, Homo Sapiens
LGGPPLKKM

SEQ ID NO: 1237961 - protein, 9 aa, Homo Sapiens
PKLMIYLLC

SEQ ID NO: 1237962 - protein, 9 aa, Homo Sapiens
KDINKNKNV

SEQ ID NO: 1237963 - protein, 9 aa, Homo Sapiens
IPSSEGASQ

SEQ ID NO: 1237964 - protein, 9 aa, Homo Sapiens
KCSVPPTQE

SEQ ID NO: 1237965 - protein, 9 aa, Homo Sapiens
DGCNGPAVG

SEQ ID NO: 1237966 - protein, 9 aa, Homo Sapiens
IPKKFRHPA

SEQ ID NO: 1237967 - protein, 9 aa, Homo Sapiens
KSLDVLKIH

SEQ ID NO: 1237968 - protein, 9 aa, Homo Sapiens
VTEDWSAAP

SEQ ID NO: 1237969 - protein, 9 aa, Homo Sapiens
RRLLRDISE

SEQ ID NO: 1237970 - protein, 9 aa, Homo Sapiens
GYFLIVTVW

SEQ ID NO: 1237971 - protein, 9 aa, Homo Sapiens
DAGPIAGLN

SEQ ID NO: 1237972 - protein, 9 aa, Homo Sapiens
HLLRTSPSW

SEQ ID NO: 1237973 - protein, 9 aa, Homo Sapiens
RHMRERHFH

SEQ ID NO: 1237974 - protein, 9 aa, Homo Sapiens
RALHSYALC

SEQ ID NO: 1237975 - protein, 9 aa, Homo Sapiens
EDYNPYQVP

SEQ ID NO: 1237976 - protein, 9 aa, Homo Sapiens
WDYDNAFLL

SEQ ID NO: 1237977 - protein, 9 aa, Homo Sapiens
NEIACLPQT

SEQ ID NO: 1237978 - protein, 9 aa, Homo Sapiens
GMPVQVDGE

SEQ ID NO: 1237979 - protein, 9 aa, Homo Sapiens
NPHTITGPP

SEQ ID NO: 1237980 - protein, 9 aa, Homo Sapiens
KSLFQRWYV

SEQ ID NO: 1237981 - protein, 9 aa, Homo Sapiens
GEPLPMPFN

SEQ ID NO: 1237982 - protein, 9 aa, Homo Sapiens
GEIPYECEE

SEQ ID NO: 1237983 - protein, 9 aa, Homo Sapiens
NSASASGCH

SEQ ID NO: 1237984 - protein, 9 aa, Homo Sapiens
LRAGPRPGG

SEQ ID NO: 1237985 - protein, 9 aa, Homo Sapiens
IGHSQSADW

SEQ ID NO: 1237986 - protein, 9 aa, Homo Sapiens
SSTGAEEIY

SEQ ID NO: 1237987 - protein, 9 aa, Homo Sapiens
VRADVNGER

SEQ ID NO: 1237988 - protein, 9 aa, Homo Sapiens
SHLKCTVEN

SEQ ID NO: 1237989 - protein, 9 aa, Homo Sapiens
FYRESLQRC

SEQ ID NO: 1237990 - protein, 9 aa, Homo Sapiens
QVMIGPSPN

SEQ ID NO: 1237991 - protein, 9 aa, Homo Sapiens
DEFVGESTT

SEQ ID NO: 1237992 - protein, 9 aa, Homo Sapiens
DDRVVLGTS

SEQ ID NO: 1237993 - protein, 9 aa, Homo Sapiens
HPLLMFSFF

SEQ ID NO: 1237994 - protein, 9 aa, Homo Sapiens
WPGWFMCGP

SEQ ID NO: 1237995 - protein, 9 aa, Homo Sapiens
YVNMDAWSR

SEQ ID NO: 1237996 - protein, 9 aa, Homo Sapiens
KSCGKHVED

SEQ ID NO: 1237997 - protein, 9 aa, Homo Sapiens
VCGEIQSFP

SEQ ID NO: 1237998 - protein, 9 aa, Homo Sapiens
IRIKEGCAY

SEQ ID NO: 1237999 - protein, 9 aa, Homo Sapiens
CDPGMTSFE

SEQ ID NO: 1238000 - protein, 9 aa, Homo Sapiens
NTLSITSEH

SEQ ID NO: 1238001 - protein, 9 aa, Homo Sapiens
FSSWGEVLF

SEQ ID NO: 1238002 - protein, 9 aa, Homo Sapiens
AFLLRMRRT

SEQ ID NO: 1238003 - protein, 9 aa, Homo Sapiens
KKGNEEKAV

SEQ ID NO: 1238004 - protein, 9 aa, Homo Sapiens
YAILQQLSL

SEQ ID NO: 1238005 - protein, 9 aa, Homo Sapiens
DEHFRQLLR

SEQ ID NO: 1238006 - protein, 9 aa, Homo Sapiens
AKCGDAEYV

SEQ ID NO: 1238007 - protein, 9 aa, Homo Sapiens
SPTSSSHNW

SEQ ID NO: 1238008 - protein, 9 aa, Homo Sapiens
QPTLSVTSN

SEQ ID NO: 1238009 - protein, 9 aa, Homo Sapiens
FYQLLLLGG

SEQ ID NO: 1238010 - protein, 9 aa, Homo Sapiens
VMFHVILSV

SEQ ID NO: 1238011 - protein, 9 aa, Homo Sapiens
CVKTCSCVG

SEQ ID NO: 1238012 - protein, 9 aa, Homo Sapiens
ECALGIGVY

SEQ ID NO: 1238013 - protein, 9 aa, Homo Sapiens
CIRHWTTKH

SEQ ID NO: 1238014 - protein, 9 aa, Homo Sapiens
RSHFSLNLL

SEQ ID NO: 1238015 - protein, 9 aa, Homo Sapiens
LQSCIQFQP

SEQ ID NO: 1238016 - protein, 9 aa, Homo Sapiens
KPIEPCREL

SEQ ID NO: 1238017 - protein, 9 aa, Homo Sapiens
AVPLPPHMA

SEQ ID NO: 1238018 - protein, 9 aa, Homo Sapiens
NIPCAAVRA

SEQ ID NO: 1238019 - protein, 9 aa, Homo Sapiens
ARTSAGEPG

SEQ ID NO: 1238020 - protein, 9 aa, Homo Sapiens
YVWIMKRKA

SEQ ID NO: 1238021 - protein, 9 aa, Homo Sapiens
FNPTLPPGR

SEQ ID NO: 1238022 - protein, 9 aa, Homo Sapiens
FVIFTVLSY

SEQ ID NO: 1238023 - protein, 9 aa, Homo Sapiens
ALHQASEDM

SEQ ID NO: 1238024 - protein, 9 aa, Homo Sapiens
VWRGKWWGE

SEQ ID NO: 1238025 - protein, 9 aa, Homo Sapiens
PCTRFNQGH

SEQ ID NO: 1238026 - protein, 9 aa, Homo Sapiens
ELWWFCLLW

SEQ ID NO: 1238027 - protein, 9 aa, Homo Sapiens
MITVHELNL

SEQ ID NO: 1238028 - protein, 9 aa, Homo Sapiens
SDAPKVETT

SEQ ID NO: 1238029 - protein, 9 aa, Homo Sapiens
DMFNFKRAH

SEQ ID NO: 1238030 - protein, 9 aa, Homo Sapiens
VVKSEGDED

SEQ ID NO: 1238031 - protein, 9 aa, Homo Sapiens
CALGREGRN

SEQ ID NO: 1238032 - protein, 9 aa, Homo Sapiens
VQVTTIQDW

SEQ ID NO: 1238033 - protein, 9 aa, Homo Sapiens
GESRSSGAV

SEQ ID NO: 1238034 - protein, 9 aa, Homo Sapiens
NKMAATKLN

SEQ ID NO: 1238035 - protein, 9 aa, Homo Sapiens
IEDEIEDPA

SEQ ID NO: 1238036 - protein, 9 aa, Homo Sapiens
ILYVTMTLE

SEQ ID NO: 1238037 - protein, 9 aa, Homo Sapiens
KTTLTRKMV

SEQ ID NO: 1238038 - protein, 9 aa, Homo Sapiens
HAPMGPYAR

SEQ ID NO: 1238039 - protein, 9 aa, Homo Sapiens
WEEQQQRQQ

SEQ ID NO: 1238040 - protein, 9 aa, Homo Sapiens
AALLLACSR

SEQ ID NO: 1238041 - protein, 9 aa, Homo Sapiens
DHVYSGAVN

SEQ ID NO: 1238042 - protein, 9 aa, Homo Sapiens
DLLQELFSE

SEQ ID NO: 1238043 - protein, 9 aa, Homo Sapiens
SISFSCSRT

SEQ ID NO: 1238044 - protein, 9 aa, Homo Sapiens
PAPAPAAVP

SEQ ID NO: 1238045 - protein, 9 aa, Homo Sapiens
RLFHRCRHQ

SEQ ID NO: 1238046 - protein, 9 aa, Homo Sapiens
KQLQQQHPN

SEQ ID NO: 1238047 - protein, 9 aa, Homo Sapiens
RDCDSEWKS

SEQ ID NO: 1238048 - protein, 9 aa, Homo Sapiens
FTRQEWDLT

SEQ ID NO: 1238049 - protein, 9 aa, Homo Sapiens
DVTAKLTSI

SEQ ID NO: 1238050 - protein, 9 aa, Homo Sapiens
KISVCGRSW

SEQ ID NO: 1238051 - protein, 9 aa, Homo Sapiens
HYVPSSGMS

SEQ ID NO: 1238052 - protein, 9 aa, Homo Sapiens
VFISKTNNH

SEQ ID NO: 1238053 - protein, 9 aa, Homo Sapiens
IVQAKVEML

SEQ ID NO: 1238054 - protein, 9 aa, Homo Sapiens
VVGAGYPVQ

SEQ ID NO: 1238055 - protein, 9 aa, Homo Sapiens
DVSEKAVAF

SEQ ID NO: 1238056 - protein, 9 aa, Homo Sapiens
LCLQGRLAA

SEQ ID NO: 1238057 - protein, 9 aa, Homo Sapiens
SFADEKFLR

SEQ ID NO: 1238058 - protein, 9 aa, Homo Sapiens
FTRKDDLVD

SEQ ID NO: 1238059 - protein, 9 aa, Homo Sapiens
FLNRFEEDK

SEQ ID NO: 1238060 - protein, 9 aa, Homo Sapiens
VPLLVTLLL

SEQ ID NO: 1238061 - protein, 9 aa, Homo Sapiens
PWRPLHTAG

SEQ ID NO: 1238062 - protein, 9 aa, Homo Sapiens
LFFDTSRHI

SEQ ID NO: 1238063 - protein, 9 aa, Homo Sapiens
WETHPLGCV

SEQ ID NO: 1238064 - protein, 9 aa, Homo Sapiens
VRAYANDTF

SEQ ID NO: 1238065 - protein, 9 aa, Homo Sapiens
FIKSNKHHM

SEQ ID NO: 1238066 - protein, 9 aa, Homo Sapiens
VAAAQRIGP

SEQ ID NO: 1238067 - protein, 9 aa, Homo Sapiens
DTTTSMRIG

SEQ ID NO: 1238068 - protein, 9 aa, Homo Sapiens
TLYQKKHGI

SEQ ID NO: 1238069 - protein, 9 aa, Homo Sapiens
VCISKKKTK

SEQ ID NO: 1238070 - protein, 9 aa, Homo Sapiens
NALKNPHLI

SEQ ID NO: 1238071 - protein, 9 aa, Homo Sapiens
TVPPLTPRP

SEQ ID NO: 1238072 - protein, 9 aa, Homo Sapiens
FWDQLCSLY

SEQ ID NO: 1238073 - protein, 9 aa, Homo Sapiens
SLEEISRSL

SEQ ID NO: 1238074 - protein, 9 aa, Homo Sapiens
TMLLRYSHH

SEQ ID NO: 1238075 - protein, 9 aa, Homo Sapiens
DSVTILASA

SEQ ID NO: 1238076 - protein, 9 aa, Homo Sapiens
EWFSEEAHR

SEQ ID NO: 1238077 - protein, 9 aa, Homo Sapiens
PGPPGVHGL

SEQ ID NO: 1238078 - protein, 9 aa, Homo Sapiens
GGMMREIRK

SEQ ID NO: 1238079 - protein, 9 aa, Homo Sapiens
KVEGGIWAV

SEQ ID NO: 1238080 - protein, 9 aa, Homo Sapiens
TTLNYLRDG

SEQ ID NO: 1238081 - protein, 9 aa, Homo Sapiens
RRKNETLIR

SEQ ID NO: 1238082 - protein, 9 aa, Homo Sapiens
KGPKTDAMA

SEQ ID NO: 1238083 - protein, 9 aa, Homo Sapiens
EAEQHQGPV

SEQ ID NO: 1238084 - protein, 9 aa, Homo Sapiens
LFMASSIIA

SEQ ID NO: 1238085 - protein, 9 aa, Homo Sapiens
LSHWENYNT

SEQ ID NO: 1238086 - protein, 9 aa, Homo Sapiens
RFLETTHQT

SEQ ID NO: 1238087 - protein, 9 aa, Homo Sapiens
RLDVHKVLS

SEQ ID NO: 1238088 - protein, 9 aa, Homo Sapiens
EGLDGSCVL

SEQ ID NO: 1238089 - protein, 9 aa, Homo Sapiens
GLSGAGKTM

SEQ ID NO: 1238090 - protein, 9 aa, Homo Sapiens
QQAKRRQKC

SEQ ID NO: 1238091 - protein, 9 aa, Homo Sapiens
GSSGNKHLS

SEQ ID NO: 1238092 - protein, 9 aa, Homo Sapiens
SSANGNGDL

SEQ ID NO: 1238093 - protein, 9 aa, Homo Sapiens
SSTYSNNES

SEQ ID NO: 1238094 - protein, 9 aa, Homo Sapiens
YEMVFDGKH

SEQ ID NO: 1238095 - protein, 9 aa, Homo Sapiens
IACILPVLM

SEQ ID NO: 1238096 - protein, 9 aa, Homo Sapiens
APAPISPKK

SEQ ID NO: 1238097 - protein, 9 aa, Homo Sapiens
SFMQVGCEL

SEQ ID NO: 1238098 - protein, 9 aa, Homo Sapiens
YLPTAECLT

SEQ ID NO: 1238099 - protein, 9 aa, Homo Sapiens
SRIGLRVYF

SEQ ID NO: 1238100 - protein, 9 aa, Homo Sapiens
FYYHLLLVG

SEQ ID NO: 1238101 - protein, 9 aa, Homo Sapiens
ASYHISSSL

SEQ ID NO: 1238102 - protein, 9 aa, Homo Sapiens
VGGHSHRGA

SEQ ID NO: 1238103 - protein, 9 aa, Homo Sapiens
RCLFLGDQT

SEQ ID NO: 1238104 - protein, 9 aa, Homo Sapiens
TGEKHYECI

SEQ ID NO: 1238105 - protein, 9 aa, Homo Sapiens
EAYNTWPIC

SEQ ID NO: 1238106 - protein, 9 aa, Homo Sapiens
ILMDMAFDR

SEQ ID NO: 1238107 - protein, 9 aa, Homo Sapiens
GGPNWGHLV

SEQ ID NO: 1238108 - protein, 9 aa, Homo Sapiens
ETEDTSFFV

SEQ ID NO: 1238109 - protein, 9 aa, Homo Sapiens
CDCKGFYKR

SEQ ID NO: 1238110 - protein, 9 aa, Homo Sapiens
TLLGYPEKR

SEQ ID NO: 1238111 - protein, 9 aa, Homo Sapiens
VARAHKQDE

SEQ ID NO: 1238112 - protein, 9 aa, Homo Sapiens
TAAAAAYGR

SEQ ID NO: 1238113 - protein, 9 aa, Homo Sapiens
VVKSSMPET

SEQ ID NO: 1238114 - protein, 9 aa, Homo Sapiens
ELPDDQVIT

SEQ ID NO: 1238115 - protein, 9 aa, Homo Sapiens
RGSILKTHK

SEQ ID NO: 1238116 - protein, 9 aa, Homo Sapiens
KDTSRCSEQ

SEQ ID NO: 1238117 - protein, 9 aa, Homo Sapiens
LGPNAWRPL

SEQ ID NO: 1238118 - protein, 9 aa, Homo Sapiens
DWGSPFHRE

SEQ ID NO: 1238119 - protein, 9 aa, Homo Sapiens
EGIVALHRA

SEQ ID NO: 1238120 - protein, 9 aa, Homo Sapiens
ELFKMFCTR

SEQ ID NO: 1238121 - protein, 9 aa, Homo Sapiens
TWPTQTWTR

SEQ ID NO: 1238122 - protein, 9 aa, Homo Sapiens
EKVSNKTYD

SEQ ID NO: 1238123 - protein, 9 aa, Homo Sapiens
PKDTTSIHL

SEQ ID NO: 1238124 - protein, 9 aa, Homo Sapiens
QLGVPSHHI

SEQ ID NO: 1238125 - protein, 9 aa, Homo Sapiens
DKTQLEQMY

SEQ ID NO: 1238126 - protein, 9 aa, Homo Sapiens
KYSSLTSKA

SEQ ID NO: 1238127 - protein, 9 aa, Homo Sapiens
QSISACAWP

SEQ ID NO: 1238128 - protein, 9 aa, Homo Sapiens
SSSTTTCSR

SEQ ID NO: 1238129 - protein, 9 aa, Homo Sapiens
STLVDAQLD

SEQ ID NO: 1238130 - protein, 9 aa, Homo Sapiens
VNVTAGVHH

SEQ ID NO: 1238131 - protein, 9 aa, Homo Sapiens
GNVLHCKIP

SEQ ID NO: 1238132 - protein, 9 aa, Homo Sapiens
PLLLPRTPR

SEQ ID NO: 1238133 - protein, 9 aa, Homo Sapiens
TPDEPQKSS

SEQ ID NO: 1238134 - protein, 9 aa, Homo Sapiens
IKPPLAPGT

SEQ ID NO: 1238135 - protein, 9 aa, Homo Sapiens
ADLCSVQDG

SEQ ID NO: 1238136 - protein, 9 aa, Homo Sapiens
DMEGMLHHF

SEQ ID NO: 1238137 - protein, 9 aa, Homo Sapiens
LLFYVTALF

SEQ ID NO: 1238138 - protein, 9 aa, Homo Sapiens
GSRTQTSKD

SEQ ID NO: 1238139 - protein, 9 aa, Homo Sapiens
GAGVLAGEP

SEQ ID NO: 1238140 - protein, 9 aa, Homo Sapiens
GMTTTLSSS

SEQ ID NO: 1238141 - protein, 9 aa, Homo Sapiens
MQHFRYPER

SEQ ID NO: 1238142 - protein, 9 aa, Homo Sapiens
ASNWLQSLP

SEQ ID NO: 1238143 - protein, 9 aa, Homo Sapiens
PVSPSHQRQ

SEQ ID NO: 1238144 - protein, 9 aa, Homo Sapiens
EDIRSLNPE

SEQ ID NO: 1238145 - protein, 9 aa, Homo Sapiens
YLQYPSTAV

SEQ ID NO: 1238146 - protein, 9 aa, Homo Sapiens
DQTWKRSRP

SEQ ID NO: 1238147 - protein, 9 aa, Homo Sapiens
MDMVLPEVA

SEQ ID NO: 1238148 - protein, 9 aa, Homo Sapiens
QTGPFWYEM

SEQ ID NO: 1238149 - protein, 9 aa, Homo Sapiens
DSDNEEEDD

SEQ ID NO: 1238150 - protein, 9 aa, Homo Sapiens
KLYPRYPLE

SEQ ID NO: 1238151 - protein, 9 aa, Homo Sapiens
IKSLFQRWY

SEQ ID NO: 1238152 - protein, 9 aa, Homo Sapiens
GGYGPVHMN

SEQ ID NO: 1238153 - protein, 9 aa, Homo Sapiens
QRKSRRKLR

SEQ ID NO: 1238154 - protein, 9 aa, Homo Sapiens
TAKPKDIAT

SEQ ID NO: 1238155 - protein, 9 aa, Homo Sapiens
DNNPEVTFH

SEQ ID NO: 1238156 - protein, 9 aa, Homo Sapiens
RGDGLKVFM

SEQ ID NO: 1238157 - protein, 9 aa, Homo Sapiens
RIDVDILRM

SEQ ID NO: 1238158 - protein, 9 aa, Homo Sapiens
YLFFDTSRH

SEQ ID NO: 1238159 - protein, 9 aa, Homo Sapiens
SQGRRPRTQ

SEQ ID NO: 1238160 - protein, 9 aa, Homo Sapiens
PSWDRRRQL

SEQ ID NO: 1238161 - protein, 9 aa, Homo Sapiens
RVETHSSST

SEQ ID NO: 1238162 - protein, 9 aa, Homo Sapiens
AAIRLREFI

SEQ ID NO: 1238163 - protein, 9 aa, Homo Sapiens
IEGIPETKE

SEQ ID NO: 1238164 - protein, 9 aa, Homo Sapiens
MGMALLAAS

SEQ ID NO: 1238165 - protein, 9 aa, Homo Sapiens
WVTRLSSLK

SEQ ID NO: 1238166 - protein, 9 aa, Homo Sapiens
MFKLLEQAL

SEQ ID NO: 1238167 - protein, 9 aa, Homo Sapiens
AHTPSVRKW

SEQ ID NO: 1238168 - protein, 9 aa, Homo Sapiens
IERPSYHLK

SEQ ID NO: 1238169 - protein, 9 aa, Homo Sapiens
EIFQRSEHI

SEQ ID NO: 1238170 - protein, 9 aa, Homo Sapiens
LLKALYTYK

SEQ ID NO: 1238171 - protein, 9 aa, Homo Sapiens
SFRWWRRRI

SEQ ID NO: 1238172 - protein, 9 aa, Homo Sapiens
AVPGFIGPQ

SEQ ID NO: 1238173 - protein, 9 aa, Homo Sapiens
TQCMPRKVC

SEQ ID NO: 1238174 - protein, 9 aa, Homo Sapiens
DQQLVELRA

SEQ ID NO: 1238175 - protein, 9 aa, Homo Sapiens
HRQRAVLEW

SEQ ID NO: 1238176 - protein, 9 aa, Homo Sapiens
RVTPVEGSK

SEQ ID NO: 1238177 - protein, 9 aa, Homo Sapiens
VEAAVRIGI

SEQ ID NO: 1238178 - protein, 9 aa, Homo Sapiens
KMECHDGIE

SEQ ID NO: 1238179 - protein, 9 aa, Homo Sapiens
AHLGYFPSS

SEQ ID NO: 1238180 - protein, 9 aa, Homo Sapiens
WPTMLDKSS

SEQ ID NO: 1238181 - protein, 9 aa, Homo Sapiens
YPASLPRCA

SEQ ID NO: 1238182 - protein, 9 aa, Homo Sapiens
KRYVQPQAQ

SEQ ID NO: 1238183 - protein, 9 aa, Homo Sapiens
SSRRNEDLD

SEQ ID NO: 1238184 - protein, 9 aa, Homo Sapiens
QDPKKPNRV

SEQ ID NO: 1238185 - protein, 9 aa, Homo Sapiens
LRKVTGLGM

SEQ ID NO: 1238186 - protein, 9 aa, Homo Sapiens
CRKNASISM

SEQ ID NO: 1238187 - protein, 9 aa, Homo Sapiens
ILERSRDVV

SEQ ID NO: 1238188 - protein, 9 aa, Homo Sapiens
YLRFTLTKL

SEQ ID NO: 1238189 - protein, 9 aa, Homo Sapiens
GGDCYIMSG

SEQ ID NO: 1238190 - protein, 9 aa, Homo Sapiens
AMLEVLSQK

SEQ ID NO: 1238191 - protein, 9 aa, Homo Sapiens
PDTHKQHGK

SEQ ID NO: 1238192 - protein, 9 aa, Homo Sapiens
STRVSSIPS

SEQ ID NO: 1238193 - protein, 9 aa, Homo Sapiens
GRLCEHCPT

SEQ ID NO: 1238194 - protein, 9 aa, Homo Sapiens
TITRTINEV

SEQ ID NO: 1238195 - protein, 9 aa, Homo Sapiens
VYCTFLDFS

SEQ ID NO: 1238196 - protein, 9 aa, Homo Sapiens
NLDEFLKKF

SEQ ID NO: 1238197 - protein, 9 aa, Homo Sapiens
RGTPGAPLP

SEQ ID NO: 1238198 - protein, 9 aa, Homo Sapiens
RCPRCMQYS

SEQ ID NO: 1238199 - protein, 9 aa, Homo Sapiens
NVLQYRGNS

SEQ ID NO: 1238200 - protein, 9 aa, Homo Sapiens
GGSALPNGL

SEQ ID NO: 1238201 - protein, 9 aa, Homo Sapiens
LRENCDINI

SEQ ID NO: 1238202 - protein, 9 aa, Homo Sapiens
ECGKAFEHF

SEQ ID NO: 1238203 - protein, 9 aa, Homo Sapiens
RGSTLPKCN

SEQ ID NO: 1238204 - protein, 9 aa, Homo Sapiens
HCLSLVIIS

SEQ ID NO: 1238205 - protein, 9 aa, Homo Sapiens
LIAFTGDIL

SEQ ID NO: 1238206 - protein, 9 aa, Homo Sapiens
SLSLAHRRF

SEQ ID NO: 1238207 - protein, 9 aa, Homo Sapiens
PVVFLVQDD

SEQ ID NO: 1238208 - protein, 9 aa, Homo Sapiens
SNTALHYSV

SEQ ID NO: 1238209 - protein, 9 aa, Homo Sapiens
EGSKKEDRG

SEQ ID NO: 1238210 - protein, 9 aa, Homo Sapiens
LATSSNSAF

SEQ ID NO: 1238211 - protein, 9 aa, Homo Sapiens
TEEAEETFE

SEQ ID NO: 1238212 - protein, 9 aa, Homo Sapiens
AHFLPLIYQ

SEQ ID NO: 1238213 - protein, 9 aa, Homo Sapiens
HLKMWEQKL

SEQ ID NO: 1238214 - protein, 9 aa, Homo Sapiens
WGVCRRSLD

SEQ ID NO: 1238215 - protein, 9 aa, Homo Sapiens
RESGLRTHT

SEQ ID NO: 1238216 - protein, 9 aa, Homo Sapiens
GARCGGNLL

SEQ ID NO: 1238217 - protein, 9 aa, Homo Sapiens
DSDVAVECD

SEQ ID NO: 1238218 - protein, 9 aa, Homo Sapiens
WGQWHLGAA

SEQ ID NO: 1238219 - protein, 9 aa, Homo Sapiens
GEGGTYTDG

SEQ ID NO: 1238220 - protein, 9 aa, Homo Sapiens
MMEGKAFLP

SEQ ID NO: 1238221 - protein, 9 aa, Homo Sapiens
KPVPRPGSG

SEQ ID NO: 1238222 - protein, 9 aa, Homo Sapiens
SLMVLEEED

SEQ ID NO: 1238223 - protein, 9 aa, Homo Sapiens
KCLAADGRG

SEQ ID NO: 1238224 - protein, 9 aa, Homo Sapiens
AGVTDEVLN

SEQ ID NO: 1238225 - protein, 9 aa, Homo Sapiens
GIIVRAFTV

SEQ ID NO: 1238226 - protein, 9 aa, Homo Sapiens
NMWHTYLSP

SEQ ID NO: 1238227 - protein, 9 aa, Homo Sapiens
RVNHMVVIH

SEQ ID NO: 1238228 - protein, 9 aa, Homo Sapiens
AGHWISRLS

SEQ ID NO: 1238229 - protein, 9 aa, Homo Sapiens
AVISLNITS

SEQ ID NO: 1238230 - protein, 9 aa, Homo Sapiens
RSASCKTGP

SEQ ID NO: 1238231 - protein, 9 aa, Homo Sapiens
GDVGTGKQW

SEQ ID NO: 1238232 - protein, 9 aa, Homo Sapiens
SVTYIEHPD

SEQ ID NO: 1238233 - protein, 9 aa, Homo Sapiens
QRYAADINI

SEQ ID NO: 1238234 - protein, 9 aa, Homo Sapiens
AAYGVENAF

SEQ ID NO: 1238235 - protein, 9 aa, Homo Sapiens
NLFIAQSIV

SEQ ID NO: 1238236 - protein, 9 aa, Homo Sapiens
KACQTLCNG

SEQ ID NO: 1238237 - protein, 9 aa, Homo Sapiens
IRHCSHSSS

SEQ ID NO: 1238238 - protein, 9 aa, Homo Sapiens
GKPVISAFV

SEQ ID NO: 1238239 - protein, 9 aa, Homo Sapiens
AHRRFHSTP

SEQ ID NO: 1238240 - protein, 9 aa, Homo Sapiens
CALYCGQGV

SEQ ID NO: 1238241 - protein, 9 aa, Homo Sapiens
SPDVPCLPV

SEQ ID NO: 1238242 - protein, 9 aa, Homo Sapiens
TMKQLQCWS

SEQ ID NO: 1238243 - protein, 9 aa, Homo Sapiens
IHKLRVTNT

SEQ ID NO: 1238244 - protein, 9 aa, Homo Sapiens
YKEDAHLLN

SEQ ID NO: 1238245 - protein, 9 aa, Homo Sapiens
TKGPSRLRL

SEQ ID NO: 1238246 - protein, 9 aa, Homo Sapiens
NTENKFQPK

SEQ ID NO: 1238247 - protein, 9 aa, Homo Sapiens
LEHWDEMLI

SEQ ID NO: 1238248 - protein, 9 aa, Homo Sapiens
AVEDAIACK

SEQ ID NO: 1238249 - protein, 9 aa, Homo Sapiens
PTGAKVALV

SEQ ID NO: 1238250 - protein, 9 aa, Homo Sapiens
HDRIFSYTG

SEQ ID NO: 1238251 - protein, 9 aa, Homo Sapiens
ERFYYQAMS

SEQ ID NO: 1238252 - protein, 9 aa, Homo Sapiens
IWMCRHPRP

SEQ ID NO: 1238253 - protein, 9 aa, Homo Sapiens
SYIFGKQTA

SEQ ID NO: 1238254 - protein, 9 aa, Homo Sapiens
GRGGPDRIA

SEQ ID NO: 1238255 - protein, 9 aa, Homo Sapiens
WSEQGIKDS

SEQ ID NO: 1238256 - protein, 9 aa, Homo Sapiens
MRITVKKLK

SEQ ID NO: 1238257 - protein, 9 aa, Homo Sapiens
ANDYNQKLK

SEQ ID NO: 1238258 - protein, 9 aa, Homo Sapiens
RLVQPRRSA

SEQ ID NO: 1238259 - protein, 9 aa, Homo Sapiens
WMATEAGPS

SEQ ID NO: 1238260 - protein, 9 aa, Homo Sapiens
TTHLHPQHC

SEQ ID NO: 1238261 - protein, 9 aa, Homo Sapiens
PQKPIRCGE

SEQ ID NO: 1238262 - protein, 9 aa, Homo Sapiens
EYQRIYTMK

SEQ ID NO: 1238263 - protein, 9 aa, Homo Sapiens
GIVSFVCEY

SEQ ID NO: 1238264 - protein, 9 aa, Homo Sapiens
LPVLCLACT

SEQ ID NO: 1238265 - protein, 9 aa, Homo Sapiens
LLPLPQLLL

SEQ ID NO: 1238266 - protein, 9 aa, Homo Sapiens
PPALPPVPG

SEQ ID NO: 1238267 - protein, 9 aa, Homo Sapiens
QTQVRALSW

SEQ ID NO: 1238268 - protein, 9 aa, Homo Sapiens
VGWYPFHDI

SEQ ID NO: 1238269 - protein, 9 aa, Homo Sapiens
VAKQLEKRH

SEQ ID NO: 1238270 - protein, 9 aa, Homo Sapiens
MVRCITSLL

SEQ ID NO: 1238271 - protein, 9 aa, Homo Sapiens
PMDAYTHVC

SEQ ID NO: 1238272 - protein, 9 aa, Homo Sapiens
IVQRMPAFL

SEQ ID NO: 1238273 - protein, 9 aa, Homo Sapiens
PQQPPPRLP

SEQ ID NO: 1238274 - protein, 9 aa, Homo Sapiens
PAPRTKQYS

SEQ ID NO: 1238275 - protein, 9 aa, Homo Sapiens
DTEETVTYT

SEQ ID NO: 1238276 - protein, 9 aa, Homo Sapiens
LLQIEVGPP

SEQ ID NO: 1238277 - protein, 9 aa, Homo Sapiens
QVTQSSVIL

SEQ ID NO: 1238278 - protein, 9 aa, Homo Sapiens
KEELHIQGV

SEQ ID NO: 1238279 - protein, 9 aa, Homo Sapiens
PYACGDCGH

SEQ ID NO: 1238280 - protein, 9 aa, Homo Sapiens
NVIYSIRIT

SEQ ID NO: 1238281 - protein, 9 aa, Homo Sapiens
ESIKNKISI

SEQ ID NO: 1238282 - protein, 9 aa, Homo Sapiens
DVDLHVYIV

SEQ ID NO: 1238283 - protein, 9 aa, Homo Sapiens
REPYGPLGG

SEQ ID NO: 1238284 - protein, 9 aa, Homo Sapiens
DFKHLDRPV

SEQ ID NO: 1238285 - protein, 9 aa, Homo Sapiens
GLITCMFKQ

SEQ ID NO: 1238286 - protein, 9 aa, Homo Sapiens
DSDTIIFQL

SEQ ID NO: 1238287 - protein, 9 aa, Homo Sapiens
ESVKSYKSY

SEQ ID NO: 1238288 - protein, 9 aa, Homo Sapiens
HRMIGLGLL

SEQ ID NO: 1238289 - protein, 9 aa, Homo Sapiens
HQYVKDVQF

SEQ ID NO: 1238290 - protein, 9 aa, Homo Sapiens
VHGSSVNRR

SEQ ID NO: 1238291 - protein, 9 aa, Homo Sapiens
YHIHRLCLS

SEQ ID NO: 1238292 - protein, 9 aa, Homo Sapiens
VIDGKEAKA

SEQ ID NO: 1238293 - protein, 9 aa, Homo Sapiens
MWVIEAKDL

SEQ ID NO: 1238294 - protein, 9 aa, Homo Sapiens
QQSEDDVHR

SEQ ID NO: 1238295 - protein, 9 aa, Homo Sapiens
TMPLESQTH

SEQ ID NO: 1238296 - protein, 9 aa, Homo Sapiens
SNPTQAFTN

SEQ ID NO: 1238297 - protein, 9 aa, Homo Sapiens
KDEEEEDDN

SEQ ID NO: 1238298 - protein, 9 aa, Homo Sapiens
VATTVCCYL

SEQ ID NO: 1238299 - protein, 9 aa, Homo Sapiens
PQLSLTLPQ

SEQ ID NO: 1238300 - protein, 9 aa, Homo Sapiens
NGLTRTPTM

SEQ ID NO: 1238301 - protein, 9 aa, Homo Sapiens
PSSGTESWP

SEQ ID NO: 1238302 - protein, 9 aa, Homo Sapiens
PRLQVLVSG

SEQ ID NO: 1238303 - protein, 9 aa, Homo Sapiens
LSAACPQEV

SEQ ID NO: 1238304 - protein, 9 aa, Homo Sapiens
LLGFSDYPH

SEQ ID NO: 1238305 - protein, 9 aa, Homo Sapiens
LTQPQPPVK

SEQ ID NO: 1238306 - protein, 9 aa, Homo Sapiens
AELIMYRKS

SEQ ID NO: 1238307 - protein, 9 aa, Homo Sapiens
VSERKRNIF

SEQ ID NO: 1238308 - protein, 9 aa, Homo Sapiens
STAKCLSIW

SEQ ID NO: 1238309 - protein, 9 aa, Homo Sapiens
DPSFITAVL

SEQ ID NO: 1238310 - protein, 9 aa, Homo Sapiens
PEPAQGAIG

SEQ ID NO: 1238311 - protein, 9 aa, Homo Sapiens
GSGGDGPWG

SEQ ID NO: 1238312 - protein, 9 aa, Homo Sapiens
CNKAKAQDG

SEQ ID NO: 1238313 - protein, 9 aa, Homo Sapiens
DMNAYLVEQ

SEQ ID NO: 1238314 - protein, 9 aa, Homo Sapiens
FNKDQLEEI

SEQ ID NO: 1238315 - protein, 9 aa, Homo Sapiens
TTVSLTSYT

SEQ ID NO: 1238316 - protein, 9 aa, Homo Sapiens
VHDLISREY

SEQ ID NO: 1238317 - protein, 9 aa, Homo Sapiens
AFSTTSNED

SEQ ID NO: 1238318 - protein, 9 aa, Homo Sapiens
INVKRFQKK

SEQ ID NO: 1238319 - protein, 9 aa, Homo Sapiens
ETLKYTLEL

SEQ ID NO: 1238320 - protein, 9 aa, Homo Sapiens
HFGVKHTTL

SEQ ID NO: 1238321 - protein, 9 aa, Homo Sapiens
PKQADVHAA

SEQ ID NO: 1238322 - protein, 9 aa, Homo Sapiens
CNRDISPTE

SEQ ID NO: 1238323 - protein, 9 aa, Homo Sapiens
HHGLTQKMI

SEQ ID NO: 1238324 - protein, 9 aa, Homo Sapiens
MSSNFIGLF

SEQ ID NO: 1238325 - protein, 9 aa, Homo Sapiens
REKIYRAFY

SEQ ID NO: 1238326 - protein, 9 aa, Homo Sapiens
PGGERGLWW

SEQ ID NO: 1238327 - protein, 9 aa, Homo Sapiens
ELEEHYSTL

SEQ ID NO: 1238328 - protein, 9 aa, Homo Sapiens
QCQENSDET

SEQ ID NO: 1238329 - protein, 9 aa, Homo Sapiens
SQGHVTFDD

SEQ ID NO: 1238330 - protein, 9 aa, Homo Sapiens
FLVQYLCNE

SEQ ID NO: 1238331 - protein, 9 aa, Homo Sapiens
LNITLDNRV

SEQ ID NO: 1238332 - protein, 9 aa, Homo Sapiens
HPHTTSCRH

SEQ ID NO: 1238333 - protein, 9 aa, Homo Sapiens
LVIYMPKVG

SEQ ID NO: 1238334 - protein, 9 aa, Homo Sapiens
VPFHPPPLH

SEQ ID NO: 1238335 - protein, 9 aa, Homo Sapiens
TVRVCDLLL

SEQ ID NO: 1238336 - protein, 9 aa, Homo Sapiens
AVLECDTLG

SEQ ID NO: 1238337 - protein, 9 aa, Homo Sapiens
VAVGVCWWL

SEQ ID NO: 1238338 - protein, 9 aa, Homo Sapiens
FTREVKAKL

SEQ ID NO: 1238339 - protein, 9 aa, Homo Sapiens
LERDTPDYL

SEQ ID NO: 1238340 - protein, 9 aa, Homo Sapiens
DPAGEMTKV

SEQ ID NO: 1238341 - protein, 9 aa, Homo Sapiens
IHCRRKNQR

SEQ ID NO: 1238342 - protein, 9 aa, Homo Sapiens
LRSVLGLHE

SEQ ID NO: 1238343 - protein, 9 aa, Homo Sapiens
WVFIPVYIA

SEQ ID NO: 1238344 - protein, 9 aa, Homo Sapiens
KVHLELLPP

SEQ ID NO: 1238345 - protein, 9 aa, Homo Sapiens
AKVHLELLP

SEQ ID NO: 1238346 - protein, 9 aa, Homo Sapiens
DNAPTLLAT

SEQ ID NO: 1238347 - protein, 9 aa, Homo Sapiens
RMELSALQS

SEQ ID NO: 1238348 - protein, 9 aa, Homo Sapiens
ILHSSLGKL

SEQ ID NO: 1238349 - protein, 9 aa, Homo Sapiens
ENGIVLDHL

SEQ ID NO: 1238350 - protein, 9 aa, Homo Sapiens
LYMAQTCDP

SEQ ID NO: 1238351 - protein, 9 aa, Homo Sapiens
GPNDTANSS

SEQ ID NO: 1238352 - protein, 9 aa, Homo Sapiens
LGSEAIPGG

SEQ ID NO: 1238353 - protein, 9 aa, Homo Sapiens
LLEDAQLQD

SEQ ID NO: 1238354 - protein, 9 aa, Homo Sapiens
SRSDNTLHL

SEQ ID NO: 1238355 - protein, 9 aa, Homo Sapiens
GFSMEQVQA

SEQ ID NO: 1238356 - protein, 9 aa, Homo Sapiens
IQDLQMKMR

SEQ ID NO: 1238357 - protein, 9 aa, Homo Sapiens
YEGKMKGCP

SEQ ID NO: 1238358 - protein, 9 aa, Homo Sapiens
VRMAIGLLD

SEQ ID NO: 1238359 - protein, 9 aa, Homo Sapiens
HITIAVMGW

SEQ ID NO: 1238360 - protein, 9 aa, Homo Sapiens
GIICLETFK

SEQ ID NO: 1238361 - protein, 9 aa, Homo Sapiens
GTGFWTGLG

SEQ ID NO: 1238362 - protein, 9 aa, Homo Sapiens
AAVAAGIPN

SEQ ID NO: 1238363 - protein, 9 aa, Homo Sapiens
ISSLVVHDE

SEQ ID NO: 1238364 - protein, 9 aa, Homo Sapiens
DTEEKRHRM

SEQ ID NO: 1238365 - protein, 9 aa, Homo Sapiens
ESYLHSHFI

SEQ ID NO: 1238366 - protein, 9 aa, Homo Sapiens
EVKRFRGLG

SEQ ID NO: 1238367 - protein, 9 aa, Homo Sapiens
IDGVNSIAR

SEQ ID NO: 1238368 - protein, 9 aa, Homo Sapiens
GGLTSVIYT

SEQ ID NO: 1238369 - protein, 9 aa, Homo Sapiens
DLFLLNGSS

SEQ ID NO: 1238370 - protein, 9 aa, Homo Sapiens
KLLVSLEWL

SEQ ID NO: 1238371 - protein, 9 aa, Homo Sapiens
RKVCENPKS

SEQ ID NO: 1238372 - protein, 9 aa, Homo Sapiens
EDGVPMLSI

SEQ ID NO: 1238373 - protein, 9 aa, Homo Sapiens
PTGTVIMLC

SEQ ID NO: 1238374 - protein, 9 aa, Homo Sapiens
LQMNAKYKA

SEQ ID NO: 1238375 - protein, 9 aa, Homo Sapiens
NDFAATRLF

SEQ ID NO: 1238376 - protein, 9 aa, Homo Sapiens
FLCVWMFIC

SEQ ID NO: 1238377 - protein, 9 aa, Homo Sapiens
DLGCCIKHY

SEQ ID NO: 1238378 - protein, 9 aa, Homo Sapiens
VFTYKAFNT

SEQ ID NO: 1238379 - protein, 9 aa, Homo Sapiens
DVRGHDTSI

SEQ ID NO: 1238380 - protein, 9 aa, Homo Sapiens
NGTLPACNG

SEQ ID NO: 1238381 - protein, 9 aa, Homo Sapiens
SLNEEEGIQ

SEQ ID NO: 1238382 - protein, 9 aa, Homo Sapiens
MNYLHNDAH

SEQ ID NO: 1238383 - protein, 9 aa, Homo Sapiens
CKGVSEKCS

SEQ ID NO: 1238384 - protein, 9 aa, Homo Sapiens
QMWLTQCRD

SEQ ID NO: 1238385 - protein, 9 aa, Homo Sapiens
IPIFRTSAL

SEQ ID NO: 1238386 - protein, 9 aa, Homo Sapiens
SHEYHECGE

SEQ ID NO: 1238387 - protein, 9 aa, Homo Sapiens
FYAWKRMDV

SEQ ID NO: 1238388 - protein, 9 aa, Homo Sapiens
EPENPEVKE

SEQ ID NO: 1238389 - protein, 9 aa, Homo Sapiens
IWMNQNAGF

SEQ ID NO: 1238390 - protein, 9 aa, Homo Sapiens
PVEGSKIGS

SEQ ID NO: 1238391 - protein, 9 aa, Homo Sapiens
ESVLKMCQP

SEQ ID NO: 1238392 - protein, 9 aa, Homo Sapiens
LLTFIGLLS

SEQ ID NO: 1238393 - protein, 9 aa, Homo Sapiens
RTTTSPDSG

SEQ ID NO: 1238394 - protein, 9 aa, Homo Sapiens
QDPKNVRMA

SEQ ID NO: 1238395 - protein, 9 aa, Homo Sapiens
EVEVQMRVM

SEQ ID NO: 1238396 - protein, 9 aa, Homo Sapiens
KFMDMMQIY

SEQ ID NO: 1238397 - protein, 9 aa, Homo Sapiens
KYLVYMLAA

SEQ ID NO: 1238398 - protein, 9 aa, Homo Sapiens
SLMSQLTCK

SEQ ID NO: 1238399 - protein, 9 aa, Homo Sapiens
RPPQNFSAT

SEQ ID NO: 1238400 - protein, 9 aa, Homo Sapiens
MFNANISYS

SEQ ID NO: 1238401 - protein, 9 aa, Homo Sapiens
GLRKGDVMI

SEQ ID NO: 1238402 - protein, 9 aa, Homo Sapiens
ALIGCFALL

SEQ ID NO: 1238403 - protein, 9 aa, Homo Sapiens
SHRDKLCLM

SEQ ID NO: 1238404 - protein, 9 aa, Homo Sapiens
GTESWPPAP

SEQ ID NO: 1238405 - protein, 9 aa, Homo Sapiens
EEDAVPEMN

SEQ ID NO: 1238406 - protein, 9 aa, Homo Sapiens
KVTKDLEMR

SEQ ID NO: 1238407 - protein, 9 aa, Homo Sapiens
VMERSKTCG

SEQ ID NO: 1238408 - protein, 9 aa, Homo Sapiens
EPSSSLPTS

SEQ ID NO: 1238409 - protein, 9 aa, Homo Sapiens
ATAAAAAYG

SEQ ID NO: 1238410 - protein, 9 aa, Homo Sapiens
NGCLGHGNL

SEQ ID NO: 1238411 - protein, 9 aa, Homo Sapiens
VTVITGGAS

SEQ ID NO: 1238412 - protein, 9 aa, Homo Sapiens
LYMDAIRFL

SEQ ID NO: 1238413 - protein, 9 aa, Homo Sapiens
TPERIDPSA

SEQ ID NO: 1238414 - protein, 9 aa, Homo Sapiens
QTIEQNSEA

SEQ ID NO: 1238415 - protein, 9 aa, Homo Sapiens
AARPIHNLG

SEQ ID NO: 1238416 - protein, 9 aa, Homo Sapiens
CTKIQRDTH

SEQ ID NO: 1238417 - protein, 9 aa, Homo Sapiens
REAQVDVLT

SEQ ID NO: 1238418 - protein, 9 aa, Homo Sapiens
GLDGRSRGC

SEQ ID NO: 1238419 - protein, 9 aa, Homo Sapiens
LAICYDAFG

SEQ ID NO: 1238420 - protein, 9 aa, Homo Sapiens
GGSESQGEE

SEQ ID NO: 1238421 - protein, 9 aa, Homo Sapiens
HERKQLVIY

SEQ ID NO: 1238422 - protein, 9 aa, Homo Sapiens
ACMQGQQGA

SEQ ID NO: 1238423 - protein, 9 aa, Homo Sapiens
KPVLPVSPA

SEQ ID NO: 1238424 - protein, 9 aa, Homo Sapiens
ASIHDMNDK

SEQ ID NO: 1238425 - protein, 9 aa, Homo Sapiens
GRKIYEPPQ

SEQ ID NO: 1238426 - protein, 9 aa, Homo Sapiens
VSVTAAAEP

SEQ ID NO: 1238427 - protein, 9 aa, Homo Sapiens
TDILYTVAI

SEQ ID NO: 1238428 - protein, 9 aa, Homo Sapiens
KILNKWDML

SEQ ID NO: 1238429 - protein, 9 aa, Homo Sapiens
EQPDYDLDT

SEQ ID NO: 1238430 - protein, 9 aa, Homo Sapiens
TSVKIECHS

SEQ ID NO: 1238431 - protein, 9 aa, Homo Sapiens
PGTQKSRVP

SEQ ID NO: 1238432 - protein, 9 aa, Homo Sapiens
GEDGIFLLG

SEQ ID NO: 1238433 - protein, 9 aa, Homo Sapiens
ADGTMRIGE

SEQ ID NO: 1238434 - protein, 9 aa, Homo Sapiens
LEPCIPPVP

SEQ ID NO: 1238435 - protein, 9 aa, Homo Sapiens
ETEISGRVH

SEQ ID NO: 1238436 - protein, 9 aa, Homo Sapiens
SHHLGFLWA

SEQ ID NO: 1238437 - protein, 9 aa, Homo Sapiens
LDLSELEGM

SEQ ID NO: 1238438 - protein, 9 aa, Homo Sapiens
RHNQQKPLP

SEQ ID NO: 1238439 - protein, 9 aa, Homo Sapiens
YETIAKHNQ

SEQ ID NO: 1238440 - protein, 9 aa, Homo Sapiens
QLVAPTQYH

SEQ ID NO: 1238441 - protein, 9 aa, Homo Sapiens
NVDYQYQLL

SEQ ID NO: 1238442 - protein, 9 aa, Homo Sapiens
GYGVASYFI

SEQ ID NO: 1238443 - protein, 9 aa, Homo Sapiens
LLLFLTQPG

SEQ ID NO: 1238444 - protein, 9 aa, Homo Sapiens
AESEALHSL

SEQ ID NO: 1238445 - protein, 9 aa, Homo Sapiens
TGKTTLTRK

SEQ ID NO: 1238446 - protein, 9 aa, Homo Sapiens
GDELADSVL

SEQ ID NO: 1238447 - protein, 9 aa, Homo Sapiens
PPLIHVQCT

SEQ ID NO: 1238448 - protein, 9 aa, Homo Sapiens
ETETVSDLA

SEQ ID NO: 1238449 - protein, 9 aa, Homo Sapiens
RMCRIIAED

SEQ ID NO: 1238450 - protein, 9 aa, Homo Sapiens
HLRFPDNDS

SEQ ID NO: 1238451 - protein, 9 aa, Homo Sapiens
EKKQPDEEH

SEQ ID NO: 1238452 - protein, 9 aa, Homo Sapiens
GYDECAVLC

SEQ ID NO: 1238453 - protein, 9 aa, Homo Sapiens
ECGRRGSKK

SEQ ID NO: 1238454 - protein, 9 aa, Homo Sapiens
LHTAGGGGG

SEQ ID NO: 1238455 - protein, 9 aa, Homo Sapiens
QPLFQPMDH

SEQ ID NO: 1238456 - protein, 9 aa, Homo Sapiens
CNPQKTVPG

SEQ ID NO: 1238457 - protein, 9 aa, Homo Sapiens
PPKSVDQYR

SEQ ID NO: 1238458 - protein, 9 aa, Homo Sapiens
GLPLAPQPL

SEQ ID NO: 1238459 - protein, 9 aa, Homo Sapiens
CYIIEHIDL

SEQ ID NO: 1238460 - protein, 9 aa, Homo Sapiens
YQGHLLQDP

SEQ ID NO: 1238461 - protein, 9 aa, Homo Sapiens
CLRNHQGTL

SEQ ID NO: 1238462 - protein, 9 aa, Homo Sapiens
GSNLSELDH

SEQ ID NO: 1238463 - protein, 9 aa, Homo Sapiens
VNKMAATKL

SEQ ID NO: 1238464 - protein, 9 aa, Homo Sapiens
FMYSKATRM

SEQ ID NO: 1238465 - protein, 9 aa, Homo Sapiens
TFQIDDYSL

SEQ ID NO: 1238466 - protein, 9 aa, Homo Sapiens
LLKWVQYTS

SEQ ID NO: 1238467 - protein, 9 aa, Homo Sapiens
VLNTQRAGY

SEQ ID NO: 1238468 - protein, 9 aa, Homo Sapiens
QKPIPLEQH

SEQ ID NO: 1238469 - protein, 9 aa, Homo Sapiens
ESLHYKVLI

SEQ ID NO: 1238470 - protein, 9 aa, Homo Sapiens
CRVAVCFLA

SEQ ID NO: 1238471 - protein, 9 aa, Homo Sapiens
LHGKKEVYD

SEQ ID NO: 1238472 - protein, 9 aa, Homo Sapiens
AGMNISLTI

SEQ ID NO: 1238473 - protein, 9 aa, Homo Sapiens
PGFMTLRNP

SEQ ID NO: 1238474 - protein, 9 aa, Homo Sapiens
VQVINYPTV

SEQ ID NO: 1238475 - protein, 9 aa, Homo Sapiens
NMFNTILTT

SEQ ID NO: 1238476 - protein, 9 aa, Homo Sapiens
WQQATMALL

SEQ ID NO: 1238477 - protein, 9 aa, Homo Sapiens
EKFLRRNDP

SEQ ID NO: 1238478 - protein, 9 aa, Homo Sapiens
SPYAYQGFP

SEQ ID NO: 1238479 - protein, 9 aa, Homo Sapiens
PPTETNSLI

SEQ ID NO: 1238480 - protein, 9 aa, Homo Sapiens
LRERDHLLA

SEQ ID NO: 1238481 - protein, 9 aa, Homo Sapiens
QVVVGAPGG

SEQ ID NO: 1238482 - protein, 9 aa, Homo Sapiens
LLQTMYLSF

SEQ ID NO: 1238483 - protein, 9 aa, Homo Sapiens
QPREIRQSA

SEQ ID NO: 1238484 - protein, 9 aa, Homo Sapiens
SLKDGIVFL

SEQ ID NO: 1238485 - protein, 9 aa, Homo Sapiens
LKYVAAMPP

SEQ ID NO: 1238486 - protein, 9 aa, Homo Sapiens
FRPDIYPYF

SEQ ID NO: 1238487 - protein, 9 aa, Homo Sapiens
AAAATAAAF

SEQ ID NO: 1238488 - protein, 9 aa, Homo Sapiens
TRGECVIDA

SEQ ID NO: 1238489 - protein, 9 aa, Homo Sapiens
KIHTGETVH

SEQ ID NO: 1238490 - protein, 9 aa, Homo Sapiens
RILMVGMDA

SEQ ID NO: 1238491 - protein, 9 aa, Homo Sapiens
RGHPGFKGS

SEQ ID NO: 1238492 - protein, 9 aa, Homo Sapiens
LMFWREFTA

SEQ ID NO: 1238493 - protein, 9 aa, Homo Sapiens
RHRHMFVKQ

SEQ ID NO: 1238494 - protein, 9 aa, Homo Sapiens
NLDGQERCV

SEQ ID NO: 1238495 - protein, 9 aa, Homo Sapiens
MGRTGRKHQ

SEQ ID NO: 1238496 - protein, 9 aa, Homo Sapiens
GYPMIEIVY

SEQ ID NO: 1238497 - protein, 9 aa, Homo Sapiens
DEKPEYISD

SEQ ID NO: 1238498 - protein, 9 aa, Homo Sapiens
IPLSNFVTD

SEQ ID NO: 1238499 - protein, 9 aa, Homo Sapiens
NHEALAKWA

SEQ ID NO: 1238500 - protein, 9 aa, Homo Sapiens
KRISNHFQG

SEQ ID NO: 1238501 - protein, 9 aa, Homo Sapiens
IYEPENPEV

SEQ ID NO: 1238502 - protein, 9 aa, Homo Sapiens
CCPYCHRCK

SEQ ID NO: 1238503 - protein, 9 aa, Homo Sapiens
LIMLFLLKL

SEQ ID NO: 1238504 - protein, 9 aa, Homo Sapiens
CPAPCHDQV

SEQ ID NO: 1238505 - protein, 9 aa, Homo Sapiens
RTGPLQRGG

SEQ ID NO: 1238506 - protein, 9 aa, Homo Sapiens
EQDKEMVRV

SEQ ID NO: 1238507 - protein, 9 aa, Homo Sapiens
MHSWLEPTP

SEQ ID NO: 1238508 - protein, 9 aa, Homo Sapiens
GVKVWYLEE

SEQ ID NO: 1238509 - protein, 9 aa, Homo Sapiens
EHYAQENFK

SEQ ID NO: 1238510 - protein, 9 aa, Homo Sapiens
DRIKFIIGK

SEQ ID NO: 1238511 - protein, 9 aa, Homo Sapiens
VALPHLFHT

SEQ ID NO: 1238512 - protein, 9 aa, Homo Sapiens
FEDFVCYLG

SEQ ID NO: 1238513 - protein, 9 aa, Homo Sapiens
LQYCFEEKS

SEQ ID NO: 1238514 - protein, 9 aa, Homo Sapiens
GLMVKRGRL

SEQ ID NO: 1238515 - protein, 9 aa, Homo Sapiens
LDLHNTTAS

SEQ ID NO: 1238516 - protein, 9 aa, Homo Sapiens
LLKKGTWRH

SEQ ID NO: 1238517 - protein, 9 aa, Homo Sapiens
GEGHGLVCD

SEQ ID NO: 1238518 - protein, 9 aa, Homo Sapiens
SWQTADIST

SEQ ID NO: 1238519 - protein, 9 aa, Homo Sapiens
FCKFCMMKL

SEQ ID NO: 1238520 - protein, 9 aa, Homo Sapiens
KRDHSLIKP

SEQ ID NO: 1238521 - protein, 9 aa, Homo Sapiens
VLLMGGASG

SEQ ID NO: 1238522 - protein, 9 aa, Homo Sapiens
NLTVSSEEK

SEQ ID NO: 1238523 - protein, 9 aa, Homo Sapiens
YFFVERKII

SEQ ID NO: 1238524 - protein, 9 aa, Homo Sapiens
HAISMDLLR

SEQ ID NO: 1238525 - protein, 9 aa, Homo Sapiens
SDIFDCLEG

SEQ ID NO: 1238526 - protein, 9 aa, Homo Sapiens
PGTLPGSSV

SEQ ID NO: 1238527 - protein, 9 aa, Homo Sapiens
QLKENQKKT

SEQ ID NO: 1238528 - protein, 9 aa, Homo Sapiens
YMAQTCDPA

SEQ ID NO: 1238529 - protein, 9 aa, Homo Sapiens
LITLAEGLI

SEQ ID NO: 1238530 - protein, 9 aa, Homo Sapiens
ESDGRIHKC

SEQ ID NO: 1238531 - protein, 9 aa, Homo Sapiens
DLKAKGVQV

SEQ ID NO: 1238532 - protein, 9 aa, Homo Sapiens
GAQVQLQHL

SEQ ID NO: 1238533 - protein, 9 aa, Homo Sapiens
HINRYISDT

SEQ ID NO: 1238534 - protein, 9 aa, Homo Sapiens
LHLETLVQK

SEQ ID NO: 1238535 - protein, 9 aa, Homo Sapiens
EYCSTFQLG

SEQ ID NO: 1238536 - protein, 9 aa, Homo Sapiens
LPTLPATQY

SEQ ID NO: 1238537 - protein, 9 aa, Homo Sapiens
PNGCISPLA

SEQ ID NO: 1238538 - protein, 9 aa, Homo Sapiens
VMNSAQSSI

SEQ ID NO: 1238539 - protein, 9 aa, Homo Sapiens
TCGVHNLHS

SEQ ID NO: 1238540 - protein, 9 aa, Homo Sapiens
NGLTPDAAR

SEQ ID NO: 1238541 - protein, 9 aa, Homo Sapiens
NILVNTLYT

SEQ ID NO: 1238542 - protein, 9 aa, Homo Sapiens
QDLEKELGS

SEQ ID NO: 1238543 - protein, 9 aa, Homo Sapiens
LTMDTALTA

SEQ ID NO: 1238544 - protein, 9 aa, Homo Sapiens
YAALSLLWA

SEQ ID NO: 1238545 - protein, 9 aa, Homo Sapiens
FVVGIFGNN

SEQ ID NO: 1238546 - protein, 9 aa, Homo Sapiens
SLTVLLASS

SEQ ID NO: 1238547 - protein, 9 aa, Homo Sapiens
HRQCKEGEN

SEQ ID NO: 1238548 - protein, 9 aa, Homo Sapiens
NRIQVRSIQ

SEQ ID NO: 1238549 - protein, 9 aa, Homo Sapiens
MTCSSCHRP

SEQ ID NO: 1238550 - protein, 9 aa, Homo Sapiens
EVEPHLVYC

SEQ ID NO: 1238551 - protein, 9 aa, Homo Sapiens
MRAQIPEPL

SEQ ID NO: 1238552 - protein, 9 aa, Homo Sapiens
RMMVQKERG

SEQ ID NO: 1238553 - protein, 9 aa, Homo Sapiens
GDLLLPPAP

SEQ ID NO: 1238554 - protein, 9 aa, Homo Sapiens
KEAFPGRRA

SEQ ID NO: 1238555 - protein, 9 aa, Homo Sapiens
HDTSIYVCR

SEQ ID NO: 1238556 - protein, 9 aa, Homo Sapiens
LQSQPKESQ

SEQ ID NO: 1238557 - protein, 9 aa, Homo Sapiens
SREELPYNF

SEQ ID NO: 1238558 - protein, 9 aa, Homo Sapiens
LDTRFLVMA

SEQ ID NO: 1238559 - protein, 9 aa, Homo Sapiens
LEQVMIGPS

SEQ ID NO: 1238560 - protein, 9 aa, Homo Sapiens
WAWIRVALM

SEQ ID NO: 1238561 - protein, 9 aa, Homo Sapiens
KWDDYRVGF

SEQ ID NO: 1238562 - protein, 9 aa, Homo Sapiens
SIYKNILSE

SEQ ID NO: 1238563 - protein, 9 aa, Homo Sapiens
NGSAGVKVW

SEQ ID NO: 1238564 - protein, 9 aa, Homo Sapiens
LFLGMGVLF

SEQ ID NO: 1238565 - protein, 9 aa, Homo Sapiens
EPGLQVRAD

SEQ ID NO: 1238566 - protein, 9 aa, Homo Sapiens
RRCSDGKSR

SEQ ID NO: 1238567 - protein, 9 aa, Homo Sapiens
IKEQNPNAT

SEQ ID NO: 1238568 - protein, 9 aa, Homo Sapiens
ISSRRNEDL

SEQ ID NO: 1238569 - protein, 9 aa, Homo Sapiens
LAARYMCDV

SEQ ID NO: 1238570 - protein, 9 aa, Homo Sapiens
KLIRTGAWG

SEQ ID NO: 1238571 - protein, 9 aa, Homo Sapiens
CGGHKDSKT

SEQ ID NO: 1238572 - protein, 9 aa, Homo Sapiens
HKLEIKVKR

SEQ ID NO: 1238573 - protein, 9 aa, Homo Sapiens
FDRYSGYRW

SEQ ID NO: 1238574 - protein, 9 aa, Homo Sapiens
SYSMEQDKI

SEQ ID NO: 1238575 - protein, 9 aa, Homo Sapiens
TNLFPIKII

SEQ ID NO: 1238576 - protein, 9 aa, Homo Sapiens
CVLMLLYSS

SEQ ID NO: 1238577 - protein, 9 aa, Homo Sapiens
NIVLGSGQA

SEQ ID NO: 1238578 - protein, 9 aa, Homo Sapiens
VFWVRSKRS

SEQ ID NO: 1238579 - protein, 9 aa, Homo Sapiens
MHISCPQEM

SEQ ID NO: 1238580 - protein, 9 aa, Homo Sapiens
LYVTMTLEL

SEQ ID NO: 1238581 - protein, 9 aa, Homo Sapiens
HRIGQTKSV

SEQ ID NO: 1238582 - protein, 9 aa, Homo Sapiens
THDEEEGGA

SEQ ID NO: 1238583 - protein, 9 aa, Homo Sapiens
NPIGVGCVD

SEQ ID NO: 1238584 - protein, 9 aa, Homo Sapiens
VMDGLHGSH

SEQ ID NO: 1238585 - protein, 9 aa, Homo Sapiens
NQTNGHPHC

SEQ ID NO: 1238586 - protein, 9 aa, Homo Sapiens
TMNWAENGG

SEQ ID NO: 1238587 - protein, 9 aa, Homo Sapiens
AVAVKAAQG

SEQ ID NO: 1238588 - protein, 9 aa, Homo Sapiens
VIRQSLPNR

SEQ ID NO: 1238589 - protein, 9 aa, Homo Sapiens
DWHVRHYRP

SEQ ID NO: 1238590 - protein, 9 aa, Homo Sapiens
AVTLARQDG

SEQ ID NO: 1238591 - protein, 9 aa, Homo Sapiens
CGALERGTG

SEQ ID NO: 1238592 - protein, 9 aa, Homo Sapiens
LVFKVLHDK

SEQ ID NO: 1238593 - protein, 9 aa, Homo Sapiens
KRKKKGGKV

SEQ ID NO: 1238594 - protein, 9 aa, Homo Sapiens
QNRLAPPVH

SEQ ID NO: 1238595 - protein, 9 aa, Homo Sapiens
CCRTTPSWC

SEQ ID NO: 1238596 - protein, 9 aa, Homo Sapiens
DAAPPVGLN

SEQ ID NO: 1238597 - protein, 9 aa, Homo Sapiens
AGIFYILVG

SEQ ID NO: 1238598 - protein, 9 aa, Homo Sapiens
LVAGSQEYV

SEQ ID NO: 1238599 - protein, 9 aa, Homo Sapiens
PGDAPDYDR

SEQ ID NO: 1238600 - protein, 9 aa, Homo Sapiens
WKSSQIGSC

SEQ ID NO: 1238601 - protein, 9 aa, Homo Sapiens
GVARFSVIF

SEQ ID NO: 1238602 - protein, 9 aa, Homo Sapiens
PAAEEGPVS

SEQ ID NO: 1238603 - protein, 9 aa, Homo Sapiens
NKFLARMFK

SEQ ID NO: 1238604 - protein, 9 aa, Homo Sapiens
GPNWGHLVA

SEQ ID NO: 1238605 - protein, 9 aa, Homo Sapiens
CTAVVYRPC

SEQ ID NO: 1238606 - protein, 9 aa, Homo Sapiens
WLQFDFQEA

SEQ ID NO: 1238607 - protein, 9 aa, Homo Sapiens
QRTPPSEEH

SEQ ID NO: 1238608 - protein, 9 aa, Homo Sapiens
CPTLIYSGL

SEQ ID NO: 1238609 - protein, 9 aa, Homo Sapiens
HSNPPPYPS

SEQ ID NO: 1238610 - protein, 9 aa, Homo Sapiens
GELKMLQDE

SEQ ID NO: 1238611 - protein, 9 aa, Homo Sapiens
QPSVDGDDN

SEQ ID NO: 1238612 - protein, 9 aa, Homo Sapiens
WGSSLIIHK

SEQ ID NO: 1238613 - protein, 9 aa, Homo Sapiens
SHPLSYKWA

SEQ ID NO: 1238614 - protein, 9 aa, Homo Sapiens
DSDHTELGF

SEQ ID NO: 1238615 - protein, 9 aa, Homo Sapiens
QTQKRSFRT

SEQ ID NO: 1238616 - protein, 9 aa, Homo Sapiens
RFMYPKEWH

SEQ ID NO: 1238617 - protein, 9 aa, Homo Sapiens
SCMVLEEEE

SEQ ID NO: 1238618 - protein, 9 aa, Homo Sapiens
PETGVWLLE

SEQ ID NO: 1238619 - protein, 9 aa, Homo Sapiens
VMAPGFARL

SEQ ID NO: 1238620 - protein, 9 aa, Homo Sapiens
GTPHQAKQD

SEQ ID NO: 1238621 - protein, 9 aa, Homo Sapiens
TRSQPEDTP

SEQ ID NO: 1238622 - protein, 9 aa, Homo Sapiens
YSRILEKLA

SEQ ID NO: 1238623 - protein, 9 aa, Homo Sapiens
FEDDSGEAM

SEQ ID NO: 1238624 - protein, 9 aa, Homo Sapiens
VDVVLFGPL

SEQ ID NO: 1238625 - protein, 9 aa, Homo Sapiens
KGEIANCEK

SEQ ID NO: 1238626 - protein, 9 aa, Homo Sapiens
SPVIKVESL

SEQ ID NO: 1238627 - protein, 9 aa, Homo Sapiens
NTLSNQSKE

SEQ ID NO: 1238628 - protein, 9 aa, Homo Sapiens
FWWEHLWLP

SEQ ID NO: 1238629 - protein, 9 aa, Homo Sapiens
ERINDLELL

SEQ ID NO: 1238630 - protein, 9 aa, Homo Sapiens
DEDAKKNLR

SEQ ID NO: 1238631 - protein, 9 aa, Homo Sapiens
IGMSDLPPY

SEQ ID NO: 1238632 - protein, 9 aa, Homo Sapiens
YMDKKNCSF

SEQ ID NO: 1238633 - protein, 9 aa, Homo Sapiens
RGGGVRPWL

SEQ ID NO: 1238634 - protein, 9 aa, Homo Sapiens
PQRYKEDGS

SEQ ID NO: 1238635 - protein, 9 aa, Homo Sapiens
KAYEQAEMM

SEQ ID NO: 1238636 - protein, 9 aa, Homo Sapiens
FSRRCPISR

SEQ ID NO: 1238637 - protein, 9 aa, Homo Sapiens
SSDCAPGMW

SEQ ID NO: 1238638 - protein, 9 aa, Homo Sapiens
YYLEVHQGP

SEQ ID NO: 1238639 - protein, 9 aa, Homo Sapiens
REYFIHGTR

SEQ ID NO: 1238640 - protein, 9 aa, Homo Sapiens
SPRPMEAPA

SEQ ID NO: 1238641 - protein, 9 aa, Homo Sapiens
KGAPDPCCG

SEQ ID NO: 1238642 - protein, 9 aa, Homo Sapiens
KIVALMSST

SEQ ID NO: 1238643 - protein, 9 aa, Homo Sapiens
LVADNAGGI

SEQ ID NO: 1238644 - protein, 9 aa, Homo Sapiens
DGTRKGYMS

SEQ ID NO: 1238645 - protein, 9 aa, Homo Sapiens
TWSLTELIQ

SEQ ID NO: 1238646 - protein, 9 aa, Homo Sapiens
LGTVEEVCS

SEQ ID NO: 1238647 - protein, 9 aa, Homo Sapiens
PSVAVDAIS

SEQ ID NO: 1238648 - protein, 9 aa, Homo Sapiens
SINGSVRLW

SEQ ID NO: 1238649 - protein, 9 aa, Homo Sapiens
NPFGQVIST

SEQ ID NO: 1238650 - protein, 9 aa, Homo Sapiens
LDPETRRVT

SEQ ID NO: 1238651 - protein, 9 aa, Homo Sapiens
QLFHKKLSL

SEQ ID NO: 1238652 - protein, 9 aa, Homo Sapiens
HKLDFRNDI

SEQ ID NO: 1238653 - protein, 9 aa, Homo Sapiens
EYTVWQLTI

SEQ ID NO: 1238654 - protein, 9 aa, Homo Sapiens
ALAQQENRY

SEQ ID NO: 1238655 - protein, 9 aa, Homo Sapiens
YLGYAITFP

SEQ ID NO: 1238656 - protein, 9 aa, Homo Sapiens
LLTEREECL

SEQ ID NO: 1238657 - protein, 9 aa, Homo Sapiens
ASCVLMTKS

SEQ ID NO: 1238658 - protein, 9 aa, Homo Sapiens
GRYSFLVRN

SEQ ID NO: 1238659 - protein, 9 aa, Homo Sapiens
IVHLPLYAA

SEQ ID NO: 1238660 - protein, 9 aa, Homo Sapiens
NLQEEEGGW

SEQ ID NO: 1238661 - protein, 9 aa, Homo Sapiens
ATRRPCQPL

SEQ ID NO: 1238662 - protein, 9 aa, Homo Sapiens
MPGDVERRL

SEQ ID NO: 1238663 - protein, 9 aa, Homo Sapiens
VAERVATER

SEQ ID NO: 1238664 - protein, 9 aa, Homo Sapiens
TLVLNKGTC

SEQ ID NO: 1238665 - protein, 9 aa, Homo Sapiens
RSRSDNTLH

SEQ ID NO: 1238666 - protein, 9 aa, Homo Sapiens
NTPAQQPGP

SEQ ID NO: 1238667 - protein, 9 aa, Homo Sapiens
QLTVLSQPN

SEQ ID NO: 1238668 - protein, 9 aa, Homo Sapiens
FSKIIVVNY

SEQ ID NO: 1238669 - protein, 9 aa, Homo Sapiens
TLQLMYTVE

SEQ ID NO: 1238670 - protein, 9 aa, Homo Sapiens
FLNLLVSTF

SEQ ID NO: 1238671 - protein, 9 aa, Homo Sapiens
GGETDEATH

SEQ ID NO: 1238672 - protein, 9 aa, Homo Sapiens
NVRMAIGLL

SEQ ID NO: 1238673 - protein, 9 aa, Homo Sapiens
CTCPSMEVY

SEQ ID NO: 1238674 - protein, 9 aa, Homo Sapiens
TDVIHAVWY

SEQ ID NO: 1238675 - protein, 9 aa, Homo Sapiens
NSVVALDLV

SEQ ID NO: 1238676 - protein, 9 aa, Homo Sapiens
QEAKYKLKS

SEQ ID NO: 1238677 - protein, 9 aa, Homo Sapiens
DLNIISQPK

SEQ ID NO: 1238678 - protein, 9 aa, Homo Sapiens
HTLYINIIS

SEQ ID NO: 1238679 - protein, 9 aa, Homo Sapiens
DLVLPDSRV

SEQ ID NO: 1238680 - protein, 9 aa, Homo Sapiens
VVGCVSCFV

SEQ ID NO: 1238681 - protein, 9 aa, Homo Sapiens
PELWALQSP

SEQ ID NO: 1238682 - protein, 9 aa, Homo Sapiens
SQIGPCKRC

SEQ ID NO: 1238683 - protein, 9 aa, Homo Sapiens
RRAQGHPAL

SEQ ID NO: 1238684 - protein, 9 aa, Homo Sapiens
ALPLPPDFH

SEQ ID NO: 1238685 - protein, 9 aa, Homo Sapiens
VQYTSGKQT

SEQ ID NO: 1238686 - protein, 9 aa, Homo Sapiens
HASLKLKLT

SEQ ID NO: 1238687 - protein, 9 aa, Homo Sapiens
VTFVGSIST

SEQ ID NO: 1238688 - protein, 9 aa, Homo Sapiens
VPPLVKVTY

SEQ ID NO: 1238689 - protein, 9 aa, Homo Sapiens
ILKALVRYG

SEQ ID NO: 1238690 - protein, 9 aa, Homo Sapiens
NNGSHMTVR

SEQ ID NO: 1238691 - protein, 9 aa, Homo Sapiens
LDNLFEKNH

SEQ ID NO: 1238692 - protein, 9 aa, Homo Sapiens
PVSAGEDVD

SEQ ID NO: 1238693 - protein, 9 aa, Homo Sapiens
PSGELYFWV

SEQ ID NO: 1238694 - protein, 9 aa, Homo Sapiens
EGNMGVTLE

SEQ ID NO: 1238695 - protein, 9 aa, Homo Sapiens
CRRKNQRAR

SEQ ID NO: 1238696 - protein, 9 aa, Homo Sapiens
THSFGHFPG

SEQ ID NO: 1238697 - protein, 9 aa, Homo Sapiens
SQEKGQGGP

SEQ ID NO: 1238698 - protein, 9 aa, Homo Sapiens
RPPHISTDP

SEQ ID NO: 1238699 - protein, 9 aa, Homo Sapiens
KKKLSDSFG

SEQ ID NO: 1238700 - protein, 9 aa, Homo Sapiens
KMMVAYHGC

SEQ ID NO: 1238701 - protein, 9 aa, Homo Sapiens
TTMKQLQCW

SEQ ID NO: 1238702 - protein, 9 aa, Homo Sapiens
QGYQAGQTI

SEQ ID NO: 1238703 - protein, 9 aa, Homo Sapiens
SVMNSPTTT

SEQ ID NO: 1238704 - protein, 9 aa, Homo Sapiens
EPKQADVHA

SEQ ID NO: 1238705 - protein, 9 aa, Homo Sapiens
ITKRTGHYL

SEQ ID NO: 1238706 - protein, 9 aa, Homo Sapiens
GRNTDHHIL

SEQ ID NO: 1238707 - protein, 9 aa, Homo Sapiens
QRPRSANKA

SEQ ID NO: 1238708 - protein, 9 aa, Homo Sapiens
HIEVCMYRE

SEQ ID NO: 1238709 - protein, 9 aa, Homo Sapiens
FSATLAYVN

SEQ ID NO: 1238710 - protein, 9 aa, Homo Sapiens
DLYRFGYGF

SEQ ID NO: 1238711 - protein, 9 aa, Homo Sapiens
VHYPGPAGP

SEQ ID NO: 1238712 - protein, 9 aa, Homo Sapiens
INGLEQLEN

SEQ ID NO: 1238713 - protein, 9 aa, Homo Sapiens
QPVDSDESL

SEQ ID NO: 1238714 - protein, 9 aa, Homo Sapiens
DRIQPPRRL

SEQ ID NO: 1238715 - protein, 9 aa, Homo Sapiens
NHTRKNPFE

SEQ ID NO: 1238716 - protein, 9 aa, Homo Sapiens
WARSTGNTC

SEQ ID NO: 1238717 - protein, 9 aa, Homo Sapiens
YAARNGLLT

SEQ ID NO: 1238718 - protein, 9 aa, Homo Sapiens
GQSTCQKEN

SEQ ID NO: 1238719 - protein, 9 aa, Homo Sapiens
QHAAQEVLQ

SEQ ID NO: 1238720 - protein, 9 aa, Homo Sapiens
GILQLGGRG

SEQ ID NO: 1238721 - protein, 9 aa, Homo Sapiens
SKVTLQNLF

SEQ ID NO: 1238722 - protein, 9 aa, Homo Sapiens
WKTKQTCWA

SEQ ID NO: 1238723 - protein, 9 aa, Homo Sapiens
AHQLHQRRT

SEQ ID NO: 1238724 - protein, 9 aa, Homo Sapiens
QNGKNNVPM

SEQ ID NO: 1238725 - protein, 9 aa, Homo Sapiens
PTPETVHFR

SEQ ID NO: 1238726 - protein, 9 aa, Homo Sapiens
EINHSLSAD

SEQ ID NO: 1238727 - protein, 9 aa, Homo Sapiens
MIRQKVWFF

SEQ ID NO: 1238728 - protein, 9 aa, Homo Sapiens
REIVSVAMV

SEQ ID NO: 1238729 - protein, 9 aa, Homo Sapiens
ITAYELLWG

SEQ ID NO: 1238730 - protein, 9 aa, Homo Sapiens
AISPLKSIV

SEQ ID NO: 1238731 - protein, 9 aa, Homo Sapiens
KFRKITDPC

SEQ ID NO: 1238732 - protein, 9 aa, Homo Sapiens
AHANFSPLS

SEQ ID NO: 1238733 - protein, 9 aa, Homo Sapiens
HIKCRRCVQ

SEQ ID NO: 1238734 - protein, 9 aa, Homo Sapiens
HRRFHSTPR

SEQ ID NO: 1238735 - protein, 9 aa, Homo Sapiens
FLAETLLQA

SEQ ID NO: 1238736 - protein, 9 aa, Homo Sapiens
VIDEIVNTT

SEQ ID NO: 1238737 - protein, 9 aa, Homo Sapiens
KEHVFNDEL

SEQ ID NO: 1238738 - protein, 9 aa, Homo Sapiens
DLKKGLQRG

SEQ ID NO: 1238739 - protein, 9 aa, Homo Sapiens
SEEVLQKRL

SEQ ID NO: 1238740 - protein, 9 aa, Homo Sapiens
GMKKMSSDS

SEQ ID NO: 1238741 - protein, 9 aa, Homo Sapiens
QQHQQMMHW

SEQ ID NO: 1238742 - protein, 9 aa, Homo Sapiens
RRPGPHRLV

SEQ ID NO: 1238743 - protein, 9 aa, Homo Sapiens
FEITRSQPE

SEQ ID NO: 1238744 - protein, 9 aa, Homo Sapiens
YLDRNLIVA

SEQ ID NO: 1238745 - protein, 9 aa, Homo Sapiens
ISSPYTSVY

SEQ ID NO: 1238746 - protein, 9 aa, Homo Sapiens
DVDTKFLAS

SEQ ID NO: 1238747 - protein, 9 aa, Homo Sapiens
APEPGLQVR

SEQ ID NO: 1238748 - protein, 9 aa, Homo Sapiens
SQKIFLWSL

SEQ ID NO: 1238749 - protein, 9 aa, Homo Sapiens
RFLHLHNDI

SEQ ID NO: 1238750 - protein, 9 aa, Homo Sapiens
NQQYAVNRR

SEQ ID NO: 1238751 - protein, 9 aa, Homo Sapiens
RKGNLGAEH

SEQ ID NO: 1238752 - protein, 9 aa, Homo Sapiens
VLKVDSPDV

SEQ ID NO: 1238753 - protein, 9 aa, Homo Sapiens
VLKRRAGDL

SEQ ID NO: 1238754 - protein, 9 aa, Homo Sapiens
EEKNQVVCH

SEQ ID NO: 1238755 - protein, 9 aa, Homo Sapiens
ECHRIKMQR

SEQ ID NO: 1238756 - protein, 9 aa, Homo Sapiens
LMELLFRNG

SEQ ID NO: 1238757 - protein, 9 aa, Homo Sapiens
LFSLPNTII

SEQ ID NO: 1238758 - protein, 9 aa, Homo Sapiens
VMSGDALGW

SEQ ID NO: 1238759 - protein, 9 aa, Homo Sapiens
SEDQGLQGL

SEQ ID NO: 1238760 - protein, 9 aa, Homo Sapiens
EDGPSCSSA

SEQ ID NO: 1238761 - protein, 9 aa, Homo Sapiens
DTAHQNLYR

SEQ ID NO: 1238762 - protein, 9 aa, Homo Sapiens
TRYNNRTYH

SEQ ID NO: 1238763 - protein, 9 aa, Homo Sapiens
SDELEMTGI

SEQ ID NO: 1238764 - protein, 9 aa, Homo Sapiens
DSGADTGLV

SEQ ID NO: 1238765 - protein, 9 aa, Homo Sapiens
PPSGCPMYE

SEQ ID NO: 1238766 - protein, 9 aa, Homo Sapiens
GSLSLRRSV

SEQ ID NO: 1238767 - protein, 9 aa, Homo Sapiens
LIEKCQGAK

SEQ ID NO: 1238768 - protein, 9 aa, Homo Sapiens
GLLKSCGKH

SEQ ID NO: 1238769 - protein, 9 aa, Homo Sapiens
EDSFQKVKT

SEQ ID NO: 1238770 - protein, 9 aa, Homo Sapiens
IDKNTDVLV

SEQ ID NO: 1238771 - protein, 9 aa, Homo Sapiens
FLLVGIIIQ

SEQ ID NO: 1238772 - protein, 9 aa, Homo Sapiens
TEDFYSIFT

SEQ ID NO: 1238773 - protein, 9 aa, Homo Sapiens
EEFLSKDVS

SEQ ID NO: 1238774 - protein, 9 aa, Homo Sapiens
VLSSRTPVL

SEQ ID NO: 1238775 - protein, 9 aa, Homo Sapiens
MEQKNYNKE

SEQ ID NO: 1238776 - protein, 9 aa, Homo Sapiens
KADLANKCM

SEQ ID NO: 1238777 - protein, 9 aa, Homo Sapiens
DYETYMSVD

SEQ ID NO: 1238778 - protein, 9 aa, Homo Sapiens
HHPDLYLES

SEQ ID NO: 1238779 - protein, 9 aa, Homo Sapiens
EDSDNLEAP

SEQ ID NO: 1238780 - protein, 9 aa, Homo Sapiens
EKPVYYALE

SEQ ID NO: 1238781 - protein, 9 aa, Homo Sapiens
STPKRERMM

SEQ ID NO: 1238782 - protein, 9 aa, Homo Sapiens
DFRESQEQS

SEQ ID NO: 1238783 - protein, 9 aa, Homo Sapiens
KKLYIDSCT

SEQ ID NO: 1238784 - protein, 9 aa, Homo Sapiens
GGPINPDTA

SEQ ID NO: 1238785 - protein, 9 aa, Homo Sapiens
PRFHEVPLV

SEQ ID NO: 1238786 - protein, 9 aa, Homo Sapiens
TQADEKISV

SEQ ID NO: 1238787 - protein, 9 aa, Homo Sapiens
GSRAIHHKT

SEQ ID NO: 1238788 - protein, 9 aa, Homo Sapiens
WRVSSKSSH

SEQ ID NO: 1238789 - protein, 9 aa, Homo Sapiens
THVCILHPE

SEQ ID NO: 1238790 - protein, 9 aa, Homo Sapiens
RNLLEQASH

SEQ ID NO: 1238791 - protein, 9 aa, Homo Sapiens
HYLGSRTQT

SEQ ID NO: 1238792 - protein, 9 aa, Homo Sapiens
SDFDRLRTT

SEQ ID NO: 1238793 - protein, 9 aa, Homo Sapiens
LQRFLAWKW

SEQ ID NO: 1238794 - protein, 9 aa, Homo Sapiens
GSSTENPKT

SEQ ID NO: 1238795 - protein, 9 aa, Homo Sapiens
SVIMMVYIT

SEQ ID NO: 1238796 - protein, 9 aa, Homo Sapiens
KAGKKCLDV

SEQ ID NO: 1238797 - protein, 9 aa, Homo Sapiens
VKRQELTET

SEQ ID NO: 1238798 - protein, 9 aa, Homo Sapiens
PLPKSPASA

SEQ ID NO: 1238799 - protein, 9 aa, Homo Sapiens
GGILDLEKA

SEQ ID NO: 1238800 - protein, 9 aa, Homo Sapiens
RSLRMDSEP

SEQ ID NO: 1238801 - protein, 9 aa, Homo Sapiens
LHHPDLYLE

SEQ ID NO: 1238802 - protein, 9 aa, Homo Sapiens
QVKVEEVGR

SEQ ID NO: 1238803 - protein, 9 aa, Homo Sapiens
PPMLMPPLP

SEQ ID NO: 1238804 - protein, 9 aa, Homo Sapiens
PKVAKGAKP

SEQ ID NO: 1238805 - protein, 9 aa, Homo Sapiens
GGGLMVGAV

SEQ ID NO: 1238806 - protein, 9 aa, Homo Sapiens
QQSLGLTWP

SEQ ID NO: 1238807 - protein, 9 aa, Homo Sapiens
TSFGILNGL

SEQ ID NO: 1238808 - protein, 9 aa, Homo Sapiens
PAGGQTQVR

SEQ ID NO: 1238809 - protein, 9 aa, Homo Sapiens
VPGSASLFH

SEQ ID NO: 1238810 - protein, 9 aa, Homo Sapiens
QLHAQDYPS

SEQ ID NO: 1238811 - protein, 9 aa, Homo Sapiens
PNTLPGTCT

SEQ ID NO: 1238812 - protein, 9 aa, Homo Sapiens
NQRYSISKN

SEQ ID NO: 1238813 - protein, 9 aa, Homo Sapiens
PPCCGQASA

SEQ ID NO: 1238814 - protein, 9 aa, Homo Sapiens
KKLTSLPEP

SEQ ID NO: 1238815 - protein, 9 aa, Homo Sapiens
LLLPRTPRS

SEQ ID NO: 1238816 - protein, 9 aa, Homo Sapiens
PRNIVSRRP

SEQ ID NO: 1238817 - protein, 9 aa, Homo Sapiens
PHTTSCRHF

SEQ ID NO: 1238818 - protein, 9 aa, Homo Sapiens
FINMSAADY

SEQ ID NO: 1238819 - protein, 9 aa, Homo Sapiens
WSILGSEAI

SEQ ID NO: 1238820 - protein, 9 aa, Homo Sapiens
LLPPAPKWR

SEQ ID NO: 1238821 - protein, 9 aa, Homo Sapiens
LHPQVIMVV

SEQ ID NO: 1238822 - protein, 9 aa, Homo Sapiens
HNYENNYHE

SEQ ID NO: 1238823 - protein, 9 aa, Homo Sapiens
KHARHKGGC

SEQ ID NO: 1238824 - protein, 9 aa, Homo Sapiens
EDALLPLYM

SEQ ID NO: 1238825 - protein, 9 aa, Homo Sapiens
SESTTLDAQ

SEQ ID NO: 1238826 - protein, 9 aa, Homo Sapiens
TPGTAIFIP

SEQ ID NO: 1238827 - protein, 9 aa, Homo Sapiens
SQKGLQALT

SEQ ID NO: 1238828 - protein, 9 aa, Homo Sapiens
QEDPFEKPI

SEQ ID NO: 1238829 - protein, 9 aa, Homo Sapiens
YHPKPASTP

SEQ ID NO: 1238830 - protein, 9 aa, Homo Sapiens
TSQCGKATC

SEQ ID NO: 1238831 - protein, 9 aa, Homo Sapiens
VKDISFLKS

SEQ ID NO: 1238832 - protein, 9 aa, Homo Sapiens
RKRDVRFER

SEQ ID NO: 1238833 - protein, 9 aa, Homo Sapiens
LDIMYNEEM

SEQ ID NO: 1238834 - protein, 9 aa, Homo Sapiens
NRWDKLDVC

SEQ ID NO: 1238835 - protein, 9 aa, Homo Sapiens
FSITSFDGV

SEQ ID NO: 1238836 - protein, 9 aa, Homo Sapiens
KTNTHLPRQ

SEQ ID NO: 1238837 - protein, 9 aa, Homo Sapiens
HRPCVTHIK

SEQ ID NO: 1238838 - protein, 9 aa, Homo Sapiens
IDYTLSCLE

SEQ ID NO: 1238839 - protein, 9 aa, Homo Sapiens
RKISSPTCS

SEQ ID NO: 1238840 - protein, 9 aa, Homo Sapiens
KPDTHKQHG

SEQ ID NO: 1238841 - protein, 9 aa, Homo Sapiens
NNDVTGSED

SEQ ID NO: 1238842 - protein, 9 aa, Homo Sapiens
VTLWIIDCL

SEQ ID NO: 1238843 - protein, 9 aa, Homo Sapiens
EYMPNAIPK

SEQ ID NO: 1238844 - protein, 9 aa, Homo Sapiens
VPCRMEKNI

SEQ ID NO: 1238845 - protein, 9 aa, Homo Sapiens
LQRHRISGG

SEQ ID NO: 1238846 - protein, 9 aa, Homo Sapiens
YGIPDFLGA

SEQ ID NO: 1238847 - protein, 9 aa, Homo Sapiens
ASRRVLVWD

SEQ ID NO: 1238848 - protein, 9 aa, Homo Sapiens
HHKRRMHSQ

SEQ ID NO: 1238849 - protein, 9 aa, Homo Sapiens
ARGPLCKRS

SEQ ID NO: 1238850 - protein, 9 aa, Homo Sapiens
LDTDPSNLG

SEQ ID NO: 1238851 - protein, 9 aa, Homo Sapiens
PEPGPGDSV

SEQ ID NO: 1238852 - protein, 9 aa, Homo Sapiens
PSGPAEGER

SEQ ID NO: 1238853 - protein, 9 aa, Homo Sapiens
VHPLNFDLS

SEQ ID NO: 1238854 - protein, 9 aa, Homo Sapiens
SNEPYRLVE

SEQ ID NO: 1238855 - protein, 9 aa, Homo Sapiens
QLPEIQRVS

SEQ ID NO: 1238856 - protein, 9 aa, Homo Sapiens
LFQPMDHQA

SEQ ID NO: 1238857 - protein, 9 aa, Homo Sapiens
PGFFLSQCQ

SEQ ID NO: 1238858 - protein, 9 aa, Homo Sapiens
IQQNICVIA

SEQ ID NO: 1238859 - protein, 9 aa, Homo Sapiens
RRMKHVWDR

SEQ ID NO: 1238860 - protein, 9 aa, Homo Sapiens
LWDDNHFSS

SEQ ID NO: 1238861 - protein, 9 aa, Homo Sapiens
PTEFRVMLL

SEQ ID NO: 1238862 - protein, 9 aa, Homo Sapiens
KKRLKLKHR

SEQ ID NO: 1238863 - protein, 9 aa, Homo Sapiens
GSTPDAMLD

SEQ ID NO: 1238864 - protein, 9 aa, Homo Sapiens
LQAPMAHLS

SEQ ID NO: 1238865 - protein, 9 aa, Homo Sapiens
LEPVKTLIT

SEQ ID NO: 1238866 - protein, 9 aa, Homo Sapiens
GEKPFKYEF

SEQ ID NO: 1238867 - protein, 9 aa, Homo Sapiens
LSLEMPETM

SEQ ID NO: 1238868 - protein, 9 aa, Homo Sapiens
MTGSASSLD

SEQ ID NO: 1238869 - protein, 9 aa, Homo Sapiens
SIKATLIWC

SEQ ID NO: 1238870 - protein, 9 aa, Homo Sapiens
ADNSHLFAL

SEQ ID NO: 1238871 - protein, 9 aa, Homo Sapiens
NETLIRRYQ

SEQ ID NO: 1238872 - protein, 9 aa, Homo Sapiens
DARLTAQCA

SEQ ID NO: 1238873 - protein, 9 aa, Homo Sapiens
LTAISTQHC

SEQ ID NO: 1238874 - protein, 9 aa, Homo Sapiens
FSTKDSSAN

SEQ ID NO: 1238875 - protein, 9 aa, Homo Sapiens
CNLSVFLAL

SEQ ID NO: 1238876 - protein, 9 aa, Homo Sapiens
TLILANQRY

SEQ ID NO: 1238877 - protein, 9 aa, Homo Sapiens
LDFKHLDRP

SEQ ID NO: 1238878 - protein, 9 aa, Homo Sapiens
LSSPVQRTM

SEQ ID NO: 1238879 - protein, 9 aa, Homo Sapiens
SGLWDFMIY

SEQ ID NO: 1238880 - protein, 9 aa, Homo Sapiens
PLGSTQDHV

SEQ ID NO: 1238881 - protein, 9 aa, Homo Sapiens
QAFAGGVMG

SEQ ID NO: 1238882 - protein, 9 aa, Homo Sapiens
TPRDLNISE

SEQ ID NO: 1238883 - protein, 9 aa, Homo Sapiens
LDRQWTLQE

SEQ ID NO: 1238884 - protein, 9 aa, Homo Sapiens
SRPVSVTYQ

SEQ ID NO: 1238885 - protein, 9 aa, Homo Sapiens
EVLVFAEWL

SEQ ID NO: 1238886 - protein, 9 aa, Homo Sapiens
RGKGSMGPW

SEQ ID NO: 1238887 - protein, 9 aa, Homo Sapiens
RCYLDLTRL

SEQ ID NO: 1238888 - protein, 9 aa, Homo Sapiens
NLIQALRDG

SEQ ID NO: 1238889 - protein, 9 aa, Homo Sapiens
MDELNFPTE

SEQ ID NO: 1238890 - protein, 9 aa, Homo Sapiens
YIDSCTRRN

SEQ ID NO: 1238891 - protein, 9 aa, Homo Sapiens
QENAIQTMK

SEQ ID NO: 1238892 - protein, 9 aa, Homo Sapiens
HVNPVGHLL

SEQ ID NO: 1238893 - protein, 9 aa, Homo Sapiens
VGWLQIRAL

SEQ ID NO: 1238894 - protein, 9 aa, Homo Sapiens
WSDSTSQII

SEQ ID NO: 1238895 - protein, 9 aa, Homo Sapiens
HVLASAGRN

SEQ ID NO: 1238896 - protein, 9 aa, Homo Sapiens
CGRSWDPET

SEQ ID NO: 1238897 - protein, 9 aa, Homo Sapiens
NSLLYAYSG

SEQ ID NO: 1238898 - protein, 9 aa, Homo Sapiens
TAAFVAAIS

SEQ ID NO: 1238899 - protein, 9 aa, Homo Sapiens
APAGRSSGR

SEQ ID NO: 1238900 - protein, 9 aa, Homo Sapiens
SKLKTSIDS

SEQ ID NO: 1238901 - protein, 9 aa, Homo Sapiens
YVTEPETWT

SEQ ID NO: 1238902 - protein, 9 aa, Homo Sapiens
FRGTPGAPL

SEQ ID NO: 1238903 - protein, 9 aa, Homo Sapiens
VKMIMVDDS

SEQ ID NO: 1238904 - protein, 9 aa, Homo Sapiens
LQNYWTEVM

SEQ ID NO: 1238905 - protein, 9 aa, Homo Sapiens
RVFHLQNPK

SEQ ID NO: 1238906 - protein, 9 aa, Homo Sapiens
LPAQCLALR

SEQ ID NO: 1238907 - protein, 9 aa, Homo Sapiens
QGVSVNPEP

SEQ ID NO: 1238908 - protein, 9 aa, Homo Sapiens
GLNALHVDY

SEQ ID NO: 1238909 - protein, 9 aa, Homo Sapiens
KKNPGALEK

SEQ ID NO: 1238910 - protein, 9 aa, Homo Sapiens
NPPPYPSRP

SEQ ID NO: 1238911 - protein, 9 aa, Homo Sapiens
NEVIQIFCD

SEQ ID NO: 1238912 - protein, 9 aa, Homo Sapiens
FEPHTAVKN

SEQ ID NO: 1238913 - protein, 9 aa, Homo Sapiens
LHPHPQFAP

SEQ ID NO: 1238914 - protein, 9 aa, Homo Sapiens
PRSMRSLTE

SEQ ID NO: 1238915 - protein, 9 aa, Homo Sapiens
SLQVDWLPQ

SEQ ID NO: 1238916 - protein, 9 aa, Homo Sapiens
HKVTLLDFG

SEQ ID NO: 1238917 - protein, 9 aa, Homo Sapiens
SQDLSCTLG

SEQ ID NO: 1238918 - protein, 9 aa, Homo Sapiens
SRSLAKEMI

SEQ ID NO: 1238919 - protein, 9 aa, Homo Sapiens
TEVPPGPSS

SEQ ID NO: 1238920 - protein, 9 aa, Homo Sapiens
DKALLVEVH

SEQ ID NO: 1238921 - protein, 9 aa, Homo Sapiens
LVIQVAPSR

SEQ ID NO: 1238922 - protein, 9 aa, Homo Sapiens
KKPFVVSGP

SEQ ID NO: 1238923 - protein, 9 aa, Homo Sapiens
AAPTDIPVP

SEQ ID NO: 1238924 - protein, 9 aa, Homo Sapiens
IQLLCFLVP

SEQ ID NO: 1238925 - protein, 9 aa, Homo Sapiens
LAVKAGHSY

SEQ ID NO: 1238926 - protein, 9 aa, Homo Sapiens
KLIPTCRDV

SEQ ID NO: 1238927 - protein, 9 aa, Homo Sapiens
VWIMKRKAF

SEQ ID NO: 1238928 - protein, 9 aa, Homo Sapiens
GGPGFLKTP

SEQ ID NO: 1238929 - protein, 9 aa, Homo Sapiens
LGDAVGGHS

SEQ ID NO: 1238930 - protein, 9 aa, Homo Sapiens
RFFKLQFLY

SEQ ID NO: 1238931 - protein, 9 aa, Homo Sapiens
QVLILDEAT

SEQ ID NO: 1238932 - protein, 9 aa, Homo Sapiens
LHTAACLEE

SEQ ID NO: 1238933 - protein, 9 aa, Homo Sapiens
FILLEGYGM

SEQ ID NO: 1238934 - protein, 9 aa, Homo Sapiens
TQVRALSWG

SEQ ID NO: 1238935 - protein, 9 aa, Homo Sapiens
ITSFCLKHC

SEQ ID NO: 1238936 - protein, 9 aa, Homo Sapiens
GASVAARKR

SEQ ID NO: 1238937 - protein, 9 aa, Homo Sapiens
NTIGKEDNK

SEQ ID NO: 1238938 - protein, 9 aa, Homo Sapiens
KLLPWQRWG

SEQ ID NO: 1238939 - protein, 9 aa, Homo Sapiens
TTGMCHQDD

SEQ ID NO: 1238940 - protein, 9 aa, Homo Sapiens
IMEKTVQAN

SEQ ID NO: 1238941 - protein, 9 aa, Homo Sapiens
EKVAEVRRI

SEQ ID NO: 1238942 - protein, 9 aa, Homo Sapiens
EDRVSTLTK

SEQ ID NO: 1238943 - protein, 9 aa, Homo Sapiens
SCIQFQPNS

SEQ ID NO: 1238944 - protein, 9 aa, Homo Sapiens
WERCPQEPR

SEQ ID NO: 1238945 - protein, 9 aa, Homo Sapiens
YKASCEICV

SEQ ID NO: 1238946 - protein, 9 aa, Homo Sapiens
WNRATLSIT

SEQ ID NO: 1238947 - protein, 9 aa, Homo Sapiens
RSAHNAPSY

SEQ ID NO: 1238948 - protein, 9 aa, Homo Sapiens
QAEEDRVST

SEQ ID NO: 1238949 - protein, 9 aa, Homo Sapiens
QPYKSLVQI

SEQ ID NO: 1238950 - protein, 9 aa, Homo Sapiens
CNKQRSHHK

SEQ ID NO: 1238951 - protein, 9 aa, Homo Sapiens
RRLPYPLLS

SEQ ID NO: 1238952 - protein, 9 aa, Homo Sapiens
DVAIDIQSS

SEQ ID NO: 1238953 - protein, 9 aa, Homo Sapiens
SESIKNKIS

SEQ ID NO: 1238954 - protein, 9 aa, Homo Sapiens
GPGLHGGIA

SEQ ID NO: 1238955 - protein, 9 aa, Homo Sapiens
GSLFTSAAY

SEQ ID NO: 1238956 - protein, 9 aa, Homo Sapiens
PNSSHWRKA

SEQ ID NO: 1238957 - protein, 9 aa, Homo Sapiens
LLGQALFTL

SEQ ID NO: 1238958 - protein, 9 aa, Homo Sapiens
GKVTDINPP

SEQ ID NO: 1238959 - protein, 9 aa, Homo Sapiens
DVRRVMFAR

SEQ ID NO: 1238960 - protein, 9 aa, Homo Sapiens
RLELYDCRQ

SEQ ID NO: 1238961 - protein, 9 aa, Homo Sapiens
GTPLPPPVT

SEQ ID NO: 1238962 - protein, 9 aa, Homo Sapiens
NNLQKEKKR

SEQ ID NO: 1238963 - protein, 9 aa, Homo Sapiens
ELYAIKMTV

SEQ ID NO: 1238964 - protein, 9 aa, Homo Sapiens
RERIWMQSP

SEQ ID NO: 1238965 - protein, 9 aa, Homo Sapiens
QVIHKMHHK

SEQ ID NO: 1238966 - protein, 9 aa, Homo Sapiens
LQNWPSMDF

SEQ ID NO: 1238967 - protein, 9 aa, Homo Sapiens
RDQRVQGKD

SEQ ID NO: 1238968 - protein, 9 aa, Homo Sapiens
CMVSGLDYR

SEQ ID NO: 1238969 - protein, 9 aa, Homo Sapiens
KNKKKLGQS

SEQ ID NO: 1238970 - protein, 9 aa, Homo Sapiens
CVEFLRPSF

SEQ ID NO: 1238971 - protein, 9 aa, Homo Sapiens
TLVVFWFLQ

SEQ ID NO: 1238972 - protein, 9 aa, Homo Sapiens
EYGDKTTRS

SEQ ID NO: 1238973 - protein, 9 aa, Homo Sapiens
LGLAGRGRP

SEQ ID NO: 1238974 - protein, 9 aa, Homo Sapiens
SLYKLEEEK

SEQ ID NO: 1238975 - protein, 9 aa, Homo Sapiens
QQRACPATH

SEQ ID NO: 1238976 - protein, 9 aa, Homo Sapiens
LIRNLLEQA

SEQ ID NO: 1238977 - protein, 9 aa, Homo Sapiens
PDCAFMVDN

SEQ ID NO: 1238978 - protein, 9 aa, Homo Sapiens
KLDCGCLLL

SEQ ID NO: 1238979 - protein, 9 aa, Homo Sapiens
HLSKKSQSW

SEQ ID NO: 1238980 - protein, 9 aa, Homo Sapiens
GVFLNSSMP

SEQ ID NO: 1238981 - protein, 9 aa, Homo Sapiens
SKEGNHLLG

SEQ ID NO: 1238982 - protein, 9 aa, Homo Sapiens
FEHCTCTLK

SEQ ID NO: 1238983 - protein, 9 aa, Homo Sapiens
AICGPQMLV

SEQ ID NO: 1238984 - protein, 9 aa, Homo Sapiens
NGLSIGLQS

SEQ ID NO: 1238985 - protein, 9 aa, Homo Sapiens
QHLLQHQSP

SEQ ID NO: 1238986 - protein, 9 aa, Homo Sapiens
RYHSLILTA

SEQ ID NO: 1238987 - protein, 9 aa, Homo Sapiens
VYQKVKLFR

SEQ ID NO: 1238988 - protein, 9 aa, Homo Sapiens
WSVLGPNAW

SEQ ID NO: 1238989 - protein, 9 aa, Homo Sapiens
AQNSKLRLS

SEQ ID NO: 1238990 - protein, 9 aa, Homo Sapiens
LGCTWYLGL

SEQ ID NO: 1238991 - protein, 9 aa, Homo Sapiens
MDGLHGSHI

SEQ ID NO: 1238992 - protein, 9 aa, Homo Sapiens
IPPVPQCLP

SEQ ID NO: 1238993 - protein, 9 aa, Homo Sapiens
GRCKQESSE

SEQ ID NO: 1238994 - protein, 9 aa, Homo Sapiens
TVGIVGIER

SEQ ID NO: 1238995 - protein, 9 aa, Homo Sapiens
RCFYVGLLF

SEQ ID NO: 1238996 - protein, 9 aa, Homo Sapiens
KEGEKSTYS

SEQ ID NO: 1238997 - protein, 9 aa, Homo Sapiens
QVCALSIEE

SEQ ID NO: 1238998 - protein, 9 aa, Homo Sapiens
NLTKKQCQT

SEQ ID NO: 1238999 - protein, 9 aa, Homo Sapiens
HKMLPSQQR

SEQ ID NO: 1239000 - protein, 9 aa, Homo Sapiens
MCLITAPVT

SEQ ID NO: 1239001 - protein, 9 aa, Homo Sapiens
ETGLNMHVI

SEQ ID NO: 1239002 - protein, 9 aa, Homo Sapiens
LKNNVMQLP

SEQ ID NO: 1239003 - protein, 9 aa, Homo Sapiens
EVTIIEKHP

SEQ ID NO: 1239004 - protein, 9 aa, Homo Sapiens
SATHPTVNY

SEQ ID NO: 1239005 - protein, 9 aa, Homo Sapiens
EDTVVAYYQ

SEQ ID NO: 1239006 - protein, 9 aa, Homo Sapiens
EEEYARESA

SEQ ID NO: 1239007 - protein, 9 aa, Homo Sapiens
QIPNDLKKG

SEQ ID NO: 1239008 - protein, 9 aa, Homo Sapiens
PSQPAAKDP

SEQ ID NO: 1239009 - protein, 9 aa, Homo Sapiens
AALFLGMGV

SEQ ID NO: 1239010 - protein, 9 aa, Homo Sapiens
HGMHAKHIR

SEQ ID NO: 1239011 - protein, 9 aa, Homo Sapiens
RRSLRQFPP

SEQ ID NO: 1239012 - protein, 9 aa, Homo Sapiens
IQELHQWQK

SEQ ID NO: 1239013 - protein, 9 aa, Homo Sapiens
ECHLLVKVI

SEQ ID NO: 1239014 - protein, 9 aa, Homo Sapiens
RQENDAELD

SEQ ID NO: 1239015 - protein, 9 aa, Homo Sapiens
GIQMRISRI

SEQ ID NO: 1239016 - protein, 9 aa, Homo Sapiens
CPWNEYKSD

SEQ ID NO: 1239017 - protein, 9 aa, Homo Sapiens
WYTMLYKPS

SEQ ID NO: 1239018 - protein, 9 aa, Homo Sapiens
ENRYWRRGT

SEQ ID NO: 1239019 - protein, 9 aa, Homo Sapiens
MTALGLAYD

SEQ ID NO: 1239020 - protein, 9 aa, Homo Sapiens
LDINTEDLL

SEQ ID NO: 1239021 - protein, 9 aa, Homo Sapiens
PVNPVFCMT

SEQ ID NO: 1239022 - protein, 9 aa, Homo Sapiens
QTGTHRHIH

SEQ ID NO: 1239023 - protein, 9 aa, Homo Sapiens
MDRGDILSY

SEQ ID NO: 1239024 - protein, 9 aa, Homo Sapiens
DIPCGPSCE

SEQ ID NO: 1239025 - protein, 9 aa, Homo Sapiens
CNMLDTTGM

SEQ ID NO: 1239026 - protein, 9 aa, Homo Sapiens
QEPCPAQEE

SEQ ID NO: 1239027 - protein, 9 aa, Homo Sapiens
KDILPAAEY

SEQ ID NO: 1239028 - protein, 9 aa, Homo Sapiens
LPFSVESKW

SEQ ID NO: 1239029 - protein, 9 aa, Homo Sapiens
HLTRYSQGD

SEQ ID NO: 1239030 - protein, 9 aa, Homo Sapiens
PQCKLFSMV

SEQ ID NO: 1239031 - protein, 9 aa, Homo Sapiens
EKDTQTALN

SEQ ID NO: 1239032 - protein, 9 aa, Homo Sapiens
HYECIKCGK

SEQ ID NO: 1239033 - protein, 9 aa, Homo Sapiens
GTVEEVCSF

SEQ ID NO: 1239034 - protein, 9 aa, Homo Sapiens
QPWSEPTPM

SEQ ID NO: 1239035 - protein, 9 aa, Homo Sapiens
EGVGGLWHW

SEQ ID NO: 1239036 - protein, 9 aa, Homo Sapiens
GWGNMQSLS

SEQ ID NO: 1239037 - protein, 9 aa, Homo Sapiens
VGLTAYVQW

SEQ ID NO: 1239038 - protein, 9 aa, Homo Sapiens
VNGRRMADV

SEQ ID NO: 1239039 - protein, 9 aa, Homo Sapiens
PWELKQVMA

SEQ ID NO: 1239040 - protein, 9 aa, Homo Sapiens
YIYVYTVSL

SEQ ID NO: 1239041 - protein, 9 aa, Homo Sapiens
STITSREIK

SEQ ID NO: 1239042 - protein, 9 aa, Homo Sapiens
QHLNSKFGK

SEQ ID NO: 1239043 - protein, 9 aa, Homo Sapiens
PDEPDILDC

SEQ ID NO: 1239044 - protein, 9 aa, Homo Sapiens
LQVTATYAD

SEQ ID NO: 1239045 - protein, 9 aa, Homo Sapiens
KEYEEELEA

SEQ ID NO: 1239046 - protein, 9 aa, Homo Sapiens
CCLYWCCCC

SEQ ID NO: 1239047 - protein, 9 aa, Homo Sapiens
SPNDHDNNP

SEQ ID NO: 1239048 - protein, 9 aa, Homo Sapiens
DFTYLIVVI

SEQ ID NO: 1239049 - protein, 9 aa, Homo Sapiens
VAVMHLRFS

SEQ ID NO: 1239050 - protein, 9 aa, Homo Sapiens
TLKEVDIMR

SEQ ID NO: 1239051 - protein, 9 aa, Homo Sapiens
VSLEKYKCK

SEQ ID NO: 1239052 - protein, 9 aa, Homo Sapiens
SETRAAGKC

SEQ ID NO: 1239053 - protein, 9 aa, Homo Sapiens
PVEADLLRR

SEQ ID NO: 1239054 - protein, 9 aa, Homo Sapiens
GTPSGTHSS

SEQ ID NO: 1239055 - protein, 9 aa, Homo Sapiens
TEKTRTKEK

SEQ ID NO: 1239056 - protein, 9 aa, Homo Sapiens
YDTFMEKYM

SEQ ID NO: 1239057 - protein, 9 aa, Homo Sapiens
PPSGMEHQQ

SEQ ID NO: 1239058 - protein, 9 aa, Homo Sapiens
GKYNLDFKS

SEQ ID NO: 1239059 - protein, 9 aa, Homo Sapiens
KKRQCKRNE

SEQ ID NO: 1239060 - protein, 9 aa, Homo Sapiens
FLLYISLAL

SEQ ID NO: 1239061 - protein, 9 aa, Homo Sapiens
IELEKIDDY

SEQ ID NO: 1239062 - protein, 9 aa, Homo Sapiens
DVLLSYPSD

SEQ ID NO: 1239063 - protein, 9 aa, Homo Sapiens
KNINLWLFL

SEQ ID NO: 1239064 - protein, 9 aa, Homo Sapiens
LCLLSTLQE

SEQ ID NO: 1239065 - protein, 9 aa, Homo Sapiens
VFNHPLPLP

SEQ ID NO: 1239066 - protein, 9 aa, Homo Sapiens
RACAHHDAP

SEQ ID NO: 1239067 - protein, 9 aa, Homo Sapiens
HPLLPFYPL

SEQ ID NO: 1239068 - protein, 9 aa, Homo Sapiens
VLEYLFKFI

SEQ ID NO: 1239069 - protein, 9 aa, Homo Sapiens
TTLTGVPED

SEQ ID NO: 1239070 - protein, 9 aa, Homo Sapiens
TLTAFIRLL

SEQ ID NO: 1239071 - protein, 9 aa, Homo Sapiens
KKAISFAGC

SEQ ID NO: 1239072 - protein, 9 aa, Homo Sapiens
PSPSHMPPT

SEQ ID NO: 1239073 - protein, 9 aa, Homo Sapiens
LPRSGNTSM

SEQ ID NO: 1239074 - protein, 9 aa, Homo Sapiens
SQDTEETVT

SEQ ID NO: 1239075 - protein, 9 aa, Homo Sapiens
GDNFNEMNS

SEQ ID NO: 1239076 - protein, 9 aa, Homo Sapiens
SAIQKIGEC

SEQ ID NO: 1239077 - protein, 9 aa, Homo Sapiens
IGLEIPDQN

SEQ ID NO: 1239078 - protein, 9 aa, Homo Sapiens
QMFSEVRND

SEQ ID NO: 1239079 - protein, 9 aa, Homo Sapiens
FAGGVMGAV

SEQ ID NO: 1239080 - protein, 9 aa, Homo Sapiens
DDVYNLAAT

SEQ ID NO: 1239081 - protein, 9 aa, Homo Sapiens
VALKVCYPE

SEQ ID NO: 1239082 - protein, 9 aa, Homo Sapiens
WEMLHNFPK

SEQ ID NO: 1239083 - protein, 9 aa, Homo Sapiens
QRCRISKYP

SEQ ID NO: 1239084 - protein, 9 aa, Homo Sapiens
NSYGSVKDM

SEQ ID NO: 1239085 - protein, 9 aa, Homo Sapiens
TIGQVGRLH

SEQ ID NO: 1239086 - protein, 9 aa, Homo Sapiens
ERGRDQCPS

SEQ ID NO: 1239087 - protein, 9 aa, Homo Sapiens
MDCKGRGVD

SEQ ID NO: 1239088 - protein, 9 aa, Homo Sapiens
NPVTPYWTS

SEQ ID NO: 1239089 - protein, 9 aa, Homo Sapiens
YFPVGNVVN

SEQ ID NO: 1239090 - protein, 9 aa, Homo Sapiens
QPQTKAESK

SEQ ID NO: 1239091 - protein, 9 aa, Homo Sapiens
KDTKEEILN

SEQ ID NO: 1239092 - protein, 9 aa, Homo Sapiens
YIHVDDCSL

SEQ ID NO: 1239093 - protein, 9 aa, Homo Sapiens
NVIITWSLY

SEQ ID NO: 1239094 - protein, 9 aa, Homo Sapiens
QSTSFWLML

SEQ ID NO: 1239095 - protein, 9 aa, Homo Sapiens
DVCGSDPSI

SEQ ID NO: 1239096 - protein, 9 aa, Homo Sapiens
MASFSENHA

SEQ ID NO: 1239097 - protein, 9 aa, Homo Sapiens
LVITSFCLK

SEQ ID NO: 1239098 - protein, 9 aa, Homo Sapiens
AHLLYFLFI

SEQ ID NO: 1239099 - protein, 9 aa, Homo Sapiens
MDTFEDLEN

SEQ ID NO: 1239100 - protein, 9 aa, Homo Sapiens
NCLNLQVTM

SEQ ID NO: 1239101 - protein, 9 aa, Homo Sapiens
HLKCTVENI

SEQ ID NO: 1239102 - protein, 9 aa, Homo Sapiens
DQLCSLYYT

SEQ ID NO: 1239103 - protein, 9 aa, Homo Sapiens
GAEAVRGAQ

SEQ ID NO: 1239104 - protein, 9 aa, Homo Sapiens
QNKHVFFLT

SEQ ID NO: 1239105 - protein, 9 aa, Homo Sapiens
YRGHMSSAA

SEQ ID NO: 1239106 - protein, 9 aa, Homo Sapiens
FTAMNRIRT

SEQ ID NO: 1239107 - protein, 9 aa, Homo Sapiens
SVDPGENSR

SEQ ID NO: 1239108 - protein, 9 aa, Homo Sapiens
RYNFMNNGF

SEQ ID NO: 1239109 - protein, 9 aa, Homo Sapiens
WESQCKIMQ

SEQ ID NO: 1239110 - protein, 9 aa, Homo Sapiens
LSKDTSRCS

SEQ ID NO: 1239111 - protein, 9 aa, Homo Sapiens
ESRSSGAVS

SEQ ID NO: 1239112 - protein, 9 aa, Homo Sapiens
VAVQMSDQQ

SEQ ID NO: 1239113 - protein, 9 aa, Homo Sapiens
GLNSMKPQS

SEQ ID NO: 1239114 - protein, 9 aa, Homo Sapiens
GVLTSGHQS

SEQ ID NO: 1239115 - protein, 9 aa, Homo Sapiens
DAVCRLLEN

SEQ ID NO: 1239116 - protein, 9 aa, Homo Sapiens
AKETARTVQ

SEQ ID NO: 1239117 - protein, 9 aa, Homo Sapiens
LIMSVIITI

SEQ ID NO: 1239118 - protein, 9 aa, Homo Sapiens
SGRYQLHVQ

SEQ ID NO: 1239119 - protein, 9 aa, Homo Sapiens
DDDCQIKNV

SEQ ID NO: 1239120 - protein, 9 aa, Homo Sapiens
GSFLMFKVD

SEQ ID NO: 1239121 - protein, 9 aa, Homo Sapiens
KDCDLKKEA

SEQ ID NO: 1239122 - protein, 9 aa, Homo Sapiens
SSRTSTFSF

SEQ ID NO: 1239123 - protein, 9 aa, Homo Sapiens
FLRRSGAPA

SEQ ID NO: 1239124 - protein, 9 aa, Homo Sapiens
IPLDKDGLG

SEQ ID NO: 1239125 - protein, 9 aa, Homo Sapiens
FTLSVTMLL

SEQ ID NO: 1239126 - protein, 9 aa, Homo Sapiens
CPSETEQGI

SEQ ID NO: 1239127 - protein, 9 aa, Homo Sapiens
QTVSEKTIW

SEQ ID NO: 1239128 - protein, 9 aa, Homo Sapiens
PKRCNKKIA

SEQ ID NO: 1239129 - protein, 9 aa, Homo Sapiens
GPAETHTLG

SEQ ID NO: 1239130 - protein, 9 aa, Homo Sapiens
MVHRGFCAT

SEQ ID NO: 1239131 - protein, 9 aa, Homo Sapiens
DSPVAAIKG

SEQ ID NO: 1239132 - protein, 9 aa, Homo Sapiens
QFYKGKKKL

SEQ ID NO: 1239133 - protein, 9 aa, Homo Sapiens
PLHCEICMA

SEQ ID NO: 1239134 - protein, 9 aa, Homo Sapiens
ILQQIKTAH

SEQ ID NO: 1239135 - protein, 9 aa, Homo Sapiens
RKTGVKLSG

SEQ ID NO: 1239136 - protein, 9 aa, Homo Sapiens
VLPTLRNLH

SEQ ID NO: 1239137 - protein, 9 aa, Homo Sapiens
KRHPRRPPH

SEQ ID NO: 1239138 - protein, 9 aa, Homo Sapiens
DRSHYAKCI

SEQ ID NO: 1239139 - protein, 9 aa, Homo Sapiens
GRRRRPRGM

SEQ ID NO: 1239140 - protein, 9 aa, Homo Sapiens
EDIRAEADA

SEQ ID NO: 1239141 - protein, 9 aa, Homo Sapiens
FALSPLHVK

SEQ ID NO: 1239142 - protein, 9 aa, Homo Sapiens
LGLVCFRPK

SEQ ID NO: 1239143 - protein, 9 aa, Homo Sapiens
SWSIISLEC

SEQ ID NO: 1239144 - protein, 9 aa, Homo Sapiens
SERDACKII

SEQ ID NO: 1239145 - protein, 9 aa, Homo Sapiens
FAHNSTRVI

SEQ ID NO: 1239146 - protein, 9 aa, Homo Sapiens
TFAALTSIA

SEQ ID NO: 1239147 - protein, 9 aa, Homo Sapiens
YLKVNRFDE

SEQ ID NO: 1239148 - protein, 9 aa, Homo Sapiens
VQHQANQAA

SEQ ID NO: 1239149 - protein, 9 aa, Homo Sapiens
DPGLEPEDN

SEQ ID NO: 1239150 - protein, 9 aa, Homo Sapiens
CRFTDVKNL

SEQ ID NO: 1239151 - protein, 9 aa, Homo Sapiens
YDCKEYKKG

SEQ ID NO: 1239152 - protein, 9 aa, Homo Sapiens
GLLHDLIHE

SEQ ID NO: 1239153 - protein, 9 aa, Homo Sapiens
YVTVGFTQE

SEQ ID NO: 1239154 - protein, 9 aa, Homo Sapiens
KSEMLVDVA

SEQ ID NO: 1239155 - protein, 9 aa, Homo Sapiens
SCTRRNLGS

SEQ ID NO: 1239156 - protein, 9 aa, Homo Sapiens
LFSMFLSMY

SEQ ID NO: 1239157 - protein, 9 aa, Homo Sapiens
ELVLEGQVT

SEQ ID NO: 1239158 - protein, 9 aa, Homo Sapiens
ECTNEPSQA

SEQ ID NO: 1239159 - protein, 9 aa, Homo Sapiens
HPQKRATPL

SEQ ID NO: 1239160 - protein, 9 aa, Homo Sapiens
RTSFFGKYD

SEQ ID NO: 1239161 - protein, 9 aa, Homo Sapiens
REYDRIAKD

SEQ ID NO: 1239162 - protein, 9 aa, Homo Sapiens
GKLYPHRVA

SEQ ID NO: 1239163 - protein, 9 aa, Homo Sapiens
NFSYFHASI

SEQ ID NO: 1239164 - protein, 9 aa, Homo Sapiens
PEESMYKRI

SEQ ID NO: 1239165 - protein, 9 aa, Homo Sapiens
EDDSRDEIQ

SEQ ID NO: 1239166 - protein, 9 aa, Homo Sapiens
REDIVGTMV

SEQ ID NO: 1239167 - protein, 9 aa, Homo Sapiens
AHSSAFHHS

SEQ ID NO: 1239168 - protein, 9 aa, Homo Sapiens
MNRENRIWE

SEQ ID NO: 1239169 - protein, 9 aa, Homo Sapiens
GNHYQLPIY

SEQ ID NO: 1239170 - protein, 9 aa, Homo Sapiens
AQAENKKSQ

SEQ ID NO: 1239171 - protein, 9 aa, Homo Sapiens
HLNEHMKLH

SEQ ID NO: 1239172 - protein, 9 aa, Homo Sapiens
EQQRHILQQ

SEQ ID NO: 1239173 - protein, 9 aa, Homo Sapiens
YSPISGHKS

SEQ ID NO: 1239174 - protein, 9 aa, Homo Sapiens
LTLVNLVCA

SEQ ID NO: 1239175 - protein, 9 aa, Homo Sapiens
RWRGMMRQR

SEQ ID NO: 1239176 - protein, 9 aa, Homo Sapiens
ATAAAFKLS

SEQ ID NO: 1239177 - protein, 9 aa, Homo Sapiens
HEVKGLQSS

SEQ ID NO: 1239178 - protein, 9 aa, Homo Sapiens
EKYKCKVSL

SEQ ID NO: 1239179 - protein, 9 aa, Homo Sapiens
WKNDKRSAF

SEQ ID NO: 1239180 - protein, 9 aa, Homo Sapiens
LAGIKTLTQ

SEQ ID NO: 1239181 - protein, 9 aa, Homo Sapiens
VHEATPLFN

SEQ ID NO: 1239182 - protein, 9 aa, Homo Sapiens
PATKSISAS

SEQ ID NO: 1239183 - protein, 9 aa, Homo Sapiens
SGPVSVASM

SEQ ID NO: 1239184 - protein, 9 aa, Homo Sapiens
VGSISTVHY

SEQ ID NO: 1239185 - protein, 9 aa, Homo Sapiens
MCKREAEDR

SEQ ID NO: 1239186 - protein, 9 aa, Homo Sapiens
ENHALRLLQ

SEQ ID NO: 1239187 - protein, 9 aa, Homo Sapiens
YNQVIVVLK

SEQ ID NO: 1239188 - protein, 9 aa, Homo Sapiens
AQGLQEGQR

SEQ ID NO: 1239189 - protein, 9 aa, Homo Sapiens
FTCAGCGKN

SEQ ID NO: 1239190 - protein, 9 aa, Homo Sapiens
NSQLEREST

SEQ ID NO: 1239191 - protein, 9 aa, Homo Sapiens
DEVGNEWIM

SEQ ID NO: 1239192 - protein, 9 aa, Homo Sapiens
VAAMPPHIG

SEQ ID NO: 1239193 - protein, 9 aa, Homo Sapiens
AEYNPKQFA

SEQ ID NO: 1239194 - protein, 9 aa, Homo Sapiens
TGVSTHVLP

SEQ ID NO: 1239195 - protein, 9 aa, Homo Sapiens
DSPDVLNDH

SEQ ID NO: 1239196 - protein, 9 aa, Homo Sapiens
PEHDANSAS

SEQ ID NO: 1239197 - protein, 9 aa, Homo Sapiens
KELAEAIKC

SEQ ID NO: 1239198 - protein, 9 aa, Homo Sapiens
DAPKVETTT

SEQ ID NO: 1239199 - protein, 9 aa, Homo Sapiens
YHAIDHNSP

SEQ ID NO: 1239200 - protein, 9 aa, Homo Sapiens
YSTTPGHQI

SEQ ID NO: 1239201 - protein, 9 aa, Homo Sapiens
DIKVLNTQR

SEQ ID NO: 1239202 - protein, 9 aa, Homo Sapiens
PNGSSTENP

SEQ ID NO: 1239203 - protein, 9 aa, Homo Sapiens
IISRTYPIT

SEQ ID NO: 1239204 - protein, 9 aa, Homo Sapiens
RSIGRLCEH

SEQ ID NO: 1239205 - protein, 9 aa, Homo Sapiens
HGHLGPELW

SEQ ID NO: 1239206 - protein, 9 aa, Homo Sapiens
RDLPSECQM

SEQ ID NO: 1239207 - protein, 9 aa, Homo Sapiens
SSQECTDST

SEQ ID NO: 1239208 - protein, 9 aa, Homo Sapiens
PHLSRHRKS

SEQ ID NO: 1239209 - protein, 9 aa, Homo Sapiens
ADCLTQCAS

SEQ ID NO: 1239210 - protein, 9 aa, Homo Sapiens
SHNFDTTKC

SEQ ID NO: 1239211 - protein, 9 aa, Homo Sapiens
QKRSLNVHM

SEQ ID NO: 1239212 - protein, 9 aa, Homo Sapiens
TMSKEELHV

SEQ ID NO: 1239213 - protein, 9 aa, Homo Sapiens
HQAKLNLKS

SEQ ID NO: 1239214 - protein, 9 aa, Homo Sapiens
GSGPCSSCT

SEQ ID NO: 1239215 - protein, 9 aa, Homo Sapiens
VQVILDGLS

SEQ ID NO: 1239216 - protein, 9 aa, Homo Sapiens
LHFNIFDSV

SEQ ID NO: 1239217 - protein, 9 aa, Homo Sapiens
VTVEAYTRE

SEQ ID NO: 1239218 - protein, 9 aa, Homo Sapiens
EWRYVQRGA

SEQ ID NO: 1239219 - protein, 9 aa, Homo Sapiens
CGRLNMHIN

SEQ ID NO: 1239220 - protein, 9 aa, Homo Sapiens
TGTPVQNTL

SEQ ID NO: 1239221 - protein, 9 aa, Homo Sapiens
RNRSAHNAP

SEQ ID NO: 1239222 - protein, 9 aa, Homo Sapiens
AATKLNSGE

SEQ ID NO: 1239223 - protein, 9 aa, Homo Sapiens
PITTTFISY

SEQ ID NO: 1239224 - protein, 9 aa, Homo Sapiens
PLHHGLTQK

SEQ ID NO: 1239225 - protein, 9 aa, Homo Sapiens
PAVPLGPAR

SEQ ID NO: 1239226 - protein, 9 aa, Homo Sapiens
MICVPLVIV

SEQ ID NO: 1239227 - protein, 9 aa, Homo Sapiens
EHECVNMED

SEQ ID NO: 1239228 - protein, 9 aa, Homo Sapiens
PDGSWTFAH

SEQ ID NO: 1239229 - protein, 9 aa, Homo Sapiens
GGVRTRELE

SEQ ID NO: 1239230 - protein, 9 aa, Homo Sapiens
QLLWNLGGS

SEQ ID NO: 1239231 - protein, 9 aa, Homo Sapiens
IYPHYPPKV

SEQ ID NO: 1239232 - protein, 9 aa, Homo Sapiens
YFGCMNAAP

SEQ ID NO: 1239233 - protein, 9 aa, Homo Sapiens
VSVAADSAQ

SEQ ID NO: 1239234 - protein, 9 aa, Homo Sapiens
TSTESWELK

SEQ ID NO: 1239235 - protein, 9 aa, Homo Sapiens
FIPVYIAAG

SEQ ID NO: 1239236 - protein, 9 aa, Homo Sapiens
YLIESVCQR

SEQ ID NO: 1239237 - protein, 9 aa, Homo Sapiens
HDISMNHKT

SEQ ID NO: 1239238 - protein, 9 aa, Homo Sapiens
NALHVVISL

SEQ ID NO: 1239239 - protein, 9 aa, Homo Sapiens
CCKPYLDSQ

SEQ ID NO: 1239240 - protein, 9 aa, Homo Sapiens
CGGFHGADH

SEQ ID NO: 1239241 - protein, 9 aa, Homo Sapiens
GSEVISWGG

SEQ ID NO: 1239242 - protein, 9 aa, Homo Sapiens
GILNSPVKA

SEQ ID NO: 1239243 - protein, 9 aa, Homo Sapiens
ETQHEKILC

SEQ ID NO: 1239244 - protein, 9 aa, Homo Sapiens
MTLKSVMEG

SEQ ID NO: 1239245 - protein, 9 aa, Homo Sapiens
IGFPFSFHL

SEQ ID NO: 1239246 - protein, 9 aa, Homo Sapiens
ECDKAFNCS

SEQ ID NO: 1239247 - protein, 9 aa, Homo Sapiens
PPTVVACPR

SEQ ID NO: 1239248 - protein, 9 aa, Homo Sapiens
CFNMGHITL

SEQ ID NO: 1239249 - protein, 9 aa, Homo Sapiens
LVALTRLAY

SEQ ID NO: 1239250 - protein, 9 aa, Homo Sapiens
HHTPPMIGE

SEQ ID NO: 1239251 - protein, 9 aa, Homo Sapiens
HRKTTSSTR

SEQ ID NO: 1239252 - protein, 9 aa, Homo Sapiens
EVMLWERLS

SEQ ID NO: 1239253 - protein, 9 aa, Homo Sapiens
SFLDLMFGE

SEQ ID NO: 1239254 - protein, 9 aa, Homo Sapiens
MSVAPQIGM

SEQ ID NO: 1239255 - protein, 9 aa, Homo Sapiens
SSDGSWAGT

SEQ ID NO: 1239256 - protein, 9 aa, Homo Sapiens
GVSRLRLVP

SEQ ID NO: 1239257 - protein, 9 aa, Homo Sapiens
VQTQPENTA

SEQ ID NO: 1239258 - protein, 9 aa, Homo Sapiens
HKHCRPKLP

SEQ ID NO: 1239259 - protein, 9 aa, Homo Sapiens
SEMTLYQKK

SEQ ID NO: 1239260 - protein, 9 aa, Homo Sapiens
NRANRVMAI

SEQ ID NO: 1239261 - protein, 9 aa, Homo Sapiens
WINDRIQPP

SEQ ID NO: 1239262 - protein, 9 aa, Homo Sapiens
GQTLVTMVT

SEQ ID NO: 1239263 - protein, 9 aa, Homo Sapiens
FHIQLNEMH

SEQ ID NO: 1239264 - protein, 9 aa, Homo Sapiens
VCMVRAATL

SEQ ID NO: 1239265 - protein, 9 aa, Homo Sapiens
EGVESVSVS

SEQ ID NO: 1239266 - protein, 9 aa, Homo Sapiens
LSDVNDNKS

SEQ ID NO: 1239267 - protein, 9 aa, Homo Sapiens
DYTASVDST

SEQ ID NO: 1239268 - protein, 9 aa, Homo Sapiens
LELVWQHRV

SEQ ID NO: 1239269 - protein, 9 aa, Homo Sapiens
RYSFLVRNP

SEQ ID NO: 1239270 - protein, 9 aa, Homo Sapiens
QSQTHPLVS

SEQ ID NO: 1239271 - protein, 9 aa, Homo Sapiens
STTSVITST

SEQ ID NO: 1239272 - protein, 9 aa, Homo Sapiens
PGAGDKASG

SEQ ID NO: 1239273 - protein, 9 aa, Homo Sapiens
YEGHSDGDS

SEQ ID NO: 1239274 - protein, 9 aa, Homo Sapiens
HIMHMISPS

SEQ ID NO: 1239275 - protein, 9 aa, Homo Sapiens
CPQCSRAFA

SEQ ID NO: 1239276 - protein, 9 aa, Homo Sapiens
SAKKWKPAW

SEQ ID NO: 1239277 - protein, 9 aa, Homo Sapiens
PTDKAYFIT

SEQ ID NO: 1239278 - protein, 9 aa, Homo Sapiens
GISLLLHEL

SEQ ID NO: 1239279 - protein, 9 aa, Homo Sapiens
LQDQLNSIA

SEQ ID NO: 1239280 - protein, 9 aa, Homo Sapiens
PPKCITPRC

SEQ ID NO: 1239281 - protein, 9 aa, Homo Sapiens
RAFCNYDSG

SEQ ID NO: 1239282 - protein, 9 aa, Homo Sapiens
HDEIKFICS

SEQ ID NO: 1239283 - protein, 9 aa, Homo Sapiens
QRDLPSECQ

SEQ ID NO: 1239284 - protein, 9 aa, Homo Sapiens
AEAIHILTS

SEQ ID NO: 1239285 - protein, 9 aa, Homo Sapiens
PWVDKKGSG

SEQ ID NO: 1239286 - protein, 9 aa, Homo Sapiens
MAVPCPPPR

SEQ ID NO: 1239287 - protein, 9 aa, Homo Sapiens
NVNASKEGK

SEQ ID NO: 1239288 - protein, 9 aa, Homo Sapiens
SVSRAIGNA

SEQ ID NO: 1239289 - protein, 9 aa, Homo Sapiens
DEINHAFPD

SEQ ID NO: 1239290 - protein, 9 aa, Homo Sapiens
YISLNKVIL

SEQ ID NO: 1239291 - protein, 9 aa, Homo Sapiens
KHREFHALI

SEQ ID NO: 1239292 - protein, 9 aa, Homo Sapiens
KKCNTVRGI

SEQ ID NO: 1239293 - protein, 9 aa, Homo Sapiens
MPTILQESK

SEQ ID NO: 1239294 - protein, 9 aa, Homo Sapiens
KLFSKELRS

SEQ ID NO: 1239295 - protein, 9 aa, Homo Sapiens
RHWTTKHVA

SEQ ID NO: 1239296 - protein, 9 aa, Homo Sapiens
SYESRCQNQ

SEQ ID NO: 1239297 - protein, 9 aa, Homo Sapiens
FEEDGCVTD

SEQ ID NO: 1239298 - protein, 9 aa, Homo Sapiens
YQVLMNSEK

SEQ ID NO: 1239299 - protein, 9 aa, Homo Sapiens
GDAGMQLLC

SEQ ID NO: 1239300 - protein, 9 aa, Homo Sapiens
SCCERGFTA

SEQ ID NO: 1239301 - protein, 9 aa, Homo Sapiens
FVYTYLHPR

SEQ ID NO: 1239302 - protein, 9 aa, Homo Sapiens
PTICHYFMC

SEQ ID NO: 1239303 - protein, 9 aa, Homo Sapiens
KEQDLLQEL

SEQ ID NO: 1239304 - protein, 9 aa, Homo Sapiens
WHTYLSPFT

SEQ ID NO: 1239305 - protein, 9 aa, Homo Sapiens
EYEAHYIRQ

SEQ ID NO: 1239306 - protein, 9 aa, Homo Sapiens
WDYGNDFAA

SEQ ID NO: 1239307 - protein, 9 aa, Homo Sapiens
ERSKTCGDH

SEQ ID NO: 1239308 - protein, 9 aa, Homo Sapiens
LRYKDLCTH

SEQ ID NO: 1239309 - protein, 9 aa, Homo Sapiens
HPLPSPGCV

SEQ ID NO: 1239310 - protein, 9 aa, Homo Sapiens
AVIDEIVNT

SEQ ID NO: 1239311 - protein, 9 aa, Homo Sapiens
VPCTNGHSS

SEQ ID NO: 1239312 - protein, 9 aa, Homo Sapiens
RAIGNAEHK

SEQ ID NO: 1239313 - protein, 9 aa, Homo Sapiens
CVNGGKCFM

SEQ ID NO: 1239314 - protein, 9 aa, Homo Sapiens
ATQVVASLA

SEQ ID NO: 1239315 - protein, 9 aa, Homo Sapiens
IIKWKGEKS

SEQ ID NO: 1239316 - protein, 9 aa, Homo Sapiens
QLLQRFKVV

SEQ ID NO: 1239317 - protein, 9 aa, Homo Sapiens
FLKKKWYLQ

SEQ ID NO: 1239318 - protein, 9 aa, Homo Sapiens
NDILPCLPG

SEQ ID NO: 1239319 - protein, 9 aa, Homo Sapiens
LESVSLHFL

SEQ ID NO: 1239320 - protein, 9 aa, Homo Sapiens
MHHKRRMHS

SEQ ID NO: 1239321 - protein, 9 aa, Homo Sapiens
MNAISPLKS

SEQ ID NO: 1239322 - protein, 9 aa, Homo Sapiens
NHLNEPLKY

SEQ ID NO: 1239323 - protein, 9 aa, Homo Sapiens
AVWYQQPRW

SEQ ID NO: 1239324 - protein, 9 aa, Homo Sapiens
PLTVITIPR

SEQ ID NO: 1239325 - protein, 9 aa, Homo Sapiens
STDLTHLRD

SEQ ID NO: 1239326 - protein, 9 aa, Homo Sapiens
AATHLSAYV

SEQ ID NO: 1239327 - protein, 9 aa, Homo Sapiens
VVAASPSAM

SEQ ID NO: 1239328 - protein, 9 aa, Homo Sapiens
LDHDNKELK

SEQ ID NO: 1239329 - protein, 9 aa, Homo Sapiens
AQASAAVLN

SEQ ID NO: 1239330 - protein, 9 aa, Homo Sapiens
DAHGPREAL

SEQ ID NO: 1239331 - protein, 9 aa, Homo Sapiens
LHENQKKQP

SEQ ID NO: 1239332 - protein, 9 aa, Homo Sapiens
ARDKNPIVV

SEQ ID NO: 1239333 - protein, 9 aa, Homo Sapiens
EYEENSWDT

SEQ ID NO: 1239334 - protein, 9 aa, Homo Sapiens
SRHASIQLQ

SEQ ID NO: 1239335 - protein, 9 aa, Homo Sapiens
GDNDYFTYI

SEQ ID NO: 1239336 - protein, 9 aa, Homo Sapiens
MMRHLNING

SEQ ID NO: 1239337 - protein, 9 aa, Homo Sapiens
ALERRKISR

SEQ ID NO: 1239338 - protein, 9 aa, Homo Sapiens
LNYKDIMKE

SEQ ID NO: 1239339 - protein, 9 aa, Homo Sapiens
WCHAHGMRC

SEQ ID NO: 1239340 - protein, 9 aa, Homo Sapiens
MQTDYSCNT

SEQ ID NO: 1239341 - protein, 9 aa, Homo Sapiens
EKSYDCKEY

SEQ ID NO: 1239342 - protein, 9 aa, Homo Sapiens
GHITLAKKL

SEQ ID NO: 1239343 - protein, 9 aa, Homo Sapiens
IVEHVFQSN

SEQ ID NO: 1239344 - protein, 9 aa, Homo Sapiens
TQARGAAKK

SEQ ID NO: 1239345 - protein, 9 aa, Homo Sapiens
GERSQGLHE

SEQ ID NO: 1239346 - protein, 9 aa, Homo Sapiens
DLSVVIHTM

SEQ ID NO: 1239347 - protein, 9 aa, Homo Sapiens
KSAHDCHEF

SEQ ID NO: 1239348 - protein, 9 aa, Homo Sapiens
GHGQQGQAG

SEQ ID NO: 1239349 - protein, 9 aa, Homo Sapiens
MWTSLVLIW

SEQ ID NO: 1239350 - protein, 9 aa, Homo Sapiens
RGLFYYHLL

SEQ ID NO: 1239351 - protein, 9 aa, Homo Sapiens
VPTPHGLAP

SEQ ID NO: 1239352 - protein, 9 aa, Homo Sapiens
DPYVKACLL

SEQ ID NO: 1239353 - protein, 9 aa, Homo Sapiens
EDFPTLVSS

SEQ ID NO: 1239354 - protein, 9 aa, Homo Sapiens
PEAPDGRAL

SEQ ID NO: 1239355 - protein, 9 aa, Homo Sapiens
YIMEEADVS

SEQ ID NO: 1239356 - protein, 9 aa, Homo Sapiens
LNSTGATAS

SEQ ID NO: 1239357 - protein, 9 aa, Homo Sapiens
RDQCFQMME

SEQ ID NO: 1239358 - protein, 9 aa, Homo Sapiens
STTPSIHRT

SEQ ID NO: 1239359 - protein, 9 aa, Homo Sapiens
PIPRPTNKF

SEQ ID NO: 1239360 - protein, 9 aa, Homo Sapiens
DGATPAIYP

SEQ ID NO: 1239361 - protein, 9 aa, Homo Sapiens
SHVWGADAS

SEQ ID NO: 1239362 - protein, 9 aa, Homo Sapiens
AKVNREQCF

SEQ ID NO: 1239363 - protein, 9 aa, Homo Sapiens
VGGDLTSRL

SEQ ID NO: 1239364 - protein, 9 aa, Homo Sapiens
PPALSDHLD

SEQ ID NO: 1239365 - protein, 9 aa, Homo Sapiens
QRKAEVNEL

SEQ ID NO: 1239366 - protein, 9 aa, Homo Sapiens
GLQCSLESH

SEQ ID NO: 1239367 - protein, 9 aa, Homo Sapiens
SSIEVIPFV

SEQ ID NO: 1239368 - protein, 9 aa, Homo Sapiens
MIQKGNALL

SEQ ID NO: 1239369 - protein, 9 aa, Homo Sapiens
KRSDGFNGA

SEQ ID NO: 1239370 - protein, 9 aa, Homo Sapiens
IMSCNKQLT

SEQ ID NO: 1239371 - protein, 9 aa, Homo Sapiens
VPSVAERLH

SEQ ID NO: 1239372 - protein, 9 aa, Homo Sapiens
KVPEKPLHE

SEQ ID NO: 1239373 - protein, 9 aa, Homo Sapiens
FRKVSEFLD

SEQ ID NO: 1239374 - protein, 9 aa, Homo Sapiens
PASQGRRPR

SEQ ID NO: 1239375 - protein, 9 aa, Homo Sapiens
KFGLHTIAL

SEQ ID NO: 1239376 - protein, 9 aa, Homo Sapiens
MAQKKMNYE

SEQ ID NO: 1239377 - protein, 9 aa, Homo Sapiens
SPPSSKRHK

SEQ ID NO: 1239378 - protein, 9 aa, Homo Sapiens
QNSKLRLSF

SEQ ID NO: 1239379 - protein, 9 aa, Homo Sapiens
QLQETRCAN

SEQ ID NO: 1239380 - protein, 9 aa, Homo Sapiens
KPRTFSKQP

SEQ ID NO: 1239381 - protein, 9 aa, Homo Sapiens
SMTVTKLGC

SEQ ID NO: 1239382 - protein, 9 aa, Homo Sapiens
YANHMAAQP

SEQ ID NO: 1239383 - protein, 9 aa, Homo Sapiens
ILEKLAERF

SEQ ID NO: 1239384 - protein, 9 aa, Homo Sapiens
QWMWCLFIG

SEQ ID NO: 1239385 - protein, 9 aa, Homo Sapiens
YFVMLLAGV

SEQ ID NO: 1239386 - protein, 9 aa, Homo Sapiens
RCCLYASVL

SEQ ID NO: 1239387 - protein, 9 aa, Homo Sapiens
ELLKNKETF

SEQ ID NO: 1239388 - protein, 9 aa, Homo Sapiens
PRWRDYKRL

SEQ ID NO: 1239389 - protein, 9 aa, Homo Sapiens
SSHLALADV

SEQ ID NO: 1239390 - protein, 9 aa, Homo Sapiens
KKCLTRLYQ

SEQ ID NO: 1239391 - protein, 9 aa, Homo Sapiens
VNPYMDGAT

SEQ ID NO: 1239392 - protein, 9 aa, Homo Sapiens
GMMERRETL

SEQ ID NO: 1239393 - protein, 9 aa, Homo Sapiens
QARCALGRW

SEQ ID NO: 1239394 - protein, 9 aa, Homo Sapiens
GGGTDGVAW

SEQ ID NO: 1239395 - protein, 9 aa, Homo Sapiens
TGLYKSHRP

SEQ ID NO: 1239396 - protein, 9 aa, Homo Sapiens
ASEMAQAEG

SEQ ID NO: 1239397 - protein, 9 aa, Homo Sapiens
ADVGVPQVS

SEQ ID NO: 1239398 - protein, 9 aa, Homo Sapiens
ICWGGREQR

SEQ ID NO: 1239399 - protein, 9 aa, Homo Sapiens
SPGWTPRWT

SEQ ID NO: 1239400 - protein, 9 aa, Homo Sapiens
SSGAVSSAP

SEQ ID NO: 1239401 - protein, 9 aa, Homo Sapiens
FSRSHILEK

SEQ ID NO: 1239402 - protein, 9 aa, Homo Sapiens
CDQFSQESG

SEQ ID NO: 1239403 - protein, 9 aa, Homo Sapiens
ALIVDPLKA

SEQ ID NO: 1239404 - protein, 9 aa, Homo Sapiens
AARSGGQVG

SEQ ID NO: 1239405 - protein, 9 aa, Homo Sapiens
HGPSGAADK

SEQ ID NO: 1239406 - protein, 9 aa, Homo Sapiens
NIAIVRLIM

SEQ ID NO: 1239407 - protein, 9 aa, Homo Sapiens
YPFLVLQIL

SEQ ID NO: 1239408 - protein, 9 aa, Homo Sapiens
LEVMNPHPK

SEQ ID NO: 1239409 - protein, 9 aa, Homo Sapiens
VAAEARSLE

SEQ ID NO: 1239410 - protein, 9 aa, Homo Sapiens
CGPSCERRV

SEQ ID NO: 1239411 - protein, 9 aa, Homo Sapiens
QHQQMMHWL

SEQ ID NO: 1239412 - protein, 9 aa, Homo Sapiens
RQEPAMRGS

SEQ ID NO: 1239413 - protein, 9 aa, Homo Sapiens
SRNYYNFPL

SEQ ID NO: 1239414 - protein, 9 aa, Homo Sapiens
PNQVRMWYL

SEQ ID NO: 1239415 - protein, 9 aa, Homo Sapiens
AAAQRDVVD

SEQ ID NO: 1239416 - protein, 9 aa, Homo Sapiens
SCPQCSRAF

SEQ ID NO: 1239417 - protein, 9 aa, Homo Sapiens
APKQRPKAN

SEQ ID NO: 1239418 - protein, 9 aa, Homo Sapiens
GFFFGYTPV

SEQ ID NO: 1239419 - protein, 9 aa, Homo Sapiens
MYPYECEKR

SEQ ID NO: 1239420 - protein, 9 aa, Homo Sapiens
QPLNPRPCQ

SEQ ID NO: 1239421 - protein, 9 aa, Homo Sapiens
NPSKISGSV

SEQ ID NO: 1239422 - protein, 9 aa, Homo Sapiens
WMVAGLMIG

SEQ ID NO: 1239423 - protein, 9 aa, Homo Sapiens
HSSLNRHMK

SEQ ID NO: 1239424 - protein, 9 aa, Homo Sapiens
CKREAEDRA

SEQ ID NO: 1239425 - protein, 9 aa, Homo Sapiens
DEATYTSDS

SEQ ID NO: 1239426 - protein, 9 aa, Homo Sapiens
DWSAQPVTE

SEQ ID NO: 1239427 - protein, 9 aa, Homo Sapiens
LIRHRHIHT

SEQ ID NO: 1239428 - protein, 9 aa, Homo Sapiens
PLNHGIYVD

SEQ ID NO: 1239429 - protein, 9 aa, Homo Sapiens
VINLADGNS

SEQ ID NO: 1239430 - protein, 9 aa, Homo Sapiens
GSMKHPARN

SEQ ID NO: 1239431 - protein, 9 aa, Homo Sapiens
NLADGNSNT

SEQ ID NO: 1239432 - protein, 9 aa, Homo Sapiens
ALSPLHVKG

SEQ ID NO: 1239433 - protein, 9 aa, Homo Sapiens
MEKFSSALQ

SEQ ID NO: 1239434 - protein, 9 aa, Homo Sapiens
QELLKNKET

SEQ ID NO: 1239435 - protein, 9 aa, Homo Sapiens
DIQLKYFVL

SEQ ID NO: 1239436 - protein, 9 aa, Homo Sapiens
GEVPMPQMC

SEQ ID NO: 1239437 - protein, 9 aa, Homo Sapiens
CGLTPLARI

SEQ ID NO: 1239438 - protein, 9 aa, Homo Sapiens
VYLDANIAT

SEQ ID NO: 1239439 - protein, 9 aa, Homo Sapiens
SQKQPKCYR

SEQ ID NO: 1239440 - protein, 9 aa, Homo Sapiens
GTCAIRNEV

SEQ ID NO: 1239441 - protein, 9 aa, Homo Sapiens
EEDEDEMED

SEQ ID NO: 1239442 - protein, 9 aa, Homo Sapiens
RHVIAWGHA

SEQ ID NO: 1239443 - protein, 9 aa, Homo Sapiens
LSKLEVYLT

SEQ ID NO: 1239444 - protein, 9 aa, Homo Sapiens
GPAKENRCA

SEQ ID NO: 1239445 - protein, 9 aa, Homo Sapiens
RVLHVLDQF

SEQ ID NO: 1239446 - protein, 9 aa, Homo Sapiens
KITQSKAIM

SEQ ID NO: 1239447 - protein, 9 aa, Homo Sapiens
YFLIVTVWT

SEQ ID NO: 1239448 - protein, 9 aa, Homo Sapiens
VPNKSPMHH

SEQ ID NO: 1239449 - protein, 9 aa, Homo Sapiens
LDKNKCLSR

SEQ ID NO: 1239450 - protein, 9 aa, Homo Sapiens
VFRELKVLC

SEQ ID NO: 1239451 - protein, 9 aa, Homo Sapiens
QMWKILYQK

SEQ ID NO: 1239452 - protein, 9 aa, Homo Sapiens
PYEFFAHDP

SEQ ID NO: 1239453 - protein, 9 aa, Homo Sapiens
TMNPGEVTS

SEQ ID NO: 1239454 - protein, 9 aa, Homo Sapiens
LSRDYLATY

SEQ ID NO: 1239455 - protein, 9 aa, Homo Sapiens
STLVYNSMR

SEQ ID NO: 1239456 - protein, 9 aa, Homo Sapiens
WRIFQLHMC

SEQ ID NO: 1239457 - protein, 9 aa, Homo Sapiens
AFKKPIKFY

SEQ ID NO: 1239458 - protein, 9 aa, Homo Sapiens
IFRGQINTE

SEQ ID NO: 1239459 - protein, 9 aa, Homo Sapiens
QKFGYKLMM

SEQ ID NO: 1239460 - protein, 9 aa, Homo Sapiens
NQGLDTGRR

SEQ ID NO: 1239461 - protein, 9 aa, Homo Sapiens
RLPWPCCLA

SEQ ID NO: 1239462 - protein, 9 aa, Homo Sapiens
ACPLDQALW

SEQ ID NO: 1239463 - protein, 9 aa, Homo Sapiens
PRIPKVQSN

SEQ ID NO: 1239464 - protein, 9 aa, Homo Sapiens
GDNTTVNYT

SEQ ID NO: 1239465 - protein, 9 aa, Homo Sapiens
ICSSAHLLY

SEQ ID NO: 1239466 - protein, 9 aa, Homo Sapiens
NITASDSGK

SEQ ID NO: 1239467 - protein, 9 aa, Homo Sapiens
SIWDYGNDF

SEQ ID NO: 1239468 - protein, 9 aa, Homo Sapiens
YTKEYNNLI

SEQ ID NO: 1239469 - protein, 9 aa, Homo Sapiens
NQCYNWTLL

SEQ ID NO: 1239470 - protein, 9 aa, Homo Sapiens
IPSGICSLE

SEQ ID NO: 1239471 - protein, 9 aa, Homo Sapiens
ASATINMIT

SEQ ID NO: 1239472 - protein, 9 aa, Homo Sapiens
HFGYGVASY

SEQ ID NO: 1239473 - protein, 9 aa, Homo Sapiens
DRMTEKLEK

SEQ ID NO: 1239474 - protein, 9 aa, Homo Sapiens
WTGRGKSLI

SEQ ID NO: 1239475 - protein, 9 aa, Homo Sapiens
LHDLIHEAF

SEQ ID NO: 1239476 - protein, 9 aa, Homo Sapiens
PQPLTSARA

SEQ ID NO: 1239477 - protein, 9 aa, Homo Sapiens
KASPTLVKR

SEQ ID NO: 1239478 - protein, 9 aa, Homo Sapiens
NVMVMILVV

SEQ ID NO: 1239479 - protein, 9 aa, Homo Sapiens
LCLVLSELL

SEQ ID NO: 1239480 - protein, 9 aa, Homo Sapiens
NDKRSAFGV

SEQ ID NO: 1239481 - protein, 9 aa, Homo Sapiens
IIMLNTACA

SEQ ID NO: 1239482 - protein, 9 aa, Homo Sapiens
LNELEVQTR

SEQ ID NO: 1239483 - protein, 9 aa, Homo Sapiens
VQGKAGKGL

SEQ ID NO: 1239484 - protein, 9 aa, Homo Sapiens
SAPCGGYLA

SEQ ID NO: 1239485 - protein, 9 aa, Homo Sapiens
LALYDGKDD

SEQ ID NO: 1239486 - protein, 9 aa, Homo Sapiens
VDRSREPPG

SEQ ID NO: 1239487 - protein, 9 aa, Homo Sapiens
EAIKPCHPM

SEQ ID NO: 1239488 - protein, 9 aa, Homo Sapiens
FALDNATKP

SEQ ID NO: 1239489 - protein, 9 aa, Homo Sapiens
DQLDESMRD

SEQ ID NO: 1239490 - protein, 9 aa, Homo Sapiens
EPYHSPSNC

SEQ ID NO: 1239491 - protein, 9 aa, Homo Sapiens
DPDNLADYF

SEQ ID NO: 1239492 - protein, 9 aa, Homo Sapiens
FQYGRTSEF

SEQ ID NO: 1239493 - protein, 9 aa, Homo Sapiens
KTIAGFQTH

SEQ ID NO: 1239494 - protein, 9 aa, Homo Sapiens
MIAHTTWWD

SEQ ID NO: 1239495 - protein, 9 aa, Homo Sapiens
VTSPSSPRP

SEQ ID NO: 1239496 - protein, 9 aa, Homo Sapiens
GKDCIGRCS

SEQ ID NO: 1239497 - protein, 9 aa, Homo Sapiens
EYNVIITVT

SEQ ID NO: 1239498 - protein, 9 aa, Homo Sapiens
VTALFSVFA

SEQ ID NO: 1239499 - protein, 9 aa, Homo Sapiens
EPWSEDRDL

SEQ ID NO: 1239500 - protein, 9 aa, Homo Sapiens
LADALLEQV

SEQ ID NO: 1239501 - protein, 9 aa, Homo Sapiens
GLLPGEAAP

SEQ ID NO: 1239502 - protein, 9 aa, Homo Sapiens
WTEEGRTVA

SEQ ID NO: 1239503 - protein, 9 aa, Homo Sapiens
LDVGSMKTL

SEQ ID NO: 1239504 - protein, 9 aa, Homo Sapiens
AQGQIQTQA

SEQ ID NO: 1239505 - protein, 9 aa, Homo Sapiens
SAFILVGPI

SEQ ID NO: 1239506 - protein, 9 aa, Homo Sapiens
PQVVMYVKN

SEQ ID NO: 1239507 - protein, 9 aa, Homo Sapiens
AQAHMATHR

SEQ ID NO: 1239508 - protein, 9 aa, Homo Sapiens
VLFLVAWLG

SEQ ID NO: 1239509 - protein, 9 aa, Homo Sapiens
AVQPELLKR

SEQ ID NO: 1239510 - protein, 9 aa, Homo Sapiens
SKAHDKSPC

SEQ ID NO: 1239511 - protein, 9 aa, Homo Sapiens
DTHFNFAIV

SEQ ID NO: 1239512 - protein, 9 aa, Homo Sapiens
IRLLPSVSY

SEQ ID NO: 1239513 - protein, 9 aa, Homo Sapiens
HTLNKCTSV

SEQ ID NO: 1239514 - protein, 9 aa, Homo Sapiens
DEDSDNLEA

SEQ ID NO: 1239515 - protein, 9 aa, Homo Sapiens
EPPGGDLRH

SEQ ID NO: 1239516 - protein, 9 aa, Homo Sapiens
GCWLGCLAG

SEQ ID NO: 1239517 - protein, 9 aa, Homo Sapiens
SLESKLYQA

SEQ ID NO: 1239518 - protein, 9 aa, Homo Sapiens
DGCYLITAT

SEQ ID NO: 1239519 - protein, 9 aa, Homo Sapiens
ELMITVHEL

SEQ ID NO: 1239520 - protein, 9 aa, Homo Sapiens
VKGAVLFLQ

SEQ ID NO: 1239521 - protein, 9 aa, Homo Sapiens
EIEKGETVQ

SEQ ID NO: 1239522 - protein, 9 aa, Homo Sapiens
RNALERHVV

SEQ ID NO: 1239523 - protein, 9 aa, Homo Sapiens
ADVPFGHPL

SEQ ID NO: 1239524 - protein, 9 aa, Homo Sapiens
YRGILNSPV

SEQ ID NO: 1239525 - protein, 9 aa, Homo Sapiens
MSPSPDSEG

SEQ ID NO: 1239526 - protein, 9 aa, Homo Sapiens
FKSMYLSEK

SEQ ID NO: 1239527 - protein, 9 aa, Homo Sapiens
LVATTTSLV

SEQ ID NO: 1239528 - protein, 9 aa, Homo Sapiens
GEHPNPPSW

SEQ ID NO: 1239529 - protein, 9 aa, Homo Sapiens
PDPNNPPAH

SEQ ID NO: 1239530 - protein, 9 aa, Homo Sapiens
SEAIPGGNL

SEQ ID NO: 1239531 - protein, 9 aa, Homo Sapiens
DATASPPTP

SEQ ID NO: 1239532 - protein, 9 aa, Homo Sapiens
NPAAVVVVT

SEQ ID NO: 1239533 - protein, 9 aa, Homo Sapiens
GMALLAASW

SEQ ID NO: 1239534 - protein, 9 aa, Homo Sapiens
KPIISAPDS

SEQ ID NO: 1239535 - protein, 9 aa, Homo Sapiens
LGVTYETHH

SEQ ID NO: 1239536 - protein, 9 aa, Homo Sapiens
EQGHVSPCT

SEQ ID NO: 1239537 - protein, 9 aa, Homo Sapiens
NSAQSSIKQ

SEQ ID NO: 1239538 - protein, 9 aa, Homo Sapiens
LASLQSLEF

SEQ ID NO: 1239539 - protein, 9 aa, Homo Sapiens
VFAYTHIVF

SEQ ID NO: 1239540 - protein, 9 aa, Homo Sapiens
KKFENPEVP

SEQ ID NO: 1239541 - protein, 9 aa, Homo Sapiens
ALKQEIAKY

SEQ ID NO: 1239542 - protein, 9 aa, Homo Sapiens
FRITCSFPR

SEQ ID NO: 1239543 - protein, 9 aa, Homo Sapiens
YIIRRGLFY

SEQ ID NO: 1239544 - protein, 9 aa, Homo Sapiens
SNIEVWSYI

SEQ ID NO: 1239545 - protein, 9 aa, Homo Sapiens
AVTVVGLMM

SEQ ID NO: 1239546 - protein, 9 aa, Homo Sapiens
RGKKLVVAA

SEQ ID NO: 1239547 - protein, 9 aa, Homo Sapiens
FRLRLLEDA

SEQ ID NO: 1239548 - protein, 9 aa, Homo Sapiens
PFSVQVTTI

SEQ ID NO: 1239549 - protein, 9 aa, Homo Sapiens
GSQNEGHGG

SEQ ID NO: 1239550 - protein, 9 aa, Homo Sapiens
QIANGMYYL

SEQ ID NO: 1239551 - protein, 9 aa, Homo Sapiens
TVMELKMHP

SEQ ID NO: 1239552 - protein, 9 aa, Homo Sapiens
KQMFQRLDC

SEQ ID NO: 1239553 - protein, 9 aa, Homo Sapiens
KLILVMLEI

SEQ ID NO: 1239554 - protein, 9 aa, Homo Sapiens
TYINSLTIL

SEQ ID NO: 1239555 - protein, 9 aa, Homo Sapiens
ATRLESSQN

SEQ ID NO: 1239556 - protein, 9 aa, Homo Sapiens
IRDRREYDR

SEQ ID NO: 1239557 - protein, 9 aa, Homo Sapiens
HWRCMLNTH

SEQ ID NO: 1239558 - protein, 9 aa, Homo Sapiens
CHSGEIFAI

SEQ ID NO: 1239559 - protein, 9 aa, Homo Sapiens
NCTLPPPPY

SEQ ID NO: 1239560 - protein, 9 aa, Homo Sapiens
NGFFLKVTA

SEQ ID NO: 1239561 - protein, 9 aa, Homo Sapiens
SLVAQLMLN

SEQ ID NO: 1239562 - protein, 9 aa, Homo Sapiens
TLEGRPGHR

SEQ ID NO: 1239563 - protein, 9 aa, Homo Sapiens
LDQACHIRL

SEQ ID NO: 1239564 - protein, 9 aa, Homo Sapiens
DYDTLTNID

SEQ ID NO: 1239565 - protein, 9 aa, Homo Sapiens
TGPSCARSR

SEQ ID NO: 1239566 - protein, 9 aa, Homo Sapiens
LVYFSEKLH

SEQ ID NO: 1239567 - protein, 9 aa, Homo Sapiens
SKGTMITIE

SEQ ID NO: 1239568 - protein, 9 aa, Homo Sapiens
SIDQRYLCV

SEQ ID NO: 1239569 - protein, 9 aa, Homo Sapiens
FQPKRLHVS

SEQ ID NO: 1239570 - protein, 9 aa, Homo Sapiens
LEVVYTGWL

SEQ ID NO: 1239571 - protein, 9 aa, Homo Sapiens
GATGIVIWG

SEQ ID NO: 1239572 - protein, 9 aa, Homo Sapiens
CSKVRGRSE

SEQ ID NO: 1239573 - protein, 9 aa, Homo Sapiens
ESSTFQFCF

SEQ ID NO: 1239574 - protein, 9 aa, Homo Sapiens
FEPFYHLFD

SEQ ID NO: 1239575 - protein, 9 aa, Homo Sapiens
AENQQMTIQ

SEQ ID NO: 1239576 - protein, 9 aa, Homo Sapiens
KNRCFICRK

SEQ ID NO: 1239577 - protein, 9 aa, Homo Sapiens
VPTFMPLAK

SEQ ID NO: 1239578 - protein, 9 aa, Homo Sapiens
GHIWSSMRR

SEQ ID NO: 1239579 - protein, 9 aa, Homo Sapiens
YTQRQAQPH

SEQ ID NO: 1239580 - protein, 9 aa, Homo Sapiens
AMESATRST

SEQ ID NO: 1239581 - protein, 9 aa, Homo Sapiens
LALSWVVSM

SEQ ID NO: 1239582 - protein, 9 aa, Homo Sapiens
EMTKVQDFL

SEQ ID NO: 1239583 - protein, 9 aa, Homo Sapiens
PHVCQDIPA

SEQ ID NO: 1239584 - protein, 9 aa, Homo Sapiens
GYRLHRKWE

SEQ ID NO: 1239585 - protein, 9 aa, Homo Sapiens
DARKSLAQP

SEQ ID NO: 1239586 - protein, 9 aa, Homo Sapiens
QLVREMEEA

SEQ ID NO: 1239587 - protein, 9 aa, Homo Sapiens
HPAILNGRH

SEQ ID NO: 1239588 - protein, 9 aa, Homo Sapiens
PGFLARKVN

SEQ ID NO: 1239589 - protein, 9 aa, Homo Sapiens
APIGLYHLS

SEQ ID NO: 1239590 - protein, 9 aa, Homo Sapiens
QWTPETLTA

SEQ ID NO: 1239591 - protein, 9 aa, Homo Sapiens
AAAPQWCGW

SEQ ID NO: 1239592 - protein, 9 aa, Homo Sapiens
LLDLSEGEE

SEQ ID NO: 1239593 - protein, 9 aa, Homo Sapiens
RGGPDRIAL

SEQ ID NO: 1239594 - protein, 9 aa, Homo Sapiens
SRRSRSDNT

SEQ ID NO: 1239595 - protein, 9 aa, Homo Sapiens
HINIAIVRL

SEQ ID NO: 1239596 - protein, 9 aa, Homo Sapiens
DCSARQAEL

SEQ ID NO: 1239597 - protein, 9 aa, Homo Sapiens
SIKTRCEGL

SEQ ID NO: 1239598 - protein, 9 aa, Homo Sapiens
VLTFLDVLA

SEQ ID NO: 1239599 - protein, 9 aa, Homo Sapiens
SHRAPGQST

SEQ ID NO: 1239600 - protein, 9 aa, Homo Sapiens
YFLIQKIFY

SEQ ID NO: 1239601 - protein, 9 aa, Homo Sapiens
VVGLKSTQN

SEQ ID NO: 1239602 - protein, 9 aa, Homo Sapiens
VCGDRATDF

SEQ ID NO: 1239603 - protein, 9 aa, Homo Sapiens
VHERPPLTT

SEQ ID NO: 1239604 - protein, 9 aa, Homo Sapiens
AFVGDKDVT

SEQ ID NO: 1239605 - protein, 9 aa, Homo Sapiens
YNPYQVPKE

SEQ ID NO: 1239606 - protein, 9 aa, Homo Sapiens
DANIFVRVK

SEQ ID NO: 1239607 - protein, 9 aa, Homo Sapiens
LANVVFFPC

SEQ ID NO: 1239608 - protein, 9 aa, Homo Sapiens
CTNRLDKPK

SEQ ID NO: 1239609 - protein, 9 aa, Homo Sapiens
TNHKRIYTG

SEQ ID NO: 1239610 - protein, 9 aa, Homo Sapiens
RKTAEDLEI

SEQ ID NO: 1239611 - protein, 9 aa, Homo Sapiens
DIDKNTDVL

SEQ ID NO: 1239612 - protein, 9 aa, Homo Sapiens
MMTRRRTKL

SEQ ID NO: 1239613 - protein, 9 aa, Homo Sapiens
KSILTSALE

SEQ ID NO: 1239614 - protein, 9 aa, Homo Sapiens
GTLPPVPLH

SEQ ID NO: 1239615 - protein, 9 aa, Homo Sapiens
CDGKEYDNL

SEQ ID NO: 1239616 - protein, 9 aa, Homo Sapiens
SIWLGPNTV

SEQ ID NO: 1239617 - protein, 9 aa, Homo Sapiens
TSQEPASSE

SEQ ID NO: 1239618 - protein, 9 aa, Homo Sapiens
PAHPRPPAL

SEQ ID NO: 1239619 - protein, 9 aa, Homo Sapiens
LLIHHLCIT

SEQ ID NO: 1239620 - protein, 9 aa, Homo Sapiens
WSIISLECS

SEQ ID NO: 1239621 - protein, 9 aa, Homo Sapiens
HLLEGALIN

SEQ ID NO: 1239622 - protein, 9 aa, Homo Sapiens
LIFLEKCLH

SEQ ID NO: 1239623 - protein, 9 aa, Homo Sapiens
LSIFHTKDF

SEQ ID NO: 1239624 - protein, 9 aa, Homo Sapiens
RQATKCATI

SEQ ID NO: 1239625 - protein, 9 aa, Homo Sapiens
MVVIHAEHV

SEQ ID NO: 1239626 - protein, 9 aa, Homo Sapiens
LGNHYLYQI

SEQ ID NO: 1239627 - protein, 9 aa, Homo Sapiens
SALVNRMIV

SEQ ID NO: 1239628 - protein, 9 aa, Homo Sapiens
ASVSTPDSV

SEQ ID NO: 1239629 - protein, 9 aa, Homo Sapiens
EAFCLPGEA

SEQ ID NO: 1239630 - protein, 9 aa, Homo Sapiens
QSQEVETGG

SEQ ID NO: 1239631 - protein, 9 aa, Homo Sapiens
ELSNDLDTQ

SEQ ID NO: 1239632 - protein, 9 aa, Homo Sapiens
LQITIIANA

SEQ ID NO: 1239633 - protein, 9 aa, Homo Sapiens
KMLTAQDMF

SEQ ID NO: 1239634 - protein, 9 aa, Homo Sapiens
MNHDELKSS

SEQ ID NO: 1239635 - protein, 9 aa, Homo Sapiens
VCSGKFSSD

SEQ ID NO: 1239636 - protein, 9 aa, Homo Sapiens
FTAPYDGCY

SEQ ID NO: 1239637 - protein, 9 aa, Homo Sapiens
FGLVPEIIG

SEQ ID NO: 1239638 - protein, 9 aa, Homo Sapiens
HFYECCIRG

SEQ ID NO: 1239639 - protein, 9 aa, Homo Sapiens
EHTKPIQDV

SEQ ID NO: 1239640 - protein, 9 aa, Homo Sapiens
DNLKQFYKG

SEQ ID NO: 1239641 - protein, 9 aa, Homo Sapiens
TTGHLVIYM

SEQ ID NO: 1239642 - protein, 9 aa, Homo Sapiens
LWLGTLCPG

SEQ ID NO: 1239643 - protein, 9 aa, Homo Sapiens
VIQDFIFFV

SEQ ID NO: 1239644 - protein, 9 aa, Homo Sapiens
PIVQRMPAF

SEQ ID NO: 1239645 - protein, 9 aa, Homo Sapiens
QYGRTSEFL

SEQ ID NO: 1239646 - protein, 9 aa, Homo Sapiens
DILSPCKEC

SEQ ID NO: 1239647 - protein, 9 aa, Homo Sapiens
FFVSCHTQF

SEQ ID NO: 1239648 - protein, 9 aa, Homo Sapiens
MIGQKIALS

SEQ ID NO: 1239649 - protein, 9 aa, Homo Sapiens
RWGSSLIIH

SEQ ID NO: 1239650 - protein, 9 aa, Homo Sapiens
MNKDYQQFW

SEQ ID NO: 1239651 - protein, 9 aa, Homo Sapiens
MRTINQQAM

SEQ ID NO: 1239652 - protein, 9 aa, Homo Sapiens
SIISSTIMD

SEQ ID NO: 1239653 - protein, 9 aa, Homo Sapiens
LAIVFMGAK

SEQ ID NO: 1239654 - protein, 9 aa, Homo Sapiens
DMAFDRYVA

SEQ ID NO: 1239655 - protein, 9 aa, Homo Sapiens
IIDYTLSCL

SEQ ID NO: 1239656 - protein, 9 aa, Homo Sapiens
RAPAQAHMA

SEQ ID NO: 1239657 - protein, 9 aa, Homo Sapiens
SHEIQHFFV

SEQ ID NO: 1239658 - protein, 9 aa, Homo Sapiens
GEFLWQVSI

SEQ ID NO: 1239659 - protein, 9 aa, Homo Sapiens
FILGCTWYL

SEQ ID NO: 1239660 - protein, 9 aa, Homo Sapiens
GAFLRASIY

SEQ ID NO: 1239661 - protein, 9 aa, Homo Sapiens
VAVKEKQKW

SEQ ID NO: 1239662 - protein, 9 aa, Homo Sapiens
ICNRDISPT

SEQ ID NO: 1239663 - protein, 9 aa, Homo Sapiens
CRSLGLLFK

SEQ ID NO: 1239664 - protein, 9 aa, Homo Sapiens
SDAGNPVIM

SEQ ID NO: 1239665 - protein, 9 aa, Homo Sapiens
PPRLNTSAE

SEQ ID NO: 1239666 - protein, 9 aa, Homo Sapiens
FQYANARDR

SEQ ID NO: 1239667 - protein, 9 aa, Homo Sapiens
DFAMSHFRS

SEQ ID NO: 1239668 - protein, 9 aa, Homo Sapiens
RSCEGGVQE

SEQ ID NO: 1239669 - protein, 9 aa, Homo Sapiens
HFVYQKVKL

SEQ ID NO: 1239670 - protein, 9 aa, Homo Sapiens
VQPRRSAPK

SEQ ID NO: 1239671 - protein, 9 aa, Homo Sapiens
VSSISTETE

SEQ ID NO: 1239672 - protein, 9 aa, Homo Sapiens
TNFLGFLLL

SEQ ID NO: 1239673 - protein, 9 aa, Homo Sapiens
AEGSKATNG

SEQ ID NO: 1239674 - protein, 9 aa, Homo Sapiens
NECNKQRSH

SEQ ID NO: 1239675 - protein, 9 aa, Homo Sapiens
TRCHRIGQS

SEQ ID NO: 1239676 - protein, 9 aa, Homo Sapiens
NYLITSLAV

SEQ ID NO: 1239677 - protein, 9 aa, Homo Sapiens
RDHTDRTKA

SEQ ID NO: 1239678 - protein, 9 aa, Homo Sapiens
RREFHSIDV

SEQ ID NO: 1239679 - protein, 9 aa, Homo Sapiens
IHIGFPFSF

SEQ ID NO: 1239680 - protein, 9 aa, Homo Sapiens
SSNQGKYPM

SEQ ID NO: 1239681 - protein, 9 aa, Homo Sapiens
YATVLVLWP

SEQ ID NO: 1239682 - protein, 9 aa, Homo Sapiens
FRHATILIY

SEQ ID NO: 1239683 - protein, 9 aa, Homo Sapiens
PELKATADE

SEQ ID NO: 1239684 - protein, 9 aa, Homo Sapiens
EVQLSSARA

SEQ ID NO: 1239685 - protein, 9 aa, Homo Sapiens
YNISIGYSG

SEQ ID NO: 1239686 - protein, 9 aa, Homo Sapiens
KMAATKLNS

SEQ ID NO: 1239687 - protein, 9 aa, Homo Sapiens
ASAWPFITT

SEQ ID NO: 1239688 - protein, 9 aa, Homo Sapiens
FDMGGMSTD

SEQ ID NO: 1239689 - protein, 9 aa, Homo Sapiens
QRSSDIFDC

SEQ ID NO: 1239690 - protein, 9 aa, Homo Sapiens
NTVNMASRM

SEQ ID NO: 1239691 - protein, 9 aa, Homo Sapiens
SRILNNGLD

SEQ ID NO: 1239692 - protein, 9 aa, Homo Sapiens
EDPAPGKVG

SEQ ID NO: 1239693 - protein, 9 aa, Homo Sapiens
QQGLTEIPS

SEQ ID NO: 1239694 - protein, 9 aa, Homo Sapiens
QRFQYANAR

SEQ ID NO: 1239695 - protein, 9 aa, Homo Sapiens
EADGELTAA

SEQ ID NO: 1239696 - protein, 9 aa, Homo Sapiens
SPPFEGMEI

SEQ ID NO: 1239697 - protein, 9 aa, Homo Sapiens
LMKTGKCIH

SEQ ID NO: 1239698 - protein, 9 aa, Homo Sapiens
ILDPSIKGT

SEQ ID NO: 1239699 - protein, 9 aa, Homo Sapiens
KCYIIEHID

SEQ ID NO: 1239700 - protein, 9 aa, Homo Sapiens
IEVLYTSTA

SEQ ID NO: 1239701 - protein, 9 aa, Homo Sapiens
QILLVTHIL

SEQ ID NO: 1239702 - protein, 9 aa, Homo Sapiens
LTLLYLAHV

SEQ ID NO: 1239703 - protein, 9 aa, Homo Sapiens
DEVAWLKML

SEQ ID NO: 1239704 - protein, 9 aa, Homo Sapiens
AVFYSIITP

SEQ ID NO: 1239705 - protein, 9 aa, Homo Sapiens
TTTVTGTKD

SEQ ID NO: 1239706 - protein, 9 aa, Homo Sapiens
GVTSFVSSW

SEQ ID NO: 1239707 - protein, 9 aa, Homo Sapiens
AAKAYEQAE

SEQ ID NO: 1239708 - protein, 9 aa, Homo Sapiens
PVTSSGTAP

SEQ ID NO: 1239709 - protein, 9 aa, Homo Sapiens
SVVKKVVVS

SEQ ID NO: 1239710 - protein, 9 aa, Homo Sapiens
REVVKHPSA

SEQ ID NO: 1239711 - protein, 9 aa, Homo Sapiens
ENIVCLIRK

SEQ ID NO: 1239712 - protein, 9 aa, Homo Sapiens
DLEPERDVM

SEQ ID NO: 1239713 - protein, 9 aa, Homo Sapiens
DQDENPLPA

SEQ ID NO: 1239714 - protein, 9 aa, Homo Sapiens
TRGYERIPI

SEQ ID NO: 1239715 - protein, 9 aa, Homo Sapiens
GNVYTAQNP

SEQ ID NO: 1239716 - protein, 9 aa, Homo Sapiens
GTPSYSPYV

SEQ ID NO: 1239717 - protein, 9 aa, Homo Sapiens
KWVTGGQAF

SEQ ID NO: 1239718 - protein, 9 aa, Homo Sapiens
INADNSHLF

SEQ ID NO: 1239719 - protein, 9 aa, Homo Sapiens
NRPYTDGPD

SEQ ID NO: 1239720 - protein, 9 aa, Homo Sapiens
VANAAGAEA

SEQ ID NO: 1239721 - protein, 9 aa, Homo Sapiens
PPGPPGVHG

SEQ ID NO: 1239722 - protein, 9 aa, Homo Sapiens
GLRVYFNLP

SEQ ID NO: 1239723 - protein, 9 aa, Homo Sapiens
ADDTFSHLQ

SEQ ID NO: 1239724 - protein, 9 aa, Homo Sapiens
FVCYLGDPN

SEQ ID NO: 1239725 - protein, 9 aa, Homo Sapiens
LAAAWDGSP

SEQ ID NO: 1239726 - protein, 9 aa, Homo Sapiens
IRVTSLRYS

SEQ ID NO: 1239727 - protein, 9 aa, Homo Sapiens
SDQQLVELR

SEQ ID NO: 1239728 - protein, 9 aa, Homo Sapiens
DCHTDDLTK

SEQ ID NO: 1239729 - protein, 9 aa, Homo Sapiens
CYSCKGNIT

SEQ ID NO: 1239730 - protein, 9 aa, Homo Sapiens
GRKHQGRIV

SEQ ID NO: 1239731 - protein, 9 aa, Homo Sapiens
ISLRSRLEA

SEQ ID NO: 1239732 - protein, 9 aa, Homo Sapiens
CKQYGKAFT

SEQ ID NO: 1239733 - protein, 9 aa, Homo Sapiens
QLLRMGGGR

SEQ ID NO: 1239734 - protein, 9 aa, Homo Sapiens
VLLQNWPSM

SEQ ID NO: 1239735 - protein, 9 aa, Homo Sapiens
QILLERHML

SEQ ID NO: 1239736 - protein, 9 aa, Homo Sapiens
KCIAKKKTH

SEQ ID NO: 1239737 - protein, 9 aa, Homo Sapiens
SRATPAAGS

SEQ ID NO: 1239738 - protein, 9 aa, Homo Sapiens
HLDTDPSNL

SEQ ID NO: 1239739 - protein, 9 aa, Homo Sapiens
RIGHSQSAD

SEQ ID NO: 1239740 - protein, 9 aa, Homo Sapiens
GGYELREPY

SEQ ID NO: 1239741 - protein, 9 aa, Homo Sapiens
PRPMEAPAP

SEQ ID NO: 1239742 - protein, 9 aa, Homo Sapiens
RHYVVARLL

SEQ ID NO: 1239743 - protein, 9 aa, Homo Sapiens
ANAHLVASF

SEQ ID NO: 1239744 - protein, 9 aa, Homo Sapiens
YISICNRDI

SEQ ID NO: 1239745 - protein, 9 aa, Homo Sapiens
RPYTDGPDG

SEQ ID NO: 1239746 - protein, 9 aa, Homo Sapiens
CCNIYRNII

SEQ ID NO: 1239747 - protein, 9 aa, Homo Sapiens
KALNNGSHM

SEQ ID NO: 1239748 - protein, 9 aa, Homo Sapiens
SMCYCIYSV

SEQ ID NO: 1239749 - protein, 9 aa, Homo Sapiens
VTVGGINGH

SEQ ID NO: 1239750 - protein, 9 aa, Homo Sapiens
YARDGLCTL

SEQ ID NO: 1239751 - protein, 9 aa, Homo Sapiens
KLEHKTKSG

SEQ ID NO: 1239752 - protein, 9 aa, Homo Sapiens
GFCGGNLRS

SEQ ID NO: 1239753 - protein, 9 aa, Homo Sapiens
KKIVYQQSQ

SEQ ID NO: 1239754 - protein, 9 aa, Homo Sapiens
GLQEGQRCV

SEQ ID NO: 1239755 - protein, 9 aa, Homo Sapiens
SINIHAGSC

SEQ ID NO: 1239756 - protein, 9 aa, Homo Sapiens
LGPLGSRTL

SEQ ID NO: 1239757 - protein, 9 aa, Homo Sapiens
RTPPIMRII

SEQ ID NO: 1239758 - protein, 9 aa, Homo Sapiens
RRHSSNYRA

SEQ ID NO: 1239759 - protein, 9 aa, Homo Sapiens
IASEDSRLA

SEQ ID NO: 1239760 - protein, 9 aa, Homo Sapiens
SSSSMVFPG

SEQ ID NO: 1239761 - protein, 9 aa, Homo Sapiens
CGHPWVAYS

SEQ ID NO: 1239762 - protein, 9 aa, Homo Sapiens
FLTPLHNFL

SEQ ID NO: 1239763 - protein, 9 aa, Homo Sapiens
QLHITIAVM

SEQ ID NO: 1239764 - protein, 9 aa, Homo Sapiens
TLQVLIKHE

SEQ ID NO: 1239765 - protein, 9 aa, Homo Sapiens
ARAIMTQLP

SEQ ID NO: 1239766 - protein, 9 aa, Homo Sapiens
GCRPYMTPE

SEQ ID NO: 1239767 - protein, 9 aa, Homo Sapiens
HRYTKLSYC

SEQ ID NO: 1239768 - protein, 9 aa, Homo Sapiens
PRVTRCYRH

SEQ ID NO: 1239769 - protein, 9 aa, Homo Sapiens
TCQKMSPKW

SEQ ID NO: 1239770 - protein, 9 aa, Homo Sapiens
GGYHQIGSA

SEQ ID NO: 1239771 - protein, 9 aa, Homo Sapiens
VKAWTSQYF

SEQ ID NO: 1239772 - protein, 9 aa, Homo Sapiens
IMTRGNVKY

SEQ ID NO: 1239773 - protein, 9 aa, Homo Sapiens
RRMCRIIAE

SEQ ID NO: 1239774 - protein, 9 aa, Homo Sapiens
EKHHMLKIM

SEQ ID NO: 1239775 - protein, 9 aa, Homo Sapiens
KNKAVNMIF

SEQ ID NO: 1239776 - protein, 9 aa, Homo Sapiens
GTDGVAWTP

SEQ ID NO: 1239777 - protein, 9 aa, Homo Sapiens
RLRENRRHP

SEQ ID NO: 1239778 - protein, 9 aa, Homo Sapiens
RQVTRAGIK

SEQ ID NO: 1239779 - protein, 9 aa, Homo Sapiens
ALPNLREMW

SEQ ID NO: 1239780 - protein, 9 aa, Homo Sapiens
SRSLMLGPS

SEQ ID NO: 1239781 - protein, 9 aa, Homo Sapiens
LNDHGVFLN

SEQ ID NO: 1239782 - protein, 9 aa, Homo Sapiens
LTHPPASEG

SEQ ID NO: 1239783 - protein, 9 aa, Homo Sapiens
YELRMIDVF

SEQ ID NO: 1239784 - protein, 9 aa, Homo Sapiens
ITNYVKEFS

SEQ ID NO: 1239785 - protein, 9 aa, Homo Sapiens
SSSSDLHLI

SEQ ID NO: 1239786 - protein, 9 aa, Homo Sapiens
VVARLPYCR

SEQ ID NO: 1239787 - protein, 9 aa, Homo Sapiens
LELREGVTR

SEQ ID NO: 1239788 - protein, 9 aa, Homo Sapiens
SLFHRRRAQ

SEQ ID NO: 1239789 - protein, 9 aa, Homo Sapiens
ILHSTAEQD

SEQ ID NO: 1239790 - protein, 9 aa, Homo Sapiens
VAASSLLHD

SEQ ID NO: 1239791 - protein, 9 aa, Homo Sapiens
IKHQQVHTG

SEQ ID NO: 1239792 - protein, 9 aa, Homo Sapiens
ASLKKDQKA

SEQ ID NO: 1239793 - protein, 9 aa, Homo Sapiens
SEPSVFQCV

SEQ ID NO: 1239794 - protein, 9 aa, Homo Sapiens
DVLFAMSTL

SEQ ID NO: 1239795 - protein, 9 aa, Homo Sapiens
VLGLPNRDQ

SEQ ID NO: 1239796 - protein, 9 aa, Homo Sapiens
ECYGHVLSG

SEQ ID NO: 1239797 - protein, 9 aa, Homo Sapiens
FPWMRPHTP

SEQ ID NO: 1239798 - protein, 9 aa, Homo Sapiens
GPAEGERQA

SEQ ID NO: 1239799 - protein, 9 aa, Homo Sapiens
GQKQRIVIA

SEQ ID NO: 1239800 - protein, 9 aa, Homo Sapiens
EMAASPSSS

SEQ ID NO: 1239801 - protein, 9 aa, Homo Sapiens
MCWASDTMY

SEQ ID NO: 1239802 - protein, 9 aa, Homo Sapiens
AVMAAVGAL

SEQ ID NO: 1239803 - protein, 9 aa, Homo Sapiens
IRYEFVIFN

SEQ ID NO: 1239804 - protein, 9 aa, Homo Sapiens
VLSQPNATP

SEQ ID NO: 1239805 - protein, 9 aa, Homo Sapiens
RAPGCTGTL

SEQ ID NO: 1239806 - protein, 9 aa, Homo Sapiens
FNILKNIFK

SEQ ID NO: 1239807 - protein, 9 aa, Homo Sapiens
HSFSKERTE

SEQ ID NO: 1239808 - protein, 9 aa, Homo Sapiens
EEEAVSLPD

SEQ ID NO: 1239809 - protein, 9 aa, Homo Sapiens
WDYYPDRSW

SEQ ID NO: 1239810 - protein, 9 aa, Homo Sapiens
KCDSGCDET

SEQ ID NO: 1239811 - protein, 9 aa, Homo Sapiens
HATFSIINI

SEQ ID NO: 1239812 - protein, 9 aa, Homo Sapiens
GDVKRCEEL

SEQ ID NO: 1239813 - protein, 9 aa, Homo Sapiens
EEKHEAATC

SEQ ID NO: 1239814 - protein, 9 aa, Homo Sapiens
HIMSCNKQL

SEQ ID NO: 1239815 - protein, 9 aa, Homo Sapiens
GHATTLIQS

SEQ ID NO: 1239816 - protein, 9 aa, Homo Sapiens
DVFLEADVQ

SEQ ID NO: 1239817 - protein, 9 aa, Homo Sapiens
VNVMNKMHT

SEQ ID NO: 1239818 - protein, 9 aa, Homo Sapiens
ATLSKPKAI

SEQ ID NO: 1239819 - protein, 9 aa, Homo Sapiens
PGLEPEDNN

SEQ ID NO: 1239820 - protein, 9 aa, Homo Sapiens
DSIMNSTEY

SEQ ID NO: 1239821 - protein, 9 aa, Homo Sapiens
PAEEELKMK

SEQ ID NO: 1239822 - protein, 9 aa, Homo Sapiens
KLEKQLMKL

SEQ ID NO: 1239823 - protein, 9 aa, Homo Sapiens
KQASSMAVV

SEQ ID NO: 1239824 - protein, 9 aa, Homo Sapiens
QEMVCMVRA

SEQ ID NO: 1239825 - protein, 9 aa, Homo Sapiens
KMIVFEPYQ

SEQ ID NO: 1239826 - protein, 9 aa, Homo Sapiens
MQLLYFFPR

SEQ ID NO: 1239827 - protein, 9 aa, Homo Sapiens
GHLPREGAY

SEQ ID NO: 1239828 - protein, 9 aa, Homo Sapiens
LLIFLVQYL

SEQ ID NO: 1239829 - protein, 9 aa, Homo Sapiens
LQCPKCDKI

SEQ ID NO: 1239830 - protein, 9 aa, Homo Sapiens
RDQCPSAWP

SEQ ID NO: 1239831 - protein, 9 aa, Homo Sapiens
SISSALAIV

SEQ ID NO: 1239832 - protein, 9 aa, Homo Sapiens
RQHSYSSKP

SEQ ID NO: 1239833 - protein, 9 aa, Homo Sapiens
PSNHQSQPL

SEQ ID NO: 1239834 - protein, 9 aa, Homo Sapiens
SYAARNGLL

SEQ ID NO: 1239835 - protein, 9 aa, Homo Sapiens
LWDILQKTV

SEQ ID NO: 1239836 - protein, 9 aa, Homo Sapiens
REDDLDDSV

SEQ ID NO: 1239837 - protein, 9 aa, Homo Sapiens
INPPQYFAI

SEQ ID NO: 1239838 - protein, 9 aa, Homo Sapiens
GVMGVYGGM

SEQ ID NO: 1239839 - protein, 9 aa, Homo Sapiens
VSNTVSGLW

SEQ ID NO: 1239840 - protein, 9 aa, Homo Sapiens
RLENLLTDD

SEQ ID NO: 1239841 - protein, 9 aa, Homo Sapiens
AAVRIGIVF

SEQ ID NO: 1239842 - protein, 9 aa, Homo Sapiens
PSLVKISEE

SEQ ID NO: 1239843 - protein, 9 aa, Homo Sapiens
SETNHWRCM

SEQ ID NO: 1239844 - protein, 9 aa, Homo Sapiens
TFLLIKEWA

SEQ ID NO: 1239845 - protein, 9 aa, Homo Sapiens
HLIFDVRVS

SEQ ID NO: 1239846 - protein, 9 aa, Homo Sapiens
VCSLISSDN

SEQ ID NO: 1239847 - protein, 9 aa, Homo Sapiens
GKVEIVLLD

SEQ ID NO: 1239848 - protein, 9 aa, Homo Sapiens
ADARLTAQC

SEQ ID NO: 1239849 - protein, 9 aa, Homo Sapiens
IGRLCEHCP

SEQ ID NO: 1239850 - protein, 9 aa, Homo Sapiens
SGAFLRASI

SEQ ID NO: 1239851 - protein, 9 aa, Homo Sapiens
DGLSKDTSR

SEQ ID NO: 1239852 - protein, 9 aa, Homo Sapiens
GNDMGYVRM

SEQ ID NO: 1239853 - protein, 9 aa, Homo Sapiens
RVTRCYRHN

SEQ ID NO: 1239854 - protein, 9 aa, Homo Sapiens
QWHYLGSLQ

SEQ ID NO: 1239855 - protein, 9 aa, Homo Sapiens
PAHWTIQKV

SEQ ID NO: 1239856 - protein, 9 aa, Homo Sapiens
DQILCDVPC

SEQ ID NO: 1239857 - protein, 9 aa, Homo Sapiens
GNTILHMDT

SEQ ID NO: 1239858 - protein, 9 aa, Homo Sapiens
LDECYHSDF

SEQ ID NO: 1239859 - protein, 9 aa, Homo Sapiens
KNVMRVWFC

SEQ ID NO: 1239860 - protein, 9 aa, Homo Sapiens
GNTPAQQPG

SEQ ID NO: 1239861 - protein, 9 aa, Homo Sapiens
YMDAIRFLL

SEQ ID NO: 1239862 - protein, 9 aa, Homo Sapiens
LFKLTIDMG

SEQ ID NO: 1239863 - protein, 9 aa, Homo Sapiens
TLVLVGMGP

SEQ ID NO: 1239864 - protein, 9 aa, Homo Sapiens
LCAALIFFT

SEQ ID NO: 1239865 - protein, 9 aa, Homo Sapiens
CGCGFKHFC

SEQ ID NO: 1239866 - protein, 9 aa, Homo Sapiens
YRLVKQIIS

SEQ ID NO: 1239867 - protein, 9 aa, Homo Sapiens
GFPERPYLA

SEQ ID NO: 1239868 - protein, 9 aa, Homo Sapiens
SCPLSERHA

SEQ ID NO: 1239869 - protein, 9 aa, Homo Sapiens
GFVPGMFGT

SEQ ID NO: 1239870 - protein, 9 aa, Homo Sapiens
WSVHPLVGH

SEQ ID NO: 1239871 - protein, 9 aa, Homo Sapiens
YNPAAVVVV

SEQ ID NO: 1239872 - protein, 9 aa, Homo Sapiens
AGSLTNLSK

SEQ ID NO: 1239873 - protein, 9 aa, Homo Sapiens
QVALAASVS

SEQ ID NO: 1239874 - protein, 9 aa, Homo Sapiens
RQAALGPST

SEQ ID NO: 1239875 - protein, 9 aa, Homo Sapiens
LSSSWLCGP

SEQ ID NO: 1239876 - protein, 9 aa, Homo Sapiens
RRRRPRGMM

SEQ ID NO: 1239877 - protein, 9 aa, Homo Sapiens
KNFVAQMLV

SEQ ID NO: 1239878 - protein, 9 aa, Homo Sapiens
SLLTPPHRV

SEQ ID NO: 1239879 - protein, 9 aa, Homo Sapiens
QHLVCTCPS

SEQ ID NO: 1239880 - protein, 9 aa, Homo Sapiens
FKYEFCDVR

SEQ ID NO: 1239881 - protein, 9 aa, Homo Sapiens
WQTADISTR

SEQ ID NO: 1239882 - protein, 9 aa, Homo Sapiens
ADNAGGIHA

SEQ ID NO: 1239883 - protein, 9 aa, Homo Sapiens
EALKLHIQE

SEQ ID NO: 1239884 - protein, 9 aa, Homo Sapiens
GTSMQPYSP

SEQ ID NO: 1239885 - protein, 9 aa, Homo Sapiens
DGPFSQIVA

SEQ ID NO: 1239886 - protein, 9 aa, Homo Sapiens
IRSLNMVPS

SEQ ID NO: 1239887 - protein, 9 aa, Homo Sapiens
RVEIVTAMR

SEQ ID NO: 1239888 - protein, 9 aa, Homo Sapiens
IKTAHTTMA

SEQ ID NO: 1239889 - protein, 9 aa, Homo Sapiens
GGRCCLVNK

SEQ ID NO: 1239890 - protein, 9 aa, Homo Sapiens
SSDSHLRTP

SEQ ID NO: 1239891 - protein, 9 aa, Homo Sapiens
TDLHVTNQG

SEQ ID NO: 1239892 - protein, 9 aa, Homo Sapiens
AEPNRIPSS

SEQ ID NO: 1239893 - protein, 9 aa, Homo Sapiens
ATERDCASP

SEQ ID NO: 1239894 - protein, 9 aa, Homo Sapiens
ARALDNGLT

SEQ ID NO: 1239895 - protein, 9 aa, Homo Sapiens
VCAPEDVTS

SEQ ID NO: 1239896 - protein, 9 aa, Homo Sapiens
LPKILLTSD

SEQ ID NO: 1239897 - protein, 9 aa, Homo Sapiens
IPETKEKTS

SEQ ID NO: 1239898 - protein, 9 aa, Homo Sapiens
QPKRKEYEM

SEQ ID NO: 1239899 - protein, 9 aa, Homo Sapiens
HRIQVIASD

SEQ ID NO: 1239900 - protein, 9 aa, Homo Sapiens
PFDSMNTFR

SEQ ID NO: 1239901 - protein, 9 aa, Homo Sapiens
PYYLATVDV

SEQ ID NO: 1239902 - protein, 9 aa, Homo Sapiens
QHNFTHHLL

SEQ ID NO: 1239903 - protein, 9 aa, Homo Sapiens
YKPDFFIKT

SEQ ID NO: 1239904 - protein, 9 aa, Homo Sapiens
TSTVAIPAI

SEQ ID NO: 1239905 - protein, 9 aa, Homo Sapiens
SSLPNPRHG

SEQ ID NO: 1239906 - protein, 9 aa, Homo Sapiens
LLKNKETFW

SEQ ID NO: 1239907 - protein, 9 aa, Homo Sapiens
MLTTNLFIA

SEQ ID NO: 1239908 - protein, 9 aa, Homo Sapiens
NTHLPRQPS

SEQ ID NO: 1239909 - protein, 9 aa, Homo Sapiens
APQWCGWRR

SEQ ID NO: 1239910 - protein, 9 aa, Homo Sapiens
AQLLTLVLE

SEQ ID NO: 1239911 - protein, 9 aa, Homo Sapiens
YRWCPKAET

SEQ ID NO: 1239912 - protein, 9 aa, Homo Sapiens
YWCCCCSCS

SEQ ID NO: 1239913 - protein, 9 aa, Homo Sapiens
SRMQHQSQK

SEQ ID NO: 1239914 - protein, 9 aa, Homo Sapiens
GFGIDGTAI

SEQ ID NO: 1239915 - protein, 9 aa, Homo Sapiens
HQAAPLIDA

SEQ ID NO: 1239916 - protein, 9 aa, Homo Sapiens
VYMDCKGRG

SEQ ID NO: 1239917 - protein, 9 aa, Homo Sapiens
TGNRKTVLF

SEQ ID NO: 1239918 - protein, 9 aa, Homo Sapiens
LNVLLMAVE

SEQ ID NO: 1239919 - protein, 9 aa, Homo Sapiens
FNKWNATNK

SEQ ID NO: 1239920 - protein, 9 aa, Homo Sapiens
GPTTIHVQW

SEQ ID NO: 1239921 - protein, 9 aa, Homo Sapiens
LYLLQNGSA

SEQ ID NO: 1239922 - protein, 9 aa, Homo Sapiens
ARYMCDVED

SEQ ID NO: 1239923 - protein, 9 aa, Homo Sapiens
LCLDGDLFR

SEQ ID NO: 1239924 - protein, 9 aa, Homo Sapiens
GFPSGMRAA

SEQ ID NO: 1239925 - protein, 9 aa, Homo Sapiens
LVTLWIIDC

SEQ ID NO: 1239926 - protein, 9 aa, Homo Sapiens
SGFSMEQVQ

SEQ ID NO: 1239927 - protein, 9 aa, Homo Sapiens
GCVMTGRTG

SEQ ID NO: 1239928 - protein, 9 aa, Homo Sapiens
RHLQEGDLP

SEQ ID NO: 1239929 - protein, 9 aa, Homo Sapiens
EAPAAEVSG

SEQ ID NO: 1239930 - protein, 9 aa, Homo Sapiens
FSFECSSNC

SEQ ID NO: 1239931 - protein, 9 aa, Homo Sapiens
QMDLMCAQL

SEQ ID NO: 1239932 - protein, 9 aa, Homo Sapiens
LMIWSVTNK

SEQ ID NO: 1239933 - protein, 9 aa, Homo Sapiens
VMQCWRCKC

SEQ ID NO: 1239934 - protein, 9 aa, Homo Sapiens
QKFTGCGGR

SEQ ID NO: 1239935 - protein, 9 aa, Homo Sapiens
GSSETRGEC

SEQ ID NO: 1239936 - protein, 9 aa, Homo Sapiens
PSSFSPHSS

SEQ ID NO: 1239937 - protein, 9 aa, Homo Sapiens
TLKLIPRKD

SEQ ID NO: 1239938 - protein, 9 aa, Homo Sapiens
ISKESESHI

SEQ ID NO: 1239939 - protein, 9 aa, Homo Sapiens
MMDKLKTHV

SEQ ID NO: 1239940 - protein, 9 aa, Homo Sapiens
EIVIHIHNK

SEQ ID NO: 1239941 - protein, 9 aa, Homo Sapiens
GDNEKAKAH

SEQ ID NO: 1239942 - protein, 9 aa, Homo Sapiens
AQHYKKVGE

SEQ ID NO: 1239943 - protein, 9 aa, Homo Sapiens
GIHTDTDTH

SEQ ID NO: 1239944 - protein, 9 aa, Homo Sapiens
GCTLQKFMD

SEQ ID NO: 1239945 - protein, 9 aa, Homo Sapiens
NLMGDAMVM

SEQ ID NO: 1239946 - protein, 9 aa, Homo Sapiens
KVLDLLWIT

SEQ ID NO: 1239947 - protein, 9 aa, Homo Sapiens
VDTRRTVPP

SEQ ID NO: 1239948 - protein, 9 aa, Homo Sapiens
FLAPGMCVV

SEQ ID NO: 1239949 - protein, 9 aa, Homo Sapiens
KRSFRTSVT

SEQ ID NO: 1239950 - protein, 9 aa, Homo Sapiens
VSESLWQLK

SEQ ID NO: 1239951 - protein, 9 aa, Homo Sapiens
LPLLPALCL

SEQ ID NO: 1239952 - protein, 9 aa, Homo Sapiens
CCGSFIPAR

SEQ ID NO: 1239953 - protein, 9 aa, Homo Sapiens
QPTLPGPGP

SEQ ID NO: 1239954 - protein, 9 aa, Homo Sapiens
KYVLTPSEA

SEQ ID NO: 1239955 - protein, 9 aa, Homo Sapiens
CLSIWALIL

SEQ ID NO: 1239956 - protein, 9 aa, Homo Sapiens
ARVTNMKAS

SEQ ID NO: 1239957 - protein, 9 aa, Homo Sapiens
LLVLGSVKY

SEQ ID NO: 1239958 - protein, 9 aa, Homo Sapiens
VNVDCMSWL

SEQ ID NO: 1239959 - protein, 9 aa, Homo Sapiens
DRPQARTLS

SEQ ID NO: 1239960 - protein, 9 aa, Homo Sapiens
QESGMALDE

SEQ ID NO: 1239961 - protein, 9 aa, Homo Sapiens
PNSELMPFL

SEQ ID NO: 1239962 - protein, 9 aa, Homo Sapiens
DKYPTRNSI

SEQ ID NO: 1239963 - protein, 9 aa, Homo Sapiens
SLAYSTPQP

SEQ ID NO: 1239964 - protein, 9 aa, Homo Sapiens
HEVPLVQLD

SEQ ID NO: 1239965 - protein, 9 aa, Homo Sapiens
AADAQEENI

SEQ ID NO: 1239966 - protein, 9 aa, Homo Sapiens
IRDPLLGML

SEQ ID NO: 1239967 - protein, 9 aa, Homo Sapiens
NTVKREDAG

SEQ ID NO: 1239968 - protein, 9 aa, Homo Sapiens
KGFAPLNQT

SEQ ID NO: 1239969 - protein, 9 aa, Homo Sapiens
TYIKSCAGY

SEQ ID NO: 1239970 - protein, 9 aa, Homo Sapiens
ATKAVTEMS

SEQ ID NO: 1239971 - protein, 9 aa, Homo Sapiens
VSLQNCILF

SEQ ID NO: 1239972 - protein, 9 aa, Homo Sapiens
KINRTLETV

SEQ ID NO: 1239973 - protein, 9 aa, Homo Sapiens
ANFLGSGTG

SEQ ID NO: 1239974 - protein, 9 aa, Homo Sapiens
LRHEKQKLV

SEQ ID NO: 1239975 - protein, 9 aa, Homo Sapiens
GGRNTDHHI

SEQ ID NO: 1239976 - protein, 9 aa, Homo Sapiens
KVTVESSVL

SEQ ID NO: 1239977 - protein, 9 aa, Homo Sapiens
SEQLQNNGL

SEQ ID NO: 1239978 - protein, 9 aa, Homo Sapiens
AIKERRCML

SEQ ID NO: 1239979 - protein, 9 aa, Homo Sapiens
FENYQMQSE

SEQ ID NO: 1239980 - protein, 9 aa, Homo Sapiens
LWVGGAESL

SEQ ID NO: 1239981 - protein, 9 aa, Homo Sapiens
ATAEYSRLL

SEQ ID NO: 1239982 - protein, 9 aa, Homo Sapiens
SWSFRNIYK

SEQ ID NO: 1239983 - protein, 9 aa, Homo Sapiens
GSSGNSGRN

SEQ ID NO: 1239984 - protein, 9 aa, Homo Sapiens
AAWCDGLDW

SEQ ID NO: 1239985 - protein, 9 aa, Homo Sapiens
WVNPYMDGA

SEQ ID NO: 1239986 - protein, 9 aa, Homo Sapiens
LNSKFGKGY

SEQ ID NO: 1239987 - protein, 9 aa, Homo Sapiens
AVLNPRGVV

SEQ ID NO: 1239988 - protein, 9 aa, Homo Sapiens
DALFREYQE

SEQ ID NO: 1239989 - protein, 9 aa, Homo Sapiens
KQRIVIARA

SEQ ID NO: 1239990 - protein, 9 aa, Homo Sapiens
PPHISTDPV

SEQ ID NO: 1239991 - protein, 9 aa, Homo Sapiens
QTMYLSFIT

SEQ ID NO: 1239992 - protein, 9 aa, Homo Sapiens
VIVTERVIE

SEQ ID NO: 1239993 - protein, 9 aa, Homo Sapiens
KNKDPKMYR

SEQ ID NO: 1239994 - protein, 9 aa, Homo Sapiens
KQKKEEKNM

SEQ ID NO: 1239995 - protein, 9 aa, Homo Sapiens
MTPGELLKA

SEQ ID NO: 1239996 - protein, 9 aa, Homo Sapiens
HQKDPVLDT

SEQ ID NO: 1239997 - protein, 9 aa, Homo Sapiens
IRTGYRPAG

SEQ ID NO: 1239998 - protein, 9 aa, Homo Sapiens
GKAFTDMSN

SEQ ID NO: 1239999 - protein, 9 aa, Homo Sapiens
RSLNMVPSI

SEQ ID NO: 1240000 - protein, 9 aa, Homo Sapiens
DGVLQTHPS

SEQ ID NO: 1240001 - protein, 9 aa, Homo Sapiens
CGVHNLHSL

SEQ ID NO: 1240002 - protein, 9 aa, Homo Sapiens
HMPGDVPVC

SEQ ID NO: 1240003 - protein, 9 aa, Homo Sapiens
EELHHLRLP

SEQ ID NO: 1240004 - protein, 9 aa, Homo Sapiens
FSSAVLIYP

SEQ ID NO: 1240005 - protein, 9 aa, Homo Sapiens
KISEGNHPG

SEQ ID NO: 1240006 - protein, 9 aa, Homo Sapiens
GHIPIFRTS

SEQ ID NO: 1240007 - protein, 9 aa, Homo Sapiens
MPGAWEELG

SEQ ID NO: 1240008 - protein, 9 aa, Homo Sapiens
IVLLTHGVN

SEQ ID NO: 1240009 - protein, 9 aa, Homo Sapiens
NTDELCSER

SEQ ID NO: 1240010 - protein, 9 aa, Homo Sapiens
SFAGAFPMF

SEQ ID NO: 1240011 - protein, 9 aa, Homo Sapiens
DIKNTVYII

SEQ ID NO: 1240012 - protein, 9 aa, Homo Sapiens
ESRAEYNVI

SEQ ID NO: 1240013 - protein, 9 aa, Homo Sapiens
DFVSFFPVF

SEQ ID NO: 1240014 - protein, 9 aa, Homo Sapiens
SSAGRKKFF

SEQ ID NO: 1240015 - protein, 9 aa, Homo Sapiens
MLATGAHDG

SEQ ID NO: 1240016 - protein, 9 aa, Homo Sapiens
TFVFNLMPG

SEQ ID NO: 1240017 - protein, 9 aa, Homo Sapiens
TQDPPEDMK

SEQ ID NO: 1240018 - protein, 9 aa, Homo Sapiens
SRYLSEWRY

SEQ ID NO: 1240019 - protein, 9 aa, Homo Sapiens
DGLTLLKCG

SEQ ID NO: 1240020 - protein, 9 aa, Homo Sapiens
RGRSEGFPT

SEQ ID NO: 1240021 - protein, 9 aa, Homo Sapiens
SQGEEEPQE

SEQ ID NO: 1240022 - protein, 9 aa, Homo Sapiens
YNRVQFLGF

SEQ ID NO: 1240023 - protein, 9 aa, Homo Sapiens
DAFFTSSKM

SEQ ID NO: 1240024 - protein, 9 aa, Homo Sapiens
TWRQLRRVL

SEQ ID NO: 1240025 - protein, 9 aa, Homo Sapiens
TFLVEFLWS

SEQ ID NO: 1240026 - protein, 9 aa, Homo Sapiens
APLTLKSSV

SEQ ID NO: 1240027 - protein, 9 aa, Homo Sapiens
YQSSLHLVI

SEQ ID NO: 1240028 - protein, 9 aa, Homo Sapiens
LDLPQHKGV

SEQ ID NO: 1240029 - protein, 9 aa, Homo Sapiens
LVNVFLCMN

SEQ ID NO: 1240030 - protein, 9 aa, Homo Sapiens
LQDSRVLHV

SEQ ID NO: 1240031 - protein, 9 aa, Homo Sapiens
TLQPGCTNV

SEQ ID NO: 1240032 - protein, 9 aa, Homo Sapiens
PNVTGHADL

SEQ ID NO: 1240033 - protein, 9 aa, Homo Sapiens
GEQTEAAIN

SEQ ID NO: 1240034 - protein, 9 aa, Homo Sapiens
CCIRGATAD

SEQ ID NO: 1240035 - protein, 9 aa, Homo Sapiens
KSKFGVNAI

SEQ ID NO: 1240036 - protein, 9 aa, Homo Sapiens
RLHFLRTNT

SEQ ID NO: 1240037 - protein, 9 aa, Homo Sapiens
TLGDGMMER

SEQ ID NO: 1240038 - protein, 9 aa, Homo Sapiens
DGFDALLTH

SEQ ID NO: 1240039 - protein, 9 aa, Homo Sapiens
AAATSSKKV

SEQ ID NO: 1240040 - protein, 9 aa, Homo Sapiens
KNEGSYGDH

SEQ ID NO: 1240041 - protein, 9 aa, Homo Sapiens
HLLMTFDVS

SEQ ID NO: 1240042 - protein, 9 aa, Homo Sapiens
HQFYINVER

SEQ ID NO: 1240043 - protein, 9 aa, Homo Sapiens
PNCNQHYGW

SEQ ID NO: 1240044 - protein, 9 aa, Homo Sapiens
KTAPQSRKA

SEQ ID NO: 1240045 - protein, 9 aa, Homo Sapiens
GKRYCFGED

SEQ ID NO: 1240046 - protein, 9 aa, Homo Sapiens
LSIWALILG

SEQ ID NO: 1240047 - protein, 9 aa, Homo Sapiens
YVIDIGTFD

SEQ ID NO: 1240048 - protein, 9 aa, Homo Sapiens
KKHRQRKSR

SEQ ID NO: 1240049 - protein, 9 aa, Homo Sapiens
PKTDAMAPD

SEQ ID NO: 1240050 - protein, 9 aa, Homo Sapiens
KEEWRRSLK

SEQ ID NO: 1240051 - protein, 9 aa, Homo Sapiens
PIWLPVFSS

SEQ ID NO: 1240052 - protein, 9 aa, Homo Sapiens
VFCMTEEVL

SEQ ID NO: 1240053 - protein, 9 aa, Homo Sapiens
GSYMPPSTI

SEQ ID NO: 1240054 - protein, 9 aa, Homo Sapiens
DPEIQELHQ

SEQ ID NO: 1240055 - protein, 9 aa, Homo Sapiens
SPLRTVMLI

SEQ ID NO: 1240056 - protein, 9 aa, Homo Sapiens
GTGWWRSQE

SEQ ID NO: 1240057 - protein, 9 aa, Homo Sapiens
TDAQDPDLQ

SEQ ID NO: 1240058 - protein, 9 aa, Homo Sapiens
KAARRQWEE

SEQ ID NO: 1240059 - protein, 9 aa, Homo Sapiens
ETTYGRSLK

SEQ ID NO: 1240060 - protein, 9 aa, Homo Sapiens
ILSQKLGRW

SEQ ID NO: 1240061 - protein, 9 aa, Homo Sapiens
VCIANNAAG

SEQ ID NO: 1240062 - protein, 9 aa, Homo Sapiens
QNGTRLEPL

SEQ ID NO: 1240063 - protein, 9 aa, Homo Sapiens
AKVKQRIEY

SEQ ID NO: 1240064 - protein, 9 aa, Homo Sapiens
PYGPPGGLF

SEQ ID NO: 1240065 - protein, 9 aa, Homo Sapiens
ATQAMPNAL

SEQ ID NO: 1240066 - protein, 9 aa, Homo Sapiens
DRQWTLQEA

SEQ ID NO: 1240067 - protein, 9 aa, Homo Sapiens
PALRARWST

SEQ ID NO: 1240068 - protein, 9 aa, Homo Sapiens
EHRPSFSGK

SEQ ID NO: 1240069 - protein, 9 aa, Homo Sapiens
DTHSHRHTH

SEQ ID NO: 1240070 - protein, 9 aa, Homo Sapiens
YNNNTMQQT

SEQ ID NO: 1240071 - protein, 9 aa, Homo Sapiens
NVQAFAGGV

SEQ ID NO: 1240072 - protein, 9 aa, Homo Sapiens
DLCSVVRLP

SEQ ID NO: 1240073 - protein, 9 aa, Homo Sapiens
NHHIIHAGE

SEQ ID NO: 1240074 - protein, 9 aa, Homo Sapiens
IVLNNLIVN

SEQ ID NO: 1240075 - protein, 9 aa, Homo Sapiens
LHCEAPRGY

SEQ ID NO: 1240076 - protein, 9 aa, Homo Sapiens
PNDHDNNPA

SEQ ID NO: 1240077 - protein, 9 aa, Homo Sapiens
PSDYVCAMR

SEQ ID NO: 1240078 - protein, 9 aa, Homo Sapiens
NRRHFKVAS

SEQ ID NO: 1240079 - protein, 9 aa, Homo Sapiens
IGEDTAALA

SEQ ID NO: 1240080 - protein, 9 aa, Homo Sapiens
SEMPHVSVS

SEQ ID NO: 1240081 - protein, 9 aa, Homo Sapiens
ESEALHSLR

SEQ ID NO: 1240082 - protein, 9 aa, Homo Sapiens
HDAKVPFKM

SEQ ID NO: 1240083 - protein, 9 aa, Homo Sapiens
QRSEGSISA

SEQ ID NO: 1240084 - protein, 9 aa, Homo Sapiens
GKCNSGQFL

SEQ ID NO: 1240085 - protein, 9 aa, Homo Sapiens
FLTQWQRHY

SEQ ID NO: 1240086 - protein, 9 aa, Homo Sapiens
TSAYLTVQY

SEQ ID NO: 1240087 - protein, 9 aa, Homo Sapiens
HLLHIDQNM

SEQ ID NO: 1240088 - protein, 9 aa, Homo Sapiens
HGADHHEVI

SEQ ID NO: 1240089 - protein, 9 aa, Homo Sapiens
IQVIASDLI

SEQ ID NO: 1240090 - protein, 9 aa, Homo Sapiens
KSPMHHWRN

SEQ ID NO: 1240091 - protein, 9 aa, Homo Sapiens
SSQGITLIW

SEQ ID NO: 1240092 - protein, 9 aa, Homo Sapiens
KRKRELHQH

SEQ ID NO: 1240093 - protein, 9 aa, Homo Sapiens
SWHKPKVSS

SEQ ID NO: 1240094 - protein, 9 aa, Homo Sapiens
FNFTCLEAR

SEQ ID NO: 1240095 - protein, 9 aa, Homo Sapiens
NGSLRKEHV

SEQ ID NO: 1240096 - protein, 9 aa, Homo Sapiens
KYIHWQEEL

SEQ ID NO: 1240097 - protein, 9 aa, Homo Sapiens
LISKFPELL

SEQ ID NO: 1240098 - protein, 9 aa, Homo Sapiens
LPDHRRVHT

SEQ ID NO: 1240099 - protein, 9 aa, Homo Sapiens
TMGSYICHC

SEQ ID NO: 1240100 - protein, 9 aa, Homo Sapiens
DSLKDKART

SEQ ID NO: 1240101 - protein, 9 aa, Homo Sapiens
AIVSFQNYT

SEQ ID NO: 1240102 - protein, 9 aa, Homo Sapiens
LFGTCAIRN

SEQ ID NO: 1240103 - protein, 9 aa, Homo Sapiens
ERGPYGSKG

SEQ ID NO: 1240104 - protein, 9 aa, Homo Sapiens
NDNKSIFKE

SEQ ID NO: 1240105 - protein, 9 aa, Homo Sapiens
KCVNSFQVY

SEQ ID NO: 1240106 - protein, 9 aa, Homo Sapiens
LYVSAPWEF

SEQ ID NO: 1240107 - protein, 9 aa, Homo Sapiens
QEGTRCYRL

SEQ ID NO: 1240108 - protein, 9 aa, Homo Sapiens
LCQLTVSNF

SEQ ID NO: 1240109 - protein, 9 aa, Homo Sapiens
TGLIKVFRS

SEQ ID NO: 1240110 - protein, 9 aa, Homo Sapiens
GILVSLTSR

SEQ ID NO: 1240111 - protein, 9 aa, Homo Sapiens
YDAYHTDLE

SEQ ID NO: 1240112 - protein, 9 aa, Homo Sapiens
ALRQREWEA

SEQ ID NO: 1240113 - protein, 9 aa, Homo Sapiens
GMQVVVQQP

SEQ ID NO: 1240114 - protein, 9 aa, Homo Sapiens
ESQRDYANG

SEQ ID NO: 1240115 - protein, 9 aa, Homo Sapiens
TKVRRFPLE

SEQ ID NO: 1240116 - protein, 9 aa, Homo Sapiens
SAPSPMLPA

SEQ ID NO: 1240117 - protein, 9 aa, Homo Sapiens
PRGPPASST

SEQ ID NO: 1240118 - protein, 9 aa, Homo Sapiens
CCALIALEH

SEQ ID NO: 1240119 - protein, 9 aa, Homo Sapiens
LMNHFMEEF

SEQ ID NO: 1240120 - protein, 9 aa, Homo Sapiens
IHVHIQSQI

SEQ ID NO: 1240121 - protein, 9 aa, Homo Sapiens
SASNPQYPT

SEQ ID NO: 1240122 - protein, 9 aa, Homo Sapiens
HYREPVLEK

SEQ ID NO: 1240123 - protein, 9 aa, Homo Sapiens
DLHQEECKY

SEQ ID NO: 1240124 - protein, 9 aa, Homo Sapiens
NASISMRAQ

SEQ ID NO: 1240125 - protein, 9 aa, Homo Sapiens
VNLSNMQCQ

SEQ ID NO: 1240126 - protein, 9 aa, Homo Sapiens
DPYDHEDCV

SEQ ID NO: 1240127 - protein, 9 aa, Homo Sapiens
HLETLVQKV

SEQ ID NO: 1240128 - protein, 9 aa, Homo Sapiens
ALQMESAAF

SEQ ID NO: 1240129 - protein, 9 aa, Homo Sapiens
SDVRKATQS

SEQ ID NO: 1240130 - protein, 9 aa, Homo Sapiens
VDKIQTETH

SEQ ID NO: 1240131 - protein, 9 aa, Homo Sapiens
TLYTIMNSF

SEQ ID NO: 1240132 - protein, 9 aa, Homo Sapiens
YYRSHNDGY

SEQ ID NO: 1240133 - protein, 9 aa, Homo Sapiens
PSDQKQHPV

SEQ ID NO: 1240134 - protein, 9 aa, Homo Sapiens
LLLLLIMSY

SEQ ID NO: 1240135 - protein, 9 aa, Homo Sapiens
MNAIKLQPR

SEQ ID NO: 1240136 - protein, 9 aa, Homo Sapiens
KDFSVYHPA

SEQ ID NO: 1240137 - protein, 9 aa, Homo Sapiens
IAKTLSYLR

SEQ ID NO: 1240138 - protein, 9 aa, Homo Sapiens
GVFLNVSSS

SEQ ID NO: 1240139 - protein, 9 aa, Homo Sapiens
YIKVVHVTV

SEQ ID NO: 1240140 - protein, 9 aa, Homo Sapiens
ETGTQWWKT

SEQ ID NO: 1240141 - protein, 9 aa, Homo Sapiens
DLAFTHLNS

SEQ ID NO: 1240142 - protein, 9 aa, Homo Sapiens
RIYEMMGHI

SEQ ID NO: 1240143 - protein, 9 aa, Homo Sapiens
SEKVLEMDI

SEQ ID NO: 1240144 - protein, 9 aa, Homo Sapiens
VEVFLPVFY

SEQ ID NO: 1240145 - protein, 9 aa, Homo Sapiens
ALSDHLDAG

SEQ ID NO: 1240146 - protein, 9 aa, Homo Sapiens
AAQEVLQCI

SEQ ID NO: 1240147 - protein, 9 aa, Homo Sapiens
KQSGEMVIH

SEQ ID NO: 1240148 - protein, 9 aa, Homo Sapiens
SLMDCQARK

SEQ ID NO: 1240149 - protein, 9 aa, Homo Sapiens
LENQESLQL

SEQ ID NO: 1240150 - protein, 9 aa, Homo Sapiens
RASTPINNI

SEQ ID NO: 1240151 - protein, 9 aa, Homo Sapiens
KEQQLKLMQ

SEQ ID NO: 1240152 - protein, 9 aa, Homo Sapiens
TQHEKILCG

SEQ ID NO: 1240153 - protein, 9 aa, Homo Sapiens
VIVSGHQKN

SEQ ID NO: 1240154 - protein, 9 aa, Homo Sapiens
LMVKRGRLV

SEQ ID NO: 1240155 - protein, 9 aa, Homo Sapiens
NDVSGPVFD

SEQ ID NO: 1240156 - protein, 9 aa, Homo Sapiens
VTTEPTSRA

SEQ ID NO: 1240157 - protein, 9 aa, Homo Sapiens
FCLLIMLFL

SEQ ID NO: 1240158 - protein, 9 aa, Homo Sapiens
RTKQEGLSH

SEQ ID NO: 1240159 - protein, 9 aa, Homo Sapiens
VHKVLSALQ

SEQ ID NO: 1240160 - protein, 9 aa, Homo Sapiens
QVKTKVFQP

SEQ ID NO: 1240161 - protein, 9 aa, Homo Sapiens
KQTAFLFAS

SEQ ID NO: 1240162 - protein, 9 aa, Homo Sapiens
REDAPTEHV

SEQ ID NO: 1240163 - protein, 9 aa, Homo Sapiens
LIFFTIWHI

SEQ ID NO: 1240164 - protein, 9 aa, Homo Sapiens
DQYRVCQEI

SEQ ID NO: 1240165 - protein, 9 aa, Homo Sapiens
EGKMQYLQV

SEQ ID NO: 1240166 - protein, 9 aa, Homo Sapiens
TPGSCPVGT

SEQ ID NO: 1240167 - protein, 9 aa, Homo Sapiens
SITFNGQVF

SEQ ID NO: 1240168 - protein, 9 aa, Homo Sapiens
VGGLWHWVL

SEQ ID NO: 1240169 - protein, 9 aa, Homo Sapiens
AKGRGGGLG

SEQ ID NO: 1240170 - protein, 9 aa, Homo Sapiens
SLKGHVEQK

SEQ ID NO: 1240171 - protein, 9 aa, Homo Sapiens
QIKKKTKKI

SEQ ID NO: 1240172 - protein, 9 aa, Homo Sapiens
LTKKQCQTL

SEQ ID NO: 1240173 - protein, 9 aa, Homo Sapiens
KDPKMYRVA

SEQ ID NO: 1240174 - protein, 9 aa, Homo Sapiens
HPSKGEELP

SEQ ID NO: 1240175 - protein, 9 aa, Homo Sapiens
RSCVNLAKN

SEQ ID NO: 1240176 - protein, 9 aa, Homo Sapiens
LEDLETLML

SEQ ID NO: 1240177 - protein, 9 aa, Homo Sapiens
DESADSGLS

SEQ ID NO: 1240178 - protein, 9 aa, Homo Sapiens
RYEWGSRDT

SEQ ID NO: 1240179 - protein, 9 aa, Homo Sapiens
IQGQLTHLE

SEQ ID NO: 1240180 - protein, 9 aa, Homo Sapiens
AGSRLACGA

SEQ ID NO: 1240181 - protein, 9 aa, Homo Sapiens
QARQLLAVG

SEQ ID NO: 1240182 - protein, 9 aa, Homo Sapiens
EIFKEINTA

SEQ ID NO: 1240183 - protein, 9 aa, Homo Sapiens
ALQRHVIAW

SEQ ID NO: 1240184 - protein, 9 aa, Homo Sapiens
RHNRCLYRA

SEQ ID NO: 1240185 - protein, 9 aa, Homo Sapiens
IRLNMLLRF

SEQ ID NO: 1240186 - protein, 9 aa, Homo Sapiens
FQKYVGKDG

SEQ ID NO: 1240187 - protein, 9 aa, Homo Sapiens
HVDFVGEVT

SEQ ID NO: 1240188 - protein, 9 aa, Homo Sapiens
KHIRFNVYC

SEQ ID NO: 1240189 - protein, 9 aa, Homo Sapiens
MFQSWSGTE

SEQ ID NO: 1240190 - protein, 9 aa, Homo Sapiens
TSSLQITII

SEQ ID NO: 1240191 - protein, 9 aa, Homo Sapiens
HTGTEHLAP

SEQ ID NO: 1240192 - protein, 9 aa, Homo Sapiens
EHLAVDSWW

SEQ ID NO: 1240193 - protein, 9 aa, Homo Sapiens
GSQEDARKS

SEQ ID NO: 1240194 - protein, 9 aa, Homo Sapiens
GFSEEQLHQ

SEQ ID NO: 1240195 - protein, 9 aa, Homo Sapiens
LHLILCTVE

SEQ ID NO: 1240196 - protein, 9 aa, Homo Sapiens
ERSRAHYEM

SEQ ID NO: 1240197 - protein, 9 aa, Homo Sapiens
TLLITKKWG

SEQ ID NO: 1240198 - protein, 9 aa, Homo Sapiens
GNTCSSGIN

SEQ ID NO: 1240199 - protein, 9 aa, Homo Sapiens
AFKTVMGID

SEQ ID NO: 1240200 - protein, 9 aa, Homo Sapiens
TEDLLLSET

SEQ ID NO: 1240201 - protein, 9 aa, Homo Sapiens
TSYHFGTGT

SEQ ID NO: 1240202 - protein, 9 aa, Homo Sapiens
CGLNYHKHC

SEQ ID NO: 1240203 - protein, 9 aa, Homo Sapiens
DEDYQVSLQ

SEQ ID NO: 1240204 - protein, 9 aa, Homo Sapiens
TQENTEYTV

SEQ ID NO: 1240205 - protein, 9 aa, Homo Sapiens
SQAVHQRMM

SEQ ID NO: 1240206 - protein, 9 aa, Homo Sapiens
KHFLDYYDL

SEQ ID NO: 1240207 - protein, 9 aa, Homo Sapiens
PYTDGPDGS

SEQ ID NO: 1240208 - protein, 9 aa, Homo Sapiens
NGAEGPTPR

SEQ ID NO: 1240209 - protein, 9 aa, Homo Sapiens
FALKILLDH

SEQ ID NO: 1240210 - protein, 9 aa, Homo Sapiens
EQSCASRLM

SEQ ID NO: 1240211 - protein, 9 aa, Homo Sapiens
ASPSSHSTT

SEQ ID NO: 1240212 - protein, 9 aa, Homo Sapiens
TNGSAAKLQ

SEQ ID NO: 1240213 - protein, 9 aa, Homo Sapiens
CPRSAVDIS

SEQ ID NO: 1240214 - protein, 9 aa, Homo Sapiens
VYKPGWQDW

SEQ ID NO: 1240215 - protein, 9 aa, Homo Sapiens
TGIQRNHTV

SEQ ID NO: 1240216 - protein, 9 aa, Homo Sapiens
KDRDDHSFG

SEQ ID NO: 1240217 - protein, 9 aa, Homo Sapiens
WDEMLIKPK

SEQ ID NO: 1240218 - protein, 9 aa, Homo Sapiens
RTYLDIEHI

SEQ ID NO: 1240219 - protein, 9 aa, Homo Sapiens
SVQPILVEC

SEQ ID NO: 1240220 - protein, 9 aa, Homo Sapiens
VLLYATVLV

SEQ ID NO: 1240221 - protein, 9 aa, Homo Sapiens
LNTSAEAPQ

SEQ ID NO: 1240222 - protein, 9 aa, Homo Sapiens
ELSTWKESP

SEQ ID NO: 1240223 - protein, 9 aa, Homo Sapiens
FYDEARNLH

SEQ ID NO: 1240224 - protein, 9 aa, Homo Sapiens
AQMRAVINQ

SEQ ID NO: 1240225 - protein, 9 aa, Homo Sapiens
KIVLGIETR

SEQ ID NO: 1240226 - protein, 9 aa, Homo Sapiens
FITALPDRG

SEQ ID NO: 1240227 - protein, 9 aa, Homo Sapiens
MDAQPAETL

SEQ ID NO: 1240228 - protein, 9 aa, Homo Sapiens
VMILVVDTK

SEQ ID NO: 1240229 - protein, 9 aa, Homo Sapiens
LDLEDKLEK

SEQ ID NO: 1240230 - protein, 9 aa, Homo Sapiens
IEHLEQEHT

SEQ ID NO: 1240231 - protein, 9 aa, Homo Sapiens
RIPKVQSNG

SEQ ID NO: 1240232 - protein, 9 aa, Homo Sapiens
PSTSAYLTV

SEQ ID NO: 1240233 - protein, 9 aa, Homo Sapiens
PTHTGHLWL

SEQ ID NO: 1240234 - protein, 9 aa, Homo Sapiens
SAESRDHNQ

SEQ ID NO: 1240235 - protein, 9 aa, Homo Sapiens
LQRGGLSPG

SEQ ID NO: 1240236 - protein, 9 aa, Homo Sapiens
NKKIAMTMD

SEQ ID NO: 1240237 - protein, 9 aa, Homo Sapiens
HENQKKQPN

SEQ ID NO: 1240238 - protein, 9 aa, Homo Sapiens
SAVNLHPQL

SEQ ID NO: 1240239 - protein, 9 aa, Homo Sapiens
PSMATTKAI

SEQ ID NO: 1240240 - protein, 9 aa, Homo Sapiens
EEMLSLKVT

SEQ ID NO: 1240241 - protein, 9 aa, Homo Sapiens
CERVMGNLV

SEQ ID NO: 1240242 - protein, 9 aa, Homo Sapiens
VPGIFCARS

SEQ ID NO: 1240243 - protein, 9 aa, Homo Sapiens
SQIKTDVNK

SEQ ID NO: 1240244 - protein, 9 aa, Homo Sapiens
SDSTSQIIY

SEQ ID NO: 1240245 - protein, 9 aa, Homo Sapiens
DDRGAGHVS

SEQ ID NO: 1240246 - protein, 9 aa, Homo Sapiens
GTDWPKDLV

SEQ ID NO: 1240247 - protein, 9 aa, Homo Sapiens
PAMKCYLLY

SEQ ID NO: 1240248 - protein, 9 aa, Homo Sapiens
AVLIPKDHQ

SEQ ID NO: 1240249 - protein, 9 aa, Homo Sapiens
MCWKQMMKR

SEQ ID NO: 1240250 - protein, 9 aa, Homo Sapiens
TEHAHIVAS

SEQ ID NO: 1240251 - protein, 9 aa, Homo Sapiens
RSAALKTSR

SEQ ID NO: 1240252 - protein, 9 aa, Homo Sapiens
ILQVITSNM

SEQ ID NO: 1240253 - protein, 9 aa, Homo Sapiens
SQKTSGTKS

SEQ ID NO: 1240254 - protein, 9 aa, Homo Sapiens
EFDISEACI

SEQ ID NO: 1240255 - protein, 9 aa, Homo Sapiens
TEFRVMLLA

SEQ ID NO: 1240256 - protein, 9 aa, Homo Sapiens
CMTGAHDQA

SEQ ID NO: 1240257 - protein, 9 aa, Homo Sapiens
LSITDILYT

SEQ ID NO: 1240258 - protein, 9 aa, Homo Sapiens
LYIRLHKWA

SEQ ID NO: 1240259 - protein, 9 aa, Homo Sapiens
STLNLANTL

SEQ ID NO: 1240260 - protein, 9 aa, Homo Sapiens
FRLHLLPQR

SEQ ID NO: 1240261 - protein, 9 aa, Homo Sapiens
KVASLELSE

SEQ ID NO: 1240262 - protein, 9 aa, Homo Sapiens
QRTKLTETR

SEQ ID NO: 1240263 - protein, 9 aa, Homo Sapiens
HFLTTLSSQ

SEQ ID NO: 1240264 - protein, 9 aa, Homo Sapiens
TLLESIRQD

SEQ ID NO: 1240265 - protein, 9 aa, Homo Sapiens
RLKLVKVLN

SEQ ID NO: 1240266 - protein, 9 aa, Homo Sapiens
EIWNASEYT

SEQ ID NO: 1240267 - protein, 9 aa, Homo Sapiens
KGISEQTVV

SEQ ID NO: 1240268 - protein, 9 aa, Homo Sapiens
QRLNELEVQ

SEQ ID NO: 1240269 - protein, 9 aa, Homo Sapiens
NFTEVTIFI

SEQ ID NO: 1240270 - protein, 9 aa, Homo Sapiens
PRKVCIDVG

SEQ ID NO: 1240271 - protein, 9 aa, Homo Sapiens
MDQKGLTND

SEQ ID NO: 1240272 - protein, 9 aa, Homo Sapiens
QDKDRDDHS

SEQ ID NO: 1240273 - protein, 9 aa, Homo Sapiens
SIWCFAWRK

SEQ ID NO: 1240274 - protein, 9 aa, Homo Sapiens
NDYFTYITK

SEQ ID NO: 1240275 - protein, 9 aa, Homo Sapiens
NVQEVEKEP

SEQ ID NO: 1240276 - protein, 9 aa, Homo Sapiens
NGGKDCDSL

SEQ ID NO: 1240277 - protein, 9 aa, Homo Sapiens
PLERTRYSP

SEQ ID NO: 1240278 - protein, 9 aa, Homo Sapiens
SKEITFQLH

SEQ ID NO: 1240279 - protein, 9 aa, Homo Sapiens
TMRLQDPGR

SEQ ID NO: 1240280 - protein, 9 aa, Homo Sapiens
KKRKEEESK

SEQ ID NO: 1240281 - protein, 9 aa, Homo Sapiens
QRQELQEIR

SEQ ID NO: 1240282 - protein, 9 aa, Homo Sapiens
EIFLPIEDN

SEQ ID NO: 1240283 - protein, 9 aa, Homo Sapiens
DTQQNPART

SEQ ID NO: 1240284 - protein, 9 aa, Homo Sapiens
LQVYNTGPG

SEQ ID NO: 1240285 - protein, 9 aa, Homo Sapiens
FHREKEVSI

SEQ ID NO: 1240286 - protein, 9 aa, Homo Sapiens
QEEHLLADL

SEQ ID NO: 1240287 - protein, 9 aa, Homo Sapiens
EYIKWLEEL

SEQ ID NO: 1240288 - protein, 9 aa, Homo Sapiens
TGHYMCNAC

SEQ ID NO: 1240289 - protein, 9 aa, Homo Sapiens
NFTTAHNTL

SEQ ID NO: 1240290 - protein, 9 aa, Homo Sapiens
FLAWKWDYL

SEQ ID NO: 1240291 - protein, 9 aa, Homo Sapiens
LTEHLITHT

SEQ ID NO: 1240292 - protein, 9 aa, Homo Sapiens
VVVGAPGGP

SEQ ID NO: 1240293 - protein, 9 aa, Homo Sapiens
MAAVKKAIS

SEQ ID NO: 1240294 - protein, 9 aa, Homo Sapiens
SMAHEADDA

SEQ ID NO: 1240295 - protein, 9 aa, Homo Sapiens
NFTEIKNIL

SEQ ID NO: 1240296 - protein, 9 aa, Homo Sapiens
QSFNSYRTM

SEQ ID NO: 1240297 - protein, 9 aa, Homo Sapiens
TDADMKSDN

SEQ ID NO: 1240298 - protein, 9 aa, Homo Sapiens
FERLHRLLA

SEQ ID NO: 1240299 - protein, 9 aa, Homo Sapiens
SGYRWCPKA

SEQ ID NO: 1240300 - protein, 9 aa, Homo Sapiens
CPSGSRTGP

SEQ ID NO: 1240301 - protein, 9 aa, Homo Sapiens
QKQGIVLKY

SEQ ID NO: 1240302 - protein, 9 aa, Homo Sapiens
KCFICRRDL

SEQ ID NO: 1240303 - protein, 9 aa, Homo Sapiens
GASKLVSVG

SEQ ID NO: 1240304 - protein, 9 aa, Homo Sapiens
KIESHFGYG

SEQ ID NO: 1240305 - protein, 9 aa, Homo Sapiens
NLWLFLFQI

SEQ ID NO: 1240306 - protein, 9 aa, Homo Sapiens
EVVAQEPLH

SEQ ID NO: 1240307 - protein, 9 aa, Homo Sapiens
NAAGAEAVR

SEQ ID NO: 1240308 - protein, 9 aa, Homo Sapiens
PRKKYMDAE

SEQ ID NO: 1240309 - protein, 9 aa, Homo Sapiens
NPEVKEFFT

SEQ ID NO: 1240310 - protein, 9 aa, Homo Sapiens
EDNCGDYLV

SEQ ID NO: 1240311 - protein, 9 aa, Homo Sapiens
VVTVESLGT

SEQ ID NO: 1240312 - protein, 9 aa, Homo Sapiens
EEHWTLKAI

SEQ ID NO: 1240313 - protein, 9 aa, Homo Sapiens
DVHALRTIV

SEQ ID NO: 1240314 - protein, 9 aa, Homo Sapiens
AETLLQAGL

SEQ ID NO: 1240315 - protein, 9 aa, Homo Sapiens
NKLLKENDV

SEQ ID NO: 1240316 - protein, 9 aa, Homo Sapiens
KKKKECQEE

SEQ ID NO: 1240317 - protein, 9 aa, Homo Sapiens
LEQMYQWAQ

SEQ ID NO: 1240318 - protein, 9 aa, Homo Sapiens
STWKESPAR

SEQ ID NO: 1240319 - protein, 9 aa, Homo Sapiens
ILKGQAVVR

SEQ ID NO: 1240320 - protein, 9 aa, Homo Sapiens
TLVITEFYF

SEQ ID NO: 1240321 - protein, 9 aa, Homo Sapiens
TIKRVGYWS

SEQ ID NO: 1240322 - protein, 9 aa, Homo Sapiens
HNWTEDMEG

SEQ ID NO: 1240323 - protein, 9 aa, Homo Sapiens
AGGYGEAND

SEQ ID NO: 1240324 - protein, 9 aa, Homo Sapiens
HDGKIKVWK

SEQ ID NO: 1240325 - protein, 9 aa, Homo Sapiens
RALGFENVT

SEQ ID NO: 1240326 - protein, 9 aa, Homo Sapiens
HAKKMRQGE

SEQ ID NO: 1240327 - protein, 9 aa, Homo Sapiens
NGSWYPGFN

SEQ ID NO: 1240328 - protein, 9 aa, Homo Sapiens
DVTNEKQAL

SEQ ID NO: 1240329 - protein, 9 aa, Homo Sapiens
YDMLHRAYS

SEQ ID NO: 1240330 - protein, 9 aa, Homo Sapiens
TLGAALPPW

SEQ ID NO: 1240331 - protein, 9 aa, Homo Sapiens
LLFITSVFM

SEQ ID NO: 1240332 - protein, 9 aa, Homo Sapiens
WNASEYTSY

SEQ ID NO: 1240333 - protein, 9 aa, Homo Sapiens
RVLSTLSVL

SEQ ID NO: 1240334 - protein, 9 aa, Homo Sapiens
ANDPVVADL

SEQ ID NO: 1240335 - protein, 9 aa, Homo Sapiens
NGVDELLEI

SEQ ID NO: 1240336 - protein, 9 aa, Homo Sapiens
MKMRRRKAC

SEQ ID NO: 1240337 - protein, 9 aa, Homo Sapiens
LCGVSKPTT

SEQ ID NO: 1240338 - protein, 9 aa, Homo Sapiens
EPGTSQLMP

SEQ ID NO: 1240339 - protein, 9 aa, Homo Sapiens
RRREGHSKT

SEQ ID NO: 1240340 - protein, 9 aa, Homo Sapiens
LEAGGGSAL

SEQ ID NO: 1240341 - protein, 9 aa, Homo Sapiens
HLVKHQGQH

SEQ ID NO: 1240342 - protein, 9 aa, Homo Sapiens
ADGRQHSYS

SEQ ID NO: 1240343 - protein, 9 aa, Homo Sapiens
PEGGFNKWN

SEQ ID NO: 1240344 - protein, 9 aa, Homo Sapiens
AHCDFVHHA

SEQ ID NO: 1240345 - protein, 9 aa, Homo Sapiens
ARSYVLRST

SEQ ID NO: 1240346 - protein, 9 aa, Homo Sapiens
SIFHTKDFQ

SEQ ID NO: 1240347 - protein, 9 aa, Homo Sapiens
LRFLALANG

SEQ ID NO: 1240348 - protein, 9 aa, Homo Sapiens
CVIDAVRFT

SEQ ID NO: 1240349 - protein, 9 aa, Homo Sapiens
LLKCLATVA

SEQ ID NO: 1240350 - protein, 9 aa, Homo Sapiens
LWFLLDKHH

SEQ ID NO: 1240351 - protein, 9 aa, Homo Sapiens
PVPSMDAHS

SEQ ID NO: 1240352 - protein, 9 aa, Homo Sapiens
GTVRVCDLL

SEQ ID NO: 1240353 - protein, 9 aa, Homo Sapiens
WQHTQNIMD

SEQ ID NO: 1240354 - protein, 9 aa, Homo Sapiens
GRRLADQTS

SEQ ID NO: 1240355 - protein, 9 aa, Homo Sapiens
LNPKDTTSI

SEQ ID NO: 1240356 - protein, 9 aa, Homo Sapiens
CWEMKSVYV

SEQ ID NO: 1240357 - protein, 9 aa, Homo Sapiens
VMDVHDSTH

SEQ ID NO: 1240358 - protein, 9 aa, Homo Sapiens
GLLASGIGI

SEQ ID NO: 1240359 - protein, 9 aa, Homo Sapiens
RPVDCLDGT

SEQ ID NO: 1240360 - protein, 9 aa, Homo Sapiens
NTTASMGTC

SEQ ID NO: 1240361 - protein, 9 aa, Homo Sapiens
ENSIFVVCA

SEQ ID NO: 1240362 - protein, 9 aa, Homo Sapiens
LVLKQVVRK

SEQ ID NO: 1240363 - protein, 9 aa, Homo Sapiens
CAHHDAPAL

SEQ ID NO: 1240364 - protein, 9 aa, Homo Sapiens
AFEHFSALR

SEQ ID NO: 1240365 - protein, 9 aa, Homo Sapiens
DAITALVKE

SEQ ID NO: 1240366 - protein, 9 aa, Homo Sapiens
TLDEIYSWI

SEQ ID NO: 1240367 - protein, 9 aa, Homo Sapiens
DIRADIDKN

SEQ ID NO: 1240368 - protein, 9 aa, Homo Sapiens
SQISHIKYF

SEQ ID NO: 1240369 - protein, 9 aa, Homo Sapiens
QGLLGQTQK

SEQ ID NO: 1240370 - protein, 9 aa, Homo Sapiens
TVPWNCRTI

SEQ ID NO: 1240371 - protein, 9 aa, Homo Sapiens
LATDFDDKF

SEQ ID NO: 1240372 - protein, 9 aa, Homo Sapiens
ELSLRSRRF

SEQ ID NO: 1240373 - protein, 9 aa, Homo Sapiens
FPTLTAFIR

SEQ ID NO: 1240374 - protein, 9 aa, Homo Sapiens
FKLKLLLEI

SEQ ID NO: 1240375 - protein, 9 aa, Homo Sapiens
ARLNPPTQQ

SEQ ID NO: 1240376 - protein, 9 aa, Homo Sapiens
FADAVFMFN

SEQ ID NO: 1240377 - protein, 9 aa, Homo Sapiens
STIFIMNRH

SEQ ID NO: 1240378 - protein, 9 aa, Homo Sapiens
DRAREQRWQ

SEQ ID NO: 1240379 - protein, 9 aa, Homo Sapiens
AEEDHAEVQ

SEQ ID NO: 1240380 - protein, 9 aa, Homo Sapiens
HSQFPRGRD

SEQ ID NO: 1240381 - protein, 9 aa, Homo Sapiens
SLTASRATK

SEQ ID NO: 1240382 - protein, 9 aa, Homo Sapiens
PKRDHATLK

SEQ ID NO: 1240383 - protein, 9 aa, Homo Sapiens
TLSVTSNLT

SEQ ID NO: 1240384 - protein, 9 aa, Homo Sapiens
EGEVGVRVE

SEQ ID NO: 1240385 - protein, 9 aa, Homo Sapiens
TVEQRQGRE

SEQ ID NO: 1240386 - protein, 9 aa, Homo Sapiens
PEDVVSDVR

SEQ ID NO: 1240387 - protein, 9 aa, Homo Sapiens
SSTSPLERT

SEQ ID NO: 1240388 - protein, 9 aa, Homo Sapiens
THFDDDELW

SEQ ID NO: 1240389 - protein, 9 aa, Homo Sapiens
PSPGPVLPQ

SEQ ID NO: 1240390 - protein, 9 aa, Homo Sapiens
AVGESVQDY

SEQ ID NO: 1240391 - protein, 9 aa, Homo Sapiens
YEAIVKRSD

SEQ ID NO: 1240392 - protein, 9 aa, Homo Sapiens
STSFTPTSL

SEQ ID NO: 1240393 - protein, 9 aa, Homo Sapiens
FIHCRRKNQ

SEQ ID NO: 1240394 - protein, 9 aa, Homo Sapiens
GFCLLIMLF

SEQ ID NO: 1240395 - protein, 9 aa, Homo Sapiens
MRILMVGMD

SEQ ID NO: 1240396 - protein, 9 aa, Homo Sapiens
KSPNDHDNN

SEQ ID NO: 1240397 - protein, 9 aa, Homo Sapiens
TTNAWRHVA

SEQ ID NO: 1240398 - protein, 9 aa, Homo Sapiens
TLAAERERN

SEQ ID NO: 1240399 - protein, 9 aa, Homo Sapiens
FDYLASLQS

SEQ ID NO: 1240400 - protein, 9 aa, Homo Sapiens
PVPPPVDIK

SEQ ID NO: 1240401 - protein, 9 aa, Homo Sapiens
EDARARVGV

SEQ ID NO: 1240402 - protein, 9 aa, Homo Sapiens
TVQHKEVEF

SEQ ID NO: 1240403 - protein, 9 aa, Homo Sapiens
ISITTIGNL

SEQ ID NO: 1240404 - protein, 9 aa, Homo Sapiens
PAPAPIRRH

SEQ ID NO: 1240405 - protein, 9 aa, Homo Sapiens
IEQVKHITL

SEQ ID NO: 1240406 - protein, 9 aa, Homo Sapiens
YFGEIMKWC

SEQ ID NO: 1240407 - protein, 9 aa, Homo Sapiens
SLSIFHTKD

SEQ ID NO: 1240408 - protein, 9 aa, Homo Sapiens
CLRIQTRSF

SEQ ID NO: 1240409 - protein, 9 aa, Homo Sapiens
SGHQSSSVL

SEQ ID NO: 1240410 - protein, 9 aa, Homo Sapiens
TTKDGGMVQ

SEQ ID NO: 1240411 - protein, 9 aa, Homo Sapiens
HNQTAGRTL

SEQ ID NO: 1240412 - protein, 9 aa, Homo Sapiens
PEIVGSGPQ

SEQ ID NO: 1240413 - protein, 9 aa, Homo Sapiens
IWPDELGCQ

SEQ ID NO: 1240414 - protein, 9 aa, Homo Sapiens
IAPEKEEDS

SEQ ID NO: 1240415 - protein, 9 aa, Homo Sapiens
WDADEESIE

SEQ ID NO: 1240416 - protein, 9 aa, Homo Sapiens
FAHRPTEQE

SEQ ID NO: 1240417 - protein, 9 aa, Homo Sapiens
SIIWSWDQG

SEQ ID NO: 1240418 - protein, 9 aa, Homo Sapiens
GALGLEGSG

SEQ ID NO: 1240419 - protein, 9 aa, Homo Sapiens
HTIKGNPAL

SEQ ID NO: 1240420 - protein, 9 aa, Homo Sapiens
PYRSMSTST

SEQ ID NO: 1240421 - protein, 9 aa, Homo Sapiens
KKDTHFNFA

SEQ ID NO: 1240422 - protein, 9 aa, Homo Sapiens
LTSVCETLV

SEQ ID NO: 1240423 - protein, 9 aa, Homo Sapiens
AGPRYLLDD

SEQ ID NO: 1240424 - protein, 9 aa, Homo Sapiens
AKHSKASLP

SEQ ID NO: 1240425 - protein, 9 aa, Homo Sapiens
KDVIVLGAD

SEQ ID NO: 1240426 - protein, 9 aa, Homo Sapiens
GSKKYSYMT

SEQ ID NO: 1240427 - protein, 9 aa, Homo Sapiens
CAYYNMIAA

SEQ ID NO: 1240428 - protein, 9 aa, Homo Sapiens
PQRSASCKT

SEQ ID NO: 1240429 - protein, 9 aa, Homo Sapiens
CLQVSLWKH

SEQ ID NO: 1240430 - protein, 9 aa, Homo Sapiens
MESAAFQAL

SEQ ID NO: 1240431 - protein, 9 aa, Homo Sapiens
TLVRSSTYS

SEQ ID NO: 1240432 - protein, 9 aa, Homo Sapiens
CSPSQMDLM

SEQ ID NO: 1240433 - protein, 9 aa, Homo Sapiens
RCFMCQACR

SEQ ID NO: 1240434 - protein, 9 aa, Homo Sapiens
IYDIDELEN

SEQ ID NO: 1240435 - protein, 9 aa, Homo Sapiens
IRVIEECHY

SEQ ID NO: 1240436 - protein, 9 aa, Homo Sapiens
LILYETHHR

SEQ ID NO: 1240437 - protein, 9 aa, Homo Sapiens
GEASNPESA

SEQ ID NO: 1240438 - protein, 9 aa, Homo Sapiens
ETEDPRLLH

SEQ ID NO: 1240439 - protein, 9 aa, Homo Sapiens
LGMWGLPPS

SEQ ID NO: 1240440 - protein, 9 aa, Homo Sapiens
KHLLGSSAS

SEQ ID NO: 1240441 - protein, 9 aa, Homo Sapiens
LGPLFFPRR

SEQ ID NO: 1240442 - protein, 9 aa, Homo Sapiens
NRLTDVLYM

SEQ ID NO: 1240443 - protein, 9 aa, Homo Sapiens
QFEKDNEET

SEQ ID NO: 1240444 - protein, 9 aa, Homo Sapiens
LALLGASAP

SEQ ID NO: 1240445 - protein, 9 aa, Homo Sapiens
NSGAAEKHV

SEQ ID NO: 1240446 - protein, 9 aa, Homo Sapiens
DRFQVFLNG

SEQ ID NO: 1240447 - protein, 9 aa, Homo Sapiens
SDDEQEAGS

SEQ ID NO: 1240448 - protein, 9 aa, Homo Sapiens
SCAHTVYTL

SEQ ID NO: 1240449 - protein, 9 aa, Homo Sapiens
TSASSLTLS

SEQ ID NO: 1240450 - protein, 9 aa, Homo Sapiens
LIHHYRTVH

SEQ ID NO: 1240451 - protein, 9 aa, Homo Sapiens
DMDELNFPT

SEQ ID NO: 1240452 - protein, 9 aa, Homo Sapiens
DHQCFFLSD

SEQ ID NO: 1240453 - protein, 9 aa, Homo Sapiens
GPIPQHTIQ

SEQ ID NO: 1240454 - protein, 9 aa, Homo Sapiens
RARDEYQHH

SEQ ID NO: 1240455 - protein, 9 aa, Homo Sapiens
GMAADMGMG

SEQ ID NO: 1240456 - protein, 9 aa, Homo Sapiens
SSEKASSIS

SEQ ID NO: 1240457 - protein, 9 aa, Homo Sapiens
ILISFSPGC

SEQ ID NO: 1240458 - protein, 9 aa, Homo Sapiens
SERPYMCND

SEQ ID NO: 1240459 - protein, 9 aa, Homo Sapiens
QQNKHVFFL

SEQ ID NO: 1240460 - protein, 9 aa, Homo Sapiens
LSQIGRVVE

SEQ ID NO: 1240461 - protein, 9 aa, Homo Sapiens
RLADQTSEW

SEQ ID NO: 1240462 - protein, 9 aa, Homo Sapiens
YSMEQDKIV

SEQ ID NO: 1240463 - protein, 9 aa, Homo Sapiens
ECALQSPTS

SEQ ID NO: 1240464 - protein, 9 aa, Homo Sapiens
LPTITNWER

SEQ ID NO: 1240465 - protein, 9 aa, Homo Sapiens
IGRMMQAFV

SEQ ID NO: 1240466 - protein, 9 aa, Homo Sapiens
VIMFDQSFG

SEQ ID NO: 1240467 - protein, 9 aa, Homo Sapiens
GNDIKIDES

SEQ ID NO: 1240468 - protein, 9 aa, Homo Sapiens
GYGYVGFGG

SEQ ID NO: 1240469 - protein, 9 aa, Homo Sapiens
LSDLERILA

SEQ ID NO: 1240470 - protein, 9 aa, Homo Sapiens
YELREPYGP

SEQ ID NO: 1240471 - protein, 9 aa, Homo Sapiens
LDHLNLSGC

SEQ ID NO: 1240472 - protein, 9 aa, Homo Sapiens
CLCFHTTVR

SEQ ID NO: 1240473 - protein, 9 aa, Homo Sapiens
GFVMYYFTY

SEQ ID NO: 1240474 - protein, 9 aa, Homo Sapiens
LSAVFYLLW

SEQ ID NO: 1240475 - protein, 9 aa, Homo Sapiens
AEVGEFLWQ

SEQ ID NO: 1240476 - protein, 9 aa, Homo Sapiens
LNKRRTESR

SEQ ID NO: 1240477 - protein, 9 aa, Homo Sapiens
MRQLQSSHY

SEQ ID NO: 1240478 - protein, 9 aa, Homo Sapiens
HPRLPLAHL

SEQ ID NO: 1240479 - protein, 9 aa, Homo Sapiens
FVEECLVDA

SEQ ID NO: 1240480 - protein, 9 aa, Homo Sapiens
FARTSLKSG

SEQ ID NO: 1240481 - protein, 9 aa, Homo Sapiens
GVLNKNRHP

SEQ ID NO: 1240482 - protein, 9 aa, Homo Sapiens
NSFNPEAHV

SEQ ID NO: 1240483 - protein, 9 aa, Homo Sapiens
EKQRSDISR

SEQ ID NO: 1240484 - protein, 9 aa, Homo Sapiens
GSVKDMCTA

SEQ ID NO: 1240485 - protein, 9 aa, Homo Sapiens
TVPGSPEEC

SEQ ID NO: 1240486 - protein, 9 aa, Homo Sapiens
ERGLWWREG

SEQ ID NO: 1240487 - protein, 9 aa, Homo Sapiens
NGPPTWPTQ

SEQ ID NO: 1240488 - protein, 9 aa, Homo Sapiens
AAAVLEKRN

SEQ ID NO: 1240489 - protein, 9 aa, Homo Sapiens
HVCRETPKG

SEQ ID NO: 1240490 - protein, 9 aa, Homo Sapiens
VRPEPSTRT

SEQ ID NO: 1240491 - protein, 9 aa, Homo Sapiens
SGEKYLTCV

SEQ ID NO: 1240492 - protein, 9 aa, Homo Sapiens
HITKDVICF

SEQ ID NO: 1240493 - protein, 9 aa, Homo Sapiens
DRPTYLWLK

SEQ ID NO: 1240494 - protein, 9 aa, Homo Sapiens
GEKSTYSVF

SEQ ID NO: 1240495 - protein, 9 aa, Homo Sapiens
PNVVIYYTS

SEQ ID NO: 1240496 - protein, 9 aa, Homo Sapiens
EDLCARTQL

SEQ ID NO: 1240497 - protein, 9 aa, Homo Sapiens
YESVSDIVP

SEQ ID NO: 1240498 - protein, 9 aa, Homo Sapiens
ISNSTRDWR

SEQ ID NO: 1240499 - protein, 9 aa, Homo Sapiens
APKLLQCSP

SEQ ID NO: 1240500 - protein, 9 aa, Homo Sapiens
MRCSAMPTE

SEQ ID NO: 1240501 - protein, 9 aa, Homo Sapiens
EFDYEYTEM

SEQ ID NO: 1240502 - protein, 9 aa, Homo Sapiens
VIDLLRVVH

SEQ ID NO: 1240503 - protein, 9 aa, Homo Sapiens
QEHSNAFMV

SEQ ID NO: 1240504 - protein, 9 aa, Homo Sapiens
GSMASDPLC

SEQ ID NO: 1240505 - protein, 9 aa, Homo Sapiens
QKLGRWCAV

SEQ ID NO: 1240506 - protein, 9 aa, Homo Sapiens
QSKHLEQQE

SEQ ID NO: 1240507 - protein, 9 aa, Homo Sapiens
AHHDAPALC

SEQ ID NO: 1240508 - protein, 9 aa, Homo Sapiens
WKQYMRMST

SEQ ID NO: 1240509 - protein, 9 aa, Homo Sapiens
PPHMFWIGW

SEQ ID NO: 1240510 - protein, 9 aa, Homo Sapiens
LDFPCINSL

SEQ ID NO: 1240511 - protein, 9 aa, Homo Sapiens
LECAEDKEA

SEQ ID NO: 1240512 - protein, 9 aa, Homo Sapiens
GCMNAAPMK

SEQ ID NO: 1240513 - protein, 9 aa, Homo Sapiens
QKCSTCSRL

SEQ ID NO: 1240514 - protein, 9 aa, Homo Sapiens
TNYPMSVAV

SEQ ID NO: 1240515 - protein, 9 aa, Homo Sapiens
IMIFCSTFL

SEQ ID NO: 1240516 - protein, 9 aa, Homo Sapiens
TCWEYCAIK

SEQ ID NO: 1240517 - protein, 9 aa, Homo Sapiens
TSTDQRPST

SEQ ID NO: 1240518 - protein, 9 aa, Homo Sapiens
RTGHYLFGA

SEQ ID NO: 1240519 - protein, 9 aa, Homo Sapiens
IHQVLMDRG

SEQ ID NO: 1240520 - protein, 9 aa, Homo Sapiens
KLRNYFSLY

SEQ ID NO: 1240521 - protein, 9 aa, Homo Sapiens
YTPKLEIKV

SEQ ID NO: 1240522 - protein, 9 aa, Homo Sapiens
FLAACRRCM

SEQ ID NO: 1240523 - protein, 9 aa, Homo Sapiens
KRLKHGYLE

SEQ ID NO: 1240524 - protein, 9 aa, Homo Sapiens
HLTCAVIKV

SEQ ID NO: 1240525 - protein, 9 aa, Homo Sapiens
DICENFQDL

SEQ ID NO: 1240526 - protein, 9 aa, Homo Sapiens
VSVHPLNFD

SEQ ID NO: 1240527 - protein, 9 aa, Homo Sapiens
PPTSSRTST

SEQ ID NO: 1240528 - protein, 9 aa, Homo Sapiens
LSYLPTAEC

SEQ ID NO: 1240529 - protein, 9 aa, Homo Sapiens
VGSDEEDED

SEQ ID NO: 1240530 - protein, 9 aa, Homo Sapiens
IGVILFDFA

SEQ ID NO: 1240531 - protein, 9 aa, Homo Sapiens
RLLLAEAER

SEQ ID NO: 1240532 - protein, 9 aa, Homo Sapiens
MHIQIKQED

SEQ ID NO: 1240533 - protein, 9 aa, Homo Sapiens
ESEEETEKE

SEQ ID NO: 1240534 - protein, 9 aa, Homo Sapiens
LVFIQYNME

SEQ ID NO: 1240535 - protein, 9 aa, Homo Sapiens
LTAQDMFYD

SEQ ID NO: 1240536 - protein, 9 aa, Homo Sapiens
KTDLTGLPE

SEQ ID NO: 1240537 - protein, 9 aa, Homo Sapiens
IWAVTFCSA

SEQ ID NO: 1240538 - protein, 9 aa, Homo Sapiens
AVVALLLGV

SEQ ID NO: 1240539 - protein, 9 aa, Homo Sapiens
KQQVSRPAA

SEQ ID NO: 1240540 - protein, 9 aa, Homo Sapiens
CFDRQIFIG

SEQ ID NO: 1240541 - protein, 9 aa, Homo Sapiens
NAQFSQILE

SEQ ID NO: 1240542 - protein, 9 aa, Homo Sapiens
AVSAQAEAN

SEQ ID NO: 1240543 - protein, 9 aa, Homo Sapiens
AVGAPGPDG

SEQ ID NO: 1240544 - protein, 9 aa, Homo Sapiens
ERARHLIHN

SEQ ID NO: 1240545 - protein, 9 aa, Homo Sapiens
SIGKDIIQN

SEQ ID NO: 1240546 - protein, 9 aa, Homo Sapiens
GNLLLLHEV

SEQ ID NO: 1240547 - protein, 9 aa, Homo Sapiens
YLPSGMEHI

SEQ ID NO: 1240548 - protein, 9 aa, Homo Sapiens
DQCFQMMEG

SEQ ID NO: 1240549 - protein, 9 aa, Homo Sapiens
DFSSSWQDV

SEQ ID NO: 1240550 - protein, 9 aa, Homo Sapiens
SITVPGRHV

SEQ ID NO: 1240551 - protein, 9 aa, Homo Sapiens
REMEEATRQ

SEQ ID NO: 1240552 - protein, 9 aa, Homo Sapiens
FITSVFMLH

SEQ ID NO: 1240553 - protein, 9 aa, Homo Sapiens
DGMFGRCQK

SEQ ID NO: 1240554 - protein, 9 aa, Homo Sapiens
ERNEMQAQI

SEQ ID NO: 1240555 - protein, 9 aa, Homo Sapiens
SAGEPGTEP

SEQ ID NO: 1240556 - protein, 9 aa, Homo Sapiens
FLFVDKTFP

SEQ ID NO: 1240557 - protein, 9 aa, Homo Sapiens
TLENLTDED

SEQ ID NO: 1240558 - protein, 9 aa, Homo Sapiens
CPLFQTPRE

SEQ ID NO: 1240559 - protein, 9 aa, Homo Sapiens
GNSCEIYGR

SEQ ID NO: 1240560 - protein, 9 aa, Homo Sapiens
TLQRTDPPL

SEQ ID NO: 1240561 - protein, 9 aa, Homo Sapiens
SIFKESLYR

SEQ ID NO: 1240562 - protein, 9 aa, Homo Sapiens
RLVQRFSTR

SEQ ID NO: 1240563 - protein, 9 aa, Homo Sapiens
DPSDYVCAM

SEQ ID NO: 1240564 - protein, 9 aa, Homo Sapiens
SPMQEDPPL

SEQ ID NO: 1240565 - protein, 9 aa, Homo Sapiens
HSKTFDWAE

SEQ ID NO: 1240566 - protein, 9 aa, Homo Sapiens
LEYALKQEI

SEQ ID NO: 1240567 - protein, 9 aa, Homo Sapiens
ALVVLFFII

SEQ ID NO: 1240568 - protein, 9 aa, Homo Sapiens
RLCSSSGLQ

SEQ ID NO: 1240569 - protein, 9 aa, Homo Sapiens
QAAASTTRV

SEQ ID NO: 1240570 - protein, 9 aa, Homo Sapiens
NNVITLSIT

SEQ ID NO: 1240571 - protein, 9 aa, Homo Sapiens
LKDIPSSEQ

SEQ ID NO: 1240572 - protein, 9 aa, Homo Sapiens
GSSDMGRKC

SEQ ID NO: 1240573 - protein, 9 aa, Homo Sapiens
CPVGTGMDG

SEQ ID NO: 1240574 - protein, 9 aa, Homo Sapiens
YANGFGGQY

SEQ ID NO: 1240575 - protein, 9 aa, Homo Sapiens
EDQECHLLV

SEQ ID NO: 1240576 - protein, 9 aa, Homo Sapiens
FIKCAYVKW

SEQ ID NO: 1240577 - protein, 9 aa, Homo Sapiens
VMLIAFTGD

SEQ ID NO: 1240578 - protein, 9 aa, Homo Sapiens
SRVNEILSQ

SEQ ID NO: 1240579 - protein, 9 aa, Homo Sapiens
SALREAQIL

SEQ ID NO: 1240580 - protein, 9 aa, Homo Sapiens
TKARDSELS

SEQ ID NO: 1240581 - protein, 9 aa, Homo Sapiens
ISQNDIPIP

SEQ ID NO: 1240582 - protein, 9 aa, Homo Sapiens
GTLEGADAE

SEQ ID NO: 1240583 - protein, 9 aa, Homo Sapiens
RPGRPRWRD

SEQ ID NO: 1240584 - protein, 9 aa, Homo Sapiens
LWHILLVLS

SEQ ID NO: 1240585 - protein, 9 aa, Homo Sapiens
NQQMGAFVE

SEQ ID NO: 1240586 - protein, 9 aa, Homo Sapiens
ELVWQHRVF

SEQ ID NO: 1240587 - protein, 9 aa, Homo Sapiens
MLASALGVG

SEQ ID NO: 1240588 - protein, 9 aa, Homo Sapiens
HDEEEGGAS

SEQ ID NO: 1240589 - protein, 9 aa, Homo Sapiens
EATYTSDSE

SEQ ID NO: 1240590 - protein, 9 aa, Homo Sapiens
SHGLSKAMS

SEQ ID NO: 1240591 - protein, 9 aa, Homo Sapiens
DRIKVCVWD

SEQ ID NO: 1240592 - protein, 9 aa, Homo Sapiens
ELTRTLQTN

SEQ ID NO: 1240593 - protein, 9 aa, Homo Sapiens
RHVFRIKHL

SEQ ID NO: 1240594 - protein, 9 aa, Homo Sapiens
IIDCLEQEL

SEQ ID NO: 1240595 - protein, 9 aa, Homo Sapiens
LILELGFSK

SEQ ID NO: 1240596 - protein, 9 aa, Homo Sapiens
RHGVYVLLI

SEQ ID NO: 1240597 - protein, 9 aa, Homo Sapiens
RVMGNLVNM

SEQ ID NO: 1240598 - protein, 9 aa, Homo Sapiens
DEDEDEQES

SEQ ID NO: 1240599 - protein, 9 aa, Homo Sapiens
FLVLQILLV

SEQ ID NO: 1240600 - protein, 9 aa, Homo Sapiens
DNAIDNPKP

SEQ ID NO: 1240601 - protein, 9 aa, Homo Sapiens
DPGGMMREI

SEQ ID NO: 1240602 - protein, 9 aa, Homo Sapiens
SGTVTCSFV

SEQ ID NO: 1240603 - protein, 9 aa, Homo Sapiens
DRHLHSPMY

SEQ ID NO: 1240604 - protein, 9 aa, Homo Sapiens
RGIFVLEEF

SEQ ID NO: 1240605 - protein, 9 aa, Homo Sapiens
INSLVAQLM

SEQ ID NO: 1240606 - protein, 9 aa, Homo Sapiens
VQKASATFN

SEQ ID NO: 1240607 - protein, 9 aa, Homo Sapiens
GSEHKLSHG

SEQ ID NO: 1240608 - protein, 9 aa, Homo Sapiens
VYITEFVNL

SEQ ID NO: 1240609 - protein, 9 aa, Homo Sapiens
HSACHGPLL

SEQ ID NO: 1240610 - protein, 9 aa, Homo Sapiens
LLDHLRECN

SEQ ID NO: 1240611 - protein, 9 aa, Homo Sapiens
DRGLDHIAE

SEQ ID NO: 1240612 - protein, 9 aa, Homo Sapiens
HFNRTMRAL

SEQ ID NO: 1240613 - protein, 9 aa, Homo Sapiens
SFTDHAISM

SEQ ID NO: 1240614 - protein, 9 aa, Homo Sapiens
LPKCDSGCD

SEQ ID NO: 1240615 - protein, 9 aa, Homo Sapiens
IVVARLPYC

SEQ ID NO: 1240616 - protein, 9 aa, Homo Sapiens
SSILHTHIR

SEQ ID NO: 1240617 - protein, 9 aa, Homo Sapiens
ETEAGYYRL

SEQ ID NO: 1240618 - protein, 9 aa, Homo Sapiens
TGGLTSVIY

SEQ ID NO: 1240619 - protein, 9 aa, Homo Sapiens
LITFLYLLG

SEQ ID NO: 1240620 - protein, 9 aa, Homo Sapiens
FTQEHKTAV

SEQ ID NO: 1240621 - protein, 9 aa, Homo Sapiens
IQRRYLRVG

SEQ ID NO: 1240622 - protein, 9 aa, Homo Sapiens
SWEPAQEAP

SEQ ID NO: 1240623 - protein, 9 aa, Homo Sapiens
LSLRVRGQK

SEQ ID NO: 1240624 - protein, 9 aa, Homo Sapiens
VLSRLGDVA

SEQ ID NO: 1240625 - protein, 9 aa, Homo Sapiens
SEDSRLAHY

SEQ ID NO: 1240626 - protein, 9 aa, Homo Sapiens
MSTCTINYS

SEQ ID NO: 1240627 - protein, 9 aa, Homo Sapiens
NLGAEHICQ

SEQ ID NO: 1240628 - protein, 9 aa, Homo Sapiens
LIHNVQKDF

SEQ ID NO: 1240629 - protein, 9 aa, Homo Sapiens
QECHLLVKV

SEQ ID NO: 1240630 - protein, 9 aa, Homo Sapiens
KLLQQSVLW

SEQ ID NO: 1240631 - protein, 9 aa, Homo Sapiens
PVCCVEAQG

SEQ ID NO: 1240632 - protein, 9 aa, Homo Sapiens
DIQPLSVPC

SEQ ID NO: 1240633 - protein, 9 aa, Homo Sapiens
SKTVGQCME

SEQ ID NO: 1240634 - protein, 9 aa, Homo Sapiens
TTRIFLNKL

SEQ ID NO: 1240635 - protein, 9 aa, Homo Sapiens
PLDDDDVFL

SEQ ID NO: 1240636 - protein, 9 aa, Homo Sapiens
GKEAEFVEV

SEQ ID NO: 1240637 - protein, 9 aa, Homo Sapiens
TDTEKRVIL

SEQ ID NO: 1240638 - protein, 9 aa, Homo Sapiens
FDQSKEKHV

SEQ ID NO: 1240639 - protein, 9 aa, Homo Sapiens
PVLLSIPWT

SEQ ID NO: 1240640 - protein, 9 aa, Homo Sapiens
FFPSASGSG

SEQ ID NO: 1240641 - protein, 9 aa, Homo Sapiens
EKQREECAA

SEQ ID NO: 1240642 - protein, 9 aa, Homo Sapiens
MGLLVKRLE

SEQ ID NO: 1240643 - protein, 9 aa, Homo Sapiens
RLVLYEKSI

SEQ ID NO: 1240644 - protein, 9 aa, Homo Sapiens
IAMLEVLSQ

SEQ ID NO: 1240645 - protein, 9 aa, Homo Sapiens
IFVLEEFVP

SEQ ID NO: 1240646 - protein, 9 aa, Homo Sapiens
LDSGADTGL

SEQ ID NO: 1240647 - protein, 9 aa, Homo Sapiens
FGTCAIRNE

SEQ ID NO: 1240648 - protein, 9 aa, Homo Sapiens
TFGKVILVW

SEQ ID NO: 1240649 - protein, 9 aa, Homo Sapiens
SHFRSHLEH

SEQ ID NO: 1240650 - protein, 9 aa, Homo Sapiens
SSVLLQHLH

SEQ ID NO: 1240651 - protein, 9 aa, Homo Sapiens
GSHEGTVHF

SEQ ID NO: 1240652 - protein, 9 aa, Homo Sapiens
GNSGRNPQA

SEQ ID NO: 1240653 - protein, 9 aa, Homo Sapiens
PPRAHVQHF

SEQ ID NO: 1240654 - protein, 9 aa, Homo Sapiens
DCAKQIQVL

SEQ ID NO: 1240655 - protein, 9 aa, Homo Sapiens
TSEHHNQPL

SEQ ID NO: 1240656 - protein, 9 aa, Homo Sapiens
ADISISPAL

SEQ ID NO: 1240657 - protein, 9 aa, Homo Sapiens
ISAIAIFLV

SEQ ID NO: 1240658 - protein, 9 aa, Homo Sapiens
ENEMLTLAE

SEQ ID NO: 1240659 - protein, 9 aa, Homo Sapiens
KPFVVSGPY

SEQ ID NO: 1240660 - protein, 9 aa, Homo Sapiens
MKFSVQVEK

SEQ ID NO: 1240661 - protein, 9 aa, Homo Sapiens
TYSCFSSSS

SEQ ID NO: 1240662 - protein, 9 aa, Homo Sapiens
TVSQHSENH

SEQ ID NO: 1240663 - protein, 9 aa, Homo Sapiens
DTPRDLNIS

SEQ ID NO: 1240664 - protein, 9 aa, Homo Sapiens
RLELQADIS

SEQ ID NO: 1240665 - protein, 9 aa, Homo Sapiens
FFRCERFDQ

SEQ ID NO: 1240666 - protein, 9 aa, Homo Sapiens
LFLRRYDEF

SEQ ID NO: 1240667 - protein, 9 aa, Homo Sapiens
CKQSVDKGK

SEQ ID NO: 1240668 - protein, 9 aa, Homo Sapiens
RGRDQCPSA

SEQ ID NO: 1240669 - protein, 9 aa, Homo Sapiens
VNMEDSYYC

SEQ ID NO: 1240670 - protein, 9 aa, Homo Sapiens
APVGTQASA

SEQ ID NO: 1240671 - protein, 9 aa, Homo Sapiens
SINDGHWDI

SEQ ID NO: 1240672 - protein, 9 aa, Homo Sapiens
YRHNLTGIL

SEQ ID NO: 1240673 - protein, 9 aa, Homo Sapiens
ESRMELSAL

SEQ ID NO: 1240674 - protein, 9 aa, Homo Sapiens
TVLERRYSD

SEQ ID NO: 1240675 - protein, 9 aa, Homo Sapiens
NCHIYNKPT

SEQ ID NO: 1240676 - protein, 9 aa, Homo Sapiens
PHPVLLSIP

SEQ ID NO: 1240677 - protein, 9 aa, Homo Sapiens
HLEGEFCDI

SEQ ID NO: 1240678 - protein, 9 aa, Homo Sapiens
KCAYVKWGT

SEQ ID NO: 1240679 - protein, 9 aa, Homo Sapiens
GRGEHQERQ

SEQ ID NO: 1240680 - protein, 9 aa, Homo Sapiens
IQQPLDILS

SEQ ID NO: 1240681 - protein, 9 aa, Homo Sapiens
EYKHRIKEL

SEQ ID NO: 1240682 - protein, 9 aa, Homo Sapiens
EYLRERSMA

SEQ ID NO: 1240683 - protein, 9 aa, Homo Sapiens
VILMEQIKL

SEQ ID NO: 1240684 - protein, 9 aa, Homo Sapiens
QVINYPTVP

SEQ ID NO: 1240685 - protein, 9 aa, Homo Sapiens
KETIKDIPK

SEQ ID NO: 1240686 - protein, 9 aa, Homo Sapiens
ISAFMFTVT

SEQ ID NO: 1240687 - protein, 9 aa, Homo Sapiens
VICKKDLIR

SEQ ID NO: 1240688 - protein, 9 aa, Homo Sapiens
RNPVGQKKC

SEQ ID NO: 1240689 - protein, 9 aa, Homo Sapiens
RIGQTKSVV

SEQ ID NO: 1240690 - protein, 9 aa, Homo Sapiens
CVEHYHLLH

SEQ ID NO: 1240691 - protein, 9 aa, Homo Sapiens
RALHPLRAL

SEQ ID NO: 1240692 - protein, 9 aa, Homo Sapiens
PFGYLQQEM

SEQ ID NO: 1240693 - protein, 9 aa, Homo Sapiens
SGDVGAPGV

SEQ ID NO: 1240694 - protein, 9 aa, Homo Sapiens
DIKIDESSL

SEQ ID NO: 1240695 - protein, 9 aa, Homo Sapiens
YNPESESIT

SEQ ID NO: 1240696 - protein, 9 aa, Homo Sapiens
QPWSLQSCW

SEQ ID NO: 1240697 - protein, 9 aa, Homo Sapiens
EDDQERIIP

SEQ ID NO: 1240698 - protein, 9 aa, Homo Sapiens
GLGFITSSQ

SEQ ID NO: 1240699 - protein, 9 aa, Homo Sapiens
KTHHISPQR

SEQ ID NO: 1240700 - protein, 9 aa, Homo Sapiens
ALKFVTAFF

SEQ ID NO: 1240701 - protein, 9 aa, Homo Sapiens
LQDVTVQYP

SEQ ID NO: 1240702 - protein, 9 aa, Homo Sapiens
GGYDTFMEK

SEQ ID NO: 1240703 - protein, 9 aa, Homo Sapiens
FMSVFRHLR

SEQ ID NO: 1240704 - protein, 9 aa, Homo Sapiens
LGWITAHVM

SEQ ID NO: 1240705 - protein, 9 aa, Homo Sapiens
EIVGSGPQL

SEQ ID NO: 1240706 - protein, 9 aa, Homo Sapiens
RVVMNSAQS

SEQ ID NO: 1240707 - protein, 9 aa, Homo Sapiens
EFLQRSSNF

SEQ ID NO: 1240708 - protein, 9 aa, Homo Sapiens
VPGTTRPQR

SEQ ID NO: 1240709 - protein, 9 aa, Homo Sapiens
DGDNFNEMN

SEQ ID NO: 1240710 - protein, 9 aa, Homo Sapiens
NMYGGNPVS

SEQ ID NO: 1240711 - protein, 9 aa, Homo Sapiens
NLRKIQSAH

SEQ ID NO: 1240712 - protein, 9 aa, Homo Sapiens
ARPLTSRIV

SEQ ID NO: 1240713 - protein, 9 aa, Homo Sapiens
AHAEMHDDA

SEQ ID NO: 1240714 - protein, 9 aa, Homo Sapiens
HSDEHFRQL

SEQ ID NO: 1240715 - protein, 9 aa, Homo Sapiens
LRPPVTAFV

SEQ ID NO: 1240716 - protein, 9 aa, Homo Sapiens
VKCTKSDLR

SEQ ID NO: 1240717 - protein, 9 aa, Homo Sapiens
MLSPDDADF

SEQ ID NO: 1240718 - protein, 9 aa, Homo Sapiens
TSHIDALYE

SEQ ID NO: 1240719 - protein, 9 aa, Homo Sapiens
DRVKKTALC

SEQ ID NO: 1240720 - protein, 9 aa, Homo Sapiens
LDSYDQNTL

SEQ ID NO: 1240721 - protein, 9 aa, Homo Sapiens
MARSEDHAV

SEQ ID NO: 1240722 - protein, 9 aa, Homo Sapiens
LQGPSPGSH

SEQ ID NO: 1240723 - protein, 9 aa, Homo Sapiens
QCVMAFDVV

SEQ ID NO: 1240724 - protein, 9 aa, Homo Sapiens
VHRKIHTGE

SEQ ID NO: 1240725 - protein, 9 aa, Homo Sapiens
SSIVSLLTE

SEQ ID NO: 1240726 - protein, 9 aa, Homo Sapiens
PGSPEECGL

SEQ ID NO: 1240727 - protein, 9 aa, Homo Sapiens
NGISRINGQ

SEQ ID NO: 1240728 - protein, 9 aa, Homo Sapiens
DSKSSSFQE

SEQ ID NO: 1240729 - protein, 9 aa, Homo Sapiens
RQVAVVEDF

SEQ ID NO: 1240730 - protein, 9 aa, Homo Sapiens
SPSQMDLMC

SEQ ID NO: 1240731 - protein, 9 aa, Homo Sapiens
YFITKEVST

SEQ ID NO: 1240732 - protein, 9 aa, Homo Sapiens
PGCFDRQIF

SEQ ID NO: 1240733 - protein, 9 aa, Homo Sapiens
FHFLFGIYQ

SEQ ID NO: 1240734 - protein, 9 aa, Homo Sapiens
SIQPKGKQK

SEQ ID NO: 1240735 - protein, 9 aa, Homo Sapiens
TKLVIHNDD

SEQ ID NO: 1240736 - protein, 9 aa, Homo Sapiens
LPPPVTSPS

SEQ ID NO: 1240737 - protein, 9 aa, Homo Sapiens
SGGLCRALH

SEQ ID NO: 1240738 - protein, 9 aa, Homo Sapiens
FLRASIYGQ

SEQ ID NO: 1240739 - protein, 9 aa, Homo Sapiens
GCLQVSLWK

SEQ ID NO: 1240740 - protein, 9 aa, Homo Sapiens
IRMKEREHR

SEQ ID NO: 1240741 - protein, 9 aa, Homo Sapiens
LHMIEERRN

SEQ ID NO: 1240742 - protein, 9 aa, Homo Sapiens
ISPYNISIG

SEQ ID NO: 1240743 - protein, 9 aa, Homo Sapiens
RLAQQSLNQ

SEQ ID NO: 1240744 - protein, 9 aa, Homo Sapiens
DNTGWTPLH

SEQ ID NO: 1240745 - protein, 9 aa, Homo Sapiens
IIHISHQDF

SEQ ID NO: 1240746 - protein, 9 aa, Homo Sapiens
MWGMYEGQQ

SEQ ID NO: 1240747 - protein, 9 aa, Homo Sapiens
TQDGKLEAQ

SEQ ID NO: 1240748 - protein, 9 aa, Homo Sapiens
SWLRTDCFH

SEQ ID NO: 1240749 - protein, 9 aa, Homo Sapiens
FRERNKGRI

SEQ ID NO: 1240750 - protein, 9 aa, Homo Sapiens
AQERAVRRV

SEQ ID NO: 1240751 - protein, 9 aa, Homo Sapiens
DGVSGDHGE

SEQ ID NO: 1240752 - protein, 9 aa, Homo Sapiens
AALGATGIV

SEQ ID NO: 1240753 - protein, 9 aa, Homo Sapiens
RRYNPESES

SEQ ID NO: 1240754 - protein, 9 aa, Homo Sapiens
FAYIFHDEF

SEQ ID NO: 1240755 - protein, 9 aa, Homo Sapiens
QVSLWKHLL

SEQ ID NO: 1240756 - protein, 9 aa, Homo Sapiens
SIDSKPSAR

SEQ ID NO: 1240757 - protein, 9 aa, Homo Sapiens
AIGFTLAPS

SEQ ID NO: 1240758 - protein, 9 aa, Homo Sapiens
RVRYGKDKA

SEQ ID NO: 1240759 - protein, 9 aa, Homo Sapiens
LKQNFSKSR

SEQ ID NO: 1240760 - protein, 9 aa, Homo Sapiens
KSHTNISHV

SEQ ID NO: 1240761 - protein, 9 aa, Homo Sapiens
IVGFFIFVL

SEQ ID NO: 1240762 - protein, 9 aa, Homo Sapiens
HPRGLRSCT

SEQ ID NO: 1240763 - protein, 9 aa, Homo Sapiens
ASPSRPTAV

SEQ ID NO: 1240764 - protein, 9 aa, Homo Sapiens
GGHKDSKTT

SEQ ID NO: 1240765 - protein, 9 aa, Homo Sapiens
ASPWSRTLA

SEQ ID NO: 1240766 - protein, 9 aa, Homo Sapiens
ACTCHTNCP

SEQ ID NO: 1240767 - protein, 9 aa, Homo Sapiens
EGSSTLNVL

SEQ ID NO: 1240768 - protein, 9 aa, Homo Sapiens
CRKFDIAIR

SEQ ID NO: 1240769 - protein, 9 aa, Homo Sapiens
FLQCIMQTY

SEQ ID NO: 1240770 - protein, 9 aa, Homo Sapiens
RDMPGHAGW

SEQ ID NO: 1240771 - protein, 9 aa, Homo Sapiens
FNTASGWLG

SEQ ID NO: 1240772 - protein, 9 aa, Homo Sapiens
HMDMVVEKQ

SEQ ID NO: 1240773 - protein, 9 aa, Homo Sapiens
IKAGKKCLD

SEQ ID NO: 1240774 - protein, 9 aa, Homo Sapiens
INGEDVLFA

SEQ ID NO: 1240775 - protein, 9 aa, Homo Sapiens
PLCKRSVPM

SEQ ID NO: 1240776 - protein, 9 aa, Homo Sapiens
SVVTPRPFV

SEQ ID NO: 1240777 - protein, 9 aa, Homo Sapiens
NYTLIRTYQ

SEQ ID NO: 1240778 - protein, 9 aa, Homo Sapiens
MVSSNVLQM

SEQ ID NO: 1240779 - protein, 9 aa, Homo Sapiens
RAITFRMPS

SEQ ID NO: 1240780 - protein, 9 aa, Homo Sapiens
QQPMKSPGK

SEQ ID NO: 1240781 - protein, 9 aa, Homo Sapiens
GHEEVLADV

SEQ ID NO: 1240782 - protein, 9 aa, Homo Sapiens
SVFEEDGCV

SEQ ID NO: 1240783 - protein, 9 aa, Homo Sapiens
LGPREYFIH

SEQ ID NO: 1240784 - protein, 9 aa, Homo Sapiens
FRVMNIGLG

SEQ ID NO: 1240785 - protein, 9 aa, Homo Sapiens
AVVSGVVQI

SEQ ID NO: 1240786 - protein, 9 aa, Homo Sapiens
NDGFCKMSG

SEQ ID NO: 1240787 - protein, 9 aa, Homo Sapiens
NQPLVGEET

SEQ ID NO: 1240788 - protein, 9 aa, Homo Sapiens
INQTNGHPH

SEQ ID NO: 1240789 - protein, 9 aa, Homo Sapiens
IPCEQLVTV

SEQ ID NO: 1240790 - protein, 9 aa, Homo Sapiens
TCLVYDSRL

SEQ ID NO: 1240791 - protein, 9 aa, Homo Sapiens
CGNRPYKCK

SEQ ID NO: 1240792 - protein, 9 aa, Homo Sapiens
IINHVSKVG

SEQ ID NO: 1240793 - protein, 9 aa, Homo Sapiens
RERVTQDLA

SEQ ID NO: 1240794 - protein, 9 aa, Homo Sapiens
QNVTEVFSK

SEQ ID NO: 1240795 - protein, 9 aa, Homo Sapiens
TDVPEIPGD

SEQ ID NO: 1240796 - protein, 9 aa, Homo Sapiens
PNLNELASL

SEQ ID NO: 1240797 - protein, 9 aa, Homo Sapiens
NLPFSVESK

SEQ ID NO: 1240798 - protein, 9 aa, Homo Sapiens
SAALKTSRW

SEQ ID NO: 1240799 - protein, 9 aa, Homo Sapiens
IFWGPISYM

SEQ ID NO: 1240800 - protein, 9 aa, Homo Sapiens
CMEFCGEGS

SEQ ID NO: 1240801 - protein, 9 aa, Homo Sapiens
KSHRPCVTH

SEQ ID NO: 1240802 - protein, 9 aa, Homo Sapiens
CFQMMEGKA

SEQ ID NO: 1240803 - protein, 9 aa, Homo Sapiens
KVDEGDGDI

SEQ ID NO: 1240804 - protein, 9 aa, Homo Sapiens
MNHFMEEFR

SEQ ID NO: 1240805 - protein, 9 aa, Homo Sapiens
TPPQIGKKQ

SEQ ID NO: 1240806 - protein, 9 aa, Homo Sapiens
SKIQLLQSL

SEQ ID NO: 1240807 - protein, 9 aa, Homo Sapiens
IHRTYQEYE

SEQ ID NO: 1240808 - protein, 9 aa, Homo Sapiens
CSVSDCSDG

SEQ ID NO: 1240809 - protein, 9 aa, Homo Sapiens
KMSGYHRAE

SEQ ID NO: 1240810 - protein, 9 aa, Homo Sapiens
YVGAALGRS

SEQ ID NO: 1240811 - protein, 9 aa, Homo Sapiens
SACLLNTSP

SEQ ID NO: 1240812 - protein, 9 aa, Homo Sapiens
LLNPMKPVD

SEQ ID NO: 1240813 - protein, 9 aa, Homo Sapiens
ALLGKCCDV

SEQ ID NO: 1240814 - protein, 9 aa, Homo Sapiens
HGSGSVAEM

SEQ ID NO: 1240815 - protein, 9 aa, Homo Sapiens
VVEIKLFKC

SEQ ID NO: 1240816 - protein, 9 aa, Homo Sapiens
KSQTAPQEN

SEQ ID NO: 1240817 - protein, 9 aa, Homo Sapiens
FKRAHEDIS

SEQ ID NO: 1240818 - protein, 9 aa, Homo Sapiens
VLSAAERQA

SEQ ID NO: 1240819 - protein, 9 aa, Homo Sapiens
LVEGEDVHL

SEQ ID NO: 1240820 - protein, 9 aa, Homo Sapiens
DEIAAPQSF

SEQ ID NO: 1240821 - protein, 9 aa, Homo Sapiens
CGQGVQFLE

SEQ ID NO: 1240822 - protein, 9 aa, Homo Sapiens
CTFAIEALK

SEQ ID NO: 1240823 - protein, 9 aa, Homo Sapiens
DLMYLLKTE

SEQ ID NO: 1240824 - protein, 9 aa, Homo Sapiens
NTGQRPYQC

SEQ ID NO: 1240825 - protein, 9 aa, Homo Sapiens
LLTVKFYWI

SEQ ID NO: 1240826 - protein, 9 aa, Homo Sapiens
THRHTGIHT

SEQ ID NO: 1240827 - protein, 9 aa, Homo Sapiens
AIELNPKDT

SEQ ID NO: 1240828 - protein, 9 aa, Homo Sapiens
RDSQKDYRK

SEQ ID NO: 1240829 - protein, 9 aa, Homo Sapiens
KFKSTVKKV

SEQ ID NO: 1240830 - protein, 9 aa, Homo Sapiens
MPSRVHYYR

SEQ ID NO: 1240831 - protein, 9 aa, Homo Sapiens
GVNSIARGQ

SEQ ID NO: 1240832 - protein, 9 aa, Homo Sapiens
CCFSWSLSW

SEQ ID NO: 1240833 - protein, 9 aa, Homo Sapiens
RDINDNPSI

SEQ ID NO: 1240834 - protein, 9 aa, Homo Sapiens
NIPMIRQQE

SEQ ID NO: 1240835 - protein, 9 aa, Homo Sapiens
SIHYEGSEH

SEQ ID NO: 1240836 - protein, 9 aa, Homo Sapiens
SYIEKSLYQ

SEQ ID NO: 1240837 - protein, 9 aa, Homo Sapiens
KHTAPSFTK

SEQ ID NO: 1240838 - protein, 9 aa, Homo Sapiens
DHMASLLKF

SEQ ID NO: 1240839 - protein, 9 aa, Homo Sapiens
PTNQRATSF

SEQ ID NO: 1240840 - protein, 9 aa, Homo Sapiens
RVRGQKKCD

SEQ ID NO: 1240841 - protein, 9 aa, Homo Sapiens
TAFDLTKRP

SEQ ID NO: 1240842 - protein, 9 aa, Homo Sapiens
SGRTTITTI

SEQ ID NO: 1240843 - protein, 9 aa, Homo Sapiens
SSCTAVVYR

SEQ ID NO: 1240844 - protein, 9 aa, Homo Sapiens
ALRAVVQSS

SEQ ID NO: 1240845 - protein, 9 aa, Homo Sapiens
DTTSIHLMG

SEQ ID NO: 1240846 - protein, 9 aa, Homo Sapiens
ITNGPDADA

SEQ ID NO: 1240847 - protein, 9 aa, Homo Sapiens
QQHPNDKTN

SEQ ID NO: 1240848 - protein, 9 aa, Homo Sapiens
PSSSCVSTY

SEQ ID NO: 1240849 - protein, 9 aa, Homo Sapiens
RTAPCTTAE

SEQ ID NO: 1240850 - protein, 9 aa, Homo Sapiens
PSENTENKF

SEQ ID NO: 1240851 - protein, 9 aa, Homo Sapiens
MGQRRMRIT

SEQ ID NO: 1240852 - protein, 9 aa, Homo Sapiens
IIMMRTTWK

SEQ ID NO: 1240853 - protein, 9 aa, Homo Sapiens
RGAFGHEHY

SEQ ID NO: 1240854 - protein, 9 aa, Homo Sapiens
YTPPDITSP

SEQ ID NO: 1240855 - protein, 9 aa, Homo Sapiens
QIIFVSVLT

SEQ ID NO: 1240856 - protein, 9 aa, Homo Sapiens
PHFICIQDA

SEQ ID NO: 1240857 - protein, 9 aa, Homo Sapiens
SSYLPSPGE

SEQ ID NO: 1240858 - protein, 9 aa, Homo Sapiens
IDQQHPRLL

SEQ ID NO: 1240859 - protein, 9 aa, Homo Sapiens
SVGFGNVCV

SEQ ID NO: 1240860 - protein, 9 aa, Homo Sapiens
DFWVQALIS

SEQ ID NO: 1240861 - protein, 9 aa, Homo Sapiens
IPLLYWINK

SEQ ID NO: 1240862 - protein, 9 aa, Homo Sapiens
LFSRSLSSS

SEQ ID NO: 1240863 - protein, 9 aa, Homo Sapiens
HSFSETLRR

SEQ ID NO: 1240864 - protein, 9 aa, Homo Sapiens
ASQPLDPNG

SEQ ID NO: 1240865 - protein, 9 aa, Homo Sapiens
GGNGSVFQT

SEQ ID NO: 1240866 - protein, 9 aa, Homo Sapiens
AGNPVIMQE

SEQ ID NO: 1240867 - protein, 9 aa, Homo Sapiens
CLSEVDNGL

SEQ ID NO: 1240868 - protein, 9 aa, Homo Sapiens
KASLQKCPD

SEQ ID NO: 1240869 - protein, 9 aa, Homo Sapiens
SCSPAGQSN

SEQ ID NO: 1240870 - protein, 9 aa, Homo Sapiens
LGVFLNSSM

SEQ ID NO: 1240871 - protein, 9 aa, Homo Sapiens
RSVHVPLML

SEQ ID NO: 1240872 - protein, 9 aa, Homo Sapiens
FVICVPEST

SEQ ID NO: 1240873 - protein, 9 aa, Homo Sapiens
KPSSVRLVP

SEQ ID NO: 1240874 - protein, 9 aa, Homo Sapiens
GKLKNQIRS

SEQ ID NO: 1240875 - protein, 9 aa, Homo Sapiens
MVAGLMIGA

SEQ ID NO: 1240876 - protein, 9 aa, Homo Sapiens
NLTDEDAGT

SEQ ID NO: 1240877 - protein, 9 aa, Homo Sapiens
VICWMNMNK

SEQ ID NO: 1240878 - protein, 9 aa, Homo Sapiens
LVGQKCSEW

SEQ ID NO: 1240879 - protein, 9 aa, Homo Sapiens
LPTALLHVL

SEQ ID NO: 1240880 - protein, 9 aa, Homo Sapiens
IKLYFMYFN

SEQ ID NO: 1240881 - protein, 9 aa, Homo Sapiens
NQWLTMTAS

SEQ ID NO: 1240882 - protein, 9 aa, Homo Sapiens
LVPRCLVPE

SEQ ID NO: 1240883 - protein, 9 aa, Homo Sapiens
QCLSPTVCT

SEQ ID NO: 1240884 - protein, 9 aa, Homo Sapiens
GRGSCAASC

SEQ ID NO: 1240885 - protein, 9 aa, Homo Sapiens
PPAHSSAFH

SEQ ID NO: 1240886 - protein, 9 aa, Homo Sapiens
PPERIANGA

SEQ ID NO: 1240887 - protein, 9 aa, Homo Sapiens
PSHLHPEGL

SEQ ID NO: 1240888 - protein, 9 aa, Homo Sapiens
QDTWQTATF

SEQ ID NO: 1240889 - protein, 9 aa, Homo Sapiens
ESFYTVFTP

SEQ ID NO: 1240890 - protein, 9 aa, Homo Sapiens
AHGMAASLA

SEQ ID NO: 1240891 - protein, 9 aa, Homo Sapiens
AAVVALLLG

SEQ ID NO: 1240892 - protein, 9 aa, Homo Sapiens
RMMLMKTVE

SEQ ID NO: 1240893 - protein, 9 aa, Homo Sapiens
AIISRWNWL

SEQ ID NO: 1240894 - protein, 9 aa, Homo Sapiens
KITQAIAET

SEQ ID NO: 1240895 - protein, 9 aa, Homo Sapiens
SNDMHFSSL

SEQ ID NO: 1240896 - protein, 9 aa, Homo Sapiens
NTRIIHTAL

SEQ ID NO: 1240897 - protein, 9 aa, Homo Sapiens
ERILGADTF

SEQ ID NO: 1240898 - protein, 9 aa, Homo Sapiens
GVMCVRNVK

SEQ ID NO: 1240899 - protein, 9 aa, Homo Sapiens
IRHRHIHTG

SEQ ID NO: 1240900 - protein, 9 aa, Homo Sapiens
LTIYHAIDH

SEQ ID NO: 1240901 - protein, 9 aa, Homo Sapiens
IFFVMPLHH

SEQ ID NO: 1240902 - protein, 9 aa, Homo Sapiens
PSEEHVLFQ

SEQ ID NO: 1240903 - protein, 9 aa, Homo Sapiens
PKSVLQSRW

SEQ ID NO: 1240904 - protein, 9 aa, Homo Sapiens
PLQSGSGPH

SEQ ID NO: 1240905 - protein, 9 aa, Homo Sapiens
QNENIPIIS

SEQ ID NO: 1240906 - protein, 9 aa, Homo Sapiens
EKGPNDTAN

SEQ ID NO: 1240907 - protein, 9 aa, Homo Sapiens
DKPLNNEWQ

SEQ ID NO: 1240908 - protein, 9 aa, Homo Sapiens
YEMRLLKCM

SEQ ID NO: 1240909 - protein, 9 aa, Homo Sapiens
QKLQLKAVD

SEQ ID NO: 1240910 - protein, 9 aa, Homo Sapiens
LHYIIISVI

SEQ ID NO: 1240911 - protein, 9 aa, Homo Sapiens
SPDSLGSFQ

SEQ ID NO: 1240912 - protein, 9 aa, Homo Sapiens
DLHSQFPRG

SEQ ID NO: 1240913 - protein, 9 aa, Homo Sapiens
LSGRLVKAS

SEQ ID NO: 1240914 - protein, 9 aa, Homo Sapiens
PESLESVSV

SEQ ID NO: 1240915 - protein, 9 aa, Homo Sapiens
RMRQTRHYE

SEQ ID NO: 1240916 - protein, 9 aa, Homo Sapiens
IIYRSTCLV

SEQ ID NO: 1240917 - protein, 9 aa, Homo Sapiens
EELKMKNMD

SEQ ID NO: 1240918 - protein, 9 aa, Homo Sapiens
DEDSLVKRQ

SEQ ID NO: 1240919 - protein, 9 aa, Homo Sapiens
VLTSGHQSS

SEQ ID NO: 1240920 - protein, 9 aa, Homo Sapiens
FPSKAMFWW

SEQ ID NO: 1240921 - protein, 9 aa, Homo Sapiens
DQASSDVEV

SEQ ID NO: 1240922 - protein, 9 aa, Homo Sapiens
IDEPVFEDQ

SEQ ID NO: 1240923 - protein, 9 aa, Homo Sapiens
TEGPELEEH

SEQ ID NO: 1240924 - protein, 9 aa, Homo Sapiens
CGSMSFTTS

SEQ ID NO: 1240925 - protein, 9 aa, Homo Sapiens
MTTYSTERS

SEQ ID NO: 1240926 - protein, 9 aa, Homo Sapiens
VQPGTVGPS

SEQ ID NO: 1240927 - protein, 9 aa, Homo Sapiens
MYSRLEHVD

SEQ ID NO: 1240928 - protein, 9 aa, Homo Sapiens
VRDIQKQVW

SEQ ID NO: 1240929 - protein, 9 aa, Homo Sapiens
VLRLIKLLF

SEQ ID NO: 1240930 - protein, 9 aa, Homo Sapiens
TVRGIFVLE

SEQ ID NO: 1240931 - protein, 9 aa, Homo Sapiens
ASQQRKILL

SEQ ID NO: 1240932 - protein, 9 aa, Homo Sapiens
ECVTEVKTD

SEQ ID NO: 1240933 - protein, 9 aa, Homo Sapiens
RYDLIGLNG

SEQ ID NO: 1240934 - protein, 9 aa, Homo Sapiens
CGSDPSIKS

SEQ ID NO: 1240935 - protein, 9 aa, Homo Sapiens
EELDPVTLY

SEQ ID NO: 1240936 - protein, 9 aa, Homo Sapiens
PERIANGAI

SEQ ID NO: 1240937 - protein, 9 aa, Homo Sapiens
HKEWGARPL

SEQ ID NO: 1240938 - protein, 9 aa, Homo Sapiens
AETYHWSRS

SEQ ID NO: 1240939 - protein, 9 aa, Homo Sapiens
WNESPGAPP

SEQ ID NO: 1240940 - protein, 9 aa, Homo Sapiens
NATTRVMTN

SEQ ID NO: 1240941 - protein, 9 aa, Homo Sapiens
DSPLVATGH

SEQ ID NO: 1240942 - protein, 9 aa, Homo Sapiens
EFHSIDVQV

SEQ ID NO: 1240943 - protein, 9 aa, Homo Sapiens
EELPWDALD

SEQ ID NO: 1240944 - protein, 9 aa, Homo Sapiens
LKRAAGVRL

SEQ ID NO: 1240945 - protein, 9 aa, Homo Sapiens
STALHGESD

SEQ ID NO: 1240946 - protein, 9 aa, Homo Sapiens
RHGFLGQVW

SEQ ID NO: 1240947 - protein, 9 aa, Homo Sapiens
RIRAMRVAR

SEQ ID NO: 1240948 - protein, 9 aa, Homo Sapiens
TPPNRTIFD

SEQ ID NO: 1240949 - protein, 9 aa, Homo Sapiens
RKIPCESNN

SEQ ID NO: 1240950 - protein, 9 aa, Homo Sapiens
LCRRCVVCH

SEQ ID NO: 1240951 - protein, 9 aa, Homo Sapiens
RSVMRRFDD

SEQ ID NO: 1240952 - protein, 9 aa, Homo Sapiens
HHGNSGHLL

SEQ ID NO: 1240953 - protein, 9 aa, Homo Sapiens
KNSFNPEAH

SEQ ID NO: 1240954 - protein, 9 aa, Homo Sapiens
GGHSHRGAG

SEQ ID NO: 1240955 - protein, 9 aa, Homo Sapiens
GETFRPNPA

SEQ ID NO: 1240956 - protein, 9 aa, Homo Sapiens
HVMKTTTRN

SEQ ID NO: 1240957 - protein, 9 aa, Homo Sapiens
APCCWRLWP

SEQ ID NO: 1240958 - protein, 9 aa, Homo Sapiens
SSASNPQYP

SEQ ID NO: 1240959 - protein, 9 aa, Homo Sapiens
LALHEDFHA

SEQ ID NO: 1240960 - protein, 9 aa, Homo Sapiens
AERARQGCL

SEQ ID NO: 1240961 - protein, 9 aa, Homo Sapiens
LHTQEYRAF

SEQ ID NO: 1240962 - protein, 9 aa, Homo Sapiens
GSLLEHHHG

SEQ ID NO: 1240963 - protein, 9 aa, Homo Sapiens
MMKNHSLRA

SEQ ID NO: 1240964 - protein, 9 aa, Homo Sapiens
RLAQDADVE

SEQ ID NO: 1240965 - protein, 9 aa, Homo Sapiens
IICSPLHLI

SEQ ID NO: 1240966 - protein, 9 aa, Homo Sapiens
RRRRLPYPL

SEQ ID NO: 1240967 - protein, 9 aa, Homo Sapiens
SLPKTDCGE

SEQ ID NO: 1240968 - protein, 9 aa, Homo Sapiens
GNSDYKRTV

SEQ ID NO: 1240969 - protein, 9 aa, Homo Sapiens
YANDTFTPS

SEQ ID NO: 1240970 - protein, 9 aa, Homo Sapiens
GGCLPLLPA

SEQ ID NO: 1240971 - protein, 9 aa, Homo Sapiens
CGKSFLSSY

SEQ ID NO: 1240972 - protein, 9 aa, Homo Sapiens
QQDEEKIPD

SEQ ID NO: 1240973 - protein, 9 aa, Homo Sapiens
ALSCLTGSH

SEQ ID NO: 1240974 - protein, 9 aa, Homo Sapiens
VGDKDVTRE

SEQ ID NO: 1240975 - protein, 9 aa, Homo Sapiens
GSAGPDCRI

SEQ ID NO: 1240976 - protein, 9 aa, Homo Sapiens
LQTMYLSFI

SEQ ID NO: 1240977 - protein, 9 aa, Homo Sapiens
RLSRTRQDL

SEQ ID NO: 1240978 - protein, 9 aa, Homo Sapiens
TKSSRKSMN

SEQ ID NO: 1240979 - protein, 9 aa, Homo Sapiens
VPASLDAFV

SEQ ID NO: 1240980 - protein, 9 aa, Homo Sapiens
ISTDLTHLR

SEQ ID NO: 1240981 - protein, 9 aa, Homo Sapiens
APQQCVVCL

SEQ ID NO: 1240982 - protein, 9 aa, Homo Sapiens
PNGYGSHLH

SEQ ID NO: 1240983 - protein, 9 aa, Homo Sapiens
FNPNVTGHA

SEQ ID NO: 1240984 - protein, 9 aa, Homo Sapiens
ILAFTGLNL

SEQ ID NO: 1240985 - protein, 9 aa, Homo Sapiens
AIGNAEHKP

SEQ ID NO: 1240986 - protein, 9 aa, Homo Sapiens
EPGIPTGED

SEQ ID NO: 1240987 - protein, 9 aa, Homo Sapiens
NGHPNENNS

SEQ ID NO: 1240988 - protein, 9 aa, Homo Sapiens
LVIAQSLSE

SEQ ID NO: 1240989 - protein, 9 aa, Homo Sapiens
YSFSNCWTP

SEQ ID NO: 1240990 - protein, 9 aa, Homo Sapiens
PSPEQFISN

SEQ ID NO: 1240991 - protein, 9 aa, Homo Sapiens
FHLNLKVRK

SEQ ID NO: 1240992 - protein, 9 aa, Homo Sapiens
QGSHVSKMA

SEQ ID NO: 1240993 - protein, 9 aa, Homo Sapiens
QSAICLLAN

SEQ ID NO: 1240994 - protein, 9 aa, Homo Sapiens
MCIIAFVGS

SEQ ID NO: 1240995 - protein, 9 aa, Homo Sapiens
RSYLPDHRR

SEQ ID NO: 1240996 - protein, 9 aa, Homo Sapiens
AGRSSGRQQ

SEQ ID NO: 1240997 - protein, 9 aa, Homo Sapiens
RHKPQCGEA

SEQ ID NO: 1240998 - protein, 9 aa, Homo Sapiens
PHISTDPVL

SEQ ID NO: 1240999 - protein, 9 aa, Homo Sapiens
RLTRQHEDG

SEQ ID NO: 1241000 - protein, 9 aa, Homo Sapiens
HSLSADVPK

SEQ ID NO: 1241001 - protein, 9 aa, Homo Sapiens
RTSSHLHLK

SEQ ID NO: 1241002 - protein, 9 aa, Homo Sapiens
SSVNEMHVS

SEQ ID NO: 1241003 - protein, 9 aa, Homo Sapiens
EGETVPTWY

SEQ ID NO: 1241004 - protein, 9 aa, Homo Sapiens
LFALEKLDI

SEQ ID NO: 1241005 - protein, 9 aa, Homo Sapiens
RDKNPIVVG

SEQ ID NO: 1241006 - protein, 9 aa, Homo Sapiens
SAQAKHKYQ

SEQ ID NO: 1241007 - protein, 9 aa, Homo Sapiens
LHHGLTQKM

SEQ ID NO: 1241008 - protein, 9 aa, Homo Sapiens
VGNLKALSK

SEQ ID NO: 1241009 - protein, 9 aa, Homo Sapiens
AERLHHPEI

SEQ ID NO: 1241010 - protein, 9 aa, Homo Sapiens
GEPAASLIV

SEQ ID NO: 1241011 - protein, 9 aa, Homo Sapiens
SLWGECTWD

SEQ ID NO: 1241012 - protein, 9 aa, Homo Sapiens
KKLHPFGYL

SEQ ID NO: 1241013 - protein, 9 aa, Homo Sapiens
RMRITVKKL

SEQ ID NO: 1241014 - protein, 9 aa, Homo Sapiens
QHSMAQQEN

SEQ ID NO: 1241015 - protein, 9 aa, Homo Sapiens
ILQLAFLTS

SEQ ID NO: 1241016 - protein, 9 aa, Homo Sapiens
LRERSMAPD

SEQ ID NO: 1241017 - protein, 9 aa, Homo Sapiens
ALGATGIVI

SEQ ID NO: 1241018 - protein, 9 aa, Homo Sapiens
EDICRRSLS

SEQ ID NO: 1241019 - protein, 9 aa, Homo Sapiens
LFKLPCLKR

SEQ ID NO: 1241020 - protein, 9 aa, Homo Sapiens
IPVPQIKPL

SEQ ID NO: 1241021 - protein, 9 aa, Homo Sapiens
GSGFRWKKL

SEQ ID NO: 1241022 - protein, 9 aa, Homo Sapiens
RGAAPTDIP

SEQ ID NO: 1241023 - protein, 9 aa, Homo Sapiens
DQDNRNTSP

SEQ ID NO: 1241024 - protein, 9 aa, Homo Sapiens
VIVNSMDKS

SEQ ID NO: 1241025 - protein, 9 aa, Homo Sapiens
ILTRKNGSN

SEQ ID NO: 1241026 - protein, 9 aa, Homo Sapiens
KIKAVQHQA

SEQ ID NO: 1241027 - protein, 9 aa, Homo Sapiens
RYYIHRQCK

SEQ ID NO: 1241028 - protein, 9 aa, Homo Sapiens
RQTQSRTAS

SEQ ID NO: 1241029 - protein, 9 aa, Homo Sapiens
PEALSSNMY

SEQ ID NO: 1241030 - protein, 9 aa, Homo Sapiens
DTFLLIKEW

SEQ ID NO: 1241031 - protein, 9 aa, Homo Sapiens
HGAVYYESQ

SEQ ID NO: 1241032 - protein, 9 aa, Homo Sapiens
TCTYECDED

SEQ ID NO: 1241033 - protein, 9 aa, Homo Sapiens
AAELLVKEQ

SEQ ID NO: 1241034 - protein, 9 aa, Homo Sapiens
AENNNLSKL

SEQ ID NO: 1241035 - protein, 9 aa, Homo Sapiens
RGVVHRRAA

SEQ ID NO: 1241036 - protein, 9 aa, Homo Sapiens
SISSQYWIS

SEQ ID NO: 1241037 - protein, 9 aa, Homo Sapiens
RVDFDLYKK

SEQ ID NO: 1241038 - protein, 9 aa, Homo Sapiens
DGCGENIGL

SEQ ID NO: 1241039 - protein, 9 aa, Homo Sapiens
VLTFAISAI

SEQ ID NO: 1241040 - protein, 9 aa, Homo Sapiens
EAPFSRRFD

SEQ ID NO: 1241041 - protein, 9 aa, Homo Sapiens
ATTTTTTLM

SEQ ID NO: 1241042 - protein, 9 aa, Homo Sapiens
KLHPPNRDT

SEQ ID NO: 1241043 - protein, 9 aa, Homo Sapiens
GLIKALFAM

SEQ ID NO: 1241044 - protein, 9 aa, Homo Sapiens
TETSIAPKQ

SEQ ID NO: 1241045 - protein, 9 aa, Homo Sapiens
GIFVLEEFV

SEQ ID NO: 1241046 - protein, 9 aa, Homo Sapiens
DVQEMELVM

SEQ ID NO: 1241047 - protein, 9 aa, Homo Sapiens
FVGIKYVNK

SEQ ID NO: 1241048 - protein, 9 aa, Homo Sapiens
DEGSDPRHE

SEQ ID NO: 1241049 - protein, 9 aa, Homo Sapiens
FLQLLLPTQ

SEQ ID NO: 1241050 - protein, 9 aa, Homo Sapiens
ANRVYTLVL

SEQ ID NO: 1241051 - protein, 9 aa, Homo Sapiens
NVLLASTEP

SEQ ID NO: 1241052 - protein, 9 aa, Homo Sapiens
SLTDIQETH

SEQ ID NO: 1241053 - protein, 9 aa, Homo Sapiens
EELKLYDSN

SEQ ID NO: 1241054 - protein, 9 aa, Homo Sapiens
QENVGRQGI

SEQ ID NO: 1241055 - protein, 9 aa, Homo Sapiens
SLSRHDEIE

SEQ ID NO: 1241056 - protein, 9 aa, Homo Sapiens
KACRFTDVK

SEQ ID NO: 1241057 - protein, 9 aa, Homo Sapiens
SLDLHSQFP

SEQ ID NO: 1241058 - protein, 9 aa, Homo Sapiens
WSKVGPYPW

SEQ ID NO: 1241059 - protein, 9 aa, Homo Sapiens
GAACPFTIT

SEQ ID NO: 1241060 - protein, 9 aa, Homo Sapiens
ESEKRYVQP

SEQ ID NO: 1241061 - protein, 9 aa, Homo Sapiens
ETKCQQICR

SEQ ID NO: 1241062 - protein, 9 aa, Homo Sapiens
SPKPATKSI

SEQ ID NO: 1241063 - protein, 9 aa, Homo Sapiens
KHQGRIVII

SEQ ID NO: 1241064 - protein, 9 aa, Homo Sapiens
CMDTWVYEC

SEQ ID NO: 1241065 - protein, 9 aa, Homo Sapiens
NIASEMADE

SEQ ID NO: 1241066 - protein, 9 aa, Homo Sapiens
VAIQVCSLE

SEQ ID NO: 1241067 - protein, 9 aa, Homo Sapiens
LQTAILLPG

SEQ ID NO: 1241068 - protein, 9 aa, Homo Sapiens
FWGKPHSTG

SEQ ID NO: 1241069 - protein, 9 aa, Homo Sapiens
RSNSLYWYG

SEQ ID NO: 1241070 - protein, 9 aa, Homo Sapiens
PTPIVQRMP

SEQ ID NO: 1241071 - protein, 9 aa, Homo Sapiens
KNKDPSPVS

SEQ ID NO: 1241072 - protein, 9 aa, Homo Sapiens
AEVKLHGFQ

SEQ ID NO: 1241073 - protein, 9 aa, Homo Sapiens
LTAFDLTKR

SEQ ID NO: 1241074 - protein, 9 aa, Homo Sapiens
LPDRKVWSC

SEQ ID NO: 1241075 - protein, 9 aa, Homo Sapiens
ELKSLSKED

SEQ ID NO: 1241076 - protein, 9 aa, Homo Sapiens
NSSHWRKAL

SEQ ID NO: 1241077 - protein, 9 aa, Homo Sapiens
DSAILEHCR

SEQ ID NO: 1241078 - protein, 9 aa, Homo Sapiens
RYYSKGTPS

SEQ ID NO: 1241079 - protein, 9 aa, Homo Sapiens
THPLGCVKI

SEQ ID NO: 1241080 - protein, 9 aa, Homo Sapiens
PRPLLEFAL

SEQ ID NO: 1241081 - protein, 9 aa, Homo Sapiens
DEKLSLRQV

SEQ ID NO: 1241082 - protein, 9 aa, Homo Sapiens
YLDQLDESM

SEQ ID NO: 1241083 - protein, 9 aa, Homo Sapiens
LAPAVRSSG

SEQ ID NO: 1241084 - protein, 9 aa, Homo Sapiens
ISFLTPLHN

SEQ ID NO: 1241085 - protein, 9 aa, Homo Sapiens
CREKNVERI

SEQ ID NO: 1241086 - protein, 9 aa, Homo Sapiens
KLYVEEVVP

SEQ ID NO: 1241087 - protein, 9 aa, Homo Sapiens
HLCCKPYLD

SEQ ID NO: 1241088 - protein, 9 aa, Homo Sapiens
PTEKLIEKC

SEQ ID NO: 1241089 - protein, 9 aa, Homo Sapiens
RAEGIPALV

SEQ ID NO: 1241090 - protein, 9 aa, Homo Sapiens
ITLCGILVL

SEQ ID NO: 1241091 - protein, 9 aa, Homo Sapiens
ACPRPSPAQ

SEQ ID NO: 1241092 - protein, 9 aa, Homo Sapiens
NPEAHVFMP

SEQ ID NO: 1241093 - protein, 9 aa, Homo Sapiens
MSNLNKHQT

SEQ ID NO: 1241094 - protein, 9 aa, Homo Sapiens
FWGVVADHF

SEQ ID NO: 1241095 - protein, 9 aa, Homo Sapiens
CPFNDRHQV

SEQ ID NO: 1241096 - protein, 9 aa, Homo Sapiens
HGDPAPPSG

SEQ ID NO: 1241097 - protein, 9 aa, Homo Sapiens
SSQAKVLLH

SEQ ID NO: 1241098 - protein, 9 aa, Homo Sapiens
YKGDVETLS

SEQ ID NO: 1241099 - protein, 9 aa, Homo Sapiens
MKLIVPRKT

SEQ ID NO: 1241100 - protein, 9 aa, Homo Sapiens
TCMHTVPDK

SEQ ID NO: 1241101 - protein, 9 aa, Homo Sapiens
TVYTFSIEN

SEQ ID NO: 1241102 - protein, 9 aa, Homo Sapiens
NHGIYVDDV

SEQ ID NO: 1241103 - protein, 9 aa, Homo Sapiens
EDQGLQGLK

SEQ ID NO: 1241104 - protein, 9 aa, Homo Sapiens
DYDLDTFVN

SEQ ID NO: 1241105 - protein, 9 aa, Homo Sapiens
KECFTSSLV

SEQ ID NO: 1241106 - protein, 9 aa, Homo Sapiens
QGHGQQGQA

SEQ ID NO: 1241107 - protein, 9 aa, Homo Sapiens
HEEKERIKY

SEQ ID NO: 1241108 - protein, 9 aa, Homo Sapiens
ECVDGGELF

SEQ ID NO: 1241109 - protein, 9 aa, Homo Sapiens
LNQHAYAVM

SEQ ID NO: 1241110 - protein, 9 aa, Homo Sapiens
ESQELMRLF

SEQ ID NO: 1241111 - protein, 9 aa, Homo Sapiens
PNLPKRWDL

SEQ ID NO: 1241112 - protein, 9 aa, Homo Sapiens
PLLINGSGQ

SEQ ID NO: 1241113 - protein, 9 aa, Homo Sapiens
GRRYDLIGL

SEQ ID NO: 1241114 - protein, 9 aa, Homo Sapiens
FLLRAASGV

SEQ ID NO: 1241115 - protein, 9 aa, Homo Sapiens
SASGSGPKL

SEQ ID NO: 1241116 - protein, 9 aa, Homo Sapiens
CLSVTIFSF

SEQ ID NO: 1241117 - protein, 9 aa, Homo Sapiens
QKVKTGSKN

SEQ ID NO: 1241118 - protein, 9 aa, Homo Sapiens
SWLPTLPAT

SEQ ID NO: 1241119 - protein, 9 aa, Homo Sapiens
GASSSKSHG

SEQ ID NO: 1241120 - protein, 9 aa, Homo Sapiens
KKRKKEPSC

SEQ ID NO: 1241121 - protein, 9 aa, Homo Sapiens
GSNGTIKVE

SEQ ID NO: 1241122 - protein, 9 aa, Homo Sapiens
PPPVELGYQ

SEQ ID NO: 1241123 - protein, 9 aa, Homo Sapiens
LHALSDDGV

SEQ ID NO: 1241124 - protein, 9 aa, Homo Sapiens
SKNQEHEEK

SEQ ID NO: 1241125 - protein, 9 aa, Homo Sapiens
EKFGLHTIA

SEQ ID NO: 1241126 - protein, 9 aa, Homo Sapiens
ITMCEPEFG

SEQ ID NO: 1241127 - protein, 9 aa, Homo Sapiens
DNEKAKAHI

SEQ ID NO: 1241128 - protein, 9 aa, Homo Sapiens
CDGVLQTHP

SEQ ID NO: 1241129 - protein, 9 aa, Homo Sapiens
PLTRLSTGR

SEQ ID NO: 1241130 - protein, 9 aa, Homo Sapiens
HCLAPENSD

SEQ ID NO: 1241131 - protein, 9 aa, Homo Sapiens
MRPVWTMIG

SEQ ID NO: 1241132 - protein, 9 aa, Homo Sapiens
AISLRSRLE

SEQ ID NO: 1241133 - protein, 9 aa, Homo Sapiens
LQPFCTVCN

SEQ ID NO: 1241134 - protein, 9 aa, Homo Sapiens
RCNKKIAMT

SEQ ID NO: 1241135 - protein, 9 aa, Homo Sapiens
EHPDIHKLG

SEQ ID NO: 1241136 - protein, 9 aa, Homo Sapiens
EGSYATVYN

SEQ ID NO: 1241137 - protein, 9 aa, Homo Sapiens
REMWLDRNQ

SEQ ID NO: 1241138 - protein, 9 aa, Homo Sapiens
QNRTHSFGH

SEQ ID NO: 1241139 - protein, 9 aa, Homo Sapiens
CFMEELGEC

SEQ ID NO: 1241140 - protein, 9 aa, Homo Sapiens
SIPSNSNVV

SEQ ID NO: 1241141 - protein, 9 aa, Homo Sapiens
GAGVEEEGY

SEQ ID NO: 1241142 - protein, 9 aa, Homo Sapiens
DRLQEYTEQ

SEQ ID NO: 1241143 - protein, 9 aa, Homo Sapiens
EGTLEGADA

SEQ ID NO: 1241144 - protein, 9 aa, Homo Sapiens
GETPPVDGL

SEQ ID NO: 1241145 - protein, 9 aa, Homo Sapiens
WGFPERPYL

SEQ ID NO: 1241146 - protein, 9 aa, Homo Sapiens
LVSIDSKPS

SEQ ID NO: 1241147 - protein, 9 aa, Homo Sapiens
RDKLCLMVC

SEQ ID NO: 1241148 - protein, 9 aa, Homo Sapiens
ISREEVNEN

SEQ ID NO: 1241149 - protein, 9 aa, Homo Sapiens
PGVRYTGTT

SEQ ID NO: 1241150 - protein, 9 aa, Homo Sapiens
LFGYDEQWQ

SEQ ID NO: 1241151 - protein, 9 aa, Homo Sapiens
LVQRHHIRG

SEQ ID NO: 1241152 - protein, 9 aa, Homo Sapiens
TGSVSSLNS

SEQ ID NO: 1241153 - protein, 9 aa, Homo Sapiens
AKNDVVKIP

SEQ ID NO: 1241154 - protein, 9 aa, Homo Sapiens
LLTSDAPKV

SEQ ID NO: 1241155 - protein, 9 aa, Homo Sapiens
FNTMFTNCH

SEQ ID NO: 1241156 - protein, 9 aa, Homo Sapiens
ECHSLDFQA

SEQ ID NO: 1241157 - protein, 9 aa, Homo Sapiens
GRLQQEEVQ

SEQ ID NO: 1241158 - protein, 9 aa, Homo Sapiens
VLNNLIVNA

SEQ ID NO: 1241159 - protein, 9 aa, Homo Sapiens
TLIWTAPRG

SEQ ID NO: 1241160 - protein, 9 aa, Homo Sapiens
TNRLGPEAD

SEQ ID NO: 1241161 - protein, 9 aa, Homo Sapiens
HQGRIVIIL

SEQ ID NO: 1241162 - protein, 9 aa, Homo Sapiens
NAWRPLEGV

SEQ ID NO: 1241163 - protein, 9 aa, Homo Sapiens
SQGKRWLTA

SEQ ID NO: 1241164 - protein, 9 aa, Homo Sapiens
IAVGLSLWV

SEQ ID NO: 1241165 - protein, 9 aa, Homo Sapiens
QEARKTLFP

SEQ ID NO: 1241166 - protein, 9 aa, Homo Sapiens
CINICRVDF

SEQ ID NO: 1241167 - protein, 9 aa, Homo Sapiens
LLTMDACYG

SEQ ID NO: 1241168 - protein, 9 aa, Homo Sapiens
KFVETPRTT

SEQ ID NO: 1241169 - protein, 9 aa, Homo Sapiens
VKRKKRRHR

SEQ ID NO: 1241170 - protein, 9 aa, Homo Sapiens
RRTLLLSLM

SEQ ID NO: 1241171 - protein, 9 aa, Homo Sapiens
HVVSLTNTL

SEQ ID NO: 1241172 - protein, 9 aa, Homo Sapiens
SSWESCCRT

SEQ ID NO: 1241173 - protein, 9 aa, Homo Sapiens
AQLKSLSTC

SEQ ID NO: 1241174 - protein, 9 aa, Homo Sapiens
SGGPINPDT

SEQ ID NO: 1241175 - protein, 9 aa, Homo Sapiens
PVNVCWLLC

SEQ ID NO: 1241176 - protein, 9 aa, Homo Sapiens
LAARVVEEM

SEQ ID NO: 1241177 - protein, 9 aa, Homo Sapiens
CAFMYMCPS

SEQ ID NO: 1241178 - protein, 9 aa, Homo Sapiens
PRAARPIHN

SEQ ID NO: 1241179 - protein, 9 aa, Homo Sapiens
TCPFNDRHQ

SEQ ID NO: 1241180 - protein, 9 aa, Homo Sapiens
NQLVREMEE

SEQ ID NO: 1241181 - protein, 9 aa, Homo Sapiens
VFLCLYCNP

SEQ ID NO: 1241182 - protein, 9 aa, Homo Sapiens
GAFPMFPPN

SEQ ID NO: 1241183 - protein, 9 aa, Homo Sapiens
APANSFVGA

SEQ ID NO: 1241184 - protein, 9 aa, Homo Sapiens
MEEEHIYAL

SEQ ID NO: 1241185 - protein, 9 aa, Homo Sapiens
GLHGPSGAA

SEQ ID NO: 1241186 - protein, 9 aa, Homo Sapiens
QRPAIYYVM

SEQ ID NO: 1241187 - protein, 9 aa, Homo Sapiens
LQAVNDLCY

SEQ ID NO: 1241188 - protein, 9 aa, Homo Sapiens
HFAVDRRVF

SEQ ID NO: 1241189 - protein, 9 aa, Homo Sapiens
TTDAQPGNT

SEQ ID NO: 1241190 - protein, 9 aa, Homo Sapiens
VFFNPWFQK

SEQ ID NO: 1241191 - protein, 9 aa, Homo Sapiens
AESTVQEEV

SEQ ID NO: 1241192 - protein, 9 aa, Homo Sapiens
NSKWDISEE

SEQ ID NO: 1241193 - protein, 9 aa, Homo Sapiens
GVMGAVNGM

SEQ ID NO: 1241194 - protein, 9 aa, Homo Sapiens
LIPGSSNQI

SEQ ID NO: 1241195 - protein, 9 aa, Homo Sapiens
CILPVLMDG

SEQ ID NO: 1241196 - protein, 9 aa, Homo Sapiens
TGPGTPRAP

SEQ ID NO: 1241197 - protein, 9 aa, Homo Sapiens
PLMELLFRN

SEQ ID NO: 1241198 - protein, 9 aa, Homo Sapiens
VFVTIPVVI

SEQ ID NO: 1241199 - protein, 9 aa, Homo Sapiens
PLLCTMEKF

SEQ ID NO: 1241200 - protein, 9 aa, Homo Sapiens
EEEDSCMVL

SEQ ID NO: 1241201 - protein, 9 aa, Homo Sapiens
QIGRVVENS

SEQ ID NO: 1241202 - protein, 9 aa, Homo Sapiens
VDPMHPELV

SEQ ID NO: 1241203 - protein, 9 aa, Homo Sapiens
ILTIGTRSG

SEQ ID NO: 1241204 - protein, 9 aa, Homo Sapiens
SERSRAHYE

SEQ ID NO: 1241205 - protein, 9 aa, Homo Sapiens
CDETLFGLK

SEQ ID NO: 1241206 - protein, 9 aa, Homo Sapiens
SPQGGQMGR

SEQ ID NO: 1241207 - protein, 9 aa, Homo Sapiens
NRLVPTGTW

SEQ ID NO: 1241208 - protein, 9 aa, Homo Sapiens
VGGPVPRTD

SEQ ID NO: 1241209 - protein, 9 aa, Homo Sapiens
QSSPSPSWD

SEQ ID NO: 1241210 - protein, 9 aa, Homo Sapiens
ELGRDRQSE

SEQ ID NO: 1241211 - protein, 9 aa, Homo Sapiens
AHEDISRLR

SEQ ID NO: 1241212 - protein, 9 aa, Homo Sapiens
HSCTLVMEC

SEQ ID NO: 1241213 - protein, 9 aa, Homo Sapiens
HAAIRVLPS

SEQ ID NO: 1241214 - protein, 9 aa, Homo Sapiens
QPQRCSDNC

SEQ ID NO: 1241215 - protein, 9 aa, Homo Sapiens
VRRSLRQFP

SEQ ID NO: 1241216 - protein, 9 aa, Homo Sapiens
HALEEHQKP

SEQ ID NO: 1241217 - protein, 9 aa, Homo Sapiens
KRYFSIVPG

SEQ ID NO: 1241218 - protein, 9 aa, Homo Sapiens
EENGIVLDH

SEQ ID NO: 1241219 - protein, 9 aa, Homo Sapiens
ERPPRAHVQ

SEQ ID NO: 1241220 - protein, 9 aa, Homo Sapiens
YQCCPHSCC

SEQ ID NO: 1241221 - protein, 9 aa, Homo Sapiens
LYISMQLLY

SEQ ID NO: 1241222 - protein, 9 aa, Homo Sapiens
ISPLTIYHA

SEQ ID NO: 1241223 - protein, 9 aa, Homo Sapiens
EAELMITVH

SEQ ID NO: 1241224 - protein, 9 aa, Homo Sapiens
SSRGQSELI

SEQ ID NO: 1241225 - protein, 9 aa, Homo Sapiens
SDLSFLDIC

SEQ ID NO: 1241226 - protein, 9 aa, Homo Sapiens
VLLTLPMAY

SEQ ID NO: 1241227 - protein, 9 aa, Homo Sapiens
ENVYKCDDC

SEQ ID NO: 1241228 - protein, 9 aa, Homo Sapiens
SRTWASPCS

SEQ ID NO: 1241229 - protein, 9 aa, Homo Sapiens
DFHFNAMTC

SEQ ID NO: 1241230 - protein, 9 aa, Homo Sapiens
ISPKESPFR

SEQ ID NO: 1241231 - protein, 9 aa, Homo Sapiens
TLCIPYCKS

SEQ ID NO: 1241232 - protein, 9 aa, Homo Sapiens
AQELLKNKE

SEQ ID NO: 1241233 - protein, 9 aa, Homo Sapiens
KDLTKRSIQ

SEQ ID NO: 1241234 - protein, 9 aa, Homo Sapiens
EKPYKRNEC

SEQ ID NO: 1241235 - protein, 9 aa, Homo Sapiens
GATIPYHPK

SEQ ID NO: 1241236 - protein, 9 aa, Homo Sapiens
LHPQKRATP

SEQ ID NO: 1241237 - protein, 9 aa, Homo Sapiens
HMLIHTSIR

SEQ ID NO: 1241238 - protein, 9 aa, Homo Sapiens
REVLESGPM

SEQ ID NO: 1241239 - protein, 9 aa, Homo Sapiens
GRKDHLGCK

SEQ ID NO: 1241240 - protein, 9 aa, Homo Sapiens
KKKRLKLKH

SEQ ID NO: 1241241 - protein, 9 aa, Homo Sapiens
DLCARTQLR

SEQ ID NO: 1241242 - protein, 9 aa, Homo Sapiens
LADDIDRWC

SEQ ID NO: 1241243 - protein, 9 aa, Homo Sapiens
LYVPRSKSE

SEQ ID NO: 1241244 - protein, 9 aa, Homo Sapiens
MCGTNVFSP

SEQ ID NO: 1241245 - protein, 9 aa, Homo Sapiens
LDADTRRAM

SEQ ID NO: 1241246 - protein, 9 aa, Homo Sapiens
ILNKWDMLK

SEQ ID NO: 1241247 - protein, 9 aa, Homo Sapiens
VGDSLEVVY

SEQ ID NO: 1241248 - protein, 9 aa, Homo Sapiens
PRASTPHPL

SEQ ID NO: 1241249 - protein, 9 aa, Homo Sapiens
YSHFEKEQQ

SEQ ID NO: 1241250 - protein, 9 aa, Homo Sapiens
KVHERPPLT

SEQ ID NO: 1241251 - protein, 9 aa, Homo Sapiens
AGPRPRVPL

SEQ ID NO: 1241252 - protein, 9 aa, Homo Sapiens
LPESLHYKV

SEQ ID NO: 1241253 - protein, 9 aa, Homo Sapiens
TLLSTLTRK

SEQ ID NO: 1241254 - protein, 9 aa, Homo Sapiens
ALRHSTTRD

SEQ ID NO: 1241255 - protein, 9 aa, Homo Sapiens
VWLLEPPRT

SEQ ID NO: 1241256 - protein, 9 aa, Homo Sapiens
ICPKCKKEY

SEQ ID NO: 1241257 - protein, 9 aa, Homo Sapiens
PGPTATAAV

SEQ ID NO: 1241258 - protein, 9 aa, Homo Sapiens
MVKRGRLVP

SEQ ID NO: 1241259 - protein, 9 aa, Homo Sapiens
MLFPPLEKV

SEQ ID NO: 1241260 - protein, 9 aa, Homo Sapiens
LRTMHGTSI

SEQ ID NO: 1241261 - protein, 9 aa, Homo Sapiens
GPDSIMNST

SEQ ID NO: 1241262 - protein, 9 aa, Homo Sapiens
CGWQSIFYF

SEQ ID NO: 1241263 - protein, 9 aa, Homo Sapiens
ELLRITLSF

SEQ ID NO: 1241264 - protein, 9 aa, Homo Sapiens
KWIPTSLAV

SEQ ID NO: 1241265 - protein, 9 aa, Homo Sapiens
FTLSNRYMQ

SEQ ID NO: 1241266 - protein, 9 aa, Homo Sapiens
APDGRYMHS

SEQ ID NO: 1241267 - protein, 9 aa, Homo Sapiens
LQSSVVISD

SEQ ID NO: 1241268 - protein, 9 aa, Homo Sapiens
TRPKPNVFP

SEQ ID NO: 1241269 - protein, 9 aa, Homo Sapiens
PEFSRSHIL

SEQ ID NO: 1241270 - protein, 9 aa, Homo Sapiens
NLAEPNKKG

SEQ ID NO: 1241271 - protein, 9 aa, Homo Sapiens
ANLLCGGGI

SEQ ID NO: 1241272 - protein, 9 aa, Homo Sapiens
IQEAASIQE

SEQ ID NO: 1241273 - protein, 9 aa, Homo Sapiens
RWRVIPYDA

SEQ ID NO: 1241274 - protein, 9 aa, Homo Sapiens
HKTAVSVLK

SEQ ID NO: 1241275 - protein, 9 aa, Homo Sapiens
GHDTSIYVC

SEQ ID NO: 1241276 - protein, 9 aa, Homo Sapiens
LLFGTCAIR

SEQ ID NO: 1241277 - protein, 9 aa, Homo Sapiens
SQTMVKCVK

SEQ ID NO: 1241278 - protein, 9 aa, Homo Sapiens
GKHVEDFIQ

SEQ ID NO: 1241279 - protein, 9 aa, Homo Sapiens
YGCSQTVAM

SEQ ID NO: 1241280 - protein, 9 aa, Homo Sapiens
FSQGSDDEQ

SEQ ID NO: 1241281 - protein, 9 aa, Homo Sapiens
EDDDEDPDL

SEQ ID NO: 1241282 - protein, 9 aa, Homo Sapiens
TNPCGSMSF

SEQ ID NO: 1241283 - protein, 9 aa, Homo Sapiens
HYYQSLQAH

SEQ ID NO: 1241284 - protein, 9 aa, Homo Sapiens
PEGPIQHHP

SEQ ID NO: 1241285 - protein, 9 aa, Homo Sapiens
PSPGSHGQE

SEQ ID NO: 1241286 - protein, 9 aa, Homo Sapiens
TLVNCSKNV

SEQ ID NO: 1241287 - protein, 9 aa, Homo Sapiens
TPGFMTLRN

SEQ ID NO: 1241288 - protein, 9 aa, Homo Sapiens
LPTIGIKRA

SEQ ID NO: 1241289 - protein, 9 aa, Homo Sapiens
LFSVLVCPP

SEQ ID NO: 1241290 - protein, 9 aa, Homo Sapiens
MGENQTMIT

SEQ ID NO: 1241291 - protein, 9 aa, Homo Sapiens
DDALYRLGR

SEQ ID NO: 1241292 - protein, 9 aa, Homo Sapiens
SVDLSYCSL

SEQ ID NO: 1241293 - protein, 9 aa, Homo Sapiens
TRDVQKVLC

SEQ ID NO: 1241294 - protein, 9 aa, Homo Sapiens
SGLKIQMGK

SEQ ID NO: 1241295 - protein, 9 aa, Homo Sapiens
DRQAKLNQH

SEQ ID NO: 1241296 - protein, 9 aa, Homo Sapiens
QRIKSFENM

SEQ ID NO: 1241297 - protein, 9 aa, Homo Sapiens
FVSQIEEEY

SEQ ID NO: 1241298 - protein, 9 aa, Homo Sapiens
FLKVTTLTK

SEQ ID NO: 1241299 - protein, 9 aa, Homo Sapiens
FPQVISYLE

SEQ ID NO: 1241300 - protein, 9 aa, Homo Sapiens
IAAVVLQNR

SEQ ID NO: 1241301 - protein, 9 aa, Homo Sapiens
YLAVRRHSR

SEQ ID NO: 1241302 - protein, 9 aa, Homo Sapiens
IKGNPALCP

SEQ ID NO: 1241303 - protein, 9 aa, Homo Sapiens
GILPEPVIR

SEQ ID NO: 1241304 - protein, 9 aa, Homo Sapiens
TRSPGSLQI

SEQ ID NO: 1241305 - protein, 9 aa, Homo Sapiens
VCFGDGSLI

SEQ ID NO: 1241306 - protein, 9 aa, Homo Sapiens
FFLKVTTLT

SEQ ID NO: 1241307 - protein, 9 aa, Homo Sapiens
GKCGKRFSH

SEQ ID NO: 1241308 - protein, 9 aa, Homo Sapiens
TRQVCSLDN

SEQ ID NO: 1241309 - protein, 9 aa, Homo Sapiens
MMKALVLGG

SEQ ID NO: 1241310 - protein, 9 aa, Homo Sapiens
VELIDKSEM

SEQ ID NO: 1241311 - protein, 9 aa, Homo Sapiens
CIDDKNPCI

SEQ ID NO: 1241312 - protein, 9 aa, Homo Sapiens
SVLAPYREC

SEQ ID NO: 1241313 - protein, 9 aa, Homo Sapiens
PKPTLWDEP

SEQ ID NO: 1241314 - protein, 9 aa, Homo Sapiens
DLQCYRQCG

SEQ ID NO: 1241315 - protein, 9 aa, Homo Sapiens
QPCTPSPLD

SEQ ID NO: 1241316 - protein, 9 aa, Homo Sapiens
KVASDEYHR

SEQ ID NO: 1241317 - protein, 9 aa, Homo Sapiens
YSSSFTQHM

SEQ ID NO: 1241318 - protein, 9 aa, Homo Sapiens
KYKPTPILI

SEQ ID NO: 1241319 - protein, 9 aa, Homo Sapiens
HQSIHTGEN

SEQ ID NO: 1241320 - protein, 9 aa, Homo Sapiens
PSPLTSLLI

SEQ ID NO: 1241321 - protein, 9 aa, Homo Sapiens
LGKCNSGQF

SEQ ID NO: 1241322 - protein, 9 aa, Homo Sapiens
STFSQRSSD

SEQ ID NO: 1241323 - protein, 9 aa, Homo Sapiens
YTLSCLERD

SEQ ID NO: 1241324 - protein, 9 aa, Homo Sapiens
GSYMCLALE

SEQ ID NO: 1241325 - protein, 9 aa, Homo Sapiens
ILGPEDLCA

SEQ ID NO: 1241326 - protein, 9 aa, Homo Sapiens
TNRLDKPKF

SEQ ID NO: 1241327 - protein, 9 aa, Homo Sapiens
CVQNNIPQL

SEQ ID NO: 1241328 - protein, 9 aa, Homo Sapiens
APKSVLQSR

SEQ ID NO: 1241329 - protein, 9 aa, Homo Sapiens
DHPKIATWR

SEQ ID NO: 1241330 - protein, 9 aa, Homo Sapiens
ATCFLRQSG

SEQ ID NO: 1241331 - protein, 9 aa, Homo Sapiens
QYAYVPPMA

SEQ ID NO: 1241332 - protein, 9 aa, Homo Sapiens
DLMASFLGQ

SEQ ID NO: 1241333 - protein, 9 aa, Homo Sapiens
VEIVLLDHG

SEQ ID NO: 1241334 - protein, 9 aa, Homo Sapiens
EMVRVQGPG

SEQ ID NO: 1241335 - protein, 9 aa, Homo Sapiens
HNDSSILDF

SEQ ID NO: 1241336 - protein, 9 aa, Homo Sapiens
SQICLNTEW

SEQ ID NO: 1241337 - protein, 9 aa, Homo Sapiens
PCMLCHENM

SEQ ID NO: 1241338 - protein, 9 aa, Homo Sapiens
RTAHFGSAL

SEQ ID NO: 1241339 - protein, 9 aa, Homo Sapiens
RWEMHHTQT

SEQ ID NO: 1241340 - protein, 9 aa, Homo Sapiens
FHAEQSLRS

SEQ ID NO: 1241341 - protein, 9 aa, Homo Sapiens
PLKAIQWEA

SEQ ID NO: 1241342 - protein, 9 aa, Homo Sapiens
RQGEATLSC

SEQ ID NO: 1241343 - protein, 9 aa, Homo Sapiens
GGLMALLLA

SEQ ID NO: 1241344 - protein, 9 aa, Homo Sapiens
ATHSPEEIR

SEQ ID NO: 1241345 - protein, 9 aa, Homo Sapiens
APPWVPAIG

SEQ ID NO: 1241346 - protein, 9 aa, Homo Sapiens
GSWTFAHRP

SEQ ID NO: 1241347 - protein, 9 aa, Homo Sapiens
EWESQCKIM

SEQ ID NO: 1241348 - protein, 9 aa, Homo Sapiens
LRQVAVVED

SEQ ID NO: 1241349 - protein, 9 aa, Homo Sapiens
SQSKHRASN

SEQ ID NO: 1241350 - protein, 9 aa, Homo Sapiens
GKISECSQY

SEQ ID NO: 1241351 - protein, 9 aa, Homo Sapiens
QYSAKHGEV

SEQ ID NO: 1241352 - protein, 9 aa, Homo Sapiens
YHGCRDVEQ

SEQ ID NO: 1241353 - protein, 9 aa, Homo Sapiens
SLQSCIQFQ

SEQ ID NO: 1241354 - protein, 9 aa, Homo Sapiens
LLMENGPGK

SEQ ID NO: 1241355 - protein, 9 aa, Homo Sapiens
RSILLFLTH

SEQ ID NO: 1241356 - protein, 9 aa, Homo Sapiens
TRINHSYTG

SEQ ID NO: 1241357 - protein, 9 aa, Homo Sapiens
YETHHMYYL

SEQ ID NO: 1241358 - protein, 9 aa, Homo Sapiens
KEKTGALWH

SEQ ID NO: 1241359 - protein, 9 aa, Homo Sapiens
QLMGAGTLT

SEQ ID NO: 1241360 - protein, 9 aa, Homo Sapiens
EHINRYISD

SEQ ID NO: 1241361 - protein, 9 aa, Homo Sapiens
ILKLIHPPL

SEQ ID NO: 1241362 - protein, 9 aa, Homo Sapiens
VLSPGADHM

SEQ ID NO: 1241363 - protein, 9 aa, Homo Sapiens
ELGGGWICW

SEQ ID NO: 1241364 - protein, 9 aa, Homo Sapiens
QHSDIAQRC

SEQ ID NO: 1241365 - protein, 9 aa, Homo Sapiens
TEKELAPEP

SEQ ID NO: 1241366 - protein, 9 aa, Homo Sapiens
VNKIGEHME

SEQ ID NO: 1241367 - protein, 9 aa, Homo Sapiens
RMERLRVEM

SEQ ID NO: 1241368 - protein, 9 aa, Homo Sapiens
LSRFHVKFT

SEQ ID NO: 1241369 - protein, 9 aa, Homo Sapiens
LDKPLFHIY

SEQ ID NO: 1241370 - protein, 9 aa, Homo Sapiens
YVKACLLPD

SEQ ID NO: 1241371 - protein, 9 aa, Homo Sapiens
NYHEVSVFV

SEQ ID NO: 1241372 - protein, 9 aa, Homo Sapiens
VMNRIFKRA

SEQ ID NO: 1241373 - protein, 9 aa, Homo Sapiens
DVRKATQSV

SEQ ID NO: 1241374 - protein, 9 aa, Homo Sapiens
TVKVEAGGG

SEQ ID NO: 1241375 - protein, 9 aa, Homo Sapiens
IKLIYNLYA

SEQ ID NO: 1241376 - protein, 9 aa, Homo Sapiens
IGQQLNGLG

SEQ ID NO: 1241377 - protein, 9 aa, Homo Sapiens
MGGCSGQGA

SEQ ID NO: 1241378 - protein, 9 aa, Homo Sapiens
HIQAQTGTH

SEQ ID NO: 1241379 - protein, 9 aa, Homo Sapiens
EKSSKPKDS

SEQ ID NO: 1241380 - protein, 9 aa, Homo Sapiens
GWLQLLNRW

SEQ ID NO: 1241381 - protein, 9 aa, Homo Sapiens
YCGVGADRS

SEQ ID NO: 1241382 - protein, 9 aa, Homo Sapiens
HYLFGAGCF

SEQ ID NO: 1241383 - protein, 9 aa, Homo Sapiens
AIMAEEKKQ

SEQ ID NO: 1241384 - protein, 9 aa, Homo Sapiens
VNHSLSIFH

SEQ ID NO: 1241385 - protein, 9 aa, Homo Sapiens
VMECRMAAK

SEQ ID NO: 1241386 - protein, 9 aa, Homo Sapiens
CRLCNTPLA

SEQ ID NO: 1241387 - protein, 9 aa, Homo Sapiens
RQERDEVVK

SEQ ID NO: 1241388 - protein, 9 aa, Homo Sapiens
ITLTFQDQR

SEQ ID NO: 1241389 - protein, 9 aa, Homo Sapiens
GRTNIETSG

SEQ ID NO: 1241390 - protein, 9 aa, Homo Sapiens
SYFMCMEAC

SEQ ID NO: 1241391 - protein, 9 aa, Homo Sapiens
PLRGAAAVP

SEQ ID NO: 1241392 - protein, 9 aa, Homo Sapiens
WKRSRPRPT

SEQ ID NO: 1241393 - protein, 9 aa, Homo Sapiens
CGILLADLQ

SEQ ID NO: 1241394 - protein, 9 aa, Homo Sapiens
CQRGARCQD

SEQ ID NO: 1241395 - protein, 9 aa, Homo Sapiens
EEEPEETLG

SEQ ID NO: 1241396 - protein, 9 aa, Homo Sapiens
GRSAALKTS

SEQ ID NO: 1241397 - protein, 9 aa, Homo Sapiens
NVRFIGELT

SEQ ID NO: 1241398 - protein, 9 aa, Homo Sapiens
RGSCAASCV

SEQ ID NO: 1241399 - protein, 9 aa, Homo Sapiens
CQTTGLMEY

SEQ ID NO: 1241400 - protein, 9 aa, Homo Sapiens
AQRTKLTET

SEQ ID NO: 1241401 - protein, 9 aa, Homo Sapiens
TPRDQRVQG

SEQ ID NO: 1241402 - protein, 9 aa, Homo Sapiens
IRLCILPGT

SEQ ID NO: 1241403 - protein, 9 aa, Homo Sapiens
LLKIQKFTG

SEQ ID NO: 1241404 - protein, 9 aa, Homo Sapiens
PVKVRTKAA

SEQ ID NO: 1241405 - protein, 9 aa, Homo Sapiens
HQDWAAIMA

SEQ ID NO: 1241406 - protein, 9 aa, Homo Sapiens
RLSILTLQP

SEQ ID NO: 1241407 - protein, 9 aa, Homo Sapiens
FTLGNMNNN

SEQ ID NO: 1241408 - protein, 9 aa, Homo Sapiens
LSVNHSSNK

SEQ ID NO: 1241409 - protein, 9 aa, Homo Sapiens
DEEKMILSF

SEQ ID NO: 1241410 - protein, 9 aa, Homo Sapiens
FNVIREIQS

SEQ ID NO: 1241411 - protein, 9 aa, Homo Sapiens
THLEDMYWM

SEQ ID NO: 1241412 - protein, 9 aa, Homo Sapiens
CGDAEYVYY

SEQ ID NO: 1241413 - protein, 9 aa, Homo Sapiens
IQQQEGMQV

SEQ ID NO: 1241414 - protein, 9 aa, Homo Sapiens
SIQTQNKAS

SEQ ID NO: 1241415 - protein, 9 aa, Homo Sapiens
VKDRFQVFL

SEQ ID NO: 1241416 - protein, 9 aa, Homo Sapiens
KSFGERLIF

SEQ ID NO: 1241417 - protein, 9 aa, Homo Sapiens
GREEEHPPP

SEQ ID NO: 1241418 - protein, 9 aa, Homo Sapiens
KSPVPVEAL

SEQ ID NO: 1241419 - protein, 9 aa, Homo Sapiens
VRIMHWFGL

SEQ ID NO: 1241420 - protein, 9 aa, Homo Sapiens
QVLSLVSEN

SEQ ID NO: 1241421 - protein, 9 aa, Homo Sapiens
CHKDFGKDM

SEQ ID NO: 1241422 - protein, 9 aa, Homo Sapiens
HSKMFPIPA

SEQ ID NO: 1241423 - protein, 9 aa, Homo Sapiens
DINKNKNVT

SEQ ID NO: 1241424 - protein, 9 aa, Homo Sapiens
LDQYSDDFC

SEQ ID NO: 1241425 - protein, 9 aa, Homo Sapiens
WGCCGEQDR

SEQ ID NO: 1241426 - protein, 9 aa, Homo Sapiens
ETASRAEGL

SEQ ID NO: 1241427 - protein, 9 aa, Homo Sapiens
QPIEKIVTD

SEQ ID NO: 1241428 - protein, 9 aa, Homo Sapiens
RRWKRLVEL

SEQ ID NO: 1241429 - protein, 9 aa, Homo Sapiens
EDAVCRLLE

SEQ ID NO: 1241430 - protein, 9 aa, Homo Sapiens
VCRAEKRLK

SEQ ID NO: 1241431 - protein, 9 aa, Homo Sapiens
AGQSNLKSN

SEQ ID NO: 1241432 - protein, 9 aa, Homo Sapiens
DDSVGHIPE

SEQ ID NO: 1241433 - protein, 9 aa, Homo Sapiens
LVIELSCMD

SEQ ID NO: 1241434 - protein, 9 aa, Homo Sapiens
KQTSECLRY

SEQ ID NO: 1241435 - protein, 9 aa, Homo Sapiens
KAEDICRRS

SEQ ID NO: 1241436 - protein, 9 aa, Homo Sapiens
ETLCEDMGQ

SEQ ID NO: 1241437 - protein, 9 aa, Homo Sapiens
DPVPFDQGS

SEQ ID NO: 1241438 - protein, 9 aa, Homo Sapiens
GKAFEHFSA

SEQ ID NO: 1241439 - protein, 9 aa, Homo Sapiens
VVHRRAAAP

SEQ ID NO: 1241440 - protein, 9 aa, Homo Sapiens
WEENDPQSG

SEQ ID NO: 1241441 - protein, 9 aa, Homo Sapiens
HYIYTPLPD

SEQ ID NO: 1241442 - protein, 9 aa, Homo Sapiens
RCIASETHV

SEQ ID NO: 1241443 - protein, 9 aa, Homo Sapiens
KTFSRGSYQ

SEQ ID NO: 1241444 - protein, 9 aa, Homo Sapiens
LCITRKKVS

SEQ ID NO: 1241445 - protein, 9 aa, Homo Sapiens
TKNYVALHI

SEQ ID NO: 1241446 - protein, 9 aa, Homo Sapiens
EDIIPDSPI

SEQ ID NO: 1241447 - protein, 9 aa, Homo Sapiens
DMPTATAET

SEQ ID NO: 1241448 - protein, 9 aa, Homo Sapiens
SGEMVIHGG

SEQ ID NO: 1241449 - protein, 9 aa, Homo Sapiens
RLAPEYETA

SEQ ID NO: 1241450 - protein, 9 aa, Homo Sapiens
NVVAWSPSG

SEQ ID NO: 1241451 - protein, 9 aa, Homo Sapiens
LQQQLRKRD

SEQ ID NO: 1241452 - protein, 9 aa, Homo Sapiens
AHWTIQKVF

SEQ ID NO: 1241453 - protein, 9 aa, Homo Sapiens
NLHPQLASV

SEQ ID NO: 1241454 - protein, 9 aa, Homo Sapiens
ALRDDPSGV

SEQ ID NO: 1241455 - protein, 9 aa, Homo Sapiens
FCVGGDIRV

SEQ ID NO: 1241456 - protein, 9 aa, Homo Sapiens
MMVILNVLL

SEQ ID NO: 1241457 - protein, 9 aa, Homo Sapiens
AWSCVQNNI

SEQ ID NO: 1241458 - protein, 9 aa, Homo Sapiens
VSVTYQFGS

SEQ ID NO: 1241459 - protein, 9 aa, Homo Sapiens
WDQLCSLYY

SEQ ID NO: 1241460 - protein, 9 aa, Homo Sapiens
VYLRSRNLL

SEQ ID NO: 1241461 - protein, 9 aa, Homo Sapiens
ITVDSLVNK

SEQ ID NO: 1241462 - protein, 9 aa, Homo Sapiens
AMVPLVRKI

SEQ ID NO: 1241463 - protein, 9 aa, Homo Sapiens
DSFQKVKTG

SEQ ID NO: 1241464 - protein, 9 aa, Homo Sapiens
WPPHLVPNQ

SEQ ID NO: 1241465 - protein, 9 aa, Homo Sapiens
DEYQRVRER

SEQ ID NO: 1241466 - protein, 9 aa, Homo Sapiens
KRFEITRSQ

SEQ ID NO: 1241467 - protein, 9 aa, Homo Sapiens
YRVCQEILE

SEQ ID NO: 1241468 - protein, 9 aa, Homo Sapiens
QRKIAVSSI

SEQ ID NO: 1241469 - protein, 9 aa, Homo Sapiens
TLLDLINFF

SEQ ID NO: 1241470 - protein, 9 aa, Homo Sapiens
FWGPISYMR

SEQ ID NO: 1241471 - protein, 9 aa, Homo Sapiens
QVIKDKNDS

SEQ ID NO: 1241472 - protein, 9 aa, Homo Sapiens
FTPQDAYSH

SEQ ID NO: 1241473 - protein, 9 aa, Homo Sapiens
HHLRLPTYQ

SEQ ID NO: 1241474 - protein, 9 aa, Homo Sapiens
SPRHKPHIS

SEQ ID NO: 1241475 - protein, 9 aa, Homo Sapiens
YENVIGYMP

SEQ ID NO: 1241476 - protein, 9 aa, Homo Sapiens
FEESLVMMV

SEQ ID NO: 1241477 - protein, 9 aa, Homo Sapiens
GNVGDVTCG

SEQ ID NO: 1241478 - protein, 9 aa, Homo Sapiens
CPPSSLAGP

SEQ ID NO: 1241479 - protein, 9 aa, Homo Sapiens
PFGAGPHSC

SEQ ID NO: 1241480 - protein, 9 aa, Homo Sapiens
EMDEINHAF

SEQ ID NO: 1241481 - protein, 9 aa, Homo Sapiens
LHASRTQIV

SEQ ID NO: 1241482 - protein, 9 aa, Homo Sapiens
FHDYNVEAP

SEQ ID NO: 1241483 - protein, 9 aa, Homo Sapiens
GAARSGGQV

SEQ ID NO: 1241484 - protein, 9 aa, Homo Sapiens
NPPAHESIL

SEQ ID NO: 1241485 - protein, 9 aa, Homo Sapiens
IQLIMIFCS

SEQ ID NO: 1241486 - protein, 9 aa, Homo Sapiens
RRTTTSPDS

SEQ ID NO: 1241487 - protein, 9 aa, Homo Sapiens
TCEDLKDQL

SEQ ID NO: 1241488 - protein, 9 aa, Homo Sapiens
DHEDCVEML

SEQ ID NO: 1241489 - protein, 9 aa, Homo Sapiens
TTYSLEHAI

SEQ ID NO: 1241490 - protein, 9 aa, Homo Sapiens
RDISLSLVI

SEQ ID NO: 1241491 - protein, 9 aa, Homo Sapiens
ALRIHNITA

SEQ ID NO: 1241492 - protein, 9 aa, Homo Sapiens
KAILTVHHK

SEQ ID NO: 1241493 - protein, 9 aa, Homo Sapiens
NMLDTTGMV

SEQ ID NO: 1241494 - protein, 9 aa, Homo Sapiens
GGVATPGRP

SEQ ID NO: 1241495 - protein, 9 aa, Homo Sapiens
ICALDVDAA

SEQ ID NO: 1241496 - protein, 9 aa, Homo Sapiens
MALADGPGA

SEQ ID NO: 1241497 - protein, 9 aa, Homo Sapiens
SMGNLNLPK

SEQ ID NO: 1241498 - protein, 9 aa, Homo Sapiens
HPLRSFVNP

SEQ ID NO: 1241499 - protein, 9 aa, Homo Sapiens
ANVPKEASA

SEQ ID NO: 1241500 - protein, 9 aa, Homo Sapiens
MGLTLNSQQ

SEQ ID NO: 1241501 - protein, 9 aa, Homo Sapiens
SPGGPGFLK

SEQ ID NO: 1241502 - protein, 9 aa, Homo Sapiens
NVFLILHFI

SEQ ID NO: 1241503 - protein, 9 aa, Homo Sapiens
DADALIVYA

SEQ ID NO: 1241504 - protein, 9 aa, Homo Sapiens
SALTLVRLI

SEQ ID NO: 1241505 - protein, 9 aa, Homo Sapiens
SYKCLHKHC

SEQ ID NO: 1241506 - protein, 9 aa, Homo Sapiens
TLCVCRIFS

SEQ ID NO: 1241507 - protein, 9 aa, Homo Sapiens
EQRPRSANK

SEQ ID NO: 1241508 - protein, 9 aa, Homo Sapiens
TILQESKSA

SEQ ID NO: 1241509 - protein, 9 aa, Homo Sapiens
VGKPHFETS

SEQ ID NO: 1241510 - protein, 9 aa, Homo Sapiens
SSPSPSWDR

SEQ ID NO: 1241511 - protein, 9 aa, Homo Sapiens
ADGDNFNEM

SEQ ID NO: 1241512 - protein, 9 aa, Homo Sapiens
GSTWADSQE

SEQ ID NO: 1241513 - protein, 9 aa, Homo Sapiens
PVGHLLMTF

SEQ ID NO: 1241514 - protein, 9 aa, Homo Sapiens
KLATCPFND

SEQ ID NO: 1241515 - protein, 9 aa, Homo Sapiens
QVQAYVMRY

SEQ ID NO: 1241516 - protein, 9 aa, Homo Sapiens
KMYSQGMAP

SEQ ID NO: 1241517 - protein, 9 aa, Homo Sapiens
MDHQATSLP

SEQ ID NO: 1241518 - protein, 9 aa, Homo Sapiens
KHVFFLTPK

SEQ ID NO: 1241519 - protein, 9 aa, Homo Sapiens
GYTLGFMSL

SEQ ID NO: 1241520 - protein, 9 aa, Homo Sapiens
RDKENVLMP

SEQ ID NO: 1241521 - protein, 9 aa, Homo Sapiens
MSVQGKAGK

SEQ ID NO: 1241522 - protein, 9 aa, Homo Sapiens
QVSVAADSA

SEQ ID NO: 1241523 - protein, 9 aa, Homo Sapiens
AGSSLCIIG

SEQ ID NO: 1241524 - protein, 9 aa, Homo Sapiens
VSQTRGISS

SEQ ID NO: 1241525 - protein, 9 aa, Homo Sapiens
VTQLGSQLI

SEQ ID NO: 1241526 - protein, 9 aa, Homo Sapiens
QRATSFGIL

SEQ ID NO: 1241527 - protein, 9 aa, Homo Sapiens
KTDAMAPDV

SEQ ID NO: 1241528 - protein, 9 aa, Homo Sapiens
QGFFQSFSD

SEQ ID NO: 1241529 - protein, 9 aa, Homo Sapiens
QSEADWLQF

SEQ ID NO: 1241530 - protein, 9 aa, Homo Sapiens
CKLQDIQEI

SEQ ID NO: 1241531 - protein, 9 aa, Homo Sapiens
TCLASWLTS

SEQ ID NO: 1241532 - protein, 9 aa, Homo Sapiens
GEFERLHRL

SEQ ID NO: 1241533 - protein, 9 aa, Homo Sapiens
KLGLRDDKD

SEQ ID NO: 1241534 - protein, 9 aa, Homo Sapiens
DGTEAMLVF

SEQ ID NO: 1241535 - protein, 9 aa, Homo Sapiens
IVNTTFEAG

SEQ ID NO: 1241536 - protein, 9 aa, Homo Sapiens
TSQANVVGP

SEQ ID NO: 1241537 - protein, 9 aa, Homo Sapiens
GSMSFTTSK

SEQ ID NO: 1241538 - protein, 9 aa, Homo Sapiens
SHDFSFTPT

SEQ ID NO: 1241539 - protein, 9 aa, Homo Sapiens
EEEWTRQGW

SEQ ID NO: 1241540 - protein, 9 aa, Homo Sapiens
QVLRDTANH

SEQ ID NO: 1241541 - protein, 9 aa, Homo Sapiens
DDDSGEGPS

SEQ ID NO: 1241542 - protein, 9 aa, Homo Sapiens
EEEDEEKDN

SEQ ID NO: 1241543 - protein, 9 aa, Homo Sapiens
MVQALEEVR

SEQ ID NO: 1241544 - protein, 9 aa, Homo Sapiens
SASGTSSTM

SEQ ID NO: 1241545 - protein, 9 aa, Homo Sapiens
AENIHYGRE

SEQ ID NO: 1241546 - protein, 9 aa, Homo Sapiens
QGLALIHAH

SEQ ID NO: 1241547 - protein, 9 aa, Homo Sapiens
EASNPESAA

SEQ ID NO: 1241548 - protein, 9 aa, Homo Sapiens
DMVNKIGEH

SEQ ID NO: 1241549 - protein, 9 aa, Homo Sapiens
NATLKTIKK

SEQ ID NO: 1241550 - protein, 9 aa, Homo Sapiens
GRKYGVATK

SEQ ID NO: 1241551 - protein, 9 aa, Homo Sapiens
EEVEWDYYP

SEQ ID NO: 1241552 - protein, 9 aa, Homo Sapiens
DEPGSVISW

SEQ ID NO: 1241553 - protein, 9 aa, Homo Sapiens
NPKAISVDP

SEQ ID NO: 1241554 - protein, 9 aa, Homo Sapiens
PAFWNRATL

SEQ ID NO: 1241555 - protein, 9 aa, Homo Sapiens
INTHITCRL

SEQ ID NO: 1241556 - protein, 9 aa, Homo Sapiens
PIAGLNVMR

SEQ ID NO: 1241557 - protein, 9 aa, Homo Sapiens
FSGNLRMPP

SEQ ID NO: 1241558 - protein, 9 aa, Homo Sapiens
EHLRRQFTS

SEQ ID NO: 1241559 - protein, 9 aa, Homo Sapiens
AKECTAPTP

SEQ ID NO: 1241560 - protein, 9 aa, Homo Sapiens
GRSKAGSGS

SEQ ID NO: 1241561 - protein, 9 aa, Homo Sapiens
WHLVHQCYD

SEQ ID NO: 1241562 - protein, 9 aa, Homo Sapiens
SLLDMEGAN

SEQ ID NO: 1241563 - protein, 9 aa, Homo Sapiens
VEVLSRLGD

SEQ ID NO: 1241564 - protein, 9 aa, Homo Sapiens
PRFVHIRQT

SEQ ID NO: 1241565 - protein, 9 aa, Homo Sapiens
HHAMADDDT

SEQ ID NO: 1241566 - protein, 9 aa, Homo Sapiens
NSMHHEIEG

SEQ ID NO: 1241567 - protein, 9 aa, Homo Sapiens
NPNTFECIA

SEQ ID NO: 1241568 - protein, 9 aa, Homo Sapiens
WMWCLFIGI

SEQ ID NO: 1241569 - protein, 9 aa, Homo Sapiens
NFADAVFMF

SEQ ID NO: 1241570 - protein, 9 aa, Homo Sapiens
LERHVVQKK

SEQ ID NO: 1241571 - protein, 9 aa, Homo Sapiens
TKAVCMIAI

SEQ ID NO: 1241572 - protein, 9 aa, Homo Sapiens
EAVTRLTRS

SEQ ID NO: 1241573 - protein, 9 aa, Homo Sapiens
VATGAASAP

SEQ ID NO: 1241574 - protein, 9 aa, Homo Sapiens
GSKAISHDS

SEQ ID NO: 1241575 - protein, 9 aa, Homo Sapiens
SSISVAGMP

SEQ ID NO: 1241576 - protein, 9 aa, Homo Sapiens
DDCQIKNVQ

SEQ ID NO: 1241577 - protein, 9 aa, Homo Sapiens
TVRRPDSRD

SEQ ID NO: 1241578 - protein, 9 aa, Homo Sapiens
SITKNVQQA

SEQ ID NO: 1241579 - protein, 9 aa, Homo Sapiens
IPASHSDVG

SEQ ID NO: 1241580 - protein, 9 aa, Homo Sapiens
CVVNDTKSG

SEQ ID NO: 1241581 - protein, 9 aa, Homo Sapiens
ETERQSMKS

SEQ ID NO: 1241582 - protein, 9 aa, Homo Sapiens
SGKRTLSMS

SEQ ID NO: 1241583 - protein, 9 aa, Homo Sapiens
QAEAAPLTL

SEQ ID NO: 1241584 - protein, 9 aa, Homo Sapiens
PKRWGWNDI

SEQ ID NO: 1241585 - protein, 9 aa, Homo Sapiens
TDQLPDCSE

SEQ ID NO: 1241586 - protein, 9 aa, Homo Sapiens
DALGWLGQA

SEQ ID NO: 1241587 - protein, 9 aa, Homo Sapiens
NGPAVGTRY

SEQ ID NO: 1241588 - protein, 9 aa, Homo Sapiens
ALAWNRVYI

SEQ ID NO: 1241589 - protein, 9 aa, Homo Sapiens
EHMDMVVEK

SEQ ID NO: 1241590 - protein, 9 aa, Homo Sapiens
EVMCLAFHP

SEQ ID NO: 1241591 - protein, 9 aa, Homo Sapiens
HLKWFGLWK

SEQ ID NO: 1241592 - protein, 9 aa, Homo Sapiens
RDHLLAING

SEQ ID NO: 1241593 - protein, 9 aa, Homo Sapiens
MDWLQICEP

SEQ ID NO: 1241594 - protein, 9 aa, Homo Sapiens
HAVGVLCYL

SEQ ID NO: 1241595 - protein, 9 aa, Homo Sapiens
DICLKEISQ

SEQ ID NO: 1241596 - protein, 9 aa, Homo Sapiens
SSQSQISRI

SEQ ID NO: 1241597 - protein, 9 aa, Homo Sapiens
PTDIPVPLS

SEQ ID NO: 1241598 - protein, 9 aa, Homo Sapiens
RENFSVLDL

SEQ ID NO: 1241599 - protein, 9 aa, Homo Sapiens
PKAGREEEH

SEQ ID NO: 1241600 - protein, 9 aa, Homo Sapiens
VSIYKLTGV

SEQ ID NO: 1241601 - protein, 9 aa, Homo Sapiens
QFHIQLNEM

SEQ ID NO: 1241602 - protein, 9 aa, Homo Sapiens
CATLIYYFV

SEQ ID NO: 1241603 - protein, 9 aa, Homo Sapiens
KEEWETMKV

SEQ ID NO: 1241604 - protein, 9 aa, Homo Sapiens
VHEDLEIGS

SEQ ID NO: 1241605 - protein, 9 aa, Homo Sapiens
PEYISDTTD

SEQ ID NO: 1241606 - protein, 9 aa, Homo Sapiens
RPSHIHHRK

SEQ ID NO: 1241607 - protein, 9 aa, Homo Sapiens
SNAFMVNGQ

SEQ ID NO: 1241608 - protein, 9 aa, Homo Sapiens
EERIKNLYK

SEQ ID NO: 1241609 - protein, 9 aa, Homo Sapiens
QSGCQDINE

SEQ ID NO: 1241610 - protein, 9 aa, Homo Sapiens
IPNSELMPF

SEQ ID NO: 1241611 - protein, 9 aa, Homo Sapiens
EHKTVYRDL

SEQ ID NO: 1241612 - protein, 9 aa, Homo Sapiens
LGYIQGMSD

SEQ ID NO: 1241613 - protein, 9 aa, Homo Sapiens
SPQSGSESK

SEQ ID NO: 1241614 - protein, 9 aa, Homo Sapiens
FGKHFMSFH

SEQ ID NO: 1241615 - protein, 9 aa, Homo Sapiens
LDKHHTPPM

SEQ ID NO: 1241616 - protein, 9 aa, Homo Sapiens
GHKSHEYHE

SEQ ID NO: 1241617 - protein, 9 aa, Homo Sapiens
PGPGELRLR

SEQ ID NO: 1241618 - protein, 9 aa, Homo Sapiens
ANWKKISIN

SEQ ID NO: 1241619 - protein, 9 aa, Homo Sapiens
LTLVLELLT

SEQ ID NO: 1241620 - protein, 9 aa, Homo Sapiens
AGSIFIGRG

SEQ ID NO: 1241621 - protein, 9 aa, Homo Sapiens
AIPGGNLFG

SEQ ID NO: 1241622 - protein, 9 aa, Homo Sapiens
YGKCWEMKS

SEQ ID NO: 1241623 - protein, 9 aa, Homo Sapiens
TASKDPTVS

SEQ ID NO: 1241624 - protein, 9 aa, Homo Sapiens
PAKPRSTRC

SEQ ID NO: 1241625 - protein, 9 aa, Homo Sapiens
PFNDRHQVP

SEQ ID NO: 1241626 - protein, 9 aa, Homo Sapiens
EVETNVKTV

SEQ ID NO: 1241627 - protein, 9 aa, Homo Sapiens
KQHTFRVNI

SEQ ID NO: 1241628 - protein, 9 aa, Homo Sapiens
EDELVDPLT

SEQ ID NO: 1241629 - protein, 9 aa, Homo Sapiens
HHHHHRRPQ

SEQ ID NO: 1241630 - protein, 9 aa, Homo Sapiens
REFVLVKLC

SEQ ID NO: 1241631 - protein, 9 aa, Homo Sapiens
EGFTIKKHM

SEQ ID NO: 1241632 - protein, 9 aa, Homo Sapiens
EYLKREWEM

SEQ ID NO: 1241633 - protein, 9 aa, Homo Sapiens
FQELYCMVV

SEQ ID NO: 1241634 - protein, 9 aa, Homo Sapiens
LGPEDLCAR

SEQ ID NO: 1241635 - protein, 9 aa, Homo Sapiens
KYKNTTKEV

SEQ ID NO: 1241636 - protein, 9 aa, Homo Sapiens
GLSAAQSSW

SEQ ID NO: 1241637 - protein, 9 aa, Homo Sapiens
GPEKMLDQS

SEQ ID NO: 1241638 - protein, 9 aa, Homo Sapiens
LAEGLIETK

SEQ ID NO: 1241639 - protein, 9 aa, Homo Sapiens
KRELDIQIS

SEQ ID NO: 1241640 - protein, 9 aa, Homo Sapiens
ATLRFLALA

SEQ ID NO: 1241641 - protein, 9 aa, Homo Sapiens
CKMHLYGLH

SEQ ID NO: 1241642 - protein, 9 aa, Homo Sapiens
RMDSAPAGS

SEQ ID NO: 1241643 - protein, 9 aa, Homo Sapiens
YPMIEIVYF

SEQ ID NO: 1241644 - protein, 9 aa, Homo Sapiens
LFKCPKGLG

SEQ ID NO: 1241645 - protein, 9 aa, Homo Sapiens
VTYHNPLCS

SEQ ID NO: 1241646 - protein, 9 aa, Homo Sapiens
HYECSKCQA

SEQ ID NO: 1241647 - protein, 9 aa, Homo Sapiens
TTLSNIARK

SEQ ID NO: 1241648 - protein, 9 aa, Homo Sapiens
AQAIKQGDL

SEQ ID NO: 1241649 - protein, 9 aa, Homo Sapiens
IFARDKNPI

SEQ ID NO: 1241650 - protein, 9 aa, Homo Sapiens
GGPSLTPTP

SEQ ID NO: 1241651 - protein, 9 aa, Homo Sapiens
PEEFQVVKV

SEQ ID NO: 1241652 - protein, 9 aa, Homo Sapiens
LPCTHSLCF

SEQ ID NO: 1241653 - protein, 9 aa, Homo Sapiens
GDENFTKDI

SEQ ID NO: 1241654 - protein, 9 aa, Homo Sapiens
MSYSMAILN

SEQ ID NO: 1241655 - protein, 9 aa, Homo Sapiens
FDLEVNYLT

SEQ ID NO: 1241656 - protein, 9 aa, Homo Sapiens
LPISAFHGV

SEQ ID NO: 1241657 - protein, 9 aa, Homo Sapiens
GKRHNLTTK

SEQ ID NO: 1241658 - protein, 9 aa, Homo Sapiens
SEEQLHQGQ

SEQ ID NO: 1241659 - protein, 9 aa, Homo Sapiens
PSGVVSIAC

SEQ ID NO: 1241660 - protein, 9 aa, Homo Sapiens
RIRVLTAKV

SEQ ID NO: 1241661 - protein, 9 aa, Homo Sapiens
DPAEMRDGP

SEQ ID NO: 1241662 - protein, 9 aa, Homo Sapiens
KAGREEEHP

SEQ ID NO: 1241663 - protein, 9 aa, Homo Sapiens
RVNIFTDFD

SEQ ID NO: 1241664 - protein, 9 aa, Homo Sapiens
RGHMSSAAL

SEQ ID NO: 1241665 - protein, 9 aa, Homo Sapiens
AAEPTHTQV

SEQ ID NO: 1241666 - protein, 9 aa, Homo Sapiens
TIRCTRMVD

SEQ ID NO: 1241667 - protein, 9 aa, Homo Sapiens
NPSNWCDGM

SEQ ID NO: 1241668 - protein, 9 aa, Homo Sapiens
SRCLCFHTT

SEQ ID NO: 1241669 - protein, 9 aa, Homo Sapiens
YKEDVTYAS

SEQ ID NO: 1241670 - protein, 9 aa, Homo Sapiens
CSKNVMFTR

SEQ ID NO: 1241671 - protein, 9 aa, Homo Sapiens
VHVAGKETT

SEQ ID NO: 1241672 - protein, 9 aa, Homo Sapiens
VLEIFKQAS

SEQ ID NO: 1241673 - protein, 9 aa, Homo Sapiens
SIFLDADTR

SEQ ID NO: 1241674 - protein, 9 aa, Homo Sapiens
MALSKREMD

SEQ ID NO: 1241675 - protein, 9 aa, Homo Sapiens
LSITSEHHN

SEQ ID NO: 1241676 - protein, 9 aa, Homo Sapiens
SVVVSRLVY

SEQ ID NO: 1241677 - protein, 9 aa, Homo Sapiens
NLHSPGVHP

SEQ ID NO: 1241678 - protein, 9 aa, Homo Sapiens
NKVTHILNA

SEQ ID NO: 1241679 - protein, 9 aa, Homo Sapiens
DTLTNIDSD

SEQ ID NO: 1241680 - protein, 9 aa, Homo Sapiens
ATFDTLQLW

SEQ ID NO: 1241681 - protein, 9 aa, Homo Sapiens
AACGTCVFT

SEQ ID NO: 1241682 - protein, 9 aa, Homo Sapiens
APISPKKPK

SEQ ID NO: 1241683 - protein, 9 aa, Homo Sapiens
FSTRAVYLA

SEQ ID NO: 1241684 - protein, 9 aa, Homo Sapiens
QVRMWYLLK

SEQ ID NO: 1241685 - protein, 9 aa, Homo Sapiens
QHYKKVGEC

SEQ ID NO: 1241686 - protein, 9 aa, Homo Sapiens
IEEVSKSLW

SEQ ID NO: 1241687 - protein, 9 aa, Homo Sapiens
EPSMATTKA

SEQ ID NO: 1241688 - protein, 9 aa, Homo Sapiens
FQPKRKEYE

SEQ ID NO: 1241689 - protein, 9 aa, Homo Sapiens
YFQQLAPAV

SEQ ID NO: 1241690 - protein, 9 aa, Homo Sapiens
NEHQVEADL

SEQ ID NO: 1241691 - protein, 9 aa, Homo Sapiens
RVPQHLQCL

SEQ ID NO: 1241692 - protein, 9 aa, Homo Sapiens
RCAPPPPPQ

SEQ ID NO: 1241693 - protein, 9 aa, Homo Sapiens
GSLDSKHQK

SEQ ID NO: 1241694 - protein, 9 aa, Homo Sapiens
RTHTGSNHS

SEQ ID NO: 1241695 - protein, 9 aa, Homo Sapiens
GRGKSLIGR

SEQ ID NO: 1241696 - protein, 9 aa, Homo Sapiens
LIAHYIYTP

SEQ ID NO: 1241697 - protein, 9 aa, Homo Sapiens
DMKSDNVKD

SEQ ID NO: 1241698 - protein, 9 aa, Homo Sapiens
LIKKRFVAG

SEQ ID NO: 1241699 - protein, 9 aa, Homo Sapiens
RSQPLLFII

SEQ ID NO: 1241700 - protein, 9 aa, Homo Sapiens
KELPDLEYL

SEQ ID NO: 1241701 - protein, 9 aa, Homo Sapiens
SNSKIVVVM

SEQ ID NO: 1241702 - protein, 9 aa, Homo Sapiens
LIFLLVGII

SEQ ID NO: 1241703 - protein, 9 aa, Homo Sapiens
VVHMSFGVV

SEQ ID NO: 1241704 - protein, 9 aa, Homo Sapiens
IFPQCLSSE

SEQ ID NO: 1241705 - protein, 9 aa, Homo Sapiens
GDMPTATAE

SEQ ID NO: 1241706 - protein, 9 aa, Homo Sapiens
YLSFITLGF

SEQ ID NO: 1241707 - protein, 9 aa, Homo Sapiens
YEEYYDDYY

SEQ ID NO: 1241708 - protein, 9 aa, Homo Sapiens
FAHALHFFR

SEQ ID NO: 1241709 - protein, 9 aa, Homo Sapiens
EACCSILSM

SEQ ID NO: 1241710 - protein, 9 aa, Homo Sapiens
LYHLEKLSS

SEQ ID NO: 1241711 - protein, 9 aa, Homo Sapiens
LQSLEFQTE

SEQ ID NO: 1241712 - protein, 9 aa, Homo Sapiens
ADTLGYTVH

SEQ ID NO: 1241713 - protein, 9 aa, Homo Sapiens
SFLLSMKKE

SEQ ID NO: 1241714 - protein, 9 aa, Homo Sapiens
SVGTTSDIL

SEQ ID NO: 1241715 - protein, 9 aa, Homo Sapiens
TGLGREDLP

SEQ ID NO: 1241716 - protein, 9 aa, Homo Sapiens
IWCLFFLIM

SEQ ID NO: 1241717 - protein, 9 aa, Homo Sapiens
EFKNKPFRH

SEQ ID NO: 1241718 - protein, 9 aa, Homo Sapiens
PQTKDEVAS

SEQ ID NO: 1241719 - protein, 9 aa, Homo Sapiens
AAEAGRKQL

SEQ ID NO: 1241720 - protein, 9 aa, Homo Sapiens
ILMDRGDIL

SEQ ID NO: 1241721 - protein, 9 aa, Homo Sapiens
QLQQFEKLK

SEQ ID NO: 1241722 - protein, 9 aa, Homo Sapiens
QEGHIWSSM

SEQ ID NO: 1241723 - protein, 9 aa, Homo Sapiens
FGTHTHKQI

SEQ ID NO: 1241724 - protein, 9 aa, Homo Sapiens
TAQLKSLST

SEQ ID NO: 1241725 - protein, 9 aa, Homo Sapiens
ISAITVFIA

SEQ ID NO: 1241726 - protein, 9 aa, Homo Sapiens
GAVKFTSLA

SEQ ID NO: 1241727 - protein, 9 aa, Homo Sapiens
TMLLHIKKT

SEQ ID NO: 1241728 - protein, 9 aa, Homo Sapiens
CHKNSINFF

SEQ ID NO: 1241729 - protein, 9 aa, Homo Sapiens
KRLTSPSEE

SEQ ID NO: 1241730 - protein, 9 aa, Homo Sapiens
PRAHVQHFH

SEQ ID NO: 1241731 - protein, 9 aa, Homo Sapiens
NSDAGNPVI

SEQ ID NO: 1241732 - protein, 9 aa, Homo Sapiens
FLSDDMKSE

SEQ ID NO: 1241733 - protein, 9 aa, Homo Sapiens
LYYATQNCM

SEQ ID NO: 1241734 - protein, 9 aa, Homo Sapiens
GVTMGSLIC

SEQ ID NO: 1241735 - protein, 9 aa, Homo Sapiens
SVQQTLVST

SEQ ID NO: 1241736 - protein, 9 aa, Homo Sapiens
YSNNESKKG

SEQ ID NO: 1241737 - protein, 9 aa, Homo Sapiens
LVGPICLVL

SEQ ID NO: 1241738 - protein, 9 aa, Homo Sapiens
RRQAEDDEQ

SEQ ID NO: 1241739 - protein, 9 aa, Homo Sapiens
TPFSVQVTT

SEQ ID NO: 1241740 - protein, 9 aa, Homo Sapiens
HFSRHDMIG

SEQ ID NO: 1241741 - protein, 9 aa, Homo Sapiens
HSNCLDQVG

SEQ ID NO: 1241742 - protein, 9 aa, Homo Sapiens
IEKSRHASI

SEQ ID NO: 1241743 - protein, 9 aa, Homo Sapiens
YFVASVFRG

SEQ ID NO: 1241744 - protein, 9 aa, Homo Sapiens
SPPTGTNMH

SEQ ID NO: 1241745 - protein, 9 aa, Homo Sapiens
SPQPWSLQS

SEQ ID NO: 1241746 - protein, 9 aa, Homo Sapiens
PCSRPRSRI

SEQ ID NO: 1241747 - protein, 9 aa, Homo Sapiens
VLSYMAEMR

SEQ ID NO: 1241748 - protein, 9 aa, Homo Sapiens
LIHVQCTGQ

SEQ ID NO: 1241749 - protein, 9 aa, Homo Sapiens
SIMKNQWLL

SEQ ID NO: 1241750 - protein, 9 aa, Homo Sapiens
NSMIGQKIA

SEQ ID NO: 1241751 - protein, 9 aa, Homo Sapiens
MRDGPQGDI

SEQ ID NO: 1241752 - protein, 9 aa, Homo Sapiens
LLPPVGPSS

SEQ ID NO: 1241753 - protein, 9 aa, Homo Sapiens
TLRYSPISG

SEQ ID NO: 1241754 - protein, 9 aa, Homo Sapiens
EALRQREWE

SEQ ID NO: 1241755 - protein, 9 aa, Homo Sapiens
WNDMDKYSV

SEQ ID NO: 1241756 - protein, 9 aa, Homo Sapiens
SVLRHQRTH

SEQ ID NO: 1241757 - protein, 9 aa, Homo Sapiens
AKTFSRGSY

SEQ ID NO: 1241758 - protein, 9 aa, Homo Sapiens
KEKVKPADD

SEQ ID NO: 1241759 - protein, 9 aa, Homo Sapiens
SGLSHISRK

SEQ ID NO: 1241760 - protein, 9 aa, Homo Sapiens
SDRIKQENF

SEQ ID NO: 1241761 - protein, 9 aa, Homo Sapiens
QQRVHHTDH

SEQ ID NO: 1241762 - protein, 9 aa, Homo Sapiens
IFRTGKPTD

SEQ ID NO: 1241763 - protein, 9 aa, Homo Sapiens
GLLMRDLEG

SEQ ID NO: 1241764 - protein, 9 aa, Homo Sapiens
PLDRAISCR

SEQ ID NO: 1241765 - protein, 9 aa, Homo Sapiens
EELEDSVIA

SEQ ID NO: 1241766 - protein, 9 aa, Homo Sapiens
NASGKLIAA

SEQ ID NO: 1241767 - protein, 9 aa, Homo Sapiens
ASARGPLCK

SEQ ID NO: 1241768 - protein, 9 aa, Homo Sapiens
TSKGLILPA

SEQ ID NO: 1241769 - protein, 9 aa, Homo Sapiens
MPRKYQVEL

SEQ ID NO: 1241770 - protein, 9 aa, Homo Sapiens
NIPNSELMP

SEQ ID NO: 1241771 - protein, 9 aa, Homo Sapiens
MYLSEKILL

SEQ ID NO: 1241772 - protein, 9 aa, Homo Sapiens
YQLSDHTIG

SEQ ID NO: 1241773 - protein, 9 aa, Homo Sapiens
SLPMDCLVD

SEQ ID NO: 1241774 - protein, 9 aa, Homo Sapiens
KNATLKTIK

SEQ ID NO: 1241775 - protein, 9 aa, Homo Sapiens
LSHEQKGRC

SEQ ID NO: 1241776 - protein, 9 aa, Homo Sapiens
QENRYWRRG

SEQ ID NO: 1241777 - protein, 9 aa, Homo Sapiens
LRPQRGPRP

SEQ ID NO: 1241778 - protein, 9 aa, Homo Sapiens
VVLVYNQDE

SEQ ID NO: 1241779 - protein, 9 aa, Homo Sapiens
DQRISPASR

SEQ ID NO: 1241780 - protein, 9 aa, Homo Sapiens
AQEVPGRVF

SEQ ID NO: 1241781 - protein, 9 aa, Homo Sapiens
PRSKWHWQV

SEQ ID NO: 1241782 - protein, 9 aa, Homo Sapiens
LQDVSGTDG

SEQ ID NO: 1241783 - protein, 9 aa, Homo Sapiens
RHLPEECHL

SEQ ID NO: 1241784 - protein, 9 aa, Homo Sapiens
LTNVRIART

SEQ ID NO: 1241785 - protein, 9 aa, Homo Sapiens
AVWVLIHAS

SEQ ID NO: 1241786 - protein, 9 aa, Homo Sapiens
ITMSNSMIN

SEQ ID NO: 1241787 - protein, 9 aa, Homo Sapiens
ERSDSELKD

SEQ ID NO: 1241788 - protein, 9 aa, Homo Sapiens
VLLSMTVTK

SEQ ID NO: 1241789 - protein, 9 aa, Homo Sapiens
VHPTSFIKI

SEQ ID NO: 1241790 - protein, 9 aa, Homo Sapiens
TLFTFIRLL

SEQ ID NO: 1241791 - protein, 9 aa, Homo Sapiens
GTPSYDATA

SEQ ID NO: 1241792 - protein, 9 aa, Homo Sapiens
HARTQQEGK

SEQ ID NO: 1241793 - protein, 9 aa, Homo Sapiens
SPHHMVRWV

SEQ ID NO: 1241794 - protein, 9 aa, Homo Sapiens
TTAHNTLGR

SEQ ID NO: 1241795 - protein, 9 aa, Homo Sapiens
RGKYSDLNE

SEQ ID NO: 1241796 - protein, 9 aa, Homo Sapiens
VVSGVVQII

SEQ ID NO: 1241797 - protein, 9 aa, Homo Sapiens
PVAAIKGPE

SEQ ID NO: 1241798 - protein, 9 aa, Homo Sapiens
NPLCSSISP

SEQ ID NO: 1241799 - protein, 9 aa, Homo Sapiens
AGQREVRPQ

SEQ ID NO: 1241800 - protein, 9 aa, Homo Sapiens
DRSGLIHVC

SEQ ID NO: 1241801 - protein, 9 aa, Homo Sapiens
SNTQGCQVT

SEQ ID NO: 1241802 - protein, 9 aa, Homo Sapiens
VPLPCGPTE

SEQ ID NO: 1241803 - protein, 9 aa, Homo Sapiens
HKRHTSSSD

SEQ ID NO: 1241804 - protein, 9 aa, Homo Sapiens
PYQQPLQSG

SEQ ID NO: 1241805 - protein, 9 aa, Homo Sapiens
HSFDALLAD

SEQ ID NO: 1241806 - protein, 9 aa, Homo Sapiens
PGPSRAHCP

SEQ ID NO: 1241807 - protein, 9 aa, Homo Sapiens
CAACCDDMA

SEQ ID NO: 1241808 - protein, 9 aa, Homo Sapiens
DAFGKINFL

SEQ ID NO: 1241809 - protein, 9 aa, Homo Sapiens
RTLETVNCM

SEQ ID NO: 1241810 - protein, 9 aa, Homo Sapiens
RYYHRCHVD

SEQ ID NO: 1241811 - protein, 9 aa, Homo Sapiens
GGWGWGNMQ

SEQ ID NO: 1241812 - protein, 9 aa, Homo Sapiens
QTRTHQGHH

SEQ ID NO: 1241813 - protein, 9 aa, Homo Sapiens
LEAHTPSVR

SEQ ID NO: 1241814 - protein, 9 aa, Homo Sapiens
LDLMFGEGM

SEQ ID NO: 1241815 - protein, 9 aa, Homo Sapiens
IPEGENMNV

SEQ ID NO: 1241816 - protein, 9 aa, Homo Sapiens
TIIANATTR

SEQ ID NO: 1241817 - protein, 9 aa, Homo Sapiens
TWLSFASTV

SEQ ID NO: 1241818 - protein, 9 aa, Homo Sapiens
TITSIFSLA

SEQ ID NO: 1241819 - protein, 9 aa, Homo Sapiens
KFLDTAKQT

SEQ ID NO: 1241820 - protein, 9 aa, Homo Sapiens
HQALGLRPT

SEQ ID NO: 1241821 - protein, 9 aa, Homo Sapiens
GVTIGLAAA

SEQ ID NO: 1241822 - protein, 9 aa, Homo Sapiens
AASGVPPPY

SEQ ID NO: 1241823 - protein, 9 aa, Homo Sapiens
LSFILLEGY

SEQ ID NO: 1241824 - protein, 9 aa, Homo Sapiens
VTPRPFVSQ

SEQ ID NO: 1241825 - protein, 9 aa, Homo Sapiens
RRRQAEDDE

SEQ ID NO: 1241826 - protein, 9 aa, Homo Sapiens
YNVIITVTD

SEQ ID NO: 1241827 - protein, 9 aa, Homo Sapiens
GTGSNIEVW

SEQ ID NO: 1241828 - protein, 9 aa, Homo Sapiens
WTLESLLSG

SEQ ID NO: 1241829 - protein, 9 aa, Homo Sapiens
GTWSFLTAK

SEQ ID NO: 1241830 - protein, 9 aa, Homo Sapiens
KRGSDYDTF

SEQ ID NO: 1241831 - protein, 9 aa, Homo Sapiens
PMCCTPASS

SEQ ID NO: 1241832 - protein, 9 aa, Homo Sapiens
FMGNMIRGI

SEQ ID NO: 1241833 - protein, 9 aa, Homo Sapiens
RLRGPAKCC

SEQ ID NO: 1241834 - protein, 9 aa, Homo Sapiens
RHSPVFHVY

SEQ ID NO: 1241835 - protein, 9 aa, Homo Sapiens
CHRYLCYLA

SEQ ID NO: 1241836 - protein, 9 aa, Homo Sapiens
CFFLSDNQS

SEQ ID NO: 1241837 - protein, 9 aa, Homo Sapiens
HFIQQLLRE

SEQ ID NO: 1241838 - protein, 9 aa, Homo Sapiens
MDIFEFQVI

SEQ ID NO: 1241839 - protein, 9 aa, Homo Sapiens
MCLLLLLAG

SEQ ID NO: 1241840 - protein, 9 aa, Homo Sapiens
KPSFSDMRR

SEQ ID NO: 1241841 - protein, 9 aa, Homo Sapiens
ERGGVATPG

SEQ ID NO: 1241842 - protein, 9 aa, Homo Sapiens
YMPGFLAGP

SEQ ID NO: 1241843 - protein, 9 aa, Homo Sapiens
YPPILYWFY

SEQ ID NO: 1241844 - protein, 9 aa, Homo Sapiens
WALTTECDL

SEQ ID NO: 1241845 - protein, 9 aa, Homo Sapiens
RKAPAVEVG

SEQ ID NO: 1241846 - protein, 9 aa, Homo Sapiens
QMIKYQKER

SEQ ID NO: 1241847 - protein, 9 aa, Homo Sapiens
QEQQRTVQD

SEQ ID NO: 1241848 - protein, 9 aa, Homo Sapiens
PAPPKLIML

SEQ ID NO: 1241849 - protein, 9 aa, Homo Sapiens
VQKERGLDI

SEQ ID NO: 1241850 - protein, 9 aa, Homo Sapiens
WLDWFLSCL

SEQ ID NO: 1241851 - protein, 9 aa, Homo Sapiens
GILIAHYIY

SEQ ID NO: 1241852 - protein, 9 aa, Homo Sapiens
TEGQPQVIE

SEQ ID NO: 1241853 - protein, 9 aa, Homo Sapiens
KSPEEVCMA

SEQ ID NO: 1241854 - protein, 9 aa, Homo Sapiens
LYFMYFNLE

SEQ ID NO: 1241855 - protein, 9 aa, Homo Sapiens
QVEHEKQMI

SEQ ID NO: 1241856 - protein, 9 aa, Homo Sapiens
ADEEEPVEL

SEQ ID NO: 1241857 - protein, 9 aa, Homo Sapiens
SACVHDSTM

SEQ ID NO: 1241858 - protein, 9 aa, Homo Sapiens
QHKLFQEIF

SEQ ID NO: 1241859 - protein, 9 aa, Homo Sapiens
ASRGHRGAH

SEQ ID NO: 1241860 - protein, 9 aa, Homo Sapiens
EVLTIPGVK

SEQ ID NO: 1241861 - protein, 9 aa, Homo Sapiens
LHMCLQDGG

SEQ ID NO: 1241862 - protein, 9 aa, Homo Sapiens
WYQCCPHSC

SEQ ID NO: 1241863 - protein, 9 aa, Homo Sapiens
TVIVNSMDK

SEQ ID NO: 1241864 - protein, 9 aa, Homo Sapiens
TNHNEEYDE

SEQ ID NO: 1241865 - protein, 9 aa, Homo Sapiens
THTGHLWLG

SEQ ID NO: 1241866 - protein, 9 aa, Homo Sapiens
VFMVTGRQE

SEQ ID NO: 1241867 - protein, 9 aa, Homo Sapiens
LFTFIGFLS

SEQ ID NO: 1241868 - protein, 9 aa, Homo Sapiens
YKHVCVQHQ

SEQ ID NO: 1241869 - protein, 9 aa, Homo Sapiens
QSVLSMTTR

SEQ ID NO: 1241870 - protein, 9 aa, Homo Sapiens
THLKWFGLW

SEQ ID NO: 1241871 - protein, 9 aa, Homo Sapiens
YCQQLIVSQ

SEQ ID NO: 1241872 - protein, 9 aa, Homo Sapiens
FYPLRGPWR

SEQ ID NO: 1241873 - protein, 9 aa, Homo Sapiens
YPFLVLQVY

SEQ ID NO: 1241874 - protein, 9 aa, Homo Sapiens
GLTVIGVFL

SEQ ID NO: 1241875 - protein, 9 aa, Homo Sapiens
LAQNMWHTY

SEQ ID NO: 1241876 - protein, 9 aa, Homo Sapiens
ALWVGGAES

SEQ ID NO: 1241877 - protein, 9 aa, Homo Sapiens
TNPIAKLIP

SEQ ID NO: 1241878 - protein, 9 aa, Homo Sapiens
SSAAVLPPP

SEQ ID NO: 1241879 - protein, 9 aa, Homo Sapiens
FELDENALN

SEQ ID NO: 1241880 - protein, 9 aa, Homo Sapiens
NLDVTNPDF

SEQ ID NO: 1241881 - protein, 9 aa, Homo Sapiens
GTMRIGEPT

SEQ ID NO: 1241882 - protein, 9 aa, Homo Sapiens
ITLPQWKAN

SEQ ID NO: 1241883 - protein, 9 aa, Homo Sapiens
MLDQSPTVM

SEQ ID NO: 1241884 - protein, 9 aa, Homo Sapiens
YASHLTSVT

SEQ ID NO: 1241885 - protein, 9 aa, Homo Sapiens
DNATDLDDP

SEQ ID NO: 1241886 - protein, 9 aa, Homo Sapiens
KNETLIRRY

SEQ ID NO: 1241887 - protein, 9 aa, Homo Sapiens
CSCSGVCIL

SEQ ID NO: 1241888 - protein, 9 aa, Homo Sapiens
PRKYVLTPS

SEQ ID NO: 1241889 - protein, 9 aa, Homo Sapiens
AWPPTVTIW

SEQ ID NO: 1241890 - protein, 9 aa, Homo Sapiens
TRTINEVET

SEQ ID NO: 1241891 - protein, 9 aa, Homo Sapiens
YKHQKKQDL

SEQ ID NO: 1241892 - protein, 9 aa, Homo Sapiens
FTCVRHWHL

SEQ ID NO: 1241893 - protein, 9 aa, Homo Sapiens
KKDQKAKER

SEQ ID NO: 1241894 - protein, 9 aa, Homo Sapiens
EYVWIVQPV

SEQ ID NO: 1241895 - protein, 9 aa, Homo Sapiens
GWVNAAIGS

SEQ ID NO: 1241896 - protein, 9 aa, Homo Sapiens
CLLSPGAAA

SEQ ID NO: 1241897 - protein, 9 aa, Homo Sapiens
QKEAFPGRR

SEQ ID NO: 1241898 - protein, 9 aa, Homo Sapiens
CYLGDPNHR

SEQ ID NO: 1241899 - protein, 9 aa, Homo Sapiens
NHVSNLVQH

SEQ ID NO: 1241900 - protein, 9 aa, Homo Sapiens
GENSNEVTK

SEQ ID NO: 1241901 - protein, 9 aa, Homo Sapiens
VLAALIVTS

SEQ ID NO: 1241902 - protein, 9 aa, Homo Sapiens
SDSELMVWD

SEQ ID NO: 1241903 - protein, 9 aa, Homo Sapiens
VVAVFYTIV

SEQ ID NO: 1241904 - protein, 9 aa, Homo Sapiens
VKFYWILTM

SEQ ID NO: 1241905 - protein, 9 aa, Homo Sapiens
PGTPGFMTL

SEQ ID NO: 1241906 - protein, 9 aa, Homo Sapiens
SLFFWDQLC

SEQ ID NO: 1241907 - protein, 9 aa, Homo Sapiens
LQCEIRLTQ

SEQ ID NO: 1241908 - protein, 9 aa, Homo Sapiens
MVLICGNFK

SEQ ID NO: 1241909 - protein, 9 aa, Homo Sapiens
TDINPPQYF

SEQ ID NO: 1241910 - protein, 9 aa, Homo Sapiens
ERSLPGAVP

SEQ ID NO: 1241911 - protein, 9 aa, Homo Sapiens
RHREADVSL

SEQ ID NO: 1241912 - protein, 9 aa, Homo Sapiens
KGLSGHPRI

SEQ ID NO: 1241913 - protein, 9 aa, Homo Sapiens
LRMSAAYLP

SEQ ID NO: 1241914 - protein, 9 aa, Homo Sapiens
FEGSRREEH

SEQ ID NO: 1241915 - protein, 9 aa, Homo Sapiens
AQTLALTQD

SEQ ID NO: 1241916 - protein, 9 aa, Homo Sapiens
MEKPPKFTE

SEQ ID NO: 1241917 - protein, 9 aa, Homo Sapiens
LYVVITPSK

SEQ ID NO: 1241918 - protein, 9 aa, Homo Sapiens
MDTYMLQNL

SEQ ID NO: 1241919 - protein, 9 aa, Homo Sapiens
NIDIKNTVY

SEQ ID NO: 1241920 - protein, 9 aa, Homo Sapiens
QKVMFHVIL

SEQ ID NO: 1241921 - protein, 9 aa, Homo Sapiens
SGKVEEDSE

SEQ ID NO: 1241922 - protein, 9 aa, Homo Sapiens
SRKDVKDKD

SEQ ID NO: 1241923 - protein, 9 aa, Homo Sapiens
LKTLMNAIS

SEQ ID NO: 1241924 - protein, 9 aa, Homo Sapiens
FMSFHWKRR

SEQ ID NO: 1241925 - protein, 9 aa, Homo Sapiens
FRVNIFTDF

SEQ ID NO: 1241926 - protein, 9 aa, Homo Sapiens
CIEMAEMCK

SEQ ID NO: 1241927 - protein, 9 aa, Homo Sapiens
QQLNGLGLN

SEQ ID NO: 1241928 - protein, 9 aa, Homo Sapiens
RSDIAVLIP

SEQ ID NO: 1241929 - protein, 9 aa, Homo Sapiens
STLYTTGAG

SEQ ID NO: 1241930 - protein, 9 aa, Homo Sapiens
KAISNKDQY

SEQ ID NO: 1241931 - protein, 9 aa, Homo Sapiens
CLSTSTVAI

SEQ ID NO: 1241932 - protein, 9 aa, Homo Sapiens
VYGDQSMHR

SEQ ID NO: 1241933 - protein, 9 aa, Homo Sapiens
DKEGIASVV

SEQ ID NO: 1241934 - protein, 9 aa, Homo Sapiens
HCEVDAHSG

SEQ ID NO: 1241935 - protein, 9 aa, Homo Sapiens
VFNLMPGDV

SEQ ID NO: 1241936 - protein, 9 aa, Homo Sapiens
GRRPALQAQ

SEQ ID NO: 1241937 - protein, 9 aa, Homo Sapiens
YHCVSGLPV

SEQ ID NO: 1241938 - protein, 9 aa, Homo Sapiens
KRLVGFVIC

SEQ ID NO: 1241939 - protein, 9 aa, Homo Sapiens
SKVSMSKNT

SEQ ID NO: 1241940 - protein, 9 aa, Homo Sapiens
SPGRCAPSA

SEQ ID NO: 1241941 - protein, 9 aa, Homo Sapiens
KQKLQEMSE

SEQ ID NO: 1241942 - protein, 9 aa, Homo Sapiens
KDPSLLIFP

SEQ ID NO: 1241943 - protein, 9 aa, Homo Sapiens
GNLVYHFCD

SEQ ID NO: 1241944 - protein, 9 aa, Homo Sapiens
GKGDDHKYM

SEQ ID NO: 1241945 - protein, 9 aa, Homo Sapiens
KAGDIIEVM

SEQ ID NO: 1241946 - protein, 9 aa, Homo Sapiens
QGNGKILKA

SEQ ID NO: 1241947 - protein, 9 aa, Homo Sapiens
GHFFALSEP

SEQ ID NO: 1241948 - protein, 9 aa, Homo Sapiens
LFYDRIKFI

SEQ ID NO: 1241949 - protein, 9 aa, Homo Sapiens
WCPSRCLVC

SEQ ID NO: 1241950 - protein, 9 aa, Homo Sapiens
MRIIIDHFV

SEQ ID NO: 1241951 - protein, 9 aa, Homo Sapiens
SCRKKSTRP

SEQ ID NO: 1241952 - protein, 9 aa, Homo Sapiens
HFLESEFYQ

SEQ ID NO: 1241953 - protein, 9 aa, Homo Sapiens
DSAQAKHKY

SEQ ID NO: 1241954 - protein, 9 aa, Homo Sapiens
LEYAKVEAH

SEQ ID NO: 1241955 - protein, 9 aa, Homo Sapiens
KAVSTPLLP

SEQ ID NO: 1241956 - protein, 9 aa, Homo Sapiens
LPLPPAMKC

SEQ ID NO: 1241957 - protein, 9 aa, Homo Sapiens
ACPCMCTEE

SEQ ID NO: 1241958 - protein, 9 aa, Homo Sapiens
KRKAFQLQQ

SEQ ID NO: 1241959 - protein, 9 aa, Homo Sapiens
LLTTDAILW

SEQ ID NO: 1241960 - protein, 9 aa, Homo Sapiens
FGNGEIGRD

SEQ ID NO: 1241961 - protein, 9 aa, Homo Sapiens
VAGSVPLSQ

SEQ ID NO: 1241962 - protein, 9 aa, Homo Sapiens
NNLNPTFSK

SEQ ID NO: 1241963 - protein, 9 aa, Homo Sapiens
SMRQKTQAY

SEQ ID NO: 1241964 - protein, 9 aa, Homo Sapiens
RAQKEVAGF

SEQ ID NO: 1241965 - protein, 9 aa, Homo Sapiens
LRGPAKCCE

SEQ ID NO: 1241966 - protein, 9 aa, Homo Sapiens
LFNSMHHEI

SEQ ID NO: 1241967 - protein, 9 aa, Homo Sapiens
IPNLTMKEV

SEQ ID NO: 1241968 - protein, 9 aa, Homo Sapiens
TNQHIWTRF

SEQ ID NO: 1241969 - protein, 9 aa, Homo Sapiens
VQRMPAFLD

SEQ ID NO: 1241970 - protein, 9 aa, Homo Sapiens
MREFILWCL

SEQ ID NO: 1241971 - protein, 9 aa, Homo Sapiens
YYEYDFECG

SEQ ID NO: 1241972 - protein, 9 aa, Homo Sapiens
SSIEQASLV

SEQ ID NO: 1241973 - protein, 9 aa, Homo Sapiens
ADSAQKEGK

SEQ ID NO: 1241974 - protein, 9 aa, Homo Sapiens
DASMDAQPA

SEQ ID NO: 1241975 - protein, 9 aa, Homo Sapiens
RDGHSASVP

SEQ ID NO: 1241976 - protein, 9 aa, Homo Sapiens
KHYMTRDAD

SEQ ID NO: 1241977 - protein, 9 aa, Homo Sapiens
RFILHAKRQ

SEQ ID NO: 1241978 - protein, 9 aa, Homo Sapiens
LDQALWAGL

SEQ ID NO: 1241979 - protein, 9 aa, Homo Sapiens
LSAPPNGSS

SEQ ID NO: 1241980 - protein, 9 aa, Homo Sapiens
GLIHVCDEL

SEQ ID NO: 1241981 - protein, 9 aa, Homo Sapiens
VLQWIRETL

SEQ ID NO: 1241982 - protein, 9 aa, Homo Sapiens
QLKAAMRRY

SEQ ID NO: 1241983 - protein, 9 aa, Homo Sapiens
ALEECECEL

SEQ ID NO: 1241984 - protein, 9 aa, Homo Sapiens
RKKELKAHT

SEQ ID NO: 1241985 - protein, 9 aa, Homo Sapiens
ITTFDRPTY

SEQ ID NO: 1241986 - protein, 9 aa, Homo Sapiens
EKYLTCVER

SEQ ID NO: 1241987 - protein, 9 aa, Homo Sapiens
WGHAFVLVY

SEQ ID NO: 1241988 - protein, 9 aa, Homo Sapiens
STRGFPRHC

SEQ ID NO: 1241989 - protein, 9 aa, Homo Sapiens
LPQMSKALF

SEQ ID NO: 1241990 - protein, 9 aa, Homo Sapiens
KEVRIMHWF

SEQ ID NO: 1241991 - protein, 9 aa, Homo Sapiens
PVPPECALG

SEQ ID NO: 1241992 - protein, 9 aa, Homo Sapiens
KLCKLEKIR

SEQ ID NO: 1241993 - protein, 9 aa, Homo Sapiens
FARTISMQA

SEQ ID NO: 1241994 - protein, 9 aa, Homo Sapiens
QVVASLAEA

SEQ ID NO: 1241995 - protein, 9 aa, Homo Sapiens
DPTAVYEAK

SEQ ID NO: 1241996 - protein, 9 aa, Homo Sapiens
DIVSWKRPF

SEQ ID NO: 1241997 - protein, 9 aa, Homo Sapiens
DCNTGKYLE

SEQ ID NO: 1241998 - protein, 9 aa, Homo Sapiens
GNCSNYPAI

SEQ ID NO: 1241999 - protein, 9 aa, Homo Sapiens
SSIKTRCEG

SEQ ID NO: 1242000 - protein, 9 aa, Homo Sapiens
MDPTFALLG

SEQ ID NO: 1242001 - protein, 9 aa, Homo Sapiens
LMACVRYIK

SEQ ID NO: 1242002 - protein, 9 aa, Homo Sapiens
RERHFHPVA

SEQ ID NO: 1242003 - protein, 9 aa, Homo Sapiens
FGEVTEMPV

SEQ ID NO: 1242004 - protein, 9 aa, Homo Sapiens
FHVTWITSF

SEQ ID NO: 1242005 - protein, 9 aa, Homo Sapiens
YKSGPPMQS

SEQ ID NO: 1242006 - protein, 9 aa, Homo Sapiens
RAPAASQEA

SEQ ID NO: 1242007 - protein, 9 aa, Homo Sapiens
TTYSSGTFY

SEQ ID NO: 1242008 - protein, 9 aa, Homo Sapiens
ASSQGITLI

SEQ ID NO: 1242009 - protein, 9 aa, Homo Sapiens
GLFQNPTVQ

SEQ ID NO: 1242010 - protein, 9 aa, Homo Sapiens
EDFYSIFTK

SEQ ID NO: 1242011 - protein, 9 aa, Homo Sapiens
KYGVATKLL

SEQ ID NO: 1242012 - protein, 9 aa, Homo Sapiens
SPEWDMVTP

SEQ ID NO: 1242013 - protein, 9 aa, Homo Sapiens
LFLNDLRAE

SEQ ID NO: 1242014 - protein, 9 aa, Homo Sapiens
RWLTADMIS

SEQ ID NO: 1242015 - protein, 9 aa, Homo Sapiens
KVFMCGTNV

SEQ ID NO: 1242016 - protein, 9 aa, Homo Sapiens
LNKIYYLLE

SEQ ID NO: 1242017 - protein, 9 aa, Homo Sapiens
MGVYGGMIY

SEQ ID NO: 1242018 - protein, 9 aa, Homo Sapiens
CVRSRTPQK

SEQ ID NO: 1242019 - protein, 9 aa, Homo Sapiens
TFCVNGGKC

SEQ ID NO: 1242020 - protein, 9 aa, Homo Sapiens
QGHSHWVNT

SEQ ID NO: 1242021 - protein, 9 aa, Homo Sapiens
PDELEAVCK

SEQ ID NO: 1242022 - protein, 9 aa, Homo Sapiens
SAVRCFYVG

SEQ ID NO: 1242023 - protein, 9 aa, Homo Sapiens
DQVLVKPYI

SEQ ID NO: 1242024 - protein, 9 aa, Homo Sapiens
PIIGKCLKQ

SEQ ID NO: 1242025 - protein, 9 aa, Homo Sapiens
LHQCLSLTM

SEQ ID NO: 1242026 - protein, 9 aa, Homo Sapiens
HTDTHRNTQ

SEQ ID NO: 1242027 - protein, 9 aa, Homo Sapiens
VKLSGGLEP

SEQ ID NO: 1242028 - protein, 9 aa, Homo Sapiens
KKTFSTYAS

SEQ ID NO: 1242029 - protein, 9 aa, Homo Sapiens
ADDIDRWCS

SEQ ID NO: 1242030 - protein, 9 aa, Homo Sapiens
EDSVTVDVT

SEQ ID NO: 1242031 - protein, 9 aa, Homo Sapiens
EEGPVSAGE

SEQ ID NO: 1242032 - protein, 9 aa, Homo Sapiens
TSRLDVHKV

SEQ ID NO: 1242033 - protein, 9 aa, Homo Sapiens
TFYERKIVT

SEQ ID NO: 1242034 - protein, 9 aa, Homo Sapiens
RIIHTALIA

SEQ ID NO: 1242035 - protein, 9 aa, Homo Sapiens
FLDEDDVYN

SEQ ID NO: 1242036 - protein, 9 aa, Homo Sapiens
NVFLCMNNC

SEQ ID NO: 1242037 - protein, 9 aa, Homo Sapiens
SCSSSWTNR

SEQ ID NO: 1242038 - protein, 9 aa, Homo Sapiens
WKVFTYKAF

SEQ ID NO: 1242039 - protein, 9 aa, Homo Sapiens
ENEEEDAVP

SEQ ID NO: 1242040 - protein, 9 aa, Homo Sapiens
EDNPVSSGH

SEQ ID NO: 1242041 - protein, 9 aa, Homo Sapiens
RLERAVCHD

SEQ ID NO: 1242042 - protein, 9 aa, Homo Sapiens
SLRSSGASQ

SEQ ID NO: 1242043 - protein, 9 aa, Homo Sapiens
AWPGWFMCG

SEQ ID NO: 1242044 - protein, 9 aa, Homo Sapiens
QSRTASPGR

SEQ ID NO: 1242045 - protein, 9 aa, Homo Sapiens
TAKHLSRLV

SEQ ID NO: 1242046 - protein, 9 aa, Homo Sapiens
VGNKNSQVC

SEQ ID NO: 1242047 - protein, 9 aa, Homo Sapiens
NVAEGHKAS

SEQ ID NO: 1242048 - protein, 9 aa, Homo Sapiens
ASFETNFFV

SEQ ID NO: 1242049 - protein, 9 aa, Homo Sapiens
ETNFFVNGL

SEQ ID NO: 1242050 - protein, 9 aa, Homo Sapiens
YGDKTTRSS

SEQ ID NO: 1242051 - protein, 9 aa, Homo Sapiens
HIYALRWKE

SEQ ID NO: 1242052 - protein, 9 aa, Homo Sapiens
LILANQRYS

SEQ ID NO: 1242053 - protein, 9 aa, Homo Sapiens
GHNGHELRI

SEQ ID NO: 1242054 - protein, 9 aa, Homo Sapiens
WTQIPQGCL

SEQ ID NO: 1242055 - protein, 9 aa, Homo Sapiens
PRWISRSAE

SEQ ID NO: 1242056 - protein, 9 aa, Homo Sapiens
EFKEGKNEL

SEQ ID NO: 1242057 - protein, 9 aa, Homo Sapiens
TCSCVGPDN

SEQ ID NO: 1242058 - protein, 9 aa, Homo Sapiens
KYGYSPCVK

SEQ ID NO: 1242059 - protein, 9 aa, Homo Sapiens
YDSDHTELG

SEQ ID NO: 1242060 - protein, 9 aa, Homo Sapiens
VFAEWLSEG

SEQ ID NO: 1242061 - protein, 9 aa, Homo Sapiens
HVLEWLKYG

SEQ ID NO: 1242062 - protein, 9 aa, Homo Sapiens
GPAVGTRYK

SEQ ID NO: 1242063 - protein, 9 aa, Homo Sapiens
GIITKSDAL

SEQ ID NO: 1242064 - protein, 9 aa, Homo Sapiens
CSCSADIWD

SEQ ID NO: 1242065 - protein, 9 aa, Homo Sapiens
EDGTMRFWD

SEQ ID NO: 1242066 - protein, 9 aa, Homo Sapiens
FVDILGLRI

SEQ ID NO: 1242067 - protein, 9 aa, Homo Sapiens
VLEASLEYA

SEQ ID NO: 1242068 - protein, 9 aa, Homo Sapiens
GGCSAVIDM

SEQ ID NO: 1242069 - protein, 9 aa, Homo Sapiens
PTITNWERE

SEQ ID NO: 1242070 - protein, 9 aa, Homo Sapiens
PISAFHGVK

SEQ ID NO: 1242071 - protein, 9 aa, Homo Sapiens
IKVSFSLQL

SEQ ID NO: 1242072 - protein, 9 aa, Homo Sapiens
SLCWCRLQC

SEQ ID NO: 1242073 - protein, 9 aa, Homo Sapiens
ERNHVKLVN

SEQ ID NO: 1242074 - protein, 9 aa, Homo Sapiens
FKKWTHPRS

SEQ ID NO: 1242075 - protein, 9 aa, Homo Sapiens
ELVGRSFYQ

SEQ ID NO: 1242076 - protein, 9 aa, Homo Sapiens
MLLGDIIIL

SEQ ID NO: 1242077 - protein, 9 aa, Homo Sapiens
QFLCLKRHV

SEQ ID NO: 1242078 - protein, 9 aa, Homo Sapiens
AICSAEGEP

SEQ ID NO: 1242079 - protein, 9 aa, Homo Sapiens
FTLCLYVLM

SEQ ID NO: 1242080 - protein, 9 aa, Homo Sapiens
GAFQLKKSG

SEQ ID NO: 1242081 - protein, 9 aa, Homo Sapiens
KYKAEEVED

SEQ ID NO: 1242082 - protein, 9 aa, Homo Sapiens
SGSTTGSVS

SEQ ID NO: 1242083 - protein, 9 aa, Homo Sapiens
SGSFLYHVS

SEQ ID NO: 1242084 - protein, 9 aa, Homo Sapiens
SSWLPTLPA

SEQ ID NO: 1242085 - protein, 9 aa, Homo Sapiens
VALPALVAV

SEQ ID NO: 1242086 - protein, 9 aa, Homo Sapiens
VARSWLITA

SEQ ID NO: 1242087 - protein, 9 aa, Homo Sapiens
IWSCSRGRW

SEQ ID NO: 1242088 - protein, 9 aa, Homo Sapiens
QLDESMRDK

SEQ ID NO: 1242089 - protein, 9 aa, Homo Sapiens
NSVLEKFTI

SEQ ID NO: 1242090 - protein, 9 aa, Homo Sapiens
ELLIFLVQY

SEQ ID NO: 1242091 - protein, 9 aa, Homo Sapiens
KGPNDTANS

SEQ ID NO: 1242092 - protein, 9 aa, Homo Sapiens
IGRLKMRKN

SEQ ID NO: 1242093 - protein, 9 aa, Homo Sapiens
EGTHDEEEG

SEQ ID NO: 1242094 - protein, 9 aa, Homo Sapiens
FVAGKYLAD

SEQ ID NO: 1242095 - protein, 9 aa, Homo Sapiens
SESSVEGPG

SEQ ID NO: 1242096 - protein, 9 aa, Homo Sapiens
GMIRQKVWF

SEQ ID NO: 1242097 - protein, 9 aa, Homo Sapiens
YRTKQEGLS

SEQ ID NO: 1242098 - protein, 9 aa, Homo Sapiens
EDLTLQPHS

SEQ ID NO: 1242099 - protein, 9 aa, Homo Sapiens
EGSGSISLA

SEQ ID NO: 1242100 - protein, 9 aa, Homo Sapiens
VAAISMVVA

SEQ ID NO: 1242101 - protein, 9 aa, Homo Sapiens
SVCGRSWDP

SEQ ID NO: 1242102 - protein, 9 aa, Homo Sapiens
TRHIHTLLW

SEQ ID NO: 1242103 - protein, 9 aa, Homo Sapiens
GYQLSDHTI

SEQ ID NO: 1242104 - protein, 9 aa, Homo Sapiens
LLLPCTHSL

SEQ ID NO: 1242105 - protein, 9 aa, Homo Sapiens
ARDEYQHHS

SEQ ID NO: 1242106 - protein, 9 aa, Homo Sapiens
EKEEMELLK

SEQ ID NO: 1242107 - protein, 9 aa, Homo Sapiens
EGEVIPSMG

SEQ ID NO: 1242108 - protein, 9 aa, Homo Sapiens
PHSTGDVFV

SEQ ID NO: 1242109 - protein, 9 aa, Homo Sapiens
EECECELLW

SEQ ID NO: 1242110 - protein, 9 aa, Homo Sapiens
DIHKEKKSR

SEQ ID NO: 1242111 - protein, 9 aa, Homo Sapiens
VGYCKRQVS

SEQ ID NO: 1242112 - protein, 9 aa, Homo Sapiens
IDEHDINFL

SEQ ID NO: 1242113 - protein, 9 aa, Homo Sapiens
SMIGIVCSP

SEQ ID NO: 1242114 - protein, 9 aa, Homo Sapiens
CLAGPVVEI

SEQ ID NO: 1242115 - protein, 9 aa, Homo Sapiens
PRGGTNKDS

SEQ ID NO: 1242116 - protein, 9 aa, Homo Sapiens
LEPPRTDPP

SEQ ID NO: 1242117 - protein, 9 aa, Homo Sapiens
AQGPRPGSP

SEQ ID NO: 1242118 - protein, 9 aa, Homo Sapiens
VLGNLKLRK

SEQ ID NO: 1242119 - protein, 9 aa, Homo Sapiens
ELQEIRREL

SEQ ID NO: 1242120 - protein, 9 aa, Homo Sapiens
FLAVLNFTA

SEQ ID NO: 1242121 - protein, 9 aa, Homo Sapiens
HNRCLYRAM

SEQ ID NO: 1242122 - protein, 9 aa, Homo Sapiens
SSAFHHSVK

SEQ ID NO: 1242123 - protein, 9 aa, Homo Sapiens
TLQDQLNSI

SEQ ID NO: 1242124 - protein, 9 aa, Homo Sapiens
CPGYRGPGY

SEQ ID NO: 1242125 - protein, 9 aa, Homo Sapiens
QFQKLQQLH

SEQ ID NO: 1242126 - protein, 9 aa, Homo Sapiens
VHVRKSRPD

SEQ ID NO: 1242127 - protein, 9 aa, Homo Sapiens
KVGTAEAVI

SEQ ID NO: 1242128 - protein, 9 aa, Homo Sapiens
SFSTALHGE

SEQ ID NO: 1242129 - protein, 9 aa, Homo Sapiens
RQIAQLKQK

SEQ ID NO: 1242130 - protein, 9 aa, Homo Sapiens
TGDLTMDTA

SEQ ID NO: 1242131 - protein, 9 aa, Homo Sapiens
IEAALRADP

SEQ ID NO: 1242132 - protein, 9 aa, Homo Sapiens
ALDPDEEHR

SEQ ID NO: 1242133 - protein, 9 aa, Homo Sapiens
VIFRKDREF

SEQ ID NO: 1242134 - protein, 9 aa, Homo Sapiens
QDWAAIMAN

SEQ ID NO: 1242135 - protein, 9 aa, Homo Sapiens
SAPWEFRPR

SEQ ID NO: 1242136 - protein, 9 aa, Homo Sapiens
RFHSFDALL

SEQ ID NO: 1242137 - protein, 9 aa, Homo Sapiens
RVRPWWDIP

SEQ ID NO: 1242138 - protein, 9 aa, Homo Sapiens
SLDLVCQCF

SEQ ID NO: 1242139 - protein, 9 aa, Homo Sapiens
PDAARDLGL

SEQ ID NO: 1242140 - protein, 9 aa, Homo Sapiens
VSGLARAHA

SEQ ID NO: 1242141 - protein, 9 aa, Homo Sapiens
HLAGCTFQD

SEQ ID NO: 1242142 - protein, 9 aa, Homo Sapiens
AQDFKTDLH

SEQ ID NO: 1242143 - protein, 9 aa, Homo Sapiens
WAFENPHTS

SEQ ID NO: 1242144 - protein, 9 aa, Homo Sapiens
DGNCRYCIK

SEQ ID NO: 1242145 - protein, 9 aa, Homo Sapiens
CQPLPQPLP

SEQ ID NO: 1242146 - protein, 9 aa, Homo Sapiens
AEIDAIYKD

SEQ ID NO: 1242147 - protein, 9 aa, Homo Sapiens
LHQSIIWSW

SEQ ID NO: 1242148 - protein, 9 aa, Homo Sapiens
DDEEIERWR

SEQ ID NO: 1242149 - protein, 9 aa, Homo Sapiens
PPCVEDLHH

SEQ ID NO: 1242150 - protein, 9 aa, Homo Sapiens
YLNSILPVR

SEQ ID NO: 1242151 - protein, 9 aa, Homo Sapiens
EATAPAASL

SEQ ID NO: 1242152 - protein, 9 aa, Homo Sapiens
PPLEKVHYL

SEQ ID NO: 1242153 - protein, 9 aa, Homo Sapiens
LGCVLIRKW

SEQ ID NO: 1242154 - protein, 9 aa, Homo Sapiens
QQGYENSGT

SEQ ID NO: 1242155 - protein, 9 aa, Homo Sapiens
GFEPFYHLF

SEQ ID NO: 1242156 - protein, 9 aa, Homo Sapiens
EILRNDLSS

SEQ ID NO: 1242157 - protein, 9 aa, Homo Sapiens
EIFEWFLNK

SEQ ID NO: 1242158 - protein, 9 aa, Homo Sapiens
DRSMRKGIM

SEQ ID NO: 1242159 - protein, 9 aa, Homo Sapiens
YSKPSIKQT

SEQ ID NO: 1242160 - protein, 9 aa, Homo Sapiens
HGYLEATVD

SEQ ID NO: 1242161 - protein, 9 aa, Homo Sapiens
FPFSSWGEV

SEQ ID NO: 1242162 - protein, 9 aa, Homo Sapiens
ARCQDRVHD

SEQ ID NO: 1242163 - protein, 9 aa, Homo Sapiens
EEDKRTYEE

SEQ ID NO: 1242164 - protein, 9 aa, Homo Sapiens
ELYFWVKEA

SEQ ID NO: 1242165 - protein, 9 aa, Homo Sapiens
TPETRKCKA

SEQ ID NO: 1242166 - protein, 9 aa, Homo Sapiens
HFSSDELQI

SEQ ID NO: 1242167 - protein, 9 aa, Homo Sapiens
TVEKETVLK

SEQ ID NO: 1242168 - protein, 9 aa, Homo Sapiens
HQFKMQLLK

SEQ ID NO: 1242169 - protein, 9 aa, Homo Sapiens
QDKCVNSFQ

SEQ ID NO: 1242170 - protein, 9 aa, Homo Sapiens
DGNMGHESE

SEQ ID NO: 1242171 - protein, 9 aa, Homo Sapiens
MRGAKEPTG

SEQ ID NO: 1242172 - protein, 9 aa, Homo Sapiens
CDRMNEIHI

SEQ ID NO: 1242173 - protein, 9 aa, Homo Sapiens
ACRNILDRN

SEQ ID NO: 1242174 - protein, 9 aa, Homo Sapiens
KQKDPSLLI

SEQ ID NO: 1242175 - protein, 9 aa, Homo Sapiens
GCCNIYRNI

SEQ ID NO: 1242176 - protein, 9 aa, Homo Sapiens
HTVPGQSGC

SEQ ID NO: 1242177 - protein, 9 aa, Homo Sapiens
NTRFHFTHT

SEQ ID NO: 1242178 - protein, 9 aa, Homo Sapiens
NEVLRELRV

SEQ ID NO: 1242179 - protein, 9 aa, Homo Sapiens
QPVSSAQDF

SEQ ID NO: 1242180 - protein, 9 aa, Homo Sapiens
IGVINVTDA

SEQ ID NO: 1242181 - protein, 9 aa, Homo Sapiens
KSKNQEHEE

SEQ ID NO: 1242182 - protein, 9 aa, Homo Sapiens
PLWPLMLLP

SEQ ID NO: 1242183 - protein, 9 aa, Homo Sapiens
TSGLLAQFE

SEQ ID NO: 1242184 - protein, 9 aa, Homo Sapiens
QVLYMVTNS

SEQ ID NO: 1242185 - protein, 9 aa, Homo Sapiens
RYVFKKGDL

SEQ ID NO: 1242186 - protein, 9 aa, Homo Sapiens
QMGEQVTNG

SEQ ID NO: 1242187 - protein, 9 aa, Homo Sapiens
EPDLASYIV

SEQ ID NO: 1242188 - protein, 9 aa, Homo Sapiens
ISFLKSCHF

SEQ ID NO: 1242189 - protein, 9 aa, Homo Sapiens
QNPDLEPIL

SEQ ID NO: 1242190 - protein, 9 aa, Homo Sapiens
NLLKEMSNI

SEQ ID NO: 1242191 - protein, 9 aa, Homo Sapiens
IIGKDQEVK

SEQ ID NO: 1242192 - protein, 9 aa, Homo Sapiens
PSPDSVSWP

SEQ ID NO: 1242193 - protein, 9 aa, Homo Sapiens
LQTVDMKIG

SEQ ID NO: 1242194 - protein, 9 aa, Homo Sapiens
RILQGLVDG

SEQ ID NO: 1242195 - protein, 9 aa, Homo Sapiens
TFLSVYVAH

SEQ ID NO: 1242196 - protein, 9 aa, Homo Sapiens
VGQKKCKMS

SEQ ID NO: 1242197 - protein, 9 aa, Homo Sapiens
CKVFSTCSS

SEQ ID NO: 1242198 - protein, 9 aa, Homo Sapiens
IGIKWVTGG

SEQ ID NO: 1242199 - protein, 9 aa, Homo Sapiens
SLKDKARTL

SEQ ID NO: 1242200 - protein, 9 aa, Homo Sapiens
HGSSLGVVT

SEQ ID NO: 1242201 - protein, 9 aa, Homo Sapiens
PAQAPLHPQ

SEQ ID NO: 1242202 - protein, 9 aa, Homo Sapiens
NSTRDWRTI

SEQ ID NO: 1242203 - protein, 9 aa, Homo Sapiens
PFSVESKWS

SEQ ID NO: 1242204 - protein, 9 aa, Homo Sapiens
AAEVSGRGE

SEQ ID NO: 1242205 - protein, 9 aa, Homo Sapiens
VERPTVKAA

SEQ ID NO: 1242206 - protein, 9 aa, Homo Sapiens
DPQAYTSLQ

SEQ ID NO: 1242207 - protein, 9 aa, Homo Sapiens
LPARSGLKR

SEQ ID NO: 1242208 - protein, 9 aa, Homo Sapiens
VPRMRQTRH

SEQ ID NO: 1242209 - protein, 9 aa, Homo Sapiens
HRCQHVDLL

SEQ ID NO: 1242210 - protein, 9 aa, Homo Sapiens
NLWLKGDKC

SEQ ID NO: 1242211 - protein, 9 aa, Homo Sapiens
NRHCMVHTS

SEQ ID NO: 1242212 - protein, 9 aa, Homo Sapiens
PSGICSLEE

SEQ ID NO: 1242213 - protein, 9 aa, Homo Sapiens
EGMGLSDTA

SEQ ID NO: 1242214 - protein, 9 aa, Homo Sapiens
EHVFQSNYF

SEQ ID NO: 1242215 - protein, 9 aa, Homo Sapiens
TSVAVRNAS

SEQ ID NO: 1242216 - protein, 9 aa, Homo Sapiens
RNCICQKFA

SEQ ID NO: 1242217 - protein, 9 aa, Homo Sapiens
AASWVICFT

SEQ ID NO: 1242218 - protein, 9 aa, Homo Sapiens
DFASLRIHS

SEQ ID NO: 1242219 - protein, 9 aa, Homo Sapiens
YPGPAGPVS

SEQ ID NO: 1242220 - protein, 9 aa, Homo Sapiens
LQDAIRISQ

SEQ ID NO: 1242221 - protein, 9 aa, Homo Sapiens
SHISMSNLT

SEQ ID NO: 1242222 - protein, 9 aa, Homo Sapiens
LDREEQRYH

SEQ ID NO: 1242223 - protein, 9 aa, Homo Sapiens
HSPFRAHSE

SEQ ID NO: 1242224 - protein, 9 aa, Homo Sapiens
SPLTSLLIT

SEQ ID NO: 1242225 - protein, 9 aa, Homo Sapiens
EHMTPCRRR

SEQ ID NO: 1242226 - protein, 9 aa, Homo Sapiens
EYSRILEKL

SEQ ID NO: 1242227 - protein, 9 aa, Homo Sapiens
YDLRADVIG

SEQ ID NO: 1242228 - protein, 9 aa, Homo Sapiens
LIVENVTDT

SEQ ID NO: 1242229 - protein, 9 aa, Homo Sapiens
RERETQSCP

SEQ ID NO: 1242230 - protein, 9 aa, Homo Sapiens
REVGWMVAG

SEQ ID NO: 1242231 - protein, 9 aa, Homo Sapiens
LGGQDESSN

SEQ ID NO: 1242232 - protein, 9 aa, Homo Sapiens
VRDLCDEEK

SEQ ID NO: 1242233 - protein, 9 aa, Homo Sapiens
GWTANMEWI

SEQ ID NO: 1242234 - protein, 9 aa, Homo Sapiens
PVSVGVQSA

SEQ ID NO: 1242235 - protein, 9 aa, Homo Sapiens
INISKVQED

SEQ ID NO: 1242236 - protein, 9 aa, Homo Sapiens
RASPAPRSP

SEQ ID NO: 1242237 - protein, 9 aa, Homo Sapiens
PGLHGPSGA

SEQ ID NO: 1242238 - protein, 9 aa, Homo Sapiens
PENSDGPNT

SEQ ID NO: 1242239 - protein, 9 aa, Homo Sapiens
PRLQTTVGV

SEQ ID NO: 1242240 - protein, 9 aa, Homo Sapiens
ASKVFVCAF

SEQ ID NO: 1242241 - protein, 9 aa, Homo Sapiens
FENMANADR

SEQ ID NO: 1242242 - protein, 9 aa, Homo Sapiens
SSQIGSCGT

SEQ ID NO: 1242243 - protein, 9 aa, Homo Sapiens
GQFSLAVIS

SEQ ID NO: 1242244 - protein, 9 aa, Homo Sapiens
YLPNCDCKG

SEQ ID NO: 1242245 - protein, 9 aa, Homo Sapiens
MAVATSSWD

SEQ ID NO: 1242246 - protein, 9 aa, Homo Sapiens
LRTLRALHP

SEQ ID NO: 1242247 - protein, 9 aa, Homo Sapiens
NHMIQAIPF

SEQ ID NO: 1242248 - protein, 9 aa, Homo Sapiens
DNCGDYLVM

SEQ ID NO: 1242249 - protein, 9 aa, Homo Sapiens
VMRQSKETA

SEQ ID NO: 1242250 - protein, 9 aa, Homo Sapiens
TRRVAVTAK

SEQ ID NO: 1242251 - protein, 9 aa, Homo Sapiens
VCWLLCGCL

SEQ ID NO: 1242252 - protein, 9 aa, Homo Sapiens
LTYTYSTSV

SEQ ID NO: 1242253 - protein, 9 aa, Homo Sapiens
HVAALVASG

SEQ ID NO: 1242254 - protein, 9 aa, Homo Sapiens
KIQYTQISQ

SEQ ID NO: 1242255 - protein, 9 aa, Homo Sapiens
ETHHMYYLK

SEQ ID NO: 1242256 - protein, 9 aa, Homo Sapiens
LISKQLAVR

SEQ ID NO: 1242257 - protein, 9 aa, Homo Sapiens
RGDILSYNM

SEQ ID NO: 1242258 - protein, 9 aa, Homo Sapiens
LLILDYHNL

SEQ ID NO: 1242259 - protein, 9 aa, Homo Sapiens
EGENIRKKY

SEQ ID NO: 1242260 - protein, 9 aa, Homo Sapiens
KALNDTCLV

SEQ ID NO: 1242261 - protein, 9 aa, Homo Sapiens
ETAAMCVCP

SEQ ID NO: 1242262 - protein, 9 aa, Homo Sapiens
DPNRAFICG

SEQ ID NO: 1242263 - protein, 9 aa, Homo Sapiens
LALVISWGT

SEQ ID NO: 1242264 - protein, 9 aa, Homo Sapiens
YLKAQAIKQ

SEQ ID NO: 1242265 - protein, 9 aa, Homo Sapiens
MLRQATKCA

SEQ ID NO: 1242266 - protein, 9 aa, Homo Sapiens
KNEVLRELR

SEQ ID NO: 1242267 - protein, 9 aa, Homo Sapiens
GNRTVGPRH

SEQ ID NO: 1242268 - protein, 9 aa, Homo Sapiens
SKHLEQQEK

SEQ ID NO: 1242269 - protein, 9 aa, Homo Sapiens
FPTLFTFIR

SEQ ID NO: 1242270 - protein, 9 aa, Homo Sapiens
APGLTKCVK

SEQ ID NO: 1242271 - protein, 9 aa, Homo Sapiens
KLRGARVSL

SEQ ID NO: 1242272 - protein, 9 aa, Homo Sapiens
RYRLVKQII

SEQ ID NO: 1242273 - protein, 9 aa, Homo Sapiens
GFSSSQTPN

SEQ ID NO: 1242274 - protein, 9 aa, Homo Sapiens
SPQTHTVDL

SEQ ID NO: 1242275 - protein, 9 aa, Homo Sapiens
LPSESKQKE

SEQ ID NO: 1242276 - protein, 9 aa, Homo Sapiens
TVAGGKYDV

SEQ ID NO: 1242277 - protein, 9 aa, Homo Sapiens
RSIIVGAGY

SEQ ID NO: 1242278 - protein, 9 aa, Homo Sapiens
HVLAPKDKK

SEQ ID NO: 1242279 - protein, 9 aa, Homo Sapiens
CFVTRIHLL

SEQ ID NO: 1242280 - protein, 9 aa, Homo Sapiens
GLLQLTAAG

SEQ ID NO: 1242281 - protein, 9 aa, Homo Sapiens
LSITCHRSS

SEQ ID NO: 1242282 - protein, 9 aa, Homo Sapiens
YATIWLWEH

SEQ ID NO: 1242283 - protein, 9 aa, Homo Sapiens
LGAANGQIL

SEQ ID NO: 1242284 - protein, 9 aa, Homo Sapiens
GGIHASKDA

SEQ ID NO: 1242285 - protein, 9 aa, Homo Sapiens
LDPVPFDQG

SEQ ID NO: 1242286 - protein, 9 aa, Homo Sapiens
SHSRPGSIH

SEQ ID NO: 1242287 - protein, 9 aa, Homo Sapiens
DKNSLLDME

SEQ ID NO: 1242288 - protein, 9 aa, Homo Sapiens
ELGKVIIQG

SEQ ID NO: 1242289 - protein, 9 aa, Homo Sapiens
RSFLKWTLI

SEQ ID NO: 1242290 - protein, 9 aa, Homo Sapiens
QGMQLEVVD

SEQ ID NO: 1242291 - protein, 9 aa, Homo Sapiens
SVDFEHPTR

SEQ ID NO: 1242292 - protein, 9 aa, Homo Sapiens
NCGVDCSCD

SEQ ID NO: 1242293 - protein, 9 aa, Homo Sapiens
DDILYPNTN

SEQ ID NO: 1242294 - protein, 9 aa, Homo Sapiens
GPRHWSSLS

SEQ ID NO: 1242295 - protein, 9 aa, Homo Sapiens
TLCKTPPMS

SEQ ID NO: 1242296 - protein, 9 aa, Homo Sapiens
STILQQIDS

SEQ ID NO: 1242297 - protein, 9 aa, Homo Sapiens
LMQDYTASV

SEQ ID NO: 1242298 - protein, 9 aa, Homo Sapiens
HVIHHCLNA

SEQ ID NO: 1242299 - protein, 9 aa, Homo Sapiens
DVIAKALVR

SEQ ID NO: 1242300 - protein, 9 aa, Homo Sapiens
SVLQDNIFD

SEQ ID NO: 1242301 - protein, 9 aa, Homo Sapiens
EAIMAEEKK

SEQ ID NO: 1242302 - protein, 9 aa, Homo Sapiens
SVVFKGADL

SEQ ID NO: 1242303 - protein, 9 aa, Homo Sapiens
VWGNLVMLG

SEQ ID NO: 1242304 - protein, 9 aa, Homo Sapiens
AIMHPRFCV

SEQ ID NO: 1242305 - protein, 9 aa, Homo Sapiens
PNPVTPYWT

SEQ ID NO: 1242306 - protein, 9 aa, Homo Sapiens
EVSGRGEDS

SEQ ID NO: 1242307 - protein, 9 aa, Homo Sapiens
ADASSVPTG

SEQ ID NO: 1242308 - protein, 9 aa, Homo Sapiens
ADGPGAEGP

SEQ ID NO: 1242309 - protein, 9 aa, Homo Sapiens
HTTMAGLTM

SEQ ID NO: 1242310 - protein, 9 aa, Homo Sapiens
APYDGCYLI

SEQ ID NO: 1242311 - protein, 9 aa, Homo Sapiens
VYYLPLTNV

SEQ ID NO: 1242312 - protein, 9 aa, Homo Sapiens
RFSIHLPQP

SEQ ID NO: 1242313 - protein, 9 aa, Homo Sapiens
RATVHCMAN

SEQ ID NO: 1242314 - protein, 9 aa, Homo Sapiens
IEIIAPPER

SEQ ID NO: 1242315 - protein, 9 aa, Homo Sapiens
RSVLGTDWP

SEQ ID NO: 1242316 - protein, 9 aa, Homo Sapiens
KTGKCIHCI

SEQ ID NO: 1242317 - protein, 9 aa, Homo Sapiens
VDVKKEVDK

SEQ ID NO: 1242318 - protein, 9 aa, Homo Sapiens
GVVTKIRPV

SEQ ID NO: 1242319 - protein, 9 aa, Homo Sapiens
LDLFKLTID

SEQ ID NO: 1242320 - protein, 9 aa, Homo Sapiens
WITAHVMKQ

SEQ ID NO: 1242321 - protein, 9 aa, Homo Sapiens
TLEGIHQFY

SEQ ID NO: 1242322 - protein, 9 aa, Homo Sapiens
SWSLDDLRD

SEQ ID NO: 1242323 - protein, 9 aa, Homo Sapiens
QVISYLEKT

SEQ ID NO: 1242324 - protein, 9 aa, Homo Sapiens
PPMPRPVSL

SEQ ID NO: 1242325 - protein, 9 aa, Homo Sapiens
WSSWGPLAC

SEQ ID NO: 1242326 - protein, 9 aa, Homo Sapiens
GISSAWTDS

SEQ ID NO: 1242327 - protein, 9 aa, Homo Sapiens
RKEYEEELE

SEQ ID NO: 1242328 - protein, 9 aa, Homo Sapiens
VVSFSLGPC

SEQ ID NO: 1242329 - protein, 9 aa, Homo Sapiens
SKKLHPFGY

SEQ ID NO: 1242330 - protein, 9 aa, Homo Sapiens
HPNTLPGTC

SEQ ID NO: 1242331 - protein, 9 aa, Homo Sapiens
ERLQRHRIS

SEQ ID NO: 1242332 - protein, 9 aa, Homo Sapiens
CAALIFFTI

SEQ ID NO: 1242333 - protein, 9 aa, Homo Sapiens
DCKGRGVDV

SEQ ID NO: 1242334 - protein, 9 aa, Homo Sapiens
VIPGNGASW

SEQ ID NO: 1242335 - protein, 9 aa, Homo Sapiens
LAACGTCVF

SEQ ID NO: 1242336 - protein, 9 aa, Homo Sapiens
QMIAHTTWW

SEQ ID NO: 1242337 - protein, 9 aa, Homo Sapiens
KKQFKKVSE

SEQ ID NO: 1242338 - protein, 9 aa, Homo Sapiens
YVALHILQQ

SEQ ID NO: 1242339 - protein, 9 aa, Homo Sapiens
ILLIQGQSC

SEQ ID NO: 1242340 - protein, 9 aa, Homo Sapiens
GGFHGADHH

SEQ ID NO: 1242341 - protein, 9 aa, Homo Sapiens
SILVLAGNS

SEQ ID NO: 1242342 - protein, 9 aa, Homo Sapiens
GKKKGRKTV

SEQ ID NO: 1242343 - protein, 9 aa, Homo Sapiens
HLQCLSVVF

SEQ ID NO: 1242344 - protein, 9 aa, Homo Sapiens
TGFPNKHIR

SEQ ID NO: 1242345 - protein, 9 aa, Homo Sapiens
YKPSPDYVT

SEQ ID NO: 1242346 - protein, 9 aa, Homo Sapiens
FMYNRVQFL

SEQ ID NO: 1242347 - protein, 9 aa, Homo Sapiens
ACFEQAGEP

SEQ ID NO: 1242348 - protein, 9 aa, Homo Sapiens
VPLVKRLTG

SEQ ID NO: 1242349 - protein, 9 aa, Homo Sapiens
AEERNGVND

SEQ ID NO: 1242350 - protein, 9 aa, Homo Sapiens
LGGEKRWGC

SEQ ID NO: 1242351 - protein, 9 aa, Homo Sapiens
DHSAGSVES

SEQ ID NO: 1242352 - protein, 9 aa, Homo Sapiens
TDLTHLRDL

SEQ ID NO: 1242353 - protein, 9 aa, Homo Sapiens
CVIAAFTVA

SEQ ID NO: 1242354 - protein, 9 aa, Homo Sapiens
RSKRPQAMA

SEQ ID NO: 1242355 - protein, 9 aa, Homo Sapiens
LKQKVMFHV

SEQ ID NO: 1242356 - protein, 9 aa, Homo Sapiens
LIQQSKSRR

SEQ ID NO: 1242357 - protein, 9 aa, Homo Sapiens
EKHCKCTEC

SEQ ID NO: 1242358 - protein, 9 aa, Homo Sapiens
LDKCLAADG

SEQ ID NO: 1242359 - protein, 9 aa, Homo Sapiens
ECIEFYELD

SEQ ID NO: 1242360 - protein, 9 aa, Homo Sapiens
VVMTGLFTL

SEQ ID NO: 1242361 - protein, 9 aa, Homo Sapiens
QDSSRKPRT

SEQ ID NO: 1242362 - protein, 9 aa, Homo Sapiens
PRTGKAVST

SEQ ID NO: 1242363 - protein, 9 aa, Homo Sapiens
HTHRYTHRH

SEQ ID NO: 1242364 - protein, 9 aa, Homo Sapiens
LHLDLEKGK

SEQ ID NO: 1242365 - protein, 9 aa, Homo Sapiens
AFPDTDLVL

SEQ ID NO: 1242366 - protein, 9 aa, Homo Sapiens
PLPLELYMS

SEQ ID NO: 1242367 - protein, 9 aa, Homo Sapiens
FVMQAKTFS

SEQ ID NO: 1242368 - protein, 9 aa, Homo Sapiens
DSWEKVTGH

SEQ ID NO: 1242369 - protein, 9 aa, Homo Sapiens
ESLMVLEEE

SEQ ID NO: 1242370 - protein, 9 aa, Homo Sapiens
EIQRELLSI

SEQ ID NO: 1242371 - protein, 9 aa, Homo Sapiens
ADAVFMFNA

SEQ ID NO: 1242372 - protein, 9 aa, Homo Sapiens
PKMLVDQVT

SEQ ID NO: 1242373 - protein, 9 aa, Homo Sapiens
FERTPPIMR

SEQ ID NO: 1242374 - protein, 9 aa, Homo Sapiens
KVNREQCFT

SEQ ID NO: 1242375 - protein, 9 aa, Homo Sapiens
GRVGPYTFT

SEQ ID NO: 1242376 - protein, 9 aa, Homo Sapiens
WWGRKTHHI

SEQ ID NO: 1242377 - protein, 9 aa, Homo Sapiens
PFICNWLFC

SEQ ID NO: 1242378 - protein, 9 aa, Homo Sapiens
HCARTMPLC

SEQ ID NO: 1242379 - protein, 9 aa, Homo Sapiens
NFFLAPGMC

SEQ ID NO: 1242380 - protein, 9 aa, Homo Sapiens
MECFPTLTA

SEQ ID NO: 1242381 - protein, 9 aa, Homo Sapiens
VVLLFLWRR

SEQ ID NO: 1242382 - protein, 9 aa, Homo Sapiens
FTTETLGVS

SEQ ID NO: 1242383 - protein, 9 aa, Homo Sapiens
TVFTSRALK

SEQ ID NO: 1242384 - protein, 9 aa, Homo Sapiens
ITSLAVTDL

SEQ ID NO: 1242385 - protein, 9 aa, Homo Sapiens
DNRAIIVRN

SEQ ID NO: 1242386 - protein, 9 aa, Homo Sapiens
ASSHHGSRG

SEQ ID NO: 1242387 - protein, 9 aa, Homo Sapiens
IDAPHDDAH

SEQ ID NO: 1242388 - protein, 9 aa, Homo Sapiens
DNGVCISKK

SEQ ID NO: 1242389 - protein, 9 aa, Homo Sapiens
CKVLPDRKV

SEQ ID NO: 1242390 - protein, 9 aa, Homo Sapiens
HSENHTDET

SEQ ID NO: 1242391 - protein, 9 aa, Homo Sapiens
PWLPRSGNT

SEQ ID NO: 1242392 - protein, 9 aa, Homo Sapiens
FPPSDQLQP

SEQ ID NO: 1242393 - protein, 9 aa, Homo Sapiens
AEHRISQHS

SEQ ID NO: 1242394 - protein, 9 aa, Homo Sapiens
SLGRSPSTS

SEQ ID NO: 1242395 - protein, 9 aa, Homo Sapiens
GPLDETQIT

SEQ ID NO: 1242396 - protein, 9 aa, Homo Sapiens
YREERECKH

SEQ ID NO: 1242397 - protein, 9 aa, Homo Sapiens
DSLEVVYTG

SEQ ID NO: 1242398 - protein, 9 aa, Homo Sapiens
TAATRLKGI

SEQ ID NO: 1242399 - protein, 9 aa, Homo Sapiens
EVKEFFTLI

SEQ ID NO: 1242400 - protein, 9 aa, Homo Sapiens
SSVMCENEN

SEQ ID NO: 1242401 - protein, 9 aa, Homo Sapiens
RTVIQIIHI

SEQ ID NO: 1242402 - protein, 9 aa, Homo Sapiens
VGRAILQNY

SEQ ID NO: 1242403 - protein, 9 aa, Homo Sapiens
HPAISPKSS

SEQ ID NO: 1242404 - protein, 9 aa, Homo Sapiens
DPYVCIPCE

SEQ ID NO: 1242405 - protein, 9 aa, Homo Sapiens
ESTGNGPPT

SEQ ID NO: 1242406 - protein, 9 aa, Homo Sapiens
RGEHKNQGT

SEQ ID NO: 1242407 - protein, 9 aa, Homo Sapiens
MSFVDICYV

SEQ ID NO: 1242408 - protein, 9 aa, Homo Sapiens
CLRSKEEPC

SEQ ID NO: 1242409 - protein, 9 aa, Homo Sapiens
ALYESAKKQ

SEQ ID NO: 1242410 - protein, 9 aa, Homo Sapiens
VMGGLKNSK

SEQ ID NO: 1242411 - protein, 9 aa, Homo Sapiens
PHGSTKRRK

SEQ ID NO: 1242412 - protein, 9 aa, Homo Sapiens
IWAVYERPN

SEQ ID NO: 1242413 - protein, 9 aa, Homo Sapiens
VALDLVISK

SEQ ID NO: 1242414 - protein, 9 aa, Homo Sapiens
LIVNDDINL

SEQ ID NO: 1242415 - protein, 9 aa, Homo Sapiens
VDRGEVRHF

SEQ ID NO: 1242416 - protein, 9 aa, Homo Sapiens
RKQRRERMT

SEQ ID NO: 1242417 - protein, 9 aa, Homo Sapiens
RLDKPKFGG

SEQ ID NO: 1242418 - protein, 9 aa, Homo Sapiens
WIMQKKTYV

SEQ ID NO: 1242419 - protein, 9 aa, Homo Sapiens
PSFNMDADY

SEQ ID NO: 1242420 - protein, 9 aa, Homo Sapiens
SVVIRSPQP

SEQ ID NO: 1242421 - protein, 9 aa, Homo Sapiens
SLPLSVMCP

SEQ ID NO: 1242422 - protein, 9 aa, Homo Sapiens
ERNGVNDVS

SEQ ID NO: 1242423 - protein, 9 aa, Homo Sapiens
FHGADHHEV

SEQ ID NO: 1242424 - protein, 9 aa, Homo Sapiens
DNYDLREDD

SEQ ID NO: 1242425 - protein, 9 aa, Homo Sapiens
TDVDLHVYI

SEQ ID NO: 1242426 - protein, 9 aa, Homo Sapiens
VPPKTRRGS

SEQ ID NO: 1242427 - protein, 9 aa, Homo Sapiens
TSMQSQITR

SEQ ID NO: 1242428 - protein, 9 aa, Homo Sapiens
RAIKDQLHK

SEQ ID NO: 1242429 - protein, 9 aa, Homo Sapiens
CHGVKIGFF

SEQ ID NO: 1242430 - protein, 9 aa, Homo Sapiens
IGFDMGGMS

SEQ ID NO: 1242431 - protein, 9 aa, Homo Sapiens
FVDKIQTET

SEQ ID NO: 1242432 - protein, 9 aa, Homo Sapiens
GRPWPPSFS

SEQ ID NO: 1242433 - protein, 9 aa, Homo Sapiens
AVTGLTQSN

SEQ ID NO: 1242434 - protein, 9 aa, Homo Sapiens
APCRCSAPA

SEQ ID NO: 1242435 - protein, 9 aa, Homo Sapiens
LSFASTVCH

SEQ ID NO: 1242436 - protein, 9 aa, Homo Sapiens
AIQKIGECA

SEQ ID NO: 1242437 - protein, 9 aa, Homo Sapiens
MDLKIKLAM

SEQ ID NO: 1242438 - protein, 9 aa, Homo Sapiens
AQRDVVDFD

SEQ ID NO: 1242439 - protein, 9 aa, Homo Sapiens
TMVKCNNQT

SEQ ID NO: 1242440 - protein, 9 aa, Homo Sapiens
IKTIAFAHN

SEQ ID NO: 1242441 - protein, 9 aa, Homo Sapiens
WQRHYFYLF

SEQ ID NO: 1242442 - protein, 9 aa, Homo Sapiens
GTVHFKCRH

SEQ ID NO: 1242443 - protein, 9 aa, Homo Sapiens
YIGGDCYIM

SEQ ID NO: 1242444 - protein, 9 aa, Homo Sapiens
ALVDQVLVK

SEQ ID NO: 1242445 - protein, 9 aa, Homo Sapiens
QMVICKKDL

SEQ ID NO: 1242446 - protein, 9 aa, Homo Sapiens
NIYRDVMLE

SEQ ID NO: 1242447 - protein, 9 aa, Homo Sapiens
LLLVVGCVS

SEQ ID NO: 1242448 - protein, 9 aa, Homo Sapiens
QGRRLADQT

SEQ ID NO: 1242449 - protein, 9 aa, Homo Sapiens
LCIEALEWH

SEQ ID NO: 1242450 - protein, 9 aa, Homo Sapiens
DSHQMNDSK

SEQ ID NO: 1242451 - protein, 9 aa, Homo Sapiens
NMADGDNFN

SEQ ID NO: 1242452 - protein, 9 aa, Homo Sapiens
QVLNYSASY

SEQ ID NO: 1242453 - protein, 9 aa, Homo Sapiens
DEGVESVSV

SEQ ID NO: 1242454 - protein, 9 aa, Homo Sapiens
ACGTCVFTN

SEQ ID NO: 1242455 - protein, 9 aa, Homo Sapiens
QQLWGAGQS

SEQ ID NO: 1242456 - protein, 9 aa, Homo Sapiens
GRLSANSGC

SEQ ID NO: 1242457 - protein, 9 aa, Homo Sapiens
RPQQASVVI

SEQ ID NO: 1242458 - protein, 9 aa, Homo Sapiens
DIGDFTLQS

SEQ ID NO: 1242459 - protein, 9 aa, Homo Sapiens
PSSPRSPAG

SEQ ID NO: 1242460 - protein, 9 aa, Homo Sapiens
DSSTREIII

SEQ ID NO: 1242461 - protein, 9 aa, Homo Sapiens
RLPMSVIIV

SEQ ID NO: 1242462 - protein, 9 aa, Homo Sapiens
TTGSVSSLN

SEQ ID NO: 1242463 - protein, 9 aa, Homo Sapiens
DPSSPRSPA

SEQ ID NO: 1242464 - protein, 9 aa, Homo Sapiens
GPGQDRHME

SEQ ID NO: 1242465 - protein, 9 aa, Homo Sapiens
EHAIDLRVE

SEQ ID NO: 1242466 - protein, 9 aa, Homo Sapiens
RCLRGGQAF

SEQ ID NO: 1242467 - protein, 9 aa, Homo Sapiens
HFGTTLNYL

SEQ ID NO: 1242468 - protein, 9 aa, Homo Sapiens
LQPHSCLQC

SEQ ID NO: 1242469 - protein, 9 aa, Homo Sapiens
TSAYTLISP

SEQ ID NO: 1242470 - protein, 9 aa, Homo Sapiens
LQDPGRLSA

SEQ ID NO: 1242471 - protein, 9 aa, Homo Sapiens
MTTLSNIAR

SEQ ID NO: 1242472 - protein, 9 aa, Homo Sapiens
LLAIIRHLR

SEQ ID NO: 1242473 - protein, 9 aa, Homo Sapiens
RSTGNTCSS

SEQ ID NO: 1242474 - protein, 9 aa, Homo Sapiens
IAGSGKWEP

SEQ ID NO: 1242475 - protein, 9 aa, Homo Sapiens
LVGPGGLFP

SEQ ID NO: 1242476 - protein, 9 aa, Homo Sapiens
ANEAHVSTN

SEQ ID NO: 1242477 - protein, 9 aa, Homo Sapiens
LDESMRDKV

SEQ ID NO: 1242478 - protein, 9 aa, Homo Sapiens
LGRQRQLLR

SEQ ID NO: 1242479 - protein, 9 aa, Homo Sapiens
IYYQVLMNS

SEQ ID NO: 1242480 - protein, 9 aa, Homo Sapiens
LPTLRNLHC

SEQ ID NO: 1242481 - protein, 9 aa, Homo Sapiens
PLHLIVENV

SEQ ID NO: 1242482 - protein, 9 aa, Homo Sapiens
QHFSAHFTL

SEQ ID NO: 1242483 - protein, 9 aa, Homo Sapiens
ASFSEAKNK

SEQ ID NO: 1242484 - protein, 9 aa, Homo Sapiens
EIKNEADMT

SEQ ID NO: 1242485 - protein, 9 aa, Homo Sapiens
IIHIPKNKE

SEQ ID NO: 1242486 - protein, 9 aa, Homo Sapiens
ALRRLQSGS

SEQ ID NO: 1242487 - protein, 9 aa, Homo Sapiens
PLVLKQVVR

SEQ ID NO: 1242488 - protein, 9 aa, Homo Sapiens
DFYSIFTKE

SEQ ID NO: 1242489 - protein, 9 aa, Homo Sapiens
NYTLFESLC

SEQ ID NO: 1242490 - protein, 9 aa, Homo Sapiens
HQDCHEKIR

SEQ ID NO: 1242491 - protein, 9 aa, Homo Sapiens
DVCKPLHYV

SEQ ID NO: 1242492 - protein, 9 aa, Homo Sapiens
RRQEVLIRY

SEQ ID NO: 1242493 - protein, 9 aa, Homo Sapiens
QVYGVPHLL

SEQ ID NO: 1242494 - protein, 9 aa, Homo Sapiens
SSHVLEWLK

SEQ ID NO: 1242495 - protein, 9 aa, Homo Sapiens
YWINKTDNN

SEQ ID NO: 1242496 - protein, 9 aa, Homo Sapiens
AQMLVENLY

SEQ ID NO: 1242497 - protein, 9 aa, Homo Sapiens
ISIILVPQA

SEQ ID NO: 1242498 - protein, 9 aa, Homo Sapiens
SDASFLTQW

SEQ ID NO: 1242499 - protein, 9 aa, Homo Sapiens
YWDALYKFM

SEQ ID NO: 1242500 - protein, 9 aa, Homo Sapiens
RKVQEHQGK

SEQ ID NO: 1242501 - protein, 9 aa, Homo Sapiens
KLPLTRVVY

SEQ ID NO: 1242502 - protein, 9 aa, Homo Sapiens
KPPFLIQLH

SEQ ID NO: 1242503 - protein, 9 aa, Homo Sapiens
QAKHKYQEA

SEQ ID NO: 1242504 - protein, 9 aa, Homo Sapiens
ICIQDAMEV

SEQ ID NO: 1242505 - protein, 9 aa, Homo Sapiens
HEQDREISD

SEQ ID NO: 1242506 - protein, 9 aa, Homo Sapiens
YQRIYTMKI

SEQ ID NO: 1242507 - protein, 9 aa, Homo Sapiens
DRREYDRIA

SEQ ID NO: 1242508 - protein, 9 aa, Homo Sapiens
LSRAVLWLD

SEQ ID NO: 1242509 - protein, 9 aa, Homo Sapiens
VGPPLTKGN

SEQ ID NO: 1242510 - protein, 9 aa, Homo Sapiens
EPASSEVVS

SEQ ID NO: 1242511 - protein, 9 aa, Homo Sapiens
AFAKRHRLH

SEQ ID NO: 1242512 - protein, 9 aa, Homo Sapiens
DLAAHLGYF

SEQ ID NO: 1242513 - protein, 9 aa, Homo Sapiens
MRQSKETAG

SEQ ID NO: 1242514 - protein, 9 aa, Homo Sapiens
EEDRCPLNI

SEQ ID NO: 1242515 - protein, 9 aa, Homo Sapiens
KLDRANNLY

SEQ ID NO: 1242516 - protein, 9 aa, Homo Sapiens
RDDFIAKVS

SEQ ID NO: 1242517 - protein, 9 aa, Homo Sapiens
IKNILVNTL

SEQ ID NO: 1242518 - protein, 9 aa, Homo Sapiens
VKFRKITDP

SEQ ID NO: 1242519 - protein, 9 aa, Homo Sapiens
LLANEHERV

SEQ ID NO: 1242520 - protein, 9 aa, Homo Sapiens
VLRHQRTHE

SEQ ID NO: 1242521 - protein, 9 aa, Homo Sapiens
VVWTNLTEA

SEQ ID NO: 1242522 - protein, 9 aa, Homo Sapiens
SLGCAMYTL

SEQ ID NO: 1242523 - protein, 9 aa, Homo Sapiens
TTTTVGVTT

SEQ ID NO: 1242524 - protein, 9 aa, Homo Sapiens
PVFNAIFEH

SEQ ID NO: 1242525 - protein, 9 aa, Homo Sapiens
EKSRHASIQ

SEQ ID NO: 1242526 - protein, 9 aa, Homo Sapiens
RIKNLYKKK

SEQ ID NO: 1242527 - protein, 9 aa, Homo Sapiens
KHMCLHRGE

SEQ ID NO: 1242528 - protein, 9 aa, Homo Sapiens
QRLFENYQM

SEQ ID NO: 1242529 - protein, 9 aa, Homo Sapiens
RPVVFLVQD

SEQ ID NO: 1242530 - protein, 9 aa, Homo Sapiens
STLLAIIRH

SEQ ID NO: 1242531 - protein, 9 aa, Homo Sapiens
EANIKAKLP

SEQ ID NO: 1242532 - protein, 9 aa, Homo Sapiens
QKKETQIPL

SEQ ID NO: 1242533 - protein, 9 aa, Homo Sapiens
VSLPDEGFV

SEQ ID NO: 1242534 - protein, 9 aa, Homo Sapiens
ATCSDSSGV

SEQ ID NO: 1242535 - protein, 9 aa, Homo Sapiens
MAAHMWMVH

SEQ ID NO: 1242536 - protein, 9 aa, Homo Sapiens
IKATLIWCL

SEQ ID NO: 1242537 - protein, 9 aa, Homo Sapiens
ASGDCSARQ

SEQ ID NO: 1242538 - protein, 9 aa, Homo Sapiens
YKAEGVNIR

SEQ ID NO: 1242539 - protein, 9 aa, Homo Sapiens
HPISICLGS

SEQ ID NO: 1242540 - protein, 9 aa, Homo Sapiens
ECHLCAESL

SEQ ID NO: 1242541 - protein, 9 aa, Homo Sapiens
DSSHYWSKN

SEQ ID NO: 1242542 - protein, 9 aa, Homo Sapiens
APGAGDKAS

SEQ ID NO: 1242543 - protein, 9 aa, Homo Sapiens
TKSQPVMII

SEQ ID NO: 1242544 - protein, 9 aa, Homo Sapiens
CQEKEIEAQ

SEQ ID NO: 1242545 - protein, 9 aa, Homo Sapiens
QELQITDII

SEQ ID NO: 1242546 - protein, 9 aa, Homo Sapiens
DEDAGTYWC

SEQ ID NO: 1242547 - protein, 9 aa, Homo Sapiens
PNCDCKGFY

SEQ ID NO: 1242548 - protein, 9 aa, Homo Sapiens
RYVQPQAQQ

SEQ ID NO: 1242549 - protein, 9 aa, Homo Sapiens
GITSSDFAS

SEQ ID NO: 1242550 - protein, 9 aa, Homo Sapiens
GAINNTLSN

SEQ ID NO: 1242551 - protein, 9 aa, Homo Sapiens
YQYGKNFSQ

SEQ ID NO: 1242552 - protein, 9 aa, Homo Sapiens
TRIHLLDSN

SEQ ID NO: 1242553 - protein, 9 aa, Homo Sapiens
EAGRYSFLV

SEQ ID NO: 1242554 - protein, 9 aa, Homo Sapiens
LLLLAISFC

SEQ ID NO: 1242555 - protein, 9 aa, Homo Sapiens
MYTAIQEPM

SEQ ID NO: 1242556 - protein, 9 aa, Homo Sapiens
KWHWQVSLR

SEQ ID NO: 1242557 - protein, 9 aa, Homo Sapiens
VPHPGVQPQ

SEQ ID NO: 1242558 - protein, 9 aa, Homo Sapiens
EDIFRHLCL

SEQ ID NO: 1242559 - protein, 9 aa, Homo Sapiens
LLFSCNSPQ

SEQ ID NO: 1242560 - protein, 9 aa, Homo Sapiens
HHLCITRKK

SEQ ID NO: 1242561 - protein, 9 aa, Homo Sapiens
PNKPQKKEK

SEQ ID NO: 1242562 - protein, 9 aa, Homo Sapiens
KSSMPETTA

SEQ ID NO: 1242563 - protein, 9 aa, Homo Sapiens
ATDLLHDTL

SEQ ID NO: 1242564 - protein, 9 aa, Homo Sapiens
NKWNATNKD

SEQ ID NO: 1242565 - protein, 9 aa, Homo Sapiens
TIIVGYILL

SEQ ID NO: 1242566 - protein, 9 aa, Homo Sapiens
NTSSLQITI

SEQ ID NO: 1242567 - protein, 9 aa, Homo Sapiens
LPSHLHPEG

SEQ ID NO: 1242568 - protein, 9 aa, Homo Sapiens
QDLRMAREK

SEQ ID NO: 1242569 - protein, 9 aa, Homo Sapiens
HFPQALTSN

SEQ ID NO: 1242570 - protein, 9 aa, Homo Sapiens
GDGAQGEGQ

SEQ ID NO: 1242571 - protein, 9 aa, Homo Sapiens
GTNKDSTSP

SEQ ID NO: 1242572 - protein, 9 aa, Homo Sapiens
EDEDEQESM

SEQ ID NO: 1242573 - protein, 9 aa, Homo Sapiens
SMPPVTSIG

SEQ ID NO: 1242574 - protein, 9 aa, Homo Sapiens
LTNAEKHVH

SEQ ID NO: 1242575 - protein, 9 aa, Homo Sapiens
ITSLNLDFN

SEQ ID NO: 1242576 - protein, 9 aa, Homo Sapiens
SLSLRVRGQ

SEQ ID NO: 1242577 - protein, 9 aa, Homo Sapiens
VWQHRVFVG

SEQ ID NO: 1242578 - protein, 9 aa, Homo Sapiens
MCCTPASSQ

SEQ ID NO: 1242579 - protein, 9 aa, Homo Sapiens
VAGEIDPVT

SEQ ID NO: 1242580 - protein, 9 aa, Homo Sapiens
LTMIRVNSM

SEQ ID NO: 1242581 - protein, 9 aa, Homo Sapiens
VGDVIRQSL

SEQ ID NO: 1242582 - protein, 9 aa, Homo Sapiens
KIESSTFQF

SEQ ID NO: 1242583 - protein, 9 aa, Homo Sapiens
SRREEHSLS

SEQ ID NO: 1242584 - protein, 9 aa, Homo Sapiens
APRGYPPIL

SEQ ID NO: 1242585 - protein, 9 aa, Homo Sapiens
SELKVTEVK

SEQ ID NO: 1242586 - protein, 9 aa, Homo Sapiens
NVNAIKAEC

SEQ ID NO: 1242587 - protein, 9 aa, Homo Sapiens
VPEAADMDY

SEQ ID NO: 1242588 - protein, 9 aa, Homo Sapiens
KHGEDYNHT

SEQ ID NO: 1242589 - protein, 9 aa, Homo Sapiens
SGLARAHAG

SEQ ID NO: 1242590 - protein, 9 aa, Homo Sapiens
WDIRGLTHA

SEQ ID NO: 1242591 - protein, 9 aa, Homo Sapiens
QEEHVYIEM

SEQ ID NO: 1242592 - protein, 9 aa, Homo Sapiens
HEKQKLVEK

SEQ ID NO: 1242593 - protein, 9 aa, Homo Sapiens
VEQTPKKHG

SEQ ID NO: 1242594 - protein, 9 aa, Homo Sapiens
QNYTPKVIE

SEQ ID NO: 1242595 - protein, 9 aa, Homo Sapiens
AYGQRGPGP

SEQ ID NO: 1242596 - protein, 9 aa, Homo Sapiens
EAGYLIRNS

SEQ ID NO: 1242597 - protein, 9 aa, Homo Sapiens
SFVDKIQTE

SEQ ID NO: 1242598 - protein, 9 aa, Homo Sapiens
FAFSPPPGS

SEQ ID NO: 1242599 - protein, 9 aa, Homo Sapiens
VEPRLRLYY

SEQ ID NO: 1242600 - protein, 9 aa, Homo Sapiens
SFQELYCMV

SEQ ID NO: 1242601 - protein, 9 aa, Homo Sapiens
VDIQLKYFV

SEQ ID NO: 1242602 - protein, 9 aa, Homo Sapiens
RFGSTLHLD

SEQ ID NO: 1242603 - protein, 9 aa, Homo Sapiens
YKLEEEKHE

SEQ ID NO: 1242604 - protein, 9 aa, Homo Sapiens
RSFLEFVED

SEQ ID NO: 1242605 - protein, 9 aa, Homo Sapiens
LENLERQQN

SEQ ID NO: 1242606 - protein, 9 aa, Homo Sapiens
QSCTLPERS

SEQ ID NO: 1242607 - protein, 9 aa, Homo Sapiens
PSVWEQVTP

SEQ ID NO: 1242608 - protein, 9 aa, Homo Sapiens
SKLESGHFP

SEQ ID NO: 1242609 - protein, 9 aa, Homo Sapiens
TGHLCEAPS

SEQ ID NO: 1242610 - protein, 9 aa, Homo Sapiens
MVCTFFDTF

SEQ ID NO: 1242611 - protein, 9 aa, Homo Sapiens
GQSKHLEQQ

SEQ ID NO: 1242612 - protein, 9 aa, Homo Sapiens
QIERVYFEI

SEQ ID NO: 1242613 - protein, 9 aa, Homo Sapiens
IGLCFPNHL

SEQ ID NO: 1242614 - protein, 9 aa, Homo Sapiens
LTSGVLHKM

SEQ ID NO: 1242615 - protein, 9 aa, Homo Sapiens
IGRRFYWTG

SEQ ID NO: 1242616 - protein, 9 aa, Homo Sapiens
LSLPWRPNT

SEQ ID NO: 1242617 - protein, 9 aa, Homo Sapiens
ASIAGSGKW

SEQ ID NO: 1242618 - protein, 9 aa, Homo Sapiens
STRSPLLSR

SEQ ID NO: 1242619 - protein, 9 aa, Homo Sapiens
MISNRRLQQ

SEQ ID NO: 1242620 - protein, 9 aa, Homo Sapiens
PKSLYTVGT

SEQ ID NO: 1242621 - protein, 9 aa, Homo Sapiens
AKTLSYLRE

SEQ ID NO: 1242622 - protein, 9 aa, Homo Sapiens
LPAPKSVLQ

SEQ ID NO: 1242623 - protein, 9 aa, Homo Sapiens
IIRFCHPNI

SEQ ID NO: 1242624 - protein, 9 aa, Homo Sapiens
EELAFFGLV

SEQ ID NO: 1242625 - protein, 9 aa, Homo Sapiens
CAKLVWEET

SEQ ID NO: 1242626 - protein, 9 aa, Homo Sapiens
TSREIKTAV

SEQ ID NO: 1242627 - protein, 9 aa, Homo Sapiens
KAFKKWTHP

SEQ ID NO: 1242628 - protein, 9 aa, Homo Sapiens
DAGNPVIMQ

SEQ ID NO: 1242629 - protein, 9 aa, Homo Sapiens
CLSRIQNRR

SEQ ID NO: 1242630 - protein, 9 aa, Homo Sapiens
AASLAILEE

SEQ ID NO: 1242631 - protein, 9 aa, Homo Sapiens
ARDGHSASV

SEQ ID NO: 1242632 - protein, 9 aa, Homo Sapiens
TCFLRQSGI

SEQ ID NO: 1242633 - protein, 9 aa, Homo Sapiens
NEGKNATLK

SEQ ID NO: 1242634 - protein, 9 aa, Homo Sapiens
QAGAPPPPA

SEQ ID NO: 1242635 - protein, 9 aa, Homo Sapiens
LEFEGDTHC

SEQ ID NO: 1242636 - protein, 9 aa, Homo Sapiens
SHCSKQRHK

SEQ ID NO: 1242637 - protein, 9 aa, Homo Sapiens
MWLSASHFT

SEQ ID NO: 1242638 - protein, 9 aa, Homo Sapiens
VAARRCKTN

SEQ ID NO: 1242639 - protein, 9 aa, Homo Sapiens
CDSSCGSRG

SEQ ID NO: 1242640 - protein, 9 aa, Homo Sapiens
LLTSNDPPT

SEQ ID NO: 1242641 - protein, 9 aa, Homo Sapiens
RKHGGSSGD

SEQ ID NO: 1242642 - protein, 9 aa, Homo Sapiens
RHYEDDGIS

SEQ ID NO: 1242643 - protein, 9 aa, Homo Sapiens
KGIRKKKDL

SEQ ID NO: 1242644 - protein, 9 aa, Homo Sapiens
EGHIWSSMR

SEQ ID NO: 1242645 - protein, 9 aa, Homo Sapiens
MCPWELKQV

SEQ ID NO: 1242646 - protein, 9 aa, Homo Sapiens
VGKSELVET

SEQ ID NO: 1242647 - protein, 9 aa, Homo Sapiens
GVKKPNKKQ

SEQ ID NO: 1242648 - protein, 9 aa, Homo Sapiens
LLEAVLFGI

SEQ ID NO: 1242649 - protein, 9 aa, Homo Sapiens
RWRKEDGER

SEQ ID NO: 1242650 - protein, 9 aa, Homo Sapiens
VKACQVCST

SEQ ID NO: 1242651 - protein, 9 aa, Homo Sapiens
ANGFGGQYG

SEQ ID NO: 1242652 - protein, 9 aa, Homo Sapiens
TISGESAGT

SEQ ID NO: 1242653 - protein, 9 aa, Homo Sapiens
TTGRNFDDI

SEQ ID NO: 1242654 - protein, 9 aa, Homo Sapiens
TGTHRHTHT

SEQ ID NO: 1242655 - protein, 9 aa, Homo Sapiens
SGRGEHPNP

SEQ ID NO: 1242656 - protein, 9 aa, Homo Sapiens
PCTHSLCFN

SEQ ID NO: 1242657 - protein, 9 aa, Homo Sapiens
IVAVLLQNW

SEQ ID NO: 1242658 - protein, 9 aa, Homo Sapiens
SLGWTLRDY

SEQ ID NO: 1242659 - protein, 9 aa, Homo Sapiens
KLLVMEDDI

SEQ ID NO: 1242660 - protein, 9 aa, Homo Sapiens
REPLLSFLQ

SEQ ID NO: 1242661 - protein, 9 aa, Homo Sapiens
CSEWMLLFR

SEQ ID NO: 1242662 - protein, 9 aa, Homo Sapiens
CQTLCNGSN

SEQ ID NO: 1242663 - protein, 9 aa, Homo Sapiens
FLAFDQNSY

SEQ ID NO: 1242664 - protein, 9 aa, Homo Sapiens
NSLESKLYQ

SEQ ID NO: 1242665 - protein, 9 aa, Homo Sapiens
AFLRASIYG

SEQ ID NO: 1242666 - protein, 9 aa, Homo Sapiens
QAVNDLCYQ

SEQ ID NO: 1242667 - protein, 9 aa, Homo Sapiens
LLFYDTSAS

SEQ ID NO: 1242668 - protein, 9 aa, Homo Sapiens
QKKMNYENS

SEQ ID NO: 1242669 - protein, 9 aa, Homo Sapiens
VGHATTLIQ

SEQ ID NO: 1242670 - protein, 9 aa, Homo Sapiens
VRHIYTAFD

SEQ ID NO: 1242671 - protein, 9 aa, Homo Sapiens
DFGMSRGIY

SEQ ID NO: 1242672 - protein, 9 aa, Homo Sapiens
SVVLKAAAH

SEQ ID NO: 1242673 - protein, 9 aa, Homo Sapiens
SLMLGPSLS

SEQ ID NO: 1242674 - protein, 9 aa, Homo Sapiens
VMQPIPAPP

SEQ ID NO: 1242675 - protein, 9 aa, Homo Sapiens
EALRRKNET

SEQ ID NO: 1242676 - protein, 9 aa, Homo Sapiens
QYDLDSPMQ

SEQ ID NO: 1242677 - protein, 9 aa, Homo Sapiens
KLEARMLCQ

SEQ ID NO: 1242678 - protein, 9 aa, Homo Sapiens
DPKIESSTF

SEQ ID NO: 1242679 - protein, 9 aa, Homo Sapiens
HSSLPNPRH

SEQ ID NO: 1242680 - protein, 9 aa, Homo Sapiens
EVWLGTMFQ

SEQ ID NO: 1242681 - protein, 9 aa, Homo Sapiens
EVLRKMGLR

SEQ ID NO: 1242682 - protein, 9 aa, Homo Sapiens
KTISDPYVC

SEQ ID NO: 1242683 - protein, 9 aa, Homo Sapiens
CKSLLTRKV

SEQ ID NO: 1242684 - protein, 9 aa, Homo Sapiens
RPQAMASHG

SEQ ID NO: 1242685 - protein, 9 aa, Homo Sapiens
VKKVLDKLY

SEQ ID NO: 1242686 - protein, 9 aa, Homo Sapiens
NFGYIVTFK

SEQ ID NO: 1242687 - protein, 9 aa, Homo Sapiens
LVNCSKNVM

SEQ ID NO: 1242688 - protein, 9 aa, Homo Sapiens
HVAVQMSDQ

SEQ ID NO: 1242689 - protein, 9 aa, Homo Sapiens
PDAISESQH

SEQ ID NO: 1242690 - protein, 9 aa, Homo Sapiens
GQTQKRSFR

SEQ ID NO: 1242691 - protein, 9 aa, Homo Sapiens
TKACAFLEY

SEQ ID NO: 1242692 - protein, 9 aa, Homo Sapiens
DNVEVVQHR

SEQ ID NO: 1242693 - protein, 9 aa, Homo Sapiens
LIGMSDLPP

SEQ ID NO: 1242694 - protein, 9 aa, Homo Sapiens
LARQDGEVV

SEQ ID NO: 1242695 - protein, 9 aa, Homo Sapiens
LCKEILHSS

SEQ ID NO: 1242696 - protein, 9 aa, Homo Sapiens
GTPTERTAL

SEQ ID NO: 1242697 - protein, 9 aa, Homo Sapiens
NCLAQICSS

SEQ ID NO: 1242698 - protein, 9 aa, Homo Sapiens
GFQRPAIYY

SEQ ID NO: 1242699 - protein, 9 aa, Homo Sapiens
ESLQSCIQF

SEQ ID NO: 1242700 - protein, 9 aa, Homo Sapiens
LPEFLVLTQ

SEQ ID NO: 1242701 - protein, 9 aa, Homo Sapiens
FIGGLLHDL

SEQ ID NO: 1242702 - protein, 9 aa, Homo Sapiens
EGSPAAGDV

SEQ ID NO: 1242703 - protein, 9 aa, Homo Sapiens
VFVCAFSKA

SEQ ID NO: 1242704 - protein, 9 aa, Homo Sapiens
TAASPPASS

SEQ ID NO: 1242705 - protein, 9 aa, Homo Sapiens
LGREDLPTI

SEQ ID NO: 1242706 - protein, 9 aa, Homo Sapiens
GTLPGSSVS

SEQ ID NO: 1242707 - protein, 9 aa, Homo Sapiens
IHIHNKILT

SEQ ID NO: 1242708 - protein, 9 aa, Homo Sapiens
IPKMNQEQF

SEQ ID NO: 1242709 - protein, 9 aa, Homo Sapiens
DIRKLLQQS

SEQ ID NO: 1242710 - protein, 9 aa, Homo Sapiens
ALHSLREAC

SEQ ID NO: 1242711 - protein, 9 aa, Homo Sapiens
SHIKYFKVL

SEQ ID NO: 1242712 - protein, 9 aa, Homo Sapiens
RVALERRKI

SEQ ID NO: 1242713 - protein, 9 aa, Homo Sapiens
IMGCIAYKH

SEQ ID NO: 1242714 - protein, 9 aa, Homo Sapiens
ILENQYTLD

SEQ ID NO: 1242715 - protein, 9 aa, Homo Sapiens
STGWYPPTP

SEQ ID NO: 1242716 - protein, 9 aa, Homo Sapiens
HKVNSLLYA

SEQ ID NO: 1242717 - protein, 9 aa, Homo Sapiens
KKDKKYYDN

SEQ ID NO: 1242718 - protein, 9 aa, Homo Sapiens
LEAFCLPGE

SEQ ID NO: 1242719 - protein, 9 aa, Homo Sapiens
TMTWETILM

SEQ ID NO: 1242720 - protein, 9 aa, Homo Sapiens
EEKDTKLAL

SEQ ID NO: 1242721 - protein, 9 aa, Homo Sapiens
SKHLRFPDN

SEQ ID NO: 1242722 - protein, 9 aa, Homo Sapiens
VDTCAPGGI

SEQ ID NO: 1242723 - protein, 9 aa, Homo Sapiens
EYANHMAAQ

SEQ ID NO: 1242724 - protein, 9 aa, Homo Sapiens
LSLLHDRIF

SEQ ID NO: 1242725 - protein, 9 aa, Homo Sapiens
VVVGTGTSL

SEQ ID NO: 1242726 - protein, 9 aa, Homo Sapiens
VPFSVAKSM

SEQ ID NO: 1242727 - protein, 9 aa, Homo Sapiens
SPRPTYSCF

SEQ ID NO: 1242728 - protein, 9 aa, Homo Sapiens
NPTQAFTNY

SEQ ID NO: 1242729 - protein, 9 aa, Homo Sapiens
TSLPFCGPN

SEQ ID NO: 1242730 - protein, 9 aa, Homo Sapiens
EPQVVVGAP

SEQ ID NO: 1242731 - protein, 9 aa, Homo Sapiens
TVSEGKKQG

SEQ ID NO: 1242732 - protein, 9 aa, Homo Sapiens
PLVTEEGKH

SEQ ID NO: 1242733 - protein, 9 aa, Homo Sapiens
GGVTEVHVP

SEQ ID NO: 1242734 - protein, 9 aa, Homo Sapiens
HRSPSAPDD

SEQ ID NO: 1242735 - protein, 9 aa, Homo Sapiens
GIQIPNLCG

SEQ ID NO: 1242736 - protein, 9 aa, Homo Sapiens
QKTSGTKSS

SEQ ID NO: 1242737 - protein, 9 aa, Homo Sapiens
PTNKFQGMV

SEQ ID NO: 1242738 - protein, 9 aa, Homo Sapiens
TSLHDAHEF

SEQ ID NO: 1242739 - protein, 9 aa, Homo Sapiens
IKRYFSIVP

SEQ ID NO: 1242740 - protein, 9 aa, Homo Sapiens
HIWDSPAFN

SEQ ID NO: 1242741 - protein, 9 aa, Homo Sapiens
PCTSTMPPR

SEQ ID NO: 1242742 - protein, 9 aa, Homo Sapiens
HIYNKPTDD

SEQ ID NO: 1242743 - protein, 9 aa, Homo Sapiens
KKSEADKCG

SEQ ID NO: 1242744 - protein, 9 aa, Homo Sapiens
QAELQGAVW

SEQ ID NO: 1242745 - protein, 9 aa, Homo Sapiens
IPLVLVGTH

SEQ ID NO: 1242746 - protein, 9 aa, Homo Sapiens
DQCDGGWLT

SEQ ID NO: 1242747 - protein, 9 aa, Homo Sapiens
TFSIENFKR

SEQ ID NO: 1242748 - protein, 9 aa, Homo Sapiens
THTQAYTLT

SEQ ID NO: 1242749 - protein, 9 aa, Homo Sapiens
VCWASTLWY

SEQ ID NO: 1242750 - protein, 9 aa, Homo Sapiens
NKTVLERRY

SEQ ID NO: 1242751 - protein, 9 aa, Homo Sapiens
ICVEYSLMV

SEQ ID NO: 1242752 - protein, 9 aa, Homo Sapiens
SYDIYIHVH

SEQ ID NO: 1242753 - protein, 9 aa, Homo Sapiens
VKGHRVSQE

SEQ ID NO: 1242754 - protein, 9 aa, Homo Sapiens
LTKIENLRF

SEQ ID NO: 1242755 - protein, 9 aa, Homo Sapiens
LEGGANVNL

SEQ ID NO: 1242756 - protein, 9 aa, Homo Sapiens
QTGCFCNTG

SEQ ID NO: 1242757 - protein, 9 aa, Homo Sapiens
GTKSLDVLK

SEQ ID NO: 1242758 - protein, 9 aa, Homo Sapiens
NIVTLQLFY

SEQ ID NO: 1242759 - protein, 9 aa, Homo Sapiens
QSMIVVPKG

SEQ ID NO: 1242760 - protein, 9 aa, Homo Sapiens
LVPQLPRPH

SEQ ID NO: 1242761 - protein, 9 aa, Homo Sapiens
AERVATERR

SEQ ID NO: 1242762 - protein, 9 aa, Homo Sapiens
ARKKDTHFN

SEQ ID NO: 1242763 - protein, 9 aa, Homo Sapiens
DSTPAFAIF

SEQ ID NO: 1242764 - protein, 9 aa, Homo Sapiens
VGASELEPI

SEQ ID NO: 1242765 - protein, 9 aa, Homo Sapiens
DFLVSLTVL

SEQ ID NO: 1242766 - protein, 9 aa, Homo Sapiens
EVMLSTYFE

SEQ ID NO: 1242767 - protein, 9 aa, Homo Sapiens
MSTREEIVV

SEQ ID NO: 1242768 - protein, 9 aa, Homo Sapiens
SEETSTESW

SEQ ID NO: 1242769 - protein, 9 aa, Homo Sapiens
RQDGEVVCE

SEQ ID NO: 1242770 - protein, 9 aa, Homo Sapiens
KGKRHHAHI

SEQ ID NO: 1242771 - protein, 9 aa, Homo Sapiens
AQGHRLGNG

SEQ ID NO: 1242772 - protein, 9 aa, Homo Sapiens
EEHPRKRGR

SEQ ID NO: 1242773 - protein, 9 aa, Homo Sapiens
KNLAEPNKK

SEQ ID NO: 1242774 - protein, 9 aa, Homo Sapiens
EEAIGIGGF

SEQ ID NO: 1242775 - protein, 9 aa, Homo Sapiens
GDETITTKE

SEQ ID NO: 1242776 - protein, 9 aa, Homo Sapiens
RMYNVRAPT

SEQ ID NO: 1242777 - protein, 9 aa, Homo Sapiens
LLALKVNHS

SEQ ID NO: 1242778 - protein, 9 aa, Homo Sapiens
LSCNEDGYM

SEQ ID NO: 1242779 - protein, 9 aa, Homo Sapiens
LDLKKNVMR

SEQ ID NO: 1242780 - protein, 9 aa, Homo Sapiens
IESVCQRDS

SEQ ID NO: 1242781 - protein, 9 aa, Homo Sapiens
VHELNLEEK

SEQ ID NO: 1242782 - protein, 9 aa, Homo Sapiens
RKSGRTTLH

SEQ ID NO: 1242783 - protein, 9 aa, Homo Sapiens
ITIIVGYIL

SEQ ID NO: 1242784 - protein, 9 aa, Homo Sapiens
AVIKVASLD

SEQ ID NO: 1242785 - protein, 9 aa, Homo Sapiens
TQITTILRE

SEQ ID NO: 1242786 - protein, 9 aa, Homo Sapiens
PRGFKFDMD

SEQ ID NO: 1242787 - protein, 9 aa, Homo Sapiens
WQWGGCRDN

SEQ ID NO: 1242788 - protein, 9 aa, Homo Sapiens
SLQQHFVLR

SEQ ID NO: 1242789 - protein, 9 aa, Homo Sapiens
YGVLCADTC

SEQ ID NO: 1242790 - protein, 9 aa, Homo Sapiens
RCGHSWSGG

SEQ ID NO: 1242791 - protein, 9 aa, Homo Sapiens
SGTEKLLAL

SEQ ID NO: 1242792 - protein, 9 aa, Homo Sapiens
VLGHPHTSC

SEQ ID NO: 1242793 - protein, 9 aa, Homo Sapiens
ALLKKAIDA

SEQ ID NO: 1242794 - protein, 9 aa, Homo Sapiens
CDCYMTSYS

SEQ ID NO: 1242795 - protein, 9 aa, Homo Sapiens
HSLIKGPLS

SEQ ID NO: 1242796 - protein, 9 aa, Homo Sapiens
FRCECAPGS

SEQ ID NO: 1242797 - protein, 9 aa, Homo Sapiens
LIHASLKLK

SEQ ID NO: 1242798 - protein, 9 aa, Homo Sapiens
TAAVSYRLL

SEQ ID NO: 1242799 - protein, 9 aa, Homo Sapiens
TMRIGEPTS

SEQ ID NO: 1242800 - protein, 9 aa, Homo Sapiens
QRQWRMLEA

SEQ ID NO: 1242801 - protein, 9 aa, Homo Sapiens
WQLDKKLDC

SEQ ID NO: 1242802 - protein, 9 aa, Homo Sapiens
ACIGIRGCT

SEQ ID NO: 1242803 - protein, 9 aa, Homo Sapiens
NEGVEQAPT

SEQ ID NO: 1242804 - protein, 9 aa, Homo Sapiens
FLTDANQGR

SEQ ID NO: 1242805 - protein, 9 aa, Homo Sapiens
CSDNCDVCG

SEQ ID NO: 1242806 - protein, 9 aa, Homo Sapiens
WHILLVLSG

SEQ ID NO: 1242807 - protein, 9 aa, Homo Sapiens
NDVFLEADV

SEQ ID NO: 1242808 - protein, 9 aa, Homo Sapiens
CHRLLHQSI

SEQ ID NO: 1242809 - protein, 9 aa, Homo Sapiens
PNKIHMHLI

SEQ ID NO: 1242810 - protein, 9 aa, Homo Sapiens
KVQSAGQIV

SEQ ID NO: 1242811 - protein, 9 aa, Homo Sapiens
LLSTPTRVC

SEQ ID NO: 1242812 - protein, 9 aa, Homo Sapiens
SDEAIVAGP

SEQ ID NO: 1242813 - protein, 9 aa, Homo Sapiens
GSESQGEEE

SEQ ID NO: 1242814 - protein, 9 aa, Homo Sapiens
TMFSNAMLF

SEQ ID NO: 1242815 - protein, 9 aa, Homo Sapiens
QVRELLSEA

SEQ ID NO: 1242816 - protein, 9 aa, Homo Sapiens
GHPRIELLF

SEQ ID NO: 1242817 - protein, 9 aa, Homo Sapiens
QIIFYCDFF

SEQ ID NO: 1242818 - protein, 9 aa, Homo Sapiens
WDIIAQRAS

SEQ ID NO: 1242819 - protein, 9 aa, Homo Sapiens
IVPVTFDCD

SEQ ID NO: 1242820 - protein, 9 aa, Homo Sapiens
RGRCDSIHF

SEQ ID NO: 1242821 - protein, 9 aa, Homo Sapiens
YREYITKKE

SEQ ID NO: 1242822 - protein, 9 aa, Homo Sapiens
NSKFGKGYF

SEQ ID NO: 1242823 - protein, 9 aa, Homo Sapiens
PLDMLLFLN

SEQ ID NO: 1242824 - protein, 9 aa, Homo Sapiens
PIEVAVLLN

SEQ ID NO: 1242825 - protein, 9 aa, Homo Sapiens
CTFLTNLAK

SEQ ID NO: 1242826 - protein, 9 aa, Homo Sapiens
DEQLTPEIC

SEQ ID NO: 1242827 - protein, 9 aa, Homo Sapiens
LPWPCCLAL

SEQ ID NO: 1242828 - protein, 9 aa, Homo Sapiens
KLSFEYVRS

SEQ ID NO: 1242829 - protein, 9 aa, Homo Sapiens
PHSTKARDS

SEQ ID NO: 1242830 - protein, 9 aa, Homo Sapiens
FTSFPILLY

SEQ ID NO: 1242831 - protein, 9 aa, Homo Sapiens
DSQEKGQGG

SEQ ID NO: 1242832 - protein, 9 aa, Homo Sapiens
EGQVTQSSV

SEQ ID NO: 1242833 - protein, 9 aa, Homo Sapiens
CLVLFLIGL

SEQ ID NO: 1242834 - protein, 9 aa, Homo Sapiens
DSVIHLCCK

SEQ ID NO: 1242835 - protein, 9 aa, Homo Sapiens
ITHVDFPPR

SEQ ID NO: 1242836 - protein, 9 aa, Homo Sapiens
PNDLKKGLQ

SEQ ID NO: 1242837 - protein, 9 aa, Homo Sapiens
TDGGGWIIF

SEQ ID NO: 1242838 - protein, 9 aa, Homo Sapiens
ILSRAAGTE

SEQ ID NO: 1242839 - protein, 9 aa, Homo Sapiens
VGNHLNEPL

SEQ ID NO: 1242840 - protein, 9 aa, Homo Sapiens
METFAMGIN

SEQ ID NO: 1242841 - protein, 9 aa, Homo Sapiens
SERSESSVE

SEQ ID NO: 1242842 - protein, 9 aa, Homo Sapiens
LKQEIAKYH

SEQ ID NO: 1242843 - protein, 9 aa, Homo Sapiens
PVFVMEPRQ

SEQ ID NO: 1242844 - protein, 9 aa, Homo Sapiens
DALKGLVDK

SEQ ID NO: 1242845 - protein, 9 aa, Homo Sapiens
GLQIHFVVD

SEQ ID NO: 1242846 - protein, 9 aa, Homo Sapiens
NTGDVCYYA

SEQ ID NO: 1242847 - protein, 9 aa, Homo Sapiens
AQVGTIIAL

SEQ ID NO: 1242848 - protein, 9 aa, Homo Sapiens
KSWIPDVFS

SEQ ID NO: 1242849 - protein, 9 aa, Homo Sapiens
RPHTPGRRS

SEQ ID NO: 1242850 - protein, 9 aa, Homo Sapiens
APRSPASPL

SEQ ID NO: 1242851 - protein, 9 aa, Homo Sapiens
LVGIIIQLR

SEQ ID NO: 1242852 - protein, 9 aa, Homo Sapiens
AFHHSVKAP

SEQ ID NO: 1242853 - protein, 9 aa, Homo Sapiens
RTLKSARSS

SEQ ID NO: 1242854 - protein, 9 aa, Homo Sapiens
MNRIFKRAF

SEQ ID NO: 1242855 - protein, 9 aa, Homo Sapiens
SCVLVHFPP

SEQ ID NO: 1242856 - protein, 9 aa, Homo Sapiens
DGHVFPPSD

SEQ ID NO: 1242857 - protein, 9 aa, Homo Sapiens
SNQSIKDKA

SEQ ID NO: 1242858 - protein, 9 aa, Homo Sapiens
INVTSVAVR

SEQ ID NO: 1242859 - protein, 9 aa, Homo Sapiens
FSGSLPIRV

SEQ ID NO: 1242860 - protein, 9 aa, Homo Sapiens
RGYPPILYW

SEQ ID NO: 1242861 - protein, 9 aa, Homo Sapiens
PPAGPSKVD

SEQ ID NO: 1242862 - protein, 9 aa, Homo Sapiens
MHETILQKR

SEQ ID NO: 1242863 - protein, 9 aa, Homo Sapiens
VHVTKLIDL

SEQ ID NO: 1242864 - protein, 9 aa, Homo Sapiens
LKCDICGMV

SEQ ID NO: 1242865 - protein, 9 aa, Homo Sapiens
KYVAAMPPH

SEQ ID NO: 1242866 - protein, 9 aa, Homo Sapiens
RFITNHSDR

SEQ ID NO: 1242867 - protein, 9 aa, Homo Sapiens
LLGVIAGIV

SEQ ID NO: 1242868 - protein, 9 aa, Homo Sapiens
PQHSMAQQE

SEQ ID NO: 1242869 - protein, 9 aa, Homo Sapiens
VLMALADGP

SEQ ID NO: 1242870 - protein, 9 aa, Homo Sapiens
GHQITSGPS

SEQ ID NO: 1242871 - protein, 9 aa, Homo Sapiens
QKLLYCDVM

SEQ ID NO: 1242872 - protein, 9 aa, Homo Sapiens
RFTLTKLSR

SEQ ID NO: 1242873 - protein, 9 aa, Homo Sapiens
YDHEDCVEM

SEQ ID NO: 1242874 - protein, 9 aa, Homo Sapiens
LVLPDSRVI

SEQ ID NO: 1242875 - protein, 9 aa, Homo Sapiens
FFLRIVHVR

SEQ ID NO: 1242876 - protein, 9 aa, Homo Sapiens
SFVSSWGCN

SEQ ID NO: 1242877 - protein, 9 aa, Homo Sapiens
YLSAQRESA

SEQ ID NO: 1242878 - protein, 9 aa, Homo Sapiens
RTASTSWHC

SEQ ID NO: 1242879 - protein, 9 aa, Homo Sapiens
LEIYTQQKK

SEQ ID NO: 1242880 - protein, 9 aa, Homo Sapiens
GTGKVEIVL

SEQ ID NO: 1242881 - protein, 9 aa, Homo Sapiens
QYSSASNPQ

SEQ ID NO: 1242882 - protein, 9 aa, Homo Sapiens
PSGTHSSRE

SEQ ID NO: 1242883 - protein, 9 aa, Homo Sapiens
MGAFVEISR

SEQ ID NO: 1242884 - protein, 9 aa, Homo Sapiens
TWLDPDPAN

SEQ ID NO: 1242885 - protein, 9 aa, Homo Sapiens
SDQVAFIFH

SEQ ID NO: 1242886 - protein, 9 aa, Homo Sapiens
TPSWSCPSS

SEQ ID NO: 1242887 - protein, 9 aa, Homo Sapiens
VNAIKAECS

SEQ ID NO: 1242888 - protein, 9 aa, Homo Sapiens
LTRLSTGRA

SEQ ID NO: 1242889 - protein, 9 aa, Homo Sapiens
TEPGKPFMS

SEQ ID NO: 1242890 - protein, 9 aa, Homo Sapiens
RRPRTQAME

SEQ ID NO: 1242891 - protein, 9 aa, Homo Sapiens
PLTPGSDWR

SEQ ID NO: 1242892 - protein, 9 aa, Homo Sapiens
GTVAAAVLE

SEQ ID NO: 1242893 - protein, 9 aa, Homo Sapiens
PEEKDTKLA

SEQ ID NO: 1242894 - protein, 9 aa, Homo Sapiens
RSLQRSPAL

SEQ ID NO: 1242895 - protein, 9 aa, Homo Sapiens
TQSMIVVPK

SEQ ID NO: 1242896 - protein, 9 aa, Homo Sapiens
WPDQQLHIF

SEQ ID NO: 1242897 - protein, 9 aa, Homo Sapiens
AVLIYPDRA

SEQ ID NO: 1242898 - protein, 9 aa, Homo Sapiens
YYRFHEYWR

SEQ ID NO: 1242899 - protein, 9 aa, Homo Sapiens
IMSGSRDAT

SEQ ID NO: 1242900 - protein, 9 aa, Homo Sapiens
ENTPFHLSL

SEQ ID NO: 1242901 - protein, 9 aa, Homo Sapiens
SEMRLKHMD

SEQ ID NO: 1242902 - protein, 9 aa, Homo Sapiens
SGPKLPCSS

SEQ ID NO: 1242903 - protein, 9 aa, Homo Sapiens
MPGHAGWLL

SEQ ID NO: 1242904 - protein, 9 aa, Homo Sapiens
NEKHLHASR

SEQ ID NO: 1242905 - protein, 9 aa, Homo Sapiens
DEDYTGATV

SEQ ID NO: 1242906 - protein, 9 aa, Homo Sapiens
MLHHFQKVI

SEQ ID NO: 1242907 - protein, 9 aa, Homo Sapiens
HVDEVMCLA

SEQ ID NO: 1242908 - protein, 9 aa, Homo Sapiens
DLEYLMKRE

SEQ ID NO: 1242909 - protein, 9 aa, Homo Sapiens
KLKNIFMFI

SEQ ID NO: 1242910 - protein, 9 aa, Homo Sapiens
YSILQTAIL

SEQ ID NO: 1242911 - protein, 9 aa, Homo Sapiens
MDVGEMAMV

SEQ ID NO: 1242912 - protein, 9 aa, Homo Sapiens
VGKDGYNYT

SEQ ID NO: 1242913 - protein, 9 aa, Homo Sapiens
FQESSQLAE

SEQ ID NO: 1242914 - protein, 9 aa, Homo Sapiens
DVGQQAVEV

SEQ ID NO: 1242915 - protein, 9 aa, Homo Sapiens
PMLKLSYKE

SEQ ID NO: 1242916 - protein, 9 aa, Homo Sapiens
SRLRTLPGG

SEQ ID NO: 1242917 - protein, 9 aa, Homo Sapiens
DEGDGDIRD

SEQ ID NO: 1242918 - protein, 9 aa, Homo Sapiens
EVTWTWARP

SEQ ID NO: 1242919 - protein, 9 aa, Homo Sapiens
IQYNMEADG

SEQ ID NO: 1242920 - protein, 9 aa, Homo Sapiens
GTSQGCTVP

SEQ ID NO: 1242921 - protein, 9 aa, Homo Sapiens
TNSAEICQY

SEQ ID NO: 1242922 - protein, 9 aa, Homo Sapiens
YRFTADSWE

SEQ ID NO: 1242923 - protein, 9 aa, Homo Sapiens
RRQENFFCA

SEQ ID NO: 1242924 - protein, 9 aa, Homo Sapiens
PASMIGIVC

SEQ ID NO: 1242925 - protein, 9 aa, Homo Sapiens
IQHFFVTRH

SEQ ID NO: 1242926 - protein, 9 aa, Homo Sapiens
SCKQELPEH

SEQ ID NO: 1242927 - protein, 9 aa, Homo Sapiens
ERVLHNVQE

SEQ ID NO: 1242928 - protein, 9 aa, Homo Sapiens
PEARKKDTH

SEQ ID NO: 1242929 - protein, 9 aa, Homo Sapiens
GSGSTTGSV

SEQ ID NO: 1242930 - protein, 9 aa, Homo Sapiens
LELYMSSNF

SEQ ID NO: 1242931 - protein, 9 aa, Homo Sapiens
NVEKTEKIG

SEQ ID NO: 1242932 - protein, 9 aa, Homo Sapiens
QRSPALRAR

SEQ ID NO: 1242933 - protein, 9 aa, Homo Sapiens
KSVLSGANI

SEQ ID NO: 1242934 - protein, 9 aa, Homo Sapiens
FRQTMWWAF

SEQ ID NO: 1242935 - protein, 9 aa, Homo Sapiens
KTAHTTMAG

SEQ ID NO: 1242936 - protein, 9 aa, Homo Sapiens
PQQKLLIKM

SEQ ID NO: 1242937 - protein, 9 aa, Homo Sapiens
TLLHHRRSH

SEQ ID NO: 1242938 - protein, 9 aa, Homo Sapiens
YLLTAEWMS

SEQ ID NO: 1242939 - protein, 9 aa, Homo Sapiens
DHYYRSHND

SEQ ID NO: 1242940 - protein, 9 aa, Homo Sapiens
GDIEDDQAG

SEQ ID NO: 1242941 - protein, 9 aa, Homo Sapiens
TLKATVINY

SEQ ID NO: 1242942 - protein, 9 aa, Homo Sapiens
TWWDLFYKL

SEQ ID NO: 1242943 - protein, 9 aa, Homo Sapiens
DDSRNKRGG

SEQ ID NO: 1242944 - protein, 9 aa, Homo Sapiens
QSLRSSGAS

SEQ ID NO: 1242945 - protein, 9 aa, Homo Sapiens
KECNQDVKY

SEQ ID NO: 1242946 - protein, 9 aa, Homo Sapiens
LDVTNPDFK

SEQ ID NO: 1242947 - protein, 9 aa, Homo Sapiens
HSDIAQRCR

SEQ ID NO: 1242948 - protein, 9 aa, Homo Sapiens
NFGGKGQGW

SEQ ID NO: 1242949 - protein, 9 aa, Homo Sapiens
TEDTSFFVR

SEQ ID NO: 1242950 - protein, 9 aa, Homo Sapiens
VGPYPWWPC

SEQ ID NO: 1242951 - protein, 9 aa, Homo Sapiens
CTHNVVSYA

SEQ ID NO: 1242952 - protein, 9 aa, Homo Sapiens
GESAALGAT

SEQ ID NO: 1242953 - protein, 9 aa, Homo Sapiens
TIITKSAHD

SEQ ID NO: 1242954 - protein, 9 aa, Homo Sapiens
FVTRIHLLD

SEQ ID NO: 1242955 - protein, 9 aa, Homo Sapiens
ACMCQDSML

SEQ ID NO: 1242956 - protein, 9 aa, Homo Sapiens
TTKRKCGYI

SEQ ID NO: 1242957 - protein, 9 aa, Homo Sapiens
TVLCDIKQA

SEQ ID NO: 1242958 - protein, 9 aa, Homo Sapiens
IIADLNELR

SEQ ID NO: 1242959 - protein, 9 aa, Homo Sapiens
LSEAMGFFC

SEQ ID NO: 1242960 - protein, 9 aa, Homo Sapiens
GFIPPFAKF

SEQ ID NO: 1242961 - protein, 9 aa, Homo Sapiens
TSSPRPMEA

SEQ ID NO: 1242962 - protein, 9 aa, Homo Sapiens
NSKIVVVMA

SEQ ID NO: 1242963 - protein, 9 aa, Homo Sapiens
GYEEYYDDY

SEQ ID NO: 1242964 - protein, 9 aa, Homo Sapiens
QLLLLCHLL

SEQ ID NO: 1242965 - protein, 9 aa, Homo Sapiens
TSLSENNMS

SEQ ID NO: 1242966 - protein, 9 aa, Homo Sapiens
CLCPCWVSS

SEQ ID NO: 1242967 - protein, 9 aa, Homo Sapiens
NAFRLFDDD

SEQ ID NO: 1242968 - protein, 9 aa, Homo Sapiens
EALVMAMFK

SEQ ID NO: 1242969 - protein, 9 aa, Homo Sapiens
LLLSSVSAE

SEQ ID NO: 1242970 - protein, 9 aa, Homo Sapiens
GKFMDDPTV

SEQ ID NO: 1242971 - protein, 9 aa, Homo Sapiens
SIPMSTSLL

SEQ ID NO: 1242972 - protein, 9 aa, Homo Sapiens
ILQYSNVYY

SEQ ID NO: 1242973 - protein, 9 aa, Homo Sapiens
FIVVFCPLK

SEQ ID NO: 1242974 - protein, 9 aa, Homo Sapiens
RAVINQKLI

SEQ ID NO: 1242975 - protein, 9 aa, Homo Sapiens
PSDVGLEIM

SEQ ID NO: 1242976 - protein, 9 aa, Homo Sapiens
LHRMPRNPW

SEQ ID NO: 1242977 - protein, 9 aa, Homo Sapiens
QGARCGGNL

SEQ ID NO: 1242978 - protein, 9 aa, Homo Sapiens
SKFGVNAIL

SEQ ID NO: 1242979 - protein, 9 aa, Homo Sapiens
ILQELNASL

SEQ ID NO: 1242980 - protein, 9 aa, Homo Sapiens
LLDYHRALC

SEQ ID NO: 1242981 - protein, 9 aa, Homo Sapiens
LVPSQKSLF

SEQ ID NO: 1242982 - protein, 9 aa, Homo Sapiens
PPSSSTTTC

SEQ ID NO: 1242983 - protein, 9 aa, Homo Sapiens
EKLSLRQVA

SEQ ID NO: 1242984 - protein, 9 aa, Homo Sapiens
TCGQMTSYP

SEQ ID NO: 1242985 - protein, 9 aa, Homo Sapiens
KEGIVALHR

SEQ ID NO: 1242986 - protein, 9 aa, Homo Sapiens
ISRASQTMV

SEQ ID NO: 1242987 - protein, 9 aa, Homo Sapiens
TSLAVTDLL

SEQ ID NO: 1242988 - protein, 9 aa, Homo Sapiens
EEAEEGEHM

SEQ ID NO: 1242989 - protein, 9 aa, Homo Sapiens
RYHHHFPQA

SEQ ID NO: 1242990 - protein, 9 aa, Homo Sapiens
VCVVMDVHD

SEQ ID NO: 1242991 - protein, 9 aa, Homo Sapiens
IWLPVFSSL

SEQ ID NO: 1242992 - protein, 9 aa, Homo Sapiens
HIHHRKFDA

SEQ ID NO: 1242993 - protein, 9 aa, Homo Sapiens
IFLNKLLKI

SEQ ID NO: 1242994 - protein, 9 aa, Homo Sapiens
KPRVWVVPM

SEQ ID NO: 1242995 - protein, 9 aa, Homo Sapiens
KIQTETHQG

SEQ ID NO: 1242996 - protein, 9 aa, Homo Sapiens
LLEVMFALW

SEQ ID NO: 1242997 - protein, 9 aa, Homo Sapiens
HTILWVQAA

SEQ ID NO: 1242998 - protein, 9 aa, Homo Sapiens
KDFSFHFLF

SEQ ID NO: 1242999 - protein, 9 aa, Homo Sapiens
TRKCKAKSC

SEQ ID NO: 1243000 - protein, 9 aa, Homo Sapiens
GHGRATDIW

SEQ ID NO: 1243001 - protein, 9 aa, Homo Sapiens
RLIAMLEVL

SEQ ID NO: 1243002 - protein, 9 aa, Homo Sapiens
LENVVKGHR

SEQ ID NO: 1243003 - protein, 9 aa, Homo Sapiens
LTSLPEPRD

SEQ ID NO: 1243004 - protein, 9 aa, Homo Sapiens
KIEDNEFHC

SEQ ID NO: 1243005 - protein, 9 aa, Homo Sapiens
RTQRQWRML

SEQ ID NO: 1243006 - protein, 9 aa, Homo Sapiens
TWKNSRYLS

SEQ ID NO: 1243007 - protein, 9 aa, Homo Sapiens
HFTLRHWLK

SEQ ID NO: 1243008 - protein, 9 aa, Homo Sapiens
HSRPGSIHT

SEQ ID NO: 1243009 - protein, 9 aa, Homo Sapiens
VRKATQSVL

SEQ ID NO: 1243010 - protein, 9 aa, Homo Sapiens
STKVQHCHY

SEQ ID NO: 1243011 - protein, 9 aa, Homo Sapiens
NHRASTPIN

SEQ ID NO: 1243012 - protein, 9 aa, Homo Sapiens
IRQQELIKG

SEQ ID NO: 1243013 - protein, 9 aa, Homo Sapiens
PATRHGWWA

SEQ ID NO: 1243014 - protein, 9 aa, Homo Sapiens
APAPHPRPT

SEQ ID NO: 1243015 - protein, 9 aa, Homo Sapiens
HYLGSLQPP

SEQ ID NO: 1243016 - protein, 9 aa, Homo Sapiens
PSRCLCFHT

SEQ ID NO: 1243017 - protein, 9 aa, Homo Sapiens
LLRTMGIRQ

SEQ ID NO: 1243018 - protein, 9 aa, Homo Sapiens
APDPCCGAT

SEQ ID NO: 1243019 - protein, 9 aa, Homo Sapiens
IYTDVRELV

SEQ ID NO: 1243020 - protein, 9 aa, Homo Sapiens
AISAIAIFL

SEQ ID NO: 1243021 - protein, 9 aa, Homo Sapiens
TSGHQSSSV

SEQ ID NO: 1243022 - protein, 9 aa, Homo Sapiens
KMTPHKSQA

SEQ ID NO: 1243023 - protein, 9 aa, Homo Sapiens
FVMTCQEYV

SEQ ID NO: 1243024 - protein, 9 aa, Homo Sapiens
LEDEATYTS

SEQ ID NO: 1243025 - protein, 9 aa, Homo Sapiens
FSVQVTTIQ

SEQ ID NO: 1243026 - protein, 9 aa, Homo Sapiens
QRWQLQKQE

SEQ ID NO: 1243027 - protein, 9 aa, Homo Sapiens
MNDSKGGEK

SEQ ID NO: 1243028 - protein, 9 aa, Homo Sapiens
VCRDQRCVS

SEQ ID NO: 1243029 - protein, 9 aa, Homo Sapiens
KKMSSDSHK

SEQ ID NO: 1243030 - protein, 9 aa, Homo Sapiens
TDFLLETTV

SEQ ID NO: 1243031 - protein, 9 aa, Homo Sapiens
QVCPLTTEK

SEQ ID NO: 1243032 - protein, 9 aa, Homo Sapiens
SITVNIAGL

SEQ ID NO: 1243033 - protein, 9 aa, Homo Sapiens
YIKGTVKVE

SEQ ID NO: 1243034 - protein, 9 aa, Homo Sapiens
ITLDIQAAQ

SEQ ID NO: 1243035 - protein, 9 aa, Homo Sapiens
GMLQMNDLV

SEQ ID NO: 1243036 - protein, 9 aa, Homo Sapiens
IKQQQYAGL

SEQ ID NO: 1243037 - protein, 9 aa, Homo Sapiens
PLLQHPQQK

SEQ ID NO: 1243038 - protein, 9 aa, Homo Sapiens
HVSKMALAY

SEQ ID NO: 1243039 - protein, 9 aa, Homo Sapiens
TGTTRVAYL

SEQ ID NO: 1243040 - protein, 9 aa, Homo Sapiens
KTFPQSSLT

SEQ ID NO: 1243041 - protein, 9 aa, Homo Sapiens
EPCTIPSGA

SEQ ID NO: 1243042 - protein, 9 aa, Homo Sapiens
LVKLQGECV

SEQ ID NO: 1243043 - protein, 9 aa, Homo Sapiens
PRAQCVVLE

SEQ ID NO: 1243044 - protein, 9 aa, Homo Sapiens
ALKDVKKEL

SEQ ID NO: 1243045 - protein, 9 aa, Homo Sapiens
SQHQRSPSL

SEQ ID NO: 1243046 - protein, 9 aa, Homo Sapiens
LEGNNLVYS

SEQ ID NO: 1243047 - protein, 9 aa, Homo Sapiens
EIGSHHLGF

SEQ ID NO: 1243048 - protein, 9 aa, Homo Sapiens
FYKTMLHKP

SEQ ID NO: 1243049 - protein, 9 aa, Homo Sapiens
GNMQSLSGE

SEQ ID NO: 1243050 - protein, 9 aa, Homo Sapiens
ANRFTKASQ

SEQ ID NO: 1243051 - protein, 9 aa, Homo Sapiens
THKQRITAS

SEQ ID NO: 1243052 - protein, 9 aa, Homo Sapiens
RRHMVVQCG

SEQ ID NO: 1243053 - protein, 9 aa, Homo Sapiens
LKKSYEDAL

SEQ ID NO: 1243054 - protein, 9 aa, Homo Sapiens
KWMNERGRD

SEQ ID NO: 1243055 - protein, 9 aa, Homo Sapiens
EPTHTGHLW

SEQ ID NO: 1243056 - protein, 9 aa, Homo Sapiens
ISEGEARSL

SEQ ID NO: 1243057 - protein, 9 aa, Homo Sapiens
NCILFVNSR

SEQ ID NO: 1243058 - protein, 9 aa, Homo Sapiens
PDTVPLGTE

SEQ ID NO: 1243059 - protein, 9 aa, Homo Sapiens
HMSFGVVLG

SEQ ID NO: 1243060 - protein, 9 aa, Homo Sapiens
PDKKHKLEI

SEQ ID NO: 1243061 - protein, 9 aa, Homo Sapiens
PETWTAAAM

SEQ ID NO: 1243062 - protein, 9 aa, Homo Sapiens
DSPIKKEEN

SEQ ID NO: 1243063 - protein, 9 aa, Homo Sapiens
KVLIYQKKY

SEQ ID NO: 1243064 - protein, 9 aa, Homo Sapiens
VKMAPNHGL

SEQ ID NO: 1243065 - protein, 9 aa, Homo Sapiens
NSYDIYIHV

SEQ ID NO: 1243066 - protein, 9 aa, Homo Sapiens
RNIYHSHHP

SEQ ID NO: 1243067 - protein, 9 aa, Homo Sapiens
FVYLRSRNL

SEQ ID NO: 1243068 - protein, 9 aa, Homo Sapiens
LTFTSGILT

SEQ ID NO: 1243069 - protein, 9 aa, Homo Sapiens
SSVPWSAGC

SEQ ID NO: 1243070 - protein, 9 aa, Homo Sapiens
TAPSQDTDS

SEQ ID NO: 1243071 - protein, 9 aa, Homo Sapiens
LNQQDEIDI

SEQ ID NO: 1243072 - protein, 9 aa, Homo Sapiens
GLHRVRPPG

SEQ ID NO: 1243073 - protein, 9 aa, Homo Sapiens
GLTQKMISE

SEQ ID NO: 1243074 - protein, 9 aa, Homo Sapiens
KIACILPVL

SEQ ID NO: 1243075 - protein, 9 aa, Homo Sapiens
ILTSKLLHE

SEQ ID NO: 1243076 - protein, 9 aa, Homo Sapiens
EKSEDQGLQ

SEQ ID NO: 1243077 - protein, 9 aa, Homo Sapiens
SDDFCQPPD

SEQ ID NO: 1243078 - protein, 9 aa, Homo Sapiens
LMETVEDWE

SEQ ID NO: 1243079 - protein, 9 aa, Homo Sapiens
RIGGSEEMD

SEQ ID NO: 1243080 - protein, 9 aa, Homo Sapiens
ATTPNATFN

SEQ ID NO: 1243081 - protein, 9 aa, Homo Sapiens
VDVQSAICL

SEQ ID NO: 1243082 - protein, 9 aa, Homo Sapiens
PQIKPLERH

SEQ ID NO: 1243083 - protein, 9 aa, Homo Sapiens
GTETVIDKS

SEQ ID NO: 1243084 - protein, 9 aa, Homo Sapiens
KNEINHSLS

SEQ ID NO: 1243085 - protein, 9 aa, Homo Sapiens
TGWVNAAIG

SEQ ID NO: 1243086 - protein, 9 aa, Homo Sapiens
NVYKCDDCG

SEQ ID NO: 1243087 - protein, 9 aa, Homo Sapiens
RLTQGMNIQ

SEQ ID NO: 1243088 - protein, 9 aa, Homo Sapiens
AAATMLPAQ

SEQ ID NO: 1243089 - protein, 9 aa, Homo Sapiens
RQGIFPHGI

SEQ ID NO: 1243090 - protein, 9 aa, Homo Sapiens
RAEEEAVSL

SEQ ID NO: 1243091 - protein, 9 aa, Homo Sapiens
GQRPIFCPV

SEQ ID NO: 1243092 - protein, 9 aa, Homo Sapiens
QIRCNTQGT

SEQ ID NO: 1243093 - protein, 9 aa, Homo Sapiens
IQRHVNVSI

SEQ ID NO: 1243094 - protein, 9 aa, Homo Sapiens
ELNDFMNVL

SEQ ID NO: 1243095 - protein, 9 aa, Homo Sapiens
SVGDATAPA

SEQ ID NO: 1243096 - protein, 9 aa, Homo Sapiens
SRPPARRSG

SEQ ID NO: 1243097 - protein, 9 aa, Homo Sapiens
EEVHQAILN

SEQ ID NO: 1243098 - protein, 9 aa, Homo Sapiens
HVQHFHKHQ

SEQ ID NO: 1243099 - protein, 9 aa, Homo Sapiens
ELKATADEF

SEQ ID NO: 1243100 - protein, 9 aa, Homo Sapiens
IMNGQGLAG

SEQ ID NO: 1243101 - protein, 9 aa, Homo Sapiens
SKCMVEKIL

SEQ ID NO: 1243102 - protein, 9 aa, Homo Sapiens
SILLFLFSS

SEQ ID NO: 1243103 - protein, 9 aa, Homo Sapiens
HPISTQNPD

SEQ ID NO: 1243104 - protein, 9 aa, Homo Sapiens
SPTFPDHLG

SEQ ID NO: 1243105 - protein, 9 aa, Homo Sapiens
ALIGMSDLP

SEQ ID NO: 1243106 - protein, 9 aa, Homo Sapiens
TLQLFYLSA

SEQ ID NO: 1243107 - protein, 9 aa, Homo Sapiens
AHCPLDLRP

SEQ ID NO: 1243108 - protein, 9 aa, Homo Sapiens
ARQELGLRI

SEQ ID NO: 1243109 - protein, 9 aa, Homo Sapiens
HMIVIFISY

SEQ ID NO: 1243110 - protein, 9 aa, Homo Sapiens
CTCLVTLMQ

SEQ ID NO: 1243111 - protein, 9 aa, Homo Sapiens
VTLLLTLLL

SEQ ID NO: 1243112 - protein, 9 aa, Homo Sapiens
RTMVEKSEP

SEQ ID NO: 1243113 - protein, 9 aa, Homo Sapiens
IGWLDDFLM

SEQ ID NO: 1243114 - protein, 9 aa, Homo Sapiens
IAKLIHVIH

SEQ ID NO: 1243115 - protein, 9 aa, Homo Sapiens
PLASPGATL

SEQ ID NO: 1243116 - protein, 9 aa, Homo Sapiens
EDRPQARTL

SEQ ID NO: 1243117 - protein, 9 aa, Homo Sapiens
MPFINGDVI

SEQ ID NO: 1243118 - protein, 9 aa, Homo Sapiens
TQASCQPRH

SEQ ID NO: 1243119 - protein, 9 aa, Homo Sapiens
PSETEQGIR

SEQ ID NO: 1243120 - protein, 9 aa, Homo Sapiens
KILDEVVAQ

SEQ ID NO: 1243121 - protein, 9 aa, Homo Sapiens
PVAVLDFWV

SEQ ID NO: 1243122 - protein, 9 aa, Homo Sapiens
LFYTPNSSH

SEQ ID NO: 1243123 - protein, 9 aa, Homo Sapiens
VDATRGQVC

SEQ ID NO: 1243124 - protein, 9 aa, Homo Sapiens
MNMNKQSKM

SEQ ID NO: 1243125 - protein, 9 aa, Homo Sapiens
SRTAPCTTA

SEQ ID NO: 1243126 - protein, 9 aa, Homo Sapiens
TSPDKLKNI

SEQ ID NO: 1243127 - protein, 9 aa, Homo Sapiens
LTFPVPPEC

SEQ ID NO: 1243128 - protein, 9 aa, Homo Sapiens
YDFECGRRG

SEQ ID NO: 1243129 - protein, 9 aa, Homo Sapiens
CRALGFENV

SEQ ID NO: 1243130 - protein, 9 aa, Homo Sapiens
VSLQERGGV

SEQ ID NO: 1243131 - protein, 9 aa, Homo Sapiens
SALNRIQVR

SEQ ID NO: 1243132 - protein, 9 aa, Homo Sapiens
LAEQQRHIL

SEQ ID NO: 1243133 - protein, 9 aa, Homo Sapiens
QREWEAAAE

SEQ ID NO: 1243134 - protein, 9 aa, Homo Sapiens
ICLVLVSYL

SEQ ID NO: 1243135 - protein, 9 aa, Homo Sapiens
QTARTHPKT

SEQ ID NO: 1243136 - protein, 9 aa, Homo Sapiens
RGTVRVCDL

SEQ ID NO: 1243137 - protein, 9 aa, Homo Sapiens
DFTLSNRYM

SEQ ID NO: 1243138 - protein, 9 aa, Homo Sapiens
LYQFSRCFH

SEQ ID NO: 1243139 - protein, 9 aa, Homo Sapiens
SGIALSFLD

SEQ ID NO: 1243140 - protein, 9 aa, Homo Sapiens
VVMDVHDST

SEQ ID NO: 1243141 - protein, 9 aa, Homo Sapiens
HVYPLLNCM

SEQ ID NO: 1243142 - protein, 9 aa, Homo Sapiens
SLPSVNQIG

SEQ ID NO: 1243143 - protein, 9 aa, Homo Sapiens
VEEEGYDGK

SEQ ID NO: 1243144 - protein, 9 aa, Homo Sapiens
YFGVKTAMY

SEQ ID NO: 1243145 - protein, 9 aa, Homo Sapiens
FQTGPQLQA

SEQ ID NO: 1243146 - protein, 9 aa, Homo Sapiens
QEADKKRQC

SEQ ID NO: 1243147 - protein, 9 aa, Homo Sapiens
IIVCSTQGV

SEQ ID NO: 1243148 - protein, 9 aa, Homo Sapiens
GFKHFCDGK

SEQ ID NO: 1243149 - protein, 9 aa, Homo Sapiens
VSFEGLKVH

SEQ ID NO: 1243150 - protein, 9 aa, Homo Sapiens
HRPTEQELR

SEQ ID NO: 1243151 - protein, 9 aa, Homo Sapiens
RDSAQAKHK

SEQ ID NO: 1243152 - protein, 9 aa, Homo Sapiens
KSGTPFLSS

SEQ ID NO: 1243153 - protein, 9 aa, Homo Sapiens
MYHFDLGYI

SEQ ID NO: 1243154 - protein, 9 aa, Homo Sapiens
KESESHILI

SEQ ID NO: 1243155 - protein, 9 aa, Homo Sapiens
LCEAPSPLM

SEQ ID NO: 1243156 - protein, 9 aa, Homo Sapiens
TATRVTTPT

SEQ ID NO: 1243157 - protein, 9 aa, Homo Sapiens
EAALRADPS

SEQ ID NO: 1243158 - protein, 9 aa, Homo Sapiens
GSEEDIDTS

SEQ ID NO: 1243159 - protein, 9 aa, Homo Sapiens
HNETYRHIV

SEQ ID NO: 1243160 - protein, 9 aa, Homo Sapiens
VQGVQVQLV

SEQ ID NO: 1243161 - protein, 9 aa, Homo Sapiens
CYPERITIL

SEQ ID NO: 1243162 - protein, 9 aa, Homo Sapiens
LQFAGMNIS

SEQ ID NO: 1243163 - protein, 9 aa, Homo Sapiens
ETAETFDVV

SEQ ID NO: 1243164 - protein, 9 aa, Homo Sapiens
VGPVQVGKE

SEQ ID NO: 1243165 - protein, 9 aa, Homo Sapiens
AYHAVEVDR

SEQ ID NO: 1243166 - protein, 9 aa, Homo Sapiens
LFTLCLYVL

SEQ ID NO: 1243167 - protein, 9 aa, Homo Sapiens
FYVVECITM

SEQ ID NO: 1243168 - protein, 9 aa, Homo Sapiens
SEDTKSPLY

SEQ ID NO: 1243169 - protein, 9 aa, Homo Sapiens
VGLLEGSAE

SEQ ID NO: 1243170 - protein, 9 aa, Homo Sapiens
EKASSISPV

SEQ ID NO: 1243171 - protein, 9 aa, Homo Sapiens
ITRKKVSLV

SEQ ID NO: 1243172 - protein, 9 aa, Homo Sapiens
WEPAQEAPL

SEQ ID NO: 1243173 - protein, 9 aa, Homo Sapiens
LPVMSGDAL

SEQ ID NO: 1243174 - protein, 9 aa, Homo Sapiens
PPPVTSPSS

SEQ ID NO: 1243175 - protein, 9 aa, Homo Sapiens
AAQGLQEGQ

SEQ ID NO: 1243176 - protein, 9 aa, Homo Sapiens
ENPNDLQFW

SEQ ID NO: 1243177 - protein, 9 aa, Homo Sapiens
KSIEPGGIG

SEQ ID NO: 1243178 - protein, 9 aa, Homo Sapiens
HLAIARQRI

SEQ ID NO: 1243179 - protein, 9 aa, Homo Sapiens
QTFSSYAPE

SEQ ID NO: 1243180 - protein, 9 aa, Homo Sapiens
TGGTFVFRG

SEQ ID NO: 1243181 - protein, 9 aa, Homo Sapiens
EGHRRPPLH

SEQ ID NO: 1243182 - protein, 9 aa, Homo Sapiens
QEVENLVRV

SEQ ID NO: 1243183 - protein, 9 aa, Homo Sapiens
KMVLMATVL

SEQ ID NO: 1243184 - protein, 9 aa, Homo Sapiens
DGQILHVPN

SEQ ID NO: 1243185 - protein, 9 aa, Homo Sapiens
RTLLEGSDL

SEQ ID NO: 1243186 - protein, 9 aa, Homo Sapiens
GGTDGVAWT

SEQ ID NO: 1243187 - protein, 9 aa, Homo Sapiens
PPLIPYYSN

SEQ ID NO: 1243188 - protein, 9 aa, Homo Sapiens
ARAGALRAH

SEQ ID NO: 1243189 - protein, 9 aa, Homo Sapiens
WGGDRFHHY

SEQ ID NO: 1243190 - protein, 9 aa, Homo Sapiens
GDATAPAGL

SEQ ID NO: 1243191 - protein, 9 aa, Homo Sapiens
TVKLCQTTG

SEQ ID NO: 1243192 - protein, 9 aa, Homo Sapiens
QKGRYVGAA

SEQ ID NO: 1243193 - protein, 9 aa, Homo Sapiens
PECYGHVLS

SEQ ID NO: 1243194 - protein, 9 aa, Homo Sapiens
RTKLTETRV

SEQ ID NO: 1243195 - protein, 9 aa, Homo Sapiens
EDKERPFHC

SEQ ID NO: 1243196 - protein, 9 aa, Homo Sapiens
HVTIHATPE

SEQ ID NO: 1243197 - protein, 9 aa, Homo Sapiens
KALDPAHWT

SEQ ID NO: 1243198 - protein, 9 aa, Homo Sapiens
NKDAQMRAV

SEQ ID NO: 1243199 - protein, 9 aa, Homo Sapiens
IVCLIRKLL

SEQ ID NO: 1243200 - protein, 9 aa, Homo Sapiens
WKSKSELQV

SEQ ID NO: 1243201 - protein, 9 aa, Homo Sapiens
LVAPTQYHI

SEQ ID NO: 1243202 - protein, 9 aa, Homo Sapiens
SARVIDGKE

SEQ ID NO: 1243203 - protein, 9 aa, Homo Sapiens
EFILWCLAR

SEQ ID NO: 1243204 - protein, 9 aa, Homo Sapiens
LRIQAEQTS

SEQ ID NO: 1243205 - protein, 9 aa, Homo Sapiens
PRSAVDISP

SEQ ID NO: 1243206 - protein, 9 aa, Homo Sapiens
SRDYLATYY

SEQ ID NO: 1243207 - protein, 9 aa, Homo Sapiens
LLGGCLACD

SEQ ID NO: 1243208 - protein, 9 aa, Homo Sapiens
EMQLMAAMS

SEQ ID NO: 1243209 - protein, 9 aa, Homo Sapiens
KGDVMIAIT

SEQ ID NO: 1243210 - protein, 9 aa, Homo Sapiens
KLWLQKNQD

SEQ ID NO: 1243211 - protein, 9 aa, Homo Sapiens
IYFGTHTHK

SEQ ID NO: 1243212 - protein, 9 aa, Homo Sapiens
KNPQLHAAI

SEQ ID NO: 1243213 - protein, 9 aa, Homo Sapiens
PKAQPLRVG

SEQ ID NO: 1243214 - protein, 9 aa, Homo Sapiens
LPLKGGLSW

SEQ ID NO: 1243215 - protein, 9 aa, Homo Sapiens
EALHRVAVQ

SEQ ID NO: 1243216 - protein, 9 aa, Homo Sapiens
PYLKTFLYN

SEQ ID NO: 1243217 - protein, 9 aa, Homo Sapiens
YVVITPSKS

SEQ ID NO: 1243218 - protein, 9 aa, Homo Sapiens
TPFANSPSD

SEQ ID NO: 1243219 - protein, 9 aa, Homo Sapiens
HIDQNMYPN

SEQ ID NO: 1243220 - protein, 9 aa, Homo Sapiens
SGECQSNGE

SEQ ID NO: 1243221 - protein, 9 aa, Homo Sapiens
RPPVTAFVR

SEQ ID NO: 1243222 - protein, 9 aa, Homo Sapiens
YGKPGGSLF

SEQ ID NO: 1243223 - protein, 9 aa, Homo Sapiens
FMDLKIKLA

SEQ ID NO: 1243224 - protein, 9 aa, Homo Sapiens
FQQLAPAVR

SEQ ID NO: 1243225 - protein, 9 aa, Homo Sapiens
RPAGLIIVH

SEQ ID NO: 1243226 - protein, 9 aa, Homo Sapiens
LDHPKARNE

SEQ ID NO: 1243227 - protein, 9 aa, Homo Sapiens
RDEYQHHSL

SEQ ID NO: 1243228 - protein, 9 aa, Homo Sapiens
QECLTFTSG

SEQ ID NO: 1243229 - protein, 9 aa, Homo Sapiens
TERQSMKSE

SEQ ID NO: 1243230 - protein, 9 aa, Homo Sapiens
RMTPLSAEI

SEQ ID NO: 1243231 - protein, 9 aa, Homo Sapiens
EGNCSNYPA

SEQ ID NO: 1243232 - protein, 9 aa, Homo Sapiens
TSLAVGFYV

SEQ ID NO: 1243233 - protein, 9 aa, Homo Sapiens
QVAFHVGLH

SEQ ID NO: 1243234 - protein, 9 aa, Homo Sapiens
VFSSKVTLQ

SEQ ID NO: 1243235 - protein, 9 aa, Homo Sapiens
RWPTMLDKS

SEQ ID NO: 1243236 - protein, 9 aa, Homo Sapiens
VHNHQPRIN

SEQ ID NO: 1243237 - protein, 9 aa, Homo Sapiens
HTKPQPDVD

SEQ ID NO: 1243238 - protein, 9 aa, Homo Sapiens
CGCSKGGCG

SEQ ID NO: 1243239 - protein, 9 aa, Homo Sapiens
TMSRFCEAE

SEQ ID NO: 1243240 - protein, 9 aa, Homo Sapiens
FMEPWASAA

SEQ ID NO: 1243241 - protein, 9 aa, Homo Sapiens
SYMTICKEF

SEQ ID NO: 1243242 - protein, 9 aa, Homo Sapiens
AVKAGHSYD

SEQ ID NO: 1243243 - protein, 9 aa, Homo Sapiens
QWWKTNTHL

SEQ ID NO: 1243244 - protein, 9 aa, Homo Sapiens
ASLCSEQSN

SEQ ID NO: 1243245 - protein, 9 aa, Homo Sapiens
TGKQEGANL

SEQ ID NO: 1243246 - protein, 9 aa, Homo Sapiens
PVPQIKPLE

SEQ ID NO: 1243247 - protein, 9 aa, Homo Sapiens
QSSDGSWAG

SEQ ID NO: 1243248 - protein, 9 aa, Homo Sapiens
TSACKRRRM

SEQ ID NO: 1243249 - protein, 9 aa, Homo Sapiens
KKNKAVNMI

SEQ ID NO: 1243250 - protein, 9 aa, Homo Sapiens
SGSHCTPPS

SEQ ID NO: 1243251 - protein, 9 aa, Homo Sapiens
QRDVVDFDV

SEQ ID NO: 1243252 - protein, 9 aa, Homo Sapiens
KNSRYLSKG

SEQ ID NO: 1243253 - protein, 9 aa, Homo Sapiens
KRPQAMASH

SEQ ID NO: 1243254 - protein, 9 aa, Homo Sapiens
EVLVNFMKD

SEQ ID NO: 1243255 - protein, 9 aa, Homo Sapiens
TCLAIDPLR

SEQ ID NO: 1243256 - protein, 9 aa, Homo Sapiens
TSFCLKHCQ

SEQ ID NO: 1243257 - protein, 9 aa, Homo Sapiens
VLEVAGTKV

SEQ ID NO: 1243258 - protein, 9 aa, Homo Sapiens
SQIGRVVEN

SEQ ID NO: 1243259 - protein, 9 aa, Homo Sapiens
QHLPHLYMY

SEQ ID NO: 1243260 - protein, 9 aa, Homo Sapiens
AHMATHRAG

SEQ ID NO: 1243261 - protein, 9 aa, Homo Sapiens
VACWTVDEV

SEQ ID NO: 1243262 - protein, 9 aa, Homo Sapiens
ASKPIVHSR

SEQ ID NO: 1243263 - protein, 9 aa, Homo Sapiens
VGNVVNEGF

SEQ ID NO: 1243264 - protein, 9 aa, Homo Sapiens
TLTYTGTHR

SEQ ID NO: 1243265 - protein, 9 aa, Homo Sapiens
LRVYFNLPE

SEQ ID NO: 1243266 - protein, 9 aa, Homo Sapiens
SMSEITSET

SEQ ID NO: 1243267 - protein, 9 aa, Homo Sapiens
RRKTINFDG

SEQ ID NO: 1243268 - protein, 9 aa, Homo Sapiens
GCCLVLFLI

SEQ ID NO: 1243269 - protein, 9 aa, Homo Sapiens
VTKQRGILD

SEQ ID NO: 1243270 - protein, 9 aa, Homo Sapiens
KKPAKSKLA

SEQ ID NO: 1243271 - protein, 9 aa, Homo Sapiens
GRRPRYDYR

SEQ ID NO: 1243272 - protein, 9 aa, Homo Sapiens
DSISRTPHW

SEQ ID NO: 1243273 - protein, 9 aa, Homo Sapiens
ITGSLIIGS

SEQ ID NO: 1243274 - protein, 9 aa, Homo Sapiens
AEDLAPKLL

SEQ ID NO: 1243275 - protein, 9 aa, Homo Sapiens
IYAAVKHTQ

SEQ ID NO: 1243276 - protein, 9 aa, Homo Sapiens
KCQQICRWH

SEQ ID NO: 1243277 - protein, 9 aa, Homo Sapiens
LRTDCFHCT

SEQ ID NO: 1243278 - protein, 9 aa, Homo Sapiens
NVLMPNWLH

SEQ ID NO: 1243279 - protein, 9 aa, Homo Sapiens
EVLVQDKCV

SEQ ID NO: 1243280 - protein, 9 aa, Homo Sapiens
RFRSVRSRL

SEQ ID NO: 1243281 - protein, 9 aa, Homo Sapiens
GHSYDSKKQ

SEQ ID NO: 1243282 - protein, 9 aa, Homo Sapiens
VKVWFQNRQ

SEQ ID NO: 1243283 - protein, 9 aa, Homo Sapiens
VLVYNQDEW

SEQ ID NO: 1243284 - protein, 9 aa, Homo Sapiens
RKDREFIEI

SEQ ID NO: 1243285 - protein, 9 aa, Homo Sapiens
QQVTLRYSP

SEQ ID NO: 1243286 - protein, 9 aa, Homo Sapiens
REVRPQVSL

SEQ ID NO: 1243287 - protein, 9 aa, Homo Sapiens
SMHHEIEGT

SEQ ID NO: 1243288 - protein, 9 aa, Homo Sapiens
CPPSPATRH

SEQ ID NO: 1243289 - protein, 9 aa, Homo Sapiens
LIRELDPLL

SEQ ID NO: 1243290 - protein, 9 aa, Homo Sapiens
PTIVSHKEW

SEQ ID NO: 1243291 - protein, 9 aa, Homo Sapiens
KQEGANLLC

SEQ ID NO: 1243292 - protein, 9 aa, Homo Sapiens
NGMSRRAGC

SEQ ID NO: 1243293 - protein, 9 aa, Homo Sapiens
LVGWYPFHD

SEQ ID NO: 1243294 - protein, 9 aa, Homo Sapiens
VEKETVLKN

SEQ ID NO: 1243295 - protein, 9 aa, Homo Sapiens
VMQLPLCEK

SEQ ID NO: 1243296 - protein, 9 aa, Homo Sapiens
AHRHSLVEK

SEQ ID NO: 1243297 - protein, 9 aa, Homo Sapiens
KSIMKVMIP

SEQ ID NO: 1243298 - protein, 9 aa, Homo Sapiens
FPIIRFCHP

SEQ ID NO: 1243299 - protein, 9 aa, Homo Sapiens
LRQREWEAA

SEQ ID NO: 1243300 - protein, 9 aa, Homo Sapiens
FFYQRRHGF

SEQ ID NO: 1243301 - protein, 9 aa, Homo Sapiens
HLTSCVWPD

SEQ ID NO: 1243302 - protein, 9 aa, Homo Sapiens
ALVVFVGIK

SEQ ID NO: 1243303 - protein, 9 aa, Homo Sapiens
IVSVFYTVI

SEQ ID NO: 1243304 - protein, 9 aa, Homo Sapiens
TFSMSSTLI

SEQ ID NO: 1243305 - protein, 9 aa, Homo Sapiens
IYVILRKCE

SEQ ID NO: 1243306 - protein, 9 aa, Homo Sapiens
GMMKNHSLR

SEQ ID NO: 1243307 - protein, 9 aa, Homo Sapiens
SCPPSSLAG

SEQ ID NO: 1243308 - protein, 9 aa, Homo Sapiens
QDRVHDFDC

SEQ ID NO: 1243309 - protein, 9 aa, Homo Sapiens
VCIVMRQSK

SEQ ID NO: 1243310 - protein, 9 aa, Homo Sapiens
RNECGKTFS

SEQ ID NO: 1243311 - protein, 9 aa, Homo Sapiens
CLHYPPSYK

SEQ ID NO: 1243312 - protein, 9 aa, Homo Sapiens
SPSMCSKVR

SEQ ID NO: 1243313 - protein, 9 aa, Homo Sapiens
MDQWMDKET

SEQ ID NO: 1243314 - protein, 9 aa, Homo Sapiens
MLCISELLS

SEQ ID NO: 1243315 - protein, 9 aa, Homo Sapiens
TPHFSAGKA

SEQ ID NO: 1243316 - protein, 9 aa, Homo Sapiens
YGKDTTTSM

SEQ ID NO: 1243317 - protein, 9 aa, Homo Sapiens
ASNGYRTLQ

SEQ ID NO: 1243318 - protein, 9 aa, Homo Sapiens
TRQSGGATA

SEQ ID NO: 1243319 - protein, 9 aa, Homo Sapiens
VSNSLMGIF

SEQ ID NO: 1243320 - protein, 9 aa, Homo Sapiens
QEECIEFYE

SEQ ID NO: 1243321 - protein, 9 aa, Homo Sapiens
GLSLWVCEA

SEQ ID NO: 1243322 - protein, 9 aa, Homo Sapiens
EADVSLSAL

SEQ ID NO: 1243323 - protein, 9 aa, Homo Sapiens
ITSPSRQQG

SEQ ID NO: 1243324 - protein, 9 aa, Homo Sapiens
PMRGAKEPT

SEQ ID NO: 1243325 - protein, 9 aa, Homo Sapiens
PLLWNMTSS

SEQ ID NO: 1243326 - protein, 9 aa, Homo Sapiens
SLDVLKIHV

SEQ ID NO: 1243327 - protein, 9 aa, Homo Sapiens
TPKRERMML

SEQ ID NO: 1243328 - protein, 9 aa, Homo Sapiens
FEWHRGYII

SEQ ID NO: 1243329 - protein, 9 aa, Homo Sapiens
YRYDGLGWR

SEQ ID NO: 1243330 - protein, 9 aa, Homo Sapiens
ECVIRAMKK

SEQ ID NO: 1243331 - protein, 9 aa, Homo Sapiens
SYFGSMGPQ

SEQ ID NO: 1243332 - protein, 9 aa, Homo Sapiens
PERSSSEDT

SEQ ID NO: 1243333 - protein, 9 aa, Homo Sapiens
QPVKMAPNH

SEQ ID NO: 1243334 - protein, 9 aa, Homo Sapiens
HGGSSGDRG

SEQ ID NO: 1243335 - protein, 9 aa, Homo Sapiens
PDVVSSGLN

SEQ ID NO: 1243336 - protein, 9 aa, Homo Sapiens
KEDRPQART

SEQ ID NO: 1243337 - protein, 9 aa, Homo Sapiens
FIAKVSPPV

SEQ ID NO: 1243338 - protein, 9 aa, Homo Sapiens
SKHSLHRKK

SEQ ID NO: 1243339 - protein, 9 aa, Homo Sapiens
GPSCARSRR

SEQ ID NO: 1243340 - protein, 9 aa, Homo Sapiens
LQTQGSHDF

SEQ ID NO: 1243341 - protein, 9 aa, Homo Sapiens
PTKVTFVGS

SEQ ID NO: 1243342 - protein, 9 aa, Homo Sapiens
AVWVLNNGQ

SEQ ID NO: 1243343 - protein, 9 aa, Homo Sapiens
GLCYQISCV

SEQ ID NO: 1243344 - protein, 9 aa, Homo Sapiens
DCGCLLLYG

SEQ ID NO: 1243345 - protein, 9 aa, Homo Sapiens
DNISSCMDN

SEQ ID NO: 1243346 - protein, 9 aa, Homo Sapiens
YYKIKDGDG

SEQ ID NO: 1243347 - protein, 9 aa, Homo Sapiens
LKTPIAFRM

SEQ ID NO: 1243348 - protein, 9 aa, Homo Sapiens
SNCTTVSLT

SEQ ID NO: 1243349 - protein, 9 aa, Homo Sapiens
ERQQNQQVE

SEQ ID NO: 1243350 - protein, 9 aa, Homo Sapiens
RHIHTGNKP

SEQ ID NO: 1243351 - protein, 9 aa, Homo Sapiens
MSPFYQWMD

SEQ ID NO: 1243352 - protein, 9 aa, Homo Sapiens
KFFFDRSPS

SEQ ID NO: 1243353 - protein, 9 aa, Homo Sapiens
LSCLERDGI

SEQ ID NO: 1243354 - protein, 9 aa, Homo Sapiens
SPVHGAPGP

SEQ ID NO: 1243355 - protein, 9 aa, Homo Sapiens
RKPRTFSKQ

SEQ ID NO: 1243356 - protein, 9 aa, Homo Sapiens
TVAEKLHVA

SEQ ID NO: 1243357 - protein, 9 aa, Homo Sapiens
PYPRPAFAG

SEQ ID NO: 1243358 - protein, 9 aa, Homo Sapiens
QNSYFYRSS

SEQ ID NO: 1243359 - protein, 9 aa, Homo Sapiens
DSLITLTFQ

SEQ ID NO: 1243360 - protein, 9 aa, Homo Sapiens
HVTWITSFY

SEQ ID NO: 1243361 - protein, 9 aa, Homo Sapiens
KKRKKIHQK

SEQ ID NO: 1243362 - protein, 9 aa, Homo Sapiens
RGKWWGEEV

SEQ ID NO: 1243363 - protein, 9 aa, Homo Sapiens
PVRGVKFVE

SEQ ID NO: 1243364 - protein, 9 aa, Homo Sapiens
GDVIRQSLP

SEQ ID NO: 1243365 - protein, 9 aa, Homo Sapiens
INFDGRLPA

SEQ ID NO: 1243366 - protein, 9 aa, Homo Sapiens
LAKVNREQC

SEQ ID NO: 1243367 - protein, 9 aa, Homo Sapiens
KECTAPTPA

SEQ ID NO: 1243368 - protein, 9 aa, Homo Sapiens
ELTLEGIHQ

SEQ ID NO: 1243369 - protein, 9 aa, Homo Sapiens
EARCREEGL

SEQ ID NO: 1243370 - protein, 9 aa, Homo Sapiens
IPHQKDPVL

SEQ ID NO: 1243371 - protein, 9 aa, Homo Sapiens
ELGPDGATL

SEQ ID NO: 1243372 - protein, 9 aa, Homo Sapiens
LTYYIAFVE

SEQ ID NO: 1243373 - protein, 9 aa, Homo Sapiens
ASVLVESVF

SEQ ID NO: 1243374 - protein, 9 aa, Homo Sapiens
TSRRYNPES

SEQ ID NO: 1243375 - protein, 9 aa, Homo Sapiens
ITGFGILGY

SEQ ID NO: 1243376 - protein, 9 aa, Homo Sapiens
QQYPGDIGY

SEQ ID NO: 1243377 - protein, 9 aa, Homo Sapiens
EKKLLVSLE

SEQ ID NO: 1243378 - protein, 9 aa, Homo Sapiens
KHQSTSFWL

SEQ ID NO: 1243379 - protein, 9 aa, Homo Sapiens
MDSHKQPVA

SEQ ID NO: 1243380 - protein, 9 aa, Homo Sapiens
HAEPYPTSR

SEQ ID NO: 1243381 - protein, 9 aa, Homo Sapiens
ILTCCQCCP

SEQ ID NO: 1243382 - protein, 9 aa, Homo Sapiens
RASFSEAKN

SEQ ID NO: 1243383 - protein, 9 aa, Homo Sapiens
IQVLLFGTC

SEQ ID NO: 1243384 - protein, 9 aa, Homo Sapiens
AQPVSSAQD

SEQ ID NO: 1243385 - protein, 9 aa, Homo Sapiens
DEWAWNDVP

SEQ ID NO: 1243386 - protein, 9 aa, Homo Sapiens
HMVPGRPAA

SEQ ID NO: 1243387 - protein, 9 aa, Homo Sapiens
MEVVSILLC

SEQ ID NO: 1243388 - protein, 9 aa, Homo Sapiens
VQLMWIRQQ

SEQ ID NO: 1243389 - protein, 9 aa, Homo Sapiens
EDEFVGEST

SEQ ID NO: 1243390 - protein, 9 aa, Homo Sapiens
EDEPRKKYM

SEQ ID NO: 1243391 - protein, 9 aa, Homo Sapiens
PIPCSAVHI

SEQ ID NO: 1243392 - protein, 9 aa, Homo Sapiens
ANMEWIMKA

SEQ ID NO: 1243393 - protein, 9 aa, Homo Sapiens
HHPSFLSYT

SEQ ID NO: 1243394 - protein, 9 aa, Homo Sapiens
RGTKSTPWQ

SEQ ID NO: 1243395 - protein, 9 aa, Homo Sapiens
QEHEEKIMK

SEQ ID NO: 1243396 - protein, 9 aa, Homo Sapiens
GLGREDLPT

SEQ ID NO: 1243397 - protein, 9 aa, Homo Sapiens
IIIRNIQEP

SEQ ID NO: 1243398 - protein, 9 aa, Homo Sapiens
SELQVTKQR

SEQ ID NO: 1243399 - protein, 9 aa, Homo Sapiens
AKKWKPAWT

SEQ ID NO: 1243400 - protein, 9 aa, Homo Sapiens
SNSKKSNWI

SEQ ID NO: 1243401 - protein, 9 aa, Homo Sapiens
ECCMLPYYT

SEQ ID NO: 1243402 - protein, 9 aa, Homo Sapiens
LAFTHLNSP

SEQ ID NO: 1243403 - protein, 9 aa, Homo Sapiens
TAAHYLVGT

SEQ ID NO: 1243404 - protein, 9 aa, Homo Sapiens
LDIGDFTLQ

SEQ ID NO: 1243405 - protein, 9 aa, Homo Sapiens
QCLPGFSDS

SEQ ID NO: 1243406 - protein, 9 aa, Homo Sapiens
FDDNYDRSM

SEQ ID NO: 1243407 - protein, 9 aa, Homo Sapiens
LSGDFKKPV

SEQ ID NO: 1243408 - protein, 9 aa, Homo Sapiens
RNILDRNQT

SEQ ID NO: 1243409 - protein, 9 aa, Homo Sapiens
SKVFVCAFS

SEQ ID NO: 1243410 - protein, 9 aa, Homo Sapiens
INLDVTNPD

SEQ ID NO: 1243411 - protein, 9 aa, Homo Sapiens
DPVLPSEAN

SEQ ID NO: 1243412 - protein, 9 aa, Homo Sapiens
SFNSYRTME

SEQ ID NO: 1243413 - protein, 9 aa, Homo Sapiens
GIRDPLLGM

SEQ ID NO: 1243414 - protein, 9 aa, Homo Sapiens
ENFRNSFVL

SEQ ID NO: 1243415 - protein, 9 aa, Homo Sapiens
PTLVSSVPK

SEQ ID NO: 1243416 - protein, 9 aa, Homo Sapiens
TRKKVSLVM

SEQ ID NO: 1243417 - protein, 9 aa, Homo Sapiens
QTRPRRLSQ

SEQ ID NO: 1243418 - protein, 9 aa, Homo Sapiens
FVSVLTLLY

SEQ ID NO: 1243419 - protein, 9 aa, Homo Sapiens
IGWAGSSLC

SEQ ID NO: 1243420 - protein, 9 aa, Homo Sapiens
RELPSAQIR

SEQ ID NO: 1243421 - protein, 9 aa, Homo Sapiens
PPVTAFVRA

SEQ ID NO: 1243422 - protein, 9 aa, Homo Sapiens
LSPPQTPQH

SEQ ID NO: 1243423 - protein, 9 aa, Homo Sapiens
QKQTIEHLE

SEQ ID NO: 1243424 - protein, 9 aa, Homo Sapiens
VKGLREART

SEQ ID NO: 1243425 - protein, 9 aa, Homo Sapiens
CFWETHPLG

SEQ ID NO: 1243426 - protein, 9 aa, Homo Sapiens
AAVQRIVRV

SEQ ID NO: 1243427 - protein, 9 aa, Homo Sapiens
KHKKSYILL

SEQ ID NO: 1243428 - protein, 9 aa, Homo Sapiens
RTLISDIET

SEQ ID NO: 1243429 - protein, 9 aa, Homo Sapiens
CIGTVQHLN

SEQ ID NO: 1243430 - protein, 9 aa, Homo Sapiens
WCERVMGNL

SEQ ID NO: 1243431 - protein, 9 aa, Homo Sapiens
AVLSSATAT

SEQ ID NO: 1243432 - protein, 9 aa, Homo Sapiens
SWLRPDQRL

SEQ ID NO: 1243433 - protein, 9 aa, Homo Sapiens
RHRLSELRL

SEQ ID NO: 1243434 - protein, 9 aa, Homo Sapiens
NTTFKTDMY

SEQ ID NO: 1243435 - protein, 9 aa, Homo Sapiens
SYHLKKYSL

SEQ ID NO: 1243436 - protein, 9 aa, Homo Sapiens
RRKIVTMDS

SEQ ID NO: 1243437 - protein, 9 aa, Homo Sapiens
MSTLSAHII

SEQ ID NO: 1243438 - protein, 9 aa, Homo Sapiens
SRTHTILWV

SEQ ID NO: 1243439 - protein, 9 aa, Homo Sapiens
WKFMDMMQI

SEQ ID NO: 1243440 - protein, 9 aa, Homo Sapiens
LVPAPPPEE

SEQ ID NO: 1243441 - protein, 9 aa, Homo Sapiens
IQAEQELDD

SEQ ID NO: 1243442 - protein, 9 aa, Homo Sapiens
RAGGLPAQC

SEQ ID NO: 1243443 - protein, 9 aa, Homo Sapiens
QLWLIILLC

SEQ ID NO: 1243444 - protein, 9 aa, Homo Sapiens
QNTLISFFD

SEQ ID NO: 1243445 - protein, 9 aa, Homo Sapiens
TGKAVSTPL

SEQ ID NO: 1243446 - protein, 9 aa, Homo Sapiens
NKGTPRLQT

SEQ ID NO: 1243447 - protein, 9 aa, Homo Sapiens
FGILGYSQN

SEQ ID NO: 1243448 - protein, 9 aa, Homo Sapiens
LCKLSFEYV

SEQ ID NO: 1243449 - protein, 9 aa, Homo Sapiens
IHKMLSPDD

SEQ ID NO: 1243450 - protein, 9 aa, Homo Sapiens
TTYRQLSNG

SEQ ID NO: 1243451 - protein, 9 aa, Homo Sapiens
PSTRTLEPP

SEQ ID NO: 1243452 - protein, 9 aa, Homo Sapiens
IVLIAESCG

SEQ ID NO: 1243453 - protein, 9 aa, Homo Sapiens
DRGLFYYHL

SEQ ID NO: 1243454 - protein, 9 aa, Homo Sapiens
ESTLLKTLA

SEQ ID NO: 1243455 - protein, 9 aa, Homo Sapiens
QLSLEMPET

SEQ ID NO: 1243456 - protein, 9 aa, Homo Sapiens
IKLNAENTG

SEQ ID NO: 1243457 - protein, 9 aa, Homo Sapiens
IDVDTKFLA

SEQ ID NO: 1243458 - protein, 9 aa, Homo Sapiens
KQTIEHLEQ

SEQ ID NO: 1243459 - protein, 9 aa, Homo Sapiens
SYVSKIKQK

SEQ ID NO: 1243460 - protein, 9 aa, Homo Sapiens
KHVMKTTTR

SEQ ID NO: 1243461 - protein, 9 aa, Homo Sapiens
NLEKLVEEH

SEQ ID NO: 1243462 - protein, 9 aa, Homo Sapiens
RRRTPQPLT

SEQ ID NO: 1243463 - protein, 9 aa, Homo Sapiens
DQALWAGLA

SEQ ID NO: 1243464 - protein, 9 aa, Homo Sapiens
GICSLEELP

SEQ ID NO: 1243465 - protein, 9 aa, Homo Sapiens
HRIKMQRAG

SEQ ID NO: 1243466 - protein, 9 aa, Homo Sapiens
GKHFGTTLN

SEQ ID NO: 1243467 - protein, 9 aa, Homo Sapiens
LAKSVRDHY

SEQ ID NO: 1243468 - protein, 9 aa, Homo Sapiens
AKHPALCSR

SEQ ID NO: 1243469 - protein, 9 aa, Homo Sapiens
QGAMFRLST

SEQ ID NO: 1243470 - protein, 9 aa, Homo Sapiens
GWMVAGLMI

SEQ ID NO: 1243471 - protein, 9 aa, Homo Sapiens
SHWDPPEEE

SEQ ID NO: 1243472 - protein, 9 aa, Homo Sapiens
TFAPSPTPD

SEQ ID NO: 1243473 - protein, 9 aa, Homo Sapiens
LFVDKTFPQ

SEQ ID NO: 1243474 - protein, 9 aa, Homo Sapiens
VQIIFYCDF

SEQ ID NO: 1243475 - protein, 9 aa, Homo Sapiens
ATFSIINIY

SEQ ID NO: 1243476 - protein, 9 aa, Homo Sapiens
EHVFNDELP

SEQ ID NO: 1243477 - protein, 9 aa, Homo Sapiens
VHNMELVKI

SEQ ID NO: 1243478 - protein, 9 aa, Homo Sapiens
RQLSNGDHH

SEQ ID NO: 1243479 - protein, 9 aa, Homo Sapiens
LGDAGMQLL

SEQ ID NO: 1243480 - protein, 9 aa, Homo Sapiens
KTAMYFAWL

SEQ ID NO: 1243481 - protein, 9 aa, Homo Sapiens
YTYKSKMAF

SEQ ID NO: 1243482 - protein, 9 aa, Homo Sapiens
CEAPRGYPP

SEQ ID NO: 1243483 - protein, 9 aa, Homo Sapiens
DWVVTADHC

SEQ ID NO: 1243484 - protein, 9 aa, Homo Sapiens
SHAYERFTG

SEQ ID NO: 1243485 - protein, 9 aa, Homo Sapiens
QQPLQSGSG

SEQ ID NO: 1243486 - protein, 9 aa, Homo Sapiens
SSLRNAVNF

SEQ ID NO: 1243487 - protein, 9 aa, Homo Sapiens
DRNQTHAIY

SEQ ID NO: 1243488 - protein, 9 aa, Homo Sapiens
NFTWKMEHQ

SEQ ID NO: 1243489 - protein, 9 aa, Homo Sapiens
HAPQPYASS

SEQ ID NO: 1243490 - protein, 9 aa, Homo Sapiens
LRLYYDILE

SEQ ID NO: 1243491 - protein, 9 aa, Homo Sapiens
ATEHLEAEI

SEQ ID NO: 1243492 - protein, 9 aa, Homo Sapiens
KILILIMKV

SEQ ID NO: 1243493 - protein, 9 aa, Homo Sapiens
YTNPIAKLI

SEQ ID NO: 1243494 - protein, 9 aa, Homo Sapiens
KDIHHMFVR

SEQ ID NO: 1243495 - protein, 9 aa, Homo Sapiens
GYDIATPKG

SEQ ID NO: 1243496 - protein, 9 aa, Homo Sapiens
NQFGPPMII

SEQ ID NO: 1243497 - protein, 9 aa, Homo Sapiens
EEQREEWKK

SEQ ID NO: 1243498 - protein, 9 aa, Homo Sapiens
LDPLLCHSD

SEQ ID NO: 1243499 - protein, 9 aa, Homo Sapiens
IDSSDFVLD

SEQ ID NO: 1243500 - protein, 9 aa, Homo Sapiens
QLHVQLGGL

SEQ ID NO: 1243501 - protein, 9 aa, Homo Sapiens
PIRCDCVIC

SEQ ID NO: 1243502 - protein, 9 aa, Homo Sapiens
AKKMRQGEA

SEQ ID NO: 1243503 - protein, 9 aa, Homo Sapiens
FGVNVDSLN

SEQ ID NO: 1243504 - protein, 9 aa, Homo Sapiens
NVKFKILDE

SEQ ID NO: 1243505 - protein, 9 aa, Homo Sapiens
NSEETSTES

SEQ ID NO: 1243506 - protein, 9 aa, Homo Sapiens
KAISGIALS

SEQ ID NO: 1243507 - protein, 9 aa, Homo Sapiens
EYAISNAET

SEQ ID NO: 1243508 - protein, 9 aa, Homo Sapiens
TIIHGIKFH

SEQ ID NO: 1243509 - protein, 9 aa, Homo Sapiens
KDIPSSEQP

SEQ ID NO: 1243510 - protein, 9 aa, Homo Sapiens
QSVLWNCAS

SEQ ID NO: 1243511 - protein, 9 aa, Homo Sapiens
FNRVNIAYL

SEQ ID NO: 1243512 - protein, 9 aa, Homo Sapiens
PRTRPQKPI

SEQ ID NO: 1243513 - protein, 9 aa, Homo Sapiens
WGGCRDNLK

SEQ ID NO: 1243514 - protein, 9 aa, Homo Sapiens
HLKKYSLHE

SEQ ID NO: 1243515 - protein, 9 aa, Homo Sapiens
LITYIGMIF

SEQ ID NO: 1243516 - protein, 9 aa, Homo Sapiens
KTHHAYAEY

SEQ ID NO: 1243517 - protein, 9 aa, Homo Sapiens
NEIHIDPGT

SEQ ID NO: 1243518 - protein, 9 aa, Homo Sapiens
DDLDDSVSS

SEQ ID NO: 1243519 - protein, 9 aa, Homo Sapiens
MYIPSGICS

SEQ ID NO: 1243520 - protein, 9 aa, Homo Sapiens
LMASVPPVF

SEQ ID NO: 1243521 - protein, 9 aa, Homo Sapiens
RAPAANLEA

SEQ ID NO: 1243522 - protein, 9 aa, Homo Sapiens
ASTGTYTLT

SEQ ID NO: 1243523 - protein, 9 aa, Homo Sapiens
TVGPRHVQN

SEQ ID NO: 1243524 - protein, 9 aa, Homo Sapiens
VNKLWYKPM

SEQ ID NO: 1243525 - protein, 9 aa, Homo Sapiens
FPIKIILRA

SEQ ID NO: 1243526 - protein, 9 aa, Homo Sapiens
TRGKGSMGP

SEQ ID NO: 1243527 - protein, 9 aa, Homo Sapiens
KKWKPAWTD

SEQ ID NO: 1243528 - protein, 9 aa, Homo Sapiens
DPPATATAA

SEQ ID NO: 1243529 - protein, 9 aa, Homo Sapiens
MPHVSVSKV

SEQ ID NO: 1243530 - protein, 9 aa, Homo Sapiens
MMWHIYVSL

SEQ ID NO: 1243531 - protein, 9 aa, Homo Sapiens
DFSYLRRMS

SEQ ID NO: 1243532 - protein, 9 aa, Homo Sapiens
RAHPAQGLA

SEQ ID NO: 1243533 - protein, 9 aa, Homo Sapiens
VQRIVRVPI

SEQ ID NO: 1243534 - protein, 9 aa, Homo Sapiens
FNTYKKEMA

SEQ ID NO: 1243535 - protein, 9 aa, Homo Sapiens
SGEFAPDSR

SEQ ID NO: 1243536 - protein, 9 aa, Homo Sapiens
CGTNVFSPM

SEQ ID NO: 1243537 - protein, 9 aa, Homo Sapiens
RERNQESPN

SEQ ID NO: 1243538 - protein, 9 aa, Homo Sapiens
LACIGIRGC

SEQ ID NO: 1243539 - protein, 9 aa, Homo Sapiens
CPPPRAPPA

SEQ ID NO: 1243540 - protein, 9 aa, Homo Sapiens
LSSFFCCFH

SEQ ID NO: 1243541 - protein, 9 aa, Homo Sapiens
PPAMKCYLL

SEQ ID NO: 1243542 - protein, 9 aa, Homo Sapiens
DRDVTYSCI

SEQ ID NO: 1243543 - protein, 9 aa, Homo Sapiens
PFEPHTAVK

SEQ ID NO: 1243544 - protein, 9 aa, Homo Sapiens
TTIAENIHY

SEQ ID NO: 1243545 - protein, 9 aa, Homo Sapiens
EHYENGAFQ

SEQ ID NO: 1243546 - protein, 9 aa, Homo Sapiens
EVRHIYTAF

SEQ ID NO: 1243547 - protein, 9 aa, Homo Sapiens
AVTRLTRSK

SEQ ID NO: 1243548 - protein, 9 aa, Homo Sapiens
PRSTRCCWC

SEQ ID NO: 1243549 - protein, 9 aa, Homo Sapiens
ENKPIITPS

SEQ ID NO: 1243550 - protein, 9 aa, Homo Sapiens
RTPSCQDWK

SEQ ID NO: 1243551 - protein, 9 aa, Homo Sapiens
YLASLQSLE

SEQ ID NO: 1243552 - protein, 9 aa, Homo Sapiens
GSLIIGSIN

SEQ ID NO: 1243553 - protein, 9 aa, Homo Sapiens
MPAFLDNHN

SEQ ID NO: 1243554 - protein, 9 aa, Homo Sapiens
LTIVVYMAV

SEQ ID NO: 1243555 - protein, 9 aa, Homo Sapiens
IRFNVYCFR

SEQ ID NO: 1243556 - protein, 9 aa, Homo Sapiens
EWCHAHGMR

SEQ ID NO: 1243557 - protein, 9 aa, Homo Sapiens
ADINIRLIR

SEQ ID NO: 1243558 - protein, 9 aa, Homo Sapiens
STLTKAKLR

SEQ ID NO: 1243559 - protein, 9 aa, Homo Sapiens
SKKALANVL

SEQ ID NO: 1243560 - protein, 9 aa, Homo Sapiens
HIQLIMIFC

SEQ ID NO: 1243561 - protein, 9 aa, Homo Sapiens
SQWMWCLFI

SEQ ID NO: 1243562 - protein, 9 aa, Homo Sapiens
DITLLDLIN

SEQ ID NO: 1243563 - protein, 9 aa, Homo Sapiens
PVNFQLYMD

SEQ ID NO: 1243564 - protein, 9 aa, Homo Sapiens
LYSLHTQEY

SEQ ID NO: 1243565 - protein, 9 aa, Homo Sapiens
SSFMISNGI

SEQ ID NO: 1243566 - protein, 9 aa, Homo Sapiens
QDENPLPAA

SEQ ID NO: 1243567 - protein, 9 aa, Homo Sapiens
LDSLGRPTQ

SEQ ID NO: 1243568 - protein, 9 aa, Homo Sapiens
ISSALAIVF

SEQ ID NO: 1243569 - protein, 9 aa, Homo Sapiens
LHQPKKYMN

SEQ ID NO: 1243570 - protein, 9 aa, Homo Sapiens
SALPSLPAR

SEQ ID NO: 1243571 - protein, 9 aa, Homo Sapiens
YVCIANNAA

SEQ ID NO: 1243572 - protein, 9 aa, Homo Sapiens
HFLFGIYQQ

SEQ ID NO: 1243573 - protein, 9 aa, Homo Sapiens
ALRANTDPS

SEQ ID NO: 1243574 - protein, 9 aa, Homo Sapiens
RPMYSRLEH

SEQ ID NO: 1243575 - protein, 9 aa, Homo Sapiens
CGADPRRLL

SEQ ID NO: 1243576 - protein, 9 aa, Homo Sapiens
HTTWWDLFY

SEQ ID NO: 1243577 - protein, 9 aa, Homo Sapiens
HQQIHTGRK

SEQ ID NO: 1243578 - protein, 9 aa, Homo Sapiens
TFVFVDQRA

SEQ ID NO: 1243579 - protein, 9 aa, Homo Sapiens
KKEGEKSTY

SEQ ID NO: 1243580 - protein, 9 aa, Homo Sapiens
VLRMALGEG

SEQ ID NO: 1243581 - protein, 9 aa, Homo Sapiens
KFMDCPYNL

SEQ ID NO: 1243582 - protein, 9 aa, Homo Sapiens
LHEDFHASD

SEQ ID NO: 1243583 - protein, 9 aa, Homo Sapiens
VMSLLFITS

SEQ ID NO: 1243584 - protein, 9 aa, Homo Sapiens
TGVRDPTDV

SEQ ID NO: 1243585 - protein, 9 aa, Homo Sapiens
RSYCIFTIY

SEQ ID NO: 1243586 - protein, 9 aa, Homo Sapiens
AAVIDEIVN

SEQ ID NO: 1243587 - protein, 9 aa, Homo Sapiens
RYIVLIAES

SEQ ID NO: 1243588 - protein, 9 aa, Homo Sapiens
WMRRKGQQR

SEQ ID NO: 1243589 - protein, 9 aa, Homo Sapiens
DVVKIPEET

SEQ ID NO: 1243590 - protein, 9 aa, Homo Sapiens
VDVLDEAES

SEQ ID NO: 1243591 - protein, 9 aa, Homo Sapiens
TRIFLNKLL

SEQ ID NO: 1243592 - protein, 9 aa, Homo Sapiens
DLGTLAGYF

SEQ ID NO: 1243593 - protein, 9 aa, Homo Sapiens
YYLATVDVD

SEQ ID NO: 1243594 - protein, 9 aa, Homo Sapiens
PFWGVVADH

SEQ ID NO: 1243595 - protein, 9 aa, Homo Sapiens
DNQWEVRIV

SEQ ID NO: 1243596 - protein, 9 aa, Homo Sapiens
KGKISECSQ

SEQ ID NO: 1243597 - protein, 9 aa, Homo Sapiens
MKRLDSKVN

SEQ ID NO: 1243598 - protein, 9 aa, Homo Sapiens
PPPISKQAT

SEQ ID NO: 1243599 - protein, 9 aa, Homo Sapiens
PLILQSDRN

SEQ ID NO: 1243600 - protein, 9 aa, Homo Sapiens
DSAVSNTPL

SEQ ID NO: 1243601 - protein, 9 aa, Homo Sapiens
DRCPLNIYY

SEQ ID NO: 1243602 - protein, 9 aa, Homo Sapiens
PGEEWERCP

SEQ ID NO: 1243603 - protein, 9 aa, Homo Sapiens
SDLERILAR

SEQ ID NO: 1243604 - protein, 9 aa, Homo Sapiens
AILVCCLIF

SEQ ID NO: 1243605 - protein, 9 aa, Homo Sapiens
NAHSDCCIK

SEQ ID NO: 1243606 - protein, 9 aa, Homo Sapiens
MSPKLMIYL

SEQ ID NO: 1243607 - protein, 9 aa, Homo Sapiens
AIALLQQPR

SEQ ID NO: 1243608 - protein, 9 aa, Homo Sapiens
FEGFGIDGT

SEQ ID NO: 1243609 - protein, 9 aa, Homo Sapiens
CHISSSACE

SEQ ID NO: 1243610 - protein, 9 aa, Homo Sapiens
AMPSDLIIS

SEQ ID NO: 1243611 - protein, 9 aa, Homo Sapiens
TSFWVAEVI

SEQ ID NO: 1243612 - protein, 9 aa, Homo Sapiens
IFDLPEEHQ

SEQ ID NO: 1243613 - protein, 9 aa, Homo Sapiens
VPGSPEECG

SEQ ID NO: 1243614 - protein, 9 aa, Homo Sapiens
YDSHGSTLS

SEQ ID NO: 1243615 - protein, 9 aa, Homo Sapiens
EIKLDDSDI

SEQ ID NO: 1243616 - protein, 9 aa, Homo Sapiens
VPRLLINQD

SEQ ID NO: 1243617 - protein, 9 aa, Homo Sapiens
THPLVSQAQ

SEQ ID NO: 1243618 - protein, 9 aa, Homo Sapiens
RTEICNLSV

SEQ ID NO: 1243619 - protein, 9 aa, Homo Sapiens
GPLPPLQFL

SEQ ID NO: 1243620 - protein, 9 aa, Homo Sapiens
PPLHRACAH

SEQ ID NO: 1243621 - protein, 9 aa, Homo Sapiens
VFVNKRKKC

SEQ ID NO: 1243622 - protein, 9 aa, Homo Sapiens
PIPQHTIQK

SEQ ID NO: 1243623 - protein, 9 aa, Homo Sapiens
ALYRLSILT

SEQ ID NO: 1243624 - protein, 9 aa, Homo Sapiens
VVGLMMGIS

SEQ ID NO: 1243625 - protein, 9 aa, Homo Sapiens
LPRQPSTPE

SEQ ID NO: 1243626 - protein, 9 aa, Homo Sapiens
LKKRGNHIT

SEQ ID NO: 1243627 - protein, 9 aa, Homo Sapiens
LLGITQASC

SEQ ID NO: 1243628 - protein, 9 aa, Homo Sapiens
RVAVTAKHL

SEQ ID NO: 1243629 - protein, 9 aa, Homo Sapiens
PEFEAIIWD

SEQ ID NO: 1243630 - protein, 9 aa, Homo Sapiens
AGGGIEDEI

SEQ ID NO: 1243631 - protein, 9 aa, Homo Sapiens
LVDMQHFRY

SEQ ID NO: 1243632 - protein, 9 aa, Homo Sapiens
ASSIIAVIC

SEQ ID NO: 1243633 - protein, 9 aa, Homo Sapiens
FNLTMSYHS

SEQ ID NO: 1243634 - protein, 9 aa, Homo Sapiens
STPAFAIFK

SEQ ID NO: 1243635 - protein, 9 aa, Homo Sapiens
YDLDTFVNK

SEQ ID NO: 1243636 - protein, 9 aa, Homo Sapiens
TNEPSQAVS

SEQ ID NO: 1243637 - protein, 9 aa, Homo Sapiens
SCDYIPGSG

SEQ ID NO: 1243638 - protein, 9 aa, Homo Sapiens
SSATATVSA

SEQ ID NO: 1243639 - protein, 9 aa, Homo Sapiens
LSITGKAGA

SEQ ID NO: 1243640 - protein, 9 aa, Homo Sapiens
HSFELDENA

SEQ ID NO: 1243641 - protein, 9 aa, Homo Sapiens
CSKPREVFG

SEQ ID NO: 1243642 - protein, 9 aa, Homo Sapiens
GHSTLGQGL

SEQ ID NO: 1243643 - protein, 9 aa, Homo Sapiens
LSFPQHSMA

SEQ ID NO: 1243644 - protein, 9 aa, Homo Sapiens
SFLLLRRQL

SEQ ID NO: 1243645 - protein, 9 aa, Homo Sapiens
LILPAVLGI

SEQ ID NO: 1243646 - protein, 9 aa, Homo Sapiens
QMHLLKSEH

SEQ ID NO: 1243647 - protein, 9 aa, Homo Sapiens
SHNWTEDME

SEQ ID NO: 1243648 - protein, 9 aa, Homo Sapiens
KPATKSISA

SEQ ID NO: 1243649 - protein, 9 aa, Homo Sapiens
LEGLFGCMR

SEQ ID NO: 1243650 - protein, 9 aa, Homo Sapiens
TYHWSRSHE

SEQ ID NO: 1243651 - protein, 9 aa, Homo Sapiens
LRGPWRGPW

SEQ ID NO: 1243652 - protein, 9 aa, Homo Sapiens
LPRAPPEAP

SEQ ID NO: 1243653 - protein, 9 aa, Homo Sapiens
GEMTKVQDF

SEQ ID NO: 1243654 - protein, 9 aa, Homo Sapiens
KSLVQKLHP

SEQ ID NO: 1243655 - protein, 9 aa, Homo Sapiens
LGECVTEVK

SEQ ID NO: 1243656 - protein, 9 aa, Homo Sapiens
LMRLFGIPY

SEQ ID NO: 1243657 - protein, 9 aa, Homo Sapiens
HQKNTTVSH

SEQ ID NO: 1243658 - protein, 9 aa, Homo Sapiens
IPQLNNVLE

SEQ ID NO: 1243659 - protein, 9 aa, Homo Sapiens
KMKSYIYVY

SEQ ID NO: 1243660 - protein, 9 aa, Homo Sapiens
SCSTEAYML

SEQ ID NO: 1243661 - protein, 9 aa, Homo Sapiens
HLDGHQQGV

SEQ ID NO: 1243662 - protein, 9 aa, Homo Sapiens
VARLETLVC

SEQ ID NO: 1243663 - protein, 9 aa, Homo Sapiens
CPSIRKMEC

SEQ ID NO: 1243664 - protein, 9 aa, Homo Sapiens
YPSIMAGKF

SEQ ID NO: 1243665 - protein, 9 aa, Homo Sapiens
AGHSYDSKK

SEQ ID NO: 1243666 - protein, 9 aa, Homo Sapiens
VRCFYVGLL

SEQ ID NO: 1243667 - protein, 9 aa, Homo Sapiens
QRNHTVCYD

SEQ ID NO: 1243668 - protein, 9 aa, Homo Sapiens
TAEPAESSM

SEQ ID NO: 1243669 - protein, 9 aa, Homo Sapiens
QWSDLITFL

SEQ ID NO: 1243670 - protein, 9 aa, Homo Sapiens
YDLLAWFEI

SEQ ID NO: 1243671 - protein, 9 aa, Homo Sapiens
CLPSYPPPP

SEQ ID NO: 1243672 - protein, 9 aa, Homo Sapiens
GGITEEPST

SEQ ID NO: 1243673 - protein, 9 aa, Homo Sapiens
PAQAMKLIV

SEQ ID NO: 1243674 - protein, 9 aa, Homo Sapiens
GSCVLVHFP

SEQ ID NO: 1243675 - protein, 9 aa, Homo Sapiens
EAILDKFGG

SEQ ID NO: 1243676 - protein, 9 aa, Homo Sapiens
VHLLESKTY

SEQ ID NO: 1243677 - protein, 9 aa, Homo Sapiens
IQRVSLEQL

SEQ ID NO: 1243678 - protein, 9 aa, Homo Sapiens
TFNLKGVLN

SEQ ID NO: 1243679 - protein, 9 aa, Homo Sapiens
KECQEEADS

SEQ ID NO: 1243680 - protein, 9 aa, Homo Sapiens
LLFFLVTTM

SEQ ID NO: 1243681 - protein, 9 aa, Homo Sapiens
TPVLTIVPH

SEQ ID NO: 1243682 - protein, 9 aa, Homo Sapiens
DEGDEFDDW

SEQ ID NO: 1243683 - protein, 9 aa, Homo Sapiens
IMAGKFCII

SEQ ID NO: 1243684 - protein, 9 aa, Homo Sapiens
RCTRMVDIP

SEQ ID NO: 1243685 - protein, 9 aa, Homo Sapiens
QQYSKGGEH

SEQ ID NO: 1243686 - protein, 9 aa, Homo Sapiens
KQCLKDHGS

SEQ ID NO: 1243687 - protein, 9 aa, Homo Sapiens
VAQMSNYQE

SEQ ID NO: 1243688 - protein, 9 aa, Homo Sapiens
TMKVSEKIV

SEQ ID NO: 1243689 - protein, 9 aa, Homo Sapiens
SENSVAERL

SEQ ID NO: 1243690 - protein, 9 aa, Homo Sapiens
VHTGLGELL

SEQ ID NO: 1243691 - protein, 9 aa, Homo Sapiens
RYLHVANPV

SEQ ID NO: 1243692 - protein, 9 aa, Homo Sapiens
SPPHPVLLS

SEQ ID NO: 1243693 - protein, 9 aa, Homo Sapiens
VGRDGQGHG

SEQ ID NO: 1243694 - protein, 9 aa, Homo Sapiens
KQDPVKTEM

SEQ ID NO: 1243695 - protein, 9 aa, Homo Sapiens
SSFKKYQRH

SEQ ID NO: 1243696 - protein, 9 aa, Homo Sapiens
WWGLQSKIE

SEQ ID NO: 1243697 - protein, 9 aa, Homo Sapiens
FMFSIWCFA

SEQ ID NO: 1243698 - protein, 9 aa, Homo Sapiens
EEGLRHLQE

SEQ ID NO: 1243699 - protein, 9 aa, Homo Sapiens
PDFFSSMQK

SEQ ID NO: 1243700 - protein, 9 aa, Homo Sapiens
SKEGSLDSK

SEQ ID NO: 1243701 - protein, 9 aa, Homo Sapiens
QKDFSVYHP

SEQ ID NO: 1243702 - protein, 9 aa, Homo Sapiens
DFSDPVFIS

SEQ ID NO: 1243703 - protein, 9 aa, Homo Sapiens
AKNASLGKF

SEQ ID NO: 1243704 - protein, 9 aa, Homo Sapiens
RKKTFSTYA

SEQ ID NO: 1243705 - protein, 9 aa, Homo Sapiens
RPRLFHRCR

SEQ ID NO: 1243706 - protein, 9 aa, Homo Sapiens
VENFWGEKI

SEQ ID NO: 1243707 - protein, 9 aa, Homo Sapiens
RFFLELNVE

SEQ ID NO: 1243708 - protein, 9 aa, Homo Sapiens
GSQDHQCFF

SEQ ID NO: 1243709 - protein, 9 aa, Homo Sapiens
SYTSYHFGT

SEQ ID NO: 1243710 - protein, 9 aa, Homo Sapiens
EHEYEEEVE

SEQ ID NO: 1243711 - protein, 9 aa, Homo Sapiens
PAPGKVGTA

SEQ ID NO: 1243712 - protein, 9 aa, Homo Sapiens
THRQPMPDP

SEQ ID NO: 1243713 - protein, 9 aa, Homo Sapiens
CAPPEKSYA

SEQ ID NO: 1243714 - protein, 9 aa, Homo Sapiens
LSRDSSQEC

SEQ ID NO: 1243715 - protein, 9 aa, Homo Sapiens
AVEQIKTNL

SEQ ID NO: 1243716 - protein, 9 aa, Homo Sapiens
LENEVSMQH

SEQ ID NO: 1243717 - protein, 9 aa, Homo Sapiens
AENRQEREK

SEQ ID NO: 1243718 - protein, 9 aa, Homo Sapiens
CSSCHRPFH

SEQ ID NO: 1243719 - protein, 9 aa, Homo Sapiens
CSVRSFMDL

SEQ ID NO: 1243720 - protein, 9 aa, Homo Sapiens
HRTVQKCQQ

SEQ ID NO: 1243721 - protein, 9 aa, Homo Sapiens
FFLTAQLKH

SEQ ID NO: 1243722 - protein, 9 aa, Homo Sapiens
VDILRMKVQ

SEQ ID NO: 1243723 - protein, 9 aa, Homo Sapiens
VYEISYGNT

SEQ ID NO: 1243724 - protein, 9 aa, Homo Sapiens
IQHYFCDAL

SEQ ID NO: 1243725 - protein, 9 aa, Homo Sapiens
RELLIFLVQ

SEQ ID NO: 1243726 - protein, 9 aa, Homo Sapiens
DSLCHMMPF

SEQ ID NO: 1243727 - protein, 9 aa, Homo Sapiens
WVVPMQLRR

SEQ ID NO: 1243728 - protein, 9 aa, Homo Sapiens
CHFRGRSAA

SEQ ID NO: 1243729 - protein, 9 aa, Homo Sapiens
EYEDEEDEE

SEQ ID NO: 1243730 - protein, 9 aa, Homo Sapiens
PRVRYGKDK

SEQ ID NO: 1243731 - protein, 9 aa, Homo Sapiens
RKKSARICR

SEQ ID NO: 1243732 - protein, 9 aa, Homo Sapiens
DQVITISNE

SEQ ID NO: 1243733 - protein, 9 aa, Homo Sapiens
SLESVSVVL

SEQ ID NO: 1243734 - protein, 9 aa, Homo Sapiens
VAGEGSGSI

SEQ ID NO: 1243735 - protein, 9 aa, Homo Sapiens
ICSPLHLIN

SEQ ID NO: 1243736 - protein, 9 aa, Homo Sapiens
FHTSYWEST

SEQ ID NO: 1243737 - protein, 9 aa, Homo Sapiens
EAADMDYVG

SEQ ID NO: 1243738 - protein, 9 aa, Homo Sapiens
QQNQQVEKM

SEQ ID NO: 1243739 - protein, 9 aa, Homo Sapiens
DLSDMEGGG

SEQ ID NO: 1243740 - protein, 9 aa, Homo Sapiens
KCITPRCPP

SEQ ID NO: 1243741 - protein, 9 aa, Homo Sapiens
GYLINSLKP

SEQ ID NO: 1243742 - protein, 9 aa, Homo Sapiens
QSIKDHRKS

SEQ ID NO: 1243743 - protein, 9 aa, Homo Sapiens
KCPKGLGFS

SEQ ID NO: 1243744 - protein, 9 aa, Homo Sapiens
PLLPAWMTL

SEQ ID NO: 1243745 - protein, 9 aa, Homo Sapiens
VPQSPAAQP

SEQ ID NO: 1243746 - protein, 9 aa, Homo Sapiens
RLDSPRYTI

SEQ ID NO: 1243747 - protein, 9 aa, Homo Sapiens
AIMDSDLLR

SEQ ID NO: 1243748 - protein, 9 aa, Homo Sapiens
AFMFEGHDT

SEQ ID NO: 1243749 - protein, 9 aa, Homo Sapiens
PVFAYTHIV

SEQ ID NO: 1243750 - protein, 9 aa, Homo Sapiens
FITTMLNPL

SEQ ID NO: 1243751 - protein, 9 aa, Homo Sapiens
DLERQNQEC

SEQ ID NO: 1243752 - protein, 9 aa, Homo Sapiens
TTLDAQSTE

SEQ ID NO: 1243753 - protein, 9 aa, Homo Sapiens
LMEKEQKTP

SEQ ID NO: 1243754 - protein, 9 aa, Homo Sapiens
HEYEEEVEE

SEQ ID NO: 1243755 - protein, 9 aa, Homo Sapiens
GASGQRPIF

SEQ ID NO: 1243756 - protein, 9 aa, Homo Sapiens
AWCPCSSCC

SEQ ID NO: 1243757 - protein, 9 aa, Homo Sapiens
IHVWRLTDQ

SEQ ID NO: 1243758 - protein, 9 aa, Homo Sapiens
LYKNLVSEG

SEQ ID NO: 1243759 - protein, 9 aa, Homo Sapiens
MCKRICILV

SEQ ID NO: 1243760 - protein, 9 aa, Homo Sapiens
DISSLVVHD

SEQ ID NO: 1243761 - protein, 9 aa, Homo Sapiens
MPLLTFEVL

SEQ ID NO: 1243762 - protein, 9 aa, Homo Sapiens
AGSTWADSQ

SEQ ID NO: 1243763 - protein, 9 aa, Homo Sapiens
LEPEDNNST

SEQ ID NO: 1243764 - protein, 9 aa, Homo Sapiens
LRPQAKAVV

SEQ ID NO: 1243765 - protein, 9 aa, Homo Sapiens
PGTLAKSTG

SEQ ID NO: 1243766 - protein, 9 aa, Homo Sapiens
QGHAQAVLQ

SEQ ID NO: 1243767 - protein, 9 aa, Homo Sapiens
TRCGGHKDS

SEQ ID NO: 1243768 - protein, 9 aa, Homo Sapiens
EKIPDPLDV

SEQ ID NO: 1243769 - protein, 9 aa, Homo Sapiens
SLKKDQKAK

SEQ ID NO: 1243770 - protein, 9 aa, Homo Sapiens
ADCLRPTAW

SEQ ID NO: 1243771 - protein, 9 aa, Homo Sapiens
VNNHRASTP

SEQ ID NO: 1243772 - protein, 9 aa, Homo Sapiens
YSCCQHSSC

SEQ ID NO: 1243773 - protein, 9 aa, Homo Sapiens
GEKSYVCEH

SEQ ID NO: 1243774 - protein, 9 aa, Homo Sapiens
LCHQHATQK

SEQ ID NO: 1243775 - protein, 9 aa, Homo Sapiens
QDQLNSIAA

SEQ ID NO: 1243776 - protein, 9 aa, Homo Sapiens
TVQFHSKEL

SEQ ID NO: 1243777 - protein, 9 aa, Homo Sapiens
QERAVRRVA

SEQ ID NO: 1243778 - protein, 9 aa, Homo Sapiens
LLCIAKTLS

SEQ ID NO: 1243779 - protein, 9 aa, Homo Sapiens
GQVKNEVLR

SEQ ID NO: 1243780 - protein, 9 aa, Homo Sapiens
MTRRRTKLE

SEQ ID NO: 1243781 - protein, 9 aa, Homo Sapiens
AVRAVIKNR

SEQ ID NO: 1243782 - protein, 9 aa, Homo Sapiens
RQQDLKGFV

SEQ ID NO: 1243783 - protein, 9 aa, Homo Sapiens
HRLGNGVQC

SEQ ID NO: 1243784 - protein, 9 aa, Homo Sapiens
QKQVWEWKE

SEQ ID NO: 1243785 - protein, 9 aa, Homo Sapiens
QITRIPEAF

SEQ ID NO: 1243786 - protein, 9 aa, Homo Sapiens
VIKDKNDSV

SEQ ID NO: 1243787 - protein, 9 aa, Homo Sapiens
IVGHLPWVK

SEQ ID NO: 1243788 - protein, 9 aa, Homo Sapiens
QQQLNNIHI

SEQ ID NO: 1243789 - protein, 9 aa, Homo Sapiens
VTAFVRAQA

SEQ ID NO: 1243790 - protein, 9 aa, Homo Sapiens
PVLMNADCS

SEQ ID NO: 1243791 - protein, 9 aa, Homo Sapiens
LNDTCLVYD

SEQ ID NO: 1243792 - protein, 9 aa, Homo Sapiens
TQTALNNAY

SEQ ID NO: 1243793 - protein, 9 aa, Homo Sapiens
ADAMTQDTQ

SEQ ID NO: 1243794 - protein, 9 aa, Homo Sapiens
MQMASSTDQ

SEQ ID NO: 1243795 - protein, 9 aa, Homo Sapiens
ATPPSGNGS

SEQ ID NO: 1243796 - protein, 9 aa, Homo Sapiens
VDMTALFQE

SEQ ID NO: 1243797 - protein, 9 aa, Homo Sapiens
QELHCEDPS

SEQ ID NO: 1243798 - protein, 9 aa, Homo Sapiens
MDRLVQRFS

SEQ ID NO: 1243799 - protein, 9 aa, Homo Sapiens
LQQMWLTQC

SEQ ID NO: 1243800 - protein, 9 aa, Homo Sapiens
TQLPQEEKA

SEQ ID NO: 1243801 - protein, 9 aa, Homo Sapiens
NRRLHALEE

SEQ ID NO: 1243802 - protein, 9 aa, Homo Sapiens
SKKTLIRFW

SEQ ID NO: 1243803 - protein, 9 aa, Homo Sapiens
PKIYFGTHT

SEQ ID NO: 1243804 - protein, 9 aa, Homo Sapiens
YGCCAFMYM

SEQ ID NO: 1243805 - protein, 9 aa, Homo Sapiens
DDRDLYDAG

SEQ ID NO: 1243806 - protein, 9 aa, Homo Sapiens
RDPLLGMLD

SEQ ID NO: 1243807 - protein, 9 aa, Homo Sapiens
MWLDRNQLS

SEQ ID NO: 1243808 - protein, 9 aa, Homo Sapiens
AKLNQHREK

SEQ ID NO: 1243809 - protein, 9 aa, Homo Sapiens
TAGGGGGPG

SEQ ID NO: 1243810 - protein, 9 aa, Homo Sapiens
CLLNTSPKV

SEQ ID NO: 1243811 - protein, 9 aa, Homo Sapiens
LIHPPLKEG

SEQ ID NO: 1243812 - protein, 9 aa, Homo Sapiens
SPGADHMAS

SEQ ID NO: 1243813 - protein, 9 aa, Homo Sapiens
AHVQHFHKH

SEQ ID NO: 1243814 - protein, 9 aa, Homo Sapiens
EDLHHQAKL

SEQ ID NO: 1243815 - protein, 9 aa, Homo Sapiens
AQEELGKVI

SEQ ID NO: 1243816 - protein, 9 aa, Homo Sapiens
SQIGNDMGY

SEQ ID NO: 1243817 - protein, 9 aa, Homo Sapiens
ATATQLLHH

SEQ ID NO: 1243818 - protein, 9 aa, Homo Sapiens
VPVEALKDV

SEQ ID NO: 1243819 - protein, 9 aa, Homo Sapiens
HLCEAPSPL

SEQ ID NO: 1243820 - protein, 9 aa, Homo Sapiens
PPTLGAALP

SEQ ID NO: 1243821 - protein, 9 aa, Homo Sapiens
DLSFLDICF

SEQ ID NO: 1243822 - protein, 9 aa, Homo Sapiens
RGRRGWKNF

SEQ ID NO: 1243823 - protein, 9 aa, Homo Sapiens
STCVKEQDL

SEQ ID NO: 1243824 - protein, 9 aa, Homo Sapiens
TMRALAKTK

SEQ ID NO: 1243825 - protein, 9 aa, Homo Sapiens
FAICGPQML

SEQ ID NO: 1243826 - protein, 9 aa, Homo Sapiens
ICCRGFRIT

SEQ ID NO: 1243827 - protein, 9 aa, Homo Sapiens
STVSQHSEN

SEQ ID NO: 1243828 - protein, 9 aa, Homo Sapiens
HKWRPDFRE

SEQ ID NO: 1243829 - protein, 9 aa, Homo Sapiens
RYQLHVQLG

SEQ ID NO: 1243830 - protein, 9 aa, Homo Sapiens
MDAWSRELL

SEQ ID NO: 1243831 - protein, 9 aa, Homo Sapiens
CPRPSPAQV

SEQ ID NO: 1243832 - protein, 9 aa, Homo Sapiens
WRLILDWIP

SEQ ID NO: 1243833 - protein, 9 aa, Homo Sapiens
GDMGQQTNM

SEQ ID NO: 1243834 - protein, 9 aa, Homo Sapiens
DLWHILLVL

SEQ ID NO: 1243835 - protein, 9 aa, Homo Sapiens
AFLSYVEVL

SEQ ID NO: 1243836 - protein, 9 aa, Homo Sapiens
EGIIYRSTC

SEQ ID NO: 1243837 - protein, 9 aa, Homo Sapiens
QQLKLMQQA

SEQ ID NO: 1243838 - protein, 9 aa, Homo Sapiens
GGHRYVNMT

SEQ ID NO: 1243839 - protein, 9 aa, Homo Sapiens
PSPEWDMVT

SEQ ID NO: 1243840 - protein, 9 aa, Homo Sapiens
SPGKAMPTT

SEQ ID NO: 1243841 - protein, 9 aa, Homo Sapiens
TRGNVKYAN

SEQ ID NO: 1243842 - protein, 9 aa, Homo Sapiens
SCFTLFENG

SEQ ID NO: 1243843 - protein, 9 aa, Homo Sapiens
IKMQRAGLQ

SEQ ID NO: 1243844 - protein, 9 aa, Homo Sapiens
SHYAKCIPY

SEQ ID NO: 1243845 - protein, 9 aa, Homo Sapiens
WLDQYSDDF

SEQ ID NO: 1243846 - protein, 9 aa, Homo Sapiens
LIVTSVVGL

SEQ ID NO: 1243847 - protein, 9 aa, Homo Sapiens
VRMWYLLKV

SEQ ID NO: 1243848 - protein, 9 aa, Homo Sapiens
NAEKHVHNF

SEQ ID NO: 1243849 - protein, 9 aa, Homo Sapiens
RRAAVEEKQ

SEQ ID NO: 1243850 - protein, 9 aa, Homo Sapiens
KIGECALQS

SEQ ID NO: 1243851 - protein, 9 aa, Homo Sapiens
RGQSELILL

SEQ ID NO: 1243852 - protein, 9 aa, Homo Sapiens
TQAYHRLKD

SEQ ID NO: 1243853 - protein, 9 aa, Homo Sapiens
GMDLVRIGL

SEQ ID NO: 1243854 - protein, 9 aa, Homo Sapiens
SYGPPHGSS

SEQ ID NO: 1243855 - protein, 9 aa, Homo Sapiens
QSQPKESQL

SEQ ID NO: 1243856 - protein, 9 aa, Homo Sapiens
GESTIHRTS

SEQ ID NO: 1243857 - protein, 9 aa, Homo Sapiens
PSSENSVAE

SEQ ID NO: 1243858 - protein, 9 aa, Homo Sapiens
EGMTCSSCH

SEQ ID NO: 1243859 - protein, 9 aa, Homo Sapiens
RMEKSVNSS

SEQ ID NO: 1243860 - protein, 9 aa, Homo Sapiens
DTNKSCDAL

SEQ ID NO: 1243861 - protein, 9 aa, Homo Sapiens
RPTSLTLTV

SEQ ID NO: 1243862 - protein, 9 aa, Homo Sapiens
SYRLLPGIF

SEQ ID NO: 1243863 - protein, 9 aa, Homo Sapiens
LAQLREKVH

SEQ ID NO: 1243864 - protein, 9 aa, Homo Sapiens
ILYRSRHKG

SEQ ID NO: 1243865 - protein, 9 aa, Homo Sapiens
PAVGTRYKC

SEQ ID NO: 1243866 - protein, 9 aa, Homo Sapiens
SSREAGAKH

SEQ ID NO: 1243867 - protein, 9 aa, Homo Sapiens
SLHTSERKL

SEQ ID NO: 1243868 - protein, 9 aa, Homo Sapiens
TKIAAVVCL

SEQ ID NO: 1243869 - protein, 9 aa, Homo Sapiens
RYMHSWLEP

SEQ ID NO: 1243870 - protein, 9 aa, Homo Sapiens
HPEEHGHQS

SEQ ID NO: 1243871 - protein, 9 aa, Homo Sapiens
PMYEGKMKG

SEQ ID NO: 1243872 - protein, 9 aa, Homo Sapiens
LDLSVSVEE

SEQ ID NO: 1243873 - protein, 9 aa, Homo Sapiens
YEEDPKSKQ

SEQ ID NO: 1243874 - protein, 9 aa, Homo Sapiens
PDLQRRPRH

SEQ ID NO: 1243875 - protein, 9 aa, Homo Sapiens
SPLAQRKGI

SEQ ID NO: 1243876 - protein, 9 aa, Homo Sapiens
FKDMPLQPS

SEQ ID NO: 1243877 - protein, 9 aa, Homo Sapiens
GYISLLLHA

SEQ ID NO: 1243878 - protein, 9 aa, Homo Sapiens
AWKQYMRMS

SEQ ID NO: 1243879 - protein, 9 aa, Homo Sapiens
DTDTHSHRH

SEQ ID NO: 1243880 - protein, 9 aa, Homo Sapiens
VQLSNTASM

SEQ ID NO: 1243881 - protein, 9 aa, Homo Sapiens
ISPGTPQSP

SEQ ID NO: 1243882 - protein, 9 aa, Homo Sapiens
VTQDLNNEL

SEQ ID NO: 1243883 - protein, 9 aa, Homo Sapiens
NMCLTRERR

SEQ ID NO: 1243884 - protein, 9 aa, Homo Sapiens
QEPPPCGPD

SEQ ID NO: 1243885 - protein, 9 aa, Homo Sapiens
KTEDSARTL

SEQ ID NO: 1243886 - protein, 9 aa, Homo Sapiens
VYALGDLFQ

SEQ ID NO: 1243887 - protein, 9 aa, Homo Sapiens
MLHGATELV

SEQ ID NO: 1243888 - protein, 9 aa, Homo Sapiens
MQLPLCEKT

SEQ ID NO: 1243889 - protein, 9 aa, Homo Sapiens
AQHQRLNTG

SEQ ID NO: 1243890 - protein, 9 aa, Homo Sapiens
KSSHRDKLC

SEQ ID NO: 1243891 - protein, 9 aa, Homo Sapiens
LDTFGNMQM

SEQ ID NO: 1243892 - protein, 9 aa, Homo Sapiens
TRVDTDDIV

SEQ ID NO: 1243893 - protein, 9 aa, Homo Sapiens
VPLFRENFS

SEQ ID NO: 1243894 - protein, 9 aa, Homo Sapiens
PQVPVRSSS

SEQ ID NO: 1243895 - protein, 9 aa, Homo Sapiens
SLSSLVVHL

SEQ ID NO: 1243896 - protein, 9 aa, Homo Sapiens
NTPFHLSLF

SEQ ID NO: 1243897 - protein, 9 aa, Homo Sapiens
RGSKDINKN

SEQ ID NO: 1243898 - protein, 9 aa, Homo Sapiens
HYLVGTPYY

SEQ ID NO: 1243899 - protein, 9 aa, Homo Sapiens
SSCCSWWKW

SEQ ID NO: 1243900 - protein, 9 aa, Homo Sapiens
MLKENTSPS

SEQ ID NO: 1243901 - protein, 9 aa, Homo Sapiens
DQRYLCVMS

SEQ ID NO: 1243902 - protein, 9 aa, Homo Sapiens
EEGEHMTPC

SEQ ID NO: 1243903 - protein, 9 aa, Homo Sapiens
ALLRAGPRP

SEQ ID NO: 1243904 - protein, 9 aa, Homo Sapiens
PQLENEVSM

SEQ ID NO: 1243905 - protein, 9 aa, Homo Sapiens
MDVQPPNFS

SEQ ID NO: 1243906 - protein, 9 aa, Homo Sapiens
LHSIGTNEG

SEQ ID NO: 1243907 - protein, 9 aa, Homo Sapiens
VLGSGQAVL

SEQ ID NO: 1243908 - protein, 9 aa, Homo Sapiens
DTLVAVLEC

SEQ ID NO: 1243909 - protein, 9 aa, Homo Sapiens
TSVVGLAEL

SEQ ID NO: 1243910 - protein, 9 aa, Homo Sapiens
MAHYGRLAD

SEQ ID NO: 1243911 - protein, 9 aa, Homo Sapiens
GPELSPPQT

SEQ ID NO: 1243912 - protein, 9 aa, Homo Sapiens
TFTSASGTS

SEQ ID NO: 1243913 - protein, 9 aa, Homo Sapiens
LHQEECKYW

SEQ ID NO: 1243914 - protein, 9 aa, Homo Sapiens
SFNLKQKVM

SEQ ID NO: 1243915 - protein, 9 aa, Homo Sapiens
MSKRSSDNT

SEQ ID NO: 1243916 - protein, 9 aa, Homo Sapiens
SHGPLDKWQ

SEQ ID NO: 1243917 - protein, 9 aa, Homo Sapiens
NVTVVRNLE

SEQ ID NO: 1243918 - protein, 9 aa, Homo Sapiens
CHYFMCLLK

SEQ ID NO: 1243919 - protein, 9 aa, Homo Sapiens
AKGIRKKKD

SEQ ID NO: 1243920 - protein, 9 aa, Homo Sapiens
NFNWGVCRR

SEQ ID NO: 1243921 - protein, 9 aa, Homo Sapiens
QPLDPNGTL

SEQ ID NO: 1243922 - protein, 9 aa, Homo Sapiens
VTMVTATVT

SEQ ID NO: 1243923 - protein, 9 aa, Homo Sapiens
TYKSKMAFL

SEQ ID NO: 1243924 - protein, 9 aa, Homo Sapiens
QASERDAPS

SEQ ID NO: 1243925 - protein, 9 aa, Homo Sapiens
CGEASWALV

SEQ ID NO: 1243926 - protein, 9 aa, Homo Sapiens
FKVASLELS

SEQ ID NO: 1243927 - protein, 9 aa, Homo Sapiens
VTYHVTSSV

SEQ ID NO: 1243928 - protein, 9 aa, Homo Sapiens
DAPTEHVER

SEQ ID NO: 1243929 - protein, 9 aa, Homo Sapiens
AFSTCTTHF

SEQ ID NO: 1243930 - protein, 9 aa, Homo Sapiens
NIEHLVITS

SEQ ID NO: 1243931 - protein, 9 aa, Homo Sapiens
VRAFTVCWL

SEQ ID NO: 1243932 - protein, 9 aa, Homo Sapiens
DRCVSSLSI

SEQ ID NO: 1243933 - protein, 9 aa, Homo Sapiens
WWQARIISD

SEQ ID NO: 1243934 - protein, 9 aa, Homo Sapiens
RAVPEAADM

SEQ ID NO: 1243935 - protein, 9 aa, Homo Sapiens
EEWPELRQF

SEQ ID NO: 1243936 - protein, 9 aa, Homo Sapiens
QKAEDICRR

SEQ ID NO: 1243937 - protein, 9 aa, Homo Sapiens
VAVLDFWVQ

SEQ ID NO: 1243938 - protein, 9 aa, Homo Sapiens
RSRSRPPAR

SEQ ID NO: 1243939 - protein, 9 aa, Homo Sapiens
VCDELREVN

SEQ ID NO: 1243940 - protein, 9 aa, Homo Sapiens
LVWEETMSR

SEQ ID NO: 1243941 - protein, 9 aa, Homo Sapiens
RLNTGQRPY

SEQ ID NO: 1243942 - protein, 9 aa, Homo Sapiens
ERGTPYAGR

SEQ ID NO: 1243943 - protein, 9 aa, Homo Sapiens
RVIQGDEVD

SEQ ID NO: 1243944 - protein, 9 aa, Homo Sapiens
QEDPQTKDE

SEQ ID NO: 1243945 - protein, 9 aa, Homo Sapiens
DGSVVKKVV

SEQ ID NO: 1243946 - protein, 9 aa, Homo Sapiens
MADEKFCET

SEQ ID NO: 1243947 - protein, 9 aa, Homo Sapiens
EGEGDIFRS

SEQ ID NO: 1243948 - protein, 9 aa, Homo Sapiens
VLMLPVCSI

SEQ ID NO: 1243949 - protein, 9 aa, Homo Sapiens
KTLLLDKSI

SEQ ID NO: 1243950 - protein, 9 aa, Homo Sapiens
VANILNNDA

SEQ ID NO: 1243951 - protein, 9 aa, Homo Sapiens
HGLTQKMIS

SEQ ID NO: 1243952 - protein, 9 aa, Homo Sapiens
VSSDRFHSF

SEQ ID NO: 1243953 - protein, 9 aa, Homo Sapiens
MSLACIGIR

SEQ ID NO: 1243954 - protein, 9 aa, Homo Sapiens
YYGRKCIAK

SEQ ID NO: 1243955 - protein, 9 aa, Homo Sapiens
EKTTWYHRY

SEQ ID NO: 1243956 - protein, 9 aa, Homo Sapiens
SRYHHRRSS

SEQ ID NO: 1243957 - protein, 9 aa, Homo Sapiens
GSMQTLTKG

SEQ ID NO: 1243958 - protein, 9 aa, Homo Sapiens
RLVHEDYTM

SEQ ID NO: 1243959 - protein, 9 aa, Homo Sapiens
TETSILSKQ

SEQ ID NO: 1243960 - protein, 9 aa, Homo Sapiens
VVDIQRRYL

SEQ ID NO: 1243961 - protein, 9 aa, Homo Sapiens
EGKRCPAKA

SEQ ID NO: 1243962 - protein, 9 aa, Homo Sapiens
CRKQKSNCG

SEQ ID NO: 1243963 - protein, 9 aa, Homo Sapiens
IQPWDPLDI

SEQ ID NO: 1243964 - protein, 9 aa, Homo Sapiens
LRSVPGTPG

SEQ ID NO: 1243965 - protein, 9 aa, Homo Sapiens
PWDTLKYLI

SEQ ID NO: 1243966 - protein, 9 aa, Homo Sapiens
QDKKFPPSL

SEQ ID NO: 1243967 - protein, 9 aa, Homo Sapiens
LHWDGGSLL

SEQ ID NO: 1243968 - protein, 9 aa, Homo Sapiens
TMGIRQPPG

SEQ ID NO: 1243969 - protein, 9 aa, Homo Sapiens
ATMFSNAML

SEQ ID NO: 1243970 - protein, 9 aa, Homo Sapiens
REFILWCLA

SEQ ID NO: 1243971 - protein, 9 aa, Homo Sapiens
DFPTLVSSV

SEQ ID NO: 1243972 - protein, 9 aa, Homo Sapiens
GQRNAMHTS

SEQ ID NO: 1243973 - protein, 9 aa, Homo Sapiens
SHRHTHTHR

SEQ ID NO: 1243974 - protein, 9 aa, Homo Sapiens
QRAYGQRGP

SEQ ID NO: 1243975 - protein, 9 aa, Homo Sapiens
LLPHRHLSE

SEQ ID NO: 1243976 - protein, 9 aa, Homo Sapiens
PTLLFSCNS

SEQ ID NO: 1243977 - protein, 9 aa, Homo Sapiens
LYPHRVACK

SEQ ID NO: 1243978 - protein, 9 aa, Homo Sapiens
LHKRCEEVD

SEQ ID NO: 1243979 - protein, 9 aa, Homo Sapiens
SDDLHNDCT

SEQ ID NO: 1243980 - protein, 9 aa, Homo Sapiens
HKCRVHDLE

SEQ ID NO: 1243981 - protein, 9 aa, Homo Sapiens
HRHIHSRTH

SEQ ID NO: 1243982 - protein, 9 aa, Homo Sapiens
LAVSRDKAS

SEQ ID NO: 1243983 - protein, 9 aa, Homo Sapiens
RECEMADEE

SEQ ID NO: 1243984 - protein, 9 aa, Homo Sapiens
CTPSPLDGP

SEQ ID NO: 1243985 - protein, 9 aa, Homo Sapiens
SPYNISIGY

SEQ ID NO: 1243986 - protein, 9 aa, Homo Sapiens
YYFCITLGY

SEQ ID NO: 1243987 - protein, 9 aa, Homo Sapiens
SMTTRIFLN

SEQ ID NO: 1243988 - protein, 9 aa, Homo Sapiens
LNAQFSQIL

SEQ ID NO: 1243989 - protein, 9 aa, Homo Sapiens
LTILDDEPV

SEQ ID NO: 1243990 - protein, 9 aa, Homo Sapiens
IPRPTNKFQ

SEQ ID NO: 1243991 - protein, 9 aa, Homo Sapiens
VDIYGVAQH

SEQ ID NO: 1243992 - protein, 9 aa, Homo Sapiens
YQCDVCDKI

SEQ ID NO: 1243993 - protein, 9 aa, Homo Sapiens
QLNALRHEK

SEQ ID NO: 1243994 - protein, 9 aa, Homo Sapiens
CPPRQSCGG

SEQ ID NO: 1243995 - protein, 9 aa, Homo Sapiens
CIMKEKKKA

SEQ ID NO: 1243996 - protein, 9 aa, Homo Sapiens
MRAQDRYYS

SEQ ID NO: 1243997 - protein, 9 aa, Homo Sapiens
MTSFEPEAL

SEQ ID NO: 1243998 - protein, 9 aa, Homo Sapiens
KEGKNELQV

SEQ ID NO: 1243999 - protein, 9 aa, Homo Sapiens
HKKKKTRTS

SEQ ID NO: 1244000 - protein, 9 aa, Homo Sapiens
KRQCKRNEG

SEQ ID NO: 1244001 - protein, 9 aa, Homo Sapiens
MQAILTGRA

SEQ ID NO: 1244002 - protein, 9 aa, Homo Sapiens
KLIPRKDLL

SEQ ID NO: 1244003 - protein, 9 aa, Homo Sapiens
TRRPCQPLT

SEQ ID NO: 1244004 - protein, 9 aa, Homo Sapiens
AHNTLGRSA

SEQ ID NO: 1244005 - protein, 9 aa, Homo Sapiens
PQERKDMTI

SEQ ID NO: 1244006 - protein, 9 aa, Homo Sapiens
CMCWKQMMK

SEQ ID NO: 1244007 - protein, 9 aa, Homo Sapiens
PPMLLKESY

SEQ ID NO: 1244008 - protein, 9 aa, Homo Sapiens
QELYTTHSL

SEQ ID NO: 1244009 - protein, 9 aa, Homo Sapiens
LGHVPLTKE

SEQ ID NO: 1244010 - protein, 9 aa, Homo Sapiens
TSLVATTTS

SEQ ID NO: 1244011 - protein, 9 aa, Homo Sapiens
ESRVVNLHF

SEQ ID NO: 1244012 - protein, 9 aa, Homo Sapiens
SLTLPQLSL

SEQ ID NO: 1244013 - protein, 9 aa, Homo Sapiens
AMSPLNFCG

SEQ ID NO: 1244014 - protein, 9 aa, Homo Sapiens
IHYEGSEHK

SEQ ID NO: 1244015 - protein, 9 aa, Homo Sapiens
DPTTNAWRH

SEQ ID NO: 1244016 - protein, 9 aa, Homo Sapiens
CQDWKKAWD

SEQ ID NO: 1244017 - protein, 9 aa, Homo Sapiens
QTGPQFCQN

SEQ ID NO: 1244018 - protein, 9 aa, Homo Sapiens
ETALIYLDR

SEQ ID NO: 1244019 - protein, 9 aa, Homo Sapiens
EQELDDLVA

SEQ ID NO: 1244020 - protein, 9 aa, Homo Sapiens
TMLKPRLKT

SEQ ID NO: 1244021 - protein, 9 aa, Homo Sapiens
HPQVVMYVK

SEQ ID NO: 1244022 - protein, 9 aa, Homo Sapiens
KMEVLKKTC

SEQ ID NO: 1244023 - protein, 9 aa, Homo Sapiens
SVRSFMDLK

SEQ ID NO: 1244024 - protein, 9 aa, Homo Sapiens
ENHSATAEY

SEQ ID NO: 1244025 - protein, 9 aa, Homo Sapiens
PKPPTRDTP

SEQ ID NO: 1244026 - protein, 9 aa, Homo Sapiens
SVLSMTTRI

SEQ ID NO: 1244027 - protein, 9 aa, Homo Sapiens
NEGSYGDHH

SEQ ID NO: 1244028 - protein, 9 aa, Homo Sapiens
RKCHSPHLN

SEQ ID NO: 1244029 - protein, 9 aa, Homo Sapiens
GRVPHSCAL

SEQ ID NO: 1244030 - protein, 9 aa, Homo Sapiens
NSIKVEGGI

SEQ ID NO: 1244031 - protein, 9 aa, Homo Sapiens
GADPHFGLI

SEQ ID NO: 1244032 - protein, 9 aa, Homo Sapiens
PFYTDQYVQ

SEQ ID NO: 1244033 - protein, 9 aa, Homo Sapiens
AEKEATLVY

SEQ ID NO: 1244034 - protein, 9 aa, Homo Sapiens
KDLINFMLR

SEQ ID NO: 1244035 - protein, 9 aa, Homo Sapiens
DTSLNHPPY

SEQ ID NO: 1244036 - protein, 9 aa, Homo Sapiens
LKPPSPPKP

SEQ ID NO: 1244037 - protein, 9 aa, Homo Sapiens
THAAAAAAT

SEQ ID NO: 1244038 - protein, 9 aa, Homo Sapiens
HGKIYDALD

SEQ ID NO: 1244039 - protein, 9 aa, Homo Sapiens
SNPQYPTAH

SEQ ID NO: 1244040 - protein, 9 aa, Homo Sapiens
FAPTILTPK

SEQ ID NO: 1244041 - protein, 9 aa, Homo Sapiens
CISGHHLME

SEQ ID NO: 1244042 - protein, 9 aa, Homo Sapiens
GTPGFMTLR

SEQ ID NO: 1244043 - protein, 9 aa, Homo Sapiens
HLFYFFYDV

SEQ ID NO: 1244044 - protein, 9 aa, Homo Sapiens
QRHILQQDW

SEQ ID NO: 1244045 - protein, 9 aa, Homo Sapiens
GTKKYILNE

SEQ ID NO: 1244046 - protein, 9 aa, Homo Sapiens
EGALINSLI

SEQ ID NO: 1244047 - protein, 9 aa, Homo Sapiens
NRIALMDAY

SEQ ID NO: 1244048 - protein, 9 aa, Homo Sapiens
LQRTDPPLV

SEQ ID NO: 1244049 - protein, 9 aa, Homo Sapiens
TSLGRHASC

SEQ ID NO: 1244050 - protein, 9 aa, Homo Sapiens
NNIHITRPA

SEQ ID NO: 1244051 - protein, 9 aa, Homo Sapiens
QVKNEVLRE

SEQ ID NO: 1244052 - protein, 9 aa, Homo Sapiens
PGPGPTTSP

SEQ ID NO: 1244053 - protein, 9 aa, Homo Sapiens
DGHSASVPS

SEQ ID NO: 1244054 - protein, 9 aa, Homo Sapiens
AHMAQRLDG

SEQ ID NO: 1244055 - protein, 9 aa, Homo Sapiens
NAPGFYIST

SEQ ID NO: 1244056 - protein, 9 aa, Homo Sapiens
GSRMAHPRL

SEQ ID NO: 1244057 - protein, 9 aa, Homo Sapiens
PEKTQEALN

SEQ ID NO: 1244058 - protein, 9 aa, Homo Sapiens
RKHPGTGKV

SEQ ID NO: 1244059 - protein, 9 aa, Homo Sapiens
EIERHAQVA

SEQ ID NO: 1244060 - protein, 9 aa, Homo Sapiens
LDHLRECNR

SEQ ID NO: 1244061 - protein, 9 aa, Homo Sapiens
DMLDGHSRE

SEQ ID NO: 1244062 - protein, 9 aa, Homo Sapiens
WRKIMSDPD

SEQ ID NO: 1244063 - protein, 9 aa, Homo Sapiens
VEKSEPWVD

SEQ ID NO: 1244064 - protein, 9 aa, Homo Sapiens
HKKALEECE

SEQ ID NO: 1244065 - protein, 9 aa, Homo Sapiens
LGEFERLHR

SEQ ID NO: 1244066 - protein, 9 aa, Homo Sapiens
DNLFEKNHC

SEQ ID NO: 1244067 - protein, 9 aa, Homo Sapiens
ECNDTTPVC

SEQ ID NO: 1244068 - protein, 9 aa, Homo Sapiens
QHSENHTDE

SEQ ID NO: 1244069 - protein, 9 aa, Homo Sapiens
CPDGGDGGN

SEQ ID NO: 1244070 - protein, 9 aa, Homo Sapiens
LAIDLSLCD

SEQ ID NO: 1244071 - protein, 9 aa, Homo Sapiens
KGNRPTILT

SEQ ID NO: 1244072 - protein, 9 aa, Homo Sapiens
QCHRDGQRK

SEQ ID NO: 1244073 - protein, 9 aa, Homo Sapiens
AAEYQTTSP

SEQ ID NO: 1244074 - protein, 9 aa, Homo Sapiens
TEGNCSNYP

SEQ ID NO: 1244075 - protein, 9 aa, Homo Sapiens
VPMHKGEHL

SEQ ID NO: 1244076 - protein, 9 aa, Homo Sapiens
QMADGMGGI

SEQ ID NO: 1244077 - protein, 9 aa, Homo Sapiens
QVKISCSNS

SEQ ID NO: 1244078 - protein, 9 aa, Homo Sapiens
FLLGGIGVL

SEQ ID NO: 1244079 - protein, 9 aa, Homo Sapiens
GNMNNNSIH

SEQ ID NO: 1244080 - protein, 9 aa, Homo Sapiens
NEDYNPYQV

SEQ ID NO: 1244081 - protein, 9 aa, Homo Sapiens
GLPGISGQD

SEQ ID NO: 1244082 - protein, 9 aa, Homo Sapiens
VPKEASAFI

SEQ ID NO: 1244083 - protein, 9 aa, Homo Sapiens
VCPPEEKDT

SEQ ID NO: 1244084 - protein, 9 aa, Homo Sapiens
AAGAREAGR

SEQ ID NO: 1244085 - protein, 9 aa, Homo Sapiens
VSNTPLVPQ

SEQ ID NO: 1244086 - protein, 9 aa, Homo Sapiens
RNTPSGPVS

SEQ ID NO: 1244087 - protein, 9 aa, Homo Sapiens
FVNNCFSTT

SEQ ID NO: 1244088 - protein, 9 aa, Homo Sapiens
EGGTYTDGE

SEQ ID NO: 1244089 - protein, 9 aa, Homo Sapiens
LITLTFQDQ

SEQ ID NO: 1244090 - protein, 9 aa, Homo Sapiens
AQVYLEEMY

SEQ ID NO: 1244091 - protein, 9 aa, Homo Sapiens
NHQLIVTRD

SEQ ID NO: 1244092 - protein, 9 aa, Homo Sapiens
KVNSLTAQP

SEQ ID NO: 1244093 - protein, 9 aa, Homo Sapiens
QSTLRHLNL

SEQ ID NO: 1244094 - protein, 9 aa, Homo Sapiens
YYTSSSDIT

SEQ ID NO: 1244095 - protein, 9 aa, Homo Sapiens
NQLRSGTVT

SEQ ID NO: 1244096 - protein, 9 aa, Homo Sapiens
WEQALSYFT

SEQ ID NO: 1244097 - protein, 9 aa, Homo Sapiens
VAILPKELL

SEQ ID NO: 1244098 - protein, 9 aa, Homo Sapiens
PCEQLVTVL

SEQ ID NO: 1244099 - protein, 9 aa, Homo Sapiens
LLWLLGSRM

SEQ ID NO: 1244100 - protein, 9 aa, Homo Sapiens
EESLHTSER

SEQ ID NO: 1244101 - protein, 9 aa, Homo Sapiens
LNMLLRFSR

SEQ ID NO: 1244102 - protein, 9 aa, Homo Sapiens
QEVAAGAHE

SEQ ID NO: 1244103 - protein, 9 aa, Homo Sapiens
RWRDYKRLW

SEQ ID NO: 1244104 - protein, 9 aa, Homo Sapiens
AHKQDEEER

SEQ ID NO: 1244105 - protein, 9 aa, Homo Sapiens
SVPWSAGCW

SEQ ID NO: 1244106 - protein, 9 aa, Homo Sapiens
MLHHMGLFD

SEQ ID NO: 1244107 - protein, 9 aa, Homo Sapiens
KKILRHGIG

SEQ ID NO: 1244108 - protein, 9 aa, Homo Sapiens
TSPKELGRD

SEQ ID NO: 1244109 - protein, 9 aa, Homo Sapiens
WELTGSLLA

SEQ ID NO: 1244110 - protein, 9 aa, Homo Sapiens
RYFSIVPGN

SEQ ID NO: 1244111 - protein, 9 aa, Homo Sapiens
TLFLLYISL

SEQ ID NO: 1244112 - protein, 9 aa, Homo Sapiens
KKQPDEEHM

SEQ ID NO: 1244113 - protein, 9 aa, Homo Sapiens
QGHVTFDDI

SEQ ID NO: 1244114 - protein, 9 aa, Homo Sapiens
EKCSDNYEV

SEQ ID NO: 1244115 - protein, 9 aa, Homo Sapiens
PLEAEPQVV

SEQ ID NO: 1244116 - protein, 9 aa, Homo Sapiens
RCKMITEQP

SEQ ID NO: 1244117 - protein, 9 aa, Homo Sapiens
RSQIKTDVN

SEQ ID NO: 1244118 - protein, 9 aa, Homo Sapiens
TSPSRQQGC

SEQ ID NO: 1244119 - protein, 9 aa, Homo Sapiens
DTFGNMQMA

SEQ ID NO: 1244120 - protein, 9 aa, Homo Sapiens
VCCLIFLTL

SEQ ID NO: 1244121 - protein, 9 aa, Homo Sapiens
NHSNQSIKD

SEQ ID NO: 1244122 - protein, 9 aa, Homo Sapiens
QKLHLVSRN

SEQ ID NO: 1244123 - protein, 9 aa, Homo Sapiens
EPQKSSLSP

SEQ ID NO: 1244124 - protein, 9 aa, Homo Sapiens
NLPSAASPW

SEQ ID NO: 1244125 - protein, 9 aa, Homo Sapiens
PPSDLDLLV

SEQ ID NO: 1244126 - protein, 9 aa, Homo Sapiens
VQYIPFYAG

SEQ ID NO: 1244127 - protein, 9 aa, Homo Sapiens
NAIFEHEME

SEQ ID NO: 1244128 - protein, 9 aa, Homo Sapiens
PAQVKLLNR

SEQ ID NO: 1244129 - protein, 9 aa, Homo Sapiens
NYKTLFIIF

SEQ ID NO: 1244130 - protein, 9 aa, Homo Sapiens
EPWRQEWEK

SEQ ID NO: 1244131 - protein, 9 aa, Homo Sapiens
YWTEVMDLI

SEQ ID NO: 1244132 - protein, 9 aa, Homo Sapiens
VTLQLFYLS

SEQ ID NO: 1244133 - protein, 9 aa, Homo Sapiens
IPCCFSWSL

SEQ ID NO: 1244134 - protein, 9 aa, Homo Sapiens
ESLSGVCES

SEQ ID NO: 1244135 - protein, 9 aa, Homo Sapiens
LMINGQVES

SEQ ID NO: 1244136 - protein, 9 aa, Homo Sapiens
TGQRPSARC

SEQ ID NO: 1244137 - protein, 9 aa, Homo Sapiens
HQIYVLQVL

SEQ ID NO: 1244138 - protein, 9 aa, Homo Sapiens
LKMWVIEAK

SEQ ID NO: 1244139 - protein, 9 aa, Homo Sapiens
VFVWTLRDF

SEQ ID NO: 1244140 - protein, 9 aa, Homo Sapiens
QFPPGMPEE

SEQ ID NO: 1244141 - protein, 9 aa, Homo Sapiens
CLVDAAGGT

SEQ ID NO: 1244142 - protein, 9 aa, Homo Sapiens
GQGWWEFPP

SEQ ID NO: 1244143 - protein, 9 aa, Homo Sapiens
SAIADLLAN

SEQ ID NO: 1244144 - protein, 9 aa, Homo Sapiens
REPPPTPPS

SEQ ID NO: 1244145 - protein, 9 aa, Homo Sapiens
CASHLTIVI

SEQ ID NO: 1244146 - protein, 9 aa, Homo Sapiens
SHFEKEQQQ

SEQ ID NO: 1244147 - protein, 9 aa, Homo Sapiens
TEATNVILM

SEQ ID NO: 1244148 - protein, 9 aa, Homo Sapiens
VSHTDADCF

SEQ ID NO: 1244149 - protein, 9 aa, Homo Sapiens
GGPPLKKMK

SEQ ID NO: 1244150 - protein, 9 aa, Homo Sapiens
EVDTCWGHY

SEQ ID NO: 1244151 - protein, 9 aa, Homo Sapiens
IWSSMRRTA

SEQ ID NO: 1244152 - protein, 9 aa, Homo Sapiens
SGVVSIACS

SEQ ID NO: 1244153 - protein, 9 aa, Homo Sapiens
REDTLLTLM

SEQ ID NO: 1244154 - protein, 9 aa, Homo Sapiens
RCIYKPDFF

SEQ ID NO: 1244155 - protein, 9 aa, Homo Sapiens
AESFRKVLI

SEQ ID NO: 1244156 - protein, 9 aa, Homo Sapiens
ERDAPSIEQ

SEQ ID NO: 1244157 - protein, 9 aa, Homo Sapiens
NKCLSRKNE

SEQ ID NO: 1244158 - protein, 9 aa, Homo Sapiens
EMAGLPGLY

SEQ ID NO: 1244159 - protein, 9 aa, Homo Sapiens
SQCSRSCEG

SEQ ID NO: 1244160 - protein, 9 aa, Homo Sapiens
ASSDSERSE

SEQ ID NO: 1244161 - protein, 9 aa, Homo Sapiens
PMNHDELKS

SEQ ID NO: 1244162 - protein, 9 aa, Homo Sapiens
KMKNMDDNT

SEQ ID NO: 1244163 - protein, 9 aa, Homo Sapiens
SFLTPLHNF

SEQ ID NO: 1244164 - protein, 9 aa, Homo Sapiens
GGYGEANDY

SEQ ID NO: 1244165 - protein, 9 aa, Homo Sapiens
DMLAKTFSR

SEQ ID NO: 1244166 - protein, 9 aa, Homo Sapiens
EICQGMHQI

SEQ ID NO: 1244167 - protein, 9 aa, Homo Sapiens
GPGPAQASA

SEQ ID NO: 1244168 - protein, 9 aa, Homo Sapiens
LDIQISKDG

SEQ ID NO: 1244169 - protein, 9 aa, Homo Sapiens
LVDTNLHDY

SEQ ID NO: 1244170 - protein, 9 aa, Homo Sapiens
HVWDRAVEF

SEQ ID NO: 1244171 - protein, 9 aa, Homo Sapiens
MIFGGDYIF

SEQ ID NO: 1244172 - protein, 9 aa, Homo Sapiens
KAFNQSSYL

SEQ ID NO: 1244173 - protein, 9 aa, Homo Sapiens
LQRCSLEGE

SEQ ID NO: 1244174 - protein, 9 aa, Homo Sapiens
HLFLYNKIR

SEQ ID NO: 1244175 - protein, 9 aa, Homo Sapiens
QDCTQFSDR

SEQ ID NO: 1244176 - protein, 9 aa, Homo Sapiens
KKNLPVNVC

SEQ ID NO: 1244177 - protein, 9 aa, Homo Sapiens
AGCGKNFGK

SEQ ID NO: 1244178 - protein, 9 aa, Homo Sapiens
NGHSSHRLC

SEQ ID NO: 1244179 - protein, 9 aa, Homo Sapiens
KSSPVDALK

SEQ ID NO: 1244180 - protein, 9 aa, Homo Sapiens
LMWIRQQED

SEQ ID NO: 1244181 - protein, 9 aa, Homo Sapiens
LDTFVNKAE

SEQ ID NO: 1244182 - protein, 9 aa, Homo Sapiens
MLETIQGQL

SEQ ID NO: 1244183 - protein, 9 aa, Homo Sapiens
LMLFSRVIP

SEQ ID NO: 1244184 - protein, 9 aa, Homo Sapiens
RVTGVIIQG

SEQ ID NO: 1244185 - protein, 9 aa, Homo Sapiens
RFPKCEQEL

SEQ ID NO: 1244186 - protein, 9 aa, Homo Sapiens
HNRRHFKVA

SEQ ID NO: 1244187 - protein, 9 aa, Homo Sapiens
RSHHKSKDR

SEQ ID NO: 1244188 - protein, 9 aa, Homo Sapiens
HQSHSSSSF

SEQ ID NO: 1244189 - protein, 9 aa, Homo Sapiens
PCVKKNSVH

SEQ ID NO: 1244190 - protein, 9 aa, Homo Sapiens
KPTSNRCTS

SEQ ID NO: 1244191 - protein, 9 aa, Homo Sapiens
RLVVNNHRA

SEQ ID NO: 1244192 - protein, 9 aa, Homo Sapiens
VNFSHWSLQ

SEQ ID NO: 1244193 - protein, 9 aa, Homo Sapiens
IDFVGHDAK

SEQ ID NO: 1244194 - protein, 9 aa, Homo Sapiens
EMAVRDRNL

SEQ ID NO: 1244195 - protein, 9 aa, Homo Sapiens
PTLWDEPGS

SEQ ID NO: 1244196 - protein, 9 aa, Homo Sapiens
HYEGSEHKL

SEQ ID NO: 1244197 - protein, 9 aa, Homo Sapiens
NTIDQDDEL

SEQ ID NO: 1244198 - protein, 9 aa, Homo Sapiens
FEEDKRTYE

SEQ ID NO: 1244199 - protein, 9 aa, Homo Sapiens
VVFFPCCLL

SEQ ID NO: 1244200 - protein, 9 aa, Homo Sapiens
MKILNKWDM

SEQ ID NO: 1244201 - protein, 9 aa, Homo Sapiens
DLPLWTLES

SEQ ID NO: 1244202 - protein, 9 aa, Homo Sapiens
VYYPTPKVQ

SEQ ID NO: 1244203 - protein, 9 aa, Homo Sapiens
LEAVLFGIN

SEQ ID NO: 1244204 - protein, 9 aa, Homo Sapiens
GIGINAELS

SEQ ID NO: 1244205 - protein, 9 aa, Homo Sapiens
SSENILPQQ

SEQ ID NO: 1244206 - protein, 9 aa, Homo Sapiens
RECLANVSW

SEQ ID NO: 1244207 - protein, 9 aa, Homo Sapiens
QVCSLDNRE

SEQ ID NO: 1244208 - protein, 9 aa, Homo Sapiens
SGLLAQFES

SEQ ID NO: 1244209 - protein, 9 aa, Homo Sapiens
VSFLETSSG

SEQ ID NO: 1244210 - protein, 9 aa, Homo Sapiens
QAVLGMDMG

SEQ ID NO: 1244211 - protein, 9 aa, Homo Sapiens
ELLWDILQK

SEQ ID NO: 1244212 - protein, 9 aa, Homo Sapiens
PYKSLVQIH

SEQ ID NO: 1244213 - protein, 9 aa, Homo Sapiens
AGLIDAIKH

SEQ ID NO: 1244214 - protein, 9 aa, Homo Sapiens
VRSSTYSNN

SEQ ID NO: 1244215 - protein, 9 aa, Homo Sapiens
FLSYVEVLT

SEQ ID NO: 1244216 - protein, 9 aa, Homo Sapiens
TMSCLNKCD

SEQ ID NO: 1244217 - protein, 9 aa, Homo Sapiens
PVGSHNIKA

SEQ ID NO: 1244218 - protein, 9 aa, Homo Sapiens
LQWIRETLP

SEQ ID NO: 1244219 - protein, 9 aa, Homo Sapiens
EPVSWSSIN

SEQ ID NO: 1244220 - protein, 9 aa, Homo Sapiens
IMIQKGNAL

SEQ ID NO: 1244221 - protein, 9 aa, Homo Sapiens
KADEGRADL

SEQ ID NO: 1244222 - protein, 9 aa, Homo Sapiens
CKEKFTASK

SEQ ID NO: 1244223 - protein, 9 aa, Homo Sapiens
VDCSQQGLT

SEQ ID NO: 1244224 - protein, 9 aa, Homo Sapiens
SKATEHLEA

SEQ ID NO: 1244225 - protein, 9 aa, Homo Sapiens
GASELEPIS

SEQ ID NO: 1244226 - protein, 9 aa, Homo Sapiens
FMVKGAVLF

SEQ ID NO: 1244227 - protein, 9 aa, Homo Sapiens
KKLSNCLAQ

SEQ ID NO: 1244228 - protein, 9 aa, Homo Sapiens
VPAASPSTH

SEQ ID NO: 1244229 - protein, 9 aa, Homo Sapiens
FTNIEAALR

SEQ ID NO: 1244230 - protein, 9 aa, Homo Sapiens
THTQVYIRT

SEQ ID NO: 1244231 - protein, 9 aa, Homo Sapiens
GTHCCRQEM

SEQ ID NO: 1244232 - protein, 9 aa, Homo Sapiens
KPQIKCGKR

SEQ ID NO: 1244233 - protein, 9 aa, Homo Sapiens
RNSATFKPF

SEQ ID NO: 1244234 - protein, 9 aa, Homo Sapiens
HLTIVILFY

SEQ ID NO: 1244235 - protein, 9 aa, Homo Sapiens
SPTVCATVA

SEQ ID NO: 1244236 - protein, 9 aa, Homo Sapiens
LKREWEMLH

SEQ ID NO: 1244237 - protein, 9 aa, Homo Sapiens
RDSQRKTDL

SEQ ID NO: 1244238 - protein, 9 aa, Homo Sapiens
KDRFQVFLN

SEQ ID NO: 1244239 - protein, 9 aa, Homo Sapiens
ITYWPKLDG

SEQ ID NO: 1244240 - protein, 9 aa, Homo Sapiens
RYSPISGHK

SEQ ID NO: 1244241 - protein, 9 aa, Homo Sapiens
VCIFKLTFV

SEQ ID NO: 1244242 - protein, 9 aa, Homo Sapiens
PQHTCPEWV

SEQ ID NO: 1244243 - protein, 9 aa, Homo Sapiens
VRMRLEATD

SEQ ID NO: 1244244 - protein, 9 aa, Homo Sapiens
QPFFTTSPE

SEQ ID NO: 1244245 - protein, 9 aa, Homo Sapiens
EVVYTGWLF

SEQ ID NO: 1244246 - protein, 9 aa, Homo Sapiens
ALACYTADI

SEQ ID NO: 1244247 - protein, 9 aa, Homo Sapiens
MKNQWLLTP

SEQ ID NO: 1244248 - protein, 9 aa, Homo Sapiens
HLVHLFYFF

SEQ ID NO: 1244249 - protein, 9 aa, Homo Sapiens
GFLQAVNDL

SEQ ID NO: 1244250 - protein, 9 aa, Homo Sapiens
RLEKEYTAM

SEQ ID NO: 1244251 - protein, 9 aa, Homo Sapiens
EAEEGHALG

SEQ ID NO: 1244252 - protein, 9 aa, Homo Sapiens
GPTSPSLAS

SEQ ID NO: 1244253 - protein, 9 aa, Homo Sapiens
HMLPLLMRV

SEQ ID NO: 1244254 - protein, 9 aa, Homo Sapiens
TVLSTLYIS

SEQ ID NO: 1244255 - protein, 9 aa, Homo Sapiens
SKVPTMDLT

SEQ ID NO: 1244256 - protein, 9 aa, Homo Sapiens
TVIDKSKSV

SEQ ID NO: 1244257 - protein, 9 aa, Homo Sapiens
IYIEKHQQV

SEQ ID NO: 1244258 - protein, 9 aa, Homo Sapiens
KEELISELQ

SEQ ID NO: 1244259 - protein, 9 aa, Homo Sapiens
AHYEMASNP

SEQ ID NO: 1244260 - protein, 9 aa, Homo Sapiens
ADVPVTSTG

SEQ ID NO: 1244261 - protein, 9 aa, Homo Sapiens
TSSHIIVHI

SEQ ID NO: 1244262 - protein, 9 aa, Homo Sapiens
IIIKGVGAE

SEQ ID NO: 1244263 - protein, 9 aa, Homo Sapiens
DMEGGGSEP

SEQ ID NO: 1244264 - protein, 9 aa, Homo Sapiens
YHISSSLTP

SEQ ID NO: 1244265 - protein, 9 aa, Homo Sapiens
SYSILIFMT

SEQ ID NO: 1244266 - protein, 9 aa, Homo Sapiens
EMLVDVATD

SEQ ID NO: 1244267 - protein, 9 aa, Homo Sapiens
GMMRELLYF

SEQ ID NO: 1244268 - protein, 9 aa, Homo Sapiens
QGTGTKGPG

SEQ ID NO: 1244269 - protein, 9 aa, Homo Sapiens
EDDLDDSVS

SEQ ID NO: 1244270 - protein, 9 aa, Homo Sapiens
VVLEGHAVE

SEQ ID NO: 1244271 - protein, 9 aa, Homo Sapiens
VELSLRSRR

SEQ ID NO: 1244272 - protein, 9 aa, Homo Sapiens
SHTRNDKYS

SEQ ID NO: 1244273 - protein, 9 aa, Homo Sapiens
GGASSSKSH

SEQ ID NO: 1244274 - protein, 9 aa, Homo Sapiens
RPSYHLKKY

SEQ ID NO: 1244275 - protein, 9 aa, Homo Sapiens
RPSTGKATT

SEQ ID NO: 1244276 - protein, 9 aa, Homo Sapiens
CVLMITGSL

SEQ ID NO: 1244277 - protein, 9 aa, Homo Sapiens
VILGPEDLC

SEQ ID NO: 1244278 - protein, 9 aa, Homo Sapiens
FSSEPPTQA

SEQ ID NO: 1244279 - protein, 9 aa, Homo Sapiens
AAPAPTPDA

SEQ ID NO: 1244280 - protein, 9 aa, Homo Sapiens
EEHIPDVSL

SEQ ID NO: 1244281 - protein, 9 aa, Homo Sapiens
KKRVEADRM

SEQ ID NO: 1244282 - protein, 9 aa, Homo Sapiens
VLLSRASGV

SEQ ID NO: 1244283 - protein, 9 aa, Homo Sapiens
LPVHSACHG

SEQ ID NO: 1244284 - protein, 9 aa, Homo Sapiens
VTTMLASAL

SEQ ID NO: 1244285 - protein, 9 aa, Homo Sapiens
KLFIGGLNF

SEQ ID NO: 1244286 - protein, 9 aa, Homo Sapiens
FGTKFETVY

SEQ ID NO: 1244287 - protein, 9 aa, Homo Sapiens
QRASNKNVT

SEQ ID NO: 1244288 - protein, 9 aa, Homo Sapiens
TVAEAAVVG

SEQ ID NO: 1244289 - protein, 9 aa, Homo Sapiens
RDHTGENVY

SEQ ID NO: 1244290 - protein, 9 aa, Homo Sapiens
SCVSTYSFM

SEQ ID NO: 1244291 - protein, 9 aa, Homo Sapiens
STQLLFYDT

SEQ ID NO: 1244292 - protein, 9 aa, Homo Sapiens
GQSYRLVLY

SEQ ID NO: 1244293 - protein, 9 aa, Homo Sapiens
ATHPTVNYF

SEQ ID NO: 1244294 - protein, 9 aa, Homo Sapiens
KYVNMDAWS

SEQ ID NO: 1244295 - protein, 9 aa, Homo Sapiens
AGVEEEGYD

SEQ ID NO: 1244296 - protein, 9 aa, Homo Sapiens
CHRCKDDPG

SEQ ID NO: 1244297 - protein, 9 aa, Homo Sapiens
NDDGGRCCL

SEQ ID NO: 1244298 - protein, 9 aa, Homo Sapiens
DNTTVNYTL

SEQ ID NO: 1244299 - protein, 9 aa, Homo Sapiens
VTTTQFRVL

SEQ ID NO: 1244300 - protein, 9 aa, Homo Sapiens
IVNSVILIM

SEQ ID NO: 1244301 - protein, 9 aa, Homo Sapiens
RCKQESSES

SEQ ID NO: 1244302 - protein, 9 aa, Homo Sapiens
VIKVESLPA

SEQ ID NO: 1244303 - protein, 9 aa, Homo Sapiens
LIKVKVKNV

SEQ ID NO: 1244304 - protein, 9 aa, Homo Sapiens
SLLHDGGRP

SEQ ID NO: 1244305 - protein, 9 aa, Homo Sapiens
LTSYTSYHF

SEQ ID NO: 1244306 - protein, 9 aa, Homo Sapiens
NKKTNLARH

SEQ ID NO: 1244307 - protein, 9 aa, Homo Sapiens
FIMDTPRDL

SEQ ID NO: 1244308 - protein, 9 aa, Homo Sapiens
EIIKLEILD

SEQ ID NO: 1244309 - protein, 9 aa, Homo Sapiens
AGLDGRSRG

SEQ ID NO: 1244310 - protein, 9 aa, Homo Sapiens
GPLQGEHSG

SEQ ID NO: 1244311 - protein, 9 aa, Homo Sapiens
MGLDAMVLL

SEQ ID NO: 1244312 - protein, 9 aa, Homo Sapiens
AFNHSAQLD

SEQ ID NO: 1244313 - protein, 9 aa, Homo Sapiens
TYHIDDVDW

SEQ ID NO: 1244314 - protein, 9 aa, Homo Sapiens
MAFDVVSFS

SEQ ID NO: 1244315 - protein, 9 aa, Homo Sapiens
APVCIVMRQ

SEQ ID NO: 1244316 - protein, 9 aa, Homo Sapiens
GDTHCLRDV

SEQ ID NO: 1244317 - protein, 9 aa, Homo Sapiens
SIKADSTFS

SEQ ID NO: 1244318 - protein, 9 aa, Homo Sapiens
AWTQGSHVW

SEQ ID NO: 1244319 - protein, 9 aa, Homo Sapiens
HKHCAFSIP

SEQ ID NO: 1244320 - protein, 9 aa, Homo Sapiens
NSRFWAKMC

SEQ ID NO: 1244321 - protein, 9 aa, Homo Sapiens
CIPPVPQCL

SEQ ID NO: 1244322 - protein, 9 aa, Homo Sapiens
ASVPSSPAV

SEQ ID NO: 1244323 - protein, 9 aa, Homo Sapiens
PYHVVGLVV

SEQ ID NO: 1244324 - protein, 9 aa, Homo Sapiens
HGSRGAADD

SEQ ID NO: 1244325 - protein, 9 aa, Homo Sapiens
SASKVFVCA

SEQ ID NO: 1244326 - protein, 9 aa, Homo Sapiens
RTREAALDT

SEQ ID NO: 1244327 - protein, 9 aa, Homo Sapiens
DRQPDFTQI

SEQ ID NO: 1244328 - protein, 9 aa, Homo Sapiens
ECVQPEYQR

SEQ ID NO: 1244329 - protein, 9 aa, Homo Sapiens
IMHLDEHLL

SEQ ID NO: 1244330 - protein, 9 aa, Homo Sapiens
LPLYIRLHK

SEQ ID NO: 1244331 - protein, 9 aa, Homo Sapiens
SPCVKKNSV

SEQ ID NO: 1244332 - protein, 9 aa, Homo Sapiens
LEPQWINVF

SEQ ID NO: 1244333 - protein, 9 aa, Homo Sapiens
EQHLLPAVT

SEQ ID NO: 1244334 - protein, 9 aa, Homo Sapiens
TELLSASVS

SEQ ID NO: 1244335 - protein, 9 aa, Homo Sapiens
KHVFLTVTE

SEQ ID NO: 1244336 - protein, 9 aa, Homo Sapiens
AIPSHPTEG

SEQ ID NO: 1244337 - protein, 9 aa, Homo Sapiens
VPRHVFRIK

SEQ ID NO: 1244338 - protein, 9 aa, Homo Sapiens
TLMFWREFT

SEQ ID NO: 1244339 - protein, 9 aa, Homo Sapiens
GLADDIDRW

SEQ ID NO: 1244340 - protein, 9 aa, Homo Sapiens
IENSAAVQH

SEQ ID NO: 1244341 - protein, 9 aa, Homo Sapiens
FDLLHKNHY

SEQ ID NO: 1244342 - protein, 9 aa, Homo Sapiens
LTTKKAVDN

SEQ ID NO: 1244343 - protein, 9 aa, Homo Sapiens
TGVSRLRLV

SEQ ID NO: 1244344 - protein, 9 aa, Homo Sapiens
LYASGRTIG

SEQ ID NO: 1244345 - protein, 9 aa, Homo Sapiens
SCLSTSTVA

SEQ ID NO: 1244346 - protein, 9 aa, Homo Sapiens
IMHWFGLVS

SEQ ID NO: 1244347 - protein, 9 aa, Homo Sapiens
ITHGCSSEE

SEQ ID NO: 1244348 - protein, 9 aa, Homo Sapiens
KQLQCWSRR

SEQ ID NO: 1244349 - protein, 9 aa, Homo Sapiens
LVEVHLLES

SEQ ID NO: 1244350 - protein, 9 aa, Homo Sapiens
ENEIRVVLC

SEQ ID NO: 1244351 - protein, 9 aa, Homo Sapiens
LFNTASGWL

SEQ ID NO: 1244352 - protein, 9 aa, Homo Sapiens
TDVCAAVYQ

SEQ ID NO: 1244353 - protein, 9 aa, Homo Sapiens
VVKGHRVSQ

SEQ ID NO: 1244354 - protein, 9 aa, Homo Sapiens
TVLLAGLLS

SEQ ID NO: 1244355 - protein, 9 aa, Homo Sapiens
ANRVMAILC

SEQ ID NO: 1244356 - protein, 9 aa, Homo Sapiens
AANKSILTS

SEQ ID NO: 1244357 - protein, 9 aa, Homo Sapiens
LHVLASAGR

SEQ ID NO: 1244358 - protein, 9 aa, Homo Sapiens
ATSSNSAFQ

SEQ ID NO: 1244359 - protein, 9 aa, Homo Sapiens
VQRFSTRAV

SEQ ID NO: 1244360 - protein, 9 aa, Homo Sapiens
YEIAQTWHF

SEQ ID NO: 1244361 - protein, 9 aa, Homo Sapiens
SYDCKEYKK

SEQ ID NO: 1244362 - protein, 9 aa, Homo Sapiens
LLYVPPTCT

SEQ ID NO: 1244363 - protein, 9 aa, Homo Sapiens
MPNALYFST

SEQ ID NO: 1244364 - protein, 9 aa, Homo Sapiens
CPSPLPDTL

SEQ ID NO: 1244365 - protein, 9 aa, Homo Sapiens
RRHYEDDGI

SEQ ID NO: 1244366 - protein, 9 aa, Homo Sapiens
HRACAHHDA

SEQ ID NO: 1244367 - protein, 9 aa, Homo Sapiens
WAQAIYPHY

SEQ ID NO: 1244368 - protein, 9 aa, Homo Sapiens
ASSLTLSSA

SEQ ID NO: 1244369 - protein, 9 aa, Homo Sapiens
VVNLENRLL

SEQ ID NO: 1244370 - protein, 9 aa, Homo Sapiens
DQDVGRGTF

SEQ ID NO: 1244371 - protein, 9 aa, Homo Sapiens
CGKSFPSTA

SEQ ID NO: 1244372 - protein, 9 aa, Homo Sapiens
FQLVMEKHS

SEQ ID NO: 1244373 - protein, 9 aa, Homo Sapiens
SGSISLALH

SEQ ID NO: 1244374 - protein, 9 aa, Homo Sapiens
YVITLVFEG

SEQ ID NO: 1244375 - protein, 9 aa, Homo Sapiens
ERERNQESP

SEQ ID NO: 1244376 - protein, 9 aa, Homo Sapiens
AAAATMLPA

SEQ ID NO: 1244377 - protein, 9 aa, Homo Sapiens
SYSSYHTLD

SEQ ID NO: 1244378 - protein, 9 aa, Homo Sapiens
STHRHPSAT

SEQ ID NO: 1244379 - protein, 9 aa, Homo Sapiens
LLKIQQNIC

SEQ ID NO: 1244380 - protein, 9 aa, Homo Sapiens
QREDDDEDP

SEQ ID NO: 1244381 - protein, 9 aa, Homo Sapiens
EETEKELAP

SEQ ID NO: 1244382 - protein, 9 aa, Homo Sapiens
VVISDCKNS

SEQ ID NO: 1244383 - protein, 9 aa, Homo Sapiens
LAEHLAGCT

SEQ ID NO: 1244384 - protein, 9 aa, Homo Sapiens
RSFYQFVHG

SEQ ID NO: 1244385 - protein, 9 aa, Homo Sapiens
KPAVLLMEK

SEQ ID NO: 1244386 - protein, 9 aa, Homo Sapiens
KSQPVMIIT

SEQ ID NO: 1244387 - protein, 9 aa, Homo Sapiens
AQEFLPKTI

SEQ ID NO: 1244388 - protein, 9 aa, Homo Sapiens
ERQSMKSER

SEQ ID NO: 1244389 - protein, 9 aa, Homo Sapiens
NSFVGTAQH

SEQ ID NO: 1244390 - protein, 9 aa, Homo Sapiens
HRKAAKVHL

SEQ ID NO: 1244391 - protein, 9 aa, Homo Sapiens
KLYPCMEVL

SEQ ID NO: 1244392 - protein, 9 aa, Homo Sapiens
GIIIQLRAQ

SEQ ID NO: 1244393 - protein, 9 aa, Homo Sapiens
KYPFRQGMQ

SEQ ID NO: 1244394 - protein, 9 aa, Homo Sapiens
TGTSFGVNV

SEQ ID NO: 1244395 - protein, 9 aa, Homo Sapiens
PGIEEADGE

SEQ ID NO: 1244396 - protein, 9 aa, Homo Sapiens
HPPNRDTMK

SEQ ID NO: 1244397 - protein, 9 aa, Homo Sapiens
HEHLPSISI

SEQ ID NO: 1244398 - protein, 9 aa, Homo Sapiens
WSFLTAKWT

SEQ ID NO: 1244399 - protein, 9 aa, Homo Sapiens
PLHRWLQQT

SEQ ID NO: 1244400 - protein, 9 aa, Homo Sapiens
QRLGKCNSG

SEQ ID NO: 1244401 - protein, 9 aa, Homo Sapiens
LPRRAPQGV

SEQ ID NO: 1244402 - protein, 9 aa, Homo Sapiens
WRRFRSVRS

SEQ ID NO: 1244403 - protein, 9 aa, Homo Sapiens
SACNKCVCS

SEQ ID NO: 1244404 - protein, 9 aa, Homo Sapiens
EEVKEVLQD

SEQ ID NO: 1244405 - protein, 9 aa, Homo Sapiens
GLQAAQRAY

SEQ ID NO: 1244406 - protein, 9 aa, Homo Sapiens
VVHVAGKET

SEQ ID NO: 1244407 - protein, 9 aa, Homo Sapiens
EEDSCMVLE

SEQ ID NO: 1244408 - protein, 9 aa, Homo Sapiens
SSHVVDRLF

SEQ ID NO: 1244409 - protein, 9 aa, Homo Sapiens
QAWLRFSIN

SEQ ID NO: 1244410 - protein, 9 aa, Homo Sapiens
NKTVEKETV

SEQ ID NO: 1244411 - protein, 9 aa, Homo Sapiens
ESATRSTRA

SEQ ID NO: 1244412 - protein, 9 aa, Homo Sapiens
QGPNLEWLK

SEQ ID NO: 1244413 - protein, 9 aa, Homo Sapiens
TALLHVLRG

SEQ ID NO: 1244414 - protein, 9 aa, Homo Sapiens
LWYRVDFQG

SEQ ID NO: 1244415 - protein, 9 aa, Homo Sapiens
EKLSAKGDP

SEQ ID NO: 1244416 - protein, 9 aa, Homo Sapiens
PYVCIPCEC

SEQ ID NO: 1244417 - protein, 9 aa, Homo Sapiens
SLPTIGIKR

SEQ ID NO: 1244418 - protein, 9 aa, Homo Sapiens
SLALIYWVS

SEQ ID NO: 1244419 - protein, 9 aa, Homo Sapiens
LHIYHYRME

SEQ ID NO: 1244420 - protein, 9 aa, Homo Sapiens
DTTEHIHTH

SEQ ID NO: 1244421 - protein, 9 aa, Homo Sapiens
LSNMSFVNN

SEQ ID NO: 1244422 - protein, 9 aa, Homo Sapiens
ESSMPPVTS

SEQ ID NO: 1244423 - protein, 9 aa, Homo Sapiens
VQIDCHTDD

SEQ ID NO: 1244424 - protein, 9 aa, Homo Sapiens
QKVSQASKD

SEQ ID NO: 1244425 - protein, 9 aa, Homo Sapiens
AISTQHCLS

SEQ ID NO: 1244426 - protein, 9 aa, Homo Sapiens
PPMNKHLSS

SEQ ID NO: 1244427 - protein, 9 aa, Homo Sapiens
DSQKDYRKD

SEQ ID NO: 1244428 - protein, 9 aa, Homo Sapiens
HPVSEEHIP

SEQ ID NO: 1244429 - protein, 9 aa, Homo Sapiens
LWAILSFIL

SEQ ID NO: 1244430 - protein, 9 aa, Homo Sapiens
TKTVEEPRT

SEQ ID NO: 1244431 - protein, 9 aa, Homo Sapiens
GTYRLVNVF

SEQ ID NO: 1244432 - protein, 9 aa, Homo Sapiens
HGKLCSNFW

SEQ ID NO: 1244433 - protein, 9 aa, Homo Sapiens
PFLVLQVYI

SEQ ID NO: 1244434 - protein, 9 aa, Homo Sapiens
RTWRLNEWH

SEQ ID NO: 1244435 - protein, 9 aa, Homo Sapiens
KWHKWSVLK

SEQ ID NO: 1244436 - protein, 9 aa, Homo Sapiens
MATKTTCMF

SEQ ID NO: 1244437 - protein, 9 aa, Homo Sapiens
VYGSLPAFI

SEQ ID NO: 1244438 - protein, 9 aa, Homo Sapiens
DVAVVLKAT

SEQ ID NO: 1244439 - protein, 9 aa, Homo Sapiens
LFSLHRMPR

SEQ ID NO: 1244440 - protein, 9 aa, Homo Sapiens
VKLEGPGPS

SEQ ID NO: 1244441 - protein, 9 aa, Homo Sapiens
SLRVCASIT

SEQ ID NO: 1244442 - protein, 9 aa, Homo Sapiens
CLEYLPPEQ

SEQ ID NO: 1244443 - protein, 9 aa, Homo Sapiens
KEAKRFEIT

SEQ ID NO: 1244444 - protein, 9 aa, Homo Sapiens
RNPCCLYWC

SEQ ID NO: 1244445 - protein, 9 aa, Homo Sapiens
ILNVKRSQG

SEQ ID NO: 1244446 - protein, 9 aa, Homo Sapiens
WEQNLCQLR

SEQ ID NO: 1244447 - protein, 9 aa, Homo Sapiens
VILLSQPPE

SEQ ID NO: 1244448 - protein, 9 aa, Homo Sapiens
QKYKRSIDA

SEQ ID NO: 1244449 - protein, 9 aa, Homo Sapiens
YIFHDEFVA

SEQ ID NO: 1244450 - protein, 9 aa, Homo Sapiens
IPDIDLIPT

SEQ ID NO: 1244451 - protein, 9 aa, Homo Sapiens
QIISRANTI

SEQ ID NO: 1244452 - protein, 9 aa, Homo Sapiens
EITSTGDQT

SEQ ID NO: 1244453 - protein, 9 aa, Homo Sapiens
RGNHITGLC

SEQ ID NO: 1244454 - protein, 9 aa, Homo Sapiens
QRRHGFTSF

SEQ ID NO: 1244455 - protein, 9 aa, Homo Sapiens
RQPLLWNMT

SEQ ID NO: 1244456 - protein, 9 aa, Homo Sapiens
LEKEHEEKE

SEQ ID NO: 1244457 - protein, 9 aa, Homo Sapiens
EPETYMAAV

SEQ ID NO: 1244458 - protein, 9 aa, Homo Sapiens
SHFVPKHIE

SEQ ID NO: 1244459 - protein, 9 aa, Homo Sapiens
QDEIDIWGK

SEQ ID NO: 1244460 - protein, 9 aa, Homo Sapiens
ITLYPTMLV

SEQ ID NO: 1244461 - protein, 9 aa, Homo Sapiens
RSRINTDFE

SEQ ID NO: 1244462 - protein, 9 aa, Homo Sapiens
RTVPGHLEH

SEQ ID NO: 1244463 - protein, 9 aa, Homo Sapiens
KIYEPPQYM

SEQ ID NO: 1244464 - protein, 9 aa, Homo Sapiens
ALINSLIQL

SEQ ID NO: 1244465 - protein, 9 aa, Homo Sapiens
MTVSERKRN

SEQ ID NO: 1244466 - protein, 9 aa, Homo Sapiens
THLGEALVP

SEQ ID NO: 1244467 - protein, 9 aa, Homo Sapiens
GTPGAPLPW

SEQ ID NO: 1244468 - protein, 9 aa, Homo Sapiens
TSSSHNWTE

SEQ ID NO: 1244469 - protein, 9 aa, Homo Sapiens
EASPGSDSD

SEQ ID NO: 1244470 - protein, 9 aa, Homo Sapiens
LRVFVERGQ

SEQ ID NO: 1244471 - protein, 9 aa, Homo Sapiens
SFSEIERHA

SEQ ID NO: 1244472 - protein, 9 aa, Homo Sapiens
SILGSEAIP

SEQ ID NO: 1244473 - protein, 9 aa, Homo Sapiens
GVVVDMIPG

SEQ ID NO: 1244474 - protein, 9 aa, Homo Sapiens
SENIGLNAP

SEQ ID NO: 1244475 - protein, 9 aa, Homo Sapiens
VESKWSLLA

SEQ ID NO: 1244476 - protein, 9 aa, Homo Sapiens
HSNYRDGMI

SEQ ID NO: 1244477 - protein, 9 aa, Homo Sapiens
QLYLDPGQT

SEQ ID NO: 1244478 - protein, 9 aa, Homo Sapiens
MVVAQNGMA

SEQ ID NO: 1244479 - protein, 9 aa, Homo Sapiens
LKKISFKRK

SEQ ID NO: 1244480 - protein, 9 aa, Homo Sapiens
MPIPCSAVH

SEQ ID NO: 1244481 - protein, 9 aa, Homo Sapiens
DLASYIVVM

SEQ ID NO: 1244482 - protein, 9 aa, Homo Sapiens
EKVLEMDIS

SEQ ID NO: 1244483 - protein, 9 aa, Homo Sapiens
EPLRSVLRM

SEQ ID NO: 1244484 - protein, 9 aa, Homo Sapiens
TIIITFIII

SEQ ID NO: 1244485 - protein, 9 aa, Homo Sapiens
HRKSHAGEN

SEQ ID NO: 1244486 - protein, 9 aa, Homo Sapiens
NFLHHPDLY

SEQ ID NO: 1244487 - protein, 9 aa, Homo Sapiens
RPDDLMASF

SEQ ID NO: 1244488 - protein, 9 aa, Homo Sapiens
MTVTLSTKQ

SEQ ID NO: 1244489 - protein, 9 aa, Homo Sapiens
NPGEVTSMS

SEQ ID NO: 1244490 - protein, 9 aa, Homo Sapiens
EITFQLHED

SEQ ID NO: 1244491 - protein, 9 aa, Homo Sapiens
QDMVNKIGE

SEQ ID NO: 1244492 - protein, 9 aa, Homo Sapiens
TLRTQCPAM

SEQ ID NO: 1244493 - protein, 9 aa, Homo Sapiens
VGIGHNGHE

SEQ ID NO: 1244494 - protein, 9 aa, Homo Sapiens
TLISFFDAA

SEQ ID NO: 1244495 - protein, 9 aa, Homo Sapiens
GVEEAEEGH

SEQ ID NO: 1244496 - protein, 9 aa, Homo Sapiens
ATILIYHDR

SEQ ID NO: 1244497 - protein, 9 aa, Homo Sapiens
LSDDMKSEE

SEQ ID NO: 1244498 - protein, 9 aa, Homo Sapiens
KNKLSDQTV

SEQ ID NO: 1244499 - protein, 9 aa, Homo Sapiens
MYEGQQPML

SEQ ID NO: 1244500 - protein, 9 aa, Homo Sapiens
GVFVNVQQS

SEQ ID NO: 1244501 - protein, 9 aa, Homo Sapiens
TACMQGQQG

SEQ ID NO: 1244502 - protein, 9 aa, Homo Sapiens
SHPWLHACM

SEQ ID NO: 1244503 - protein, 9 aa, Homo Sapiens
RHYRPIYEF

SEQ ID NO: 1244504 - protein, 9 aa, Homo Sapiens
FTKRDIALI

SEQ ID NO: 1244505 - protein, 9 aa, Homo Sapiens
LLGGIGVLN

SEQ ID NO: 1244506 - protein, 9 aa, Homo Sapiens
GHPWVAYSF

SEQ ID NO: 1244507 - protein, 9 aa, Homo Sapiens
LLHFSVLML

SEQ ID NO: 1244508 - protein, 9 aa, Homo Sapiens
EETSLVPEL

SEQ ID NO: 1244509 - protein, 9 aa, Homo Sapiens
FLTAQLKHD

SEQ ID NO: 1244510 - protein, 9 aa, Homo Sapiens
CQTLRKMVI

SEQ ID NO: 1244511 - protein, 9 aa, Homo Sapiens
KSINPWERK

SEQ ID NO: 1244512 - protein, 9 aa, Homo Sapiens
VGTPNLIST

SEQ ID NO: 1244513 - protein, 9 aa, Homo Sapiens
VIITWSLYY

SEQ ID NO: 1244514 - protein, 9 aa, Homo Sapiens
MALDEETRD

SEQ ID NO: 1244515 - protein, 9 aa, Homo Sapiens
QHPEEHGHQ

SEQ ID NO: 1244516 - protein, 9 aa, Homo Sapiens
ALVCLSVTI

SEQ ID NO: 1244517 - protein, 9 aa, Homo Sapiens
YGKAFRQSS

SEQ ID NO: 1244518 - protein, 9 aa, Homo Sapiens
SQEVETGGI

SEQ ID NO: 1244519 - protein, 9 aa, Homo Sapiens
FLEGLFGCM

SEQ ID NO: 1244520 - protein, 9 aa, Homo Sapiens
AERRSTAAT

SEQ ID NO: 1244521 - protein, 9 aa, Homo Sapiens
DEIQESSDA

SEQ ID NO: 1244522 - protein, 9 aa, Homo Sapiens
LLRLVDEDL

SEQ ID NO: 1244523 - protein, 9 aa, Homo Sapiens
QVLIKQTGR

SEQ ID NO: 1244524 - protein, 9 aa, Homo Sapiens
MQIVVILSG

SEQ ID NO: 1244525 - protein, 9 aa, Homo Sapiens
CVTDTKNVQ

SEQ ID NO: 1244526 - protein, 9 aa, Homo Sapiens
GEANDYSDC

SEQ ID NO: 1244527 - protein, 9 aa, Homo Sapiens
SMNRLTDVL

SEQ ID NO: 1244528 - protein, 9 aa, Homo Sapiens
PMWMRSLKP

SEQ ID NO: 1244529 - protein, 9 aa, Homo Sapiens
DSSHPWLHA

SEQ ID NO: 1244530 - protein, 9 aa, Homo Sapiens
FPTVTYTTM

SEQ ID NO: 1244531 - protein, 9 aa, Homo Sapiens
VPIVPQSPA

SEQ ID NO: 1244532 - protein, 9 aa, Homo Sapiens
DNCDVCGSD

SEQ ID NO: 1244533 - protein, 9 aa, Homo Sapiens
MDELKPWIE

SEQ ID NO: 1244534 - protein, 9 aa, Homo Sapiens
IWGNTVNMA

SEQ ID NO: 1244535 - protein, 9 aa, Homo Sapiens
IQGDEVDIN

SEQ ID NO: 1244536 - protein, 9 aa, Homo Sapiens
IYFFVERKI

SEQ ID NO: 1244537 - protein, 9 aa, Homo Sapiens
GIGAVPATC

SEQ ID NO: 1244538 - protein, 9 aa, Homo Sapiens
TGVKLSGGL

SEQ ID NO: 1244539 - protein, 9 aa, Homo Sapiens
LLILPVLLL

SEQ ID NO: 1244540 - protein, 9 aa, Homo Sapiens
KGHKIRLIV

SEQ ID NO: 1244541 - protein, 9 aa, Homo Sapiens
KAGGTNLGA

SEQ ID NO: 1244542 - protein, 9 aa, Homo Sapiens
TEVHVPTRF

SEQ ID NO: 1244543 - protein, 9 aa, Homo Sapiens
SSPTSSSHN

SEQ ID NO: 1244544 - protein, 9 aa, Homo Sapiens
WWGEGGRRP

SEQ ID NO: 1244545 - protein, 9 aa, Homo Sapiens
VVARLLKEL

SEQ ID NO: 1244546 - protein, 9 aa, Homo Sapiens
FPPNAAAAV

SEQ ID NO: 1244547 - protein, 9 aa, Homo Sapiens
VPSQKSLFY

SEQ ID NO: 1244548 - protein, 9 aa, Homo Sapiens
LPDVLLERR

SEQ ID NO: 1244549 - protein, 9 aa, Homo Sapiens
YHTIHPSLL

SEQ ID NO: 1244550 - protein, 9 aa, Homo Sapiens
GMSMLDTIK

SEQ ID NO: 1244551 - protein, 9 aa, Homo Sapiens
ESPVFAHVY

SEQ ID NO: 1244552 - protein, 9 aa, Homo Sapiens
KNTASINIH

SEQ ID NO: 1244553 - protein, 9 aa, Homo Sapiens
EQRNLYRNV

SEQ ID NO: 1244554 - protein, 9 aa, Homo Sapiens
PVSEEHIPD

SEQ ID NO: 1244555 - protein, 9 aa, Homo Sapiens
PSSFYVKHC

SEQ ID NO: 1244556 - protein, 9 aa, Homo Sapiens
HILPPQLQP

SEQ ID NO: 1244557 - protein, 9 aa, Homo Sapiens
VYDGKIKVW

SEQ ID NO: 1244558 - protein, 9 aa, Homo Sapiens
HQRVLHSAM

SEQ ID NO: 1244559 - protein, 9 aa, Homo Sapiens
ASGRTTITT

SEQ ID NO: 1244560 - protein, 9 aa, Homo Sapiens
CFFLLTVKF

SEQ ID NO: 1244561 - protein, 9 aa, Homo Sapiens
CDGGWLTDG

SEQ ID NO: 1244562 - protein, 9 aa, Homo Sapiens
CEAPSPLMI

SEQ ID NO: 1244563 - protein, 9 aa, Homo Sapiens
PSPTPDVVS

SEQ ID NO: 1244564 - protein, 9 aa, Homo Sapiens
SHGPLQTDV

SEQ ID NO: 1244565 - protein, 9 aa, Homo Sapiens
NNLIVNAEN

SEQ ID NO: 1244566 - protein, 9 aa, Homo Sapiens
KILLTSDAP

SEQ ID NO: 1244567 - protein, 9 aa, Homo Sapiens
LEELPGRSI

SEQ ID NO: 1244568 - protein, 9 aa, Homo Sapiens
RGETFRPNP

SEQ ID NO: 1244569 - protein, 9 aa, Homo Sapiens
QVSGTLART

SEQ ID NO: 1244570 - protein, 9 aa, Homo Sapiens
SSDDKYPTR

SEQ ID NO: 1244571 - protein, 9 aa, Homo Sapiens
IEKKLTSLP

SEQ ID NO: 1244572 - protein, 9 aa, Homo Sapiens
VLEQVHSSP

SEQ ID NO: 1244573 - protein, 9 aa, Homo Sapiens
SHWVNTMAL

SEQ ID NO: 1244574 - protein, 9 aa, Homo Sapiens
ALKNSRKAL

SEQ ID NO: 1244575 - protein, 9 aa, Homo Sapiens
IGSLTADYG

SEQ ID NO: 1244576 - protein, 9 aa, Homo Sapiens
ISLLLHAEP

SEQ ID NO: 1244577 - protein, 9 aa, Homo Sapiens
MDTPRDLNI

SEQ ID NO: 1244578 - protein, 9 aa, Homo Sapiens
LSYQPNVLP

SEQ ID NO: 1244579 - protein, 9 aa, Homo Sapiens
WMEYATHST

SEQ ID NO: 1244580 - protein, 9 aa, Homo Sapiens
LQHTQNTHG

SEQ ID NO: 1244581 - protein, 9 aa, Homo Sapiens
SGNVTWNSL

SEQ ID NO: 1244582 - protein, 9 aa, Homo Sapiens
WSTSFCLAP

SEQ ID NO: 1244583 - protein, 9 aa, Homo Sapiens
KLILEQLES

SEQ ID NO: 1244584 - protein, 9 aa, Homo Sapiens
FTLVRSSTY

SEQ ID NO: 1244585 - protein, 9 aa, Homo Sapiens
QYSNTYCFR

SEQ ID NO: 1244586 - protein, 9 aa, Homo Sapiens
QEVPGRVFG

SEQ ID NO: 1244587 - protein, 9 aa, Homo Sapiens
CDFLPVLCL

SEQ ID NO: 1244588 - protein, 9 aa, Homo Sapiens
IDATQLQCL

SEQ ID NO: 1244589 - protein, 9 aa, Homo Sapiens
DVLTNVFRE

SEQ ID NO: 1244590 - protein, 9 aa, Homo Sapiens
FPGRRAPLQ

SEQ ID NO: 1244591 - protein, 9 aa, Homo Sapiens
LYLHSRGIL

SEQ ID NO: 1244592 - protein, 9 aa, Homo Sapiens
RKTTISPAQ

SEQ ID NO: 1244593 - protein, 9 aa, Homo Sapiens
ETVPTWYPC

SEQ ID NO: 1244594 - protein, 9 aa, Homo Sapiens
EARRCLREF

SEQ ID NO: 1244595 - protein, 9 aa, Homo Sapiens
VEMIKQFHI

SEQ ID NO: 1244596 - protein, 9 aa, Homo Sapiens
QGHLLQDPA

SEQ ID NO: 1244597 - protein, 9 aa, Homo Sapiens
RNNDVTGSE

SEQ ID NO: 1244598 - protein, 9 aa, Homo Sapiens
VQSESHLAA

SEQ ID NO: 1244599 - protein, 9 aa, Homo Sapiens
HRNDPMERY

SEQ ID NO: 1244600 - protein, 9 aa, Homo Sapiens
IYMPRKYQV

SEQ ID NO: 1244601 - protein, 9 aa, Homo Sapiens
ENLFLAMLY

SEQ ID NO: 1244602 - protein, 9 aa, Homo Sapiens
SFDHHCKWL

SEQ ID NO: 1244603 - protein, 9 aa, Homo Sapiens
PGAEPHLTV

SEQ ID NO: 1244604 - protein, 9 aa, Homo Sapiens
RTTDGKEEA

SEQ ID NO: 1244605 - protein, 9 aa, Homo Sapiens
PGFCCLLPL

SEQ ID NO: 1244606 - protein, 9 aa, Homo Sapiens
LEDQDENPL

SEQ ID NO: 1244607 - protein, 9 aa, Homo Sapiens
NIRVMECRM

SEQ ID NO: 1244608 - protein, 9 aa, Homo Sapiens
KPEPNAREE

SEQ ID NO: 1244609 - protein, 9 aa, Homo Sapiens
KIEIDAFSW

SEQ ID NO: 1244610 - protein, 9 aa, Homo Sapiens
SGRLWAILQ

SEQ ID NO: 1244611 - protein, 9 aa, Homo Sapiens
PCANGITCT

SEQ ID NO: 1244612 - protein, 9 aa, Homo Sapiens
LSYVFIHLW

SEQ ID NO: 1244613 - protein, 9 aa, Homo Sapiens
GMAVATSSW

SEQ ID NO: 1244614 - protein, 9 aa, Homo Sapiens
KFDVQSNQS

SEQ ID NO: 1244615 - protein, 9 aa, Homo Sapiens
EQGIRLSTS

SEQ ID NO: 1244616 - protein, 9 aa, Homo Sapiens
IKLEILDES

SEQ ID NO: 1244617 - protein, 9 aa, Homo Sapiens
ILQKAEDIC

SEQ ID NO: 1244618 - protein, 9 aa, Homo Sapiens
PAALKDRHM

SEQ ID NO: 1244619 - protein, 9 aa, Homo Sapiens
VPFKYESPE

SEQ ID NO: 1244620 - protein, 9 aa, Homo Sapiens
HRGFSDLQG

SEQ ID NO: 1244621 - protein, 9 aa, Homo Sapiens
TLYLKCKLG

SEQ ID NO: 1244622 - protein, 9 aa, Homo Sapiens
KHLNEHMKL

SEQ ID NO: 1244623 - protein, 9 aa, Homo Sapiens
EDAQLQDLE

SEQ ID NO: 1244624 - protein, 9 aa, Homo Sapiens
FHPLLPDPS

SEQ ID NO: 1244625 - protein, 9 aa, Homo Sapiens
KCEQELEIS

SEQ ID NO: 1244626 - protein, 9 aa, Homo Sapiens
TEGTHCCRQ

SEQ ID NO: 1244627 - protein, 9 aa, Homo Sapiens
IRVNSMSII

SEQ ID NO: 1244628 - protein, 9 aa, Homo Sapiens
DGGGITEEP

SEQ ID NO: 1244629 - protein, 9 aa, Homo Sapiens
ELKKALVTS

SEQ ID NO: 1244630 - protein, 9 aa, Homo Sapiens
LWMEYATHS

SEQ ID NO: 1244631 - protein, 9 aa, Homo Sapiens
PLHPQPAPA

SEQ ID NO: 1244632 - protein, 9 aa, Homo Sapiens
RLTRQSGGA

SEQ ID NO: 1244633 - protein, 9 aa, Homo Sapiens
GLSHHIHVL

SEQ ID NO: 1244634 - protein, 9 aa, Homo Sapiens
CIPVDSDVA

SEQ ID NO: 1244635 - protein, 9 aa, Homo Sapiens
SLQHDNIAK

SEQ ID NO: 1244636 - protein, 9 aa, Homo Sapiens
GEWTACVVH

SEQ ID NO: 1244637 - protein, 9 aa, Homo Sapiens
IDPNCNVPE

SEQ ID NO: 1244638 - protein, 9 aa, Homo Sapiens
AEVSGRGED

SEQ ID NO: 1244639 - protein, 9 aa, Homo Sapiens
MTGIDLGTT

SEQ ID NO: 1244640 - protein, 9 aa, Homo Sapiens
GHIICSPLH

SEQ ID NO: 1244641 - protein, 9 aa, Homo Sapiens
FQLGCDAVL

SEQ ID NO: 1244642 - protein, 9 aa, Homo Sapiens
PMPPMLMPP

SEQ ID NO: 1244643 - protein, 9 aa, Homo Sapiens
ENGKTCKDS

SEQ ID NO: 1244644 - protein, 9 aa, Homo Sapiens
MSMLDTIKK

SEQ ID NO: 1244645 - protein, 9 aa, Homo Sapiens
SSDVEVESS

SEQ ID NO: 1244646 - protein, 9 aa, Homo Sapiens
DFEIFDLPE

SEQ ID NO: 1244647 - protein, 9 aa, Homo Sapiens
KKKWYLQAA

SEQ ID NO: 1244648 - protein, 9 aa, Homo Sapiens
ALEWHVIQA

SEQ ID NO: 1244649 - protein, 9 aa, Homo Sapiens
VDTRGRHQK

SEQ ID NO: 1244650 - protein, 9 aa, Homo Sapiens
CKMSGYHRA

SEQ ID NO: 1244651 - protein, 9 aa, Homo Sapiens
GYHNWGHQS

SEQ ID NO: 1244652 - protein, 9 aa, Homo Sapiens
IEPSSSLPT

SEQ ID NO: 1244653 - protein, 9 aa, Homo Sapiens
TVQKCQQQK

SEQ ID NO: 1244654 - protein, 9 aa, Homo Sapiens
LQKAEDICR

SEQ ID NO: 1244655 - protein, 9 aa, Homo Sapiens
RRVAVTAKH

SEQ ID NO: 1244656 - protein, 9 aa, Homo Sapiens
TPYAGRFKD

SEQ ID NO: 1244657 - protein, 9 aa, Homo Sapiens
YWTGRGKSL

SEQ ID NO: 1244658 - protein, 9 aa, Homo Sapiens
CTTHFCAIV

SEQ ID NO: 1244659 - protein, 9 aa, Homo Sapiens
HFHPVAAAA

SEQ ID NO: 1244660 - protein, 9 aa, Homo Sapiens
CRCLRCFPQ

SEQ ID NO: 1244661 - protein, 9 aa, Homo Sapiens
ENPKSREVQ

SEQ ID NO: 1244662 - protein, 9 aa, Homo Sapiens
LATSYFIDR

SEQ ID NO: 1244663 - protein, 9 aa, Homo Sapiens
SDEAWNERV

SEQ ID NO: 1244664 - protein, 9 aa, Homo Sapiens
QRGLASGDC

SEQ ID NO: 1244665 - protein, 9 aa, Homo Sapiens
ISCLYNEKR

SEQ ID NO: 1244666 - protein, 9 aa, Homo Sapiens
EEDEEKDNS

SEQ ID NO: 1244667 - protein, 9 aa, Homo Sapiens
MISNPDLMR

SEQ ID NO: 1244668 - protein, 9 aa, Homo Sapiens
NSSINSHEV

SEQ ID NO: 1244669 - protein, 9 aa, Homo Sapiens
TPLKVGGIY

SEQ ID NO: 1244670 - protein, 9 aa, Homo Sapiens
KPDNFLMGN

SEQ ID NO: 1244671 - protein, 9 aa, Homo Sapiens
SFPQHSMAQ

SEQ ID NO: 1244672 - protein, 9 aa, Homo Sapiens
KLLNTCMLK

SEQ ID NO: 1244673 - protein, 9 aa, Homo Sapiens
RRAGNVVSK

SEQ ID NO: 1244674 - protein, 9 aa, Homo Sapiens
NSIETRTID

SEQ ID NO: 1244675 - protein, 9 aa, Homo Sapiens
VATALLLLK

SEQ ID NO: 1244676 - protein, 9 aa, Homo Sapiens
IPTHPFEEG

SEQ ID NO: 1244677 - protein, 9 aa, Homo Sapiens
DNLLGDAGM

SEQ ID NO: 1244678 - protein, 9 aa, Homo Sapiens
GIDNLYVQL

SEQ ID NO: 1244679 - protein, 9 aa, Homo Sapiens
LQEDTQYMT

SEQ ID NO: 1244680 - protein, 9 aa, Homo Sapiens
GLSHISRKF

SEQ ID NO: 1244681 - protein, 9 aa, Homo Sapiens
AIKLQPRQV

SEQ ID NO: 1244682 - protein, 9 aa, Homo Sapiens
LPGMHPPTL

SEQ ID NO: 1244683 - protein, 9 aa, Homo Sapiens
VKHQGQHLF

SEQ ID NO: 1244684 - protein, 9 aa, Homo Sapiens
QELDDLVAV

SEQ ID NO: 1244685 - protein, 9 aa, Homo Sapiens
KLQQELLIG

SEQ ID NO: 1244686 - protein, 9 aa, Homo Sapiens
MRTKLYPRY
